United States Patent 10,058,623 (COMPOSITIONS AND METHODS FOR MODULATING UTRN EXPRESSION) - sequence listing, part 7

SEQ ID NO: 205118 - DNA, 15 bp, Homo sapiens
gactgagctactgca

SEQ ID NO: 205119 - DNA, 15 bp, Homo sapiens
tgactgagctactgc

SEQ ID NO: 205120 - DNA, 15 bp, Homo sapiens
ttgactgagctactg

SEQ ID NO: 205121 - DNA, 15 bp, Homo sapiens
tttgactgagctact

SEQ ID NO: 205122 - DNA, 15 bp, Homo sapiens
atttgactgagctac

SEQ ID NO: 205123 - DNA, 15 bp, Homo sapiens
aatttgactgagcta

SEQ ID NO: 205124 - DNA, 15 bp, Homo sapiens
aaatttgactgagct

SEQ ID NO: 205125 - DNA, 15 bp, Homo sapiens
taaatttgactgagc

SEQ ID NO: 205126 - DNA, 15 bp, Homo sapiens
ataaatttgactgag

SEQ ID NO: 205127 - DNA, 15 bp, Homo sapiens
aataaatttgactga

SEQ ID NO: 205128 - DNA, 15 bp, Homo sapiens
aaataaatttgactg

SEQ ID NO: 205129 - DNA, 15 bp, Homo sapiens
caaataaatttgact

SEQ ID NO: 205130 - DNA, 15 bp, Homo sapiens
gcaaataaatttgac

SEQ ID NO: 205131 - DNA, 15 bp, Homo sapiens
agcaaataaatttga

SEQ ID NO: 205132 - DNA, 15 bp, Homo sapiens
cagcaaataaatttg

SEQ ID NO: 205133 - DNA, 15 bp, Homo sapiens
gcagcaaataaattt

SEQ ID NO: 205134 - DNA, 15 bp, Homo sapiens
tgcagcaaataaatt

SEQ ID NO: 205135 - DNA, 15 bp, Homo sapiens
ttgcagcaaataaat

SEQ ID NO: 205136 - DNA, 15 bp, Homo sapiens
tttgcagcaaataaa

SEQ ID NO: 205137 - DNA, 15 bp, Homo sapiens
ttttgcagcaaataa

SEQ ID NO: 205138 - DNA, 15 bp, Homo sapiens
attttgcagcaaata

SEQ ID NO: 205139 - DNA, 15 bp, Homo sapiens
cattttgcagcaaat

SEQ ID NO: 205140 - DNA, 15 bp, Homo sapiens
ccattttgcagcaaa

SEQ ID NO: 205141 - DNA, 15 bp, Homo sapiens
gccattttgcagcaa

SEQ ID NO: 205142 - DNA, 15 bp, Homo sapiens
agccattttgcagca

SEQ ID NO: 205143 - DNA, 15 bp, Homo sapiens
aagccattttgcagc

SEQ ID NO: 205144 - DNA, 15 bp, Homo sapiens
taagccattttgcag

SEQ ID NO: 205145 - DNA, 15 bp, Homo sapiens
ctaagccattttgca

SEQ ID NO: 205146 - DNA, 15 bp, Homo sapiens
tctaagccattttgc

SEQ ID NO: 205147 - DNA, 15 bp, Homo sapiens
ttctaagccattttg

SEQ ID NO: 205148 - DNA, 15 bp, Homo sapiens
gttctaagccatttt

SEQ ID NO: 205149 - DNA, 15 bp, Homo sapiens
agttctaagccattt

SEQ ID NO: 205150 - DNA, 15 bp, Homo sapiens
tagttctaagccatt

SEQ ID NO: 205151 - DNA, 15 bp, Homo sapiens
gtagttctaagccat

SEQ ID NO: 205152 - DNA, 15 bp, Homo sapiens
tgtagttctaagcca

SEQ ID NO: 205153 - DNA, 15 bp, Homo sapiens
ctgtagttctaagcc

SEQ ID NO: 205154 - DNA, 15 bp, Homo sapiens
tctgtagttctaagc

SEQ ID NO: 205155 - DNA, 15 bp, Homo sapiens
ctctgtagttctaag

SEQ ID NO: 205156 - DNA, 15 bp, Homo sapiens
tctctgtagttctaa

SEQ ID NO: 205157 - DNA, 15 bp, Homo sapiens
ttctctgtagttcta

SEQ ID NO: 205158 - DNA, 15 bp, Homo sapiens
attctctgtagttct

SEQ ID NO: 205159 - DNA, 15 bp, Homo sapiens
aattctctgtagttc

SEQ ID NO: 205160 - DNA, 15 bp, Homo sapiens
aaattctctgtagtt

SEQ ID NO: 205161 - DNA, 15 bp, Homo sapiens
aaaattctctgtagt

SEQ ID NO: 205162 - DNA, 15 bp, Homo sapiens
gaaaattctctgtag

SEQ ID NO: 205163 - DNA, 15 bp, Homo sapiens
tgaaaattctctgta

SEQ ID NO: 205164 - DNA, 15 bp, Homo sapiens
ctgaaaattctctgt

SEQ ID NO: 205165 - DNA, 15 bp, Homo sapiens
actgaaaattctctg

SEQ ID NO: 205166 - DNA, 15 bp, Homo sapiens
aactgaaaattctct

SEQ ID NO: 205167 - DNA, 15 bp, Homo sapiens
taactgaaaattctc

SEQ ID NO: 205168 - DNA, 15 bp, Homo sapiens
ttaactgaaaattct

SEQ ID NO: 205169 - DNA, 15 bp, Homo sapiens
attaactgaaaattc

SEQ ID NO: 205170 - DNA, 15 bp, Homo sapiens
tattaactgaaaatt

SEQ ID NO: 205171 - DNA, 15 bp, Homo sapiens
atattaactgaaaat

SEQ ID NO: 205172 - DNA, 15 bp, Homo sapiens
tatattaactgaaaa

SEQ ID NO: 205173 - DNA, 15 bp, Homo sapiens
ttatattaactgaaa

SEQ ID NO: 205174 - DNA, 15 bp, Homo sapiens
attatattaactgaa

SEQ ID NO: 205175 - DNA, 15 bp, Homo sapiens
aattatattaactga

SEQ ID NO: 205176 - DNA, 15 bp, Homo sapiens
caattatattaactg

SEQ ID NO: 205177 - DNA, 15 bp, Homo sapiens
tcaattatattaact

SEQ ID NO: 205178 - DNA, 15 bp, Homo sapiens
ttcaattatattaac

SEQ ID NO: 205179 - DNA, 15 bp, Homo sapiens
tttcaattatattaa

SEQ ID NO: 205180 - DNA, 15 bp, Homo sapiens
atttcaattatatta

SEQ ID NO: 205181 - DNA, 15 bp, Homo sapiens
aatttcaattatatt

SEQ ID NO: 205182 - DNA, 15 bp, Homo sapiens
taatttcaattatat

SEQ ID NO: 205183 - DNA, 15 bp, Homo sapiens
ataatttcaattata

SEQ ID NO: 205184 - DNA, 15 bp, Homo sapiens
aataatttcaattat

SEQ ID NO: 205185 - DNA, 15 bp, Homo sapiens
aaataatttcaatta

SEQ ID NO: 205186 - DNA, 15 bp, Homo sapiens
taaataatttcaatt

SEQ ID NO: 205187 - DNA, 15 bp, Homo sapiens
ctaaataatttcaat

SEQ ID NO: 205188 - DNA, 15 bp, Homo sapiens
actaaataatttcaa

SEQ ID NO: 205189 - DNA, 15 bp, Homo sapiens
aactaaataatttca

SEQ ID NO: 205190 - DNA, 15 bp, Homo sapiens
gaactaaataatttc

SEQ ID NO: 205191 - DNA, 15 bp, Homo sapiens
agaactaaataattt

SEQ ID NO: 205192 - DNA, 15 bp, Homo sapiens
cagaactaaataatt

SEQ ID NO: 205193 - DNA, 15 bp, Homo sapiens
gcagaactaaataat

SEQ ID NO: 205194 - DNA, 15 bp, Homo sapiens
agcagaactaaataa

SEQ ID NO: 205195 - DNA, 15 bp, Homo sapiens
gagcagaactaaata

SEQ ID NO: 205196 - DNA, 15 bp, Homo sapiens
agagcagaactaaat

SEQ ID NO: 205197 - DNA, 15 bp, Homo sapiens
acagagcagaactaa

SEQ ID NO: 205198 - DNA, 15 bp, Homo sapiens
cacagagcagaacta

SEQ ID NO: 205199 - DNA, 15 bp, Homo sapiens
tcacagagcagaact

SEQ ID NO: 205200 - DNA, 15 bp, Homo sapiens
gtcacagagcagaac

SEQ ID NO: 205201 - DNA, 15 bp, Homo sapiens
tgtcacagagcagaa

SEQ ID NO: 205202 - DNA, 15 bp, Homo sapiens
ttgtcacagagcaga

SEQ ID NO: 205203 - DNA, 15 bp, Homo sapiens
cttgtcacagagcag

SEQ ID NO: 205204 - DNA, 15 bp, Homo sapiens
acttgtcacagagca

SEQ ID NO: 205205 - DNA, 15 bp, Homo sapiens
cacttgtcacagagc

SEQ ID NO: 205206 - DNA, 15 bp, Homo sapiens
tcacttgtcacagag

SEQ ID NO: 205207 - DNA, 15 bp, Homo sapiens
ttcacttgtcacaga

SEQ ID NO: 205208 - DNA, 15 bp, Homo sapiens
tttcacttgtcacag

SEQ ID NO: 205209 - DNA, 15 bp, Homo sapiens
atttcacttgtcaca

SEQ ID NO: 205210 - DNA, 15 bp, Homo sapiens
aatttcacttgtcac

SEQ ID NO: 205211 - DNA, 15 bp, Homo sapiens
taatttcacttgtca

SEQ ID NO: 205212 - DNA, 15 bp, Homo sapiens
ataatttcacttgtc

SEQ ID NO: 205213 - DNA, 15 bp, Homo sapiens
aataatttcacttgt

SEQ ID NO: 205214 - DNA, 15 bp, Homo sapiens
taataatttcacttg

SEQ ID NO: 205215 - DNA, 15 bp, Homo sapiens
ctaataatttcactt

SEQ ID NO: 205216 - DNA, 15 bp, Homo sapiens
actaataatttcact

SEQ ID NO: 205217 - DNA, 15 bp, Homo sapiens
aactaataatttcac

SEQ ID NO: 205218 - DNA, 15 bp, Homo sapiens
taactaataatttca

SEQ ID NO: 205219 - DNA, 15 bp, Homo sapiens
ataactaataatttc

SEQ ID NO: 205220 - DNA, 15 bp, Homo sapiens
gataactaataattt

SEQ ID NO: 205221 - DNA, 15 bp, Homo sapiens
tgataactaataatt

SEQ ID NO: 205222 - DNA, 15 bp, Homo sapiens
ctgataactaataat

SEQ ID NO: 205223 - DNA, 15 bp, Homo sapiens
cctgataactaataa

SEQ ID NO: 205224 - DNA, 15 bp, Homo sapiens
ccctgataactaata

SEQ ID NO: 205225 - DNA, 15 bp, Homo sapiens
tccctgataactaat

SEQ ID NO: 205226 - DNA, 15 bp, Homo sapiens
ttccctgataactaa

SEQ ID NO: 205227 - DNA, 15 bp, Homo sapiens
tttccctgataacta

SEQ ID NO: 205228 - DNA, 15 bp, Homo sapiens
ctttccctgataact

SEQ ID NO: 205229 - DNA, 15 bp, Homo sapiens
cctttccctgataac

SEQ ID NO: 205230 - DNA, 15 bp, Homo sapiens
acctttccctgataa

SEQ ID NO: 205231 - DNA, 15 bp, Homo sapiens
tacctttccctgata

SEQ ID NO: 205232 - DNA, 15 bp, Homo sapiens
ttacctttccctgat

SEQ ID NO: 205233 - DNA, 15 bp, Homo sapiens
attacctttccctga

SEQ ID NO: 205234 - DNA, 15 bp, Homo sapiens
aattacctttccctg

SEQ ID NO: 205235 - DNA, 15 bp, Homo sapiens
taattacctttccct

SEQ ID NO: 205236 - DNA, 15 bp, Homo sapiens
gtaattacctttccc

SEQ ID NO: 205237 - DNA, 15 bp, Homo sapiens
tgtaattacctttcc

SEQ ID NO: 205238 - DNA, 15 bp, Homo sapiens
atgtaattacctttc

SEQ ID NO: 205239 - DNA, 15 bp, Homo sapiens
tatgtaattaccttt

SEQ ID NO: 205240 - DNA, 15 bp, Homo sapiens
atatgtaattacctt

SEQ ID NO: 205241 - DNA, 15 bp, Homo sapiens
aatatgtaattacct

SEQ ID NO: 205242 - DNA, 15 bp, Homo sapiens
aaatatgtaattacc

SEQ ID NO: 205243 - DNA, 15 bp, Homo sapiens
caaatatgtaattac

SEQ ID NO: 205244 - DNA, 15 bp, Homo sapiens
ccaaatatgtaatta

SEQ ID NO: 205245 - DNA, 15 bp, Homo sapiens
gccaaatatgtaatt

SEQ ID NO: 205246 - DNA, 15 bp, Homo sapiens
ggccaaatatgtaat

SEQ ID NO: 205247 - DNA, 15 bp, Homo sapiens
aggccaaatatgtaa

SEQ ID NO: 205248 - DNA, 15 bp, Homo sapiens
taggccaaatatgta

SEQ ID NO: 205249 - DNA, 15 bp, Homo sapiens
ttaggccaaatatgt

SEQ ID NO: 205250 - DNA, 15 bp, Homo sapiens
tttaggccaaatatg

SEQ ID NO: 205251 - DNA, 15 bp, Homo sapiens
ctttaggccaaatat

SEQ ID NO: 205252 - DNA, 15 bp, Homo sapiens
actttaggccaaata

SEQ ID NO: 205253 - DNA, 15 bp, Homo sapiens
aactttaggccaaat

SEQ ID NO: 205254 - DNA, 15 bp, Homo sapiens
taactttaggccaaa

SEQ ID NO: 205255 - DNA, 15 bp, Homo sapiens
ttaactttaggccaa

SEQ ID NO: 205256 - DNA, 15 bp, Homo sapiens
attaactttaggcca

SEQ ID NO: 205257 - DNA, 15 bp, Homo sapiens
gattaactttaggcc

SEQ ID NO: 205258 - DNA, 15 bp, Homo sapiens
tgattaactttaggc

SEQ ID NO: 205259 - DNA, 15 bp, Homo sapiens
ttgattaactttagg

SEQ ID NO: 205260 - DNA, 15 bp, Homo sapiens
attgattaactttag

SEQ ID NO: 205261 - DNA, 15 bp, Homo sapiens
tattgattaacttta

SEQ ID NO: 205262 - DNA, 15 bp, Homo sapiens
atattgattaacttt

SEQ ID NO: 205263 - DNA, 15 bp, Homo sapiens
catattgattaactt

SEQ ID NO: 205264 - DNA, 15 bp, Homo sapiens
tcatattgattaact

SEQ ID NO: 205265 - DNA, 15 bp, Homo sapiens
ttcatattgattaac

SEQ ID NO: 205266 - DNA, 15 bp, Homo sapiens
gttcatattgattaa

SEQ ID NO: 205267 - DNA, 15 bp, Homo sapiens
tgttcatattgatta

SEQ ID NO: 205268 - DNA, 15 bp, Homo sapiens
gtgttcatattgatt

SEQ ID NO: 205269 - DNA, 15 bp, Homo sapiens
tgtgttcatattgat

SEQ ID NO: 205270 - DNA, 15 bp, Homo sapiens
ctgtgttcatattga

SEQ ID NO: 205271 - DNA, 15 bp, Homo sapiens
tctgtgttcatattg

SEQ ID NO: 205272 - DNA, 15 bp, Homo sapiens
ttctgtgttcatatt

SEQ ID NO: 205273 - DNA, 15 bp, Homo sapiens
tttctgtgttcatat

SEQ ID NO: 205274 - DNA, 15 bp, Homo sapiens
ttttctgtgttcata

SEQ ID NO: 205275 - DNA, 15 bp, Homo sapiens
cttttctgtgttcat

SEQ ID NO: 205276 - DNA, 15 bp, Homo sapiens
gcttttctgtgttca

SEQ ID NO: 205277 - DNA, 15 bp, Homo sapiens
agcttttctgtgttc

SEQ ID NO: 205278 - DNA, 15 bp, Homo sapiens
cagcttttctgtgtt

SEQ ID NO: 205279 - DNA, 15 bp, Homo sapiens
ccagcttttctgtgt

SEQ ID NO: 205280 - DNA, 15 bp, Homo sapiens
tccagcttttctgtg

SEQ ID NO: 205281 - DNA, 15 bp, Homo sapiens
ctccagcttttctgt

SEQ ID NO: 205282 - DNA, 15 bp, Homo sapiens
gctccagcttttctg

SEQ ID NO: 205283 - DNA, 15 bp, Homo sapiens
agctccagcttttct

SEQ ID NO: 205284 - DNA, 15 bp, Homo sapiens
gagctccagcttttc

SEQ ID NO: 205285 - DNA, 15 bp, Homo sapiens
tgagctccagctttt

SEQ ID NO: 205286 - DNA, 15 bp, Homo sapiens
ttgagctccagcttt

SEQ ID NO: 205287 - DNA, 15 bp, Homo sapiens
cttgagctccagctt

SEQ ID NO: 205288 - DNA, 15 bp, Homo sapiens
gcttgagctccagct

SEQ ID NO: 205289 - DNA, 15 bp, Homo sapiens
tgcttgagctccagc

SEQ ID NO: 205290 - DNA, 15 bp, Homo sapiens
ctgcttgagctccag

SEQ ID NO: 205291 - DNA, 15 bp, Homo sapiens
tctgcttgagctcca

SEQ ID NO: 205292 - DNA, 15 bp, Homo sapiens
ttctgcttgagctcc

SEQ ID NO: 205293 - DNA, 15 bp, Homo sapiens
attctgcttgagctc

SEQ ID NO: 205294 - DNA, 15 bp, Homo sapiens
gattctgcttgagct

SEQ ID NO: 205295 - DNA, 15 bp, Homo sapiens
tgattctgcttgagc

SEQ ID NO: 205296 - DNA, 15 bp, Homo sapiens
ctgattctgcttgag

SEQ ID NO: 205297 - DNA, 15 bp, Homo sapiens
cctgattctgcttga

SEQ ID NO: 205298 - DNA, 15 bp, Homo sapiens
tcctgattctgcttg

SEQ ID NO: 205299 - DNA, 15 bp, Homo sapiens
gtcctgattctgctt

SEQ ID NO: 205300 - DNA, 15 bp, Homo sapiens
ggtcctgattctgct

SEQ ID NO: 205301 - DNA, 15 bp, Homo sapiens
aggtcctgattctgc

SEQ ID NO: 205302 - DNA, 15 bp, Homo sapiens
aaggtcctgattctg

SEQ ID NO: 205303 - DNA, 15 bp, Homo sapiens
caaggtcctgattct

SEQ ID NO: 205304 - DNA, 15 bp, Homo sapiens
acaaggtcctgattc

SEQ ID NO: 205305 - DNA, 15 bp, Homo sapiens
aacaaggtcctgatt

SEQ ID NO: 205306 - DNA, 15 bp, Homo sapiens
taacaaggtcctgat

SEQ ID NO: 205307 - DNA, 15 bp, Homo sapiens
ttaacaaggtcctga

SEQ ID NO: 205308 - DNA, 15 bp, Homo sapiens
gttaacaaggtcctg

SEQ ID NO: 205309 - DNA, 15 bp, Homo sapiens
ggttaacaaggtcct

SEQ ID NO: 205310 - DNA, 15 bp, Homo sapiens
tggttaacaaggtcc

SEQ ID NO: 205311 - DNA, 15 bp, Homo sapiens
gtggttaacaaggtc

SEQ ID NO: 205312 - DNA, 15 bp, Homo sapiens
tgtggttaacaaggt

SEQ ID NO: 205313 - DNA, 15 bp, Homo sapiens
ctgtggttaacaagg

SEQ ID NO: 205314 - DNA, 15 bp, Homo sapiens
actgtggttaacaag

SEQ ID NO: 205315 - DNA, 15 bp, Homo sapiens
aactgtggttaacaa

SEQ ID NO: 205316 - DNA, 15 bp, Homo sapiens
aaactgtggttaaca

SEQ ID NO: 205317 - DNA, 15 bp, Homo sapiens
aaaactgtggttaac

SEQ ID NO: 205318 - DNA, 15 bp, Homo sapiens
caaaactgtggttaa

SEQ ID NO: 205319 - DNA, 15 bp, Homo sapiens
acaaaactgtggtta

SEQ ID NO: 205320 - DNA, 15 bp, Homo sapiens
tacaaaactgtggtt

SEQ ID NO: 205321 - DNA, 15 bp, Homo sapiens
ttacaaaactgtggt

SEQ ID NO: 205322 - DNA, 15 bp, Homo sapiens
tttacaaaactgtgg

SEQ ID NO: 205323 - DNA, 15 bp, Homo sapiens
ttttacaaaactgtg

SEQ ID NO: 205324 - DNA, 15 bp, Homo sapiens
attttacaaaactgt

SEQ ID NO: 205325 - DNA, 15 bp, Homo sapiens
cattttacaaaactg

SEQ ID NO: 205326 - DNA, 15 bp, Homo sapiens
tcattttacaaaact

SEQ ID NO: 205327 - DNA, 15 bp, Homo sapiens
ctcattttacaaaac

SEQ ID NO: 205328 - DNA, 15 bp, Homo sapiens
actcattttacaaaa

SEQ ID NO: 205329 - DNA, 15 bp, Homo sapiens
aactcattttacaaa

SEQ ID NO: 205330 - DNA, 15 bp, Homo sapiens
gaactcattttacaa

SEQ ID NO: 205331 - DNA, 15 bp, Homo sapiens
tgaactcattttaca

SEQ ID NO: 205332 - DNA, 15 bp, Homo sapiens
ttgaactcattttac

SEQ ID NO: 205333 - DNA, 15 bp, Homo sapiens
attgaactcatttta

SEQ ID NO: 205334 - DNA, 15 bp, Homo sapiens
aattgaactcatttt

SEQ ID NO: 205335 - DNA, 15 bp, Homo sapiens
caattgaactcattt

SEQ ID NO: 205336 - DNA, 15 bp, Homo sapiens
acaattgaactcatt

SEQ ID NO: 205337 - DNA, 15 bp, Homo sapiens
tacaattgaactcat

SEQ ID NO: 205338 - DNA, 15 bp, Homo sapiens
ctacaattgaactca

SEQ ID NO: 205339 - DNA, 15 bp, Homo sapiens
gctacaattgaactc

SEQ ID NO: 205340 - DNA, 15 bp, Homo sapiens
tgctacaattgaact

SEQ ID NO: 205341 - DNA, 15 bp, Homo sapiens
gtgctacaattgaac

SEQ ID NO: 205342 - DNA, 15 bp, Homo sapiens
ggtgctacaattgaa

SEQ ID NO: 205343 - DNA, 15 bp, Homo sapiens
aggtgctacaattga

SEQ ID NO: 205344 - DNA, 15 bp, Homo sapiens
caggtgctacaattg

SEQ ID NO: 205345 - DNA, 15 bp, Homo sapiens
acaggtgctacaatt

SEQ ID NO: 205346 - DNA, 15 bp, Homo sapiens
cacaggtgctacaat

SEQ ID NO: 205347 - DNA, 15 bp, Homo sapiens
ccacaggtgctacaa

SEQ ID NO: 205348 - DNA, 15 bp, Homo sapiens
tccacaggtgctaca

SEQ ID NO: 205349 - DNA, 15 bp, Homo sapiens
ttccacaggtgctac

SEQ ID NO: 205350 - DNA, 15 bp, Homo sapiens
attccacaggtgcta

SEQ ID NO: 205351 - DNA, 15 bp, Homo sapiens
tattccacaggtgct

SEQ ID NO: 205352 - DNA, 15 bp, Homo sapiens
ttattccacaggtgc

SEQ ID NO: 205353 - DNA, 15 bp, Homo sapiens
tttattccacaggtg

SEQ ID NO: 205354 - DNA, 15 bp, Homo sapiens
atttattccacaggt

SEQ ID NO: 205355 - DNA, 15 bp, Homo sapiens
tatttattccacagg

SEQ ID NO: 205356 - DNA, 15 bp, Homo sapiens
ctatttattccacag

SEQ ID NO: 205357 - DNA, 15 bp, Homo sapiens
tctatttattccaca

SEQ ID NO: 205358 - DNA, 15 bp, Homo sapiens
ttctatttattccac

SEQ ID NO: 205359 - DNA, 15 bp, Homo sapiens
gttctatttattcca

SEQ ID NO: 205360 - DNA, 15 bp, Homo sapiens
agttctatttattcc

SEQ ID NO: 205361 - DNA, 15 bp, Homo sapiens
cagttctatttattc

SEQ ID NO: 205362 - DNA, 15 bp, Homo sapiens
tcagttctatttatt

SEQ ID NO: 205363 - DNA, 15 bp, Homo sapiens
atcagttctatttat

SEQ ID NO: 205364 - DNA, 15 bp, Homo sapiens
gatcagttctattta

SEQ ID NO: 205365 - DNA, 15 bp, Homo sapiens
tgatcagttctattt

SEQ ID NO: 205366 - DNA, 15 bp, Homo sapiens
atgatcagttctatt

SEQ ID NO: 205367 - DNA, 15 bp, Homo sapiens
tatgatcagttctat

SEQ ID NO: 205368 - DNA, 15 bp, Homo sapiens
ttatgatcagttcta

SEQ ID NO: 205369 - DNA, 15 bp, Homo sapiens
tttatgatcagttct

SEQ ID NO: 205370 - DNA, 15 bp, Homo sapiens
atttatgatcagttc

SEQ ID NO: 205371 - DNA, 15 bp, Homo sapiens
tatttatgatcagtt

SEQ ID NO: 205372 - DNA, 15 bp, Homo sapiens
gtatttatgatcagt

SEQ ID NO: 205373 - DNA, 15 bp, Homo sapiens
tgtatttatgatcag

SEQ ID NO: 205374 - DNA, 15 bp, Homo sapiens
ttgtatttatgatca

SEQ ID NO: 205375 - DNA, 15 bp, Homo sapiens
cttgtatttatgatc

SEQ ID NO: 205376 - DNA, 15 bp, Homo sapiens
tcttgtatttatgat

SEQ ID NO: 205377 - DNA, 15 bp, Homo sapiens
ttcttgtatttatga

SEQ ID NO: 205378 - DNA, 15 bp, Homo sapiens
tttcttgtatttatg

SEQ ID NO: 205379 - DNA, 15 bp, Homo sapiens
ttttcttgtatttat

SEQ ID NO: 205380 - DNA, 15 bp, Homo sapiens
attttcttgtattta

SEQ ID NO: 205381 - DNA, 15 bp, Homo sapiens
tattttcttgtattt

SEQ ID NO: 205382 - DNA, 15 bp, Homo sapiens
ttattttcttgtatt

SEQ ID NO: 205383 - DNA, 15 bp, Homo sapiens
tttattttcttgtat

SEQ ID NO: 205384 - DNA, 15 bp, Homo sapiens
atttattttcttgta

SEQ ID NO: 205385 - DNA, 15 bp, Homo sapiens
aatttattttcttgt

SEQ ID NO: 205386 - DNA, 15 bp, Homo sapiens
aaatttattttcttg

SEQ ID NO: 205387 - DNA, 15 bp, Homo sapiens
aaaatttattttctt

SEQ ID NO: 205388 - DNA, 15 bp, Homo sapiens
gaaaatttattttct

SEQ ID NO: 205389 - DNA, 15 bp, Homo sapiens
agaaaatttattttc

SEQ ID NO: 205390 - DNA, 15 bp, Homo sapiens
tagaaaatttatttt

SEQ ID NO: 205391 - DNA, 15 bp, Homo sapiens
ttagaaaatttattt

SEQ ID NO: 205392 - DNA, 15 bp, Homo sapiens
attagaaaatttatt

SEQ ID NO: 205393 - DNA, 15 bp, Homo sapiens
gattagaaaatttat

SEQ ID NO: 205394 - DNA, 15 bp, Homo sapiens
tgattagaaaattta

SEQ ID NO: 205395 - DNA, 15 bp, Homo sapiens
atgattagaaaattt

SEQ ID NO: 205396 - DNA, 15 bp, Homo sapiens
tatgattagaaaatt

SEQ ID NO: 205397 - DNA, 15 bp, Homo sapiens
gtatgattagaaaat

SEQ ID NO: 205398 - DNA, 15 bp, Homo sapiens
agtatgattagaaaa

SEQ ID NO: 205399 - DNA, 15 bp, Homo sapiens
cagtatgattagaaa

SEQ ID NO: 205400 - DNA, 15 bp, Homo sapiens
acagtatgattagaa

SEQ ID NO: 205401 - DNA, 15 bp, Homo sapiens
aacagtatgattaga

SEQ ID NO: 205402 - DNA, 15 bp, Homo sapiens
gaacagtatgattag

SEQ ID NO: 205403 - DNA, 15 bp, Homo sapiens
agaacagtatgatta

SEQ ID NO: 205404 - DNA, 15 bp, Homo sapiens
gagaacagtatgatt

SEQ ID NO: 205405 - DNA, 15 bp, Homo sapiens
tgagaacagtatgat

SEQ ID NO: 205406 - DNA, 15 bp, Homo sapiens
ctgagaacagtatga

SEQ ID NO: 205407 - DNA, 15 bp, Homo sapiens
tctgagaacagtatg

SEQ ID NO: 205408 - DNA, 15 bp, Homo sapiens
ctctgagaacagtat

SEQ ID NO: 205409 - DNA, 15 bp, Homo sapiens
tctctgagaacagta

SEQ ID NO: 205410 - DNA, 15 bp, Homo sapiens
atctctgagaacagt

SEQ ID NO: 205411 - DNA, 15 bp, Homo sapiens
aatctctgagaacag

SEQ ID NO: 205412 - DNA, 15 bp, Homo sapiens
aaatctctgagaaca

SEQ ID NO: 205413 - DNA, 15 bp, Homo sapiens
taaatctctgagaac

SEQ ID NO: 205414 - DNA, 15 bp, Homo sapiens
gtaaatctctgagaa

SEQ ID NO: 205415 - DNA, 15 bp, Homo sapiens
tgtaaatctctgaga

SEQ ID NO: 205416 - DNA, 15 bp, Homo sapiens
ttgtaaatctctgag

SEQ ID NO: 205417 - DNA, 15 bp, Homo sapiens
tttgtaaatctctga

SEQ ID NO: 205418 - DNA, 15 bp, Homo sapiens
ttttgtaaatctctg

SEQ ID NO: 205419 - DNA, 15 bp, Homo sapiens
attttgtaaatctct

SEQ ID NO: 205420 - DNA, 15 bp, Homo sapiens
cattttgtaaatctc

SEQ ID NO: 205421 - DNA, 15 bp, Homo sapiens
gcattttgtaaatct

SEQ ID NO: 205422 - DNA, 15 bp, Homo sapiens
agcattttgtaaatc

SEQ ID NO: 205423 - DNA, 15 bp, Homo sapiens
aagcattttgtaaat

SEQ ID NO: 205424 - DNA, 15 bp, Homo sapiens
aaagcattttgtaaa

SEQ ID NO: 205425 - DNA, 15 bp, Homo sapiens
caaagcattttgtaa

SEQ ID NO: 205426 - DNA, 15 bp, Homo sapiens
tcaaagcattttgta

SEQ ID NO: 205427 - DNA, 15 bp, Homo sapiens
ttcaaagcattttgt

SEQ ID NO: 205428 - DNA, 15 bp, Homo sapiens
gttcaaagcattttg

SEQ ID NO: 205429 - DNA, 15 bp, Homo sapiens
agttcaaagcatttt

SEQ ID NO: 205430 - DNA, 15 bp, Homo sapiens
aagttcaaagcattt

SEQ ID NO: 205431 - DNA, 15 bp, Homo sapiens
gaagttcaaagcatt

SEQ ID NO: 205432 - DNA, 15 bp, Homo sapiens
cgaagttcaaagcat

SEQ ID NO: 205433 - DNA, 15 bp, Homo sapiens
acgaagttcaaagca

SEQ ID NO: 205434 - DNA, 15 bp, Homo sapiens
aacgaagttcaaagc

SEQ ID NO: 205435 - DNA, 15 bp, Homo sapiens
gaacgaagttcaaag

SEQ ID NO: 205436 - DNA, 15 bp, Homo sapiens
agaacgaagttcaaa

SEQ ID NO: 205437 - DNA, 15 bp, Homo sapiens
cagaacgaagttcaa

SEQ ID NO: 205438 - DNA, 15 bp, Homo sapiens
acagaacgaagttca

SEQ ID NO: 205439 - DNA, 15 bp, Homo sapiens
tacagaacgaagttc

SEQ ID NO: 205440 - DNA, 15 bp, Homo sapiens
atacagaacgaagtt

SEQ ID NO: 205441 - DNA, 15 bp, Homo sapiens
aatacagaacgaagt

SEQ ID NO: 205442 - DNA, 15 bp, Homo sapiens
aaatacagaacgaag

SEQ ID NO: 205443 - DNA, 15 bp, Homo sapiens
taaatacagaacgaa

SEQ ID NO: 205444 - DNA, 15 bp, Homo sapiens
ttaaatacagaacga

SEQ ID NO: 205445 - DNA, 15 bp, Homo sapiens
tttaaatacagaacg

SEQ ID NO: 205446 - DNA, 15 bp, Homo sapiens
gtttaaatacagaac

SEQ ID NO: 205447 - DNA, 15 bp, Homo sapiens
agtttaaatacagaa

SEQ ID NO: 205448 - DNA, 15 bp, Homo sapiens
aagtttaaatacaga

SEQ ID NO: 205449 - DNA, 15 bp, Homo sapiens
aaagtttaaatacag

SEQ ID NO: 205450 - DNA, 15 bp, Homo sapiens
aaaagtttaaataca

SEQ ID NO: 205451 - DNA, 15 bp, Homo sapiens
aaaaagtttaaatac

SEQ ID NO: 205452 - DNA, 15 bp, Homo sapiens
aaaaaagtttaaata

SEQ ID NO: 205453 - DNA, 15 bp, Homo sapiens
aaaaaaagtttaaat

SEQ ID NO: 205454 - DNA, 15 bp, Homo sapiens
taaaaaaagtttaaa

SEQ ID NO: 205455 - DNA, 15 bp, Homo sapiens
ataaaaaaagtttaa

SEQ ID NO: 205456 - DNA, 15 bp, Homo sapiens
aataaaaaaagttta

SEQ ID NO: 205457 - DNA, 15 bp, Homo sapiens
taataaaaaaagttt

SEQ ID NO: 205458 - DNA, 15 bp, Homo sapiens
ataataaaaaaagtt

SEQ ID NO: 205459 - DNA, 15 bp, Homo sapiens
aataataaaaaaagt

SEQ ID NO: 205460 - DNA, 15 bp, Homo sapiens
aaataataaaaaaag

SEQ ID NO: 205461 - DNA, 15 bp, Homo sapiens
gaaataataaaaaaa

SEQ ID NO: 205462 - DNA, 15 bp, Homo sapiens
tgaaataataaaaaa

SEQ ID NO: 205463 - DNA, 15 bp, Homo sapiens
gtgaaataataaaaa

SEQ ID NO: 205464 - DNA, 15 bp, Homo sapiens
tgtgaaataataaaa

SEQ ID NO: 205465 - DNA, 15 bp, Homo sapiens
gtgtgaaataataaa

SEQ ID NO: 205466 - DNA, 15 bp, Homo sapiens
tgtgtgaaataataa

SEQ ID NO: 205467 - DNA, 15 bp, Homo sapiens
ctgtgtgaaataata

SEQ ID NO: 205468 - DNA, 15 bp, Homo sapiens
gctgtgtgaaataat

SEQ ID NO: 205469 - DNA, 15 bp, Homo sapiens
cgctgtgtgaaataa

SEQ ID NO: 205470 - DNA, 15 bp, Homo sapiens
acgctgtgtgaaata

SEQ ID NO: 205471 - DNA, 15 bp, Homo sapiens
aacgctgtgtgaaat

SEQ ID NO: 205472 - DNA, 15 bp, Homo sapiens
aaacgctgtgtgaaa

SEQ ID NO: 205473 - DNA, 15 bp, Homo sapiens
aaaacgctgtgtgaa

SEQ ID NO: 205474 - DNA, 15 bp, Homo sapiens
aaaaacgctgtgtga

SEQ ID NO: 205475 - DNA, 15 bp, Homo sapiens
aaaaaacgctgtgtg

SEQ ID NO: 205476 - DNA, 15 bp, Homo sapiens
taaaaaacgctgtgt

SEQ ID NO: 205477 - DNA, 15 bp, Homo sapiens
ttaaaaaacgctgtg

SEQ ID NO: 205478 - DNA, 15 bp, Homo sapiens
attaaaaaacgctgt

SEQ ID NO: 205479 - DNA, 15 bp, Homo sapiens
gattaaaaaacgctg

SEQ ID NO: 205480 - DNA, 15 bp, Homo sapiens
tgattaaaaaacgct

SEQ ID NO: 205481 - DNA, 15 bp, Homo sapiens
ctgattaaaaaacgc

SEQ ID NO: 205482 - DNA, 15 bp, Homo sapiens
gctgattaaaaaacg

SEQ ID NO: 205483 - DNA, 15 bp, Homo sapiens
tgctgattaaaaaac

SEQ ID NO: 205484 - DNA, 15 bp, Homo sapiens
atgctgattaaaaaa

SEQ ID NO: 205485 - DNA, 15 bp, Homo sapiens
tatgctgattaaaaa

SEQ ID NO: 205486 - DNA, 15 bp, Homo sapiens
atatgctgattaaaa

SEQ ID NO: 205487 - DNA, 15 bp, Homo sapiens
catatgctgattaaa

SEQ ID NO: 205488 - DNA, 15 bp, Homo sapiens
gcatatgctgattaa

SEQ ID NO: 205489 - DNA, 15 bp, Homo sapiens
agcatatgctgatta

SEQ ID NO: 205490 - DNA, 15 bp, Homo sapiens
cagcatatgctgatt

SEQ ID NO: 205491 - DNA, 15 bp, Homo sapiens
catcagcatatgctg

SEQ ID NO: 205492 - DNA, 15 bp, Homo sapiens
tcatcagcatatgct

SEQ ID NO: 205493 - DNA, 15 bp, Homo sapiens
ttcatcagcatatgc

SEQ ID NO: 205494 - DNA, 15 bp, Homo sapiens
tttcatcagcatatg

SEQ ID NO: 205495 - DNA, 15 bp, Homo sapiens
ctttcatcagcatat

SEQ ID NO: 205496 - DNA, 15 bp, Homo sapiens
cctttcatcagcata

SEQ ID NO: 205497 - DNA, 15 bp, Homo sapiens
gcctttcatcagcat

SEQ ID NO: 205498 - DNA, 15 bp, Homo sapiens
tgcctttcatcagca

SEQ ID NO: 205499 - DNA, 15 bp, Homo sapiens
ctgcctttcatcagc

SEQ ID NO: 205500 - DNA, 15 bp, Homo sapiens
tctgcctttcatcag

SEQ ID NO: 205501 - DNA, 15 bp, Homo sapiens
gtctgcctttcatca

SEQ ID NO: 205502 - DNA, 15 bp, Homo sapiens
cgtctgcctttcatc

SEQ ID NO: 205503 - DNA, 15 bp, Homo sapiens
acgtctgcctttcat

SEQ ID NO: 205504 - DNA, 15 bp, Homo sapiens
cacgtctgcctttca

SEQ ID NO: 205505 - DNA, 15 bp, Homo sapiens
acacgtctgcctttc

SEQ ID NO: 205506 - DNA, 15 bp, Homo sapiens
cacacgtctgccttt

SEQ ID NO: 205507 - DNA, 15 bp, Homo sapiens
gcacacgtctgcctt

SEQ ID NO: 205508 - DNA, 15 bp, Homo sapiens
ggcacacgtctgcct

SEQ ID NO: 205509 - DNA, 15 bp, Homo sapiens
aggcacacgtctgcc

SEQ ID NO: 205510 - DNA, 15 bp, Homo sapiens
aaggcacacgtctgc

SEQ ID NO: 205511 - DNA, 15 bp, Homo sapiens
caaggcacacgtctg

SEQ ID NO: 205512 - DNA, 15 bp, Homo sapiens
acaaggcacacgtct

SEQ ID NO: 205513 - DNA, 15 bp, Homo sapiens
aacaaggcacacgtc

SEQ ID NO: 205514 - DNA, 15 bp, Homo sapiens
taacaaggcacacgt

SEQ ID NO: 205515 - DNA, 15 bp, Homo sapiens
gtaacaaggcacacg

SEQ ID NO: 205516 - DNA, 15 bp, Homo sapiens
tgtaacaaggcacac

SEQ ID NO: 205517 - DNA, 15 bp, Homo sapiens
gtgtaacaaggcaca

SEQ ID NO: 205518 - DNA, 15 bp, Homo sapiens
ggtgtaacaaggcac

SEQ ID NO: 205519 - DNA, 15 bp, Homo sapiens
aggtgtaacaaggca

SEQ ID NO: 205520 - DNA, 15 bp, Homo sapiens
gaggtgtaacaaggc

SEQ ID NO: 205521 - DNA, 15 bp, Homo sapiens
agaggtgtaacaagg

SEQ ID NO: 205522 - DNA, 15 bp, Homo sapiens
tagaggtgtaacaag

SEQ ID NO: 205523 - DNA, 15 bp, Homo sapiens
ttagaggtgtaacaa

SEQ ID NO: 205524 - DNA, 15 bp, Homo sapiens
tttagaggtgtaaca

SEQ ID NO: 205525 - DNA, 15 bp, Homo sapiens
gtttagaggtgtaac

SEQ ID NO: 205526 - DNA, 15 bp, Homo sapiens
ggtttagaggtgtaa

SEQ ID NO: 205527 - DNA, 15 bp, Homo sapiens
aggtttagaggtgta

SEQ ID NO: 205528 - DNA, 15 bp, Homo sapiens
gaggtttagaggtgt

SEQ ID NO: 205529 - DNA, 15 bp, Homo sapiens
tgaggtttagaggtg

SEQ ID NO: 205530 - DNA, 15 bp, Homo sapiens
ttgaggtttagaggt

SEQ ID NO: 205531 - DNA, 15 bp, Homo sapiens
tttgaggtttagagg

SEQ ID NO: 205532 - DNA, 15 bp, Homo sapiens
ctttgaggtttagag

SEQ ID NO: 205533 - DNA, 15 bp, Homo sapiens
tctttgaggtttaga

SEQ ID NO: 205534 - DNA, 15 bp, Homo sapiens
atctttgaggtttag

SEQ ID NO: 205535 - DNA, 15 bp, Homo sapiens
gatctttgaggttta

SEQ ID NO: 205536 - DNA, 15 bp, Homo sapiens
tgatctttgaggttt

SEQ ID NO: 205537 - DNA, 15 bp, Homo sapiens
atgatctttgaggtt

SEQ ID NO: 205538 - DNA, 15 bp, Homo sapiens
catgatctttgaggt

SEQ ID NO: 205539 - DNA, 15 bp, Homo sapiens
ccatgatctttgagg

SEQ ID NO: 205540 - DNA, 15 bp, Homo sapiens
cccatgatctttgag

SEQ ID NO: 205541 - DNA, 15 bp, Homo sapiens
gcccatgatctttga

SEQ ID NO: 205542 - DNA, 15 bp, Homo sapiens
tgcccatgatctttg

SEQ ID NO: 205543 - DNA, 15 bp, Homo sapiens
ctgcccatgatcttt

SEQ ID NO: 205544 - DNA, 15 bp, Homo sapiens
actgcccatgatctt

SEQ ID NO: 205545 - DNA, 15 bp, Homo sapiens
gactgcccatgatct

SEQ ID NO: 205546 - DNA, 15 bp, Homo sapiens
tgactgcccatgatc

SEQ ID NO: 205547 - DNA, 15 bp, Homo sapiens
gtgactgcccatgat

SEQ ID NO: 205548 - DNA, 15 bp, Homo sapiens
tgtgactgcccatga

SEQ ID NO: 205549 - DNA, 15 bp, Homo sapiens
ctgtgactgcccatg

SEQ ID NO: 205550 - DNA, 15 bp, Homo sapiens
actgtgactgcccat

SEQ ID NO: 205551 - DNA, 15 bp, Homo sapiens
tactgtgactgccca

SEQ ID NO: 205552 - DNA, 15 bp, Homo sapiens
ttactgtgactgccc

SEQ ID NO: 205553 - DNA, 15 bp, Homo sapiens
attactgtgactgcc

SEQ ID NO: 205554 - DNA, 15 bp, Homo sapiens
aattactgtgactgc

SEQ ID NO: 205555 - DNA, 15 bp, Homo sapiens
gaattactgtgactg

SEQ ID NO: 205556 - DNA, 15 bp, Homo sapiens
ggaattactgtgact

SEQ ID NO: 205557 - DNA, 15 bp, Homo sapiens
tggaattactgtgac

SEQ ID NO: 205558 - DNA, 15 bp, Homo sapiens
atggaattactgtga

SEQ ID NO: 205559 - DNA, 15 bp, Homo sapiens
aatggaattactgtg

SEQ ID NO: 205560 - DNA, 15 bp, Homo sapiens
aaatggaattactgt

SEQ ID NO: 205561 - DNA, 15 bp, Homo sapiens
gaaatggaattactg

SEQ ID NO: 205562 - DNA, 15 bp, Homo sapiens
ggaaatggaattact

SEQ ID NO: 205563 - DNA, 15 bp, Homo sapiens
gggaaatggaattac

SEQ ID NO: 205564 - DNA, 15 bp, Homo sapiens
ggggaaatggaatta

SEQ ID NO: 205565 - DNA, 15 bp, Homo sapiens
tggggaaatggaatt

SEQ ID NO: 205566 - DNA, 15 bp, Homo sapiens
ttggggaaatggaat

SEQ ID NO: 205567 - DNA, 15 bp, Homo sapiens
cttggggaaatggaa

SEQ ID NO: 205568 - DNA, 15 bp, Homo sapiens
acttggggaaatgga

SEQ ID NO: 205569 - DNA, 15 bp, Homo sapiens
aacttggggaaatgg

SEQ ID NO: 205570 - DNA, 15 bp, Homo sapiens
taacttggggaaatg

SEQ ID NO: 205571 - DNA, 15 bp, Homo sapiens
ttaacttggggaaat

SEQ ID NO: 205572 - DNA, 15 bp, Homo sapiens
cttaacttggggaaa

SEQ ID NO: 205573 - DNA, 15 bp, Homo sapiens
ccttaacttggggaa

SEQ ID NO: 205574 - DNA, 15 bp, Homo sapiens
gccttaacttgggga

SEQ ID NO: 205575 - DNA, 15 bp, Homo sapiens
tgccttaacttgggg

SEQ ID NO: 205576 - DNA, 15 bp, Homo sapiens
atgccttaacttggg

SEQ ID NO: 205577 - DNA, 15 bp, Homo sapiens
tatgccttaacttgg

SEQ ID NO: 205578 - DNA, 15 bp, Homo sapiens
ttatgccttaacttg

SEQ ID NO: 205579 - DNA, 15 bp, Homo sapiens
cttatgccttaactt

SEQ ID NO: 205580 - DNA, 15 bp, Homo sapiens
gcttatgccttaact

SEQ ID NO: 205581 - DNA, 15 bp, Homo sapiens
ggcttatgccttaac

SEQ ID NO: 205582 - DNA, 15 bp, Homo sapiens
gggcttatgccttaa

SEQ ID NO: 205583 - DNA, 15 bp, Homo sapiens
cgggcttatgcctta

SEQ ID NO: 205584 - DNA, 15 bp, Homo sapiens
gcgggcttatgcctt

SEQ ID NO: 205585 - DNA, 15 bp, Homo sapiens
tgcgggcttatgcct

SEQ ID NO: 205586 - DNA, 15 bp, Homo sapiens
atgcgggcttatgcc

SEQ ID NO: 205587 - DNA, 15 bp, Homo sapiens
aatgcgggcttatgc

SEQ ID NO: 205588 - DNA, 15 bp, Homo sapiens
gaatgcgggcttatg

SEQ ID NO: 205589 - DNA, 15 bp, Homo sapiens
tgaatgcgggcttat

SEQ ID NO: 205590 - DNA, 15 bp, Homo sapiens
gtgaatgcgggctta

SEQ ID NO: 205591 - DNA, 15 bp, Homo sapiens
tgtgaatgcgggctt

SEQ ID NO: 205592 - DNA, 15 bp, Homo sapiens
ctgtgaatgcgggct

SEQ ID NO: 205593 - DNA, 15 bp, Homo sapiens
actgtgaatgcgggc

SEQ ID NO: 205594 - DNA, 15 bp, Homo sapiens
gactgtgaatgcggg

SEQ ID NO: 205595 - DNA, 15 bp, Homo sapiens
agactgtgaatgcgg

SEQ ID NO: 205596 - DNA, 15 bp, Homo sapiens
cagactgtgaatgcg

SEQ ID NO: 205597 - DNA, 15 bp, Homo sapiens
gcagactgtgaatgc

SEQ ID NO: 205598 - DNA, 15 bp, Homo sapiens
ggcagactgtgaatg

SEQ ID NO: 205599 - DNA, 15 bp, Homo sapiens
gggcagactgtgaat

SEQ ID NO: 205600 - DNA, 15 bp, Homo sapiens
agggcagactgtgaa

SEQ ID NO: 205601 - DNA, 15 bp, Homo sapiens
gagggcagactgtga

SEQ ID NO: 205602 - DNA, 15 bp, Homo sapiens
agagggcagactgtg

SEQ ID NO: 205603 - DNA, 15 bp, Homo sapiens
cagagggcagactgt

SEQ ID NO: 205604 - DNA, 15 bp, Homo sapiens
ccagagggcagactg

SEQ ID NO: 205605 - DNA, 15 bp, Homo sapiens
cccagagggcagact

SEQ ID NO: 205606 - DNA, 15 bp, Homo sapiens
tcccagagggcagac

SEQ ID NO: 205607 - DNA, 15 bp, Homo sapiens
atcccagagggcaga

SEQ ID NO: 205608 - DNA, 15 bp, Homo sapiens
catcccagagggcag

SEQ ID NO: 205609 - DNA, 15 bp, Homo sapiens
tcatcccagagggca

SEQ ID NO: 205610 - DNA, 15 bp, Homo sapiens
atcatcccagagggc

SEQ ID NO: 205611 - DNA, 15 bp, Homo sapiens
catcatcccagaggg

SEQ ID NO: 205612 - DNA, 15 bp, Homo sapiens
gcatcatcccagagg

SEQ ID NO: 205613 - DNA, 15 bp, Homo sapiens
tgcatcatcccagag

SEQ ID NO: 205614 - DNA, 15 bp, Homo sapiens
ctgcatcatcccaga

SEQ ID NO: 205615 - DNA, 15 bp, Homo sapiens
cctgcatcatcccag

SEQ ID NO: 205616 - DNA, 15 bp, Homo sapiens
tcctgcatcatccca

SEQ ID NO: 205617 - DNA, 15 bp, Homo sapiens
atcctgcatcatccc

SEQ ID NO: 205618 - DNA, 15 bp, Homo sapiens
aatcctgcatcatcc

SEQ ID NO: 205619 - DNA, 15 bp, Homo sapiens
caatcctgcatcatc

SEQ ID NO: 205620 - DNA, 15 bp, Homo sapiens
tcaatcctgcatcat

SEQ ID NO: 205621 - DNA, 15 bp, Homo sapiens
ctcaatcctgcatca

SEQ ID NO: 205622 - DNA, 15 bp, Homo sapiens
actcaatcctgcatc

SEQ ID NO: 205623 - DNA, 15 bp, Homo sapiens
gactcaatcctgcat

SEQ ID NO: 205624 - DNA, 15 bp, Homo sapiens
tgactcaatcctgca

SEQ ID NO: 205625 - DNA, 15 bp, Homo sapiens
ttgactcaatcctgc

SEQ ID NO: 205626 - DNA, 15 bp, Homo sapiens
cttgactcaatcctg

SEQ ID NO: 205627 - DNA, 15 bp, Homo sapiens
gcttgactcaatcct

SEQ ID NO: 205628 - DNA, 15 bp, Homo sapiens
ggcttgactcaatcc

SEQ ID NO: 205629 - DNA, 15 bp, Homo sapiens
gggcttgactcaatc

SEQ ID NO: 205630 - DNA, 15 bp, Homo sapiens
tgggcttgactcaat

SEQ ID NO: 205631 - DNA, 15 bp, Homo sapiens
ctgggcttgactcaa

SEQ ID NO: 205632 - DNA, 15 bp, Homo sapiens
actgggcttgactca

SEQ ID NO: 205633 - DNA, 15 bp, Homo sapiens
aactgggcttgactc

SEQ ID NO: 205634 - DNA, 15 bp, Homo sapiens
gaactgggcttgact

SEQ ID NO: 205635 - DNA, 15 bp, Homo sapiens
cgaactgggcttgac

SEQ ID NO: 205636 - DNA, 15 bp, Homo sapiens
tcgaactgggcttga

SEQ ID NO: 205637 - DNA, 15 bp, Homo sapiens
atcgaactgggcttg

SEQ ID NO: 205638 - DNA, 15 bp, Homo sapiens
aatcgaactgggctt

SEQ ID NO: 205639 - DNA, 15 bp, Homo sapiens
gaatcgaactgggct

SEQ ID NO: 205640 - DNA, 15 bp, Homo sapiens
ggaatcgaactgggc

SEQ ID NO: 205641 - DNA, 15 bp, Homo sapiens
aggaatcgaactggg

SEQ ID NO: 205642 - DNA, 15 bp, Homo sapiens
aaggaatcgaactgg

SEQ ID NO: 205643 - DNA, 15 bp, Homo sapiens
caaggaatcgaactg

SEQ ID NO: 205644 - DNA, 15 bp, Homo sapiens
tcaaggaatcgaact

SEQ ID NO: 205645 - DNA, 15 bp, Homo sapiens
ctcaaggaatcgaac

SEQ ID NO: 205646 - DNA, 15 bp, Homo sapiens
actcaaggaatcgaa

SEQ ID NO: 205647 - DNA, 15 bp, Homo sapiens
gactcaaggaatcga

SEQ ID NO: 205648 - DNA, 15 bp, Homo sapiens
cgactcaaggaatcg

SEQ ID NO: 205649 - DNA, 15 bp, Homo sapiens
gcgactcaaggaatc

SEQ ID NO: 205650 - DNA, 15 bp, Homo sapiens
agcgactcaaggaat

SEQ ID NO: 205651 - DNA, 15 bp, Homo sapiens
cagcgactcaaggaa

SEQ ID NO: 205652 - DNA, 15 bp, Homo sapiens
ccagcgactcaagga

SEQ ID NO: 205653 - DNA, 15 bp, Homo sapiens
tccagcgactcaagg

SEQ ID NO: 205654 - DNA, 15 bp, Homo sapiens
ctccagcgactcaag

SEQ ID NO: 205655 - DNA, 15 bp, Homo sapiens
actccagcgactcaa

SEQ ID NO: 205656 - DNA, 15 bp, Homo sapiens
aactccagcgactca

SEQ ID NO: 205657 - DNA, 15 bp, Homo sapiens
caactccagcgactc

SEQ ID NO: 205658 - DNA, 15 bp, Homo sapiens
acaactccagcgact

SEQ ID NO: 205659 - DNA, 15 bp, Homo sapiens
aacaactccagcgac

SEQ ID NO: 205660 - DNA, 15 bp, Homo sapiens
aaacaactccagcga

SEQ ID NO: 205661 - DNA, 15 bp, Homo sapiens
gaaacaactccagcg

SEQ ID NO: 205662 - DNA, 15 bp, Homo sapiens
agaaacaactccagc

SEQ ID NO: 205663 - DNA, 15 bp, Homo sapiens
cagaaacaactccag

SEQ ID NO: 205664 - DNA, 15 bp, Homo sapiens
tcagaaacaactcca

SEQ ID NO: 205665 - DNA, 15 bp, Homo sapiens
gtcagaaacaactcc

SEQ ID NO: 205666 - DNA, 15 bp, Homo sapiens
agtcagaaacaactc

SEQ ID NO: 205667 - DNA, 15 bp, Homo sapiens
cagtcagaaacaact

SEQ ID NO: 205668 - DNA, 15 bp, Homo sapiens
tcagtcagaaacaac

SEQ ID NO: 205669 - DNA, 15 bp, Homo sapiens
atcagtcagaaacaa

SEQ ID NO: 205670 - DNA, 15 bp, Homo sapiens
gatcagtcagaaaca

SEQ ID NO: 205671 - DNA, 15 bp, Homo sapiens
ggatcagtcagaaac

SEQ ID NO: 205672 - DNA, 15 bp, Homo sapiens
tggatcagtcagaaa

SEQ ID NO: 205673 - DNA, 15 bp, Homo sapiens
atggatcagtcagaa

SEQ ID NO: 205674 - DNA, 15 bp, Homo sapiens
tatggatcagtcaga

SEQ ID NO: 205675 - DNA, 15 bp, Homo sapiens
atatggatcagtcag

SEQ ID NO: 205676 - DNA, 15 bp, Homo sapiens
aatatggatcagtca

SEQ ID NO: 205677 - DNA, 15 bp, Homo sapiens
aaatatggatcagtc

SEQ ID NO: 205678 - DNA, 15 bp, Homo sapiens
aaaatatggatcagt

SEQ ID NO: 205679 - DNA, 15 bp, Homo sapiens
gaaaatatggatcag

SEQ ID NO: 205680 - DNA, 15 bp, Homo sapiens
tgaaaatatggatca

SEQ ID NO: 205681 - DNA, 15 bp, Homo sapiens
ttgaaaatatggatc

SEQ ID NO: 205682 - DNA, 15 bp, Homo sapiens
tttgaaaatatggat

SEQ ID NO: 205683 - DNA, 15 bp, Homo sapiens
atttgaaaatatgga

SEQ ID NO: 205684 - DNA, 15 bp, Homo sapiens
gatttgaaaatatgg

SEQ ID NO: 205685 - DNA, 15 bp, Homo sapiens
ggatttgaaaatatg

SEQ ID NO: 205686 - DNA, 15 bp, Homo sapiens
tggatttgaaaatat

SEQ ID NO: 205687 - DNA, 15 bp, Homo sapiens
ctggatttgaaaata

SEQ ID NO: 205688 - DNA, 15 bp, Homo sapiens
gctggatttgaaaat

SEQ ID NO: 205689 - DNA, 15 bp, Homo sapiens
ggctggatttgaaaa

SEQ ID NO: 205690 - DNA, 15 bp, Homo sapiens
gggctggatttgaaa

SEQ ID NO: 205691 - DNA, 15 bp, Homo sapiens
tgggctggatttgaa

SEQ ID NO: 205692 - DNA, 15 bp, Homo sapiens
gtgggctggatttga

SEQ ID NO: 205693 - DNA, 15 bp, Homo sapiens
ggtgggctggatttg

SEQ ID NO: 205694 - DNA, 15 bp, Homo sapiens
tggtgggctggattt

SEQ ID NO: 205695 - DNA, 15 bp, Homo sapiens
ctggtgggctggatt

SEQ ID NO: 205696 - DNA, 15 bp, Homo sapiens
actggtgggctggat

SEQ ID NO: 205697 - DNA, 15 bp, Homo sapiens
cactggtgggctgga

SEQ ID NO: 205698 - DNA, 15 bp, Homo sapiens
ccactggtgggctgg

SEQ ID NO: 205699 - DNA, 15 bp, Homo sapiens
cccactggtgggctg

SEQ ID NO: 205700 - DNA, 15 bp, Homo sapiens
gcccactggtgggct

SEQ ID NO: 205701 - DNA, 15 bp, Homo sapiens
ggcccactggtgggc

SEQ ID NO: 205702 - DNA, 15 bp, Homo sapiens
aggcccactggtggg

SEQ ID NO: 205703 - DNA, 15 bp, Homo sapiens
caggcccactggtgg

SEQ ID NO: 205704 - DNA, 15 bp, Homo sapiens
tcaggcccactggtg

SEQ ID NO: 205705 - DNA, 15 bp, Homo sapiens
ctcaggcccactggt

SEQ ID NO: 205706 - DNA, 15 bp, Homo sapiens
cctcaggcccactgg

SEQ ID NO: 205707 - DNA, 15 bp, Homo sapiens
gcctcaggcccactg

SEQ ID NO: 205708 - DNA, 15 bp, Homo sapiens
agcctcaggcccact

SEQ ID NO: 205709 - DNA, 15 bp, Homo sapiens
cagcctcaggcccac

SEQ ID NO: 205710 - DNA, 15 bp, Homo sapiens
ccagcctcaggccca

SEQ ID NO: 205711 - DNA, 15 bp, Homo sapiens
tccagcctcaggccc

SEQ ID NO: 205712 - DNA, 15 bp, Homo sapiens
atccagcctcaggcc

SEQ ID NO: 205713 - DNA, 15 bp, Homo sapiens
tatccagcctcaggc

SEQ ID NO: 205714 - DNA, 15 bp, Homo sapiens
ttatccagcctcagg

SEQ ID NO: 205715 - DNA, 15 bp, Homo sapiens
cttatccagcctcag

SEQ ID NO: 205716 - DNA, 15 bp, Homo sapiens
acttatccagcctca

SEQ ID NO: 205717 - DNA, 15 bp, Homo sapiens
cacttatccagcctc

SEQ ID NO: 205718 - DNA, 15 bp, Homo sapiens
ccacttatccagcct

SEQ ID NO: 205719 - DNA, 15 bp, Homo sapiens
cccacttatccagcc

SEQ ID NO: 205720 - DNA, 15 bp, Homo sapiens
gcccacttatccagc

SEQ ID NO: 205721 - DNA, 15 bp, Homo sapiens
agcccacttatccag

SEQ ID NO: 205722 - DNA, 15 bp, Homo sapiens
aagcccacttatcca

SEQ ID NO: 205723 - DNA, 15 bp, Homo sapiens
aaagcccacttatcc

SEQ ID NO: 205724 - DNA, 15 bp, Homo sapiens
gaaagcccacttatc

SEQ ID NO: 205725 - DNA, 15 bp, Homo sapiens
tgaaagcccacttat

SEQ ID NO: 205726 - DNA, 15 bp, Homo sapiens
gtgaaagcccactta

SEQ ID NO: 205727 - DNA, 15 bp, Homo sapiens
ggtgaaagcccactt

SEQ ID NO: 205728 - DNA, 15 bp, Homo sapiens
tggtgaaagcccact

SEQ ID NO: 205729 - DNA, 15 bp, Homo sapiens
ctggtgaaagcccac

SEQ ID NO: 205730 - DNA, 15 bp, Homo sapiens
cctggtgaaagccca

SEQ ID NO: 205731 - DNA, 15 bp, Homo sapiens
ccctggtgaaagccc

SEQ ID NO: 205732 - DNA, 15 bp, Homo sapiens
gccctggtgaaagcc

SEQ ID NO: 205733 - DNA, 15 bp, Homo sapiens
ggccctggtgaaagc

SEQ ID NO: 205734 - DNA, 15 bp, Homo sapiens
gggccctggtgaaag

SEQ ID NO: 205735 - DNA, 15 bp, Homo sapiens
agggccctggtgaaa

SEQ ID NO: 205736 - DNA, 15 bp, Homo sapiens
tagggccctggtgaa

SEQ ID NO: 205737 - DNA, 15 bp, Homo sapiens
ttagggccctggtga

SEQ ID NO: 205738 - DNA, 15 bp, Homo sapiens
gttagggccctggtg

SEQ ID NO: 205739 - DNA, 15 bp, Homo sapiens
tgttagggccctggt

SEQ ID NO: 205740 - DNA, 15 bp, Homo sapiens
ttgttagggccctgg

SEQ ID NO: 205741 - DNA, 15 bp, Homo sapiens
cttgttagggccctg

SEQ ID NO: 205742 - DNA, 15 bp, Homo sapiens
tcttgttagggccct

SEQ ID NO: 205743 - DNA, 15 bp, Homo sapiens
ctcttgttagggccc

SEQ ID NO: 205744 - DNA, 15 bp, Homo sapiens
gctcttgttagggcc

SEQ ID NO: 205745 - DNA, 15 bp, Homo sapiens
tgctcttgttagggc

SEQ ID NO: 205746 - DNA, 15 bp, Homo sapiens
ttgctcttgttaggg

SEQ ID NO: 205747 - DNA, 15 bp, Homo sapiens
tttgctcttgttagg

SEQ ID NO: 205748 - DNA, 15 bp, Homo sapiens
ttttgctcttgttag

SEQ ID NO: 205749 - DNA, 15 bp, Homo sapiens
tttttgctcttgtta

SEQ ID NO: 205750 - DNA, 15 bp, Homo sapiens
ttttttgctcttgtt

SEQ ID NO: 205751 - DNA, 15 bp, Homo sapiens
cttttttgctcttgt

SEQ ID NO: 205752 - DNA, 15 bp, Homo sapiens
ccttttttgctcttg

SEQ ID NO: 205753 - DNA, 15 bp, Homo sapiens
tccttttttgctctt

SEQ ID NO: 205754 - DNA, 15 bp, Homo sapiens
ttccttttttgctct

SEQ ID NO: 205755 - DNA, 15 bp, Homo sapiens
gttccttttttgctc

SEQ ID NO: 205756 - DNA, 15 bp, Homo sapiens
tgttccttttttgct

SEQ ID NO: 205757 - DNA, 15 bp, Homo sapiens
atgttccttttttgc

SEQ ID NO: 205758 - DNA, 15 bp, Homo sapiens
catgttccttttttg

SEQ ID NO: 205759 - DNA, 15 bp, Homo sapiens
acatgttcctttttt

SEQ ID NO: 205760 - DNA, 15 bp, Homo sapiens
cacatgttccttttt

SEQ ID NO: 205761 - DNA, 15 bp, Homo sapiens
gcacatgttcctttt

SEQ ID NO: 205762 - DNA, 15 bp, Homo sapiens
tgcacatgttccttt

SEQ ID NO: 205763 - DNA, 15 bp, Homo sapiens
atgcacatgttcctt

SEQ ID NO: 205764 - DNA, 15 bp, Homo sapiens
tatgcacatgttcct

SEQ ID NO: 205765 - DNA, 15 bp, Homo sapiens
ctatgcacatgttcc

SEQ ID NO: 205766 - DNA, 15 bp, Homo sapiens
tctatgcacatgttc

SEQ ID NO: 205767 - DNA, 15 bp, Homo sapiens
atctatgcacatgtt

SEQ ID NO: 205768 - DNA, 15 bp, Homo sapiens
aatctatgcacatgt

SEQ ID NO: 205769 - DNA, 15 bp, Homo sapiens
aaatctatgcacatg

SEQ ID NO: 205770 - DNA, 15 bp, Homo sapiens
taaatctatgcacat

SEQ ID NO: 205771 - DNA, 15 bp, Homo sapiens
ataaatctatgcaca

SEQ ID NO: 205772 - DNA, 15 bp, Homo sapiens
tataaatctatgcac

SEQ ID NO: 205773 - DNA, 15 bp, Homo sapiens
gtataaatctatgca

SEQ ID NO: 205774 - DNA, 15 bp, Homo sapiens
agtataaatctatgc

SEQ ID NO: 205775 - DNA, 15 bp, Homo sapiens
gagtataaatctatg

SEQ ID NO: 205776 - DNA, 15 bp, Homo sapiens
ggagtataaatctat

SEQ ID NO: 205777 - DNA, 15 bp, Homo sapiens
aggagtataaatcta

SEQ ID NO: 205778 - DNA, 15 bp, Homo sapiens
taggagtataaatct

SEQ ID NO: 205779 - DNA, 15 bp, Homo sapiens
ataggagtataaatc

SEQ ID NO: 205780 - DNA, 15 bp, Homo sapiens
aataggagtataaat

SEQ ID NO: 205781 - DNA, 15 bp, Homo sapiens
gaataggagtataaa

SEQ ID NO: 205782 - DNA, 15 bp, Homo sapiens
agaataggagtataa

SEQ ID NO: 205783 - DNA, 15 bp, Homo sapiens
gagaataggagtata

SEQ ID NO: 205784 - DNA, 15 bp, Homo sapiens
tgagaataggagtat

SEQ ID NO: 205785 - DNA, 15 bp, Homo sapiens
ttgagaataggagta

SEQ ID NO: 205786 - DNA, 15 bp, Homo sapiens
cttgagaataggagt

SEQ ID NO: 205787 - DNA, 15 bp, Homo sapiens
ccttgagaataggag

SEQ ID NO: 205788 - DNA, 15 bp, Homo sapiens
cccttgagaatagga

SEQ ID NO: 205789 - DNA, 15 bp, Homo sapiens
gcccttgagaatagg

SEQ ID NO: 205790 - DNA, 15 bp, Homo sapiens
ggcccttgagaatag

SEQ ID NO: 205791 - DNA, 15 bp, Homo sapiens
aggcccttgagaata

SEQ ID NO: 205792 - DNA, 15 bp, Homo sapiens
aaggcccttgagaat

SEQ ID NO: 205793 - DNA, 15 bp, Homo sapiens
aaaggcccttgagaa

SEQ ID NO: 205794 - DNA, 15 bp, Homo sapiens
caaaggcccttgaga

SEQ ID NO: 205795 - DNA, 15 bp, Homo sapiens
gcaaaggcccttgag

SEQ ID NO: 205796 - DNA, 15 bp, Homo sapiens
agcaaaggcccttga

SEQ ID NO: 205797 - DNA, 15 bp, Homo sapiens
gagcaaaggcccttg

SEQ ID NO: 205798 - DNA, 15 bp, Homo sapiens
agagcaaaggccctt

SEQ ID NO: 205799 - DNA, 15 bp, Homo sapiens
aagagcaaaggccct

SEQ ID NO: 205800 - DNA, 15 bp, Homo sapiens
taagagcaaaggccc

SEQ ID NO: 205801 - DNA, 15 bp, Homo sapiens
ataagagcaaaggcc

SEQ ID NO: 205802 - DNA, 15 bp, Homo sapiens
aataagagcaaaggc

SEQ ID NO: 205803 - DNA, 15 bp, Homo sapiens
caataagagcaaagg

SEQ ID NO: 205804 - DNA, 15 bp, Homo sapiens
ccaataagagcaaag

SEQ ID NO: 205805 - DNA, 15 bp, Homo sapiens
tccaataagagcaaa

SEQ ID NO: 205806 - DNA, 15 bp, Homo sapiens
ttccaataagagcaa

SEQ ID NO: 205807 - DNA, 15 bp, Homo sapiens
gttccaataagagca

SEQ ID NO: 205808 - DNA, 15 bp, Homo sapiens
ggttccaataagagc

SEQ ID NO: 205809 - DNA, 15 bp, Homo sapiens
aggttccaataagag

SEQ ID NO: 205810 - DNA, 15 bp, Homo sapiens
aaggttccaataaga

SEQ ID NO: 205811 - DNA, 15 bp, Homo sapiens
taaggttccaataag

SEQ ID NO: 205812 - DNA, 15 bp, Homo sapiens
ttaaggttccaataa

SEQ ID NO: 205813 - DNA, 15 bp, Homo sapiens
gttaaggttccaata

SEQ ID NO: 205814 - DNA, 15 bp, Homo sapiens
ggttaaggttccaat

SEQ ID NO: 205815 - DNA, 15 bp, Homo sapiens
tggttaaggttccaa

SEQ ID NO: 205816 - DNA, 15 bp, Homo sapiens
atggttaaggttcca

SEQ ID NO: 205817 - DNA, 15 bp, Homo sapiens
tatggttaaggttcc

SEQ ID NO: 205818 - DNA, 15 bp, Homo sapiens
atatggttaaggttc

SEQ ID NO: 205819 - DNA, 15 bp, Homo sapiens
gatatggttaaggtt

SEQ ID NO: 205820 - DNA, 15 bp, Homo sapiens
tgatatggttaaggt

SEQ ID NO: 205821 - DNA, 15 bp, Homo sapiens
ttgatatggttaagg

SEQ ID NO: 205822 - DNA, 15 bp, Homo sapiens
tttgatatggttaag

SEQ ID NO: 205823 - DNA, 15 bp, Homo sapiens
ttttgatatggttaa

SEQ ID NO: 205824 - DNA, 15 bp, Homo sapiens
attttgatatggtta

SEQ ID NO: 205825 - DNA, 15 bp, Homo sapiens
cattttgatatggtt

SEQ ID NO: 205826 - DNA, 15 bp, Homo sapiens
acattttgatatggt

SEQ ID NO: 205827 - DNA, 15 bp, Homo sapiens
tacattttgatatgg

SEQ ID NO: 205828 - DNA, 15 bp, Homo sapiens
atacattttgatatg

SEQ ID NO: 205829 - DNA, 15 bp, Homo sapiens
aatacattttgatat

SEQ ID NO: 205830 - DNA, 15 bp, Homo sapiens
aaatacattttgata

SEQ ID NO: 205831 - DNA, 15 bp, Homo sapiens
aggaaatacattttg

SEQ ID NO: 205832 - DNA, 15 bp, Homo sapiens
taggaaatacatttt

SEQ ID NO: 205833 - DNA, 15 bp, Homo sapiens
ttaggaaatacattt

SEQ ID NO: 205834 - DNA, 15 bp, Homo sapiens
tttaggaaatacatt

SEQ ID NO: 205835 - DNA, 15 bp, Homo sapiens
gtttaggaaatacat

SEQ ID NO: 205836 - DNA, 15 bp, Homo sapiens
tgtttaggaaataca

SEQ ID NO: 205837 - DNA, 15 bp, Homo sapiens
atgtttaggaaatac

SEQ ID NO: 205838 - DNA, 15 bp, Homo sapiens
tatgtttaggaaata

SEQ ID NO: 205839 - DNA, 15 bp, Homo sapiens
atatgtttaggaaat

SEQ ID NO: 205840 - DNA, 15 bp, Homo sapiens
gatatgtttaggaaa

SEQ ID NO: 205841 - DNA, 15 bp, Homo sapiens
agatatgtttaggaa

SEQ ID NO: 205842 - DNA, 15 bp, Homo sapiens
cagatatgtttagga

SEQ ID NO: 205843 - DNA, 15 bp, Homo sapiens
acagatatgtttagg

SEQ ID NO: 205844 - DNA, 15 bp, Homo sapiens
cacagatatgtttag

SEQ ID NO: 205845 - DNA, 15 bp, Homo sapiens
tcacagatatgttta

SEQ ID NO: 205846 - DNA, 15 bp, Homo sapiens
atcacagatatgttt

SEQ ID NO: 205847 - DNA, 15 bp, Homo sapiens
aatcacagatatgtt

SEQ ID NO: 205848 - DNA, 15 bp, Homo sapiens
taatcacagatatgt

SEQ ID NO: 205849 - DNA, 15 bp, Homo sapiens
ataatcacagatatg

SEQ ID NO: 205850 - DNA, 15 bp, Homo sapiens
cataatcacagatat

SEQ ID NO: 205851 - DNA, 15 bp, Homo sapiens
ccataatcacagata

SEQ ID NO: 205852 - DNA, 15 bp, Homo sapiens
tccataatcacagat

SEQ ID NO: 205853 - DNA, 15 bp, Homo sapiens
ctccataatcacaga

SEQ ID NO: 205854 - DNA, 15 bp, Homo sapiens
actccataatcacag

SEQ ID NO: 205855 - DNA, 15 bp, Homo sapiens
aactccataatcaca

SEQ ID NO: 205856 - DNA, 15 bp, Homo sapiens
gaactccataatcac

SEQ ID NO: 205857 - DNA, 15 bp, Homo sapiens
tgaactccataatca

SEQ ID NO: 205858 - DNA, 15 bp, Homo sapiens
atgaactccataatc

SEQ ID NO: 205859 - DNA, 15 bp, Homo sapiens
tatgaactccataat

SEQ ID NO: 205860 - DNA, 15 bp, Homo sapiens
ttatgaactccataa

SEQ ID NO: 205861 - DNA, 15 bp, Homo sapiens
attatgaactccata

SEQ ID NO: 205862 - DNA, 15 bp, Homo sapiens
gattatgaactccat

SEQ ID NO: 205863 - DNA, 15 bp, Homo sapiens
agattatgaactcca

SEQ ID NO: 205864 - DNA, 15 bp, Homo sapiens
tagattatgaactcc

SEQ ID NO: 205865 - DNA, 15 bp, Homo sapiens
ttagattatgaactc

SEQ ID NO: 205866 - DNA, 15 bp, Homo sapiens
cttagattatgaact

SEQ ID NO: 205867 - DNA, 15 bp, Homo sapiens
tcttagattatgaac

SEQ ID NO: 205868 - DNA, 15 bp, Homo sapiens
ttcttagattatgaa

SEQ ID NO: 205869 - DNA, 15 bp, Homo sapiens
attcttagattatga

SEQ ID NO: 205870 - DNA, 15 bp, Homo sapiens
gattcttagattatg

SEQ ID NO: 205871 - DNA, 15 bp, Homo sapiens
agattcttagattat

SEQ ID NO: 205872 - DNA, 15 bp, Homo sapiens
cagattcttagatta

SEQ ID NO: 205873 - DNA, 15 bp, Homo sapiens
tcagattcttagatt

SEQ ID NO: 205874 - DNA, 15 bp, Homo sapiens
ttcagattcttagat

SEQ ID NO: 205875 - DNA, 15 bp, Homo sapiens
cttcagattcttaga

SEQ ID NO: 205876 - DNA, 15 bp, Homo sapiens
ccttcagattcttag

SEQ ID NO: 205877 - DNA, 15 bp, Homo sapiens
accttcagattctta

SEQ ID NO: 205878 - DNA, 15 bp, Homo sapiens
caccttcagattctt

SEQ ID NO: 205879 - DNA, 15 bp, Homo sapiens
gcaccttcagattct

SEQ ID NO: 205880 - DNA, 15 bp, Homo sapiens
tgcaccttcagattc

SEQ ID NO: 205881 - DNA, 15 bp, Homo sapiens
atgcaccttcagatt

SEQ ID NO: 205882 - DNA, 15 bp, Homo sapiens
aatgcaccttcagat

SEQ ID NO: 205883 - DNA, 15 bp, Homo sapiens
aaatgcaccttcaga

SEQ ID NO: 205884 - DNA, 15 bp, Homo sapiens
gaaatgcaccttcag

SEQ ID NO: 205885 - DNA, 15 bp, Homo sapiens
agaaatgcaccttca

SEQ ID NO: 205886 - DNA, 15 bp, Homo sapiens
cagaaatgcaccttc

SEQ ID NO: 205887 - DNA, 15 bp, Homo sapiens
acagaaatgcacctt

SEQ ID NO: 205888 - DNA, 15 bp, Homo sapiens
cacagaaatgcacct

SEQ ID NO: 205889 - DNA, 15 bp, Homo sapiens
acacagaaatgcacc

SEQ ID NO: 205890 - DNA, 15 bp, Homo sapiens
aacacagaaatgcac

SEQ ID NO: 205891 - DNA, 15 bp, Homo sapiens
taacacagaaatgca

SEQ ID NO: 205892 - DNA, 15 bp, Homo sapiens
ttaacacagaaatgc

SEQ ID NO: 205893 - DNA, 15 bp, Homo sapiens
tttaacacagaaatg

SEQ ID NO: 205894 - DNA, 15 bp, Homo sapiens
atttaacacagaaat

SEQ ID NO: 205895 - DNA, 15 bp, Homo sapiens
catttaacacagaaa

SEQ ID NO: 205896 - DNA, 15 bp, Homo sapiens
gcatttaacacagaa

SEQ ID NO: 205897 - DNA, 15 bp, Homo sapiens
tgcatttaacacaga

SEQ ID NO: 205898 - DNA, 15 bp, Homo sapiens
ctgcatttaacacag

SEQ ID NO: 205899 - DNA, 15 bp, Homo sapiens
tctgcatttaacaca

SEQ ID NO: 205900 - DNA, 15 bp, Homo sapiens
ttctgcatttaacac

SEQ ID NO: 205901 - DNA, 15 bp, Homo sapiens
tttctgcatttaaca

SEQ ID NO: 205902 - DNA, 15 bp, Homo sapiens
atttctgcatttaac

SEQ ID NO: 205903 - DNA, 15 bp, Homo sapiens
aatttctgcatttaa

SEQ ID NO: 205904 - DNA, 15 bp, Homo sapiens
taatttctgcattta

SEQ ID NO: 205905 - DNA, 15 bp, Homo sapiens
ataatttctgcattt

SEQ ID NO: 205906 - DNA, 15 bp, Homo sapiens
aataatttctgcatt

SEQ ID NO: 205907 - DNA, 15 bp, Homo sapiens
taataatttctgcat

SEQ ID NO: 205908 - DNA, 15 bp, Homo sapiens
ataataatttctgca

SEQ ID NO: 205909 - DNA, 15 bp, Homo sapiens
aataataatttctgc

SEQ ID NO: 205910 - DNA, 15 bp, Homo sapiens
caataataatttctg

SEQ ID NO: 205911 - DNA, 15 bp, Homo sapiens
tcaataataatttct

SEQ ID NO: 205912 - DNA, 15 bp, Homo sapiens
ttcaataataatttc

SEQ ID NO: 205913 - DNA, 15 bp, Homo sapiens
tttcaataataattt

SEQ ID NO: 205914 - DNA, 15 bp, Homo sapiens
gtttcaataataatt

SEQ ID NO: 205915 - DNA, 15 bp, Homo sapiens
tgtttcaataataat

SEQ ID NO: 205916 - DNA, 15 bp, Homo sapiens
ttgtttcaataataa

SEQ ID NO: 205917 - DNA, 15 bp, Homo sapiens
tttgtttcaataata

SEQ ID NO: 205918 - DNA, 15 bp, Homo sapiens
ctttgtttcaataat

SEQ ID NO: 205919 - DNA, 15 bp, Homo sapiens
tctttgtttcaataa

SEQ ID NO: 205920 - DNA, 15 bp, Homo sapiens
gtctttgtttcaata

SEQ ID NO: 205921 - DNA, 15 bp, Homo sapiens
ggtctttgtttcaat

SEQ ID NO: 205922 - DNA, 15 bp, Homo sapiens
aggtctttgtttcaa

SEQ ID NO: 205923 - DNA, 15 bp, Homo sapiens
gaggtctttgtttca

SEQ ID NO: 205924 - DNA, 15 bp, Homo sapiens
tgaggtctttgtttc

SEQ ID NO: 205925 - DNA, 15 bp, Homo sapiens
gtgaggtctttgttt

SEQ ID NO: 205926 - DNA, 15 bp, Homo sapiens
ggtgaggtctttgtt

SEQ ID NO: 205927 - DNA, 15 bp, Homo sapiens
aggtgaggtctttgt

SEQ ID NO: 205928 - DNA, 15 bp, Homo sapiens
aaggtgaggtctttg

SEQ ID NO: 205929 - DNA, 15 bp, Homo sapiens
aaaggtgaggtcttt

SEQ ID NO: 205930 - DNA, 15 bp, Homo sapiens
taaaggtgaggtctt

SEQ ID NO: 205931 - DNA, 15 bp, Homo sapiens
ttaaaggtgaggtct

SEQ ID NO: 205932 - DNA, 15 bp, Homo sapiens
tttaaaggtgaggtc

SEQ ID NO: 205933 - DNA, 15 bp, Homo sapiens
atttaaaggtgaggt

SEQ ID NO: 205934 - DNA, 15 bp, Homo sapiens
catttaaaggtgagg

SEQ ID NO: 205935 - DNA, 15 bp, Homo sapiens
tcatttaaaggtgag

SEQ ID NO: 205936 - DNA, 15 bp, Homo sapiens
ctcatttaaaggtga

SEQ ID NO: 205937 - DNA, 15 bp, Homo sapiens
tctcatttaaaggtg

SEQ ID NO: 205938 - DNA, 15 bp, Homo sapiens
ctctcatttaaaggt

SEQ ID NO: 205939 - DNA, 15 bp, Homo sapiens
actctcatttaaagg

SEQ ID NO: 205940 - DNA, 15 bp, Homo sapiens
tactctcatttaaag

SEQ ID NO: 205941 - DNA, 15 bp, Homo sapiens
atactctcatttaaa

SEQ ID NO: 205942 - DNA, 15 bp, Homo sapiens
tatactctcatttaa

SEQ ID NO: 205943 - DNA, 15 bp, Homo sapiens
ttatactctcattta

SEQ ID NO: 205944 - DNA, 15 bp, Homo sapiens
tttatactctcattt

SEQ ID NO: 205945 - DNA, 15 bp, Homo sapiens
ctttatactctcatt

SEQ ID NO: 205946 - DNA, 15 bp, Homo sapiens
actttatactctcat

SEQ ID NO: 205947 - DNA, 15 bp, Homo sapiens
tactttatactctca

SEQ ID NO: 205948 - DNA, 15 bp, Homo sapiens
gtactttatactctc

SEQ ID NO: 205949 - DNA, 15 bp, Homo sapiens
agtactttatactct

SEQ ID NO: 205950 - DNA, 15 bp, Homo sapiens
cagtactttatactc

SEQ ID NO: 205951 - DNA, 15 bp, Homo sapiens
gcagtactttatact

SEQ ID NO: 205952 - DNA, 15 bp, Homo sapiens
tgcagtactttatac

SEQ ID NO: 205953 - DNA, 15 bp, Homo sapiens
ctgcagtactttata

SEQ ID NO: 205954 - DNA, 15 bp, Homo sapiens
actgcagtactttat

SEQ ID NO: 205955 - DNA, 15 bp, Homo sapiens
cactgcagtacttta

SEQ ID NO: 205956 - DNA, 15 bp, Homo sapiens
tcactgcagtacttt

SEQ ID NO: 205957 - DNA, 15 bp, Homo sapiens
gtcactgcagtactt

SEQ ID NO: 205958 - DNA, 15 bp, Homo sapiens
agtcactgcagtact

SEQ ID NO: 205959 - DNA, 15 bp, Homo sapiens
aagtcactgcagtac

SEQ ID NO: 205960 - DNA, 15 bp, Homo sapiens
aaagtcactgcagta

SEQ ID NO: 205961 - DNA, 15 bp, Homo sapiens
gaaagtcactgcagt

SEQ ID NO: 205962 - DNA, 15 bp, Homo sapiens
cgaaagtcactgcag

SEQ ID NO: 205963 - DNA, 15 bp, Homo sapiens
gcgaaagtcactgca

SEQ ID NO: 205964 - DNA, 15 bp, Homo sapiens
ggcgaaagtcactgc

SEQ ID NO: 205965 - DNA, 15 bp, Homo sapiens
gggcgaaagtcactg

SEQ ID NO: 205966 - DNA, 15 bp, Homo sapiens
tgggcgaaagtcact

SEQ ID NO: 205967 - DNA, 15 bp, Homo sapiens
ttgggcgaaagtcac

SEQ ID NO: 205968 - DNA, 15 bp, Homo sapiens
gttgggcgaaagtca

SEQ ID NO: 205969 - DNA, 15 bp, Homo sapiens
agttgggcgaaagtc

SEQ ID NO: 205970 - DNA, 15 bp, Homo sapiens
cagttgggcgaaagt

SEQ ID NO: 205971 - DNA, 15 bp, Homo sapiens
acagttgggcgaaag

SEQ ID NO: 205972 - DNA, 15 bp, Homo sapiens
aacagttgggcgaaa

SEQ ID NO: 205973 - DNA, 15 bp, Homo sapiens
gaacagttgggcgaa

SEQ ID NO: 205974 - DNA, 15 bp, Homo sapiens
agaacagttgggcga

SEQ ID NO: 205975 - DNA, 15 bp, Homo sapiens
gagaacagttgggcg

SEQ ID NO: 205976 - DNA, 15 bp, Homo sapiens
agagaacagttgggc

SEQ ID NO: 205977 - DNA, 15 bp, Homo sapiens
tagagaacagttggg

SEQ ID NO: 205978 - DNA, 15 bp, Homo sapiens
atagagaacagttgg

SEQ ID NO: 205979 - DNA, 15 bp, Homo sapiens
aatagagaacagttg

SEQ ID NO: 205980 - DNA, 15 bp, Homo sapiens
gaatagagaacagtt

SEQ ID NO: 205981 - DNA, 15 bp, Homo sapiens
tgaatagagaacagt

SEQ ID NO: 205982 - DNA, 15 bp, Homo sapiens
gtgaatagagaacag

SEQ ID NO: 205983 - DNA, 15 bp, Homo sapiens
tgtgaatagagaaca

SEQ ID NO: 205984 - DNA, 15 bp, Homo sapiens
gtgtgaatagagaac

SEQ ID NO: 205985 - DNA, 15 bp, Homo sapiens
agtgtgaatagagaa

SEQ ID NO: 205986 - DNA, 15 bp, Homo sapiens
cagtgtgaatagaga

SEQ ID NO: 205987 - DNA, 15 bp, Homo sapiens
ccagtgtgaatagag

SEQ ID NO: 205988 - DNA, 15 bp, Homo sapiens
accagtgtgaataga

SEQ ID NO: 205989 - DNA, 15 bp, Homo sapiens
gaccagtgtgaatag

SEQ ID NO: 205990 - DNA, 15 bp, Homo sapiens
tgaccagtgtgaata

SEQ ID NO: 205991 - DNA, 15 bp, Homo sapiens
atgaccagtgtgaat

SEQ ID NO: 205992 - DNA, 15 bp, Homo sapiens
aatgaccagtgtgaa

SEQ ID NO: 205993 - DNA, 15 bp, Homo sapiens
aaatgaccagtgtga

SEQ ID NO: 205994 - DNA, 15 bp, Homo sapiens
caaatgaccagtgtg

SEQ ID NO: 205995 - DNA, 15 bp, Homo sapiens
acaaatgaccagtgt

SEQ ID NO: 205996 - DNA, 15 bp, Homo sapiens
gacaaatgaccagtg

SEQ ID NO: 205997 - DNA, 15 bp, Homo sapiens
tgacaaatgaccagt

SEQ ID NO: 205998 - DNA, 15 bp, Homo sapiens
gtgacaaatgaccag

SEQ ID NO: 205999 - DNA, 15 bp, Homo sapiens
agtgacaaatgacca

SEQ ID NO: 206000 - DNA, 15 bp, Homo sapiens
tagtgacaaatgacc

SEQ ID NO: 206001 - DNA, 15 bp, Homo sapiens
ctagtgacaaatgac

SEQ ID NO: 206002 - DNA, 15 bp, Homo sapiens
tctagtgacaaatga

SEQ ID NO: 206003 - DNA, 15 bp, Homo sapiens
gtctagtgacaaatg

SEQ ID NO: 206004 - DNA, 15 bp, Homo sapiens
tgtctagtgacaaat

SEQ ID NO: 206005 - DNA, 15 bp, Homo sapiens
atgtctagtgacaaa

SEQ ID NO: 206006 - DNA, 15 bp, Homo sapiens
aatgtctagtgacaa

SEQ ID NO: 206007 - DNA, 15 bp, Homo sapiens
caatgtctagtgaca

SEQ ID NO: 206008 - DNA, 15 bp, Homo sapiens
ccaatgtctagtgac

SEQ ID NO: 206009 - DNA, 15 bp, Homo sapiens
accaatgtctagtga

SEQ ID NO: 206010 - DNA, 15 bp, Homo sapiens
gaccaatgtctagtg

SEQ ID NO: 206011 - DNA, 15 bp, Homo sapiens
tgaccaatgtctagt

SEQ ID NO: 206012 - DNA, 15 bp, Homo sapiens
ttgaccaatgtctag

SEQ ID NO: 206013 - DNA, 15 bp, Homo sapiens
gttgaccaatgtcta

SEQ ID NO: 206014 - DNA, 15 bp, Homo sapiens
ggttgaccaatgtct

SEQ ID NO: 206015 - DNA, 15 bp, Homo sapiens
aggttgaccaatgtc

SEQ ID NO: 206016 - DNA, 15 bp, Homo sapiens
aaggttgaccaatgt

SEQ ID NO: 206017 - DNA, 15 bp, Homo sapiens
taaggttgaccaatg

SEQ ID NO: 206018 - DNA, 15 bp, Homo sapiens
ttaaggttgaccaat

SEQ ID NO: 206019 - DNA, 15 bp, Homo sapiens
cttaaggttgaccaa

SEQ ID NO: 206020 - DNA, 15 bp, Homo sapiens
gcttaaggttgacca

SEQ ID NO: 206021 - DNA, 15 bp, Homo sapiens
ggcttaaggttgacc

SEQ ID NO: 206022 - DNA, 15 bp, Homo sapiens
tggcttaaggttgac

SEQ ID NO: 206023 - DNA, 15 bp, Homo sapiens
ttggcttaaggttga

SEQ ID NO: 206024 - DNA, 15 bp, Homo sapiens
tttggcttaaggttg

SEQ ID NO: 206025 - DNA, 15 bp, Homo sapiens
atttggcttaaggtt

SEQ ID NO: 206026 - DNA, 15 bp, Homo sapiens
tatttggcttaaggt

SEQ ID NO: 206027 - DNA, 15 bp, Homo sapiens
ctatttggcttaagg

SEQ ID NO: 206028 - DNA, 15 bp, Homo sapiens
actatttggcttaag

SEQ ID NO: 206029 - DNA, 15 bp, Homo sapiens
tactatttggcttaa

SEQ ID NO: 206030 - DNA, 15 bp, Homo sapiens
atactatttggctta

SEQ ID NO: 206031 - DNA, 15 bp, Homo sapiens
gatactatttggctt

SEQ ID NO: 206032 - DNA, 15 bp, Homo sapiens
ggatactatttggct

SEQ ID NO: 206033 - DNA, 15 bp, Homo sapiens
aggatactatttggc

SEQ ID NO: 206034 - DNA, 15 bp, Homo sapiens
caggatactatttgg

SEQ ID NO: 206035 - DNA, 15 bp, Homo sapiens
acaggatactatttg

SEQ ID NO: 206036 - DNA, 15 bp, Homo sapiens
gacaggatactattt

SEQ ID NO: 206037 - DNA, 15 bp, Homo sapiens
cgacaggatactatt

SEQ ID NO: 206038 - DNA, 15 bp, Homo sapiens
tcgacaggatactat

SEQ ID NO: 206039 - DNA, 15 bp, Homo sapiens
ttcgacaggatacta

SEQ ID NO: 206040 - DNA, 15 bp, Homo sapiens
cttcgacaggatact

SEQ ID NO: 206041 - DNA, 15 bp, Homo sapiens
gcttcgacaggatac

SEQ ID NO: 206042 - DNA, 15 bp, Homo sapiens
tgcttcgacaggata

SEQ ID NO: 206043 - DNA, 15 bp, Homo sapiens
ttgcttcgacaggat

SEQ ID NO: 206044 - DNA, 15 bp, Homo sapiens
attgcttcgacagga

SEQ ID NO: 206045 - DNA, 15 bp, Homo sapiens
cattgcttcgacagg

SEQ ID NO: 206046 - DNA, 15 bp, Homo sapiens
gcattgcttcgacag

SEQ ID NO: 206047 - DNA, 15 bp, Homo sapiens
ggcattgcttcgaca

SEQ ID NO: 206048 - DNA, 15 bp, Homo sapiens
aggcattgcttcgac

SEQ ID NO: 206049 - DNA, 15 bp, Homo sapiens
caggcattgcttcga

SEQ ID NO: 206050 - DNA, 15 bp, Homo sapiens
tcaggcattgcttcg

SEQ ID NO: 206051 - DNA, 15 bp, Homo sapiens
atcaggcattgcttc

SEQ ID NO: 206052 - DNA, 15 bp, Homo sapiens
aatcaggcattgctt

SEQ ID NO: 206053 - DNA, 15 bp, Homo sapiens
taatcaggcattgct

SEQ ID NO: 206054 - DNA, 15 bp, Homo sapiens
ataatcaggcattgc

SEQ ID NO: 206055 - DNA, 15 bp, Homo sapiens
aataatcaggcattg

SEQ ID NO: 206056 - DNA, 15 bp, Homo sapiens
aaataatcaggcatt

SEQ ID NO: 206057 - DNA, 15 bp, Homo sapiens
aaaataatcaggcat

SEQ ID NO: 206058 - DNA, 15 bp, Homo sapiens
gaaaataatcaggca

SEQ ID NO: 206059 - DNA, 15 bp, Homo sapiens
ggaaaataatcaggc

SEQ ID NO: 206060 - DNA, 15 bp, Homo sapiens
tggaaaataatcagg

SEQ ID NO: 206061 - DNA, 15 bp, Homo sapiens
ttggaaaataatcag

SEQ ID NO: 206062 - DNA, 15 bp, Homo sapiens
gttggaaaataatca

SEQ ID NO: 206063 - DNA, 15 bp, Homo sapiens
agttggaaaataatc

SEQ ID NO: 206064 - DNA, 15 bp, Homo sapiens
aagttggaaaataat

SEQ ID NO: 206065 - DNA, 15 bp, Homo sapiens
aaagttggaaaataa

SEQ ID NO: 206066 - DNA, 15 bp, Homo sapiens
aaaagttggaaaata

SEQ ID NO: 206067 - DNA, 15 bp, Homo sapiens
aaaaagttggaaaat

SEQ ID NO: 206068 - DNA, 15 bp, Homo sapiens
caaaaagttggaaaa

SEQ ID NO: 206069 - DNA, 15 bp, Homo sapiens
tcaaaaagttggaaa

SEQ ID NO: 206070 - DNA, 15 bp, Homo sapiens
ttcaaaaagttggaa

SEQ ID NO: 206071 - DNA, 15 bp, Homo sapiens
cttcaaaaagttgga

SEQ ID NO: 206072 - DNA, 15 bp, Homo sapiens
acttcaaaaagttgg

SEQ ID NO: 206073 - DNA, 15 bp, Homo sapiens
tacttcaaaaagttg

SEQ ID NO: 206074 - DNA, 15 bp, Homo sapiens
ttacttcaaaaagtt

SEQ ID NO: 206075 - DNA, 15 bp, Homo sapiens
tttacttcaaaaagt

SEQ ID NO: 206076 - DNA, 15 bp, Homo sapiens
gtttacttcaaaaag

SEQ ID NO: 206077 - DNA, 15 bp, Homo sapiens
tgtttacttcaaaaa

SEQ ID NO: 206078 - DNA, 15 bp, Homo sapiens
atgtttacttcaaaa

SEQ ID NO: 206079 - DNA, 15 bp, Homo sapiens
aatgtttacttcaaa

SEQ ID NO: 206080 - DNA, 15 bp, Homo sapiens
caatgtttacttcaa

SEQ ID NO: 206081 - DNA, 15 bp, Homo sapiens
gcaatgtttacttca

SEQ ID NO: 206082 - DNA, 15 bp, Homo sapiens
agcaatgtttacttc

SEQ ID NO: 206083 - DNA, 15 bp, Homo sapiens
tagcaatgtttactt

SEQ ID NO: 206084 - DNA, 15 bp, Homo sapiens
atagcaatgtttact

SEQ ID NO: 206085 - DNA, 15 bp, Homo sapiens
aatagcaatgtttac

SEQ ID NO: 206086 - DNA, 15 bp, Homo sapiens
caatagcaatgttta

SEQ ID NO: 206087 - DNA, 15 bp, Homo sapiens
acaatagcaatgttt

SEQ ID NO: 206088 - DNA, 15 bp, Homo sapiens
aacaatagcaatgtt

SEQ ID NO: 206089 - DNA, 15 bp, Homo sapiens
gaacaatagcaatgt

SEQ ID NO: 206090 - DNA, 15 bp, Homo sapiens
agaacaatagcaatg

SEQ ID NO: 206091 - DNA, 15 bp, Homo sapiens
cagaacaatagcaat

SEQ ID NO: 206092 - DNA, 15 bp, Homo sapiens
gcagaacaatagcaa

SEQ ID NO: 206093 - DNA, 15 bp, Homo sapiens
agcagaacaatagca

SEQ ID NO: 206094 - DNA, 15 bp, Homo sapiens
aagcagaacaatagc

SEQ ID NO: 206095 - DNA, 15 bp, Homo sapiens
aaagcagaacaatag

SEQ ID NO: 206096 - DNA, 15 bp, Homo sapiens
aaaagcagaacaata

SEQ ID NO: 206097 - DNA, 15 bp, Homo sapiens
aaaaagcagaacaat

SEQ ID NO: 206098 - DNA, 15 bp, Homo sapiens
caaaaagcagaacaa

SEQ ID NO: 206099 - DNA, 15 bp, Homo sapiens
ccaaaaagcagaaca

SEQ ID NO: 206100 - DNA, 15 bp, Homo sapiens
accaaaaagcagaac

SEQ ID NO: 206101 - DNA, 15 bp, Homo sapiens
aaccaaaaagcagaa

SEQ ID NO: 206102 - DNA, 15 bp, Homo sapiens
taaccaaaaagcaga

SEQ ID NO: 206103 - DNA, 15 bp, Homo sapiens
gtaaccaaaaagcag

SEQ ID NO: 206104 - DNA, 15 bp, Homo sapiens
tgtaaccaaaaagca

SEQ ID NO: 206105 - DNA, 15 bp, Homo sapiens
ttgtaaccaaaaagc

SEQ ID NO: 206106 - DNA, 15 bp, Homo sapiens
gttgtaaccaaaaag

SEQ ID NO: 206107 - DNA, 15 bp, Homo sapiens
tgttgtaaccaaaaa

SEQ ID NO: 206108 - DNA, 15 bp, Homo sapiens
ctgttgtaaccaaaa

SEQ ID NO: 206109 - DNA, 15 bp, Homo sapiens
tctgttgtaaccaaa

SEQ ID NO: 206110 - DNA, 15 bp, Homo sapiens
ttctgttgtaaccaa

SEQ ID NO: 206111 - DNA, 15 bp, Homo sapiens
cttctgttgtaacca

SEQ ID NO: 206112 - DNA, 15 bp, Homo sapiens
ccttctgttgtaacc

SEQ ID NO: 206113 - DNA, 15 bp, Homo sapiens
tccttctgttgtaac

SEQ ID NO: 206114 - DNA, 15 bp, Homo sapiens
ctccttctgttgtaa

SEQ ID NO: 206115 - DNA, 15 bp, Homo sapiens
actccttctgttgta

SEQ ID NO: 206116 - DNA, 15 bp, Homo sapiens
aactccttctgttgt

SEQ ID NO: 206117 - DNA, 15 bp, Homo sapiens
aaactccttctgttg

SEQ ID NO: 206118 - DNA, 15 bp, Homo sapiens
aaaactccttctgtt

SEQ ID NO: 206119 - DNA, 15 bp, Homo sapiens
aaaaactccttctgt

SEQ ID NO: 206120 - DNA, 15 bp, Homo sapiens
caaaaactccttctg

SEQ ID NO: 206121 - DNA, 15 bp, Homo sapiens
ccaaaaactccttct

SEQ ID NO: 206122 - DNA, 15 bp, Homo sapiens
accaaaaactccttc

SEQ ID NO: 206123 - DNA, 15 bp, Homo sapiens
aaccaaaaactcctt

SEQ ID NO: 206124 - DNA, 15 bp, Homo sapiens
taaccaaaaactcct

SEQ ID NO: 206125 - DNA, 15 bp, Homo sapiens
gtaaccaaaaactcc

SEQ ID NO: 206126 - DNA, 15 bp, Homo sapiens
tgtaaccaaaaactc

SEQ ID NO: 206127 - DNA, 15 bp, Homo sapiens
ttgtaaccaaaaact

SEQ ID NO: 206128 - DNA, 15 bp, Homo sapiens
cttgtaaccaaaaac

SEQ ID NO: 206129 - DNA, 15 bp, Homo sapiens
tcttgtaaccaaaaa

SEQ ID NO: 206130 - DNA, 15 bp, Homo sapiens
ctcttgtaaccaaaa

SEQ ID NO: 206131 - DNA, 15 bp, Homo sapiens
tctcttgtaaccaaa

SEQ ID NO: 206132 - DNA, 15 bp, Homo sapiens
ttctcttgtaaccaa

SEQ ID NO: 206133 - DNA, 15 bp, Homo sapiens
tttctcttgtaacca

SEQ ID NO: 206134 - DNA, 15 bp, Homo sapiens
ctttctcttgtaacc

SEQ ID NO: 206135 - DNA, 15 bp, Homo sapiens
actttctcttgtaac

SEQ ID NO: 206136 - DNA, 15 bp, Homo sapiens
tactttctcttgtaa

SEQ ID NO: 206137 - DNA, 15 bp, Homo sapiens
ttactttctcttgta

SEQ ID NO: 206138 - DNA, 15 bp, Homo sapiens
gttactttctcttgt

SEQ ID NO: 206139 - DNA, 15 bp, Homo sapiens
tgttactttctcttg

SEQ ID NO: 206140 - DNA, 15 bp, Homo sapiens
gtgttactttctctt

SEQ ID NO: 206141 - DNA, 15 bp, Homo sapiens
tgtgttactttctct

SEQ ID NO: 206142 - DNA, 15 bp, Homo sapiens
atgtgttactttctc

SEQ ID NO: 206143 - DNA, 15 bp, Homo sapiens
gatgtgttactttct

SEQ ID NO: 206144 - DNA, 15 bp, Homo sapiens
tgatgtgttactttc

SEQ ID NO: 206145 - DNA, 15 bp, Homo sapiens
ctgatgtgttacttt

SEQ ID NO: 206146 - DNA, 15 bp, Homo sapiens
actgatgtgttactt

SEQ ID NO: 206147 - DNA, 15 bp, Homo sapiens
tactgatgtgttact

SEQ ID NO: 206148 - DNA, 15 bp, Homo sapiens
ttactgatgtgttac

SEQ ID NO: 206149 - DNA, 15 bp, Homo sapiens
attactgatgtgtta

SEQ ID NO: 206150 - DNA, 15 bp, Homo sapiens
aattactgatgtgtt

SEQ ID NO: 206151 - DNA, 15 bp, Homo sapiens
aaattactgatgtgt

SEQ ID NO: 206152 - DNA, 15 bp, Homo sapiens
gaaattactgatgtg

SEQ ID NO: 206153 - DNA, 15 bp, Homo sapiens
ggaaattactgatgt

SEQ ID NO: 206154 - DNA, 15 bp, Homo sapiens
tggaaattactgatg

SEQ ID NO: 206155 - DNA, 15 bp, Homo sapiens
atggaaattactgat

SEQ ID NO: 206156 - DNA, 15 bp, Homo sapiens
aatggaaattactga

SEQ ID NO: 206157 - DNA, 15 bp, Homo sapiens
gaatggaaattactg

SEQ ID NO: 206158 - DNA, 15 bp, Homo sapiens
ggaatggaaattact

SEQ ID NO: 206159 - DNA, 15 bp, Homo sapiens
aggaatggaaattac

SEQ ID NO: 206160 - DNA, 15 bp, Homo sapiens
taggaatggaaatta

SEQ ID NO: 206161 - DNA, 15 bp, Homo sapiens
ttaggaatggaaatt

SEQ ID NO: 206162 - DNA, 15 bp, Homo sapiens
tttaggaatggaaat

SEQ ID NO: 206163 - DNA, 15 bp, Homo sapiens
ttttaggaatggaaa

SEQ ID NO: 206164 - DNA, 15 bp, Homo sapiens
tttttaggaatggaa

SEQ ID NO: 206165 - DNA, 15 bp, Homo sapiens
ttttttaggaatgga

SEQ ID NO: 206166 - DNA, 15 bp, Homo sapiens
cttttttaggaatgg

SEQ ID NO: 206167 - DNA, 15 bp, Homo sapiens
acttttttaggaatg

SEQ ID NO: 206168 - DNA, 15 bp, Homo sapiens
aacttttttaggaat

SEQ ID NO: 206169 - DNA, 15 bp, Homo sapiens
taacttttttaggaa

SEQ ID NO: 206170 - DNA, 15 bp, Homo sapiens
ttaacttttttagga

SEQ ID NO: 206171 - DNA, 15 bp, Homo sapiens
attaacttttttagg

SEQ ID NO: 206172 - DNA, 15 bp, Homo sapiens
gattaacttttttag

SEQ ID NO: 206173 - DNA, 15 bp, Homo sapiens
tgattaactttttta

SEQ ID NO: 206174 - DNA, 15 bp, Homo sapiens
ttgattaactttttt

SEQ ID NO: 206175 - DNA, 15 bp, Homo sapiens
cttgattaacttttt

SEQ ID NO: 206176 - DNA, 15 bp, Homo sapiens
tcttgattaactttt

SEQ ID NO: 206177 - DNA, 15 bp, Homo sapiens
gtcttgattaacttt

SEQ ID NO: 206178 - DNA, 15 bp, Homo sapiens
ggtcttgattaactt

SEQ ID NO: 206179 - DNA, 15 bp, Homo sapiens
tggtcttgattaact

SEQ ID NO: 206180 - DNA, 15 bp, Homo sapiens
ctggtcttgattaac

SEQ ID NO: 206181 - DNA, 15 bp, Homo sapiens
cctggtcttgattaa

SEQ ID NO: 206182 - DNA, 15 bp, Homo sapiens
gcctggtcttgatta

SEQ ID NO: 206183 - DNA, 15 bp, Homo sapiens
cgcctggtcttgatt

SEQ ID NO: 206184 - DNA, 15 bp, Homo sapiens
gcgcctggtcttgat

SEQ ID NO: 206185 - DNA, 15 bp, Homo sapiens
cgcgcctggtcttga

SEQ ID NO: 206186 - DNA, 15 bp, Homo sapiens
ccgcgcctggtcttg

SEQ ID NO: 206187 - DNA, 15 bp, Homo sapiens
accgcgcctggtctt

SEQ ID NO: 206188 - DNA, 15 bp, Homo sapiens
caccgcgcctggtct

SEQ ID NO: 206189 - DNA, 15 bp, Homo sapiens
ccaccgcgcctggtc

SEQ ID NO: 206190 - DNA, 15 bp, Homo sapiens
gccaccgcgcctggt

SEQ ID NO: 206191 - DNA, 15 bp, Homo sapiens
tgtgagccaccgcgc

SEQ ID NO: 206192 - DNA, 15 bp, Homo sapiens
gtgtgagccaccgcg

SEQ ID NO: 206193 - DNA, 15 bp, Homo sapiens
caggtgtgagccacc

SEQ ID NO: 206194 - DNA, 15 bp, Homo sapiens
actcccaaagtgctg

SEQ ID NO: 206195 - DNA, 15 bp, Homo sapiens
gactcccaaagtgct

SEQ ID NO: 206196 - DNA, 15 bp, Homo sapiens
ggactcccaaagtgc

SEQ ID NO: 206197 - DNA, 15 bp, Homo sapiens
gggactcccaaagtg

SEQ ID NO: 206198 - DNA, 15 bp, Homo sapiens
agggactcccaaagt

SEQ ID NO: 206199 - DNA, 15 bp, Homo sapiens
cagggactcccaaag

SEQ ID NO: 206200 - DNA, 15 bp, Homo sapiens
ccagggactcccaaa

SEQ ID NO: 206201 - DNA, 15 bp, Homo sapiens
gccagggactcccaa

SEQ ID NO: 206202 - DNA, 15 bp, Homo sapiens
ggccagggactccca

SEQ ID NO: 206203 - DNA, 15 bp, Homo sapiens
cggccagggactccc

SEQ ID NO: 206204 - DNA, 15 bp, Homo sapiens
ccggccagggactcc

SEQ ID NO: 206205 - DNA, 15 bp, Homo sapiens
accggccagggactc

SEQ ID NO: 206206 - DNA, 15 bp, Homo sapiens
caccggccagggact

SEQ ID NO: 206207 - DNA, 15 bp, Homo sapiens
ccaccggccagggac

SEQ ID NO: 206208 - DNA, 15 bp, Homo sapiens
tccaccggccaggga

SEQ ID NO: 206209 - DNA, 15 bp, Homo sapiens
atccaccggccaggg

SEQ ID NO: 206210 - DNA, 15 bp, Homo sapiens
gatccaccggccagg

SEQ ID NO: 206211 - DNA, 15 bp, Homo sapiens
tgatccaccggccag

SEQ ID NO: 206212 - DNA, 15 bp, Homo sapiens
atgatccaccggcca

SEQ ID NO: 206213 - DNA, 15 bp, Homo sapiens
catgatccaccggcc

SEQ ID NO: 206214 - DNA, 15 bp, Homo sapiens
tcatgatccaccggc

SEQ ID NO: 206215 - DNA, 15 bp, Homo sapiens
ctcatgatccaccgg

SEQ ID NO: 206216 - DNA, 15 bp, Homo sapiens
cctcatgatccaccg

SEQ ID NO: 206217 - DNA, 15 bp, Homo sapiens
actcctgacctcatg

SEQ ID NO: 206218 - DNA, 15 bp, Homo sapiens
aactcctgacctcat

SEQ ID NO: 206219 - DNA, 15 bp, Homo sapiens
gaaactcctgacctc

SEQ ID NO: 206220 - DNA, 15 bp, Homo sapiens
tgaaactcctgacct

SEQ ID NO: 206221 - DNA, 15 bp, Homo sapiens
ctgaaactcctgacc

SEQ ID NO: 206222 - DNA, 15 bp, Homo sapiens
tctgaaactcctgac

SEQ ID NO: 206223 - DNA, 15 bp, Homo sapiens
gtctgaaactcctga

SEQ ID NO: 206224 - DNA, 15 bp, Homo sapiens
ggtctgaaactcctg

SEQ ID NO: 206225 - DNA, 15 bp, Homo sapiens
tggtctgaaactcct

SEQ ID NO: 206226 - DNA, 15 bp, Homo sapiens
ctggtctgaaactcc

SEQ ID NO: 206227 - DNA, 15 bp, Homo sapiens
cctggtctgaaactc

SEQ ID NO: 206228 - DNA, 15 bp, Homo sapiens
gcctggtctgaaact

SEQ ID NO: 206229 - DNA, 15 bp, Homo sapiens
agcctggtctgaaac

SEQ ID NO: 206230 - DNA, 15 bp, Homo sapiens
cagcctggtctgaaa

SEQ ID NO: 206231 - DNA, 15 bp, Homo sapiens
tcagcctggtctgaa

SEQ ID NO: 206232 - DNA, 15 bp, Homo sapiens
ttcagcctggtctga

SEQ ID NO: 206233 - DNA, 15 bp, Homo sapiens
gttcagcctggtctg

SEQ ID NO: 206234 - DNA, 15 bp, Homo sapiens
tgttcagcctggtct

SEQ ID NO: 206235 - DNA, 15 bp, Homo sapiens
ttgttcagcctggtc

SEQ ID NO: 206236 - DNA, 15 bp, Homo sapiens
gttgttcagcctggt

SEQ ID NO: 206237 - DNA, 15 bp, Homo sapiens
tgttgttcagcctgg

SEQ ID NO: 206238 - DNA, 15 bp, Homo sapiens
atgttgttcagcctg

SEQ ID NO: 206239 - DNA, 15 bp, Homo sapiens
catgttgttcagcct

SEQ ID NO: 206240 - DNA, 15 bp, Homo sapiens
ccatgttgttcagcc

SEQ ID NO: 206241 - DNA, 15 bp, Homo sapiens
accatgttgttcagc

SEQ ID NO: 206242 - DNA, 15 bp, Homo sapiens
caccatgttgttcag

SEQ ID NO: 206243 - DNA, 15 bp, Homo sapiens
tcaccatgttgttca

SEQ ID NO: 206244 - DNA, 15 bp, Homo sapiens
ttcaccatgttgttc

SEQ ID NO: 206245 - DNA, 15 bp, Homo sapiens
tttcaccatgttgtt

SEQ ID NO: 206246 - DNA, 15 bp, Homo sapiens
atttcaccatgttgt

SEQ ID NO: 206247 - DNA, 15 bp, Homo sapiens
ttaattttcgtattt

SEQ ID NO: 206248 - DNA, 15 bp, Homo sapiens
gttaattttcgtatt

SEQ ID NO: 206249 - DNA, 15 bp, Homo sapiens
ggttaattttcgtat

SEQ ID NO: 206250 - DNA, 15 bp, Homo sapiens
cggttaattttcgta

SEQ ID NO: 206251 - DNA, 15 bp, Homo sapiens
ccggttaattttcgt

SEQ ID NO: 206252 - DNA, 15 bp, Homo sapiens
cccggttaattttcg

SEQ ID NO: 206253 - DNA, 15 bp, Homo sapiens
gcccggttaattttc

SEQ ID NO: 206254 - DNA, 15 bp, Homo sapiens
tgcccggttaatttt

SEQ ID NO: 206255 - DNA, 15 bp, Homo sapiens
atgcccggttaattt

SEQ ID NO: 206256 - DNA, 15 bp, Homo sapiens
catgcccggttaatt

SEQ ID NO: 206257 - DNA, 15 bp, Homo sapiens
ccatgcccggttaat

SEQ ID NO: 206258 - DNA, 15 bp, Homo sapiens
accatgcccggttaa

SEQ ID NO: 206259 - DNA, 15 bp, Homo sapiens
caccatgcccggtta

SEQ ID NO: 206260 - DNA, 15 bp, Homo sapiens
ccaccatgcccggtt

SEQ ID NO: 206261 - DNA, 15 bp, Homo sapiens
gccaccatgcccggt

SEQ ID NO: 206262 - DNA, 15 bp, Homo sapiens
gtgccaccatgcccg

SEQ ID NO: 206263 - DNA, 15 bp, Homo sapiens
aattacaggcatgtg

SEQ ID NO: 206264 - DNA, 15 bp, Homo sapiens
gaattacaggcatgt

SEQ ID NO: 206265 - DNA, 15 bp, Homo sapiens
ggaattacaggcatg

SEQ ID NO: 206266 - DNA, 15 bp, Homo sapiens
tggaattacaggcat

SEQ ID NO: 206267 - DNA, 15 bp, Homo sapiens
ctggaattacaggca

SEQ ID NO: 206268 - DNA, 15 bp, Homo sapiens
gctggaattacaggc

SEQ ID NO: 206269 - DNA, 15 bp, Homo sapiens
agctggaattacagg

SEQ ID NO: 206270 - DNA, 15 bp, Homo sapiens
cagctggaattacag

SEQ ID NO: 206271 - DNA, 15 bp, Homo sapiens
acagctggaattaca

SEQ ID NO: 206272 - DNA, 15 bp, Homo sapiens
tacagctggaattac

SEQ ID NO: 206273 - DNA, 15 bp, Homo sapiens
atacagctggaatta

SEQ ID NO: 206274 - DNA, 15 bp, Homo sapiens
aatacagctggaatt

SEQ ID NO: 206275 - DNA, 15 bp, Homo sapiens
gaatacagctggaat

SEQ ID NO: 206276 - DNA, 15 bp, Homo sapiens
tgaatacagctggaa

SEQ ID NO: 206277 - DNA, 15 bp, Homo sapiens
ctgaatacagctgga

SEQ ID NO: 206278 - DNA, 15 bp, Homo sapiens
cctgaatacagctgg

SEQ ID NO: 206279 - DNA, 15 bp, Homo sapiens
tcctgaatacagctg

SEQ ID NO: 206280 - DNA, 15 bp, Homo sapiens
ctcctgaatacagct

SEQ ID NO: 206281 - DNA, 15 bp, Homo sapiens
cctcctgaatacagc

SEQ ID NO: 206282 - DNA, 15 bp, Homo sapiens
gcctcctgaatacag

SEQ ID NO: 206283 - DNA, 15 bp, Homo sapiens
agcctcctgaataca

SEQ ID NO: 206284 - DNA, 15 bp, Homo sapiens
cagcctcctgaatac

SEQ ID NO: 206285 - DNA, 15 bp, Homo sapiens
tcagcctcctgaata

SEQ ID NO: 206286 - DNA, 15 bp, Homo sapiens
ctcagcctcctgaat

SEQ ID NO: 206287 - DNA, 15 bp, Homo sapiens
cctcagcctcctgaa

SEQ ID NO: 206288 - DNA, 15 bp, Homo sapiens
gctgcctcagcctcc

SEQ ID NO: 206289 - DNA, 15 bp, Homo sapiens
tgctgcctcagcctc

SEQ ID NO: 206290 - DNA, 15 bp, Homo sapiens
ctgctgcctcagcct

SEQ ID NO: 206291 - DNA, 15 bp, Homo sapiens
tctgctgcctcagcc

SEQ ID NO: 206292 - DNA, 15 bp, Homo sapiens
ttctgctgcctcagc

SEQ ID NO: 206293 - DNA, 15 bp, Homo sapiens
attctgctgcctcag

SEQ ID NO: 206294 - DNA, 15 bp, Homo sapiens
tattctgctgcctca

SEQ ID NO: 206295 - DNA, 15 bp, Homo sapiens
ctattctgctgcctc

SEQ ID NO: 206296 - DNA, 15 bp, Homo sapiens
actattctgctgcct

SEQ ID NO: 206297 - DNA, 15 bp, Homo sapiens
aactattctgctgcc

SEQ ID NO: 206298 - DNA, 15 bp, Homo sapiens
aaactattctgctgc

SEQ ID NO: 206299 - DNA, 15 bp, Homo sapiens
caaactattctgctg

SEQ ID NO: 206300 - DNA, 15 bp, Homo sapiens
tcaaactattctgct

SEQ ID NO: 206301 - DNA, 15 bp, Homo sapiens
ttcaaactattctgc

SEQ ID NO: 206302 - DNA, 15 bp, Homo sapiens
gttcaaactattctg

SEQ ID NO: 206303 - DNA, 15 bp, Homo sapiens
ggttcaaactattct

SEQ ID NO: 206304 - DNA, 15 bp, Homo sapiens
gggttcaaactattc

SEQ ID NO: 206305 - DNA, 15 bp, Homo sapiens
tgggttcaaactatt

SEQ ID NO: 206306 - DNA, 15 bp, Homo sapiens
ctgggttcaaactat

SEQ ID NO: 206307 - DNA, 15 bp, Homo sapiens
cctgggttcaaacta

SEQ ID NO: 206308 - DNA, 15 bp, Homo sapiens
tcctgggttcaaact

SEQ ID NO: 206309 - DNA, 15 bp, Homo sapiens
ctcctgggttcaaac

SEQ ID NO: 206310 - DNA, 15 bp, Homo sapiens
cctcctgggttcaaa

SEQ ID NO: 206311 - DNA, 15 bp, Homo sapiens
gacctctgcctcctg

SEQ ID NO: 206312 - DNA, 15 bp, Homo sapiens
cgacctctgcctcct

SEQ ID NO: 206313 - DNA, 15 bp, Homo sapiens
gcgacctctgcctcc

SEQ ID NO: 206314 - DNA, 15 bp, Homo sapiens
tgcgacctctgcctc

SEQ ID NO: 206315 - DNA, 15 bp, Homo sapiens
ctgcgacctctgcct

SEQ ID NO: 206316 - DNA, 15 bp, Homo sapiens
actgcgacctctgcc

SEQ ID NO: 206317 - DNA, 15 bp, Homo sapiens
cactgcgacctctgc

SEQ ID NO: 206318 - DNA, 15 bp, Homo sapiens
tcactgcgacctctg

SEQ ID NO: 206319 - DNA, 15 bp, Homo sapiens
ctcactgcgacctct

SEQ ID NO: 206320 - DNA, 15 bp, Homo sapiens
gctcactgcgacctc

SEQ ID NO: 206321 - DNA, 15 bp, Homo sapiens
ggctcactgcgacct

SEQ ID NO: 206322 - DNA, 15 bp, Homo sapiens
cggctcactgcgacc

SEQ ID NO: 206323 - DNA, 15 bp, Homo sapiens
tcggctcactgcgac

SEQ ID NO: 206324 - DNA, 15 bp, Homo sapiens
ctcggctcactgcga

SEQ ID NO: 206325 - DNA, 15 bp, Homo sapiens
tctcggctcactgcg

SEQ ID NO: 206326 - DNA, 15 bp, Homo sapiens
gagtattgctctgtc

SEQ ID NO: 206327 - DNA, 15 bp, Homo sapiens
agagtattgctctgt

SEQ ID NO: 206328 - DNA, 15 bp, Homo sapiens
cagagtattgctctg

SEQ ID NO: 206329 - DNA, 15 bp, Homo sapiens
acagagtattgctct

SEQ ID NO: 206330 - DNA, 15 bp, Homo sapiens
gacagagtattgctc

SEQ ID NO: 206331 - DNA, 15 bp, Homo sapiens
agacagagtattgct

SEQ ID NO: 206332 - DNA, 15 bp, Homo sapiens
gagacagagtattgc

SEQ ID NO: 206333 - DNA, 15 bp, Homo sapiens
tgagacagagtattg

SEQ ID NO: 206334 - DNA, 15 bp, Homo sapiens
ttgagacagagtatt

SEQ ID NO: 206335 - DNA, 15 bp, Homo sapiens
tttgagacagagtat

SEQ ID NO: 206336 - DNA, 15 bp, Homo sapiens
ttttgagacagagta

SEQ ID NO: 206337 - DNA, 15 bp, Homo sapiens
atttttttttttgag

SEQ ID NO: 206338 - DNA, 15 bp, Homo sapiens
tatttttttttttga

SEQ ID NO: 206339 - DNA, 15 bp, Homo sapiens
ttatttttttttttg

SEQ ID NO: 206340 - DNA, 15 bp, Homo sapiens
attattttttttttt

SEQ ID NO: 206341 - DNA, 15 bp, Homo sapiens
tattattattttttt

SEQ ID NO: 206342 - DNA, 15 bp, Homo sapiens
ttattattatttttt

SEQ ID NO: 206343 - DNA, 15 bp, Homo sapiens
attattattattttt

SEQ ID NO: 206344 - DNA, 15 bp, Homo sapiens
ctaattattattatt

SEQ ID NO: 206345 - DNA, 15 bp, Homo sapiens
actaattattattat

SEQ ID NO: 206346 - DNA, 15 bp, Homo sapiens
gactaattattatta

SEQ ID NO: 206347 - DNA, 15 bp, Homo sapiens
tgactaattattatt

SEQ ID NO: 206348 - DNA, 15 bp, Homo sapiens
ctgactaattattat

SEQ ID NO: 206349 - DNA, 15 bp, Homo sapiens
actgactaattatta

SEQ ID NO: 206350 - DNA, 15 bp, Homo sapiens
cactgactaattatt

SEQ ID NO: 206351 - DNA, 15 bp, Homo sapiens
ccactgactaattat

SEQ ID NO: 206352 - DNA, 15 bp, Homo sapiens
accactgactaatta

SEQ ID NO: 206353 - DNA, 15 bp, Homo sapiens
aaccactgactaatt

SEQ ID NO: 206354 - DNA, 15 bp, Homo sapiens
aaaccactgactaat

SEQ ID NO: 206355 - DNA, 15 bp, Homo sapiens
aaaaccactgactaa

SEQ ID NO: 206356 - DNA, 15 bp, Homo sapiens
aaaaaccactgacta

SEQ ID NO: 206357 - DNA, 15 bp, Homo sapiens
aaaaaaccactgact

SEQ ID NO: 206358 - DNA, 15 bp, Homo sapiens
aaaaaaaccactgac

SEQ ID NO: 206359 - DNA, 15 bp, Homo sapiens
aaaaaaaaccactga

SEQ ID NO: 206360 - DNA, 15 bp, Homo sapiens
aaaaaaaaaccactg

SEQ ID NO: 206361 - DNA, 15 bp, Homo sapiens
aaaaaaaaaaccact

SEQ ID NO: 206362 - DNA, 15 bp, Homo sapiens
ttccaaaaaaaaaaa

SEQ ID NO: 206363 - DNA, 15 bp, Homo sapiens
tttccaaaaaaaaaa

SEQ ID NO: 206364 - DNA, 15 bp, Homo sapiens
ctttccaaaaaaaaa

SEQ ID NO: 206365 - DNA, 15 bp, Homo sapiens
tctttccaaaaaaaa

SEQ ID NO: 206366 - DNA, 15 bp, Homo sapiens
ttctttccaaaaaaa

SEQ ID NO: 206367 - DNA, 15 bp, Homo sapiens
tttctttccaaaaaa

SEQ ID NO: 206368 - DNA, 15 bp, Homo sapiens
ttttctttccaaaaa

SEQ ID NO: 206369 - DNA, 15 bp, Homo sapiens
tttttctttccaaaa

SEQ ID NO: 206370 - DNA, 15 bp, Homo sapiens
atttttctttccaaa

SEQ ID NO: 206371 - DNA, 15 bp, Homo sapiens
tatttttctttccaa

SEQ ID NO: 206372 - DNA, 15 bp, Homo sapiens
gtatttttctttcca

SEQ ID NO: 206373 - DNA, 15 bp, Homo sapiens
agtatttttctttcc

SEQ ID NO: 206374 - DNA, 15 bp, Homo sapiens
tagtatttttctttc

SEQ ID NO: 206375 - DNA, 15 bp, Homo sapiens
atagtatttttcttt

SEQ ID NO: 206376 - DNA, 15 bp, Homo sapiens
catagtatttttctt

SEQ ID NO: 206377 - DNA, 15 bp, Homo sapiens
tcatagtatttttct

SEQ ID NO: 206378 - DNA, 15 bp, Homo sapiens
ctcatagtatttttc

SEQ ID NO: 206379 - DNA, 15 bp, Homo sapiens
actcatagtattttt

SEQ ID NO: 206380 - DNA, 15 bp, Homo sapiens
gactcatagtatttt

SEQ ID NO: 206381 - DNA, 15 bp, Homo sapiens
agactcatagtattt

SEQ ID NO: 206382 - DNA, 15 bp, Homo sapiens
cagactcatagtatt

SEQ ID NO: 206383 - DNA, 15 bp, Homo sapiens
acagactcatagtat

SEQ ID NO: 206384 - DNA, 15 bp, Homo sapiens
aacagactcatagta

SEQ ID NO: 206385 - DNA, 15 bp, Homo sapiens
caacagactcatagt

SEQ ID NO: 206386 - DNA, 15 bp, Homo sapiens
acaacagactcatag

SEQ ID NO: 206387 - DNA, 15 bp, Homo sapiens
tacaacagactcata

SEQ ID NO: 206388 - DNA, 15 bp, Homo sapiens
ttacaacagactcat

SEQ ID NO: 206389 - DNA, 15 bp, Homo sapiens
tttacaacagactca

SEQ ID NO: 206390 - DNA, 15 bp, Homo sapiens
atttacaacagactc

SEQ ID NO: 206391 - DNA, 15 bp, Homo sapiens
gatttacaacagact

SEQ ID NO: 206392 - DNA, 15 bp, Homo sapiens
ggatttacaacagac

SEQ ID NO: 206393 - DNA, 15 bp, Homo sapiens
aggatttacaacaga

SEQ ID NO: 206394 - DNA, 15 bp, Homo sapiens
aaggatttacaacag

SEQ ID NO: 206395 - DNA, 15 bp, Homo sapiens
taaggatttacaaca

SEQ ID NO: 206396 - DNA, 15 bp, Homo sapiens
ttaaggatttacaac

SEQ ID NO: 206397 - DNA, 15 bp, Homo sapiens
tttaaggatttacaa

SEQ ID NO: 206398 - DNA, 15 bp, Homo sapiens
atttaaggatttaca

SEQ ID NO: 206399 - DNA, 15 bp, Homo sapiens
catttaaggatttac

SEQ ID NO: 206400 - DNA, 15 bp, Homo sapiens
ccatttaaggattta

SEQ ID NO: 206401 - DNA, 15 bp, Homo sapiens
gccatttaaggattt

SEQ ID NO: 206402 - DNA, 15 bp, Homo sapiens
cgccatttaaggatt

SEQ ID NO: 206403 - DNA, 15 bp, Homo sapiens
acgccatttaaggat

SEQ ID NO: 206404 - DNA, 15 bp, Homo sapiens
tacgccatttaagga

SEQ ID NO: 206405 - DNA, 15 bp, Homo sapiens
ttacgccatttaagg

SEQ ID NO: 206406 - DNA, 15 bp, Homo sapiens
tttacgccatttaag

SEQ ID NO: 206407 - DNA, 15 bp, Homo sapiens
ttttacgccatttaa

SEQ ID NO: 206408 - DNA, 15 bp, Homo sapiens
tttttacgccattta

SEQ ID NO: 206409 - DNA, 15 bp, Homo sapiens
atttttacgccattt

SEQ ID NO: 206410 - DNA, 15 bp, Homo sapiens
tatttttacgccatt

SEQ ID NO: 206411 - DNA, 15 bp, Homo sapiens
ctatttttacgccat

SEQ ID NO: 206412 - DNA, 15 bp, Homo sapiens
gctatttttacgcca

SEQ ID NO: 206413 - DNA, 15 bp, Homo sapiens
agctatttttacgcc

SEQ ID NO: 206414 - DNA, 15 bp, Homo sapiens
tagctatttttacgc

SEQ ID NO: 206415 - DNA, 15 bp, Homo sapiens
ttagctatttttacg

SEQ ID NO: 206416 - DNA, 15 bp, Homo sapiens
tttagctatttttac

SEQ ID NO: 206417 - DNA, 15 bp, Homo sapiens
ttttagctattttta

SEQ ID NO: 206418 - DNA, 15 bp, Homo sapiens
attttagctattttt

SEQ ID NO: 206419 - DNA, 15 bp, Homo sapiens
aattttagctatttt

SEQ ID NO: 206420 - DNA, 15 bp, Homo sapiens
taattttagctattt

SEQ ID NO: 206421 - DNA, 15 bp, Homo sapiens
ctaattttagctatt

SEQ ID NO: 206422 - DNA, 15 bp, Homo sapiens
cctaattttagctat

SEQ ID NO: 206423 - DNA, 15 bp, Homo sapiens
acctaattttagcta

SEQ ID NO: 206424 - DNA, 15 bp, Homo sapiens
tacctaattttagct

SEQ ID NO: 206425 - DNA, 15 bp, Homo sapiens
atacctaattttagc

SEQ ID NO: 206426 - DNA, 15 bp, Homo sapiens
aatacctaattttag

SEQ ID NO: 206427 - DNA, 15 bp, Homo sapiens
aaatacctaatttta

SEQ ID NO: 206428 - DNA, 15 bp, Homo sapiens
taaatacctaatttt

SEQ ID NO: 206429 - DNA, 15 bp, Homo sapiens
gtaaatacctaattt

SEQ ID NO: 206430 - DNA, 15 bp, Homo sapiens
agtaaatacctaatt

SEQ ID NO: 206431 - DNA, 15 bp, Homo sapiens
cagtaaatacctaat

SEQ ID NO: 206432 - DNA, 15 bp, Homo sapiens
acagtaaatacctaa

SEQ ID NO: 206433 - DNA, 15 bp, Homo sapiens
cacagtaaataccta

SEQ ID NO: 206434 - DNA, 15 bp, Homo sapiens
gcacagtaaatacct

SEQ ID NO: 206435 - DNA, 15 bp, Homo sapiens
agcacagtaaatacc

SEQ ID NO: 206436 - DNA, 15 bp, Homo sapiens
gagcacagtaaatac

SEQ ID NO: 206437 - DNA, 15 bp, Homo sapiens
agagcacagtaaata

SEQ ID NO: 206438 - DNA, 15 bp, Homo sapiens
aagagcacagtaaat

SEQ ID NO: 206439 - DNA, 15 bp, Homo sapiens
taagagcacagtaaa

SEQ ID NO: 206440 - DNA, 15 bp, Homo sapiens
ctaagagcacagtaa

SEQ ID NO: 206441 - DNA, 15 bp, Homo sapiens
actaagagcacagta

SEQ ID NO: 206442 - DNA, 15 bp, Homo sapiens
cactaagagcacagt

SEQ ID NO: 206443 - DNA, 15 bp, Homo sapiens
ccactaagagcacag

SEQ ID NO: 206444 - DNA, 15 bp, Homo sapiens
accactaagagcaca

SEQ ID NO: 206445 - DNA, 15 bp, Homo sapiens
aaccactaagagcac

SEQ ID NO: 206446 - DNA, 15 bp, Homo sapiens
taaccactaagagca

SEQ ID NO: 206447 - DNA, 15 bp, Homo sapiens
ataaccactaagagc

SEQ ID NO: 206448 - DNA, 15 bp, Homo sapiens
aataaccactaagag

SEQ ID NO: 206449 - DNA, 15 bp, Homo sapiens
aaataaccactaaga

SEQ ID NO: 206450 - DNA, 15 bp, Homo sapiens
aaaataaccactaag

SEQ ID NO: 206451 - DNA, 15 bp, Homo sapiens
gaaaataaccactaa

SEQ ID NO: 206452 - DNA, 15 bp, Homo sapiens
ggaaaataaccacta

SEQ ID NO: 206453 - DNA, 15 bp, Homo sapiens
aggaaaataaccact

SEQ ID NO: 206454 - DNA, 15 bp, Homo sapiens
gaggaaaataaccac

SEQ ID NO: 206455 - DNA, 15 bp, Homo sapiens
agaggaaaataacca

SEQ ID NO: 206456 - DNA, 15 bp, Homo sapiens
gagaggaaaataacc

SEQ ID NO: 206457 - DNA, 15 bp, Homo sapiens
agagaggaaaataac

SEQ ID NO: 206458 - DNA, 15 bp, Homo sapiens
gagagaggaaaataa

SEQ ID NO: 206459 - DNA, 15 bp, Homo sapiens
agagagaggaaaata

SEQ ID NO: 206460 - DNA, 15 bp, Homo sapiens
gagagagaggaaaat

SEQ ID NO: 206461 - DNA, 15 bp, Homo sapiens
agagagagaggaaaa

SEQ ID NO: 206462 - DNA, 15 bp, Homo sapiens
gagagagagaggaaa

SEQ ID NO: 206463 - DNA, 15 bp, Homo sapiens
agagagagagaggaa

SEQ ID NO: 206464 - DNA, 15 bp, Homo sapiens
gagagagagagagga

SEQ ID NO: 206465 - DNA, 15 bp, Homo sapiens
ggagagagagagagg

SEQ ID NO: 206466 - DNA, 15 bp, Homo sapiens
tggagagagagagag

SEQ ID NO: 206467 - DNA, 15 bp, Homo sapiens
atggagagagagaga

SEQ ID NO: 206468 - DNA, 15 bp, Homo sapiens
catggagagagagag

SEQ ID NO: 206469 - DNA, 15 bp, Homo sapiens
acatggagagagaga

SEQ ID NO: 206470 - DNA, 15 bp, Homo sapiens
tacatggagagagag

SEQ ID NO: 206471 - DNA, 15 bp, Homo sapiens
atacatggagagaga

SEQ ID NO: 206472 - DNA, 15 bp, Homo sapiens
tatacatggagagag

SEQ ID NO: 206473 - DNA, 15 bp, Homo sapiens
ctatacatggagaga

SEQ ID NO: 206474 - DNA, 15 bp, Homo sapiens
tctatacatggagag

SEQ ID NO: 206475 - DNA, 15 bp, Homo sapiens
ctctatacatggaga

SEQ ID NO: 206476 - DNA, 15 bp, Homo sapiens
tctctatacatggag

SEQ ID NO: 206477 - DNA, 15 bp, Homo sapiens
atctctatacatgga

SEQ ID NO: 206478 - DNA, 15 bp, Homo sapiens
tatctctatacatgg

SEQ ID NO: 206479 - DNA, 15 bp, Homo sapiens
ttatctctatacatg

SEQ ID NO: 206480 - DNA, 15 bp, Homo sapiens
tttatctctatacat

SEQ ID NO: 206481 - DNA, 15 bp, Homo sapiens
ttttatctctataca

SEQ ID NO: 206482 - DNA, 15 bp, Homo sapiens
attttatctctatac

SEQ ID NO: 206483 - DNA, 15 bp, Homo sapiens
cattttatctctata

SEQ ID NO: 206484 - DNA, 15 bp, Homo sapiens
tcattttatctctat

SEQ ID NO: 206485 - DNA, 15 bp, Homo sapiens
ctcattttatctcta

SEQ ID NO: 206486 - DNA, 15 bp, Homo sapiens
tctcattttatctct

SEQ ID NO: 206487 - DNA, 15 bp, Homo sapiens
ttctcattttatctc

SEQ ID NO: 206488 - DNA, 15 bp, Homo sapiens
tttctcattttatct

SEQ ID NO: 206489 - DNA, 15 bp, Homo sapiens
ttttctcattttatc

SEQ ID NO: 206490 - DNA, 15 bp, Homo sapiens
tttttctcattttat

SEQ ID NO: 206491 - DNA, 15 bp, Homo sapiens
ttttttctcatttta

SEQ ID NO: 206492 - DNA, 15 bp, Homo sapiens
tttttttctcatttt

SEQ ID NO: 206493 - DNA, 15 bp, Homo sapiens
atttttttctcattt

SEQ ID NO: 206494 - DNA, 15 bp, Homo sapiens
tatttttttctcatt

SEQ ID NO: 206495 - DNA, 15 bp, Homo sapiens
atatttttttctcat

SEQ ID NO: 206496 - DNA, 15 bp, Homo sapiens
tatatttttttctca

SEQ ID NO: 206497 - DNA, 15 bp, Homo sapiens
atatatttttttctc

SEQ ID NO: 206498 - DNA, 15 bp, Homo sapiens
aatatatttttttct

SEQ ID NO: 206499 - DNA, 15 bp, Homo sapiens
aaatatatttttttc

SEQ ID NO: 206500 - DNA, 15 bp, Homo sapiens
caaatatattttttt

SEQ ID NO: 206501 - DNA, 15 bp, Homo sapiens
ccaaatatatttttt

SEQ ID NO: 206502 - DNA, 15 bp, Homo sapiens
tccaaatatattttt

SEQ ID NO: 206503 - DNA, 15 bp, Homo sapiens
atccaaatatatttt

SEQ ID NO: 206504 - DNA, 15 bp, Homo sapiens
catccaaatatattt

SEQ ID NO: 206505 - DNA, 15 bp, Homo sapiens
acatccaaatatatt

SEQ ID NO: 206506 - DNA, 15 bp, Homo sapiens
cacatccaaatatat

SEQ ID NO: 206507 - DNA, 15 bp, Homo sapiens
gcacatccaaatata

SEQ ID NO: 206508 - DNA, 15 bp, Homo sapiens
cgcacatccaaatat

SEQ ID NO: 206509 - DNA, 15 bp, Homo sapiens
acgcacatccaaata

SEQ ID NO: 206510 - DNA, 15 bp, Homo sapiens
tacgcacatccaaat

SEQ ID NO: 206511 - DNA, 15 bp, Homo sapiens
atacgcacatccaaa

SEQ ID NO: 206512 - DNA, 15 bp, Homo sapiens
tatacgcacatccaa

SEQ ID NO: 206513 - DNA, 15 bp, Homo sapiens
atatacgcacatcca

SEQ ID NO: 206514 - DNA, 15 bp, Homo sapiens
tatatacgcacatcc

SEQ ID NO: 206515 - DNA, 15 bp, Homo sapiens
gtatatacgcacatc

SEQ ID NO: 206516 - DNA, 15 bp, Homo sapiens
agtatatacgcacat

SEQ ID NO: 206517 - DNA, 15 bp, Homo sapiens
tagtatatacgcaca

SEQ ID NO: 206518 - DNA, 15 bp, Homo sapiens
atagtatatacgcac

SEQ ID NO: 206519 - DNA, 15 bp, Homo sapiens
tatagtatatacgca

SEQ ID NO: 206520 - DNA, 15 bp, Homo sapiens
gtatagtatatacgc

SEQ ID NO: 206521 - DNA, 15 bp, Homo sapiens
tgtatagtatatacg

SEQ ID NO: 206522 - DNA, 15 bp, Homo sapiens
atgtatagtatatac

SEQ ID NO: 206523 - DNA, 15 bp, Homo sapiens
tatgtatagtatata

SEQ ID NO: 206524 - DNA, 15 bp, Homo sapiens
ttatgtatagtatat

SEQ ID NO: 206525 - DNA, 15 bp, Homo sapiens
tttatgtatagtata

SEQ ID NO: 206526 - DNA, 15 bp, Homo sapiens
gtttatgtatagtat

SEQ ID NO: 206527 - DNA, 15 bp, Homo sapiens
agtttatgtatagta

SEQ ID NO: 206528 - DNA, 15 bp, Homo sapiens
tagtttatgtatagt

SEQ ID NO: 206529 - DNA, 15 bp, Homo sapiens
atagtttatgtatag

SEQ ID NO: 206530 - DNA, 15 bp, Homo sapiens
gatagtttatgtata

SEQ ID NO: 206531 - DNA, 15 bp, Homo sapiens
tgatagtttatgtat

SEQ ID NO: 206532 - DNA, 15 bp, Homo sapiens
ttgatagtttatgta

SEQ ID NO: 206533 - DNA, 15 bp, Homo sapiens
tttgatagtttatgt

SEQ ID NO: 206534 - DNA, 15 bp, Homo sapiens
ttttgatagtttatg

SEQ ID NO: 206535 - DNA, 15 bp, Homo sapiens
gttttgatagtttat

SEQ ID NO: 206536 - DNA, 15 bp, Homo sapiens
agttttgatagttta

SEQ ID NO: 206537 - DNA, 15 bp, Homo sapiens
aagttttgatagttt

SEQ ID NO: 206538 - DNA, 15 bp, Homo sapiens
caagttttgatagtt

SEQ ID NO: 206539 - DNA, 15 bp, Homo sapiens
ccaagttttgatagt

SEQ ID NO: 206540 - DNA, 15 bp, Homo sapiens
accaagttttgatag

SEQ ID NO: 206541 - DNA, 15 bp, Homo sapiens
aaccaagttttgata

SEQ ID NO: 206542 - DNA, 15 bp, Homo sapiens
aaaccaagttttgat

SEQ ID NO: 206543 - DNA, 15 bp, Homo sapiens
taaaccaagttttga

SEQ ID NO: 206544 - DNA, 15 bp, Homo sapiens
ataaaccaagttttg

SEQ ID NO: 206545 - DNA, 15 bp, Homo sapiens
tataaaccaagtttt

SEQ ID NO: 206546 - DNA, 15 bp, Homo sapiens
ttataaaccaagttt

SEQ ID NO: 206547 - DNA, 15 bp, Homo sapiens
attataaaccaagtt

SEQ ID NO: 206548 - DNA, 15 bp, Homo sapiens
aattataaaccaagt

SEQ ID NO: 206549 - DNA, 15 bp, Homo sapiens
caattataaaccaag

SEQ ID NO: 206550 - DNA, 15 bp, Homo sapiens
acaattataaaccaa

SEQ ID NO: 206551 - DNA, 15 bp, Homo sapiens
tacaattataaacca

SEQ ID NO: 206552 - DNA, 15 bp, Homo sapiens
gtacaattataaacc

SEQ ID NO: 206553 - DNA, 15 bp, Homo sapiens
tgtacaattataaac

SEQ ID NO: 206554 - DNA, 15 bp, Homo sapiens
atgtacaattataaa

SEQ ID NO: 206555 - DNA, 15 bp, Homo sapiens
aatgtacaattataa

SEQ ID NO: 206556 - DNA, 15 bp, Homo sapiens
gaatgtacaattata

SEQ ID NO: 206557 - DNA, 15 bp, Homo sapiens
agaatgtacaattat

SEQ ID NO: 206558 - DNA, 15 bp, Homo sapiens
tagaatgtacaatta

SEQ ID NO: 206559 - DNA, 15 bp, Homo sapiens
atagaatgtacaatt

SEQ ID NO: 206560 - DNA, 15 bp, Homo sapiens
gatagaatgtacaat

SEQ ID NO: 206561 - DNA, 15 bp, Homo sapiens
tgatagaatgtacaa

SEQ ID NO: 206562 - DNA, 15 bp, Homo sapiens
gtgatagaatgtaca

SEQ ID NO: 206563 - DNA, 15 bp, Homo sapiens
cgtgatagaatgtac

SEQ ID NO: 206564 - DNA, 15 bp, Homo sapiens
ccgtgatagaatgta

SEQ ID NO: 206565 - DNA, 15 bp, Homo sapiens
tccgtgatagaatgt

SEQ ID NO: 206566 - DNA, 15 bp, Homo sapiens
gtccgtgatagaatg

SEQ ID NO: 206567 - DNA, 15 bp, Homo sapiens
tgtccgtgatagaat

SEQ ID NO: 206568 - DNA, 15 bp, Homo sapiens
atgtccgtgatagaa

SEQ ID NO: 206569 - DNA, 15 bp, Homo sapiens
gatgtccgtgataga

SEQ ID NO: 206570 - DNA, 15 bp, Homo sapiens
ggatgtccgtgatag

SEQ ID NO: 206571 - DNA, 15 bp, Homo sapiens
aggatgtccgtgata

SEQ ID NO: 206572 - DNA, 15 bp, Homo sapiens
aaggatgtccgtgat

SEQ ID NO: 206573 - DNA, 15 bp, Homo sapiens
gaaggatgtccgtga

SEQ ID NO: 206574 - DNA, 15 bp, Homo sapiens
agaaggatgtccgtg

SEQ ID NO: 206575 - DNA, 15 bp, Homo sapiens
aagaaggatgtccgt

SEQ ID NO: 206576 - DNA, 15 bp, Homo sapiens
caagaaggatgtccg

SEQ ID NO: 206577 - DNA, 15 bp, Homo sapiens
tcaagaaggatgtcc

SEQ ID NO: 206578 - DNA, 15 bp, Homo sapiens
ttcaagaaggatgtc

SEQ ID NO: 206579 - DNA, 15 bp, Homo sapiens
tttcaagaaggatgt

SEQ ID NO: 206580 - DNA, 15 bp, Homo sapiens
ctttcaagaaggatg

SEQ ID NO: 206581 - DNA, 15 bp, Homo sapiens
gctttcaagaaggat

SEQ ID NO: 206582 - DNA, 15 bp, Homo sapiens
ggctttcaagaagga

SEQ ID NO: 206583 - DNA, 15 bp, Homo sapiens
aggctttcaagaagg

SEQ ID NO: 206584 - DNA, 15 bp, Homo sapiens
aaggctttcaagaag

SEQ ID NO: 206585 - DNA, 15 bp, Homo sapiens
gaaggctttcaagaa

SEQ ID NO: 206586 - DNA, 15 bp, Homo sapiens
cgaaggctttcaaga

SEQ ID NO: 206587 - DNA, 15 bp, Homo sapiens
acgaaggctttcaag

SEQ ID NO: 206588 - DNA, 15 bp, Homo sapiens
aacgaaggctttcaa

SEQ ID NO: 206589 - DNA, 15 bp, Homo sapiens
aaacgaaggctttca

SEQ ID NO: 206590 - DNA, 15 bp, Homo sapiens
aaaacgaaggctttc

SEQ ID NO: 206591 - DNA, 15 bp, Homo sapiens
caaaacgaaggcttt

SEQ ID NO: 206592 - DNA, 15 bp, Homo sapiens
acaaaacgaaggctt

SEQ ID NO: 206593 - DNA, 15 bp, Homo sapiens
tacaaaacgaaggct

SEQ ID NO: 206594 - DNA, 15 bp, Homo sapiens
atacaaaacgaaggc

SEQ ID NO: 206595 - DNA, 15 bp, Homo sapiens
tatacaaaacgaagg

SEQ ID NO: 206596 - DNA, 15 bp, Homo sapiens
ctatacaaaacgaag

SEQ ID NO: 206597 - DNA, 15 bp, Homo sapiens
cctatacaaaacgaa

SEQ ID NO: 206598 - DNA, 15 bp, Homo sapiens
acctatacaaaacga

SEQ ID NO: 206599 - DNA, 15 bp, Homo sapiens
gacctatacaaaacg

SEQ ID NO: 206600 - DNA, 15 bp, Homo sapiens
agacctatacaaaac

SEQ ID NO: 206601 - DNA, 15 bp, Homo sapiens
cagacctatacaaaa

SEQ ID NO: 206602 - DNA, 15 bp, Homo sapiens
acagacctatacaaa

SEQ ID NO: 206603 - DNA, 15 bp, Homo sapiens
cacagacctatacaa

SEQ ID NO: 206604 - DNA, 15 bp, Homo sapiens
acacagacctataca

SEQ ID NO: 206605 - DNA, 15 bp, Homo sapiens
aacacagacctatac

SEQ ID NO: 206606 - DNA, 15 bp, Homo sapiens
aaacacagacctata

SEQ ID NO: 206607 - DNA, 15 bp, Homo sapiens
aaaacacagacctat

SEQ ID NO: 206608 - DNA, 15 bp, Homo sapiens
taaaacacagaccta

SEQ ID NO: 206609 - DNA, 15 bp, Homo sapiens
ttaaaacacagacct

SEQ ID NO: 206610 - DNA, 15 bp, Homo sapiens
tttaaaacacagacc

SEQ ID NO: 206611 - DNA, 15 bp, Homo sapiens
atttaaaacacagac

SEQ ID NO: 206612 - DNA, 15 bp, Homo sapiens
aatttaaaacacaga

SEQ ID NO: 206613 - DNA, 15 bp, Homo sapiens
aaatttaaaacacag

SEQ ID NO: 206614 - DNA, 15 bp, Homo sapiens
aaaatttaaaacaca

SEQ ID NO: 206615 - DNA, 15 bp, Homo sapiens
caaaatttaaaacac

SEQ ID NO: 206616 - DNA, 15 bp, Homo sapiens
tcaaaatttaaaaca

SEQ ID NO: 206617 - DNA, 15 bp, Homo sapiens
atcaaaatttaaaac

SEQ ID NO: 206618 - DNA, 15 bp, Homo sapiens
tatcaaaatttaaaa

SEQ ID NO: 206619 - DNA, 15 bp, Homo sapiens
ctatcaaaatttaaa

SEQ ID NO: 206620 - DNA, 15 bp, Homo sapiens
actatcaaaatttaa

SEQ ID NO: 206621 - DNA, 15 bp, Homo sapiens
aactatcaaaattta

SEQ ID NO: 206622 - DNA, 15 bp, Homo sapiens
taactatcaaaattt

SEQ ID NO: 206623 - DNA, 15 bp, Homo sapiens
ataactatcaaaatt

SEQ ID NO: 206624 - DNA, 15 bp, Homo sapiens
aataactatcaaaat

SEQ ID NO: 206625 - DNA, 15 bp, Homo sapiens
taataactatcaaaa

SEQ ID NO: 206626 - DNA, 15 bp, Homo sapiens
gtaataactatcaaa

SEQ ID NO: 206627 - DNA, 15 bp, Homo sapiens
ggtaataactatcaa

SEQ ID NO: 206628 - DNA, 15 bp, Homo sapiens
tggtaataactatca

SEQ ID NO: 206629 - DNA, 15 bp, Homo sapiens
ttggtaataactatc

SEQ ID NO: 206630 - DNA, 15 bp, Homo sapiens
attggtaataactat

SEQ ID NO: 206631 - DNA, 15 bp, Homo sapiens
tattggtaataacta

SEQ ID NO: 206632 - DNA, 15 bp, Homo sapiens
ttattggtaataact

SEQ ID NO: 206633 - DNA, 15 bp, Homo sapiens
tttattggtaataac

SEQ ID NO: 206634 - DNA, 15 bp, Homo sapiens
atttattggtaataa

SEQ ID NO: 206635 - DNA, 15 bp, Homo sapiens
gatttattggtaata

SEQ ID NO: 206636 - DNA, 15 bp, Homo sapiens
ggatttattggtaat

SEQ ID NO: 206637 - DNA, 15 bp, Homo sapiens
aggatttattggtaa

SEQ ID NO: 206638 - DNA, 15 bp, Homo sapiens
gaggatttattggta

SEQ ID NO: 206639 - DNA, 15 bp, Homo sapiens
agaggatttattggt

SEQ ID NO: 206640 - DNA, 15 bp, Homo sapiens
cagaggatttattgg

SEQ ID NO: 206641 - DNA, 15 bp, Homo sapiens
tcagaggatttattg

SEQ ID NO: 206642 - DNA, 15 bp, Homo sapiens
ttcagaggatttatt

SEQ ID NO: 206643 - DNA, 15 bp, Homo sapiens
attcagaggatttat

SEQ ID NO: 206644 - DNA, 15 bp, Homo sapiens
tattcagaggattta

SEQ ID NO: 206645 - DNA, 15 bp, Homo sapiens
atattcagaggattt

SEQ ID NO: 206646 - DNA, 15 bp, Homo sapiens
aatattcagaggatt

SEQ ID NO: 206647 - DNA, 15 bp, Homo sapiens
taatattcagaggat

SEQ ID NO: 206648 - DNA, 15 bp, Homo sapiens
ataatattcagagga

SEQ ID NO: 206649 - DNA, 15 bp, Homo sapiens
tataatattcagagg

SEQ ID NO: 206650 - DNA, 15 bp, Homo sapiens
ctataatattcagag

SEQ ID NO: 206651 - DNA, 15 bp, Homo sapiens
gctataatattcaga

SEQ ID NO: 206652 - DNA, 15 bp, Homo sapiens
ggctataatattcag

SEQ ID NO: 206653 - DNA, 15 bp, Homo sapiens
aggctataatattca

SEQ ID NO: 206654 - DNA, 15 bp, Homo sapiens
taggctataatattc

SEQ ID NO: 206655 - DNA, 15 bp, Homo sapiens
ataggctataatatt

SEQ ID NO: 206656 - DNA, 15 bp, Homo sapiens
aataggctataatat

SEQ ID NO: 206657 - DNA, 15 bp, Homo sapiens
gaataggctataata

SEQ ID NO: 206658 - DNA, 15 bp, Homo sapiens
tgaataggctataat

SEQ ID NO: 206659 - DNA, 15 bp, Homo sapiens
ttgaataggctataa

SEQ ID NO: 206660 - DNA, 15 bp, Homo sapiens
tttgaataggctata

SEQ ID NO: 206661 - DNA, 15 bp, Homo sapiens
ttttgaataggctat

SEQ ID NO: 206662 - DNA, 15 bp, Homo sapiens
attttgaataggcta

SEQ ID NO: 206663 - DNA, 15 bp, Homo sapiens
tattttgaataggct

SEQ ID NO: 206664 - DNA, 15 bp, Homo sapiens
ctattttgaataggc

SEQ ID NO: 206665 - DNA, 15 bp, Homo sapiens
gctattttgaatagg

SEQ ID NO: 206666 - DNA, 15 bp, Homo sapiens
agctattttgaatag

SEQ ID NO: 206667 - DNA, 15 bp, Homo sapiens
cagctattttgaata

SEQ ID NO: 206668 - DNA, 15 bp, Homo sapiens
acagctattttgaat

SEQ ID NO: 206669 - DNA, 15 bp, Homo sapiens
aacagctattttgaa

SEQ ID NO: 206670 - DNA, 15 bp, Homo sapiens
aaacagctattttga

SEQ ID NO: 206671 - DNA, 15 bp, Homo sapiens
gaaacagctattttg

SEQ ID NO: 206672 - DNA, 15 bp, Homo sapiens
agaaacagctatttt

SEQ ID NO: 206673 - DNA, 15 bp, Homo sapiens
aagaaacagctattt

SEQ ID NO: 206674 - DNA, 15 bp, Homo sapiens
taagaaacagctatt

SEQ ID NO: 206675 - DNA, 15 bp, Homo sapiens
gtaagaaacagctat

SEQ ID NO: 206676 - DNA, 15 bp, Homo sapiens
tgtaagaaacagcta

SEQ ID NO: 206677 - DNA, 15 bp, Homo sapiens
ctgtaagaaacagct

SEQ ID NO: 206678 - DNA, 15 bp, Homo sapiens
cctgtaagaaacagc

SEQ ID NO: 206679 - DNA, 15 bp, Homo sapiens
tcctgtaagaaacag

SEQ ID NO: 206680 - DNA, 15 bp, Homo sapiens
ttcctgtaagaaaca

SEQ ID NO: 206681 - DNA, 15 bp, Homo sapiens
tttcctgtaagaaac

SEQ ID NO: 206682 - DNA, 15 bp, Homo sapiens
atttcctgtaagaaa

SEQ ID NO: 206683 - DNA, 15 bp, Homo sapiens
catttcctgtaagaa

SEQ ID NO: 206684 - DNA, 15 bp, Homo sapiens
ccatttcctgtaaga

SEQ ID NO: 206685 - DNA, 15 bp, Homo sapiens
tccatttcctgtaag

SEQ ID NO: 206686 - DNA, 15 bp, Homo sapiens
atccatttcctgtaa

SEQ ID NO: 206687 - DNA, 15 bp, Homo sapiens
tatccatttcctgta

SEQ ID NO: 206688 - DNA, 15 bp, Homo sapiens
atatccatttcctgt

SEQ ID NO: 206689 - DNA, 15 bp, Homo sapiens
tatatccatttcctg

SEQ ID NO: 206690 - DNA, 15 bp, Homo sapiens
atatatccatttcct

SEQ ID NO: 206691 - DNA, 15 bp, Homo sapiens
catatatccatttcc

SEQ ID NO: 206692 - DNA, 15 bp, Homo sapiens
acatatatccatttc

SEQ ID NO: 206693 - DNA, 15 bp, Homo sapiens
cacatatatccattt

SEQ ID NO: 206694 - DNA, 15 bp, Homo sapiens
acacatatatccatt

SEQ ID NO: 206695 - DNA, 15 bp, Homo sapiens
cacacatatatccat

SEQ ID NO: 206696 - DNA, 15 bp, Homo sapiens
acacacatatatcca

SEQ ID NO: 206697 - DNA, 15 bp, Homo sapiens
tacacacatatatcc

SEQ ID NO: 206698 - DNA, 15 bp, Homo sapiens
atacacacatatatc

SEQ ID NO: 206699 - DNA, 15 bp, Homo sapiens
tatacacacatatat

SEQ ID NO: 206700 - DNA, 15 bp, Homo sapiens
gtatacacacatata

SEQ ID NO: 206701 - DNA, 15 bp, Homo sapiens
tgtatacacacatat

SEQ ID NO: 206702 - DNA, 15 bp, Homo sapiens
atgtatacacacata

SEQ ID NO: 206703 - DNA, 15 bp, Homo sapiens
tatgtatacacacat

SEQ ID NO: 206704 - DNA, 15 bp, Homo sapiens
catatgtatacacac

SEQ ID NO: 206705 - DNA, 15 bp, Homo sapiens
acatatgtatacaca

SEQ ID NO: 206706 - DNA, 15 bp, Homo sapiens
tacatatgtatacac

SEQ ID NO: 206707 - DNA, 15 bp, Homo sapiens
atacatatgtataca

SEQ ID NO: 206708 - DNA, 15 bp, Homo sapiens
tatacatatgtatac

SEQ ID NO: 206709 - DNA, 15 bp, Homo sapiens
ttatacatatgtata

SEQ ID NO: 206710 - DNA, 15 bp, Homo sapiens
tttatacatatgtat

SEQ ID NO: 206711 - DNA, 15 bp, Homo sapiens
atttatacatatgta

SEQ ID NO: 206712 - DNA, 15 bp, Homo sapiens
tatttatacatatgt

SEQ ID NO: 206713 - DNA, 15 bp, Homo sapiens
atatttatacatatg

SEQ ID NO: 206714 - DNA, 15 bp, Homo sapiens
tatatttatacatat

SEQ ID NO: 206715 - DNA, 15 bp, Homo sapiens
atatatttatacata

SEQ ID NO: 206716 - DNA, 15 bp, Homo sapiens
tatatatttatacat

SEQ ID NO: 206717 - DNA, 15 bp, Homo sapiens
atatatatttataca

SEQ ID NO: 206718 - DNA, 15 bp, Homo sapiens
tatatatatttatac

SEQ ID NO: 206719 - DNA, 15 bp, Homo sapiens
gtatatatatttata

SEQ ID NO: 206720 - DNA, 15 bp, Homo sapiens
agtatatatatttat

SEQ ID NO: 206721 - DNA, 15 bp, Homo sapiens
aagtatatatattta

SEQ ID NO: 206722 - DNA, 15 bp, Homo sapiens
taagtatatatattt

SEQ ID NO: 206723 - DNA, 15 bp, Homo sapiens
ataagtatatatatt

SEQ ID NO: 206724 - DNA, 15 bp, Homo sapiens
cataagtatatatat

SEQ ID NO: 206725 - DNA, 15 bp, Homo sapiens
acataagtatatata

SEQ ID NO: 206726 - DNA, 15 bp, Homo sapiens
tacataagtatatat

SEQ ID NO: 206727 - DNA, 15 bp, Homo sapiens
ttacataagtatata

SEQ ID NO: 206728 - DNA, 15 bp, Homo sapiens
attacataagtatat

SEQ ID NO: 206729 - DNA, 15 bp, Homo sapiens
tattacataagtata

SEQ ID NO: 206730 - DNA, 15 bp, Homo sapiens
atattacataagtat

SEQ ID NO: 206731 - DNA, 15 bp, Homo sapiens
tatattacataagta

SEQ ID NO: 206732 - DNA, 15 bp, Homo sapiens
atatattacataagt

SEQ ID NO: 206733 - DNA, 15 bp, Homo sapiens
catatattacataag

SEQ ID NO: 206734 - DNA, 15 bp, Homo sapiens
acatatattacataa

SEQ ID NO: 206735 - DNA, 15 bp, Homo sapiens
tacatatattacata

SEQ ID NO: 206736 - DNA, 15 bp, Homo sapiens
atacatatattacat

SEQ ID NO: 206737 - DNA, 15 bp, Homo sapiens
aatacatatattaca

SEQ ID NO: 206738 - DNA, 15 bp, Homo sapiens
caatacatatattac

SEQ ID NO: 206739 - DNA, 15 bp, Homo sapiens
acaatacatatatta

SEQ ID NO: 206740 - DNA, 15 bp, Homo sapiens
tacaatacatatatt

SEQ ID NO: 206741 - DNA, 15 bp, Homo sapiens
atacaatacatatat

SEQ ID NO: 206742 - DNA, 15 bp, Homo sapiens
tatacaatacatata

SEQ ID NO: 206743 - DNA, 15 bp, Homo sapiens
atatacaatacatat

SEQ ID NO: 206744 - DNA, 15 bp, Homo sapiens
tatatacaatacata

SEQ ID NO: 206745 - DNA, 15 bp, Homo sapiens
atatatacaatacat

SEQ ID NO: 206746 - DNA, 15 bp, Homo sapiens
catatatacaataca

SEQ ID NO: 206747 - DNA, 15 bp, Homo sapiens
acatatatacaatac

SEQ ID NO: 206748 - DNA, 15 bp, Homo sapiens
tacatatatacaata

SEQ ID NO: 206749 - DNA, 15 bp, Homo sapiens
atacatatatacaat

SEQ ID NO: 206750 - DNA, 15 bp, Homo sapiens
tatacatatatacaa

SEQ ID NO: 206751 - DNA, 15 bp, Homo sapiens
atatacatatataca

SEQ ID NO: 206752 - DNA, 15 bp, Homo sapiens
gatatacatatatac

SEQ ID NO: 206753 - DNA, 15 bp, Homo sapiens
tgatatacatatata

SEQ ID NO: 206754 - DNA, 15 bp, Homo sapiens
atgatatacatatat

SEQ ID NO: 206755 - DNA, 15 bp, Homo sapiens
tatgatatacatata

SEQ ID NO: 206756 - DNA, 15 bp, Homo sapiens
gtatgatatacatat

SEQ ID NO: 206757 - DNA, 15 bp, Homo sapiens
tgtatgatatacata

SEQ ID NO: 206758 - DNA, 15 bp, Homo sapiens
atgtatgatatacat

SEQ ID NO: 206759 - DNA, 15 bp, Homo sapiens
tatgtatgatataca

SEQ ID NO: 206760 - DNA, 15 bp, Homo sapiens
atatgtatgatatac

SEQ ID NO: 206761 - DNA, 15 bp, Homo sapiens
tatatgtatgatata

SEQ ID NO: 206762 - DNA, 15 bp, Homo sapiens
atatatgtatgatat

SEQ ID NO: 206763 - DNA, 15 bp, Homo sapiens
tatatatgtatgata

SEQ ID NO: 206764 - DNA, 15 bp, Homo sapiens
atatatatgtatgat

SEQ ID NO: 206765 - DNA, 15 bp, Homo sapiens
catatatatgtatga

SEQ ID NO: 206766 - DNA, 15 bp, Homo sapiens
acatatatatgtatg

SEQ ID NO: 206767 - DNA, 15 bp, Homo sapiens
tatacatatatatgt

SEQ ID NO: 206768 - DNA, 15 bp, Homo sapiens
atatacatatatatg

SEQ ID NO: 206769 - DNA, 15 bp, Homo sapiens
tatatacatatatat

SEQ ID NO: 206770 - DNA, 15 bp, Homo sapiens
atatatacatatata

SEQ ID NO: 206771 - DNA, 15 bp, Homo sapiens
tatatatacatatat

SEQ ID NO: 206772 - DNA, 15 bp, Homo sapiens
ctatatatacatata

SEQ ID NO: 206773 - DNA, 15 bp, Homo sapiens
actatatatacatat

SEQ ID NO: 206774 - DNA, 15 bp, Homo sapiens
tactatatatacata

SEQ ID NO: 206775 - DNA, 15 bp, Homo sapiens
atactatatatacat

SEQ ID NO: 206776 - DNA, 15 bp, Homo sapiens
tatactatatataca

SEQ ID NO: 206777 - DNA, 15 bp, Homo sapiens
atatactatatatac

SEQ ID NO: 206778 - DNA, 15 bp, Homo sapiens
aatatactatatata

SEQ ID NO: 206779 - DNA, 15 bp, Homo sapiens
taatatactatatat

SEQ ID NO: 206780 - DNA, 15 bp, Homo sapiens
ataatatactatata

SEQ ID NO: 206781 - DNA, 15 bp, Homo sapiens
tataatatactatat

SEQ ID NO: 206782 - DNA, 15 bp, Homo sapiens
ttataatatactata

SEQ ID NO: 206783 - DNA, 15 bp, Homo sapiens
tttataatatactat

SEQ ID NO: 206784 - DNA, 15 bp, Homo sapiens
atttataatatacta

SEQ ID NO: 206785 - DNA, 15 bp, Homo sapiens
tatttataatatact

SEQ ID NO: 206786 - DNA, 15 bp, Homo sapiens
gtatttataatatac

SEQ ID NO: 206787 - DNA, 15 bp, Homo sapiens
tgtatttataatata

SEQ ID NO: 206788 - DNA, 15 bp, Homo sapiens
atgtatttataatat

SEQ ID NO: 206789 - DNA, 15 bp, Homo sapiens
tatgtatttataata

SEQ ID NO: 206790 - DNA, 15 bp, Homo sapiens
atatgtatttataat

SEQ ID NO: 206791 - DNA, 15 bp, Homo sapiens
tatatgtatttataa

SEQ ID NO: 206792 - DNA, 15 bp, Homo sapiens
atatatgtatttata

SEQ ID NO: 206793 - DNA, 15 bp, Homo sapiens
tatatatgtatttat

SEQ ID NO: 206794 - DNA, 15 bp, Homo sapiens
gtaaatacatatata

SEQ ID NO: 206795 - DNA, 15 bp, Homo sapiens
tgtaaatacatatat

SEQ ID NO: 206796 - DNA, 15 bp, Homo sapiens
ttgtaaatacatata

SEQ ID NO: 206797 - DNA, 15 bp, Homo sapiens
cttgtaaatacatat

SEQ ID NO: 206798 - DNA, 15 bp, Homo sapiens
ccttgtaaatacata

SEQ ID NO: 206799 - DNA, 15 bp, Homo sapiens
tccttgtaaatacat

SEQ ID NO: 206800 - DNA, 15 bp, Homo sapiens
ctccttgtaaataca

SEQ ID NO: 206801 - DNA, 15 bp, Homo sapiens
actccttgtaaatac

SEQ ID NO: 206802 - DNA, 15 bp, Homo sapiens
gactccttgtaaata

SEQ ID NO: 206803 - DNA, 15 bp, Homo sapiens
tgactccttgtaaat

SEQ ID NO: 206804 - DNA, 15 bp, Homo sapiens
ctgactccttgtaaa

SEQ ID NO: 206805 - DNA, 15 bp, Homo sapiens
actgactccttgtaa

SEQ ID NO: 206806 - DNA, 15 bp, Homo sapiens
gactgactccttgta

SEQ ID NO: 206807 - DNA, 15 bp, Homo sapiens
agactgactccttgt

SEQ ID NO: 206808 - DNA, 15 bp, Homo sapiens
gagactgactccttg

SEQ ID NO: 206809 - DNA, 15 bp, Homo sapiens
agagactgactcctt

SEQ ID NO: 206810 - DNA, 15 bp, Homo sapiens
aagagactgactcct

SEQ ID NO: 206811 - DNA, 15 bp, Homo sapiens
aaagagactgactcc

SEQ ID NO: 206812 - DNA, 15 bp, Homo sapiens
aaaagagactgactc

SEQ ID NO: 206813 - DNA, 15 bp, Homo sapiens
caaaagagactgact

SEQ ID NO: 206814 - DNA, 15 bp, Homo sapiens
acaaaagagactgac

SEQ ID NO: 206815 - DNA, 15 bp, Homo sapiens
cacaaaagagactga

SEQ ID NO: 206816 - DNA, 15 bp, Homo sapiens
ccacaaaagagactg

SEQ ID NO: 206817 - DNA, 15 bp, Homo sapiens
tccacaaaagagact

SEQ ID NO: 206818 - DNA, 15 bp, Homo sapiens
ttccacaaaagagac

SEQ ID NO: 206819 - DNA, 15 bp, Homo sapiens
cttccacaaaagaga

SEQ ID NO: 206820 - DNA, 15 bp, Homo sapiens
acttccacaaaagag

SEQ ID NO: 206821 - DNA, 15 bp, Homo sapiens
tacttccacaaaaga

SEQ ID NO: 206822 - DNA, 15 bp, Homo sapiens
ttacttccacaaaag

SEQ ID NO: 206823 - DNA, 15 bp, Homo sapiens
tttacttccacaaaa

SEQ ID NO: 206824 - DNA, 15 bp, Homo sapiens
gtttacttccacaaa

SEQ ID NO: 206825 - DNA, 15 bp, Homo sapiens
tgtttacttccacaa

SEQ ID NO: 206826 - DNA, 15 bp, Homo sapiens
atgtttacttccaca

SEQ ID NO: 206827 - DNA, 15 bp, Homo sapiens
aatgtttacttccac

SEQ ID NO: 206828 - DNA, 15 bp, Homo sapiens
taatgtttacttcca

SEQ ID NO: 206829 - DNA, 15 bp, Homo sapiens
gtaatgtttacttcc

SEQ ID NO: 206830 - DNA, 15 bp, Homo sapiens
agtaatgtttacttc

SEQ ID NO: 206831 - DNA, 15 bp, Homo sapiens
aagtaatgtttactt

SEQ ID NO: 206832 - DNA, 15 bp, Homo sapiens
caagtaatgtttact

SEQ ID NO: 206833 - DNA, 15 bp, Homo sapiens
ccaagtaatgtttac

SEQ ID NO: 206834 - DNA, 15 bp, Homo sapiens
accaagtaatgttta

SEQ ID NO: 206835 - DNA, 15 bp, Homo sapiens
gaccaagtaatgttt

SEQ ID NO: 206836 - DNA, 15 bp, Homo sapiens
tgaccaagtaatgtt

SEQ ID NO: 206837 - DNA, 15 bp, Homo sapiens
ctgaccaagtaatgt

SEQ ID NO: 206838 - DNA, 15 bp, Homo sapiens
tctgaccaagtaatg

SEQ ID NO: 206839 - DNA, 15 bp, Homo sapiens
atctgaccaagtaat

SEQ ID NO: 206840 - DNA, 15 bp, Homo sapiens
tatctgaccaagtaa

SEQ ID NO: 206841 - DNA, 15 bp, Homo sapiens
ttatctgaccaagta

SEQ ID NO: 206842 - DNA, 15 bp, Homo sapiens
cttatctgaccaagt

SEQ ID NO: 206843 - DNA, 15 bp, Homo sapiens
tcttatctgaccaag

SEQ ID NO: 206844 - DNA, 15 bp, Homo sapiens
atcttatctgaccaa

SEQ ID NO: 206845 - DNA, 15 bp, Homo sapiens
aatcttatctgacca

SEQ ID NO: 206846 - DNA, 15 bp, Homo sapiens
taatcttatctgacc

SEQ ID NO: 206847 - DNA, 15 bp, Homo sapiens
ataatcttatctgac

SEQ ID NO: 206848 - DNA, 15 bp, Homo sapiens
aataatcttatctga

SEQ ID NO: 206849 - DNA, 15 bp, Homo sapiens
taataatcttatctg

SEQ ID NO: 206850 - DNA, 15 bp, Homo sapiens
ataataatcttatct

SEQ ID NO: 206851 - DNA, 15 bp, Homo sapiens
cataataatcttatc

SEQ ID NO: 206852 - DNA, 15 bp, Homo sapiens
gcataataatcttat

SEQ ID NO: 206853 - DNA, 15 bp, Homo sapiens
agcataataatctta

SEQ ID NO: 206854 - DNA, 15 bp, Homo sapiens
tagcataataatctt

SEQ ID NO: 206855 - DNA, 15 bp, Homo sapiens
ttagcataataatct

SEQ ID NO: 206856 - DNA, 15 bp, Homo sapiens
tttagcataataatc

SEQ ID NO: 206857 - DNA, 15 bp, Homo sapiens
ctttagcataataat

SEQ ID NO: 206858 - DNA, 15 bp, Homo sapiens
cctttagcataataa

SEQ ID NO: 206859 - DNA, 15 bp, Homo sapiens
tcctttagcataata

SEQ ID NO: 206860 - DNA, 15 bp, Homo sapiens
ttcctttagcataat

SEQ ID NO: 206861 - DNA, 15 bp, Homo sapiens
cttcctttagcataa

SEQ ID NO: 206862 - DNA, 15 bp, Homo sapiens
ccttcctttagcata

SEQ ID NO: 206863 - DNA, 15 bp, Homo sapiens
accttcctttagcat

SEQ ID NO: 206864 - DNA, 15 bp, Homo sapiens
taccttcctttagca

SEQ ID NO: 206865 - DNA, 15 bp, Homo sapiens
ctaccttcctttagc

SEQ ID NO: 206866 - DNA, 15 bp, Homo sapiens
tctaccttcctttag

SEQ ID NO: 206867 - DNA, 15 bp, Homo sapiens
atctaccttccttta

SEQ ID NO: 206868 - DNA, 15 bp, Homo sapiens
tatctaccttccttt

SEQ ID NO: 206869 - DNA, 15 bp, Homo sapiens
ttatctaccttcctt

SEQ ID NO: 206870 - DNA, 15 bp, Homo sapiens
attatctaccttcct

SEQ ID NO: 206871 - DNA, 15 bp, Homo sapiens
aattatctaccttcc

SEQ ID NO: 206872 - DNA, 15 bp, Homo sapiens
aaattatctaccttc

SEQ ID NO: 206873 - DNA, 15 bp, Homo sapiens
aaaattatctacctt

SEQ ID NO: 206874 - DNA, 15 bp, Homo sapiens
caaaattatctacct

SEQ ID NO: 206875 - DNA, 15 bp, Homo sapiens
acaaaattatctacc

SEQ ID NO: 206876 - DNA, 15 bp, Homo sapiens
cacaaaattatctac

SEQ ID NO: 206877 - DNA, 15 bp, Homo sapiens
tcacaaaattatcta

SEQ ID NO: 206878 - DNA, 15 bp, Homo sapiens
ttcacaaaattatct

SEQ ID NO: 206879 - DNA, 15 bp, Homo sapiens
attcacaaaattatc

SEQ ID NO: 206880 - DNA, 15 bp, Homo sapiens
cattcacaaaattat

SEQ ID NO: 206881 - DNA, 15 bp, Homo sapiens
acattcacaaaatta

SEQ ID NO: 206882 - DNA, 15 bp, Homo sapiens
tacattcacaaaatt

SEQ ID NO: 206883 - DNA, 15 bp, Homo sapiens
ttacattcacaaaat

SEQ ID NO: 206884 - DNA, 15 bp, Homo sapiens
attacattcacaaaa

SEQ ID NO: 206885 - DNA, 15 bp, Homo sapiens
aattacattcacaaa

SEQ ID NO: 206886 - DNA, 15 bp, Homo sapiens
aaattacattcacaa

SEQ ID NO: 206887 - DNA, 15 bp, Homo sapiens
caaattacattcaca

SEQ ID NO: 206888 - DNA, 15 bp, Homo sapiens
gcaaattacattcac

SEQ ID NO: 206889 - DNA, 15 bp, Homo sapiens
tgcaaattacattca

SEQ ID NO: 206890 - DNA, 15 bp, Homo sapiens
atgcaaattacattc

SEQ ID NO: 206891 - DNA, 15 bp, Homo sapiens
aatgcaaattacatt

SEQ ID NO: 206892 - DNA, 15 bp, Homo sapiens
aaatgcaaattacat

SEQ ID NO: 206893 - DNA, 15 bp, Homo sapiens
gaaatgcaaattaca

SEQ ID NO: 206894 - DNA, 15 bp, Homo sapiens
agaaatgcaaattac

SEQ ID NO: 206895 - DNA, 15 bp, Homo sapiens
tagaaatgcaaatta

SEQ ID NO: 206896 - DNA, 15 bp, Homo sapiens
ttagaaatgcaaatt

SEQ ID NO: 206897 - DNA, 15 bp, Homo sapiens
tttagaaatgcaaat

SEQ ID NO: 206898 - DNA, 15 bp, Homo sapiens
atttagaaatgcaaa

SEQ ID NO: 206899 - DNA, 15 bp, Homo sapiens
catttagaaatgcaa

SEQ ID NO: 206900 - DNA, 15 bp, Homo sapiens
acatttagaaatgca

SEQ ID NO: 206901 - DNA, 15 bp, Homo sapiens
cacatttagaaatgc

SEQ ID NO: 206902 - DNA, 15 bp, Homo sapiens
ccacatttagaaatg

SEQ ID NO: 206903 - DNA, 15 bp, Homo sapiens
accacatttagaaat

SEQ ID NO: 206904 - DNA, 15 bp, Homo sapiens
aaccacatttagaaa

SEQ ID NO: 206905 - DNA, 15 bp, Homo sapiens
taaccacatttagaa

SEQ ID NO: 206906 - DNA, 15 bp, Homo sapiens
ataaccacatttaga

SEQ ID NO: 206907 - DNA, 15 bp, Homo sapiens
aataaccacatttag

SEQ ID NO: 206908 - DNA, 15 bp, Homo sapiens
taataaccacattta

SEQ ID NO: 206909 - DNA, 15 bp, Homo sapiens
ataataaccacattt

SEQ ID NO: 206910 - DNA, 15 bp, Homo sapiens
aataataaccacatt

SEQ ID NO: 206911 - DNA, 15 bp, Homo sapiens
taataataaccacat

SEQ ID NO: 206912 - DNA, 15 bp, Homo sapiens
ataataataaccaca

SEQ ID NO: 206913 - DNA, 15 bp, Homo sapiens
aataataataaccac

SEQ ID NO: 206914 - DNA, 15 bp, Homo sapiens
taataataataacca

SEQ ID NO: 206915 - DNA, 15 bp, Homo sapiens
ataataataataacc

SEQ ID NO: 206916 - DNA, 15 bp, Homo sapiens
gagataataataata

SEQ ID NO: 206917 - DNA, 15 bp, Homo sapiens
agagataataataat

SEQ ID NO: 206918 - DNA, 15 bp, Homo sapiens
gagagataataataa

SEQ ID NO: 206919 - DNA, 15 bp, Homo sapiens
tgagagataataata

SEQ ID NO: 206920 - DNA, 15 bp, Homo sapiens
ttgagagataataat

SEQ ID NO: 206921 - DNA, 15 bp, Homo sapiens
gttgagagataataa

SEQ ID NO: 206922 - DNA, 15 bp, Homo sapiens
tgttgagagataata

SEQ ID NO: 206923 - DNA, 15 bp, Homo sapiens
ctgttgagagataat

SEQ ID NO: 206924 - DNA, 15 bp, Homo sapiens
cctgttgagagataa

SEQ ID NO: 206925 - DNA, 15 bp, Homo sapiens
ccctgttgagagata

SEQ ID NO: 206926 - DNA, 15 bp, Homo sapiens
gccctgttgagagat

SEQ ID NO: 206927 - DNA, 15 bp, Homo sapiens
ggccctgttgagaga

SEQ ID NO: 206928 - DNA, 15 bp, Homo sapiens
gggccctgttgagag

SEQ ID NO: 206929 - DNA, 15 bp, Homo sapiens
tgggccctgttgaga

SEQ ID NO: 206930 - DNA, 15 bp, Homo sapiens
atgggccctgttgag

SEQ ID NO: 206931 - DNA, 15 bp, Homo sapiens
aatgggccctgttga

SEQ ID NO: 206932 - DNA, 15 bp, Homo sapiens
aaatgggccctgttg

SEQ ID NO: 206933 - DNA, 15 bp, Homo sapiens
caaatgggccctgtt

SEQ ID NO: 206934 - DNA, 15 bp, Homo sapiens
ccaaatgggccctgt

SEQ ID NO: 206935 - DNA, 15 bp, Homo sapiens
tccaaatgggccctg

SEQ ID NO: 206936 - DNA, 15 bp, Homo sapiens
ctccaaatgggccct

SEQ ID NO: 206937 - DNA, 15 bp, Homo sapiens
cctccaaatgggccc

SEQ ID NO: 206938 - DNA, 15 bp, Homo sapiens
gcctccaaatgggcc

SEQ ID NO: 206939 - DNA, 15 bp, Homo sapiens
ggcctccaaatgggc

SEQ ID NO: 206940 - DNA, 15 bp, Homo sapiens
tggcctccaaatggg

SEQ ID NO: 206941 - DNA, 15 bp, Homo sapiens
ctggcctccaaatgg

SEQ ID NO: 206942 - DNA, 15 bp, Homo sapiens
gctggcctccaaatg

SEQ ID NO: 206943 - DNA, 15 bp, Homo sapiens
cgctggcctccaaat

SEQ ID NO: 206944 - DNA, 15 bp, Homo sapiens
gcgctggcctccaaa

SEQ ID NO: 206945 - DNA, 15 bp, Homo sapiens
agcgctggcctccaa

SEQ ID NO: 206946 - DNA, 15 bp, Homo sapiens
cagcgctggcctcca

SEQ ID NO: 206947 - DNA, 15 bp, Homo sapiens
tcagcgctggcctcc

SEQ ID NO: 206948 - DNA, 15 bp, Homo sapiens
ctcagcgctggcctc

SEQ ID NO: 206949 - DNA, 15 bp, Homo sapiens
tctcagcgctggcct

SEQ ID NO: 206950 - DNA, 15 bp, Homo sapiens
ttctcagcgctggcc

SEQ ID NO: 206951 - DNA, 15 bp, Homo sapiens
cttctcagcgctggc

SEQ ID NO: 206952 - DNA, 15 bp, Homo sapiens
acttctcagcgctgg

SEQ ID NO: 206953 - DNA, 15 bp, Homo sapiens
cacttctcagcgctg

SEQ ID NO: 206954 - DNA, 15 bp, Homo sapiens
ccacttctcagcgct

SEQ ID NO: 206955 - DNA, 15 bp, Homo sapiens
tccacttctcagcgc

SEQ ID NO: 206956 - DNA, 15 bp, Homo sapiens
ttccacttctcagcg

SEQ ID NO: 206957 - DNA, 15 bp, Homo sapiens
gttccacttctcagc

SEQ ID NO: 206958 - DNA, 15 bp, Homo sapiens
tgttccacttctcag

SEQ ID NO: 206959 - DNA, 15 bp, Homo sapiens
ctgttccacttctca

SEQ ID NO: 206960 - DNA, 15 bp, Homo sapiens
cctgttccacttctc

SEQ ID NO: 206961 - DNA, 15 bp, Homo sapiens
acctgttccacttct

SEQ ID NO: 206962 - DNA, 15 bp, Homo sapiens
aacctgttccacttc

SEQ ID NO: 206963 - DNA, 15 bp, Homo sapiens
caacctgttccactt

SEQ ID NO: 206964 - DNA, 15 bp, Homo sapiens
gcaacctgttccact

SEQ ID NO: 206965 - DNA, 15 bp, Homo sapiens
agcaacctgttccac

SEQ ID NO: 206966 - DNA, 15 bp, Homo sapiens
cagcaacctgttcca

SEQ ID NO: 206967 - DNA, 15 bp, Homo sapiens
tcagcaacctgttcc

SEQ ID NO: 206968 - DNA, 15 bp, Homo sapiens
atcagcaacctgttc

SEQ ID NO: 206969 - DNA, 15 bp, Homo sapiens
catcagcaacctgtt

SEQ ID NO: 206970 - DNA, 15 bp, Homo sapiens
acatcagcaacctgt

SEQ ID NO: 206971 - DNA, 15 bp, Homo sapiens
gacatcagcaacctg

SEQ ID NO: 206972 - DNA, 15 bp, Homo sapiens
ggacatcagcaacct

SEQ ID NO: 206973 - DNA, 15 bp, Homo sapiens
aggacatcagcaacc

SEQ ID NO: 206974 - DNA, 15 bp, Homo sapiens
aaggacatcagcaac

SEQ ID NO: 206975 - DNA, 15 bp, Homo sapiens
taaggacatcagcaa

SEQ ID NO: 206976 - DNA, 15 bp, Homo sapiens
ctaaggacatcagca

SEQ ID NO: 206977 - DNA, 15 bp, Homo sapiens
tctaaggacatcagc

SEQ ID NO: 206978 - DNA, 15 bp, Homo sapiens
ttctaaggacatcag

SEQ ID NO: 206979 - DNA, 15 bp, Homo sapiens
cttctaaggacatca

SEQ ID NO: 206980 - DNA, 15 bp, Homo sapiens
tcttctaaggacatc

SEQ ID NO: 206981 - DNA, 15 bp, Homo sapiens
ttcttctaaggacat

SEQ ID NO: 206982 - DNA, 15 bp, Homo sapiens
gttcttctaaggaca

SEQ ID NO: 206983 - DNA, 15 bp, Homo sapiens
agttcttctaaggac

SEQ ID NO: 206984 - DNA, 15 bp, Homo sapiens
cagttcttctaagga

SEQ ID NO: 206985 - DNA, 15 bp, Homo sapiens
tcagttcttctaagg

SEQ ID NO: 206986 - DNA, 15 bp, Homo sapiens
atcagttcttctaag

SEQ ID NO: 206987 - DNA, 15 bp, Homo sapiens
gatcagttcttctaa

SEQ ID NO: 206988 - DNA, 15 bp, Homo sapiens
tgatcagttcttcta

SEQ ID NO: 206989 - DNA, 15 bp, Homo sapiens
ttgatcagttcttct

SEQ ID NO: 206990 - DNA, 15 bp, Homo sapiens
tttgatcagttcttc

SEQ ID NO: 206991 - DNA, 15 bp, Homo sapiens
atttgatcagttctt

SEQ ID NO: 206992 - DNA, 15 bp, Homo sapiens
catttgatcagttct

SEQ ID NO: 206993 - DNA, 15 bp, Homo sapiens
ccatttgatcagttc

SEQ ID NO: 206994 - DNA, 15 bp, Homo sapiens
gccatttgatcagtt

SEQ ID NO: 206995 - DNA, 15 bp, Homo sapiens
agccatttgatcagt

SEQ ID NO: 206996 - DNA, 15 bp, Homo sapiens
cagccatttgatcag

SEQ ID NO: 206997 - DNA, 15 bp, Homo sapiens
tcagccatttgatca

SEQ ID NO: 206998 - DNA, 15 bp, Homo sapiens
ttcagccatttgatc

SEQ ID NO: 206999 - DNA, 15 bp, Homo sapiens
attcagccatttgat

SEQ ID NO: 207000 - DNA, 15 bp, Homo sapiens
atattcagccatttg

SEQ ID NO: 207001 - DNA, 15 bp, Homo sapiens
catattcagccattt

SEQ ID NO: 207002 - DNA, 15 bp, Homo sapiens
tcatattcagccatt

SEQ ID NO: 207003 - DNA, 15 bp, Homo sapiens
ttcatattcagccat

SEQ ID NO: 207004 - DNA, 15 bp, Homo sapiens
tttcatattcagcca

SEQ ID NO: 207005 - DNA, 15 bp, Homo sapiens
ctttcatattcagcc

SEQ ID NO: 207006 - DNA, 15 bp, Homo sapiens
tctttcatattcagc

SEQ ID NO: 207007 - DNA, 15 bp, Homo sapiens
atctttcatattcag

SEQ ID NO: 207008 - DNA, 15 bp, Homo sapiens
catctttcatattca

SEQ ID NO: 207009 - DNA, 15 bp, Homo sapiens
tcatctttcatattc

SEQ ID NO: 207010 - DNA, 15 bp, Homo sapiens
ttcatctttcatatt

SEQ ID NO: 207011 - DNA, 15 bp, Homo sapiens
cttcatctttcatat

SEQ ID NO: 207012 - DNA, 15 bp, Homo sapiens
tcttcatctttcata

SEQ ID NO: 207013 - DNA, 15 bp, Homo sapiens
ctcttcatctttcat

SEQ ID NO: 207014 - DNA, 15 bp, Homo sapiens
gctcttcatctttca

SEQ ID NO: 207015 - DNA, 15 bp, Homo sapiens
agctcttcatctttc

SEQ ID NO: 207016 - DNA, 15 bp, Homo sapiens
aagctcttcatcttt

SEQ ID NO: 207017 - DNA, 15 bp, Homo sapiens
taagctcttcatctt

SEQ ID NO: 207018 - DNA, 15 bp, Homo sapiens
ttaagctcttcatct

SEQ ID NO: 207019 - DNA, 15 bp, Homo sapiens
cttaagctcttcatc

SEQ ID NO: 207020 - DNA, 15 bp, Homo sapiens
tcttaagctcttcat

SEQ ID NO: 207021 - DNA, 15 bp, Homo sapiens
ttcttaagctcttca

SEQ ID NO: 207022 - DNA, 15 bp, Homo sapiens
tttcttaagctcttc

SEQ ID NO: 207023 - DNA, 15 bp, Homo sapiens
gtttcttaagctctt

SEQ ID NO: 207024 - DNA, 15 bp, Homo sapiens
tgtttcttaagctct

SEQ ID NO: 207025 - DNA, 15 bp, Homo sapiens
ttgtttcttaagctc

SEQ ID NO: 207026 - DNA, 15 bp, Homo sapiens
tttgtttcttaagct

SEQ ID NO: 207027 - DNA, 15 bp, Homo sapiens
atttgtttcttaagc

SEQ ID NO: 207028 - DNA, 15 bp, Homo sapiens
catttgtttcttaag

SEQ ID NO: 207029 - DNA, 15 bp, Homo sapiens
gcatttgtttcttaa

SEQ ID NO: 207030 - DNA, 15 bp, Homo sapiens
ggcatttgtttctta

SEQ ID NO: 207031 - DNA, 15 bp, Homo sapiens
aggcatttgtttctt

SEQ ID NO: 207032 - DNA, 15 bp, Homo sapiens
taggcatttgtttct

SEQ ID NO: 207033 - DNA, 15 bp, Homo sapiens
ataggcatttgtttc

SEQ ID NO: 207034 - DNA, 15 bp, Homo sapiens
aataggcatttgttt

SEQ ID NO: 207035 - DNA, 15 bp, Homo sapiens
caataggcatttgtt

SEQ ID NO: 207036 - DNA, 15 bp, Homo sapiens
ccaataggcatttgt

SEQ ID NO: 207037 - DNA, 15 bp, Homo sapiens
tccaataggcatttg

SEQ ID NO: 207038 - DNA, 15 bp, Homo sapiens
ctccaataggcattt

SEQ ID NO: 207039 - DNA, 15 bp, Homo sapiens
cctccaataggcatt

SEQ ID NO: 207040 - DNA, 15 bp, Homo sapiens
tcctccaataggcat

SEQ ID NO: 207041 - DNA, 15 bp, Homo sapiens
ctcctccaataggca

SEQ ID NO: 207042 - DNA, 15 bp, Homo sapiens
tctcctccaataggc

SEQ ID NO: 207043 - DNA, 15 bp, Homo sapiens
atctcctccaatagg

SEQ ID NO: 207044 - DNA, 15 bp, Homo sapiens
catctcctccaatag

SEQ ID NO: 207045 - DNA, 15 bp, Homo sapiens
acatctcctccaata

SEQ ID NO: 207046 - DNA, 15 bp, Homo sapiens
aacatctcctccaat

SEQ ID NO: 207047 - DNA, 15 bp, Homo sapiens
gaacatctcctccaa

SEQ ID NO: 207048 - DNA, 15 bp, Homo sapiens
ggaacatctcctcca

SEQ ID NO: 207049 - DNA, 15 bp, Homo sapiens
tggaacatctcctcc

SEQ ID NO: 207050 - DNA, 15 bp, Homo sapiens
ctggaacatctcctc

SEQ ID NO: 207051 - DNA, 15 bp, Homo sapiens
gctggaacatctcct

SEQ ID NO: 207052 - DNA, 15 bp, Homo sapiens
ggctggaacatctcc

SEQ ID NO: 207053 - DNA, 15 bp, Homo sapiens
aggctggaacatctc

SEQ ID NO: 207054 - DNA, 15 bp, Homo sapiens
aaggctggaacatct

SEQ ID NO: 207055 - DNA, 15 bp, Homo sapiens
taaggctggaacatc

SEQ ID NO: 207056 - DNA, 15 bp, Homo sapiens
gtaaggctggaacat

SEQ ID NO: 207057 - DNA, 15 bp, Homo sapiens
tgtaaggctggaaca

SEQ ID NO: 207058 - DNA, 15 bp, Homo sapiens
ctgtaaggctggaac

SEQ ID NO: 207059 - DNA, 15 bp, Homo sapiens
gctgtaaggctggaa

SEQ ID NO: 207060 - DNA, 15 bp, Homo sapiens
agctgtaaggctgga

SEQ ID NO: 207061 - DNA, 15 bp, Homo sapiens
gagctgtaaggctgg

SEQ ID NO: 207062 - DNA, 15 bp, Homo sapiens
ggagctgtaaggctg

SEQ ID NO: 207063 - DNA, 15 bp, Homo sapiens
tggagctgtaaggct

SEQ ID NO: 207064 - DNA, 15 bp, Homo sapiens
ctggagctgtaaggc

SEQ ID NO: 207065 - DNA, 15 bp, Homo sapiens
actggagctgtaagg

SEQ ID NO: 207066 - DNA, 15 bp, Homo sapiens
tactggagctgtaag

SEQ ID NO: 207067 - DNA, 15 bp, Homo sapiens
atactggagctgtaa

SEQ ID NO: 207068 - DNA, 15 bp, Homo sapiens
catactggagctgta

SEQ ID NO: 207069 - DNA, 15 bp, Homo sapiens
tcatactggagctgt

SEQ ID NO: 207070 - DNA, 15 bp, Homo sapiens
gtcatactggagctg

SEQ ID NO: 207071 - DNA, 15 bp, Homo sapiens
ggtcatactggagct

SEQ ID NO: 207072 - DNA, 15 bp, Homo sapiens
tggtcatactggagc

SEQ ID NO: 207073 - DNA, 15 bp, Homo sapiens
atggtcatactggag

SEQ ID NO: 207074 - DNA, 15 bp, Homo sapiens
aatggtcatactgga

SEQ ID NO: 207075 - DNA, 15 bp, Homo sapiens
caatggtcatactgg

SEQ ID NO: 207076 - DNA, 15 bp, Homo sapiens
acaatggtcatactg

SEQ ID NO: 207077 - DNA, 15 bp, Homo sapiens
tacaatggtcatact

SEQ ID NO: 207078 - DNA, 15 bp, Homo sapiens
ttacaatggtcatac

SEQ ID NO: 207079 - DNA, 15 bp, Homo sapiens
cttacaatggtcata

SEQ ID NO: 207080 - DNA, 15 bp, Homo sapiens
ccttacaatggtcat

SEQ ID NO: 207081 - DNA, 15 bp, Homo sapiens
accttacaatggtca

SEQ ID NO: 207082 - DNA, 15 bp, Homo sapiens
taccttacaatggtc

SEQ ID NO: 207083 - DNA, 15 bp, Homo sapiens
ttaccttacaatggt

SEQ ID NO: 207084 - DNA, 15 bp, Homo sapiens
cttaccttacaatgg

SEQ ID NO: 207085 - DNA, 15 bp, Homo sapiens
acttaccttacaatg

SEQ ID NO: 207086 - DNA, 15 bp, Homo sapiens
cacttaccttacaat

SEQ ID NO: 207087 - DNA, 15 bp, Homo sapiens
ccacttaccttacaa

SEQ ID NO: 207088 - DNA, 15 bp, Homo sapiens
tccacttaccttaca

SEQ ID NO: 207089 - DNA, 15 bp, Homo sapiens
atccacttaccttac

SEQ ID NO: 207090 - DNA, 15 bp, Homo sapiens
tatccacttacctta

SEQ ID NO: 207091 - DNA, 15 bp, Homo sapiens
ttatccacttacctt

SEQ ID NO: 207092 - DNA, 15 bp, Homo sapiens
gttatccacttacct

SEQ ID NO: 207093 - DNA, 15 bp, Homo sapiens
ggttatccacttacc

SEQ ID NO: 207094 - DNA, 15 bp, Homo sapiens
aggttatccacttac

SEQ ID NO: 207095 - DNA, 15 bp, Homo sapiens
taggttatccactta

SEQ ID NO: 207096 - DNA, 15 bp, Homo sapiens
ataggttatccactt

SEQ ID NO: 207097 - DNA, 15 bp, Homo sapiens
tataggttatccact

SEQ ID NO: 207098 - DNA, 15 bp, Homo sapiens
ctataggttatccac

SEQ ID NO: 207099 - DNA, 15 bp, Homo sapiens
actataggttatcca

SEQ ID NO: 207100 - DNA, 15 bp, Homo sapiens
cactataggttatcc

SEQ ID NO: 207101 - DNA, 15 bp, Homo sapiens
tcactataggttatc

SEQ ID NO: 207102 - DNA, 15 bp, Homo sapiens
ctcactataggttat

SEQ ID NO: 207103 - DNA, 15 bp, Homo sapiens
actcactataggtta

SEQ ID NO: 207104 - DNA, 15 bp, Homo sapiens
gactcactataggtt

SEQ ID NO: 207105 - DNA, 15 bp, Homo sapiens
cgactcactataggt

SEQ ID NO: 207106 - DNA, 15 bp, Homo sapiens
gcgactcactatagg

SEQ ID NO: 207107 - DNA, 15 bp, Homo sapiens
agcgactcactatag

SEQ ID NO: 207108 - DNA, 15 bp, Homo sapiens
aagcgactcactata

SEQ ID NO: 207109 - DNA, 15 bp, Homo sapiens
taagcgactcactat

SEQ ID NO: 207110 - DNA, 15 bp, Homo sapiens
ttaagcgactcacta

SEQ ID NO: 207111 - DNA, 15 bp, Homo sapiens
attaagcgactcact

SEQ ID NO: 207112 - DNA, 15 bp, Homo sapiens
aattaagcgactcac

SEQ ID NO: 207113 - DNA, 15 bp, Homo sapiens
gaattaagcgactca

SEQ ID NO: 207114 - DNA, 15 bp, Homo sapiens
tgaattaagcgactc

SEQ ID NO: 207115 - DNA, 15 bp, Homo sapiens
ttgaattaagcgact

SEQ ID NO: 207116 - DNA, 15 bp, Homo sapiens
tttgaattaagcgac

SEQ ID NO: 207117 - DNA, 15 bp, Homo sapiens
atttgaattaagcga

SEQ ID NO: 207118 - DNA, 15 bp, Homo sapiens
aatttgaattaagcg

SEQ ID NO: 207119 - DNA, 15 bp, Homo sapiens
gaatttgaattaagc

SEQ ID NO: 207120 - DNA, 15 bp, Homo sapiens
agaatttgaattaag

SEQ ID NO: 207121 - DNA, 15 bp, Homo sapiens
tagaatttgaattaa

SEQ ID NO: 207122 - DNA, 15 bp, Homo sapiens
ctagaatttgaatta

SEQ ID NO: 207123 - DNA, 15 bp, Homo sapiens
actagaatttgaatt

SEQ ID NO: 207124 - DNA, 15 bp, Homo sapiens
cactagaatttgaat

SEQ ID NO: 207125 - DNA, 15 bp, Homo sapiens
tcactagaatttgaa

SEQ ID NO: 207126 - DNA, 15 bp, Homo sapiens
ctcactagaatttga

SEQ ID NO: 207127 - DNA, 15 bp, Homo sapiens
cctcactagaatttg

SEQ ID NO: 207128 - DNA, 15 bp, Homo sapiens
acctcactagaattt

SEQ ID NO: 207129 - DNA, 15 bp, Homo sapiens
tacctcactagaatt

SEQ ID NO: 207130 - DNA, 15 bp, Homo sapiens
ctacctcactagaat

SEQ ID NO: 207131 - DNA, 15 bp, Homo sapiens
tctacctcactagaa

SEQ ID NO: 207132 - DNA, 15 bp, Homo sapiens
atctacctcactaga

SEQ ID NO: 207133 - DNA, 15 bp, Homo sapiens
tatctacctcactag

SEQ ID NO: 207134 - DNA, 15 bp, Homo sapiens
atatctacctcacta

SEQ ID NO: 207135 - DNA, 15 bp, Homo sapiens
aatatctacctcact

SEQ ID NO: 207136 - DNA, 15 bp, Homo sapiens
aaatatctacctcac

SEQ ID NO: 207137 - DNA, 15 bp, Homo sapiens
caaatatctacctca

SEQ ID NO: 207138 - DNA, 15 bp, Homo sapiens
tcaaatatctacctc

SEQ ID NO: 207139 - DNA, 15 bp, Homo sapiens
ttcaaatatctacct

SEQ ID NO: 207140 - DNA, 15 bp, Homo sapiens
tttcaaatatctacc

SEQ ID NO: 207141 - DNA, 15 bp, Homo sapiens
atttcaaatatctac

SEQ ID NO: 207142 - DNA, 15 bp, Homo sapiens
tatttcaaatatcta

SEQ ID NO: 207143 - DNA, 15 bp, Homo sapiens
gtatttcaaatatct

SEQ ID NO: 207144 - DNA, 15 bp, Homo sapiens
tgtatttcaaatatc

SEQ ID NO: 207145 - DNA, 15 bp, Homo sapiens
ttgtatttcaaatat

SEQ ID NO: 207146 - DNA, 15 bp, Homo sapiens
attgtatttcaaata

SEQ ID NO: 207147 - DNA, 15 bp, Homo sapiens
aattgtatttcaaat

SEQ ID NO: 207148 - DNA, 15 bp, Homo sapiens
taattgtatttcaaa

SEQ ID NO: 207149 - DNA, 15 bp, Homo sapiens
ataattgtatttcaa

SEQ ID NO: 207150 - DNA, 15 bp, Homo sapiens
tataattgtatttca

SEQ ID NO: 207151 - DNA, 15 bp, Homo sapiens
ctataattgtatttc

SEQ ID NO: 207152 - DNA, 15 bp, Homo sapiens
tctataattgtattt

SEQ ID NO: 207153 - DNA, 15 bp, Homo sapiens
atctataattgtatt

SEQ ID NO: 207154 - DNA, 15 bp, Homo sapiens
tatctataattgtat

SEQ ID NO: 207155 - DNA, 15 bp, Homo sapiens
ttatctataattgta

SEQ ID NO: 207156 - DNA, 15 bp, Homo sapiens
cttatctataattgt

SEQ ID NO: 207157 - DNA, 15 bp, Homo sapiens
acttatctataattg

SEQ ID NO: 207158 - DNA, 15 bp, Homo sapiens
tacttatctataatt

SEQ ID NO: 207159 - DNA, 15 bp, Homo sapiens
atacttatctataat

SEQ ID NO: 207160 - DNA, 15 bp, Homo sapiens
gatacttatctataa

SEQ ID NO: 207161 - DNA, 15 bp, Homo sapiens
tgatacttatctata

SEQ ID NO: 207162 - DNA, 15 bp, Homo sapiens
ctgatacttatctat

SEQ ID NO: 207163 - DNA, 15 bp, Homo sapiens
tctgatacttatcta

SEQ ID NO: 207164 - DNA, 15 bp, Homo sapiens
ctctgatacttatct

SEQ ID NO: 207165 - DNA, 15 bp, Homo sapiens
actctgatacttatc

SEQ ID NO: 207166 - DNA, 15 bp, Homo sapiens
aactctgatacttat

SEQ ID NO: 207167 - DNA, 15 bp, Homo sapiens
caactctgatactta

SEQ ID NO: 207168 - DNA, 15 bp, Homo sapiens
tcaactctgatactt

SEQ ID NO: 207169 - DNA, 15 bp, Homo sapiens
ttcaactctgatact

SEQ ID NO: 207170 - DNA, 15 bp, Homo sapiens
gttcaactctgatac

SEQ ID NO: 207171 - DNA, 15 bp, Homo sapiens
ggttcaactctgata

SEQ ID NO: 207172 - DNA, 15 bp, Homo sapiens
tggttcaactctgat

SEQ ID NO: 207173 - DNA, 15 bp, Homo sapiens
ttggttcaactctga

SEQ ID NO: 207174 - DNA, 15 bp, Homo sapiens
attggttcaactctg

SEQ ID NO: 207175 - DNA, 15 bp, Homo sapiens
aattggttcaactct

SEQ ID NO: 207176 - DNA, 15 bp, Homo sapiens
taattggttcaactc

SEQ ID NO: 207177 - DNA, 15 bp, Homo sapiens
ataattggttcaact

SEQ ID NO: 207178 - DNA, 15 bp, Homo sapiens
gataattggttcaac

SEQ ID NO: 207179 - DNA, 15 bp, Homo sapiens
tgataattggttcaa

SEQ ID NO: 207180 - DNA, 15 bp, Homo sapiens
gtgataattggttca

SEQ ID NO: 207181 - DNA, 15 bp, Homo sapiens
tgtgataattggttc

SEQ ID NO: 207182 - DNA, 15 bp, Homo sapiens
ctgtgataattggtt

SEQ ID NO: 207183 - DNA, 15 bp, Homo sapiens
cctgtgataattggt

SEQ ID NO: 207184 - DNA, 15 bp, Homo sapiens
tcctgtgataattgg

SEQ ID NO: 207185 - DNA, 15 bp, Homo sapiens
atcctgtgataattg

SEQ ID NO: 207186 - DNA, 15 bp, Homo sapiens
aatcctgtgataatt

SEQ ID NO: 207187 - DNA, 15 bp, Homo sapiens
gaatcctgtgataat

SEQ ID NO: 207188 - DNA, 15 bp, Homo sapiens
ggaatcctgtgataa

SEQ ID NO: 207189 - DNA, 15 bp, Homo sapiens
gggaatcctgtgata

SEQ ID NO: 207190 - DNA, 15 bp, Homo sapiens
ggggaatcctgtgat

SEQ ID NO: 207191 - DNA, 15 bp, Homo sapiens
gggggaatcctgtga

SEQ ID NO: 207192 - DNA, 15 bp, Homo sapiens
ggggggaatcctgtg

SEQ ID NO: 207193 - DNA, 15 bp, Homo sapiens
gggggggaatcctgt

SEQ ID NO: 207194 - DNA, 15 bp, Homo sapiens
ggggggggaatcctg

SEQ ID NO: 207195 - DNA, 15 bp, Homo sapiens
gggggggggaatcct

SEQ ID NO: 207196 - DNA, 15 bp, Homo sapiens
tgggggggggaatcc

SEQ ID NO: 207197 - DNA, 15 bp, Homo sapiens
gtgggggggggaatc

SEQ ID NO: 207198 - DNA, 15 bp, Homo sapiens
ggtgggggggggaat

SEQ ID NO: 207199 - DNA, 15 bp, Homo sapiens
tggtgggggggggaa

SEQ ID NO: 207200 - DNA, 15 bp, Homo sapiens
gtggtggggggggga

SEQ ID NO: 207201 - DNA, 15 bp, Homo sapiens
ggtggtggggggggg

SEQ ID NO: 207202 - DNA, 15 bp, Homo sapiens
cggtggtgggggggg

SEQ ID NO: 207203 - DNA, 15 bp, Homo sapiens
acggtggtggggggg

SEQ ID NO: 207204 - DNA, 15 bp, Homo sapiens
gacggtggtgggggg

SEQ ID NO: 207205 - DNA, 15 bp, Homo sapiens
agacggtggtggggg

SEQ ID NO: 207206 - DNA, 15 bp, Homo sapiens
cagacggtggtgggg

SEQ ID NO: 207207 - DNA, 15 bp, Homo sapiens
gcagacggtggtggg

SEQ ID NO: 207208 - DNA, 15 bp, Homo sapiens
agcagacggtggtgg

SEQ ID NO: 207209 - DNA, 15 bp, Homo sapiens
aagcagacggtggtg

SEQ ID NO: 207210 - DNA, 15 bp, Homo sapiens
aaagcagacggtggt

SEQ ID NO: 207211 - DNA, 15 bp, Homo sapiens
aaaagcagacggtgg

SEQ ID NO: 207212 - DNA, 15 bp, Homo sapiens
taaaagcagacggtg

SEQ ID NO: 207213 - DNA, 15 bp, Homo sapiens
ctaaaagcagacggt

SEQ ID NO: 207214 - DNA, 15 bp, Homo sapiens
actaaaagcagacgg

SEQ ID NO: 207215 - DNA, 15 bp, Homo sapiens
aactaaaagcagacg

SEQ ID NO: 207216 - DNA, 15 bp, Homo sapiens
caactaaaagcagac

SEQ ID NO: 207217 - DNA, 15 bp, Homo sapiens
gcaactaaaagcaga

SEQ ID NO: 207218 - DNA, 15 bp, Homo sapiens
ggcaactaaaagcag

SEQ ID NO: 207219 - DNA, 15 bp, Homo sapiens
tggcaactaaaagca

SEQ ID NO: 207220 - DNA, 15 bp, Homo sapiens
ctggcaactaaaagc

SEQ ID NO: 207221 - DNA, 15 bp, Homo sapiens
actggcaactaaaag

SEQ ID NO: 207222 - DNA, 15 bp, Homo sapiens
tactggcaactaaaa

SEQ ID NO: 207223 - DNA, 15 bp, Homo sapiens
ctactggcaactaaa

SEQ ID NO: 207224 - DNA, 15 bp, Homo sapiens
tctactggcaactaa

SEQ ID NO: 207225 - DNA, 15 bp, Homo sapiens
gtctactggcaacta

SEQ ID NO: 207226 - DNA, 15 bp, Homo sapiens
tgtctactggcaact

SEQ ID NO: 207227 - DNA, 15 bp, Homo sapiens
atgtctactggcaac

SEQ ID NO: 207228 - DNA, 15 bp, Homo sapiens
aatgtctactggcaa

SEQ ID NO: 207229 - DNA, 15 bp, Homo sapiens
aaatgtctactggca

SEQ ID NO: 207230 - DNA, 15 bp, Homo sapiens
taaatgtctactggc

SEQ ID NO: 207231 - DNA, 15 bp, Homo sapiens
ttaaatgtctactgg

SEQ ID NO: 207232 - DNA, 15 bp, Homo sapiens
tttaaatgtctactg

SEQ ID NO: 207233 - DNA, 15 bp, Homo sapiens
ctttaaatgtctact

SEQ ID NO: 207234 - DNA, 15 bp, Homo sapiens
actttaaatgtctac

SEQ ID NO: 207235 - DNA, 15 bp, Homo sapiens
cactttaaatgtcta

SEQ ID NO: 207236 - DNA, 15 bp, Homo sapiens
tgcactttaaatgtc

SEQ ID NO: 207237 - DNA, 15 bp, Homo sapiens
atgcactttaaatgt

SEQ ID NO: 207238 - DNA, 15 bp, Homo sapiens
tatgcactttaaatg

SEQ ID NO: 207239 - DNA, 15 bp, Homo sapiens
gtatgcactttaaat

SEQ ID NO: 207240 - DNA, 15 bp, Homo sapiens
tgtatgcactttaaa

SEQ ID NO: 207241 - DNA, 15 bp, Homo sapiens
atgtatgcactttaa

SEQ ID NO: 207242 - DNA, 15 bp, Homo sapiens
aatgtatgcacttta

SEQ ID NO: 207243 - DNA, 15 bp, Homo sapiens
caatgtatgcacttt

SEQ ID NO: 207244 - DNA, 15 bp, Homo sapiens
acaatgtatgcactt

SEQ ID NO: 207245 - DNA, 15 bp, Homo sapiens
aacaatgtatgcact

SEQ ID NO: 207246 - DNA, 15 bp, Homo sapiens
aaacaatgtatgcac

SEQ ID NO: 207247 - DNA, 15 bp, Homo sapiens
gaaacaatgtatgca

SEQ ID NO: 207248 - DNA, 15 bp, Homo sapiens
ggaaacaatgtatgc

SEQ ID NO: 207249 - DNA, 15 bp, Homo sapiens
tggaaacaatgtatg

SEQ ID NO: 207250 - DNA, 15 bp, Homo sapiens
atggaaacaatgtat

SEQ ID NO: 207251 - DNA, 15 bp, Homo sapiens
aatggaaacaatgta

SEQ ID NO: 207252 - DNA, 15 bp, Homo sapiens
aaatggaaacaatgt

SEQ ID NO: 207253 - DNA, 15 bp, Homo sapiens
caaatggaaacaatg

SEQ ID NO: 207254 - DNA, 15 bp, Homo sapiens
acaaatggaaacaat

SEQ ID NO: 207255 - DNA, 15 bp, Homo sapiens
tacaaatggaaacaa

SEQ ID NO: 207256 - DNA, 15 bp, Homo sapiens
atacaaatggaaaca

SEQ ID NO: 207257 - DNA, 15 bp, Homo sapiens
aatacaaatggaaac

SEQ ID NO: 207258 - DNA, 15 bp, Homo sapiens
taatacaaatggaaa

SEQ ID NO: 207259 - DNA, 15 bp, Homo sapiens
ataatacaaatggaa

SEQ ID NO: 207260 - DNA, 15 bp, Homo sapiens
gataatacaaatgga

SEQ ID NO: 207261 - DNA, 15 bp, Homo sapiens
agataatacaaatgg

SEQ ID NO: 207262 - DNA, 15 bp, Homo sapiens
aagataatacaaatg

SEQ ID NO: 207263 - DNA, 15 bp, Homo sapiens
gaagataatacaaat

SEQ ID NO: 207264 - DNA, 15 bp, Homo sapiens
tgaagataatacaaa

SEQ ID NO: 207265 - DNA, 15 bp, Homo sapiens
gtgaagataatacaa

SEQ ID NO: 207266 - DNA, 15 bp, Homo sapiens
tgtgaagataataca

SEQ ID NO: 207267 - DNA, 15 bp, Homo sapiens
atgtgaagataatac

SEQ ID NO: 207268 - DNA, 15 bp, Homo sapiens
aatgtgaagataata

SEQ ID NO: 207269 - DNA, 15 bp, Homo sapiens
aaatgtgaagataat

SEQ ID NO: 207270 - DNA, 15 bp, Homo sapiens
taaatgtgaagataa

SEQ ID NO: 207271 - DNA, 15 bp, Homo sapiens
ttaaatgtgaagata

SEQ ID NO: 207272 - DNA, 15 bp, Homo sapiens
gttaaatgtgaagat

SEQ ID NO: 207273 - DNA, 15 bp, Homo sapiens
agttaaatgtgaaga

SEQ ID NO: 207274 - DNA, 15 bp, Homo sapiens
tagttaaatgtgaag

SEQ ID NO: 207275 - DNA, 15 bp, Homo sapiens
ttagttaaatgtgaa

SEQ ID NO: 207276 - DNA, 15 bp, Homo sapiens
tttagttaaatgtga

SEQ ID NO: 207277 - DNA, 15 bp, Homo sapiens
atttagttaaatgtg

SEQ ID NO: 207278 - DNA, 15 bp, Homo sapiens
aatttagttaaatgt

SEQ ID NO: 207279 - DNA, 15 bp, Homo sapiens
aaatttagttaaatg

SEQ ID NO: 207280 - DNA, 15 bp, Homo sapiens
aaaatttagttaaat

SEQ ID NO: 207281 - DNA, 15 bp, Homo sapiens
aaaaatttagttaaa

SEQ ID NO: 207282 - DNA, 15 bp, Homo sapiens
aaaaaatttagttaa

SEQ ID NO: 207283 - DNA, 15 bp, Homo sapiens
aaaaaaatttagtta

SEQ ID NO: 207284 - DNA, 15 bp, Homo sapiens
gaaaaaaatttagtt

SEQ ID NO: 207285 - DNA, 15 bp, Homo sapiens
tgaaaaaaatttagt

SEQ ID NO: 207286 - DNA, 15 bp, Homo sapiens
ttgaaaaaaatttag

SEQ ID NO: 207287 - DNA, 15 bp, Homo sapiens
tttgaaaaaaattta

SEQ ID NO: 207288 - DNA, 15 bp, Homo sapiens
gtttgaaaaaaattt

SEQ ID NO: 207289 - DNA, 15 bp, Homo sapiens
tgtttgaaaaaaatt

SEQ ID NO: 207290 - DNA, 15 bp, Homo sapiens
gtgtttgaaaaaaat

SEQ ID NO: 207291 - DNA, 15 bp, Homo sapiens
agtgtttgaaaaaaa

SEQ ID NO: 207292 - DNA, 15 bp, Homo sapiens
tagtgtttgaaaaaa

SEQ ID NO: 207293 - DNA, 15 bp, Homo sapiens
gtagtgtttgaaaaa

SEQ ID NO: 207294 - DNA, 15 bp, Homo sapiens
ggtagtgtttgaaaa

SEQ ID NO: 207295 - DNA, 15 bp, Homo sapiens
tggtagtgtttgaaa

SEQ ID NO: 207296 - DNA, 15 bp, Homo sapiens
ctggtagtgtttgaa

SEQ ID NO: 207297 - DNA, 15 bp, Homo sapiens
actggtagtgtttga

SEQ ID NO: 207298 - DNA, 15 bp, Homo sapiens
tactggtagtgtttg

SEQ ID NO: 207299 - DNA, 15 bp, Homo sapiens
atactggtagtgttt

SEQ ID NO: 207300 - DNA, 15 bp, Homo sapiens
gatactggtagtgtt

SEQ ID NO: 207301 - DNA, 15 bp, Homo sapiens
agatactggtagtgt

SEQ ID NO: 207302 - DNA, 15 bp, Homo sapiens
cagatactggtagtg

SEQ ID NO: 207303 - DNA, 15 bp, Homo sapiens
tcagatactggtagt

SEQ ID NO: 207304 - DNA, 15 bp, Homo sapiens
ttcagatactggtag

SEQ ID NO: 207305 - DNA, 15 bp, Homo sapiens
cttcagatactggta

SEQ ID NO: 207306 - DNA, 15 bp, Homo sapiens
acttcagatactggt

SEQ ID NO: 207307 - DNA, 15 bp, Homo sapiens
tacttcagatactgg

SEQ ID NO: 207308 - DNA, 15 bp, Homo sapiens
atacttcagatactg

SEQ ID NO: 207309 - DNA, 15 bp, Homo sapiens
tatacttcagatact

SEQ ID NO: 207310 - DNA, 15 bp, Homo sapiens
ttatacttcagatac

SEQ ID NO: 207311 - DNA, 15 bp, Homo sapiens
attatacttcagata

SEQ ID NO: 207312 - DNA, 15 bp, Homo sapiens
tattatacttcagat

SEQ ID NO: 207313 - DNA, 15 bp, Homo sapiens
atattatacttcaga

SEQ ID NO: 207314 - DNA, 15 bp, Homo sapiens
aatattatacttcag

SEQ ID NO: 207315 - DNA, 15 bp, Homo sapiens
caatattatacttca

SEQ ID NO: 207316 - DNA, 15 bp, Homo sapiens
gcaatattatacttc

SEQ ID NO: 207317 - DNA, 15 bp, Homo sapiens
agcaatattatactt

SEQ ID NO: 207318 - DNA, 15 bp, Homo sapiens
aagcaatattatact

SEQ ID NO: 207319 - DNA, 15 bp, Homo sapiens
aaagcaatattatac

SEQ ID NO: 207320 - DNA, 15 bp, Homo sapiens
aaaagcaatattata

SEQ ID NO: 207321 - DNA, 15 bp, Homo sapiens
taaaagcaatattat

SEQ ID NO: 207322 - DNA, 15 bp, Homo sapiens
ctaaaagcaatatta

SEQ ID NO: 207323 - DNA, 15 bp, Homo sapiens
gctaaaagcaatatt

SEQ ID NO: 207324 - DNA, 15 bp, Homo sapiens
agctaaaagcaatat

SEQ ID NO: 207325 - DNA, 15 bp, Homo sapiens
aagctaaaagcaata

SEQ ID NO: 207326 - DNA, 15 bp, Homo sapiens
taagctaaaagcaat

SEQ ID NO: 207327 - DNA, 15 bp, Homo sapiens
ataagctaaaagcaa

SEQ ID NO: 207328 - DNA, 15 bp, Homo sapiens
aataagctaaaagca

SEQ ID NO: 207329 - DNA, 15 bp, Homo sapiens
taataagctaaaagc

SEQ ID NO: 207330 - DNA, 15 bp, Homo sapiens
ataataagctaaaag

SEQ ID NO: 207331 - DNA, 15 bp, Homo sapiens
cataataagctaaaa

SEQ ID NO: 207332 - DNA, 15 bp, Homo sapiens
tcataataagctaaa

SEQ ID NO: 207333 - DNA, 15 bp, Homo sapiens
ttcataataagctaa

SEQ ID NO: 207334 - DNA, 15 bp, Homo sapiens
cttcataataagcta

SEQ ID NO: 207335 - DNA, 15 bp, Homo sapiens
acttcataataagct

SEQ ID NO: 207336 - DNA, 15 bp, Homo sapiens
aacttcataataagc

SEQ ID NO: 207337 - DNA, 15 bp, Homo sapiens
aaacttcataataag

SEQ ID NO: 207338 - DNA, 15 bp, Homo sapiens
taaacttcataataa

SEQ ID NO: 207339 - DNA, 15 bp, Homo sapiens
ataaacttcataata

SEQ ID NO: 207340 - DNA, 15 bp, Homo sapiens
gataaacttcataat

SEQ ID NO: 207341 - DNA, 15 bp, Homo sapiens
agataaacttcataa

SEQ ID NO: 207342 - DNA, 15 bp, Homo sapiens
tagataaacttcata

SEQ ID NO: 207343 - DNA, 15 bp, Homo sapiens
ttagataaacttcat

SEQ ID NO: 207344 - DNA, 15 bp, Homo sapiens
tttagataaacttca

SEQ ID NO: 207345 - DNA, 15 bp, Homo sapiens
atttagataaacttc

SEQ ID NO: 207346 - DNA, 15 bp, Homo sapiens
aatttagataaactt

SEQ ID NO: 207347 - DNA, 15 bp, Homo sapiens
aaatttagataaact

SEQ ID NO: 207348 - DNA, 15 bp, Homo sapiens
gaaatttagataaac

SEQ ID NO: 207349 - DNA, 15 bp, Homo sapiens
tagaaatttagataa

SEQ ID NO: 207350 - DNA, 15 bp, Homo sapiens
ttagaaatttagata

SEQ ID NO: 207351 - DNA, 15 bp, Homo sapiens
attagaaatttagat

SEQ ID NO: 207352 - DNA, 15 bp, Homo sapiens
tattagaaatttaga

SEQ ID NO: 207353 - DNA, 15 bp, Homo sapiens
ctattagaaatttag

SEQ ID NO: 207354 - DNA, 15 bp, Homo sapiens
cctattagaaattta

SEQ ID NO: 207355 - DNA, 15 bp, Homo sapiens
acctattagaaattt

SEQ ID NO: 207356 - DNA, 15 bp, Homo sapiens
aacctattagaaatt

SEQ ID NO: 207357 - DNA, 15 bp, Homo sapiens
aaacctattagaaat

SEQ ID NO: 207358 - DNA, 15 bp, Homo sapiens
aaaacctattagaaa

SEQ ID NO: 207359 - DNA, 15 bp, Homo sapiens
taaaacctattagaa

SEQ ID NO: 207360 - DNA, 15 bp, Homo sapiens
ctaaaacctattaga

SEQ ID NO: 207361 - DNA, 15 bp, Homo sapiens
tctaaaacctattag

SEQ ID NO: 207362 - DNA, 15 bp, Homo sapiens
ttctaaaacctatta

SEQ ID NO: 207363 - DNA, 15 bp, Homo sapiens
attctaaaacctatt

SEQ ID NO: 207364 - DNA, 15 bp, Homo sapiens
gattctaaaacctat

SEQ ID NO: 207365 - DNA, 15 bp, Homo sapiens
tgattctaaaaccta

SEQ ID NO: 207366 - DNA, 15 bp, Homo sapiens
atgattctaaaacct

SEQ ID NO: 207367 - DNA, 15 bp, Homo sapiens
tatgattctaaaacc

SEQ ID NO: 207368 - DNA, 15 bp, Homo sapiens
ttatgattctaaaac

SEQ ID NO: 207369 - DNA, 15 bp, Homo sapiens
attatgattctaaaa

SEQ ID NO: 207370 - DNA, 15 bp, Homo sapiens
tattatgattctaaa

SEQ ID NO: 207371 - DNA, 15 bp, Homo sapiens
atattatgattctaa

SEQ ID NO: 207372 - DNA, 15 bp, Homo sapiens
tatattatgattcta

SEQ ID NO: 207373 - DNA, 15 bp, Homo sapiens
atatattatgattct

SEQ ID NO: 207374 - DNA, 15 bp, Homo sapiens
aatatattatgattc

SEQ ID NO: 207375 - DNA, 15 bp, Homo sapiens
caatatattatgatt

SEQ ID NO: 207376 - DNA, 15 bp, Homo sapiens
tcaatatattatgat

SEQ ID NO: 207377 - DNA, 15 bp, Homo sapiens
ctcaatatattatga

SEQ ID NO: 207378 - DNA, 15 bp, Homo sapiens
cctcaatatattatg

SEQ ID NO: 207379 - DNA, 15 bp, Homo sapiens
acctcaatatattat

SEQ ID NO: 207380 - DNA, 15 bp, Homo sapiens
aacctcaatatatta

SEQ ID NO: 207381 - DNA, 15 bp, Homo sapiens
aaacctcaatatatt

SEQ ID NO: 207382 - DNA, 15 bp, Homo sapiens
aaaacctcaatatat

SEQ ID NO: 207383 - DNA, 15 bp, Homo sapiens
caaaacctcaatata

SEQ ID NO: 207384 - DNA, 15 bp, Homo sapiens
ccaaaacctcaatat

SEQ ID NO: 207385 - DNA, 15 bp, Homo sapiens
cccaaaacctcaata

SEQ ID NO: 207386 - DNA, 15 bp, Homo sapiens
acccaaaacctcaat

SEQ ID NO: 207387 - DNA, 15 bp, Homo sapiens
aacccaaaacctcaa

SEQ ID NO: 207388 - DNA, 15 bp, Homo sapiens
aaacccaaaacctca

SEQ ID NO: 207389 - DNA, 15 bp, Homo sapiens
aaaacccaaaacctc

SEQ ID NO: 207390 - DNA, 15 bp, Homo sapiens
aaaaacccaaaacct

SEQ ID NO: 207391 - DNA, 15 bp, Homo sapiens
aaaaaacccaaaacc

SEQ ID NO: 207392 - DNA, 15 bp, Homo sapiens
aaaaaaacccaaaac

SEQ ID NO: 207393 - DNA, 15 bp, Homo sapiens
aaaaaaaacccaaaa

SEQ ID NO: 207394 - DNA, 15 bp, Homo sapiens
caaaaaaaacccaaa

SEQ ID NO: 207395 - DNA, 15 bp, Homo sapiens
acaaaaaaaacccaa

SEQ ID NO: 207396 - DNA, 15 bp, Homo sapiens
aacaaaaaaaaccca

SEQ ID NO: 207397 - DNA, 15 bp, Homo sapiens
aaacaaaaaaaaccc

SEQ ID NO: 207398 - DNA, 15 bp, Homo sapiens
aaaacaaaaaaaacc

SEQ ID NO: 207399 - DNA, 15 bp, Homo sapiens
aaaaacaaaaaaaac

SEQ ID NO: 207400 - DNA, 15 bp, Homo sapiens
caaaaaacaaaaaaa

SEQ ID NO: 207401 - DNA, 15 bp, Homo sapiens
acaaaaaacaaaaaa

SEQ ID NO: 207402 - DNA, 15 bp, Homo sapiens
caaacaaaaaacaaa

SEQ ID NO: 207403 - DNA, 15 bp, Homo sapiens
acaaacaaaaaacaa

SEQ ID NO: 207404 - DNA, 15 bp, Homo sapiens
taaaacaaacaaaca

SEQ ID NO: 207405 - DNA, 15 bp, Homo sapiens
gtaaaacaaacaaac

SEQ ID NO: 207406 - DNA, 15 bp, Homo sapiens
ggtaaaacaaacaaa

SEQ ID NO: 207407 - DNA, 15 bp, Homo sapiens
tggtaaaacaaacaa

SEQ ID NO: 207408 - DNA, 15 bp, Homo sapiens
ttggtaaaacaaaca

SEQ ID NO: 207409 - DNA, 15 bp, Homo sapiens
cttggtaaaacaaac

SEQ ID NO: 207410 - DNA, 15 bp, Homo sapiens
acttggtaaaacaaa

SEQ ID NO: 207411 - DNA, 15 bp, Homo sapiens
aacttggtaaaacaa

SEQ ID NO: 207412 - DNA, 15 bp, Homo sapiens
aaacttggtaaaaca

SEQ ID NO: 207413 - DNA, 15 bp, Homo sapiens
gaaacttggtaaaac

SEQ ID NO: 207414 - DNA, 15 bp, Homo sapiens
tgaaacttggtaaaa

SEQ ID NO: 207415 - DNA, 15 bp, Homo sapiens
gtgaaacttggtaaa

SEQ ID NO: 207416 - DNA, 15 bp, Homo sapiens
agtgaaacttggtaa

SEQ ID NO: 207417 - DNA, 15 bp, Homo sapiens
gagtgaaacttggta

SEQ ID NO: 207418 - DNA, 15 bp, Homo sapiens
agagtgaaacttggt

SEQ ID NO: 207419 - DNA, 15 bp, Homo sapiens
aagagtgaaacttgg

SEQ ID NO: 207420 - DNA, 15 bp, Homo sapiens
caagagtgaaacttg

SEQ ID NO: 207421 - DNA, 15 bp, Homo sapiens
acaagagtgaaactt

SEQ ID NO: 207422 - DNA, 15 bp, Homo sapiens
ccattgtactccagc

SEQ ID NO: 207423 - DNA, 15 bp, Homo sapiens
gccattgtactccag

SEQ ID NO: 207424 - DNA, 15 bp, Homo sapiens
tgccattgtactcca

SEQ ID NO: 207425 - DNA, 15 bp, Homo sapiens
atgccattgtactcc

SEQ ID NO: 207426 - DNA, 15 bp, Homo sapiens
catgccattgtactc

SEQ ID NO: 207427 - DNA, 15 bp, Homo sapiens
tcatgccattgtact

SEQ ID NO: 207428 - DNA, 15 bp, Homo sapiens
atcatgccattgtac

SEQ ID NO: 207429 - DNA, 15 bp, Homo sapiens
gatcatgccattgta

SEQ ID NO: 207430 - DNA, 15 bp, Homo sapiens
agatcatgccattgt

SEQ ID NO: 207431 - DNA, 15 bp, Homo sapiens
gagatcatgccattg

SEQ ID NO: 207432 - DNA, 15 bp, Homo sapiens
cgagatcatgccatt

SEQ ID NO: 207433 - DNA, 15 bp, Homo sapiens
ccgagatcatgccat

SEQ ID NO: 207434 - DNA, 15 bp, Homo sapiens
cagaggctgcagtga

SEQ ID NO: 207435 - DNA, 15 bp, Homo sapiens
gcagaggctgcagtg

SEQ ID NO: 207436 - DNA, 15 bp, Homo sapiens
agcagaggctgcagt

SEQ ID NO: 207437 - DNA, 15 bp, Homo sapiens
aagcagaggctgcag

SEQ ID NO: 207438 - DNA, 15 bp, Homo sapiens
gaagcagaggctgca

SEQ ID NO: 207439 - DNA, 15 bp, Homo sapiens
ggaagcagaggctgc

SEQ ID NO: 207440 - DNA, 15 bp, Homo sapiens
aggaagcagaggctg

SEQ ID NO: 207441 - DNA, 15 bp, Homo sapiens
caggaagcagaggct

SEQ ID NO: 207442 - DNA, 15 bp, Homo sapiens
ccaggaagcagaggc

SEQ ID NO: 207443 - DNA, 15 bp, Homo sapiens
aggcacctgtagtcc

SEQ ID NO: 207444 - DNA, 15 bp, Homo sapiens
caggcacctgtagtc

SEQ ID NO: 207445 - DNA, 15 bp, Homo sapiens
gcaggcacctgtagt

SEQ ID NO: 207446 - DNA, 15 bp, Homo sapiens
ggcaggcacctgtag

SEQ ID NO: 207447 - DNA, 15 bp, Homo sapiens
atggcaggcacctgt

SEQ ID NO: 207448 - DNA, 15 bp, Homo sapiens
gatggcaggcacctg

SEQ ID NO: 207449 - DNA, 15 bp, Homo sapiens
tgatggcaggcacct

SEQ ID NO: 207450 - DNA, 15 bp, Homo sapiens
gtgatggcaggcacc

SEQ ID NO: 207451 - DNA, 15 bp, Homo sapiens
tgtgatggcaggcac

SEQ ID NO: 207452 - DNA, 15 bp, Homo sapiens
gtgtgatggcaggca

SEQ ID NO: 207453 - DNA, 15 bp, Homo sapiens
ggtgtgatggcaggc

SEQ ID NO: 207454 - DNA, 15 bp, Homo sapiens
gggtgtgatggcagg

SEQ ID NO: 207455 - DNA, 15 bp, Homo sapiens
tgggtgtgatggcag

SEQ ID NO: 207456 - DNA, 15 bp, Homo sapiens
ttgggtgtgatggca

SEQ ID NO: 207457 - DNA, 15 bp, Homo sapiens
gttgggtgtgatggc

SEQ ID NO: 207458 - DNA, 15 bp, Homo sapiens
agttgggtgtgatgg

SEQ ID NO: 207459 - DNA, 15 bp, Homo sapiens
tagttgggtgtgatg

SEQ ID NO: 207460 - DNA, 15 bp, Homo sapiens
ttagttgggtgtgat

SEQ ID NO: 207461 - DNA, 15 bp, Homo sapiens
gttagttgggtgtga

SEQ ID NO: 207462 - DNA, 15 bp, Homo sapiens
agttagttgggtgtg

SEQ ID NO: 207463 - DNA, 15 bp, Homo sapiens
aagttagttgggtgt

SEQ ID NO: 207464 - DNA, 15 bp, Homo sapiens
aaagttagttgggtg

SEQ ID NO: 207465 - DNA, 15 bp, Homo sapiens
caaagttagttgggt

SEQ ID NO: 207466 - DNA, 15 bp, Homo sapiens
acaaagttagttggg

SEQ ID NO: 207467 - DNA, 15 bp, Homo sapiens
aacaaagttagttgg

SEQ ID NO: 207468 - DNA, 15 bp, Homo sapiens
aaacaaagttagttg

SEQ ID NO: 207469 - DNA, 15 bp, Homo sapiens
aaaacaaagttagtt

SEQ ID NO: 207470 - DNA, 15 bp, Homo sapiens
aaaaacaaagttagt

SEQ ID NO: 207471 - DNA, 15 bp, Homo sapiens
aaaaaacaaagttag

SEQ ID NO: 207472 - DNA, 15 bp, Homo sapiens
aaaaaaacaaagtta

SEQ ID NO: 207473 - DNA, 15 bp, Homo sapiens
aaaaaaaacaaagtt

SEQ ID NO: 207474 - DNA, 15 bp, Homo sapiens
aaaaaaaaacaaagt

SEQ ID NO: 207475 - DNA, 15 bp, Homo sapiens
taaaaaaaaaaaaca

SEQ ID NO: 207476 - DNA, 15 bp, Homo sapiens
ttaaaaaaaaaaaac

SEQ ID NO: 207477 - DNA, 15 bp, Homo sapiens
cttaaaaaaaaaaaa

SEQ ID NO: 207478 - DNA, 15 bp, Homo sapiens
tcttaaaaaaaaaaa

SEQ ID NO: 207479 - DNA, 15 bp, Homo sapiens
atcttaaaaaaaaaa

SEQ ID NO: 207480 - DNA, 15 bp, Homo sapiens
catcttaaaaaaaaa

SEQ ID NO: 207481 - DNA, 15 bp, Homo sapiens
ccatcttaaaaaaaa

SEQ ID NO: 207482 - DNA, 15 bp, Homo sapiens
tccatcttaaaaaaa

SEQ ID NO: 207483 - DNA, 15 bp, Homo sapiens
ctccatcttaaaaaa

SEQ ID NO: 207484 - DNA, 15 bp, Homo sapiens
actccatcttaaaaa

SEQ ID NO: 207485 - DNA, 15 bp, Homo sapiens
gactccatcttaaaa

SEQ ID NO: 207486 - DNA, 15 bp, Homo sapiens
agactccatcttaaa

SEQ ID NO: 207487 - DNA, 15 bp, Homo sapiens
aagactccatcttaa

SEQ ID NO: 207488 - DNA, 15 bp, Homo sapiens
caagactccatctta

SEQ ID NO: 207489 - DNA, 15 bp, Homo sapiens
gcaagactccatctt

SEQ ID NO: 207490 - DNA, 15 bp, Homo sapiens
acctgggtgacagag

SEQ ID NO: 207491 - DNA, 15 bp, Homo sapiens
aacctgggtgacaga

SEQ ID NO: 207492 - DNA, 15 bp, Homo sapiens
caacctgggtgacag

SEQ ID NO: 207493 - DNA, 15 bp, Homo sapiens
ccaacctgggtgaca

SEQ ID NO: 207494 - DNA, 15 bp, Homo sapiens
tccaacctgggtgac

SEQ ID NO: 207495 - DNA, 15 bp, Homo sapiens
ctccaacctgggtga

SEQ ID NO: 207496 - DNA, 15 bp, Homo sapiens
actccaacctgggtg

SEQ ID NO: 207497 - DNA, 15 bp, Homo sapiens
cactccaacctgggt

SEQ ID NO: 207498 - DNA, 15 bp, Homo sapiens
gcactccaacctggg

SEQ ID NO: 207499 - DNA, 15 bp, Homo sapiens
tgcactccaacctgg

SEQ ID NO: 207500 - DNA, 15 bp, Homo sapiens
ctgcactccaacctg

SEQ ID NO: 207501 - DNA, 15 bp, Homo sapiens
actgcactccaacct

SEQ ID NO: 207502 - DNA, 15 bp, Homo sapiens
cactgcactccaacc

SEQ ID NO: 207503 - DNA, 15 bp, Homo sapiens
ccactgcactccaac

SEQ ID NO: 207504 - DNA, 15 bp, Homo sapiens
gccactgcactccaa

SEQ ID NO: 207505 - DNA, 15 bp, Homo sapiens
tgatcatgccactgc

SEQ ID NO: 207506 - DNA, 15 bp, Homo sapiens
gtgatcatgccactg

SEQ ID NO: 207507 - DNA, 15 bp, Homo sapiens
tgtgatcatgccact

SEQ ID NO: 207508 - DNA, 15 bp, Homo sapiens
ctgtgatcatgccac

SEQ ID NO: 207509 - DNA, 15 bp, Homo sapiens
gctgtgatcatgcca

SEQ ID NO: 207510 - DNA, 15 bp, Homo sapiens
agctgtgatcatgcc

SEQ ID NO: 207511 - DNA, 15 bp, Homo sapiens
gagctgtgatcatgc

SEQ ID NO: 207512 - DNA, 15 bp, Homo sapiens
tgagctgtgatcatg

SEQ ID NO: 207513 - DNA, 15 bp, Homo sapiens
gcagtgagctgtgat

SEQ ID NO: 207514 - DNA, 15 bp, Homo sapiens
tgcagtgagctgtga

SEQ ID NO: 207515 - DNA, 15 bp, Homo sapiens
ttgcagtgagctgtg

SEQ ID NO: 207516 - DNA, 15 bp, Homo sapiens
gttgcagtgagctgt

SEQ ID NO: 207517 - DNA, 15 bp, Homo sapiens
ggtggttgcaggtgc

SEQ ID NO: 207518 - DNA, 15 bp, Homo sapiens
gggtggttgcaggtg

SEQ ID NO: 207519 - DNA, 15 bp, Homo sapiens
ggggtggttgcaggt

SEQ ID NO: 207520 - DNA, 15 bp, Homo sapiens
gggggtggttgcagg

SEQ ID NO: 207521 - DNA, 15 bp, Homo sapiens
tgggggtggttgcag

SEQ ID NO: 207522 - DNA, 15 bp, Homo sapiens
ctgggggtggttgca

SEQ ID NO: 207523 - DNA, 15 bp, Homo sapiens
gctgggggtggttgc

SEQ ID NO: 207524 - DNA, 15 bp, Homo sapiens
agctgggggtggttg

SEQ ID NO: 207525 - DNA, 15 bp, Homo sapiens
tagctgggggtggtt

SEQ ID NO: 207526 - DNA, 15 bp, Homo sapiens
ttagctgggggtggt

SEQ ID NO: 207527 - DNA, 15 bp, Homo sapiens
attagctgggggtgg

SEQ ID NO: 207528 - DNA, 15 bp, Homo sapiens
aattagctgggggtg

SEQ ID NO: 207529 - DNA, 15 bp, Homo sapiens
aaattagctgggggt

SEQ ID NO: 207530 - DNA, 15 bp, Homo sapiens
caaaatacaaaatta

SEQ ID NO: 207531 - DNA, 15 bp, Homo sapiens
acaaaatacaaaatt

SEQ ID NO: 207532 - DNA, 15 bp, Homo sapiens
tacaaaatacaaaat

SEQ ID NO: 207533 - DNA, 15 bp, Homo sapiens
atacaaaatacaaaa

SEQ ID NO: 207534 - DNA, 15 bp, Homo sapiens
aatacaaaatacaaa

SEQ ID NO: 207535 - DNA, 15 bp, Homo sapiens
aaatacaaaatacaa

SEQ ID NO: 207536 - DNA, 15 bp, Homo sapiens
aaaatacaaaataca

SEQ ID NO: 207537 - DNA, 15 bp, Homo sapiens
aaaaatacaaaatac

SEQ ID NO: 207538 - DNA, 15 bp, Homo sapiens
aaaaaaaaaatacaa

SEQ ID NO: 207539 - DNA, 15 bp, Homo sapiens
aaaaaaaaaaataca

SEQ ID NO: 207540 - DNA, 15 bp, Homo sapiens
taaaaaaaaaaatac

SEQ ID NO: 207541 - DNA, 15 bp, Homo sapiens
ctaaaaaaaaaaata

SEQ ID NO: 207542 - DNA, 15 bp, Homo sapiens
tctaaaaaaaaaaat

SEQ ID NO: 207543 - DNA, 15 bp, Homo sapiens
atctaaaaaaaaaaa

SEQ ID NO: 207544 - DNA, 15 bp, Homo sapiens
catctaaaaaaaaaa

SEQ ID NO: 207545 - DNA, 15 bp, Homo sapiens
ccatctaaaaaaaaa

SEQ ID NO: 207546 - DNA, 15 bp, Homo sapiens
tccatctaaaaaaaa

SEQ ID NO: 207547 - DNA, 15 bp, Homo sapiens
ctccatctaaaaaaa

SEQ ID NO: 207548 - DNA, 15 bp, Homo sapiens
actccatctaaaaaa

SEQ ID NO: 207549 - DNA, 15 bp, Homo sapiens
gactccatctaaaaa

SEQ ID NO: 207550 - DNA, 15 bp, Homo sapiens
agactccatctaaaa

SEQ ID NO: 207551 - DNA, 15 bp, Homo sapiens
gagactccatctaaa

SEQ ID NO: 207552 - DNA, 15 bp, Homo sapiens
cgagactccatctaa

SEQ ID NO: 207553 - DNA, 15 bp, Homo sapiens
gcgagactccatcta

SEQ ID NO: 207554 - DNA, 15 bp, Homo sapiens
gacccaggaggtgaa

SEQ ID NO: 207555 - DNA, 15 bp, Homo sapiens
ggacccaggaggtga

SEQ ID NO: 207556 - DNA, 15 bp, Homo sapiens
tggacccaggaggtg

SEQ ID NO: 207557 - DNA, 15 bp, Homo sapiens
ttggacccaggaggt

SEQ ID NO: 207558 - DNA, 15 bp, Homo sapiens
cttggacccaggagg

SEQ ID NO: 207559 - DNA, 15 bp, Homo sapiens
tcttggacccaggag

SEQ ID NO: 207560 - DNA, 15 bp, Homo sapiens
ctcttggacccagga

SEQ ID NO: 207561 - DNA, 15 bp, Homo sapiens
tctcttggacccagg

SEQ ID NO: 207562 - DNA, 15 bp, Homo sapiens
atctcttggacccag

SEQ ID NO: 207563 - DNA, 15 bp, Homo sapiens
aatctcttggaccca

SEQ ID NO: 207564 - DNA, 15 bp, Homo sapiens
gaatctcttggaccc

SEQ ID NO: 207565 - DNA, 15 bp, Homo sapiens
agaatctcttggacc

SEQ ID NO: 207566 - DNA, 15 bp, Homo sapiens
gagaatctcttggac

SEQ ID NO: 207567 - DNA, 15 bp, Homo sapiens
ggagaatctcttgga

SEQ ID NO: 207568 - DNA, 15 bp, Homo sapiens
aggagaatctcttgg

SEQ ID NO: 207569 - DNA, 15 bp, Homo sapiens
caggagaatctcttg

SEQ ID NO: 207570 - DNA, 15 bp, Homo sapiens
gcaggagaatctctt

SEQ ID NO: 207571 - DNA, 15 bp, Homo sapiens
ggcaggagaatctct

SEQ ID NO: 207572 - DNA, 15 bp, Homo sapiens
aggcaggagaatctc

SEQ ID NO: 207573 - DNA, 15 bp, Homo sapiens
gaggcaggagaatct

SEQ ID NO: 207574 - DNA, 15 bp, Homo sapiens
ggcatgcgcctgtag

SEQ ID NO: 207575 - DNA, 15 bp, Homo sapiens
tggcatgcgcctgta

SEQ ID NO: 207576 - DNA, 15 bp, Homo sapiens
gtggcatgcgcctgt

SEQ ID NO: 207577 - DNA, 15 bp, Homo sapiens
ggtggcatgcgcctg

SEQ ID NO: 207578 - DNA, 15 bp, Homo sapiens
tggtggcatgcgcct

SEQ ID NO: 207579 - DNA, 15 bp, Homo sapiens
atggtggcatgcgcc

SEQ ID NO: 207580 - DNA, 15 bp, Homo sapiens
catggtggcatgcgc

SEQ ID NO: 207581 - DNA, 15 bp, Homo sapiens
gcatggtggcatgcg

SEQ ID NO: 207582 - DNA, 15 bp, Homo sapiens
ccgggcatggtggca

SEQ ID NO: 207583 - DNA, 15 bp, Homo sapiens
gtctctagtaaaaat

SEQ ID NO: 207584 - DNA, 15 bp, Homo sapiens
cgtctctagtaaaaa

SEQ ID NO: 207585 - DNA, 15 bp, Homo sapiens
ccgtctctagtaaaa

SEQ ID NO: 207586 - DNA, 15 bp, Homo sapiens
cccgtctctagtaaa

SEQ ID NO: 207587 - DNA, 15 bp, Homo sapiens
tcccgtctctagtaa

SEQ ID NO: 207588 - DNA, 15 bp, Homo sapiens
atcccgtctctagta

SEQ ID NO: 207589 - DNA, 15 bp, Homo sapiens
aatcccgtctctagt

SEQ ID NO: 207590 - DNA, 15 bp, Homo sapiens
aaatcccgtctctag

SEQ ID NO: 207591 - DNA, 15 bp, Homo sapiens
catggtgaaatcccg

SEQ ID NO: 207592 - DNA, 15 bp, Homo sapiens
acatggtgaaatccc

SEQ ID NO: 207593 - DNA, 15 bp, Homo sapiens
aacatggtgaaatcc

SEQ ID NO: 207594 - DNA, 15 bp, Homo sapiens
acagatcacctgagg

SEQ ID NO: 207595 - DNA, 15 bp, Homo sapiens
gacagatcacctgag

SEQ ID NO: 207596 - DNA, 15 bp, Homo sapiens
agacagatcacctga

SEQ ID NO: 207597 - DNA, 15 bp, Homo sapiens
aagacagatcacctg

SEQ ID NO: 207598 - DNA, 15 bp, Homo sapiens
gaagacagatcacct

SEQ ID NO: 207599 - DNA, 15 bp, Homo sapiens
ggaagacagatcacc

SEQ ID NO: 207600 - DNA, 15 bp, Homo sapiens
aggaagacagatcac

SEQ ID NO: 207601 - DNA, 15 bp, Homo sapiens
gaggaagacagatca

SEQ ID NO: 207602 - DNA, 15 bp, Homo sapiens
cgaggaagacagatc

SEQ ID NO: 207603 - DNA, 15 bp, Homo sapiens
ccgaggaagacagat

SEQ ID NO: 207604 - DNA, 15 bp, Homo sapiens
gccgaggaagacaga

SEQ ID NO: 207605 - DNA, 15 bp, Homo sapiens
ggccgaggaagacag

SEQ ID NO: 207606 - DNA, 15 bp, Homo sapiens
aggccgaggaagaca

SEQ ID NO: 207607 - DNA, 15 bp, Homo sapiens
gaggccgaggaagac

SEQ ID NO: 207608 - DNA, 15 bp, Homo sapiens
ggaggccgaggaaga

SEQ ID NO: 207609 - DNA, 15 bp, Homo sapiens
aggtggctcatgcct

SEQ ID NO: 207610 - DNA, 15 bp, Homo sapiens
aaggtggctcatgcc

SEQ ID NO: 207611 - DNA, 15 bp, Homo sapiens
taaggtggctcatgc

SEQ ID NO: 207612 - DNA, 15 bp, Homo sapiens
gtaaggtggctcatg

SEQ ID NO: 207613 - DNA, 15 bp, Homo sapiens
ggtaaggtggctcat

SEQ ID NO: 207614 - DNA, 15 bp, Homo sapiens
gggtaaggtggctca

SEQ ID NO: 207615 - DNA, 15 bp, Homo sapiens
cgggtaaggtggctc

SEQ ID NO: 207616 - DNA, 15 bp, Homo sapiens
tcgggtaaggtggct

SEQ ID NO: 207617 - DNA, 15 bp, Homo sapiens
gtcgggtaaggtggc

SEQ ID NO: 207618 - DNA, 15 bp, Homo sapiens
ggtcgggtaaggtgg

SEQ ID NO: 207619 - DNA, 15 bp, Homo sapiens
aggtcgggtaaggtg

SEQ ID NO: 207620 - DNA, 15 bp, Homo sapiens
caggtcgggtaaggt

SEQ ID NO: 207621 - DNA, 15 bp, Homo sapiens
tcaggtcgggtaagg

SEQ ID NO: 207622 - DNA, 15 bp, Homo sapiens
ctcaggtcgggtaag

SEQ ID NO: 207623 - DNA, 15 bp, Homo sapiens
tctcaggtcgggtaa

SEQ ID NO: 207624 - DNA, 15 bp, Homo sapiens
ttctcaggtcgggta

SEQ ID NO: 207625 - DNA, 15 bp, Homo sapiens
tttctcaggtcgggt

SEQ ID NO: 207626 - DNA, 15 bp, Homo sapiens
ttttctcaggtcggg

SEQ ID NO: 207627 - DNA, 15 bp, Homo sapiens
attttctcaggtcgg

SEQ ID NO: 207628 - DNA, 15 bp, Homo sapiens
aattttctcaggtcg

SEQ ID NO: 207629 - DNA, 15 bp, Homo sapiens
aaattttctcaggtc

SEQ ID NO: 207630 - DNA, 15 bp, Homo sapiens
aaaattttctcaggt

SEQ ID NO: 207631 - DNA, 15 bp, Homo sapiens
aaaaattttctcagg

SEQ ID NO: 207632 - DNA, 15 bp, Homo sapiens
taaaaattttctcag

SEQ ID NO: 207633 - DNA, 15 bp, Homo sapiens
ttaaaaattttctca

SEQ ID NO: 207634 - DNA, 15 bp, Homo sapiens
tttaaaaattttctc

SEQ ID NO: 207635 - DNA, 15 bp, Homo sapiens
gtttaaaaattttct

SEQ ID NO: 207636 - DNA, 15 bp, Homo sapiens
agtttaaaaattttc

SEQ ID NO: 207637 - DNA, 15 bp, Homo sapiens
tagtttaaaaatttt

SEQ ID NO: 207638 - DNA, 15 bp, Homo sapiens
gtagtttaaaaattt

SEQ ID NO: 207639 - DNA, 15 bp, Homo sapiens
tgtagtttaaaaatt

SEQ ID NO: 207640 - DNA, 15 bp, Homo sapiens
ttgtagtttaaaaat

SEQ ID NO: 207641 - DNA, 15 bp, Homo sapiens
tttgtagtttaaaaa

SEQ ID NO: 207642 - DNA, 15 bp, Homo sapiens
atttgtagtttaaaa

SEQ ID NO: 207643 - DNA, 15 bp, Homo sapiens
aatttgtagtttaaa

SEQ ID NO: 207644 - DNA, 15 bp, Homo sapiens
taatttgtagtttaa

SEQ ID NO: 207645 - DNA, 15 bp, Homo sapiens
ttaatttgtagttta

SEQ ID NO: 207646 - DNA, 15 bp, Homo sapiens
attaatttgtagttt

SEQ ID NO: 207647 - DNA, 15 bp, Homo sapiens
gattaatttgtagtt

SEQ ID NO: 207648 - DNA, 15 bp, Homo sapiens
agattaatttgtagt

SEQ ID NO: 207649 - DNA, 15 bp, Homo sapiens
aagattaatttgtag

SEQ ID NO: 207650 - DNA, 15 bp, Homo sapiens
taagattaatttgta

SEQ ID NO: 207651 - DNA, 15 bp, Homo sapiens
ttaagattaatttgt

SEQ ID NO: 207652 - DNA, 15 bp, Homo sapiens
tttaagattaatttg

SEQ ID NO: 207653 - DNA, 15 bp, Homo sapiens
atttaagattaattt

SEQ ID NO: 207654 - DNA, 15 bp, Homo sapiens
aatttaagattaatt

SEQ ID NO: 207655 - DNA, 15 bp, Homo sapiens
gaatttaagattaat

SEQ ID NO: 207656 - DNA, 15 bp, Homo sapiens
tgaatttaagattaa

SEQ ID NO: 207657 - DNA, 15 bp, Homo sapiens
ttgaatttaagatta

SEQ ID NO: 207658 - DNA, 15 bp, Homo sapiens
tttgaatttaagatt

SEQ ID NO: 207659 - DNA, 15 bp, Homo sapiens
ccttttgaatttaag

SEQ ID NO: 207660 - DNA, 15 bp, Homo sapiens
gccttttgaatttaa

SEQ ID NO: 207661 - DNA, 15 bp, Homo sapiens
tgccttttgaattta

SEQ ID NO: 207662 - DNA, 15 bp, Homo sapiens
atgccttttgaattt

SEQ ID NO: 207663 - DNA, 15 bp, Homo sapiens
gatgccttttgaatt

SEQ ID NO: 207664 - DNA, 15 bp, Homo sapiens
cgatgccttttgaat

SEQ ID NO: 207665 - DNA, 15 bp, Homo sapiens
tcgatgccttttgaa

SEQ ID NO: 207666 - DNA, 15 bp, Homo sapiens
ctcgatgccttttga

SEQ ID NO: 207667 - DNA, 15 bp, Homo sapiens
actcgatgccttttg

SEQ ID NO: 207668 - DNA, 15 bp, Homo sapiens
gactcgatgcctttt

SEQ ID NO: 207669 - DNA, 15 bp, Homo sapiens
tgactcgatgccttt

SEQ ID NO: 207670 - DNA, 15 bp, Homo sapiens
atgactcgatgcctt

SEQ ID NO: 207671 - DNA, 15 bp, Homo sapiens
tatgactcgatgcct

SEQ ID NO: 207672 - DNA, 15 bp, Homo sapiens
ttatgactcgatgcc

SEQ ID NO: 207673 - DNA, 15 bp, Homo sapiens
cttatgactcgatgc

SEQ ID NO: 207674 - DNA, 15 bp, Homo sapiens
ccttatgactcgatg

SEQ ID NO: 207675 - DNA, 15 bp, Homo sapiens
tccttatgactcgat

SEQ ID NO: 207676 - DNA, 15 bp, Homo sapiens
ttccttatgactcga

SEQ ID NO: 207677 - DNA, 15 bp, Homo sapiens
attccttatgactcg

SEQ ID NO: 207678 - DNA, 15 bp, Homo sapiens
aattccttatgactc

SEQ ID NO: 207679 - DNA, 15 bp, Homo sapiens
taattccttatgact

SEQ ID NO: 207680 - DNA, 15 bp, Homo sapiens
gtaattccttatgac

SEQ ID NO: 207681 - DNA, 15 bp, Homo sapiens
tgtaattccttatga

SEQ ID NO: 207682 - DNA, 15 bp, Homo sapiens
ttgtaattccttatg

SEQ ID NO: 207683 - DNA, 15 bp, Homo sapiens
tttgtaattccttat

SEQ ID NO: 207684 - DNA, 15 bp, Homo sapiens
gtttgtaattcctta

SEQ ID NO: 207685 - DNA, 15 bp, Homo sapiens
agtttgtaattcctt

SEQ ID NO: 207686 - DNA, 15 bp, Homo sapiens
tagtttgtaattcct

SEQ ID NO: 207687 - DNA, 15 bp, Homo sapiens
atagtttgtaattcc

SEQ ID NO: 207688 - DNA, 15 bp, Homo sapiens
gatagtttgtaattc

SEQ ID NO: 207689 - DNA, 15 bp, Homo sapiens
agatagtttgtaatt

SEQ ID NO: 207690 - DNA, 15 bp, Homo sapiens
aagatagtttgtaat

SEQ ID NO: 207691 - DNA, 15 bp, Homo sapiens
caagatagtttgtaa

SEQ ID NO: 207692 - DNA, 15 bp, Homo sapiens
acaagatagtttgta

SEQ ID NO: 207693 - DNA, 15 bp, Homo sapiens
aacaagatagtttgt

SEQ ID NO: 207694 - DNA, 15 bp, Homo sapiens
aaacaagatagtttg

SEQ ID NO: 207695 - DNA, 15 bp, Homo sapiens
caaacaagatagttt

SEQ ID NO: 207696 - DNA, 15 bp, Homo sapiens
acaaacaagatagtt

SEQ ID NO: 207697 - DNA, 15 bp, Homo sapiens
cacaaacaagatagt

SEQ ID NO: 207698 - DNA, 15 bp, Homo sapiens
acacaaacaagatag

SEQ ID NO: 207699 - DNA, 15 bp, Homo sapiens
aacacaaacaagata

SEQ ID NO: 207700 - DNA, 15 bp, Homo sapiens
aaacacaaacaagat

SEQ ID NO: 207701 - DNA, 15 bp, Homo sapiens
taaacacaaacaaga

SEQ ID NO: 207702 - DNA, 15 bp, Homo sapiens
ttaaacacaaacaag

SEQ ID NO: 207703 - DNA, 15 bp, Homo sapiens
attaaacacaaacaa

SEQ ID NO: 207704 - DNA, 15 bp, Homo sapiens
tattaaacacaaaca

SEQ ID NO: 207705 - DNA, 15 bp, Homo sapiens
ttattaaacacaaac

SEQ ID NO: 207706 - DNA, 15 bp, Homo sapiens
tttattaaacacaaa

SEQ ID NO: 207707 - DNA, 15 bp, Homo sapiens
ttttattaaacacaa

SEQ ID NO: 207708 - DNA, 15 bp, Homo sapiens
cttttattaaacaca

SEQ ID NO: 207709 - DNA, 15 bp, Homo sapiens
acttttattaaacac

SEQ ID NO: 207710 - DNA, 15 bp, Homo sapiens
cacttttattaaaca

SEQ ID NO: 207711 - DNA, 15 bp, Homo sapiens
tcacttttattaaac

SEQ ID NO: 207712 - DNA, 15 bp, Homo sapiens
ttcacttttattaaa

SEQ ID NO: 207713 - DNA, 15 bp, Homo sapiens
tttcacttttattaa

SEQ ID NO: 207714 - DNA, 15 bp, Homo sapiens
ttttcacttttatta

SEQ ID NO: 207715 - DNA, 15 bp, Homo sapiens
tttttcacttttatt

SEQ ID NO: 207716 - DNA, 15 bp, Homo sapiens
atttttcacttttat

SEQ ID NO: 207717 - DNA, 15 bp, Homo sapiens
tatttttcactttta

SEQ ID NO: 207718 - DNA, 15 bp, Homo sapiens
ttatttttcactttt

SEQ ID NO: 207719 - DNA, 15 bp, Homo sapiens
cttatttttcacttt

SEQ ID NO: 207720 - DNA, 15 bp, Homo sapiens
ccttatttttcactt

SEQ ID NO: 207721 - DNA, 15 bp, Homo sapiens
tccttatttttcact

SEQ ID NO: 207722 - DNA, 15 bp, Homo sapiens
gtccttatttttcac

SEQ ID NO: 207723 - DNA, 15 bp, Homo sapiens
agtccttatttttca

SEQ ID NO: 207724 - DNA, 15 bp, Homo sapiens
aagtccttatttttc

SEQ ID NO: 207725 - DNA, 15 bp, Homo sapiens
caagtccttattttt

SEQ ID NO: 207726 - DNA, 15 bp, Homo sapiens
acaagtccttatttt

SEQ ID NO: 207727 - DNA, 15 bp, Homo sapiens
tacaagtccttattt

SEQ ID NO: 207728 - DNA, 15 bp, Homo sapiens
ctacaagtccttatt

SEQ ID NO: 207729 - DNA, 15 bp, Homo sapiens
actacaagtccttat

SEQ ID NO: 207730 - DNA, 15 bp, Homo sapiens
tactacaagtcctta

SEQ ID NO: 207731 - DNA, 15 bp, Homo sapiens
ttactacaagtcctt

SEQ ID NO: 207732 - DNA, 15 bp, Homo sapiens
tttactacaagtcct

SEQ ID NO: 207733 - DNA, 15 bp, Homo sapiens
ttttactacaagtcc

SEQ ID NO: 207734 - DNA, 15 bp, Homo sapiens
tttttactacaagtc

SEQ ID NO: 207735 - DNA, 15 bp, Homo sapiens
ttttttactacaagt

SEQ ID NO: 207736 - DNA, 15 bp, Homo sapiens
tttttttactacaag

SEQ ID NO: 207737 - DNA, 15 bp, Homo sapiens
ttttttttactacaa

SEQ ID NO: 207738 - DNA, 15 bp, Homo sapiens
tttttttttactaca

SEQ ID NO: 207739 - DNA, 15 bp, Homo sapiens
ttttttttttactac

SEQ ID NO: 207740 - DNA, 15 bp, Homo sapiens
tttttttttttacta

SEQ ID NO: 207741 - DNA, 15 bp, Homo sapiens
attactttttttttt

SEQ ID NO: 207742 - DNA, 15 bp, Homo sapiens
cattacttttttttt

SEQ ID NO: 207743 - DNA, 15 bp, Homo sapiens
gcattactttttttt

SEQ ID NO: 207744 - DNA, 15 bp, Homo sapiens
tgcattacttttttt

SEQ ID NO: 207745 - DNA, 15 bp, Homo sapiens
ctgcattactttttt

SEQ ID NO: 207746 - DNA, 15 bp, Homo sapiens
tctgcattacttttt

SEQ ID NO: 207747 - DNA, 15 bp, Homo sapiens
atctgcattactttt

SEQ ID NO: 207748 - DNA, 15 bp, Homo sapiens
catctgcattacttt

SEQ ID NO: 207749 - DNA, 15 bp, Homo sapiens
tcatctgcattactt

SEQ ID NO: 207750 - DNA, 15 bp, Homo sapiens
ttcatctgcattact

SEQ ID NO: 207751 - DNA, 15 bp, Homo sapiens
cttcatctgcattac

SEQ ID NO: 207752 - DNA, 15 bp, Homo sapiens
tcttcatctgcatta

SEQ ID NO: 207753 - DNA, 15 bp, Homo sapiens
gtcttcatctgcatt

SEQ ID NO: 207754 - DNA, 15 bp, Homo sapiens
ggtcttcatctgcat

SEQ ID NO: 207755 - DNA, 15 bp, Homo sapiens
tggtcttcatctgca

SEQ ID NO: 207756 - DNA, 15 bp, Homo sapiens
atggtcttcatctgc

SEQ ID NO: 207757 - DNA, 15 bp, Homo sapiens
tatggtcttcatctg

SEQ ID NO: 207758 - DNA, 15 bp, Homo sapiens
gtatggtcttcatct

SEQ ID NO: 207759 - DNA, 15 bp, Homo sapiens
agtatggtcttcatc

SEQ ID NO: 207760 - DNA, 15 bp, Homo sapiens
tagtatggtcttcat

SEQ ID NO: 207761 - DNA, 15 bp, Homo sapiens
atagtatggtcttca

SEQ ID NO: 207762 - DNA, 15 bp, Homo sapiens
aatagtatggtcttc

SEQ ID NO: 207763 - DNA, 15 bp, Homo sapiens
aaatagtatggtctt

SEQ ID NO: 207764 - DNA, 15 bp, Homo sapiens
taaatagtatggtct

SEQ ID NO: 207765 - DNA, 15 bp, Homo sapiens
ttaaatagtatggtc

SEQ ID NO: 207766 - DNA, 15 bp, Homo sapiens
tttaaatagtatggt

SEQ ID NO: 207767 - DNA, 15 bp, Homo sapiens
ttttaaatagtatgg

SEQ ID NO: 207768 - DNA, 15 bp, Homo sapiens
attttaaatagtatg

SEQ ID NO: 207769 - DNA, 15 bp, Homo sapiens
gattttaaatagtat

SEQ ID NO: 207770 - DNA, 15 bp, Homo sapiens
tgattttaaatagta

SEQ ID NO: 207771 - DNA, 15 bp, Homo sapiens
atgattttaaatagt

SEQ ID NO: 207772 - DNA, 15 bp, Homo sapiens
aatgattttaaatag

SEQ ID NO: 207773 - DNA, 15 bp, Homo sapiens
aaatgattttaaata

SEQ ID NO: 207774 - DNA, 15 bp, Homo sapiens
aaaatgattttaaat

SEQ ID NO: 207775 - DNA, 15 bp, Homo sapiens
taaaatgattttaaa

SEQ ID NO: 207776 - DNA, 15 bp, Homo sapiens
ataaaatgattttaa

SEQ ID NO: 207777 - DNA, 15 bp, Homo sapiens
cataaaatgatttta

SEQ ID NO: 207778 - DNA, 15 bp, Homo sapiens
acataaaatgatttt

SEQ ID NO: 207779 - DNA, 15 bp, Homo sapiens
cacataaaatgattt

SEQ ID NO: 207780 - DNA, 15 bp, Homo sapiens
acacataaaatgatt

SEQ ID NO: 207781 - DNA, 15 bp, Homo sapiens
aacacataaaatgat

SEQ ID NO: 207782 - DNA, 15 bp, Homo sapiens
aaacacataaaatga

SEQ ID NO: 207783 - DNA, 15 bp, Homo sapiens
aaaacacataaaatg

SEQ ID NO: 207784 - DNA, 15 bp, Homo sapiens
taaaacacataaaat

SEQ ID NO: 207785 - DNA, 15 bp, Homo sapiens
gtaaaacacataaaa

SEQ ID NO: 207786 - DNA, 15 bp, Homo sapiens
agtaaaacacataaa

SEQ ID NO: 207787 - DNA, 15 bp, Homo sapiens
aagtaaaacacataa

SEQ ID NO: 207788 - DNA, 15 bp, Homo sapiens
aaagtaaaacacata

SEQ ID NO: 207789 - DNA, 15 bp, Homo sapiens
aaaagtaaaacacat

SEQ ID NO: 207790 - DNA, 15 bp, Homo sapiens
gaaaagtaaaacaca

SEQ ID NO: 207791 - DNA, 15 bp, Homo sapiens
agaaaagtaaaacac

SEQ ID NO: 207792 - DNA, 15 bp, Homo sapiens
cagaaaagtaaaaca

SEQ ID NO: 207793 - DNA, 15 bp, Homo sapiens
tcagaaaagtaaaac

SEQ ID NO: 207794 - DNA, 15 bp, Homo sapiens
ctcagaaaagtaaaa

SEQ ID NO: 207795 - DNA, 15 bp, Homo sapiens
gctcagaaaagtaaa

SEQ ID NO: 207796 - DNA, 15 bp, Homo sapiens
ggctcagaaaagtaa

SEQ ID NO: 207797 - DNA, 15 bp, Homo sapiens
tggctcagaaaagta

SEQ ID NO: 207798 - DNA, 15 bp, Homo sapiens
ttggctcagaaaagt

SEQ ID NO: 207799 - DNA, 15 bp, Homo sapiens
cttggctcagaaaag

SEQ ID NO: 207800 - DNA, 15 bp, Homo sapiens
gcttggctcagaaaa

SEQ ID NO: 207801 - DNA, 15 bp, Homo sapiens
ggcttggctcagaaa

SEQ ID NO: 207802 - DNA, 15 bp, Homo sapiens
aggcttggctcagaa

SEQ ID NO: 207803 - DNA, 15 bp, Homo sapiens
aaggcttggctcaga

SEQ ID NO: 207804 - DNA, 15 bp, Homo sapiens
aaaggcttggctcag

SEQ ID NO: 207805 - DNA, 15 bp, Homo sapiens
aaaaggcttggctca

SEQ ID NO: 207806 - DNA, 15 bp, Homo sapiens
gaaaaggcttggctc

SEQ ID NO: 207807 - DNA, 15 bp, Homo sapiens
agaaaaggcttggct

SEQ ID NO: 207808 - DNA, 15 bp, Homo sapiens
aagaaaaggcttggc

SEQ ID NO: 207809 - DNA, 15 bp, Homo sapiens
aaagaaaaggcttgg

SEQ ID NO: 207810 - DNA, 15 bp, Homo sapiens
caaagaaaaggcttg

SEQ ID NO: 207811 - DNA, 15 bp, Homo sapiens
tcaaagaaaaggctt

SEQ ID NO: 207812 - DNA, 15 bp, Homo sapiens
atcaaagaaaaggct

SEQ ID NO: 207813 - DNA, 15 bp, Homo sapiens
aatcaaagaaaaggc

SEQ ID NO: 207814 - DNA, 15 bp, Homo sapiens
taatcaaagaaaagg

SEQ ID NO: 207815 - DNA, 15 bp, Homo sapiens
gtaatcaaagaaaag

SEQ ID NO: 207816 - DNA, 15 bp, Homo sapiens
tgtaatcaaagaaaa

SEQ ID NO: 207817 - DNA, 15 bp, Homo sapiens
atgtaatcaaagaaa

SEQ ID NO: 207818 - DNA, 15 bp, Homo sapiens
aatgtaatcaaagaa

SEQ ID NO: 207819 - DNA, 15 bp, Homo sapiens
aaatgtaatcaaaga

SEQ ID NO: 207820 - DNA, 15 bp, Homo sapiens
aaaatgtaatcaaag

SEQ ID NO: 207821 - DNA, 15 bp, Homo sapiens
aaaaatgtaatcaaa

SEQ ID NO: 207822 - DNA, 15 bp, Homo sapiens
taaaaatgtaatcaa

SEQ ID NO: 207823 - DNA, 15 bp, Homo sapiens
ataaaaatgtaatca

SEQ ID NO: 207824 - DNA, 15 bp, Homo sapiens
tataaaaatgtaatc

SEQ ID NO: 207825 - DNA, 15 bp, Homo sapiens
gtataaaaatgtaat

SEQ ID NO: 207826 - DNA, 15 bp, Homo sapiens
agtataaaaatgtaa

SEQ ID NO: 207827 - DNA, 15 bp, Homo sapiens
cagtataaaaatgta

SEQ ID NO: 207828 - DNA, 15 bp, Homo sapiens
gcagtataaaaatgt

SEQ ID NO: 207829 - DNA, 15 bp, Homo sapiens
agcagtataaaaatg

SEQ ID NO: 207830 - DNA, 15 bp, Homo sapiens
gagcagtataaaaat

SEQ ID NO: 207831 - DNA, 15 bp, Homo sapiens
tgagcagtataaaaa

SEQ ID NO: 207832 - DNA, 15 bp, Homo sapiens
ttgagcagtataaaa

SEQ ID NO: 207833 - DNA, 15 bp, Homo sapiens
tttgagcagtataaa

SEQ ID NO: 207834 - DNA, 15 bp, Homo sapiens
atttgagcagtataa

SEQ ID NO: 207835 - DNA, 15 bp, Homo sapiens
aatttgagcagtata

SEQ ID NO: 207836 - DNA, 15 bp, Homo sapiens
aaatttgagcagtat

SEQ ID NO: 207837 - DNA, 15 bp, Homo sapiens
gaaatttgagcagta

SEQ ID NO: 207838 - DNA, 15 bp, Homo sapiens
agaaatttgagcagt

SEQ ID NO: 207839 - DNA, 15 bp, Homo sapiens
cagaaatttgagcag

SEQ ID NO: 207840 - DNA, 15 bp, Homo sapiens
acagaaatttgagca

SEQ ID NO: 207841 - DNA, 15 bp, Homo sapiens
aacagaaatttgagc

SEQ ID NO: 207842 - DNA, 15 bp, Homo sapiens
gaacagaaatttgag

SEQ ID NO: 207843 - DNA, 15 bp, Homo sapiens
ggaacagaaatttga

SEQ ID NO: 207844 - DNA, 15 bp, Homo sapiens
aggaacagaaatttg

SEQ ID NO: 207845 - DNA, 15 bp, Homo sapiens
taggaacagaaattt

SEQ ID NO: 207846 - DNA, 15 bp, Homo sapiens
ataggaacagaaatt

SEQ ID NO: 207847 - DNA, 15 bp, Homo sapiens
cataggaacagaaat

SEQ ID NO: 207848 - DNA, 15 bp, Homo sapiens
gcataggaacagaaa

SEQ ID NO: 207849 - DNA, 15 bp, Homo sapiens
tgcataggaacagaa

SEQ ID NO: 207850 - DNA, 15 bp, Homo sapiens
ttgcataggaacaga

SEQ ID NO: 207851 - DNA, 15 bp, Homo sapiens
tttgcataggaacag

SEQ ID NO: 207852 - DNA, 15 bp, Homo sapiens
atttgcataggaaca

SEQ ID NO: 207853 - DNA, 15 bp, Homo sapiens
catttgcataggaac

SEQ ID NO: 207854 - DNA, 15 bp, Homo sapiens
acatttgcataggaa

SEQ ID NO: 207855 - DNA, 15 bp, Homo sapiens
tacatttgcatagga

SEQ ID NO: 207856 - DNA, 15 bp, Homo sapiens
atacatttgcatagg

SEQ ID NO: 207857 - DNA, 15 bp, Homo sapiens
tatacatttgcatag

SEQ ID NO: 207858 - DNA, 15 bp, Homo sapiens
gtatacatttgcata

SEQ ID NO: 207859 - DNA, 15 bp, Homo sapiens
agtatacatttgcat

SEQ ID NO: 207860 - DNA, 15 bp, Homo sapiens
aagtatacatttgca

SEQ ID NO: 207861 - DNA, 15 bp, Homo sapiens
aaagtatacatttgc

SEQ ID NO: 207862 - DNA, 15 bp, Homo sapiens
aaaagtatacatttg

SEQ ID NO: 207863 - DNA, 15 bp, Homo sapiens
taaaagtatacattt

SEQ ID NO: 207864 - DNA, 15 bp, Homo sapiens
gtaaaagtatacatt

SEQ ID NO: 207865 - DNA, 15 bp, Homo sapiens
agtaaaagtatacat

SEQ ID NO: 207866 - DNA, 15 bp, Homo sapiens
gagtaaaagtataca

SEQ ID NO: 207867 - DNA, 15 bp, Homo sapiens
agagtaaaagtatac

SEQ ID NO: 207868 - DNA, 15 bp, Homo sapiens
cagagtaaaagtata

SEQ ID NO: 207869 - DNA, 15 bp, Homo sapiens
tcagagtaaaagtat

SEQ ID NO: 207870 - DNA, 15 bp, Homo sapiens
atcagagtaaaagta

SEQ ID NO: 207871 - DNA, 15 bp, Homo sapiens
gatcagagtaaaagt

SEQ ID NO: 207872 - DNA, 15 bp, Homo sapiens
tgatcagagtaaaag

SEQ ID NO: 207873 - DNA, 15 bp, Homo sapiens
ctgatcagagtaaaa

SEQ ID NO: 207874 - DNA, 15 bp, Homo sapiens
gctgatcagagtaaa

SEQ ID NO: 207875 - DNA, 15 bp, Homo sapiens
ggctgatcagagtaa

SEQ ID NO: 207876 - DNA, 15 bp, Homo sapiens
tggctgatcagagta

SEQ ID NO: 207877 - DNA, 15 bp, Homo sapiens
ttggctgatcagagt

SEQ ID NO: 207878 - DNA, 15 bp, Homo sapiens
tttggctgatcagag

SEQ ID NO: 207879 - DNA, 15 bp, Homo sapiens
ttttggctgatcaga

SEQ ID NO: 207880 - DNA, 15 bp, Homo sapiens
cttttggctgatcag

SEQ ID NO: 207881 - DNA, 15 bp, Homo sapiens
tcttttggctgatca

SEQ ID NO: 207882 - DNA, 15 bp, Homo sapiens
atcttttggctgatc

SEQ ID NO: 207883 - DNA, 15 bp, Homo sapiens
tatcttttggctgat

SEQ ID NO: 207884 - DNA, 15 bp, Homo sapiens
atatcttttggctga

SEQ ID NO: 207885 - DNA, 15 bp, Homo sapiens
catatcttttggctg

SEQ ID NO: 207886 - DNA, 15 bp, Homo sapiens
gcatatcttttggct

SEQ ID NO: 207887 - DNA, 15 bp, Homo sapiens
agcatatcttttggc

SEQ ID NO: 207888 - DNA, 15 bp, Homo sapiens
cagcatatcttttgg

SEQ ID NO: 207889 - DNA, 15 bp, Homo sapiens
tcagcatatcttttg

SEQ ID NO: 207890 - DNA, 15 bp, Homo sapiens
ttcagcatatctttt

SEQ ID NO: 207891 - DNA, 15 bp, Homo sapiens
tttcagcatatcttt

SEQ ID NO: 207892 - DNA, 15 bp, Homo sapiens
atttcagcatatctt

SEQ ID NO: 207893 - DNA, 15 bp, Homo sapiens
catttcagcatatct

SEQ ID NO: 207894 - DNA, 15 bp, Homo sapiens
acatttcagcatatc

SEQ ID NO: 207895 - DNA, 15 bp, Homo sapiens
aacatttcagcatat

SEQ ID NO: 207896 - DNA, 15 bp, Homo sapiens
taacatttcagcata

SEQ ID NO: 207897 - DNA, 15 bp, Homo sapiens
ataacatttcagcat

SEQ ID NO: 207898 - DNA, 15 bp, Homo sapiens
gataacatttcagca

SEQ ID NO: 207899 - DNA, 15 bp, Homo sapiens
tgataacatttcagc

SEQ ID NO: 207900 - DNA, 15 bp, Homo sapiens
ttgataacatttcag

SEQ ID NO: 207901 - DNA, 15 bp, Homo sapiens
gttgataacatttca

SEQ ID NO: 207902 - DNA, 15 bp, Homo sapiens
agttgataacatttc

SEQ ID NO: 207903 - DNA, 15 bp, Homo sapiens
cagttgataacattt

SEQ ID NO: 207904 - DNA, 15 bp, Homo sapiens
tcagttgataacatt

SEQ ID NO: 207905 - DNA, 15 bp, Homo sapiens
gtcagttgataacat

SEQ ID NO: 207906 - DNA, 15 bp, Homo sapiens
tgtcagttgataaca

SEQ ID NO: 207907 - DNA, 15 bp, Homo sapiens
gtgtcagttgataac

SEQ ID NO: 207908 - DNA, 15 bp, Homo sapiens
tgtgtcagttgataa

SEQ ID NO: 207909 - DNA, 15 bp, Homo sapiens
atgtgtcagttgata

SEQ ID NO: 207910 - DNA, 15 bp, Homo sapiens
aatgtgtcagttgat

SEQ ID NO: 207911 - DNA, 15 bp, Homo sapiens
taatgtgtcagttga

SEQ ID NO: 207912 - DNA, 15 bp, Homo sapiens
ttaatgtgtcagttg

SEQ ID NO: 207913 - DNA, 15 bp, Homo sapiens
attaatgtgtcagtt

SEQ ID NO: 207914 - DNA, 15 bp, Homo sapiens
gattaatgtgtcagt

SEQ ID NO: 207915 - DNA, 15 bp, Homo sapiens
ggattaatgtgtcag

SEQ ID NO: 207916 - DNA, 15 bp, Homo sapiens
aggattaatgtgtca

SEQ ID NO: 207917 - DNA, 15 bp, Homo sapiens
aaggattaatgtgtc

SEQ ID NO: 207918 - DNA, 15 bp, Homo sapiens
taaggattaatgtgt

SEQ ID NO: 207919 - DNA, 15 bp, Homo sapiens
ctaaggattaatgtg

SEQ ID NO: 207920 - DNA, 15 bp, Homo sapiens
tctaaggattaatgt

SEQ ID NO: 207921 - DNA, 15 bp, Homo sapiens
atctaaggattaatg

SEQ ID NO: 207922 - DNA, 15 bp, Homo sapiens
gatctaaggattaat

SEQ ID NO: 207923 - DNA, 15 bp, Homo sapiens
ggatctaaggattaa

SEQ ID NO: 207924 - DNA, 15 bp, Homo sapiens
aggatctaaggatta

SEQ ID NO: 207925 - DNA, 15 bp, Homo sapiens
aaggatctaaggatt

SEQ ID NO: 207926 - DNA, 15 bp, Homo sapiens
caaggatctaaggat

SEQ ID NO: 207927 - DNA, 15 bp, Homo sapiens
acaaggatctaagga

SEQ ID NO: 207928 - DNA, 15 bp, Homo sapiens
cacaaggatctaagg

SEQ ID NO: 207929 - DNA, 15 bp, Homo sapiens
acacaaggatctaag

SEQ ID NO: 207930 - DNA, 15 bp, Homo sapiens
cacacaaggatctaa

SEQ ID NO: 207931 - DNA, 15 bp, Homo sapiens
tcacacaaggatcta

SEQ ID NO: 207932 - DNA, 15 bp, Homo sapiens
atcacacaaggatct

SEQ ID NO: 207933 - DNA, 15 bp, Homo sapiens
aatcacacaaggatc

SEQ ID NO: 207934 - DNA, 15 bp, Homo sapiens
taatcacacaaggat

SEQ ID NO: 207935 - DNA, 15 bp, Homo sapiens
ttaatcacacaagga

SEQ ID NO: 207936 - DNA, 15 bp, Homo sapiens
tttaatcacacaagg

SEQ ID NO: 207937 - DNA, 15 bp, Homo sapiens
atttaatcacacaag

SEQ ID NO: 207938 - DNA, 15 bp, Homo sapiens
aatttaatcacacaa

SEQ ID NO: 207939 - DNA, 15 bp, Homo sapiens
aaatttaatcacaca

SEQ ID NO: 207940 - DNA, 15 bp, Homo sapiens
caaatttaatcacac

SEQ ID NO: 207941 - DNA, 15 bp, Homo sapiens
acaaatttaatcaca

SEQ ID NO: 207942 - DNA, 15 bp, Homo sapiens
cacaaatttaatcac

SEQ ID NO: 207943 - DNA, 15 bp, Homo sapiens
gcacaaatttaatca

SEQ ID NO: 207944 - DNA, 15 bp, Homo sapiens
ggcacaaatttaatc

SEQ ID NO: 207945 - DNA, 15 bp, Homo sapiens
aggcacaaatttaat

SEQ ID NO: 207946 - DNA, 15 bp, Homo sapiens
aaggcacaaatttaa

SEQ ID NO: 207947 - DNA, 15 bp, Homo sapiens
caaggcacaaattta

SEQ ID NO: 207948 - DNA, 15 bp, Homo sapiens
acaaggcacaaattt

SEQ ID NO: 207949 - DNA, 15 bp, Homo sapiens
aacaaggcacaaatt

SEQ ID NO: 207950 - DNA, 15 bp, Homo sapiens
gaacaaggcacaaat

SEQ ID NO: 207951 - DNA, 15 bp, Homo sapiens
tgaacaaggcacaaa

SEQ ID NO: 207952 - DNA, 15 bp, Homo sapiens
gtgaacaaggcacaa

SEQ ID NO: 207953 - DNA, 15 bp, Homo sapiens
agtgaacaaggcaca

SEQ ID NO: 207954 - DNA, 15 bp, Homo sapiens
aagtgaacaaggcac

SEQ ID NO: 207955 - DNA, 15 bp, Homo sapiens
aaagtgaacaaggca

SEQ ID NO: 207956 - DNA, 15 bp, Homo sapiens
gaaagtgaacaaggc

SEQ ID NO: 207957 - DNA, 15 bp, Homo sapiens
ggaaagtgaacaagg

SEQ ID NO: 207958 - DNA, 15 bp, Homo sapiens
tggaaagtgaacaag

SEQ ID NO: 207959 - DNA, 15 bp, Homo sapiens
atggaaagtgaacaa

SEQ ID NO: 207960 - DNA, 15 bp, Homo sapiens
aatggaaagtgaaca

SEQ ID NO: 207961 - DNA, 15 bp, Homo sapiens
caatggaaagtgaac

SEQ ID NO: 207962 - DNA, 15 bp, Homo sapiens
tcaatggaaagtgaa

SEQ ID NO: 207963 - DNA, 15 bp, Homo sapiens
atcaatggaaagtga

SEQ ID NO: 207964 - DNA, 15 bp, Homo sapiens
aatcaatggaaagtg

SEQ ID NO: 207965 - DNA, 15 bp, Homo sapiens
aaatcaatggaaagt

SEQ ID NO: 207966 - DNA, 15 bp, Homo sapiens
gaaatcaatggaaag

SEQ ID NO: 207967 - DNA, 15 bp, Homo sapiens
agaaatcaatggaaa

SEQ ID NO: 207968 - DNA, 15 bp, Homo sapiens
aagaaatcaatggaa

SEQ ID NO: 207969 - DNA, 15 bp, Homo sapiens
aaagaaatcaatgga

SEQ ID NO: 207970 - DNA, 15 bp, Homo sapiens
taaagaaatcaatgg

SEQ ID NO: 207971 - DNA, 15 bp, Homo sapiens
ttaaagaaatcaatg

SEQ ID NO: 207972 - DNA, 15 bp, Homo sapiens
attaaagaaatcaat

SEQ ID NO: 207973 - DNA, 15 bp, Homo sapiens
tattaaagaaatcaa

SEQ ID NO: 207974 - DNA, 15 bp, Homo sapiens
atattaaagaaatca

SEQ ID NO: 207975 - DNA, 15 bp, Homo sapiens
gatattaaagaaatc

SEQ ID NO: 207976 - DNA, 15 bp, Homo sapiens
agatattaaagaaat

SEQ ID NO: 207977 - DNA, 15 bp, Homo sapiens
gagatattaaagaaa

SEQ ID NO: 207978 - DNA, 15 bp, Homo sapiens
agagatattaaagaa

SEQ ID NO: 207979 - DNA, 15 bp, Homo sapiens
aagagatattaaaga

SEQ ID NO: 207980 - DNA, 15 bp, Homo sapiens
aaagagatattaaag

SEQ ID NO: 207981 - DNA, 15 bp, Homo sapiens
taaagagatattaaa

SEQ ID NO: 207982 - DNA, 15 bp, Homo sapiens
ataaagagatattaa

SEQ ID NO: 207983 - DNA, 15 bp, Homo sapiens
cataaagagatatta

SEQ ID NO: 207984 - DNA, 15 bp, Homo sapiens
gcataaagagatatt

SEQ ID NO: 207985 - DNA, 15 bp, Homo sapiens
ggcataaagagatat

SEQ ID NO: 207986 - DNA, 15 bp, Homo sapiens
gggcataaagagata

SEQ ID NO: 207987 - DNA, 15 bp, Homo sapiens
tgggcataaagagat

SEQ ID NO: 207988 - DNA, 15 bp, Homo sapiens
atgggcataaagaga

SEQ ID NO: 207989 - DNA, 15 bp, Homo sapiens
aatgggcataaagag

SEQ ID NO: 207990 - DNA, 15 bp, Homo sapiens
aaatgggcataaaga

SEQ ID NO: 207991 - DNA, 15 bp, Homo sapiens
aaaatgggcataaag

SEQ ID NO: 207992 - DNA, 15 bp, Homo sapiens
gaaaatgggcataaa

SEQ ID NO: 207993 - DNA, 15 bp, Homo sapiens
agaaaatgggcataa

SEQ ID NO: 207994 - DNA, 15 bp, Homo sapiens
aagaaaatgggcata

SEQ ID NO: 207995 - DNA, 15 bp, Homo sapiens
caagaaaatgggcat

SEQ ID NO: 207996 - DNA, 15 bp, Homo sapiens
acaagaaaatgggca

SEQ ID NO: 207997 - DNA, 15 bp, Homo sapiens
tacaagaaaatgggc

SEQ ID NO: 207998 - DNA, 15 bp, Homo sapiens
atacaagaaaatggg

SEQ ID NO: 207999 - DNA, 15 bp, Homo sapiens
tatacaagaaaatgg

SEQ ID NO: 208000 - DNA, 15 bp, Homo sapiens
atatacaagaaaatg

SEQ ID NO: 208001 - DNA, 15 bp, Homo sapiens
tatatacaagaaaat

SEQ ID NO: 208002 - DNA, 15 bp, Homo sapiens
gtatatacaagaaaa

SEQ ID NO: 208003 - DNA, 15 bp, Homo sapiens
tgtatatacaagaaa

SEQ ID NO: 208004 - DNA, 15 bp, Homo sapiens
atgtatatacaagaa

SEQ ID NO: 208005 - DNA, 15 bp, Homo sapiens
tatgtatatacaaga

SEQ ID NO: 208006 - DNA, 15 bp, Homo sapiens
atatgtatatacaag

SEQ ID NO: 208007 - DNA, 15 bp, Homo sapiens
gatatgtatatacaa

SEQ ID NO: 208008 - DNA, 15 bp, Homo sapiens
tgatatgtatataca

SEQ ID NO: 208009 - DNA, 15 bp, Homo sapiens
atgatatgtatatac

SEQ ID NO: 208010 - DNA, 15 bp, Homo sapiens
gatgatatgtatata

SEQ ID NO: 208011 - DNA, 15 bp, Homo sapiens
agatgatatgtatat

SEQ ID NO: 208012 - DNA, 15 bp, Homo sapiens
aagatgatatgtata

SEQ ID NO: 208013 - DNA, 15 bp, Homo sapiens
taagatgatatgtat

SEQ ID NO: 208014 - DNA, 15 bp, Homo sapiens
ataagatgatatgta

SEQ ID NO: 208015 - DNA, 15 bp, Homo sapiens
aataagatgatatgt

SEQ ID NO: 208016 - DNA, 15 bp, Homo sapiens
aaataagatgatatg

SEQ ID NO: 208017 - DNA, 15 bp, Homo sapiens
aaaataagatgatat

SEQ ID NO: 208018 - DNA, 15 bp, Homo sapiens
acaataaaataagat

SEQ ID NO: 208019 - DNA, 15 bp, Homo sapiens
tacaataaaataaga

SEQ ID NO: 208020 - DNA, 15 bp, Homo sapiens
atacaataaaataag

SEQ ID NO: 208021 - DNA, 15 bp, Homo sapiens
aatacaataaaataa

SEQ ID NO: 208022 - DNA, 15 bp, Homo sapiens
aaatacaataaaata

SEQ ID NO: 208023 - DNA, 15 bp, Homo sapiens
aaaatacaataaaat

SEQ ID NO: 208024 - DNA, 15 bp, Homo sapiens
aaaaatacaataaaa

SEQ ID NO: 208025 - DNA, 15 bp, Homo sapiens
gaaaaatacaataaa

SEQ ID NO: 208026 - DNA, 15 bp, Homo sapiens
tgaaaaatacaataa

SEQ ID NO: 208027 - DNA, 15 bp, Homo sapiens
gtgaaaaatacaata

SEQ ID NO: 208028 - DNA, 15 bp, Homo sapiens
agtgaaaaatacaat

SEQ ID NO: 208029 - DNA, 15 bp, Homo sapiens
gagtgaaaaatacaa

SEQ ID NO: 208030 - DNA, 15 bp, Homo sapiens
ggagtgaaaaataca

SEQ ID NO: 208031 - DNA, 15 bp, Homo sapiens
aggagtgaaaaatac

SEQ ID NO: 208032 - DNA, 15 bp, Homo sapiens
gaggagtgaaaaata

SEQ ID NO: 208033 - DNA, 15 bp, Homo sapiens
ggaggagtgaaaaat

SEQ ID NO: 208034 - DNA, 15 bp, Homo sapiens
gggaggagtgaaaaa

SEQ ID NO: 208035 - DNA, 15 bp, Homo sapiens
tgggaggagtgaaaa

SEQ ID NO: 208036 - DNA, 15 bp, Homo sapiens
atgggaggagtgaaa

SEQ ID NO: 208037 - DNA, 15 bp, Homo sapiens
catgggaggagtgaa

SEQ ID NO: 208038 - DNA, 15 bp, Homo sapiens
acatgggaggagtga

SEQ ID NO: 208039 - DNA, 15 bp, Homo sapiens
tacatgggaggagtg

SEQ ID NO: 208040 - DNA, 15 bp, Homo sapiens
ttacatgggaggagt

SEQ ID NO: 208041 - DNA, 15 bp, Homo sapiens
attacatgggaggag

SEQ ID NO: 208042 - DNA, 15 bp, Homo sapiens
cattacatgggagga

SEQ ID NO: 208043 - DNA, 15 bp, Homo sapiens
tcattacatgggagg

SEQ ID NO: 208044 - DNA, 15 bp, Homo sapiens
ttcattacatgggag

SEQ ID NO: 208045 - DNA, 15 bp, Homo sapiens
tttcattacatggga

SEQ ID NO: 208046 - DNA, 15 bp, Homo sapiens
ctttcattacatggg

SEQ ID NO: 208047 - DNA, 15 bp, Homo sapiens
actttcattacatgg

SEQ ID NO: 208048 - DNA, 15 bp, Homo sapiens
aactttcattacatg

SEQ ID NO: 208049 - DNA, 15 bp, Homo sapiens
gaactttcattacat

SEQ ID NO: 208050 - DNA, 15 bp, Homo sapiens
agaactttcattaca

SEQ ID NO: 208051 - DNA, 15 bp, Homo sapiens
gagaactttcattac

SEQ ID NO: 208052 - DNA, 15 bp, Homo sapiens
tgagaactttcatta

SEQ ID NO: 208053 - DNA, 15 bp, Homo sapiens
atgagaactttcatt

SEQ ID NO: 208054 - DNA, 15 bp, Homo sapiens
aatgagaactttcat

SEQ ID NO: 208055 - DNA, 15 bp, Homo sapiens
gaatgagaactttca

SEQ ID NO: 208056 - DNA, 15 bp, Homo sapiens
agaatgagaactttc

SEQ ID NO: 208057 - DNA, 15 bp, Homo sapiens
tagaatgagaacttt

SEQ ID NO: 208058 - DNA, 15 bp, Homo sapiens
ttagaatgagaactt

SEQ ID NO: 208059 - DNA, 15 bp, Homo sapiens
tttagaatgagaact

SEQ ID NO: 208060 - DNA, 15 bp, Homo sapiens
atttagaatgagaac

SEQ ID NO: 208061 - DNA, 15 bp, Homo sapiens
gatttagaatgagaa

SEQ ID NO: 208062 - DNA, 15 bp, Homo sapiens
agatttagaatgaga

SEQ ID NO: 208063 - DNA, 15 bp, Homo sapiens
cagatttagaatgag

SEQ ID NO: 208064 - DNA, 15 bp, Homo sapiens
ccagatttagaatga

SEQ ID NO: 208065 - DNA, 15 bp, Homo sapiens
accagatttagaatg

SEQ ID NO: 208066 - DNA, 15 bp, Homo sapiens
gaccagatttagaat

SEQ ID NO: 208067 - DNA, 15 bp, Homo sapiens
tgaccagatttagaa

SEQ ID NO: 208068 - DNA, 15 bp, Homo sapiens
atgaccagatttaga

SEQ ID NO: 208069 - DNA, 15 bp, Homo sapiens
aatgaccagatttag

SEQ ID NO: 208070 - DNA, 15 bp, Homo sapiens
aaatgaccagattta

SEQ ID NO: 208071 - DNA, 15 bp, Homo sapiens
aaaatgaccagattt

SEQ ID NO: 208072 - DNA, 15 bp, Homo sapiens
taaaatgaccagatt

SEQ ID NO: 208073 - DNA, 15 bp, Homo sapiens
ttaaaatgaccagat

SEQ ID NO: 208074 - DNA, 15 bp, Homo sapiens
cttaaaatgaccaga

SEQ ID NO: 208075 - DNA, 15 bp, Homo sapiens
ccttaaaatgaccag

SEQ ID NO: 208076 - DNA, 15 bp, Homo sapiens
accttaaaatgacca

SEQ ID NO: 208077 - DNA, 15 bp, Homo sapiens
caccttaaaatgacc

SEQ ID NO: 208078 - DNA, 15 bp, Homo sapiens
tcaccttaaaatgac

SEQ ID NO: 208079 - DNA, 15 bp, Homo sapiens
gtcaccttaaaatga

SEQ ID NO: 208080 - DNA, 15 bp, Homo sapiens
tgtcaccttaaaatg

SEQ ID NO: 208081 - DNA, 15 bp, Homo sapiens
gtgtcaccttaaaat

SEQ ID NO: 208082 - DNA, 15 bp, Homo sapiens
agtgtcaccttaaaa

SEQ ID NO: 208083 - DNA, 15 bp, Homo sapiens
tagtgtcaccttaaa

SEQ ID NO: 208084 - DNA, 15 bp, Homo sapiens
atagtgtcaccttaa

SEQ ID NO: 208085 - DNA, 15 bp, Homo sapiens
catagtgtcacctta

SEQ ID NO: 208086 - DNA, 15 bp, Homo sapiens
tcatagtgtcacctt

SEQ ID NO: 208087 - DNA, 15 bp, Homo sapiens
atcatagtgtcacct

SEQ ID NO: 208088 - DNA, 15 bp, Homo sapiens
aatcatagtgtcacc

SEQ ID NO: 208089 - DNA, 15 bp, Homo sapiens
gaatcatagtgtcac

SEQ ID NO: 208090 - DNA, 15 bp, Homo sapiens
agaatcatagtgtca

SEQ ID NO: 208091 - DNA, 15 bp, Homo sapiens
tagaatcatagtgtc

SEQ ID NO: 208092 - DNA, 15 bp, Homo sapiens
atagaatcatagtgt

SEQ ID NO: 208093 - DNA, 15 bp, Homo sapiens
aatagaatcatagtg

SEQ ID NO: 208094 - DNA, 15 bp, Homo sapiens
aaatagaatcatagt

SEQ ID NO: 208095 - DNA, 15 bp, Homo sapiens
gaaatagaatcatag

SEQ ID NO: 208096 - DNA, 15 bp, Homo sapiens
ggaaatagaatcata

SEQ ID NO: 208097 - DNA, 15 bp, Homo sapiens
tggaaatagaatcat

SEQ ID NO: 208098 - DNA, 15 bp, Homo sapiens
atggaaatagaatca

SEQ ID NO: 208099 - DNA, 15 bp, Homo sapiens
aatggaaatagaatc

SEQ ID NO: 208100 - DNA, 15 bp, Homo sapiens
aaatggaaatagaat

SEQ ID NO: 208101 - DNA, 15 bp, Homo sapiens
aaaatggaaatagaa

SEQ ID NO: 208102 - DNA, 15 bp, Homo sapiens
taaaatggaaataga

SEQ ID NO: 208103 - DNA, 15 bp, Homo sapiens
ttaaaatggaaatag

SEQ ID NO: 208104 - DNA, 15 bp, Homo sapiens
tttaaaatggaaata

SEQ ID NO: 208105 - DNA, 15 bp, Homo sapiens
ttttaaaatggaaat

SEQ ID NO: 208106 - DNA, 15 bp, Homo sapiens
tttttaaaatggaaa

SEQ ID NO: 208107 - DNA, 15 bp, Homo sapiens
atttttaaaatggaa

SEQ ID NO: 208108 - DNA, 15 bp, Homo sapiens
catttttaaaatgga

SEQ ID NO: 208109 - DNA, 15 bp, Homo sapiens
tcatttttaaaatgg

SEQ ID NO: 208110 - DNA, 15 bp, Homo sapiens
gtcatttttaaaatg

SEQ ID NO: 208111 - DNA, 15 bp, Homo sapiens
tgtcatttttaaaat

SEQ ID NO: 208112 - DNA, 15 bp, Homo sapiens
ttgtcatttttaaaa

SEQ ID NO: 208113 - DNA, 15 bp, Homo sapiens
tttgtcatttttaaa

SEQ ID NO: 208114 - DNA, 15 bp, Homo sapiens
gtttgtcatttttaa

SEQ ID NO: 208115 - DNA, 15 bp, Homo sapiens
tgtttgtcattttta

SEQ ID NO: 208116 - DNA, 15 bp, Homo sapiens
gtgtttgtcattttt

SEQ ID NO: 208117 - DNA, 15 bp, Homo sapiens
cgtgtttgtcatttt

SEQ ID NO: 208118 - DNA, 15 bp, Homo sapiens
tcgtgtttgtcattt

SEQ ID NO: 208119 - DNA, 15 bp, Homo sapiens
ttcgtgtttgtcatt

SEQ ID NO: 208120 - DNA, 15 bp, Homo sapiens
attcgtgtttgtcat

SEQ ID NO: 208121 - DNA, 15 bp, Homo sapiens
cattcgtgtttgtca

SEQ ID NO: 208122 - DNA, 15 bp, Homo sapiens
gcattcgtgtttgtc

SEQ ID NO: 208123 - DNA, 15 bp, Homo sapiens
tgcattcgtgtttgt

SEQ ID NO: 208124 - DNA, 15 bp, Homo sapiens
gtgcattcgtgtttg

SEQ ID NO: 208125 - DNA, 15 bp, Homo sapiens
tgtgcattcgtgttt

SEQ ID NO: 208126 - DNA, 15 bp, Homo sapiens
gtgtgcattcgtgtt

SEQ ID NO: 208127 - DNA, 15 bp, Homo sapiens
tgtgtgcattcgtgt

SEQ ID NO: 208128 - DNA, 15 bp, Homo sapiens
atgtgtgcattcgtg

SEQ ID NO: 208129 - DNA, 15 bp, Homo sapiens
gatgtgtgcattcgt

SEQ ID NO: 208130 - DNA, 15 bp, Homo sapiens
agatgtgtgcattcg

SEQ ID NO: 208131 - DNA, 15 bp, Homo sapiens
gagatgtgtgcattc

SEQ ID NO: 208132 - DNA, 15 bp, Homo sapiens
ggagatgtgtgcatt

SEQ ID NO: 208133 - DNA, 15 bp, Homo sapiens
aggagatgtgtgcat

SEQ ID NO: 208134 - DNA, 15 bp, Homo sapiens
taggagatgtgtgca

SEQ ID NO: 208135 - DNA, 15 bp, Homo sapiens
ttaggagatgtgtgc

SEQ ID NO: 208136 - DNA, 15 bp, Homo sapiens
tttaggagatgtgtg

SEQ ID NO: 208137 - DNA, 15 bp, Homo sapiens
ctttaggagatgtgt

SEQ ID NO: 208138 - DNA, 15 bp, Homo sapiens
cctttaggagatgtg

SEQ ID NO: 208139 - DNA, 15 bp, Homo sapiens
tcctttaggagatgt

SEQ ID NO: 208140 - DNA, 15 bp, Homo sapiens
ttcctttaggagatg

SEQ ID NO: 208141 - DNA, 15 bp, Homo sapiens
tttcctttaggagat

SEQ ID NO: 208142 - DNA, 15 bp, Homo sapiens
ttttcctttaggaga

SEQ ID NO: 208143 - DNA, 15 bp, Homo sapiens
attttcctttaggag

SEQ ID NO: 208144 - DNA, 15 bp, Homo sapiens
cattttcctttagga

SEQ ID NO: 208145 - DNA, 15 bp, Homo sapiens
acattttcctttagg

SEQ ID NO: 208146 - DNA, 15 bp, Homo sapiens
gacattttcctttag

SEQ ID NO: 208147 - DNA, 15 bp, Homo sapiens
tgacattttccttta

SEQ ID NO: 208148 - DNA, 15 bp, Homo sapiens
atgacattttccttt

SEQ ID NO: 208149 - DNA, 15 bp, Homo sapiens
aatgacattttcctt

SEQ ID NO: 208150 - DNA, 15 bp, Homo sapiens
aaatgacattttcct

SEQ ID NO: 208151 - DNA, 15 bp, Homo sapiens
taaatgacattttcc

SEQ ID NO: 208152 - DNA, 15 bp, Homo sapiens
ataaatgacattttc

SEQ ID NO: 208153 - DNA, 15 bp, Homo sapiens
cataaatgacatttt

SEQ ID NO: 208154 - DNA, 15 bp, Homo sapiens
acataaatgacattt

SEQ ID NO: 208155 - DNA, 15 bp, Homo sapiens
tacataaatgacatt

SEQ ID NO: 208156 - DNA, 15 bp, Homo sapiens
ttacataaatgacat

SEQ ID NO: 208157 - DNA, 15 bp, Homo sapiens
attacataaatgaca

SEQ ID NO: 208158 - DNA, 15 bp, Homo sapiens
tattacataaatgac

SEQ ID NO: 208159 - DNA, 15 bp, Homo sapiens
ttattacataaatga

SEQ ID NO: 208160 - DNA, 15 bp, Homo sapiens
cttattacataaatg

SEQ ID NO: 208161 - DNA, 15 bp, Homo sapiens
acttattacataaat

SEQ ID NO: 208162 - DNA, 15 bp, Homo sapiens
aacttattacataaa

SEQ ID NO: 208163 - DNA, 15 bp, Homo sapiens
caacttattacataa

SEQ ID NO: 208164 - DNA, 15 bp, Homo sapiens
gcaacttattacata

SEQ ID NO: 208165 - DNA, 15 bp, Homo sapiens
agcaacttattacat

SEQ ID NO: 208166 - DNA, 15 bp, Homo sapiens
aagcaacttattaca

SEQ ID NO: 208167 - DNA, 15 bp, Homo sapiens
aaagcaacttattac

SEQ ID NO: 208168 - DNA, 15 bp, Homo sapiens
taaagcaacttatta

SEQ ID NO: 208169 - DNA, 15 bp, Homo sapiens
ttaaagcaacttatt

SEQ ID NO: 208170 - DNA, 15 bp, Homo sapiens
attaaagcaacttat

SEQ ID NO: 208171 - DNA, 15 bp, Homo sapiens
tattaaagcaactta

SEQ ID NO: 208172 - DNA, 15 bp, Homo sapiens
gtattaaagcaactt

SEQ ID NO: 208173 - DNA, 15 bp, Homo sapiens
tgtattaaagcaact

SEQ ID NO: 208174 - DNA, 15 bp, Homo sapiens
ttgtattaaagcaac

SEQ ID NO: 208175 - DNA, 15 bp, Homo sapiens
tttgtattaaagcaa

SEQ ID NO: 208176 - DNA, 15 bp, Homo sapiens
ttttgtattaaagca

SEQ ID NO: 208177 - DNA, 15 bp, Homo sapiens
attttgtattaaagc

SEQ ID NO: 208178 - DNA, 15 bp, Homo sapiens
cattttgtattaaag

SEQ ID NO: 208179 - DNA, 15 bp, Homo sapiens
tcattttgtattaaa

SEQ ID NO: 208180 - DNA, 15 bp, Homo sapiens
atcattttgtattaa

SEQ ID NO: 208181 - DNA, 15 bp, Homo sapiens
tatcattttgtatta

SEQ ID NO: 208182 - DNA, 15 bp, Homo sapiens
ttatcattttgtatt

SEQ ID NO: 208183 - DNA, 15 bp, Homo sapiens
cttatcattttgtat

SEQ ID NO: 208184 - DNA, 15 bp, Homo sapiens
tcttatcattttgta

SEQ ID NO: 208185 - DNA, 15 bp, Homo sapiens
gtcttatcattttgt

SEQ ID NO: 208186 - DNA, 15 bp, Homo sapiens
ggtcttatcattttg

SEQ ID NO: 208187 - DNA, 15 bp, Homo sapiens
gggtcttatcatttt

SEQ ID NO: 208188 - DNA, 15 bp, Homo sapiens
agggtcttatcattt

SEQ ID NO: 208189 - DNA, 15 bp, Homo sapiens
cagggtcttatcatt

SEQ ID NO: 208190 - DNA, 15 bp, Homo sapiens
tcagggtcttatcat

SEQ ID NO: 208191 - DNA, 15 bp, Homo sapiens
ttcagggtcttatca

SEQ ID NO: 208192 - DNA, 15 bp, Homo sapiens
tttcagggtcttatc

SEQ ID NO: 208193 - DNA, 15 bp, Homo sapiens
atttcagggtcttat

SEQ ID NO: 208194 - DNA, 15 bp, Homo sapiens
aatttcagggtctta

SEQ ID NO: 208195 - DNA, 15 bp, Homo sapiens
aaatttcagggtctt

SEQ ID NO: 208196 - DNA, 15 bp, Homo sapiens
taaatttcagggtct

SEQ ID NO: 208197 - DNA, 15 bp, Homo sapiens
ataaatttcagggtc

SEQ ID NO: 208198 - DNA, 15 bp, Homo sapiens
aataaatttcagggt

SEQ ID NO: 208199 - DNA, 15 bp, Homo sapiens
aaataaatttcaggg

SEQ ID NO: 208200 - DNA, 15 bp, Homo sapiens
taaataaatttcagg

SEQ ID NO: 208201 - DNA, 15 bp, Homo sapiens
ataaataaatttcag

SEQ ID NO: 208202 - DNA, 15 bp, Homo sapiens
aataaataaatttca

SEQ ID NO: 208203 - DNA, 15 bp, Homo sapiens
aaataaataaatttc

SEQ ID NO: 208204 - DNA, 15 bp, Homo sapiens
caaataaataaattt

SEQ ID NO: 208205 - DNA, 15 bp, Homo sapiens
gcaaataaataaatt

SEQ ID NO: 208206 - DNA, 15 bp, Homo sapiens
agcaaataaataaat

SEQ ID NO: 208207 - DNA, 15 bp, Homo sapiens
aagcaaataaataaa

SEQ ID NO: 208208 - DNA, 15 bp, Homo sapiens
aaagcaaataaataa

SEQ ID NO: 208209 - DNA, 15 bp, Homo sapiens
aaaagcaaataaata

SEQ ID NO: 208210 - DNA, 15 bp, Homo sapiens
aaaaagcaaataaat

SEQ ID NO: 208211 - DNA, 15 bp, Homo sapiens
caaaaagcaaataaa

SEQ ID NO: 208212 - DNA, 15 bp, Homo sapiens
tcaaaaagcaaataa

SEQ ID NO: 208213 - DNA, 15 bp, Homo sapiens
ttcaaaaagcaaata

SEQ ID NO: 208214 - DNA, 15 bp, Homo sapiens
gttcaaaaagcaaat

SEQ ID NO: 208215 - DNA, 15 bp, Homo sapiens
ggttcaaaaagcaaa

SEQ ID NO: 208216 - DNA, 15 bp, Homo sapiens
gggttcaaaaagcaa

SEQ ID NO: 208217 - DNA, 15 bp, Homo sapiens
agggttcaaaaagca

SEQ ID NO: 208218 - DNA, 15 bp, Homo sapiens
aagggttcaaaaagc

SEQ ID NO: 208219 - DNA, 15 bp, Homo sapiens
caagggttcaaaaag

SEQ ID NO: 208220 - DNA, 15 bp, Homo sapiens
acaagggttcaaaaa

SEQ ID NO: 208221 - DNA, 15 bp, Homo sapiens
cacaagggttcaaaa

SEQ ID NO: 208222 - DNA, 15 bp, Homo sapiens
tcacaagggttcaaa

SEQ ID NO: 208223 - DNA, 15 bp, Homo sapiens
gtcacaagggttcaa

SEQ ID NO: 208224 - DNA, 15 bp, Homo sapiens
agtcacaagggttca

SEQ ID NO: 208225 - DNA, 15 bp, Homo sapiens
tagtcacaagggttc

SEQ ID NO: 208226 - DNA, 15 bp, Homo sapiens
ctagtcacaagggtt

SEQ ID NO: 208227 - DNA, 15 bp, Homo sapiens
tctagtcacaagggt

SEQ ID NO: 208228 - DNA, 15 bp, Homo sapiens
atctagtcacaaggg

SEQ ID NO: 208229 - DNA, 15 bp, Homo sapiens
aatctagtcacaagg

SEQ ID NO: 208230 - DNA, 15 bp, Homo sapiens
taatctagtcacaag

SEQ ID NO: 208231 - DNA, 15 bp, Homo sapiens
ataatctagtcacaa

SEQ ID NO: 208232 - DNA, 15 bp, Homo sapiens
gataatctagtcaca

SEQ ID NO: 208233 - DNA, 15 bp, Homo sapiens
tgataatctagtcac

SEQ ID NO: 208234 - DNA, 15 bp, Homo sapiens
ttgataatctagtca

SEQ ID NO: 208235 - DNA, 15 bp, Homo sapiens
tttgataatctagtc

SEQ ID NO: 208236 - DNA, 15 bp, Homo sapiens
ttttgataatctagt

SEQ ID NO: 208237 - DNA, 15 bp, Homo sapiens
attttgataatctag

SEQ ID NO: 208238 - DNA, 15 bp, Homo sapiens
aattttgataatcta

SEQ ID NO: 208239 - DNA, 15 bp, Homo sapiens
taattttgataatct

SEQ ID NO: 208240 - DNA, 15 bp, Homo sapiens
gtaattttgataatc

SEQ ID NO: 208241 - DNA, 15 bp, Homo sapiens
ggtaattttgataat

SEQ ID NO: 208242 - DNA, 15 bp, Homo sapiens
tggtaattttgataa

SEQ ID NO: 208243 - DNA, 15 bp, Homo sapiens
atggtaattttgata

SEQ ID NO: 208244 - DNA, 15 bp, Homo sapiens
aatggtaattttgat

SEQ ID NO: 208245 - DNA, 15 bp, Homo sapiens
aaatggtaattttga

SEQ ID NO: 208246 - DNA, 15 bp, Homo sapiens
caaatggtaattttg

SEQ ID NO: 208247 - DNA, 15 bp, Homo sapiens
ccaaatggtaatttt

SEQ ID NO: 208248 - DNA, 15 bp, Homo sapiens
cccaaatggtaattt

SEQ ID NO: 208249 - DNA, 15 bp, Homo sapiens
acccaaatggtaatt

SEQ ID NO: 208250 - DNA, 15 bp, Homo sapiens
cacccaaatggtaat

SEQ ID NO: 208251 - DNA, 15 bp, Homo sapiens
acacccaaatggtaa

SEQ ID NO: 208252 - DNA, 15 bp, Homo sapiens
tacacccaaatggta

SEQ ID NO: 208253 - DNA, 15 bp, Homo sapiens
atacacccaaatggt

SEQ ID NO: 208254 - DNA, 15 bp, Homo sapiens
aatacacccaaatgg

SEQ ID NO: 208255 - DNA, 15 bp, Homo sapiens
aaatacacccaaatg

SEQ ID NO: 208256 - DNA, 15 bp, Homo sapiens
aaaatacacccaaat

SEQ ID NO: 208257 - DNA, 15 bp, Homo sapiens
aaaaatacacccaaa

SEQ ID NO: 208258 - DNA, 15 bp, Homo sapiens
aaaaaatacacccaa

SEQ ID NO: 208259 - DNA, 15 bp, Homo sapiens
aaaaaaatacaccca

SEQ ID NO: 208260 - DNA, 15 bp, Homo sapiens
aaaaaaaatacaccc

SEQ ID NO: 208261 - DNA, 15 bp, Homo sapiens
gaaaaaaaatacacc

SEQ ID NO: 208262 - DNA, 15 bp, Homo sapiens
agaaaaaaaatacac

SEQ ID NO: 208263 - DNA, 15 bp, Homo sapiens
aagaaaaaaaataca

SEQ ID NO: 208264 - DNA, 15 bp, Homo sapiens
aaagaaaaaaaatac

SEQ ID NO: 208265 - DNA, 15 bp, Homo sapiens
gaaagaaaaaaaata

SEQ ID NO: 208266 - DNA, 15 bp, Homo sapiens
agaaagaaaaaaaat

SEQ ID NO: 208267 - DNA, 15 bp, Homo sapiens
tagaaagaaaaaaaa

SEQ ID NO: 208268 - DNA, 15 bp, Homo sapiens
gtagaaagaaaaaaa

SEQ ID NO: 208269 - DNA, 15 bp, Homo sapiens
agtagaaagaaaaaa

SEQ ID NO: 208270 - DNA, 15 bp, Homo sapiens
gagtagaaagaaaaa

SEQ ID NO: 208271 - DNA, 15 bp, Homo sapiens
cgagtagaaagaaaa

SEQ ID NO: 208272 - DNA, 15 bp, Homo sapiens
tcgagtagaaagaaa

SEQ ID NO: 208273 - DNA, 15 bp, Homo sapiens
ttcgagtagaaagaa

SEQ ID NO: 208274 - DNA, 15 bp, Homo sapiens
cttcgagtagaaaga

SEQ ID NO: 208275 - DNA, 15 bp, Homo sapiens
gcttcgagtagaaag

SEQ ID NO: 208276 - DNA, 15 bp, Homo sapiens
tgcttcgagtagaaa

SEQ ID NO: 208277 - DNA, 15 bp, Homo sapiens
ctgcttcgagtagaa

SEQ ID NO: 208278 - DNA, 15 bp, Homo sapiens
cctgcttcgagtaga

SEQ ID NO: 208279 - DNA, 15 bp, Homo sapiens
tcctgcttcgagtag

SEQ ID NO: 208280 - DNA, 15 bp, Homo sapiens
ttcctgcttcgagta

SEQ ID NO: 208281 - DNA, 15 bp, Homo sapiens
attcctgcttcgagt

SEQ ID NO: 208282 - DNA, 15 bp, Homo sapiens
tattcctgcttcgag

SEQ ID NO: 208283 - DNA, 15 bp, Homo sapiens
atattcctgcttcga

SEQ ID NO: 208284 - DNA, 15 bp, Homo sapiens
catattcctgcttcg

SEQ ID NO: 208285 - DNA, 15 bp, Homo sapiens
tcatattcctgcttc

SEQ ID NO: 208286 - DNA, 15 bp, Homo sapiens
atcatattcctgctt

SEQ ID NO: 208287 - DNA, 15 bp, Homo sapiens
tatcatattcctgct

SEQ ID NO: 208288 - DNA, 15 bp, Homo sapiens
ctatcatattcctgc

SEQ ID NO: 208289 - DNA, 15 bp, Homo sapiens
tctatcatattcctg

SEQ ID NO: 208290 - DNA, 15 bp, Homo sapiens
ctctatcatattcct

SEQ ID NO: 208291 - DNA, 15 bp, Homo sapiens
tctctatcatattcc

SEQ ID NO: 208292 - DNA, 15 bp, Homo sapiens
ttctctatcatattc

SEQ ID NO: 208293 - DNA, 15 bp, Homo sapiens
tttctctatcatatt

SEQ ID NO: 208294 - DNA, 15 bp, Homo sapiens
atttctctatcatat

SEQ ID NO: 208295 - DNA, 15 bp, Homo sapiens
tatttctctatcata

SEQ ID NO: 208296 - DNA, 15 bp, Homo sapiens
ctatttctctatcat

SEQ ID NO: 208297 - DNA, 15 bp, Homo sapiens
gctatttctctatca

SEQ ID NO: 208298 - DNA, 15 bp, Homo sapiens
agctatttctctatc

SEQ ID NO: 208299 - DNA, 15 bp, Homo sapiens
gagctatttctctat

SEQ ID NO: 208300 - DNA, 15 bp, Homo sapiens
ggagctatttctcta

SEQ ID NO: 208301 - DNA, 15 bp, Homo sapiens
tggagctatttctct

SEQ ID NO: 208302 - DNA, 15 bp, Homo sapiens
ttggagctatttctc

SEQ ID NO: 208303 - DNA, 15 bp, Homo sapiens
cttggagctatttct

SEQ ID NO: 208304 - DNA, 15 bp, Homo sapiens
tcttggagctatttc

SEQ ID NO: 208305 - DNA, 15 bp, Homo sapiens
atcttggagctattt

SEQ ID NO: 208306 - DNA, 15 bp, Homo sapiens
tatcttggagctatt

SEQ ID NO: 208307 - DNA, 15 bp, Homo sapiens
ttatcttggagctat

SEQ ID NO: 208308 - DNA, 15 bp, Homo sapiens
cttatcttggagcta

SEQ ID NO: 208309 - DNA, 15 bp, Homo sapiens
tcttatcttggagct

SEQ ID NO: 208310 - DNA, 15 bp, Homo sapiens
ttcttatcttggagc

SEQ ID NO: 208311 - DNA, 15 bp, Homo sapiens
tttcttatcttggag

SEQ ID NO: 208312 - DNA, 15 bp, Homo sapiens
ttttcttatcttgga

SEQ ID NO: 208313 - DNA, 15 bp, Homo sapiens
tttttcttatcttgg

SEQ ID NO: 208314 - DNA, 15 bp, Homo sapiens
ctttttcttatcttg

SEQ ID NO: 208315 - DNA, 15 bp, Homo sapiens
cctttttcttatctt

SEQ ID NO: 208316 - DNA, 15 bp, Homo sapiens
tcctttttcttatct

SEQ ID NO: 208317 - DNA, 15 bp, Homo sapiens
ttcctttttcttatc

SEQ ID NO: 208318 - DNA, 15 bp, Homo sapiens
tttcctttttcttat

SEQ ID NO: 208319 - DNA, 15 bp, Homo sapiens
ttttcctttttctta

SEQ ID NO: 208320 - DNA, 15 bp, Homo sapiens
gttttcctttttctt

SEQ ID NO: 208321 - DNA, 15 bp, Homo sapiens
tgttttcctttttct

SEQ ID NO: 208322 - DNA, 15 bp, Homo sapiens
gtgttttcctttttc

SEQ ID NO: 208323 - DNA, 15 bp, Homo sapiens
agtgttttccttttt

SEQ ID NO: 208324 - DNA, 15 bp, Homo sapiens
cagtgttttcctttt

SEQ ID NO: 208325 - DNA, 15 bp, Homo sapiens
acagtgttttccttt

SEQ ID NO: 208326 - DNA, 15 bp, Homo sapiens
aacagtgttttcctt

SEQ ID NO: 208327 - DNA, 15 bp, Homo sapiens
caacagtgttttcct

SEQ ID NO: 208328 - DNA, 15 bp, Homo sapiens
tcaacagtgttttcc

SEQ ID NO: 208329 - DNA, 15 bp, Homo sapiens
atcaacagtgttttc

SEQ ID NO: 208330 - DNA, 15 bp, Homo sapiens
catcaacagtgtttt

SEQ ID NO: 208331 - DNA, 15 bp, Homo sapiens
acatcaacagtgttt

SEQ ID NO: 208332 - DNA, 15 bp, Homo sapiens
tacatcaacagtgtt

SEQ ID NO: 208333 - DNA, 15 bp, Homo sapiens
atacatcaacagtgt

SEQ ID NO: 208334 - DNA, 15 bp, Homo sapiens
catacatcaacagtg

SEQ ID NO: 208335 - DNA, 15 bp, Homo sapiens
tcatacatcaacagt

SEQ ID NO: 208336 - DNA, 15 bp, Homo sapiens
atcatacatcaacag

SEQ ID NO: 208337 - DNA, 15 bp, Homo sapiens
tatcatacatcaaca

SEQ ID NO: 208338 - DNA, 15 bp, Homo sapiens
atatcatacatcaac

SEQ ID NO: 208339 - DNA, 15 bp, Homo sapiens
catatcatacatcaa

SEQ ID NO: 208340 - DNA, 15 bp, Homo sapiens
gcatatcatacatca

SEQ ID NO: 208341 - DNA, 15 bp, Homo sapiens
tgcatatcatacatc

SEQ ID NO: 208342 - DNA, 15 bp, Homo sapiens
ttgcatatcatacat

SEQ ID NO: 208343 - DNA, 15 bp, Homo sapiens
cttgcatatcataca

SEQ ID NO: 208344 - DNA, 15 bp, Homo sapiens
tcttgcatatcatac

SEQ ID NO: 208345 - DNA, 15 bp, Homo sapiens
atcttgcatatcata

SEQ ID NO: 208346 - DNA, 15 bp, Homo sapiens
tatcttgcatatcat

SEQ ID NO: 208347 - DNA, 15 bp, Homo sapiens
ttatcttgcatatca

SEQ ID NO: 208348 - DNA, 15 bp, Homo sapiens
attatcttgcatatc

SEQ ID NO: 208349 - DNA, 15 bp, Homo sapiens
tattatcttgcatat

SEQ ID NO: 208350 - DNA, 15 bp, Homo sapiens
ttattatcttgcata

SEQ ID NO: 208351 - DNA, 15 bp, Homo sapiens
attattatcttgcat

SEQ ID NO: 208352 - DNA, 15 bp, Homo sapiens
tattattatcttgca

SEQ ID NO: 208353 - DNA, 15 bp, Homo sapiens
ttattattatcttgc

SEQ ID NO: 208354 - DNA, 15 bp, Homo sapiens
attattattatcttg

SEQ ID NO: 208355 - DNA, 15 bp, Homo sapiens
tattattattatctt

SEQ ID NO: 208356 - DNA, 15 bp, Homo sapiens
ctattattattatta

SEQ ID NO: 208357 - DNA, 15 bp, Homo sapiens
tctattattattatt

SEQ ID NO: 208358 - DNA, 15 bp, Homo sapiens
ttctattattattat

SEQ ID NO: 208359 - DNA, 15 bp, Homo sapiens
cttctattattatta

SEQ ID NO: 208360 - DNA, 15 bp, Homo sapiens
tcttctattattatt

SEQ ID NO: 208361 - DNA, 15 bp, Homo sapiens
atcttctattattat

SEQ ID NO: 208362 - DNA, 15 bp, Homo sapiens
aatcttctattatta

SEQ ID NO: 208363 - DNA, 15 bp, Homo sapiens
aaatcttctattatt

SEQ ID NO: 208364 - DNA, 15 bp, Homo sapiens
taaatcttctattat

SEQ ID NO: 208365 - DNA, 15 bp, Homo sapiens
ttaaatcttctatta

SEQ ID NO: 208366 - DNA, 15 bp, Homo sapiens
tttaaatcttctatt

SEQ ID NO: 208367 - DNA, 15 bp, Homo sapiens
ttttaaatcttctat

SEQ ID NO: 208368 - DNA, 15 bp, Homo sapiens
attttaaatcttcta

SEQ ID NO: 208369 - DNA, 15 bp, Homo sapiens
cattttaaatcttct

SEQ ID NO: 208370 - DNA, 15 bp, Homo sapiens
tcattttaaatcttc

SEQ ID NO: 208371 - DNA, 15 bp, Homo sapiens
gtcattttaaatctt

SEQ ID NO: 208372 - DNA, 15 bp, Homo sapiens
ggtcattttaaatct

SEQ ID NO: 208373 - DNA, 15 bp, Homo sapiens
cggtcattttaaatc

SEQ ID NO: 208374 - DNA, 15 bp, Homo sapiens
tcggtcattttaaat

SEQ ID NO: 208375 - DNA, 15 bp, Homo sapiens
atcggtcattttaaa

SEQ ID NO: 208376 - DNA, 15 bp, Homo sapiens
aatcggtcattttaa

SEQ ID NO: 208377 - DNA, 15 bp, Homo sapiens
aaatcggtcatttta

SEQ ID NO: 208378 - DNA, 15 bp, Homo sapiens
taaatcggtcatttt

SEQ ID NO: 208379 - DNA, 15 bp, Homo sapiens
ttaaatcggtcattt

SEQ ID NO: 208380 - DNA, 15 bp, Homo sapiens
cttaaatcggtcatt

SEQ ID NO: 208381 - DNA, 15 bp, Homo sapiens
tcttaaatcggtcat

SEQ ID NO: 208382 - DNA, 15 bp, Homo sapiens
ttcttaaatcggtca

SEQ ID NO: 208383 - DNA, 15 bp, Homo sapiens
tttcttaaatcggtc

SEQ ID NO: 208384 - DNA, 15 bp, Homo sapiens
ttttcttaaatcggt

SEQ ID NO: 208385 - DNA, 15 bp, Homo sapiens
attttcttaaatcgg

SEQ ID NO: 208386 - DNA, 15 bp, Homo sapiens
gattttcttaaatcg

SEQ ID NO: 208387 - DNA, 15 bp, Homo sapiens
ggattttcttaaatc

SEQ ID NO: 208388 - DNA, 15 bp, Homo sapiens
aggattttcttaaat

SEQ ID NO: 208389 - DNA, 15 bp, Homo sapiens
taggattttcttaaa

SEQ ID NO: 208390 - DNA, 15 bp, Homo sapiens
ataggattttcttaa

SEQ ID NO: 208391 - DNA, 15 bp, Homo sapiens
aataggattttctta

SEQ ID NO: 208392 - DNA, 15 bp, Homo sapiens
gaataggattttctt

SEQ ID NO: 208393 - DNA, 15 bp, Homo sapiens
agaataggattttct

SEQ ID NO: 208394 - DNA, 15 bp, Homo sapiens
gagaataggattttc

SEQ ID NO: 208395 - DNA, 15 bp, Homo sapiens
agagaataggatttt

SEQ ID NO: 208396 - DNA, 15 bp, Homo sapiens
gagagaataggattt

SEQ ID NO: 208397 - DNA, 15 bp, Homo sapiens
ggagagaataggatt

SEQ ID NO: 208398 - DNA, 15 bp, Homo sapiens
aggagagaataggat

SEQ ID NO: 208399 - DNA, 15 bp, Homo sapiens
taggagagaatagga

SEQ ID NO: 208400 - DNA, 15 bp, Homo sapiens
ttaggagagaatagg

SEQ ID NO: 208401 - DNA, 15 bp, Homo sapiens
gttaggagagaatag

SEQ ID NO: 208402 - DNA, 15 bp, Homo sapiens
agttaggagagaata

SEQ ID NO: 208403 - DNA, 15 bp, Homo sapiens
aagttaggagagaat

SEQ ID NO: 208404 - DNA, 15 bp, Homo sapiens
aaagttaggagagaa

SEQ ID NO: 208405 - DNA, 15 bp, Homo sapiens
aaaagttaggagaga

SEQ ID NO: 208406 - DNA, 15 bp, Homo sapiens
aaaaagttaggagag

SEQ ID NO: 208407 - DNA, 15 bp, Homo sapiens
gaaaaagttaggaga

SEQ ID NO: 208408 - DNA, 15 bp, Homo sapiens
agaaaaagttaggag

SEQ ID NO: 208409 - DNA, 15 bp, Homo sapiens
tagaaaaagttagga

SEQ ID NO: 208410 - DNA, 15 bp, Homo sapiens
ttagaaaaagttagg

SEQ ID NO: 208411 - DNA, 15 bp, Homo sapiens
gttagaaaaagttag

SEQ ID NO: 208412 - DNA, 15 bp, Homo sapiens
agttagaaaaagtta

SEQ ID NO: 208413 - DNA, 15 bp, Homo sapiens
aagttagaaaaagtt

SEQ ID NO: 208414 - DNA, 15 bp, Homo sapiens
aaagttagaaaaagt

SEQ ID NO: 208415 - DNA, 15 bp, Homo sapiens
aaaagttagaaaaag

SEQ ID NO: 208416 - DNA, 15 bp, Homo sapiens
taaaagttagaaaaa

SEQ ID NO: 208417 - DNA, 15 bp, Homo sapiens
gtaaaagttagaaaa

SEQ ID NO: 208418 - DNA, 15 bp, Homo sapiens
agtaaaagttagaaa

SEQ ID NO: 208419 - DNA, 15 bp, Homo sapiens
aagtaaaagttagaa

SEQ ID NO: 208420 - DNA, 15 bp, Homo sapiens
gaagtaaaagttaga

SEQ ID NO: 208421 - DNA, 15 bp, Homo sapiens
agaagtaaaagttag

SEQ ID NO: 208422 - DNA, 15 bp, Homo sapiens
tagaagtaaaagtta

SEQ ID NO: 208423 - DNA, 15 bp, Homo sapiens
atagaagtaaaagtt

SEQ ID NO: 208424 - DNA, 15 bp, Homo sapiens
aatagaagtaaaagt

SEQ ID NO: 208425 - DNA, 15 bp, Homo sapiens
taatagaagtaaaag

SEQ ID NO: 208426 - DNA, 15 bp, Homo sapiens
ttaatagaagtaaaa

SEQ ID NO: 208427 - DNA, 15 bp, Homo sapiens
attaatagaagtaaa

SEQ ID NO: 208428 - DNA, 15 bp, Homo sapiens
aattaatagaagtaa

SEQ ID NO: 208429 - DNA, 15 bp, Homo sapiens
taattaatagaagta

SEQ ID NO: 208430 - DNA, 15 bp, Homo sapiens
ataattaatagaagt

SEQ ID NO: 208431 - DNA, 15 bp, Homo sapiens
aataattaatagaag

SEQ ID NO: 208432 - DNA, 15 bp, Homo sapiens
gaataattaatagaa

SEQ ID NO: 208433 - DNA, 15 bp, Homo sapiens
tgaataattaataga

SEQ ID NO: 208434 - DNA, 15 bp, Homo sapiens
atgaataattaatag

SEQ ID NO: 208435 - DNA, 15 bp, Homo sapiens
tatgaataattaata

SEQ ID NO: 208436 - DNA, 15 bp, Homo sapiens
gtatgaataattaat

SEQ ID NO: 208437 - DNA, 15 bp, Homo sapiens
tgtatgaataattaa

SEQ ID NO: 208438 - DNA, 15 bp, Homo sapiens
ctgtatgaataatta

SEQ ID NO: 208439 - DNA, 15 bp, Homo sapiens
actgtatgaataatt

SEQ ID NO: 208440 - DNA, 15 bp, Homo sapiens
tactgtatgaataat

SEQ ID NO: 208441 - DNA, 15 bp, Homo sapiens
ctactgtatgaataa

SEQ ID NO: 208442 - DNA, 15 bp, Homo sapiens
actactgtatgaata

SEQ ID NO: 208443 - DNA, 15 bp, Homo sapiens
gactactgtatgaat

SEQ ID NO: 208444 - DNA, 15 bp, Homo sapiens
ggactactgtatgaa

SEQ ID NO: 208445 - DNA, 15 bp, Homo sapiens
gggactactgtatga

SEQ ID NO: 208446 - DNA, 15 bp, Homo sapiens
agggactactgtatg

SEQ ID NO: 208447 - DNA, 15 bp, Homo sapiens
aagggactactgtat

SEQ ID NO: 208448 - DNA, 15 bp, Homo sapiens
aaagggactactgta

SEQ ID NO: 208449 - DNA, 15 bp, Homo sapiens
aaaagggactactgt

SEQ ID NO: 208450 - DNA, 15 bp, Homo sapiens
aaaaagggactactg

SEQ ID NO: 208451 - DNA, 15 bp, Homo sapiens
caaaaagggactact

SEQ ID NO: 208452 - DNA, 15 bp, Homo sapiens
acaaaaagggactac

SEQ ID NO: 208453 - DNA, 15 bp, Homo sapiens
cacaaaaagggacta

SEQ ID NO: 208454 - DNA, 15 bp, Homo sapiens
ccacaaaaagggact

SEQ ID NO: 208455 - DNA, 15 bp, Homo sapiens
cccacaaaaagggac

SEQ ID NO: 208456 - DNA, 15 bp, Homo sapiens
acccacaaaaaggga

SEQ ID NO: 208457 - DNA, 15 bp, Homo sapiens
aacccacaaaaaggg

SEQ ID NO: 208458 - DNA, 15 bp, Homo sapiens
taacccacaaaaagg

SEQ ID NO: 208459 - DNA, 15 bp, Homo sapiens
gtaacccacaaaaag

SEQ ID NO: 208460 - DNA, 15 bp, Homo sapiens
tgtaacccacaaaaa

SEQ ID NO: 208461 - DNA, 15 bp, Homo sapiens
ctgtaacccacaaaa

SEQ ID NO: 208462 - DNA, 15 bp, Homo sapiens
actgtaacccacaaa

SEQ ID NO: 208463 - DNA, 15 bp, Homo sapiens
tactgtaacccacaa

SEQ ID NO: 208464 - DNA, 15 bp, Homo sapiens
atactgtaacccaca

SEQ ID NO: 208465 - DNA, 15 bp, Homo sapiens
aatactgtaacccac

SEQ ID NO: 208466 - DNA, 15 bp, Homo sapiens
taatactgtaaccca

SEQ ID NO: 208467 - DNA, 15 bp, Homo sapiens
ctaatactgtaaccc

SEQ ID NO: 208468 - DNA, 15 bp, Homo sapiens
cctaatactgtaacc

SEQ ID NO: 208469 - DNA, 15 bp, Homo sapiens
ccctaatactgtaac

SEQ ID NO: 208470 - DNA, 15 bp, Homo sapiens
tccctaatactgtaa

SEQ ID NO: 208471 - DNA, 15 bp, Homo sapiens
atccctaatactgta

SEQ ID NO: 208472 - DNA, 15 bp, Homo sapiens
catccctaatactgt

SEQ ID NO: 208473 - DNA, 15 bp, Homo sapiens
tcatccctaatactg

SEQ ID NO: 208474 - DNA, 15 bp, Homo sapiens
ttcatccctaatact

SEQ ID NO: 208475 - DNA, 15 bp, Homo sapiens
tttcatccctaatac

SEQ ID NO: 208476 - DNA, 15 bp, Homo sapiens
gtttcatccctaata

SEQ ID NO: 208477 - DNA, 15 bp, Homo sapiens
tgtttcatccctaat

SEQ ID NO: 208478 - DNA, 15 bp, Homo sapiens
ctgtttcatccctaa

SEQ ID NO: 208479 - DNA, 15 bp, Homo sapiens
tctgtttcatcccta

SEQ ID NO: 208480 - DNA, 15 bp, Homo sapiens
ttctgtttcatccct

SEQ ID NO: 208481 - DNA, 15 bp, Homo sapiens
attctgtttcatccc

SEQ ID NO: 208482 - DNA, 15 bp, Homo sapiens
tattctgtttcatcc

SEQ ID NO: 208483 - DNA, 15 bp, Homo sapiens
ttattctgtttcatc

SEQ ID NO: 208484 - DNA, 15 bp, Homo sapiens
gttattctgtttcat

SEQ ID NO: 208485 - DNA, 15 bp, Homo sapiens
tgttattctgtttca

SEQ ID NO: 208486 - DNA, 15 bp, Homo sapiens
gtgttattctgtttc

SEQ ID NO: 208487 - DNA, 15 bp, Homo sapiens
tgtgttattctgttt

SEQ ID NO: 208488 - DNA, 15 bp, Homo sapiens
ttgtgttattctgtt

SEQ ID NO: 208489 - DNA, 15 bp, Homo sapiens
tttgtgttattctgt

SEQ ID NO: 208490 - DNA, 15 bp, Homo sapiens
ctttgtgttattctg

SEQ ID NO: 208491 - DNA, 15 bp, Homo sapiens
gctttgtgttattct

SEQ ID NO: 208492 - DNA, 15 bp, Homo sapiens
agctttgtgttattc

SEQ ID NO: 208493 - DNA, 15 bp, Homo sapiens
gagctttgtgttatt

SEQ ID NO: 208494 - DNA, 15 bp, Homo sapiens
agagctttgtgttat

SEQ ID NO: 208495 - DNA, 15 bp, Homo sapiens
aagagctttgtgtta

SEQ ID NO: 208496 - DNA, 15 bp, Homo sapiens
gaagagctttgtgtt

SEQ ID NO: 208497 - DNA, 15 bp, Homo sapiens
agaagagctttgtgt

SEQ ID NO: 208498 - DNA, 15 bp, Homo sapiens
tagaagagctttgtg

SEQ ID NO: 208499 - DNA, 15 bp, Homo sapiens
ttagaagagctttgt

SEQ ID NO: 208500 - DNA, 15 bp, Homo sapiens
attagaagagctttg

SEQ ID NO: 208501 - DNA, 15 bp, Homo sapiens
tattagaagagcttt

SEQ ID NO: 208502 - DNA, 15 bp, Homo sapiens
ctattagaagagctt

SEQ ID NO: 208503 - DNA, 15 bp, Homo sapiens
tctattagaagagct

SEQ ID NO: 208504 - DNA, 15 bp, Homo sapiens
atctattagaagagc

SEQ ID NO: 208505 - DNA, 15 bp, Homo sapiens
catctattagaagag

SEQ ID NO: 208506 - DNA, 15 bp, Homo sapiens
acatctattagaaga

SEQ ID NO: 208507 - DNA, 15 bp, Homo sapiens
cacatctattagaag

SEQ ID NO: 208508 - DNA, 15 bp, Homo sapiens
gcacatctattagaa

SEQ ID NO: 208509 - DNA, 15 bp, Homo sapiens
agcacatctattaga

SEQ ID NO: 208510 - DNA, 15 bp, Homo sapiens
gagcacatctattag

SEQ ID NO: 208511 - DNA, 15 bp, Homo sapiens
agagcacatctatta

SEQ ID NO: 208512 - DNA, 15 bp, Homo sapiens
cagagcacatctatt

SEQ ID NO: 208513 - DNA, 15 bp, Homo sapiens
acagagcacatctat

SEQ ID NO: 208514 - DNA, 15 bp, Homo sapiens
tacagagcacatcta

SEQ ID NO: 208515 - DNA, 15 bp, Homo sapiens
ttacagagcacatct

SEQ ID NO: 208516 - DNA, 15 bp, Homo sapiens
cttacagagcacatc

SEQ ID NO: 208517 - DNA, 15 bp, Homo sapiens
ccttacagagcacat

SEQ ID NO: 208518 - DNA, 15 bp, Homo sapiens
tccttacagagcaca

SEQ ID NO: 208519 - DNA, 15 bp, Homo sapiens
ttccttacagagcac

SEQ ID NO: 208520 - DNA, 15 bp, Homo sapiens
attccttacagagca

SEQ ID NO: 208521 - DNA, 15 bp, Homo sapiens
tattccttacagagc

SEQ ID NO: 208522 - DNA, 15 bp, Homo sapiens
gtattccttacagag

SEQ ID NO: 208523 - DNA, 15 bp, Homo sapiens
tgtattccttacaga

SEQ ID NO: 208524 - DNA, 15 bp, Homo sapiens
ttgtattccttacag

SEQ ID NO: 208525 - DNA, 15 bp, Homo sapiens
cttgtattccttaca

SEQ ID NO: 208526 - DNA, 15 bp, Homo sapiens
gcttgtattccttac

SEQ ID NO: 208527 - DNA, 15 bp, Homo sapiens
agcttgtattcctta

SEQ ID NO: 208528 - DNA, 15 bp, Homo sapiens
cagcttgtattcctt

SEQ ID NO: 208529 - DNA, 15 bp, Homo sapiens
gcagcttgtattcct

SEQ ID NO: 208530 - DNA, 15 bp, Homo sapiens
agcagcttgtattcc

SEQ ID NO: 208531 - DNA, 15 bp, Homo sapiens
aagcagcttgtattc

SEQ ID NO: 208532 - DNA, 15 bp, Homo sapiens
taagcagcttgtatt

SEQ ID NO: 208533 - DNA, 15 bp, Homo sapiens
ataagcagcttgtat

SEQ ID NO: 208534 - DNA, 15 bp, Homo sapiens
cataagcagcttgta

SEQ ID NO: 208535 - DNA, 15 bp, Homo sapiens
ccataagcagcttgt

SEQ ID NO: 208536 - DNA, 15 bp, Homo sapiens
gccataagcagcttg

SEQ ID NO: 208537 - DNA, 15 bp, Homo sapiens
ggccataagcagctt

SEQ ID NO: 208538 - DNA, 15 bp, Homo sapiens
tggccataagcagct

SEQ ID NO: 208539 - DNA, 15 bp, Homo sapiens
atggccataagcagc

SEQ ID NO: 208540 - DNA, 15 bp, Homo sapiens
tatggccataagcag

SEQ ID NO: 208541 - DNA, 15 bp, Homo sapiens
atatggccataagca

SEQ ID NO: 208542 - DNA, 15 bp, Homo sapiens
catatggccataagc

SEQ ID NO: 208543 - DNA, 15 bp, Homo sapiens
gcatatggccataag

SEQ ID NO: 208544 - DNA, 15 bp, Homo sapiens
agcatatggccataa

SEQ ID NO: 208545 - DNA, 15 bp, Homo sapiens
tagcatatggccata

SEQ ID NO: 208546 - DNA, 15 bp, Homo sapiens
ttagcatatggccat

SEQ ID NO: 208547 - DNA, 15 bp, Homo sapiens
attagcatatggcca

SEQ ID NO: 208548 - DNA, 15 bp, Homo sapiens
tattagcatatggcc

SEQ ID NO: 208549 - DNA, 15 bp, Homo sapiens
ctattagcatatggc

SEQ ID NO: 208550 - DNA, 15 bp, Homo sapiens
actattagcatatgg

SEQ ID NO: 208551 - DNA, 15 bp, Homo sapiens
cactattagcatatg

SEQ ID NO: 208552 - DNA, 15 bp, Homo sapiens
acactattagcatat

SEQ ID NO: 208553 - DNA, 15 bp, Homo sapiens
aacactattagcata

SEQ ID NO: 208554 - DNA, 15 bp, Homo sapiens
aaacactattagcat

SEQ ID NO: 208555 - DNA, 15 bp, Homo sapiens
taaacactattagca

SEQ ID NO: 208556 - DNA, 15 bp, Homo sapiens
gtaaacactattagc

SEQ ID NO: 208557 - DNA, 15 bp, Homo sapiens
ggtaaacactattag

SEQ ID NO: 208558 - DNA, 15 bp, Homo sapiens
cggtaaacactatta

SEQ ID NO: 208559 - DNA, 15 bp, Homo sapiens
tcggtaaacactatt

SEQ ID NO: 208560 - DNA, 15 bp, Homo sapiens
ttcggtaaacactat

SEQ ID NO: 208561 - DNA, 15 bp, Homo sapiens
tttcggtaaacacta

SEQ ID NO: 208562 - DNA, 15 bp, Homo sapiens
atttcggtaaacact

SEQ ID NO: 208563 - DNA, 15 bp, Homo sapiens
gatttcggtaaacac

SEQ ID NO: 208564 - DNA, 15 bp, Homo sapiens
ggatttcggtaaaca

SEQ ID NO: 208565 - DNA, 15 bp, Homo sapiens
tggatttcggtaaac

SEQ ID NO: 208566 - DNA, 15 bp, Homo sapiens
gtggatttcggtaaa

SEQ ID NO: 208567 - DNA, 15 bp, Homo sapiens
tgtggatttcggtaa

SEQ ID NO: 208568 - DNA, 15 bp, Homo sapiens
atgtggatttcggta

SEQ ID NO: 208569 - DNA, 15 bp, Homo sapiens
gatgtggatttcggt

SEQ ID NO: 208570 - DNA, 15 bp, Homo sapiens
agatgtggatttcgg

SEQ ID NO: 208571 - DNA, 15 bp, Homo sapiens
aagatgtggatttcg

SEQ ID NO: 208572 - DNA, 15 bp, Homo sapiens
caagatgtggatttc

SEQ ID NO: 208573 - DNA, 15 bp, Homo sapiens
tcaagatgtggattt

SEQ ID NO: 208574 - DNA, 15 bp, Homo sapiens
ctcaagatgtggatt

SEQ ID NO: 208575 - DNA, 15 bp, Homo sapiens
cctcaagatgtggat

SEQ ID NO: 208576 - DNA, 15 bp, Homo sapiens
acctcaagatgtgga

SEQ ID NO: 208577 - DNA, 15 bp, Homo sapiens
tacctcaagatgtgg

SEQ ID NO: 208578 - DNA, 15 bp, Homo sapiens
atacctcaagatgtg

SEQ ID NO: 208579 - DNA, 15 bp, Homo sapiens
catacctcaagatgt

SEQ ID NO: 208580 - DNA, 15 bp, Homo sapiens
tcatacctcaagatg

SEQ ID NO: 208581 - DNA, 15 bp, Homo sapiens
ttcatacctcaagat

SEQ ID NO: 208582 - DNA, 15 bp, Homo sapiens
tttcatacctcaaga

SEQ ID NO: 208583 - DNA, 15 bp, Homo sapiens
atttcatacctcaag

SEQ ID NO: 208584 - DNA, 15 bp, Homo sapiens
catttcatacctcaa

SEQ ID NO: 208585 - DNA, 15 bp, Homo sapiens
tcatttcatacctca

SEQ ID NO: 208586 - DNA, 15 bp, Homo sapiens
atcatttcatacctc

SEQ ID NO: 208587 - DNA, 15 bp, Homo sapiens
aatcatttcatacct

SEQ ID NO: 208588 - DNA, 15 bp, Homo sapiens
aaatcatttcatacc

SEQ ID NO: 208589 - DNA, 15 bp, Homo sapiens
aaaatcatttcatac

SEQ ID NO: 208590 - DNA, 15 bp, Homo sapiens
gaaaatcatttcata

SEQ ID NO: 208591 - DNA, 15 bp, Homo sapiens
ggaaaatcatttcat

SEQ ID NO: 208592 - DNA, 15 bp, Homo sapiens
aggaaaatcatttca

SEQ ID NO: 208593 - DNA, 15 bp, Homo sapiens
gaggaaaatcatttc

SEQ ID NO: 208594 - DNA, 15 bp, Homo sapiens
agaggaaaatcattt

SEQ ID NO: 208595 - DNA, 15 bp, Homo sapiens
aagaggaaaatcatt

SEQ ID NO: 208596 - DNA, 15 bp, Homo sapiens
gaagaggaaaatcat

SEQ ID NO: 208597 - DNA, 15 bp, Homo sapiens
agaagaggaaaatca

SEQ ID NO: 208598 - DNA, 15 bp, Homo sapiens
cagaagaggaaaatc

SEQ ID NO: 208599 - DNA, 15 bp, Homo sapiens
ccagaagaggaaaat

SEQ ID NO: 208600 - DNA, 15 bp, Homo sapiens
gccagaagaggaaaa

SEQ ID NO: 208601 - DNA, 15 bp, Homo sapiens
ggccagaagaggaaa

SEQ ID NO: 208602 - DNA, 15 bp, Homo sapiens
aggccagaagaggaa

SEQ ID NO: 208603 - DNA, 15 bp, Homo sapiens
aaggccagaagagga

SEQ ID NO: 208604 - DNA, 15 bp, Homo sapiens
taaggccagaagagg

SEQ ID NO: 208605 - DNA, 15 bp, Homo sapiens
ctaaggccagaagag

SEQ ID NO: 208606 - DNA, 15 bp, Homo sapiens
gctaaggccagaaga

SEQ ID NO: 208607 - DNA, 15 bp, Homo sapiens
tgctaaggccagaag

SEQ ID NO: 208608 - DNA, 15 bp, Homo sapiens
gtgctaaggccagaa

SEQ ID NO: 208609 - DNA, 15 bp, Homo sapiens
tgtgctaaggccaga

SEQ ID NO: 208610 - DNA, 15 bp, Homo sapiens
atgtgctaaggccag

SEQ ID NO: 208611 - DNA, 15 bp, Homo sapiens
tatgtgctaaggcca

SEQ ID NO: 208612 - DNA, 15 bp, Homo sapiens
ttatgtgctaaggcc

SEQ ID NO: 208613 - DNA, 15 bp, Homo sapiens
tttatgtgctaaggc

SEQ ID NO: 208614 - DNA, 15 bp, Homo sapiens
ctttatgtgctaagg

SEQ ID NO: 208615 - DNA, 15 bp, Homo sapiens
actttatgtgctaag

SEQ ID NO: 208616 - DNA, 15 bp, Homo sapiens
tactttatgtgctaa

SEQ ID NO: 208617 - DNA, 15 bp, Homo sapiens
atactttatgtgcta

SEQ ID NO: 208618 - DNA, 15 bp, Homo sapiens
catactttatgtgct

SEQ ID NO: 208619 - DNA, 15 bp, Homo sapiens
acatactttatgtgc

SEQ ID NO: 208620 - DNA, 15 bp, Homo sapiens
tacatactttatgtg

SEQ ID NO: 208621 - DNA, 15 bp, Homo sapiens
atacatactttatgt

SEQ ID NO: 208622 - DNA, 15 bp, Homo sapiens
gatacatactttatg

SEQ ID NO: 208623 - DNA, 15 bp, Homo sapiens
tgatacatactttat

SEQ ID NO: 208624 - DNA, 15 bp, Homo sapiens
ctgatacatacttta

SEQ ID NO: 208625 - DNA, 15 bp, Homo sapiens
gctgatacatacttt

SEQ ID NO: 208626 - DNA, 15 bp, Homo sapiens
ggctgatacatactt

SEQ ID NO: 208627 - DNA, 15 bp, Homo sapiens
aggctgatacatact

SEQ ID NO: 208628 - DNA, 15 bp, Homo sapiens
gaggctgatacatac

SEQ ID NO: 208629 - DNA, 15 bp, Homo sapiens
agaggctgatacata

SEQ ID NO: 208630 - DNA, 15 bp, Homo sapiens
gagaggctgatacat

SEQ ID NO: 208631 - DNA, 15 bp, Homo sapiens
tgagaggctgataca

SEQ ID NO: 208632 - DNA, 15 bp, Homo sapiens
ctgagaggctgatac

SEQ ID NO: 208633 - DNA, 15 bp, Homo sapiens
actgagaggctgata

SEQ ID NO: 208634 - DNA, 15 bp, Homo sapiens
gactgagaggctgat

SEQ ID NO: 208635 - DNA, 15 bp, Homo sapiens
agactgagaggctga

SEQ ID NO: 208636 - DNA, 15 bp, Homo sapiens
cagactgagaggctg

SEQ ID NO: 208637 - DNA, 15 bp, Homo sapiens
acagactgagaggct

SEQ ID NO: 208638 - DNA, 15 bp, Homo sapiens
gacagactgagaggc

SEQ ID NO: 208639 - DNA, 15 bp, Homo sapiens
ggacagactgagagg

SEQ ID NO: 208640 - DNA, 15 bp, Homo sapiens
aggacagactgagag

SEQ ID NO: 208641 - DNA, 15 bp, Homo sapiens
caggacagactgaga

SEQ ID NO: 208642 - DNA, 15 bp, Homo sapiens
ccaggacagactgag

SEQ ID NO: 208643 - DNA, 15 bp, Homo sapiens
gccaggacagactga

SEQ ID NO: 208644 - DNA, 15 bp, Homo sapiens
agccaggacagactg

SEQ ID NO: 208645 - DNA, 15 bp, Homo sapiens
cagccaggacagact

SEQ ID NO: 208646 - DNA, 15 bp, Homo sapiens
acagccaggacagac

SEQ ID NO: 208647 - DNA, 15 bp, Homo sapiens
tacagccaggacaga

SEQ ID NO: 208648 - DNA, 15 bp, Homo sapiens
atacagccaggacag

SEQ ID NO: 208649 - DNA, 15 bp, Homo sapiens
aatacagccaggaca

SEQ ID NO: 208650 - DNA, 15 bp, Homo sapiens
aaatacagccaggac

SEQ ID NO: 208651 - DNA, 15 bp, Homo sapiens
aaaatacagccagga

SEQ ID NO: 208652 - DNA, 15 bp, Homo sapiens
caaaatacagccagg

SEQ ID NO: 208653 - DNA, 15 bp, Homo sapiens
ccaaaatacagccag

SEQ ID NO: 208654 - DNA, 15 bp, Homo sapiens
gccaaaatacagcca

SEQ ID NO: 208655 - DNA, 15 bp, Homo sapiens
ggccaaaatacagcc

SEQ ID NO: 208656 - DNA, 15 bp, Homo sapiens
aggccaaaatacagc

SEQ ID NO: 208657 - DNA, 15 bp, Homo sapiens
atcagacactgataa

SEQ ID NO: 208658 - DNA, 15 bp, Homo sapiens
gatcagacactgata

SEQ ID NO: 208659 - DNA, 15 bp, Homo sapiens
tgatcagacactgat

SEQ ID NO: 208660 - DNA, 15 bp, Homo sapiens
atgatcagacactga

SEQ ID NO: 208661 - DNA, 15 bp, Homo sapiens
aatgatcagacactg

SEQ ID NO: 208662 - DNA, 15 bp, Homo sapiens
aaatgatcagacact

SEQ ID NO: 208663 - DNA, 15 bp, Homo sapiens
caaatgatcagacac

SEQ ID NO: 208664 - DNA, 15 bp, Homo sapiens
tcaaatgatcagaca

SEQ ID NO: 208665 - DNA, 15 bp, Homo sapiens
atcaaatgatcagac

SEQ ID NO: 208666 - DNA, 15 bp, Homo sapiens
tatcaaatgatcaga

SEQ ID NO: 208667 - DNA, 15 bp, Homo sapiens
ttatcaaatgatcag

SEQ ID NO: 208668 - DNA, 15 bp, Homo sapiens
cttatcaaatgatca

SEQ ID NO: 208669 - DNA, 15 bp, Homo sapiens
tcttatcaaatgatc

SEQ ID NO: 208670 - DNA, 15 bp, Homo sapiens
gtcttatcaaatgat

SEQ ID NO: 208671 - DNA, 15 bp, Homo sapiens
ggtcttatcaaatga

SEQ ID NO: 208672 - DNA, 15 bp, Homo sapiens
tggtcttatcaaatg

SEQ ID NO: 208673 - DNA, 15 bp, Homo sapiens
ttggtcttatcaaat

SEQ ID NO: 208674 - DNA, 15 bp, Homo sapiens
attggtcttatcaaa

SEQ ID NO: 208675 - DNA, 15 bp, Homo sapiens
cattggtcttatcaa

SEQ ID NO: 208676 - DNA, 15 bp, Homo sapiens
ccattggtcttatca

SEQ ID NO: 208677 - DNA, 15 bp, Homo sapiens
tccattggtcttatc

SEQ ID NO: 208678 - DNA, 15 bp, Homo sapiens
ttccattggtcttat

SEQ ID NO: 208679 - DNA, 15 bp, Homo sapiens
cttccattggtctta

SEQ ID NO: 208680 - DNA, 15 bp, Homo sapiens
ccttccattggtctt

SEQ ID NO: 208681 - DNA, 15 bp, Homo sapiens
accttccattggtct

SEQ ID NO: 208682 - DNA, 15 bp, Homo sapiens
aaccttccattggtc

SEQ ID NO: 208683 - DNA, 15 bp, Homo sapiens
aaaccttccattggt

SEQ ID NO: 208684 - DNA, 15 bp, Homo sapiens
caaaccttccattgg

SEQ ID NO: 208685 - DNA, 15 bp, Homo sapiens
ccaaaccttccattg

SEQ ID NO: 208686 - DNA, 15 bp, Homo sapiens
tccaaaccttccatt

SEQ ID NO: 208687 - DNA, 15 bp, Homo sapiens
atccaaaccttccat

SEQ ID NO: 208688 - DNA, 15 bp, Homo sapiens
tatccaaaccttcca

SEQ ID NO: 208689 - DNA, 15 bp, Homo sapiens
ctatccaaaccttcc

SEQ ID NO: 208690 - DNA, 15 bp, Homo sapiens
actatccaaaccttc

SEQ ID NO: 208691 - DNA, 15 bp, Homo sapiens
tactatccaaacctt

SEQ ID NO: 208692 - DNA, 15 bp, Homo sapiens
ctactatccaaacct

SEQ ID NO: 208693 - DNA, 15 bp, Homo sapiens
gctactatccaaacc

SEQ ID NO: 208694 - DNA, 15 bp, Homo sapiens
ggctactatccaaac

SEQ ID NO: 208695 - DNA, 15 bp, Homo sapiens
tggctactatccaaa

SEQ ID NO: 208696 - DNA, 15 bp, Homo sapiens
ctggctactatccaa

SEQ ID NO: 208697 - DNA, 15 bp, Homo sapiens
actggctactatcca

SEQ ID NO: 208698 - DNA, 15 bp, Homo sapiens
aactggctactatcc

SEQ ID NO: 208699 - DNA, 15 bp, Homo sapiens
taactggctactatc

SEQ ID NO: 208700 - DNA, 15 bp, Homo sapiens
ataactggctactat

SEQ ID NO: 208701 - DNA, 15 bp, Homo sapiens
aataactggctacta

SEQ ID NO: 208702 - DNA, 15 bp, Homo sapiens
aaataactggctact

SEQ ID NO: 208703 - DNA, 15 bp, Homo sapiens
aaaataactggctac

SEQ ID NO: 208704 - DNA, 15 bp, Homo sapiens
aaaaataactggcta

SEQ ID NO: 208705 - DNA, 15 bp, Homo sapiens
caaaaataactggct

SEQ ID NO: 208706 - DNA, 15 bp, Homo sapiens
tcaaaaataactggc

SEQ ID NO: 208707 - DNA, 15 bp, Homo sapiens
ttcaaaaataactgg

SEQ ID NO: 208708 - DNA, 15 bp, Homo sapiens
attcaaaaataactg

SEQ ID NO: 208709 - DNA, 15 bp, Homo sapiens
aattcaaaaataact

SEQ ID NO: 208710 - DNA, 15 bp, Homo sapiens
caattcaaaaataac

SEQ ID NO: 208711 - DNA, 15 bp, Homo sapiens
gcaattcaaaaataa

SEQ ID NO: 208712 - DNA, 15 bp, Homo sapiens
agcaattcaaaaata

SEQ ID NO: 208713 - DNA, 15 bp, Homo sapiens
aagcaattcaaaaat

SEQ ID NO: 208714 - DNA, 15 bp, Homo sapiens
caagcaattcaaaaa

SEQ ID NO: 208715 - DNA, 15 bp, Homo sapiens
tcaagcaattcaaaa

SEQ ID NO: 208716 - DNA, 15 bp, Homo sapiens
ttcaagcaattcaaa

SEQ ID NO: 208717 - DNA, 15 bp, Homo sapiens
cttcaagcaattcaa

SEQ ID NO: 208718 - DNA, 15 bp, Homo sapiens
tcttcaagcaattca

SEQ ID NO: 208719 - DNA, 15 bp, Homo sapiens
ctcttcaagcaattc

SEQ ID NO: 208720 - DNA, 15 bp, Homo sapiens
tctcttcaagcaatt

SEQ ID NO: 208721 - DNA, 15 bp, Homo sapiens
ttctcttcaagcaat

SEQ ID NO: 208722 - DNA, 15 bp, Homo sapiens
attctcttcaagcaa

SEQ ID NO: 208723 - DNA, 15 bp, Homo sapiens
gattctcttcaagca

SEQ ID NO: 208724 - DNA, 15 bp, Homo sapiens
agattctcttcaagc

SEQ ID NO: 208725 - DNA, 15 bp, Homo sapiens
aagattctcttcaag

SEQ ID NO: 208726 - DNA, 15 bp, Homo sapiens
caagattctcttcaa

SEQ ID NO: 208727 - DNA, 15 bp, Homo sapiens
acaagattctcttca

SEQ ID NO: 208728 - DNA, 15 bp, Homo sapiens
tacaagattctcttc

SEQ ID NO: 208729 - DNA, 15 bp, Homo sapiens
ttacaagattctctt

SEQ ID NO: 208730 - DNA, 15 bp, Homo sapiens
tttacaagattctct

SEQ ID NO: 208731 - DNA, 15 bp, Homo sapiens
atttacaagattctc

SEQ ID NO: 208732 - DNA, 15 bp, Homo sapiens
aatttacaagattct

SEQ ID NO: 208733 - DNA, 15 bp, Homo sapiens
aaatttacaagattc

SEQ ID NO: 208734 - DNA, 15 bp, Homo sapiens
caaatttacaagatt

SEQ ID NO: 208735 - DNA, 15 bp, Homo sapiens
acaaatttacaagat

SEQ ID NO: 208736 - DNA, 15 bp, Homo sapiens
tacaaatttacaaga

SEQ ID NO: 208737 - DNA, 15 bp, Homo sapiens
ctacaaatttacaag

SEQ ID NO: 208738 - DNA, 15 bp, Homo sapiens
actacaaatttacaa

SEQ ID NO: 208739 - DNA, 15 bp, Homo sapiens
gactacaaatttaca

SEQ ID NO: 208740 - DNA, 15 bp, Homo sapiens
ggactacaaatttac

SEQ ID NO: 208741 - DNA, 15 bp, Homo sapiens
tggactacaaattta

SEQ ID NO: 208742 - DNA, 15 bp, Homo sapiens
ctggactacaaattt

SEQ ID NO: 208743 - DNA, 15 bp, Homo sapiens
tctggactacaaatt

SEQ ID NO: 208744 - DNA, 15 bp, Homo sapiens
ctctggactacaaat

SEQ ID NO: 208745 - DNA, 15 bp, Homo sapiens
cctctggactacaaa

SEQ ID NO: 208746 - DNA, 15 bp, Homo sapiens
acctctggactacaa

SEQ ID NO: 208747 - DNA, 15 bp, Homo sapiens
tacctctggactaca

SEQ ID NO: 208748 - DNA, 15 bp, Homo sapiens
ttacctctggactac

SEQ ID NO: 208749 - DNA, 15 bp, Homo sapiens
attacctctggacta

SEQ ID NO: 208750 - DNA, 15 bp, Homo sapiens
aattacctctggact

SEQ ID NO: 208751 - DNA, 15 bp, Homo sapiens
gaattacctctggac

SEQ ID NO: 208752 - DNA, 15 bp, Homo sapiens
agaattacctctgga

SEQ ID NO: 208753 - DNA, 15 bp, Homo sapiens
cagaattacctctgg

SEQ ID NO: 208754 - DNA, 15 bp, Homo sapiens
gcagaattacctctg

SEQ ID NO: 208755 - DNA, 15 bp, Homo sapiens
cgcagaattacctct

SEQ ID NO: 208756 - DNA, 15 bp, Homo sapiens
tcgcagaattacctc

SEQ ID NO: 208757 - DNA, 15 bp, Homo sapiens
atcgcagaattacct

SEQ ID NO: 208758 - DNA, 15 bp, Homo sapiens
aatcgcagaattacc

SEQ ID NO: 208759 - DNA, 15 bp, Homo sapiens
caatcgcagaattac

SEQ ID NO: 208760 - DNA, 15 bp, Homo sapiens
gcaatcgcagaatta

SEQ ID NO: 208761 - DNA, 15 bp, Homo sapiens
agcaatcgcagaatt

SEQ ID NO: 208762 - DNA, 15 bp, Homo sapiens
aagcaatcgcagaat

SEQ ID NO: 208763 - DNA, 15 bp, Homo sapiens
gaagcaatcgcagaa

SEQ ID NO: 208764 - DNA, 15 bp, Homo sapiens
tgaagcaatcgcaga

SEQ ID NO: 208765 - DNA, 15 bp, Homo sapiens
ttgaagcaatcgcag

SEQ ID NO: 208766 - DNA, 15 bp, Homo sapiens
attgaagcaatcgca

SEQ ID NO: 208767 - DNA, 15 bp, Homo sapiens
tattgaagcaatcgc

SEQ ID NO: 208768 - DNA, 15 bp, Homo sapiens
gtattgaagcaatcg

SEQ ID NO: 208769 - DNA, 15 bp, Homo sapiens
agtattgaagcaatc

SEQ ID NO: 208770 - DNA, 15 bp, Homo sapiens
aagtattgaagcaat

SEQ ID NO: 208771 - DNA, 15 bp, Homo sapiens
caagtattgaagcaa

SEQ ID NO: 208772 - DNA, 15 bp, Homo sapiens
ccaagtattgaagca

SEQ ID NO: 208773 - DNA, 15 bp, Homo sapiens
tccaagtattgaagc

SEQ ID NO: 208774 - DNA, 15 bp, Homo sapiens
ttccaagtattgaag

SEQ ID NO: 208775 - DNA, 15 bp, Homo sapiens
attccaagtattgaa

SEQ ID NO: 208776 - DNA, 15 bp, Homo sapiens
aattccaagtattga

SEQ ID NO: 208777 - DNA, 15 bp, Homo sapiens
caattccaagtattg

SEQ ID NO: 208778 - DNA, 15 bp, Homo sapiens
gcaattccaagtatt

SEQ ID NO: 208779 - DNA, 15 bp, Homo sapiens
tgcaattccaagtat

SEQ ID NO: 208780 - DNA, 15 bp, Homo sapiens
ttgcaattccaagta

SEQ ID NO: 208781 - DNA, 15 bp, Homo sapiens
attgcaattccaagt

SEQ ID NO: 208782 - DNA, 15 bp, Homo sapiens
tattgcaattccaag

SEQ ID NO: 208783 - DNA, 15 bp, Homo sapiens
ctattgcaattccaa

SEQ ID NO: 208784 - DNA, 15 bp, Homo sapiens
tctattgcaattcca

SEQ ID NO: 208785 - DNA, 15 bp, Homo sapiens
ctctattgcaattcc

SEQ ID NO: 208786 - DNA, 15 bp, Homo sapiens
actctattgcaattc

SEQ ID NO: 208787 - DNA, 15 bp, Homo sapiens
aactctattgcaatt

SEQ ID NO: 208788 - DNA, 15 bp, Homo sapiens
caactctattgcaat

SEQ ID NO: 208789 - DNA, 15 bp, Homo sapiens
acaactctattgcaa

SEQ ID NO: 208790 - DNA, 15 bp, Homo sapiens
tacaactctattgca

SEQ ID NO: 208791 - DNA, 15 bp, Homo sapiens
ttacaactctattgc

SEQ ID NO: 208792 - DNA, 15 bp, Homo sapiens
cttacaactctattg

SEQ ID NO: 208793 - DNA, 15 bp, Homo sapiens
acttacaactctatt

SEQ ID NO: 208794 - DNA, 15 bp, Homo sapiens
tacttacaactctat

SEQ ID NO: 208795 - DNA, 15 bp, Homo sapiens
gtacttacaactcta

SEQ ID NO: 208796 - DNA, 15 bp, Homo sapiens
agtacttacaactct

SEQ ID NO: 208797 - DNA, 15 bp, Homo sapiens
cagtacttacaactc

SEQ ID NO: 208798 - DNA, 15 bp, Homo sapiens
tcagtacttacaact

SEQ ID NO: 208799 - DNA, 15 bp, Homo sapiens
atcagtacttacaac

SEQ ID NO: 208800 - DNA, 15 bp, Homo sapiens
aatcagtacttacaa

SEQ ID NO: 208801 - DNA, 15 bp, Homo sapiens
gaatcagtacttaca

SEQ ID NO: 208802 - DNA, 15 bp, Homo sapiens
agaatcagtacttac

SEQ ID NO: 208803 - DNA, 15 bp, Homo sapiens
aagaatcagtactta

SEQ ID NO: 208804 - DNA, 15 bp, Homo sapiens
aaagaatcagtactt

SEQ ID NO: 208805 - DNA, 15 bp, Homo sapiens
aaaagaatcagtact

SEQ ID NO: 208806 - DNA, 15 bp, Homo sapiens
taaaagaatcagtac

SEQ ID NO: 208807 - DNA, 15 bp, Homo sapiens
gtaaaagaatcagta

SEQ ID NO: 208808 - DNA, 15 bp, Homo sapiens
tgtaaaagaatcagt

SEQ ID NO: 208809 - DNA, 15 bp, Homo sapiens
ttgtaaaagaatcag

SEQ ID NO: 208810 - DNA, 15 bp, Homo sapiens
cttgtaaaagaatca

SEQ ID NO: 208811 - DNA, 15 bp, Homo sapiens
tcttgtaaaagaatc

SEQ ID NO: 208812 - DNA, 15 bp, Homo sapiens
gtcttgtaaaagaat

SEQ ID NO: 208813 - DNA, 15 bp, Homo sapiens
ggtcttgtaaaagaa

SEQ ID NO: 208814 - DNA, 15 bp, Homo sapiens
tggtcttgtaaaaga

SEQ ID NO: 208815 - DNA, 15 bp, Homo sapiens
atggtcttgtaaaag

SEQ ID NO: 208816 - DNA, 15 bp, Homo sapiens
catggtcttgtaaaa

SEQ ID NO: 208817 - DNA, 15 bp, Homo sapiens
acatggtcttgtaaa

SEQ ID NO: 208818 - DNA, 15 bp, Homo sapiens
tacatggtcttgtaa

SEQ ID NO: 208819 - DNA, 15 bp, Homo sapiens
atacatggtcttgta

SEQ ID NO: 208820 - DNA, 15 bp, Homo sapiens
tatacatggtcttgt

SEQ ID NO: 208821 - DNA, 15 bp, Homo sapiens
ttatacatggtcttg

SEQ ID NO: 208822 - DNA, 15 bp, Homo sapiens
tttatacatggtctt

SEQ ID NO: 208823 - DNA, 15 bp, Homo sapiens
gtttatacatggtct

SEQ ID NO: 208824 - DNA, 15 bp, Homo sapiens
ggtttatacatggtc

SEQ ID NO: 208825 - DNA, 15 bp, Homo sapiens
tggtttatacatggt

SEQ ID NO: 208826 - DNA, 15 bp, Homo sapiens
ttggtttatacatgg

SEQ ID NO: 208827 - DNA, 15 bp, Homo sapiens
cttggtttatacatg

SEQ ID NO: 208828 - DNA, 15 bp, Homo sapiens
tcttggtttatacat

SEQ ID NO: 208829 - DNA, 15 bp, Homo sapiens
ttcttggtttataca

SEQ ID NO: 208830 - DNA, 15 bp, Homo sapiens
cttcttggtttatac

SEQ ID NO: 208831 - DNA, 15 bp, Homo sapiens
acttcttggtttata

SEQ ID NO: 208832 - DNA, 15 bp, Homo sapiens
gacttcttggtttat

SEQ ID NO: 208833 - DNA, 15 bp, Homo sapiens
agacttcttggttta

SEQ ID NO: 208834 - DNA, 15 bp, Homo sapiens
aagacttcttggttt

SEQ ID NO: 208835 - DNA, 15 bp, Homo sapiens
gaagacttcttggtt

SEQ ID NO: 208836 - DNA, 15 bp, Homo sapiens
agaagacttcttggt

SEQ ID NO: 208837 - DNA, 15 bp, Homo sapiens
cagaagacttcttgg

SEQ ID NO: 208838 - DNA, 15 bp, Homo sapiens
acagaagacttcttg

SEQ ID NO: 208839 - DNA, 15 bp, Homo sapiens
tacagaagacttctt

SEQ ID NO: 208840 - DNA, 15 bp, Homo sapiens
atacagaagacttct

SEQ ID NO: 208841 - DNA, 15 bp, Homo sapiens
aatacagaagacttc

SEQ ID NO: 208842 - DNA, 15 bp, Homo sapiens
aaatacagaagactt

SEQ ID NO: 208843 - DNA, 15 bp, Homo sapiens
aaaatacagaagact

SEQ ID NO: 208844 - DNA, 15 bp, Homo sapiens
gaaaatacagaagac

SEQ ID NO: 208845 - DNA, 15 bp, Homo sapiens
ggaaaatacagaaga

SEQ ID NO: 208846 - DNA, 15 bp, Homo sapiens
ctggaaaatacagaa

SEQ ID NO: 208847 - DNA, 15 bp, Homo sapiens
actggaaaatacaga

SEQ ID NO: 208848 - DNA, 15 bp, Homo sapiens
gactggaaaatacag

SEQ ID NO: 208849 - DNA, 15 bp, Homo sapiens
ggactggaaaataca

SEQ ID NO: 208850 - DNA, 15 bp, Homo sapiens
gggactggaaaatac

SEQ ID NO: 208851 - DNA, 15 bp, Homo sapiens
tgggactggaaaata

SEQ ID NO: 208852 - DNA, 15 bp, Homo sapiens
ttgggactggaaaat

SEQ ID NO: 208853 - DNA, 15 bp, Homo sapiens
tttgggactggaaaa

SEQ ID NO: 208854 - DNA, 15 bp, Homo sapiens
ttttgggactggaaa

SEQ ID NO: 208855 - DNA, 15 bp, Homo sapiens
gttttgggactggaa

SEQ ID NO: 208856 - DNA, 15 bp, Homo sapiens
agttttgggactgga

SEQ ID NO: 208857 - DNA, 15 bp, Homo sapiens
cagttttgggactgg

SEQ ID NO: 208858 - DNA, 15 bp, Homo sapiens
tcagttttgggactg

SEQ ID NO: 208859 - DNA, 15 bp, Homo sapiens
ttcagttttgggact

SEQ ID NO: 208860 - DNA, 15 bp, Homo sapiens
attcagttttgggac

SEQ ID NO: 208861 - DNA, 15 bp, Homo sapiens
gattcagttttggga

SEQ ID NO: 208862 - DNA, 15 bp, Homo sapiens
cgattcagttttggg

SEQ ID NO: 208863 - DNA, 15 bp, Homo sapiens
tcgattcagttttgg

SEQ ID NO: 208864 - DNA, 15 bp, Homo sapiens
atcgattcagttttg

SEQ ID NO: 208865 - DNA, 15 bp, Homo sapiens
tatcgattcagtttt

SEQ ID NO: 208866 - DNA, 15 bp, Homo sapiens
ttatcgattcagttt

SEQ ID NO: 208867 - DNA, 15 bp, Homo sapiens
tttatcgattcagtt

SEQ ID NO: 208868 - DNA, 15 bp, Homo sapiens
ttttatcgattcagt

SEQ ID NO: 208869 - DNA, 15 bp, Homo sapiens
tttttatcgattcag

SEQ ID NO: 208870 - DNA, 15 bp, Homo sapiens
ttttttatcgattca

SEQ ID NO: 208871 - DNA, 15 bp, Homo sapiens
cttttttatcgattc

SEQ ID NO: 208872 - DNA, 15 bp, Homo sapiens
tcttttttatcgatt

SEQ ID NO: 208873 - DNA, 15 bp, Homo sapiens
ctcttttttatcgat

SEQ ID NO: 208874 - DNA, 15 bp, Homo sapiens
actcttttttatcga

SEQ ID NO: 208875 - DNA, 15 bp, Homo sapiens
cactcttttttatcg

SEQ ID NO: 208876 - DNA, 15 bp, Homo sapiens
gcactcttttttatc

SEQ ID NO: 208877 - DNA, 15 bp, Homo sapiens
ggcactcttttttat

SEQ ID NO: 208878 - DNA, 15 bp, Homo sapiens
tggcactctttttta

SEQ ID NO: 208879 - DNA, 15 bp, Homo sapiens
atggcactctttttt

SEQ ID NO: 208880 - DNA, 15 bp, Homo sapiens
aatggcactcttttt

SEQ ID NO: 208881 - DNA, 15 bp, Homo sapiens
aaatggcactctttt

SEQ ID NO: 208882 - DNA, 15 bp, Homo sapiens
aaaatggcactcttt

SEQ ID NO: 208883 - DNA, 15 bp, Homo sapiens
aaaaatggcactctt

SEQ ID NO: 208884 - DNA, 15 bp, Homo sapiens
aaaaaatggcactct

SEQ ID NO: 208885 - DNA, 15 bp, Homo sapiens
taaaaaatggcactc

SEQ ID NO: 208886 - DNA, 15 bp, Homo sapiens
ctaaaaaatggcact

SEQ ID NO: 208887 - DNA, 15 bp, Homo sapiens
tctaaaaaatggcac

SEQ ID NO: 208888 - DNA, 15 bp, Homo sapiens
atctaaaaaatggca

SEQ ID NO: 208889 - DNA, 15 bp, Homo sapiens
tatctaaaaaatggc

SEQ ID NO: 208890 - DNA, 15 bp, Homo sapiens
ttatctaaaaaatgg

SEQ ID NO: 208891 - DNA, 15 bp, Homo sapiens
tttatctaaaaaatg

SEQ ID NO: 208892 - DNA, 15 bp, Homo sapiens
ctttatctaaaaaat

SEQ ID NO: 208893 - DNA, 15 bp, Homo sapiens
actttatctaaaaaa

SEQ ID NO: 208894 - DNA, 15 bp, Homo sapiens
cactttatctaaaaa

SEQ ID NO: 208895 - DNA, 15 bp, Homo sapiens
acactttatctaaaa

SEQ ID NO: 208896 - DNA, 15 bp, Homo sapiens
aacactttatctaaa

SEQ ID NO: 208897 - DNA, 15 bp, Homo sapiens
aaacactttatctaa

SEQ ID NO: 208898 - DNA, 15 bp, Homo sapiens
taaacactttatcta

SEQ ID NO: 208899 - DNA, 15 bp, Homo sapiens
ctaaacactttatct

SEQ ID NO: 208900 - DNA, 15 bp, Homo sapiens
tctaaacactttatc

SEQ ID NO: 208901 - DNA, 15 bp, Homo sapiens
ctctaaacactttat

SEQ ID NO: 208902 - DNA, 15 bp, Homo sapiens
cctctaaacacttta

SEQ ID NO: 208903 - DNA, 15 bp, Homo sapiens
gcctctaaacacttt

SEQ ID NO: 208904 - DNA, 15 bp, Homo sapiens
agcctctaaacactt

SEQ ID NO: 208905 - DNA, 15 bp, Homo sapiens
aagcctctaaacact

SEQ ID NO: 208906 - DNA, 15 bp, Homo sapiens
aaagcctctaaacac

SEQ ID NO: 208907 - DNA, 15 bp, Homo sapiens
caaagcctctaaaca

SEQ ID NO: 208908 - DNA, 15 bp, Homo sapiens
gcaaagcctctaaac

SEQ ID NO: 208909 - DNA, 15 bp, Homo sapiens
ggcaaagcctctaaa

SEQ ID NO: 208910 - DNA, 15 bp, Homo sapiens
aggcaaagcctctaa

SEQ ID NO: 208911 - DNA, 15 bp, Homo sapiens
aaggcaaagcctcta

SEQ ID NO: 208912 - DNA, 15 bp, Homo sapiens
aaaggcaaagcctct

SEQ ID NO: 208913 - DNA, 15 bp, Homo sapiens
caaaggcaaagcctc

SEQ ID NO: 208914 - DNA, 15 bp, Homo sapiens
ccaaaggcaaagcct

SEQ ID NO: 208915 - DNA, 15 bp, Homo sapiens
gccaaaggcaaagcc

SEQ ID NO: 208916 - DNA, 15 bp, Homo sapiens
ggccaaaggcaaagc

SEQ ID NO: 208917 - DNA, 15 bp, Homo sapiens
aggccaaaggcaaag

SEQ ID NO: 208918 - DNA, 15 bp, Homo sapiens
gaggccaaaggcaaa

SEQ ID NO: 208919 - DNA, 15 bp, Homo sapiens
agaggccaaaggcaa

SEQ ID NO: 208920 - DNA, 15 bp, Homo sapiens
gagaggccaaaggca

SEQ ID NO: 208921 - DNA, 15 bp, Homo sapiens
tgagaggccaaaggc

SEQ ID NO: 208922 - DNA, 15 bp, Homo sapiens
atgagaggccaaagg

SEQ ID NO: 208923 - DNA, 15 bp, Homo sapiens
tatgagaggccaaag

SEQ ID NO: 208924 - DNA, 15 bp, Homo sapiens
atatgagaggccaaa

SEQ ID NO: 208925 - DNA, 15 bp, Homo sapiens
aatatgagaggccaa

SEQ ID NO: 208926 - DNA, 15 bp, Homo sapiens
aaatatgagaggcca

SEQ ID NO: 208927 - DNA, 15 bp, Homo sapiens
aaaatatgagaggcc

SEQ ID NO: 208928 - DNA, 15 bp, Homo sapiens
gaaaatatgagaggc

SEQ ID NO: 208929 - DNA, 15 bp, Homo sapiens
ggaaaatatgagagg

SEQ ID NO: 208930 - DNA, 15 bp, Homo sapiens
aggaaaatatgagag

SEQ ID NO: 208931 - DNA, 15 bp, Homo sapiens
aaggaaaatatgaga

SEQ ID NO: 208932 - DNA, 15 bp, Homo sapiens
aaaggaaaatatgag

SEQ ID NO: 208933 - DNA, 15 bp, Homo sapiens
gaaaggaaaatatga

SEQ ID NO: 208934 - DNA, 15 bp, Homo sapiens
agaaaggaaaatatg

SEQ ID NO: 208935 - DNA, 15 bp, Homo sapiens
aagaaaggaaaatat

SEQ ID NO: 208936 - DNA, 15 bp, Homo sapiens
gaagaaaggaaaata

SEQ ID NO: 208937 - DNA, 15 bp, Homo sapiens
agaagaaaggaaaat

SEQ ID NO: 208938 - DNA, 15 bp, Homo sapiens
gagaagaaaggaaaa

SEQ ID NO: 208939 - DNA, 15 bp, Homo sapiens
agagaagaaaggaaa

SEQ ID NO: 208940 - DNA, 15 bp, Homo sapiens
tagagaagaaaggaa

SEQ ID NO: 208941 - DNA, 15 bp, Homo sapiens
ctagagaagaaagga

SEQ ID NO: 208942 - DNA, 15 bp, Homo sapiens
tctagagaagaaagg

SEQ ID NO: 208943 - DNA, 15 bp, Homo sapiens
ctctagagaagaaag

SEQ ID NO: 208944 - DNA, 15 bp, Homo sapiens
cctctagagaagaaa

SEQ ID NO: 208945 - DNA, 15 bp, Homo sapiens
gcctctagagaagaa

SEQ ID NO: 208946 - DNA, 15 bp, Homo sapiens
agcctctagagaaga

SEQ ID NO: 208947 - DNA, 15 bp, Homo sapiens
gagcctctagagaag

SEQ ID NO: 208948 - DNA, 15 bp, Homo sapiens
agagcctctagagaa

SEQ ID NO: 208949 - DNA, 15 bp, Homo sapiens
cagagcctctagaga

SEQ ID NO: 208950 - DNA, 15 bp, Homo sapiens
tcagagcctctagag

SEQ ID NO: 208951 - DNA, 15 bp, Homo sapiens
gtcagagcctctaga

SEQ ID NO: 208952 - DNA, 15 bp, Homo sapiens
agtcagagcctctag

SEQ ID NO: 208953 - DNA, 15 bp, Homo sapiens
gagtcagagcctcta

SEQ ID NO: 208954 - DNA, 15 bp, Homo sapiens
ggagtcagagcctct

SEQ ID NO: 208955 - DNA, 15 bp, Homo sapiens
aggagtcagagcctc

SEQ ID NO: 208956 - DNA, 15 bp, Homo sapiens
gaggagtcagagcct

SEQ ID NO: 208957 - DNA, 15 bp, Homo sapiens
cgaggagtcagagcc

SEQ ID NO: 208958 - DNA, 15 bp, Homo sapiens
ccgaggagtcagagc

SEQ ID NO: 208959 - DNA, 15 bp, Homo sapiens
cccgaggagtcagag

SEQ ID NO: 208960 - DNA, 15 bp, Homo sapiens
gcccgaggagtcaga

SEQ ID NO: 208961 - DNA, 15 bp, Homo sapiens
ggcccgaggagtcag

SEQ ID NO: 208962 - DNA, 15 bp, Homo sapiens
aggcccgaggagtca

SEQ ID NO: 208963 - DNA, 15 bp, Homo sapiens
gaggcccgaggagtc

SEQ ID NO: 208964 - DNA, 15 bp, Homo sapiens
agaggcccgaggagt

SEQ ID NO: 208965 - DNA, 15 bp, Homo sapiens
cagaggcccgaggag

SEQ ID NO: 208966 - DNA, 15 bp, Homo sapiens
tcagaggcccgagga

SEQ ID NO: 208967 - DNA, 15 bp, Homo sapiens
gtcagaggcccgagg

SEQ ID NO: 208968 - DNA, 15 bp, Homo sapiens
agtcagaggcccgag

SEQ ID NO: 208969 - DNA, 15 bp, Homo sapiens
gagtcagaggcccga

SEQ ID NO: 208970 - DNA, 15 bp, Homo sapiens
ggagtcagaggcccg

SEQ ID NO: 208971 - DNA, 15 bp, Homo sapiens
aggagtcagaggccc

SEQ ID NO: 208972 - DNA, 15 bp, Homo sapiens
gaggagtcagaggcc

SEQ ID NO: 208973 - DNA, 15 bp, Homo sapiens
tgaggagtcagaggc

SEQ ID NO: 208974 - DNA, 15 bp, Homo sapiens
gtgaggagtcagagg

SEQ ID NO: 208975 - DNA, 15 bp, Homo sapiens
cgtgaggagtcagag

SEQ ID NO: 208976 - DNA, 15 bp, Homo sapiens
gcgtgaggagtcaga

SEQ ID NO: 208977 - DNA, 15 bp, Homo sapiens
ggcgtgaggagtcag

SEQ ID NO: 208978 - DNA, 15 bp, Homo sapiens
aggcgtgaggagtca

SEQ ID NO: 208979 - DNA, 15 bp, Homo sapiens
aaggcgtgaggagtc

SEQ ID NO: 208980 - DNA, 15 bp, Homo sapiens
gaaggcgtgaggagt

SEQ ID NO: 208981 - DNA, 15 bp, Homo sapiens
tgaaggcgtgaggag

SEQ ID NO: 208982 - DNA, 15 bp, Homo sapiens
atgaaggcgtgagga

SEQ ID NO: 208983 - DNA, 15 bp, Homo sapiens
gatgaaggcgtgagg

SEQ ID NO: 208984 - DNA, 15 bp, Homo sapiens
ggatgaaggcgtgag

SEQ ID NO: 208985 - DNA, 15 bp, Homo sapiens
gggatgaaggcgtga

SEQ ID NO: 208986 - DNA, 15 bp, Homo sapiens
ggggatgaaggcgtg

SEQ ID NO: 208987 - DNA, 15 bp, Homo sapiens
aggggatgaaggcgt

SEQ ID NO: 208988 - DNA, 15 bp, Homo sapiens
gaggggatgaaggcg

SEQ ID NO: 208989 - DNA, 15 bp, Homo sapiens
agaggggatgaaggc

SEQ ID NO: 208990 - DNA, 15 bp, Homo sapiens
cagaggggatgaagg

SEQ ID NO: 208991 - DNA, 15 bp, Homo sapiens
tcagaggggatgaag

SEQ ID NO: 208992 - DNA, 15 bp, Homo sapiens
ctcagaggggatgaa

SEQ ID NO: 208993 - DNA, 15 bp, Homo sapiens
actcagaggggatga

SEQ ID NO: 208994 - DNA, 15 bp, Homo sapiens
aactcagaggggatg

SEQ ID NO: 208995 - DNA, 15 bp, Homo sapiens
gaactcagaggggat

SEQ ID NO: 208996 - DNA, 15 bp, Homo sapiens
agaactcagagggga

SEQ ID NO: 208997 - DNA, 15 bp, Homo sapiens
aagaactcagagggg

SEQ ID NO: 208998 - DNA, 15 bp, Homo sapiens
gaagaactcagaggg

SEQ ID NO: 208999 - DNA, 15 bp, Homo sapiens
agaagaactcagagg

SEQ ID NO: 209000 - DNA, 15 bp, Homo sapiens
tagaagaactcagag

SEQ ID NO: 209001 - DNA, 15 bp, Homo sapiens
ctagaagaactcaga

SEQ ID NO: 209002 - DNA, 15 bp, Homo sapiens
cctagaagaactcag

SEQ ID NO: 209003 - DNA, 15 bp, Homo sapiens
tcctagaagaactca

SEQ ID NO: 209004 - DNA, 15 bp, Homo sapiens
atcctagaagaactc

SEQ ID NO: 209005 - DNA, 15 bp, Homo sapiens
gatcctagaagaact

SEQ ID NO: 209006 - DNA, 15 bp, Homo sapiens
agatcctagaagaac

SEQ ID NO: 209007 - DNA, 15 bp, Homo sapiens
tagatcctagaagaa

SEQ ID NO: 209008 - DNA, 15 bp, Homo sapiens
ttagatcctagaaga

SEQ ID NO: 209009 - DNA, 15 bp, Homo sapiens
cttagatcctagaag

SEQ ID NO: 209010 - DNA, 15 bp, Homo sapiens
tcttagatcctagaa

SEQ ID NO: 209011 - DNA, 15 bp, Homo sapiens
gtcttagatcctaga

SEQ ID NO: 209012 - DNA, 15 bp, Homo sapiens
tgtcttagatcctag

SEQ ID NO: 209013 - DNA, 15 bp, Homo sapiens
gtgtcttagatccta

SEQ ID NO: 209014 - DNA, 15 bp, Homo sapiens
ggtgtcttagatcct

SEQ ID NO: 209015 - DNA, 15 bp, Homo sapiens
tggtgtcttagatcc

SEQ ID NO: 209016 - DNA, 15 bp, Homo sapiens
ctggtgtcttagatc

SEQ ID NO: 209017 - DNA, 15 bp, Homo sapiens
tctggtgtcttagat

SEQ ID NO: 209018 - DNA, 15 bp, Homo sapiens
ctctggtgtcttaga

SEQ ID NO: 209019 - DNA, 15 bp, Homo sapiens
tctctggtgtcttag

SEQ ID NO: 209020 - DNA, 15 bp, Homo sapiens
ctctctggtgtctta

SEQ ID NO: 209021 - DNA, 15 bp, Homo sapiens
cctctctggtgtctt

SEQ ID NO: 209022 - DNA, 15 bp, Homo sapiens
acctctctggtgtct

SEQ ID NO: 209023 - DNA, 15 bp, Homo sapiens
gacctctctggtgtc

SEQ ID NO: 209024 - DNA, 15 bp, Homo sapiens
ggacctctctggtgt

SEQ ID NO: 209025 - DNA, 15 bp, Homo sapiens
aggacctctctggtg

SEQ ID NO: 209026 - DNA, 15 bp, Homo sapiens
caggacctctctggt

SEQ ID NO: 209027 - DNA, 15 bp, Homo sapiens
ccaggacctctctgg

SEQ ID NO: 209028 - DNA, 15 bp, Homo sapiens
accaggacctctctg

SEQ ID NO: 209029 - DNA, 15 bp, Homo sapiens
taccaggacctctct

SEQ ID NO: 209030 - DNA, 15 bp, Homo sapiens
ataccaggacctctc

SEQ ID NO: 209031 - DNA, 15 bp, Homo sapiens
tataccaggacctct

SEQ ID NO: 209032 - DNA, 15 bp, Homo sapiens
ctataccaggacctc

SEQ ID NO: 209033 - DNA, 15 bp, Homo sapiens
tctataccaggacct

SEQ ID NO: 209034 - DNA, 15 bp, Homo sapiens
ttctataccaggacc

SEQ ID NO: 209035 - DNA, 15 bp, Homo sapiens
tttctataccaggac

SEQ ID NO: 209036 - DNA, 15 bp, Homo sapiens
ttttctataccagga

SEQ ID NO: 209037 - DNA, 15 bp, Homo sapiens
tttttctataccagg

SEQ ID NO: 209038 - DNA, 15 bp, Homo sapiens
ttttttctataccag

SEQ ID NO: 209039 - DNA, 15 bp, Homo sapiens
tttttttctatacca

SEQ ID NO: 209040 - DNA, 15 bp, Homo sapiens
gtttttttctatacc

SEQ ID NO: 209041 - DNA, 15 bp, Homo sapiens
tgtttttttctatac

SEQ ID NO: 209042 - DNA, 15 bp, Homo sapiens
gtgtttttttctata

SEQ ID NO: 209043 - DNA, 15 bp, Homo sapiens
tgtgtttttttctat

SEQ ID NO: 209044 - DNA, 15 bp, Homo sapiens
ctgtgtttttttcta

SEQ ID NO: 209045 - DNA, 15 bp, Homo sapiens
actgtgtttttttct

SEQ ID NO: 209046 - DNA, 15 bp, Homo sapiens
gactgtgtttttttc

SEQ ID NO: 209047 - DNA, 15 bp, Homo sapiens
ggactgtgttttttt

SEQ ID NO: 209048 - DNA, 15 bp, Homo sapiens
gggactgtgtttttt

SEQ ID NO: 209049 - DNA, 15 bp, Homo sapiens
agggactgtgttttt

SEQ ID NO: 209050 - DNA, 15 bp, Homo sapiens
cagggactgtgtttt

SEQ ID NO: 209051 - DNA, 15 bp, Homo sapiens
acagggactgtgttt

SEQ ID NO: 209052 - DNA, 15 bp, Homo sapiens
aacagggactgtgtt

SEQ ID NO: 209053 - DNA, 15 bp, Homo sapiens
aaacagggactgtgt

SEQ ID NO: 209054 - DNA, 15 bp, Homo sapiens
taaacagggactgtg

SEQ ID NO: 209055 - DNA, 15 bp, Homo sapiens
gtaaacagggactgt

SEQ ID NO: 209056 - DNA, 15 bp, Homo sapiens
tgtaaacagggactg

SEQ ID NO: 209057 - DNA, 15 bp, Homo sapiens
atgtaaacagggact

SEQ ID NO: 209058 - DNA, 15 bp, Homo sapiens
catgtaaacagggac

SEQ ID NO: 209059 - DNA, 15 bp, Homo sapiens
tcatgtaaacaggga

SEQ ID NO: 209060 - DNA, 15 bp, Homo sapiens
ttcatgtaaacaggg

SEQ ID NO: 209061 - DNA, 15 bp, Homo sapiens
tttcatgtaaacagg

SEQ ID NO: 209062 - DNA, 15 bp, Homo sapiens
atttcatgtaaacag

SEQ ID NO: 209063 - DNA, 15 bp, Homo sapiens
aatttcatgtaaaca

SEQ ID NO: 209064 - DNA, 15 bp, Homo sapiens
aaatttcatgtaaac

SEQ ID NO: 209065 - DNA, 15 bp, Homo sapiens
taaatttcatgtaaa

SEQ ID NO: 209066 - DNA, 15 bp, Homo sapiens
gtaaatttcatgtaa

SEQ ID NO: 209067 - DNA, 15 bp, Homo sapiens
tgtaaatttcatgta

SEQ ID NO: 209068 - DNA, 15 bp, Homo sapiens
atgtaaatttcatgt

SEQ ID NO: 209069 - DNA, 15 bp, Homo sapiens
aatgtaaatttcatg

SEQ ID NO: 209070 - DNA, 15 bp, Homo sapiens
gaatgtaaatttcat

SEQ ID NO: 209071 - DNA, 15 bp, Homo sapiens
tgaatgtaaatttca

SEQ ID NO: 209072 - DNA, 15 bp, Homo sapiens
ttgaatgtaaatttc

SEQ ID NO: 209073 - DNA, 15 bp, Homo sapiens
cttgaatgtaaattt

SEQ ID NO: 209074 - DNA, 15 bp, Homo sapiens
ccttgaatgtaaatt

SEQ ID NO: 209075 - DNA, 15 bp, Homo sapiens
cccttgaatgtaaat

SEQ ID NO: 209076 - DNA, 15 bp, Homo sapiens
tcccttgaatgtaaa

SEQ ID NO: 209077 - DNA, 15 bp, Homo sapiens
ctcccttgaatgtaa

SEQ ID NO: 209078 - DNA, 15 bp, Homo sapiens
tctcccttgaatgta

SEQ ID NO: 209079 - DNA, 15 bp, Homo sapiens
atctcccttgaatgt

SEQ ID NO: 209080 - DNA, 15 bp, Homo sapiens
gatctcccttgaatg

SEQ ID NO: 209081 - DNA, 15 bp, Homo sapiens
ggatctcccttgaat

SEQ ID NO: 209082 - DNA, 15 bp, Homo sapiens
aggatctcccttgaa

SEQ ID NO: 209083 - DNA, 15 bp, Homo sapiens
gaggatctcccttga

SEQ ID NO: 209084 - DNA, 15 bp, Homo sapiens
agaggatctcccttg

SEQ ID NO: 209085 - DNA, 15 bp, Homo sapiens
cagaggatctccctt

SEQ ID NO: 209086 - DNA, 15 bp, Homo sapiens
gcagaggatctccct

SEQ ID NO: 209087 - DNA, 15 bp, Homo sapiens
agcagaggatctccc

SEQ ID NO: 209088 - DNA, 15 bp, Homo sapiens
aagcagaggatctcc

SEQ ID NO: 209089 - DNA, 15 bp, Homo sapiens
taagcagaggatctc

SEQ ID NO: 209090 - DNA, 15 bp, Homo sapiens
ataagcagaggatct

SEQ ID NO: 209091 - DNA, 15 bp, Homo sapiens
gataagcagaggatc

SEQ ID NO: 209092 - DNA, 15 bp, Homo sapiens
ggataagcagaggat

SEQ ID NO: 209093 - DNA, 15 bp, Homo sapiens
aggataagcagagga

SEQ ID NO: 209094 - DNA, 15 bp, Homo sapiens
aaggataagcagagg

SEQ ID NO: 209095 - DNA, 15 bp, Homo sapiens
taaggataagcagag

SEQ ID NO: 209096 - DNA, 15 bp, Homo sapiens
ttaaggataagcaga

SEQ ID NO: 209097 - DNA, 15 bp, Homo sapiens
tttaaggataagcag

SEQ ID NO: 209098 - DNA, 15 bp, Homo sapiens
gtttaaggataagca

SEQ ID NO: 209099 - DNA, 15 bp, Homo sapiens
agtttaaggataagc

SEQ ID NO: 209100 - DNA, 15 bp, Homo sapiens
aagtttaaggataag

SEQ ID NO: 209101 - DNA, 15 bp, Homo sapiens
taagtttaaggataa

SEQ ID NO: 209102 - DNA, 15 bp, Homo sapiens
ctaagtttaaggata

SEQ ID NO: 209103 - DNA, 15 bp, Homo sapiens
tctaagtttaaggat

SEQ ID NO: 209104 - DNA, 15 bp, Homo sapiens
ctctaagtttaagga

SEQ ID NO: 209105 - DNA, 15 bp, Homo sapiens
actctaagtttaagg

SEQ ID NO: 209106 - DNA, 15 bp, Homo sapiens
aactctaagtttaag

SEQ ID NO: 209107 - DNA, 15 bp, Homo sapiens
gaactctaagtttaa

SEQ ID NO: 209108 - DNA, 15 bp, Homo sapiens
ggaactctaagttta

SEQ ID NO: 209109 - DNA, 15 bp, Homo sapiens
aggaactctaagttt

SEQ ID NO: 209110 - DNA, 15 bp, Homo sapiens
caggaactctaagtt

SEQ ID NO: 209111 - DNA, 15 bp, Homo sapiens
acaggaactctaagt

SEQ ID NO: 209112 - DNA, 15 bp, Homo sapiens
aacaggaactctaag

SEQ ID NO: 209113 - DNA, 15 bp, Homo sapiens
gaacaggaactctaa

SEQ ID NO: 209114 - DNA, 15 bp, Homo sapiens
agaacaggaactcta

SEQ ID NO: 209115 - DNA, 15 bp, Homo sapiens
gagaacaggaactct

SEQ ID NO: 209116 - DNA, 15 bp, Homo sapiens
agagaacaggaactc

SEQ ID NO: 209117 - DNA, 15 bp, Homo sapiens
cagagaacaggaact

SEQ ID NO: 209118 - DNA, 15 bp, Homo sapiens
acagagaacaggaac

SEQ ID NO: 209119 - DNA, 15 bp, Homo sapiens
cacagagaacaggaa

SEQ ID NO: 209120 - DNA, 15 bp, Homo sapiens
acacagagaacagga

SEQ ID NO: 209121 - DNA, 15 bp, Homo sapiens
aacacagagaacagg

SEQ ID NO: 209122 - DNA, 15 bp, Homo sapiens
aaacacagagaacag

SEQ ID NO: 209123 - DNA, 15 bp, Homo sapiens
aaaacacagagaaca

SEQ ID NO: 209124 - DNA, 15 bp, Homo sapiens
caaaacacagagaac

SEQ ID NO: 209125 - DNA, 15 bp, Homo sapiens
tcaaaacacagagaa

SEQ ID NO: 209126 - DNA, 15 bp, Homo sapiens
ctcaaaacacagaga

SEQ ID NO: 209127 - DNA, 15 bp, Homo sapiens
tctcaaaacacagag

SEQ ID NO: 209128 - DNA, 15 bp, Homo sapiens
ttctcaaaacacaga

SEQ ID NO: 209129 - DNA, 15 bp, Homo sapiens
tttctcaaaacacag

SEQ ID NO: 209130 - DNA, 15 bp, Homo sapiens
atttctcaaaacaca

SEQ ID NO: 209131 - DNA, 15 bp, Homo sapiens
gatttctcaaaacac

SEQ ID NO: 209132 - DNA, 15 bp, Homo sapiens
tgatttctcaaaaca

SEQ ID NO: 209133 - DNA, 15 bp, Homo sapiens
atgatttctcaaaac

SEQ ID NO: 209134 - DNA, 15 bp, Homo sapiens
aatgatttctcaaaa

SEQ ID NO: 209135 - DNA, 15 bp, Homo sapiens
aaatgatttctcaaa

SEQ ID NO: 209136 - DNA, 15 bp, Homo sapiens
gaaatgatttctcaa

SEQ ID NO: 209137 - DNA, 15 bp, Homo sapiens
ggaaatgatttctca

SEQ ID NO: 209138 - DNA, 15 bp, Homo sapiens
gggaaatgatttctc

SEQ ID NO: 209139 - DNA, 15 bp, Homo sapiens
tgggaaatgatttct

SEQ ID NO: 209140 - DNA, 15 bp, Homo sapiens
ttgggaaatgatttc

SEQ ID NO: 209141 - DNA, 15 bp, Homo sapiens
tttgggaaatgattt

SEQ ID NO: 209142 - DNA, 15 bp, Homo sapiens
ttttgggaaatgatt

SEQ ID NO: 209143 - DNA, 15 bp, Homo sapiens
cttttgggaaatgat

SEQ ID NO: 209144 - DNA, 15 bp, Homo sapiens
ccttttgggaaatga

SEQ ID NO: 209145 - DNA, 15 bp, Homo sapiens
accttttgggaaatg

SEQ ID NO: 209146 - DNA, 15 bp, Homo sapiens
aaccttttgggaaat

SEQ ID NO: 209147 - DNA, 15 bp, Homo sapiens
taaccttttgggaaa

SEQ ID NO: 209148 - DNA, 15 bp, Homo sapiens
ataaccttttgggaa

SEQ ID NO: 209149 - DNA, 15 bp, Homo sapiens
cataaccttttggga

SEQ ID NO: 209150 - DNA, 15 bp, Homo sapiens
ccataaccttttggg

SEQ ID NO: 209151 - DNA, 15 bp, Homo sapiens
gccataaccttttgg

SEQ ID NO: 209152 - DNA, 15 bp, Homo sapiens
agccataaccttttg

SEQ ID NO: 209153 - DNA, 15 bp, Homo sapiens
cagccataacctttt

SEQ ID NO: 209154 - DNA, 15 bp, Homo sapiens
tcagccataaccttt

SEQ ID NO: 209155 - DNA, 15 bp, Homo sapiens
ctcagccataacctt

SEQ ID NO: 209156 - DNA, 15 bp, Homo sapiens
gctcagccataacct

SEQ ID NO: 209157 - DNA, 15 bp, Homo sapiens
agctcagccataacc

SEQ ID NO: 209158 - DNA, 15 bp, Homo sapiens
cagctcagccataac

SEQ ID NO: 209159 - DNA, 15 bp, Homo sapiens
cacagctcagccata

SEQ ID NO: 209160 - DNA, 15 bp, Homo sapiens
tcacagctcagccat

SEQ ID NO: 209161 - DNA, 15 bp, Homo sapiens
ttcacagctcagcca

SEQ ID NO: 209162 - DNA, 15 bp, Homo sapiens
gttcacagctcagcc

SEQ ID NO: 209163 - DNA, 15 bp, Homo sapiens
agttcacagctcagc

SEQ ID NO: 209164 - DNA, 15 bp, Homo sapiens
cagttcacagctcag

SEQ ID NO: 209165 - DNA, 15 bp, Homo sapiens
gcagttcacagctca

SEQ ID NO: 209166 - DNA, 15 bp, Homo sapiens
cgcagttcacagctc

SEQ ID NO: 209167 - DNA, 15 bp, Homo sapiens
gcgcagttcacagct

SEQ ID NO: 209168 - DNA, 15 bp, Homo sapiens
tgcgcagttcacagc

SEQ ID NO: 209169 - DNA, 15 bp, Homo sapiens
atgcgcagttcacag

SEQ ID NO: 209170 - DNA, 15 bp, Homo sapiens
aatgcgcagttcaca

SEQ ID NO: 209171 - DNA, 15 bp, Homo sapiens
caatgcgcagttcac

SEQ ID NO: 209172 - DNA, 15 bp, Homo sapiens
acaatgcgcagttca

SEQ ID NO: 209173 - DNA, 15 bp, Homo sapiens
aacaatgcgcagttc

SEQ ID NO: 209174 - DNA, 15 bp, Homo sapiens
taacaatgcgcagtt

SEQ ID NO: 209175 - DNA, 15 bp, Homo sapiens
ataacaatgcgcagt

SEQ ID NO: 209176 - DNA, 15 bp, Homo sapiens
gataacaatgcgcag

SEQ ID NO: 209177 - DNA, 15 bp, Homo sapiens
ggataacaatgcgca

SEQ ID NO: 209178 - DNA, 15 bp, Homo sapiens
gggataacaatgcgc

SEQ ID NO: 209179 - DNA, 15 bp, Homo sapiens
tgggataacaatgcg

SEQ ID NO: 209180 - DNA, 15 bp, Homo sapiens
ttgggataacaatgc

SEQ ID NO: 209181 - DNA, 15 bp, Homo sapiens
tttgggataacaatg

SEQ ID NO: 209182 - DNA, 15 bp, Homo sapiens
atttgggataacaat

SEQ ID NO: 209183 - DNA, 15 bp, Homo sapiens
gatttgggataacaa

SEQ ID NO: 209184 - DNA, 15 bp, Homo sapiens
agatttgggataaca

SEQ ID NO: 209185 - DNA, 15 bp, Homo sapiens
gagatttgggataac

SEQ ID NO: 209186 - DNA, 15 bp, Homo sapiens
tgagatttgggataa

SEQ ID NO: 209187 - DNA, 15 bp, Homo sapiens
ctgagatttgggata

SEQ ID NO: 209188 - DNA, 15 bp, Homo sapiens
cctgagatttgggat

SEQ ID NO: 209189 - DNA, 15 bp, Homo sapiens
acctgagatttggga

SEQ ID NO: 209190 - DNA, 15 bp, Homo sapiens
aacctgagatttggg

SEQ ID NO: 209191 - DNA, 15 bp, Homo sapiens
caacctgagatttgg

SEQ ID NO: 209192 - DNA, 15 bp, Homo sapiens
acaacctgagatttg

SEQ ID NO: 209193 - DNA, 15 bp, Homo sapiens
gacaacctgagattt

SEQ ID NO: 209194 - DNA, 15 bp, Homo sapiens
agacaacctgagatt

SEQ ID NO: 209195 - DNA, 15 bp, Homo sapiens
aagacaacctgagat

SEQ ID NO: 209196 - DNA, 15 bp, Homo sapiens
aaagacaacctgaga

SEQ ID NO: 209197 - DNA, 15 bp, Homo sapiens
caaagacaacctgag

SEQ ID NO: 209198 - DNA, 15 bp, Homo sapiens
gcaaagacaacctga

SEQ ID NO: 209199 - DNA, 15 bp, Homo sapiens
ggcaaagacaacctg

SEQ ID NO: 209200 - DNA, 15 bp, Homo sapiens
gggcaaagacaacct

SEQ ID NO: 209201 - DNA, 15 bp, Homo sapiens
tgggcaaagacaacc

SEQ ID NO: 209202 - DNA, 15 bp, Homo sapiens
ctgggcaaagacaac

SEQ ID NO: 209203 - DNA, 15 bp, Homo sapiens
actgggcaaagacaa

SEQ ID NO: 209204 - DNA, 15 bp, Homo sapiens
gactgggcaaagaca

SEQ ID NO: 209205 - DNA, 15 bp, Homo sapiens
tgactgggcaaagac

SEQ ID NO: 209206 - DNA, 15 bp, Homo sapiens
atgactgggcaaaga

SEQ ID NO: 209207 - DNA, 15 bp, Homo sapiens
gatgactgggcaaag

SEQ ID NO: 209208 - DNA, 15 bp, Homo sapiens
ggatgactgggcaaa

SEQ ID NO: 209209 - DNA, 15 bp, Homo sapiens
tggatgactgggcaa

SEQ ID NO: 209210 - DNA, 15 bp, Homo sapiens
gtggatgactgggca

SEQ ID NO: 209211 - DNA, 15 bp, Homo sapiens
agtggatgactgggc

SEQ ID NO: 209212 - DNA, 15 bp, Homo sapiens
aagtggatgactggg

SEQ ID NO: 209213 - DNA, 15 bp, Homo sapiens
gaagtggatgactgg

SEQ ID NO: 209214 - DNA, 15 bp, Homo sapiens
agaagtggatgactg

SEQ ID NO: 209215 - DNA, 15 bp, Homo sapiens
cagaagtggatgact

SEQ ID NO: 209216 - DNA, 15 bp, Homo sapiens
acagaagtggatgac

SEQ ID NO: 209217 - DNA, 15 bp, Homo sapiens
tacagaagtggatga

SEQ ID NO: 209218 - DNA, 15 bp, Homo sapiens
ttacagaagtggatg

SEQ ID NO: 209219 - DNA, 15 bp, Homo sapiens
gttacagaagtggat

SEQ ID NO: 209220 - DNA, 15 bp, Homo sapiens
ggttacagaagtgga

SEQ ID NO: 209221 - DNA, 15 bp, Homo sapiens
gggttacagaagtgg

SEQ ID NO: 209222 - DNA, 15 bp, Homo sapiens
ggggttacagaagtg

SEQ ID NO: 209223 - DNA, 15 bp, Homo sapiens
tggggttacagaagt

SEQ ID NO: 209224 - DNA, 15 bp, Homo sapiens
ttggggttacagaag

SEQ ID NO: 209225 - DNA, 15 bp, Homo sapiens
gttggggttacagaa

SEQ ID NO: 209226 - DNA, 15 bp, Homo sapiens
agttggggttacaga

SEQ ID NO: 209227 - DNA, 15 bp, Homo sapiens
aagttggggttacag

SEQ ID NO: 209228 - DNA, 15 bp, Homo sapiens
aaagttggggttaca

SEQ ID NO: 209229 - DNA, 15 bp, Homo sapiens
aaaagttggggttac

SEQ ID NO: 209230 - DNA, 15 bp, Homo sapiens
gaaaagttggggtta

SEQ ID NO: 209231 - DNA, 15 bp, Homo sapiens
agaaaagttggggtt

SEQ ID NO: 209232 - DNA, 15 bp, Homo sapiens
gagaaaagttggggt

SEQ ID NO: 209233 - DNA, 15 bp, Homo sapiens
ggagaaaagttgggg

SEQ ID NO: 209234 - DNA, 15 bp, Homo sapiens
gggagaaaagttggg

SEQ ID NO: 209235 - DNA, 15 bp, Homo sapiens
agggagaaaagttgg

SEQ ID NO: 209236 - DNA, 15 bp, Homo sapiens
aagggagaaaagttg

SEQ ID NO: 209237 - DNA, 15 bp, Homo sapiens
caagggagaaaagtt

SEQ ID NO: 209238 - DNA, 15 bp, Homo sapiens
ccaagggagaaaagt

SEQ ID NO: 209239 - DNA, 15 bp, Homo sapiens
accaagggagaaaag

SEQ ID NO: 209240 - DNA, 15 bp, Homo sapiens
caccaagggagaaaa

SEQ ID NO: 209241 - DNA, 15 bp, Homo sapiens
acaccaagggagaaa

SEQ ID NO: 209242 - DNA, 15 bp, Homo sapiens
aacaccaagggagaa

SEQ ID NO: 209243 - DNA, 15 bp, Homo sapiens
aaacaccaagggaga

SEQ ID NO: 209244 - DNA, 15 bp, Homo sapiens
aaaacaccaagggag

SEQ ID NO: 209245 - DNA, 15 bp, Homo sapiens
taaaacaccaaggga

SEQ ID NO: 209246 - DNA, 15 bp, Homo sapiens
ctaaaacaccaaggg

SEQ ID NO: 209247 - DNA, 15 bp, Homo sapiens
actaaaacaccaagg

SEQ ID NO: 209248 - DNA, 15 bp, Homo sapiens
gactaaaacaccaag

SEQ ID NO: 209249 - DNA, 15 bp, Homo sapiens
agactaaaacaccaa

SEQ ID NO: 209250 - DNA, 15 bp, Homo sapiens
cagactaaaacacca

SEQ ID NO: 209251 - DNA, 15 bp, Homo sapiens
acagactaaaacacc

SEQ ID NO: 209252 - DNA, 15 bp, Homo sapiens
gacagactaaaacac

SEQ ID NO: 209253 - DNA, 15 bp, Homo sapiens
agacagactaaaaca

SEQ ID NO: 209254 - DNA, 15 bp, Homo sapiens
aagacagactaaaac

SEQ ID NO: 209255 - DNA, 15 bp, Homo sapiens
aaagacagactaaaa

SEQ ID NO: 209256 - DNA, 15 bp, Homo sapiens
aaaagacagactaaa

SEQ ID NO: 209257 - DNA, 15 bp, Homo sapiens
caaaagacagactaa

SEQ ID NO: 209258 - DNA, 15 bp, Homo sapiens
gcaaaagacagacta

SEQ ID NO: 209259 - DNA, 15 bp, Homo sapiens
agcaaaagacagact

SEQ ID NO: 209260 - DNA, 15 bp, Homo sapiens
cagcaaaagacagac

SEQ ID NO: 209261 - DNA, 15 bp, Homo sapiens
gcagcaaaagacaga

SEQ ID NO: 209262 - DNA, 15 bp, Homo sapiens
agcagcaaaagacag

SEQ ID NO: 209263 - DNA, 15 bp, Homo sapiens
cagcagcaaaagaca

SEQ ID NO: 209264 - DNA, 15 bp, Homo sapiens
acagcagcaaaagac

SEQ ID NO: 209265 - DNA, 15 bp, Homo sapiens
tacagcagcaaaaga

SEQ ID NO: 209266 - DNA, 15 bp, Homo sapiens
ttacagcagcaaaag

SEQ ID NO: 209267 - DNA, 15 bp, Homo sapiens
gttacagcagcaaaa

SEQ ID NO: 209268 - DNA, 15 bp, Homo sapiens
tgttacagcagcaaa

SEQ ID NO: 209269 - DNA, 15 bp, Homo sapiens
ctgttacagcagcaa

SEQ ID NO: 209270 - DNA, 15 bp, Homo sapiens
tctgttacagcagca

SEQ ID NO: 209271 - DNA, 15 bp, Homo sapiens
ttctgttacagcagc

SEQ ID NO: 209272 - DNA, 15 bp, Homo sapiens
attctgttacagcag

SEQ ID NO: 209273 - DNA, 15 bp, Homo sapiens
cattctgttacagca

SEQ ID NO: 209274 - DNA, 15 bp, Homo sapiens
acattctgttacagc

SEQ ID NO: 209275 - DNA, 15 bp, Homo sapiens
gacattctgttacag

SEQ ID NO: 209276 - DNA, 15 bp, Homo sapiens
tgacattctgttaca

SEQ ID NO: 209277 - DNA, 15 bp, Homo sapiens
ctgacattctgttac

SEQ ID NO: 209278 - DNA, 15 bp, Homo sapiens
cctgacattctgtta

SEQ ID NO: 209279 - DNA, 15 bp, Homo sapiens
ccctgacattctgtt

SEQ ID NO: 209280 - DNA, 15 bp, Homo sapiens
tccctgacattctgt

SEQ ID NO: 209281 - DNA, 15 bp, Homo sapiens
gtccctgacattctg

SEQ ID NO: 209282 - DNA, 15 bp, Homo sapiens
agtccctgacattct

SEQ ID NO: 209283 - DNA, 15 bp, Homo sapiens
cagtccctgacattc

SEQ ID NO: 209284 - DNA, 15 bp, Homo sapiens
tcagtccctgacatt

SEQ ID NO: 209285 - DNA, 15 bp, Homo sapiens
ctcagtccctgacat

SEQ ID NO: 209286 - DNA, 15 bp, Homo sapiens
actcagtccctgaca

SEQ ID NO: 209287 - DNA, 15 bp, Homo sapiens
gactcagtccctgac

SEQ ID NO: 209288 - DNA, 15 bp, Homo sapiens
tgactcagtccctga

SEQ ID NO: 209289 - DNA, 15 bp, Homo sapiens
atgactcagtccctg

SEQ ID NO: 209290 - DNA, 15 bp, Homo sapiens
aatgactcagtccct

SEQ ID NO: 209291 - DNA, 15 bp, Homo sapiens
aaatgactcagtccc

SEQ ID NO: 209292 - DNA, 15 bp, Homo sapiens
taaatgactcagtcc

SEQ ID NO: 209293 - DNA, 15 bp, Homo sapiens
ataaatgactcagtc

SEQ ID NO: 209294 - DNA, 15 bp, Homo sapiens
tataaatgactcagt

SEQ ID NO: 209295 - DNA, 15 bp, Homo sapiens
ttataaatgactcag

SEQ ID NO: 209296 - DNA, 15 bp, Homo sapiens
cttataaatgactca

SEQ ID NO: 209297 - DNA, 15 bp, Homo sapiens
ccttataaatgactc

SEQ ID NO: 209298 - DNA, 15 bp, Homo sapiens
tccttataaatgact

SEQ ID NO: 209299 - DNA, 15 bp, Homo sapiens
ttccttataaatgac

SEQ ID NO: 209300 - DNA, 15 bp, Homo sapiens
cttccttataaatga

SEQ ID NO: 209301 - DNA, 15 bp, Homo sapiens
tcttccttataaatg

SEQ ID NO: 209302 - DNA, 15 bp, Homo sapiens
ctcttccttataaat

SEQ ID NO: 209303 - DNA, 15 bp, Homo sapiens
tctcttccttataaa

SEQ ID NO: 209304 - DNA, 15 bp, Homo sapiens
ctctcttccttataa

SEQ ID NO: 209305 - DNA, 15 bp, Homo sapiens
tctctcttccttata

SEQ ID NO: 209306 - DNA, 15 bp, Homo sapiens
atctctcttccttat

SEQ ID NO: 209307 - DNA, 15 bp, Homo sapiens
aatctctcttcctta

SEQ ID NO: 209308 - DNA, 15 bp, Homo sapiens
aaatctctcttcctt

SEQ ID NO: 209309 - DNA, 15 bp, Homo sapiens
taaatctctcttcct

SEQ ID NO: 209310 - DNA, 15 bp, Homo sapiens
ataaatctctcttcc

SEQ ID NO: 209311 - DNA, 15 bp, Homo sapiens
aataaatctctcttc

SEQ ID NO: 209312 - DNA, 15 bp, Homo sapiens
aaataaatctctctt

SEQ ID NO: 209313 - DNA, 15 bp, Homo sapiens
caaataaatctctct

SEQ ID NO: 209314 - DNA, 15 bp, Homo sapiens
ccaaataaatctctc

SEQ ID NO: 209315 - DNA, 15 bp, Homo sapiens
gccaaataaatctct

SEQ ID NO: 209316 - DNA, 15 bp, Homo sapiens
agccaaataaatctc

SEQ ID NO: 209317 - DNA, 15 bp, Homo sapiens
gagccaaataaatct

SEQ ID NO: 209318 - DNA, 15 bp, Homo sapiens
tgagccaaataaatc

SEQ ID NO: 209319 - DNA, 15 bp, Homo sapiens
gtgagccaaataaat

SEQ ID NO: 209320 - DNA, 15 bp, Homo sapiens
tgtgagccaaataaa

SEQ ID NO: 209321 - DNA, 15 bp, Homo sapiens
gtgtgagccaaataa

SEQ ID NO: 209322 - DNA, 15 bp, Homo sapiens
agtgtgagccaaata

SEQ ID NO: 209323 - DNA, 15 bp, Homo sapiens
aagtgtgagccaaat

SEQ ID NO: 209324 - DNA, 15 bp, Homo sapiens
aaagtgtgagccaaa

SEQ ID NO: 209325 - DNA, 15 bp, Homo sapiens
aaaagtgtgagccaa

SEQ ID NO: 209326 - DNA, 15 bp, Homo sapiens
caaaagtgtgagcca

SEQ ID NO: 209327 - DNA, 15 bp, Homo sapiens
ccaaaagtgtgagcc

SEQ ID NO: 209328 - DNA, 15 bp, Homo sapiens
tccaaaagtgtgagc

SEQ ID NO: 209329 - DNA, 15 bp, Homo sapiens
ctccaaaagtgtgag

SEQ ID NO: 209330 - DNA, 15 bp, Homo sapiens
cctccaaaagtgtga

SEQ ID NO: 209331 - DNA, 15 bp, Homo sapiens
gcctccaaaagtgtg

SEQ ID NO: 209332 - DNA, 15 bp, Homo sapiens
agcctccaaaagtgt

SEQ ID NO: 209333 - DNA, 15 bp, Homo sapiens
cagcctccaaaagtg

SEQ ID NO: 209334 - DNA, 15 bp, Homo sapiens
ccagcctccaaaagt

SEQ ID NO: 209335 - DNA, 15 bp, Homo sapiens
cccagcctccaaaag

SEQ ID NO: 209336 - DNA, 15 bp, Homo sapiens
gcccagcctccaaaa

SEQ ID NO: 209337 - DNA, 15 bp, Homo sapiens
agcccagcctccaaa

SEQ ID NO: 209338 - DNA, 15 bp, Homo sapiens
gagcccagcctccaa

SEQ ID NO: 209339 - DNA, 15 bp, Homo sapiens
tgagcccagcctcca

SEQ ID NO: 209340 - DNA, 15 bp, Homo sapiens
gtgagcccagcctcc

SEQ ID NO: 209341 - DNA, 15 bp, Homo sapiens
tgtgagcccagcctc

SEQ ID NO: 209342 - DNA, 15 bp, Homo sapiens
ctgtgagcccagcct

SEQ ID NO: 209343 - DNA, 15 bp, Homo sapiens
actgtgagcccagcc

SEQ ID NO: 209344 - DNA, 15 bp, Homo sapiens
aactgtgagcccagc

SEQ ID NO: 209345 - DNA, 15 bp, Homo sapiens
gaactgtgagcccag

SEQ ID NO: 209346 - DNA, 15 bp, Homo sapiens
ggaactgtgagccca

SEQ ID NO: 209347 - DNA, 15 bp, Homo sapiens
tggaactgtgagccc

SEQ ID NO: 209348 - DNA, 15 bp, Homo sapiens
ctggaactgtgagcc

SEQ ID NO: 209349 - DNA, 15 bp, Homo sapiens
tctggaactgtgagc

SEQ ID NO: 209350 - DNA, 15 bp, Homo sapiens
ctctggaactgtgag

SEQ ID NO: 209351 - DNA, 15 bp, Homo sapiens
cctctggaactgtga

SEQ ID NO: 209352 - DNA, 15 bp, Homo sapiens
gcctctggaactgtg

SEQ ID NO: 209353 - DNA, 15 bp, Homo sapiens
cgcctctggaactgt

SEQ ID NO: 209354 - DNA, 15 bp, Homo sapiens
ccgcctctggaactg

SEQ ID NO: 209355 - DNA, 15 bp, Homo sapiens
cccgcctctggaact

SEQ ID NO: 209356 - DNA, 15 bp, Homo sapiens
ccccgcctctggaac

SEQ ID NO: 209357 - DNA, 15 bp, Homo sapiens
tccccgcctctggaa

SEQ ID NO: 209358 - DNA, 15 bp, Homo sapiens
ttccccgcctctgga

SEQ ID NO: 209359 - DNA, 15 bp, Homo sapiens
cttccccgcctctgg

SEQ ID NO: 209360 - DNA, 15 bp, Homo sapiens
acttccccgcctctg

SEQ ID NO: 209361 - DNA, 15 bp, Homo sapiens
aacttccccgcctct

SEQ ID NO: 209362 - DNA, 15 bp, Homo sapiens
gaacttccccgcctc

SEQ ID NO: 209363 - DNA, 15 bp, Homo sapiens
tgaacttccccgcct

SEQ ID NO: 209364 - DNA, 15 bp, Homo sapiens
ttgaacttccccgcc

SEQ ID NO: 209365 - DNA, 15 bp, Homo sapiens
tttgaacttccccgc

SEQ ID NO: 209366 - DNA, 15 bp, Homo sapiens
atttgaacttccccg

SEQ ID NO: 209367 - DNA, 15 bp, Homo sapiens
gatttgaacttcccc

SEQ ID NO: 209368 - DNA, 15 bp, Homo sapiens
tgatttgaacttccc

SEQ ID NO: 209369 - DNA, 15 bp, Homo sapiens
ttgatttgaacttcc

SEQ ID NO: 209370 - DNA, 15 bp, Homo sapiens
cttgatttgaacttc

SEQ ID NO: 209371 - DNA, 15 bp, Homo sapiens
ccttgatttgaactt

SEQ ID NO: 209372 - DNA, 15 bp, Homo sapiens
cccttgatttgaact

SEQ ID NO: 209373 - DNA, 15 bp, Homo sapiens
gcccttgatttgaac

SEQ ID NO: 209374 - DNA, 15 bp, Homo sapiens
ggcccttgatttgaa

SEQ ID NO: 209375 - DNA, 15 bp, Homo sapiens
aggcccttgatttga

SEQ ID NO: 209376 - DNA, 15 bp, Homo sapiens
caggcccttgatttg

SEQ ID NO: 209377 - DNA, 15 bp, Homo sapiens
acaggcccttgattt

SEQ ID NO: 209378 - DNA, 15 bp, Homo sapiens
tacaggcccttgatt

SEQ ID NO: 209379 - DNA, 15 bp, Homo sapiens
atacaggcccttgat

SEQ ID NO: 209380 - DNA, 15 bp, Homo sapiens
gatacaggcccttga

SEQ ID NO: 209381 - DNA, 15 bp, Homo sapiens
agatacaggcccttg

SEQ ID NO: 209382 - DNA, 15 bp, Homo sapiens
cagatacaggccctt

SEQ ID NO: 209383 - DNA, 15 bp, Homo sapiens
tcagatacaggccct

SEQ ID NO: 209384 - DNA, 15 bp, Homo sapiens
atcagatacaggccc

SEQ ID NO: 209385 - DNA, 15 bp, Homo sapiens
catcagatacaggcc

SEQ ID NO: 209386 - DNA, 15 bp, Homo sapiens
tcatcagatacaggc

SEQ ID NO: 209387 - DNA, 15 bp, Homo sapiens
ctcatcagatacagg

SEQ ID NO: 209388 - DNA, 15 bp, Homo sapiens
cctcatcagatacag

SEQ ID NO: 209389 - DNA, 15 bp, Homo sapiens
ccctcatcagataca

SEQ ID NO: 209390 - DNA, 15 bp, Homo sapiens
accctcatcagatac

SEQ ID NO: 209391 - DNA, 15 bp, Homo sapiens
gaccctcatcagata

SEQ ID NO: 209392 - DNA, 15 bp, Homo sapiens
agaccctcatcagat

SEQ ID NO: 209393 - DNA, 15 bp, Homo sapiens
aagaccctcatcaga

SEQ ID NO: 209394 - DNA, 15 bp, Homo sapiens
gaagaccctcatcag

SEQ ID NO: 209395 - DNA, 15 bp, Homo sapiens
ggaagaccctcatca

SEQ ID NO: 209396 - DNA, 15 bp, Homo sapiens
aggaagaccctcatc

SEQ ID NO: 209397 - DNA, 15 bp, Homo sapiens
caggaagaccctcat

SEQ ID NO: 209398 - DNA, 15 bp, Homo sapiens
gcaggaagaccctca

SEQ ID NO: 209399 - DNA, 15 bp, Homo sapiens
agcaggaagaccctc

SEQ ID NO: 209400 - DNA, 15 bp, Homo sapiens
cagcaggaagaccct

SEQ ID NO: 209401 - DNA, 15 bp, Homo sapiens
acagcaggaagaccc

SEQ ID NO: 209402 - DNA, 15 bp, Homo sapiens
cacagcaggaagacc

SEQ ID NO: 209403 - DNA, 15 bp, Homo sapiens
acacagcaggaagac

SEQ ID NO: 209404 - DNA, 15 bp, Homo sapiens
gacacagcaggaaga

SEQ ID NO: 209405 - DNA, 15 bp, Homo sapiens
tgacacagcaggaag

SEQ ID NO: 209406 - DNA, 15 bp, Homo sapiens
atgacacagcaggaa

SEQ ID NO: 209407 - DNA, 15 bp, Homo sapiens
gatgacacagcagga

SEQ ID NO: 209408 - DNA, 15 bp, Homo sapiens
ggatgacacagcagg

SEQ ID NO: 209409 - DNA, 15 bp, Homo sapiens
tggatgacacagcag

SEQ ID NO: 209410 - DNA, 15 bp, Homo sapiens
ttggatgacacagca

SEQ ID NO: 209411 - DNA, 15 bp, Homo sapiens
attggatgacacagc

SEQ ID NO: 209412 - DNA, 15 bp, Homo sapiens
cattggatgacacag

SEQ ID NO: 209413 - DNA, 15 bp, Homo sapiens
ccattggatgacaca

SEQ ID NO: 209414 - DNA, 15 bp, Homo sapiens
accattggatgacac

SEQ ID NO: 209415 - DNA, 15 bp, Homo sapiens
caccattggatgaca

SEQ ID NO: 209416 - DNA, 15 bp, Homo sapiens
ccaccattggatgac

SEQ ID NO: 209417 - DNA, 15 bp, Homo sapiens
tccaccattggatga

SEQ ID NO: 209418 - DNA, 15 bp, Homo sapiens
ttccaccattggatg

SEQ ID NO: 209419 - DNA, 15 bp, Homo sapiens
tttccaccattggat

SEQ ID NO: 209420 - DNA, 15 bp, Homo sapiens
ctttccaccattgga

SEQ ID NO: 209421 - DNA, 15 bp, Homo sapiens
gctttccaccattgg

SEQ ID NO: 209422 - DNA, 15 bp, Homo sapiens
tgctttccaccattg

SEQ ID NO: 209423 - DNA, 15 bp, Homo sapiens
gtgctttccaccatt

SEQ ID NO: 209424 - DNA, 15 bp, Homo sapiens
tgtgctttccaccat

SEQ ID NO: 209425 - DNA, 15 bp, Homo sapiens
ttgtgctttccacca

SEQ ID NO: 209426 - DNA, 15 bp, Homo sapiens
tttgtgctttccacc

SEQ ID NO: 209427 - DNA, 15 bp, Homo sapiens
ctttgtgctttccac

SEQ ID NO: 209428 - DNA, 15 bp, Homo sapiens
cctttgtgctttcca

SEQ ID NO: 209429 - DNA, 15 bp, Homo sapiens
gcctttgtgctttcc

SEQ ID NO: 209430 - DNA, 15 bp, Homo sapiens
tgcctttgtgctttc

SEQ ID NO: 209431 - DNA, 15 bp, Homo sapiens
ttgcctttgtgcttt

SEQ ID NO: 209432 - DNA, 15 bp, Homo sapiens
cttgcctttgtgctt

SEQ ID NO: 209433 - DNA, 15 bp, Homo sapiens
tcttgcctttgtgct

SEQ ID NO: 209434 - DNA, 15 bp, Homo sapiens
ctcttgcctttgtgc

SEQ ID NO: 209435 - DNA, 15 bp, Homo sapiens
tctcttgcctttgtg

SEQ ID NO: 209436 - DNA, 15 bp, Homo sapiens
ctctcttgcctttgt

SEQ ID NO: 209437 - DNA, 15 bp, Homo sapiens
gctctcttgcctttg

SEQ ID NO: 209438 - DNA, 15 bp, Homo sapiens
cgctctcttgccttt

SEQ ID NO: 209439 - DNA, 15 bp, Homo sapiens
acgctctcttgcctt

SEQ ID NO: 209440 - DNA, 15 bp, Homo sapiens
aacgctctcttgcct

SEQ ID NO: 209441 - DNA, 15 bp, Homo sapiens
gaacgctctcttgcc

SEQ ID NO: 209442 - DNA, 15 bp, Homo sapiens
tgaacgctctcttgc

SEQ ID NO: 209443 - DNA, 15 bp, Homo sapiens
atgaacgctctcttg

SEQ ID NO: 209444 - DNA, 15 bp, Homo sapiens
catgaacgctctctt

SEQ ID NO: 209445 - DNA, 15 bp, Homo sapiens
tcatgaacgctctct

SEQ ID NO: 209446 - DNA, 15 bp, Homo sapiens
gtcatgaacgctctc

SEQ ID NO: 209447 - DNA, 15 bp, Homo sapiens
tgtcatgaacgctct

SEQ ID NO: 209448 - DNA, 15 bp, Homo sapiens
ctgtcatgaacgctc

SEQ ID NO: 209449 - DNA, 15 bp, Homo sapiens
tctgtcatgaacgct

SEQ ID NO: 209450 - DNA, 15 bp, Homo sapiens
ctctgtcatgaacgc

SEQ ID NO: 209451 - DNA, 15 bp, Homo sapiens
tctctgtcatgaacg

SEQ ID NO: 209452 - DNA, 15 bp, Homo sapiens
ctctctgtcatgaac

SEQ ID NO: 209453 - DNA, 15 bp, Homo sapiens
cctctctgtcatgaa

SEQ ID NO: 209454 - DNA, 15 bp, Homo sapiens
tcctctctgtcatga

SEQ ID NO: 209455 - DNA, 15 bp, Homo sapiens
ctcctctctgtcatg

SEQ ID NO: 209456 - DNA, 15 bp, Homo sapiens
tctcctctctgtcat

SEQ ID NO: 209457 - DNA, 15 bp, Homo sapiens
atctcctctctgtca

SEQ ID NO: 209458 - DNA, 15 bp, Homo sapiens
catctcctctctgtc

SEQ ID NO: 209459 - DNA, 15 bp, Homo sapiens
ccatctcctctctgt

SEQ ID NO: 209460 - DNA, 15 bp, Homo sapiens
tccatctcctctctg

SEQ ID NO: 209461 - DNA, 15 bp, Homo sapiens
ttccatctcctctct

SEQ ID NO: 209462 - DNA, 15 bp, Homo sapiens
cttccatctcctctc

SEQ ID NO: 209463 - DNA, 15 bp, Homo sapiens
gcttccatctcctct

SEQ ID NO: 209464 - DNA, 15 bp, Homo sapiens
agcttccatctcctc

SEQ ID NO: 209465 - DNA, 15 bp, Homo sapiens
cagcttccatctcct

SEQ ID NO: 209466 - DNA, 15 bp, Homo sapiens
tcagcttccatctcc

SEQ ID NO: 209467 - DNA, 15 bp, Homo sapiens
ttcagcttccatctc

SEQ ID NO: 209468 - DNA, 15 bp, Homo sapiens
gttcagcttccatct

SEQ ID NO: 209469 - DNA, 15 bp, Homo sapiens
agttcagcttccatc

SEQ ID NO: 209470 - DNA, 15 bp, Homo sapiens
aagttcagcttccat

SEQ ID NO: 209471 - DNA, 15 bp, Homo sapiens
taagttcagcttcca

SEQ ID NO: 209472 - DNA, 15 bp, Homo sapiens
ataagttcagcttcc

SEQ ID NO: 209473 - DNA, 15 bp, Homo sapiens
gataagttcagcttc

SEQ ID NO: 209474 - DNA, 15 bp, Homo sapiens
ggataagttcagctt

SEQ ID NO: 209475 - DNA, 15 bp, Homo sapiens
aggataagttcagct

SEQ ID NO: 209476 - DNA, 15 bp, Homo sapiens
aaggataagttcagc

SEQ ID NO: 209477 - DNA, 15 bp, Homo sapiens
aaaggataagttcag

SEQ ID NO: 209478 - DNA, 15 bp, Homo sapiens
caaaggataagttca

SEQ ID NO: 209479 - DNA, 15 bp, Homo sapiens
tcaaaggataagttc

SEQ ID NO: 209480 - DNA, 15 bp, Homo sapiens
ctcaaaggataagtt

SEQ ID NO: 209481 - DNA, 15 bp, Homo sapiens
gctcaaaggataagt

SEQ ID NO: 209482 - DNA, 15 bp, Homo sapiens
ggctcaaaggataag

SEQ ID NO: 209483 - DNA, 15 bp, Homo sapiens
gggctcaaaggataa

SEQ ID NO: 209484 - DNA, 15 bp, Homo sapiens
tgggctcaaaggata

SEQ ID NO: 209485 - DNA, 15 bp, Homo sapiens
gtgggctcaaaggat

SEQ ID NO: 209486 - DNA, 15 bp, Homo sapiens
agtgggctcaaagga

SEQ ID NO: 209487 - DNA, 15 bp, Homo sapiens
gagtgggctcaaagg

SEQ ID NO: 209488 - DNA, 15 bp, Homo sapiens
ggagtgggctcaaag

SEQ ID NO: 209489 - DNA, 15 bp, Homo sapiens
aggagtgggctcaaa

SEQ ID NO: 209490 - DNA, 15 bp, Homo sapiens
caggagtgggctcaa

SEQ ID NO: 209491 - DNA, 15 bp, Homo sapiens
gcaggagtgggctca

SEQ ID NO: 209492 - DNA, 15 bp, Homo sapiens
agcaggagtgggctc

SEQ ID NO: 209493 - DNA, 15 bp, Homo sapiens
tagcaggagtgggct

SEQ ID NO: 209494 - DNA, 15 bp, Homo sapiens
atagcaggagtgggc

SEQ ID NO: 209495 - DNA, 15 bp, Homo sapiens
tatagcaggagtggg

SEQ ID NO: 209496 - DNA, 15 bp, Homo sapiens
ttatagcaggagtgg

SEQ ID NO: 209497 - DNA, 15 bp, Homo sapiens
gttatagcaggagtg

SEQ ID NO: 209498 - DNA, 15 bp, Homo sapiens
agttatagcaggagt

SEQ ID NO: 209499 - DNA, 15 bp, Homo sapiens
tagttatagcaggag

SEQ ID NO: 209500 - DNA, 15 bp, Homo sapiens
ttagttatagcagga

SEQ ID NO: 209501 - DNA, 15 bp, Homo sapiens
gttagttatagcagg

SEQ ID NO: 209502 - DNA, 15 bp, Homo sapiens
ggttagttatagcag

SEQ ID NO: 209503 - DNA, 15 bp, Homo sapiens
gggttagttatagca

SEQ ID NO: 209504 - DNA, 15 bp, Homo sapiens
tgggttagttatagc

SEQ ID NO: 209505 - DNA, 15 bp, Homo sapiens
gtgggttagttatag

SEQ ID NO: 209506 - DNA, 15 bp, Homo sapiens
agtgggttagttata

SEQ ID NO: 209507 - DNA, 15 bp, Homo sapiens
gagtgggttagttat

SEQ ID NO: 209508 - DNA, 15 bp, Homo sapiens
ggagtgggttagtta

SEQ ID NO: 209509 - DNA, 15 bp, Homo sapiens
gggagtgggttagtt

SEQ ID NO: 209510 - DNA, 15 bp, Homo sapiens
tgggagtgggttagt

SEQ ID NO: 209511 - DNA, 15 bp, Homo sapiens
gtgggagtgggttag

SEQ ID NO: 209512 - DNA, 15 bp, Homo sapiens
agtgggagtgggtta

SEQ ID NO: 209513 - DNA, 15 bp, Homo sapiens
cagtgggagtgggtt

SEQ ID NO: 209514 - DNA, 15 bp, Homo sapiens
acagtgggagtgggt

SEQ ID NO: 209515 - DNA, 15 bp, Homo sapiens
cacagtgggagtggg

SEQ ID NO: 209516 - DNA, 15 bp, Homo sapiens
tcacagtgggagtgg

SEQ ID NO: 209517 - DNA, 15 bp, Homo sapiens
atcacagtgggagtg

SEQ ID NO: 209518 - DNA, 15 bp, Homo sapiens
tatcacagtgggagt

SEQ ID NO: 209519 - DNA, 15 bp, Homo sapiens
ttatcacagtgggag

SEQ ID NO: 209520 - DNA, 15 bp, Homo sapiens
attatcacagtggga

SEQ ID NO: 209521 - DNA, 15 bp, Homo sapiens
cattatcacagtggg

SEQ ID NO: 209522 - DNA, 15 bp, Homo sapiens
tcattatcacagtgg

SEQ ID NO: 209523 - DNA, 15 bp, Homo sapiens
gtcattatcacagtg

SEQ ID NO: 209524 - DNA, 15 bp, Homo sapiens
tgtcattatcacagt

SEQ ID NO: 209525 - DNA, 15 bp, Homo sapiens
atgtcattatcacag

SEQ ID NO: 209526 - DNA, 15 bp, Homo sapiens
aatgtcattatcaca

SEQ ID NO: 209527 - DNA, 15 bp, Homo sapiens
taatgtcattatcac

SEQ ID NO: 209528 - DNA, 15 bp, Homo sapiens
ctaatgtcattatca

SEQ ID NO: 209529 - DNA, 15 bp, Homo sapiens
actaatgtcattatc

SEQ ID NO: 209530 - DNA, 15 bp, Homo sapiens
gactaatgtcattat

SEQ ID NO: 209531 - DNA, 15 bp, Homo sapiens
ggactaatgtcatta

SEQ ID NO: 209532 - DNA, 15 bp, Homo sapiens
tggactaatgtcatt

SEQ ID NO: 209533 - DNA, 15 bp, Homo sapiens
atggactaatgtcat

SEQ ID NO: 209534 - DNA, 15 bp, Homo sapiens
aatggactaatgtca

SEQ ID NO: 209535 - DNA, 15 bp, Homo sapiens
gaatggactaatgtc

SEQ ID NO: 209536 - DNA, 15 bp, Homo sapiens
tgaatggactaatgt

SEQ ID NO: 209537 - DNA, 15 bp, Homo sapiens
atgaatggactaatg

SEQ ID NO: 209538 - DNA, 15 bp, Homo sapiens
catgaatggactaat

SEQ ID NO: 209539 - DNA, 15 bp, Homo sapiens
tcatgaatggactaa

SEQ ID NO: 209540 - DNA, 15 bp, Homo sapiens
ttcatgaatggacta

SEQ ID NO: 209541 - DNA, 15 bp, Homo sapiens
cttcatgaatggact

SEQ ID NO: 209542 - DNA, 15 bp, Homo sapiens
ccttcatgaatggac

SEQ ID NO: 209543 - DNA, 15 bp, Homo sapiens
accttcatgaatgga

SEQ ID NO: 209544 - DNA, 15 bp, Homo sapiens
gaccttcatgaatgg

SEQ ID NO: 209545 - DNA, 15 bp, Homo sapiens
tgaccttcatgaatg

SEQ ID NO: 209546 - DNA, 15 bp, Homo sapiens
ttgaccttcatgaat

SEQ ID NO: 209547 - DNA, 15 bp, Homo sapiens
tttgaccttcatgaa

SEQ ID NO: 209548 - DNA, 15 bp, Homo sapiens
gtttgaccttcatga

SEQ ID NO: 209549 - DNA, 15 bp, Homo sapiens
ggtttgaccttcatg

SEQ ID NO: 209550 - DNA, 15 bp, Homo sapiens
gggtttgaccttcat

SEQ ID NO: 209551 - DNA, 15 bp, Homo sapiens
agggtttgaccttca

SEQ ID NO: 209552 - DNA, 15 bp, Homo sapiens
gagggtttgaccttc

SEQ ID NO: 209553 - DNA, 15 bp, Homo sapiens
tgagggtttgacctt

SEQ ID NO: 209554 - DNA, 15 bp, Homo sapiens
atgagggtttgacct

SEQ ID NO: 209555 - DNA, 15 bp, Homo sapiens
catgagggtttgacc

SEQ ID NO: 209556 - DNA, 15 bp, Homo sapiens
tcatgagggtttgac

SEQ ID NO: 209557 - DNA, 15 bp, Homo sapiens
gtcatgagggtttga

SEQ ID NO: 209558 - DNA, 15 bp, Homo sapiens
ggtcatgagggtttg

SEQ ID NO: 209559 - DNA, 15 bp, Homo sapiens
aggtcatgagggttt

SEQ ID NO: 209560 - DNA, 15 bp, Homo sapiens
taggtcatgagggtt

SEQ ID NO: 209561 - DNA, 15 bp, Homo sapiens
ttaggtcatgagggt

SEQ ID NO: 209562 - DNA, 15 bp, Homo sapiens
attaggtcatgaggg

SEQ ID NO: 209563 - DNA, 15 bp, Homo sapiens
gattaggtcatgagg

SEQ ID NO: 209564 - DNA, 15 bp, Homo sapiens
tgattaggtcatgag

SEQ ID NO: 209565 - DNA, 15 bp, Homo sapiens
gtgattaggtcatga

SEQ ID NO: 209566 - DNA, 15 bp, Homo sapiens
ggtgattaggtcatg

SEQ ID NO: 209567 - DNA, 15 bp, Homo sapiens
cggtgattaggtcat

SEQ ID NO: 209568 - DNA, 15 bp, Homo sapiens
gcggtgattaggtca

SEQ ID NO: 209569 - DNA, 15 bp, Homo sapiens
agcggtgattaggtc

SEQ ID NO: 209570 - DNA, 15 bp, Homo sapiens
aagcggtgattaggt

SEQ ID NO: 209571 - DNA, 15 bp, Homo sapiens
taagcggtgattagg

SEQ ID NO: 209572 - DNA, 15 bp, Homo sapiens
ttaagcggtgattag

SEQ ID NO: 209573 - DNA, 15 bp, Homo sapiens
tttaagcggtgatta

SEQ ID NO: 209574 - DNA, 15 bp, Homo sapiens
ctttaagcggtgatt

SEQ ID NO: 209575 - DNA, 15 bp, Homo sapiens
cctttaagcggtgat

SEQ ID NO: 209576 - DNA, 15 bp, Homo sapiens
gcctttaagcggtga

SEQ ID NO: 209577 - DNA, 15 bp, Homo sapiens
agcctttaagcggtg

SEQ ID NO: 209578 - DNA, 15 bp, Homo sapiens
cagcctttaagcggt

SEQ ID NO: 209579 - DNA, 15 bp, Homo sapiens
gcagcctttaagcgg

SEQ ID NO: 209580 - DNA, 15 bp, Homo sapiens
agcagcctttaagcg

SEQ ID NO: 209581 - DNA, 15 bp, Homo sapiens
gagcagcctttaagc

SEQ ID NO: 209582 - DNA, 15 bp, Homo sapiens
ggagcagcctttaag

SEQ ID NO: 209583 - DNA, 15 bp, Homo sapiens
aggagcagcctttaa

SEQ ID NO: 209584 - DNA, 15 bp, Homo sapiens
gaggagcagccttta

SEQ ID NO: 209585 - DNA, 15 bp, Homo sapiens
agaggagcagccttt

SEQ ID NO: 209586 - DNA, 15 bp, Homo sapiens
aagaggagcagcctt

SEQ ID NO: 209587 - DNA, 15 bp, Homo sapiens
taagaggagcagcct

SEQ ID NO: 209588 - DNA, 15 bp, Homo sapiens
ttaagaggagcagcc

SEQ ID NO: 209589 - DNA, 15 bp, Homo sapiens
attaagaggagcagc

SEQ ID NO: 209590 - DNA, 15 bp, Homo sapiens
tattaagaggagcag

SEQ ID NO: 209591 - DNA, 15 bp, Homo sapiens
atattaagaggagca

SEQ ID NO: 209592 - DNA, 15 bp, Homo sapiens
gatattaagaggagc

SEQ ID NO: 209593 - DNA, 15 bp, Homo sapiens
tgatattaagaggag

SEQ ID NO: 209594 - DNA, 15 bp, Homo sapiens
ctgatattaagagga

SEQ ID NO: 209595 - DNA, 15 bp, Homo sapiens
gctgatattaagagg

SEQ ID NO: 209596 - DNA, 15 bp, Homo sapiens
tgctgatattaagag

SEQ ID NO: 209597 - DNA, 15 bp, Homo sapiens
gtgctgatattaaga

SEQ ID NO: 209598 - DNA, 15 bp, Homo sapiens
tgtgctgatattaag

SEQ ID NO: 209599 - DNA, 15 bp, Homo sapiens
ctgtgctgatattaa

SEQ ID NO: 209600 - DNA, 15 bp, Homo sapiens
actgtgctgatatta

SEQ ID NO: 209601 - DNA, 15 bp, Homo sapiens
cactgtgctgatatt

SEQ ID NO: 209602 - DNA, 15 bp, Homo sapiens
acactgtgctgatat

SEQ ID NO: 209603 - DNA, 15 bp, Homo sapiens
gacactgtgctgata

SEQ ID NO: 209604 - DNA, 15 bp, Homo sapiens
tgacactgtgctgat

SEQ ID NO: 209605 - DNA, 15 bp, Homo sapiens
gtgacactgtgctga

SEQ ID NO: 209606 - DNA, 15 bp, Homo sapiens
agtgacactgtgctg

SEQ ID NO: 209607 - DNA, 15 bp, Homo sapiens
aagtgacactgtgct

SEQ ID NO: 209608 - DNA, 15 bp, Homo sapiens
taagtgacactgtgc

SEQ ID NO: 209609 - DNA, 15 bp, Homo sapiens
ttaagtgacactgtg

SEQ ID NO: 209610 - DNA, 15 bp, Homo sapiens
tttaagtgacactgt

SEQ ID NO: 209611 - DNA, 15 bp, Homo sapiens
atttaagtgacactg

SEQ ID NO: 209612 - DNA, 15 bp, Homo sapiens
aatttaagtgacact

SEQ ID NO: 209613 - DNA, 15 bp, Homo sapiens
aaatttaagtgacac

SEQ ID NO: 209614 - DNA, 15 bp, Homo sapiens
gaaatttaagtgaca

SEQ ID NO: 209615 - DNA, 15 bp, Homo sapiens
tgaaatttaagtgac

SEQ ID NO: 209616 - DNA, 15 bp, Homo sapiens
atgaaatttaagtga

SEQ ID NO: 209617 - DNA, 15 bp, Homo sapiens
gatgaaatttaagtg

SEQ ID NO: 209618 - DNA, 15 bp, Homo sapiens
agatgaaatttaagt

SEQ ID NO: 209619 - DNA, 15 bp, Homo sapiens
aagatgaaatttaag

SEQ ID NO: 209620 - DNA, 15 bp, Homo sapiens
caagatgaaatttaa

SEQ ID NO: 209621 - DNA, 15 bp, Homo sapiens
tcaagatgaaattta

SEQ ID NO: 209622 - DNA, 15 bp, Homo sapiens
ctcaagatgaaattt

SEQ ID NO: 209623 - DNA, 15 bp, Homo sapiens
actcaagatgaaatt

SEQ ID NO: 209624 - DNA, 15 bp, Homo sapiens
aactcaagatgaaat

SEQ ID NO: 209625 - DNA, 15 bp, Homo sapiens
aaactcaagatgaaa

SEQ ID NO: 209626 - DNA, 15 bp, Homo sapiens
aaaactcaagatgaa

SEQ ID NO: 209627 - DNA, 15 bp, Homo sapiens
caaaactcaagatga

SEQ ID NO: 209628 - DNA, 15 bp, Homo sapiens
ccaaaactcaagatg

SEQ ID NO: 209629 - DNA, 15 bp, Homo sapiens
tccaaaactcaagat

SEQ ID NO: 209630 - DNA, 15 bp, Homo sapiens
ctccaaaactcaaga

SEQ ID NO: 209631 - DNA, 15 bp, Homo sapiens
cctccaaaactcaag

SEQ ID NO: 209632 - DNA, 15 bp, Homo sapiens
ccctccaaaactcaa

SEQ ID NO: 209633 - DNA, 15 bp, Homo sapiens
cccctccaaaactca

SEQ ID NO: 209634 - DNA, 15 bp, Homo sapiens
tcccctccaaaactc

SEQ ID NO: 209635 - DNA, 15 bp, Homo sapiens
gtcccctccaaaact

SEQ ID NO: 209636 - DNA, 15 bp, Homo sapiens
tgtcccctccaaaac

SEQ ID NO: 209637 - DNA, 15 bp, Homo sapiens
atgtcccctccaaaa

SEQ ID NO: 209638 - DNA, 15 bp, Homo sapiens
aatgtcccctccaaa

SEQ ID NO: 209639 - DNA, 15 bp, Homo sapiens
gaatgtcccctccaa

SEQ ID NO: 209640 - DNA, 15 bp, Homo sapiens
tgaatgtcccctcca

SEQ ID NO: 209641 - DNA, 15 bp, Homo sapiens
ttgaatgtcccctcc

SEQ ID NO: 209642 - DNA, 15 bp, Homo sapiens
tttgaatgtcccctc

SEQ ID NO: 209643 - DNA, 15 bp, Homo sapiens
gtttgaatgtcccct

SEQ ID NO: 209644 - DNA, 15 bp, Homo sapiens
ggtttgaatgtcccc

SEQ ID NO: 209645 - DNA, 15 bp, Homo sapiens
tggtttgaatgtccc

SEQ ID NO: 209646 - DNA, 15 bp, Homo sapiens
atggtttgaatgtcc

SEQ ID NO: 209647 - DNA, 15 bp, Homo sapiens
tatggtttgaatgtc

SEQ ID NO: 209648 - DNA, 15 bp, Homo sapiens
ctatggtttgaatgt

SEQ ID NO: 209649 - DNA, 15 bp, Homo sapiens
actatggtttgaatg

SEQ ID NO: 209650 - DNA, 15 bp, Homo sapiens
tactatggtttgaat

SEQ ID NO: 209651 - DNA, 15 bp, Homo sapiens
gtactatggtttgaa

SEQ ID NO: 209652 - DNA, 15 bp, Homo sapiens
agtactatggtttga

SEQ ID NO: 209653 - DNA, 15 bp, Homo sapiens
aagtactatggtttg

SEQ ID NO: 209654 - DNA, 15 bp, Homo sapiens
gaagtactatggttt

SEQ ID NO: 209655 - DNA, 15 bp, Homo sapiens
cgaagtactatggtt

SEQ ID NO: 209656 - DNA, 15 bp, Homo sapiens
acgaagtactatggt

SEQ ID NO: 209657 - DNA, 15 bp, Homo sapiens
aacgaagtactatgg

SEQ ID NO: 209658 - DNA, 15 bp, Homo sapiens
caacgaagtactatg

SEQ ID NO: 209659 - DNA, 15 bp, Homo sapiens
gcaacgaagtactat

SEQ ID NO: 209660 - DNA, 15 bp, Homo sapiens
tgcaacgaagtacta

SEQ ID NO: 209661 - DNA, 15 bp, Homo sapiens
ttgcaacgaagtact

SEQ ID NO: 209662 - DNA, 15 bp, Homo sapiens
attgcaacgaagtac

SEQ ID NO: 209663 - DNA, 15 bp, Homo sapiens
aattgcaacgaagta

SEQ ID NO: 209664 - DNA, 15 bp, Homo sapiens
gaattgcaacgaagt

SEQ ID NO: 209665 - DNA, 15 bp, Homo sapiens
cgaattgcaacgaag

SEQ ID NO: 209666 - DNA, 15 bp, Homo sapiens
ccgaattgcaacgaa

SEQ ID NO: 209667 - DNA, 15 bp, Homo sapiens
cccgaattgcaacga

SEQ ID NO: 209668 - DNA, 15 bp, Homo sapiens
gcccgaattgcaacg

SEQ ID NO: 209669 - DNA, 15 bp, Homo sapiens
tgcccgaattgcaac

SEQ ID NO: 209670 - DNA, 15 bp, Homo sapiens
ttgcccgaattgcaa

SEQ ID NO: 209671 - DNA, 15 bp, Homo sapiens
cttgcccgaattgca

SEQ ID NO: 209672 - DNA, 15 bp, Homo sapiens
gcttgcccgaattgc

SEQ ID NO: 209673 - DNA, 15 bp, Homo sapiens
agcttgcccgaattg

SEQ ID NO: 209674 - DNA, 15 bp, Homo sapiens
aagcttgcccgaatt

SEQ ID NO: 209675 - DNA, 15 bp, Homo sapiens
aaagcttgcccgaat

SEQ ID NO: 209676 - DNA, 15 bp, Homo sapiens
aaaagcttgcccgaa

SEQ ID NO: 209677 - DNA, 15 bp, Homo sapiens
taaaagcttgcccga

SEQ ID NO: 209678 - DNA, 15 bp, Homo sapiens
ctaaaagcttgcccg

SEQ ID NO: 209679 - DNA, 15 bp, Homo sapiens
actaaaagcttgccc

SEQ ID NO: 209680 - DNA, 15 bp, Homo sapiens
aactaaaagcttgcc

SEQ ID NO: 209681 - DNA, 15 bp, Homo sapiens
gaactaaaagcttgc

SEQ ID NO: 209682 - DNA, 15 bp, Homo sapiens
tgaactaaaagcttg

SEQ ID NO: 209683 - DNA, 15 bp, Homo sapiens
atgaactaaaagctt

SEQ ID NO: 209684 - DNA, 15 bp, Homo sapiens
catgaactaaaagct

SEQ ID NO: 209685 - DNA, 15 bp, Homo sapiens
acatgaactaaaagc

SEQ ID NO: 209686 - DNA, 15 bp, Homo sapiens
tacatgaactaaaag

SEQ ID NO: 209687 - DNA, 15 bp, Homo sapiens
gtacatgaactaaaa

SEQ ID NO: 209688 - DNA, 15 bp, Homo sapiens
ggtacatgaactaaa

SEQ ID NO: 209689 - DNA, 15 bp, Homo sapiens
gggtacatgaactaa

SEQ ID NO: 209690 - DNA, 15 bp, Homo sapiens
tgggtacatgaacta

SEQ ID NO: 209691 - DNA, 15 bp, Homo sapiens
atgggtacatgaact

SEQ ID NO: 209692 - DNA, 15 bp, Homo sapiens
aatgggtacatgaac

SEQ ID NO: 209693 - DNA, 15 bp, Homo sapiens
aaatgggtacatgaa

SEQ ID NO: 209694 - DNA, 15 bp, Homo sapiens
taaatgggtacatga

SEQ ID NO: 209695 - DNA, 15 bp, Homo sapiens
ataaatgggtacatg

SEQ ID NO: 209696 - DNA, 15 bp, Homo sapiens
aataaatgggtacat

SEQ ID NO: 209697 - DNA, 15 bp, Homo sapiens
aaataaatgggtaca

SEQ ID NO: 209698 - DNA, 15 bp, Homo sapiens
gaaataaatgggtac

SEQ ID NO: 209699 - DNA, 15 bp, Homo sapiens
ggaaataaatgggta

SEQ ID NO: 209700 - DNA, 15 bp, Homo sapiens
tggaaataaatgggt

SEQ ID NO: 209701 - DNA, 15 bp, Homo sapiens
ttggaaataaatggg

SEQ ID NO: 209702 - DNA, 15 bp, Homo sapiens
attggaaataaatgg

SEQ ID NO: 209703 - DNA, 15 bp, Homo sapiens
gattggaaataaatg

SEQ ID NO: 209704 - DNA, 15 bp, Homo sapiens
agattggaaataaat

SEQ ID NO: 209705 - DNA, 15 bp, Homo sapiens
gagattggaaataaa

SEQ ID NO: 209706 - DNA, 15 bp, Homo sapiens
agagattggaaataa

SEQ ID NO: 209707 - DNA, 15 bp, Homo sapiens
aagagattggaaata

SEQ ID NO: 209708 - DNA, 15 bp, Homo sapiens
gaagagattggaaat

SEQ ID NO: 209709 - DNA, 15 bp, Homo sapiens
agaagagattggaaa

SEQ ID NO: 209710 - DNA, 15 bp, Homo sapiens
aagaagagattggaa

SEQ ID NO: 209711 - DNA, 15 bp, Homo sapiens
aaagaagagattgga

SEQ ID NO: 209712 - DNA, 15 bp, Homo sapiens
taaagaagagattgg

SEQ ID NO: 209713 - DNA, 15 bp, Homo sapiens
ttaaagaagagattg

SEQ ID NO: 209714 - DNA, 15 bp, Homo sapiens
cttaaagaagagatt

SEQ ID NO: 209715 - DNA, 15 bp, Homo sapiens
ccttaaagaagagat

SEQ ID NO: 209716 - DNA, 15 bp, Homo sapiens
cccttaaagaagaga

SEQ ID NO: 209717 - DNA, 15 bp, Homo sapiens
tcccttaaagaagag

SEQ ID NO: 209718 - DNA, 15 bp, Homo sapiens
ttcccttaaagaaga

SEQ ID NO: 209719 - DNA, 15 bp, Homo sapiens
attcccttaaagaag

SEQ ID NO: 209720 - DNA, 15 bp, Homo sapiens
tattcccttaaagaa

SEQ ID NO: 209721 - DNA, 15 bp, Homo sapiens
gtattcccttaaaga

SEQ ID NO: 209722 - DNA, 15 bp, Homo sapiens
tgtattcccttaaag

SEQ ID NO: 209723 - DNA, 15 bp, Homo sapiens
ctgtattcccttaaa

SEQ ID NO: 209724 - DNA, 15 bp, Homo sapiens
tctgtattcccttaa

SEQ ID NO: 209725 - DNA, 15 bp, Homo sapiens
ttctgtattccctta

SEQ ID NO: 209726 - DNA, 15 bp, Homo sapiens
gttctgtattccctt

SEQ ID NO: 209727 - DNA, 15 bp, Homo sapiens
agttctgtattccct

SEQ ID NO: 209728 - DNA, 15 bp, Homo sapiens
gagttctgtattccc

SEQ ID NO: 209729 - DNA, 15 bp, Homo sapiens
agagttctgtattcc

SEQ ID NO: 209730 - DNA, 15 bp, Homo sapiens
aagagttctgtattc

SEQ ID NO: 209731 - DNA, 15 bp, Homo sapiens
aaagagttctgtatt

SEQ ID NO: 209732 - DNA, 15 bp, Homo sapiens
aaaagagttctgtat

SEQ ID NO: 209733 - DNA, 15 bp, Homo sapiens
gaaaagagttctgta

SEQ ID NO: 209734 - DNA, 15 bp, Homo sapiens
tgaaaagagttctgt

SEQ ID NO: 209735 - DNA, 15 bp, Homo sapiens
ttgaaaagagttctg

SEQ ID NO: 209736 - DNA, 15 bp, Homo sapiens
attgaaaagagttct

SEQ ID NO: 209737 - DNA, 15 bp, Homo sapiens
aattgaaaagagttc

SEQ ID NO: 209738 - DNA, 15 bp, Homo sapiens
taattgaaaagagtt

SEQ ID NO: 209739 - DNA, 15 bp, Homo sapiens
ataattgaaaagagt

SEQ ID NO: 209740 - DNA, 15 bp, Homo sapiens
tataattgaaaagag

SEQ ID NO: 209741 - DNA, 15 bp, Homo sapiens
ttataattgaaaaga

SEQ ID NO: 209742 - DNA, 15 bp, Homo sapiens
gttataattgaaaag

SEQ ID NO: 209743 - DNA, 15 bp, Homo sapiens
tgttataattgaaaa

SEQ ID NO: 209744 - DNA, 15 bp, Homo sapiens
atgttataattgaaa

SEQ ID NO: 209745 - DNA, 15 bp, Homo sapiens
aatgttataattgaa

SEQ ID NO: 209746 - DNA, 15 bp, Homo sapiens
taatgttataattga

SEQ ID NO: 209747 - DNA, 15 bp, Homo sapiens
ataatgttataattg

SEQ ID NO: 209748 - DNA, 15 bp, Homo sapiens
cataatgttataatt

SEQ ID NO: 209749 - DNA, 15 bp, Homo sapiens
tcataatgttataat

SEQ ID NO: 209750 - DNA, 15 bp, Homo sapiens
atcataatgttataa

SEQ ID NO: 209751 - DNA, 15 bp, Homo sapiens
catcataatgttata

SEQ ID NO: 209752 - DNA, 15 bp, Homo sapiens
acatcataatgttat

SEQ ID NO: 209753 - DNA, 15 bp, Homo sapiens
tacatcataatgtta

SEQ ID NO: 209754 - DNA, 15 bp, Homo sapiens
ctacatcataatgtt

SEQ ID NO: 209755 - DNA, 15 bp, Homo sapiens
gctacatcataatgt

SEQ ID NO: 209756 - DNA, 15 bp, Homo sapiens
agctacatcataatg

SEQ ID NO: 209757 - DNA, 15 bp, Homo sapiens
aagctacatcataat

SEQ ID NO: 209758 - DNA, 15 bp, Homo sapiens
aaagctacatcataa

SEQ ID NO: 209759 - DNA, 15 bp, Homo sapiens
taaagctacatcata

SEQ ID NO: 209760 - DNA, 15 bp, Homo sapiens
ttaaagctacatcat

SEQ ID NO: 209761 - DNA, 15 bp, Homo sapiens
tttaaagctacatca

SEQ ID NO: 209762 - DNA, 15 bp, Homo sapiens
gtttaaagctacatc

SEQ ID NO: 209763 - DNA, 15 bp, Homo sapiens
tgtttaaagctacat

SEQ ID NO: 209764 - DNA, 15 bp, Homo sapiens
ctgtttaaagctaca

SEQ ID NO: 209765 - DNA, 15 bp, Homo sapiens
tctgtttaaagctac

SEQ ID NO: 209766 - DNA, 15 bp, Homo sapiens
ttctgtttaaagcta

SEQ ID NO: 209767 - DNA, 15 bp, Homo sapiens
gttctgtttaaagct

SEQ ID NO: 209768 - DNA, 15 bp, Homo sapiens
tgttctgtttaaagc

SEQ ID NO: 209769 - DNA, 15 bp, Homo sapiens
atgttctgtttaaag

SEQ ID NO: 209770 - DNA, 15 bp, Homo sapiens
tatgttctgtttaaa

SEQ ID NO: 209771 - DNA, 15 bp, Homo sapiens
ttatgttctgtttaa

SEQ ID NO: 209772 - DNA, 15 bp, Homo sapiens
tttatgttctgttta

SEQ ID NO: 209773 - DNA, 15 bp, Homo sapiens
ttttatgttctgttt

SEQ ID NO: 209774 - DNA, 15 bp, Homo sapiens
attttatgttctgtt

SEQ ID NO: 209775 - DNA, 15 bp, Homo sapiens
tattttatgttctgt

SEQ ID NO: 209776 - DNA, 15 bp, Homo sapiens
ttattttatgttctg

SEQ ID NO: 209777 - DNA, 15 bp, Homo sapiens
gttattttatgttct

SEQ ID NO: 209778 - DNA, 15 bp, Homo sapiens
agttattttatgttc

SEQ ID NO: 209779 - DNA, 15 bp, Homo sapiens
aagttattttatgtt

SEQ ID NO: 209780 - DNA, 15 bp, Homo sapiens
aaagttattttatgt

SEQ ID NO: 209781 - DNA, 15 bp, Homo sapiens
aaaagttattttatg

SEQ ID NO: 209782 - DNA, 15 bp, Homo sapiens
taaaagttattttat

SEQ ID NO: 209783 - DNA, 15 bp, Homo sapiens
ttaaaagttatttta

SEQ ID NO: 209784 - DNA, 15 bp, Homo sapiens
tttaaaagttatttt

SEQ ID NO: 209785 - DNA, 15 bp, Homo sapiens
ttttaaaagttattt

SEQ ID NO: 209786 - DNA, 15 bp, Homo sapiens
gttttaaaagttatt

SEQ ID NO: 209787 - DNA, 15 bp, Homo sapiens
ggttttaaaagttat

SEQ ID NO: 209788 - DNA, 15 bp, Homo sapiens
tggttttaaaagtta

SEQ ID NO: 209789 - DNA, 15 bp, Homo sapiens
ttggttttaaaagtt

SEQ ID NO: 209790 - DNA, 15 bp, Homo sapiens
attggttttaaaagt

SEQ ID NO: 209791 - DNA, 15 bp, Homo sapiens
aattggttttaaaag

SEQ ID NO: 209792 - DNA, 15 bp, Homo sapiens
aaattggttttaaaa

SEQ ID NO: 209793 - DNA, 15 bp, Homo sapiens
aaaattggttttaaa

SEQ ID NO: 209794 - DNA, 15 bp, Homo sapiens
aaaaattggttttaa

SEQ ID NO: 209795 - DNA, 15 bp, Homo sapiens
aaaaaattggtttta

SEQ ID NO: 209796 - DNA, 15 bp, Homo sapiens
gaaaaaattggtttt

SEQ ID NO: 209797 - DNA, 15 bp, Homo sapiens
tgaaaaaattggttt

SEQ ID NO: 209798 - DNA, 15 bp, Homo sapiens
ctgaaaaaattggtt

SEQ ID NO: 209799 - DNA, 15 bp, Homo sapiens
tctgaaaaaattggt

SEQ ID NO: 209800 - DNA, 15 bp, Homo sapiens
atctgaaaaaattgg

SEQ ID NO: 209801 - DNA, 15 bp, Homo sapiens
tatctgaaaaaattg

SEQ ID NO: 209802 - DNA, 15 bp, Homo sapiens
atatctgaaaaaatt

SEQ ID NO: 209803 - DNA, 15 bp, Homo sapiens
catatctgaaaaaat

SEQ ID NO: 209804 - DNA, 15 bp, Homo sapiens
acatatctgaaaaaa

SEQ ID NO: 209805 - DNA, 15 bp, Homo sapiens
aacatatctgaaaaa

SEQ ID NO: 209806 - DNA, 15 bp, Homo sapiens
aaacatatctgaaaa

SEQ ID NO: 209807 - DNA, 15 bp, Homo sapiens
aaaacatatctgaaa

SEQ ID NO: 209808 - DNA, 15 bp, Homo sapiens
taaaacatatctgaa

SEQ ID NO: 209809 - DNA, 15 bp, Homo sapiens
ctaaaacatatctga

SEQ ID NO: 209810 - DNA, 15 bp, Homo sapiens
gctaaaacatatctg

SEQ ID NO: 209811 - DNA, 15 bp, Homo sapiens
agctaaaacatatct

SEQ ID NO: 209812 - DNA, 15 bp, Homo sapiens
aagctaaaacatatc

SEQ ID NO: 209813 - DNA, 15 bp, Homo sapiens
taagctaaaacatat

SEQ ID NO: 209814 - DNA, 15 bp, Homo sapiens
gtaagctaaaacata

SEQ ID NO: 209815 - DNA, 15 bp, Homo sapiens
agtaagctaaaacat

SEQ ID NO: 209816 - DNA, 15 bp, Homo sapiens
cagtaagctaaaaca

SEQ ID NO: 209817 - DNA, 15 bp, Homo sapiens
tcagtaagctaaaac

SEQ ID NO: 209818 - DNA, 15 bp, Homo sapiens
ttcagtaagctaaaa

SEQ ID NO: 209819 - DNA, 15 bp, Homo sapiens
tttcagtaagctaaa

SEQ ID NO: 209820 - DNA, 15 bp, Homo sapiens
atttcagtaagctaa

SEQ ID NO: 209821 - DNA, 15 bp, Homo sapiens
tatttcagtaagcta

SEQ ID NO: 209822 - DNA, 15 bp, Homo sapiens
ttatttcagtaagct

SEQ ID NO: 209823 - DNA, 15 bp, Homo sapiens
tttatttcagtaagc

SEQ ID NO: 209824 - DNA, 15 bp, Homo sapiens
ctttatttcagtaag

SEQ ID NO: 209825 - DNA, 15 bp, Homo sapiens
aactttatttcagta

SEQ ID NO: 209826 - DNA, 15 bp, Homo sapiens
caactttatttcagt

SEQ ID NO: 209827 - DNA, 15 bp, Homo sapiens
gcaactttatttcag

SEQ ID NO: 209828 - DNA, 15 bp, Homo sapiens
agcaactttatttca

SEQ ID NO: 209829 - DNA, 15 bp, Homo sapiens
aagcaactttatttc

SEQ ID NO: 209830 - DNA, 15 bp, Homo sapiens
gaagcaactttattt

SEQ ID NO: 209831 - DNA, 15 bp, Homo sapiens
agaagcaactttatt

SEQ ID NO: 209832 - DNA, 15 bp, Homo sapiens
gagaagcaactttat

SEQ ID NO: 209833 - DNA, 15 bp, Homo sapiens
agagaagcaacttta

SEQ ID NO: 209834 - DNA, 15 bp, Homo sapiens
aagagaagcaacttt

SEQ ID NO: 209835 - DNA, 15 bp, Homo sapiens
aaagagaagcaactt

SEQ ID NO: 209836 - DNA, 15 bp, Homo sapiens
aaaagagaagcaact

SEQ ID NO: 209837 - DNA, 15 bp, Homo sapiens
gaaaagagaagcaac

SEQ ID NO: 209838 - DNA, 15 bp, Homo sapiens
tgaaaagagaagcaa

SEQ ID NO: 209839 - DNA, 15 bp, Homo sapiens
atgaaaagagaagca

SEQ ID NO: 209840 - DNA, 15 bp, Homo sapiens
aatgaaaagagaagc

SEQ ID NO: 209841 - DNA, 15 bp, Homo sapiens
aaatgaaaagagaag

SEQ ID NO: 209842 - DNA, 15 bp, Homo sapiens
taaatgaaaagagaa

SEQ ID NO: 209843 - DNA, 15 bp, Homo sapiens
ctaaatgaaaagaga

SEQ ID NO: 209844 - DNA, 15 bp, Homo sapiens
actaaatgaaaagag

SEQ ID NO: 209845 - DNA, 15 bp, Homo sapiens
gactaaatgaaaaga

SEQ ID NO: 209846 - DNA, 15 bp, Homo sapiens
agactaaatgaaaag

SEQ ID NO: 209847 - DNA, 15 bp, Homo sapiens
aagactaaatgaaaa

SEQ ID NO: 209848 - DNA, 15 bp, Homo sapiens
caagactaaatgaaa

SEQ ID NO: 209849 - DNA, 15 bp, Homo sapiens
acaagactaaatgaa

SEQ ID NO: 209850 - DNA, 15 bp, Homo sapiens
gacaagactaaatga

SEQ ID NO: 209851 - DNA, 15 bp, Homo sapiens
agacaagactaaatg

SEQ ID NO: 209852 - DNA, 15 bp, Homo sapiens
tagacaagactaaat

SEQ ID NO: 209853 - DNA, 15 bp, Homo sapiens
atagacaagactaaa

SEQ ID NO: 209854 - DNA, 15 bp, Homo sapiens
aatagacaagactaa

SEQ ID NO: 209855 - DNA, 15 bp, Homo sapiens
taatagacaagacta

SEQ ID NO: 209856 - DNA, 15 bp, Homo sapiens
ataatagacaagact

SEQ ID NO: 209857 - DNA, 15 bp, Homo sapiens
aataatagacaagac

SEQ ID NO: 209858 - DNA, 15 bp, Homo sapiens
taataatagacaaga

SEQ ID NO: 209859 - DNA, 15 bp, Homo sapiens
ataataatagacaag

SEQ ID NO: 209860 - DNA, 15 bp, Homo sapiens
tataataatagacaa

SEQ ID NO: 209861 - DNA, 15 bp, Homo sapiens
ttataataatagaca

SEQ ID NO: 209862 - DNA, 15 bp, Homo sapiens
tttataataatagac

SEQ ID NO: 209863 - DNA, 15 bp, Homo sapiens
atttataataataga

SEQ ID NO: 209864 - DNA, 15 bp, Homo sapiens
aatttataataatag

SEQ ID NO: 209865 - DNA, 15 bp, Homo sapiens
gaatttataataata

SEQ ID NO: 209866 - DNA, 15 bp, Homo sapiens
agaatttataataat

SEQ ID NO: 209867 - DNA, 15 bp, Homo sapiens
cagaatttataataa

SEQ ID NO: 209868 - DNA, 15 bp, Homo sapiens
acagaatttataata

SEQ ID NO: 209869 - DNA, 15 bp, Homo sapiens
aacagaatttataat

SEQ ID NO: 209870 - DNA, 15 bp, Homo sapiens
taacagaatttataa

SEQ ID NO: 209871 - DNA, 15 bp, Homo sapiens
ctaacagaatttata

SEQ ID NO: 209872 - DNA, 15 bp, Homo sapiens
actaacagaatttat

SEQ ID NO: 209873 - DNA, 15 bp, Homo sapiens
tactaacagaattta

SEQ ID NO: 209874 - DNA, 15 bp, Homo sapiens
atactaacagaattt

SEQ ID NO: 209875 - DNA, 15 bp, Homo sapiens
aatactaacagaatt

SEQ ID NO: 209876 - DNA, 15 bp, Homo sapiens
aaatactaacagaat

SEQ ID NO: 209877 - DNA, 15 bp, Homo sapiens
aaaatactaacagaa

SEQ ID NO: 209878 - DNA, 15 bp, Homo sapiens
aaaaatactaacaga

SEQ ID NO: 209879 - DNA, 15 bp, Homo sapiens
aaaaaatactaacag

SEQ ID NO: 209880 - DNA, 15 bp, Homo sapiens
gaaaaaatactaaca

SEQ ID NO: 209881 - DNA, 15 bp, Homo sapiens
agaaaaaatactaac

SEQ ID NO: 209882 - DNA, 15 bp, Homo sapiens
cagaaaaaatactaa

SEQ ID NO: 209883 - DNA, 15 bp, Homo sapiens
tcagaaaaaatacta

SEQ ID NO: 209884 - DNA, 15 bp, Homo sapiens
atcagaaaaaatact

SEQ ID NO: 209885 - DNA, 15 bp, Homo sapiens
gatcagaaaaaatac

SEQ ID NO: 209886 - DNA, 15 bp, Homo sapiens
agatcagaaaaaata

SEQ ID NO: 209887 - DNA, 15 bp, Homo sapiens
gagatcagaaaaaat

SEQ ID NO: 209888 - DNA, 15 bp, Homo sapiens
ggagatcagaaaaaa

SEQ ID NO: 209889 - DNA, 15 bp, Homo sapiens
aggagatcagaaaaa

SEQ ID NO: 209890 - DNA, 15 bp, Homo sapiens
taggagatcagaaaa

SEQ ID NO: 209891 - DNA, 15 bp, Homo sapiens
gtaggagatcagaaa

SEQ ID NO: 209892 - DNA, 15 bp, Homo sapiens
agtaggagatcagaa

SEQ ID NO: 209893 - DNA, 15 bp, Homo sapiens
aagtaggagatcaga

SEQ ID NO: 209894 - DNA, 15 bp, Homo sapiens
aaagtaggagatcag

SEQ ID NO: 209895 - DNA, 15 bp, Homo sapiens
aaaagtaggagatca

SEQ ID NO: 209896 - DNA, 15 bp, Homo sapiens
aaaaagtaggagatc

SEQ ID NO: 209897 - DNA, 15 bp, Homo sapiens
taaaaagtaggagat

SEQ ID NO: 209898 - DNA, 15 bp, Homo sapiens
ctaaaaagtaggaga

SEQ ID NO: 209899 - DNA, 15 bp, Homo sapiens
cctaaaaagtaggag

SEQ ID NO: 209900 - DNA, 15 bp, Homo sapiens
acctaaaaagtagga

SEQ ID NO: 209901 - DNA, 15 bp, Homo sapiens
gacctaaaaagtagg

SEQ ID NO: 209902 - DNA, 15 bp, Homo sapiens
agacctaaaaagtag

SEQ ID NO: 209903 - DNA, 15 bp, Homo sapiens
aagacctaaaaagta

SEQ ID NO: 209904 - DNA, 15 bp, Homo sapiens
aaagacctaaaaagt

SEQ ID NO: 209905 - DNA, 15 bp, Homo sapiens
aaaagacctaaaaag

SEQ ID NO: 209906 - DNA, 15 bp, Homo sapiens
gaaaagacctaaaaa

SEQ ID NO: 209907 - DNA, 15 bp, Homo sapiens
ggaaaagacctaaaa

SEQ ID NO: 209908 - DNA, 15 bp, Homo sapiens
aggaaaagacctaaa

SEQ ID NO: 209909 - DNA, 15 bp, Homo sapiens
aaggaaaagacctaa

SEQ ID NO: 209910 - DNA, 15 bp, Homo sapiens
aaaggaaaagaccta

SEQ ID NO: 209911 - DNA, 15 bp, Homo sapiens
aaaaggaaaagacct

SEQ ID NO: 209912 - DNA, 15 bp, Homo sapiens
aaaaaggaaaagacc

SEQ ID NO: 209913 - DNA, 15 bp, Homo sapiens
caaaaaggaaaagac

SEQ ID NO: 209914 - DNA, 15 bp, Homo sapiens
acaaaaaggaaaaga

SEQ ID NO: 209915 - DNA, 15 bp, Homo sapiens
tacaaaaaggaaaag

SEQ ID NO: 209916 - DNA, 15 bp, Homo sapiens
ttacaaaaaggaaaa

SEQ ID NO: 209917 - DNA, 15 bp, Homo sapiens
attacaaaaaggaaa

SEQ ID NO: 209918 - DNA, 15 bp, Homo sapiens
tattacaaaaaggaa

SEQ ID NO: 209919 - DNA, 15 bp, Homo sapiens
ttattacaaaaagga

SEQ ID NO: 209920 - DNA, 15 bp, Homo sapiens
tttattacaaaaagg

SEQ ID NO: 209921 - DNA, 15 bp, Homo sapiens
ctttattacaaaaag

SEQ ID NO: 209922 - DNA, 15 bp, Homo sapiens
actttattacaaaaa

SEQ ID NO: 209923 - DNA, 15 bp, Homo sapiens
aactttattacaaaa

SEQ ID NO: 209924 - DNA, 15 bp, Homo sapiens
aaactttattacaaa

SEQ ID NO: 209925 - DNA, 15 bp, Homo sapiens
taaactttattacaa

SEQ ID NO: 209926 - DNA, 15 bp, Homo sapiens
ttaaactttattaca

SEQ ID NO: 209927 - DNA, 15 bp, Homo sapiens
tttaaactttattac

SEQ ID NO: 209928 - DNA, 15 bp, Homo sapiens
ttttaaactttatta

SEQ ID NO: 209929 - DNA, 15 bp, Homo sapiens
tttttaaactttatt

SEQ ID NO: 209930 - DNA, 15 bp, Homo sapiens
atttttaaactttat

SEQ ID NO: 209931 - DNA, 15 bp, Homo sapiens
gatttttaaacttta

SEQ ID NO: 209932 - DNA, 15 bp, Homo sapiens
agatttttaaacttt

SEQ ID NO: 209933 - DNA, 15 bp, Homo sapiens
aagatttttaaactt

SEQ ID NO: 209934 - DNA, 15 bp, Homo sapiens
aaagatttttaaact

SEQ ID NO: 209935 - DNA, 15 bp, Homo sapiens
aaaagatttttaaac

SEQ ID NO: 209936 - DNA, 15 bp, Homo sapiens
aaaaagatttttaaa

SEQ ID NO: 209937 - DNA, 15 bp, Homo sapiens
taaaaagatttttaa

SEQ ID NO: 209938 - DNA, 15 bp, Homo sapiens
ctaaaaagattttta

SEQ ID NO: 209939 - DNA, 15 bp, Homo sapiens
gctaaaaagattttt

SEQ ID NO: 209940 - DNA, 15 bp, Homo sapiens
agctaaaaagatttt

SEQ ID NO: 209941 - DNA, 15 bp, Homo sapiens
tagctaaaaagattt

SEQ ID NO: 209942 - DNA, 15 bp, Homo sapiens
gtagctaaaaagatt

SEQ ID NO: 209943 - DNA, 15 bp, Homo sapiens
tgtagctaaaaagat

SEQ ID NO: 209944 - DNA, 15 bp, Homo sapiens
ttgtagctaaaaaga

SEQ ID NO: 209945 - DNA, 15 bp, Homo sapiens
tttgtagctaaaaag

SEQ ID NO: 209946 - DNA, 15 bp, Homo sapiens
ctttgtagctaaaaa

SEQ ID NO: 209947 - DNA, 15 bp, Homo sapiens
tctttgtagctaaaa

SEQ ID NO: 209948 - DNA, 15 bp, Homo sapiens
ttctttgtagctaaa

SEQ ID NO: 209949 - DNA, 15 bp, Homo sapiens
gttctttgtagctaa

SEQ ID NO: 209950 - DNA, 15 bp, Homo sapiens
agttctttgtagcta

SEQ ID NO: 209951 - DNA, 15 bp, Homo sapiens
gagttctttgtagct

SEQ ID NO: 209952 - DNA, 15 bp, Homo sapiens
agagttctttgtagc

SEQ ID NO: 209953 - DNA, 15 bp, Homo sapiens
aagagttctttgtag

SEQ ID NO: 209954 - DNA, 15 bp, Homo sapiens
caagagttctttgta

SEQ ID NO: 209955 - DNA, 15 bp, Homo sapiens
acaagagttctttgt

SEQ ID NO: 209956 - DNA, 15 bp, Homo sapiens
gacaagagttctttg

SEQ ID NO: 209957 - DNA, 15 bp, Homo sapiens
agacaagagttcttt

SEQ ID NO: 209958 - DNA, 15 bp, Homo sapiens
aagacaagagttctt

SEQ ID NO: 209959 - DNA, 15 bp, Homo sapiens
taagacaagagttct

SEQ ID NO: 209960 - DNA, 15 bp, Homo sapiens
gtaagacaagagttc

SEQ ID NO: 209961 - DNA, 15 bp, Homo sapiens
tgtaagacaagagtt

SEQ ID NO: 209962 - DNA, 15 bp, Homo sapiens
ctgtaagacaagagt

SEQ ID NO: 209963 - DNA, 15 bp, Homo sapiens
gctgtaagacaagag

SEQ ID NO: 209964 - DNA, 15 bp, Homo sapiens
agctgtaagacaaga

SEQ ID NO: 209965 - DNA, 15 bp, Homo sapiens
gagctgtaagacaag

SEQ ID NO: 209966 - DNA, 15 bp, Homo sapiens
tgagctgtaagacaa

SEQ ID NO: 209967 - DNA, 15 bp, Homo sapiens
ttgagctgtaagaca

SEQ ID NO: 209968 - DNA, 15 bp, Homo sapiens
tttgagctgtaagac

SEQ ID NO: 209969 - DNA, 15 bp, Homo sapiens
ttttgagctgtaaga

SEQ ID NO: 209970 - DNA, 15 bp, Homo sapiens
cttttgagctgtaag

SEQ ID NO: 209971 - DNA, 15 bp, Homo sapiens
acttttgagctgtaa

SEQ ID NO: 209972 - DNA, 15 bp, Homo sapiens
tacttttgagctgta

SEQ ID NO: 209973 - DNA, 15 bp, Homo sapiens
gtacttttgagctgt

SEQ ID NO: 209974 - DNA, 15 bp, Homo sapiens
tgtacttttgagctg

SEQ ID NO: 209975 - DNA, 15 bp, Homo sapiens
atgtacttttgagct

SEQ ID NO: 209976 - DNA, 15 bp, Homo sapiens
tatgtacttttgagc

SEQ ID NO: 209977 - DNA, 15 bp, Homo sapiens
ttatgtacttttgag

SEQ ID NO: 209978 - DNA, 15 bp, Homo sapiens
attatgtacttttga

SEQ ID NO: 209979 - DNA, 15 bp, Homo sapiens
aattatgtacttttg

SEQ ID NO: 209980 - DNA, 15 bp, Homo sapiens
taattatgtactttt

SEQ ID NO: 209981 - DNA, 15 bp, Homo sapiens
ctaattatgtacttt

SEQ ID NO: 209982 - DNA, 15 bp, Homo sapiens
tctaattatgtactt

SEQ ID NO: 209983 - DNA, 15 bp, Homo sapiens
ttctaattatgtact

SEQ ID NO: 209984 - DNA, 15 bp, Homo sapiens
attctaattatgtac

SEQ ID NO: 209985 - DNA, 15 bp, Homo sapiens
gattctaattatgta

SEQ ID NO: 209986 - DNA, 15 bp, Homo sapiens
tgattctaattatgt

SEQ ID NO: 209987 - DNA, 15 bp, Homo sapiens
ttgattctaattatg

SEQ ID NO: 209988 - DNA, 15 bp, Homo sapiens
attgattctaattat

SEQ ID NO: 209989 - DNA, 15 bp, Homo sapiens
gattgattctaatta

SEQ ID NO: 209990 - DNA, 15 bp, Homo sapiens
tgattgattctaatt

SEQ ID NO: 209991 - DNA, 15 bp, Homo sapiens
ttgattgattctaat

SEQ ID NO: 209992 - DNA, 15 bp, Homo sapiens
cttgattgattctaa

SEQ ID NO: 209993 - DNA, 15 bp, Homo sapiens
tcttgattgattcta

SEQ ID NO: 209994 - DNA, 15 bp, Homo sapiens
atcttgattgattct

SEQ ID NO: 209995 - DNA, 15 bp, Homo sapiens
gatcttgattgattc

SEQ ID NO: 209996 - DNA, 15 bp, Homo sapiens
tgatcttgattgatt

SEQ ID NO: 209997 - DNA, 15 bp, Homo sapiens
ttgatcttgattgat

SEQ ID NO: 209998 - DNA, 15 bp, Homo sapiens
gttgatcttgattga

SEQ ID NO: 209999 - DNA, 15 bp, Homo sapiens
ggttgatcttgattg

SEQ ID NO: 210000 - DNA, 15 bp, Homo sapiens
gggttgatcttgatt

SEQ ID NO: 210001 - DNA, 15 bp, Homo sapiens
agggttgatcttgat

SEQ ID NO: 210002 - DNA, 15 bp, Homo sapiens
gagggttgatcttga

SEQ ID NO: 210003 - DNA, 15 bp, Homo sapiens
tgagggttgatcttg

SEQ ID NO: 210004 - DNA, 15 bp, Homo sapiens
ctgagggttgatctt

SEQ ID NO: 210005 - DNA, 15 bp, Homo sapiens
tctgagggttgatct

SEQ ID NO: 210006 - DNA, 15 bp, Homo sapiens
atctgagggttgatc

SEQ ID NO: 210007 - DNA, 15 bp, Homo sapiens
catctgagggttgat

SEQ ID NO: 210008 - DNA, 15 bp, Homo sapiens
ccatctgagggttga

SEQ ID NO: 210009 - DNA, 15 bp, Homo sapiens
gccatctgagggttg

SEQ ID NO: 210010 - DNA, 15 bp, Homo sapiens
agccatctgagggtt

SEQ ID NO: 210011 - DNA, 15 bp, Homo sapiens
aagccatctgagggt

SEQ ID NO: 210012 - DNA, 15 bp, Homo sapiens
caagccatctgaggg

SEQ ID NO: 210013 - DNA, 15 bp, Homo sapiens
tcaagccatctgagg

SEQ ID NO: 210014 - DNA, 15 bp, Homo sapiens
atcaagccatctgag

SEQ ID NO: 210015 - DNA, 15 bp, Homo sapiens
tatcaagccatctga

SEQ ID NO: 210016 - DNA, 15 bp, Homo sapiens
gtatcaagccatctg

SEQ ID NO: 210017 - DNA, 15 bp, Homo sapiens
agtatcaagccatct

SEQ ID NO: 210018 - DNA, 15 bp, Homo sapiens
tagtatcaagccatc

SEQ ID NO: 210019 - DNA, 15 bp, Homo sapiens
ttagtatcaagccat

SEQ ID NO: 210020 - DNA, 15 bp, Homo sapiens
attagtatcaagcca

SEQ ID NO: 210021 - DNA, 15 bp, Homo sapiens
tattagtatcaagcc

SEQ ID NO: 210022 - DNA, 15 bp, Homo sapiens
atattagtatcaagc

SEQ ID NO: 210023 - DNA, 15 bp, Homo sapiens
aatattagtatcaag

SEQ ID NO: 210024 - DNA, 15 bp, Homo sapiens
taatattagtatcaa

SEQ ID NO: 210025 - DNA, 15 bp, Homo sapiens
ctaatattagtatca

SEQ ID NO: 210026 - DNA, 15 bp, Homo sapiens
gctaatattagtatc

SEQ ID NO: 210027 - DNA, 15 bp, Homo sapiens
ggctaatattagtat

SEQ ID NO: 210028 - DNA, 15 bp, Homo sapiens
tggctaatattagta

SEQ ID NO: 210029 - DNA, 15 bp, Homo sapiens
ttggctaatattagt

SEQ ID NO: 210030 - DNA, 15 bp, Homo sapiens
cttggctaatattag

SEQ ID NO: 210031 - DNA, 15 bp, Homo sapiens
ccttggctaatatta

SEQ ID NO: 210032 - DNA, 15 bp, Homo sapiens
accttggctaatatt

SEQ ID NO: 210033 - DNA, 15 bp, Homo sapiens
aaccttggctaatat

SEQ ID NO: 210034 - DNA, 15 bp, Homo sapiens
aaaccttggctaata

SEQ ID NO: 210035 - DNA, 15 bp, Homo sapiens
aaaaccttggctaat

SEQ ID NO: 210036 - DNA, 15 bp, Homo sapiens
aaaaaccttggctaa

SEQ ID NO: 210037 - DNA, 15 bp, Homo sapiens
aaaaaaccttggcta

SEQ ID NO: 210038 - DNA, 15 bp, Homo sapiens
taaaaaaccttggct

SEQ ID NO: 210039 - DNA, 15 bp, Homo sapiens
ataaaaaaccttggc

SEQ ID NO: 210040 - DNA, 15 bp, Homo sapiens
aataaaaaaccttgg

SEQ ID NO: 210041 - DNA, 15 bp, Homo sapiens
gaataaaaaaccttg

SEQ ID NO: 210042 - DNA, 15 bp, Homo sapiens
ggaataaaaaacctt

SEQ ID NO: 210043 - DNA, 15 bp, Homo sapiens
gggaataaaaaacct

SEQ ID NO: 210044 - DNA, 15 bp, Homo sapiens
agggaataaaaaacc

SEQ ID NO: 210045 - DNA, 15 bp, Homo sapiens
tagggaataaaaaac

SEQ ID NO: 210046 - DNA, 15 bp, Homo sapiens
ttagggaataaaaaa

SEQ ID NO: 210047 - DNA, 15 bp, Homo sapiens
tttagggaataaaaa

SEQ ID NO: 210048 - DNA, 15 bp, Homo sapiens
ttttagggaataaaa

SEQ ID NO: 210049 - DNA, 15 bp, Homo sapiens
cttttagggaataaa

SEQ ID NO: 210050 - DNA, 15 bp, Homo sapiens
acttttagggaataa

SEQ ID NO: 210051 - DNA, 15 bp, Homo sapiens
aacttttagggaata

SEQ ID NO: 210052 - DNA, 15 bp, Homo sapiens
gaacttttagggaat

SEQ ID NO: 210053 - DNA, 15 bp, Homo sapiens
ggaacttttagggaa

SEQ ID NO: 210054 - DNA, 15 bp, Homo sapiens
gggaacttttaggga

SEQ ID NO: 210055 - DNA, 15 bp, Homo sapiens
tgggaacttttaggg

SEQ ID NO: 210056 - DNA, 15 bp, Homo sapiens
atgggaacttttagg

SEQ ID NO: 210057 - DNA, 15 bp, Homo sapiens
tatgggaacttttag

SEQ ID NO: 210058 - DNA, 15 bp, Homo sapiens
ctatgggaactttta

SEQ ID NO: 210059 - DNA, 15 bp, Homo sapiens
tctatgggaactttt

SEQ ID NO: 210060 - DNA, 15 bp, Homo sapiens
ttctatgggaacttt

SEQ ID NO: 210061 - DNA, 15 bp, Homo sapiens
tttctatgggaactt

SEQ ID NO: 210062 - DNA, 15 bp, Homo sapiens
ctttctatgggaact

SEQ ID NO: 210063 - DNA, 15 bp, Homo sapiens
tctttctatgggaac

SEQ ID NO: 210064 - DNA, 15 bp, Homo sapiens
ttctttctatgggaa

SEQ ID NO: 210065 - DNA, 15 bp, Homo sapiens
tttctttctatggga

SEQ ID NO: 210066 - DNA, 15 bp, Homo sapiens
ctttctttctatggg

SEQ ID NO: 210067 - DNA, 15 bp, Homo sapiens
cctttctttctatgg

SEQ ID NO: 210068 - DNA, 15 bp, Homo sapiens
ccctttctttctatg

SEQ ID NO: 210069 - DNA, 15 bp, Homo sapiens
tccctttctttctat

SEQ ID NO: 210070 - DNA, 15 bp, Homo sapiens
gtccctttctttcta

SEQ ID NO: 210071 - DNA, 15 bp, Homo sapiens
ggtccctttctttct

SEQ ID NO: 210072 - DNA, 15 bp, Homo sapiens
aggtccctttctttc

SEQ ID NO: 210073 - DNA, 15 bp, Homo sapiens
aaggtccctttcttt

SEQ ID NO: 210074 - DNA, 15 bp, Homo sapiens
caaggtccctttctt

SEQ ID NO: 210075 - DNA, 15 bp, Homo sapiens
acaaggtccctttct

SEQ ID NO: 210076 - DNA, 15 bp, Homo sapiens
tacaaggtccctttc

SEQ ID NO: 210077 - DNA, 15 bp, Homo sapiens
gtacaaggtcccttt

SEQ ID NO: 210078 - DNA, 15 bp, Homo sapiens
agtacaaggtccctt

SEQ ID NO: 210079 - DNA, 15 bp, Homo sapiens
aagtacaaggtccct

SEQ ID NO: 210080 - DNA, 15 bp, Homo sapiens
caagtacaaggtccc

SEQ ID NO: 210081 - DNA, 15 bp, Homo sapiens
tcaagtacaaggtcc

SEQ ID NO: 210082 - DNA, 15 bp, Homo sapiens
atcaagtacaaggtc

SEQ ID NO: 210083 - DNA, 15 bp, Homo sapiens
aatcaagtacaaggt

SEQ ID NO: 210084 - DNA, 15 bp, Homo sapiens
aaatcaagtacaagg

SEQ ID NO: 210085 - DNA, 15 bp, Homo sapiens
gaaatcaagtacaag

SEQ ID NO: 210086 - DNA, 15 bp, Homo sapiens
agaaatcaagtacaa

SEQ ID NO: 210087 - DNA, 15 bp, Homo sapiens
tagaaatcaagtaca

SEQ ID NO: 210088 - DNA, 15 bp, Homo sapiens
ttagaaatcaagtac

SEQ ID NO: 210089 - DNA, 15 bp, Homo sapiens
attagaaatcaagta

SEQ ID NO: 210090 - DNA, 15 bp, Homo sapiens
aattagaaatcaagt

SEQ ID NO: 210091 - DNA, 15 bp, Homo sapiens
gaattagaaatcaag

SEQ ID NO: 210092 - DNA, 15 bp, Homo sapiens
tgaattagaaatcaa

SEQ ID NO: 210093 - DNA, 15 bp, Homo sapiens
atgaattagaaatca

SEQ ID NO: 210094 - DNA, 15 bp, Homo sapiens
aatgaattagaaatc

SEQ ID NO: 210095 - DNA, 15 bp, Homo sapiens
gaatgaattagaaat

SEQ ID NO: 210096 - DNA, 15 bp, Homo sapiens
agaatgaattagaaa

SEQ ID NO: 210097 - DNA, 15 bp, Homo sapiens
gagaatgaattagaa

SEQ ID NO: 210098 - DNA, 15 bp, Homo sapiens
agagaatgaattaga

SEQ ID NO: 210099 - DNA, 15 bp, Homo sapiens
tagagaatgaattag

SEQ ID NO: 210100 - DNA, 15 bp, Homo sapiens
ttagagaatgaatta

SEQ ID NO: 210101 - DNA, 15 bp, Homo sapiens
attagagaatgaatt

SEQ ID NO: 210102 - DNA, 15 bp, Homo sapiens
gattagagaatgaat

SEQ ID NO: 210103 - DNA, 15 bp, Homo sapiens
agattagagaatgaa

SEQ ID NO: 210104 - DNA, 15 bp, Homo sapiens
aagattagagaatga

SEQ ID NO: 210105 - DNA, 15 bp, Homo sapiens
taagattagagaatg

SEQ ID NO: 210106 - DNA, 15 bp, Homo sapiens
ttaagattagagaat

SEQ ID NO: 210107 - DNA, 15 bp, Homo sapiens
cttaagattagagaa

SEQ ID NO: 210108 - DNA, 15 bp, Homo sapiens
ccttaagattagaga

SEQ ID NO: 210109 - DNA, 15 bp, Homo sapiens
accttaagattagag

SEQ ID NO: 210110 - DNA, 15 bp, Homo sapiens
taccttaagattaga

SEQ ID NO: 210111 - DNA, 15 bp, Homo sapiens
ttaccttaagattag

SEQ ID NO: 210112 - DNA, 15 bp, Homo sapiens
attaccttaagatta

SEQ ID NO: 210113 - DNA, 15 bp, Homo sapiens
tattaccttaagatt

SEQ ID NO: 210114 - DNA, 15 bp, Homo sapiens
ctattaccttaagat

SEQ ID NO: 210115 - DNA, 15 bp, Homo sapiens
actattaccttaaga

SEQ ID NO: 210116 - DNA, 15 bp, Homo sapiens
aactattaccttaag

SEQ ID NO: 210117 - DNA, 15 bp, Homo sapiens
aaactattaccttaa

SEQ ID NO: 210118 - DNA, 15 bp, Homo sapiens
caaactattacctta

SEQ ID NO: 210119 - DNA, 15 bp, Homo sapiens
tcaaactattacctt

SEQ ID NO: 210120 - DNA, 15 bp, Homo sapiens
ttcaaactattacct

SEQ ID NO: 210121 - DNA, 15 bp, Homo sapiens
attcaaactattacc

SEQ ID NO: 210122 - DNA, 15 bp, Homo sapiens
aattcaaactattac

SEQ ID NO: 210123 - DNA, 15 bp, Homo sapiens
taattcaaactatta

SEQ ID NO: 210124 - DNA, 15 bp, Homo sapiens
gtaattcaaactatt

SEQ ID NO: 210125 - DNA, 15 bp, Homo sapiens
agtaattcaaactat

SEQ ID NO: 210126 - DNA, 15 bp, Homo sapiens
aagtaattcaaacta

SEQ ID NO: 210127 - DNA, 15 bp, Homo sapiens
aaagtaattcaaact

SEQ ID NO: 210128 - DNA, 15 bp, Homo sapiens
taaagtaattcaaac

SEQ ID NO: 210129 - DNA, 15 bp, Homo sapiens
ataaagtaattcaaa

SEQ ID NO: 210130 - DNA, 15 bp, Homo sapiens
aataaagtaattcaa

SEQ ID NO: 210131 - DNA, 15 bp, Homo sapiens
aaataaagtaattca

SEQ ID NO: 210132 - DNA, 15 bp, Homo sapiens
gaaataaagtaattc

SEQ ID NO: 210133 - DNA, 15 bp, Homo sapiens
tgaaataaagtaatt

SEQ ID NO: 210134 - DNA, 15 bp, Homo sapiens
ttgaaataaagtaat

SEQ ID NO: 210135 - DNA, 15 bp, Homo sapiens
cttgaaataaagtaa

SEQ ID NO: 210136 - DNA, 15 bp, Homo sapiens
gcttgaaataaagta

SEQ ID NO: 210137 - DNA, 15 bp, Homo sapiens
tgcttgaaataaagt

SEQ ID NO: 210138 - DNA, 15 bp, Homo sapiens
ttgcttgaaataaag

SEQ ID NO: 210139 - DNA, 15 bp, Homo sapiens
gttgcttgaaataaa

SEQ ID NO: 210140 - DNA, 15 bp, Homo sapiens
tgttgcttgaaataa

SEQ ID NO: 210141 - DNA, 15 bp, Homo sapiens
gtgttgcttgaaata

SEQ ID NO: 210142 - DNA, 15 bp, Homo sapiens
tgtgttgcttgaaat

SEQ ID NO: 210143 - DNA, 15 bp, Homo sapiens
ttgtgttgcttgaaa

SEQ ID NO: 210144 - DNA, 15 bp, Homo sapiens
attgtgttgcttgaa

SEQ ID NO: 210145 - DNA, 15 bp, Homo sapiens
tattgtgttgcttga

SEQ ID NO: 210146 - DNA, 15 bp, Homo sapiens
gtattgtgttgcttg

SEQ ID NO: 210147 - DNA, 15 bp, Homo sapiens
agtattgtgttgctt

SEQ ID NO: 210148 - DNA, 15 bp, Homo sapiens
cagtattgtgttgct

SEQ ID NO: 210149 - DNA, 15 bp, Homo sapiens
tcagtattgtgttgc

SEQ ID NO: 210150 - DNA, 15 bp, Homo sapiens
atcagtattgtgttg

SEQ ID NO: 210151 - DNA, 15 bp, Homo sapiens
aatcagtattgtgtt

SEQ ID NO: 210152 - DNA, 15 bp, Homo sapiens
taatcagtattgtgt

SEQ ID NO: 210153 - DNA, 15 bp, Homo sapiens
ttaatcagtattgtg

SEQ ID NO: 210154 - DNA, 15 bp, Homo sapiens
attaatcagtattgt

SEQ ID NO: 210155 - DNA, 15 bp, Homo sapiens
aattaatcagtattg

SEQ ID NO: 210156 - DNA, 15 bp, Homo sapiens
aaattaatcagtatt

SEQ ID NO: 210157 - DNA, 15 bp, Homo sapiens
caaattaatcagtat

SEQ ID NO: 210158 - DNA, 15 bp, Homo sapiens
tcaaattaatcagta

SEQ ID NO: 210159 - DNA, 15 bp, Homo sapiens
gtcaaattaatcagt

SEQ ID NO: 210160 - DNA, 15 bp, Homo sapiens
cgtcaaattaatcag

SEQ ID NO: 210161 - DNA, 15 bp, Homo sapiens
acgtcaaattaatca

SEQ ID NO: 210162 - DNA, 15 bp, Homo sapiens
tacgtcaaattaatc

SEQ ID NO: 210163 - DNA, 15 bp, Homo sapiens
ttacgtcaaattaat

SEQ ID NO: 210164 - DNA, 15 bp, Homo sapiens
tttacgtcaaattaa

SEQ ID NO: 210165 - DNA, 15 bp, Homo sapiens
gtttacgtcaaatta

SEQ ID NO: 210166 - DNA, 15 bp, Homo sapiens
agtttacgtcaaatt

SEQ ID NO: 210167 - DNA, 15 bp, Homo sapiens
gagtttacgtcaaat

SEQ ID NO: 210168 - DNA, 15 bp, Homo sapiens
agagtttacgtcaaa

SEQ ID NO: 210169 - DNA, 15 bp, Homo sapiens
gagagtttacgtcaa

SEQ ID NO: 210170 - DNA, 15 bp, Homo sapiens
tgagagtttacgtca

SEQ ID NO: 210171 - DNA, 15 bp, Homo sapiens
gtgagagtttacgtc

SEQ ID NO: 210172 - DNA, 15 bp, Homo sapiens
agtgagagtttacgt

SEQ ID NO: 210173 - DNA, 15 bp, Homo sapiens
cagtgagagtttacg

SEQ ID NO: 210174 - DNA, 15 bp, Homo sapiens
gcagtgagagtttac

SEQ ID NO: 210175 - DNA, 15 bp, Homo sapiens
agcagtgagagttta

SEQ ID NO: 210176 - DNA, 15 bp, Homo sapiens
tagcagtgagagttt

SEQ ID NO: 210177 - DNA, 15 bp, Homo sapiens
ttagcagtgagagtt

SEQ ID NO: 210178 - DNA, 15 bp, Homo sapiens
attagcagtgagagt

SEQ ID NO: 210179 - DNA, 15 bp, Homo sapiens
aattagcagtgagag

SEQ ID NO: 210180 - DNA, 15 bp, Homo sapiens
aaattagcagtgaga

SEQ ID NO: 210181 - DNA, 15 bp, Homo sapiens
taaattagcagtgag

SEQ ID NO: 210182 - DNA, 15 bp, Homo sapiens
ttaaattagcagtga

SEQ ID NO: 210183 - DNA, 15 bp, Homo sapiens
cttaaattagcagtg

SEQ ID NO: 210184 - DNA, 15 bp, Homo sapiens
tcttaaattagcagt

SEQ ID NO: 210185 - DNA, 15 bp, Homo sapiens
atcttaaattagcag

SEQ ID NO: 210186 - DNA, 15 bp, Homo sapiens
catcttaaattagca

SEQ ID NO: 210187 - DNA, 15 bp, Homo sapiens
acatcttaaattagc

SEQ ID NO: 210188 - DNA, 15 bp, Homo sapiens
gacatcttaaattag

SEQ ID NO: 210189 - DNA, 15 bp, Homo sapiens
agacatcttaaatta

SEQ ID NO: 210190 - DNA, 15 bp, Homo sapiens
tagacatcttaaatt

SEQ ID NO: 210191 - DNA, 15 bp, Homo sapiens
ttagacatcttaaat

SEQ ID NO: 210192 - DNA, 15 bp, Homo sapiens
tttagacatcttaaa

SEQ ID NO: 210193 - DNA, 15 bp, Homo sapiens
ctttagacatcttaa

SEQ ID NO: 210194 - DNA, 15 bp, Homo sapiens
tctttagacatctta

SEQ ID NO: 210195 - DNA, 15 bp, Homo sapiens
ttctttagacatctt

SEQ ID NO: 210196 - DNA, 15 bp, Homo sapiens
attctttagacatct

SEQ ID NO: 210197 - DNA, 15 bp, Homo sapiens
tattctttagacatc

SEQ ID NO: 210198 - DNA, 15 bp, Homo sapiens
atattctttagacat

SEQ ID NO: 210199 - DNA, 15 bp, Homo sapiens
gatattctttagaca

SEQ ID NO: 210200 - DNA, 15 bp, Homo sapiens
tgatattctttagac

SEQ ID NO: 210201 - DNA, 15 bp, Homo sapiens
ctgatattctttaga

SEQ ID NO: 210202 - DNA, 15 bp, Homo sapiens
tctgatattctttag

SEQ ID NO: 210203 - DNA, 15 bp, Homo sapiens
atctgatattcttta

SEQ ID NO: 210204 - DNA, 15 bp, Homo sapiens
catctgatattcttt

SEQ ID NO: 210205 - DNA, 15 bp, Homo sapiens
ccatctgatattctt

SEQ ID NO: 210206 - DNA, 15 bp, Homo sapiens
tccatctgatattct

SEQ ID NO: 210207 - DNA, 15 bp, Homo sapiens
ttccatctgatattc

SEQ ID NO: 210208 - DNA, 15 bp, Homo sapiens
attccatctgatatt

SEQ ID NO: 210209 - DNA, 15 bp, Homo sapiens
aattccatctgatat

SEQ ID NO: 210210 - DNA, 15 bp, Homo sapiens
aaattccatctgata

SEQ ID NO: 210211 - DNA, 15 bp, Homo sapiens
aaaattccatctgat

SEQ ID NO: 210212 - DNA, 15 bp, Homo sapiens
caaaattccatctga

SEQ ID NO: 210213 - DNA, 15 bp, Homo sapiens
acaaaattccatctg

SEQ ID NO: 210214 - DNA, 15 bp, Homo sapiens
cacaaaattccatct

SEQ ID NO: 210215 - DNA, 15 bp, Homo sapiens
tcacaaaattccatc

SEQ ID NO: 210216 - DNA, 15 bp, Homo sapiens
ttcacaaaattccat

SEQ ID NO: 210217 - DNA, 15 bp, Homo sapiens
cttcacaaaattcca

SEQ ID NO: 210218 - DNA, 15 bp, Homo sapiens
tcttcacaaaattcc

SEQ ID NO: 210219 - DNA, 15 bp, Homo sapiens
ctcttcacaaaattc

SEQ ID NO: 210220 - DNA, 15 bp, Homo sapiens
tctcttcacaaaatt

SEQ ID NO: 210221 - DNA, 15 bp, Homo sapiens
gtctcttcacaaaat

SEQ ID NO: 210222 - DNA, 15 bp, Homo sapiens
tgtctcttcacaaaa

SEQ ID NO: 210223 - DNA, 15 bp, Homo sapiens
ttgtctcttcacaaa

SEQ ID NO: 210224 - DNA, 15 bp, Homo sapiens
tttgtctcttcacaa

SEQ ID NO: 210225 - DNA, 15 bp, Homo sapiens
ctttgtctcttcaca

SEQ ID NO: 210226 - DNA, 15 bp, Homo sapiens
tctttgtctcttcac

SEQ ID NO: 210227 - DNA, 15 bp, Homo sapiens
ttctttgtctcttca

SEQ ID NO: 210228 - DNA, 15 bp, Homo sapiens
gttctttgtctcttc

SEQ ID NO: 210229 - DNA, 15 bp, Homo sapiens
agttctttgtctctt

SEQ ID NO: 210230 - DNA, 15 bp, Homo sapiens
aagttctttgtctct

SEQ ID NO: 210231 - DNA, 15 bp, Homo sapiens
taagttctttgtctc

SEQ ID NO: 210232 - DNA, 15 bp, Homo sapiens
ttaagttctttgtct

SEQ ID NO: 210233 - DNA, 15 bp, Homo sapiens
gttaagttctttgtc

SEQ ID NO: 210234 - DNA, 15 bp, Homo sapiens
tgttaagttctttgt

SEQ ID NO: 210235 - DNA, 15 bp, Homo sapiens
gtgttaagttctttg

SEQ ID NO: 210236 - DNA, 15 bp, Homo sapiens
agtgttaagttcttt

SEQ ID NO: 210237 - DNA, 15 bp, Homo sapiens
tagtgttaagttctt

SEQ ID NO: 210238 - DNA, 15 bp, Homo sapiens
ttagtgttaagttct

SEQ ID NO: 210239 - DNA, 15 bp, Homo sapiens
attagtgttaagttc

SEQ ID NO: 210240 - DNA, 15 bp, Homo sapiens
aattagtgttaagtt

SEQ ID NO: 210241 - DNA, 15 bp, Homo sapiens
aaattagtgttaagt

SEQ ID NO: 210242 - DNA, 15 bp, Homo sapiens
taaattagtgttaag

SEQ ID NO: 210243 - DNA, 15 bp, Homo sapiens
ttaaattagtgttaa

SEQ ID NO: 210244 - DNA, 15 bp, Homo sapiens
attaaattagtgtta

SEQ ID NO: 210245 - DNA, 15 bp, Homo sapiens
aattaaattagtgtt

SEQ ID NO: 210246 - DNA, 15 bp, Homo sapiens
taattaaattagtgt

SEQ ID NO: 210247 - DNA, 15 bp, Homo sapiens
ataattaaattagtg

SEQ ID NO: 210248 - DNA, 15 bp, Homo sapiens
aataattaaattagt

SEQ ID NO: 210249 - DNA, 15 bp, Homo sapiens
gaataattaaattag

SEQ ID NO: 210250 - DNA, 15 bp, Homo sapiens
ggaataattaaatta

SEQ ID NO: 210251 - DNA, 15 bp, Homo sapiens
tggaataattaaatt

SEQ ID NO: 210252 - DNA, 15 bp, Homo sapiens
ttggaataattaaat

SEQ ID NO: 210253 - DNA, 15 bp, Homo sapiens
tttggaataattaaa

SEQ ID NO: 210254 - DNA, 15 bp, Homo sapiens
ttttggaataattaa

SEQ ID NO: 210255 - DNA, 15 bp, Homo sapiens
cttttggaataatta

SEQ ID NO: 210256 - DNA, 15 bp, Homo sapiens
ccttttggaataatt

SEQ ID NO: 210257 - DNA, 15 bp, Homo sapiens
accttttggaataat

SEQ ID NO: 210258 - DNA, 15 bp, Homo sapiens
taccttttggaataa

SEQ ID NO: 210259 - DNA, 15 bp, Homo sapiens
ataccttttggaata

SEQ ID NO: 210260 - DNA, 15 bp, Homo sapiens
cataccttttggaat

SEQ ID NO: 210261 - DNA, 15 bp, Homo sapiens
tcataccttttggaa

SEQ ID NO: 210262 - DNA, 15 bp, Homo sapiens
atcataccttttgga

SEQ ID NO: 210263 - DNA, 15 bp, Homo sapiens
gatcataccttttgg

SEQ ID NO: 210264 - DNA, 15 bp, Homo sapiens
agatcataccttttg

SEQ ID NO: 210265 - DNA, 15 bp, Homo sapiens
gagatcatacctttt

SEQ ID NO: 210266 - DNA, 15 bp, Homo sapiens
tgagatcataccttt

SEQ ID NO: 210267 - DNA, 15 bp, Homo sapiens
atgagatcatacctt

SEQ ID NO: 210268 - DNA, 15 bp, Homo sapiens
tatgagatcatacct

SEQ ID NO: 210269 - DNA, 15 bp, Homo sapiens
ttatgagatcatacc

SEQ ID NO: 210270 - DNA, 15 bp, Homo sapiens
tttatgagatcatac

SEQ ID NO: 210271 - DNA, 15 bp, Homo sapiens
atttatgagatcata

SEQ ID NO: 210272 - DNA, 15 bp, Homo sapiens
catttatgagatcat

SEQ ID NO: 210273 - DNA, 15 bp, Homo sapiens
gcatttatgagatca

SEQ ID NO: 210274 - DNA, 15 bp, Homo sapiens
tgcatttatgagatc

SEQ ID NO: 210275 - DNA, 15 bp, Homo sapiens
ttgcatttatgagat

SEQ ID NO: 210276 - DNA, 15 bp, Homo sapiens
cttgcatttatgaga

SEQ ID NO: 210277 - DNA, 15 bp, Homo sapiens
acttgcatttatgag

SEQ ID NO: 210278 - DNA, 15 bp, Homo sapiens
aacttgcatttatga

SEQ ID NO: 210279 - DNA, 15 bp, Homo sapiens
aaacttgcatttatg

SEQ ID NO: 210280 - DNA, 15 bp, Homo sapiens
aaaacttgcatttat

SEQ ID NO: 210281 - DNA, 15 bp, Homo sapiens
caaaacttgcattta

SEQ ID NO: 210282 - DNA, 15 bp, Homo sapiens
tcaaaacttgcattt

SEQ ID NO: 210283 - DNA, 15 bp, Homo sapiens
ttcaaaacttgcatt

SEQ ID NO: 210284 - DNA, 15 bp, Homo sapiens
attcaaaacttgcat

SEQ ID NO: 210285 - DNA, 15 bp, Homo sapiens
tattcaaaacttgca

SEQ ID NO: 210286 - DNA, 15 bp, Homo sapiens
gtattcaaaacttgc

SEQ ID NO: 210287 - DNA, 15 bp, Homo sapiens
ggtattcaaaacttg

SEQ ID NO: 210288 - DNA, 15 bp, Homo sapiens
tggtattcaaaactt

SEQ ID NO: 210289 - DNA, 15 bp, Homo sapiens
gtggtattcaaaact

SEQ ID NO: 210290 - DNA, 15 bp, Homo sapiens
agtggtattcaaaac

SEQ ID NO: 210291 - DNA, 15 bp, Homo sapiens
tagtggtattcaaaa

SEQ ID NO: 210292 - DNA, 15 bp, Homo sapiens
atagtggtattcaaa

SEQ ID NO: 210293 - DNA, 15 bp, Homo sapiens
tatagtggtattcaa

SEQ ID NO: 210294 - DNA, 15 bp, Homo sapiens
atatagtggtattca

SEQ ID NO: 210295 - DNA, 15 bp, Homo sapiens
tatatagtggtattc

SEQ ID NO: 210296 - DNA, 15 bp, Homo sapiens
gtatatagtggtatt

SEQ ID NO: 210297 - DNA, 15 bp, Homo sapiens
tgtatatagtggtat

SEQ ID NO: 210298 - DNA, 15 bp, Homo sapiens
ttgtatatagtggta

SEQ ID NO: 210299 - DNA, 15 bp, Homo sapiens
gttgtatatagtggt

SEQ ID NO: 210300 - DNA, 15 bp, Homo sapiens
ggttgtatatagtgg

SEQ ID NO: 210301 - DNA, 15 bp, Homo sapiens
aggttgtatatagtg

SEQ ID NO: 210302 - DNA, 15 bp, Homo sapiens
aaggttgtatatagt

SEQ ID NO: 210303 - DNA, 15 bp, Homo sapiens
aaaggttgtatatag

SEQ ID NO: 210304 - DNA, 15 bp, Homo sapiens
taaaggttgtatata

SEQ ID NO: 210305 - DNA, 15 bp, Homo sapiens
ataaaggttgtatat

SEQ ID NO: 210306 - DNA, 15 bp, Homo sapiens
aataaaggttgtata

SEQ ID NO: 210307 - DNA, 15 bp, Homo sapiens
aaataaaggttgtat

SEQ ID NO: 210308 - DNA, 15 bp, Homo sapiens
taaataaaggttgta

SEQ ID NO: 210309 - DNA, 15 bp, Homo sapiens
ctaaataaaggttgt

SEQ ID NO: 210310 - DNA, 15 bp, Homo sapiens
cctaaataaaggttg

SEQ ID NO: 210311 - DNA, 15 bp, Homo sapiens
ccctaaataaaggtt

SEQ ID NO: 210312 - DNA, 15 bp, Homo sapiens
cccctaaataaaggt

SEQ ID NO: 210313 - DNA, 15 bp, Homo sapiens
acccctaaataaagg

SEQ ID NO: 210314 - DNA, 15 bp, Homo sapiens
aacccctaaataaag

SEQ ID NO: 210315 - DNA, 15 bp, Homo sapiens
caacccctaaataaa

SEQ ID NO: 210316 - DNA, 15 bp, Homo sapiens
tcaacccctaaataa

SEQ ID NO: 210317 - DNA, 15 bp, Homo sapiens
atcaacccctaaata

SEQ ID NO: 210318 - DNA, 15 bp, Homo sapiens
aatcaacccctaaat

SEQ ID NO: 210319 - DNA, 15 bp, Homo sapiens
aaatcaacccctaaa

SEQ ID NO: 210320 - DNA, 15 bp, Homo sapiens
taaatcaacccctaa

SEQ ID NO: 210321 - DNA, 15 bp, Homo sapiens
ataaatcaaccccta

SEQ ID NO: 210322 - DNA, 15 bp, Homo sapiens
tataaatcaacccct

SEQ ID NO: 210323 - DNA, 15 bp, Homo sapiens
ctataaatcaacccc

SEQ ID NO: 210324 - DNA, 15 bp, Homo sapiens
tctataaatcaaccc

SEQ ID NO: 210325 - DNA, 15 bp, Homo sapiens
ttctataaatcaacc

SEQ ID NO: 210326 - DNA, 15 bp, Homo sapiens
tttctataaatcaac

SEQ ID NO: 210327 - DNA, 15 bp, Homo sapiens
gtttctataaatcaa

SEQ ID NO: 210328 - DNA, 15 bp, Homo sapiens
agtttctataaatca

SEQ ID NO: 210329 - DNA, 15 bp, Homo sapiens
gagtttctataaatc

SEQ ID NO: 210330 - DNA, 15 bp, Homo sapiens
tgagtttctataaat

SEQ ID NO: 210331 - DNA, 15 bp, Homo sapiens
atgagtttctataaa

SEQ ID NO: 210332 - DNA, 15 bp, Homo sapiens
tatgagtttctataa

SEQ ID NO: 210333 - DNA, 15 bp, Homo sapiens
atatgagtttctata

SEQ ID NO: 210334 - DNA, 15 bp, Homo sapiens
tatatgagtttctat

SEQ ID NO: 210335 - DNA, 15 bp, Homo sapiens
atatatgagtttcta

SEQ ID NO: 210336 - DNA, 15 bp, Homo sapiens
aatatatgagtttct

SEQ ID NO: 210337 - DNA, 15 bp, Homo sapiens
gaatatatgagtttc

SEQ ID NO: 210338 - DNA, 15 bp, Homo sapiens
agaatatatgagttt

SEQ ID NO: 210339 - DNA, 15 bp, Homo sapiens
cagaatatatgagtt

SEQ ID NO: 210340 - DNA, 15 bp, Homo sapiens
tcagaatatatgagt

SEQ ID NO: 210341 - DNA, 15 bp, Homo sapiens
ctcagaatatatgag

SEQ ID NO: 210342 - DNA, 15 bp, Homo sapiens
actcagaatatatga

SEQ ID NO: 210343 - DNA, 15 bp, Homo sapiens
gactcagaatatatg

SEQ ID NO: 210344 - DNA, 15 bp, Homo sapiens
agactcagaatatat

SEQ ID NO: 210345 - DNA, 15 bp, Homo sapiens
aagactcagaatata

SEQ ID NO: 210346 - DNA, 15 bp, Homo sapiens
gaagactcagaatat

SEQ ID NO: 210347 - DNA, 15 bp, Homo sapiens
agaagactcagaata

SEQ ID NO: 210348 - DNA, 15 bp, Homo sapiens
cagaagactcagaat

SEQ ID NO: 210349 - DNA, 15 bp, Homo sapiens
tcagaagactcagaa

SEQ ID NO: 210350 - DNA, 15 bp, Homo sapiens
atcagaagactcaga

SEQ ID NO: 210351 - DNA, 15 bp, Homo sapiens
aatcagaagactcag

SEQ ID NO: 210352 - DNA, 15 bp, Homo sapiens
gaatcagaagactca

SEQ ID NO: 210353 - DNA, 15 bp, Homo sapiens
ggaatcagaagactc

SEQ ID NO: 210354 - DNA, 15 bp, Homo sapiens
cggaatcagaagact

SEQ ID NO: 210355 - DNA, 15 bp, Homo sapiens
tcggaatcagaagac

SEQ ID NO: 210356 - DNA, 15 bp, Homo sapiens
ttcggaatcagaaga

SEQ ID NO: 210357 - DNA, 15 bp, Homo sapiens
gttcggaatcagaag

SEQ ID NO: 210358 - DNA, 15 bp, Homo sapiens
agttcggaatcagaa

SEQ ID NO: 210359 - DNA, 15 bp, Homo sapiens
tagttcggaatcaga

SEQ ID NO: 210360 - DNA, 15 bp, Homo sapiens
atagttcggaatcag

SEQ ID NO: 210361 - DNA, 15 bp, Homo sapiens
gatagttcggaatca

SEQ ID NO: 210362 - DNA, 15 bp, Homo sapiens
agatagttcggaatc

SEQ ID NO: 210363 - DNA, 15 bp, Homo sapiens
aagatagttcggaat

SEQ ID NO: 210364 - DNA, 15 bp, Homo sapiens
aaagatagttcggaa

SEQ ID NO: 210365 - DNA, 15 bp, Homo sapiens
taaagatagttcgga

SEQ ID NO: 210366 - DNA, 15 bp, Homo sapiens
ataaagatagttcgg

SEQ ID NO: 210367 - DNA, 15 bp, Homo sapiens
tataaagatagttcg

SEQ ID NO: 210368 - DNA, 15 bp, Homo sapiens
atataaagatagttc

SEQ ID NO: 210369 - DNA, 15 bp, Homo sapiens
tatataaagatagtt

SEQ ID NO: 210370 - DNA, 15 bp, Homo sapiens
atatataaagatagt

SEQ ID NO: 210371 - DNA, 15 bp, Homo sapiens
aatatataaagatag

SEQ ID NO: 210372 - DNA, 15 bp, Homo sapiens
gaatatataaagata

SEQ ID NO: 210373 - DNA, 15 bp, Homo sapiens
agaatatataaagat

SEQ ID NO: 210374 - DNA, 15 bp, Homo sapiens
tagaatatataaaga

SEQ ID NO: 210375 - DNA, 15 bp, Homo sapiens
ctagaatatataaag

SEQ ID NO: 210376 - DNA, 15 bp, Homo sapiens
actagaatatataaa

SEQ ID NO: 210377 - DNA, 15 bp, Homo sapiens
gactagaatatataa

SEQ ID NO: 210378 - DNA, 15 bp, Homo sapiens
ggactagaatatata

SEQ ID NO: 210379 - DNA, 15 bp, Homo sapiens
aggactagaatatat

SEQ ID NO: 210380 - DNA, 15 bp, Homo sapiens
aaggactagaatata

SEQ ID NO: 210381 - DNA, 15 bp, Homo sapiens
aaaggactagaatat

SEQ ID NO: 210382 - DNA, 15 bp, Homo sapiens
taaaggactagaata

SEQ ID NO: 210383 - DNA, 15 bp, Homo sapiens
ataaaggactagaat

SEQ ID NO: 210384 - DNA, 15 bp, Homo sapiens
tataaaggactagaa

SEQ ID NO: 210385 - DNA, 15 bp, Homo sapiens
atataaaggactaga

SEQ ID NO: 210386 - DNA, 15 bp, Homo sapiens
catataaaggactag

SEQ ID NO: 210387 - DNA, 15 bp, Homo sapiens
acatataaaggacta

SEQ ID NO: 210388 - DNA, 15 bp, Homo sapiens
tacatataaaggact

SEQ ID NO: 210389 - DNA, 15 bp, Homo sapiens
gtacatataaaggac

SEQ ID NO: 210390 - DNA, 15 bp, Homo sapiens
tgtacatataaagga

SEQ ID NO: 210391 - DNA, 15 bp, Homo sapiens
atgtacatataaagg

SEQ ID NO: 210392 - DNA, 15 bp, Homo sapiens
tatgtacatataaag

SEQ ID NO: 210393 - DNA, 15 bp, Homo sapiens
ttatgtacatataaa

SEQ ID NO: 210394 - DNA, 15 bp, Homo sapiens
tttatgtacatataa

SEQ ID NO: 210395 - DNA, 15 bp, Homo sapiens
atttatgtacatata

SEQ ID NO: 210396 - DNA, 15 bp, Homo sapiens
catttatgtacatat

SEQ ID NO: 210397 - DNA, 15 bp, Homo sapiens
tcatttatgtacata

SEQ ID NO: 210398 - DNA, 15 bp, Homo sapiens
atcatttatgtacat

SEQ ID NO: 210399 - DNA, 15 bp, Homo sapiens
aatcatttatgtaca

SEQ ID NO: 210400 - DNA, 15 bp, Homo sapiens
aaatcatttatgtac

SEQ ID NO: 210401 - DNA, 15 bp, Homo sapiens
taaatcatttatgta

SEQ ID NO: 210402 - DNA, 15 bp, Homo sapiens
ttaaatcatttatgt

SEQ ID NO: 210403 - DNA, 15 bp, Homo sapiens
attaaatcatttatg

SEQ ID NO: 210404 - DNA, 15 bp, Homo sapiens
cattaaatcatttat

SEQ ID NO: 210405 - DNA, 15 bp, Homo sapiens
tcattaaatcattta

SEQ ID NO: 210406 - DNA, 15 bp, Homo sapiens
gtcattaaatcattt

SEQ ID NO: 210407 - DNA, 15 bp, Homo sapiens
agtcattaaatcatt

SEQ ID NO: 210408 - DNA, 15 bp, Homo sapiens
gagtcattaaatcat

SEQ ID NO: 210409 - DNA, 15 bp, Homo sapiens
ggagtcattaaatca

SEQ ID NO: 210410 - DNA, 15 bp, Homo sapiens
aggagtcattaaatc

SEQ ID NO: 210411 - DNA, 15 bp, Homo sapiens
aaggagtcattaaat

SEQ ID NO: 210412 - DNA, 15 bp, Homo sapiens
aaaggagtcattaaa

SEQ ID NO: 210413 - DNA, 15 bp, Homo sapiens
aaaaggagtcattaa

SEQ ID NO: 210414 - DNA, 15 bp, Homo sapiens
gaaaaggagtcatta

SEQ ID NO: 210415 - DNA, 15 bp, Homo sapiens
tgaaaaggagtcatt

SEQ ID NO: 210416 - DNA, 15 bp, Homo sapiens
ttgaaaaggagtcat

SEQ ID NO: 210417 - DNA, 15 bp, Homo sapiens
tttgaaaaggagtca

SEQ ID NO: 210418 - DNA, 15 bp, Homo sapiens
ctttgaaaaggagtc

SEQ ID NO: 210419 - DNA, 15 bp, Homo sapiens
actttgaaaaggagt

SEQ ID NO: 210420 - DNA, 15 bp, Homo sapiens
aactttgaaaaggag

SEQ ID NO: 210421 - DNA, 15 bp, Homo sapiens
taactttgaaaagga

SEQ ID NO: 210422 - DNA, 15 bp, Homo sapiens
gtaactttgaaaagg

SEQ ID NO: 210423 - DNA, 15 bp, Homo sapiens
gagtaactttgaaaa

SEQ ID NO: 210424 - DNA, 15 bp, Homo sapiens
agagtaactttgaaa

SEQ ID NO: 210425 - DNA, 15 bp, Homo sapiens
aagagtaactttgaa

SEQ ID NO: 210426 - DNA, 15 bp, Homo sapiens
aaagagtaactttga

SEQ ID NO: 210427 - DNA, 15 bp, Homo sapiens
caaagagtaactttg

SEQ ID NO: 210428 - DNA, 15 bp, Homo sapiens
tcaaagagtaacttt

SEQ ID NO: 210429 - DNA, 15 bp, Homo sapiens
atcaaagagtaactt

SEQ ID NO: 210430 - DNA, 15 bp, Homo sapiens
tatcaaagagtaact

SEQ ID NO: 210431 - DNA, 15 bp, Homo sapiens
ttatcaaagagtaac

SEQ ID NO: 210432 - DNA, 15 bp, Homo sapiens
attatcaaagagtaa

SEQ ID NO: 210433 - DNA, 15 bp, Homo sapiens
tattatcaaagagta

SEQ ID NO: 210434 - DNA, 15 bp, Homo sapiens
ctattatcaaagagt

SEQ ID NO: 210435 - DNA, 15 bp, Homo sapiens
actattatcaaagag

SEQ ID NO: 210436 - DNA, 15 bp, Homo sapiens
cactattatcaaaga

SEQ ID NO: 210437 - DNA, 15 bp, Homo sapiens
ccactattatcaaag

SEQ ID NO: 210438 - DNA, 15 bp, Homo sapiens
accactattatcaaa

SEQ ID NO: 210439 - DNA, 15 bp, Homo sapiens
caccactattatcaa

SEQ ID NO: 210440 - DNA, 15 bp, Homo sapiens
gcaccactattatca

SEQ ID NO: 210441 - DNA, 15 bp, Homo sapiens
ggcaccactattatc

SEQ ID NO: 210442 - DNA, 15 bp, Homo sapiens
tggcaccactattat

SEQ ID NO: 210443 - DNA, 15 bp, Homo sapiens
ttggcaccactatta

SEQ ID NO: 210444 - DNA, 15 bp, Homo sapiens
attggcaccactatt

SEQ ID NO: 210445 - DNA, 15 bp, Homo sapiens
gattggcaccactat

SEQ ID NO: 210446 - DNA, 15 bp, Homo sapiens
tgattggcaccacta

SEQ ID NO: 210447 - DNA, 15 bp, Homo sapiens
atgattggcaccact

SEQ ID NO: 210448 - DNA, 15 bp, Homo sapiens
aatgattggcaccac

SEQ ID NO: 210449 - DNA, 15 bp, Homo sapiens
aaatgattggcacca

SEQ ID NO: 210450 - DNA, 15 bp, Homo sapiens
gaaatgattggcacc

SEQ ID NO: 210451 - DNA, 15 bp, Homo sapiens
tgaaatgattggcac

SEQ ID NO: 210452 - DNA, 15 bp, Homo sapiens
atgaaatgattggca

SEQ ID NO: 210453 - DNA, 15 bp, Homo sapiens
aatgaaatgattggc

SEQ ID NO: 210454 - DNA, 15 bp, Homo sapiens
gaatgaaatgattgg

SEQ ID NO: 210455 - DNA, 15 bp, Homo sapiens
ggaatgaaatgattg

SEQ ID NO: 210456 - DNA, 15 bp, Homo sapiens
gggaatgaaatgatt

SEQ ID NO: 210457 - DNA, 15 bp, Homo sapiens
ggggaatgaaatgat

SEQ ID NO: 210458 - DNA, 15 bp, Homo sapiens
tggggaatgaaatga

SEQ ID NO: 210459 - DNA, 15 bp, Homo sapiens
atggggaatgaaatg

SEQ ID NO: 210460 - DNA, 15 bp, Homo sapiens
gatggggaatgaaat

SEQ ID NO: 210461 - DNA, 15 bp, Homo sapiens
ggatggggaatgaaa

SEQ ID NO: 210462 - DNA, 15 bp, Homo sapiens
tggatggggaatgaa

SEQ ID NO: 210463 - DNA, 15 bp, Homo sapiens
atggatggggaatga

SEQ ID NO: 210464 - DNA, 15 bp, Homo sapiens
gatggatggggaatg

SEQ ID NO: 210465 - DNA, 15 bp, Homo sapiens
ggatggatggggaat

SEQ ID NO: 210466 - DNA, 15 bp, Homo sapiens
tggatggatggggaa

SEQ ID NO: 210467 - DNA, 15 bp, Homo sapiens
gtggatggatgggga

SEQ ID NO: 210468 - DNA, 15 bp, Homo sapiens
ggtggatggatgggg

SEQ ID NO: 210469 - DNA, 15 bp, Homo sapiens
gggtggatggatggg

SEQ ID NO: 210470 - DNA, 15 bp, Homo sapiens
tgggtggatggatgg

SEQ ID NO: 210471 - DNA, 15 bp, Homo sapiens
gtgggtggatggatg

SEQ ID NO: 210472 - DNA, 15 bp, Homo sapiens
ggtgggtggatggat

SEQ ID NO: 210473 - DNA, 15 bp, Homo sapiens
aggtgggtggatgga

SEQ ID NO: 210474 - DNA, 15 bp, Homo sapiens
taggtgggtggatgg

SEQ ID NO: 210475 - DNA, 15 bp, Homo sapiens
ataggtgggtggatg

SEQ ID NO: 210476 - DNA, 15 bp, Homo sapiens
gataggtgggtggat

SEQ ID NO: 210477 - DNA, 15 bp, Homo sapiens
ggataggtgggtgga

SEQ ID NO: 210478 - DNA, 15 bp, Homo sapiens
tggataggtgggtgg

SEQ ID NO: 210479 - DNA, 15 bp, Homo sapiens
gtggataggtgggtg

SEQ ID NO: 210480 - DNA, 15 bp, Homo sapiens
tgtggataggtgggt

SEQ ID NO: 210481 - DNA, 15 bp, Homo sapiens
gtgtggataggtggg

SEQ ID NO: 210482 - DNA, 15 bp, Homo sapiens
agtgtggataggtgg

SEQ ID NO: 210483 - DNA, 15 bp, Homo sapiens
tagtgtggataggtg

SEQ ID NO: 210484 - DNA, 15 bp, Homo sapiens
atagtgtggataggt

SEQ ID NO: 210485 - DNA, 15 bp, Homo sapiens
aatagtgtggatagg

SEQ ID NO: 210486 - DNA, 15 bp, Homo sapiens
gaatagtgtggatag

SEQ ID NO: 210487 - DNA, 15 bp, Homo sapiens
tgaatagtgtggata

SEQ ID NO: 210488 - DNA, 15 bp, Homo sapiens
gtgaatagtgtggat

SEQ ID NO: 210489 - DNA, 15 bp, Homo sapiens
ggtgaatagtgtgga

SEQ ID NO: 210490 - DNA, 15 bp, Homo sapiens
tggtgaatagtgtgg

SEQ ID NO: 210491 - DNA, 15 bp, Homo sapiens
ttggtgaatagtgtg

SEQ ID NO: 210492 - DNA, 15 bp, Homo sapiens
tttggtgaatagtgt

SEQ ID NO: 210493 - DNA, 15 bp, Homo sapiens
atttggtgaatagtg

SEQ ID NO: 210494 - DNA, 15 bp, Homo sapiens
catttggtgaatagt

SEQ ID NO: 210495 - DNA, 15 bp, Homo sapiens
acatttggtgaatag

SEQ ID NO: 210496 - DNA, 15 bp, Homo sapiens
gacatttggtgaata

SEQ ID NO: 210497 - DNA, 15 bp, Homo sapiens
agacatttggtgaat

SEQ ID NO: 210498 - DNA, 15 bp, Homo sapiens
aagacatttggtgaa

SEQ ID NO: 210499 - DNA, 15 bp, Homo sapiens
taagacatttggtga

SEQ ID NO: 210500 - DNA, 15 bp, Homo sapiens
ttaagacatttggtg

SEQ ID NO: 210501 - DNA, 15 bp, Homo sapiens
attaagacatttggt

SEQ ID NO: 210502 - DNA, 15 bp, Homo sapiens
cattaagacatttgg

SEQ ID NO: 210503 - DNA, 15 bp, Homo sapiens
acattaagacatttg

SEQ ID NO: 210504 - DNA, 15 bp, Homo sapiens
aacattaagacattt

SEQ ID NO: 210505 - DNA, 15 bp, Homo sapiens
taacattaagacatt

SEQ ID NO: 210506 - DNA, 15 bp, Homo sapiens
ttaacattaagacat

SEQ ID NO: 210507 - DNA, 15 bp, Homo sapiens
tttaacattaagaca

SEQ ID NO: 210508 - DNA, 15 bp, Homo sapiens
ctttaacattaagac

SEQ ID NO: 210509 - DNA, 15 bp, Homo sapiens
actttaacattaaga

SEQ ID NO: 210510 - DNA, 15 bp, Homo sapiens
aactttaacattaag

SEQ ID NO: 210511 - DNA, 15 bp, Homo sapiens
caactttaacattaa

SEQ ID NO: 210512 - DNA, 15 bp, Homo sapiens
tcaactttaacatta

SEQ ID NO: 210513 - DNA, 15 bp, Homo sapiens
atcaactttaacatt

SEQ ID NO: 210514 - DNA, 15 bp, Homo sapiens
catcaactttaacat

SEQ ID NO: 210515 - DNA, 15 bp, Homo sapiens
gcatcaactttaaca

SEQ ID NO: 210516 - DNA, 15 bp, Homo sapiens
agcatcaactttaac

SEQ ID NO: 210517 - DNA, 15 bp, Homo sapiens
aagcatcaactttaa

SEQ ID NO: 210518 - DNA, 15 bp, Homo sapiens
gaagcatcaacttta

SEQ ID NO: 210519 - DNA, 15 bp, Homo sapiens
agaagcatcaacttt

SEQ ID NO: 210520 - DNA, 15 bp, Homo sapiens
cagaagcatcaactt

SEQ ID NO: 210521 - DNA, 15 bp, Homo sapiens
acagaagcatcaact

SEQ ID NO: 210522 - DNA, 15 bp, Homo sapiens
tacagaagcatcaac

SEQ ID NO: 210523 - DNA, 15 bp, Homo sapiens
gtacagaagcatcaa

SEQ ID NO: 210524 - DNA, 15 bp, Homo sapiens
cgtacagaagcatca

SEQ ID NO: 210525 - DNA, 15 bp, Homo sapiens
tcgtacagaagcatc

SEQ ID NO: 210526 - DNA, 15 bp, Homo sapiens
ttcgtacagaagcat

SEQ ID NO: 210527 - DNA, 15 bp, Homo sapiens
cttcgtacagaagca

SEQ ID NO: 210528 - DNA, 15 bp, Homo sapiens
tcttcgtacagaagc

SEQ ID NO: 210529 - DNA, 15 bp, Homo sapiens
ctcttcgtacagaag

SEQ ID NO: 210530 - DNA, 15 bp, Homo sapiens
gctcttcgtacagaa

SEQ ID NO: 210531 - DNA, 15 bp, Homo sapiens
tgctcttcgtacaga

SEQ ID NO: 210532 - DNA, 15 bp, Homo sapiens
ttgctcttcgtacag

SEQ ID NO: 210533 - DNA, 15 bp, Homo sapiens
attgctcttcgtaca

SEQ ID NO: 210534 - DNA, 15 bp, Homo sapiens
tattgctcttcgtac

SEQ ID NO: 210535 - DNA, 15 bp, Homo sapiens
ttattgctcttcgta

SEQ ID NO: 210536 - DNA, 15 bp, Homo sapiens
cttattgctcttcgt

SEQ ID NO: 210537 - DNA, 15 bp, Homo sapiens
ccttattgctcttcg

SEQ ID NO: 210538 - DNA, 15 bp, Homo sapiens
accttattgctcttc

SEQ ID NO: 210539 - DNA, 15 bp, Homo sapiens
taccttattgctctt

SEQ ID NO: 210540 - DNA, 15 bp, Homo sapiens
ataccttattgctct

SEQ ID NO: 210541 - DNA, 15 bp, Homo sapiens
tataccttattgctc

SEQ ID NO: 210542 - DNA, 15 bp, Homo sapiens
ctataccttattgct

SEQ ID NO: 210543 - DNA, 15 bp, Homo sapiens
gctataccttattgc

SEQ ID NO: 210544 - DNA, 15 bp, Homo sapiens
ggctataccttattg

SEQ ID NO: 210545 - DNA, 15 bp, Homo sapiens
aggctataccttatt

SEQ ID NO: 210546 - DNA, 15 bp, Homo sapiens
gaggctataccttat

SEQ ID NO: 210547 - DNA, 15 bp, Homo sapiens
agaggctatacctta

SEQ ID NO: 210548 - DNA, 15 bp, Homo sapiens
cagaggctatacctt

SEQ ID NO: 210549 - DNA, 15 bp, Homo sapiens
gcagaggctatacct

SEQ ID NO: 210550 - DNA, 15 bp, Homo sapiens
tgcagaggctatacc

SEQ ID NO: 210551 - DNA, 15 bp, Homo sapiens
gtgcagaggctatac

SEQ ID NO: 210552 - DNA, 15 bp, Homo sapiens
ggtgcagaggctata

SEQ ID NO: 210553 - DNA, 15 bp, Homo sapiens
aggtgcagaggctat

SEQ ID NO: 210554 - DNA, 15 bp, Homo sapiens
gaggtgcagaggcta

SEQ ID NO: 210555 - DNA, 15 bp, Homo sapiens
tgaggtgcagaggct

SEQ ID NO: 210556 - DNA, 15 bp, Homo sapiens
ctgaggtgcagaggc

SEQ ID NO: 210557 - DNA, 15 bp, Homo sapiens
actgaggtgcagagg

SEQ ID NO: 210558 - DNA, 15 bp, Homo sapiens
cactgaggtgcagag

SEQ ID NO: 210559 - DNA, 15 bp, Homo sapiens
tcactgaggtgcaga

SEQ ID NO: 210560 - DNA, 15 bp, Homo sapiens
atcactgaggtgcag

SEQ ID NO: 210561 - DNA, 15 bp, Homo sapiens
tatcactgaggtgca

SEQ ID NO: 210562 - DNA, 15 bp, Homo sapiens
atatcactgaggtgc

SEQ ID NO: 210563 - DNA, 15 bp, Homo sapiens
tatatcactgaggtg

SEQ ID NO: 210564 - DNA, 15 bp, Homo sapiens
atatatcactgaggt

SEQ ID NO: 210565 - DNA, 15 bp, Homo sapiens
aatatatcactgagg

SEQ ID NO: 210566 - DNA, 15 bp, Homo sapiens
aaatatatcactgag

SEQ ID NO: 210567 - DNA, 15 bp, Homo sapiens
aaaatatatcactga

SEQ ID NO: 210568 - DNA, 15 bp, Homo sapiens
taaaatatatcactg

SEQ ID NO: 210569 - DNA, 15 bp, Homo sapiens
ttaaaatatatcact

SEQ ID NO: 210570 - DNA, 15 bp, Homo sapiens
attaaaatatatcac

SEQ ID NO: 210571 - DNA, 15 bp, Homo sapiens
tattaaaatatatca

SEQ ID NO: 210572 - DNA, 15 bp, Homo sapiens
ttattaaaatatatc

SEQ ID NO: 210573 - DNA, 15 bp, Homo sapiens
attattaaaatatat

SEQ ID NO: 210574 - DNA, 15 bp, Homo sapiens
aattattaaaatata

SEQ ID NO: 210575 - DNA, 15 bp, Homo sapiens
gaattattaaaatat

SEQ ID NO: 210576 - DNA, 15 bp, Homo sapiens
ggaattattaaaata

SEQ ID NO: 210577 - DNA, 15 bp, Homo sapiens
aggaattattaaaat

SEQ ID NO: 210578 - DNA, 15 bp, Homo sapiens
taggaattattaaaa

SEQ ID NO: 210579 - DNA, 15 bp, Homo sapiens
ataggaattattaaa

SEQ ID NO: 210580 - DNA, 15 bp, Homo sapiens
aataggaattattaa

SEQ ID NO: 210581 - DNA, 15 bp, Homo sapiens
taataggaattatta

SEQ ID NO: 210582 - DNA, 15 bp, Homo sapiens
gtaataggaattatt

SEQ ID NO: 210583 - DNA, 15 bp, Homo sapiens
agtaataggaattat

SEQ ID NO: 210584 - DNA, 15 bp, Homo sapiens
tagtaataggaatta

SEQ ID NO: 210585 - DNA, 15 bp, Homo sapiens
ttagtaataggaatt

SEQ ID NO: 210586 - DNA, 15 bp, Homo sapiens
tttagtaataggaat

SEQ ID NO: 210587 - DNA, 15 bp, Homo sapiens
ttttagtaataggaa

SEQ ID NO: 210588 - DNA, 15 bp, Homo sapiens
cttttagtaatagga

SEQ ID NO: 210589 - DNA, 15 bp, Homo sapiens
gcttttagtaatagg

SEQ ID NO: 210590 - DNA, 15 bp, Homo sapiens
ggcttttagtaatag

SEQ ID NO: 210591 - DNA, 15 bp, Homo sapiens
gggcttttagtaata

SEQ ID NO: 210592 - DNA, 15 bp, Homo sapiens
agggcttttagtaat

SEQ ID NO: 210593 - DNA, 15 bp, Homo sapiens
cagggcttttagtaa

SEQ ID NO: 210594 - DNA, 15 bp, Homo sapiens
acagggcttttagta

SEQ ID NO: 210595 - DNA, 15 bp, Homo sapiens
cacagggcttttagt

SEQ ID NO: 210596 - DNA, 15 bp, Homo sapiens
gcacagggcttttag

SEQ ID NO: 210597 - DNA, 15 bp, Homo sapiens
agcacagggctttta

SEQ ID NO: 210598 - DNA, 15 bp, Homo sapiens
aagcacagggctttt

SEQ ID NO: 210599 - DNA, 15 bp, Homo sapiens
caagcacagggcttt

SEQ ID NO: 210600 - DNA, 15 bp, Homo sapiens
acaagcacagggctt

SEQ ID NO: 210601 - DNA, 15 bp, Homo sapiens
cacaagcacagggct

SEQ ID NO: 210602 - DNA, 15 bp, Homo sapiens
ccacaagcacagggc

SEQ ID NO: 210603 - DNA, 15 bp, Homo sapiens
accacaagcacaggg

SEQ ID NO: 210604 - DNA, 15 bp, Homo sapiens
aaccacaagcacagg

SEQ ID NO: 210605 - DNA, 15 bp, Homo sapiens
aaaccacaagcacag

SEQ ID NO: 210606 - DNA, 15 bp, Homo sapiens
caaaccacaagcaca

SEQ ID NO: 210607 - DNA, 15 bp, Homo sapiens
acaaaccacaagcac

SEQ ID NO: 210608 - DNA, 15 bp, Homo sapiens
aacaaaccacaagca

SEQ ID NO: 210609 - DNA, 15 bp, Homo sapiens
caacaaaccacaagc

SEQ ID NO: 210610 - DNA, 15 bp, Homo sapiens
ccaacaaaccacaag

SEQ ID NO: 210611 - DNA, 15 bp, Homo sapiens
gccaacaaaccacaa

SEQ ID NO: 210612 - DNA, 15 bp, Homo sapiens
agccaacaaaccaca

SEQ ID NO: 210613 - DNA, 15 bp, Homo sapiens
cagccaacaaaccac

SEQ ID NO: 210614 - DNA, 15 bp, Homo sapiens
acagccaacaaacca

SEQ ID NO: 210615 - DNA, 15 bp, Homo sapiens
tacagccaacaaacc

SEQ ID NO: 210616 - DNA, 15 bp, Homo sapiens
atacagccaacaaac

SEQ ID NO: 210617 - DNA, 15 bp, Homo sapiens
gatacagccaacaaa

SEQ ID NO: 210618 - DNA, 15 bp, Homo sapiens
ggatacagccaacaa

SEQ ID NO: 210619 - DNA, 15 bp, Homo sapiens
tggatacagccaaca

SEQ ID NO: 210620 - DNA, 15 bp, Homo sapiens
ctggatacagccaac

SEQ ID NO: 210621 - DNA, 15 bp, Homo sapiens
tctggatacagccaa

SEQ ID NO: 210622 - DNA, 15 bp, Homo sapiens
ctctggatacagcca

SEQ ID NO: 210623 - DNA, 15 bp, Homo sapiens
cctctggatacagcc

SEQ ID NO: 210624 - DNA, 15 bp, Homo sapiens
ccctctggatacagc

SEQ ID NO: 210625 - DNA, 15 bp, Homo sapiens
tccctctggatacag

SEQ ID NO: 210626 - DNA, 15 bp, Homo sapiens
ttccctctggataca

SEQ ID NO: 210627 - DNA, 15 bp, Homo sapiens
attccctctggatac

SEQ ID NO: 210628 - DNA, 15 bp, Homo sapiens
tattccctctggata

SEQ ID NO: 210629 - DNA, 15 bp, Homo sapiens
gtattccctctggat

SEQ ID NO: 210630 - DNA, 15 bp, Homo sapiens
agtattccctctgga

SEQ ID NO: 210631 - DNA, 15 bp, Homo sapiens
aagtattccctctgg

SEQ ID NO: 210632 - DNA, 15 bp, Homo sapiens
aaagtattccctctg

SEQ ID NO: 210633 - DNA, 15 bp, Homo sapiens
taaagtattccctct

SEQ ID NO: 210634 - DNA, 15 bp, Homo sapiens
gtaaagtattccctc

SEQ ID NO: 210635 - DNA, 15 bp, Homo sapiens
tgtaaagtattccct

SEQ ID NO: 210636 - DNA, 15 bp, Homo sapiens
atgtaaagtattccc

SEQ ID NO: 210637 - DNA, 15 bp, Homo sapiens
aatgtaaagtattcc

SEQ ID NO: 210638 - DNA, 15 bp, Homo sapiens
aaatgtaaagtattc

SEQ ID NO: 210639 - DNA, 15 bp, Homo sapiens
taaatgtaaagtatt

SEQ ID NO: 210640 - DNA, 15 bp, Homo sapiens
ttaaatgtaaagtat

SEQ ID NO: 210641 - DNA, 15 bp, Homo sapiens
tttaaatgtaaagta

SEQ ID NO: 210642 - DNA, 15 bp, Homo sapiens
atttaaatgtaaagt

SEQ ID NO: 210643 - DNA, 15 bp, Homo sapiens
catttaaatgtaaag

SEQ ID NO: 210644 - DNA, 15 bp, Homo sapiens
acatttaaatgtaaa

SEQ ID NO: 210645 - DNA, 15 bp, Homo sapiens
aacatttaaatgtaa

SEQ ID NO: 210646 - DNA, 15 bp, Homo sapiens
aaacatttaaatgta

SEQ ID NO: 210647 - DNA, 15 bp, Homo sapiens
taaacatttaaatgt

SEQ ID NO: 210648 - DNA, 15 bp, Homo sapiens
ctaaacatttaaatg

SEQ ID NO: 210649 - DNA, 15 bp, Homo sapiens
cctaaacatttaaat

SEQ ID NO: 210650 - DNA, 15 bp, Homo sapiens
acctaaacatttaaa

SEQ ID NO: 210651 - DNA, 15 bp, Homo sapiens
cacctaaacatttaa

SEQ ID NO: 210652 - DNA, 15 bp, Homo sapiens
tcacctaaacattta

SEQ ID NO: 210653 - DNA, 15 bp, Homo sapiens
atcacctaaacattt

SEQ ID NO: 210654 - DNA, 15 bp, Homo sapiens
catcacctaaacatt

SEQ ID NO: 210655 - DNA, 15 bp, Homo sapiens
ccatcacctaaacat

SEQ ID NO: 210656 - DNA, 15 bp, Homo sapiens
gccatcacctaaaca

SEQ ID NO: 210657 - DNA, 15 bp, Homo sapiens
agccatcacctaaac

SEQ ID NO: 210658 - DNA, 15 bp, Homo sapiens
gagccatcacctaaa

SEQ ID NO: 210659 - DNA, 15 bp, Homo sapiens
agagccatcacctaa

SEQ ID NO: 210660 - DNA, 15 bp, Homo sapiens
cagagccatcaccta

SEQ ID NO: 210661 - DNA, 15 bp, Homo sapiens
tcagagccatcacct

SEQ ID NO: 210662 - DNA, 15 bp, Homo sapiens
ctcagagccatcacc

SEQ ID NO: 210663 - DNA, 15 bp, Homo sapiens
tctcagagccatcac

SEQ ID NO: 210664 - DNA, 15 bp, Homo sapiens
atctcagagccatca

SEQ ID NO: 210665 - DNA, 15 bp, Homo sapiens
aatctcagagccatc

SEQ ID NO: 210666 - DNA, 15 bp, Homo sapiens
aaatctcagagccat

SEQ ID NO: 210667 - DNA, 15 bp, Homo sapiens
gaaatctcagagcca

SEQ ID NO: 210668 - DNA, 15 bp, Homo sapiens
cgaaatctcagagcc

SEQ ID NO: 210669 - DNA, 15 bp, Homo sapiens
gcgaaatctcagagc

SEQ ID NO: 210670 - DNA, 15 bp, Homo sapiens
ggcgaaatctcagag

SEQ ID NO: 210671 - DNA, 15 bp, Homo sapiens
aggcgaaatctcaga

SEQ ID NO: 210672 - DNA, 15 bp, Homo sapiens
aaggcgaaatctcag

SEQ ID NO: 210673 - DNA, 15 bp, Homo sapiens
taaggcgaaatctca

SEQ ID NO: 210674 - DNA, 15 bp, Homo sapiens
ctaaggcgaaatctc

SEQ ID NO: 210675 - DNA, 15 bp, Homo sapiens
tctaaggcgaaatct

SEQ ID NO: 210676 - DNA, 15 bp, Homo sapiens
ttctaaggcgaaatc

SEQ ID NO: 210677 - DNA, 15 bp, Homo sapiens
attctaaggcgaaat

SEQ ID NO: 210678 - DNA, 15 bp, Homo sapiens
tattctaaggcgaaa

SEQ ID NO: 210679 - DNA, 15 bp, Homo sapiens
ctattctaaggcgaa

SEQ ID NO: 210680 - DNA, 15 bp, Homo sapiens
cctattctaaggcga

SEQ ID NO: 210681 - DNA, 15 bp, Homo sapiens
ccctattctaaggcg

SEQ ID NO: 210682 - DNA, 15 bp, Homo sapiens
tccctattctaaggc

SEQ ID NO: 210683 - DNA, 15 bp, Homo sapiens
atccctattctaagg

SEQ ID NO: 210684 - DNA, 15 bp, Homo sapiens
tatccctattctaag

SEQ ID NO: 210685 - DNA, 15 bp, Homo sapiens
atatccctattctaa

SEQ ID NO: 210686 - DNA, 15 bp, Homo sapiens
tatatccctattcta

SEQ ID NO: 210687 - DNA, 15 bp, Homo sapiens
ttatatccctattct

SEQ ID NO: 210688 - DNA, 15 bp, Homo sapiens
tttatatccctattc

SEQ ID NO: 210689 - DNA, 15 bp, Homo sapiens
ctttatatccctatt

SEQ ID NO: 210690 - DNA, 15 bp, Homo sapiens
gctttatatccctat

SEQ ID NO: 210691 - DNA, 15 bp, Homo sapiens
tgctttatatcccta

SEQ ID NO: 210692 - DNA, 15 bp, Homo sapiens
ttgctttatatccct

SEQ ID NO: 210693 - DNA, 15 bp, Homo sapiens
attgctttatatccc

SEQ ID NO: 210694 - DNA, 15 bp, Homo sapiens
cattgctttatatcc

SEQ ID NO: 210695 - DNA, 15 bp, Homo sapiens
gcattgctttatatc

SEQ ID NO: 210696 - DNA, 15 bp, Homo sapiens
agcattgctttatat

SEQ ID NO: 210697 - DNA, 15 bp, Homo sapiens
aagcattgctttata

SEQ ID NO: 210698 - DNA, 15 bp, Homo sapiens
aaagcattgctttat

SEQ ID NO: 210699 - DNA, 15 bp, Homo sapiens
taaagcattgcttta

SEQ ID NO: 210700 - DNA, 15 bp, Homo sapiens
ttaaagcattgcttt

SEQ ID NO: 210701 - DNA, 15 bp, Homo sapiens
tttaaagcattgctt

SEQ ID NO: 210702 - DNA, 15 bp, Homo sapiens
ctttaaagcattgct

SEQ ID NO: 210703 - DNA, 15 bp, Homo sapiens
gctttaaagcattgc

SEQ ID NO: 210704 - DNA, 15 bp, Homo sapiens
tgctttaaagcattg

SEQ ID NO: 210705 - DNA, 15 bp, Homo sapiens
atgctttaaagcatt

SEQ ID NO: 210706 - DNA, 15 bp, Homo sapiens
gatgctttaaagcat

SEQ ID NO: 210707 - DNA, 15 bp, Homo sapiens
agatgctttaaagca

SEQ ID NO: 210708 - DNA, 15 bp, Homo sapiens
gagatgctttaaagc

SEQ ID NO: 210709 - DNA, 15 bp, Homo sapiens
ggagatgctttaaag

SEQ ID NO: 210710 - DNA, 15 bp, Homo sapiens
aggagatgctttaaa

SEQ ID NO: 210711 - DNA, 15 bp, Homo sapiens
taggagatgctttaa

SEQ ID NO: 210712 - DNA, 15 bp, Homo sapiens
ataggagatgcttta

SEQ ID NO: 210713 - DNA, 15 bp, Homo sapiens
cataggagatgcttt

SEQ ID NO: 210714 - DNA, 15 bp, Homo sapiens
acataggagatgctt

SEQ ID NO: 210715 - DNA, 15 bp, Homo sapiens
aacataggagatgct

SEQ ID NO: 210716 - DNA, 15 bp, Homo sapiens
gaacataggagatgc

SEQ ID NO: 210717 - DNA, 15 bp, Homo sapiens
tgaacataggagatg

SEQ ID NO: 210718 - DNA, 15 bp, Homo sapiens
ttgaacataggagat

SEQ ID NO: 210719 - DNA, 15 bp, Homo sapiens
tttgaacataggaga

SEQ ID NO: 210720 - DNA, 15 bp, Homo sapiens
gtttgaacataggag

SEQ ID NO: 210721 - DNA, 15 bp, Homo sapiens
tgtttgaacatagga

SEQ ID NO: 210722 - DNA, 15 bp, Homo sapiens
gtgtttgaacatagg

SEQ ID NO: 210723 - DNA, 15 bp, Homo sapiens
ggtgtttgaacatag

SEQ ID NO: 210724 - DNA, 15 bp, Homo sapiens
aggtgtttgaacata

SEQ ID NO: 210725 - DNA, 15 bp, Homo sapiens
taggtgtttgaacat

SEQ ID NO: 210726 - DNA, 15 bp, Homo sapiens
ctaggtgtttgaaca

SEQ ID NO: 210727 - DNA, 15 bp, Homo sapiens
gctaggtgtttgaac

SEQ ID NO: 210728 - DNA, 15 bp, Homo sapiens
cgctaggtgtttgaa

SEQ ID NO: 210729 - DNA, 15 bp, Homo sapiens
ccgctaggtgtttga

SEQ ID NO: 210730 - DNA, 15 bp, Homo sapiens
accgctaggtgtttg

SEQ ID NO: 210731 - DNA, 15 bp, Homo sapiens
aaccgctaggtgttt

SEQ ID NO: 210732 - DNA, 15 bp, Homo sapiens
taaccgctaggtgtt

SEQ ID NO: 210733 - DNA, 15 bp, Homo sapiens
ataaccgctaggtgt

SEQ ID NO: 210734 - DNA, 15 bp, Homo sapiens
tataaccgctaggtg

SEQ ID NO: 210735 - DNA, 15 bp, Homo sapiens
ctataaccgctaggt

SEQ ID NO: 210736 - DNA, 15 bp, Homo sapiens
tctataaccgctagg

SEQ ID NO: 210737 - DNA, 15 bp, Homo sapiens
atctataaccgctag

SEQ ID NO: 210738 - DNA, 15 bp, Homo sapiens
gatctataaccgcta

SEQ ID NO: 210739 - DNA, 15 bp, Homo sapiens
tgatctataaccgct

SEQ ID NO: 210740 - DNA, 15 bp, Homo sapiens
ttgatctataaccgc

SEQ ID NO: 210741 - DNA, 15 bp, Homo sapiens
tttgatctataaccg

SEQ ID NO: 210742 - DNA, 15 bp, Homo sapiens
atttgatctataacc

SEQ ID NO: 210743 - DNA, 15 bp, Homo sapiens
tatttgatctataac

SEQ ID NO: 210744 - DNA, 15 bp, Homo sapiens
atatttgatctataa

SEQ ID NO: 210745 - DNA, 15 bp, Homo sapiens
tatatttgatctata

SEQ ID NO: 210746 - DNA, 15 bp, Homo sapiens
ttatatttgatctat

SEQ ID NO: 210747 - DNA, 15 bp, Homo sapiens
tttatatttgatcta

SEQ ID NO: 210748 - DNA, 15 bp, Homo sapiens
ttttatatttgatct

SEQ ID NO: 210749 - DNA, 15 bp, Homo sapiens
tttttatatttgatc

SEQ ID NO: 210750 - DNA, 15 bp, Homo sapiens
ttttttatatttgat

SEQ ID NO: 210751 - DNA, 15 bp, Homo sapiens
gttttttatatttga

SEQ ID NO: 210752 - DNA, 15 bp, Homo sapiens
tgttttttatatttg

SEQ ID NO: 210753 - DNA, 15 bp, Homo sapiens
ctgttttttatattt

SEQ ID NO: 210754 - DNA, 15 bp, Homo sapiens
tctgttttttatatt

SEQ ID NO: 210755 - DNA, 15 bp, Homo sapiens
ttctgttttttatat

SEQ ID NO: 210756 - DNA, 15 bp, Homo sapiens
tttctgttttttata

SEQ ID NO: 210757 - DNA, 15 bp, Homo sapiens
ttttctgttttttat

SEQ ID NO: 210758 - DNA, 15 bp, Homo sapiens
gttttctgtttttta

SEQ ID NO: 210759 - DNA, 15 bp, Homo sapiens
ggttttctgtttttt

SEQ ID NO: 210760 - DNA, 15 bp, Homo sapiens
tggttttctgttttt

SEQ ID NO: 210761 - DNA, 15 bp, Homo sapiens
ttggttttctgtttt

SEQ ID NO: 210762 - DNA, 15 bp, Homo sapiens
tttggttttctgttt

SEQ ID NO: 210763 - DNA, 15 bp, Homo sapiens
tgtttggttttctgt

SEQ ID NO: 210764 - DNA, 15 bp, Homo sapiens
atgtttggttttctg

SEQ ID NO: 210765 - DNA, 15 bp, Homo sapiens
catgtttggttttct

SEQ ID NO: 210766 - DNA, 15 bp, Homo sapiens
ccatgtttggttttc

SEQ ID NO: 210767 - DNA, 15 bp, Homo sapiens
gccatgtttggtttt

SEQ ID NO: 210768 - DNA, 15 bp, Homo sapiens
tgccatgtttggttt

SEQ ID NO: 210769 - DNA, 15 bp, Homo sapiens
atgccatgtttggtt

SEQ ID NO: 210770 - DNA, 15 bp, Homo sapiens
aatgccatgtttggt

SEQ ID NO: 210771 - DNA, 15 bp, Homo sapiens
caatgccatgtttgg

SEQ ID NO: 210772 - DNA, 15 bp, Homo sapiens
acaatgccatgtttg

SEQ ID NO: 210773 - DNA, 15 bp, Homo sapiens
cacaatgccatgttt

SEQ ID NO: 210774 - DNA, 15 bp, Homo sapiens
ccacaatgccatgtt

SEQ ID NO: 210775 - DNA, 15 bp, Homo sapiens
cccacaatgccatgt

SEQ ID NO: 210776 - DNA, 15 bp, Homo sapiens
gcccacaatgccatg

SEQ ID NO: 210777 - DNA, 15 bp, Homo sapiens
agcccacaatgccat

SEQ ID NO: 210778 - DNA, 15 bp, Homo sapiens
gagcccacaatgcca

SEQ ID NO: 210779 - DNA, 15 bp, Homo sapiens
ggagcccacaatgcc

SEQ ID NO: 210780 - DNA, 15 bp, Homo sapiens
tggagcccacaatgc

SEQ ID NO: 210781 - DNA, 15 bp, Homo sapiens
ttggagcccacaatg

SEQ ID NO: 210782 - DNA, 15 bp, Homo sapiens
tttggagcccacaat

SEQ ID NO: 210783 - DNA, 15 bp, Homo sapiens
ttttggagcccacaa

SEQ ID NO: 210784 - DNA, 15 bp, Homo sapiens
gttttggagcccaca

SEQ ID NO: 210785 - DNA, 15 bp, Homo sapiens
tgttttggagcccac

SEQ ID NO: 210786 - DNA, 15 bp, Homo sapiens
atgttttggagccca

SEQ ID NO: 210787 - DNA, 15 bp, Homo sapiens
catgttttggagccc

SEQ ID NO: 210788 - DNA, 15 bp, Homo sapiens
tcatgttttggagcc

SEQ ID NO: 210789 - DNA, 15 bp, Homo sapiens
gtcatgttttggagc

SEQ ID NO: 210790 - DNA, 15 bp, Homo sapiens
tgtcatgttttggag

SEQ ID NO: 210791 - DNA, 15 bp, Homo sapiens
ttgtcatgttttgga

SEQ ID NO: 210792 - DNA, 15 bp, Homo sapiens
attgtcatgttttgg

SEQ ID NO: 210793 - DNA, 15 bp, Homo sapiens
gattgtcatgttttg

SEQ ID NO: 210794 - DNA, 15 bp, Homo sapiens
tgattgtcatgtttt

SEQ ID NO: 210795 - DNA, 15 bp, Homo sapiens
atgattgtcatgttt

SEQ ID NO: 210796 - DNA, 15 bp, Homo sapiens
aatgattgtcatgtt

SEQ ID NO: 210797 - DNA, 15 bp, Homo sapiens
gaatgattgtcatgt

SEQ ID NO: 210798 - DNA, 15 bp, Homo sapiens
agaatgattgtcatg

SEQ ID NO: 210799 - DNA, 15 bp, Homo sapiens
tagaatgattgtcat

SEQ ID NO: 210800 - DNA, 15 bp, Homo sapiens
gtagaatgattgtca

SEQ ID NO: 210801 - DNA, 15 bp, Homo sapiens
tgtagaatgattgtc

SEQ ID NO: 210802 - DNA, 15 bp, Homo sapiens
ctgtagaatgattgt

SEQ ID NO: 210803 - DNA, 15 bp, Homo sapiens
cctgtagaatgattg

SEQ ID NO: 210804 - DNA, 15 bp, Homo sapiens
gcctgtagaatgatt

SEQ ID NO: 210805 - DNA, 15 bp, Homo sapiens
ggcctgtagaatgat

SEQ ID NO: 210806 - DNA, 15 bp, Homo sapiens
tggcctgtagaatga

SEQ ID NO: 210807 - DNA, 15 bp, Homo sapiens
ctggcctgtagaatg

SEQ ID NO: 210808 - DNA, 15 bp, Homo sapiens
tctggcctgtagaat

SEQ ID NO: 210809 - DNA, 15 bp, Homo sapiens
ttctggcctgtagaa

SEQ ID NO: 210810 - DNA, 15 bp, Homo sapiens
tttctggcctgtaga

SEQ ID NO: 210811 - DNA, 15 bp, Homo sapiens
gtttctggcctgtag

SEQ ID NO: 210812 - DNA, 15 bp, Homo sapiens
tgtttctggcctgta

SEQ ID NO: 210813 - DNA, 15 bp, Homo sapiens
ttgtttctggcctgt

SEQ ID NO: 210814 - DNA, 15 bp, Homo sapiens
tttgtttctggcctg

SEQ ID NO: 210815 - DNA, 15 bp, Homo sapiens
ctttgtttctggcct

SEQ ID NO: 210816 - DNA, 15 bp, Homo sapiens
gctttgtttctggcc

SEQ ID NO: 210817 - DNA, 15 bp, Homo sapiens
tgctttgtttctggc

SEQ ID NO: 210818 - DNA, 15 bp, Homo sapiens
ctgctttgtttctgg

SEQ ID NO: 210819 - DNA, 15 bp, Homo sapiens
tctgctttgtttctg

SEQ ID NO: 210820 - DNA, 15 bp, Homo sapiens
ttctgctttgtttct

SEQ ID NO: 210821 - DNA, 15 bp, Homo sapiens
tttctgctttgtttc

SEQ ID NO: 210822 - DNA, 15 bp, Homo sapiens
ttttctgctttgttt

SEQ ID NO: 210823 - DNA, 15 bp, Homo sapiens
cttttctgctttgtt

SEQ ID NO: 210824 - DNA, 15 bp, Homo sapiens
gcttttctgctttgt

SEQ ID NO: 210825 - DNA, 15 bp, Homo sapiens
tgcttttctgctttg

SEQ ID NO: 210826 - DNA, 15 bp, Homo sapiens
ttgcttttctgcttt

SEQ ID NO: 210827 - DNA, 15 bp, Homo sapiens
tttgcttttctgctt

SEQ ID NO: 210828 - DNA, 15 bp, Homo sapiens
gtttgcttttctgct

SEQ ID NO: 210829 - DNA, 15 bp, Homo sapiens
agtttgcttttctgc

SEQ ID NO: 210830 - DNA, 15 bp, Homo sapiens
tagtttgcttttctg

SEQ ID NO: 210831 - DNA, 15 bp, Homo sapiens
ctagtttgcttttct

SEQ ID NO: 210832 - DNA, 15 bp, Homo sapiens
gctagtttgcttttc

SEQ ID NO: 210833 - DNA, 15 bp, Homo sapiens
agctagtttgctttt

SEQ ID NO: 210834 - DNA, 15 bp, Homo sapiens
tagctagtttgcttt

SEQ ID NO: 210835 - DNA, 15 bp, Homo sapiens
ctagctagtttgctt

SEQ ID NO: 210836 - DNA, 15 bp, Homo sapiens
actagctagtttgct

SEQ ID NO: 210837 - DNA, 15 bp, Homo sapiens
cactagctagtttgc

SEQ ID NO: 210838 - DNA, 15 bp, Homo sapiens
tcactagctagtttg

SEQ ID NO: 210839 - DNA, 15 bp, Homo sapiens
atcactagctagttt

SEQ ID NO: 210840 - DNA, 15 bp, Homo sapiens
catcactagctagtt

SEQ ID NO: 210841 - DNA, 15 bp, Homo sapiens
acatcactagctagt

SEQ ID NO: 210842 - DNA, 15 bp, Homo sapiens
aacatcactagctag

SEQ ID NO: 210843 - DNA, 15 bp, Homo sapiens
caacatcactagcta

SEQ ID NO: 210844 - DNA, 15 bp, Homo sapiens
tcaacatcactagct

SEQ ID NO: 210845 - DNA, 15 bp, Homo sapiens
atcaacatcactagc

SEQ ID NO: 210846 - DNA, 15 bp, Homo sapiens
catcaacatcactag

SEQ ID NO: 210847 - DNA, 15 bp, Homo sapiens
gcatcaacatcacta

SEQ ID NO: 210848 - DNA, 15 bp, Homo sapiens
agcatcaacatcact

SEQ ID NO: 210849 - DNA, 15 bp, Homo sapiens
cagcatcaacatcac

SEQ ID NO: 210850 - DNA, 15 bp, Homo sapiens
gcagcatcaacatca

SEQ ID NO: 210851 - DNA, 15 bp, Homo sapiens
agcagcatcaacatc

SEQ ID NO: 210852 - DNA, 15 bp, Homo sapiens
cagcagcatcaacat

SEQ ID NO: 210853 - DNA, 15 bp, Homo sapiens
ccagcagcatcaaca

SEQ ID NO: 210854 - DNA, 15 bp, Homo sapiens
tccagcagcatcaac

SEQ ID NO: 210855 - DNA, 15 bp, Homo sapiens
ttccagcagcatcaa

SEQ ID NO: 210856 - DNA, 15 bp, Homo sapiens
tttccagcagcatca

SEQ ID NO: 210857 - DNA, 15 bp, Homo sapiens
ttttccagcagcatc

SEQ ID NO: 210858 - DNA, 15 bp, Homo sapiens
tttttccagcagcat

SEQ ID NO: 210859 - DNA, 15 bp, Homo sapiens
atttttccagcagca

SEQ ID NO: 210860 - DNA, 15 bp, Homo sapiens
catttttccagcagc

SEQ ID NO: 210861 - DNA, 15 bp, Homo sapiens
acatttttccagcag

SEQ ID NO: 210862 - DNA, 15 bp, Homo sapiens
tacatttttccagca

SEQ ID NO: 210863 - DNA, 15 bp, Homo sapiens
ctacatttttccagc

SEQ ID NO: 210864 - DNA, 15 bp, Homo sapiens
gctacatttttccag

SEQ ID NO: 210865 - DNA, 15 bp, Homo sapiens
tgctacatttttcca

SEQ ID NO: 210866 - DNA, 15 bp, Homo sapiens
ctgctacatttttcc

SEQ ID NO: 210867 - DNA, 15 bp, Homo sapiens
tctgctacatttttc

SEQ ID NO: 210868 - DNA, 15 bp, Homo sapiens
gtctgctacattttt

SEQ ID NO: 210869 - DNA, 15 bp, Homo sapiens
ggtctgctacatttt

SEQ ID NO: 210870 - DNA, 15 bp, Homo sapiens
gggtctgctacattt

SEQ ID NO: 210871 - DNA, 15 bp, Homo sapiens
agggtctgctacatt

SEQ ID NO: 210872 - DNA, 15 bp, Homo sapiens
tagggtctgctacat

SEQ ID NO: 210873 - DNA, 15 bp, Homo sapiens
ctagggtctgctaca

SEQ ID NO: 210874 - DNA, 15 bp, Homo sapiens
actagggtctgctac

SEQ ID NO: 210875 - DNA, 15 bp, Homo sapiens
cactagggtctgcta

SEQ ID NO: 210876 - DNA, 15 bp, Homo sapiens
tcactagggtctgct

SEQ ID NO: 210877 - DNA, 15 bp, Homo sapiens
atcactagggtctgc

SEQ ID NO: 210878 - DNA, 15 bp, Homo sapiens
catcactagggtctg

SEQ ID NO: 210879 - DNA, 15 bp, Homo sapiens
tcatcactagggtct

SEQ ID NO: 210880 - DNA, 15 bp, Homo sapiens
ctcatcactagggtc

SEQ ID NO: 210881 - DNA, 15 bp, Homo sapiens
gctcatcactagggt

SEQ ID NO: 210882 - DNA, 15 bp, Homo sapiens
tgctcatcactaggg

SEQ ID NO: 210883 - DNA, 15 bp, Homo sapiens
ctgctcatcactagg

SEQ ID NO: 210884 - DNA, 15 bp, Homo sapiens
cctgctcatcactag

SEQ ID NO: 210885 - DNA, 15 bp, Homo sapiens
gcctgctcatcacta

SEQ ID NO: 210886 - DNA, 15 bp, Homo sapiens
tgcctgctcatcact

SEQ ID NO: 210887 - DNA, 15 bp, Homo sapiens
ctgcctgctcatcac

SEQ ID NO: 210888 - DNA, 15 bp, Homo sapiens
cctgcctgctcatca

SEQ ID NO: 210889 - DNA, 15 bp, Homo sapiens
tcctgcctgctcatc

SEQ ID NO: 210890 - DNA, 15 bp, Homo sapiens
ttcctgcctgctcat

SEQ ID NO: 210891 - DNA, 15 bp, Homo sapiens
cttcctgcctgctca

SEQ ID NO: 210892 - DNA, 15 bp, Homo sapiens
gcttcctgcctgctc

SEQ ID NO: 210893 - DNA, 15 bp, Homo sapiens
ggcttcctgcctgct

SEQ ID NO: 210894 - DNA, 15 bp, Homo sapiens
gggcttcctgcctgc

SEQ ID NO: 210895 - DNA, 15 bp, Homo sapiens
ggggcttcctgcctg

SEQ ID NO: 210896 - DNA, 15 bp, Homo sapiens
tggggcttcctgcct

SEQ ID NO: 210897 - DNA, 15 bp, Homo sapiens
atggggcttcctgcc

SEQ ID NO: 210898 - DNA, 15 bp, Homo sapiens
tatggggcttcctgc

SEQ ID NO: 210899 - DNA, 15 bp, Homo sapiens
ctatggggcttcctg

SEQ ID NO: 210900 - DNA, 15 bp, Homo sapiens
gctatggggcttcct

SEQ ID NO: 210901 - DNA, 15 bp, Homo sapiens
tgctatggggcttcc

SEQ ID NO: 210902 - DNA, 15 bp, Homo sapiens
ttgctatggggcttc

SEQ ID NO: 210903 - DNA, 15 bp, Homo sapiens
tttgctatggggctt

SEQ ID NO: 210904 - DNA, 15 bp, Homo sapiens
ctttgctatggggct

SEQ ID NO: 210905 - DNA, 15 bp, Homo sapiens
tctttgctatggggc

SEQ ID NO: 210906 - DNA, 15 bp, Homo sapiens
gtctttgctatgggg

SEQ ID NO: 210907 - DNA, 15 bp, Homo sapiens
agtctttgctatggg

SEQ ID NO: 210908 - DNA, 15 bp, Homo sapiens
gagtctttgctatgg

SEQ ID NO: 210909 - DNA, 15 bp, Homo sapiens
tgagtctttgctatg

SEQ ID NO: 210910 - DNA, 15 bp, Homo sapiens
ctgagtctttgctat

SEQ ID NO: 210911 - DNA, 15 bp, Homo sapiens
gctgagtctttgcta

SEQ ID NO: 210912 - DNA, 15 bp, Homo sapiens
agctgagtctttgct

SEQ ID NO: 210913 - DNA, 15 bp, Homo sapiens
gagctgagtctttgc

SEQ ID NO: 210914 - DNA, 15 bp, Homo sapiens
tgagctgagtctttg

SEQ ID NO: 210915 - DNA, 15 bp, Homo sapiens
ttgagctgagtcttt

SEQ ID NO: 210916 - DNA, 15 bp, Homo sapiens
tttgagctgagtctt

SEQ ID NO: 210917 - DNA, 15 bp, Homo sapiens
ttttgagctgagtct

SEQ ID NO: 210918 - DNA, 15 bp, Homo sapiens
gttttgagctgagtc

SEQ ID NO: 210919 - DNA, 15 bp, Homo sapiens
ggttttgagctgagt

SEQ ID NO: 210920 - DNA, 15 bp, Homo sapiens
gggttttgagctgag

SEQ ID NO: 210921 - DNA, 15 bp, Homo sapiens
agggttttgagctga

SEQ ID NO: 210922 - DNA, 15 bp, Homo sapiens
aagggttttgagctg

SEQ ID NO: 210923 - DNA, 15 bp, Homo sapiens
gaagggttttgagct

SEQ ID NO: 210924 - DNA, 15 bp, Homo sapiens
agaagggttttgagc

SEQ ID NO: 210925 - DNA, 15 bp, Homo sapiens
gagaagggttttgag

SEQ ID NO: 210926 - DNA, 15 bp, Homo sapiens
agagaagggttttga

SEQ ID NO: 210927 - DNA, 15 bp, Homo sapiens
aagagaagggttttg

SEQ ID NO: 210928 - DNA, 15 bp, Homo sapiens
taagagaagggtttt

SEQ ID NO: 210929 - DNA, 15 bp, Homo sapiens
gtaagagaagggttt

SEQ ID NO: 210930 - DNA, 15 bp, Homo sapiens
tgtaagagaagggtt

SEQ ID NO: 210931 - DNA, 15 bp, Homo sapiens
gtgtaagagaagggt

SEQ ID NO: 210932 - DNA, 15 bp, Homo sapiens
tgtgtaagagaaggg

SEQ ID NO: 210933 - DNA, 15 bp, Homo sapiens
gtgtgtaagagaagg

SEQ ID NO: 210934 - DNA, 15 bp, Homo sapiens
tgtgtgtaagagaag

SEQ ID NO: 210935 - DNA, 15 bp, Homo sapiens
ctgtgtgtaagagaa

SEQ ID NO: 210936 - DNA, 15 bp, Homo sapiens
tctgtgtgtaagaga

SEQ ID NO: 210937 - DNA, 15 bp, Homo sapiens
ttctgtgtgtaagag

SEQ ID NO: 210938 - DNA, 15 bp, Homo sapiens
tttctgtgtgtaaga

SEQ ID NO: 210939 - DNA, 15 bp, Homo sapiens
atttctgtgtgtaag

SEQ ID NO: 210940 - DNA, 15 bp, Homo sapiens
catttctgtgtgtaa

SEQ ID NO: 210941 - DNA, 15 bp, Homo sapiens
tcatttctgtgtgta

SEQ ID NO: 210942 - DNA, 15 bp, Homo sapiens
ctcatttctgtgtgt

SEQ ID NO: 210943 - DNA, 15 bp, Homo sapiens
actcatttctgtgtg

SEQ ID NO: 210944 - DNA, 15 bp, Homo sapiens
cactcatttctgtgt

SEQ ID NO: 210945 - DNA, 15 bp, Homo sapiens
tcactcatttctgtg

SEQ ID NO: 210946 - DNA, 15 bp, Homo sapiens
atcactcatttctgt

SEQ ID NO: 210947 - DNA, 15 bp, Homo sapiens
aatcactcatttctg

SEQ ID NO: 210948 - DNA, 15 bp, Homo sapiens
gaatcactcatttct

SEQ ID NO: 210949 - DNA, 15 bp, Homo sapiens
tgaatcactcatttc

SEQ ID NO: 210950 - DNA, 15 bp, Homo sapiens
gtgaatcactcattt

SEQ ID NO: 210951 - DNA, 15 bp, Homo sapiens
tgtgaatcactcatt

SEQ ID NO: 210952 - DNA, 15 bp, Homo sapiens
ctgtgaatcactcat

SEQ ID NO: 210953 - DNA, 15 bp, Homo sapiens
tctgtgaatcactca

SEQ ID NO: 210954 - DNA, 15 bp, Homo sapiens
atctgtgaatcactc

SEQ ID NO: 210955 - DNA, 15 bp, Homo sapiens
aatctgtgaatcact

SEQ ID NO: 210956 - DNA, 15 bp, Homo sapiens
caatctgtgaatcac

SEQ ID NO: 210957 - DNA, 15 bp, Homo sapiens
ccaatctgtgaatca

SEQ ID NO: 210958 - DNA, 15 bp, Homo sapiens
gccaatctgtgaatc

SEQ ID NO: 210959 - DNA, 15 bp, Homo sapiens
tgccaatctgtgaat

SEQ ID NO: 210960 - DNA, 15 bp, Homo sapiens
atgccaatctgtgaa

SEQ ID NO: 210961 - DNA, 15 bp, Homo sapiens
gatgccaatctgtga

SEQ ID NO: 210962 - DNA, 15 bp, Homo sapiens
ggatgccaatctgtg

SEQ ID NO: 210963 - DNA, 15 bp, Homo sapiens
aggatgccaatctgt

SEQ ID NO: 210964 - DNA, 15 bp, Homo sapiens
aaggatgccaatctg

SEQ ID NO: 210965 - DNA, 15 bp, Homo sapiens
aaaggatgccaatct

SEQ ID NO: 210966 - DNA, 15 bp, Homo sapiens
gaaaggatgccaatc

SEQ ID NO: 210967 - DNA, 15 bp, Homo sapiens
ggaaaggatgccaat

SEQ ID NO: 210968 - DNA, 15 bp, Homo sapiens
aggaaaggatgccaa

SEQ ID NO: 210969 - DNA, 15 bp, Homo sapiens
aaggaaaggatgcca

SEQ ID NO: 210970 - DNA, 15 bp, Homo sapiens
gaaggaaaggatgcc

SEQ ID NO: 210971 - DNA, 15 bp, Homo sapiens
ggaaggaaaggatgc

SEQ ID NO: 210972 - DNA, 15 bp, Homo sapiens
cggaaggaaaggatg

SEQ ID NO: 210973 - DNA, 15 bp, Homo sapiens
acggaaggaaaggat

SEQ ID NO: 210974 - DNA, 15 bp, Homo sapiens
tacggaaggaaagga

SEQ ID NO: 210975 - DNA, 15 bp, Homo sapiens
ctacggaaggaaagg

SEQ ID NO: 210976 - DNA, 15 bp, Homo sapiens
actacggaaggaaag

SEQ ID NO: 210977 - DNA, 15 bp, Homo sapiens
cactacggaaggaaa

SEQ ID NO: 210978 - DNA, 15 bp, Homo sapiens
acactacggaaggaa

SEQ ID NO: 210979 - DNA, 15 bp, Homo sapiens
tacactacggaagga

SEQ ID NO: 210980 - DNA, 15 bp, Homo sapiens
ttacactacggaagg

SEQ ID NO: 210981 - DNA, 15 bp, Homo sapiens
tttacactacggaag

SEQ ID NO: 210982 - DNA, 15 bp, Homo sapiens
atttacactacggaa

SEQ ID NO: 210983 - DNA, 15 bp, Homo sapiens
catttacactacgga

SEQ ID NO: 210984 - DNA, 15 bp, Homo sapiens
gcatttacactacgg

SEQ ID NO: 210985 - DNA, 15 bp, Homo sapiens
ggcatttacactacg

SEQ ID NO: 210986 - DNA, 15 bp, Homo sapiens
gggcatttacactac

SEQ ID NO: 210987 - DNA, 15 bp, Homo sapiens
ggggcatttacacta

SEQ ID NO: 210988 - DNA, 15 bp, Homo sapiens
tggggcatttacact

SEQ ID NO: 210989 - DNA, 15 bp, Homo sapiens
ctggggcatttacac

SEQ ID NO: 210990 - DNA, 15 bp, Homo sapiens
cctggggcatttaca

SEQ ID NO: 210991 - DNA, 15 bp, Homo sapiens
gcctggggcatttac

SEQ ID NO: 210992 - DNA, 15 bp, Homo sapiens
tgcctggggcattta

SEQ ID NO: 210993 - DNA, 15 bp, Homo sapiens
gtgcctggggcattt

SEQ ID NO: 210994 - DNA, 15 bp, Homo sapiens
agtgcctggggcatt

SEQ ID NO: 210995 - DNA, 15 bp, Homo sapiens
cagtgcctggggcat

SEQ ID NO: 210996 - DNA, 15 bp, Homo sapiens
gcagtgcctggggca

SEQ ID NO: 210997 - DNA, 15 bp, Homo sapiens
agcagtgcctggggc

SEQ ID NO: 210998 - DNA, 15 bp, Homo sapiens
tagcagtgcctgggg

SEQ ID NO: 210999 - DNA, 15 bp, Homo sapiens
atagcagtgcctggg

SEQ ID NO: 211000 - DNA, 15 bp, Homo sapiens
aatagcagtgcctgg

SEQ ID NO: 211001 - DNA, 15 bp, Homo sapiens
taatagcagtgcctg

SEQ ID NO: 211002 - DNA, 15 bp, Homo sapiens
ataatagcagtgcct

SEQ ID NO: 211003 - DNA, 15 bp, Homo sapiens
cataatagcagtgcc

SEQ ID NO: 211004 - DNA, 15 bp, Homo sapiens
tcataatagcagtgc

SEQ ID NO: 211005 - DNA, 15 bp, Homo sapiens
ttcataatagcagtg

SEQ ID NO: 211006 - DNA, 15 bp, Homo sapiens
tttcataatagcagt

SEQ ID NO: 211007 - DNA, 15 bp, Homo sapiens
gtttcataatagcag

SEQ ID NO: 211008 - DNA, 15 bp, Homo sapiens
agtttcataatagca

SEQ ID NO: 211009 - DNA, 15 bp, Homo sapiens
aagtttcataatagc

SEQ ID NO: 211010 - DNA, 15 bp, Homo sapiens
gaagtttcataatag

SEQ ID NO: 211011 - DNA, 15 bp, Homo sapiens
tgaagtttcataata

SEQ ID NO: 211012 - DNA, 15 bp, Homo sapiens
ctgaagtttcataat

SEQ ID NO: 211013 - DNA, 15 bp, Homo sapiens
actgaagtttcataa

SEQ ID NO: 211014 - DNA, 15 bp, Homo sapiens
cactgaagtttcata

SEQ ID NO: 211015 - DNA, 15 bp, Homo sapiens
acactgaagtttcat

SEQ ID NO: 211016 - DNA, 15 bp, Homo sapiens
tacactgaagtttca

SEQ ID NO: 211017 - DNA, 15 bp, Homo sapiens
atacactgaagtttc

SEQ ID NO: 211018 - DNA, 15 bp, Homo sapiens
aatacactgaagttt

SEQ ID NO: 211019 - DNA, 15 bp, Homo sapiens
caatacactgaagtt

SEQ ID NO: 211020 - DNA, 15 bp, Homo sapiens
acaatacactgaagt

SEQ ID NO: 211021 - DNA, 15 bp, Homo sapiens
aacaatacactgaag

SEQ ID NO: 211022 - DNA, 15 bp, Homo sapiens
caacaatacactgaa

SEQ ID NO: 211023 - DNA, 15 bp, Homo sapiens
tcaacaatacactga

SEQ ID NO: 211024 - DNA, 15 bp, Homo sapiens
atcaacaatacactg

SEQ ID NO: 211025 - DNA, 15 bp, Homo sapiens
gatcaacaatacact

SEQ ID NO: 211026 - DNA, 15 bp, Homo sapiens
ggatcaacaatacac

SEQ ID NO: 211027 - DNA, 15 bp, Homo sapiens
aggatcaacaataca

SEQ ID NO: 211028 - DNA, 15 bp, Homo sapiens
aaggatcaacaatac

SEQ ID NO: 211029 - DNA, 15 bp, Homo sapiens
taaggatcaacaata

SEQ ID NO: 211030 - DNA, 15 bp, Homo sapiens
ttaaggatcaacaat

SEQ ID NO: 211031 - DNA, 15 bp, Homo sapiens
attaaggatcaacaa

SEQ ID NO: 211032 - DNA, 15 bp, Homo sapiens
aattaaggatcaaca

SEQ ID NO: 211033 - DNA, 15 bp, Homo sapiens
taattaaggatcaac

SEQ ID NO: 211034 - DNA, 15 bp, Homo sapiens
ttaattaaggatcaa

SEQ ID NO: 211035 - DNA, 15 bp, Homo sapiens
tttaattaaggatca

SEQ ID NO: 211036 - DNA, 15 bp, Homo sapiens
atttaattaaggatc

SEQ ID NO: 211037 - DNA, 15 bp, Homo sapiens
catttaattaaggat

SEQ ID NO: 211038 - DNA, 15 bp, Homo sapiens
acatttaattaagga

SEQ ID NO: 211039 - DNA, 15 bp, Homo sapiens
cacatttaattaagg

SEQ ID NO: 211040 - DNA, 15 bp, Homo sapiens
gcacatttaattaag

SEQ ID NO: 211041 - DNA, 15 bp, Homo sapiens
cgcacatttaattaa

SEQ ID NO: 211042 - DNA, 15 bp, Homo sapiens
acgcacatttaatta

SEQ ID NO: 211043 - DNA, 15 bp, Homo sapiens
tacgcacatttaatt

SEQ ID NO: 211044 - DNA, 15 bp, Homo sapiens
gtacgcacatttaat

SEQ ID NO: 211045 - DNA, 15 bp, Homo sapiens
agtacgcacatttaa

SEQ ID NO: 211046 - DNA, 15 bp, Homo sapiens
aagtacgcacattta

SEQ ID NO: 211047 - DNA, 15 bp, Homo sapiens
aaagtacgcacattt

SEQ ID NO: 211048 - DNA, 15 bp, Homo sapiens
gaaagtacgcacatt

SEQ ID NO: 211049 - DNA, 15 bp, Homo sapiens
agaaagtacgcacat

SEQ ID NO: 211050 - DNA, 15 bp, Homo sapiens
aagaaagtacgcaca

SEQ ID NO: 211051 - DNA, 15 bp, Homo sapiens
caagaaagtacgcac

SEQ ID NO: 211052 - DNA, 15 bp, Homo sapiens
ccaagaaagtacgca

SEQ ID NO: 211053 - DNA, 15 bp, Homo sapiens
cccaagaaagtacgc

SEQ ID NO: 211054 - DNA, 15 bp, Homo sapiens
acccaagaaagtacg

SEQ ID NO: 211055 - DNA, 15 bp, Homo sapiens
cacccaagaaagtac

SEQ ID NO: 211056 - DNA, 15 bp, Homo sapiens
acacccaagaaagta

SEQ ID NO: 211057 - DNA, 15 bp, Homo sapiens
aacacccaagaaagt

SEQ ID NO: 211058 - DNA, 15 bp, Homo sapiens
aaacacccaagaaag

SEQ ID NO: 211059 - DNA, 15 bp, Homo sapiens
aaaacacccaagaaa

SEQ ID NO: 211060 - DNA, 15 bp, Homo sapiens
taaaacacccaagaa

SEQ ID NO: 211061 - DNA, 15 bp, Homo sapiens
ttaaaacacccaaga

SEQ ID NO: 211062 - DNA, 15 bp, Homo sapiens
attaaaacacccaag

SEQ ID NO: 211063 - DNA, 15 bp, Homo sapiens
gattaaaacacccaa

SEQ ID NO: 211064 - DNA, 15 bp, Homo sapiens
tgattaaaacaccca

SEQ ID NO: 211065 - DNA, 15 bp, Homo sapiens
ctgattaaaacaccc

SEQ ID NO: 211066 - DNA, 15 bp, Homo sapiens
actgattaaaacacc

SEQ ID NO: 211067 - DNA, 15 bp, Homo sapiens
cactgattaaaacac

SEQ ID NO: 211068 - DNA, 15 bp, Homo sapiens
acactgattaaaaca

SEQ ID NO: 211069 - DNA, 15 bp, Homo sapiens
gacactgattaaaac

SEQ ID NO: 211070 - DNA, 15 bp, Homo sapiens
agacactgattaaaa

SEQ ID NO: 211071 - DNA, 15 bp, Homo sapiens
gagacactgattaaa

SEQ ID NO: 211072 - DNA, 15 bp, Homo sapiens
tgagacactgattaa

SEQ ID NO: 211073 - DNA, 15 bp, Homo sapiens
ctgagacactgatta

SEQ ID NO: 211074 - DNA, 15 bp, Homo sapiens
tctgagacactgatt

SEQ ID NO: 211075 - DNA, 15 bp, Homo sapiens
ttctgagacactgat

SEQ ID NO: 211076 - DNA, 15 bp, Homo sapiens
gttctgagacactga

SEQ ID NO: 211077 - DNA, 15 bp, Homo sapiens
tgttctgagacactg

SEQ ID NO: 211078 - DNA, 15 bp, Homo sapiens
atgttctgagacact

SEQ ID NO: 211079 - DNA, 15 bp, Homo sapiens
aatgttctgagacac

SEQ ID NO: 211080 - DNA, 15 bp, Homo sapiens
caatgttctgagaca

SEQ ID NO: 211081 - DNA, 15 bp, Homo sapiens
tcaatgttctgagac

SEQ ID NO: 211082 - DNA, 15 bp, Homo sapiens
atcaatgttctgaga

SEQ ID NO: 211083 - DNA, 15 bp, Homo sapiens
tatcaatgttctgag

SEQ ID NO: 211084 - DNA, 15 bp, Homo sapiens
atatcaatgttctga

SEQ ID NO: 211085 - DNA, 15 bp, Homo sapiens
tatatcaatgttctg

SEQ ID NO: 211086 - DNA, 15 bp, Homo sapiens
atatatcaatgttct

SEQ ID NO: 211087 - DNA, 15 bp, Homo sapiens
aatatatcaatgttc

SEQ ID NO: 211088 - DNA, 15 bp, Homo sapiens
aaatatatcaatgtt

SEQ ID NO: 211089 - DNA, 15 bp, Homo sapiens
aaaatatatcaatgt

SEQ ID NO: 211090 - DNA, 15 bp, Homo sapiens
gaaaatatatcaatg

SEQ ID NO: 211091 - DNA, 15 bp, Homo sapiens
tgaaaatatatcaat

SEQ ID NO: 211092 - DNA, 15 bp, Homo sapiens
ctgaaaatatatcaa

SEQ ID NO: 211093 - DNA, 15 bp, Homo sapiens
gctgaaaatatatca

SEQ ID NO: 211094 - DNA, 15 bp, Homo sapiens
tgctgaaaatatatc

SEQ ID NO: 211095 - DNA, 15 bp, Homo sapiens
ttgctgaaaatatat

SEQ ID NO: 211096 - DNA, 15 bp, Homo sapiens
gttgctgaaaatata

SEQ ID NO: 211097 - DNA, 15 bp, Homo sapiens
tgttgctgaaaatat

SEQ ID NO: 211098 - DNA, 15 bp, Homo sapiens
atgttgctgaaaata

SEQ ID NO: 211099 - DNA, 15 bp, Homo sapiens
gatgttgctgaaaat

SEQ ID NO: 211100 - DNA, 15 bp, Homo sapiens
tgatgttgctgaaaa

SEQ ID NO: 211101 - DNA, 15 bp, Homo sapiens
ttgatgttgctgaaa

SEQ ID NO: 211102 - DNA, 15 bp, Homo sapiens
attgatgttgctgaa

SEQ ID NO: 211103 - DNA, 15 bp, Homo sapiens
tattgatgttgctga

SEQ ID NO: 211104 - DNA, 15 bp, Homo sapiens
ttattgatgttgctg

SEQ ID NO: 211105 - DNA, 15 bp, Homo sapiens
attattgatgttgct

SEQ ID NO: 211106 - DNA, 15 bp, Homo sapiens
tattattgatgttgc

SEQ ID NO: 211107 - DNA, 15 bp, Homo sapiens
ttattattgatgttg

SEQ ID NO: 211108 - DNA, 15 bp, Homo sapiens
tttattattgatgtt

SEQ ID NO: 211109 - DNA, 15 bp, Homo sapiens
atttattattgatgt

SEQ ID NO: 211110 - DNA, 15 bp, Homo sapiens
tatttattattgatg

SEQ ID NO: 211111 - DNA, 15 bp, Homo sapiens
gtatttattattgat

SEQ ID NO: 211112 - DNA, 15 bp, Homo sapiens
agtatttattattga

SEQ ID NO: 211113 - DNA, 15 bp, Homo sapiens
aagtatttattattg

SEQ ID NO: 211114 - DNA, 15 bp, Homo sapiens
aaagtatttattatt

SEQ ID NO: 211115 - DNA, 15 bp, Homo sapiens
caaagtatttattat

SEQ ID NO: 211116 - DNA, 15 bp, Homo sapiens
acaaagtatttatta

SEQ ID NO: 211117 - DNA, 15 bp, Homo sapiens
aacaaagtatttatt

SEQ ID NO: 211118 - DNA, 15 bp, Homo sapiens
gaacaaagtatttat

SEQ ID NO: 211119 - DNA, 15 bp, Homo sapiens
tgaacaaagtattta

SEQ ID NO: 211120 - DNA, 15 bp, Homo sapiens
ctgaacaaagtattt

SEQ ID NO: 211121 - DNA, 15 bp, Homo sapiens
actgaacaaagtatt

SEQ ID NO: 211122 - DNA, 15 bp, Homo sapiens
cactgaacaaagtat

SEQ ID NO: 211123 - DNA, 15 bp, Homo sapiens
gcactgaacaaagta

SEQ ID NO: 211124 - DNA, 15 bp, Homo sapiens
agcactgaacaaagt

SEQ ID NO: 211125 - DNA, 15 bp, Homo sapiens
aagcactgaacaaag

SEQ ID NO: 211126 - DNA, 15 bp, Homo sapiens
gaagcactgaacaaa

SEQ ID NO: 211127 - DNA, 15 bp, Homo sapiens
tgaagcactgaacaa

SEQ ID NO: 211128 - DNA, 15 bp, Homo sapiens
ttgaagcactgaaca

SEQ ID NO: 211129 - DNA, 15 bp, Homo sapiens
gttgaagcactgaac

SEQ ID NO: 211130 - DNA, 15 bp, Homo sapiens
tgttgaagcactgaa

SEQ ID NO: 211131 - DNA, 15 bp, Homo sapiens
ttgttgaagcactga

SEQ ID NO: 211132 - DNA, 15 bp, Homo sapiens
attgttgaagcactg

SEQ ID NO: 211133 - DNA, 15 bp, Homo sapiens
tattgttgaagcact

SEQ ID NO: 211134 - DNA, 15 bp, Homo sapiens
gtattgttgaagcac

SEQ ID NO: 211135 - DNA, 15 bp, Homo sapiens
tgtattgttgaagca

SEQ ID NO: 211136 - DNA, 15 bp, Homo sapiens
atgtattgttgaagc

SEQ ID NO: 211137 - DNA, 15 bp, Homo sapiens
tatgtattgttgaag

SEQ ID NO: 211138 - DNA, 15 bp, Homo sapiens
ttatgtattgttgaa

SEQ ID NO: 211139 - DNA, 15 bp, Homo sapiens
tttatgtattgttga

SEQ ID NO: 211140 - DNA, 15 bp, Homo sapiens
gtttatgtattgttg

SEQ ID NO: 211141 - DNA, 15 bp, Homo sapiens
tgtttatgtattgtt

SEQ ID NO: 211142 - DNA, 15 bp, Homo sapiens
atgtttatgtattgt

SEQ ID NO: 211143 - DNA, 15 bp, Homo sapiens
aatgtttatgtattg

SEQ ID NO: 211144 - DNA, 15 bp, Homo sapiens
aaatgtttatgtatt

SEQ ID NO: 211145 - DNA, 15 bp, Homo sapiens
caaatgtttatgtat

SEQ ID NO: 211146 - DNA, 15 bp, Homo sapiens
tcaaatgtttatgta

SEQ ID NO: 211147 - DNA, 15 bp, Homo sapiens
ctcaaatgtttatgt

SEQ ID NO: 211148 - DNA, 15 bp, Homo sapiens
tctcaaatgtttatg

SEQ ID NO: 211149 - DNA, 15 bp, Homo sapiens
gtctcaaatgtttat

SEQ ID NO: 211150 - DNA, 15 bp, Homo sapiens
ggtctcaaatgttta

SEQ ID NO: 211151 - DNA, 15 bp, Homo sapiens
aggtctcaaatgttt

SEQ ID NO: 211152 - DNA, 15 bp, Homo sapiens
caggtctcaaatgtt

SEQ ID NO: 211153 - DNA, 15 bp, Homo sapiens
ccaggtctcaaatgt

SEQ ID NO: 211154 - DNA, 15 bp, Homo sapiens
cccaggtctcaaatg

SEQ ID NO: 211155 - DNA, 15 bp, Homo sapiens
ccccaggtctcaaat

SEQ ID NO: 211156 - DNA, 15 bp, Homo sapiens
gccccaggtctcaaa

SEQ ID NO: 211157 - DNA, 15 bp, Homo sapiens
ggccccaggtctcaa

SEQ ID NO: 211158 - DNA, 15 bp, Homo sapiens
aggccccaggtctca

SEQ ID NO: 211159 - DNA, 15 bp, Homo sapiens
taggccccaggtctc

SEQ ID NO: 211160 - DNA, 15 bp, Homo sapiens
ctaggccccaggtct

SEQ ID NO: 211161 - DNA, 15 bp, Homo sapiens
gctaggccccaggtc

SEQ ID NO: 211162 - DNA, 15 bp, Homo sapiens
tgctaggccccaggt

SEQ ID NO: 211163 - DNA, 15 bp, Homo sapiens
gtgctaggccccagg

SEQ ID NO: 211164 - DNA, 15 bp, Homo sapiens
tgtgctaggccccag

SEQ ID NO: 211165 - DNA, 15 bp, Homo sapiens
atgtgctaggcccca

SEQ ID NO: 211166 - DNA, 15 bp, Homo sapiens
tatgtgctaggcccc

SEQ ID NO: 211167 - DNA, 15 bp, Homo sapiens
ctatgtgctaggccc

SEQ ID NO: 211168 - DNA, 15 bp, Homo sapiens
actatgtgctaggcc

SEQ ID NO: 211169 - DNA, 15 bp, Homo sapiens
ttactatgtgctagg

SEQ ID NO: 211170 - DNA, 15 bp, Homo sapiens
tttactatgtgctag

SEQ ID NO: 211171 - DNA, 15 bp, Homo sapiens
gtttactatgtgcta

SEQ ID NO: 211172 - DNA, 15 bp, Homo sapiens
tgtttactatgtgct

SEQ ID NO: 211173 - DNA, 15 bp, Homo sapiens
gtgtttactatgtgc

SEQ ID NO: 211174 - DNA, 15 bp, Homo sapiens
gagtgtttactatgt

SEQ ID NO: 211175 - DNA, 15 bp, Homo sapiens
tgagtgtttactatg

SEQ ID NO: 211176 - DNA, 15 bp, Homo sapiens
ctgagtgtttactat

SEQ ID NO: 211177 - DNA, 15 bp, Homo sapiens
actgagtgtttacta

SEQ ID NO: 211178 - DNA, 15 bp, Homo sapiens
tactgagtgtttact

SEQ ID NO: 211179 - DNA, 15 bp, Homo sapiens
ttactgagtgtttac

SEQ ID NO: 211180 - DNA, 15 bp, Homo sapiens
tttactgagtgttta

SEQ ID NO: 211181 - DNA, 15 bp, Homo sapiens
ttttactgagtgttt

SEQ ID NO: 211182 - DNA, 15 bp, Homo sapiens
cttttactgagtgtt

SEQ ID NO: 211183 - DNA, 15 bp, Homo sapiens
ccttttactgagtgt

SEQ ID NO: 211184 - DNA, 15 bp, Homo sapiens
accttttactgagtg

SEQ ID NO: 211185 - DNA, 15 bp, Homo sapiens
caccttttactgagt

SEQ ID NO: 211186 - DNA, 15 bp, Homo sapiens
ccaccttttactgag

SEQ ID NO: 211187 - DNA, 15 bp, Homo sapiens
gccaccttttactga

SEQ ID NO: 211188 - DNA, 15 bp, Homo sapiens
agccaccttttactg

SEQ ID NO: 211189 - DNA, 15 bp, Homo sapiens
cagccaccttttact

SEQ ID NO: 211190 - DNA, 15 bp, Homo sapiens
tcagccaccttttac

SEQ ID NO: 211191 - DNA, 15 bp, Homo sapiens
atcagccacctttta

SEQ ID NO: 211192 - DNA, 15 bp, Homo sapiens
tatcagccacctttt

SEQ ID NO: 211193 - DNA, 15 bp, Homo sapiens
atatcagccaccttt

SEQ ID NO: 211194 - DNA, 15 bp, Homo sapiens
gatatcagccacctt

SEQ ID NO: 211195 - DNA, 15 bp, Homo sapiens
agatatcagccacct

SEQ ID NO: 211196 - DNA, 15 bp, Homo sapiens
aagatatcagccacc

SEQ ID NO: 211197 - DNA, 15 bp, Homo sapiens
aaagatatcagccac

SEQ ID NO: 211198 - DNA, 15 bp, Homo sapiens
aaaagatatcagcca

SEQ ID NO: 211199 - DNA, 15 bp, Homo sapiens
gaaaagatatcagcc

SEQ ID NO: 211200 - DNA, 15 bp, Homo sapiens
ggaaaagatatcagc

SEQ ID NO: 211201 - DNA, 15 bp, Homo sapiens
gggaaaagatatcag

SEQ ID NO: 211202 - DNA, 15 bp, Homo sapiens
tgggaaaagatatca

SEQ ID NO: 211203 - DNA, 15 bp, Homo sapiens
atgggaaaagatatc

SEQ ID NO: 211204 - DNA, 15 bp, Homo sapiens
tatgggaaaagatat

SEQ ID NO: 211205 - DNA, 15 bp, Homo sapiens
ttatgggaaaagata

SEQ ID NO: 211206 - DNA, 15 bp, Homo sapiens
attatgggaaaagat

SEQ ID NO: 211207 - DNA, 15 bp, Homo sapiens
aattatgggaaaaga

SEQ ID NO: 211208 - DNA, 15 bp, Homo sapiens
caattatgggaaaag

SEQ ID NO: 211209 - DNA, 15 bp, Homo sapiens
acaattatgggaaaa

SEQ ID NO: 211210 - DNA, 15 bp, Homo sapiens
aacaattatgggaaa

SEQ ID NO: 211211 - DNA, 15 bp, Homo sapiens
caacaattatgggaa

SEQ ID NO: 211212 - DNA, 15 bp, Homo sapiens
ccaacaattatggga

SEQ ID NO: 211213 - DNA, 15 bp, Homo sapiens
cccaacaattatggg

SEQ ID NO: 211214 - DNA, 15 bp, Homo sapiens
tcccaacaattatgg

SEQ ID NO: 211215 - DNA, 15 bp, Homo sapiens
ctcccaacaattatg

SEQ ID NO: 211216 - DNA, 15 bp, Homo sapiens
actcccaacaattat

SEQ ID NO: 211217 - DNA, 15 bp, Homo sapiens
gactcccaacaatta

SEQ ID NO: 211218 - DNA, 15 bp, Homo sapiens
agactcccaacaatt

SEQ ID NO: 211219 - DNA, 15 bp, Homo sapiens
aagactcccaacaat

SEQ ID NO: 211220 - DNA, 15 bp, Homo sapiens
aaagactcccaacaa

SEQ ID NO: 211221 - DNA, 15 bp, Homo sapiens
aaaagactcccaaca

SEQ ID NO: 211222 - DNA, 15 bp, Homo sapiens
gaaaagactcccaac

SEQ ID NO: 211223 - DNA, 15 bp, Homo sapiens
agaaaagactcccaa

SEQ ID NO: 211224 - DNA, 15 bp, Homo sapiens
cagaaaagactccca

SEQ ID NO: 211225 - DNA, 15 bp, Homo sapiens
tcagaaaagactccc

SEQ ID NO: 211226 - DNA, 15 bp, Homo sapiens
atcagaaaagactcc

SEQ ID NO: 211227 - DNA, 15 bp, Homo sapiens
tatcagaaaagactc

SEQ ID NO: 211228 - DNA, 15 bp, Homo sapiens
ctatcagaaaagact

SEQ ID NO: 211229 - DNA, 15 bp, Homo sapiens
actatcagaaaagac

SEQ ID NO: 211230 - DNA, 15 bp, Homo sapiens
aactatcagaaaaga

SEQ ID NO: 211231 - DNA, 15 bp, Homo sapiens
aaactatcagaaaag

SEQ ID NO: 211232 - DNA, 15 bp, Homo sapiens
aaaactatcagaaaa

SEQ ID NO: 211233 - DNA, 15 bp, Homo sapiens
caaaactatcagaaa

SEQ ID NO: 211234 - DNA, 15 bp, Homo sapiens
tcaaaactatcagaa

SEQ ID NO: 211235 - DNA, 15 bp, Homo sapiens
atcaaaactatcaga

SEQ ID NO: 211236 - DNA, 15 bp, Homo sapiens
gatcaaaactatcag

SEQ ID NO: 211237 - DNA, 15 bp, Homo sapiens
tgatcaaaactatca

SEQ ID NO: 211238 - DNA, 15 bp, Homo sapiens
atgatcaaaactatc

SEQ ID NO: 211239 - DNA, 15 bp, Homo sapiens
aatgatcaaaactat

SEQ ID NO: 211240 - DNA, 15 bp, Homo sapiens
aaatgatcaaaacta

SEQ ID NO: 211241 - DNA, 15 bp, Homo sapiens
aaaatgatcaaaact

SEQ ID NO: 211242 - DNA, 15 bp, Homo sapiens
aaaaatgatcaaaac

SEQ ID NO: 211243 - DNA, 15 bp, Homo sapiens
taaaaatgatcaaaa

SEQ ID NO: 211244 - DNA, 15 bp, Homo sapiens
ataaaaatgatcaaa

SEQ ID NO: 211245 - DNA, 15 bp, Homo sapiens
aataaaaatgatcaa

SEQ ID NO: 211246 - DNA, 15 bp, Homo sapiens
aaataaaaatgatca

SEQ ID NO: 211247 - DNA, 15 bp, Homo sapiens
aaaataaaaatgatc

SEQ ID NO: 211248 - DNA, 15 bp, Homo sapiens
caaaataaaaatgat

SEQ ID NO: 211249 - DNA, 15 bp, Homo sapiens
acaaaataaaaatga

SEQ ID NO: 211250 - DNA, 15 bp, Homo sapiens
aacaaaataaaaatg

SEQ ID NO: 211251 - DNA, 15 bp, Homo sapiens
aaacaaaataaaaat

SEQ ID NO: 211252 - DNA, 15 bp, Homo sapiens
taaacaaaataaaaa

SEQ ID NO: 211253 - DNA, 15 bp, Homo sapiens
ttaaacaaaataaaa

SEQ ID NO: 211254 - DNA, 15 bp, Homo sapiens
tttaaacaaaataaa

SEQ ID NO: 211255 - DNA, 15 bp, Homo sapiens
ttttaaacaaaataa

SEQ ID NO: 211256 - DNA, 15 bp, Homo sapiens
gttttaaacaaaata

SEQ ID NO: 211257 - DNA, 15 bp, Homo sapiens
agttttaaacaaaat

SEQ ID NO: 211258 - DNA, 15 bp, Homo sapiens
tagttttaaacaaaa

SEQ ID NO: 211259 - DNA, 15 bp, Homo sapiens
atagttttaaacaaa

SEQ ID NO: 211260 - DNA, 15 bp, Homo sapiens
tatagttttaaacaa

SEQ ID NO: 211261 - DNA, 15 bp, Homo sapiens
atatagttttaaaca

SEQ ID NO: 211262 - DNA, 15 bp, Homo sapiens
tatatagttttaaac

SEQ ID NO: 211263 - DNA, 15 bp, Homo sapiens
ctatatagttttaaa

SEQ ID NO: 211264 - DNA, 15 bp, Homo sapiens
cctatatagttttaa

SEQ ID NO: 211265 - DNA, 15 bp, Homo sapiens
gcctatatagtttta

SEQ ID NO: 211266 - DNA, 15 bp, Homo sapiens
agcctatatagtttt

SEQ ID NO: 211267 - DNA, 15 bp, Homo sapiens
tagcctatatagttt

SEQ ID NO: 211268 - DNA, 15 bp, Homo sapiens
gtagcctatatagtt

SEQ ID NO: 211269 - DNA, 15 bp, Homo sapiens
tgtagcctatatagt

SEQ ID NO: 211270 - DNA, 15 bp, Homo sapiens
atgtagcctatatag

SEQ ID NO: 211271 - DNA, 15 bp, Homo sapiens
catgtagcctatata

SEQ ID NO: 211272 - DNA, 15 bp, Homo sapiens
tcatgtagcctatat

SEQ ID NO: 211273 - DNA, 15 bp, Homo sapiens
ctcatgtagcctata

SEQ ID NO: 211274 - DNA, 15 bp, Homo sapiens
gctcatgtagcctat

SEQ ID NO: 211275 - DNA, 15 bp, Homo sapiens
tgctcatgtagccta

SEQ ID NO: 211276 - DNA, 15 bp, Homo sapiens
ctgctcatgtagcct

SEQ ID NO: 211277 - DNA, 15 bp, Homo sapiens
actgctcatgtagcc

SEQ ID NO: 211278 - DNA, 15 bp, Homo sapiens
aactgctcatgtagc

SEQ ID NO: 211279 - DNA, 15 bp, Homo sapiens
aaactgctcatgtag

SEQ ID NO: 211280 - DNA, 15 bp, Homo sapiens
aaaactgctcatgta

SEQ ID NO: 211281 - DNA, 15 bp, Homo sapiens
taaaactgctcatgt

SEQ ID NO: 211282 - DNA, 15 bp, Homo sapiens
ttaaaactgctcatg

SEQ ID NO: 211283 - DNA, 15 bp, Homo sapiens
gttaaaactgctcat

SEQ ID NO: 211284 - DNA, 15 bp, Homo sapiens
agttaaaactgctca

SEQ ID NO: 211285 - DNA, 15 bp, Homo sapiens
tagttaaaactgctc

SEQ ID NO: 211286 - DNA, 15 bp, Homo sapiens
ttagttaaaactgct

SEQ ID NO: 211287 - DNA, 15 bp, Homo sapiens
tttagttaaaactgc

SEQ ID NO: 211288 - DNA, 15 bp, Homo sapiens
atttagttaaaactg

SEQ ID NO: 211289 - DNA, 15 bp, Homo sapiens
tatttagttaaaact

SEQ ID NO: 211290 - DNA, 15 bp, Homo sapiens
ttatttagttaaaac

SEQ ID NO: 211291 - DNA, 15 bp, Homo sapiens
tttatttagttaaaa

SEQ ID NO: 211292 - DNA, 15 bp, Homo sapiens
ttttatttagttaaa

SEQ ID NO: 211293 - DNA, 15 bp, Homo sapiens
gttttatttagttaa

SEQ ID NO: 211294 - DNA, 15 bp, Homo sapiens
agttttatttagtta

SEQ ID NO: 211295 - DNA, 15 bp, Homo sapiens
cagttttatttagtt

SEQ ID NO: 211296 - DNA, 15 bp, Homo sapiens
acagttttatttagt

SEQ ID NO: 211297 - DNA, 15 bp, Homo sapiens
tacagttttatttag

SEQ ID NO: 211298 - DNA, 15 bp, Homo sapiens
atacagttttattta

SEQ ID NO: 211299 - DNA, 15 bp, Homo sapiens
aatacagttttattt

SEQ ID NO: 211300 - DNA, 15 bp, Homo sapiens
taatacagttttatt

SEQ ID NO: 211301 - DNA, 15 bp, Homo sapiens
ttaatacagttttat

SEQ ID NO: 211302 - DNA, 15 bp, Homo sapiens
attaatacagtttta

SEQ ID NO: 211303 - DNA, 15 bp, Homo sapiens
tattaatacagtttt

SEQ ID NO: 211304 - DNA, 15 bp, Homo sapiens
gtattaatacagttt

SEQ ID NO: 211305 - DNA, 15 bp, Homo sapiens
ggtattaatacagtt

SEQ ID NO: 211306 - DNA, 15 bp, Homo sapiens
aggtattaatacagt

SEQ ID NO: 211307 - DNA, 15 bp, Homo sapiens
caggtattaatacag

SEQ ID NO: 211308 - DNA, 15 bp, Homo sapiens
acaggtattaataca

SEQ ID NO: 211309 - DNA, 15 bp, Homo sapiens
aacaggtattaatac

SEQ ID NO: 211310 - DNA, 15 bp, Homo sapiens
taacaggtattaata

SEQ ID NO: 211311 - DNA, 15 bp, Homo sapiens
ataacaggtattaat

SEQ ID NO: 211312 - DNA, 15 bp, Homo sapiens
aataacaggtattaa

SEQ ID NO: 211313 - DNA, 15 bp, Homo sapiens
aaataacaggtatta

SEQ ID NO: 211314 - DNA, 15 bp, Homo sapiens
taaataacaggtatt

SEQ ID NO: 211315 - DNA, 15 bp, Homo sapiens
gtaaataacaggtat

SEQ ID NO: 211316 - DNA, 15 bp, Homo sapiens
ggtaaataacaggta

SEQ ID NO: 211317 - DNA, 15 bp, Homo sapiens
tggtaaataacaggt

SEQ ID NO: 211318 - DNA, 15 bp, Homo sapiens
gtggtaaataacagg

SEQ ID NO: 211319 - DNA, 15 bp, Homo sapiens
ggtggtaaataacag

SEQ ID NO: 211320 - DNA, 15 bp, Homo sapiens
aggtggtaaataaca

SEQ ID NO: 211321 - DNA, 15 bp, Homo sapiens
taggtggtaaataac

SEQ ID NO: 211322 - DNA, 15 bp, Homo sapiens
ctaggtggtaaataa

SEQ ID NO: 211323 - DNA, 15 bp, Homo sapiens
actaggtggtaaata

SEQ ID NO: 211324 - DNA, 15 bp, Homo sapiens
tactaggtggtaaat

SEQ ID NO: 211325 - DNA, 15 bp, Homo sapiens
atactaggtggtaaa

SEQ ID NO: 211326 - DNA, 15 bp, Homo sapiens
tatactaggtggtaa

SEQ ID NO: 211327 - DNA, 15 bp, Homo sapiens
ttatactaggtggta

SEQ ID NO: 211328 - DNA, 15 bp, Homo sapiens
gttatactaggtggt

SEQ ID NO: 211329 - DNA, 15 bp, Homo sapiens
ggttatactaggtgg

SEQ ID NO: 211330 - DNA, 15 bp, Homo sapiens
gggttatactaggtg

SEQ ID NO: 211331 - DNA, 15 bp, Homo sapiens
tgggttatactaggt

SEQ ID NO: 211332 - DNA, 15 bp, Homo sapiens
ttgggttatactagg

SEQ ID NO: 211333 - DNA, 15 bp, Homo sapiens
gttgggttatactag

SEQ ID NO: 211334 - DNA, 15 bp, Homo sapiens
tgttgggttatacta

SEQ ID NO: 211335 - DNA, 15 bp, Homo sapiens
ctgttgggttatact

SEQ ID NO: 211336 - DNA, 15 bp, Homo sapiens
tctgttgggttatac

SEQ ID NO: 211337 - DNA, 15 bp, Homo sapiens
ttctgttgggttata

SEQ ID NO: 211338 - DNA, 15 bp, Homo sapiens
gttctgttgggttat

SEQ ID NO: 211339 - DNA, 15 bp, Homo sapiens
agttctgttgggtta

SEQ ID NO: 211340 - DNA, 15 bp, Homo sapiens
tagttctgttgggtt

SEQ ID NO: 211341 - DNA, 15 bp, Homo sapiens
ctagttctgttgggt

SEQ ID NO: 211342 - DNA, 15 bp, Homo sapiens
gctagttctgttggg

SEQ ID NO: 211343 - DNA, 15 bp, Homo sapiens
agctagttctgttgg

SEQ ID NO: 211344 - DNA, 15 bp, Homo sapiens
aagctagttctgttg

SEQ ID NO: 211345 - DNA, 15 bp, Homo sapiens
aaagctagttctgtt

SEQ ID NO: 211346 - DNA, 15 bp, Homo sapiens
gaaagctagttctgt

SEQ ID NO: 211347 - DNA, 15 bp, Homo sapiens
tgaaagctagttctg

SEQ ID NO: 211348 - DNA, 15 bp, Homo sapiens
ttgaaagctagttct

SEQ ID NO: 211349 - DNA, 15 bp, Homo sapiens
attgaaagctagttc

SEQ ID NO: 211350 - DNA, 15 bp, Homo sapiens
aattgaaagctagtt

SEQ ID NO: 211351 - DNA, 15 bp, Homo sapiens
taattgaaagctagt

SEQ ID NO: 211352 - DNA, 15 bp, Homo sapiens
gtaattgaaagctag

SEQ ID NO: 211353 - DNA, 15 bp, Homo sapiens
agtaattgaaagcta

SEQ ID NO: 211354 - DNA, 15 bp, Homo sapiens
tagtaattgaaagct

SEQ ID NO: 211355 - DNA, 15 bp, Homo sapiens
atagtaattgaaagc

SEQ ID NO: 211356 - DNA, 15 bp, Homo sapiens
gatagtaattgaaag

SEQ ID NO: 211357 - DNA, 15 bp, Homo sapiens
agatagtaattgaaa

SEQ ID NO: 211358 - DNA, 15 bp, Homo sapiens
tagatagtaattgaa

SEQ ID NO: 211359 - DNA, 15 bp, Homo sapiens
ctagatagtaattga

SEQ ID NO: 211360 - DNA, 15 bp, Homo sapiens
tctagatagtaattg

SEQ ID NO: 211361 - DNA, 15 bp, Homo sapiens
atctagatagtaatt

SEQ ID NO: 211362 - DNA, 15 bp, Homo sapiens
aatctagatagtaat

SEQ ID NO: 211363 - DNA, 15 bp, Homo sapiens
taatctagatagtaa

SEQ ID NO: 211364 - DNA, 15 bp, Homo sapiens
ttaatctagatagta

SEQ ID NO: 211365 - DNA, 15 bp, Homo sapiens
gttaatctagatagt

SEQ ID NO: 211366 - DNA, 15 bp, Homo sapiens
ggttaatctagatag

SEQ ID NO: 211367 - DNA, 15 bp, Homo sapiens
gggttaatctagata

SEQ ID NO: 211368 - DNA, 15 bp, Homo sapiens
cgggttaatctagat

SEQ ID NO: 211369 - DNA, 15 bp, Homo sapiens
acgggttaatctaga

SEQ ID NO: 211370 - DNA, 15 bp, Homo sapiens
gacgggttaatctag

SEQ ID NO: 211371 - DNA, 15 bp, Homo sapiens
tgacgggttaatcta

SEQ ID NO: 211372 - DNA, 15 bp, Homo sapiens
ttgacgggttaatct

SEQ ID NO: 211373 - DNA, 15 bp, Homo sapiens
tttgacgggttaatc

SEQ ID NO: 211374 - DNA, 15 bp, Homo sapiens
atttgacgggttaat

SEQ ID NO: 211375 - DNA, 15 bp, Homo sapiens
aatttgacgggttaa

SEQ ID NO: 211376 - DNA, 15 bp, Homo sapiens
taatttgacgggtta

SEQ ID NO: 211377 - DNA, 15 bp, Homo sapiens
ctaatttgacgggtt

SEQ ID NO: 211378 - DNA, 15 bp, Homo sapiens
tctaatttgacgggt

SEQ ID NO: 211379 - DNA, 15 bp, Homo sapiens
gtctaatttgacggg

SEQ ID NO: 211380 - DNA, 15 bp, Homo sapiens
tgtctaatttgacgg

SEQ ID NO: 211381 - DNA, 15 bp, Homo sapiens
ttgtctaatttgacg

SEQ ID NO: 211382 - DNA, 15 bp, Homo sapiens
cttgtctaatttgac

SEQ ID NO: 211383 - DNA, 15 bp, Homo sapiens
ccttgtctaatttga

SEQ ID NO: 211384 - DNA, 15 bp, Homo sapiens
cccttgtctaatttg

SEQ ID NO: 211385 - DNA, 15 bp, Homo sapiens
acccttgtctaattt

SEQ ID NO: 211386 - DNA, 15 bp, Homo sapiens
gacccttgtctaatt

SEQ ID NO: 211387 - DNA, 15 bp, Homo sapiens
tgacccttgtctaat

SEQ ID NO: 211388 - DNA, 15 bp, Homo sapiens
gtgacccttgtctaa

SEQ ID NO: 211389 - DNA, 15 bp, Homo sapiens
ggtgacccttgtcta

SEQ ID NO: 211390 - DNA, 15 bp, Homo sapiens
aggtgacccttgtct

SEQ ID NO: 211391 - DNA, 15 bp, Homo sapiens
aaggtgacccttgtc

SEQ ID NO: 211392 - DNA, 15 bp, Homo sapiens
taaggtgacccttgt

SEQ ID NO: 211393 - DNA, 15 bp, Homo sapiens
ataaggtgacccttg

SEQ ID NO: 211394 - DNA, 15 bp, Homo sapiens
tataaggtgaccctt

SEQ ID NO: 211395 - DNA, 15 bp, Homo sapiens
ctataaggtgaccct

SEQ ID NO: 211396 - DNA, 15 bp, Homo sapiens
actataaggtgaccc

SEQ ID NO: 211397 - DNA, 15 bp, Homo sapiens
gactataaggtgacc

SEQ ID NO: 211398 - DNA, 15 bp, Homo sapiens
agactataaggtgac

SEQ ID NO: 211399 - DNA, 15 bp, Homo sapiens
aagactataaggtga

SEQ ID NO: 211400 - DNA, 15 bp, Homo sapiens
aaagactataaggtg

SEQ ID NO: 211401 - DNA, 15 bp, Homo sapiens
caaagactataaggt

SEQ ID NO: 211402 - DNA, 15 bp, Homo sapiens
gcaaagactataagg

SEQ ID NO: 211403 - DNA, 15 bp, Homo sapiens
tgcaaagactataag

SEQ ID NO: 211404 - DNA, 15 bp, Homo sapiens
ttgcaaagactataa

SEQ ID NO: 211405 - DNA, 15 bp, Homo sapiens
cttgcaaagactata

SEQ ID NO: 211406 - DNA, 15 bp, Homo sapiens
acttgcaaagactat

SEQ ID NO: 211407 - DNA, 15 bp, Homo sapiens
tacttgcaaagacta

SEQ ID NO: 211408 - DNA, 15 bp, Homo sapiens
atacttgcaaagact

SEQ ID NO: 211409 - DNA, 15 bp, Homo sapiens
gatacttgcaaagac

SEQ ID NO: 211410 - DNA, 15 bp, Homo sapiens
tgatacttgcaaaga

SEQ ID NO: 211411 - DNA, 15 bp, Homo sapiens
ctgatacttgcaaag

SEQ ID NO: 211412 - DNA, 15 bp, Homo sapiens
actgatacttgcaaa

SEQ ID NO: 211413 - DNA, 15 bp, Homo sapiens
aactgatacttgcaa

SEQ ID NO: 211414 - DNA, 15 bp, Homo sapiens
aaactgatacttgca

SEQ ID NO: 211415 - DNA, 15 bp, Homo sapiens
caaactgatacttgc

SEQ ID NO: 211416 - DNA, 15 bp, Homo sapiens
ccaaactgatacttg

SEQ ID NO: 211417 - DNA, 15 bp, Homo sapiens
accaaactgatactt

SEQ ID NO: 211418 - DNA, 15 bp, Homo sapiens
taccaaactgatact

SEQ ID NO: 211419 - DNA, 15 bp, Homo sapiens
ttaccaaactgatac

SEQ ID NO: 211420 - DNA, 15 bp, Homo sapiens
tttaccaaactgata

SEQ ID NO: 211421 - DNA, 15 bp, Homo sapiens
gtttaccaaactgat

SEQ ID NO: 211422 - DNA, 15 bp, Homo sapiens
tgtttaccaaactga

SEQ ID NO: 211423 - DNA, 15 bp, Homo sapiens
ctgtttaccaaactg

SEQ ID NO: 211424 - DNA, 15 bp, Homo sapiens
gctgtttaccaaact

SEQ ID NO: 211425 - DNA, 15 bp, Homo sapiens
tgctgtttaccaaac

SEQ ID NO: 211426 - DNA, 15 bp, Homo sapiens
gtgctgtttaccaaa

SEQ ID NO: 211427 - DNA, 15 bp, Homo sapiens
tgtgctgtttaccaa

SEQ ID NO: 211428 - DNA, 15 bp, Homo sapiens
gtgtgctgtttacca

SEQ ID NO: 211429 - DNA, 15 bp, Homo sapiens
agtgtgctgtttacc

SEQ ID NO: 211430 - DNA, 15 bp, Homo sapiens
gagtgtgctgtttac

SEQ ID NO: 211431 - DNA, 15 bp, Homo sapiens
tgagtgtgctgttta

SEQ ID NO: 211432 - DNA, 15 bp, Homo sapiens
atgagtgtgctgttt

SEQ ID NO: 211433 - DNA, 15 bp, Homo sapiens
aatgagtgtgctgtt

SEQ ID NO: 211434 - DNA, 15 bp, Homo sapiens
taatgagtgtgctgt

SEQ ID NO: 211435 - DNA, 15 bp, Homo sapiens
ataatgagtgtgctg

SEQ ID NO: 211436 - DNA, 15 bp, Homo sapiens
aataatgagtgtgct

SEQ ID NO: 211437 - DNA, 15 bp, Homo sapiens
aaataatgagtgtgc

SEQ ID NO: 211438 - DNA, 15 bp, Homo sapiens
aaaataatgagtgtg

SEQ ID NO: 211439 - DNA, 15 bp, Homo sapiens
aaaaataatgagtgt

SEQ ID NO: 211440 - DNA, 15 bp, Homo sapiens
aaaaaataatgagtg

SEQ ID NO: 211441 - DNA, 15 bp, Homo sapiens
aaaaaaataatgagt

SEQ ID NO: 211442 - DNA, 15 bp, Homo sapiens
gaaaaaaataatgag

SEQ ID NO: 211443 - DNA, 15 bp, Homo sapiens
cgaaaaaaataatga

SEQ ID NO: 211444 - DNA, 15 bp, Homo sapiens
acgaaaaaaataatg

SEQ ID NO: 211445 - DNA, 15 bp, Homo sapiens
cacgaaaaaaataat

SEQ ID NO: 211446 - DNA, 15 bp, Homo sapiens
acacgaaaaaaataa

SEQ ID NO: 211447 - DNA, 15 bp, Homo sapiens
tacacgaaaaaaata

SEQ ID NO: 211448 - DNA, 15 bp, Homo sapiens
ttacacgaaaaaaat

SEQ ID NO: 211449 - DNA, 15 bp, Homo sapiens
cttacacgaaaaaaa

SEQ ID NO: 211450 - DNA, 15 bp, Homo sapiens
acttacacgaaaaaa

SEQ ID NO: 211451 - DNA, 15 bp, Homo sapiens
tacttacacgaaaaa

SEQ ID NO: 211452 - DNA, 15 bp, Homo sapiens
gtacttacacgaaaa

SEQ ID NO: 211453 - DNA, 15 bp, Homo sapiens
tgtacttacacgaaa

SEQ ID NO: 211454 - DNA, 15 bp, Homo sapiens
atgtacttacacgaa

SEQ ID NO: 211455 - DNA, 15 bp, Homo sapiens
catgtacttacacga

SEQ ID NO: 211456 - DNA, 15 bp, Homo sapiens
acatgtacttacacg

SEQ ID NO: 211457 - DNA, 15 bp, Homo sapiens
aacatgtacttacac

SEQ ID NO: 211458 - DNA, 15 bp, Homo sapiens
aaacatgtacttaca

SEQ ID NO: 211459 - DNA, 15 bp, Homo sapiens
taaacatgtacttac

SEQ ID NO: 211460 - DNA, 15 bp, Homo sapiens
ttaaacatgtactta

SEQ ID NO: 211461 - DNA, 15 bp, Homo sapiens
attaaacatgtactt

SEQ ID NO: 211462 - DNA, 15 bp, Homo sapiens
aattaaacatgtact

SEQ ID NO: 211463 - DNA, 15 bp, Homo sapiens
gaattaaacatgtac

SEQ ID NO: 211464 - DNA, 15 bp, Homo sapiens
ggaattaaacatgta

SEQ ID NO: 211465 - DNA, 15 bp, Homo sapiens
gggaattaaacatgt

SEQ ID NO: 211466 - DNA, 15 bp, Homo sapiens
agggaattaaacatg

SEQ ID NO: 211467 - DNA, 15 bp, Homo sapiens
gagggaattaaacat

SEQ ID NO: 211468 - DNA, 15 bp, Homo sapiens
tgagggaattaaaca

SEQ ID NO: 211469 - DNA, 15 bp, Homo sapiens
ttgagggaattaaac

SEQ ID NO: 211470 - DNA, 15 bp, Homo sapiens
tttgagggaattaaa

SEQ ID NO: 211471 - DNA, 15 bp, Homo sapiens
atttgagggaattaa

SEQ ID NO: 211472 - DNA, 15 bp, Homo sapiens
catttgagggaatta

SEQ ID NO: 211473 - DNA, 15 bp, Homo sapiens
acatttgagggaatt

SEQ ID NO: 211474 - DNA, 15 bp, Homo sapiens
aacatttgagggaat

SEQ ID NO: 211475 - DNA, 15 bp, Homo sapiens
taacatttgagggaa

SEQ ID NO: 211476 - DNA, 15 bp, Homo sapiens
ttaacatttgaggga

SEQ ID NO: 211477 - DNA, 15 bp, Homo sapiens
gttaacatttgaggg

SEQ ID NO: 211478 - DNA, 15 bp, Homo sapiens
tgttaacatttgagg

SEQ ID NO: 211479 - DNA, 15 bp, Homo sapiens
atgttaacatttgag

SEQ ID NO: 211480 - DNA, 15 bp, Homo sapiens
tatgttaacatttga

SEQ ID NO: 211481 - DNA, 15 bp, Homo sapiens
ttatgttaacatttg

SEQ ID NO: 211482 - DNA, 15 bp, Homo sapiens
tttatgttaacattt

SEQ ID NO: 211483 - DNA, 15 bp, Homo sapiens
atttatgttaacatt

SEQ ID NO: 211484 - DNA, 15 bp, Homo sapiens
aatttatgttaacat

SEQ ID NO: 211485 - DNA, 15 bp, Homo sapiens
caatttatgttaaca

SEQ ID NO: 211486 - DNA, 15 bp, Homo sapiens
gcaatttatgttaac

SEQ ID NO: 211487 - DNA, 15 bp, Homo sapiens
agcaatttatgttaa

SEQ ID NO: 211488 - DNA, 15 bp, Homo sapiens
tagcaatttatgtta

SEQ ID NO: 211489 - DNA, 15 bp, Homo sapiens
gtagcaatttatgtt

SEQ ID NO: 211490 - DNA, 15 bp, Homo sapiens
agtagcaatttatgt

SEQ ID NO: 211491 - DNA, 15 bp, Homo sapiens
aagtagcaatttatg

SEQ ID NO: 211492 - DNA, 15 bp, Homo sapiens
taagtagcaatttat

SEQ ID NO: 211493 - DNA, 15 bp, Homo sapiens
ttaagtagcaattta

SEQ ID NO: 211494 - DNA, 15 bp, Homo sapiens
tttaagtagcaattt

SEQ ID NO: 211495 - DNA, 15 bp, Homo sapiens
ttttaagtagcaatt

SEQ ID NO: 211496 - DNA, 15 bp, Homo sapiens
tttttaagtagcaat

SEQ ID NO: 211497 - DNA, 15 bp, Homo sapiens
ttttttaagtagcaa

SEQ ID NO: 211498 - DNA, 15 bp, Homo sapiens
attttttaagtagca

SEQ ID NO: 211499 - DNA, 15 bp, Homo sapiens
tattttttaagtagc

SEQ ID NO: 211500 - DNA, 15 bp, Homo sapiens
atattttttaagtag

SEQ ID NO: 211501 - DNA, 15 bp, Homo sapiens
catattttttaagta

SEQ ID NO: 211502 - DNA, 15 bp, Homo sapiens
acatattttttaagt

SEQ ID NO: 211503 - DNA, 15 bp, Homo sapiens
tacatattttttaag

SEQ ID NO: 211504 - DNA, 15 bp, Homo sapiens
ctacatattttttaa

SEQ ID NO: 211505 - DNA, 15 bp, Homo sapiens
actacatatttttta

SEQ ID NO: 211506 - DNA, 15 bp, Homo sapiens
cactacatatttttt

SEQ ID NO: 211507 - DNA, 15 bp, Homo sapiens
acactacatattttt

SEQ ID NO: 211508 - DNA, 15 bp, Homo sapiens
aacactacatatttt

SEQ ID NO: 211509 - DNA, 15 bp, Homo sapiens
aaacactacatattt

SEQ ID NO: 211510 - DNA, 15 bp, Homo sapiens
aaaacactacatatt

SEQ ID NO: 211511 - DNA, 15 bp, Homo sapiens
taaaacactacatat

SEQ ID NO: 211512 - DNA, 15 bp, Homo sapiens
ttaaaacactacata

SEQ ID NO: 211513 - DNA, 15 bp, Homo sapiens
cttaaaacactacat

SEQ ID NO: 211514 - DNA, 15 bp, Homo sapiens
ccttaaaacactaca

SEQ ID NO: 211515 - DNA, 15 bp, Homo sapiens
tccttaaaacactac

SEQ ID NO: 211516 - DNA, 15 bp, Homo sapiens
gtccttaaaacacta

SEQ ID NO: 211517 - DNA, 15 bp, Homo sapiens
agtccttaaaacact

SEQ ID NO: 211518 - DNA, 15 bp, Homo sapiens
cagtccttaaaacac

SEQ ID NO: 211519 - DNA, 15 bp, Homo sapiens
acagtccttaaaaca

SEQ ID NO: 211520 - DNA, 15 bp, Homo sapiens
aacagtccttaaaac

SEQ ID NO: 211521 - DNA, 15 bp, Homo sapiens
aaacagtccttaaaa

SEQ ID NO: 211522 - DNA, 15 bp, Homo sapiens
aaaacagtccttaaa

SEQ ID NO: 211523 - DNA, 15 bp, Homo sapiens
taaaacagtccttaa

SEQ ID NO: 211524 - DNA, 15 bp, Homo sapiens
ttaaaacagtcctta

SEQ ID NO: 211525 - DNA, 15 bp, Homo sapiens
tttaaaacagtcctt

SEQ ID NO: 211526 - DNA, 15 bp, Homo sapiens
ttttaaaacagtcct

SEQ ID NO: 211527 - DNA, 15 bp, Homo sapiens
attttaaaacagtcc

SEQ ID NO: 211528 - DNA, 15 bp, Homo sapiens
tattttaaaacagtc

SEQ ID NO: 211529 - DNA, 15 bp, Homo sapiens
ttattttaaaacagt

SEQ ID NO: 211530 - DNA, 15 bp, Homo sapiens
tttattttaaaacag

SEQ ID NO: 211531 - DNA, 15 bp, Homo sapiens
atttattttaaaaca

SEQ ID NO: 211532 - DNA, 15 bp, Homo sapiens
catttattttaaaac

SEQ ID NO: 211533 - DNA, 15 bp, Homo sapiens
ccatttattttaaaa

SEQ ID NO: 211534 - DNA, 15 bp, Homo sapiens
tccatttattttaaa

SEQ ID NO: 211535 - DNA, 15 bp, Homo sapiens
atccatttattttaa

SEQ ID NO: 211536 - DNA, 15 bp, Homo sapiens
tatccatttatttta

SEQ ID NO: 211537 - DNA, 15 bp, Homo sapiens
ctatccatttatttt

SEQ ID NO: 211538 - DNA, 15 bp, Homo sapiens
cctatccatttattt

SEQ ID NO: 211539 - DNA, 15 bp, Homo sapiens
gcctatccatttatt

SEQ ID NO: 211540 - DNA, 15 bp, Homo sapiens
agcctatccatttat

SEQ ID NO: 211541 - DNA, 15 bp, Homo sapiens
tagcctatccattta

SEQ ID NO: 211542 - DNA, 15 bp, Homo sapiens
ctagcctatccattt

SEQ ID NO: 211543 - DNA, 15 bp, Homo sapiens
cctagcctatccatt

SEQ ID NO: 211544 - DNA, 15 bp, Homo sapiens
gcctagcctatccat

SEQ ID NO: 211545 - DNA, 15 bp, Homo sapiens
tgcctagcctatcca

SEQ ID NO: 211546 - DNA, 15 bp, Homo sapiens
gtgcctagcctatcc

SEQ ID NO: 211547 - DNA, 15 bp, Homo sapiens
agtgcctagcctatc

SEQ ID NO: 211548 - DNA, 15 bp, Homo sapiens
cagtgcctagcctat

SEQ ID NO: 211549 - DNA, 15 bp, Homo sapiens
acagtgcctagccta

SEQ ID NO: 211550 - DNA, 15 bp, Homo sapiens
cacagtgcctagcct

SEQ ID NO: 211551 - DNA, 15 bp, Homo sapiens
ccacagtgcctagcc

SEQ ID NO: 211552 - DNA, 15 bp, Homo sapiens
gccacagtgcctagc

SEQ ID NO: 211553 - DNA, 15 bp, Homo sapiens
agccacagtgcctag

SEQ ID NO: 211554 - DNA, 15 bp, Homo sapiens
gagccacagtgccta

SEQ ID NO: 211555 - DNA, 15 bp, Homo sapiens
tgagccacagtgcct

SEQ ID NO: 211556 - DNA, 15 bp, Homo sapiens
atgagccacagtgcc

SEQ ID NO: 211557 - DNA, 15 bp, Homo sapiens
tatgagccacagtgc

SEQ ID NO: 211558 - DNA, 15 bp, Homo sapiens
gtatgagccacagtg

SEQ ID NO: 211559 - DNA, 15 bp, Homo sapiens
ggtatgagccacagt

SEQ ID NO: 211560 - DNA, 15 bp, Homo sapiens
aggtatgagccacag

SEQ ID NO: 211561 - DNA, 15 bp, Homo sapiens
caggtatgagccaca

SEQ ID NO: 211562 - DNA, 15 bp, Homo sapiens
acaggtatgagccac

SEQ ID NO: 211563 - DNA, 15 bp, Homo sapiens
cggcttcccaaagtg

SEQ ID NO: 211564 - DNA, 15 bp, Homo sapiens
tcggcttcccaaagt

SEQ ID NO: 211565 - DNA, 15 bp, Homo sapiens
ctcggcttcccaaag

SEQ ID NO: 211566 - DNA, 15 bp, Homo sapiens
cctcggcttcccaaa

SEQ ID NO: 211567 - DNA, 15 bp, Homo sapiens
gcctcggcttcccaa

SEQ ID NO: 211568 - DNA, 15 bp, Homo sapiens
cgcctcggcttccca

SEQ ID NO: 211569 - DNA, 15 bp, Homo sapiens
ccgcctcggcttccc

SEQ ID NO: 211570 - DNA, 15 bp, Homo sapiens
cccgcctcggcttcc

SEQ ID NO: 211571 - DNA, 15 bp, Homo sapiens
acccgcctcggcttc

SEQ ID NO: 211572 - DNA, 15 bp, Homo sapiens
cacccgcctcggctt

SEQ ID NO: 211573 - DNA, 15 bp, Homo sapiens
ccacccgcctcggct

SEQ ID NO: 211574 - DNA, 15 bp, Homo sapiens
agtgatccacccgcc

SEQ ID NO: 211575 - DNA, 15 bp, Homo sapiens
aagtgatccacccgc

SEQ ID NO: 211576 - DNA, 15 bp, Homo sapiens
caagtgatccacccg

SEQ ID NO: 211577 - DNA, 15 bp, Homo sapiens
agaactcctggcctc

SEQ ID NO: 211578 - DNA, 15 bp, Homo sapiens
tagaactcctggcct

SEQ ID NO: 211579 - DNA, 15 bp, Homo sapiens
ctagaactcctggcc

SEQ ID NO: 211580 - DNA, 15 bp, Homo sapiens
tctagaactcctggc

SEQ ID NO: 211581 - DNA, 15 bp, Homo sapiens
atctagaactcctgg

SEQ ID NO: 211582 - DNA, 15 bp, Homo sapiens
aatctagaactcctg

SEQ ID NO: 211583 - DNA, 15 bp, Homo sapiens
taatctagaactcct

SEQ ID NO: 211584 - DNA, 15 bp, Homo sapiens
ctaatctagaactcc

SEQ ID NO: 211585 - DNA, 15 bp, Homo sapiens
cctaatctagaactc

SEQ ID NO: 211586 - DNA, 15 bp, Homo sapiens
gcctaatctagaact

SEQ ID NO: 211587 - DNA, 15 bp, Homo sapiens
agcctaatctagaac

SEQ ID NO: 211588 - DNA, 15 bp, Homo sapiens
cagcctaatctagaa

SEQ ID NO: 211589 - DNA, 15 bp, Homo sapiens
ccagcctaatctaga

SEQ ID NO: 211590 - DNA, 15 bp, Homo sapiens
gccagcctaatctag

SEQ ID NO: 211591 - DNA, 15 bp, Homo sapiens
ggccagcctaatcta

SEQ ID NO: 211592 - DNA, 15 bp, Homo sapiens
tggccagcctaatct

SEQ ID NO: 211593 - DNA, 15 bp, Homo sapiens
ttggccagcctaatc

SEQ ID NO: 211594 - DNA, 15 bp, Homo sapiens
gttggccagcctaat

SEQ ID NO: 211595 - DNA, 15 bp, Homo sapiens
tgttggccagcctaa

SEQ ID NO: 211596 - DNA, 15 bp, Homo sapiens
atgttggccagccta

SEQ ID NO: 211597 - DNA, 15 bp, Homo sapiens
cagagatgaggtttc

SEQ ID NO: 211598 - DNA, 15 bp, Homo sapiens
gcagagatgaggttt

SEQ ID NO: 211599 - DNA, 15 bp, Homo sapiens
agcagagatgaggtt

SEQ ID NO: 211600 - DNA, 15 bp, Homo sapiens
tagcagagatgaggt

SEQ ID NO: 211601 - DNA, 15 bp, Homo sapiens
ttagcagagatgagg

SEQ ID NO: 211602 - DNA, 15 bp, Homo sapiens
tttagcagagatgag

SEQ ID NO: 211603 - DNA, 15 bp, Homo sapiens
ttttagcagagatga

SEQ ID NO: 211604 - DNA, 15 bp, Homo sapiens
tttttagcagagatg

SEQ ID NO: 211605 - DNA, 15 bp, Homo sapiens
atttttagcagagat

SEQ ID NO: 211606 - DNA, 15 bp, Homo sapiens
tatttttagcagaga

SEQ ID NO: 211607 - DNA, 15 bp, Homo sapiens
atatttttagcagag

SEQ ID NO: 211608 - DNA, 15 bp, Homo sapiens
tatatttttagcaga

SEQ ID NO: 211609 - DNA, 15 bp, Homo sapiens
ttatatttttagcag

SEQ ID NO: 211610 - DNA, 15 bp, Homo sapiens
tttatatttttagca

SEQ ID NO: 211611 - DNA, 15 bp, Homo sapiens
ttttatatttttagc

SEQ ID NO: 211612 - DNA, 15 bp, Homo sapiens
cctaatttttatatt

SEQ ID NO: 211613 - DNA, 15 bp, Homo sapiens
acctaatttttatat

SEQ ID NO: 211614 - DNA, 15 bp, Homo sapiens
cacctaatttttata

SEQ ID NO: 211615 - DNA, 15 bp, Homo sapiens
acacctaatttttat

SEQ ID NO: 211616 - DNA, 15 bp, Homo sapiens
cacacctaattttta

SEQ ID NO: 211617 - DNA, 15 bp, Homo sapiens
ccacacctaattttt

SEQ ID NO: 211618 - DNA, 15 bp, Homo sapiens
accacacctaatttt

SEQ ID NO: 211619 - DNA, 15 bp, Homo sapiens
caccacacctaattt

SEQ ID NO: 211620 - DNA, 15 bp, Homo sapiens
ccaccacacctaatt

SEQ ID NO: 211621 - DNA, 15 bp, Homo sapiens
gccaccacacctaat

SEQ ID NO: 211622 - DNA, 15 bp, Homo sapiens
cgccaccacacctaa

SEQ ID NO: 211623 - DNA, 15 bp, Homo sapiens
ccgccaccacaccta

SEQ ID NO: 211624 - DNA, 15 bp, Homo sapiens
cccgccaccacacct

SEQ ID NO: 211625 - DNA, 15 bp, Homo sapiens
acccgccaccacacc

SEQ ID NO: 211626 - DNA, 15 bp, Homo sapiens
cacccgccaccacac

SEQ ID NO: 211627 - DNA, 15 bp, Homo sapiens
gcacccgccaccaca

SEQ ID NO: 211628 - DNA, 15 bp, Homo sapiens
ggcacccgccaccac

SEQ ID NO: 211629 - DNA, 15 bp, Homo sapiens
aggcacccgccacca

SEQ ID NO: 211630 - DNA, 15 bp, Homo sapiens
taggcacccgccacc

SEQ ID NO: 211631 - DNA, 15 bp, Homo sapiens
ataggcacccgccac

SEQ ID NO: 211632 - DNA, 15 bp, Homo sapiens
gataggcacccgcca

SEQ ID NO: 211633 - DNA, 15 bp, Homo sapiens
tgataggcacccgcc

SEQ ID NO: 211634 - DNA, 15 bp, Homo sapiens
atgataggcacccgc

SEQ ID NO: 211635 - DNA, 15 bp, Homo sapiens
gatgataggcacccg

SEQ ID NO: 211636 - DNA, 15 bp, Homo sapiens
agatgataggcaccc

SEQ ID NO: 211637 - DNA, 15 bp, Homo sapiens
gagatgataggcacc

SEQ ID NO: 211638 - DNA, 15 bp, Homo sapiens
tgagatgataggcac

SEQ ID NO: 211639 - DNA, 15 bp, Homo sapiens
ctgagatgataggca

SEQ ID NO: 211640 - DNA, 15 bp, Homo sapiens
gctgagatgataggc

SEQ ID NO: 211641 - DNA, 15 bp, Homo sapiens
agctgagatgatagg

SEQ ID NO: 211642 - DNA, 15 bp, Homo sapiens
tagctgagatgatag

SEQ ID NO: 211643 - DNA, 15 bp, Homo sapiens
gtagctgagatgata

SEQ ID NO: 211644 - DNA, 15 bp, Homo sapiens
agtagctgagatgat

SEQ ID NO: 211645 - DNA, 15 bp, Homo sapiens
aagtagctgagatga

SEQ ID NO: 211646 - DNA, 15 bp, Homo sapiens
caagtagctgagatg

SEQ ID NO: 211647 - DNA, 15 bp, Homo sapiens
acaagtagctgagat

SEQ ID NO: 211648 - DNA, 15 bp, Homo sapiens
aacaagtagctgaga

SEQ ID NO: 211649 - DNA, 15 bp, Homo sapiens
caacaagtagctgag

SEQ ID NO: 211650 - DNA, 15 bp, Homo sapiens
ccaacaagtagctga

SEQ ID NO: 211651 - DNA, 15 bp, Homo sapiens
tccaacaagtagctg

SEQ ID NO: 211652 - DNA, 15 bp, Homo sapiens
ctccaacaagtagct

SEQ ID NO: 211653 - DNA, 15 bp, Homo sapiens
tctccaacaagtagc

SEQ ID NO: 211654 - DNA, 15 bp, Homo sapiens
gtctccaacaagtag

SEQ ID NO: 211655 - DNA, 15 bp, Homo sapiens
agtctccaacaagta

SEQ ID NO: 211656 - DNA, 15 bp, Homo sapiens
cagtctccaacaagt

SEQ ID NO: 211657 - DNA, 15 bp, Homo sapiens
tcagtctccaacaag

SEQ ID NO: 211658 - DNA, 15 bp, Homo sapiens
ctcagtctccaacaa

SEQ ID NO: 211659 - DNA, 15 bp, Homo sapiens
cctcagtctccaaca

SEQ ID NO: 211660 - DNA, 15 bp, Homo sapiens
gcctcagtctccaac

SEQ ID NO: 211661 - DNA, 15 bp, Homo sapiens
tgcctcagtctccaa

SEQ ID NO: 211662 - DNA, 15 bp, Homo sapiens
ctgcctcagtctcca

SEQ ID NO: 211663 - DNA, 15 bp, Homo sapiens
actgcctcagtctcc

SEQ ID NO: 211664 - DNA, 15 bp, Homo sapiens
tactgcctcagtctc

SEQ ID NO: 211665 - DNA, 15 bp, Homo sapiens
ctactgcctcagtct

SEQ ID NO: 211666 - DNA, 15 bp, Homo sapiens
tctactgcctcagtc

SEQ ID NO: 211667 - DNA, 15 bp, Homo sapiens
ttctactgcctcagt

SEQ ID NO: 211668 - DNA, 15 bp, Homo sapiens
attctactgcctcag

SEQ ID NO: 211669 - DNA, 15 bp, Homo sapiens
gattctactgcctca

SEQ ID NO: 211670 - DNA, 15 bp, Homo sapiens
cgattctactgcctc

SEQ ID NO: 211671 - DNA, 15 bp, Homo sapiens
gcgattctactgcct

SEQ ID NO: 211672 - DNA, 15 bp, Homo sapiens
agcgattctactgcc

SEQ ID NO: 211673 - DNA, 15 bp, Homo sapiens
aagcgattctactgc

SEQ ID NO: 211674 - DNA, 15 bp, Homo sapiens
caagcgattctactg

SEQ ID NO: 211675 - DNA, 15 bp, Homo sapiens
tcaagcgattctact

SEQ ID NO: 211676 - DNA, 15 bp, Homo sapiens
ttcaagcgattctac

SEQ ID NO: 211677 - DNA, 15 bp, Homo sapiens
gttcaagcgattcta

SEQ ID NO: 211678 - DNA, 15 bp, Homo sapiens
ccctgggttcaagcg

SEQ ID NO: 211679 - DNA, 15 bp, Homo sapiens
cccctgggttcaagc

SEQ ID NO: 211680 - DNA, 15 bp, Homo sapiens
ccccctgggttcaag

SEQ ID NO: 211681 - DNA, 15 bp, Homo sapiens
gccccctgggttcaa

SEQ ID NO: 211682 - DNA, 15 bp, Homo sapiens
cgccccctgggttca

SEQ ID NO: 211683 - DNA, 15 bp, Homo sapiens
ccgccccctgggttc

SEQ ID NO: 211684 - DNA, 15 bp, Homo sapiens
tccgccccctgggtt

SEQ ID NO: 211685 - DNA, 15 bp, Homo sapiens
ctccgccccctgggt

SEQ ID NO: 211686 - DNA, 15 bp, Homo sapiens
cctccgccccctggg

SEQ ID NO: 211687 - DNA, 15 bp, Homo sapiens
acctccgccccctgg

SEQ ID NO: 211688 - DNA, 15 bp, Homo sapiens
aacctccgccccctg

SEQ ID NO: 211689 - DNA, 15 bp, Homo sapiens
caacctccgccccct

SEQ ID NO: 211690 - DNA, 15 bp, Homo sapiens
ttcactgcaacctcc

SEQ ID NO: 211691 - DNA, 15 bp, Homo sapiens
gttcactgcaacctc

SEQ ID NO: 211692 - DNA, 15 bp, Homo sapiens
tggttcactgcaacc

SEQ ID NO: 211693 - DNA, 15 bp, Homo sapiens
ttggttcactgcaac

SEQ ID NO: 211694 - DNA, 15 bp, Homo sapiens
cttggttcactgcaa

SEQ ID NO: 211695 - DNA, 15 bp, Homo sapiens
tcttggttcactgca

SEQ ID NO: 211696 - DNA, 15 bp, Homo sapiens
atcttggttcactgc

SEQ ID NO: 211697 - DNA, 15 bp, Homo sapiens
gatcttggttcactg

SEQ ID NO: 211698 - DNA, 15 bp, Homo sapiens
tgatcttggttcact

SEQ ID NO: 211699 - DNA, 15 bp, Homo sapiens
gtgatcttggttcac

SEQ ID NO: 211700 - DNA, 15 bp, Homo sapiens
tgtgatcttggttca

SEQ ID NO: 211701 - DNA, 15 bp, Homo sapiens
gtgtgatcttggttc

SEQ ID NO: 211702 - DNA, 15 bp, Homo sapiens
ggtgtgatcttggtt

SEQ ID NO: 211703 - DNA, 15 bp, Homo sapiens
aggtgtgatcttggt

SEQ ID NO: 211704 - DNA, 15 bp, Homo sapiens
gaggtgtgatcttgg

SEQ ID NO: 211705 - DNA, 15 bp, Homo sapiens
agaggtgtgatcttg

SEQ ID NO: 211706 - DNA, 15 bp, Homo sapiens
cagaggtgtgatctt

SEQ ID NO: 211707 - DNA, 15 bp, Homo sapiens
gcagaggtgtgatct

SEQ ID NO: 211708 - DNA, 15 bp, Homo sapiens
tgcagaggtgtgatc

SEQ ID NO: 211709 - DNA, 15 bp, Homo sapiens
gtgcagaggtgtgat

SEQ ID NO: 211710 - DNA, 15 bp, Homo sapiens
agtgcagaggtgtga

SEQ ID NO: 211711 - DNA, 15 bp, Homo sapiens
gagtgcagaggtgtg

SEQ ID NO: 211712 - DNA, 15 bp, Homo sapiens
ggagtgcagaggtgt

SEQ ID NO: 211713 - DNA, 15 bp, Homo sapiens
tggagtgcagaggtg

SEQ ID NO: 211714 - DNA, 15 bp, Homo sapiens
ctggagtgcagaggt

SEQ ID NO: 211715 - DNA, 15 bp, Homo sapiens
atctgttgccaggct

SEQ ID NO: 211716 - DNA, 15 bp, Homo sapiens
aatctgttgccaggc

SEQ ID NO: 211717 - DNA, 15 bp, Homo sapiens
caatctgttgccagg

SEQ ID NO: 211718 - DNA, 15 bp, Homo sapiens
tcaatctgttgccag

SEQ ID NO: 211719 - DNA, 15 bp, Homo sapiens
ctcaatctgttgcca

SEQ ID NO: 211720 - DNA, 15 bp, Homo sapiens
tctcaatctgttgcc

SEQ ID NO: 211721 - DNA, 15 bp, Homo sapiens
gtctcaatctgttgc

SEQ ID NO: 211722 - DNA, 15 bp, Homo sapiens
agtctcaatctgttg

SEQ ID NO: 211723 - DNA, 15 bp, Homo sapiens
gagtctcaatctgtt

SEQ ID NO: 211724 - DNA, 15 bp, Homo sapiens
ggagtctcaatctgt

SEQ ID NO: 211725 - DNA, 15 bp, Homo sapiens
gggagtctcaatctg

SEQ ID NO: 211726 - DNA, 15 bp, Homo sapiens
cgggagtctcaatct

SEQ ID NO: 211727 - DNA, 15 bp, Homo sapiens
acgggagtctcaatc

SEQ ID NO: 211728 - DNA, 15 bp, Homo sapiens
gacgggagtctcaat

SEQ ID NO: 211729 - DNA, 15 bp, Homo sapiens
agacgggagtctcaa

SEQ ID NO: 211730 - DNA, 15 bp, Homo sapiens
gagacgggagtctca

SEQ ID NO: 211731 - DNA, 15 bp, Homo sapiens
tgagacgggagtctc

SEQ ID NO: 211732 - DNA, 15 bp, Homo sapiens
ttgagacgggagtct

SEQ ID NO: 211733 - DNA, 15 bp, Homo sapiens
tttgagacgggagtc

SEQ ID NO: 211734 - DNA, 15 bp, Homo sapiens
ttttgagacgggagt

SEQ ID NO: 211735 - DNA, 15 bp, Homo sapiens
gttttgagacgggag

SEQ ID NO: 211736 - DNA, 15 bp, Homo sapiens
tgttttgagacggga

SEQ ID NO: 211737 - DNA, 15 bp, Homo sapiens
ttgttttgagacggg

SEQ ID NO: 211738 - DNA, 15 bp, Homo sapiens
tttgttttgagacgg

SEQ ID NO: 211739 - DNA, 15 bp, Homo sapiens
gtttgttttgagacg

SEQ ID NO: 211740 - DNA, 15 bp, Homo sapiens
tgtttgttttgagac

SEQ ID NO: 211741 - DNA, 15 bp, Homo sapiens
ttgtttgttttgaga

SEQ ID NO: 211742 - DNA, 15 bp, Homo sapiens
tttgtttgttttgag

SEQ ID NO: 211743 - DNA, 15 bp, Homo sapiens
gtttgtttgttttga

SEQ ID NO: 211744 - DNA, 15 bp, Homo sapiens
tgtttgtttgttttg

SEQ ID NO: 211745 - DNA, 15 bp, Homo sapiens
ttttttttgtttgtt

SEQ ID NO: 211746 - DNA, 15 bp, Homo sapiens
tttttttttgtttgt

SEQ ID NO: 211747 - DNA, 15 bp, Homo sapiens
ttttttttttgtttg

SEQ ID NO: 211748 - DNA, 15 bp, Homo sapiens
tttttttttttgttt

SEQ ID NO: 211749 - DNA, 15 bp, Homo sapiens
ttttttttttttgtt

SEQ ID NO: 211750 - DNA, 15 bp, Homo sapiens
cttttttttttttgt

SEQ ID NO: 211751 - DNA, 15 bp, Homo sapiens
gcttttttttttttg

SEQ ID NO: 211752 - DNA, 15 bp, Homo sapiens
ctgcttttttttttt

SEQ ID NO: 211753 - DNA, 15 bp, Homo sapiens
gctgctttttttttt

SEQ ID NO: 211754 - DNA, 15 bp, Homo sapiens
agctgcttttttttt

SEQ ID NO: 211755 - DNA, 15 bp, Homo sapiens
aagctgctttttttt

SEQ ID NO: 211756 - DNA, 15 bp, Homo sapiens
taagctgcttttttt

SEQ ID NO: 211757 - DNA, 15 bp, Homo sapiens
gtaagctgctttttt

SEQ ID NO: 211758 - DNA, 15 bp, Homo sapiens
agtaagctgcttttt

SEQ ID NO: 211759 - DNA, 15 bp, Homo sapiens
tagtaagctgctttt

SEQ ID NO: 211760 - DNA, 15 bp, Homo sapiens
ttagtaagctgcttt

SEQ ID NO: 211761 - DNA, 15 bp, Homo sapiens
attagtaagctgctt

SEQ ID NO: 211762 - DNA, 15 bp, Homo sapiens
tattagtaagctgct

SEQ ID NO: 211763 - DNA, 15 bp, Homo sapiens
ttattagtaagctgc

SEQ ID NO: 211764 - DNA, 15 bp, Homo sapiens
tttattagtaagctg

SEQ ID NO: 211765 - DNA, 15 bp, Homo sapiens
atttattagtaagct

SEQ ID NO: 211766 - DNA, 15 bp, Homo sapiens
tatttattagtaagc

SEQ ID NO: 211767 - DNA, 15 bp, Homo sapiens
ttatttattagtaag

SEQ ID NO: 211768 - DNA, 15 bp, Homo sapiens
attatttattagtaa

SEQ ID NO: 211769 - DNA, 15 bp, Homo sapiens
tattatttattagta

SEQ ID NO: 211770 - DNA, 15 bp, Homo sapiens
ttattatttattagt

SEQ ID NO: 211771 - DNA, 15 bp, Homo sapiens
tttattatttattag

SEQ ID NO: 211772 - DNA, 15 bp, Homo sapiens
ttttattatttatta

SEQ ID NO: 211773 - DNA, 15 bp, Homo sapiens
tattttattatttat

SEQ ID NO: 211774 - DNA, 15 bp, Homo sapiens
ttattttattattta

SEQ ID NO: 211775 - DNA, 15 bp, Homo sapiens
tttattttattattt

SEQ ID NO: 211776 - DNA, 15 bp, Homo sapiens
atttattttattatt

SEQ ID NO: 211777 - DNA, 15 bp, Homo sapiens
catttattttattat

SEQ ID NO: 211778 - DNA, 15 bp, Homo sapiens
ccatttattttatta

SEQ ID NO: 211779 - DNA, 15 bp, Homo sapiens
cccatttattttatt

SEQ ID NO: 211780 - DNA, 15 bp, Homo sapiens
acccatttattttat

SEQ ID NO: 211781 - DNA, 15 bp, Homo sapiens
tacccatttatttta

SEQ ID NO: 211782 - DNA, 15 bp, Homo sapiens
ttacccatttatttt

SEQ ID NO: 211783 - DNA, 15 bp, Homo sapiens
tttacccatttattt

SEQ ID NO: 211784 - DNA, 15 bp, Homo sapiens
ctttacccatttatt

SEQ ID NO: 211785 - DNA, 15 bp, Homo sapiens
actttacccatttat

SEQ ID NO: 211786 - DNA, 15 bp, Homo sapiens
aactttacccattta

SEQ ID NO: 211787 - DNA, 15 bp, Homo sapiens
caactttacccattt

SEQ ID NO: 211788 - DNA, 15 bp, Homo sapiens
tcaactttacccatt

SEQ ID NO: 211789 - DNA, 15 bp, Homo sapiens
ttcaactttacccat

SEQ ID NO: 211790 - DNA, 15 bp, Homo sapiens
attcaactttaccca

SEQ ID NO: 211791 - DNA, 15 bp, Homo sapiens
gattcaactttaccc

SEQ ID NO: 211792 - DNA, 15 bp, Homo sapiens
agattcaactttacc

SEQ ID NO: 211793 - DNA, 15 bp, Homo sapiens
aagattcaactttac

SEQ ID NO: 211794 - DNA, 15 bp, Homo sapiens
gaagattcaacttta

SEQ ID NO: 211795 - DNA, 15 bp, Homo sapiens
ggaagattcaacttt

SEQ ID NO: 211796 - DNA, 15 bp, Homo sapiens
gggaagattcaactt

SEQ ID NO: 211797 - DNA, 15 bp, Homo sapiens
tgggaagattcaact

SEQ ID NO: 211798 - DNA, 15 bp, Homo sapiens
atgggaagattcaac

SEQ ID NO: 211799 - DNA, 15 bp, Homo sapiens
gatgggaagattcaa

SEQ ID NO: 211800 - DNA, 15 bp, Homo sapiens
agatgggaagattca

SEQ ID NO: 211801 - DNA, 15 bp, Homo sapiens
tagatgggaagattc

SEQ ID NO: 211802 - DNA, 15 bp, Homo sapiens
ttagatgggaagatt

SEQ ID NO: 211803 - DNA, 15 bp, Homo sapiens
attagatgggaagat

SEQ ID NO: 211804 - DNA, 15 bp, Homo sapiens
cattagatgggaaga

SEQ ID NO: 211805 - DNA, 15 bp, Homo sapiens
tcattagatgggaag

SEQ ID NO: 211806 - DNA, 15 bp, Homo sapiens
gtcattagatgggaa

SEQ ID NO: 211807 - DNA, 15 bp, Homo sapiens
agtcattagatggga

SEQ ID NO: 211808 - DNA, 15 bp, Homo sapiens
aagtcattagatggg

SEQ ID NO: 211809 - DNA, 15 bp, Homo sapiens
gaagtcattagatgg

SEQ ID NO: 211810 - DNA, 15 bp, Homo sapiens
tgaagtcattagatg

SEQ ID NO: 211811 - DNA, 15 bp, Homo sapiens
ttgaagtcattagat

SEQ ID NO: 211812 - DNA, 15 bp, Homo sapiens
attgaagtcattaga

SEQ ID NO: 211813 - DNA, 15 bp, Homo sapiens
gattgaagtcattag

SEQ ID NO: 211814 - DNA, 15 bp, Homo sapiens
cgattgaagtcatta

SEQ ID NO: 211815 - DNA, 15 bp, Homo sapiens
tcgattgaagtcatt

SEQ ID NO: 211816 - DNA, 15 bp, Homo sapiens
ttcgattgaagtcat

SEQ ID NO: 211817 - DNA, 15 bp, Homo sapiens
attcgattgaagtca

SEQ ID NO: 211818 - DNA, 15 bp, Homo sapiens
aattcgattgaagtc

SEQ ID NO: 211819 - DNA, 15 bp, Homo sapiens
aaattcgattgaagt

SEQ ID NO: 211820 - DNA, 15 bp, Homo sapiens
aaaattcgattgaag

SEQ ID NO: 211821 - DNA, 15 bp, Homo sapiens
aaaaattcgattgaa

SEQ ID NO: 211822 - DNA, 15 bp, Homo sapiens
taaaaattcgattga

SEQ ID NO: 211823 - DNA, 15 bp, Homo sapiens
ctaaaaattcgattg

SEQ ID NO: 211824 - DNA, 15 bp, Homo sapiens
tctaaaaattcgatt

SEQ ID NO: 211825 - DNA, 15 bp, Homo sapiens
ttctaaaaattcgat

SEQ ID NO: 211826 - DNA, 15 bp, Homo sapiens
attctaaaaattcga

SEQ ID NO: 211827 - DNA, 15 bp, Homo sapiens
gattctaaaaattcg

SEQ ID NO: 211828 - DNA, 15 bp, Homo sapiens
tgattctaaaaattc

SEQ ID NO: 211829 - DNA, 15 bp, Homo sapiens
atgattctaaaaatt

SEQ ID NO: 211830 - DNA, 15 bp, Homo sapiens
aatgattctaaaaat

SEQ ID NO: 211831 - DNA, 15 bp, Homo sapiens
aaatgattctaaaaa

SEQ ID NO: 211832 - DNA, 15 bp, Homo sapiens
aaaatgattctaaaa

SEQ ID NO: 211833 - DNA, 15 bp, Homo sapiens
aaaaatgattctaaa

SEQ ID NO: 211834 - DNA, 15 bp, Homo sapiens
caaaaatgattctaa

SEQ ID NO: 211835 - DNA, 15 bp, Homo sapiens
tcaaaaatgattcta

SEQ ID NO: 211836 - DNA, 15 bp, Homo sapiens
ttcaaaaatgattct

SEQ ID NO: 211837 - DNA, 15 bp, Homo sapiens
cttcaaaaatgattc

SEQ ID NO: 211838 - DNA, 15 bp, Homo sapiens
acttcaaaaatgatt

SEQ ID NO: 211839 - DNA, 15 bp, Homo sapiens
aacttcaaaaatgat

SEQ ID NO: 211840 - DNA, 15 bp, Homo sapiens
aaacttcaaaaatga

SEQ ID NO: 211841 - DNA, 15 bp, Homo sapiens
aaaacttcaaaaatg

SEQ ID NO: 211842 - DNA, 15 bp, Homo sapiens
caaaacttcaaaaat

SEQ ID NO: 211843 - DNA, 15 bp, Homo sapiens
tcaaaacttcaaaaa

SEQ ID NO: 211844 - DNA, 15 bp, Homo sapiens
ttcaaaacttcaaaa

SEQ ID NO: 211845 - DNA, 15 bp, Homo sapiens
cttcaaaacttcaaa

SEQ ID NO: 211846 - DNA, 15 bp, Homo sapiens
tcttcaaaacttcaa

SEQ ID NO: 211847 - DNA, 15 bp, Homo sapiens
ttcttcaaaacttca

SEQ ID NO: 211848 - DNA, 15 bp, Homo sapiens
cttcttcaaaacttc

SEQ ID NO: 211849 - DNA, 15 bp, Homo sapiens
gcttcttcaaaactt

SEQ ID NO: 211850 - DNA, 15 bp, Homo sapiens
agcttcttcaaaact

SEQ ID NO: 211851 - DNA, 15 bp, Homo sapiens
cagcttcttcaaaac

SEQ ID NO: 211852 - DNA, 15 bp, Homo sapiens
tcagcttcttcaaaa

SEQ ID NO: 211853 - DNA, 15 bp, Homo sapiens
ctcagcttcttcaaa

SEQ ID NO: 211854 - DNA, 15 bp, Homo sapiens
cctcagcttcttcaa

SEQ ID NO: 211855 - DNA, 15 bp, Homo sapiens
acctcagcttcttca

SEQ ID NO: 211856 - DNA, 15 bp, Homo sapiens
gacctcagcttcttc

SEQ ID NO: 211857 - DNA, 15 bp, Homo sapiens
tgacctcagcttctt

SEQ ID NO: 211858 - DNA, 15 bp, Homo sapiens
gtgacctcagcttct

SEQ ID NO: 211859 - DNA, 15 bp, Homo sapiens
agtgacctcagcttc

SEQ ID NO: 211860 - DNA, 15 bp, Homo sapiens
aagtgacctcagctt

SEQ ID NO: 211861 - DNA, 15 bp, Homo sapiens
taagtgacctcagct

SEQ ID NO: 211862 - DNA, 15 bp, Homo sapiens
ataagtgacctcagc

SEQ ID NO: 211863 - DNA, 15 bp, Homo sapiens
tataagtgacctcag

SEQ ID NO: 211864 - DNA, 15 bp, Homo sapiens
atataagtgacctca

SEQ ID NO: 211865 - DNA, 15 bp, Homo sapiens
catataagtgacctc

SEQ ID NO: 211866 - DNA, 15 bp, Homo sapiens
gcatataagtgacct

SEQ ID NO: 211867 - DNA, 15 bp, Homo sapiens
tgcatataagtgacc

SEQ ID NO: 211868 - DNA, 15 bp, Homo sapiens
ttgcatataagtgac

SEQ ID NO: 211869 - DNA, 15 bp, Homo sapiens
gttgcatataagtga

SEQ ID NO: 211870 - DNA, 15 bp, Homo sapiens
agttgcatataagtg

SEQ ID NO: 211871 - DNA, 15 bp, Homo sapiens
aagttgcatataagt

SEQ ID NO: 211872 - DNA, 15 bp, Homo sapiens
gaagttgcatataag

SEQ ID NO: 211873 - DNA, 15 bp, Homo sapiens
ggaagttgcatataa

SEQ ID NO: 211874 - DNA, 15 bp, Homo sapiens
gggaagttgcatata

SEQ ID NO: 211875 - DNA, 15 bp, Homo sapiens
agggaagttgcatat

SEQ ID NO: 211876 - DNA, 15 bp, Homo sapiens
aagggaagttgcata

SEQ ID NO: 211877 - DNA, 15 bp, Homo sapiens
aaagggaagttgcat

SEQ ID NO: 211878 - DNA, 15 bp, Homo sapiens
gaaagggaagttgca

SEQ ID NO: 211879 - DNA, 15 bp, Homo sapiens
tgaaagggaagttgc

SEQ ID NO: 211880 - DNA, 15 bp, Homo sapiens
ttgaaagggaagttg

SEQ ID NO: 211881 - DNA, 15 bp, Homo sapiens
cttgaaagggaagtt

SEQ ID NO: 211882 - DNA, 15 bp, Homo sapiens
tcttgaaagggaagt

SEQ ID NO: 211883 - DNA, 15 bp, Homo sapiens
ttcttgaaagggaag

SEQ ID NO: 211884 - DNA, 15 bp, Homo sapiens
attcttgaaagggaa

SEQ ID NO: 211885 - DNA, 15 bp, Homo sapiens
cattcttgaaaggga

SEQ ID NO: 211886 - DNA, 15 bp, Homo sapiens
acattcttgaaaggg

SEQ ID NO: 211887 - DNA, 15 bp, Homo sapiens
cacattcttgaaagg

SEQ ID NO: 211888 - DNA, 15 bp, Homo sapiens
tcacattcttgaaag

SEQ ID NO: 211889 - DNA, 15 bp, Homo sapiens
ctcacattcttgaaa

SEQ ID NO: 211890 - DNA, 15 bp, Homo sapiens
gctcacattcttgaa

SEQ ID NO: 211891 - DNA, 15 bp, Homo sapiens
agctcacattcttga

SEQ ID NO: 211892 - DNA, 15 bp, Homo sapiens
aagctcacattcttg

SEQ ID NO: 211893 - DNA, 15 bp, Homo sapiens
taagctcacattctt

SEQ ID NO: 211894 - DNA, 15 bp, Homo sapiens
ataagctcacattct

SEQ ID NO: 211895 - DNA, 15 bp, Homo sapiens
gataagctcacattc

SEQ ID NO: 211896 - DNA, 15 bp, Homo sapiens
tgataagctcacatt

SEQ ID NO: 211897 - DNA, 15 bp, Homo sapiens
atgataagctcacat

SEQ ID NO: 211898 - DNA, 15 bp, Homo sapiens
aatgataagctcaca

SEQ ID NO: 211899 - DNA, 15 bp, Homo sapiens
gaatgataagctcac

SEQ ID NO: 211900 - DNA, 15 bp, Homo sapiens
tgaatgataagctca

SEQ ID NO: 211901 - DNA, 15 bp, Homo sapiens
ctgaatgataagctc

SEQ ID NO: 211902 - DNA, 15 bp, Homo sapiens
actgaatgataagct

SEQ ID NO: 211903 - DNA, 15 bp, Homo sapiens
gactgaatgataagc

SEQ ID NO: 211904 - DNA, 15 bp, Homo sapiens
tgactgaatgataag

SEQ ID NO: 211905 - DNA, 15 bp, Homo sapiens
ttgactgaatgataa

SEQ ID NO: 211906 - DNA, 15 bp, Homo sapiens
gttgactgaatgata

SEQ ID NO: 211907 - DNA, 15 bp, Homo sapiens
tgttgactgaatgat

SEQ ID NO: 211908 - DNA, 15 bp, Homo sapiens
ttgttgactgaatga

SEQ ID NO: 211909 - DNA, 15 bp, Homo sapiens
attgttgactgaatg

SEQ ID NO: 211910 - DNA, 15 bp, Homo sapiens
aattgttgactgaat

SEQ ID NO: 211911 - DNA, 15 bp, Homo sapiens
taattgttgactgaa

SEQ ID NO: 211912 - DNA, 15 bp, Homo sapiens
gtaattgttgactga

SEQ ID NO: 211913 - DNA, 15 bp, Homo sapiens
ggtaattgttgactg

SEQ ID NO: 211914 - DNA, 15 bp, Homo sapiens
aggtaattgttgact

SEQ ID NO: 211915 - DNA, 15 bp, Homo sapiens
taggtaattgttgac

SEQ ID NO: 211916 - DNA, 15 bp, Homo sapiens
ataggtaattgttga

SEQ ID NO: 211917 - DNA, 15 bp, Homo sapiens
tataggtaattgttg

SEQ ID NO: 211918 - DNA, 15 bp, Homo sapiens
ttataggtaattgtt

SEQ ID NO: 211919 - DNA, 15 bp, Homo sapiens
attataggtaattgt

SEQ ID NO: 211920 - DNA, 15 bp, Homo sapiens
cattataggtaattg

SEQ ID NO: 211921 - DNA, 15 bp, Homo sapiens
gcattataggtaatt

SEQ ID NO: 211922 - DNA, 15 bp, Homo sapiens
tgcattataggtaat

SEQ ID NO: 211923 - DNA, 15 bp, Homo sapiens
gtgcattataggtaa

SEQ ID NO: 211924 - DNA, 15 bp, Homo sapiens
ggtgcattataggta

SEQ ID NO: 211925 - DNA, 15 bp, Homo sapiens
aggtgcattataggt

SEQ ID NO: 211926 - DNA, 15 bp, Homo sapiens
taggtgcattatagg

SEQ ID NO: 211927 - DNA, 15 bp, Homo sapiens
gtaggtgcattatag

SEQ ID NO: 211928 - DNA, 15 bp, Homo sapiens
tgtaggtgcattata

SEQ ID NO: 211929 - DNA, 15 bp, Homo sapiens
ttgtaggtgcattat

SEQ ID NO: 211930 - DNA, 15 bp, Homo sapiens
attgtaggtgcatta

SEQ ID NO: 211931 - DNA, 15 bp, Homo sapiens
cattgtaggtgcatt

SEQ ID NO: 211932 - DNA, 15 bp, Homo sapiens
acattgtaggtgcat

SEQ ID NO: 211933 - DNA, 15 bp, Homo sapiens
tacattgtaggtgca

SEQ ID NO: 211934 - DNA, 15 bp, Homo sapiens
atacattgtaggtgc

SEQ ID NO: 211935 - DNA, 15 bp, Homo sapiens
tatacattgtaggtg

SEQ ID NO: 211936 - DNA, 15 bp, Homo sapiens
atatacattgtaggt

SEQ ID NO: 211937 - DNA, 15 bp, Homo sapiens
tatatacattgtagg

SEQ ID NO: 211938 - DNA, 15 bp, Homo sapiens
ctatatacattgtag

SEQ ID NO: 211939 - DNA, 15 bp, Homo sapiens
actatatacattgta

SEQ ID NO: 211940 - DNA, 15 bp, Homo sapiens
cactatatacattgt

SEQ ID NO: 211941 - DNA, 15 bp, Homo sapiens
acactatatacattg

SEQ ID NO: 211942 - DNA, 15 bp, Homo sapiens
aacactatatacatt

SEQ ID NO: 211943 - DNA, 15 bp, Homo sapiens
aaacactatatacat

SEQ ID NO: 211944 - DNA, 15 bp, Homo sapiens
caaacactatataca

SEQ ID NO: 211945 - DNA, 15 bp, Homo sapiens
acaaacactatatac

SEQ ID NO: 211946 - DNA, 15 bp, Homo sapiens
tacaaacactatata

SEQ ID NO: 211947 - DNA, 15 bp, Homo sapiens
ttacaaacactatat

SEQ ID NO: 211948 - DNA, 15 bp, Homo sapiens
attacaaacactata

SEQ ID NO: 211949 - DNA, 15 bp, Homo sapiens
cattacaaacactat

SEQ ID NO: 211950 - DNA, 15 bp, Homo sapiens
acattacaaacacta

SEQ ID NO: 211951 - DNA, 15 bp, Homo sapiens
aacattacaaacact

SEQ ID NO: 211952 - DNA, 15 bp, Homo sapiens
taacattacaaacac

SEQ ID NO: 211953 - DNA, 15 bp, Homo sapiens
ataacattacaaaca

SEQ ID NO: 211954 - DNA, 15 bp, Homo sapiens
cataacattacaaac

SEQ ID NO: 211955 - DNA, 15 bp, Homo sapiens
ccataacattacaaa

SEQ ID NO: 211956 - DNA, 15 bp, Homo sapiens
tccataacattacaa

SEQ ID NO: 211957 - DNA, 15 bp, Homo sapiens
atccataacattaca

SEQ ID NO: 211958 - DNA, 15 bp, Homo sapiens
aatccataacattac

SEQ ID NO: 211959 - DNA, 15 bp, Homo sapiens
aaatccataacatta

SEQ ID NO: 211960 - DNA, 15 bp, Homo sapiens
taaatccataacatt

SEQ ID NO: 211961 - DNA, 15 bp, Homo sapiens
gtaaatccataacat

SEQ ID NO: 211962 - DNA, 15 bp, Homo sapiens
agtaaatccataaca

SEQ ID NO: 211963 - DNA, 15 bp, Homo sapiens
gagtaaatccataac

SEQ ID NO: 211964 - DNA, 15 bp, Homo sapiens
agagtaaatccataa

SEQ ID NO: 211965 - DNA, 15 bp, Homo sapiens
tagagtaaatccata

SEQ ID NO: 211966 - DNA, 15 bp, Homo sapiens
ttagagtaaatccat

SEQ ID NO: 211967 - DNA, 15 bp, Homo sapiens
gttagagtaaatcca

SEQ ID NO: 211968 - DNA, 15 bp, Homo sapiens
ggttagagtaaatcc

SEQ ID NO: 211969 - DNA, 15 bp, Homo sapiens
tggttagagtaaatc

SEQ ID NO: 211970 - DNA, 15 bp, Homo sapiens
ttggttagagtaaat

SEQ ID NO: 211971 - DNA, 15 bp, Homo sapiens
tttggttagagtaaa

SEQ ID NO: 211972 - DNA, 15 bp, Homo sapiens
atttggttagagtaa

SEQ ID NO: 211973 - DNA, 15 bp, Homo sapiens
catttggttagagta

SEQ ID NO: 211974 - DNA, 15 bp, Homo sapiens
gcatttggttagagt

SEQ ID NO: 211975 - DNA, 15 bp, Homo sapiens
agcatttggttagag

SEQ ID NO: 211976 - DNA, 15 bp, Homo sapiens
gagcatttggttaga

SEQ ID NO: 211977 - DNA, 15 bp, Homo sapiens
agagcatttggttag

SEQ ID NO: 211978 - DNA, 15 bp, Homo sapiens
aagagcatttggtta

SEQ ID NO: 211979 - DNA, 15 bp, Homo sapiens
caagagcatttggtt

SEQ ID NO: 211980 - DNA, 15 bp, Homo sapiens
tcaagagcatttggt

SEQ ID NO: 211981 - DNA, 15 bp, Homo sapiens
ctcaagagcatttgg

SEQ ID NO: 211982 - DNA, 15 bp, Homo sapiens
actcaagagcatttg

SEQ ID NO: 211983 - DNA, 15 bp, Homo sapiens
cactcaagagcattt

SEQ ID NO: 211984 - DNA, 15 bp, Homo sapiens
ccactcaagagcatt

SEQ ID NO: 211985 - DNA, 15 bp, Homo sapiens
tccactcaagagcat

SEQ ID NO: 211986 - DNA, 15 bp, Homo sapiens
atccactcaagagca

SEQ ID NO: 211987 - DNA, 15 bp, Homo sapiens
tatccactcaagagc

SEQ ID NO: 211988 - DNA, 15 bp, Homo sapiens
ttatccactcaagag

SEQ ID NO: 211989 - DNA, 15 bp, Homo sapiens
tttatccactcaaga

SEQ ID NO: 211990 - DNA, 15 bp, Homo sapiens
ttttatccactcaag

SEQ ID NO: 211991 - DNA, 15 bp, Homo sapiens
attttatccactcaa

SEQ ID NO: 211992 - DNA, 15 bp, Homo sapiens
aattttatccactca

SEQ ID NO: 211993 - DNA, 15 bp, Homo sapiens
caattttatccactc

SEQ ID NO: 211994 - DNA, 15 bp, Homo sapiens
gcaattttatccact

SEQ ID NO: 211995 - DNA, 15 bp, Homo sapiens
tgcaattttatccac

SEQ ID NO: 211996 - DNA, 15 bp, Homo sapiens
ctgcaattttatcca

SEQ ID NO: 211997 - DNA, 15 bp, Homo sapiens
tctgcaattttatcc

SEQ ID NO: 211998 - DNA, 15 bp, Homo sapiens
atctgcaattttatc

SEQ ID NO: 211999 - DNA, 15 bp, Homo sapiens
catctgcaattttat

SEQ ID NO: 212000 - DNA, 15 bp, Homo sapiens
gcatctgcaatttta

SEQ ID NO: 212001 - DNA, 15 bp, Homo sapiens
tgcatctgcaatttt

SEQ ID NO: 212002 - DNA, 15 bp, Homo sapiens
ctgcatctgcaattt

SEQ ID NO: 212003 - DNA, 15 bp, Homo sapiens
tctgcatctgcaatt

SEQ ID NO: 212004 - DNA, 15 bp, Homo sapiens
atctgcatctgcaat

SEQ ID NO: 212005 - DNA, 15 bp, Homo sapiens
aatctgcatctgcaa

SEQ ID NO: 212006 - DNA, 15 bp, Homo sapiens
aaatctgcatctgca

SEQ ID NO: 212007 - DNA, 15 bp, Homo sapiens
aaaatctgcatctgc

SEQ ID NO: 212008 - DNA, 15 bp, Homo sapiens
taaaatctgcatctg

SEQ ID NO: 212009 - DNA, 15 bp, Homo sapiens
gtaaaatctgcatct

SEQ ID NO: 212010 - DNA, 15 bp, Homo sapiens
agtaaaatctgcatc

SEQ ID NO: 212011 - DNA, 15 bp, Homo sapiens
cagtaaaatctgcat

SEQ ID NO: 212012 - DNA, 15 bp, Homo sapiens
acagtaaaatctgca

SEQ ID NO: 212013 - DNA, 15 bp, Homo sapiens
tacagtaaaatctgc

SEQ ID NO: 212014 - DNA, 15 bp, Homo sapiens
gtacagtaaaatctg

SEQ ID NO: 212015 - DNA, 15 bp, Homo sapiens
tgtacagtaaaatct

SEQ ID NO: 212016 - DNA, 15 bp, Homo sapiens
ttgtacagtaaaatc

SEQ ID NO: 212017 - DNA, 15 bp, Homo sapiens
attgtacagtaaaat

SEQ ID NO: 212018 - DNA, 15 bp, Homo sapiens
aattgtacagtaaaa

SEQ ID NO: 212019 - DNA, 15 bp, Homo sapiens
aaattgtacagtaaa

SEQ ID NO: 212020 - DNA, 15 bp, Homo sapiens
caaattgtacagtaa

SEQ ID NO: 212021 - DNA, 15 bp, Homo sapiens
gcaaattgtacagta

SEQ ID NO: 212022 - DNA, 15 bp, Homo sapiens
tgcaaattgtacagt

SEQ ID NO: 212023 - DNA, 15 bp, Homo sapiens
gtgcaaattgtacag

SEQ ID NO: 212024 - DNA, 15 bp, Homo sapiens
agtgcaaattgtaca

SEQ ID NO: 212025 - DNA, 15 bp, Homo sapiens
aagtgcaaattgtac

SEQ ID NO: 212026 - DNA, 15 bp, Homo sapiens
gaagtgcaaattgta

SEQ ID NO: 212027 - DNA, 15 bp, Homo sapiens
tgaagtgcaaattgt

SEQ ID NO: 212028 - DNA, 15 bp, Homo sapiens
atgaagtgcaaattg

SEQ ID NO: 212029 - DNA, 15 bp, Homo sapiens
aatgaagtgcaaatt

SEQ ID NO: 212030 - DNA, 15 bp, Homo sapiens
aaatgaagtgcaaat

SEQ ID NO: 212031 - DNA, 15 bp, Homo sapiens
aaaatgaagtgcaaa

SEQ ID NO: 212032 - DNA, 15 bp, Homo sapiens
gaaaatgaagtgcaa

SEQ ID NO: 212033 - DNA, 15 bp, Homo sapiens
tgaaaatgaagtgca

SEQ ID NO: 212034 - DNA, 15 bp, Homo sapiens
atgaaaatgaagtgc

SEQ ID NO: 212035 - DNA, 15 bp, Homo sapiens
tatgaaaatgaagtg

SEQ ID NO: 212036 - DNA, 15 bp, Homo sapiens
ttatgaaaatgaagt

SEQ ID NO: 212037 - DNA, 15 bp, Homo sapiens
gttatgaaaatgaag

SEQ ID NO: 212038 - DNA, 15 bp, Homo sapiens
tgttatgaaaatgaa

SEQ ID NO: 212039 - DNA, 15 bp, Homo sapiens
ttgttatgaaaatga

SEQ ID NO: 212040 - DNA, 15 bp, Homo sapiens
attgttatgaaaatg

SEQ ID NO: 212041 - DNA, 15 bp, Homo sapiens
cattgttatgaaaat

SEQ ID NO: 212042 - DNA, 15 bp, Homo sapiens
acattgttatgaaaa

SEQ ID NO: 212043 - DNA, 15 bp, Homo sapiens
tacattgttatgaaa

SEQ ID NO: 212044 - DNA, 15 bp, Homo sapiens
ttacattgttatgaa

SEQ ID NO: 212045 - DNA, 15 bp, Homo sapiens
tttacattgttatga

SEQ ID NO: 212046 - DNA, 15 bp, Homo sapiens
atttacattgttatg

SEQ ID NO: 212047 - DNA, 15 bp, Homo sapiens
tatttacattgttat

SEQ ID NO: 212048 - DNA, 15 bp, Homo sapiens
atatttacattgtta

SEQ ID NO: 212049 - DNA, 15 bp, Homo sapiens
aatatttacattgtt

SEQ ID NO: 212050 - DNA, 15 bp, Homo sapiens
taatatttacattgt

SEQ ID NO: 212051 - DNA, 15 bp, Homo sapiens
ttaatatttacattg

SEQ ID NO: 212052 - DNA, 15 bp, Homo sapiens
cttaatatttacatt

SEQ ID NO: 212053 - DNA, 15 bp, Homo sapiens
acttaatatttacat

SEQ ID NO: 212054 - DNA, 15 bp, Homo sapiens
aacttaatatttaca

SEQ ID NO: 212055 - DNA, 15 bp, Homo sapiens
taacttaatatttac

SEQ ID NO: 212056 - DNA, 15 bp, Homo sapiens
ataacttaatattta

SEQ ID NO: 212057 - DNA, 15 bp, Homo sapiens
cataacttaatattt

SEQ ID NO: 212058 - DNA, 15 bp, Homo sapiens
acataacttaatatt

SEQ ID NO: 212059 - DNA, 15 bp, Homo sapiens
tacataacttaatat

SEQ ID NO: 212060 - DNA, 15 bp, Homo sapiens
ctacataacttaata

SEQ ID NO: 212061 - DNA, 15 bp, Homo sapiens
cctacataacttaat

SEQ ID NO: 212062 - DNA, 15 bp, Homo sapiens
tcctacataacttaa

SEQ ID NO: 212063 - DNA, 15 bp, Homo sapiens
ctcctacataactta

SEQ ID NO: 212064 - DNA, 15 bp, Homo sapiens
gctcctacataactt

SEQ ID NO: 212065 - DNA, 15 bp, Homo sapiens
tgctcctacataact

SEQ ID NO: 212066 - DNA, 15 bp, Homo sapiens
ttgctcctacataac

SEQ ID NO: 212067 - DNA, 15 bp, Homo sapiens
attgctcctacataa

SEQ ID NO: 212068 - DNA, 15 bp, Homo sapiens
aattgctcctacata

SEQ ID NO: 212069 - DNA, 15 bp, Homo sapiens
taattgctcctacat

SEQ ID NO: 212070 - DNA, 15 bp, Homo sapiens
ataattgctcctaca

SEQ ID NO: 212071 - DNA, 15 bp, Homo sapiens
gataattgctcctac

SEQ ID NO: 212072 - DNA, 15 bp, Homo sapiens
tgataattgctccta

SEQ ID NO: 212073 - DNA, 15 bp, Homo sapiens
ctgataattgctcct

SEQ ID NO: 212074 - DNA, 15 bp, Homo sapiens
tctgataattgctcc

SEQ ID NO: 212075 - DNA, 15 bp, Homo sapiens
ctctgataattgctc

SEQ ID NO: 212076 - DNA, 15 bp, Homo sapiens
gctctgataattgct

SEQ ID NO: 212077 - DNA, 15 bp, Homo sapiens
agctctgataattgc

SEQ ID NO: 212078 - DNA, 15 bp, Homo sapiens
gagctctgataattg

SEQ ID NO: 212079 - DNA, 15 bp, Homo sapiens
agagctctgataatt

SEQ ID NO: 212080 - DNA, 15 bp, Homo sapiens
tagagctctgataat

SEQ ID NO: 212081 - DNA, 15 bp, Homo sapiens
ttagagctctgataa

SEQ ID NO: 212082 - DNA, 15 bp, Homo sapiens
attagagctctgata

SEQ ID NO: 212083 - DNA, 15 bp, Homo sapiens
tattagagctctgat

SEQ ID NO: 212084 - DNA, 15 bp, Homo sapiens
gtattagagctctga

SEQ ID NO: 212085 - DNA, 15 bp, Homo sapiens
ggtattagagctctg

SEQ ID NO: 212086 - DNA, 15 bp, Homo sapiens
gggtattagagctct

SEQ ID NO: 212087 - DNA, 15 bp, Homo sapiens
agggtattagagctc

SEQ ID NO: 212088 - DNA, 15 bp, Homo sapiens
aagggtattagagct

SEQ ID NO: 212089 - DNA, 15 bp, Homo sapiens
aaagggtattagagc

SEQ ID NO: 212090 - DNA, 15 bp, Homo sapiens
gaaagggtattagag

SEQ ID NO: 212091 - DNA, 15 bp, Homo sapiens
agaaagggtattaga

SEQ ID NO: 212092 - DNA, 15 bp, Homo sapiens
gagaaagggtattag

SEQ ID NO: 212093 - DNA, 15 bp, Homo sapiens
ggagaaagggtatta

SEQ ID NO: 212094 - DNA, 15 bp, Homo sapiens
tggagaaagggtatt

SEQ ID NO: 212095 - DNA, 15 bp, Homo sapiens
ttggagaaagggtat

SEQ ID NO: 212096 - DNA, 15 bp, Homo sapiens
attggagaaagggta

SEQ ID NO: 212097 - DNA, 15 bp, Homo sapiens
tattggagaaagggt

SEQ ID NO: 212098 - DNA, 15 bp, Homo sapiens
ctattggagaaaggg

SEQ ID NO: 212099 - DNA, 15 bp, Homo sapiens
tctattggagaaagg

SEQ ID NO: 212100 - DNA, 15 bp, Homo sapiens
ttctattggagaaag

SEQ ID NO: 212101 - DNA, 15 bp, Homo sapiens
attctattggagaaa

SEQ ID NO: 212102 - DNA, 15 bp, Homo sapiens
cattctattggagaa

SEQ ID NO: 212103 - DNA, 15 bp, Homo sapiens
gcattctattggaga

SEQ ID NO: 212104 - DNA, 15 bp, Homo sapiens
tgcattctattggag

SEQ ID NO: 212105 - DNA, 15 bp, Homo sapiens
atgcattctattgga

SEQ ID NO: 212106 - DNA, 15 bp, Homo sapiens
tatgcattctattgg

SEQ ID NO: 212107 - DNA, 15 bp, Homo sapiens
atatgcattctattg

SEQ ID NO: 212108 - DNA, 15 bp, Homo sapiens
aatatgcattctatt

SEQ ID NO: 212109 - DNA, 15 bp, Homo sapiens
aaatatgcattctat

SEQ ID NO: 212110 - DNA, 15 bp, Homo sapiens
caaatatgcattcta

SEQ ID NO: 212111 - DNA, 15 bp, Homo sapiens
tcaaatatgcattct

SEQ ID NO: 212112 - DNA, 15 bp, Homo sapiens
atcaaatatgcattc

SEQ ID NO: 212113 - DNA, 15 bp, Homo sapiens
catcaaatatgcatt

SEQ ID NO: 212114 - DNA, 15 bp, Homo sapiens
acatcaaatatgcat

SEQ ID NO: 212115 - DNA, 15 bp, Homo sapiens
aacatcaaatatgca

SEQ ID NO: 212116 - DNA, 15 bp, Homo sapiens
taacatcaaatatgc

SEQ ID NO: 212117 - DNA, 15 bp, Homo sapiens
ctaacatcaaatatg

SEQ ID NO: 212118 - DNA, 15 bp, Homo sapiens
tctaacatcaaatat

SEQ ID NO: 212119 - DNA, 15 bp, Homo sapiens
ttctaacatcaaata

SEQ ID NO: 212120 - DNA, 15 bp, Homo sapiens
tttctaacatcaaat

SEQ ID NO: 212121 - DNA, 15 bp, Homo sapiens
ttttctaacatcaaa

SEQ ID NO: 212122 - DNA, 15 bp, Homo sapiens
cttttctaacatcaa

SEQ ID NO: 212123 - DNA, 15 bp, Homo sapiens
gcttttctaacatca

SEQ ID NO: 212124 - DNA, 15 bp, Homo sapiens
tgcttttctaacatc

SEQ ID NO: 212125 - DNA, 15 bp, Homo sapiens
ttgcttttctaacat

SEQ ID NO: 212126 - DNA, 15 bp, Homo sapiens
tttgcttttctaaca

SEQ ID NO: 212127 - DNA, 15 bp, Homo sapiens
atttgcttttctaac

SEQ ID NO: 212128 - DNA, 15 bp, Homo sapiens
gatttgcttttctaa

SEQ ID NO: 212129 - DNA, 15 bp, Homo sapiens
agatttgcttttcta

SEQ ID NO: 212130 - DNA, 15 bp, Homo sapiens
tagatttgcttttct

SEQ ID NO: 212131 - DNA, 15 bp, Homo sapiens
ctagatttgcttttc

SEQ ID NO: 212132 - DNA, 15 bp, Homo sapiens
tctagatttgctttt

SEQ ID NO: 212133 - DNA, 15 bp, Homo sapiens
ttctagatttgcttt

SEQ ID NO: 212134 - DNA, 15 bp, Homo sapiens
attctagatttgctt

SEQ ID NO: 212135 - DNA, 15 bp, Homo sapiens
tattctagatttgct

SEQ ID NO: 212136 - DNA, 15 bp, Homo sapiens
ttattctagatttgc

SEQ ID NO: 212137 - DNA, 15 bp, Homo sapiens
attattctagatttg

SEQ ID NO: 212138 - DNA, 15 bp, Homo sapiens
aattattctagattt

SEQ ID NO: 212139 - DNA, 15 bp, Homo sapiens
caattattctagatt

SEQ ID NO: 212140 - DNA, 15 bp, Homo sapiens
tcaattattctagat

SEQ ID NO: 212141 - DNA, 15 bp, Homo sapiens
ttcaattattctaga

SEQ ID NO: 212142 - DNA, 15 bp, Homo sapiens
tttcaattattctag

SEQ ID NO: 212143 - DNA, 15 bp, Homo sapiens
ctttcaattattcta

SEQ ID NO: 212144 - DNA, 15 bp, Homo sapiens
actttcaattattct

SEQ ID NO: 212145 - DNA, 15 bp, Homo sapiens
cactttcaattattc

SEQ ID NO: 212146 - DNA, 15 bp, Homo sapiens
gcactttcaattatt

SEQ ID NO: 212147 - DNA, 15 bp, Homo sapiens
tgcactttcaattat

SEQ ID NO: 212148 - DNA, 15 bp, Homo sapiens
atgcactttcaatta

SEQ ID NO: 212149 - DNA, 15 bp, Homo sapiens
catgcactttcaatt

SEQ ID NO: 212150 - DNA, 15 bp, Homo sapiens
tcatgcactttcaat

SEQ ID NO: 212151 - DNA, 15 bp, Homo sapiens
atcatgcactttcaa

SEQ ID NO: 212152 - DNA, 15 bp, Homo sapiens
aatcatgcactttca

SEQ ID NO: 212153 - DNA, 15 bp, Homo sapiens
gaatcatgcactttc

SEQ ID NO: 212154 - DNA, 15 bp, Homo sapiens
tgaatcatgcacttt

SEQ ID NO: 212155 - DNA, 15 bp, Homo sapiens
ctgaatcatgcactt

SEQ ID NO: 212156 - DNA, 15 bp, Homo sapiens
cctgaatcatgcact

SEQ ID NO: 212157 - DNA, 15 bp, Homo sapiens
acctgaatcatgcac

SEQ ID NO: 212158 - DNA, 15 bp, Homo sapiens
tacctgaatcatgca

SEQ ID NO: 212159 - DNA, 15 bp, Homo sapiens
atacctgaatcatgc

SEQ ID NO: 212160 - DNA, 15 bp, Homo sapiens
tatacctgaatcatg

SEQ ID NO: 212161 - DNA, 15 bp, Homo sapiens
ttatacctgaatcat

SEQ ID NO: 212162 - DNA, 15 bp, Homo sapiens
attatacctgaatca

SEQ ID NO: 212163 - DNA, 15 bp, Homo sapiens
aattatacctgaatc

SEQ ID NO: 212164 - DNA, 15 bp, Homo sapiens
aaattatacctgaat

SEQ ID NO: 212165 - DNA, 15 bp, Homo sapiens
gaaattatacctgaa

SEQ ID NO: 212166 - DNA, 15 bp, Homo sapiens
agaaattatacctga

SEQ ID NO: 212167 - DNA, 15 bp, Homo sapiens
aagaaattatacctg

SEQ ID NO: 212168 - DNA, 15 bp, Homo sapiens
caagaaattatacct

SEQ ID NO: 212169 - DNA, 15 bp, Homo sapiens
acaagaaattatacc

SEQ ID NO: 212170 - DNA, 15 bp, Homo sapiens
aacaagaaattatac

SEQ ID NO: 212171 - DNA, 15 bp, Homo sapiens
aaacaagaaattata

SEQ ID NO: 212172 - DNA, 15 bp, Homo sapiens
caaacaagaaattat

SEQ ID NO: 212173 - DNA, 15 bp, Homo sapiens
acaaacaagaaatta

SEQ ID NO: 212174 - DNA, 15 bp, Homo sapiens
cacaaacaagaaatt

SEQ ID NO: 212175 - DNA, 15 bp, Homo sapiens
acacaaacaagaaat

SEQ ID NO: 212176 - DNA, 15 bp, Homo sapiens
cacacaaacaagaaa

SEQ ID NO: 212177 - DNA, 15 bp, Homo sapiens
acacacaaacaagaa

SEQ ID NO: 212178 - DNA, 15 bp, Homo sapiens
aacacacaaacaaga

SEQ ID NO: 212179 - DNA, 15 bp, Homo sapiens
gaacacacaaacaag

SEQ ID NO: 212180 - DNA, 15 bp, Homo sapiens
agaacacacaaacaa

SEQ ID NO: 212181 - DNA, 15 bp, Homo sapiens
aagaacacacaaaca

SEQ ID NO: 212182 - DNA, 15 bp, Homo sapiens
aaagaacacacaaac

SEQ ID NO: 212183 - DNA, 15 bp, Homo sapiens
gaaagaacacacaaa

SEQ ID NO: 212184 - DNA, 15 bp, Homo sapiens
ggaaagaacacacaa

SEQ ID NO: 212185 - DNA, 15 bp, Homo sapiens
gggaaagaacacaca

SEQ ID NO: 212186 - DNA, 15 bp, Homo sapiens
agggaaagaacacac

SEQ ID NO: 212187 - DNA, 15 bp, Homo sapiens
gagggaaagaacaca

SEQ ID NO: 212188 - DNA, 15 bp, Homo sapiens
tgagggaaagaacac

SEQ ID NO: 212189 - DNA, 15 bp, Homo sapiens
ctgagggaaagaaca

SEQ ID NO: 212190 - DNA, 15 bp, Homo sapiens
cctgagggaaagaac

SEQ ID NO: 212191 - DNA, 15 bp, Homo sapiens
ccctgagggaaagaa

SEQ ID NO: 212192 - DNA, 15 bp, Homo sapiens
gccctgagggaaaga

SEQ ID NO: 212193 - DNA, 15 bp, Homo sapiens
agccctgagggaaag

SEQ ID NO: 212194 - DNA, 15 bp, Homo sapiens
tagccctgagggaaa

SEQ ID NO: 212195 - DNA, 15 bp, Homo sapiens
gtagccctgagggaa

SEQ ID NO: 212196 - DNA, 15 bp, Homo sapiens
agtagccctgaggga

SEQ ID NO: 212197 - DNA, 15 bp, Homo sapiens
gagtagccctgaggg

SEQ ID NO: 212198 - DNA, 15 bp, Homo sapiens
agagtagccctgagg

SEQ ID NO: 212199 - DNA, 15 bp, Homo sapiens
cagagtagccctgag

SEQ ID NO: 212200 - DNA, 15 bp, Homo sapiens
ccagagtagccctga

SEQ ID NO: 212201 - DNA, 15 bp, Homo sapiens
gccagagtagccctg

SEQ ID NO: 212202 - DNA, 15 bp, Homo sapiens
ggccagagtagccct

SEQ ID NO: 212203 - DNA, 15 bp, Homo sapiens
aggccagagtagccc

SEQ ID NO: 212204 - DNA, 15 bp, Homo sapiens
aaggccagagtagcc

SEQ ID NO: 212205 - DNA, 15 bp, Homo sapiens
aaaggccagagtagc

SEQ ID NO: 212206 - DNA, 15 bp, Homo sapiens
caaaggccagagtag

SEQ ID NO: 212207 - DNA, 15 bp, Homo sapiens
gcaaaggccagagta

SEQ ID NO: 212208 - DNA, 15 bp, Homo sapiens
agcaaaggccagagt

SEQ ID NO: 212209 - DNA, 15 bp, Homo sapiens
aagcaaaggccagag

SEQ ID NO: 212210 - DNA, 15 bp, Homo sapiens
taagcaaaggccaga

SEQ ID NO: 212211 - DNA, 15 bp, Homo sapiens
ttaagcaaaggccag

SEQ ID NO: 212212 - DNA, 15 bp, Homo sapiens
gttaagcaaaggcca

SEQ ID NO: 212213 - DNA, 15 bp, Homo sapiens
ggttaagcaaaggcc

SEQ ID NO: 212214 - DNA, 15 bp, Homo sapiens
gggttaagcaaaggc

SEQ ID NO: 212215 - DNA, 15 bp, Homo sapiens
tgggttaagcaaagg

SEQ ID NO: 212216 - DNA, 15 bp, Homo sapiens
ctgggttaagcaaag

SEQ ID NO: 212217 - DNA, 15 bp, Homo sapiens
actgggttaagcaaa

SEQ ID NO: 212218 - DNA, 15 bp, Homo sapiens
aactgggttaagcaa

SEQ ID NO: 212219 - DNA, 15 bp, Homo sapiens
aaactgggttaagca

SEQ ID NO: 212220 - DNA, 15 bp, Homo sapiens
taaactgggttaagc

SEQ ID NO: 212221 - DNA, 15 bp, Homo sapiens
ataaactgggttaag

SEQ ID NO: 212222 - DNA, 15 bp, Homo sapiens
aataaactgggttaa

SEQ ID NO: 212223 - DNA, 15 bp, Homo sapiens
aaataaactgggtta

SEQ ID NO: 212224 - DNA, 15 bp, Homo sapiens
gaaataaactgggtt

SEQ ID NO: 212225 - DNA, 15 bp, Homo sapiens
ggaaataaactgggt

SEQ ID NO: 212226 - DNA, 15 bp, Homo sapiens
aggaaataaactggg

SEQ ID NO: 212227 - DNA, 15 bp, Homo sapiens
taggaaataaactgg

SEQ ID NO: 212228 - DNA, 15 bp, Homo sapiens
ataggaaataaactg

SEQ ID NO: 212229 - DNA, 15 bp, Homo sapiens
tataggaaataaact

SEQ ID NO: 212230 - DNA, 15 bp, Homo sapiens
atataggaaataaac

SEQ ID NO: 212231 - DNA, 15 bp, Homo sapiens
aatataggaaataaa

SEQ ID NO: 212232 - DNA, 15 bp, Homo sapiens
gaatataggaaataa

SEQ ID NO: 212233 - DNA, 15 bp, Homo sapiens
tgaatataggaaata

SEQ ID NO: 212234 - DNA, 15 bp, Homo sapiens
ttgaatataggaaat

SEQ ID NO: 212235 - DNA, 15 bp, Homo sapiens
cttgaatataggaaa

SEQ ID NO: 212236 - DNA, 15 bp, Homo sapiens
gcttgaatataggaa

SEQ ID NO: 212237 - DNA, 15 bp, Homo sapiens
agcttgaatatagga

SEQ ID NO: 212238 - DNA, 15 bp, Homo sapiens
aagcttgaatatagg

SEQ ID NO: 212239 - DNA, 15 bp, Homo sapiens
aaagcttgaatatag

SEQ ID NO: 212240 - DNA, 15 bp, Homo sapiens
taaagcttgaatata

SEQ ID NO: 212241 - DNA, 15 bp, Homo sapiens
ataaagcttgaatat

SEQ ID NO: 212242 - DNA, 15 bp, Homo sapiens
aataaagcttgaata

SEQ ID NO: 212243 - DNA, 15 bp, Homo sapiens
taataaagcttgaat

SEQ ID NO: 212244 - DNA, 15 bp, Homo sapiens
ataataaagcttgaa

SEQ ID NO: 212245 - DNA, 15 bp, Homo sapiens
tataataaagcttga

SEQ ID NO: 212246 - DNA, 15 bp, Homo sapiens
atataataaagcttg

SEQ ID NO: 212247 - DNA, 15 bp, Homo sapiens
tatataataaagctt

SEQ ID NO: 212248 - DNA, 15 bp, Homo sapiens
ttatataataaagct

SEQ ID NO: 212249 - DNA, 15 bp, Homo sapiens
cttatataataaagc

SEQ ID NO: 212250 - DNA, 15 bp, Homo sapiens
tcttatataataaag

SEQ ID NO: 212251 - DNA, 15 bp, Homo sapiens
gtcttatataataaa

SEQ ID NO: 212252 - DNA, 15 bp, Homo sapiens
agtcttatataataa

SEQ ID NO: 212253 - DNA, 15 bp, Homo sapiens
gagtcttatataata

SEQ ID NO: 212254 - DNA, 15 bp, Homo sapiens
tgagtcttatataat

SEQ ID NO: 212255 - DNA, 15 bp, Homo sapiens
ctgagtcttatataa

SEQ ID NO: 212256 - DNA, 15 bp, Homo sapiens
tctgagtcttatata

SEQ ID NO: 212257 - DNA, 15 bp, Homo sapiens
ttctgagtcttatat

SEQ ID NO: 212258 - DNA, 15 bp, Homo sapiens
gttctgagtcttata

SEQ ID NO: 212259 - DNA, 15 bp, Homo sapiens
tgttctgagtcttat

SEQ ID NO: 212260 - DNA, 15 bp, Homo sapiens
atgttctgagtctta

SEQ ID NO: 212261 - DNA, 15 bp, Homo sapiens
tatgttctgagtctt

SEQ ID NO: 212262 - DNA, 15 bp, Homo sapiens
atatgttctgagtct

SEQ ID NO: 212263 - DNA, 15 bp, Homo sapiens
gatatgttctgagtc

SEQ ID NO: 212264 - DNA, 15 bp, Homo sapiens
agatatgttctgagt

SEQ ID NO: 212265 - DNA, 15 bp, Homo sapiens
cagatatgttctgag

SEQ ID NO: 212266 - DNA, 15 bp, Homo sapiens
ccagatatgttctga

SEQ ID NO: 212267 - DNA, 15 bp, Homo sapiens
gccagatatgttctg

SEQ ID NO: 212268 - DNA, 15 bp, Homo sapiens
ggccagatatgttct

SEQ ID NO: 212269 - DNA, 15 bp, Homo sapiens
aggccagatatgttc

SEQ ID NO: 212270 - DNA, 15 bp, Homo sapiens
aaggccagatatgtt

SEQ ID NO: 212271 - DNA, 15 bp, Homo sapiens
taaggccagatatgt

SEQ ID NO: 212272 - DNA, 15 bp, Homo sapiens
ttaaggccagatatg

SEQ ID NO: 212273 - DNA, 15 bp, Homo sapiens
cttaaggccagatat

SEQ ID NO: 212274 - DNA, 15 bp, Homo sapiens
gcttaaggccagata

SEQ ID NO: 212275 - DNA, 15 bp, Homo sapiens
agcttaaggccagat

SEQ ID NO: 212276 - DNA, 15 bp, Homo sapiens
cagcttaaggccaga

SEQ ID NO: 212277 - DNA, 15 bp, Homo sapiens
tcagcttaaggccag

SEQ ID NO: 212278 - DNA, 15 bp, Homo sapiens
ttcagcttaaggcca

SEQ ID NO: 212279 - DNA, 15 bp, Homo sapiens
attcagcttaaggcc

SEQ ID NO: 212280 - DNA, 15 bp, Homo sapiens
aattcagcttaaggc

SEQ ID NO: 212281 - DNA, 15 bp, Homo sapiens
caattcagcttaagg

SEQ ID NO: 212282 - DNA, 15 bp, Homo sapiens
gcaattcagcttaag

SEQ ID NO: 212283 - DNA, 15 bp, Homo sapiens
ggcaattcagcttaa

SEQ ID NO: 212284 - DNA, 15 bp, Homo sapiens
tggcaattcagctta

SEQ ID NO: 212285 - DNA, 15 bp, Homo sapiens
ttggcaattcagctt

SEQ ID NO: 212286 - DNA, 15 bp, Homo sapiens
cttggcaattcagct

SEQ ID NO: 212287 - DNA, 15 bp, Homo sapiens
tcttggcaattcagc

SEQ ID NO: 212288 - DNA, 15 bp, Homo sapiens
ttcttggcaattcag

SEQ ID NO: 212289 - DNA, 15 bp, Homo sapiens
tttcttggcaattca

SEQ ID NO: 212290 - DNA, 15 bp, Homo sapiens
gtttcttggcaattc

SEQ ID NO: 212291 - DNA, 15 bp, Homo sapiens
tgtttcttggcaatt

SEQ ID NO: 212292 - DNA, 15 bp, Homo sapiens
atgtttcttggcaat

SEQ ID NO: 212293 - DNA, 15 bp, Homo sapiens
aatgtttcttggcaa

SEQ ID NO: 212294 - DNA, 15 bp, Homo sapiens
taatgtttcttggca

SEQ ID NO: 212295 - DNA, 15 bp, Homo sapiens
ctaatgtttcttggc

SEQ ID NO: 212296 - DNA, 15 bp, Homo sapiens
gctaatgtttcttgg

SEQ ID NO: 212297 - DNA, 15 bp, Homo sapiens
tgctaatgtttcttg

SEQ ID NO: 212298 - DNA, 15 bp, Homo sapiens
ttgctaatgtttctt

SEQ ID NO: 212299 - DNA, 15 bp, Homo sapiens
tttgctaatgtttct

SEQ ID NO: 212300 - DNA, 15 bp, Homo sapiens
gtttgctaatgtttc

SEQ ID NO: 212301 - DNA, 15 bp, Homo sapiens
agtttgctaatgttt

SEQ ID NO: 212302 - DNA, 15 bp, Homo sapiens
aagtttgctaatgtt

SEQ ID NO: 212303 - DNA, 15 bp, Homo sapiens
caagtttgctaatgt

SEQ ID NO: 212304 - DNA, 15 bp, Homo sapiens
gcaagtttgctaatg

SEQ ID NO: 212305 - DNA, 15 bp, Homo sapiens
agcaagtttgctaat

SEQ ID NO: 212306 - DNA, 15 bp, Homo sapiens
gagcaagtttgctaa

SEQ ID NO: 212307 - DNA, 15 bp, Homo sapiens
tgagcaagtttgcta

SEQ ID NO: 212308 - DNA, 15 bp, Homo sapiens
atgagcaagtttgct

SEQ ID NO: 212309 - DNA, 15 bp, Homo sapiens
aatgagcaagtttgc

SEQ ID NO: 212310 - DNA, 15 bp, Homo sapiens
taatgagcaagtttg

SEQ ID NO: 212311 - DNA, 15 bp, Homo sapiens
ttaatgagcaagttt

SEQ ID NO: 212312 - DNA, 15 bp, Homo sapiens
tttaatgagcaagtt

SEQ ID NO: 212313 - DNA, 15 bp, Homo sapiens
ttttaatgagcaagt

SEQ ID NO: 212314 - DNA, 15 bp, Homo sapiens
attttaatgagcaag

SEQ ID NO: 212315 - DNA, 15 bp, Homo sapiens
tattttaatgagcaa

SEQ ID NO: 212316 - DNA, 15 bp, Homo sapiens
ttattttaatgagca

SEQ ID NO: 212317 - DNA, 15 bp, Homo sapiens
gttattttaatgagc

SEQ ID NO: 212318 - DNA, 15 bp, Homo sapiens
tgttattttaatgag

SEQ ID NO: 212319 - DNA, 15 bp, Homo sapiens
ttgttattttaatga

SEQ ID NO: 212320 - DNA, 15 bp, Homo sapiens
tttgttattttaatg

SEQ ID NO: 212321 - DNA, 15 bp, Homo sapiens
atttgttattttaat

SEQ ID NO: 212322 - DNA, 15 bp, Homo sapiens
aatttgttattttaa

SEQ ID NO: 212323 - DNA, 15 bp, Homo sapiens
gaatttgttatttta

SEQ ID NO: 212324 - DNA, 15 bp, Homo sapiens
agaatttgttatttt

SEQ ID NO: 212325 - DNA, 15 bp, Homo sapiens
tagaatttgttattt

SEQ ID NO: 212326 - DNA, 15 bp, Homo sapiens
ttagaatttgttatt

SEQ ID NO: 212327 - DNA, 15 bp, Homo sapiens
gttagaatttgttat

SEQ ID NO: 212328 - DNA, 15 bp, Homo sapiens
tgttagaatttgtta

SEQ ID NO: 212329 - DNA, 15 bp, Homo sapiens
atgttagaatttgtt

SEQ ID NO: 212330 - DNA, 15 bp, Homo sapiens
aatgttagaatttgt

SEQ ID NO: 212331 - DNA, 15 bp, Homo sapiens
caatgttagaatttg

SEQ ID NO: 212332 - DNA, 15 bp, Homo sapiens
acaatgttagaattt

SEQ ID NO: 212333 - DNA, 15 bp, Homo sapiens
gacaatgttagaatt

SEQ ID NO: 212334 - DNA, 15 bp, Homo sapiens
agacaatgttagaat

SEQ ID NO: 212335 - DNA, 15 bp, Homo sapiens
aagacaatgttagaa

SEQ ID NO: 212336 - DNA, 15 bp, Homo sapiens
aaagacaatgttaga

SEQ ID NO: 212337 - DNA, 15 bp, Homo sapiens
taaagacaatgttag

SEQ ID NO: 212338 - DNA, 15 bp, Homo sapiens
ttaaagacaatgtta

SEQ ID NO: 212339 - DNA, 15 bp, Homo sapiens
tttaaagacaatgtt

SEQ ID NO: 212340 - DNA, 15 bp, Homo sapiens
gttttaaagacaatg

SEQ ID NO: 212341 - DNA, 15 bp, Homo sapiens
tgttttaaagacaat

SEQ ID NO: 212342 - DNA, 15 bp, Homo sapiens
ttgttttaaagacaa

SEQ ID NO: 212343 - DNA, 15 bp, Homo sapiens
gttgttttaaagaca

SEQ ID NO: 212344 - DNA, 15 bp, Homo sapiens
tgttgttttaaagac

SEQ ID NO: 212345 - DNA, 15 bp, Homo sapiens
ttgttgttttaaaga

SEQ ID NO: 212346 - DNA, 15 bp, Homo sapiens
gttgttgttttaaag

SEQ ID NO: 212347 - DNA, 15 bp, Homo sapiens
tgttgttgttttaaa

SEQ ID NO: 212348 - DNA, 15 bp, Homo sapiens
gtgttgttgttttaa

SEQ ID NO: 212349 - DNA, 15 bp, Homo sapiens
ggtgttgttgtttta

SEQ ID NO: 212350 - DNA, 15 bp, Homo sapiens
gggtgttgttgtttt

SEQ ID NO: 212351 - DNA, 15 bp, Homo sapiens
agggtgttgttgttt

SEQ ID NO: 212352 - DNA, 15 bp, Homo sapiens
tagggtgttgttgtt

SEQ ID NO: 212353 - DNA, 15 bp, Homo sapiens
gtagggtgttgttgt

SEQ ID NO: 212354 - DNA, 15 bp, Homo sapiens
agtagggtgttgttg

SEQ ID NO: 212355 - DNA, 15 bp, Homo sapiens
cagtagggtgttgtt

SEQ ID NO: 212356 - DNA, 15 bp, Homo sapiens
acagtagggtgttgt

SEQ ID NO: 212357 - DNA, 15 bp, Homo sapiens
aacagtagggtgttg

SEQ ID NO: 212358 - DNA, 15 bp, Homo sapiens
taacagtagggtgtt

SEQ ID NO: 212359 - DNA, 15 bp, Homo sapiens
ttaacagtagggtgt

SEQ ID NO: 212360 - DNA, 15 bp, Homo sapiens
tttaacagtagggtg

SEQ ID NO: 212361 - DNA, 15 bp, Homo sapiens
atttaacagtagggt

SEQ ID NO: 212362 - DNA, 15 bp, Homo sapiens
aatttaacagtaggg

SEQ ID NO: 212363 - DNA, 15 bp, Homo sapiens
aaatttaacagtagg

SEQ ID NO: 212364 - DNA, 15 bp, Homo sapiens
taaatttaacagtag

SEQ ID NO: 212365 - DNA, 15 bp, Homo sapiens
ctaaatttaacagta

SEQ ID NO: 212366 - DNA, 15 bp, Homo sapiens
cctaaatttaacagt

SEQ ID NO: 212367 - DNA, 15 bp, Homo sapiens
gcctaaatttaacag

SEQ ID NO: 212368 - DNA, 15 bp, Homo sapiens
agcctaaatttaaca

SEQ ID NO: 212369 - DNA, 15 bp, Homo sapiens
cagcctaaatttaac

SEQ ID NO: 212370 - DNA, 15 bp, Homo sapiens
acagcctaaatttaa

SEQ ID NO: 212371 - DNA, 15 bp, Homo sapiens
cacagcctaaattta

SEQ ID NO: 212372 - DNA, 15 bp, Homo sapiens
acacagcctaaattt

SEQ ID NO: 212373 - DNA, 15 bp, Homo sapiens
cacacagcctaaatt

SEQ ID NO: 212374 - DNA, 15 bp, Homo sapiens
acacacagcctaaat

SEQ ID NO: 212375 - DNA, 15 bp, Homo sapiens
cacacacagcctaaa

SEQ ID NO: 212376 - DNA, 15 bp, Homo sapiens
acacacacagcctaa

SEQ ID NO: 212377 - DNA, 15 bp, Homo sapiens
cacacacacagccta

SEQ ID NO: 212378 - DNA, 15 bp, Homo sapiens
acacacacacagcct

SEQ ID NO: 212379 - DNA, 15 bp, Homo sapiens
gcacagacacacaca

SEQ ID NO: 212380 - DNA, 15 bp, Homo sapiens
tgcacagacacacac

SEQ ID NO: 212381 - DNA, 15 bp, Homo sapiens
gtgcacagacacaca

SEQ ID NO: 212382 - DNA, 15 bp, Homo sapiens
tgtgcacagacacac

SEQ ID NO: 212383 - DNA, 15 bp, Homo sapiens
gtgtgcacagacaca

SEQ ID NO: 212384 - DNA, 15 bp, Homo sapiens
cgtgtgcacagacac

SEQ ID NO: 212385 - DNA, 15 bp, Homo sapiens
acgtgtgcacagaca

SEQ ID NO: 212386 - DNA, 15 bp, Homo sapiens
tacgtgtgcacagac

SEQ ID NO: 212387 - DNA, 15 bp, Homo sapiens
ctacgtgtgcacaga

SEQ ID NO: 212388 - DNA, 15 bp, Homo sapiens
cctacgtgtgcacag

SEQ ID NO: 212389 - DNA, 15 bp, Homo sapiens
acctacgtgtgcaca

SEQ ID NO: 212390 - DNA, 15 bp, Homo sapiens
cacctacgtgtgcac

SEQ ID NO: 212391 - DNA, 15 bp, Homo sapiens
acacctacgtgtgca

SEQ ID NO: 212392 - DNA, 15 bp, Homo sapiens
cacacctacgtgtgc

SEQ ID NO: 212393 - DNA, 15 bp, Homo sapiens
ccacacctacgtgtg

SEQ ID NO: 212394 - DNA, 15 bp, Homo sapiens
accacacctacgtgt

SEQ ID NO: 212395 - DNA, 15 bp, Homo sapiens
taccacacctacgtg

SEQ ID NO: 212396 - DNA, 15 bp, Homo sapiens
ctaccacacctacgt

SEQ ID NO: 212397 - DNA, 15 bp, Homo sapiens
tctaccacacctacg

SEQ ID NO: 212398 - DNA, 15 bp, Homo sapiens
ttctaccacacctac

SEQ ID NO: 212399 - DNA, 15 bp, Homo sapiens
attctaccacaccta

SEQ ID NO: 212400 - DNA, 15 bp, Homo sapiens
aattctaccacacct

SEQ ID NO: 212401 - DNA, 15 bp, Homo sapiens
aaattctaccacacc

SEQ ID NO: 212402 - DNA, 15 bp, Homo sapiens
aaaattctaccacac

SEQ ID NO: 212403 - DNA, 15 bp, Homo sapiens
aaaaattctaccaca

SEQ ID NO: 212404 - DNA, 15 bp, Homo sapiens
aaaaaattctaccac

SEQ ID NO: 212405 - DNA, 15 bp, Homo sapiens
aaaaaaattctacca

SEQ ID NO: 212406 - DNA, 15 bp, Homo sapiens
aaaaaaaattctacc

SEQ ID NO: 212407 - DNA, 15 bp, Homo sapiens
gaaaaaaaattctac

SEQ ID NO: 212408 - DNA, 15 bp, Homo sapiens
ggaaaaaaaattcta

SEQ ID NO: 212409 - DNA, 15 bp, Homo sapiens
gggaaaaaaaattct

SEQ ID NO: 212410 - DNA, 15 bp, Homo sapiens
agggaaaaaaaattc

SEQ ID NO: 212411 - DNA, 15 bp, Homo sapiens
tagggaaaaaaaatt

SEQ ID NO: 212412 - DNA, 15 bp, Homo sapiens
gtagggaaaaaaaat

SEQ ID NO: 212413 - DNA, 15 bp, Homo sapiens
agtagggaaaaaaaa

SEQ ID NO: 212414 - DNA, 15 bp, Homo sapiens
tagtagggaaaaaaa

SEQ ID NO: 212415 - DNA, 15 bp, Homo sapiens
ttagtagggaaaaaa

SEQ ID NO: 212416 - DNA, 15 bp, Homo sapiens
tttagtagggaaaaa

SEQ ID NO: 212417 - DNA, 15 bp, Homo sapiens
ctttagtagggaaaa

SEQ ID NO: 212418 - DNA, 15 bp, Homo sapiens
actttagtagggaaa

SEQ ID NO: 212419 - DNA, 15 bp, Homo sapiens
tactttagtagggaa

SEQ ID NO: 212420 - DNA, 15 bp, Homo sapiens
ttactttagtaggga

SEQ ID NO: 212421 - DNA, 15 bp, Homo sapiens
attactttagtaggg

SEQ ID NO: 212422 - DNA, 15 bp, Homo sapiens
gattactttagtagg

SEQ ID NO: 212423 - DNA, 15 bp, Homo sapiens
cgattactttagtag

SEQ ID NO: 212424 - DNA, 15 bp, Homo sapiens
ccgattactttagta

SEQ ID NO: 212425 - DNA, 15 bp, Homo sapiens
tccgattactttagt

SEQ ID NO: 212426 - DNA, 15 bp, Homo sapiens
ctccgattactttag

SEQ ID NO: 212427 - DNA, 15 bp, Homo sapiens
tctccgattacttta

SEQ ID NO: 212428 - DNA, 15 bp, Homo sapiens
gtctccgattacttt

SEQ ID NO: 212429 - DNA, 15 bp, Homo sapiens
agtctccgattactt

SEQ ID NO: 212430 - DNA, 15 bp, Homo sapiens
gagtctccgattact

SEQ ID NO: 212431 - DNA, 15 bp, Homo sapiens
agagtctccgattac

SEQ ID NO: 212432 - DNA, 15 bp, Homo sapiens
cagagtctccgatta

SEQ ID NO: 212433 - DNA, 15 bp, Homo sapiens
gcagagtctccgatt

SEQ ID NO: 212434 - DNA, 15 bp, Homo sapiens
ggcagagtctccgat

SEQ ID NO: 212435 - DNA, 15 bp, Homo sapiens
aggcagagtctccga

SEQ ID NO: 212436 - DNA, 15 bp, Homo sapiens
caggcagagtctccg

SEQ ID NO: 212437 - DNA, 15 bp, Homo sapiens
tcaggcagagtctcc

SEQ ID NO: 212438 - DNA, 15 bp, Homo sapiens
ttcaggcagagtctc

SEQ ID NO: 212439 - DNA, 15 bp, Homo sapiens
tttcaggcagagtct

SEQ ID NO: 212440 - DNA, 15 bp, Homo sapiens
atttcaggcagagtc

SEQ ID NO: 212441 - DNA, 15 bp, Homo sapiens
aatttcaggcagagt

SEQ ID NO: 212442 - DNA, 15 bp, Homo sapiens
gaatttcaggcagag

SEQ ID NO: 212443 - DNA, 15 bp, Homo sapiens
agaatttcaggcaga

SEQ ID NO: 212444 - DNA, 15 bp, Homo sapiens
cagaatttcaggcag

SEQ ID NO: 212445 - DNA, 15 bp, Homo sapiens
acagaatttcaggca

SEQ ID NO: 212446 - DNA, 15 bp, Homo sapiens
tacagaatttcaggc

SEQ ID NO: 212447 - DNA, 15 bp, Homo sapiens
ttacagaatttcagg

SEQ ID NO: 212448 - DNA, 15 bp, Homo sapiens
attacagaatttcag

SEQ ID NO: 212449 - DNA, 15 bp, Homo sapiens
aattacagaatttca

SEQ ID NO: 212450 - DNA, 15 bp, Homo sapiens
aaattacagaatttc

SEQ ID NO: 212451 - DNA, 15 bp, Homo sapiens
aaaattacagaattt

SEQ ID NO: 212452 - DNA, 15 bp, Homo sapiens
caaaattacagaatt

SEQ ID NO: 212453 - DNA, 15 bp, Homo sapiens
tcaaaattacagaat

SEQ ID NO: 212454 - DNA, 15 bp, Homo sapiens
ctcaaaattacagaa

SEQ ID NO: 212455 - DNA, 15 bp, Homo sapiens
cctcaaaattacaga

SEQ ID NO: 212456 - DNA, 15 bp, Homo sapiens
acctcaaaattacag

SEQ ID NO: 212457 - DNA, 15 bp, Homo sapiens
gacctcaaaattaca

SEQ ID NO: 212458 - DNA, 15 bp, Homo sapiens
agacctcaaaattac

SEQ ID NO: 212459 - DNA, 15 bp, Homo sapiens
aagacctcaaaatta

SEQ ID NO: 212460 - DNA, 15 bp, Homo sapiens
caagacctcaaaatt

SEQ ID NO: 212461 - DNA, 15 bp, Homo sapiens
acaagacctcaaaat

SEQ ID NO: 212462 - DNA, 15 bp, Homo sapiens
aacaagacctcaaaa

SEQ ID NO: 212463 - DNA, 15 bp, Homo sapiens
caacaagacctcaaa

SEQ ID NO: 212464 - DNA, 15 bp, Homo sapiens
acaacaagacctcaa

SEQ ID NO: 212465 - DNA, 15 bp, Homo sapiens
cacaacaagacctca

SEQ ID NO: 212466 - DNA, 15 bp, Homo sapiens
acacaacaagacctc

SEQ ID NO: 212467 - DNA, 15 bp, Homo sapiens
aacacaacaagacct

SEQ ID NO: 212468 - DNA, 15 bp, Homo sapiens
taacacaacaagacc

SEQ ID NO: 212469 - DNA, 15 bp, Homo sapiens
ctaacacaacaagac

SEQ ID NO: 212470 - DNA, 15 bp, Homo sapiens
tctaacacaacaaga

SEQ ID NO: 212471 - DNA, 15 bp, Homo sapiens
ttctaacacaacaag

SEQ ID NO: 212472 - DNA, 15 bp, Homo sapiens
cttctaacacaacaa

SEQ ID NO: 212473 - DNA, 15 bp, Homo sapiens
ccttctaacacaaca

SEQ ID NO: 212474 - DNA, 15 bp, Homo sapiens
accttctaacacaac

SEQ ID NO: 212475 - DNA, 15 bp, Homo sapiens
aaccttctaacacaa

SEQ ID NO: 212476 - DNA, 15 bp, Homo sapiens
caaccttctaacaca

SEQ ID NO: 212477 - DNA, 15 bp, Homo sapiens
gcaaccttctaacac

SEQ ID NO: 212478 - DNA, 15 bp, Homo sapiens
ggcaaccttctaaca

SEQ ID NO: 212479 - DNA, 15 bp, Homo sapiens
aggcaaccttctaac

SEQ ID NO: 212480 - DNA, 15 bp, Homo sapiens
taggcaaccttctaa

SEQ ID NO: 212481 - DNA, 15 bp, Homo sapiens
gtaggcaaccttcta

SEQ ID NO: 212482 - DNA, 15 bp, Homo sapiens
tgtaggcaaccttct

SEQ ID NO: 212483 - DNA, 15 bp, Homo sapiens
ctgtaggcaaccttc

SEQ ID NO: 212484 - DNA, 15 bp, Homo sapiens
actgtaggcaacctt

SEQ ID NO: 212485 - DNA, 15 bp, Homo sapiens
cactgtaggcaacct

SEQ ID NO: 212486 - DNA, 15 bp, Homo sapiens
ccactgtaggcaacc

SEQ ID NO: 212487 - DNA, 15 bp, Homo sapiens
cccactgtaggcaac

SEQ ID NO: 212488 - DNA, 15 bp, Homo sapiens
tcccactgtaggcaa

SEQ ID NO: 212489 - DNA, 15 bp, Homo sapiens
ttcccactgtaggca

SEQ ID NO: 212490 - DNA, 15 bp, Homo sapiens
tttcccactgtaggc

SEQ ID NO: 212491 - DNA, 15 bp, Homo sapiens
gtttcccactgtagg

SEQ ID NO: 212492 - DNA, 15 bp, Homo sapiens
agtttcccactgtag

SEQ ID NO: 212493 - DNA, 15 bp, Homo sapiens
aagtttcccactgta

SEQ ID NO: 212494 - DNA, 15 bp, Homo sapiens
caagtttcccactgt

SEQ ID NO: 212495 - DNA, 15 bp, Homo sapiens
acaagtttcccactg

SEQ ID NO: 212496 - DNA, 15 bp, Homo sapiens
gacaagtttcccact

SEQ ID NO: 212497 - DNA, 15 bp, Homo sapiens
agacaagtttcccac

SEQ ID NO: 212498 - DNA, 15 bp, Homo sapiens
aagacaagtttccca

SEQ ID NO: 212499 - DNA, 15 bp, Homo sapiens
aaagacaagtttccc

SEQ ID NO: 212500 - DNA, 15 bp, Homo sapiens
aaaagacaagtttcc

SEQ ID NO: 212501 - DNA, 15 bp, Homo sapiens
aaaaagacaagtttc

SEQ ID NO: 212502 - DNA, 15 bp, Homo sapiens
gaaaaagacaagttt

SEQ ID NO: 212503 - DNA, 15 bp, Homo sapiens
agaaaaagacaagtt

SEQ ID NO: 212504 - DNA, 15 bp, Homo sapiens
cagaaaaagacaagt

SEQ ID NO: 212505 - DNA, 15 bp, Homo sapiens
tcagaaaaagacaag

SEQ ID NO: 212506 - DNA, 15 bp, Homo sapiens
ttcagaaaaagacaa

SEQ ID NO: 212507 - DNA, 15 bp, Homo sapiens
tttcagaaaaagaca

SEQ ID NO: 212508 - DNA, 15 bp, Homo sapiens
atttcagaaaaagac

SEQ ID NO: 212509 - DNA, 15 bp, Homo sapiens
aatttcagaaaaaga

SEQ ID NO: 212510 - DNA, 15 bp, Homo sapiens
taatttcagaaaaag

SEQ ID NO: 212511 - DNA, 15 bp, Homo sapiens
ttaatttcagaaaaa

SEQ ID NO: 212512 - DNA, 15 bp, Homo sapiens
tttaatttcagaaaa

SEQ ID NO: 212513 - DNA, 15 bp, Homo sapiens
ttttaatttcagaaa

SEQ ID NO: 212514 - DNA, 15 bp, Homo sapiens
tttttaatttcagaa

SEQ ID NO: 212515 - DNA, 15 bp, Homo sapiens
ttttttaatttcaga

SEQ ID NO: 212516 - DNA, 15 bp, Homo sapiens
tttttttaatttcag

SEQ ID NO: 212517 - DNA, 15 bp, Homo sapiens
ttttttttaatttca

SEQ ID NO: 212518 - DNA, 15 bp, Homo sapiens
attttttttaatttc

SEQ ID NO: 212519 - DNA, 15 bp, Homo sapiens
aattttttttaattt

SEQ ID NO: 212520 - DNA, 15 bp, Homo sapiens
taattttttttaatt

SEQ ID NO: 212521 - DNA, 15 bp, Homo sapiens
ataattttttttaat

SEQ ID NO: 212522 - DNA, 15 bp, Homo sapiens
aataattttttttaa

SEQ ID NO: 212523 - DNA, 15 bp, Homo sapiens
aaataatttttttta

SEQ ID NO: 212524 - DNA, 15 bp, Homo sapiens
aaaataatttttttt

SEQ ID NO: 212525 - DNA, 15 bp, Homo sapiens
gaaaataattttttt

SEQ ID NO: 212526 - DNA, 15 bp, Homo sapiens
ggaaaataatttttt

SEQ ID NO: 212527 - DNA, 15 bp, Homo sapiens
tggaaaataattttt

SEQ ID NO: 212528 - DNA, 15 bp, Homo sapiens
ttggaaaataatttt

SEQ ID NO: 212529 - DNA, 15 bp, Homo sapiens
cttggaaaataattt

SEQ ID NO: 212530 - DNA, 15 bp, Homo sapiens
acttggaaaataatt

SEQ ID NO: 212531 - DNA, 15 bp, Homo sapiens
aacttggaaaataat

SEQ ID NO: 212532 - DNA, 15 bp, Homo sapiens
gaacttggaaaataa

SEQ ID NO: 212533 - DNA, 15 bp, Homo sapiens
ggaacttggaaaata

SEQ ID NO: 212534 - DNA, 15 bp, Homo sapiens
aggaacttggaaaat

SEQ ID NO: 212535 - DNA, 15 bp, Homo sapiens
gaggaacttggaaaa

SEQ ID NO: 212536 - DNA, 15 bp, Homo sapiens
agaggaacttggaaa

SEQ ID NO: 212537 - DNA, 15 bp, Homo sapiens
gagaggaacttggaa

SEQ ID NO: 212538 - DNA, 15 bp, Homo sapiens
ggagaggaacttgga

SEQ ID NO: 212539 - DNA, 15 bp, Homo sapiens
tggagaggaacttgg

SEQ ID NO: 212540 - DNA, 15 bp, Homo sapiens
ttggagaggaacttg

SEQ ID NO: 212541 - DNA, 15 bp, Homo sapiens
gttggagaggaactt

SEQ ID NO: 212542 - DNA, 15 bp, Homo sapiens
ggttggagaggaact

SEQ ID NO: 212543 - DNA, 15 bp, Homo sapiens
aggttggagaggaac

SEQ ID NO: 212544 - DNA, 15 bp, Homo sapiens
aaggttggagaggaa

SEQ ID NO: 212545 - DNA, 15 bp, Homo sapiens
aaaggttggagagga

SEQ ID NO: 212546 - DNA, 15 bp, Homo sapiens
caaaggttggagagg

SEQ ID NO: 212547 - DNA, 15 bp, Homo sapiens
gcaaaggttggagag

SEQ ID NO: 212548 - DNA, 15 bp, Homo sapiens
ggcaaaggttggaga

SEQ ID NO: 212549 - DNA, 15 bp, Homo sapiens
tggcaaaggttggag

SEQ ID NO: 212550 - DNA, 15 bp, Homo sapiens
ctggcaaaggttgga

SEQ ID NO: 212551 - DNA, 15 bp, Homo sapiens
actggcaaaggttgg

SEQ ID NO: 212552 - DNA, 15 bp, Homo sapiens
gactggcaaaggttg

SEQ ID NO: 212553 - DNA, 15 bp, Homo sapiens
agactggcaaaggtt

SEQ ID NO: 212554 - DNA, 15 bp, Homo sapiens
cagactggcaaaggt

SEQ ID NO: 212555 - DNA, 15 bp, Homo sapiens
acagactggcaaagg

SEQ ID NO: 212556 - DNA, 15 bp, Homo sapiens
cacagactggcaaag

SEQ ID NO: 212557 - DNA, 15 bp, Homo sapiens
aacacagactggcaa

SEQ ID NO: 212558 - DNA, 15 bp, Homo sapiens
caacacagactggca

SEQ ID NO: 212559 - DNA, 15 bp, Homo sapiens
tcaacacagactggc

SEQ ID NO: 212560 - DNA, 15 bp, Homo sapiens
gtcaacacagactgg

SEQ ID NO: 212561 - DNA, 15 bp, Homo sapiens
agtcaacacagactg

SEQ ID NO: 212562 - DNA, 15 bp, Homo sapiens
aagtcaacacagact

SEQ ID NO: 212563 - DNA, 15 bp, Homo sapiens
taagtcaacacagac

SEQ ID NO: 212564 - DNA, 15 bp, Homo sapiens
gtaagtcaacacaga

SEQ ID NO: 212565 - DNA, 15 bp, Homo sapiens
agtaagtcaacacag

SEQ ID NO: 212566 - DNA, 15 bp, Homo sapiens
gagtaagtcaacaca

SEQ ID NO: 212567 - DNA, 15 bp, Homo sapiens
ggagtaagtcaacac

SEQ ID NO: 212568 - DNA, 15 bp, Homo sapiens
aggagtaagtcaaca

SEQ ID NO: 212569 - DNA, 15 bp, Homo sapiens
aaggagtaagtcaac

SEQ ID NO: 212570 - DNA, 15 bp, Homo sapiens
taaggagtaagtcaa

SEQ ID NO: 212571 - DNA, 15 bp, Homo sapiens
ataaggagtaagtca

SEQ ID NO: 212572 - DNA, 15 bp, Homo sapiens
aataaggagtaagtc

SEQ ID NO: 212573 - DNA, 15 bp, Homo sapiens
taataaggagtaagt

SEQ ID NO: 212574 - DNA, 15 bp, Homo sapiens
ttaataaggagtaag

SEQ ID NO: 212575 - DNA, 15 bp, Homo sapiens
tttaataaggagtaa

SEQ ID NO: 212576 - DNA, 15 bp, Homo sapiens
gtttaataaggagta

SEQ ID NO: 212577 - DNA, 15 bp, Homo sapiens
cgtttaataaggagt

SEQ ID NO: 212578 - DNA, 15 bp, Homo sapiens
gcgtttaataaggag

SEQ ID NO: 212579 - DNA, 15 bp, Homo sapiens
agcgtttaataagga

SEQ ID NO: 212580 - DNA, 15 bp, Homo sapiens
gagcgtttaataagg

SEQ ID NO: 212581 - DNA, 15 bp, Homo sapiens
tgagcgtttaataag

SEQ ID NO: 212582 - DNA, 15 bp, Homo sapiens
ctgagcgtttaataa

SEQ ID NO: 212583 - DNA, 15 bp, Homo sapiens
gctgagcgtttaata

SEQ ID NO: 212584 - DNA, 15 bp, Homo sapiens
agctgagcgtttaat

SEQ ID NO: 212585 - DNA, 15 bp, Homo sapiens
gagctgagcgtttaa

SEQ ID NO: 212586 - DNA, 15 bp, Homo sapiens
agagctgagcgttta

SEQ ID NO: 212587 - DNA, 15 bp, Homo sapiens
aagagctgagcgttt

SEQ ID NO: 212588 - DNA, 15 bp, Homo sapiens
aaagagctgagcgtt

SEQ ID NO: 212589 - DNA, 15 bp, Homo sapiens
taaagagctgagcgt

SEQ ID NO: 212590 - DNA, 15 bp, Homo sapiens
ttaaagagctgagcg

SEQ ID NO: 212591 - DNA, 15 bp, Homo sapiens
cttaaagagctgagc

SEQ ID NO: 212592 - DNA, 15 bp, Homo sapiens
ccttaaagagctgag

SEQ ID NO: 212593 - DNA, 15 bp, Homo sapiens
gccttaaagagctga

SEQ ID NO: 212594 - DNA, 15 bp, Homo sapiens
ggccttaaagagctg

SEQ ID NO: 212595 - DNA, 15 bp, Homo sapiens
gggccttaaagagct

SEQ ID NO: 212596 - DNA, 15 bp, Homo sapiens
tgggccttaaagagc

SEQ ID NO: 212597 - DNA, 15 bp, Homo sapiens
atgggccttaaagag

SEQ ID NO: 212598 - DNA, 15 bp, Homo sapiens
aatgggccttaaaga

SEQ ID NO: 212599 - DNA, 15 bp, Homo sapiens
taatgggccttaaag

SEQ ID NO: 212600 - DNA, 15 bp, Homo sapiens
taacagactgaaaat

SEQ ID NO: 212601 - DNA, 15 bp, Homo sapiens
ctaacagactgaaaa

SEQ ID NO: 212602 - DNA, 15 bp, Homo sapiens
cctaacagactgaaa

SEQ ID NO: 212603 - DNA, 15 bp, Homo sapiens
tcctaacagactgaa

SEQ ID NO: 212604 - DNA, 15 bp, Homo sapiens
ttcctaacagactga

SEQ ID NO: 212605 - DNA, 15 bp, Homo sapiens
tttcctaacagactg

SEQ ID NO: 212606 - DNA, 15 bp, Homo sapiens
atttcctaacagact

SEQ ID NO: 212607 - DNA, 15 bp, Homo sapiens
gatttcctaacagac

SEQ ID NO: 212608 - DNA, 15 bp, Homo sapiens
ggatttcctaacaga

SEQ ID NO: 212609 - DNA, 15 bp, Homo sapiens
aggatttcctaacag

SEQ ID NO: 212610 - DNA, 15 bp, Homo sapiens
caggatttcctaaca

SEQ ID NO: 212611 - DNA, 15 bp, Homo sapiens
acaggatttcctaac

SEQ ID NO: 212612 - DNA, 15 bp, Homo sapiens
aacaggatttcctaa

SEQ ID NO: 212613 - DNA, 15 bp, Homo sapiens
caacaggatttccta

SEQ ID NO: 212614 - DNA, 15 bp, Homo sapiens
ccaacaggatttcct

SEQ ID NO: 212615 - DNA, 15 bp, Homo sapiens
accaacaggatttcc

SEQ ID NO: 212616 - DNA, 15 bp, Homo sapiens
aaccaacaggatttc

SEQ ID NO: 212617 - DNA, 15 bp, Homo sapiens
gaaccaacaggattt

SEQ ID NO: 212618 - DNA, 15 bp, Homo sapiens
agaaccaacaggatt

SEQ ID NO: 212619 - DNA, 15 bp, Homo sapiens
gagaaccaacaggat

SEQ ID NO: 212620 - DNA, 15 bp, Homo sapiens
agagaaccaacagga

SEQ ID NO: 212621 - DNA, 15 bp, Homo sapiens
cagagaaccaacagg

SEQ ID NO: 212622 - DNA, 15 bp, Homo sapiens
acagagaaccaacag

SEQ ID NO: 212623 - DNA, 15 bp, Homo sapiens
aacagagaaccaaca

SEQ ID NO: 212624 - DNA, 15 bp, Homo sapiens
gaacagagaaccaac

SEQ ID NO: 212625 - DNA, 15 bp, Homo sapiens
tgaacagagaaccaa

SEQ ID NO: 212626 - DNA, 15 bp, Homo sapiens
ttgaacagagaacca

SEQ ID NO: 212627 - DNA, 15 bp, Homo sapiens
tttgaacagagaacc

SEQ ID NO: 212628 - DNA, 15 bp, Homo sapiens
ttttgaacagagaac

SEQ ID NO: 212629 - DNA, 15 bp, Homo sapiens
attttgaacagagaa

SEQ ID NO: 212630 - DNA, 15 bp, Homo sapiens
tattttgaacagaga

SEQ ID NO: 212631 - DNA, 15 bp, Homo sapiens
atattttgaacagag

SEQ ID NO: 212632 - DNA, 15 bp, Homo sapiens
tatattttgaacaga

SEQ ID NO: 212633 - DNA, 15 bp, Homo sapiens
ctatattttgaacag

SEQ ID NO: 212634 - DNA, 15 bp, Homo sapiens
tctatattttgaaca

SEQ ID NO: 212635 - DNA, 15 bp, Homo sapiens
ttctatattttgaac

SEQ ID NO: 212636 - DNA, 15 bp, Homo sapiens
attctatattttgaa

SEQ ID NO: 212637 - DNA, 15 bp, Homo sapiens
gattctatattttga

SEQ ID NO: 212638 - DNA, 15 bp, Homo sapiens
agattctatattttg

SEQ ID NO: 212639 - DNA, 15 bp, Homo sapiens
cagattctatatttt

SEQ ID NO: 212640 - DNA, 15 bp, Homo sapiens
tcagattctatattt

SEQ ID NO: 212641 - DNA, 15 bp, Homo sapiens
ttcagattctatatt

SEQ ID NO: 212642 - DNA, 15 bp, Homo sapiens
attcagattctatat

SEQ ID NO: 212643 - DNA, 15 bp, Homo sapiens
gattcagattctata

SEQ ID NO: 212644 - DNA, 15 bp, Homo sapiens
agattcagattctat

SEQ ID NO: 212645 - DNA, 15 bp, Homo sapiens
tagattcagattcta

SEQ ID NO: 212646 - DNA, 15 bp, Homo sapiens
gtagattcagattct

SEQ ID NO: 212647 - DNA, 15 bp, Homo sapiens
ggtagattcagattc

SEQ ID NO: 212648 - DNA, 15 bp, Homo sapiens
tggtagattcagatt

SEQ ID NO: 212649 - DNA, 15 bp, Homo sapiens
gtggtagattcagat

SEQ ID NO: 212650 - DNA, 15 bp, Homo sapiens
ggtggtagattcaga

SEQ ID NO: 212651 - DNA, 15 bp, Homo sapiens
aggtggtagattcag

SEQ ID NO: 212652 - DNA, 15 bp, Homo sapiens
caggtggtagattca

SEQ ID NO: 212653 - DNA, 15 bp, Homo sapiens
acaggtggtagattc

SEQ ID NO: 212654 - DNA, 15 bp, Homo sapiens
cacaggtggtagatt

SEQ ID NO: 212655 - DNA, 15 bp, Homo sapiens
tcacaggtggtagat

SEQ ID NO: 212656 - DNA, 15 bp, Homo sapiens
gtcacaggtggtaga

SEQ ID NO: 212657 - DNA, 15 bp, Homo sapiens
tgtcacaggtggtag

SEQ ID NO: 212658 - DNA, 15 bp, Homo sapiens
gtgtcacaggtggta

SEQ ID NO: 212659 - DNA, 15 bp, Homo sapiens
agtgtcacaggtggt

SEQ ID NO: 212660 - DNA, 15 bp, Homo sapiens
gagtgtcacaggtgg

SEQ ID NO: 212661 - DNA, 15 bp, Homo sapiens
ggagtgtcacaggtg

SEQ ID NO: 212662 - DNA, 15 bp, Homo sapiens
aggagtgtcacaggt

SEQ ID NO: 212663 - DNA, 15 bp, Homo sapiens
gaggagtgtcacagg

SEQ ID NO: 212664 - DNA, 15 bp, Homo sapiens
agaggagtgtcacag

SEQ ID NO: 212665 - DNA, 15 bp, Homo sapiens
cagaggagtgtcaca

SEQ ID NO: 212666 - DNA, 15 bp, Homo sapiens
acagaggagtgtcac

SEQ ID NO: 212667 - DNA, 15 bp, Homo sapiens
gacagaggagtgtca

SEQ ID NO: 212668 - DNA, 15 bp, Homo sapiens
agacagaggagtgtc

SEQ ID NO: 212669 - DNA, 15 bp, Homo sapiens
gagacagaggagtgt

SEQ ID NO: 212670 - DNA, 15 bp, Homo sapiens
agagacagaggagtg

SEQ ID NO: 212671 - DNA, 15 bp, Homo sapiens
cagagacagaggagt

SEQ ID NO: 212672 - DNA, 15 bp, Homo sapiens
ccagagacagaggag

SEQ ID NO: 212673 - DNA, 15 bp, Homo sapiens
tccagagacagagga

SEQ ID NO: 212674 - DNA, 15 bp, Homo sapiens
ttccagagacagagg

SEQ ID NO: 212675 - DNA, 15 bp, Homo sapiens
cttccagagacagag

SEQ ID NO: 212676 - DNA, 15 bp, Homo sapiens
acttccagagacaga

SEQ ID NO: 212677 - DNA, 15 bp, Homo sapiens
tacttccagagacag

SEQ ID NO: 212678 - DNA, 15 bp, Homo sapiens
atacttccagagaca

SEQ ID NO: 212679 - DNA, 15 bp, Homo sapiens
gatacttccagagac

SEQ ID NO: 212680 - DNA, 15 bp, Homo sapiens
tgatacttccagaga

SEQ ID NO: 212681 - DNA, 15 bp, Homo sapiens
ctgatacttccagag

SEQ ID NO: 212682 - DNA, 15 bp, Homo sapiens
actgatacttccaga

SEQ ID NO: 212683 - DNA, 15 bp, Homo sapiens
gactgatacttccag

SEQ ID NO: 212684 - DNA, 15 bp, Homo sapiens
ggactgatacttcca

SEQ ID NO: 212685 - DNA, 15 bp, Homo sapiens
tggactgatacttcc

SEQ ID NO: 212686 - DNA, 15 bp, Homo sapiens
ctggactgatacttc

SEQ ID NO: 212687 - DNA, 15 bp, Homo sapiens
gctggactgatactt

SEQ ID NO: 212688 - DNA, 15 bp, Homo sapiens
tgctggactgatact

SEQ ID NO: 212689 - DNA, 15 bp, Homo sapiens
ttgctggactgatac

SEQ ID NO: 212690 - DNA, 15 bp, Homo sapiens
gttgctggactgata

SEQ ID NO: 212691 - DNA, 15 bp, Homo sapiens
ggttgctggactgat

SEQ ID NO: 212692 - DNA, 15 bp, Homo sapiens
tggttgctggactga

SEQ ID NO: 212693 - DNA, 15 bp, Homo sapiens
ctggttgctggactg

SEQ ID NO: 212694 - DNA, 15 bp, Homo sapiens
tctggttgctggact

SEQ ID NO: 212695 - DNA, 15 bp, Homo sapiens
ctctggttgctggac

SEQ ID NO: 212696 - DNA, 15 bp, Homo sapiens
actctggttgctgga

SEQ ID NO: 212697 - DNA, 15 bp, Homo sapiens
cactctggttgctgg

SEQ ID NO: 212698 - DNA, 15 bp, Homo sapiens
acactctggttgctg

SEQ ID NO: 212699 - DNA, 15 bp, Homo sapiens
aacactctggttgct

SEQ ID NO: 212700 - DNA, 15 bp, Homo sapiens
gaacactctggttgc

SEQ ID NO: 212701 - DNA, 15 bp, Homo sapiens
ggaacactctggttg

SEQ ID NO: 212702 - DNA, 15 bp, Homo sapiens
aggaacactctggtt

SEQ ID NO: 212703 - DNA, 15 bp, Homo sapiens
taggaacactctggt

SEQ ID NO: 212704 - DNA, 15 bp, Homo sapiens
ataggaacactctgg

SEQ ID NO: 212705 - DNA, 15 bp, Homo sapiens
aataggaacactctg

SEQ ID NO: 212706 - DNA, 15 bp, Homo sapiens
taataggaacactct

SEQ ID NO: 212707 - DNA, 15 bp, Homo sapiens
ttaataggaacactc

SEQ ID NO: 212708 - DNA, 15 bp, Homo sapiens
tttaataggaacact

SEQ ID NO: 212709 - DNA, 15 bp, Homo sapiens
ttttaataggaacac

SEQ ID NO: 212710 - DNA, 15 bp, Homo sapiens
attttaataggaaca

SEQ ID NO: 212711 - DNA, 15 bp, Homo sapiens
tattttaataggaac

SEQ ID NO: 212712 - DNA, 15 bp, Homo sapiens
ttattttaataggaa

SEQ ID NO: 212713 - DNA, 15 bp, Homo sapiens
tttattttaatagga

SEQ ID NO: 212714 - DNA, 15 bp, Homo sapiens
atttattttaatagg

SEQ ID NO: 212715 - DNA, 15 bp, Homo sapiens
gatttattttaatag

SEQ ID NO: 212716 - DNA, 15 bp, Homo sapiens
tgatttattttaata

SEQ ID NO: 212717 - DNA, 15 bp, Homo sapiens
ttgatttattttaat

SEQ ID NO: 212718 - DNA, 15 bp, Homo sapiens
tttgatttattttaa

SEQ ID NO: 212719 - DNA, 15 bp, Homo sapiens
gtttgatttatttta

SEQ ID NO: 212720 - DNA, 15 bp, Homo sapiens
agtttgatttatttt

SEQ ID NO: 212721 - DNA, 15 bp, Homo sapiens
gagtttgatttattt

SEQ ID NO: 212722 - DNA, 15 bp, Homo sapiens
agagtttgatttatt

SEQ ID NO: 212723 - DNA, 15 bp, Homo sapiens
cagagtttgatttat

SEQ ID NO: 212724 - DNA, 15 bp, Homo sapiens
acagagtttgattta

SEQ ID NO: 212725 - DNA, 15 bp, Homo sapiens
tacagagtttgattt

SEQ ID NO: 212726 - DNA, 15 bp, Homo sapiens
ctacagagtttgatt

SEQ ID NO: 212727 - DNA, 15 bp, Homo sapiens
cctacagagtttgat

SEQ ID NO: 212728 - DNA, 15 bp, Homo sapiens
ccctacagagtttga

SEQ ID NO: 212729 - DNA, 15 bp, Homo sapiens
cccctacagagtttg

SEQ ID NO: 212730 - DNA, 15 bp, Homo sapiens
gcccctacagagttt

SEQ ID NO: 212731 - DNA, 15 bp, Homo sapiens
agcccctacagagtt

SEQ ID NO: 212732 - DNA, 15 bp, Homo sapiens
aagcccctacagagt

SEQ ID NO: 212733 - DNA, 15 bp, Homo sapiens
gaagcccctacagag

SEQ ID NO: 212734 - DNA, 15 bp, Homo sapiens
ggaagcccctacaga

SEQ ID NO: 212735 - DNA, 15 bp, Homo sapiens
aggaagcccctacag

SEQ ID NO: 212736 - DNA, 15 bp, Homo sapiens
taggaagcccctaca

SEQ ID NO: 212737 - DNA, 15 bp, Homo sapiens
ttaggaagcccctac

SEQ ID NO: 212738 - DNA, 15 bp, Homo sapiens
gttaggaagccccta

SEQ ID NO: 212739 - DNA, 15 bp, Homo sapiens
agttaggaagcccct

SEQ ID NO: 212740 - DNA, 15 bp, Homo sapiens
aagttaggaagcccc

SEQ ID NO: 212741 - DNA, 15 bp, Homo sapiens
taagttaggaagccc

SEQ ID NO: 212742 - DNA, 15 bp, Homo sapiens
ataagttaggaagcc

SEQ ID NO: 212743 - DNA, 15 bp, Homo sapiens
aataagttaggaagc

SEQ ID NO: 212744 - DNA, 15 bp, Homo sapiens
gaataagttaggaag

SEQ ID NO: 212745 - DNA, 15 bp, Homo sapiens
tgaataagttaggaa

SEQ ID NO: 212746 - DNA, 15 bp, Homo sapiens
ctgaataagttagga

SEQ ID NO: 212747 - DNA, 15 bp, Homo sapiens
tctgaataagttagg

SEQ ID NO: 212748 - DNA, 15 bp, Homo sapiens
ctctgaataagttag

SEQ ID NO: 212749 - DNA, 15 bp, Homo sapiens
cctctgaataagtta

SEQ ID NO: 212750 - DNA, 15 bp, Homo sapiens
tcctctgaataagtt

SEQ ID NO: 212751 - DNA, 15 bp, Homo sapiens
ttcctctgaataagt

SEQ ID NO: 212752 - DNA, 15 bp, Homo sapiens
tttcctctgaataag

SEQ ID NO: 212753 - DNA, 15 bp, Homo sapiens
ttttcctctgaataa

SEQ ID NO: 212754 - DNA, 15 bp, Homo sapiens
cttttcctctgaata

SEQ ID NO: 212755 - DNA, 15 bp, Homo sapiens
gcttttcctctgaat

SEQ ID NO: 212756 - DNA, 15 bp, Homo sapiens
ggcttttcctctgaa

SEQ ID NO: 212757 - DNA, 15 bp, Homo sapiens
tggcttttcctctga

SEQ ID NO: 212758 - DNA, 15 bp, Homo sapiens
gtggcttttcctctg

SEQ ID NO: 212759 - DNA, 15 bp, Homo sapiens
tgtggcttttcctct

SEQ ID NO: 212760 - DNA, 15 bp, Homo sapiens
ctgtggcttttcctc

SEQ ID NO: 212761 - DNA, 15 bp, Homo sapiens
gctgtggcttttcct

SEQ ID NO: 212762 - DNA, 15 bp, Homo sapiens
agctgtggcttttcc

SEQ ID NO: 212763 - DNA, 15 bp, Homo sapiens
gagctgtggcttttc

SEQ ID NO: 212764 - DNA, 15 bp, Homo sapiens
agagctgtggctttt

SEQ ID NO: 212765 - DNA, 15 bp, Homo sapiens
gagagctgtggcttt

SEQ ID NO: 212766 - DNA, 15 bp, Homo sapiens
cgagagctgtggctt

SEQ ID NO: 212767 - DNA, 15 bp, Homo sapiens
ccgagagctgtggct

SEQ ID NO: 212768 - DNA, 15 bp, Homo sapiens
tccgagagctgtggc

SEQ ID NO: 212769 - DNA, 15 bp, Homo sapiens
ttccgagagctgtgg

SEQ ID NO: 212770 - DNA, 15 bp, Homo sapiens
attccgagagctgtg

SEQ ID NO: 212771 - DNA, 15 bp, Homo sapiens
cattccgagagctgt

SEQ ID NO: 212772 - DNA, 15 bp, Homo sapiens
ccattccgagagctg

SEQ ID NO: 212773 - DNA, 15 bp, Homo sapiens
accattccgagagct

SEQ ID NO: 212774 - DNA, 15 bp, Homo sapiens
gaccattccgagagc

SEQ ID NO: 212775 - DNA, 15 bp, Homo sapiens
agaccattccgagag

SEQ ID NO: 212776 - DNA, 15 bp, Homo sapiens
cagaccattccgaga

SEQ ID NO: 212777 - DNA, 15 bp, Homo sapiens
gcagaccattccgag

SEQ ID NO: 212778 - DNA, 15 bp, Homo sapiens
tgcagaccattccga

SEQ ID NO: 212779 - DNA, 15 bp, Homo sapiens
ttgcagaccattccg

SEQ ID NO: 212780 - DNA, 15 bp, Homo sapiens
cttgcagaccattcc

SEQ ID NO: 212781 - DNA, 15 bp, Homo sapiens
ccttgcagaccattc

SEQ ID NO: 212782 - DNA, 15 bp, Homo sapiens
gccttgcagaccatt

SEQ ID NO: 212783 - DNA, 15 bp, Homo sapiens
ggccttgcagaccat

SEQ ID NO: 212784 - DNA, 15 bp, Homo sapiens
gggccttgcagacca

SEQ ID NO: 212785 - DNA, 15 bp, Homo sapiens
agggccttgcagacc

SEQ ID NO: 212786 - DNA, 15 bp, Homo sapiens
cagggccttgcagac

SEQ ID NO: 212787 - DNA, 15 bp, Homo sapiens
gcagggccttgcaga

SEQ ID NO: 212788 - DNA, 15 bp, Homo sapiens
ggcagggccttgcag

SEQ ID NO: 212789 - DNA, 15 bp, Homo sapiens
aggcagggccttgca

SEQ ID NO: 212790 - DNA, 15 bp, Homo sapiens
caggcagggccttgc

SEQ ID NO: 212791 - DNA, 15 bp, Homo sapiens
tcaggcagggccttg

SEQ ID NO: 212792 - DNA, 15 bp, Homo sapiens
atcaggcagggcctt

SEQ ID NO: 212793 - DNA, 15 bp, Homo sapiens
gatcaggcagggcct

SEQ ID NO: 212794 - DNA, 15 bp, Homo sapiens
agatcaggcagggcc

SEQ ID NO: 212795 - DNA, 15 bp, Homo sapiens
cagatcaggcagggc

SEQ ID NO: 212796 - DNA, 15 bp, Homo sapiens
tcagatcaggcaggg

SEQ ID NO: 212797 - DNA, 15 bp, Homo sapiens
gtcagatcaggcagg

SEQ ID NO: 212798 - DNA, 15 bp, Homo sapiens
ggtcagatcaggcag

SEQ ID NO: 212799 - DNA, 15 bp, Homo sapiens
aggtcagatcaggca

SEQ ID NO: 212800 - DNA, 15 bp, Homo sapiens
taggtcagatcaggc

SEQ ID NO: 212801 - DNA, 15 bp, Homo sapiens
gtaggtcagatcagg

SEQ ID NO: 212802 - DNA, 15 bp, Homo sapiens
ggtaggtcagatcag

SEQ ID NO: 212803 - DNA, 15 bp, Homo sapiens
gggtaggtcagatca

SEQ ID NO: 212804 - DNA, 15 bp, Homo sapiens
ggggtaggtcagatc

SEQ ID NO: 212805 - DNA, 15 bp, Homo sapiens
gggggtaggtcagat

SEQ ID NO: 212806 - DNA, 15 bp, Homo sapiens
agggggtaggtcaga

SEQ ID NO: 212807 - DNA, 15 bp, Homo sapiens
tagggggtaggtcag

SEQ ID NO: 212808 - DNA, 15 bp, Homo sapiens
gtagggggtaggtca

SEQ ID NO: 212809 - DNA, 15 bp, Homo sapiens
agtagggggtaggtc

SEQ ID NO: 212810 - DNA, 15 bp, Homo sapiens
gagtagggggtaggt

SEQ ID NO: 212811 - DNA, 15 bp, Homo sapiens
tgagtagggggtagg

SEQ ID NO: 212812 - DNA, 15 bp, Homo sapiens
gtgagtagggggtag

SEQ ID NO: 212813 - DNA, 15 bp, Homo sapiens
tgtgagtagggggta

SEQ ID NO: 212814 - DNA, 15 bp, Homo sapiens
gtgtgagtagggggt

SEQ ID NO: 212815 - DNA, 15 bp, Homo sapiens
ggtgtgagtaggggg

SEQ ID NO: 212816 - DNA, 15 bp, Homo sapiens
aggtgtgagtagggg

SEQ ID NO: 212817 - DNA, 15 bp, Homo sapiens
aaggtgtgagtaggg

SEQ ID NO: 212818 - DNA, 15 bp, Homo sapiens
caaggtgtgagtagg

SEQ ID NO: 212819 - DNA, 15 bp, Homo sapiens
gcaaggtgtgagtag

SEQ ID NO: 212820 - DNA, 15 bp, Homo sapiens
agcaaggtgtgagta

SEQ ID NO: 212821 - DNA, 15 bp, Homo sapiens
gagcaaggtgtgagt

SEQ ID NO: 212822 - DNA, 15 bp, Homo sapiens
tgagcaaggtgtgag

SEQ ID NO: 212823 - DNA, 15 bp, Homo sapiens
atgagcaaggtgtga

SEQ ID NO: 212824 - DNA, 15 bp, Homo sapiens
aatgagcaaggtgtg

SEQ ID NO: 212825 - DNA, 15 bp, Homo sapiens
aaatgagcaaggtgt

SEQ ID NO: 212826 - DNA, 15 bp, Homo sapiens
gaaatgagcaaggtg

SEQ ID NO: 212827 - DNA, 15 bp, Homo sapiens
ggaaatgagcaaggt

SEQ ID NO: 212828 - DNA, 15 bp, Homo sapiens
aggaaatgagcaagg

SEQ ID NO: 212829 - DNA, 15 bp, Homo sapiens
gaggaaatgagcaag

SEQ ID NO: 212830 - DNA, 15 bp, Homo sapiens
agaggaaatgagcaa

SEQ ID NO: 212831 - DNA, 15 bp, Homo sapiens
gagaggaaatgagca

SEQ ID NO: 212832 - DNA, 15 bp, Homo sapiens
agagaggaaatgagc

SEQ ID NO: 212833 - DNA, 15 bp, Homo sapiens
aagagaggaaatgag

SEQ ID NO: 212834 - DNA, 15 bp, Homo sapiens
caagagaggaaatga

SEQ ID NO: 212835 - DNA, 15 bp, Homo sapiens
gcaagagaggaaatg

SEQ ID NO: 212836 - DNA, 15 bp, Homo sapiens
agcaagagaggaaat

SEQ ID NO: 212837 - DNA, 15 bp, Homo sapiens
cagcaagagaggaaa

SEQ ID NO: 212838 - DNA, 15 bp, Homo sapiens
acagcaagagaggaa

SEQ ID NO: 212839 - DNA, 15 bp, Homo sapiens
aacagcaagagagga

SEQ ID NO: 212840 - DNA, 15 bp, Homo sapiens
aaacagcaagagagg

SEQ ID NO: 212841 - DNA, 15 bp, Homo sapiens
aaaacagcaagagag

SEQ ID NO: 212842 - DNA, 15 bp, Homo sapiens
aaaaacagcaagaga

SEQ ID NO: 212843 - DNA, 15 bp, Homo sapiens
aaaaaacagcaagag

SEQ ID NO: 212844 - DNA, 15 bp, Homo sapiens
gaaaaaacagcaaga

SEQ ID NO: 212845 - DNA, 15 bp, Homo sapiens
agaaaaaacagcaag

SEQ ID NO: 212846 - DNA, 15 bp, Homo sapiens
gagaaaaaacagcaa

SEQ ID NO: 212847 - DNA, 15 bp, Homo sapiens
agagaaaaaacagca

SEQ ID NO: 212848 - DNA, 15 bp, Homo sapiens
cagagaaaaaacagc

SEQ ID NO: 212849 - DNA, 15 bp, Homo sapiens
tcagagaaaaaacag

SEQ ID NO: 212850 - DNA, 15 bp, Homo sapiens
gtcagagaaaaaaca

SEQ ID NO: 212851 - DNA, 15 bp, Homo sapiens
tgtcagagaaaaaac

SEQ ID NO: 212852 - DNA, 15 bp, Homo sapiens
gtgtcagagaaaaaa

SEQ ID NO: 212853 - DNA, 15 bp, Homo sapiens
tgtgtcagagaaaaa

SEQ ID NO: 212854 - DNA, 15 bp, Homo sapiens
gtgtgtcagagaaaa

SEQ ID NO: 212855 - DNA, 15 bp, Homo sapiens
agtgtgtcagagaaa

SEQ ID NO: 212856 - DNA, 15 bp, Homo sapiens
cagtgtgtcagagaa

SEQ ID NO: 212857 - DNA, 15 bp, Homo sapiens
ccagtgtgtcagaga

SEQ ID NO: 212858 - DNA, 15 bp, Homo sapiens
accagtgtgtcagag

SEQ ID NO: 212859 - DNA, 15 bp, Homo sapiens
aaccagtgtgtcaga

SEQ ID NO: 212860 - DNA, 15 bp, Homo sapiens
aaaccagtgtgtcag

SEQ ID NO: 212861 - DNA, 15 bp, Homo sapiens
gaaaccagtgtgtca

SEQ ID NO: 212862 - DNA, 15 bp, Homo sapiens
cgaaaccagtgtgtc

SEQ ID NO: 212863 - DNA, 15 bp, Homo sapiens
ccgaaaccagtgtgt

SEQ ID NO: 212864 - DNA, 15 bp, Homo sapiens
gccgaaaccagtgtg

SEQ ID NO: 212865 - DNA, 15 bp, Homo sapiens
ggccgaaaccagtgt

SEQ ID NO: 212866 - DNA, 15 bp, Homo sapiens
tggccgaaaccagtg

SEQ ID NO: 212867 - DNA, 15 bp, Homo sapiens
gtggccgaaaccagt

SEQ ID NO: 212868 - DNA, 15 bp, Homo sapiens
tgtggccgaaaccag

SEQ ID NO: 212869 - DNA, 15 bp, Homo sapiens
gtgtggccgaaacca

SEQ ID NO: 212870 - DNA, 15 bp, Homo sapiens
agtgtggccgaaacc

SEQ ID NO: 212871 - DNA, 15 bp, Homo sapiens
cagtgtggccgaaac

SEQ ID NO: 212872 - DNA, 15 bp, Homo sapiens
ccagtgtggccgaaa

SEQ ID NO: 212873 - DNA, 15 bp, Homo sapiens
accagtgtggccgaa

SEQ ID NO: 212874 - DNA, 15 bp, Homo sapiens
gaccagtgtggccga

SEQ ID NO: 212875 - DNA, 15 bp, Homo sapiens
ggaccagtgtggccg

SEQ ID NO: 212876 - DNA, 15 bp, Homo sapiens
gggaccagtgtggcc

SEQ ID NO: 212877 - DNA, 15 bp, Homo sapiens
agggaccagtgtggc

SEQ ID NO: 212878 - DNA, 15 bp, Homo sapiens
aagggaccagtgtgg

SEQ ID NO: 212879 - DNA, 15 bp, Homo sapiens
caagggaccagtgtg

SEQ ID NO: 212880 - DNA, 15 bp, Homo sapiens
gcaagggaccagtgt

SEQ ID NO: 212881 - DNA, 15 bp, Homo sapiens
agcaagggaccagtg

SEQ ID NO: 212882 - DNA, 15 bp, Homo sapiens
cagcaagggaccagt

SEQ ID NO: 212883 - DNA, 15 bp, Homo sapiens
tcagcaagggaccag

SEQ ID NO: 212884 - DNA, 15 bp, Homo sapiens
ctcagcaagggacca

SEQ ID NO: 212885 - DNA, 15 bp, Homo sapiens
gctcagcaagggacc

SEQ ID NO: 212886 - DNA, 15 bp, Homo sapiens
agctcagcaagggac

SEQ ID NO: 212887 - DNA, 15 bp, Homo sapiens
aagctcagcaaggga

SEQ ID NO: 212888 - DNA, 15 bp, Homo sapiens
aaagctcagcaaggg

SEQ ID NO: 212889 - DNA, 15 bp, Homo sapiens
gaaagctcagcaagg

SEQ ID NO: 212890 - DNA, 15 bp, Homo sapiens
tgaaagctcagcaag

SEQ ID NO: 212891 - DNA, 15 bp, Homo sapiens
ctgaaagctcagcaa

SEQ ID NO: 212892 - DNA, 15 bp, Homo sapiens
actgaaagctcagca

SEQ ID NO: 212893 - DNA, 15 bp, Homo sapiens
gactgaaagctcagc

SEQ ID NO: 212894 - DNA, 15 bp, Homo sapiens
tgactgaaagctcag

SEQ ID NO: 212895 - DNA, 15 bp, Homo sapiens
gtgactgaaagctca

SEQ ID NO: 212896 - DNA, 15 bp, Homo sapiens
tgtgactgaaagctc

SEQ ID NO: 212897 - DNA, 15 bp, Homo sapiens
ctgtgactgaaagct

SEQ ID NO: 212898 - DNA, 15 bp, Homo sapiens
actgtgactgaaagc

SEQ ID NO: 212899 - DNA, 15 bp, Homo sapiens
cactgtgactgaaag

SEQ ID NO: 212900 - DNA, 15 bp, Homo sapiens
gcactgtgactgaaa

SEQ ID NO: 212901 - DNA, 15 bp, Homo sapiens
ggcactgtgactgaa

SEQ ID NO: 212902 - DNA, 15 bp, Homo sapiens
tggcactgtgactga

SEQ ID NO: 212903 - DNA, 15 bp, Homo sapiens
ctggcactgtgactg

SEQ ID NO: 212904 - DNA, 15 bp, Homo sapiens
gctggcactgtgact

SEQ ID NO: 212905 - DNA, 15 bp, Homo sapiens
ggctggcactgtgac

SEQ ID NO: 212906 - DNA, 15 bp, Homo sapiens
aggctggcactgtga

SEQ ID NO: 212907 - DNA, 15 bp, Homo sapiens
caggctggcactgtg

SEQ ID NO: 212908 - DNA, 15 bp, Homo sapiens
acaggctggcactgt

SEQ ID NO: 212909 - DNA, 15 bp, Homo sapiens
gacaggctggcactg

SEQ ID NO: 212910 - DNA, 15 bp, Homo sapiens
agacaggctggcact

SEQ ID NO: 212911 - DNA, 15 bp, Homo sapiens
cagacaggctggcac

SEQ ID NO: 212912 - DNA, 15 bp, Homo sapiens
gcagacaggctggca

SEQ ID NO: 212913 - DNA, 15 bp, Homo sapiens
agcagacaggctggc

SEQ ID NO: 212914 - DNA, 15 bp, Homo sapiens
gagcagacaggctgg

SEQ ID NO: 212915 - DNA, 15 bp, Homo sapiens
agagcagacaggctg

SEQ ID NO: 212916 - DNA, 15 bp, Homo sapiens
cagagcagacaggct

SEQ ID NO: 212917 - DNA, 15 bp, Homo sapiens
gcagagcagacaggc

SEQ ID NO: 212918 - DNA, 15 bp, Homo sapiens
ggcagagcagacagg

SEQ ID NO: 212919 - DNA, 15 bp, Homo sapiens
gggcagagcagacag

SEQ ID NO: 212920 - DNA, 15 bp, Homo sapiens
tgggcagagcagaca

SEQ ID NO: 212921 - DNA, 15 bp, Homo sapiens
ttgggcagagcagac

SEQ ID NO: 212922 - DNA, 15 bp, Homo sapiens
tttgggcagagcaga

SEQ ID NO: 212923 - DNA, 15 bp, Homo sapiens
ttttgggcagagcag

SEQ ID NO: 212924 - DNA, 15 bp, Homo sapiens
attttgggcagagca

SEQ ID NO: 212925 - DNA, 15 bp, Homo sapiens
cattttgggcagagc

SEQ ID NO: 212926 - DNA, 15 bp, Homo sapiens
gcattttgggcagag

SEQ ID NO: 212927 - DNA, 15 bp, Homo sapiens
ggcattttgggcaga

SEQ ID NO: 212928 - DNA, 15 bp, Homo sapiens
gggcattttgggcag

SEQ ID NO: 212929 - DNA, 15 bp, Homo sapiens
ggggcattttgggca

SEQ ID NO: 212930 - DNA, 15 bp, Homo sapiens
aggggcattttgggc

SEQ ID NO: 212931 - DNA, 15 bp, Homo sapiens
aaggggcattttggg

SEQ ID NO: 212932 - DNA, 15 bp, Homo sapiens
gaaggggcattttgg

SEQ ID NO: 212933 - DNA, 15 bp, Homo sapiens
agaaggggcattttg

SEQ ID NO: 212934 - DNA, 15 bp, Homo sapiens
aagaaggggcatttt

SEQ ID NO: 212935 - DNA, 15 bp, Homo sapiens
aaagaaggggcattt

SEQ ID NO: 212936 - DNA, 15 bp, Homo sapiens
taaagaaggggcatt

SEQ ID NO: 212937 - DNA, 15 bp, Homo sapiens
gtaaagaaggggcat

SEQ ID NO: 212938 - DNA, 15 bp, Homo sapiens
agtaaagaaggggca

SEQ ID NO: 212939 - DNA, 15 bp, Homo sapiens
gagtaaagaaggggc

SEQ ID NO: 212940 - DNA, 15 bp, Homo sapiens
tgagtaaagaagggg

SEQ ID NO: 212941 - DNA, 15 bp, Homo sapiens
ttgagtaaagaaggg

SEQ ID NO: 212942 - DNA, 15 bp, Homo sapiens
gttgagtaaagaagg

SEQ ID NO: 212943 - DNA, 15 bp, Homo sapiens
agttgagtaaagaag

SEQ ID NO: 212944 - DNA, 15 bp, Homo sapiens
aagttgagtaaagaa

SEQ ID NO: 212945 - DNA, 15 bp, Homo sapiens
gaagttgagtaaaga

SEQ ID NO: 212946 - DNA, 15 bp, Homo sapiens
agaagttgagtaaag

SEQ ID NO: 212947 - DNA, 15 bp, Homo sapiens
gagaagttgagtaaa

SEQ ID NO: 212948 - DNA, 15 bp, Homo sapiens
agagaagttgagtaa

SEQ ID NO: 212949 - DNA, 15 bp, Homo sapiens
tagagaagttgagta

SEQ ID NO: 212950 - DNA, 15 bp, Homo sapiens
gtagagaagttgagt

SEQ ID NO: 212951 - DNA, 15 bp, Homo sapiens
agtagagaagttgag

SEQ ID NO: 212952 - DNA, 15 bp, Homo sapiens
aagtagagaagttga

SEQ ID NO: 212953 - DNA, 15 bp, Homo sapiens
caagtagagaagttg

SEQ ID NO: 212954 - DNA, 15 bp, Homo sapiens
tcaagtagagaagtt

SEQ ID NO: 212955 - DNA, 15 bp, Homo sapiens
ttcaagtagagaagt

SEQ ID NO: 212956 - DNA, 15 bp, Homo sapiens
gttcaagtagagaag

SEQ ID NO: 212957 - DNA, 15 bp, Homo sapiens
agttcaagtagagaa

SEQ ID NO: 212958 - DNA, 15 bp, Homo sapiens
cagttcaagtagaga

SEQ ID NO: 212959 - DNA, 15 bp, Homo sapiens
gcagttcaagtagag

SEQ ID NO: 212960 - DNA, 15 bp, Homo sapiens
tgcagttcaagtaga

SEQ ID NO: 212961 - DNA, 15 bp, Homo sapiens
ctgcagttcaagtag

SEQ ID NO: 212962 - DNA, 15 bp, Homo sapiens
gctgcagttcaagta

SEQ ID NO: 212963 - DNA, 15 bp, Homo sapiens
agctgcagttcaagt

SEQ ID NO: 212964 - DNA, 15 bp, Homo sapiens
gagctgcagttcaag

SEQ ID NO: 212965 - DNA, 15 bp, Homo sapiens
ggagctgcagttcaa

SEQ ID NO: 212966 - DNA, 15 bp, Homo sapiens
gggagctgcagttca

SEQ ID NO: 212967 - DNA, 15 bp, Homo sapiens
agggagctgcagttc

SEQ ID NO: 212968 - DNA, 15 bp, Homo sapiens
gagggagctgcagtt

SEQ ID NO: 212969 - DNA, 15 bp, Homo sapiens
agagggagctgcagt

SEQ ID NO: 212970 - DNA, 15 bp, Homo sapiens
cagagggagctgcag

SEQ ID NO: 212971 - DNA, 15 bp, Homo sapiens
tcagagggagctgca

SEQ ID NO: 212972 - DNA, 15 bp, Homo sapiens
ctcagagggagctgc

SEQ ID NO: 212973 - DNA, 15 bp, Homo sapiens
gctcagagggagctg

SEQ ID NO: 212974 - DNA, 15 bp, Homo sapiens
tgctcagagggagct

SEQ ID NO: 212975 - DNA, 15 bp, Homo sapiens
gtgctcagagggagc

SEQ ID NO: 212976 - DNA, 15 bp, Homo sapiens
agtgctcagagggag

SEQ ID NO: 212977 - DNA, 15 bp, Homo sapiens
gagtgctcagaggga

SEQ ID NO: 212978 - DNA, 15 bp, Homo sapiens
ggagtgctcagaggg

SEQ ID NO: 212979 - DNA, 15 bp, Homo sapiens
aggagtgctcagagg

SEQ ID NO: 212980 - DNA, 15 bp, Homo sapiens
aaggagtgctcagag

SEQ ID NO: 212981 - DNA, 15 bp, Homo sapiens
gaaggagtgctcaga

SEQ ID NO: 212982 - DNA, 15 bp, Homo sapiens
agaaggagtgctcag

SEQ ID NO: 212983 - DNA, 15 bp, Homo sapiens
gagaaggagtgctca

SEQ ID NO: 212984 - DNA, 15 bp, Homo sapiens
agagaaggagtgctc

SEQ ID NO: 212985 - DNA, 15 bp, Homo sapiens
gagagaaggagtgct

SEQ ID NO: 212986 - DNA, 15 bp, Homo sapiens
agagagaaggagtgc

SEQ ID NO: 212987 - DNA, 15 bp, Homo sapiens
gagagagaaggagtg

SEQ ID NO: 212988 - DNA, 15 bp, Homo sapiens
agagagagaaggagt

SEQ ID NO: 212989 - DNA, 15 bp, Homo sapiens
gagagagagaaggag

SEQ ID NO: 212990 - DNA, 15 bp, Homo sapiens
agagagagagaagga

SEQ ID NO: 212991 - DNA, 15 bp, Homo sapiens
gagagagagagaagg

SEQ ID NO: 212992 - DNA, 15 bp, Homo sapiens
tgagagagagagaag

SEQ ID NO: 212993 - DNA, 15 bp, Homo sapiens
atgagagagagagaa

SEQ ID NO: 212994 - DNA, 15 bp, Homo sapiens
aatgagagagagaga

SEQ ID NO: 212995 - DNA, 15 bp, Homo sapiens
gaatgagagagagag

SEQ ID NO: 212996 - DNA, 15 bp, Homo sapiens
agaatgagagagaga

SEQ ID NO: 212997 - DNA, 15 bp, Homo sapiens
gagaatgagagagag

SEQ ID NO: 212998 - DNA, 15 bp, Homo sapiens
agagaatgagagaga

SEQ ID NO: 212999 - DNA, 15 bp, Homo sapiens
gagagaatgagagag

SEQ ID NO: 213000 - DNA, 15 bp, Homo sapiens
agagagaatgagaga

SEQ ID NO: 213001 - DNA, 15 bp, Homo sapiens
agagagagagaatga

SEQ ID NO: 213002 - DNA, 15 bp, Homo sapiens
aagagagagagaatg

SEQ ID NO: 213003 - DNA, 15 bp, Homo sapiens
gaagagagagagaat

SEQ ID NO: 213004 - DNA, 15 bp, Homo sapiens
ggaagagagagagaa

SEQ ID NO: 213005 - DNA, 15 bp, Homo sapiens
gggaagagagagaga

SEQ ID NO: 213006 - DNA, 15 bp, Homo sapiens
ggggaagagagagag

SEQ ID NO: 213007 - DNA, 15 bp, Homo sapiens
gggggaagagagaga

SEQ ID NO: 213008 - DNA, 15 bp, Homo sapiens
ggggggaagagagag

SEQ ID NO: 213009 - DNA, 15 bp, Homo sapiens
gggggggaagagaga

SEQ ID NO: 213010 - DNA, 15 bp, Homo sapiens
ggggggggaagagag

SEQ ID NO: 213011 - DNA, 15 bp, Homo sapiens
tggggggggaagaga

SEQ ID NO: 213012 - DNA, 15 bp, Homo sapiens
gtggggggggaagag

SEQ ID NO: 213013 - DNA, 15 bp, Homo sapiens
ggtggggggggaaga

SEQ ID NO: 213014 - DNA, 15 bp, Homo sapiens
gggtggggggggaag

SEQ ID NO: 213015 - DNA, 15 bp, Homo sapiens
agggtggggggggaa

SEQ ID NO: 213016 - DNA, 15 bp, Homo sapiens
aagggtgggggggga

SEQ ID NO: 213017 - DNA, 15 bp, Homo sapiens
aaagggtgggggggg

SEQ ID NO: 213018 - DNA, 15 bp, Homo sapiens
aaaagggtggggggg

SEQ ID NO: 213019 - DNA, 15 bp, Homo sapiens
gaaaagggtgggggg

SEQ ID NO: 213020 - DNA, 15 bp, Homo sapiens
agaaaagggtggggg

SEQ ID NO: 213021 - DNA, 15 bp, Homo sapiens
tagaaaagggtgggg

SEQ ID NO: 213022 - DNA, 15 bp, Homo sapiens
gtagaaaagggtggg

SEQ ID NO: 213023 - DNA, 15 bp, Homo sapiens
agtagaaaagggtgg

SEQ ID NO: 213024 - DNA, 15 bp, Homo sapiens
aagtagaaaagggtg

SEQ ID NO: 213025 - DNA, 15 bp, Homo sapiens
gaagtagaaaagggt

SEQ ID NO: 213026 - DNA, 15 bp, Homo sapiens
agaagtagaaaaggg

SEQ ID NO: 213027 - DNA, 15 bp, Homo sapiens
aagaagtagaaaagg

SEQ ID NO: 213028 - DNA, 15 bp, Homo sapiens
aaagaagtagaaaag

SEQ ID NO: 213029 - DNA, 15 bp, Homo sapiens
gaaagaagtagaaaa

SEQ ID NO: 213030 - DNA, 15 bp, Homo sapiens
agaaagaagtagaaa

SEQ ID NO: 213031 - DNA, 15 bp, Homo sapiens
aagaaagaagtagaa

SEQ ID NO: 213032 - DNA, 15 bp, Homo sapiens
aaagaaagaagtaga

SEQ ID NO: 213033 - DNA, 15 bp, Homo sapiens
aaaagaaagaagtag

SEQ ID NO: 213034 - DNA, 15 bp, Homo sapiens
aaaaagaaagaagta

SEQ ID NO: 213035 - DNA, 15 bp, Homo sapiens
gaaaaagaaagaagt

SEQ ID NO: 213036 - DNA, 15 bp, Homo sapiens
agaaaaagaaagaag

SEQ ID NO: 213037 - DNA, 15 bp, Homo sapiens
tagaaaaagaaagaa

SEQ ID NO: 213038 - DNA, 15 bp, Homo sapiens
atagaaaaagaaaga

SEQ ID NO: 213039 - DNA, 15 bp, Homo sapiens
tatagaaaaagaaag

SEQ ID NO: 213040 - DNA, 15 bp, Homo sapiens
ctatagaaaaagaaa

SEQ ID NO: 213041 - DNA, 15 bp, Homo sapiens
gctatagaaaaagaa

SEQ ID NO: 213042 - DNA, 15 bp, Homo sapiens
tgctatagaaaaaga

SEQ ID NO: 213043 - DNA, 15 bp, Homo sapiens
atgctatagaaaaag

SEQ ID NO: 213044 - DNA, 15 bp, Homo sapiens
aatgctatagaaaaa

SEQ ID NO: 213045 - DNA, 15 bp, Homo sapiens
aaatgctatagaaaa

SEQ ID NO: 213046 - DNA, 15 bp, Homo sapiens
taaatgctatagaaa

SEQ ID NO: 213047 - DNA, 15 bp, Homo sapiens
ataaatgctatagaa

SEQ ID NO: 213048 - DNA, 15 bp, Homo sapiens
gataaatgctataga

SEQ ID NO: 213049 - DNA, 15 bp, Homo sapiens
tgataaatgctatag

SEQ ID NO: 213050 - DNA, 15 bp, Homo sapiens
ctgataaatgctata

SEQ ID NO: 213051 - DNA, 15 bp, Homo sapiens
tctgataaatgctat

SEQ ID NO: 213052 - DNA, 15 bp, Homo sapiens
ttctgataaatgcta

SEQ ID NO: 213053 - DNA, 15 bp, Homo sapiens
attctgataaatgct

SEQ ID NO: 213054 - DNA, 15 bp, Homo sapiens
gattctgataaatgc

SEQ ID NO: 213055 - DNA, 15 bp, Homo sapiens
agattctgataaatg

SEQ ID NO: 213056 - DNA, 15 bp, Homo sapiens
tagattctgataaat

SEQ ID NO: 213057 - DNA, 15 bp, Homo sapiens
ttagattctgataaa

SEQ ID NO: 213058 - DNA, 15 bp, Homo sapiens
gttagattctgataa

SEQ ID NO: 213059 - DNA, 15 bp, Homo sapiens
tgttagattctgata

SEQ ID NO: 213060 - DNA, 15 bp, Homo sapiens
gtgttagattctgat

SEQ ID NO: 213061 - DNA, 15 bp, Homo sapiens
tgtgttagattctga

SEQ ID NO: 213062 - DNA, 15 bp, Homo sapiens
ttgtgttagattctg

SEQ ID NO: 213063 - DNA, 15 bp, Homo sapiens
attgtgttagattct

SEQ ID NO: 213064 - DNA, 15 bp, Homo sapiens
cattgtgttagattc

SEQ ID NO: 213065 - DNA, 15 bp, Homo sapiens
tcattgtgttagatt

SEQ ID NO: 213066 - DNA, 15 bp, Homo sapiens
gtcattgtgttagat

SEQ ID NO: 213067 - DNA, 15 bp, Homo sapiens
agtcattgtgttaga

SEQ ID NO: 213068 - DNA, 15 bp, Homo sapiens
aagtcattgtgttag

SEQ ID NO: 213069 - DNA, 15 bp, Homo sapiens
taagtcattgtgtta

SEQ ID NO: 213070 - DNA, 15 bp, Homo sapiens
ataagtcattgtgtt

SEQ ID NO: 213071 - DNA, 15 bp, Homo sapiens
aataagtcattgtgt

SEQ ID NO: 213072 - DNA, 15 bp, Homo sapiens
aaataagtcattgtg

SEQ ID NO: 213073 - DNA, 15 bp, Homo sapiens
aaaataagtcattgt

SEQ ID NO: 213074 - DNA, 15 bp, Homo sapiens
gaaaataagtcattg

SEQ ID NO: 213075 - DNA, 15 bp, Homo sapiens
agaaaataagtcatt

SEQ ID NO: 213076 - DNA, 15 bp, Homo sapiens
tagaaaataagtcat

SEQ ID NO: 213077 - DNA, 15 bp, Homo sapiens
atagaaaataagtca

SEQ ID NO: 213078 - DNA, 15 bp, Homo sapiens
catagaaaataagtc

SEQ ID NO: 213079 - DNA, 15 bp, Homo sapiens
acatagaaaataagt

SEQ ID NO: 213080 - DNA, 15 bp, Homo sapiens
gacatagaaaataag

SEQ ID NO: 213081 - DNA, 15 bp, Homo sapiens
agacatagaaaataa

SEQ ID NO: 213082 - DNA, 15 bp, Homo sapiens
aagacatagaaaata

SEQ ID NO: 213083 - DNA, 15 bp, Homo sapiens
aaagacatagaaaat

SEQ ID NO: 213084 - DNA, 15 bp, Homo sapiens
aaaagacatagaaaa

SEQ ID NO: 213085 - DNA, 15 bp, Homo sapiens
aaaaagacatagaaa

SEQ ID NO: 213086 - DNA, 15 bp, Homo sapiens
aaaaaagacatagaa

SEQ ID NO: 213087 - DNA, 15 bp, Homo sapiens
aaaaaaagacataga

SEQ ID NO: 213088 - DNA, 15 bp, Homo sapiens
aaaaaaaagacatag

SEQ ID NO: 213089 - DNA, 15 bp, Homo sapiens
aaaaaaaaagacata

SEQ ID NO: 213090 - DNA, 15 bp, Homo sapiens
aaaaaaaaaagacat

SEQ ID NO: 213091 - DNA, 15 bp, Homo sapiens
aaaaaaaaaaagaca

SEQ ID NO: 213092 - DNA, 15 bp, Homo sapiens
caagcaaaaaaaaaa

SEQ ID NO: 213093 - DNA, 15 bp, Homo sapiens
ccaagcaaaaaaaaa

SEQ ID NO: 213094 - DNA, 15 bp, Homo sapiens
accaagcaaaaaaaa

SEQ ID NO: 213095 - DNA, 15 bp, Homo sapiens
taccaagcaaaaaaa

SEQ ID NO: 213096 - DNA, 15 bp, Homo sapiens
gtaccaagcaaaaaa

SEQ ID NO: 213097 - DNA, 15 bp, Homo sapiens
agtaccaagcaaaaa

SEQ ID NO: 213098 - DNA, 15 bp, Homo sapiens
gagtaccaagcaaaa

SEQ ID NO: 213099 - DNA, 15 bp, Homo sapiens
agagtaccaagcaaa

SEQ ID NO: 213100 - DNA, 15 bp, Homo sapiens
cagagtaccaagcaa

SEQ ID NO: 213101 - DNA, 15 bp, Homo sapiens
ccagagtaccaagca

SEQ ID NO: 213102 - DNA, 15 bp, Homo sapiens
tccagagtaccaagc

SEQ ID NO: 213103 - DNA, 15 bp, Homo sapiens
atccagagtaccaag

SEQ ID NO: 213104 - DNA, 15 bp, Homo sapiens
catccagagtaccaa

SEQ ID NO: 213105 - DNA, 15 bp, Homo sapiens
gcatccagagtacca

SEQ ID NO: 213106 - DNA, 15 bp, Homo sapiens
agcatccagagtacc

SEQ ID NO: 213107 - DNA, 15 bp, Homo sapiens
gagcatccagagtac

SEQ ID NO: 213108 - DNA, 15 bp, Homo sapiens
cgagcatccagagta

SEQ ID NO: 213109 - DNA, 15 bp, Homo sapiens
tcgagcatccagagt

SEQ ID NO: 213110 - DNA, 15 bp, Homo sapiens
atcgagcatccagag

SEQ ID NO: 213111 - DNA, 15 bp, Homo sapiens
tatcgagcatccaga

SEQ ID NO: 213112 - DNA, 15 bp, Homo sapiens
ttatcgagcatccag

SEQ ID NO: 213113 - DNA, 15 bp, Homo sapiens
tttatcgagcatcca

SEQ ID NO: 213114 - DNA, 15 bp, Homo sapiens
ttttatcgagcatcc

SEQ ID NO: 213115 - DNA, 15 bp, Homo sapiens
cttttatcgagcatc

SEQ ID NO: 213116 - DNA, 15 bp, Homo sapiens
acttttatcgagcat

SEQ ID NO: 213117 - DNA, 15 bp, Homo sapiens
aacttttatcgagca

SEQ ID NO: 213118 - DNA, 15 bp, Homo sapiens
caacttttatcgagc

SEQ ID NO: 213119 - DNA, 15 bp, Homo sapiens
tcaacttttatcgag

SEQ ID NO: 213120 - DNA, 15 bp, Homo sapiens
ttcaacttttatcga

SEQ ID NO: 213121 - DNA, 15 bp, Homo sapiens
attcaacttttatcg

SEQ ID NO: 213122 - DNA, 15 bp, Homo sapiens
cattcaacttttatc

SEQ ID NO: 213123 - DNA, 15 bp, Homo sapiens
acattcaacttttat

SEQ ID NO: 213124 - DNA, 15 bp, Homo sapiens
aacattcaactttta

SEQ ID NO: 213125 - DNA, 15 bp, Homo sapiens
caacattcaactttt

SEQ ID NO: 213126 - DNA, 15 bp, Homo sapiens
tcaacattcaacttt

SEQ ID NO: 213127 - DNA, 15 bp, Homo sapiens
gtcaacattcaactt

SEQ ID NO: 213128 - DNA, 15 bp, Homo sapiens
agtcaacattcaact

SEQ ID NO: 213129 - DNA, 15 bp, Homo sapiens
cagtcaacattcaac

SEQ ID NO: 213130 - DNA, 15 bp, Homo sapiens
tcagtcaacattcaa

SEQ ID NO: 213131 - DNA, 15 bp, Homo sapiens
ttcagtcaacattca

SEQ ID NO: 213132 - DNA, 15 bp, Homo sapiens
tttcagtcaacattc

SEQ ID NO: 213133 - DNA, 15 bp, Homo sapiens
ctttcagtcaacatt

SEQ ID NO: 213134 - DNA, 15 bp, Homo sapiens
tctttcagtcaacat

SEQ ID NO: 213135 - DNA, 15 bp, Homo sapiens
ctctttcagtcaaca

SEQ ID NO: 213136 - DNA, 15 bp, Homo sapiens
gctctttcagtcaac

SEQ ID NO: 213137 - DNA, 15 bp, Homo sapiens
agctctttcagtcaa

SEQ ID NO: 213138 - DNA, 15 bp, Homo sapiens
tagctctttcagtca

SEQ ID NO: 213139 - DNA, 15 bp, Homo sapiens
atagctctttcagtc

SEQ ID NO: 213140 - DNA, 15 bp, Homo sapiens
tatagctctttcagt

SEQ ID NO: 213141 - DNA, 15 bp, Homo sapiens
gtatagctctttcag

SEQ ID NO: 213142 - DNA, 15 bp, Homo sapiens
ggtatagctctttca

SEQ ID NO: 213143 - DNA, 15 bp, Homo sapiens
gggtatagctctttc

SEQ ID NO: 213144 - DNA, 15 bp, Homo sapiens
tgggtatagctcttt

SEQ ID NO: 213145 - DNA, 15 bp, Homo sapiens
ttgggtatagctctt

SEQ ID NO: 213146 - DNA, 15 bp, Homo sapiens
cttgggtatagctct

SEQ ID NO: 213147 - DNA, 15 bp, Homo sapiens
ccttgggtatagctc

SEQ ID NO: 213148 - DNA, 15 bp, Homo sapiens
cccttgggtatagct

SEQ ID NO: 213149 - DNA, 15 bp, Homo sapiens
tcccttgggtatagc

SEQ ID NO: 213150 - DNA, 15 bp, Homo sapiens
ttcccttgggtatag

SEQ ID NO: 213151 - DNA, 15 bp, Homo sapiens
gttcccttgggtata

SEQ ID NO: 213152 - DNA, 15 bp, Homo sapiens
tgttcccttgggtat

SEQ ID NO: 213153 - DNA, 15 bp, Homo sapiens
atgttcccttgggta

SEQ ID NO: 213154 - DNA, 15 bp, Homo sapiens
catgttcccttgggt

SEQ ID NO: 213155 - DNA, 15 bp, Homo sapiens
acatgttcccttggg

SEQ ID NO: 213156 - DNA, 15 bp, Homo sapiens
gacatgttcccttgg

SEQ ID NO: 213157 - DNA, 15 bp, Homo sapiens
ggacatgttcccttg

SEQ ID NO: 213158 - DNA, 15 bp, Homo sapiens
aggacatgttccctt

SEQ ID NO: 213159 - DNA, 15 bp, Homo sapiens
aaggacatgttccct

SEQ ID NO: 213160 - DNA, 15 bp, Homo sapiens
aaaggacatgttccc

SEQ ID NO: 213161 - DNA, 15 bp, Homo sapiens
caaaggacatgttcc

SEQ ID NO: 213162 - DNA, 15 bp, Homo sapiens
ccaaaggacatgttc

SEQ ID NO: 213163 - DNA, 15 bp, Homo sapiens
accaaaggacatgtt

SEQ ID NO: 213164 - DNA, 15 bp, Homo sapiens
caccaaaggacatgt

SEQ ID NO: 213165 - DNA, 15 bp, Homo sapiens
acaccaaaggacatg

SEQ ID NO: 213166 - DNA, 15 bp, Homo sapiens
cacaccaaaggacat

SEQ ID NO: 213167 - DNA, 15 bp, Homo sapiens
tcacaccaaaggaca

SEQ ID NO: 213168 - DNA, 15 bp, Homo sapiens
ttcacaccaaaggac

SEQ ID NO: 213169 - DNA, 15 bp, Homo sapiens
attcacaccaaagga

SEQ ID NO: 213170 - DNA, 15 bp, Homo sapiens
cattcacaccaaagg

SEQ ID NO: 213171 - DNA, 15 bp, Homo sapiens
acattcacaccaaag

SEQ ID NO: 213172 - DNA, 15 bp, Homo sapiens
aacattcacaccaaa

SEQ ID NO: 213173 - DNA, 15 bp, Homo sapiens
gaacattcacaccaa

SEQ ID NO: 213174 - DNA, 15 bp, Homo sapiens
ggaacattcacacca

SEQ ID NO: 213175 - DNA, 15 bp, Homo sapiens
aggaacattcacacc

SEQ ID NO: 213176 - DNA, 15 bp, Homo sapiens
aaggaacattcacac

SEQ ID NO: 213177 - DNA, 15 bp, Homo sapiens
aaaggaacattcaca

SEQ ID NO: 213178 - DNA, 15 bp, Homo sapiens
aaaaggaacattcac

SEQ ID NO: 213179 - DNA, 15 bp, Homo sapiens
caaaaggaacattca

SEQ ID NO: 213180 - DNA, 15 bp, Homo sapiens
acaaaaggaacattc

SEQ ID NO: 213181 - DNA, 15 bp, Homo sapiens
gacaaaaggaacatt

SEQ ID NO: 213182 - DNA, 15 bp, Homo sapiens
agacaaaaggaacat

SEQ ID NO: 213183 - DNA, 15 bp, Homo sapiens
gagacaaaaggaaca

SEQ ID NO: 213184 - DNA, 15 bp, Homo sapiens
agagacaaaaggaac

SEQ ID NO: 213185 - DNA, 15 bp, Homo sapiens
aagagacaaaaggaa

SEQ ID NO: 213186 - DNA, 15 bp, Homo sapiens
aaagagacaaaagga

SEQ ID NO: 213187 - DNA, 15 bp, Homo sapiens
taaagagacaaaagg

SEQ ID NO: 213188 - DNA, 15 bp, Homo sapiens
ataaagagacaaaag

SEQ ID NO: 213189 - DNA, 15 bp, Homo sapiens
aataaagagacaaaa

SEQ ID NO: 213190 - DNA, 15 bp, Homo sapiens
aaataaagagacaaa

SEQ ID NO: 213191 - DNA, 15 bp, Homo sapiens
gaaataaagagacaa

SEQ ID NO: 213192 - DNA, 15 bp, Homo sapiens
agaaataaagagaca

SEQ ID NO: 213193 - DNA, 15 bp, Homo sapiens
gagaaataaagagac

SEQ ID NO: 213194 - DNA, 15 bp, Homo sapiens
tgagaaataaagaga

SEQ ID NO: 213195 - DNA, 15 bp, Homo sapiens
ctgagaaataaagag

SEQ ID NO: 213196 - DNA, 15 bp, Homo sapiens
actgagaaataaaga

SEQ ID NO: 213197 - DNA, 15 bp, Homo sapiens
tactgagaaataaag

SEQ ID NO: 213198 - DNA, 15 bp, Homo sapiens
ttactgagaaataaa

SEQ ID NO: 213199 - DNA, 15 bp, Homo sapiens
attactgagaaataa

SEQ ID NO: 213200 - DNA, 15 bp, Homo sapiens
aattactgagaaata

SEQ ID NO: 213201 - DNA, 15 bp, Homo sapiens
gaattactgagaaat

SEQ ID NO: 213202 - DNA, 15 bp, Homo sapiens
agaattactgagaaa

SEQ ID NO: 213203 - DNA, 15 bp, Homo sapiens
aagaattactgagaa

SEQ ID NO: 213204 - DNA, 15 bp, Homo sapiens
aaagaattactgaga

SEQ ID NO: 213205 - DNA, 15 bp, Homo sapiens
aaaagaattactgag

SEQ ID NO: 213206 - DNA, 15 bp, Homo sapiens
aaaaagaattactga

SEQ ID NO: 213207 - DNA, 15 bp, Homo sapiens
aaaaaagaattactg

SEQ ID NO: 213208 - DNA, 15 bp, Homo sapiens
taaaaaagaattact

SEQ ID NO: 213209 - DNA, 15 bp, Homo sapiens
ataaaaaagaattac

SEQ ID NO: 213210 - DNA, 15 bp, Homo sapiens
aataaaaaagaatta

SEQ ID NO: 213211 - DNA, 15 bp, Homo sapiens
gaataaaaaagaatt

SEQ ID NO: 213212 - DNA, 15 bp, Homo sapiens
tgaataaaaaagaat

SEQ ID NO: 213213 - DNA, 15 bp, Homo sapiens
atgaataaaaaagaa

SEQ ID NO: 213214 - DNA, 15 bp, Homo sapiens
aatgaataaaaaaga

SEQ ID NO: 213215 - DNA, 15 bp, Homo sapiens
aaatgaataaaaaag

SEQ ID NO: 213216 - DNA, 15 bp, Homo sapiens
caaatgaataaaaaa

SEQ ID NO: 213217 - DNA, 15 bp, Homo sapiens
gcaaatgaataaaaa

SEQ ID NO: 213218 - DNA, 15 bp, Homo sapiens
cgcaaatgaataaaa

SEQ ID NO: 213219 - DNA, 15 bp, Homo sapiens
acgcaaatgaataaa

SEQ ID NO: 213220 - DNA, 15 bp, Homo sapiens
aacgcaaatgaataa

SEQ ID NO: 213221 - DNA, 15 bp, Homo sapiens
gaacgcaaatgaata

SEQ ID NO: 213222 - DNA, 15 bp, Homo sapiens
agaacgcaaatgaat

SEQ ID NO: 213223 - DNA, 15 bp, Homo sapiens
tagaacgcaaatgaa

SEQ ID NO: 213224 - DNA, 15 bp, Homo sapiens
ttagaacgcaaatga

SEQ ID NO: 213225 - DNA, 15 bp, Homo sapiens
tttagaacgcaaatg

SEQ ID NO: 213226 - DNA, 15 bp, Homo sapiens
ctttagaacgcaaat

SEQ ID NO: 213227 - DNA, 15 bp, Homo sapiens
tctttagaacgcaaa

SEQ ID NO: 213228 - DNA, 15 bp, Homo sapiens
ttctttagaacgcaa

SEQ ID NO: 213229 - DNA, 15 bp, Homo sapiens
attctttagaacgca

SEQ ID NO: 213230 - DNA, 15 bp, Homo sapiens
tattctttagaacgc

SEQ ID NO: 213231 - DNA, 15 bp, Homo sapiens
atattctttagaacg

SEQ ID NO: 213232 - DNA, 15 bp, Homo sapiens
aatattctttagaac

SEQ ID NO: 213233 - DNA, 15 bp, Homo sapiens
taatattctttagaa

SEQ ID NO: 213234 - DNA, 15 bp, Homo sapiens
gtaatattctttaga

SEQ ID NO: 213235 - DNA, 15 bp, Homo sapiens
tgtaatattctttag

SEQ ID NO: 213236 - DNA, 15 bp, Homo sapiens
atgtaatattcttta

SEQ ID NO: 213237 - DNA, 15 bp, Homo sapiens
aatgtaatattcttt

SEQ ID NO: 213238 - DNA, 15 bp, Homo sapiens
aaatgtaatattctt

SEQ ID NO: 213239 - DNA, 15 bp, Homo sapiens
aaaatgtaatattct

SEQ ID NO: 213240 - DNA, 15 bp, Homo sapiens
caaaatgtaatattc

SEQ ID NO: 213241 - DNA, 15 bp, Homo sapiens
tcaaaatgtaatatt

SEQ ID NO: 213242 - DNA, 15 bp, Homo sapiens
ttcaaaatgtaatat

SEQ ID NO: 213243 - DNA, 15 bp, Homo sapiens
tttcaaaatgtaata

SEQ ID NO: 213244 - DNA, 15 bp, Homo sapiens
ttttcaaaatgtaat

SEQ ID NO: 213245 - DNA, 15 bp, Homo sapiens
attttcaaaatgtaa

SEQ ID NO: 213246 - DNA, 15 bp, Homo sapiens
tattttcaaaatgta

SEQ ID NO: 213247 - DNA, 15 bp, Homo sapiens
atattttcaaaatgt

SEQ ID NO: 213248 - DNA, 15 bp, Homo sapiens
aatattttcaaaatg

SEQ ID NO: 213249 - DNA, 15 bp, Homo sapiens
gaatattttcaaaat

SEQ ID NO: 213250 - DNA, 15 bp, Homo sapiens
ggaatattttcaaaa

SEQ ID NO: 213251 - DNA, 15 bp, Homo sapiens
aggaatattttcaaa

SEQ ID NO: 213252 - DNA, 15 bp, Homo sapiens
taggaatattttcaa

SEQ ID NO: 213253 - DNA, 15 bp, Homo sapiens
gtaggaatattttca

SEQ ID NO: 213254 - DNA, 15 bp, Homo sapiens
agtaggaatattttc

SEQ ID NO: 213255 - DNA, 15 bp, Homo sapiens
aagtaggaatatttt

SEQ ID NO: 213256 - DNA, 15 bp, Homo sapiens
aaagtaggaatattt

SEQ ID NO: 213257 - DNA, 15 bp, Homo sapiens
taaagtaggaatatt

SEQ ID NO: 213258 - DNA, 15 bp, Homo sapiens
ttaaagtaggaatat

SEQ ID NO: 213259 - DNA, 15 bp, Homo sapiens
tttaaagtaggaata

SEQ ID NO: 213260 - DNA, 15 bp, Homo sapiens
atttaaagtaggaat

SEQ ID NO: 213261 - DNA, 15 bp, Homo sapiens
tatttaaagtaggaa

SEQ ID NO: 213262 - DNA, 15 bp, Homo sapiens
ctatttaaagtagga

SEQ ID NO: 213263 - DNA, 15 bp, Homo sapiens
gctatttaaagtagg

SEQ ID NO: 213264 - DNA, 15 bp, Homo sapiens
ggctatttaaagtag

SEQ ID NO: 213265 - DNA, 15 bp, Homo sapiens
tggctatttaaagta

SEQ ID NO: 213266 - DNA, 15 bp, Homo sapiens
ttggctatttaaagt

SEQ ID NO: 213267 - DNA, 15 bp, Homo sapiens
tttggctatttaaag

SEQ ID NO: 213268 - DNA, 15 bp, Homo sapiens
atttggctatttaaa

SEQ ID NO: 213269 - DNA, 15 bp, Homo sapiens
catttggctatttaa

SEQ ID NO: 213270 - DNA, 15 bp, Homo sapiens
acatttggctattta

SEQ ID NO: 213271 - DNA, 15 bp, Homo sapiens
aacatttggctattt

SEQ ID NO: 213272 - DNA, 15 bp, Homo sapiens
aaacatttggctatt

SEQ ID NO: 213273 - DNA, 15 bp, Homo sapiens
taaacatttggctat

SEQ ID NO: 213274 - DNA, 15 bp, Homo sapiens
ttaaacatttggcta

SEQ ID NO: 213275 - DNA, 15 bp, Homo sapiens
attaaacatttggct

SEQ ID NO: 213276 - DNA, 15 bp, Homo sapiens
tattaaacatttggc

SEQ ID NO: 213277 - DNA, 15 bp, Homo sapiens
ttattaaacatttgg

SEQ ID NO: 213278 - DNA, 15 bp, Homo sapiens
tttattaaacatttg

SEQ ID NO: 213279 - DNA, 15 bp, Homo sapiens
ctttattaaacattt

SEQ ID NO: 213280 - DNA, 15 bp, Homo sapiens
cctttattaaacatt

SEQ ID NO: 213281 - DNA, 15 bp, Homo sapiens
acctttattaaacat

SEQ ID NO: 213282 - DNA, 15 bp, Homo sapiens
tacctttattaaaca

SEQ ID NO: 213283 - DNA, 15 bp, Homo sapiens
ttacctttattaaac

SEQ ID NO: 213284 - DNA, 15 bp, Homo sapiens
attacctttattaaa

SEQ ID NO: 213285 - DNA, 15 bp, Homo sapiens
tattacctttattaa

SEQ ID NO: 213286 - DNA, 15 bp, Homo sapiens
ttattacctttatta

SEQ ID NO: 213287 - DNA, 15 bp, Homo sapiens
gttattacctttatt

SEQ ID NO: 213288 - DNA, 15 bp, Homo sapiens
agttattacctttat

SEQ ID NO: 213289 - DNA, 15 bp, Homo sapiens
cagttattaccttta

SEQ ID NO: 213290 - DNA, 15 bp, Homo sapiens
tcagttattaccttt

SEQ ID NO: 213291 - DNA, 15 bp, Homo sapiens
ttcagttattacctt

SEQ ID NO: 213292 - DNA, 15 bp, Homo sapiens
tttcagttattacct

SEQ ID NO: 213293 - DNA, 15 bp, Homo sapiens
atttcagttattacc

SEQ ID NO: 213294 - DNA, 15 bp, Homo sapiens
tatttcagttattac

SEQ ID NO: 213295 - DNA, 15 bp, Homo sapiens
ctatttcagttatta

SEQ ID NO: 213296 - DNA, 15 bp, Homo sapiens
tctatttcagttatt

SEQ ID NO: 213297 - DNA, 15 bp, Homo sapiens
ttctatttcagttat

SEQ ID NO: 213298 - DNA, 15 bp, Homo sapiens
cttctatttcagtta

SEQ ID NO: 213299 - DNA, 15 bp, Homo sapiens
acttctatttcagtt

SEQ ID NO: 213300 - DNA, 15 bp, Homo sapiens
cacttctatttcagt

SEQ ID NO: 213301 - DNA, 15 bp, Homo sapiens
acacttctatttcag

SEQ ID NO: 213302 - DNA, 15 bp, Homo sapiens
tacacttctatttca

SEQ ID NO: 213303 - DNA, 15 bp, Homo sapiens
ttacacttctatttc

SEQ ID NO: 213304 - DNA, 15 bp, Homo sapiens
cttacacttctattt

SEQ ID NO: 213305 - DNA, 15 bp, Homo sapiens
gcttacacttctatt

SEQ ID NO: 213306 - DNA, 15 bp, Homo sapiens
tgcttacacttctat

SEQ ID NO: 213307 - DNA, 15 bp, Homo sapiens
ttgcttacacttcta

SEQ ID NO: 213308 - DNA, 15 bp, Homo sapiens
attgcttacacttct

SEQ ID NO: 213309 - DNA, 15 bp, Homo sapiens
tattgcttacacttc

SEQ ID NO: 213310 - DNA, 15 bp, Homo sapiens
ttattgcttacactt

SEQ ID NO: 213311 - DNA, 15 bp, Homo sapiens
attattgcttacact

SEQ ID NO: 213312 - DNA, 15 bp, Homo sapiens
gattattgcttacac

SEQ ID NO: 213313 - DNA, 15 bp, Homo sapiens
agattattgcttaca

SEQ ID NO: 213314 - DNA, 15 bp, Homo sapiens
aagattattgcttac

SEQ ID NO: 213315 - DNA, 15 bp, Homo sapiens
caagattattgctta

SEQ ID NO: 213316 - DNA, 15 bp, Homo sapiens
acaagattattgctt

SEQ ID NO: 213317 - DNA, 15 bp, Homo sapiens
gacaagattattgct

SEQ ID NO: 213318 - DNA, 15 bp, Homo sapiens
agacaagattattgc

SEQ ID NO: 213319 - DNA, 15 bp, Homo sapiens
gagacaagattattg

SEQ ID NO: 213320 - DNA, 15 bp, Homo sapiens
cgagacaagattatt

SEQ ID NO: 213321 - DNA, 15 bp, Homo sapiens
tcgagacaagattat

SEQ ID NO: 213322 - DNA, 15 bp, Homo sapiens
ctcgagacaagatta

SEQ ID NO: 213323 - DNA, 15 bp, Homo sapiens
tctcgagacaagatt

SEQ ID NO: 213324 - DNA, 15 bp, Homo sapiens
ctctcgagacaagat

SEQ ID NO: 213325 - DNA, 15 bp, Homo sapiens
gctctcgagacaaga

SEQ ID NO: 213326 - DNA, 15 bp, Homo sapiens
agctctcgagacaag

SEQ ID NO: 213327 - DNA, 15 bp, Homo sapiens
tagctctcgagacaa

SEQ ID NO: 213328 - DNA, 15 bp, Homo sapiens
ctagctctcgagaca

SEQ ID NO: 213329 - DNA, 15 bp, Homo sapiens
tctagctctcgagac

SEQ ID NO: 213330 - DNA, 15 bp, Homo sapiens
ttctagctctcgaga

SEQ ID NO: 213331 - DNA, 15 bp, Homo sapiens
tttctagctctcgag

SEQ ID NO: 213332 - DNA, 15 bp, Homo sapiens
atttctagctctcga

SEQ ID NO: 213333 - DNA, 15 bp, Homo sapiens
gatttctagctctcg

SEQ ID NO: 213334 - DNA, 15 bp, Homo sapiens
tgatttctagctctc

SEQ ID NO: 213335 - DNA, 15 bp, Homo sapiens
atgatttctagctct

SEQ ID NO: 213336 - DNA, 15 bp, Homo sapiens
aatgatttctagctc

SEQ ID NO: 213337 - DNA, 15 bp, Homo sapiens
aaatgatttctagct

SEQ ID NO: 213338 - DNA, 15 bp, Homo sapiens
gaaatgatttctagc

SEQ ID NO: 213339 - DNA, 15 bp, Homo sapiens
tgaaatgatttctag

SEQ ID NO: 213340 - DNA, 15 bp, Homo sapiens
ctgaaatgatttcta

SEQ ID NO: 213341 - DNA, 15 bp, Homo sapiens
actgaaatgatttct

SEQ ID NO: 213342 - DNA, 15 bp, Homo sapiens
aactgaaatgatttc

SEQ ID NO: 213343 - DNA, 15 bp, Homo sapiens
taactgaaatgattt

SEQ ID NO: 213344 - DNA, 15 bp, Homo sapiens
gtaactgaaatgatt

SEQ ID NO: 213345 - DNA, 15 bp, Homo sapiens
tgtaactgaaatgat

SEQ ID NO: 213346 - DNA, 15 bp, Homo sapiens
atgtaactgaaatga

SEQ ID NO: 213347 - DNA, 15 bp, Homo sapiens
catgtaactgaaatg

SEQ ID NO: 213348 - DNA, 15 bp, Homo sapiens
tcatgtaactgaaat

SEQ ID NO: 213349 - DNA, 15 bp, Homo sapiens
gtcatgtaactgaaa

SEQ ID NO: 213350 - DNA, 15 bp, Homo sapiens
tgtcatgtaactgaa

SEQ ID NO: 213351 - DNA, 15 bp, Homo sapiens
atgtcatgtaactga

SEQ ID NO: 213352 - DNA, 15 bp, Homo sapiens
tatgtcatgtaactg

SEQ ID NO: 213353 - DNA, 15 bp, Homo sapiens
atatgtcatgtaact

SEQ ID NO: 213354 - DNA, 15 bp, Homo sapiens
aatatgtcatgtaac

SEQ ID NO: 213355 - DNA, 15 bp, Homo sapiens
aaatatgtcatgtaa

SEQ ID NO: 213356 - DNA, 15 bp, Homo sapiens
caaatatgtcatgta

SEQ ID NO: 213357 - DNA, 15 bp, Homo sapiens
tcaaatatgtcatgt

SEQ ID NO: 213358 - DNA, 15 bp, Homo sapiens
ttcaaatatgtcatg

SEQ ID NO: 213359 - DNA, 15 bp, Homo sapiens
tttcaaatatgtcat

SEQ ID NO: 213360 - DNA, 15 bp, Homo sapiens
atttcaaatatgtca

SEQ ID NO: 213361 - DNA, 15 bp, Homo sapiens
catttcaaatatgtc

SEQ ID NO: 213362 - DNA, 15 bp, Homo sapiens
acatttcaaatatgt

SEQ ID NO: 213363 - DNA, 15 bp, Homo sapiens
tacatttcaaatatg

SEQ ID NO: 213364 - DNA, 15 bp, Homo sapiens
ttacatttcaaatat

SEQ ID NO: 213365 - DNA, 15 bp, Homo sapiens
cttacatttcaaata

SEQ ID NO: 213366 - DNA, 15 bp, Homo sapiens
gcttacatttcaaat

SEQ ID NO: 213367 - DNA, 15 bp, Homo sapiens
tgcttacatttcaaa

SEQ ID NO: 213368 - DNA, 15 bp, Homo sapiens
ttgcttacatttcaa

SEQ ID NO: 213369 - DNA, 15 bp, Homo sapiens
tttgcttacatttca

SEQ ID NO: 213370 - DNA, 15 bp, Homo sapiens
atttgcttacatttc

SEQ ID NO: 213371 - DNA, 15 bp, Homo sapiens
aatttgcttacattt

SEQ ID NO: 213372 - DNA, 15 bp, Homo sapiens
taatttgcttacatt

SEQ ID NO: 213373 - DNA, 15 bp, Homo sapiens
ttaatttgcttacat

SEQ ID NO: 213374 - DNA, 15 bp, Homo sapiens
tttaatttgcttaca

SEQ ID NO: 213375 - DNA, 15 bp, Homo sapiens
atttaatttgcttac

SEQ ID NO: 213376 - DNA, 15 bp, Homo sapiens
tatttaatttgctta

SEQ ID NO: 213377 - DNA, 15 bp, Homo sapiens
ttatttaatttgctt

SEQ ID NO: 213378 - DNA, 15 bp, Homo sapiens
gttatttaatttgct

SEQ ID NO: 213379 - DNA, 15 bp, Homo sapiens
tgttatttaatttgc

SEQ ID NO: 213380 - DNA, 15 bp, Homo sapiens
gtgttatttaatttg

SEQ ID NO: 213381 - DNA, 15 bp, Homo sapiens
tgtgttatttaattt

SEQ ID NO: 213382 - DNA, 15 bp, Homo sapiens
ttgtgttatttaatt

SEQ ID NO: 213383 - DNA, 15 bp, Homo sapiens
attgtgttatttaat

SEQ ID NO: 213384 - DNA, 15 bp, Homo sapiens
cattgtgttatttaa

SEQ ID NO: 213385 - DNA, 15 bp, Homo sapiens
ccattgtgttattta

SEQ ID NO: 213386 - DNA, 15 bp, Homo sapiens
gccattgtgttattt

SEQ ID NO: 213387 - DNA, 15 bp, Homo sapiens
tgccattgtgttatt

SEQ ID NO: 213388 - DNA, 15 bp, Homo sapiens
gtgccattgtgttat

SEQ ID NO: 213389 - DNA, 15 bp, Homo sapiens
agtgccattgtgtta

SEQ ID NO: 213390 - DNA, 15 bp, Homo sapiens
aagtgccattgtgtt

SEQ ID NO: 213391 - DNA, 15 bp, Homo sapiens
aaagtgccattgtgt

SEQ ID NO: 213392 - DNA, 15 bp, Homo sapiens
taaagtgccattgtg

SEQ ID NO: 213393 - DNA, 15 bp, Homo sapiens
ataaagtgccattgt

SEQ ID NO: 213394 - DNA, 15 bp, Homo sapiens
cataaagtgccattg

SEQ ID NO: 213395 - DNA, 15 bp, Homo sapiens
gcataaagtgccatt

SEQ ID NO: 213396 - DNA, 15 bp, Homo sapiens
ggcataaagtgccat

SEQ ID NO: 213397 - DNA, 15 bp, Homo sapiens
aggcataaagtgcca

SEQ ID NO: 213398 - DNA, 15 bp, Homo sapiens
aaggcataaagtgcc

SEQ ID NO: 213399 - DNA, 15 bp, Homo sapiens
caaggcataaagtgc

SEQ ID NO: 213400 - DNA, 15 bp, Homo sapiens
tcaaggcataaagtg

SEQ ID NO: 213401 - DNA, 15 bp, Homo sapiens
atcaaggcataaagt

SEQ ID NO: 213402 - DNA, 15 bp, Homo sapiens
tatcaaggcataaag

SEQ ID NO: 213403 - DNA, 15 bp, Homo sapiens
atatcaaggcataaa

SEQ ID NO: 213404 - DNA, 15 bp, Homo sapiens
aatatcaaggcataa

SEQ ID NO: 213405 - DNA, 15 bp, Homo sapiens
caatatcaaggcata

SEQ ID NO: 213406 - DNA, 15 bp, Homo sapiens
acaatatcaaggcat

SEQ ID NO: 213407 - DNA, 15 bp, Homo sapiens
tacaatatcaaggca

SEQ ID NO: 213408 - DNA, 15 bp, Homo sapiens
ctacaatatcaaggc

SEQ ID NO: 213409 - DNA, 15 bp, Homo sapiens
actacaatatcaagg

SEQ ID NO: 213410 - DNA, 15 bp, Homo sapiens
gactacaatatcaag

SEQ ID NO: 213411 - DNA, 15 bp, Homo sapiens
tgactacaatatcaa

SEQ ID NO: 213412 - DNA, 15 bp, Homo sapiens
ctgactacaatatca

SEQ ID NO: 213413 - DNA, 15 bp, Homo sapiens
actgactacaatatc

SEQ ID NO: 213414 - DNA, 15 bp, Homo sapiens
aactgactacaatat

SEQ ID NO: 213415 - DNA, 15 bp, Homo sapiens
gaactgactacaata

SEQ ID NO: 213416 - DNA, 15 bp, Homo sapiens
tgaactgactacaat

SEQ ID NO: 213417 - DNA, 15 bp, Homo sapiens
ctgaactgactacaa

SEQ ID NO: 213418 - DNA, 15 bp, Homo sapiens
tctgaactgactaca

SEQ ID NO: 213419 - DNA, 15 bp, Homo sapiens
ctctgaactgactac

SEQ ID NO: 213420 - DNA, 15 bp, Homo sapiens
cctctgaactgacta

SEQ ID NO: 213421 - DNA, 15 bp, Homo sapiens
acctctgaactgact

SEQ ID NO: 213422 - DNA, 15 bp, Homo sapiens
aacctctgaactgac

SEQ ID NO: 213423 - DNA, 15 bp, Homo sapiens
taacctctgaactga

SEQ ID NO: 213424 - DNA, 15 bp, Homo sapiens
ataacctctgaactg

SEQ ID NO: 213425 - DNA, 15 bp, Homo sapiens
gataacctctgaact

SEQ ID NO: 213426 - DNA, 15 bp, Homo sapiens
agataacctctgaac

SEQ ID NO: 213427 - DNA, 15 bp, Homo sapiens
aagataacctctgaa

SEQ ID NO: 213428 - DNA, 15 bp, Homo sapiens
aaagataacctctga

SEQ ID NO: 213429 - DNA, 15 bp, Homo sapiens
aaaagataacctctg

SEQ ID NO: 213430 - DNA, 15 bp, Homo sapiens
gaaaagataacctct

SEQ ID NO: 213431 - DNA, 15 bp, Homo sapiens
agaaaagataacctc

SEQ ID NO: 213432 - DNA, 15 bp, Homo sapiens
gagaaaagataacct

SEQ ID NO: 213433 - DNA, 15 bp, Homo sapiens
agagaaaagataacc

SEQ ID NO: 213434 - DNA, 15 bp, Homo sapiens
tagagaaaagataac

SEQ ID NO: 213435 - DNA, 15 bp, Homo sapiens
atagagaaaagataa

SEQ ID NO: 213436 - DNA, 15 bp, Homo sapiens
gatagagaaaagata

SEQ ID NO: 213437 - DNA, 15 bp, Homo sapiens
agatagagaaaagat

SEQ ID NO: 213438 - DNA, 15 bp, Homo sapiens
aagatagagaaaaga

SEQ ID NO: 213439 - DNA, 15 bp, Homo sapiens
taagatagagaaaag

SEQ ID NO: 213440 - DNA, 15 bp, Homo sapiens
ttaagatagagaaaa

SEQ ID NO: 213441 - DNA, 15 bp, Homo sapiens
attaagatagagaaa

SEQ ID NO: 213442 - DNA, 15 bp, Homo sapiens
tattaagatagagaa

SEQ ID NO: 213443 - DNA, 15 bp, Homo sapiens
gtattaagatagaga

SEQ ID NO: 213444 - DNA, 15 bp, Homo sapiens
agtattaagatagag

SEQ ID NO: 213445 - DNA, 15 bp, Homo sapiens
cagtattaagataga

SEQ ID NO: 213446 - DNA, 15 bp, Homo sapiens
gcagtattaagatag

SEQ ID NO: 213447 - DNA, 15 bp, Homo sapiens
ggcagtattaagata

SEQ ID NO: 213448 - DNA, 15 bp, Homo sapiens
aggcagtattaagat

SEQ ID NO: 213449 - DNA, 15 bp, Homo sapiens
taggcagtattaaga

SEQ ID NO: 213450 - DNA, 15 bp, Homo sapiens
ttaggcagtattaag

SEQ ID NO: 213451 - DNA, 15 bp, Homo sapiens
tttaggcagtattaa

SEQ ID NO: 213452 - DNA, 15 bp, Homo sapiens
atttaggcagtatta

SEQ ID NO: 213453 - DNA, 15 bp, Homo sapiens
aatttaggcagtatt

SEQ ID NO: 213454 - DNA, 15 bp, Homo sapiens
aaatttaggcagtat

SEQ ID NO: 213455 - DNA, 15 bp, Homo sapiens
aaaatttaggcagta

SEQ ID NO: 213456 - DNA, 15 bp, Homo sapiens
gaaaatttaggcagt

SEQ ID NO: 213457 - DNA, 15 bp, Homo sapiens
tgaaaatttaggcag

SEQ ID NO: 213458 - DNA, 15 bp, Homo sapiens
ttgaaaatttaggca

SEQ ID NO: 213459 - DNA, 15 bp, Homo sapiens
gttgaaaatttaggc

SEQ ID NO: 213460 - DNA, 15 bp, Homo sapiens
agttgaaaatttagg

SEQ ID NO: 213461 - DNA, 15 bp, Homo sapiens
gagttgaaaatttag

SEQ ID NO: 213462 - DNA, 15 bp, Homo sapiens
tgagttgaaaattta

SEQ ID NO: 213463 - DNA, 15 bp, Homo sapiens
ttgagttgaaaattt

SEQ ID NO: 213464 - DNA, 15 bp, Homo sapiens
cttgagttgaaaatt

SEQ ID NO: 213465 - DNA, 15 bp, Homo sapiens
tcttgagttgaaaat

SEQ ID NO: 213466 - DNA, 15 bp, Homo sapiens
ttcttgagttgaaaa

SEQ ID NO: 213467 - DNA, 15 bp, Homo sapiens
attcttgagttgaaa

SEQ ID NO: 213468 - DNA, 15 bp, Homo sapiens
cattcttgagttgaa

SEQ ID NO: 213469 - DNA, 15 bp, Homo sapiens
ccattcttgagttga

SEQ ID NO: 213470 - DNA, 15 bp, Homo sapiens
cccattcttgagttg

SEQ ID NO: 213471 - DNA, 15 bp, Homo sapiens
tcccattcttgagtt

SEQ ID NO: 213472 - DNA, 15 bp, Homo sapiens
ttcccattcttgagt

SEQ ID NO: 213473 - DNA, 15 bp, Homo sapiens
tttcccattcttgag

SEQ ID NO: 213474 - DNA, 15 bp, Homo sapiens
ctttcccattcttga

SEQ ID NO: 213475 - DNA, 15 bp, Homo sapiens
tctttcccattcttg

SEQ ID NO: 213476 - DNA, 15 bp, Homo sapiens
atctttcccattctt

SEQ ID NO: 213477 - DNA, 15 bp, Homo sapiens
aatctttcccattct

SEQ ID NO: 213478 - DNA, 15 bp, Homo sapiens
aaatctttcccattc

SEQ ID NO: 213479 - DNA, 15 bp, Homo sapiens
aaaatctttcccatt

SEQ ID NO: 213480 - DNA, 15 bp, Homo sapiens
aaaaatctttcccat

SEQ ID NO: 213481 - DNA, 15 bp, Homo sapiens
taaaaatctttccca

SEQ ID NO: 213482 - DNA, 15 bp, Homo sapiens
ataaaaatctttccc

SEQ ID NO: 213483 - DNA, 15 bp, Homo sapiens
aataaaaatctttcc

SEQ ID NO: 213484 - DNA, 15 bp, Homo sapiens
aaataaaaatctttc

SEQ ID NO: 213485 - DNA, 15 bp, Homo sapiens
taaataaaaatcttt

SEQ ID NO: 213486 - DNA, 15 bp, Homo sapiens
ttaaataaaaatctt

SEQ ID NO: 213487 - DNA, 15 bp, Homo sapiens
cttaaataaaaatct

SEQ ID NO: 213488 - DNA, 15 bp, Homo sapiens
ccttaaataaaaatc

SEQ ID NO: 213489 - DNA, 15 bp, Homo sapiens
cccttaaataaaaat

SEQ ID NO: 213490 - DNA, 15 bp, Homo sapiens
tcccttaaataaaaa

SEQ ID NO: 213491 - DNA, 15 bp, Homo sapiens
ttcccttaaataaaa

SEQ ID NO: 213492 - DNA, 15 bp, Homo sapiens
tttcccttaaataaa

SEQ ID NO: 213493 - DNA, 15 bp, Homo sapiens
ttttcccttaaataa

SEQ ID NO: 213494 - DNA, 15 bp, Homo sapiens
attttcccttaaata

SEQ ID NO: 213495 - DNA, 15 bp, Homo sapiens
cattttcccttaaat

SEQ ID NO: 213496 - DNA, 15 bp, Homo sapiens
tcattttcccttaaa

SEQ ID NO: 213497 - DNA, 15 bp, Homo sapiens
ttcattttcccttaa

SEQ ID NO: 213498 - DNA, 15 bp, Homo sapiens
attcattttccctta

SEQ ID NO: 213499 - DNA, 15 bp, Homo sapiens
aattcattttccctt

SEQ ID NO: 213500 - DNA, 15 bp, Homo sapiens
caattcattttccct

SEQ ID NO: 213501 - DNA, 15 bp, Homo sapiens
ccaattcattttccc

SEQ ID NO: 213502 - DNA, 15 bp, Homo sapiens
gccaattcattttcc

SEQ ID NO: 213503 - DNA, 15 bp, Homo sapiens
tgccaattcattttc

SEQ ID NO: 213504 - DNA, 15 bp, Homo sapiens
atgccaattcatttt

SEQ ID NO: 213505 - DNA, 15 bp, Homo sapiens
tatgccaattcattt

SEQ ID NO: 213506 - DNA, 15 bp, Homo sapiens
gtatgccaattcatt

SEQ ID NO: 213507 - DNA, 15 bp, Homo sapiens
ggtatgccaattcat

SEQ ID NO: 213508 - DNA, 15 bp, Homo sapiens
aggtatgccaattca

SEQ ID NO: 213509 - DNA, 15 bp, Homo sapiens
aaggtatgccaattc

SEQ ID NO: 213510 - DNA, 15 bp, Homo sapiens
aaaggtatgccaatt

SEQ ID NO: 213511 - DNA, 15 bp, Homo sapiens
taaaggtatgccaat

SEQ ID NO: 213512 - DNA, 15 bp, Homo sapiens
ttaaaggtatgccaa

SEQ ID NO: 213513 - DNA, 15 bp, Homo sapiens
attaaaggtatgcca

SEQ ID NO: 213514 - DNA, 15 bp, Homo sapiens
aattaaaggtatgcc

SEQ ID NO: 213515 - DNA, 15 bp, Homo sapiens
caattaaaggtatgc

SEQ ID NO: 213516 - DNA, 15 bp, Homo sapiens
acaattaaaggtatg

SEQ ID NO: 213517 - DNA, 15 bp, Homo sapiens
aacaattaaaggtat

SEQ ID NO: 213518 - DNA, 15 bp, Homo sapiens
caacaattaaaggta

SEQ ID NO: 213519 - DNA, 15 bp, Homo sapiens
tcaacaattaaaggt

SEQ ID NO: 213520 - DNA, 15 bp, Homo sapiens
ctcaacaattaaagg

SEQ ID NO: 213521 - DNA, 15 bp, Homo sapiens
tctcaacaattaaag

SEQ ID NO: 213522 - DNA, 15 bp, Homo sapiens
atctcaacaattaaa

SEQ ID NO: 213523 - DNA, 15 bp, Homo sapiens
tatctcaacaattaa

SEQ ID NO: 213524 - DNA, 15 bp, Homo sapiens
ctatctcaacaatta

SEQ ID NO: 213525 - DNA, 15 bp, Homo sapiens
gctatctcaacaatt

SEQ ID NO: 213526 - DNA, 15 bp, Homo sapiens
agctatctcaacaat

SEQ ID NO: 213527 - DNA, 15 bp, Homo sapiens
aagctatctcaacaa

SEQ ID NO: 213528 - DNA, 15 bp, Homo sapiens
aaagctatctcaaca

SEQ ID NO: 213529 - DNA, 15 bp, Homo sapiens
aaaagctatctcaac

SEQ ID NO: 213530 - DNA, 15 bp, Homo sapiens
taaaagctatctcaa

SEQ ID NO: 213531 - DNA, 15 bp, Homo sapiens
ttaaaagctatctca

SEQ ID NO: 213532 - DNA, 15 bp, Homo sapiens
tttaaaagctatctc

SEQ ID NO: 213533 - DNA, 15 bp, Homo sapiens
ttttaaaagctatct

SEQ ID NO: 213534 - DNA, 15 bp, Homo sapiens
attttaaaagctatc

SEQ ID NO: 213535 - DNA, 15 bp, Homo sapiens
tattttaaaagctat

SEQ ID NO: 213536 - DNA, 15 bp, Homo sapiens
atattttaaaagcta

SEQ ID NO: 213537 - DNA, 15 bp, Homo sapiens
tatattttaaaagct

SEQ ID NO: 213538 - DNA, 15 bp, Homo sapiens
ctatattttaaaagc

SEQ ID NO: 213539 - DNA, 15 bp, Homo sapiens
gctatattttaaaag

SEQ ID NO: 213540 - DNA, 15 bp, Homo sapiens
agctatattttaaaa

SEQ ID NO: 213541 - DNA, 15 bp, Homo sapiens
aagctatattttaaa

SEQ ID NO: 213542 - DNA, 15 bp, Homo sapiens
aaagctatattttaa

SEQ ID NO: 213543 - DNA, 15 bp, Homo sapiens
aaaagctatatttta

SEQ ID NO: 213544 - DNA, 15 bp, Homo sapiens
aaaaagctatatttt

SEQ ID NO: 213545 - DNA, 15 bp, Homo sapiens
aaaaaagctatattt

SEQ ID NO: 213546 - DNA, 15 bp, Homo sapiens
aaaaaaagctatatt

SEQ ID NO: 213547 - DNA, 15 bp, Homo sapiens
aaaaaaaagctatat

SEQ ID NO: 213548 - DNA, 15 bp, Homo sapiens
aaaaaaaaagctata

SEQ ID NO: 213549 - DNA, 15 bp, Homo sapiens
aaaaaaaaaagctat

SEQ ID NO: 213550 - DNA, 15 bp, Homo sapiens
aaaaaaaaaaagcta

SEQ ID NO: 213551 - DNA, 15 bp, Homo sapiens
acagctaaaaaaaaa

SEQ ID NO: 213552 - DNA, 15 bp, Homo sapiens
tacagctaaaaaaaa

SEQ ID NO: 213553 - DNA, 15 bp, Homo sapiens
atacagctaaaaaaa

SEQ ID NO: 213554 - DNA, 15 bp, Homo sapiens
catacagctaaaaaa

SEQ ID NO: 213555 - DNA, 15 bp, Homo sapiens
acatacagctaaaaa

SEQ ID NO: 213556 - DNA, 15 bp, Homo sapiens
cacatacagctaaaa

SEQ ID NO: 213557 - DNA, 15 bp, Homo sapiens
gcacatacagctaaa

SEQ ID NO: 213558 - DNA, 15 bp, Homo sapiens
agcacatacagctaa

SEQ ID NO: 213559 - DNA, 15 bp, Homo sapiens
cagcacatacagcta

SEQ ID NO: 213560 - DNA, 15 bp, Homo sapiens
ccagcacatacagct

SEQ ID NO: 213561 - DNA, 15 bp, Homo sapiens
tccagcacatacagc

SEQ ID NO: 213562 - DNA, 15 bp, Homo sapiens
atccagcacatacag

SEQ ID NO: 213563 - DNA, 15 bp, Homo sapiens
tatccagcacataca

SEQ ID NO: 213564 - DNA, 15 bp, Homo sapiens
atatccagcacatac

SEQ ID NO: 213565 - DNA, 15 bp, Homo sapiens
aatatccagcacata

SEQ ID NO: 213566 - DNA, 15 bp, Homo sapiens
caatatccagcacat

SEQ ID NO: 213567 - DNA, 15 bp, Homo sapiens
gcaatatccagcaca

SEQ ID NO: 213568 - DNA, 15 bp, Homo sapiens
agcaatatccagcac

SEQ ID NO: 213569 - DNA, 15 bp, Homo sapiens
tagcaatatccagca

SEQ ID NO: 213570 - DNA, 15 bp, Homo sapiens
ctagcaatatccagc

SEQ ID NO: 213571 - DNA, 15 bp, Homo sapiens
tctagcaatatccag

SEQ ID NO: 213572 - DNA, 15 bp, Homo sapiens
atctagcaatatcca

SEQ ID NO: 213573 - DNA, 15 bp, Homo sapiens
aatctagcaatatcc

SEQ ID NO: 213574 - DNA, 15 bp, Homo sapiens
gaatctagcaatatc

SEQ ID NO: 213575 - DNA, 15 bp, Homo sapiens
agaatctagcaatat

SEQ ID NO: 213576 - DNA, 15 bp, Homo sapiens
aagaatctagcaata

SEQ ID NO: 213577 - DNA, 15 bp, Homo sapiens
gaagaatctagcaat

SEQ ID NO: 213578 - DNA, 15 bp, Homo sapiens
ggaagaatctagcaa

SEQ ID NO: 213579 - DNA, 15 bp, Homo sapiens
tggaagaatctagca

SEQ ID NO: 213580 - DNA, 15 bp, Homo sapiens
ctggaagaatctagc

SEQ ID NO: 213581 - DNA, 15 bp, Homo sapiens
actggaagaatctag

SEQ ID NO: 213582 - DNA, 15 bp, Homo sapiens
cactggaagaatcta

SEQ ID NO: 213583 - DNA, 15 bp, Homo sapiens
acactggaagaatct

SEQ ID NO: 213584 - DNA, 15 bp, Homo sapiens
aacactggaagaatc

SEQ ID NO: 213585 - DNA, 15 bp, Homo sapiens
aaacactggaagaat

SEQ ID NO: 213586 - DNA, 15 bp, Homo sapiens
caaacactggaagaa

SEQ ID NO: 213587 - DNA, 15 bp, Homo sapiens
acaaacactggaaga

SEQ ID NO: 213588 - DNA, 15 bp, Homo sapiens
cacaaacactggaag

SEQ ID NO: 213589 - DNA, 15 bp, Homo sapiens
gcacaaacactggaa

SEQ ID NO: 213590 - DNA, 15 bp, Homo sapiens
agcacaaacactgga

SEQ ID NO: 213591 - DNA, 15 bp, Homo sapiens
aagcacaaacactgg

SEQ ID NO: 213592 - DNA, 15 bp, Homo sapiens
gaagcacaaacactg

SEQ ID NO: 213593 - DNA, 15 bp, Homo sapiens
agaagcacaaacact

SEQ ID NO: 213594 - DNA, 15 bp, Homo sapiens
gagaagcacaaacac

SEQ ID NO: 213595 - DNA, 15 bp, Homo sapiens
agagaagcacaaaca

SEQ ID NO: 213596 - DNA, 15 bp, Homo sapiens
gagagaagcacaaac

SEQ ID NO: 213597 - DNA, 15 bp, Homo sapiens
agagagaagcacaaa

SEQ ID NO: 213598 - DNA, 15 bp, Homo sapiens
cagagagaagcacaa

SEQ ID NO: 213599 - DNA, 15 bp, Homo sapiens
acagagagaagcaca

SEQ ID NO: 213600 - DNA, 15 bp, Homo sapiens
aacagagagaagcac

SEQ ID NO: 213601 - DNA, 15 bp, Homo sapiens
caacagagagaagca

SEQ ID NO: 213602 - DNA, 15 bp, Homo sapiens
acaacagagagaagc

SEQ ID NO: 213603 - DNA, 15 bp, Homo sapiens
tacaacagagagaag

SEQ ID NO: 213604 - DNA, 15 bp, Homo sapiens
ctacaacagagagaa

SEQ ID NO: 213605 - DNA, 15 bp, Homo sapiens
cctacaacagagaga

SEQ ID NO: 213606 - DNA, 15 bp, Homo sapiens
tcctacaacagagag

SEQ ID NO: 213607 - DNA, 15 bp, Homo sapiens
ttcctacaacagaga

SEQ ID NO: 213608 - DNA, 15 bp, Homo sapiens
attcctacaacagag

SEQ ID NO: 213609 - DNA, 15 bp, Homo sapiens
aattcctacaacaga

SEQ ID NO: 213610 - DNA, 15 bp, Homo sapiens
aaattcctacaacag

SEQ ID NO: 213611 - DNA, 15 bp, Homo sapiens
caaattcctacaaca

SEQ ID NO: 213612 - DNA, 15 bp, Homo sapiens
tcaaattcctacaac

SEQ ID NO: 213613 - DNA, 15 bp, Homo sapiens
atcaaattcctacaa

SEQ ID NO: 213614 - DNA, 15 bp, Homo sapiens
tatcaaattcctaca

SEQ ID NO: 213615 - DNA, 15 bp, Homo sapiens
gtatcaaattcctac

SEQ ID NO: 213616 - DNA, 15 bp, Homo sapiens
ggtatcaaattccta

SEQ ID NO: 213617 - DNA, 15 bp, Homo sapiens
aggtatcaaattcct

SEQ ID NO: 213618 - DNA, 15 bp, Homo sapiens
aaggtatcaaattcc

SEQ ID NO: 213619 - DNA, 15 bp, Homo sapiens
aaaggtatcaaattc

SEQ ID NO: 213620 - DNA, 15 bp, Homo sapiens
caaaggtatcaaatt

SEQ ID NO: 213621 - DNA, 15 bp, Homo sapiens
tcaaaggtatcaaat

SEQ ID NO: 213622 - DNA, 15 bp, Homo sapiens
ttcaaaggtatcaaa

SEQ ID NO: 213623 - DNA, 15 bp, Homo sapiens
attcaaaggtatcaa

SEQ ID NO: 213624 - DNA, 15 bp, Homo sapiens
cattcaaaggtatca

SEQ ID NO: 213625 - DNA, 15 bp, Homo sapiens
gcattcaaaggtatc

SEQ ID NO: 213626 - DNA, 15 bp, Homo sapiens
agcattcaaaggtat

SEQ ID NO: 213627 - DNA, 15 bp, Homo sapiens
tagcattcaaaggta

SEQ ID NO: 213628 - DNA, 15 bp, Homo sapiens
ctagcattcaaaggt

SEQ ID NO: 213629 - DNA, 15 bp, Homo sapiens
actagcattcaaagg

SEQ ID NO: 213630 - DNA, 15 bp, Homo sapiens
aactagcattcaaag

SEQ ID NO: 213631 - DNA, 15 bp, Homo sapiens
caactagcattcaaa

SEQ ID NO: 213632 - DNA, 15 bp, Homo sapiens
tcaactagcattcaa

SEQ ID NO: 213633 - DNA, 15 bp, Homo sapiens
ctcaactagcattca

SEQ ID NO: 213634 - DNA, 15 bp, Homo sapiens
actcaactagcattc

SEQ ID NO: 213635 - DNA, 15 bp, Homo sapiens
aactcaactagcatt

SEQ ID NO: 213636 - DNA, 15 bp, Homo sapiens
caactcaactagcat

SEQ ID NO: 213637 - DNA, 15 bp, Homo sapiens
tcaactcaactagca

SEQ ID NO: 213638 - DNA, 15 bp, Homo sapiens
ctcaactcaactagc

SEQ ID NO: 213639 - DNA, 15 bp, Homo sapiens
tctcaactcaactag

SEQ ID NO: 213640 - DNA, 15 bp, Homo sapiens
atctcaactcaacta

SEQ ID NO: 213641 - DNA, 15 bp, Homo sapiens
aatctcaactcaact

SEQ ID NO: 213642 - DNA, 15 bp, Homo sapiens
gaatctcaactcaac

SEQ ID NO: 213643 - DNA, 15 bp, Homo sapiens
agaatctcaactcaa

SEQ ID NO: 213644 - DNA, 15 bp, Homo sapiens
aagaatctcaactca

SEQ ID NO: 213645 - DNA, 15 bp, Homo sapiens
taagaatctcaactc

SEQ ID NO: 213646 - DNA, 15 bp, Homo sapiens
ttaagaatctcaact

SEQ ID NO: 213647 - DNA, 15 bp, Homo sapiens
gttaagaatctcaac

SEQ ID NO: 213648 - DNA, 15 bp, Homo sapiens
tgttaagaatctcaa

SEQ ID NO: 213649 - DNA, 15 bp, Homo sapiens
ttgttaagaatctca

SEQ ID NO: 213650 - DNA, 15 bp, Homo sapiens
tttgttaagaatctc

SEQ ID NO: 213651 - DNA, 15 bp, Homo sapiens
atttgttaagaatct

SEQ ID NO: 213652 - DNA, 15 bp, Homo sapiens
catttgttaagaatc

SEQ ID NO: 213653 - DNA, 15 bp, Homo sapiens
gcatttgttaagaat

SEQ ID NO: 213654 - DNA, 15 bp, Homo sapiens
tgcatttgttaagaa

SEQ ID NO: 213655 - DNA, 15 bp, Homo sapiens
ctgcatttgttaaga

SEQ ID NO: 213656 - DNA, 15 bp, Homo sapiens
cctgcatttgttaag

SEQ ID NO: 213657 - DNA, 15 bp, Homo sapiens
ccctgcatttgttaa

SEQ ID NO: 213658 - DNA, 15 bp, Homo sapiens
tccctgcatttgtta

SEQ ID NO: 213659 - DNA, 15 bp, Homo sapiens
ctccctgcatttgtt

SEQ ID NO: 213660 - DNA, 15 bp, Homo sapiens
tctccctgcatttgt

SEQ ID NO: 213661 - DNA, 15 bp, Homo sapiens
ttctccctgcatttg

SEQ ID NO: 213662 - DNA, 15 bp, Homo sapiens
cttctccctgcattt

SEQ ID NO: 213663 - DNA, 15 bp, Homo sapiens
gcttctccctgcatt

SEQ ID NO: 213664 - DNA, 15 bp, Homo sapiens
agcttctccctgcat

SEQ ID NO: 213665 - DNA, 15 bp, Homo sapiens
aagcttctccctgca

SEQ ID NO: 213666 - DNA, 15 bp, Homo sapiens
taagcttctccctgc

SEQ ID NO: 213667 - DNA, 15 bp, Homo sapiens
ttaagcttctccctg

SEQ ID NO: 213668 - DNA, 15 bp, Homo sapiens
tttaagcttctccct

SEQ ID NO: 213669 - DNA, 15 bp, Homo sapiens
gtttaagcttctccc

SEQ ID NO: 213670 - DNA, 15 bp, Homo sapiens
tgtttaagcttctcc

SEQ ID NO: 213671 - DNA, 15 bp, Homo sapiens
atgtttaagcttctc

SEQ ID NO: 213672 - DNA, 15 bp, Homo sapiens
catgtttaagcttct

SEQ ID NO: 213673 - DNA, 15 bp, Homo sapiens
acatgtttaagcttc

SEQ ID NO: 213674 - DNA, 15 bp, Homo sapiens
cacatgtttaagctt

SEQ ID NO: 213675 - DNA, 15 bp, Homo sapiens
ccacatgtttaagct

SEQ ID NO: 213676 - DNA, 15 bp, Homo sapiens
tccacatgtttaagc

SEQ ID NO: 213677 - DNA, 15 bp, Homo sapiens
ctccacatgtttaag

SEQ ID NO: 213678 - DNA, 15 bp, Homo sapiens
actccacatgtttaa

SEQ ID NO: 213679 - DNA, 15 bp, Homo sapiens
gactccacatgttta

SEQ ID NO: 213680 - DNA, 15 bp, Homo sapiens
agactccacatgttt

SEQ ID NO: 213681 - DNA, 15 bp, Homo sapiens
gagactccacatgtt

SEQ ID NO: 213682 - DNA, 15 bp, Homo sapiens
agagactccacatgt

SEQ ID NO: 213683 - DNA, 15 bp, Homo sapiens
gagagactccacatg

SEQ ID NO: 213684 - DNA, 15 bp, Homo sapiens
tgagagactccacat

SEQ ID NO: 213685 - DNA, 15 bp, Homo sapiens
atgagagactccaca

SEQ ID NO: 213686 - DNA, 15 bp, Homo sapiens
aatgagagactccac

SEQ ID NO: 213687 - DNA, 15 bp, Homo sapiens
gaatgagagactcca

SEQ ID NO: 213688 - DNA, 15 bp, Homo sapiens
tgaatgagagactcc

SEQ ID NO: 213689 - DNA, 15 bp, Homo sapiens
ctgaatgagagactc

SEQ ID NO: 213690 - DNA, 15 bp, Homo sapiens
actgaatgagagact

SEQ ID NO: 213691 - DNA, 15 bp, Homo sapiens
cactgaatgagagac

SEQ ID NO: 213692 - DNA, 15 bp, Homo sapiens
tcactgaatgagaga

SEQ ID NO: 213693 - DNA, 15 bp, Homo sapiens
gtcactgaatgagag

SEQ ID NO: 213694 - DNA, 15 bp, Homo sapiens
agtcactgaatgaga

SEQ ID NO: 213695 - DNA, 15 bp, Homo sapiens
tagtcactgaatgag

SEQ ID NO: 213696 - DNA, 15 bp, Homo sapiens
atagtcactgaatga

SEQ ID NO: 213697 - DNA, 15 bp, Homo sapiens
catagtcactgaatg

SEQ ID NO: 213698 - DNA, 15 bp, Homo sapiens
acatagtcactgaat

SEQ ID NO: 213699 - DNA, 15 bp, Homo sapiens
aacatagtcactgaa

SEQ ID NO: 213700 - DNA, 15 bp, Homo sapiens
caacatagtcactga

SEQ ID NO: 213701 - DNA, 15 bp, Homo sapiens
acaacatagtcactg

SEQ ID NO: 213702 - DNA, 15 bp, Homo sapiens
gacaacatagtcact

SEQ ID NO: 213703 - DNA, 15 bp, Homo sapiens
tgacaacatagtcac

SEQ ID NO: 213704 - DNA, 15 bp, Homo sapiens
atgacaacatagtca

SEQ ID NO: 213705 - DNA, 15 bp, Homo sapiens
catgacaacatagtc

SEQ ID NO: 213706 - DNA, 15 bp, Homo sapiens
gcatgacaacatagt

SEQ ID NO: 213707 - DNA, 15 bp, Homo sapiens
tgcatgacaacatag

SEQ ID NO: 213708 - DNA, 15 bp, Homo sapiens
atgcatgacaacata

SEQ ID NO: 213709 - DNA, 15 bp, Homo sapiens
aatgcatgacaacat

SEQ ID NO: 213710 - DNA, 15 bp, Homo sapiens
taatgcatgacaaca

SEQ ID NO: 213711 - DNA, 15 bp, Homo sapiens
ataatgcatgacaac

SEQ ID NO: 213712 - DNA, 15 bp, Homo sapiens
tataatgcatgacaa

SEQ ID NO: 213713 - DNA, 15 bp, Homo sapiens
atataatgcatgaca

SEQ ID NO: 213714 - DNA, 15 bp, Homo sapiens
aatataatgcatgac

SEQ ID NO: 213715 - DNA, 15 bp, Homo sapiens
aaatataatgcatga

SEQ ID NO: 213716 - DNA, 15 bp, Homo sapiens
aaaatataatgcatg

SEQ ID NO: 213717 - DNA, 15 bp, Homo sapiens
taaaatataatgcat

SEQ ID NO: 213718 - DNA, 15 bp, Homo sapiens
ataaaatataatgca

SEQ ID NO: 213719 - DNA, 15 bp, Homo sapiens
tataaaatataatgc

SEQ ID NO: 213720 - DNA, 15 bp, Homo sapiens
ttataaaatataatg

SEQ ID NO: 213721 - DNA, 15 bp, Homo sapiens
tttataaaatataat

SEQ ID NO: 213722 - DNA, 15 bp, Homo sapiens
atttataaaatataa

SEQ ID NO: 213723 - DNA, 15 bp, Homo sapiens
ttatttataaaatat

SEQ ID NO: 213724 - DNA, 15 bp, Homo sapiens
tttatttataaaata

SEQ ID NO: 213725 - DNA, 15 bp, Homo sapiens
atttatttataaaat

SEQ ID NO: 213726 - DNA, 15 bp, Homo sapiens
tatttatttataaaa

SEQ ID NO: 213727 - DNA, 15 bp, Homo sapiens
atatttatttataaa

SEQ ID NO: 213728 - DNA, 15 bp, Homo sapiens
tatatttatttataa

SEQ ID NO: 213729 - DNA, 15 bp, Homo sapiens
ctatatttatttata

SEQ ID NO: 213730 - DNA, 15 bp, Homo sapiens
gctatatttatttat

SEQ ID NO: 213731 - DNA, 15 bp, Homo sapiens
ggctatatttattta

SEQ ID NO: 213732 - DNA, 15 bp, Homo sapiens
gggctatatttattt

SEQ ID NO: 213733 - DNA, 15 bp, Homo sapiens
ggggctatatttatt

SEQ ID NO: 213734 - DNA, 15 bp, Homo sapiens
tggggctatatttat

SEQ ID NO: 213735 - DNA, 15 bp, Homo sapiens
ttggggctatattta

SEQ ID NO: 213736 - DNA, 15 bp, Homo sapiens
cttggggctatattt

SEQ ID NO: 213737 - DNA, 15 bp, Homo sapiens
acttggggctatatt

SEQ ID NO: 213738 - DNA, 15 bp, Homo sapiens
gacttggggctatat

SEQ ID NO: 213739 - DNA, 15 bp, Homo sapiens
tgacttggggctata

SEQ ID NO: 213740 - DNA, 15 bp, Homo sapiens
atgacttggggctat

SEQ ID NO: 213741 - DNA, 15 bp, Homo sapiens
aatgacttggggcta

SEQ ID NO: 213742 - DNA, 15 bp, Homo sapiens
caatgacttggggct

SEQ ID NO: 213743 - DNA, 15 bp, Homo sapiens
tcaatgacttggggc

SEQ ID NO: 213744 - DNA, 15 bp, Homo sapiens
ttcaatgacttgggg

SEQ ID NO: 213745 - DNA, 15 bp, Homo sapiens
cttcaatgacttggg

SEQ ID NO: 213746 - DNA, 15 bp, Homo sapiens
gcttcaatgacttgg

SEQ ID NO: 213747 - DNA, 15 bp, Homo sapiens
tgcttcaatgacttg

SEQ ID NO: 213748 - DNA, 15 bp, Homo sapiens
ttgcttcaatgactt

SEQ ID NO: 213749 - DNA, 15 bp, Homo sapiens
tttgcttcaatgact

SEQ ID NO: 213750 - DNA, 15 bp, Homo sapiens
ttttgcttcaatgac

SEQ ID NO: 213751 - DNA, 15 bp, Homo sapiens
attttgcttcaatga

SEQ ID NO: 213752 - DNA, 15 bp, Homo sapiens
tattttgcttcaatg

SEQ ID NO: 213753 - DNA, 15 bp, Homo sapiens
atattttgcttcaat

SEQ ID NO: 213754 - DNA, 15 bp, Homo sapiens
tatattttgcttcaa

SEQ ID NO: 213755 - DNA, 15 bp, Homo sapiens
ttatattttgcttca

SEQ ID NO: 213756 - DNA, 15 bp, Homo sapiens
tttatattttgcttc

SEQ ID NO: 213757 - DNA, 15 bp, Homo sapiens
ctttatattttgctt

SEQ ID NO: 213758 - DNA, 15 bp, Homo sapiens
cctttatattttgct

SEQ ID NO: 213759 - DNA, 15 bp, Homo sapiens
ccctttatattttgc

SEQ ID NO: 213760 - DNA, 15 bp, Homo sapiens
tccctttatattttg

SEQ ID NO: 213761 - DNA, 15 bp, Homo sapiens
ttccctttatatttt

SEQ ID NO: 213762 - DNA, 15 bp, Homo sapiens
tttccctttatattt

SEQ ID NO: 213763 - DNA, 15 bp, Homo sapiens
ctttccctttatatt

SEQ ID NO: 213764 - DNA, 15 bp, Homo sapiens
actttccctttatat

SEQ ID NO: 213765 - DNA, 15 bp, Homo sapiens
aactttccctttata

SEQ ID NO: 213766 - DNA, 15 bp, Homo sapiens
aaactttccctttat

SEQ ID NO: 213767 - DNA, 15 bp, Homo sapiens
aaaactttcccttta

SEQ ID NO: 213768 - DNA, 15 bp, Homo sapiens
taaaactttcccttt

SEQ ID NO: 213769 - DNA, 15 bp, Homo sapiens
ataaaactttccctt

SEQ ID NO: 213770 - DNA, 15 bp, Homo sapiens
tataaaactttccct

SEQ ID NO: 213771 - DNA, 15 bp, Homo sapiens
ttataaaactttccc

SEQ ID NO: 213772 - DNA, 15 bp, Homo sapiens
attataaaactttcc

SEQ ID NO: 213773 - DNA, 15 bp, Homo sapiens
aattataaaactttc

SEQ ID NO: 213774 - DNA, 15 bp, Homo sapiens
caattataaaacttt

SEQ ID NO: 213775 - DNA, 15 bp, Homo sapiens
acaattataaaactt

SEQ ID NO: 213776 - DNA, 15 bp, Homo sapiens
aacaattataaaact

SEQ ID NO: 213777 - DNA, 15 bp, Homo sapiens
taacaattataaaac

SEQ ID NO: 213778 - DNA, 15 bp, Homo sapiens
gtaacaattataaaa

SEQ ID NO: 213779 - DNA, 15 bp, Homo sapiens
tgtaacaattataaa

SEQ ID NO: 213780 - DNA, 15 bp, Homo sapiens
ttgtaacaattataa

SEQ ID NO: 213781 - DNA, 15 bp, Homo sapiens
tttgtaacaattata

SEQ ID NO: 213782 - DNA, 15 bp, Homo sapiens
atttgtaacaattat

SEQ ID NO: 213783 - DNA, 15 bp, Homo sapiens
tatttgtaacaatta

SEQ ID NO: 213784 - DNA, 15 bp, Homo sapiens
gtatttgtaacaatt

SEQ ID NO: 213785 - DNA, 15 bp, Homo sapiens
tgtatttgtaacaat

SEQ ID NO: 213786 - DNA, 15 bp, Homo sapiens
ttgtatttgtaacaa

SEQ ID NO: 213787 - DNA, 15 bp, Homo sapiens
tttgtatttgtaaca

SEQ ID NO: 213788 - DNA, 15 bp, Homo sapiens
ttttgtatttgtaac

SEQ ID NO: 213789 - DNA, 15 bp, Homo sapiens
tttttgtatttgtaa

SEQ ID NO: 213790 - DNA, 15 bp, Homo sapiens
ttttttgtatttgta

SEQ ID NO: 213791 - DNA, 15 bp, Homo sapiens
attttttgtatttgt

SEQ ID NO: 213792 - DNA, 15 bp, Homo sapiens
cattttttgtatttg

SEQ ID NO: 213793 - DNA, 15 bp, Homo sapiens
ccattttttgtattt

SEQ ID NO: 213794 - DNA, 15 bp, Homo sapiens
cccattttttgtatt

SEQ ID NO: 213795 - DNA, 15 bp, Homo sapiens
gcccattttttgtat

SEQ ID NO: 213796 - DNA, 15 bp, Homo sapiens
agcccattttttgta

SEQ ID NO: 213797 - DNA, 15 bp, Homo sapiens
aagcccattttttgt

SEQ ID NO: 213798 - DNA, 15 bp, Homo sapiens
gaagcccattttttg

SEQ ID NO: 213799 - DNA, 15 bp, Homo sapiens
agaagcccatttttt

SEQ ID NO: 213800 - DNA, 15 bp, Homo sapiens
tagaagcccattttt

SEQ ID NO: 213801 - DNA, 15 bp, Homo sapiens
ttagaagcccatttt

SEQ ID NO: 213802 - DNA, 15 bp, Homo sapiens
tttagaagcccattt

SEQ ID NO: 213803 - DNA, 15 bp, Homo sapiens
gtttagaagcccatt

SEQ ID NO: 213804 - DNA, 15 bp, Homo sapiens
tgtttagaagcccat

SEQ ID NO: 213805 - DNA, 15 bp, Homo sapiens
gtgtttagaagccca

SEQ ID NO: 213806 - DNA, 15 bp, Homo sapiens
tgtgtttagaagccc

SEQ ID NO: 213807 - DNA, 15 bp, Homo sapiens
atgtgtttagaagcc

SEQ ID NO: 213808 - DNA, 15 bp, Homo sapiens
aatgtgtttagaagc

SEQ ID NO: 213809 - DNA, 15 bp, Homo sapiens
aaatgtgtttagaag

SEQ ID NO: 213810 - DNA, 15 bp, Homo sapiens
caaatgtgtttagaa

SEQ ID NO: 213811 - DNA, 15 bp, Homo sapiens
acaaatgtgtttaga

SEQ ID NO: 213812 - DNA, 15 bp, Homo sapiens
tacaaatgtgtttag

SEQ ID NO: 213813 - DNA, 15 bp, Homo sapiens
ttacaaatgtgttta

SEQ ID NO: 213814 - DNA, 15 bp, Homo sapiens
attacaaatgtgttt

SEQ ID NO: 213815 - DNA, 15 bp, Homo sapiens
aattacaaatgtgtt

SEQ ID NO: 213816 - DNA, 15 bp, Homo sapiens
gaattacaaatgtgt

SEQ ID NO: 213817 - DNA, 15 bp, Homo sapiens
agaattacaaatgtg

SEQ ID NO: 213818 - DNA, 15 bp, Homo sapiens
aagaattacaaatgt

SEQ ID NO: 213819 - DNA, 15 bp, Homo sapiens
gaagaattacaaatg

SEQ ID NO: 213820 - DNA, 15 bp, Homo sapiens
tgaagaattacaaat

SEQ ID NO: 213821 - DNA, 15 bp, Homo sapiens
atgaagaattacaaa

SEQ ID NO: 213822 - DNA, 15 bp, Homo sapiens
tatgaagaattacaa

SEQ ID NO: 213823 - DNA, 15 bp, Homo sapiens
ttatgaagaattaca

SEQ ID NO: 213824 - DNA, 15 bp, Homo sapiens
attatgaagaattac

SEQ ID NO: 213825 - DNA, 15 bp, Homo sapiens
cattatgaagaatta

SEQ ID NO: 213826 - DNA, 15 bp, Homo sapiens
gcattatgaagaatt

SEQ ID NO: 213827 - DNA, 15 bp, Homo sapiens
agcattatgaagaat

SEQ ID NO: 213828 - DNA, 15 bp, Homo sapiens
cagcattatgaagaa

SEQ ID NO: 213829 - DNA, 15 bp, Homo sapiens
acagcattatgaaga

SEQ ID NO: 213830 - DNA, 15 bp, Homo sapiens
aacagcattatgaag

SEQ ID NO: 213831 - DNA, 15 bp, Homo sapiens
gaacagcattatgaa

SEQ ID NO: 213832 - DNA, 15 bp, Homo sapiens
agaacagcattatga

SEQ ID NO: 213833 - DNA, 15 bp, Homo sapiens
aagaacagcattatg

SEQ ID NO: 213834 - DNA, 15 bp, Homo sapiens
aaagaacagcattat

SEQ ID NO: 213835 - DNA, 15 bp, Homo sapiens
caaagaacagcatta

SEQ ID NO: 213836 - DNA, 15 bp, Homo sapiens
tcaaagaacagcatt

SEQ ID NO: 213837 - DNA, 15 bp, Homo sapiens
ttcaaagaacagcat

SEQ ID NO: 213838 - DNA, 15 bp, Homo sapiens
tttcaaagaacagca

SEQ ID NO: 213839 - DNA, 15 bp, Homo sapiens
ctttcaaagaacagc

SEQ ID NO: 213840 - DNA, 15 bp, Homo sapiens
gctttcaaagaacag

SEQ ID NO: 213841 - DNA, 15 bp, Homo sapiens
tgctttcaaagaaca

SEQ ID NO: 213842 - DNA, 15 bp, Homo sapiens
ctgctttcaaagaac

SEQ ID NO: 213843 - DNA, 15 bp, Homo sapiens
actgctttcaaagaa

SEQ ID NO: 213844 - DNA, 15 bp, Homo sapiens
tactgctttcaaaga

SEQ ID NO: 213845 - DNA, 15 bp, Homo sapiens
ttactgctttcaaag

SEQ ID NO: 213846 - DNA, 15 bp, Homo sapiens
attactgctttcaaa

SEQ ID NO: 213847 - DNA, 15 bp, Homo sapiens
aattactgctttcaa

SEQ ID NO: 213848 - DNA, 15 bp, Homo sapiens
aaattactgctttca

SEQ ID NO: 213849 - DNA, 15 bp, Homo sapiens
taaattactgctttc

SEQ ID NO: 213850 - DNA, 15 bp, Homo sapiens
ataaattactgcttt

SEQ ID NO: 213851 - DNA, 15 bp, Homo sapiens
aataaattactgctt

SEQ ID NO: 213852 - DNA, 15 bp, Homo sapiens
gaataaattactgct

SEQ ID NO: 213853 - DNA, 15 bp, Homo sapiens
tgaataaattactgc

SEQ ID NO: 213854 - DNA, 15 bp, Homo sapiens
ttgaataaattactg

SEQ ID NO: 213855 - DNA, 15 bp, Homo sapiens
attgaataaattact

SEQ ID NO: 213856 - DNA, 15 bp, Homo sapiens
cattgaataaattac

SEQ ID NO: 213857 - DNA, 15 bp, Homo sapiens
gcattgaataaatta

SEQ ID NO: 213858 - DNA, 15 bp, Homo sapiens
agcattgaataaatt

SEQ ID NO: 213859 - DNA, 15 bp, Homo sapiens
tagcattgaataaat

SEQ ID NO: 213860 - DNA, 15 bp, Homo sapiens
ttagcattgaataaa

SEQ ID NO: 213861 - DNA, 15 bp, Homo sapiens
tttagcattgaataa

SEQ ID NO: 213862 - DNA, 15 bp, Homo sapiens
atttagcattgaata

SEQ ID NO: 213863 - DNA, 15 bp, Homo sapiens
catttagcattgaat

SEQ ID NO: 213864 - DNA, 15 bp, Homo sapiens
tcatttagcattgaa

SEQ ID NO: 213865 - DNA, 15 bp, Homo sapiens
ctcatttagcattga

SEQ ID NO: 213866 - DNA, 15 bp, Homo sapiens
gctcatttagcattg

SEQ ID NO: 213867 - DNA, 15 bp, Homo sapiens
agctcatttagcatt

SEQ ID NO: 213868 - DNA, 15 bp, Homo sapiens
gagctcatttagcat

SEQ ID NO: 213869 - DNA, 15 bp, Homo sapiens
tgagctcatttagca

SEQ ID NO: 213870 - DNA, 15 bp, Homo sapiens
ttgagctcatttagc

SEQ ID NO: 213871 - DNA, 15 bp, Homo sapiens
attgagctcatttag

SEQ ID NO: 213872 - DNA, 15 bp, Homo sapiens
aattgagctcattta

SEQ ID NO: 213873 - DNA, 15 bp, Homo sapiens
gaattgagctcattt

SEQ ID NO: 213874 - DNA, 15 bp, Homo sapiens
agaattgagctcatt

SEQ ID NO: 213875 - DNA, 15 bp, Homo sapiens
tagaattgagctcat

SEQ ID NO: 213876 - DNA, 15 bp, Homo sapiens
ctagaattgagctca

SEQ ID NO: 213877 - DNA, 15 bp, Homo sapiens
actagaattgagctc

SEQ ID NO: 213878 - DNA, 15 bp, Homo sapiens
cactagaattgagct

SEQ ID NO: 213879 - DNA, 15 bp, Homo sapiens
ccactagaattgagc

SEQ ID NO: 213880 - DNA, 15 bp, Homo sapiens
cccactagaattgag

SEQ ID NO: 213881 - DNA, 15 bp, Homo sapiens
gcccactagaattga

SEQ ID NO: 213882 - DNA, 15 bp, Homo sapiens
tgcccactagaattg

SEQ ID NO: 213883 - DNA, 15 bp, Homo sapiens
atgcccactagaatt

SEQ ID NO: 213884 - DNA, 15 bp, Homo sapiens
aatgcccactagaat

SEQ ID NO: 213885 - DNA, 15 bp, Homo sapiens
gaatgcccactagaa

SEQ ID NO: 213886 - DNA, 15 bp, Homo sapiens
ggaatgcccactaga

SEQ ID NO: 213887 - DNA, 15 bp, Homo sapiens
aggaatgcccactag

SEQ ID NO: 213888 - DNA, 15 bp, Homo sapiens
aaggaatgcccacta

SEQ ID NO: 213889 - DNA, 15 bp, Homo sapiens
aaaggaatgcccact

SEQ ID NO: 213890 - DNA, 15 bp, Homo sapiens
gaaaggaatgcccac

SEQ ID NO: 213891 - DNA, 15 bp, Homo sapiens
agaaaggaatgccca

SEQ ID NO: 213892 - DNA, 15 bp, Homo sapiens
aagaaaggaatgccc

SEQ ID NO: 213893 - DNA, 15 bp, Homo sapiens
taagaaaggaatgcc

SEQ ID NO: 213894 - DNA, 15 bp, Homo sapiens
ttaagaaaggaatgc

SEQ ID NO: 213895 - DNA, 15 bp, Homo sapiens
tttaagaaaggaatg

SEQ ID NO: 213896 - DNA, 15 bp, Homo sapiens
ttttaagaaaggaat

SEQ ID NO: 213897 - DNA, 15 bp, Homo sapiens
cttttaagaaaggaa

SEQ ID NO: 213898 - DNA, 15 bp, Homo sapiens
acttttaagaaagga

SEQ ID NO: 213899 - DNA, 15 bp, Homo sapiens
tacttttaagaaagg

SEQ ID NO: 213900 - DNA, 15 bp, Homo sapiens
atacttttaagaaag

SEQ ID NO: 213901 - DNA, 15 bp, Homo sapiens
tatacttttaagaaa

SEQ ID NO: 213902 - DNA, 15 bp, Homo sapiens
ttatacttttaagaa

SEQ ID NO: 213903 - DNA, 15 bp, Homo sapiens
attatacttttaaga

SEQ ID NO: 213904 - DNA, 15 bp, Homo sapiens
aattatacttttaag

SEQ ID NO: 213905 - DNA, 15 bp, Homo sapiens
aaattatacttttaa

SEQ ID NO: 213906 - DNA, 15 bp, Homo sapiens
aaaattatactttta

SEQ ID NO: 213907 - DNA, 15 bp, Homo sapiens
aaaaattatactttt

SEQ ID NO: 213908 - DNA, 15 bp, Homo sapiens
taaaaattatacttt

SEQ ID NO: 213909 - DNA, 15 bp, Homo sapiens
ttaaaaattatactt

SEQ ID NO: 213910 - DNA, 15 bp, Homo sapiens
attaaaaattatact

SEQ ID NO: 213911 - DNA, 15 bp, Homo sapiens
aattaaaaattatac

SEQ ID NO: 213912 - DNA, 15 bp, Homo sapiens
taattaaaaattata

SEQ ID NO: 213913 - DNA, 15 bp, Homo sapiens
ataattaaaaattat

SEQ ID NO: 213914 - DNA, 15 bp, Homo sapiens
cataattaaaaatta

SEQ ID NO: 213915 - DNA, 15 bp, Homo sapiens
tcataattaaaaatt

SEQ ID NO: 213916 - DNA, 15 bp, Homo sapiens
ttcataattaaaaat

SEQ ID NO: 213917 - DNA, 15 bp, Homo sapiens
tttcataattaaaaa

SEQ ID NO: 213918 - DNA, 15 bp, Homo sapiens
ttttcataattaaaa

SEQ ID NO: 213919 - DNA, 15 bp, Homo sapiens
attttcataattaaa

SEQ ID NO: 213920 - DNA, 15 bp, Homo sapiens
tattttcataattaa

SEQ ID NO: 213921 - DNA, 15 bp, Homo sapiens
ttattttcataatta

SEQ ID NO: 213922 - DNA, 15 bp, Homo sapiens
attattttcataatt

SEQ ID NO: 213923 - DNA, 15 bp, Homo sapiens
tattattttcataat

SEQ ID NO: 213924 - DNA, 15 bp, Homo sapiens
ttattattttcataa

SEQ ID NO: 213925 - DNA, 15 bp, Homo sapiens
gttattattttcata

SEQ ID NO: 213926 - DNA, 15 bp, Homo sapiens
tgttattattttcat

SEQ ID NO: 213927 - DNA, 15 bp, Homo sapiens
atgttattattttca

SEQ ID NO: 213928 - DNA, 15 bp, Homo sapiens
tatgttattattttc

SEQ ID NO: 213929 - DNA, 15 bp, Homo sapiens
atatgttattatttt

SEQ ID NO: 213930 - DNA, 15 bp, Homo sapiens
aatatgttattattt

SEQ ID NO: 213931 - DNA, 15 bp, Homo sapiens
taatatgttattatt

SEQ ID NO: 213932 - DNA, 15 bp, Homo sapiens
gtaatatgttattat

SEQ ID NO: 213933 - DNA, 15 bp, Homo sapiens
tgtaatatgttatta

SEQ ID NO: 213934 - DNA, 15 bp, Homo sapiens
ctgtaatatgttatt

SEQ ID NO: 213935 - DNA, 15 bp, Homo sapiens
tctgtaatatgttat

SEQ ID NO: 213936 - DNA, 15 bp, Homo sapiens
ctctgtaatatgtta

SEQ ID NO: 213937 - DNA, 15 bp, Homo sapiens
actctgtaatatgtt

SEQ ID NO: 213938 - DNA, 15 bp, Homo sapiens
aactctgtaatatgt

SEQ ID NO: 213939 - DNA, 15 bp, Homo sapiens
aaactctgtaatatg

SEQ ID NO: 213940 - DNA, 15 bp, Homo sapiens
taaactctgtaatat

SEQ ID NO: 213941 - DNA, 15 bp, Homo sapiens
ataaactctgtaata

SEQ ID NO: 213942 - DNA, 15 bp, Homo sapiens
cataaactctgtaat

SEQ ID NO: 213943 - DNA, 15 bp, Homo sapiens
tcataaactctgtaa

SEQ ID NO: 213944 - DNA, 15 bp, Homo sapiens
ttcataaactctgta

SEQ ID NO: 213945 - DNA, 15 bp, Homo sapiens
tttcataaactctgt

SEQ ID NO: 213946 - DNA, 15 bp, Homo sapiens
atttcataaactctg

SEQ ID NO: 213947 - DNA, 15 bp, Homo sapiens
tatttcataaactct

SEQ ID NO: 213948 - DNA, 15 bp, Homo sapiens
ttatttcataaactc

SEQ ID NO: 213949 - DNA, 15 bp, Homo sapiens
tttatttcataaact

SEQ ID NO: 213950 - DNA, 15 bp, Homo sapiens
ctttatttcataaac

SEQ ID NO: 213951 - DNA, 15 bp, Homo sapiens
tctttatttcataaa

SEQ ID NO: 213952 - DNA, 15 bp, Homo sapiens
ttctttatttcataa

SEQ ID NO: 213953 - DNA, 15 bp, Homo sapiens
attctttatttcata

SEQ ID NO: 213954 - DNA, 15 bp, Homo sapiens
tattctttatttcat

SEQ ID NO: 213955 - DNA, 15 bp, Homo sapiens
ttattctttatttca

SEQ ID NO: 213956 - DNA, 15 bp, Homo sapiens
tttattctttatttc

SEQ ID NO: 213957 - DNA, 15 bp, Homo sapiens
ttttattctttattt

SEQ ID NO: 213958 - DNA, 15 bp, Homo sapiens
tttttattctttatt

SEQ ID NO: 213959 - DNA, 15 bp, Homo sapiens
tgtttttattcttta

SEQ ID NO: 213960 - DNA, 15 bp, Homo sapiens
atgtttttattcttt

SEQ ID NO: 213961 - DNA, 15 bp, Homo sapiens
catgtttttattctt

SEQ ID NO: 213962 - DNA, 15 bp, Homo sapiens
ccatgtttttattct

SEQ ID NO: 213963 - DNA, 15 bp, Homo sapiens
gccatgtttttattc

SEQ ID NO: 213964 - DNA, 15 bp, Homo sapiens
ggccatgtttttatt

SEQ ID NO: 213965 - DNA, 15 bp, Homo sapiens
tggccatgtttttat

SEQ ID NO: 213966 - DNA, 15 bp, Homo sapiens
atggccatgttttta

SEQ ID NO: 213967 - DNA, 15 bp, Homo sapiens
tatggccatgttttt

SEQ ID NO: 213968 - DNA, 15 bp, Homo sapiens
ttatggccatgtttt

SEQ ID NO: 213969 - DNA, 15 bp, Homo sapiens
attatggccatgttt

SEQ ID NO: 213970 - DNA, 15 bp, Homo sapiens
aattatggccatgtt

SEQ ID NO: 213971 - DNA, 15 bp, Homo sapiens
aaattatggccatgt

SEQ ID NO: 213972 - DNA, 15 bp, Homo sapiens
aaaattatggccatg

SEQ ID NO: 213973 - DNA, 15 bp, Homo sapiens
taaaattatggccat

SEQ ID NO: 213974 - DNA, 15 bp, Homo sapiens
ataaaattatggcca

SEQ ID NO: 213975 - DNA, 15 bp, Homo sapiens
gataaaattatggcc

SEQ ID NO: 213976 - DNA, 15 bp, Homo sapiens
tgataaaattatggc

SEQ ID NO: 213977 - DNA, 15 bp, Homo sapiens
gtgataaaattatgg

SEQ ID NO: 213978 - DNA, 15 bp, Homo sapiens
ggtgataaaattatg

SEQ ID NO: 213979 - DNA, 15 bp, Homo sapiens
tggtgataaaattat

SEQ ID NO: 213980 - DNA, 15 bp, Homo sapiens
atggtgataaaatta

SEQ ID NO: 213981 - DNA, 15 bp, Homo sapiens
tatggtgataaaatt

SEQ ID NO: 213982 - DNA, 15 bp, Homo sapiens
ttatggtgataaaat

SEQ ID NO: 213983 - DNA, 15 bp, Homo sapiens
gttatggtgataaaa

SEQ ID NO: 213984 - DNA, 15 bp, Homo sapiens
tgttatggtgataaa

SEQ ID NO: 213985 - DNA, 15 bp, Homo sapiens
ttgttatggtgataa

SEQ ID NO: 213986 - DNA, 15 bp, Homo sapiens
gttgttatggtgata

SEQ ID NO: 213987 - DNA, 15 bp, Homo sapiens
ggttgttatggtgat

SEQ ID NO: 213988 - DNA, 15 bp, Homo sapiens
gggttgttatggtga

SEQ ID NO: 213989 - DNA, 15 bp, Homo sapiens
agggttgttatggtg

SEQ ID NO: 213990 - DNA, 15 bp, Homo sapiens
aagggttgttatggt

SEQ ID NO: 213991 - DNA, 15 bp, Homo sapiens
aaagggttgttatgg

SEQ ID NO: 213992 - DNA, 15 bp, Homo sapiens
aaaagggttgttatg

SEQ ID NO: 213993 - DNA, 15 bp, Homo sapiens
gaaaagggttgttat

SEQ ID NO: 213994 - DNA, 15 bp, Homo sapiens
tgaaaagggttgtta

SEQ ID NO: 213995 - DNA, 15 bp, Homo sapiens
atgaaaagggttgtt

SEQ ID NO: 213996 - DNA, 15 bp, Homo sapiens
aatgaaaagggttgt

SEQ ID NO: 213997 - DNA, 15 bp, Homo sapiens
aaatgaaaagggttg

SEQ ID NO: 213998 - DNA, 15 bp, Homo sapiens
aaaatgaaaagggtt

SEQ ID NO: 213999 - DNA, 15 bp, Homo sapiens
caaaatgaaaagggt

SEQ ID NO: 214000 - DNA, 15 bp, Homo sapiens
gcaaaatgaaaaggg

SEQ ID NO: 214001 - DNA, 15 bp, Homo sapiens
tgcaaaatgaaaagg

SEQ ID NO: 214002 - DNA, 15 bp, Homo sapiens
atgcaaaatgaaaag

SEQ ID NO: 214003 - DNA, 15 bp, Homo sapiens
aatgcaaaatgaaaa

SEQ ID NO: 214004 - DNA, 15 bp, Homo sapiens
taatgcaaaatgaaa

SEQ ID NO: 214005 - DNA, 15 bp, Homo sapiens
ataatgcaaaatgaa

SEQ ID NO: 214006 - DNA, 15 bp, Homo sapiens
aataatgcaaaatga

SEQ ID NO: 214007 - DNA, 15 bp, Homo sapiens
aaataatgcaaaatg

SEQ ID NO: 214008 - DNA, 15 bp, Homo sapiens
gaaataatgcaaaat

SEQ ID NO: 214009 - DNA, 15 bp, Homo sapiens
ggaaataatgcaaaa

SEQ ID NO: 214010 - DNA, 15 bp, Homo sapiens
aggaaataatgcaaa

SEQ ID NO: 214011 - DNA, 15 bp, Homo sapiens
aaggaaataatgcaa

SEQ ID NO: 214012 - DNA, 15 bp, Homo sapiens
aaaggaaataatgca

SEQ ID NO: 214013 - DNA, 15 bp, Homo sapiens
aaaaggaaataatgc

SEQ ID NO: 214014 - DNA, 15 bp, Homo sapiens
aaaaaggaaataatg

SEQ ID NO: 214015 - DNA, 15 bp, Homo sapiens
caaaaaggaaataat

SEQ ID NO: 214016 - DNA, 15 bp, Homo sapiens
gcaaaaaggaaataa

SEQ ID NO: 214017 - DNA, 15 bp, Homo sapiens
tgcaaaaaggaaata

SEQ ID NO: 214018 - DNA, 15 bp, Homo sapiens
atgcaaaaaggaaat

SEQ ID NO: 214019 - DNA, 15 bp, Homo sapiens
tatgcaaaaaggaaa

SEQ ID NO: 214020 - DNA, 15 bp, Homo sapiens
atatgcaaaaaggaa

SEQ ID NO: 214021 - DNA, 15 bp, Homo sapiens
aatatgcaaaaagga

SEQ ID NO: 214022 - DNA, 15 bp, Homo sapiens
aaatatgcaaaaagg

SEQ ID NO: 214023 - DNA, 15 bp, Homo sapiens
taaatatgcaaaaag

SEQ ID NO: 214024 - DNA, 15 bp, Homo sapiens
gtaaatatgcaaaaa

SEQ ID NO: 214025 - DNA, 15 bp, Homo sapiens
ggtaaatatgcaaaa

SEQ ID NO: 214026 - DNA, 15 bp, Homo sapiens
aggtaaatatgcaaa

SEQ ID NO: 214027 - DNA, 15 bp, Homo sapiens
aaggtaaatatgcaa

SEQ ID NO: 214028 - DNA, 15 bp, Homo sapiens
aaaggtaaatatgca

SEQ ID NO: 214029 - DNA, 15 bp, Homo sapiens
aaaaggtaaatatgc

SEQ ID NO: 214030 - DNA, 15 bp, Homo sapiens
caaaaggtaaatatg

SEQ ID NO: 214031 - DNA, 15 bp, Homo sapiens
gcaaaaggtaaatat

SEQ ID NO: 214032 - DNA, 15 bp, Homo sapiens
tgcaaaaggtaaata

SEQ ID NO: 214033 - DNA, 15 bp, Homo sapiens
atgcaaaaggtaaat

SEQ ID NO: 214034 - DNA, 15 bp, Homo sapiens
tatgcaaaaggtaaa

SEQ ID NO: 214035 - DNA, 15 bp, Homo sapiens
ctatgcaaaaggtaa

SEQ ID NO: 214036 - DNA, 15 bp, Homo sapiens
actatgcaaaaggta

SEQ ID NO: 214037 - DNA, 15 bp, Homo sapiens
aactatgcaaaaggt

SEQ ID NO: 214038 - DNA, 15 bp, Homo sapiens
aaactatgcaaaagg

SEQ ID NO: 214039 - DNA, 15 bp, Homo sapiens
aaaactatgcaaaag

SEQ ID NO: 214040 - DNA, 15 bp, Homo sapiens
taaaactatgcaaaa

SEQ ID NO: 214041 - DNA, 15 bp, Homo sapiens
gtaaaactatgcaaa

SEQ ID NO: 214042 - DNA, 15 bp, Homo sapiens
agtaaaactatgcaa

SEQ ID NO: 214043 - DNA, 15 bp, Homo sapiens
aagtaaaactatgca

SEQ ID NO: 214044 - DNA, 15 bp, Homo sapiens
caagtaaaactatgc

SEQ ID NO: 214045 - DNA, 15 bp, Homo sapiens
ccaagtaaaactatg

SEQ ID NO: 214046 - DNA, 15 bp, Homo sapiens
cccaagtaaaactat

SEQ ID NO: 214047 - DNA, 15 bp, Homo sapiens
acccaagtaaaacta

SEQ ID NO: 214048 - DNA, 15 bp, Homo sapiens
cacccaagtaaaact

SEQ ID NO: 214049 - DNA, 15 bp, Homo sapiens
gcacccaagtaaaac

SEQ ID NO: 214050 - DNA, 15 bp, Homo sapiens
tgcacccaagtaaaa

SEQ ID NO: 214051 - DNA, 15 bp, Homo sapiens
ctgcacccaagtaaa

SEQ ID NO: 214052 - DNA, 15 bp, Homo sapiens
tctgcacccaagtaa

SEQ ID NO: 214053 - DNA, 15 bp, Homo sapiens
ctctgcacccaagta

SEQ ID NO: 214054 - DNA, 15 bp, Homo sapiens
actctgcacccaagt

SEQ ID NO: 214055 - DNA, 15 bp, Homo sapiens
aactctgcacccaag

SEQ ID NO: 214056 - DNA, 15 bp, Homo sapiens
aaactctgcacccaa

SEQ ID NO: 214057 - DNA, 15 bp, Homo sapiens
aaaactctgcaccca

SEQ ID NO: 214058 - DNA, 15 bp, Homo sapiens
aaaaactctgcaccc

SEQ ID NO: 214059 - DNA, 15 bp, Homo sapiens
taaaaactctgcacc

SEQ ID NO: 214060 - DNA, 15 bp, Homo sapiens
ataaaaactctgcac

SEQ ID NO: 214061 - DNA, 15 bp, Homo sapiens
cataaaaactctgca

SEQ ID NO: 214062 - DNA, 15 bp, Homo sapiens
acataaaaactctgc

SEQ ID NO: 214063 - DNA, 15 bp, Homo sapiens
gacataaaaactctg

SEQ ID NO: 214064 - DNA, 15 bp, Homo sapiens
tgacataaaaactct

SEQ ID NO: 214065 - DNA, 15 bp, Homo sapiens
atgacataaaaactc

SEQ ID NO: 214066 - DNA, 15 bp, Homo sapiens
gatgacataaaaact

SEQ ID NO: 214067 - DNA, 15 bp, Homo sapiens
agatgacataaaaac

SEQ ID NO: 214068 - DNA, 15 bp, Homo sapiens
aagatgacataaaaa

SEQ ID NO: 214069 - DNA, 15 bp, Homo sapiens
aaagatgacataaaa

SEQ ID NO: 214070 - DNA, 15 bp, Homo sapiens
aaaagatgacataaa

SEQ ID NO: 214071 - DNA, 15 bp, Homo sapiens
aaaaagatgacataa

SEQ ID NO: 214072 - DNA, 15 bp, Homo sapiens
gaaaaagatgacata

SEQ ID NO: 214073 - DNA, 15 bp, Homo sapiens
tgaaaaagatgacat

SEQ ID NO: 214074 - DNA, 15 bp, Homo sapiens
gtgaaaaagatgaca

SEQ ID NO: 214075 - DNA, 15 bp, Homo sapiens
agtgaaaaagatgac

SEQ ID NO: 214076 - DNA, 15 bp, Homo sapiens
aagtgaaaaagatga

SEQ ID NO: 214077 - DNA, 15 bp, Homo sapiens
taagtgaaaaagatg

SEQ ID NO: 214078 - DNA, 15 bp, Homo sapiens
ctaagtgaaaaagat

SEQ ID NO: 214079 - DNA, 15 bp, Homo sapiens
tctaagtgaaaaaga

SEQ ID NO: 214080 - DNA, 15 bp, Homo sapiens
atctaagtgaaaaag

SEQ ID NO: 214081 - DNA, 15 bp, Homo sapiens
tatctaagtgaaaaa

SEQ ID NO: 214082 - DNA, 15 bp, Homo sapiens
gtatctaagtgaaaa

SEQ ID NO: 214083 - DNA, 15 bp, Homo sapiens
tgtatctaagtgaaa

SEQ ID NO: 214084 - DNA, 15 bp, Homo sapiens
atgtatctaagtgaa

SEQ ID NO: 214085 - DNA, 15 bp, Homo sapiens
catgtatctaagtga

SEQ ID NO: 214086 - DNA, 15 bp, Homo sapiens
acatgtatctaagtg

SEQ ID NO: 214087 - DNA, 15 bp, Homo sapiens
gacatgtatctaagt

SEQ ID NO: 214088 - DNA, 15 bp, Homo sapiens
tgacatgtatctaag

SEQ ID NO: 214089 - DNA, 15 bp, Homo sapiens
atgacatgtatctaa

SEQ ID NO: 214090 - DNA, 15 bp, Homo sapiens
catgacatgtatcta

SEQ ID NO: 214091 - DNA, 15 bp, Homo sapiens
gcatgacatgtatct

SEQ ID NO: 214092 - DNA, 15 bp, Homo sapiens
ggcatgacatgtatc

SEQ ID NO: 214093 - DNA, 15 bp, Homo sapiens
aggcatgacatgtat

SEQ ID NO: 214094 - DNA, 15 bp, Homo sapiens
taggcatgacatgta

SEQ ID NO: 214095 - DNA, 15 bp, Homo sapiens
ataggcatgacatgt

SEQ ID NO: 214096 - DNA, 15 bp, Homo sapiens
aataggcatgacatg

SEQ ID NO: 214097 - DNA, 15 bp, Homo sapiens
aaataggcatgacat

SEQ ID NO: 214098 - DNA, 15 bp, Homo sapiens
gaaataggcatgaca

SEQ ID NO: 214099 - DNA, 15 bp, Homo sapiens
agaaataggcatgac

SEQ ID NO: 214100 - DNA, 15 bp, Homo sapiens
aagaaataggcatga

SEQ ID NO: 214101 - DNA, 15 bp, Homo sapiens
gaagaaataggcatg

SEQ ID NO: 214102 - DNA, 15 bp, Homo sapiens
tgaagaaataggcat

SEQ ID NO: 214103 - DNA, 15 bp, Homo sapiens
gtgaagaaataggca

SEQ ID NO: 214104 - DNA, 15 bp, Homo sapiens
tgtgaagaaataggc

SEQ ID NO: 214105 - DNA, 15 bp, Homo sapiens
atgtgaagaaatagg

SEQ ID NO: 214106 - DNA, 15 bp, Homo sapiens
aatgtgaagaaatag

SEQ ID NO: 214107 - DNA, 15 bp, Homo sapiens
caatgtgaagaaata

SEQ ID NO: 214108 - DNA, 15 bp, Homo sapiens
gcaatgtgaagaaat

SEQ ID NO: 214109 - DNA, 15 bp, Homo sapiens
agcaatgtgaagaaa

SEQ ID NO: 214110 - DNA, 15 bp, Homo sapiens
tagcaatgtgaagaa

SEQ ID NO: 214111 - DNA, 15 bp, Homo sapiens
atagcaatgtgaaga

SEQ ID NO: 214112 - DNA, 15 bp, Homo sapiens
catagcaatgtgaag

SEQ ID NO: 214113 - DNA, 15 bp, Homo sapiens
acatagcaatgtgaa

SEQ ID NO: 214114 - DNA, 15 bp, Homo sapiens
cacatagcaatgtga

SEQ ID NO: 214115 - DNA, 15 bp, Homo sapiens
ccacatagcaatgtg

SEQ ID NO: 214116 - DNA, 15 bp, Homo sapiens
accacatagcaatgt

SEQ ID NO: 214117 - DNA, 15 bp, Homo sapiens
gaccacatagcaatg

SEQ ID NO: 214118 - DNA, 15 bp, Homo sapiens
tgaccacatagcaat

SEQ ID NO: 214119 - DNA, 15 bp, Homo sapiens
atgaccacatagcaa

SEQ ID NO: 214120 - DNA, 15 bp, Homo sapiens
aatgaccacatagca

SEQ ID NO: 214121 - DNA, 15 bp, Homo sapiens
taatgaccacatagc

SEQ ID NO: 214122 - DNA, 15 bp, Homo sapiens
ataatgaccacatag

SEQ ID NO: 214123 - DNA, 15 bp, Homo sapiens
gataatgaccacata

SEQ ID NO: 214124 - DNA, 15 bp, Homo sapiens
tgataatgaccacat

SEQ ID NO: 214125 - DNA, 15 bp, Homo sapiens
gtgataatgaccaca

SEQ ID NO: 214126 - DNA, 15 bp, Homo sapiens
tgtgataatgaccac

SEQ ID NO: 214127 - DNA, 15 bp, Homo sapiens
ttgtgataatgacca

SEQ ID NO: 214128 - DNA, 15 bp, Homo sapiens
attgtgataatgacc

SEQ ID NO: 214129 - DNA, 15 bp, Homo sapiens
tattgtgataatgac

SEQ ID NO: 214130 - DNA, 15 bp, Homo sapiens
ttattgtgataatga

SEQ ID NO: 214131 - DNA, 15 bp, Homo sapiens
gttattgtgataatg

SEQ ID NO: 214132 - DNA, 15 bp, Homo sapiens
agttattgtgataat

SEQ ID NO: 214133 - DNA, 15 bp, Homo sapiens
aagttattgtgataa

SEQ ID NO: 214134 - DNA, 15 bp, Homo sapiens
aaagttattgtgata

SEQ ID NO: 214135 - DNA, 15 bp, Homo sapiens
aaaagttattgtgat

SEQ ID NO: 214136 - DNA, 15 bp, Homo sapiens
gaaaagttattgtga

SEQ ID NO: 214137 - DNA, 15 bp, Homo sapiens
tgaaaagttattgtg

SEQ ID NO: 214138 - DNA, 15 bp, Homo sapiens
ttgaaaagttattgt

SEQ ID NO: 214139 - DNA, 15 bp, Homo sapiens
cttgaaaagttattg

SEQ ID NO: 214140 - DNA, 15 bp, Homo sapiens
ccttgaaaagttatt

SEQ ID NO: 214141 - DNA, 15 bp, Homo sapiens
accttgaaaagttat

SEQ ID NO: 214142 - DNA, 15 bp, Homo sapiens
aaccttgaaaagtta

SEQ ID NO: 214143 - DNA, 15 bp, Homo sapiens
caaccttgaaaagtt

SEQ ID NO: 214144 - DNA, 15 bp, Homo sapiens
gcaaccttgaaaagt

SEQ ID NO: 214145 - DNA, 15 bp, Homo sapiens
tgcaaccttgaaaag

SEQ ID NO: 214146 - DNA, 15 bp, Homo sapiens
atgcaaccttgaaaa

SEQ ID NO: 214147 - DNA, 15 bp, Homo sapiens
tatgcaaccttgaaa

SEQ ID NO: 214148 - DNA, 15 bp, Homo sapiens
ttatgcaaccttgaa

SEQ ID NO: 214149 - DNA, 15 bp, Homo sapiens
attatgcaaccttga

SEQ ID NO: 214150 - DNA, 15 bp, Homo sapiens
cattatgcaaccttg

SEQ ID NO: 214151 - DNA, 15 bp, Homo sapiens
ccattatgcaacctt

SEQ ID NO: 214152 - DNA, 15 bp, Homo sapiens
gccattatgcaacct

SEQ ID NO: 214153 - DNA, 15 bp, Homo sapiens
ggccattatgcaacc

SEQ ID NO: 214154 - DNA, 15 bp, Homo sapiens
aggccattatgcaac

SEQ ID NO: 214155 - DNA, 15 bp, Homo sapiens
gaggccattatgcaa

SEQ ID NO: 214156 - DNA, 15 bp, Homo sapiens
agaggccattatgca

SEQ ID NO: 214157 - DNA, 15 bp, Homo sapiens
tagaggccattatgc

SEQ ID NO: 214158 - DNA, 15 bp, Homo sapiens
atagaggccattatg

SEQ ID NO: 214159 - DNA, 15 bp, Homo sapiens
aatagaggccattat

SEQ ID NO: 214160 - DNA, 15 bp, Homo sapiens
caatagaggccatta

SEQ ID NO: 214161 - DNA, 15 bp, Homo sapiens
acaatagaggccatt

SEQ ID NO: 214162 - DNA, 15 bp, Homo sapiens
cacaatagaggccat

SEQ ID NO: 214163 - DNA, 15 bp, Homo sapiens
ccacaatagaggcca

SEQ ID NO: 214164 - DNA, 15 bp, Homo sapiens
gccacaatagaggcc

SEQ ID NO: 214165 - DNA, 15 bp, Homo sapiens
ggccacaatagaggc

SEQ ID NO: 214166 - DNA, 15 bp, Homo sapiens
tggccacaatagagg

SEQ ID NO: 214167 - DNA, 15 bp, Homo sapiens
atggccacaatagag

SEQ ID NO: 214168 - DNA, 15 bp, Homo sapiens
tatggccacaataga

SEQ ID NO: 214169 - DNA, 15 bp, Homo sapiens
atatggccacaatag

SEQ ID NO: 214170 - DNA, 15 bp, Homo sapiens
gatatggccacaata

SEQ ID NO: 214171 - DNA, 15 bp, Homo sapiens
tgatatggccacaat

SEQ ID NO: 214172 - DNA, 15 bp, Homo sapiens
atgatatggccacaa

SEQ ID NO: 214173 - DNA, 15 bp, Homo sapiens
tatgatatggccaca

SEQ ID NO: 214174 - DNA, 15 bp, Homo sapiens
ctatgatatggccac

SEQ ID NO: 214175 - DNA, 15 bp, Homo sapiens
tctatgatatggcca

SEQ ID NO: 214176 - DNA, 15 bp, Homo sapiens
ttctatgatatggcc

SEQ ID NO: 214177 - DNA, 15 bp, Homo sapiens
gttctatgatatggc

SEQ ID NO: 214178 - DNA, 15 bp, Homo sapiens
ggttctatgatatgg

SEQ ID NO: 214179 - DNA, 15 bp, Homo sapiens
aggttctatgatatg

SEQ ID NO: 214180 - DNA, 15 bp, Homo sapiens
taggttctatgatat

SEQ ID NO: 214181 - DNA, 15 bp, Homo sapiens
ttaggttctatgata

SEQ ID NO: 214182 - DNA, 15 bp, Homo sapiens
tttaggttctatgat

SEQ ID NO: 214183 - DNA, 15 bp, Homo sapiens
atttaggttctatga

SEQ ID NO: 214184 - DNA, 15 bp, Homo sapiens
tatttaggttctatg

SEQ ID NO: 214185 - DNA, 15 bp, Homo sapiens
atatttaggttctat

SEQ ID NO: 214186 - DNA, 15 bp, Homo sapiens
tatatttaggttcta

SEQ ID NO: 214187 - DNA, 15 bp, Homo sapiens
atatatttaggttct

SEQ ID NO: 214188 - DNA, 15 bp, Homo sapiens
aatatatttaggttc

SEQ ID NO: 214189 - DNA, 15 bp, Homo sapiens
gaatatatttaggtt

SEQ ID NO: 214190 - DNA, 15 bp, Homo sapiens
ggaatatatttaggt

SEQ ID NO: 214191 - DNA, 15 bp, Homo sapiens
tggaatatatttagg

SEQ ID NO: 214192 - DNA, 15 bp, Homo sapiens
ctggaatatatttag

SEQ ID NO: 214193 - DNA, 15 bp, Homo sapiens
cctggaatatattta

SEQ ID NO: 214194 - DNA, 15 bp, Homo sapiens
acctggaatatattt

SEQ ID NO: 214195 - DNA, 15 bp, Homo sapiens
cacctggaatatatt

SEQ ID NO: 214196 - DNA, 15 bp, Homo sapiens
acacctggaatatat

SEQ ID NO: 214197 - DNA, 15 bp, Homo sapiens
aacacctggaatata

SEQ ID NO: 214198 - DNA, 15 bp, Homo sapiens
caacacctggaatat

SEQ ID NO: 214199 - DNA, 15 bp, Homo sapiens
ccaacacctggaata

SEQ ID NO: 214200 - DNA, 15 bp, Homo sapiens
tccaacacctggaat

SEQ ID NO: 214201 - DNA, 15 bp, Homo sapiens
ctccaacacctggaa

SEQ ID NO: 214202 - DNA, 15 bp, Homo sapiens
tctccaacacctgga

SEQ ID NO: 214203 - DNA, 15 bp, Homo sapiens
atctccaacacctgg

SEQ ID NO: 214204 - DNA, 15 bp, Homo sapiens
aatctccaacacctg

SEQ ID NO: 214205 - DNA, 15 bp, Homo sapiens
aaatctccaacacct

SEQ ID NO: 214206 - DNA, 15 bp, Homo sapiens
taaatctccaacacc

SEQ ID NO: 214207 - DNA, 15 bp, Homo sapiens
ttaaatctccaacac

SEQ ID NO: 214208 - DNA, 15 bp, Homo sapiens
cttaaatctccaaca

SEQ ID NO: 214209 - DNA, 15 bp, Homo sapiens
acttaaatctccaac

SEQ ID NO: 214210 - DNA, 15 bp, Homo sapiens
aacttaaatctccaa

SEQ ID NO: 214211 - DNA, 15 bp, Homo sapiens
aaacttaaatctcca

SEQ ID NO: 214212 - DNA, 15 bp, Homo sapiens
gaaacttaaatctcc

SEQ ID NO: 214213 - DNA, 15 bp, Homo sapiens
agaaacttaaatctc

SEQ ID NO: 214214 - DNA, 15 bp, Homo sapiens
aagaaacttaaatct

SEQ ID NO: 214215 - DNA, 15 bp, Homo sapiens
aaagaaacttaaatc

SEQ ID NO: 214216 - DNA, 15 bp, Homo sapiens
gaaagaaacttaaat

SEQ ID NO: 214217 - DNA, 15 bp, Homo sapiens
tgaaagaaacttaaa

SEQ ID NO: 214218 - DNA, 15 bp, Homo sapiens
ttgaaagaaacttaa

SEQ ID NO: 214219 - DNA, 15 bp, Homo sapiens
attgaaagaaactta

SEQ ID NO: 214220 - DNA, 15 bp, Homo sapiens
aattgaaagaaactt

SEQ ID NO: 214221 - DNA, 15 bp, Homo sapiens
aaattgaaagaaact

SEQ ID NO: 214222 - DNA, 15 bp, Homo sapiens
aaaattgaaagaaac

SEQ ID NO: 214223 - DNA, 15 bp, Homo sapiens
aaaaattgaaagaaa

SEQ ID NO: 214224 - DNA, 15 bp, Homo sapiens
aaaaaattgaaagaa

SEQ ID NO: 214225 - DNA, 15 bp, Homo sapiens
taaaaaattgaaaga

SEQ ID NO: 214226 - DNA, 15 bp, Homo sapiens
ttaaaaaattgaaag

SEQ ID NO: 214227 - DNA, 15 bp, Homo sapiens
tttaaaaaattgaaa

SEQ ID NO: 214228 - DNA, 15 bp, Homo sapiens
ttttaaaaaattgaa

SEQ ID NO: 214229 - DNA, 15 bp, Homo sapiens
tttttaaaaaattga

SEQ ID NO: 214230 - DNA, 15 bp, Homo sapiens
atttttaaaaaattg

SEQ ID NO: 214231 - DNA, 15 bp, Homo sapiens
gatttttaaaaaatt

SEQ ID NO: 214232 - DNA, 15 bp, Homo sapiens
tgatttttaaaaaat

SEQ ID NO: 214233 - DNA, 15 bp, Homo sapiens
atgatttttaaaaaa

SEQ ID NO: 214234 - DNA, 15 bp, Homo sapiens
tatgatttttaaaaa

SEQ ID NO: 214235 - DNA, 15 bp, Homo sapiens
ttatgatttttaaaa

SEQ ID NO: 214236 - DNA, 15 bp, Homo sapiens
tttatgatttttaaa

SEQ ID NO: 214237 - DNA, 15 bp, Homo sapiens
atttatgatttttaa

SEQ ID NO: 214238 - DNA, 15 bp, Homo sapiens
tatttatgattttta

SEQ ID NO: 214239 - DNA, 15 bp, Homo sapiens
ttatttatgattttt

SEQ ID NO: 214240 - DNA, 15 bp, Homo sapiens
attatttatgatttt

SEQ ID NO: 214241 - DNA, 15 bp, Homo sapiens
cattatttatgattt

SEQ ID NO: 214242 - DNA, 15 bp, Homo sapiens
acattatttatgatt

SEQ ID NO: 214243 - DNA, 15 bp, Homo sapiens
aacattatttatgat

SEQ ID NO: 214244 - DNA, 15 bp, Homo sapiens
taacattatttatga

SEQ ID NO: 214245 - DNA, 15 bp, Homo sapiens
ataacattatttatg

SEQ ID NO: 214246 - DNA, 15 bp, Homo sapiens
tataacattatttat

SEQ ID NO: 214247 - DNA, 15 bp, Homo sapiens
ttataacattattta

SEQ ID NO: 214248 - DNA, 15 bp, Homo sapiens
attataacattattt

SEQ ID NO: 214249 - DNA, 15 bp, Homo sapiens
cattataacattatt

SEQ ID NO: 214250 - DNA, 15 bp, Homo sapiens
tcattataacattat

SEQ ID NO: 214251 - DNA, 15 bp, Homo sapiens
ttcattataacatta

SEQ ID NO: 214252 - DNA, 15 bp, Homo sapiens
gttcattataacatt

SEQ ID NO: 214253 - DNA, 15 bp, Homo sapiens
tgttcattataacat

SEQ ID NO: 214254 - DNA, 15 bp, Homo sapiens
gtgttcattataaca

SEQ ID NO: 214255 - DNA, 15 bp, Homo sapiens
agtgttcattataac

SEQ ID NO: 214256 - DNA, 15 bp, Homo sapiens
aagtgttcattataa

SEQ ID NO: 214257 - DNA, 15 bp, Homo sapiens
aaagtgttcattata

SEQ ID NO: 214258 - DNA, 15 bp, Homo sapiens
aaaagtgttcattat

SEQ ID NO: 214259 - DNA, 15 bp, Homo sapiens
caaaagtgttcatta

SEQ ID NO: 214260 - DNA, 15 bp, Homo sapiens
acaaaagtgttcatt

SEQ ID NO: 214261 - DNA, 15 bp, Homo sapiens
cacaaaagtgttcat

SEQ ID NO: 214262 - DNA, 15 bp, Homo sapiens
acacaaaagtgttca

SEQ ID NO: 214263 - DNA, 15 bp, Homo sapiens
aacacaaaagtgttc

SEQ ID NO: 214264 - DNA, 15 bp, Homo sapiens
gaacacaaaagtgtt

SEQ ID NO: 214265 - DNA, 15 bp, Homo sapiens
cgaacacaaaagtgt

SEQ ID NO: 214266 - DNA, 15 bp, Homo sapiens
acgaacacaaaagtg

SEQ ID NO: 214267 - DNA, 15 bp, Homo sapiens
tacgaacacaaaagt

SEQ ID NO: 214268 - DNA, 15 bp, Homo sapiens
ctacgaacacaaaag

SEQ ID NO: 214269 - DNA, 15 bp, Homo sapiens
gctacgaacacaaaa

SEQ ID NO: 214270 - DNA, 15 bp, Homo sapiens
agctacgaacacaaa

SEQ ID NO: 214271 - DNA, 15 bp, Homo sapiens
aagctacgaacacaa

SEQ ID NO: 214272 - DNA, 15 bp, Homo sapiens
aaagctacgaacaca

SEQ ID NO: 214273 - DNA, 15 bp, Homo sapiens
aaaagctacgaacac

SEQ ID NO: 214274 - DNA, 15 bp, Homo sapiens
gaaaagctacgaaca

SEQ ID NO: 214275 - DNA, 15 bp, Homo sapiens
agaaaagctacgaac

SEQ ID NO: 214276 - DNA, 15 bp, Homo sapiens
cagaaaagctacgaa

SEQ ID NO: 214277 - DNA, 15 bp, Homo sapiens
ccagaaaagctacga

SEQ ID NO: 214278 - DNA, 15 bp, Homo sapiens
tccagaaaagctacg

SEQ ID NO: 214279 - DNA, 15 bp, Homo sapiens
atccagaaaagctac

SEQ ID NO: 214280 - DNA, 15 bp, Homo sapiens
gatccagaaaagcta

SEQ ID NO: 214281 - DNA, 15 bp, Homo sapiens
tgatccagaaaagct

SEQ ID NO: 214282 - DNA, 15 bp, Homo sapiens
atgatccagaaaagc

SEQ ID NO: 214283 - DNA, 15 bp, Homo sapiens
aatgatccagaaaag

SEQ ID NO: 214284 - DNA, 15 bp, Homo sapiens
aaatgatccagaaaa

SEQ ID NO: 214285 - DNA, 15 bp, Homo sapiens
aaaatgatccagaaa

SEQ ID NO: 214286 - DNA, 15 bp, Homo sapiens
gaaaatgatccagaa

SEQ ID NO: 214287 - DNA, 15 bp, Homo sapiens
agaaaatgatccaga

SEQ ID NO: 214288 - DNA, 15 bp, Homo sapiens
aagaaaatgatccag

SEQ ID NO: 214289 - DNA, 15 bp, Homo sapiens
taagaaaatgatcca

SEQ ID NO: 214290 - DNA, 15 bp, Homo sapiens
ctaagaaaatgatcc

SEQ ID NO: 214291 - DNA, 15 bp, Homo sapiens
cctaagaaaatgatc

SEQ ID NO: 214292 - DNA, 15 bp, Homo sapiens
tcctaagaaaatgat

SEQ ID NO: 214293 - DNA, 15 bp, Homo sapiens
atcctaagaaaatga

SEQ ID NO: 214294 - DNA, 15 bp, Homo sapiens
tatcctaagaaaatg

SEQ ID NO: 214295 - DNA, 15 bp, Homo sapiens
atatcctaagaaaat

SEQ ID NO: 214296 - DNA, 15 bp, Homo sapiens
tatatcctaagaaaa

SEQ ID NO: 214297 - DNA, 15 bp, Homo sapiens
atatatcctaagaaa

SEQ ID NO: 214298 - DNA, 15 bp, Homo sapiens
aatatatcctaagaa

SEQ ID NO: 214299 - DNA, 15 bp, Homo sapiens
ggaatatatcctaag

SEQ ID NO: 214300 - DNA, 15 bp, Homo sapiens
gggaatatatcctaa

SEQ ID NO: 214301 - DNA, 15 bp, Homo sapiens
tgggaatatatccta

SEQ ID NO: 214302 - DNA, 15 bp, Homo sapiens
ttgggaatatatcct

SEQ ID NO: 214303 - DNA, 15 bp, Homo sapiens
tttgggaatatatcc

SEQ ID NO: 214304 - DNA, 15 bp, Homo sapiens
ttttgggaatatatc

SEQ ID NO: 214305 - DNA, 15 bp, Homo sapiens
cttttgggaatatat

SEQ ID NO: 214306 - DNA, 15 bp, Homo sapiens
acttttgggaatata

SEQ ID NO: 214307 - DNA, 15 bp, Homo sapiens
cacttttgggaatat

SEQ ID NO: 214308 - DNA, 15 bp, Homo sapiens
tcacttttgggaata

SEQ ID NO: 214309 - DNA, 15 bp, Homo sapiens
ttcacttttgggaat

SEQ ID NO: 214310 - DNA, 15 bp, Homo sapiens
tttcacttttgggaa

SEQ ID NO: 214311 - DNA, 15 bp, Homo sapiens
atttcacttttggga

SEQ ID NO: 214312 - DNA, 15 bp, Homo sapiens
aatttcacttttggg

SEQ ID NO: 214313 - DNA, 15 bp, Homo sapiens
gaatttcacttttgg

SEQ ID NO: 214314 - DNA, 15 bp, Homo sapiens
ggaatttcacttttg

SEQ ID NO: 214315 - DNA, 15 bp, Homo sapiens
aggaatttcactttt

SEQ ID NO: 214316 - DNA, 15 bp, Homo sapiens
caggaatttcacttt

SEQ ID NO: 214317 - DNA, 15 bp, Homo sapiens
acaggaatttcactt

SEQ ID NO: 214318 - DNA, 15 bp, Homo sapiens
aacaggaatttcact

SEQ ID NO: 214319 - DNA, 15 bp, Homo sapiens
aaacaggaatttcac

SEQ ID NO: 214320 - DNA, 15 bp, Homo sapiens
gaaacaggaatttca

SEQ ID NO: 214321 - DNA, 15 bp, Homo sapiens
tgaaacaggaatttc

SEQ ID NO: 214322 - DNA, 15 bp, Homo sapiens
gtgaaacaggaattt

SEQ ID NO: 214323 - DNA, 15 bp, Homo sapiens
tgtgaaacaggaatt

SEQ ID NO: 214324 - DNA, 15 bp, Homo sapiens
gtgtgaaacaggaat

SEQ ID NO: 214325 - DNA, 15 bp, Homo sapiens
tgtgtgaaacaggaa

SEQ ID NO: 214326 - DNA, 15 bp, Homo sapiens
ttgtgtgaaacagga

SEQ ID NO: 214327 - DNA, 15 bp, Homo sapiens
attgtgtgaaacagg

SEQ ID NO: 214328 - DNA, 15 bp, Homo sapiens
tattgtgtgaaacag

SEQ ID NO: 214329 - DNA, 15 bp, Homo sapiens
atattgtgtgaaaca

SEQ ID NO: 214330 - DNA, 15 bp, Homo sapiens
catattgtgtgaaac

SEQ ID NO: 214331 - DNA, 15 bp, Homo sapiens
tcatattgtgtgaaa

SEQ ID NO: 214332 - DNA, 15 bp, Homo sapiens
gtcatattgtgtgaa

SEQ ID NO: 214333 - DNA, 15 bp, Homo sapiens
ggtcatattgtgtga

SEQ ID NO: 214334 - DNA, 15 bp, Homo sapiens
tggtcatattgtgtg

SEQ ID NO: 214335 - DNA, 15 bp, Homo sapiens
atggtcatattgtgt

SEQ ID NO: 214336 - DNA, 15 bp, Homo sapiens
tatggtcatattgtg

SEQ ID NO: 214337 - DNA, 15 bp, Homo sapiens
ctatggtcatattgt

SEQ ID NO: 214338 - DNA, 15 bp, Homo sapiens
actatggtcatattg

SEQ ID NO: 214339 - DNA, 15 bp, Homo sapiens
tactatggtcatatt

SEQ ID NO: 214340 - DNA, 15 bp, Homo sapiens
ttactatggtcatat

SEQ ID NO: 214341 - DNA, 15 bp, Homo sapiens
attactatggtcata

SEQ ID NO: 214342 - DNA, 15 bp, Homo sapiens
cattactatggtcat

SEQ ID NO: 214343 - DNA, 15 bp, Homo sapiens
tcattactatggtca

SEQ ID NO: 214344 - DNA, 15 bp, Homo sapiens
gtcattactatggtc

SEQ ID NO: 214345 - DNA, 15 bp, Homo sapiens
agtcattactatggt

SEQ ID NO: 214346 - DNA, 15 bp, Homo sapiens
aagtcattactatgg

SEQ ID NO: 214347 - DNA, 15 bp, Homo sapiens
aaagtcattactatg

SEQ ID NO: 214348 - DNA, 15 bp, Homo sapiens
aaaagtcattactat

SEQ ID NO: 214349 - DNA, 15 bp, Homo sapiens
caaaagtcattacta

SEQ ID NO: 214350 - DNA, 15 bp, Homo sapiens
tcaaaagtcattact

SEQ ID NO: 214351 - DNA, 15 bp, Homo sapiens
atcaaaagtcattac

SEQ ID NO: 214352 - DNA, 15 bp, Homo sapiens
tatcaaaagtcatta

SEQ ID NO: 214353 - DNA, 15 bp, Homo sapiens
atatcaaaagtcatt

SEQ ID NO: 214354 - DNA, 15 bp, Homo sapiens
tatatcaaaagtcat

SEQ ID NO: 214355 - DNA, 15 bp, Homo sapiens
atatatcaaaagtca

SEQ ID NO: 214356 - DNA, 15 bp, Homo sapiens
aatatatcaaaagtc

SEQ ID NO: 214357 - DNA, 15 bp, Homo sapiens
caatatatcaaaagt

SEQ ID NO: 214358 - DNA, 15 bp, Homo sapiens
gcaatatatcaaaag

SEQ ID NO: 214359 - DNA, 15 bp, Homo sapiens
ggcaatatatcaaaa

SEQ ID NO: 214360 - DNA, 15 bp, Homo sapiens
tggcaatatatcaaa

SEQ ID NO: 214361 - DNA, 15 bp, Homo sapiens
ctggcaatatatcaa

SEQ ID NO: 214362 - DNA, 15 bp, Homo sapiens
gctggcaatatatca

SEQ ID NO: 214363 - DNA, 15 bp, Homo sapiens
ggctggcaatatatc

SEQ ID NO: 214364 - DNA, 15 bp, Homo sapiens
aggctggcaatatat

SEQ ID NO: 214365 - DNA, 15 bp, Homo sapiens
taggctggcaatata

SEQ ID NO: 214366 - DNA, 15 bp, Homo sapiens
gtaggctggcaatat

SEQ ID NO: 214367 - DNA, 15 bp, Homo sapiens
agtaggctggcaata

SEQ ID NO: 214368 - DNA, 15 bp, Homo sapiens
aagtaggctggcaat

SEQ ID NO: 214369 - DNA, 15 bp, Homo sapiens
aaagtaggctggcaa

SEQ ID NO: 214370 - DNA, 15 bp, Homo sapiens
gaaagtaggctggca

SEQ ID NO: 214371 - DNA, 15 bp, Homo sapiens
ggaaagtaggctggc

SEQ ID NO: 214372 - DNA, 15 bp, Homo sapiens
gggaaagtaggctgg

SEQ ID NO: 214373 - DNA, 15 bp, Homo sapiens
tgggaaagtaggctg

SEQ ID NO: 214374 - DNA, 15 bp, Homo sapiens
ttgggaaagtaggct

SEQ ID NO: 214375 - DNA, 15 bp, Homo sapiens
tttgggaaagtaggc

SEQ ID NO: 214376 - DNA, 15 bp, Homo sapiens
atttgggaaagtagg

SEQ ID NO: 214377 - DNA, 15 bp, Homo sapiens
catttgggaaagtag

SEQ ID NO: 214378 - DNA, 15 bp, Homo sapiens
tcatttgggaaagta

SEQ ID NO: 214379 - DNA, 15 bp, Homo sapiens
atcatttgggaaagt

SEQ ID NO: 214380 - DNA, 15 bp, Homo sapiens
gatcatttgggaaag

SEQ ID NO: 214381 - DNA, 15 bp, Homo sapiens
tgatcatttgggaaa

SEQ ID NO: 214382 - DNA, 15 bp, Homo sapiens
ttgatcatttgggaa

SEQ ID NO: 214383 - DNA, 15 bp, Homo sapiens
tttgatcatttggga

SEQ ID NO: 214384 - DNA, 15 bp, Homo sapiens
gtttgatcatttggg

SEQ ID NO: 214385 - DNA, 15 bp, Homo sapiens
ggtttgatcatttgg

SEQ ID NO: 214386 - DNA, 15 bp, Homo sapiens
tggtttgatcatttg

SEQ ID NO: 214387 - DNA, 15 bp, Homo sapiens
ttggtttgatcattt

SEQ ID NO: 214388 - DNA, 15 bp, Homo sapiens
attggtttgatcatt

SEQ ID NO: 214389 - DNA, 15 bp, Homo sapiens
aattggtttgatcat

SEQ ID NO: 214390 - DNA, 15 bp, Homo sapiens
aaattggtttgatca

SEQ ID NO: 214391 - DNA, 15 bp, Homo sapiens
aaaattggtttgatc

SEQ ID NO: 214392 - DNA, 15 bp, Homo sapiens
aaaaattggtttgat

SEQ ID NO: 214393 - DNA, 15 bp, Homo sapiens
aaaaaattggtttga

SEQ ID NO: 214394 - DNA, 15 bp, Homo sapiens
caaaaaattggtttg

SEQ ID NO: 214395 - DNA, 15 bp, Homo sapiens
gcaaaaaattggttt

SEQ ID NO: 214396 - DNA, 15 bp, Homo sapiens
ggcaaaaaattggtt

SEQ ID NO: 214397 - DNA, 15 bp, Homo sapiens
aggcaaaaaattggt

SEQ ID NO: 214398 - DNA, 15 bp, Homo sapiens
gaggcaaaaaattgg

SEQ ID NO: 214399 - DNA, 15 bp, Homo sapiens
ggaggcaaaaaattg

SEQ ID NO: 214400 - DNA, 15 bp, Homo sapiens
tggaggcaaaaaatt

SEQ ID NO: 214401 - DNA, 15 bp, Homo sapiens
ctggaggcaaaaaat

SEQ ID NO: 214402 - DNA, 15 bp, Homo sapiens
gctggaggcaaaaaa

SEQ ID NO: 214403 - DNA, 15 bp, Homo sapiens
tgctggaggcaaaaa

SEQ ID NO: 214404 - DNA, 15 bp, Homo sapiens
ttgctggaggcaaaa

SEQ ID NO: 214405 - DNA, 15 bp, Homo sapiens
attgctggaggcaaa

SEQ ID NO: 214406 - DNA, 15 bp, Homo sapiens
cattgctggaggcaa

SEQ ID NO: 214407 - DNA, 15 bp, Homo sapiens
acattgctggaggca

SEQ ID NO: 214408 - DNA, 15 bp, Homo sapiens
cacattgctggaggc

SEQ ID NO: 214409 - DNA, 15 bp, Homo sapiens
acacattgctggagg

SEQ ID NO: 214410 - DNA, 15 bp, Homo sapiens
cacacattgctggag

SEQ ID NO: 214411 - DNA, 15 bp, Homo sapiens
tcacacattgctgga

SEQ ID NO: 214412 - DNA, 15 bp, Homo sapiens
ttcacacattgctgg

SEQ ID NO: 214413 - DNA, 15 bp, Homo sapiens
tttcacacattgctg

SEQ ID NO: 214414 - DNA, 15 bp, Homo sapiens
ctttcacacattgct

SEQ ID NO: 214415 - DNA, 15 bp, Homo sapiens
actttcacacattgc

SEQ ID NO: 214416 - DNA, 15 bp, Homo sapiens
cactttcacacattg

SEQ ID NO: 214417 - DNA, 15 bp, Homo sapiens
tcactttcacacatt

SEQ ID NO: 214418 - DNA, 15 bp, Homo sapiens
ttcactttcacacat

SEQ ID NO: 214419 - DNA, 15 bp, Homo sapiens
cttcactttcacaca

SEQ ID NO: 214420 - DNA, 15 bp, Homo sapiens
gcttcactttcacac

SEQ ID NO: 214421 - DNA, 15 bp, Homo sapiens
agcttcactttcaca

SEQ ID NO: 214422 - DNA, 15 bp, Homo sapiens
aagcttcactttcac

SEQ ID NO: 214423 - DNA, 15 bp, Homo sapiens
aaagcttcactttca

SEQ ID NO: 214424 - DNA, 15 bp, Homo sapiens
taaagcttcactttc

SEQ ID NO: 214425 - DNA, 15 bp, Homo sapiens
gtaaagcttcacttt

SEQ ID NO: 214426 - DNA, 15 bp, Homo sapiens
ggtaaagcttcactt

SEQ ID NO: 214427 - DNA, 15 bp, Homo sapiens
tggtaaagcttcact

SEQ ID NO: 214428 - DNA, 15 bp, Homo sapiens
atggtaaagcttcac

SEQ ID NO: 214429 - DNA, 15 bp, Homo sapiens
tatggtaaagcttca

SEQ ID NO: 214430 - DNA, 15 bp, Homo sapiens
gtatggtaaagcttc

SEQ ID NO: 214431 - DNA, 15 bp, Homo sapiens
ggtatggtaaagctt

SEQ ID NO: 214432 - DNA, 15 bp, Homo sapiens
gggtatggtaaagct

SEQ ID NO: 214433 - DNA, 15 bp, Homo sapiens
agggtatggtaaagc

SEQ ID NO: 214434 - DNA, 15 bp, Homo sapiens
cagggtatggtaaag

SEQ ID NO: 214435 - DNA, 15 bp, Homo sapiens
ccagggtatggtaaa

SEQ ID NO: 214436 - DNA, 15 bp, Homo sapiens
gccagggtatggtaa

SEQ ID NO: 214437 - DNA, 15 bp, Homo sapiens
ggccagggtatggta

SEQ ID NO: 214438 - DNA, 15 bp, Homo sapiens
aggccagggtatggt

SEQ ID NO: 214439 - DNA, 15 bp, Homo sapiens
caggccagggtatgg

SEQ ID NO: 214440 - DNA, 15 bp, Homo sapiens
acaggccagggtatg

SEQ ID NO: 214441 - DNA, 15 bp, Homo sapiens
cacaggccagggtat

SEQ ID NO: 214442 - DNA, 15 bp, Homo sapiens
tcacaggccagggta

SEQ ID NO: 214443 - DNA, 15 bp, Homo sapiens
atcacaggccagggt

SEQ ID NO: 214444 - DNA, 15 bp, Homo sapiens
aatcacaggccaggg

SEQ ID NO: 214445 - DNA, 15 bp, Homo sapiens
aaatcacaggccagg

SEQ ID NO: 214446 - DNA, 15 bp, Homo sapiens
gaaatcacaggccag

SEQ ID NO: 214447 - DNA, 15 bp, Homo sapiens
agaaatcacaggcca

SEQ ID NO: 214448 - DNA, 15 bp, Homo sapiens
gagaaatcacaggcc

SEQ ID NO: 214449 - DNA, 15 bp, Homo sapiens
tgagaaatcacaggc

SEQ ID NO: 214450 - DNA, 15 bp, Homo sapiens
atgagaaatcacagg

SEQ ID NO: 214451 - DNA, 15 bp, Homo sapiens
aatgagaaatcacag

SEQ ID NO: 214452 - DNA, 15 bp, Homo sapiens
aaatgagaaatcaca

SEQ ID NO: 214453 - DNA, 15 bp, Homo sapiens
aaaatgagaaatcac

SEQ ID NO: 214454 - DNA, 15 bp, Homo sapiens
aaaaatgagaaatca

SEQ ID NO: 214455 - DNA, 15 bp, Homo sapiens
caaaaatgagaaatc

SEQ ID NO: 214456 - DNA, 15 bp, Homo sapiens
acaaaaatgagaaat

SEQ ID NO: 214457 - DNA, 15 bp, Homo sapiens
aacaaaaatgagaaa

SEQ ID NO: 214458 - DNA, 15 bp, Homo sapiens
gaacaaaaatgagaa

SEQ ID NO: 214459 - DNA, 15 bp, Homo sapiens
agaacaaaaatgaga

SEQ ID NO: 214460 - DNA, 15 bp, Homo sapiens
tagaacaaaaatgag

SEQ ID NO: 214461 - DNA, 15 bp, Homo sapiens
atagaacaaaaatga

SEQ ID NO: 214462 - DNA, 15 bp, Homo sapiens
aatagaacaaaaatg

SEQ ID NO: 214463 - DNA, 15 bp, Homo sapiens
taatagaacaaaaat

SEQ ID NO: 214464 - DNA, 15 bp, Homo sapiens
ataatagaacaaaaa

SEQ ID NO: 214465 - DNA, 15 bp, Homo sapiens
aataatagaacaaaa

SEQ ID NO: 214466 - DNA, 15 bp, Homo sapiens
taataatagaacaaa

SEQ ID NO: 214467 - DNA, 15 bp, Homo sapiens
ctaataatagaacaa

SEQ ID NO: 214468 - DNA, 15 bp, Homo sapiens
actaataatagaaca

SEQ ID NO: 214469 - DNA, 15 bp, Homo sapiens
cactaataatagaac

SEQ ID NO: 214470 - DNA, 15 bp, Homo sapiens
tcactaataatagaa

SEQ ID NO: 214471 - DNA, 15 bp, Homo sapiens
atcactaataataga

SEQ ID NO: 214472 - DNA, 15 bp, Homo sapiens
gatcactaataatag

SEQ ID NO: 214473 - DNA, 15 bp, Homo sapiens
ggatcactaataata

SEQ ID NO: 214474 - DNA, 15 bp, Homo sapiens
aggatcactaataat

SEQ ID NO: 214475 - DNA, 15 bp, Homo sapiens
aaggatcactaataa

SEQ ID NO: 214476 - DNA, 15 bp, Homo sapiens
caaggatcactaata

SEQ ID NO: 214477 - DNA, 15 bp, Homo sapiens
acaaggatcactaat

SEQ ID NO: 214478 - DNA, 15 bp, Homo sapiens
tacaaggatcactaa

SEQ ID NO: 214479 - DNA, 15 bp, Homo sapiens
atacaaggatcacta

SEQ ID NO: 214480 - DNA, 15 bp, Homo sapiens
aatacaaggatcact

SEQ ID NO: 214481 - DNA, 15 bp, Homo sapiens
caatacaaggatcac

SEQ ID NO: 214482 - DNA, 15 bp, Homo sapiens
acaatacaaggatca

SEQ ID NO: 214483 - DNA, 15 bp, Homo sapiens
aacaatacaaggatc

SEQ ID NO: 214484 - DNA, 15 bp, Homo sapiens
taacaatacaaggat

SEQ ID NO: 214485 - DNA, 15 bp, Homo sapiens
ctaacaatacaagga

SEQ ID NO: 214486 - DNA, 15 bp, Homo sapiens
gctaacaatacaagg

SEQ ID NO: 214487 - DNA, 15 bp, Homo sapiens
tgctaacaatacaag

SEQ ID NO: 214488 - DNA, 15 bp, Homo sapiens
ctgctaacaatacaa

SEQ ID NO: 214489 - DNA, 15 bp, Homo sapiens
actgctaacaataca

SEQ ID NO: 214490 - DNA, 15 bp, Homo sapiens
tactgctaacaatac

SEQ ID NO: 214491 - DNA, 15 bp, Homo sapiens
ttactgctaacaata

SEQ ID NO: 214492 - DNA, 15 bp, Homo sapiens
tttactgctaacaat

SEQ ID NO: 214493 - DNA, 15 bp, Homo sapiens
ttttactgctaacaa

SEQ ID NO: 214494 - DNA, 15 bp, Homo sapiens
attttactgctaaca

SEQ ID NO: 214495 - DNA, 15 bp, Homo sapiens
tattttactgctaac

SEQ ID NO: 214496 - DNA, 15 bp, Homo sapiens
gtattttactgctaa

SEQ ID NO: 214497 - DNA, 15 bp, Homo sapiens
agtattttactgcta

SEQ ID NO: 214498 - DNA, 15 bp, Homo sapiens
tagtattttactgct

SEQ ID NO: 214499 - DNA, 15 bp, Homo sapiens
ctagtattttactgc

SEQ ID NO: 214500 - DNA, 15 bp, Homo sapiens
actagtattttactg

SEQ ID NO: 214501 - DNA, 15 bp, Homo sapiens
tactagtattttact

SEQ ID NO: 214502 - DNA, 15 bp, Homo sapiens
gtactagtattttac

SEQ ID NO: 214503 - DNA, 15 bp, Homo sapiens
agtactagtatttta

SEQ ID NO: 214504 - DNA, 15 bp, Homo sapiens
aagtactagtatttt

SEQ ID NO: 214505 - DNA, 15 bp, Homo sapiens
gaagtactagtattt

SEQ ID NO: 214506 - DNA, 15 bp, Homo sapiens
tgaagtactagtatt

SEQ ID NO: 214507 - DNA, 15 bp, Homo sapiens
atgaagtactagtat

SEQ ID NO: 214508 - DNA, 15 bp, Homo sapiens
tatgaagtactagta

SEQ ID NO: 214509 - DNA, 15 bp, Homo sapiens
ctatgaagtactagt

SEQ ID NO: 214510 - DNA, 15 bp, Homo sapiens
tctatgaagtactag

SEQ ID NO: 214511 - DNA, 15 bp, Homo sapiens
atctatgaagtacta

SEQ ID NO: 214512 - DNA, 15 bp, Homo sapiens
catctatgaagtact

SEQ ID NO: 214513 - DNA, 15 bp, Homo sapiens
acatctatgaagtac

SEQ ID NO: 214514 - DNA, 15 bp, Homo sapiens
tacatctatgaagta

SEQ ID NO: 214515 - DNA, 15 bp, Homo sapiens
atacatctatgaagt

SEQ ID NO: 214516 - DNA, 15 bp, Homo sapiens
tatacatctatgaag

SEQ ID NO: 214517 - DNA, 15 bp, Homo sapiens
ctatacatctatgaa

SEQ ID NO: 214518 - DNA, 15 bp, Homo sapiens
tctatacatctatga

SEQ ID NO: 214519 - DNA, 15 bp, Homo sapiens
ttctatacatctatg

SEQ ID NO: 214520 - DNA, 15 bp, Homo sapiens
tttctatacatctat

SEQ ID NO: 214521 - DNA, 15 bp, Homo sapiens
atttctatacatcta

SEQ ID NO: 214522 - DNA, 15 bp, Homo sapiens
aatttctatacatct

SEQ ID NO: 214523 - DNA, 15 bp, Homo sapiens
aaatttctatacatc

SEQ ID NO: 214524 - DNA, 15 bp, Homo sapiens
taaatttctatacat

SEQ ID NO: 214525 - DNA, 15 bp, Homo sapiens
ctaaatttctataca

SEQ ID NO: 214526 - DNA, 15 bp, Homo sapiens
tctaaatttctatac

SEQ ID NO: 214527 - DNA, 15 bp, Homo sapiens
ttctaaatttctata

SEQ ID NO: 214528 - DNA, 15 bp, Homo sapiens
tttctaaatttctat

SEQ ID NO: 214529 - DNA, 15 bp, Homo sapiens
ttttctaaatttcta

SEQ ID NO: 214530 - DNA, 15 bp, Homo sapiens
gttttctaaatttct

SEQ ID NO: 214531 - DNA, 15 bp, Homo sapiens
tgttttctaaatttc

SEQ ID NO: 214532 - DNA, 15 bp, Homo sapiens
ctgttttctaaattt

SEQ ID NO: 214533 - DNA, 15 bp, Homo sapiens
actgttttctaaatt

SEQ ID NO: 214534 - DNA, 15 bp, Homo sapiens
aactgttttctaaat

SEQ ID NO: 214535 - DNA, 15 bp, Homo sapiens
aaactgttttctaaa

SEQ ID NO: 214536 - DNA, 15 bp, Homo sapiens
aaaactgttttctaa

SEQ ID NO: 214537 - DNA, 15 bp, Homo sapiens
caaaactgttttcta

SEQ ID NO: 214538 - DNA, 15 bp, Homo sapiens
ccaaaactgttttct

SEQ ID NO: 214539 - DNA, 15 bp, Homo sapiens
tccaaaactgttttc

SEQ ID NO: 214540 - DNA, 15 bp, Homo sapiens
ttccaaaactgtttt

SEQ ID NO: 214541 - DNA, 15 bp, Homo sapiens
attccaaaactgttt

SEQ ID NO: 214542 - DNA, 15 bp, Homo sapiens
tattccaaaactgtt

SEQ ID NO: 214543 - DNA, 15 bp, Homo sapiens
atattccaaaactgt

SEQ ID NO: 214544 - DNA, 15 bp, Homo sapiens
gatattccaaaactg

SEQ ID NO: 214545 - DNA, 15 bp, Homo sapiens
tgatattccaaaact

SEQ ID NO: 214546 - DNA, 15 bp, Homo sapiens
ctgatattccaaaac

SEQ ID NO: 214547 - DNA, 15 bp, Homo sapiens
tctgatattccaaaa

SEQ ID NO: 214548 - DNA, 15 bp, Homo sapiens
gtctgatattccaaa

SEQ ID NO: 214549 - DNA, 15 bp, Homo sapiens
tgtctgatattccaa

SEQ ID NO: 214550 - DNA, 15 bp, Homo sapiens
gtgtctgatattcca

SEQ ID NO: 214551 - DNA, 15 bp, Homo sapiens
ggtgtctgatattcc

SEQ ID NO: 214552 - DNA, 15 bp, Homo sapiens
aggtgtctgatattc

SEQ ID NO: 214553 - DNA, 15 bp, Homo sapiens
caggtgtctgatatt

SEQ ID NO: 214554 - DNA, 15 bp, Homo sapiens
tcaggtgtctgatat

SEQ ID NO: 214555 - DNA, 15 bp, Homo sapiens
ctcaggtgtctgata

SEQ ID NO: 214556 - DNA, 15 bp, Homo sapiens
actcaggtgtctgat

SEQ ID NO: 214557 - DNA, 15 bp, Homo sapiens
gactcaggtgtctga

SEQ ID NO: 214558 - DNA, 15 bp, Homo sapiens
tgactcaggtgtctg

SEQ ID NO: 214559 - DNA, 15 bp, Homo sapiens
ttgactcaggtgtct

SEQ ID NO: 214560 - DNA, 15 bp, Homo sapiens
cttgactcaggtgtc

SEQ ID NO: 214561 - DNA, 15 bp, Homo sapiens
ccttgactcaggtgt

SEQ ID NO: 214562 - DNA, 15 bp, Homo sapiens
accttgactcaggtg

SEQ ID NO: 214563 - DNA, 15 bp, Homo sapiens
aaccttgactcaggt

SEQ ID NO: 214564 - DNA, 15 bp, Homo sapiens
gaaccttgactcagg

SEQ ID NO: 214565 - DNA, 15 bp, Homo sapiens
agaaccttgactcag

SEQ ID NO: 214566 - DNA, 15 bp, Homo sapiens
gagaaccttgactca

SEQ ID NO: 214567 - DNA, 15 bp, Homo sapiens
agagaaccttgactc

SEQ ID NO: 214568 - DNA, 15 bp, Homo sapiens
gagagaaccttgact

SEQ ID NO: 214569 - DNA, 15 bp, Homo sapiens
ggagagaaccttgac

SEQ ID NO: 214570 - DNA, 15 bp, Homo sapiens
tggagagaaccttga

SEQ ID NO: 214571 - DNA, 15 bp, Homo sapiens
gtggagagaaccttg

SEQ ID NO: 214572 - DNA, 15 bp, Homo sapiens
tgtggagagaacctt

SEQ ID NO: 214573 - DNA, 15 bp, Homo sapiens
ttgtggagagaacct

SEQ ID NO: 214574 - DNA, 15 bp, Homo sapiens
tttgtggagagaacc

SEQ ID NO: 214575 - DNA, 15 bp, Homo sapiens
ctttgtggagagaac

SEQ ID NO: 214576 - DNA, 15 bp, Homo sapiens
tctttgtggagagaa

SEQ ID NO: 214577 - DNA, 15 bp, Homo sapiens
ctctttgtggagaga

SEQ ID NO: 214578 - DNA, 15 bp, Homo sapiens
cctctttgtggagag

SEQ ID NO: 214579 - DNA, 15 bp, Homo sapiens
tcctctttgtggaga

SEQ ID NO: 214580 - DNA, 15 bp, Homo sapiens
ttcctctttgtggag

SEQ ID NO: 214581 - DNA, 15 bp, Homo sapiens
cttcctctttgtgga

SEQ ID NO: 214582 - DNA, 15 bp, Homo sapiens
tcttcctctttgtgg

SEQ ID NO: 214583 - DNA, 15 bp, Homo sapiens
ctcttcctctttgtg

SEQ ID NO: 214584 - DNA, 15 bp, Homo sapiens
cctcttcctctttgt

SEQ ID NO: 214585 - DNA, 15 bp, Homo sapiens
tcctcttcctctttg

SEQ ID NO: 214586 - DNA, 15 bp, Homo sapiens
ctcctcttcctcttt

SEQ ID NO: 214587 - DNA, 15 bp, Homo sapiens
tctcctcttcctctt

SEQ ID NO: 214588 - DNA, 15 bp, Homo sapiens
ttctcctcttcctct

SEQ ID NO: 214589 - DNA, 15 bp, Homo sapiens
gttctcctcttcctc

SEQ ID NO: 214590 - DNA, 15 bp, Homo sapiens
agttctcctcttcct

SEQ ID NO: 214591 - DNA, 15 bp, Homo sapiens
cagttctcctcttcc

SEQ ID NO: 214592 - DNA, 15 bp, Homo sapiens
ccagttctcctcttc

SEQ ID NO: 214593 - DNA, 15 bp, Homo sapiens
accagttctcctctt

SEQ ID NO: 214594 - DNA, 15 bp, Homo sapiens
aaccagttctcctct

SEQ ID NO: 214595 - DNA, 15 bp, Homo sapiens
aaaccagttctcctc

SEQ ID NO: 214596 - DNA, 15 bp, Homo sapiens
caaaccagttctcct

SEQ ID NO: 214597 - DNA, 15 bp, Homo sapiens
tcaaaccagttctcc

SEQ ID NO: 214598 - DNA, 15 bp, Homo sapiens
atcaaaccagttctc

SEQ ID NO: 214599 - DNA, 15 bp, Homo sapiens
catcaaaccagttct

SEQ ID NO: 214600 - DNA, 15 bp, Homo sapiens
acatcaaaccagttc

SEQ ID NO: 214601 - DNA, 15 bp, Homo sapiens
aacatcaaaccagtt

SEQ ID NO: 214602 - DNA, 15 bp, Homo sapiens
aaacatcaaaccagt

SEQ ID NO: 214603 - DNA, 15 bp, Homo sapiens
caaacatcaaaccag

SEQ ID NO: 214604 - DNA, 15 bp, Homo sapiens
ccaaacatcaaacca

SEQ ID NO: 214605 - DNA, 15 bp, Homo sapiens
cccaaacatcaaacc

SEQ ID NO: 214606 - DNA, 15 bp, Homo sapiens
acccaaacatcaaac

SEQ ID NO: 214607 - DNA, 15 bp, Homo sapiens
aacccaaacatcaaa

SEQ ID NO: 214608 - DNA, 15 bp, Homo sapiens
taacccaaacatcaa

SEQ ID NO: 214609 - DNA, 15 bp, Homo sapiens
ctaacccaaacatca

SEQ ID NO: 214610 - DNA, 15 bp, Homo sapiens
actaacccaaacatc

SEQ ID NO: 214611 - DNA, 15 bp, Homo sapiens
gactaacccaaacat

SEQ ID NO: 214612 - DNA, 15 bp, Homo sapiens
tgactaacccaaaca

SEQ ID NO: 214613 - DNA, 15 bp, Homo sapiens
atgactaacccaaac

SEQ ID NO: 214614 - DNA, 15 bp, Homo sapiens
catgactaacccaaa

SEQ ID NO: 214615 - DNA, 15 bp, Homo sapiens
gcatgactaacccaa

SEQ ID NO: 214616 - DNA, 15 bp, Homo sapiens
ggcatgactaaccca

SEQ ID NO: 214617 - DNA, 15 bp, Homo sapiens
aggcatgactaaccc

SEQ ID NO: 214618 - DNA, 15 bp, Homo sapiens
taggcatgactaacc

SEQ ID NO: 214619 - DNA, 15 bp, Homo sapiens
ctaggcatgactaac

SEQ ID NO: 214620 - DNA, 15 bp, Homo sapiens
tctaggcatgactaa

SEQ ID NO: 214621 - DNA, 15 bp, Homo sapiens
ttctaggcatgacta

SEQ ID NO: 214622 - DNA, 15 bp, Homo sapiens
cttctaggcatgact

SEQ ID NO: 214623 - DNA, 15 bp, Homo sapiens
ccttctaggcatgac

SEQ ID NO: 214624 - DNA, 15 bp, Homo sapiens
tccttctaggcatga

SEQ ID NO: 214625 - DNA, 15 bp, Homo sapiens
atccttctaggcatg

SEQ ID NO: 214626 - DNA, 15 bp, Homo sapiens
tatccttctaggcat

SEQ ID NO: 214627 - DNA, 15 bp, Homo sapiens
ctatccttctaggca

SEQ ID NO: 214628 - DNA, 15 bp, Homo sapiens
cctatccttctaggc

SEQ ID NO: 214629 - DNA, 15 bp, Homo sapiens
tcctatccttctagg

SEQ ID NO: 214630 - DNA, 15 bp, Homo sapiens
ctcctatccttctag

SEQ ID NO: 214631 - DNA, 15 bp, Homo sapiens
tctcctatccttcta

SEQ ID NO: 214632 - DNA, 15 bp, Homo sapiens
ttctcctatccttct

SEQ ID NO: 214633 - DNA, 15 bp, Homo sapiens
tttctcctatccttc

SEQ ID NO: 214634 - DNA, 15 bp, Homo sapiens
ttttctcctatcctt

SEQ ID NO: 214635 - DNA, 15 bp, Homo sapiens
cttttctcctatcct

SEQ ID NO: 214636 - DNA, 15 bp, Homo sapiens
gcttttctcctatcc

SEQ ID NO: 214637 - DNA, 15 bp, Homo sapiens
agcttttctcctatc

SEQ ID NO: 214638 - DNA, 15 bp, Homo sapiens
gagcttttctcctat

SEQ ID NO: 214639 - DNA, 15 bp, Homo sapiens
agagcttttctccta

SEQ ID NO: 214640 - DNA, 15 bp, Homo sapiens
gagagcttttctcct

SEQ ID NO: 214641 - DNA, 15 bp, Homo sapiens
ggagagcttttctcc

SEQ ID NO: 214642 - DNA, 15 bp, Homo sapiens
tggagagcttttctc

SEQ ID NO: 214643 - DNA, 15 bp, Homo sapiens
atggagagcttttct

SEQ ID NO: 214644 - DNA, 15 bp, Homo sapiens
catggagagcttttc

SEQ ID NO: 214645 - DNA, 15 bp, Homo sapiens
ccatggagagctttt

SEQ ID NO: 214646 - DNA, 15 bp, Homo sapiens
gccatggagagcttt

SEQ ID NO: 214647 - DNA, 15 bp, Homo sapiens
agccatggagagctt

SEQ ID NO: 214648 - DNA, 15 bp, Homo sapiens
aagccatggagagct

SEQ ID NO: 214649 - DNA, 15 bp, Homo sapiens
caagccatggagagc

SEQ ID NO: 214650 - DNA, 15 bp, Homo sapiens
acaagccatggagag

SEQ ID NO: 214651 - DNA, 15 bp, Homo sapiens
aacaagccatggaga

SEQ ID NO: 214652 - DNA, 15 bp, Homo sapiens
taacaagccatggag

SEQ ID NO: 214653 - DNA, 15 bp, Homo sapiens
ttaacaagccatgga

SEQ ID NO: 214654 - DNA, 15 bp, Homo sapiens
tttaacaagccatgg

SEQ ID NO: 214655 - DNA, 15 bp, Homo sapiens
gtttaacaagccatg

SEQ ID NO: 214656 - DNA, 15 bp, Homo sapiens
tgtttaacaagccat

SEQ ID NO: 214657 - DNA, 15 bp, Homo sapiens
gtgtttaacaagcca

SEQ ID NO: 214658 - DNA, 15 bp, Homo sapiens
tgtgtttaacaagcc

SEQ ID NO: 214659 - DNA, 15 bp, Homo sapiens
atgtgtttaacaagc

SEQ ID NO: 214660 - DNA, 15 bp, Homo sapiens
aatgtgtttaacaag

SEQ ID NO: 214661 - DNA, 15 bp, Homo sapiens
taatgtgtttaacaa

SEQ ID NO: 214662 - DNA, 15 bp, Homo sapiens
ctaatgtgtttaaca

SEQ ID NO: 214663 - DNA, 15 bp, Homo sapiens
actaatgtgtttaac

SEQ ID NO: 214664 - DNA, 15 bp, Homo sapiens
aactaatgtgtttaa

SEQ ID NO: 214665 - DNA, 15 bp, Homo sapiens
caactaatgtgttta

SEQ ID NO: 214666 - DNA, 15 bp, Homo sapiens
tcaactaatgtgttt

SEQ ID NO: 214667 - DNA, 15 bp, Homo sapiens
ttcaactaatgtgtt

SEQ ID NO: 214668 - DNA, 15 bp, Homo sapiens
cttcaactaatgtgt

SEQ ID NO: 214669 - DNA, 15 bp, Homo sapiens
tcttcaactaatgtg

SEQ ID NO: 214670 - DNA, 15 bp, Homo sapiens
ttcttcaactaatgt

SEQ ID NO: 214671 - DNA, 15 bp, Homo sapiens
tttcttcaactaatg

SEQ ID NO: 214672 - DNA, 15 bp, Homo sapiens
atttcttcaactaat

SEQ ID NO: 214673 - DNA, 15 bp, Homo sapiens
aatttcttcaactaa

SEQ ID NO: 214674 - DNA, 15 bp, Homo sapiens
aaatttcttcaacta

SEQ ID NO: 214675 - DNA, 15 bp, Homo sapiens
taaatttcttcaact

SEQ ID NO: 214676 - DNA, 15 bp, Homo sapiens
ataaatttcttcaac

SEQ ID NO: 214677 - DNA, 15 bp, Homo sapiens
tataaatttcttcaa

SEQ ID NO: 214678 - DNA, 15 bp, Homo sapiens
atataaatttcttca

SEQ ID NO: 214679 - DNA, 15 bp, Homo sapiens
aatataaatttcttc

SEQ ID NO: 214680 - DNA, 15 bp, Homo sapiens
aaatataaatttctt

SEQ ID NO: 214681 - DNA, 15 bp, Homo sapiens
caaatataaatttct

SEQ ID NO: 214682 - DNA, 15 bp, Homo sapiens
acaaatataaatttc

SEQ ID NO: 214683 - DNA, 15 bp, Homo sapiens
gacaaatataaattt

SEQ ID NO: 214684 - DNA, 15 bp, Homo sapiens
agacaaatataaatt

SEQ ID NO: 214685 - DNA, 15 bp, Homo sapiens
cagacaaatataaat

SEQ ID NO: 214686 - DNA, 15 bp, Homo sapiens
tcagacaaatataaa

SEQ ID NO: 214687 - DNA, 15 bp, Homo sapiens
ttcagacaaatataa

SEQ ID NO: 214688 - DNA, 15 bp, Homo sapiens
tttcagacaaatata

SEQ ID NO: 214689 - DNA, 15 bp, Homo sapiens
atttcagacaaatat

SEQ ID NO: 214690 - DNA, 15 bp, Homo sapiens
aatttcagacaaata

SEQ ID NO: 214691 - DNA, 15 bp, Homo sapiens
taatttcagacaaat

SEQ ID NO: 214692 - DNA, 15 bp, Homo sapiens
ctaatttcagacaaa

SEQ ID NO: 214693 - DNA, 15 bp, Homo sapiens
actaatttcagacaa

SEQ ID NO: 214694 - DNA, 15 bp, Homo sapiens
cactaatttcagaca

SEQ ID NO: 214695 - DNA, 15 bp, Homo sapiens
acactaatttcagac

SEQ ID NO: 214696 - DNA, 15 bp, Homo sapiens
cacactaatttcaga

SEQ ID NO: 214697 - DNA, 15 bp, Homo sapiens
acacactaatttcag

SEQ ID NO: 214698 - DNA, 15 bp, Homo sapiens
cacacactaatttca

SEQ ID NO: 214699 - DNA, 15 bp, Homo sapiens
acacacactaatttc

SEQ ID NO: 214700 - DNA, 15 bp, Homo sapiens
cacacacactaattt

SEQ ID NO: 214701 - DNA, 15 bp, Homo sapiens
tcacacacactaatt

SEQ ID NO: 214702 - DNA, 15 bp, Homo sapiens
atcacacacactaat

SEQ ID NO: 214703 - DNA, 15 bp, Homo sapiens
catcacacacactaa

SEQ ID NO: 214704 - DNA, 15 bp, Homo sapiens
acatcacacacacta

SEQ ID NO: 214705 - DNA, 15 bp, Homo sapiens
gacatcacacacact

SEQ ID NO: 214706 - DNA, 15 bp, Homo sapiens
tgacatcacacacac

SEQ ID NO: 214707 - DNA, 15 bp, Homo sapiens
atgacatcacacaca

SEQ ID NO: 214708 - DNA, 15 bp, Homo sapiens
gatgacatcacacac

SEQ ID NO: 214709 - DNA, 15 bp, Homo sapiens
agatgacatcacaca

SEQ ID NO: 214710 - DNA, 15 bp, Homo sapiens
tagatgacatcacac

SEQ ID NO: 214711 - DNA, 15 bp, Homo sapiens
ctagatgacatcaca

SEQ ID NO: 214712 - DNA, 15 bp, Homo sapiens
gctagatgacatcac

SEQ ID NO: 214713 - DNA, 15 bp, Homo sapiens
agctagatgacatca

SEQ ID NO: 214714 - DNA, 15 bp, Homo sapiens
cagctagatgacatc

SEQ ID NO: 214715 - DNA, 15 bp, Homo sapiens
tcagctagatgacat

SEQ ID NO: 214716 - DNA, 15 bp, Homo sapiens
gtcagctagatgaca

SEQ ID NO: 214717 - DNA, 15 bp, Homo sapiens
ggtcagctagatgac

SEQ ID NO: 214718 - DNA, 15 bp, Homo sapiens
tggtcagctagatga

SEQ ID NO: 214719 - DNA, 15 bp, Homo sapiens
atggtcagctagatg

SEQ ID NO: 214720 - DNA, 15 bp, Homo sapiens
aatggtcagctagat

SEQ ID NO: 214721 - DNA, 15 bp, Homo sapiens
aaatggtcagctaga

SEQ ID NO: 214722 - DNA, 15 bp, Homo sapiens
taaatggtcagctag

SEQ ID NO: 214723 - DNA, 15 bp, Homo sapiens
ataaatggtcagcta

SEQ ID NO: 214724 - DNA, 15 bp, Homo sapiens
tataaatggtcagct

SEQ ID NO: 214725 - DNA, 15 bp, Homo sapiens
gtataaatggtcagc

SEQ ID NO: 214726 - DNA, 15 bp, Homo sapiens
ggtataaatggtcag

SEQ ID NO: 214727 - DNA, 15 bp, Homo sapiens
aggtataaatggtca

SEQ ID NO: 214728 - DNA, 15 bp, Homo sapiens
gaggtataaatggtc

SEQ ID NO: 214729 - DNA, 15 bp, Homo sapiens
ggaggtataaatggt

SEQ ID NO: 214730 - DNA, 15 bp, Homo sapiens
aggaggtataaatgg

SEQ ID NO: 214731 - DNA, 15 bp, Homo sapiens
aaggaggtataaatg

SEQ ID NO: 214732 - DNA, 15 bp, Homo sapiens
taaggaggtataaat

SEQ ID NO: 214733 - DNA, 15 bp, Homo sapiens
ctaaggaggtataaa

SEQ ID NO: 214734 - DNA, 15 bp, Homo sapiens
tctaaggaggtataa

SEQ ID NO: 214735 - DNA, 15 bp, Homo sapiens
ctctaaggaggtata

SEQ ID NO: 214736 - DNA, 15 bp, Homo sapiens
tctctaaggaggtat

SEQ ID NO: 214737 - DNA, 15 bp, Homo sapiens
ttctctaaggaggta

SEQ ID NO: 214738 - DNA, 15 bp, Homo sapiens
attctctaaggaggt

SEQ ID NO: 214739 - DNA, 15 bp, Homo sapiens
aattctctaaggagg

SEQ ID NO: 214740 - DNA, 15 bp, Homo sapiens
caattctctaaggag

SEQ ID NO: 214741 - DNA, 15 bp, Homo sapiens
acaattctctaagga

SEQ ID NO: 214742 - DNA, 15 bp, Homo sapiens
aacaattctctaagg

SEQ ID NO: 214743 - DNA, 15 bp, Homo sapiens
aaacaattctctaag

SEQ ID NO: 214744 - DNA, 15 bp, Homo sapiens
aaaacaattctctaa

SEQ ID NO: 214745 - DNA, 15 bp, Homo sapiens
caaaacaattctcta

SEQ ID NO: 214746 - DNA, 15 bp, Homo sapiens
gcaaaacaattctct

SEQ ID NO: 214747 - DNA, 15 bp, Homo sapiens
ggcaaaacaattctc

SEQ ID NO: 214748 - DNA, 15 bp, Homo sapiens
gggcaaaacaattct

SEQ ID NO: 214749 - DNA, 15 bp, Homo sapiens
agggcaaaacaattc

SEQ ID NO: 214750 - DNA, 15 bp, Homo sapiens
aagggcaaaacaatt

SEQ ID NO: 214751 - DNA, 15 bp, Homo sapiens
aaagggcaaaacaat

SEQ ID NO: 214752 - DNA, 15 bp, Homo sapiens
aaaagggcaaaacaa

SEQ ID NO: 214753 - DNA, 15 bp, Homo sapiens
taaaagggcaaaaca

SEQ ID NO: 214754 - DNA, 15 bp, Homo sapiens
ataaaagggcaaaac

SEQ ID NO: 214755 - DNA, 15 bp, Homo sapiens
aataaaagggcaaaa

SEQ ID NO: 214756 - DNA, 15 bp, Homo sapiens
gaataaaagggcaaa

SEQ ID NO: 214757 - DNA, 15 bp, Homo sapiens
agaataaaagggcaa

SEQ ID NO: 214758 - DNA, 15 bp, Homo sapiens
cagaataaaagggca

SEQ ID NO: 214759 - DNA, 15 bp, Homo sapiens
ccagaataaaagggc

SEQ ID NO: 214760 - DNA, 15 bp, Homo sapiens
tccagaataaaaggg

SEQ ID NO: 214761 - DNA, 15 bp, Homo sapiens
ttccagaataaaagg

SEQ ID NO: 214762 - DNA, 15 bp, Homo sapiens
cttccagaataaaag

SEQ ID NO: 214763 - DNA, 15 bp, Homo sapiens
tcttccagaataaaa

SEQ ID NO: 214764 - DNA, 15 bp, Homo sapiens
ttcttccagaataaa

SEQ ID NO: 214765 - DNA, 15 bp, Homo sapiens
tttcttccagaataa

SEQ ID NO: 214766 - DNA, 15 bp, Homo sapiens
gtttcttccagaata

SEQ ID NO: 214767 - DNA, 15 bp, Homo sapiens
ggtttcttccagaat

SEQ ID NO: 214768 - DNA, 15 bp, Homo sapiens
cggtttcttccagaa

SEQ ID NO: 214769 - DNA, 15 bp, Homo sapiens
ccggtttcttccaga

SEQ ID NO: 214770 - DNA, 15 bp, Homo sapiens
accggtttcttccag

SEQ ID NO: 214771 - DNA, 15 bp, Homo sapiens
aaccggtttcttcca

SEQ ID NO: 214772 - DNA, 15 bp, Homo sapiens
gaaccggtttcttcc

SEQ ID NO: 214773 - DNA, 15 bp, Homo sapiens
tgaaccggtttcttc

SEQ ID NO: 214774 - DNA, 15 bp, Homo sapiens
gtgaaccggtttctt

SEQ ID NO: 214775 - DNA, 15 bp, Homo sapiens
tgtgaaccggtttct

SEQ ID NO: 214776 - DNA, 15 bp, Homo sapiens
ttgtgaaccggtttc

SEQ ID NO: 214777 - DNA, 15 bp, Homo sapiens
tttgtgaaccggttt

SEQ ID NO: 214778 - DNA, 15 bp, Homo sapiens
ttttgtgaaccggtt

SEQ ID NO: 214779 - DNA, 15 bp, Homo sapiens
tttttgtgaaccggt

SEQ ID NO: 214780 - DNA, 15 bp, Homo sapiens
ttttttgtgaaccgg

SEQ ID NO: 214781 - DNA, 15 bp, Homo sapiens
tttttttgtgaaccg

SEQ ID NO: 214782 - DNA, 15 bp, Homo sapiens
gtttttttgtgaacc

SEQ ID NO: 214783 - DNA, 15 bp, Homo sapiens
ggtttttttgtgaac

SEQ ID NO: 214784 - DNA, 15 bp, Homo sapiens
cggtttttttgtgaa

SEQ ID NO: 214785 - DNA, 15 bp, Homo sapiens
gcggtttttttgtga

SEQ ID NO: 214786 - DNA, 15 bp, Homo sapiens
agcggtttttttgtg

SEQ ID NO: 214787 - DNA, 15 bp, Homo sapiens
cagcggtttttttgt

SEQ ID NO: 214788 - DNA, 15 bp, Homo sapiens
gcagcggtttttttg

SEQ ID NO: 214789 - DNA, 15 bp, Homo sapiens
tgcagcggttttttt

SEQ ID NO: 214790 - DNA, 15 bp, Homo sapiens
atgcagcggtttttt

SEQ ID NO: 214791 - DNA, 15 bp, Homo sapiens
aatgcagcggttttt

SEQ ID NO: 214792 - DNA, 15 bp, Homo sapiens
aaatgcagcggtttt

SEQ ID NO: 214793 - DNA, 15 bp, Homo sapiens
taaatgcagcggttt

SEQ ID NO: 214794 - DNA, 15 bp, Homo sapiens
ataaatgcagcggtt

SEQ ID NO: 214795 - DNA, 15 bp, Homo sapiens
aataaatgcagcggt

SEQ ID NO: 214796 - DNA, 15 bp, Homo sapiens
aaataaatgcagcgg

SEQ ID NO: 214797 - DNA, 15 bp, Homo sapiens
gaaataaatgcagcg

SEQ ID NO: 214798 - DNA, 15 bp, Homo sapiens
agaaataaatgcagc

SEQ ID NO: 214799 - DNA, 15 bp, Homo sapiens
aagaaataaatgcag

SEQ ID NO: 214800 - DNA, 15 bp, Homo sapiens
aaagaaataaatgca

SEQ ID NO: 214801 - DNA, 15 bp, Homo sapiens
caaagaaataaatgc

SEQ ID NO: 214802 - DNA, 15 bp, Homo sapiens
gcaaagaaataaatg

SEQ ID NO: 214803 - DNA, 15 bp, Homo sapiens
agcaaagaaataaat

SEQ ID NO: 214804 - DNA, 15 bp, Homo sapiens
aagcaaagaaataaa

SEQ ID NO: 214805 - DNA, 15 bp, Homo sapiens
aaagcaaagaaataa

SEQ ID NO: 214806 - DNA, 15 bp, Homo sapiens
gaaagcaaagaaata

SEQ ID NO: 214807 - DNA, 15 bp, Homo sapiens
agaaagcaaagaaat

SEQ ID NO: 214808 - DNA, 15 bp, Homo sapiens
tagaaagcaaagaaa

SEQ ID NO: 214809 - DNA, 15 bp, Homo sapiens
ttagaaagcaaagaa

SEQ ID NO: 214810 - DNA, 15 bp, Homo sapiens
cttagaaagcaaaga

SEQ ID NO: 214811 - DNA, 15 bp, Homo sapiens
tcttagaaagcaaag

SEQ ID NO: 214812 - DNA, 15 bp, Homo sapiens
ttcttagaaagcaaa

SEQ ID NO: 214813 - DNA, 15 bp, Homo sapiens
attcttagaaagcaa

SEQ ID NO: 214814 - DNA, 15 bp, Homo sapiens
gattcttagaaagca

SEQ ID NO: 214815 - DNA, 15 bp, Homo sapiens
agattcttagaaagc

SEQ ID NO: 214816 - DNA, 15 bp, Homo sapiens
tagattcttagaaag

SEQ ID NO: 214817 - DNA, 15 bp, Homo sapiens
ttagattcttagaaa

SEQ ID NO: 214818 - DNA, 15 bp, Homo sapiens
tttagattcttagaa

SEQ ID NO: 214819 - DNA, 15 bp, Homo sapiens
gtttagattcttaga

SEQ ID NO: 214820 - DNA, 15 bp, Homo sapiens
agtttagattcttag

SEQ ID NO: 214821 - DNA, 15 bp, Homo sapiens
cagtttagattctta

SEQ ID NO: 214822 - DNA, 15 bp, Homo sapiens
tcagtttagattctt

SEQ ID NO: 214823 - DNA, 15 bp, Homo sapiens
atcagtttagattct

SEQ ID NO: 214824 - DNA, 15 bp, Homo sapiens
tatcagtttagattc

SEQ ID NO: 214825 - DNA, 15 bp, Homo sapiens
atatcagtttagatt

SEQ ID NO: 214826 - DNA, 15 bp, Homo sapiens
catatcagtttagat

SEQ ID NO: 214827 - DNA, 15 bp, Homo sapiens
tcatatcagtttaga

SEQ ID NO: 214828 - DNA, 15 bp, Homo sapiens
ctcatatcagtttag

SEQ ID NO: 214829 - DNA, 15 bp, Homo sapiens
actcatatcagttta

SEQ ID NO: 214830 - DNA, 15 bp, Homo sapiens
gactcatatcagttt

SEQ ID NO: 214831 - DNA, 15 bp, Homo sapiens
agactcatatcagtt

SEQ ID NO: 214832 - DNA, 15 bp, Homo sapiens
aagactcatatcagt

SEQ ID NO: 214833 - DNA, 15 bp, Homo sapiens
caagactcatatcag

SEQ ID NO: 214834 - DNA, 15 bp, Homo sapiens
gcaagactcatatca

SEQ ID NO: 214835 - DNA, 15 bp, Homo sapiens
tgcaagactcatatc

SEQ ID NO: 214836 - DNA, 15 bp, Homo sapiens
ttgcaagactcatat

SEQ ID NO: 214837 - DNA, 15 bp, Homo sapiens
gttgcaagactcata

SEQ ID NO: 214838 - DNA, 15 bp, Homo sapiens
tgttgcaagactcat

SEQ ID NO: 214839 - DNA, 15 bp, Homo sapiens
gtgttgcaagactca

SEQ ID NO: 214840 - DNA, 15 bp, Homo sapiens
tgtgttgcaagactc

SEQ ID NO: 214841 - DNA, 15 bp, Homo sapiens
ctgtgttgcaagact

SEQ ID NO: 214842 - DNA, 15 bp, Homo sapiens
actgtgttgcaagac

SEQ ID NO: 214843 - DNA, 15 bp, Homo sapiens
aactgtgttgcaaga

SEQ ID NO: 214844 - DNA, 15 bp, Homo sapiens
aaactgtgttgcaag

SEQ ID NO: 214845 - DNA, 15 bp, Homo sapiens
aaaactgtgttgcaa

SEQ ID NO: 214846 - DNA, 15 bp, Homo sapiens
gaaaactgtgttgca

SEQ ID NO: 214847 - DNA, 15 bp, Homo sapiens
agaaaactgtgttgc

SEQ ID NO: 214848 - DNA, 15 bp, Homo sapiens
cagaaaactgtgttg

SEQ ID NO: 214849 - DNA, 15 bp, Homo sapiens
gcagaaaactgtgtt

SEQ ID NO: 214850 - DNA, 15 bp, Homo sapiens
agcagaaaactgtgt

SEQ ID NO: 214851 - DNA, 15 bp, Homo sapiens
aagcagaaaactgtg

SEQ ID NO: 214852 - DNA, 15 bp, Homo sapiens
taagcagaaaactgt

SEQ ID NO: 214853 - DNA, 15 bp, Homo sapiens
ataagcagaaaactg

SEQ ID NO: 214854 - DNA, 15 bp, Homo sapiens
cataagcagaaaact

SEQ ID NO: 214855 - DNA, 15 bp, Homo sapiens
tcataagcagaaaac

SEQ ID NO: 214856 - DNA, 15 bp, Homo sapiens
ttcataagcagaaaa

SEQ ID NO: 214857 - DNA, 15 bp, Homo sapiens
tttcataagcagaaa

SEQ ID NO: 214858 - DNA, 15 bp, Homo sapiens
atttcataagcagaa

SEQ ID NO: 214859 - DNA, 15 bp, Homo sapiens
tatttcataagcaga

SEQ ID NO: 214860 - DNA, 15 bp, Homo sapiens
atatttcataagcag

SEQ ID NO: 214861 - DNA, 15 bp, Homo sapiens
aatatttcataagca

SEQ ID NO: 214862 - DNA, 15 bp, Homo sapiens
aaatatttcataagc

SEQ ID NO: 214863 - DNA, 15 bp, Homo sapiens
aaaatatttcataag

SEQ ID NO: 214864 - DNA, 15 bp, Homo sapiens
caaaatatttcataa

SEQ ID NO: 214865 - DNA, 15 bp, Homo sapiens
ccaaaatatttcata

SEQ ID NO: 214866 - DNA, 15 bp, Homo sapiens
gccaaaatatttcat

SEQ ID NO: 214867 - DNA, 15 bp, Homo sapiens
agccaaaatatttca

SEQ ID NO: 214868 - DNA, 15 bp, Homo sapiens
aagccaaaatatttc

SEQ ID NO: 214869 - DNA, 15 bp, Homo sapiens
aaagccaaaatattt

SEQ ID NO: 214870 - DNA, 15 bp, Homo sapiens
taaagccaaaatatt

SEQ ID NO: 214871 - DNA, 15 bp, Homo sapiens
ataaagccaaaatat

SEQ ID NO: 214872 - DNA, 15 bp, Homo sapiens
gataaagccaaaata

SEQ ID NO: 214873 - DNA, 15 bp, Homo sapiens
agataaagccaaaat

SEQ ID NO: 214874 - DNA, 15 bp, Homo sapiens
aagataaagccaaaa

SEQ ID NO: 214875 - DNA, 15 bp, Homo sapiens
caagataaagccaaa

SEQ ID NO: 214876 - DNA, 15 bp, Homo sapiens
ccaagataaagccaa

SEQ ID NO: 214877 - DNA, 15 bp, Homo sapiens
tccaagataaagcca

SEQ ID NO: 214878 - DNA, 15 bp, Homo sapiens
ctccaagataaagcc

SEQ ID NO: 214879 - DNA, 15 bp, Homo sapiens
tctccaagataaagc

SEQ ID NO: 214880 - DNA, 15 bp, Homo sapiens
ttctccaagataaag

SEQ ID NO: 214881 - DNA, 15 bp, Homo sapiens
attctccaagataaa

SEQ ID NO: 214882 - DNA, 15 bp, Homo sapiens
gattctccaagataa

SEQ ID NO: 214883 - DNA, 15 bp, Homo sapiens
tgattctccaagata

SEQ ID NO: 214884 - DNA, 15 bp, Homo sapiens
gtgattctccaagat

SEQ ID NO: 214885 - DNA, 15 bp, Homo sapiens
tgtgattctccaaga

SEQ ID NO: 214886 - DNA, 15 bp, Homo sapiens
atgtgattctccaag

SEQ ID NO: 214887 - DNA, 15 bp, Homo sapiens
tatgtgattctccaa

SEQ ID NO: 214888 - DNA, 15 bp, Homo sapiens
ttatgtgattctcca

SEQ ID NO: 214889 - DNA, 15 bp, Homo sapiens
attatgtgattctcc

SEQ ID NO: 214890 - DNA, 15 bp, Homo sapiens
aattatgtgattctc

SEQ ID NO: 214891 - DNA, 15 bp, Homo sapiens
gaattatgtgattct

SEQ ID NO: 214892 - DNA, 15 bp, Homo sapiens
ggaattatgtgattc

SEQ ID NO: 214893 - DNA, 15 bp, Homo sapiens
tggaattatgtgatt

SEQ ID NO: 214894 - DNA, 15 bp, Homo sapiens
atggaattatgtgat

SEQ ID NO: 214895 - DNA, 15 bp, Homo sapiens
aatggaattatgtga

SEQ ID NO: 214896 - DNA, 15 bp, Homo sapiens
aaatggaattatgtg

SEQ ID NO: 214897 - DNA, 15 bp, Homo sapiens
aaaatggaattatgt

SEQ ID NO: 214898 - DNA, 15 bp, Homo sapiens
aaaaatggaattatg

SEQ ID NO: 214899 - DNA, 15 bp, Homo sapiens
aaaaaatggaattat

SEQ ID NO: 214900 - DNA, 15 bp, Homo sapiens
aaaaaaatggaatta

SEQ ID NO: 214901 - DNA, 15 bp, Homo sapiens
gaaaaaaatggaatt

SEQ ID NO: 214902 - DNA, 15 bp, Homo sapiens
agaaaaaaatggaat

SEQ ID NO: 214903 - DNA, 15 bp, Homo sapiens
aagaaaaaaatggaa

SEQ ID NO: 214904 - DNA, 15 bp, Homo sapiens
aaagaaaaaaatgga

SEQ ID NO: 214905 - DNA, 15 bp, Homo sapiens
aaaagaaaaaaatgg

SEQ ID NO: 214906 - DNA, 15 bp, Homo sapiens
aaaaagaaaaaaatg

SEQ ID NO: 214907 - DNA, 15 bp, Homo sapiens
gaaaaagaaaaaaat

SEQ ID NO: 214908 - DNA, 15 bp, Homo sapiens
agaaaaagaaaaaaa

SEQ ID NO: 214909 - DNA, 15 bp, Homo sapiens
aaaagaaaaagaaaa

SEQ ID NO: 214910 - DNA, 15 bp, Homo sapiens
gaaaaagaaaaagaa

SEQ ID NO: 214911 - DNA, 15 bp, Homo sapiens
agaaaaagaaaaaga

SEQ ID NO: 214912 - DNA, 15 bp, Homo sapiens
aagaaaaagaaaaag

SEQ ID NO: 214913 - DNA, 15 bp, Homo sapiens
gaaaagaaaaagaaa

SEQ ID NO: 214914 - DNA, 15 bp, Homo sapiens
agaaaagaaaaagaa

SEQ ID NO: 214915 - DNA, 15 bp, Homo sapiens
aagaaaagaaaaaga

SEQ ID NO: 214916 - DNA, 15 bp, Homo sapiens
aaagaaaagaaaaag

SEQ ID NO: 214917 - DNA, 15 bp, Homo sapiens
agaaaaaagaaaaga

SEQ ID NO: 214918 - DNA, 15 bp, Homo sapiens
aaaaaaagaaaaaag

SEQ ID NO: 214919 - DNA, 15 bp, Homo sapiens
ggcgagactctgtct

SEQ ID NO: 214920 - DNA, 15 bp, Homo sapiens
gggcgagactctgtc

SEQ ID NO: 214921 - DNA, 15 bp, Homo sapiens
tgggcgagactctgt

SEQ ID NO: 214922 - DNA, 15 bp, Homo sapiens
ctgggcgagactctg

SEQ ID NO: 214923 - DNA, 15 bp, Homo sapiens
actgggcgagactct

SEQ ID NO: 214924 - DNA, 15 bp, Homo sapiens
aactgggcgagactc

SEQ ID NO: 214925 - DNA, 15 bp, Homo sapiens
caactgggcgagact

SEQ ID NO: 214926 - DNA, 15 bp, Homo sapiens
gcaactgggcgagac

SEQ ID NO: 214927 - DNA, 15 bp, Homo sapiens
ggcaactgggcgaga

SEQ ID NO: 214928 - DNA, 15 bp, Homo sapiens
gggcaactgggcgag

SEQ ID NO: 214929 - DNA, 15 bp, Homo sapiens
tgggcaactgggcga

SEQ ID NO: 214930 - DNA, 15 bp, Homo sapiens
ctgggcaactgggcg

SEQ ID NO: 214931 - DNA, 15 bp, Homo sapiens
cctgggcaactgggc

SEQ ID NO: 214932 - DNA, 15 bp, Homo sapiens
gcctgggcaactggg

SEQ ID NO: 214933 - DNA, 15 bp, Homo sapiens
agcctgggcaactgg

SEQ ID NO: 214934 - DNA, 15 bp, Homo sapiens
cagcctgggcaactg

SEQ ID NO: 214935 - DNA, 15 bp, Homo sapiens
ccagcctgggcaact

SEQ ID NO: 214936 - DNA, 15 bp, Homo sapiens
gtccagcctgggcaa

SEQ ID NO: 214937 - DNA, 15 bp, Homo sapiens
agtccagcctgggca

SEQ ID NO: 214938 - DNA, 15 bp, Homo sapiens
cagtccagcctgggc

SEQ ID NO: 214939 - DNA, 15 bp, Homo sapiens
gcagtccagcctggg

SEQ ID NO: 214940 - DNA, 15 bp, Homo sapiens
tgcagtccagcctgg

SEQ ID NO: 214941 - DNA, 15 bp, Homo sapiens
ttgcagtccagcctg

SEQ ID NO: 214942 - DNA, 15 bp, Homo sapiens
attgcagtccagcct

SEQ ID NO: 214943 - DNA, 15 bp, Homo sapiens
cattgcagtccagcc

SEQ ID NO: 214944 - DNA, 15 bp, Homo sapiens
ccattgcagtccagc

SEQ ID NO: 214945 - DNA, 15 bp, Homo sapiens
gccattgcagtccag

SEQ ID NO: 214946 - DNA, 15 bp, Homo sapiens
agccattgcagtcca

SEQ ID NO: 214947 - DNA, 15 bp, Homo sapiens
gagccattgcagtcc

SEQ ID NO: 214948 - DNA, 15 bp, Homo sapiens
cgagccattgcagtc

SEQ ID NO: 214949 - DNA, 15 bp, Homo sapiens
tcgagccattgcagt

SEQ ID NO: 214950 - DNA, 15 bp, Homo sapiens
atcgagccattgcag

SEQ ID NO: 214951 - DNA, 15 bp, Homo sapiens
gatcgagccattgca

SEQ ID NO: 214952 - DNA, 15 bp, Homo sapiens
agatcgagccattgc

SEQ ID NO: 214953 - DNA, 15 bp, Homo sapiens
gagatcgagccattg

SEQ ID NO: 214954 - DNA, 15 bp, Homo sapiens
cgagatcgagccatt

SEQ ID NO: 214955 - DNA, 15 bp, Homo sapiens
ccgagatcgagccat

SEQ ID NO: 214956 - DNA, 15 bp, Homo sapiens
gccgagatcgagcca

SEQ ID NO: 214957 - DNA, 15 bp, Homo sapiens
agccgagatcgagcc

SEQ ID NO: 214958 - DNA, 15 bp, Homo sapiens
gagccgagatcgagc

SEQ ID NO: 214959 - DNA, 15 bp, Homo sapiens
tgagccgagatcgag

SEQ ID NO: 214960 - DNA, 15 bp, Homo sapiens
gtgagccgagatcga

SEQ ID NO: 214961 - DNA, 15 bp, Homo sapiens
gacccgggaggcgga

SEQ ID NO: 214962 - DNA, 15 bp, Homo sapiens
ggacccgggaggcgg

SEQ ID NO: 214963 - DNA, 15 bp, Homo sapiens
tggacccgggaggcg

SEQ ID NO: 214964 - DNA, 15 bp, Homo sapiens
ttggacccgggaggc

SEQ ID NO: 214965 - DNA, 15 bp, Homo sapiens
tttggacccgggagg

SEQ ID NO: 214966 - DNA, 15 bp, Homo sapiens
atttggacccgggag

SEQ ID NO: 214967 - DNA, 15 bp, Homo sapiens
catttggacccggga

SEQ ID NO: 214968 - DNA, 15 bp, Homo sapiens
tcatttggacccggg

SEQ ID NO: 214969 - DNA, 15 bp, Homo sapiens
gtcatttggacccgg

SEQ ID NO: 214970 - DNA, 15 bp, Homo sapiens
agtcatttggacccg

SEQ ID NO: 214971 - DNA, 15 bp, Homo sapiens
gagtcatttggaccc

SEQ ID NO: 214972 - DNA, 15 bp, Homo sapiens
agagtcatttggacc

SEQ ID NO: 214973 - DNA, 15 bp, Homo sapiens
gagagtcatttggac

SEQ ID NO: 214974 - DNA, 15 bp, Homo sapiens
ggagagtcatttgga

SEQ ID NO: 214975 - DNA, 15 bp, Homo sapiens
aggagagtcatttgg

SEQ ID NO: 214976 - DNA, 15 bp, Homo sapiens
caggagagtcatttg

SEQ ID NO: 214977 - DNA, 15 bp, Homo sapiens
gcaggagagtcattt

SEQ ID NO: 214978 - DNA, 15 bp, Homo sapiens
ggcaggagagtcatt

SEQ ID NO: 214979 - DNA, 15 bp, Homo sapiens
aggcaggagagtcat

SEQ ID NO: 214980 - DNA, 15 bp, Homo sapiens
gtggtggcaggcacc

SEQ ID NO: 214981 - DNA, 15 bp, Homo sapiens
tgtggtggcaggcac

SEQ ID NO: 214982 - DNA, 15 bp, Homo sapiens
gtgtggtggcaggca

SEQ ID NO: 214983 - DNA, 15 bp, Homo sapiens
ggtgtggtggcaggc

SEQ ID NO: 214984 - DNA, 15 bp, Homo sapiens
tccccgtctctacta

SEQ ID NO: 214985 - DNA, 15 bp, Homo sapiens
atccccgtctctact

SEQ ID NO: 214986 - DNA, 15 bp, Homo sapiens
aatccccgtctctac

SEQ ID NO: 214987 - DNA, 15 bp, Homo sapiens
aaatccccgtctcta

SEQ ID NO: 214988 - DNA, 15 bp, Homo sapiens
gaaatccccgtctct

SEQ ID NO: 214989 - DNA, 15 bp, Homo sapiens
tgaaatccccgtctc

SEQ ID NO: 214990 - DNA, 15 bp, Homo sapiens
gtgaaatccccgtct

SEQ ID NO: 214991 - DNA, 15 bp, Homo sapiens
ggtgaaatccccgtc

SEQ ID NO: 214992 - DNA, 15 bp, Homo sapiens
tggtgaaatccccgt

SEQ ID NO: 214993 - DNA, 15 bp, Homo sapiens
atggtgaaatccccg

SEQ ID NO: 214994 - DNA, 15 bp, Homo sapiens
catggtgaaatcccc

SEQ ID NO: 214995 - DNA, 15 bp, Homo sapiens
tcaacatggtgaaat

SEQ ID NO: 214996 - DNA, 15 bp, Homo sapiens
atcaacatggtgaaa

SEQ ID NO: 214997 - DNA, 15 bp, Homo sapiens
gatcaacatggtgaa

SEQ ID NO: 214998 - DNA, 15 bp, Homo sapiens
tgatcaacatggtga

SEQ ID NO: 214999 - DNA, 15 bp, Homo sapiens
ctgatcaacatggtg

SEQ ID NO: 215000 - DNA, 15 bp, Homo sapiens
cctgatcaacatggt

SEQ ID NO: 215001 - DNA, 15 bp, Homo sapiens
gcctgatcaacatgg

SEQ ID NO: 215002 - DNA, 15 bp, Homo sapiens
agcctgatcaacatg

SEQ ID NO: 215003 - DNA, 15 bp, Homo sapiens
cagcctgatcaacat

SEQ ID NO: 215004 - DNA, 15 bp, Homo sapiens
ccagcctgatcaaca

SEQ ID NO: 215005 - DNA, 15 bp, Homo sapiens
accagcctgatcaac

SEQ ID NO: 215006 - DNA, 15 bp, Homo sapiens
gaccagcctgatcaa

SEQ ID NO: 215007 - DNA, 15 bp, Homo sapiens
agaccagcctgatca

SEQ ID NO: 215008 - DNA, 15 bp, Homo sapiens
gagaccagcctgatc

SEQ ID NO: 215009 - DNA, 15 bp, Homo sapiens
cgagaccagcctgat

SEQ ID NO: 215010 - DNA, 15 bp, Homo sapiens
ggatcatgaggtcag

SEQ ID NO: 215011 - DNA, 15 bp, Homo sapiens
gggtggatcatgagg

SEQ ID NO: 215012 - DNA, 15 bp, Homo sapiens
cgggtggatcatgag

SEQ ID NO: 215013 - DNA, 15 bp, Homo sapiens
gcgggtggatcatga

SEQ ID NO: 215014 - DNA, 15 bp, Homo sapiens
ggcgggtggatcatg

SEQ ID NO: 215015 - DNA, 15 bp, Homo sapiens
aggcgggtggatcat

SEQ ID NO: 215016 - DNA, 15 bp, Homo sapiens
ggctgaggcgggtgg

SEQ ID NO: 215017 - DNA, 15 bp, Homo sapiens
accagcactttggga

SEQ ID NO: 215018 - DNA, 15 bp, Homo sapiens
taccagcactttggg

SEQ ID NO: 215019 - DNA, 15 bp, Homo sapiens
gtaccagcactttgg

SEQ ID NO: 215020 - DNA, 15 bp, Homo sapiens
agtaccagcactttg

SEQ ID NO: 215021 - DNA, 15 bp, Homo sapiens
tagtaccagcacttt

SEQ ID NO: 215022 - DNA, 15 bp, Homo sapiens
gtagtaccagcactt

SEQ ID NO: 215023 - DNA, 15 bp, Homo sapiens
tgtagtaccagcact

SEQ ID NO: 215024 - DNA, 15 bp, Homo sapiens
ctgtagtaccagcac

SEQ ID NO: 215025 - DNA, 15 bp, Homo sapiens
cctgtagtaccagca

SEQ ID NO: 215026 - DNA, 15 bp, Homo sapiens
gcctgtagtaccagc

SEQ ID NO: 215027 - DNA, 15 bp, Homo sapiens
tgcctgtagtaccag

SEQ ID NO: 215028 - DNA, 15 bp, Homo sapiens
tcatgcctgtagtac

SEQ ID NO: 215029 - DNA, 15 bp, Homo sapiens
ctcatgcctgtagta

SEQ ID NO: 215030 - DNA, 15 bp, Homo sapiens
caggctgggcacagt

SEQ ID NO: 215031 - DNA, 15 bp, Homo sapiens
tcaggctgggcacag

SEQ ID NO: 215032 - DNA, 15 bp, Homo sapiens
ctcaggctgggcaca

SEQ ID NO: 215033 - DNA, 15 bp, Homo sapiens
gctcaggctgggcac

SEQ ID NO: 215034 - DNA, 15 bp, Homo sapiens
ggctcaggctgggca

SEQ ID NO: 215035 - DNA, 15 bp, Homo sapiens
tggctcaggctgggc

SEQ ID NO: 215036 - DNA, 15 bp, Homo sapiens
gtggctcaggctggg

SEQ ID NO: 215037 - DNA, 15 bp, Homo sapiens
agtggctcaggctgg

SEQ ID NO: 215038 - DNA, 15 bp, Homo sapiens
cagtggctcaggctg

SEQ ID NO: 215039 - DNA, 15 bp, Homo sapiens
gcagtggctcaggct

SEQ ID NO: 215040 - DNA, 15 bp, Homo sapiens
tgcagtggctcaggc

SEQ ID NO: 215041 - DNA, 15 bp, Homo sapiens
gtgcagtggctcagg

SEQ ID NO: 215042 - DNA, 15 bp, Homo sapiens
ggtgcagtggctcag

SEQ ID NO: 215043 - DNA, 15 bp, Homo sapiens
tgggccaggtgcagt

SEQ ID NO: 215044 - DNA, 15 bp, Homo sapiens
atgggccaggtgcag

SEQ ID NO: 215045 - DNA, 15 bp, Homo sapiens
aatgggccaggtgca

SEQ ID NO: 215046 - DNA, 15 bp, Homo sapiens
aaatgggccaggtgc

SEQ ID NO: 215047 - DNA, 15 bp, Homo sapiens
aaaatgggccaggtg

SEQ ID NO: 215048 - DNA, 15 bp, Homo sapiens
aaaaatgggccaggt

SEQ ID NO: 215049 - DNA, 15 bp, Homo sapiens
aaaaaaatgggccag

SEQ ID NO: 215050 - DNA, 15 bp, Homo sapiens
gaaaaaaatgggcca

SEQ ID NO: 215051 - DNA, 15 bp, Homo sapiens
tgaaaaaaatgggcc

SEQ ID NO: 215052 - DNA, 15 bp, Homo sapiens
atgaaaaaaatgggc

SEQ ID NO: 215053 - DNA, 15 bp, Homo sapiens
tatgaaaaaaatggg

SEQ ID NO: 215054 - DNA, 15 bp, Homo sapiens
ttatgaaaaaaatgg

SEQ ID NO: 215055 - DNA, 15 bp, Homo sapiens
attatgaaaaaaatg

SEQ ID NO: 215056 - DNA, 15 bp, Homo sapiens
aattatgaaaaaaat

SEQ ID NO: 215057 - DNA, 15 bp, Homo sapiens
taattatgaaaaaaa

SEQ ID NO: 215058 - DNA, 15 bp, Homo sapiens
ttaattatgaaaaaa

SEQ ID NO: 215059 - DNA, 15 bp, Homo sapiens
tttaattatgaaaaa

SEQ ID NO: 215060 - DNA, 15 bp, Homo sapiens
atttaattatgaaaa

SEQ ID NO: 215061 - DNA, 15 bp, Homo sapiens
tatttaattatgaaa

SEQ ID NO: 215062 - DNA, 15 bp, Homo sapiens
ttatttaattatgaa

SEQ ID NO: 215063 - DNA, 15 bp, Homo sapiens
attatttaattatga

SEQ ID NO: 215064 - DNA, 15 bp, Homo sapiens
aattatttaattatg

SEQ ID NO: 215065 - DNA, 15 bp, Homo sapiens
aaattatttaattat

SEQ ID NO: 215066 - DNA, 15 bp, Homo sapiens
taaattatttaatta

SEQ ID NO: 215067 - DNA, 15 bp, Homo sapiens
ataaattatttaatt

SEQ ID NO: 215068 - DNA, 15 bp, Homo sapiens
gataaattatttaat

SEQ ID NO: 215069 - DNA, 15 bp, Homo sapiens
ggataaattatttaa

SEQ ID NO: 215070 - DNA, 15 bp, Homo sapiens
gggataaattattta

SEQ ID NO: 215071 - DNA, 15 bp, Homo sapiens
agggataaattattt

SEQ ID NO: 215072 - DNA, 15 bp, Homo sapiens
aagggataaattatt

SEQ ID NO: 215073 - DNA, 15 bp, Homo sapiens
taagggataaattat

SEQ ID NO: 215074 - DNA, 15 bp, Homo sapiens
ctaagggataaatta

SEQ ID NO: 215075 - DNA, 15 bp, Homo sapiens
tctaagggataaatt

SEQ ID NO: 215076 - DNA, 15 bp, Homo sapiens
ttctaagggataaat

SEQ ID NO: 215077 - DNA, 15 bp, Homo sapiens
cttctaagggataaa

SEQ ID NO: 215078 - DNA, 15 bp, Homo sapiens
tcttctaagggataa

SEQ ID NO: 215079 - DNA, 15 bp, Homo sapiens
ctcttctaagggata

SEQ ID NO: 215080 - DNA, 15 bp, Homo sapiens
actcttctaagggat

SEQ ID NO: 215081 - DNA, 15 bp, Homo sapiens
aactcttctaaggga

SEQ ID NO: 215082 - DNA, 15 bp, Homo sapiens
taactcttctaaggg

SEQ ID NO: 215083 - DNA, 15 bp, Homo sapiens
ttaactcttctaagg

SEQ ID NO: 215084 - DNA, 15 bp, Homo sapiens
cttaactcttctaag

SEQ ID NO: 215085 - DNA, 15 bp, Homo sapiens
acttaactcttctaa

SEQ ID NO: 215086 - DNA, 15 bp, Homo sapiens
gacttaactcttcta

SEQ ID NO: 215087 - DNA, 15 bp, Homo sapiens
tgacttaactcttct

SEQ ID NO: 215088 - DNA, 15 bp, Homo sapiens
atgacttaactcttc

SEQ ID NO: 215089 - DNA, 15 bp, Homo sapiens
gatgacttaactctt

SEQ ID NO: 215090 - DNA, 15 bp, Homo sapiens
agatgacttaactct

SEQ ID NO: 215091 - DNA, 15 bp, Homo sapiens
tagatgacttaactc

SEQ ID NO: 215092 - DNA, 15 bp, Homo sapiens
gtagatgacttaact

SEQ ID NO: 215093 - DNA, 15 bp, Homo sapiens
agtagatgacttaac

SEQ ID NO: 215094 - DNA, 15 bp, Homo sapiens
aagtagatgacttaa

SEQ ID NO: 215095 - DNA, 15 bp, Homo sapiens
aaagtagatgactta

SEQ ID NO: 215096 - DNA, 15 bp, Homo sapiens
gaaagtagatgactt

SEQ ID NO: 215097 - DNA, 15 bp, Homo sapiens
tgaaagtagatgact

SEQ ID NO: 215098 - DNA, 15 bp, Homo sapiens
ctgaaagtagatgac

SEQ ID NO: 215099 - DNA, 15 bp, Homo sapiens
tctgaaagtagatga

SEQ ID NO: 215100 - DNA, 15 bp, Homo sapiens
atctgaaagtagatg

SEQ ID NO: 215101 - DNA, 15 bp, Homo sapiens
catctgaaagtagat

SEQ ID NO: 215102 - DNA, 15 bp, Homo sapiens
acatctgaaagtaga

SEQ ID NO: 215103 - DNA, 15 bp, Homo sapiens
aacatctgaaagtag

SEQ ID NO: 215104 - DNA, 15 bp, Homo sapiens
gaacatctgaaagta

SEQ ID NO: 215105 - DNA, 15 bp, Homo sapiens
ggaacatctgaaagt

SEQ ID NO: 215106 - DNA, 15 bp, Homo sapiens
aggaacatctgaaag

SEQ ID NO: 215107 - DNA, 15 bp, Homo sapiens
caggaacatctgaaa

SEQ ID NO: 215108 - DNA, 15 bp, Homo sapiens
gcaggaacatctgaa

SEQ ID NO: 215109 - DNA, 15 bp, Homo sapiens
tgcaggaacatctga

SEQ ID NO: 215110 - DNA, 15 bp, Homo sapiens
ttgcaggaacatctg

SEQ ID NO: 215111 - DNA, 15 bp, Homo sapiens
tttgcaggaacatct

SEQ ID NO: 215112 - DNA, 15 bp, Homo sapiens
gtttgcaggaacatc

SEQ ID NO: 215113 - DNA, 15 bp, Homo sapiens
cgtttgcaggaacat

SEQ ID NO: 215114 - DNA, 15 bp, Homo sapiens
ccgtttgcaggaaca

SEQ ID NO: 215115 - DNA, 15 bp, Homo sapiens
tccgtttgcaggaac

SEQ ID NO: 215116 - DNA, 15 bp, Homo sapiens
ctccgtttgcaggaa

SEQ ID NO: 215117 - DNA, 15 bp, Homo sapiens
cctccgtttgcagga

SEQ ID NO: 215118 - DNA, 15 bp, Homo sapiens
ccctccgtttgcagg

SEQ ID NO: 215119 - DNA, 15 bp, Homo sapiens
gccctccgtttgcag

SEQ ID NO: 215120 - DNA, 15 bp, Homo sapiens
agccctccgtttgca

SEQ ID NO: 215121 - DNA, 15 bp, Homo sapiens
aagccctccgtttgc

SEQ ID NO: 215122 - DNA, 15 bp, Homo sapiens
aaagccctccgtttg

SEQ ID NO: 215123 - DNA, 15 bp, Homo sapiens
caaagccctccgttt

SEQ ID NO: 215124 - DNA, 15 bp, Homo sapiens
acaaagccctccgtt

SEQ ID NO: 215125 - DNA, 15 bp, Homo sapiens
aacaaagccctccgt

SEQ ID NO: 215126 - DNA, 15 bp, Homo sapiens
gaacaaagccctccg

SEQ ID NO: 215127 - DNA, 15 bp, Homo sapiens
agaacaaagccctcc

SEQ ID NO: 215128 - DNA, 15 bp, Homo sapiens
cagaacaaagccctc

SEQ ID NO: 215129 - DNA, 15 bp, Homo sapiens
ccagaacaaagccct

SEQ ID NO: 215130 - DNA, 15 bp, Homo sapiens
gccagaacaaagccc

SEQ ID NO: 215131 - DNA, 15 bp, Homo sapiens
tgccagaacaaagcc

SEQ ID NO: 215132 - DNA, 15 bp, Homo sapiens
atgccagaacaaagc

SEQ ID NO: 215133 - DNA, 15 bp, Homo sapiens
aatgccagaacaaag

SEQ ID NO: 215134 - DNA, 15 bp, Homo sapiens
caatgccagaacaaa

SEQ ID NO: 215135 - DNA, 15 bp, Homo sapiens
ccaatgccagaacaa

SEQ ID NO: 215136 - DNA, 15 bp, Homo sapiens
accaatgccagaaca

SEQ ID NO: 215137 - DNA, 15 bp, Homo sapiens
gaccaatgccagaac

SEQ ID NO: 215138 - DNA, 15 bp, Homo sapiens
tgaccaatgccagaa

SEQ ID NO: 215139 - DNA, 15 bp, Homo sapiens
ttgaccaatgccaga

SEQ ID NO: 215140 - DNA, 15 bp, Homo sapiens
gttgaccaatgccag

SEQ ID NO: 215141 - DNA, 15 bp, Homo sapiens
ggttgaccaatgcca

SEQ ID NO: 215142 - DNA, 15 bp, Homo sapiens
tggttgaccaatgcc

SEQ ID NO: 215143 - DNA, 15 bp, Homo sapiens
ttggttgaccaatgc

SEQ ID NO: 215144 - DNA, 15 bp, Homo sapiens
tttggttgaccaatg

SEQ ID NO: 215145 - DNA, 15 bp, Homo sapiens
ctttggttgaccaat

SEQ ID NO: 215146 - DNA, 15 bp, Homo sapiens
gctttggttgaccaa

SEQ ID NO: 215147 - DNA, 15 bp, Homo sapiens
agctttggttgacca

SEQ ID NO: 215148 - DNA, 15 bp, Homo sapiens
gagctttggttgacc

SEQ ID NO: 215149 - DNA, 15 bp, Homo sapiens
agagctttggttgac

SEQ ID NO: 215150 - DNA, 15 bp, Homo sapiens
tagagctttggttga

SEQ ID NO: 215151 - DNA, 15 bp, Homo sapiens
ctagagctttggttg

SEQ ID NO: 215152 - DNA, 15 bp, Homo sapiens
cctagagctttggtt

SEQ ID NO: 215153 - DNA, 15 bp, Homo sapiens
acctagagctttggt

SEQ ID NO: 215154 - DNA, 15 bp, Homo sapiens
tacctagagctttgg

SEQ ID NO: 215155 - DNA, 15 bp, Homo sapiens
ttacctagagctttg

SEQ ID NO: 215156 - DNA, 15 bp, Homo sapiens
tttacctagagcttt

SEQ ID NO: 215157 - DNA, 15 bp, Homo sapiens
ttttacctagagctt

SEQ ID NO: 215158 - DNA, 15 bp, Homo sapiens
attttacctagagct

SEQ ID NO: 215159 - DNA, 15 bp, Homo sapiens
cattttacctagagc

SEQ ID NO: 215160 - DNA, 15 bp, Homo sapiens
ccattttacctagag

SEQ ID NO: 215161 - DNA, 15 bp, Homo sapiens
gccattttacctaga

SEQ ID NO: 215162 - DNA, 15 bp, Homo sapiens
agccattttacctag

SEQ ID NO: 215163 - DNA, 15 bp, Homo sapiens
tagccattttaccta

SEQ ID NO: 215164 - DNA, 15 bp, Homo sapiens
ctagccattttacct

SEQ ID NO: 215165 - DNA, 15 bp, Homo sapiens
tctagccattttacc

SEQ ID NO: 215166 - DNA, 15 bp, Homo sapiens
ttctagccattttac

SEQ ID NO: 215167 - DNA, 15 bp, Homo sapiens
gttctagccatttta

SEQ ID NO: 215168 - DNA, 15 bp, Homo sapiens
ggttctagccatttt

SEQ ID NO: 215169 - DNA, 15 bp, Homo sapiens
aggttctagccattt

SEQ ID NO: 215170 - DNA, 15 bp, Homo sapiens
aaggttctagccatt

SEQ ID NO: 215171 - DNA, 15 bp, Homo sapiens
gaaggttctagccat

SEQ ID NO: 215172 - DNA, 15 bp, Homo sapiens
ggaaggttctagcca

SEQ ID NO: 215173 - DNA, 15 bp, Homo sapiens
aggaaggttctagcc

SEQ ID NO: 215174 - DNA, 15 bp, Homo sapiens
gaggaaggttctagc

SEQ ID NO: 215175 - DNA, 15 bp, Homo sapiens
agaggaaggttctag

SEQ ID NO: 215176 - DNA, 15 bp, Homo sapiens
tagaggaaggttcta

SEQ ID NO: 215177 - DNA, 15 bp, Homo sapiens
gtagaggaaggttct

SEQ ID NO: 215178 - DNA, 15 bp, Homo sapiens
tgtagaggaaggttc

SEQ ID NO: 215179 - DNA, 15 bp, Homo sapiens
ttgtagaggaaggtt

SEQ ID NO: 215180 - DNA, 15 bp, Homo sapiens
cttgtagaggaaggt

SEQ ID NO: 215181 - DNA, 15 bp, Homo sapiens
acttgtagaggaagg

SEQ ID NO: 215182 - DNA, 15 bp, Homo sapiens
tacttgtagaggaag

SEQ ID NO: 215183 - DNA, 15 bp, Homo sapiens
ttacttgtagaggaa

SEQ ID NO: 215184 - DNA, 15 bp, Homo sapiens
cttacttgtagagga

SEQ ID NO: 215185 - DNA, 15 bp, Homo sapiens
tcttacttgtagagg

SEQ ID NO: 215186 - DNA, 15 bp, Homo sapiens
ctcttacttgtagag

SEQ ID NO: 215187 - DNA, 15 bp, Homo sapiens
actcttacttgtaga

SEQ ID NO: 215188 - DNA, 15 bp, Homo sapiens
cactcttacttgtag

SEQ ID NO: 215189 - DNA, 15 bp, Homo sapiens
tcactcttacttgta

SEQ ID NO: 215190 - DNA, 15 bp, Homo sapiens
ttcactcttacttgt

SEQ ID NO: 215191 - DNA, 15 bp, Homo sapiens
attcactcttacttg

SEQ ID NO: 215192 - DNA, 15 bp, Homo sapiens
tattcactcttactt

SEQ ID NO: 215193 - DNA, 15 bp, Homo sapiens
ctattcactcttact

SEQ ID NO: 215194 - DNA, 15 bp, Homo sapiens
tctattcactcttac

SEQ ID NO: 215195 - DNA, 15 bp, Homo sapiens
ctctattcactctta

SEQ ID NO: 215196 - DNA, 15 bp, Homo sapiens
cctctattcactctt

SEQ ID NO: 215197 - DNA, 15 bp, Homo sapiens
gcctctattcactct

SEQ ID NO: 215198 - DNA, 15 bp, Homo sapiens
agcctctattcactc

SEQ ID NO: 215199 - DNA, 15 bp, Homo sapiens
aagcctctattcact

SEQ ID NO: 215200 - DNA, 15 bp, Homo sapiens
aaagcctctattcac

SEQ ID NO: 215201 - DNA, 15 bp, Homo sapiens
caaagcctctattca

SEQ ID NO: 215202 - DNA, 15 bp, Homo sapiens
ccaaagcctctattc

SEQ ID NO: 215203 - DNA, 15 bp, Homo sapiens
tccaaagcctctatt

SEQ ID NO: 215204 - DNA, 15 bp, Homo sapiens
ttccaaagcctctat

SEQ ID NO: 215205 - DNA, 15 bp, Homo sapiens
tttccaaagcctcta

SEQ ID NO: 215206 - DNA, 15 bp, Homo sapiens
ctttccaaagcctct

SEQ ID NO: 215207 - DNA, 15 bp, Homo sapiens
tctttccaaagcctc

SEQ ID NO: 215208 - DNA, 15 bp, Homo sapiens
ttctttccaaagcct

SEQ ID NO: 215209 - DNA, 15 bp, Homo sapiens
tttctttccaaagcc

SEQ ID NO: 215210 - DNA, 15 bp, Homo sapiens
atttctttccaaagc

SEQ ID NO: 215211 - DNA, 15 bp, Homo sapiens
aatttctttccaaag

SEQ ID NO: 215212 - DNA, 15 bp, Homo sapiens
gaatttctttccaaa

SEQ ID NO: 215213 - DNA, 15 bp, Homo sapiens
tgaatttctttccaa

SEQ ID NO: 215214 - DNA, 15 bp, Homo sapiens
ctgaatttctttcca

SEQ ID NO: 215215 - DNA, 15 bp, Homo sapiens
actgaatttctttcc

SEQ ID NO: 215216 - DNA, 15 bp, Homo sapiens
gactgaatttctttc

SEQ ID NO: 215217 - DNA, 15 bp, Homo sapiens
agactgaatttcttt

SEQ ID NO: 215218 - DNA, 15 bp, Homo sapiens
cagactgaatttctt

SEQ ID NO: 215219 - DNA, 15 bp, Homo sapiens
tcagactgaatttct

SEQ ID NO: 215220 - DNA, 15 bp, Homo sapiens
ctcagactgaatttc

SEQ ID NO: 215221 - DNA, 15 bp, Homo sapiens
tctcagactgaattt

SEQ ID NO: 215222 - DNA, 15 bp, Homo sapiens
gtctcagactgaatt

SEQ ID NO: 215223 - DNA, 15 bp, Homo sapiens
tgtctcagactgaat

SEQ ID NO: 215224 - DNA, 15 bp, Homo sapiens
ttgtctcagactgaa

SEQ ID NO: 215225 - DNA, 15 bp, Homo sapiens
cttgtctcagactga

SEQ ID NO: 215226 - DNA, 15 bp, Homo sapiens
tcttgtctcagactg

SEQ ID NO: 215227 - DNA, 15 bp, Homo sapiens
ctcttgtctcagact

SEQ ID NO: 215228 - DNA, 15 bp, Homo sapiens
gctcttgtctcagac

SEQ ID NO: 215229 - DNA, 15 bp, Homo sapiens
agctcttgtctcaga

SEQ ID NO: 215230 - DNA, 15 bp, Homo sapiens
cagctcttgtctcag

SEQ ID NO: 215231 - DNA, 15 bp, Homo sapiens
tcagctcttgtctca

SEQ ID NO: 215232 - DNA, 15 bp, Homo sapiens
ctcagctcttgtctc

SEQ ID NO: 215233 - DNA, 15 bp, Homo sapiens
tctcagctcttgtct

SEQ ID NO: 215234 - DNA, 15 bp, Homo sapiens
ttctcagctcttgtc

SEQ ID NO: 215235 - DNA, 15 bp, Homo sapiens
tttctcagctcttgt

SEQ ID NO: 215236 - DNA, 15 bp, Homo sapiens
gtttctcagctcttg

SEQ ID NO: 215237 - DNA, 15 bp, Homo sapiens
tgtttctcagctctt

SEQ ID NO: 215238 - DNA, 15 bp, Homo sapiens
atgtttctcagctct

SEQ ID NO: 215239 - DNA, 15 bp, Homo sapiens
catgtttctcagctc

SEQ ID NO: 215240 - DNA, 15 bp, Homo sapiens
ccatgtttctcagct

SEQ ID NO: 215241 - DNA, 15 bp, Homo sapiens
accatgtttctcagc

SEQ ID NO: 215242 - DNA, 15 bp, Homo sapiens
taccatgtttctcag

SEQ ID NO: 215243 - DNA, 15 bp, Homo sapiens
ctaccatgtttctca

SEQ ID NO: 215244 - DNA, 15 bp, Homo sapiens
tctaccatgtttctc

SEQ ID NO: 215245 - DNA, 15 bp, Homo sapiens
ttctaccatgtttct

SEQ ID NO: 215246 - DNA, 15 bp, Homo sapiens
attctaccatgtttc

SEQ ID NO: 215247 - DNA, 15 bp, Homo sapiens
aattctaccatgttt

SEQ ID NO: 215248 - DNA, 15 bp, Homo sapiens
aaattctaccatgtt

SEQ ID NO: 215249 - DNA, 15 bp, Homo sapiens
aaaattctaccatgt

SEQ ID NO: 215250 - DNA, 15 bp, Homo sapiens
taaaattctaccatg

SEQ ID NO: 215251 - DNA, 15 bp, Homo sapiens
ctaaaattctaccat

SEQ ID NO: 215252 - DNA, 15 bp, Homo sapiens
tctaaaattctacca

SEQ ID NO: 215253 - DNA, 15 bp, Homo sapiens
atctaaaattctacc

SEQ ID NO: 215254 - DNA, 15 bp, Homo sapiens
aatctaaaattctac

SEQ ID NO: 215255 - DNA, 15 bp, Homo sapiens
taatctaaaattcta

SEQ ID NO: 215256 - DNA, 15 bp, Homo sapiens
ctaatctaaaattct

SEQ ID NO: 215257 - DNA, 15 bp, Homo sapiens
gctaatctaaaattc

SEQ ID NO: 215258 - DNA, 15 bp, Homo sapiens
tgctaatctaaaatt

SEQ ID NO: 215259 - DNA, 15 bp, Homo sapiens
atgctaatctaaaat

SEQ ID NO: 215260 - DNA, 15 bp, Homo sapiens
catgctaatctaaaa

SEQ ID NO: 215261 - DNA, 15 bp, Homo sapiens
tcatgctaatctaaa

SEQ ID NO: 215262 - DNA, 15 bp, Homo sapiens
atcatgctaatctaa

SEQ ID NO: 215263 - DNA, 15 bp, Homo sapiens
aatcatgctaatcta

SEQ ID NO: 215264 - DNA, 15 bp, Homo sapiens
aaatcatgctaatct

SEQ ID NO: 215265 - DNA, 15 bp, Homo sapiens
aaaatcatgctaatc

SEQ ID NO: 215266 - DNA, 15 bp, Homo sapiens
taaaatcatgctaat

SEQ ID NO: 215267 - DNA, 15 bp, Homo sapiens
ttaaaatcatgctaa

SEQ ID NO: 215268 - DNA, 15 bp, Homo sapiens
attaaaatcatgcta

SEQ ID NO: 215269 - DNA, 15 bp, Homo sapiens
tattaaaatcatgct

SEQ ID NO: 215270 - DNA, 15 bp, Homo sapiens
ctattaaaatcatgc

SEQ ID NO: 215271 - DNA, 15 bp, Homo sapiens
actattaaaatcatg

SEQ ID NO: 215272 - DNA, 15 bp, Homo sapiens
tactattaaaatcat

SEQ ID NO: 215273 - DNA, 15 bp, Homo sapiens
ttactattaaaatca

SEQ ID NO: 215274 - DNA, 15 bp, Homo sapiens
attactattaaaatc

SEQ ID NO: 215275 - DNA, 15 bp, Homo sapiens
cattactattaaaat

SEQ ID NO: 215276 - DNA, 15 bp, Homo sapiens
ccattactattaaaa

SEQ ID NO: 215277 - DNA, 15 bp, Homo sapiens
cccattactattaaa

SEQ ID NO: 215278 - DNA, 15 bp, Homo sapiens
gcccattactattaa

SEQ ID NO: 215279 - DNA, 15 bp, Homo sapiens
agcccattactatta

SEQ ID NO: 215280 - DNA, 15 bp, Homo sapiens
cagcccattactatt

SEQ ID NO: 215281 - DNA, 15 bp, Homo sapiens
ccagcccattactat

SEQ ID NO: 215282 - DNA, 15 bp, Homo sapiens
cccagcccattacta

SEQ ID NO: 215283 - DNA, 15 bp, Homo sapiens
tcccagcccattact

SEQ ID NO: 215284 - DNA, 15 bp, Homo sapiens
ctcccagcccattac

SEQ ID NO: 215285 - DNA, 15 bp, Homo sapiens
actcccagcccatta

SEQ ID NO: 215286 - DNA, 15 bp, Homo sapiens
cactcccagcccatt

SEQ ID NO: 215287 - DNA, 15 bp, Homo sapiens
ccactcccagcccat

SEQ ID NO: 215288 - DNA, 15 bp, Homo sapiens
accactcccagccca

SEQ ID NO: 215289 - DNA, 15 bp, Homo sapiens
caccactcccagccc

SEQ ID NO: 215290 - DNA, 15 bp, Homo sapiens
gcaccactcccagcc

SEQ ID NO: 215291 - DNA, 15 bp, Homo sapiens
agcaccactcccagc

SEQ ID NO: 215292 - DNA, 15 bp, Homo sapiens
gagcaccactcccag

SEQ ID NO: 215293 - DNA, 15 bp, Homo sapiens
tgagcaccactccca

SEQ ID NO: 215294 - DNA, 15 bp, Homo sapiens
gtgagcaccactccc

SEQ ID NO: 215295 - DNA, 15 bp, Homo sapiens
tgtgagcaccactcc

SEQ ID NO: 215296 - DNA, 15 bp, Homo sapiens
gtgtgagcaccactc

SEQ ID NO: 215297 - DNA, 15 bp, Homo sapiens
ggtgtgagcaccact

SEQ ID NO: 215298 - DNA, 15 bp, Homo sapiens
aggtgtgagcaccac

SEQ ID NO: 215299 - DNA, 15 bp, Homo sapiens
caggtgtgagcacca

SEQ ID NO: 215300 - DNA, 15 bp, Homo sapiens
acaggtgtgagcacc

SEQ ID NO: 215301 - DNA, 15 bp, Homo sapiens
tacaggtgtgagcac

SEQ ID NO: 215302 - DNA, 15 bp, Homo sapiens
ttacaggtgtgagca

SEQ ID NO: 215303 - DNA, 15 bp, Homo sapiens
actgggattacaggt

SEQ ID NO: 215304 - DNA, 15 bp, Homo sapiens
tactgggattacagg

SEQ ID NO: 215305 - DNA, 15 bp, Homo sapiens
gtactgggattacag

SEQ ID NO: 215306 - DNA, 15 bp, Homo sapiens
tcctcccaaagtact

SEQ ID NO: 215307 - DNA, 15 bp, Homo sapiens
ttcctcccaaagtac

SEQ ID NO: 215308 - DNA, 15 bp, Homo sapiens
tttcctcccaaagta

SEQ ID NO: 215309 - DNA, 15 bp, Homo sapiens
ttttcctcccaaagt

SEQ ID NO: 215310 - DNA, 15 bp, Homo sapiens
cttttcctcccaaag

SEQ ID NO: 215311 - DNA, 15 bp, Homo sapiens
acttttcctcccaaa

SEQ ID NO: 215312 - DNA, 15 bp, Homo sapiens
gacttttcctcccaa

SEQ ID NO: 215313 - DNA, 15 bp, Homo sapiens
tgacttttcctccca

SEQ ID NO: 215314 - DNA, 15 bp, Homo sapiens
ctgacttttcctccc

SEQ ID NO: 215315 - DNA, 15 bp, Homo sapiens
cctgacttttcctcc

SEQ ID NO: 215316 - DNA, 15 bp, Homo sapiens
tcctgacttttcctc

SEQ ID NO: 215317 - DNA, 15 bp, Homo sapiens
ctcctgacttttcct

SEQ ID NO: 215318 - DNA, 15 bp, Homo sapiens
cctcctgacttttcc

SEQ ID NO: 215319 - DNA, 15 bp, Homo sapiens
tcctcctgacttttc

SEQ ID NO: 215320 - DNA, 15 bp, Homo sapiens
atcctcctgactttt

SEQ ID NO: 215321 - DNA, 15 bp, Homo sapiens
gatcctcctgacttt

SEQ ID NO: 215322 - DNA, 15 bp, Homo sapiens
tgatcctcctgactt

SEQ ID NO: 215323 - DNA, 15 bp, Homo sapiens
gtgatcctcctgact

SEQ ID NO: 215324 - DNA, 15 bp, Homo sapiens
agtgatcctcctgac

SEQ ID NO: 215325 - DNA, 15 bp, Homo sapiens
aagtgatcctcctga

SEQ ID NO: 215326 - DNA, 15 bp, Homo sapiens
tgaactcctggcctc

SEQ ID NO: 215327 - DNA, 15 bp, Homo sapiens
gtcttgaactcctgg

SEQ ID NO: 215328 - DNA, 15 bp, Homo sapiens
cagtcttgaactcct

SEQ ID NO: 215329 - DNA, 15 bp, Homo sapiens
ccagtcttgaactcc

SEQ ID NO: 215330 - DNA, 15 bp, Homo sapiens
gccagtcttgaactc

SEQ ID NO: 215331 - DNA, 15 bp, Homo sapiens
ggccagtcttgaact

SEQ ID NO: 215332 - DNA, 15 bp, Homo sapiens
aggccagtcttgaac

SEQ ID NO: 215333 - DNA, 15 bp, Homo sapiens
caggccagtcttgaa

SEQ ID NO: 215334 - DNA, 15 bp, Homo sapiens
ccaggccagtcttga

SEQ ID NO: 215335 - DNA, 15 bp, Homo sapiens
accaggccagtcttg

SEQ ID NO: 215336 - DNA, 15 bp, Homo sapiens
gaccaggccagtctt

SEQ ID NO: 215337 - DNA, 15 bp, Homo sapiens
tgaccaggccagtct

SEQ ID NO: 215338 - DNA, 15 bp, Homo sapiens
ttgaccaggccagtc

SEQ ID NO: 215339 - DNA, 15 bp, Homo sapiens
gttgaccaggccagt

SEQ ID NO: 215340 - DNA, 15 bp, Homo sapiens
tgttgaccaggccag

SEQ ID NO: 215341 - DNA, 15 bp, Homo sapiens
atgttgaccaggcca

SEQ ID NO: 215342 - DNA, 15 bp, Homo sapiens
tatgttgaccaggcc

SEQ ID NO: 215343 - DNA, 15 bp, Homo sapiens
ctatgttgaccaggc

SEQ ID NO: 215344 - DNA, 15 bp, Homo sapiens
gctatgttgaccagg

SEQ ID NO: 215345 - DNA, 15 bp, Homo sapiens
tgctatgttgaccag

SEQ ID NO: 215346 - DNA, 15 bp, Homo sapiens
ttgctatgttgacca

SEQ ID NO: 215347 - DNA, 15 bp, Homo sapiens
cttgctatgttgacc

SEQ ID NO: 215348 - DNA, 15 bp, Homo sapiens
tcttgctatgttgac

SEQ ID NO: 215349 - DNA, 15 bp, Homo sapiens
gtcttgctatgttga

SEQ ID NO: 215350 - DNA, 15 bp, Homo sapiens
agtcttgctatgttg

SEQ ID NO: 215351 - DNA, 15 bp, Homo sapiens
gagtcttgctatgtt

SEQ ID NO: 215352 - DNA, 15 bp, Homo sapiens
agagtcttgctatgt

SEQ ID NO: 215353 - DNA, 15 bp, Homo sapiens
cagagtcttgctatg

SEQ ID NO: 215354 - DNA, 15 bp, Homo sapiens
acagagtcttgctat

SEQ ID NO: 215355 - DNA, 15 bp, Homo sapiens
gacagagtcttgcta

SEQ ID NO: 215356 - DNA, 15 bp, Homo sapiens
agggacagagtcttg

SEQ ID NO: 215357 - DNA, 15 bp, Homo sapiens
tagggacagagtctt

SEQ ID NO: 215358 - DNA, 15 bp, Homo sapiens
atagggacagagtct

SEQ ID NO: 215359 - DNA, 15 bp, Homo sapiens
aatagggacagagtc

SEQ ID NO: 215360 - DNA, 15 bp, Homo sapiens
aaatagggacagagt

SEQ ID NO: 215361 - DNA, 15 bp, Homo sapiens
taaatagggacagag

SEQ ID NO: 215362 - DNA, 15 bp, Homo sapiens
ttaaatagggacaga

SEQ ID NO: 215363 - DNA, 15 bp, Homo sapiens
tttaaatagggacag

SEQ ID NO: 215364 - DNA, 15 bp, Homo sapiens
ttttaaatagggaca

SEQ ID NO: 215365 - DNA, 15 bp, Homo sapiens
tttttaaatagggac

SEQ ID NO: 215366 - DNA, 15 bp, Homo sapiens
ttttttaaataggga

SEQ ID NO: 215367 - DNA, 15 bp, Homo sapiens
ttttttttaaatagg

SEQ ID NO: 215368 - DNA, 15 bp, Homo sapiens
tttttttttaaatag

SEQ ID NO: 215369 - DNA, 15 bp, Homo sapiens
atttttttttaaata

SEQ ID NO: 215370 - DNA, 15 bp, Homo sapiens
aatttttttttaaat

SEQ ID NO: 215371 - DNA, 15 bp, Homo sapiens
ttaatttttttttaa

SEQ ID NO: 215372 - DNA, 15 bp, Homo sapiens
attaattttttttta

SEQ ID NO: 215373 - DNA, 15 bp, Homo sapiens
ctaattaattttttt

SEQ ID NO: 215374 - DNA, 15 bp, Homo sapiens
gctaattaatttttt

SEQ ID NO: 215375 - DNA, 15 bp, Homo sapiens
ggctaattaattttt

SEQ ID NO: 215376 - DNA, 15 bp, Homo sapiens
aggctaattaatttt

SEQ ID NO: 215377 - DNA, 15 bp, Homo sapiens
caggctaattaattt

SEQ ID NO: 215378 - DNA, 15 bp, Homo sapiens
ccaggctaattaatt

SEQ ID NO: 215379 - DNA, 15 bp, Homo sapiens
accaggctaattaat

SEQ ID NO: 215380 - DNA, 15 bp, Homo sapiens
taccaggctaattaa

SEQ ID NO: 215381 - DNA, 15 bp, Homo sapiens
ataccaggctaatta

SEQ ID NO: 215382 - DNA, 15 bp, Homo sapiens
cataccaggctaatt

SEQ ID NO: 215383 - DNA, 15 bp, Homo sapiens
ccataccaggctaat

SEQ ID NO: 215384 - DNA, 15 bp, Homo sapiens
accataccaggctaa

SEQ ID NO: 215385 - DNA, 15 bp, Homo sapiens
caccataccaggcta

SEQ ID NO: 215386 - DNA, 15 bp, Homo sapiens
ccaccataccaggct

SEQ ID NO: 215387 - DNA, 15 bp, Homo sapiens
gccaccataccaggc

SEQ ID NO: 215388 - DNA, 15 bp, Homo sapiens
tgccaccataccagg

SEQ ID NO: 215389 - DNA, 15 bp, Homo sapiens
atgccaccataccag

SEQ ID NO: 215390 - DNA, 15 bp, Homo sapiens
catgccaccatacca

SEQ ID NO: 215391 - DNA, 15 bp, Homo sapiens
gcatgccaccatacc

SEQ ID NO: 215392 - DNA, 15 bp, Homo sapiens
tgcatgccaccatac

SEQ ID NO: 215393 - DNA, 15 bp, Homo sapiens
ttgcatgccaccata

SEQ ID NO: 215394 - DNA, 15 bp, Homo sapiens
gttgcatgccaccat

SEQ ID NO: 215395 - DNA, 15 bp, Homo sapiens
agttgcatgccacca

SEQ ID NO: 215396 - DNA, 15 bp, Homo sapiens
cagttgcatgccacc

SEQ ID NO: 215397 - DNA, 15 bp, Homo sapiens
acagttgcatgccac

SEQ ID NO: 215398 - DNA, 15 bp, Homo sapiens
tacagttgcatgcca

SEQ ID NO: 215399 - DNA, 15 bp, Homo sapiens
ctacagttgcatgcc

SEQ ID NO: 215400 - DNA, 15 bp, Homo sapiens
actacagttgcatgc

SEQ ID NO: 215401 - DNA, 15 bp, Homo sapiens
aactacagttgcatg

SEQ ID NO: 215402 - DNA, 15 bp, Homo sapiens
aaactacagttgcat

SEQ ID NO: 215403 - DNA, 15 bp, Homo sapiens
taaactacagttgca

SEQ ID NO: 215404 - DNA, 15 bp, Homo sapiens
ctaaactacagttgc

SEQ ID NO: 215405 - DNA, 15 bp, Homo sapiens
gctaaactacagttg

SEQ ID NO: 215406 - DNA, 15 bp, Homo sapiens
agctaaactacagtt

SEQ ID NO: 215407 - DNA, 15 bp, Homo sapiens
tagctaaactacagt

SEQ ID NO: 215408 - DNA, 15 bp, Homo sapiens
gtagctaaactacag

SEQ ID NO: 215409 - DNA, 15 bp, Homo sapiens
agtagctaaactaca

SEQ ID NO: 215410 - DNA, 15 bp, Homo sapiens
aagtagctaaactac

SEQ ID NO: 215411 - DNA, 15 bp, Homo sapiens
taagtagctaaacta

SEQ ID NO: 215412 - DNA, 15 bp, Homo sapiens
ttaagtagctaaact

SEQ ID NO: 215413 - DNA, 15 bp, Homo sapiens
cttaagtagctaaac

SEQ ID NO: 215414 - DNA, 15 bp, Homo sapiens
tcttaagtagctaaa

SEQ ID NO: 215415 - DNA, 15 bp, Homo sapiens
ctcttaagtagctaa

SEQ ID NO: 215416 - DNA, 15 bp, Homo sapiens
cctcttaagtagcta

SEQ ID NO: 215417 - DNA, 15 bp, Homo sapiens
gcctcttaagtagct

SEQ ID NO: 215418 - DNA, 15 bp, Homo sapiens
agcctcttaagtagc

SEQ ID NO: 215419 - DNA, 15 bp, Homo sapiens
cagcctcttaagtag

SEQ ID NO: 215420 - DNA, 15 bp, Homo sapiens
tcagcctcttaagta

SEQ ID NO: 215421 - DNA, 15 bp, Homo sapiens
ctcagcctcttaagt

SEQ ID NO: 215422 - DNA, 15 bp, Homo sapiens
cctcagcctcttaag

SEQ ID NO: 215423 - DNA, 15 bp, Homo sapiens
gcctcagcctcttaa

SEQ ID NO: 215424 - DNA, 15 bp, Homo sapiens
tgcctcagcctctta

SEQ ID NO: 215425 - DNA, 15 bp, Homo sapiens
ctgcctcagcctctt

SEQ ID NO: 215426 - DNA, 15 bp, Homo sapiens
tctgcctcagcctct

SEQ ID NO: 215427 - DNA, 15 bp, Homo sapiens
tttctgcctcagcct

SEQ ID NO: 215428 - DNA, 15 bp, Homo sapiens
ctttctgcctcagcc

SEQ ID NO: 215429 - DNA, 15 bp, Homo sapiens
tctttctgcctcagc

SEQ ID NO: 215430 - DNA, 15 bp, Homo sapiens
atctttctgcctcag

SEQ ID NO: 215431 - DNA, 15 bp, Homo sapiens
gatctttctgcctca

SEQ ID NO: 215432 - DNA, 15 bp, Homo sapiens
tgatctttctgcctc

SEQ ID NO: 215433 - DNA, 15 bp, Homo sapiens
gtgatctttctgcct

SEQ ID NO: 215434 - DNA, 15 bp, Homo sapiens
agtgatctttctgcc

SEQ ID NO: 215435 - DNA, 15 bp, Homo sapiens
aagtgatctttctgc

SEQ ID NO: 215436 - DNA, 15 bp, Homo sapiens
caagtgatctttctg

SEQ ID NO: 215437 - DNA, 15 bp, Homo sapiens
tcaagtgatctttct

SEQ ID NO: 215438 - DNA, 15 bp, Homo sapiens
ctcaagtgatctttc

SEQ ID NO: 215439 - DNA, 15 bp, Homo sapiens
gctcaagtgatcttt

SEQ ID NO: 215440 - DNA, 15 bp, Homo sapiens
cgggctcaagtgatc

SEQ ID NO: 215441 - DNA, 15 bp, Homo sapiens
tccgggctcaagtga

SEQ ID NO: 215442 - DNA, 15 bp, Homo sapiens
ttccgggctcaagtg

SEQ ID NO: 215443 - DNA, 15 bp, Homo sapiens
cttccgggctcaagt

SEQ ID NO: 215444 - DNA, 15 bp, Homo sapiens
acttccgggctcaag

SEQ ID NO: 215445 - DNA, 15 bp, Homo sapiens
aacttccgggctcaa

SEQ ID NO: 215446 - DNA, 15 bp, Homo sapiens
gaacttccgggctca

SEQ ID NO: 215447 - DNA, 15 bp, Homo sapiens
tgaacttccgggctc

SEQ ID NO: 215448 - DNA, 15 bp, Homo sapiens
ttgaacttccgggct

SEQ ID NO: 215449 - DNA, 15 bp, Homo sapiens
cttgaacttccgggc

SEQ ID NO: 215450 - DNA, 15 bp, Homo sapiens
ccttgaacttccggg

SEQ ID NO: 215451 - DNA, 15 bp, Homo sapiens
gccttgaacttccgg

SEQ ID NO: 215452 - DNA, 15 bp, Homo sapiens
agccttgaacttccg

SEQ ID NO: 215453 - DNA, 15 bp, Homo sapiens
cagccttgaacttcc

SEQ ID NO: 215454 - DNA, 15 bp, Homo sapiens
gcagccttgaacttc

SEQ ID NO: 215455 - DNA, 15 bp, Homo sapiens
tgcagccttgaactt

SEQ ID NO: 215456 - DNA, 15 bp, Homo sapiens
aagctcactgcagcc

SEQ ID NO: 215457 - DNA, 15 bp, Homo sapiens
aaagctcactgcagc

SEQ ID NO: 215458 - DNA, 15 bp, Homo sapiens
caaagctcactgcag

SEQ ID NO: 215459 - DNA, 15 bp, Homo sapiens
tcaaagctcactgca

SEQ ID NO: 215460 - DNA, 15 bp, Homo sapiens
atcaaagctcactgc

SEQ ID NO: 215461 - DNA, 15 bp, Homo sapiens
catcaaagctcactg

SEQ ID NO: 215462 - DNA, 15 bp, Homo sapiens
ccatcaaagctcact

SEQ ID NO: 215463 - DNA, 15 bp, Homo sapiens
accatcaaagctcac

SEQ ID NO: 215464 - DNA, 15 bp, Homo sapiens
caccatcaaagctca

SEQ ID NO: 215465 - DNA, 15 bp, Homo sapiens
acaccatcaaagctc

SEQ ID NO: 215466 - DNA, 15 bp, Homo sapiens
tacaccatcaaagct

SEQ ID NO: 215467 - DNA, 15 bp, Homo sapiens
gtacaccatcaaagc

SEQ ID NO: 215468 - DNA, 15 bp, Homo sapiens
ggtacaccatcaaag

SEQ ID NO: 215469 - DNA, 15 bp, Homo sapiens
tggtacaccatcaaa

SEQ ID NO: 215470 - DNA, 15 bp, Homo sapiens
ctggtacaccatcaa

SEQ ID NO: 215471 - DNA, 15 bp, Homo sapiens
gctggtacaccatca

SEQ ID NO: 215472 - DNA, 15 bp, Homo sapiens
agctggtacaccatc

SEQ ID NO: 215473 - DNA, 15 bp, Homo sapiens
aagctggtacaccat

SEQ ID NO: 215474 - DNA, 15 bp, Homo sapiens
caagctggtacacca

SEQ ID NO: 215475 - DNA, 15 bp, Homo sapiens
ccaagctggtacacc

SEQ ID NO: 215476 - DNA, 15 bp, Homo sapiens
cccaagctggtacac

SEQ ID NO: 215477 - DNA, 15 bp, Homo sapiens
gcccaagctggtaca

SEQ ID NO: 215478 - DNA, 15 bp, Homo sapiens
tgcccaagctggtac

SEQ ID NO: 215479 - DNA, 15 bp, Homo sapiens
ttgcccaagctggta

SEQ ID NO: 215480 - DNA, 15 bp, Homo sapiens
gttgcccaagctggt

SEQ ID NO: 215481 - DNA, 15 bp, Homo sapiens
tgttgcccaagctgg

SEQ ID NO: 215482 - DNA, 15 bp, Homo sapiens
ctgttgcccaagctg

SEQ ID NO: 215483 - DNA, 15 bp, Homo sapiens
tctgttgcccaagct

SEQ ID NO: 215484 - DNA, 15 bp, Homo sapiens
ctctgttgcccaagc

SEQ ID NO: 215485 - DNA, 15 bp, Homo sapiens
actctgttgcccaag

SEQ ID NO: 215486 - DNA, 15 bp, Homo sapiens
cactctgttgcccaa

SEQ ID NO: 215487 - DNA, 15 bp, Homo sapiens
ggtctcactctgttg

SEQ ID NO: 215488 - DNA, 15 bp, Homo sapiens
gggtctcactctgtt

SEQ ID NO: 215489 - DNA, 15 bp, Homo sapiens
agggtctcactctgt

SEQ ID NO: 215490 - DNA, 15 bp, Homo sapiens
cagggtctcactctg

SEQ ID NO: 215491 - DNA, 15 bp, Homo sapiens
acagggtctcactct

SEQ ID NO: 215492 - DNA, 15 bp, Homo sapiens
gacagggtctcactc

SEQ ID NO: 215493 - DNA, 15 bp, Homo sapiens
aagagacagggtctc

SEQ ID NO: 215494 - DNA, 15 bp, Homo sapiens
taagagacagggtct

SEQ ID NO: 215495 - DNA, 15 bp, Homo sapiens
ttaagagacagggtc

SEQ ID NO: 215496 - DNA, 15 bp, Homo sapiens
tttaagagacagggt

SEQ ID NO: 215497 - DNA, 15 bp, Homo sapiens
ttttaagagacaggg

SEQ ID NO: 215498 - DNA, 15 bp, Homo sapiens
tttttaagagacagg

SEQ ID NO: 215499 - DNA, 15 bp, Homo sapiens
ttttttaagagacag

SEQ ID NO: 215500 - DNA, 15 bp, Homo sapiens
tttttttaagagaca

SEQ ID NO: 215501 - DNA, 15 bp, Homo sapiens
ctttttttaagagac

SEQ ID NO: 215502 - DNA, 15 bp, Homo sapiens
actttttttaagaga

SEQ ID NO: 215503 - DNA, 15 bp, Homo sapiens
tactttttttaagag

SEQ ID NO: 215504 - DNA, 15 bp, Homo sapiens
ttactttttttaaga

SEQ ID NO: 215505 - DNA, 15 bp, Homo sapiens
attactttttttaag

SEQ ID NO: 215506 - DNA, 15 bp, Homo sapiens
aattactttttttaa

SEQ ID NO: 215507 - DNA, 15 bp, Homo sapiens
aaattacttttttta

SEQ ID NO: 215508 - DNA, 15 bp, Homo sapiens
aaaattacttttttt

SEQ ID NO: 215509 - DNA, 15 bp, Homo sapiens
aaaaattactttttt

SEQ ID NO: 215510 - DNA, 15 bp, Homo sapiens
aaaaaattacttttt

SEQ ID NO: 215511 - DNA, 15 bp, Homo sapiens
taaaaaattactttt

SEQ ID NO: 215512 - DNA, 15 bp, Homo sapiens
ataaaaaattacttt

SEQ ID NO: 215513 - DNA, 15 bp, Homo sapiens
aataaaaaattactt

SEQ ID NO: 215514 - DNA, 15 bp, Homo sapiens
gaataaaaaattact

SEQ ID NO: 215515 - DNA, 15 bp, Homo sapiens
agaataaaaaattac

SEQ ID NO: 215516 - DNA, 15 bp, Homo sapiens
tagaataaaaaatta

SEQ ID NO: 215517 - DNA, 15 bp, Homo sapiens
gtagaataaaaaatt

SEQ ID NO: 215518 - DNA, 15 bp, Homo sapiens
tgtagaataaaaaat

SEQ ID NO: 215519 - DNA, 15 bp, Homo sapiens
ctgtagaataaaaaa

SEQ ID NO: 215520 - DNA, 15 bp, Homo sapiens
gctgtagaataaaaa

SEQ ID NO: 215521 - DNA, 15 bp, Homo sapiens
tgctgtagaataaaa

SEQ ID NO: 215522 - DNA, 15 bp, Homo sapiens
gtgctgtagaataaa

SEQ ID NO: 215523 - DNA, 15 bp, Homo sapiens
agtgctgtagaataa

SEQ ID NO: 215524 - DNA, 15 bp, Homo sapiens
cagtgctgtagaata

SEQ ID NO: 215525 - DNA, 15 bp, Homo sapiens
tcagtgctgtagaat

SEQ ID NO: 215526 - DNA, 15 bp, Homo sapiens
ttcagtgctgtagaa

SEQ ID NO: 215527 - DNA, 15 bp, Homo sapiens
attcagtgctgtaga

SEQ ID NO: 215528 - DNA, 15 bp, Homo sapiens
tattcagtgctgtag

SEQ ID NO: 215529 - DNA, 15 bp, Homo sapiens
ctattcagtgctgta

SEQ ID NO: 215530 - DNA, 15 bp, Homo sapiens
actattcagtgctgt

SEQ ID NO: 215531 - DNA, 15 bp, Homo sapiens
aactattcagtgctg

SEQ ID NO: 215532 - DNA, 15 bp, Homo sapiens
aaactattcagtgct

SEQ ID NO: 215533 - DNA, 15 bp, Homo sapiens
gaaactattcagtgc

SEQ ID NO: 215534 - DNA, 15 bp, Homo sapiens
tgaaactattcagtg

SEQ ID NO: 215535 - DNA, 15 bp, Homo sapiens
ttgaaactattcagt

SEQ ID NO: 215536 - DNA, 15 bp, Homo sapiens
tttgaaactattcag

SEQ ID NO: 215537 - DNA, 15 bp, Homo sapiens
ttttgaaactattca

SEQ ID NO: 215538 - DNA, 15 bp, Homo sapiens
attttgaaactattc

SEQ ID NO: 215539 - DNA, 15 bp, Homo sapiens
tattttgaaactatt

SEQ ID NO: 215540 - DNA, 15 bp, Homo sapiens
atattttgaaactat

SEQ ID NO: 215541 - DNA, 15 bp, Homo sapiens
gatattttgaaacta

SEQ ID NO: 215542 - DNA, 15 bp, Homo sapiens
agatattttgaaact

SEQ ID NO: 215543 - DNA, 15 bp, Homo sapiens
aagatattttgaaac

SEQ ID NO: 215544 - DNA, 15 bp, Homo sapiens
aaagatattttgaaa

SEQ ID NO: 215545 - DNA, 15 bp, Homo sapiens
aaaagatattttgaa

SEQ ID NO: 215546 - DNA, 15 bp, Homo sapiens
gaaaagatattttga

SEQ ID NO: 215547 - DNA, 15 bp, Homo sapiens
tgaaaagatattttg

SEQ ID NO: 215548 - DNA, 15 bp, Homo sapiens
atgaaaagatatttt

SEQ ID NO: 215549 - DNA, 15 bp, Homo sapiens
aatgaaaagatattt

SEQ ID NO: 215550 - DNA, 15 bp, Homo sapiens
gaatgaaaagatatt

SEQ ID NO: 215551 - DNA, 15 bp, Homo sapiens
tgaatgaaaagatat

SEQ ID NO: 215552 - DNA, 15 bp, Homo sapiens
gtgaatgaaaagata

SEQ ID NO: 215553 - DNA, 15 bp, Homo sapiens
agtgaatgaaaagat

SEQ ID NO: 215554 - DNA, 15 bp, Homo sapiens
cagtgaatgaaaaga

SEQ ID NO: 215555 - DNA, 15 bp, Homo sapiens
acagtgaatgaaaag

SEQ ID NO: 215556 - DNA, 15 bp, Homo sapiens
gacagtgaatgaaaa

SEQ ID NO: 215557 - DNA, 15 bp, Homo sapiens
agacagtgaatgaaa

SEQ ID NO: 215558 - DNA, 15 bp, Homo sapiens
gagacagtgaatgaa

SEQ ID NO: 215559 - DNA, 15 bp, Homo sapiens
tgagacagtgaatga

SEQ ID NO: 215560 - DNA, 15 bp, Homo sapiens
gtgagacagtgaatg

SEQ ID NO: 215561 - DNA, 15 bp, Homo sapiens
ggtgagacagtgaat

SEQ ID NO: 215562 - DNA, 15 bp, Homo sapiens
tggtgagacagtgaa

SEQ ID NO: 215563 - DNA, 15 bp, Homo sapiens
ctggtgagacagtga

SEQ ID NO: 215564 - DNA, 15 bp, Homo sapiens
actggtgagacagtg

SEQ ID NO: 215565 - DNA, 15 bp, Homo sapiens
cactggtgagacagt

SEQ ID NO: 215566 - DNA, 15 bp, Homo sapiens
tcactggtgagacag

SEQ ID NO: 215567 - DNA, 15 bp, Homo sapiens
ttcactggtgagaca

SEQ ID NO: 215568 - DNA, 15 bp, Homo sapiens
cttcactggtgagac

SEQ ID NO: 215569 - DNA, 15 bp, Homo sapiens
acttcactggtgaga

SEQ ID NO: 215570 - DNA, 15 bp, Homo sapiens
aacttcactggtgag

SEQ ID NO: 215571 - DNA, 15 bp, Homo sapiens
taacttcactggtga

SEQ ID NO: 215572 - DNA, 15 bp, Homo sapiens
ctaacttcactggtg

SEQ ID NO: 215573 - DNA, 15 bp, Homo sapiens
actaacttcactggt

SEQ ID NO: 215574 - DNA, 15 bp, Homo sapiens
tactaacttcactgg

SEQ ID NO: 215575 - DNA, 15 bp, Homo sapiens
ttactaacttcactg

SEQ ID NO: 215576 - DNA, 15 bp, Homo sapiens
tttactaacttcact

SEQ ID NO: 215577 - DNA, 15 bp, Homo sapiens
ttttactaacttcac

SEQ ID NO: 215578 - DNA, 15 bp, Homo sapiens
attttactaacttca

SEQ ID NO: 215579 - DNA, 15 bp, Homo sapiens
cattttactaacttc

SEQ ID NO: 215580 - DNA, 15 bp, Homo sapiens
tcattttactaactt

SEQ ID NO: 215581 - DNA, 15 bp, Homo sapiens
ctcattttactaact

SEQ ID NO: 215582 - DNA, 15 bp, Homo sapiens
tctcattttactaac

SEQ ID NO: 215583 - DNA, 15 bp, Homo sapiens
ctctcattttactaa

SEQ ID NO: 215584 - DNA, 15 bp, Homo sapiens
tctctcattttacta

SEQ ID NO: 215585 - DNA, 15 bp, Homo sapiens
ctctctcattttact

SEQ ID NO: 215586 - DNA, 15 bp, Homo sapiens
tctctctcattttac

SEQ ID NO: 215587 - DNA, 15 bp, Homo sapiens
atctctctcatttta

SEQ ID NO: 215588 - DNA, 15 bp, Homo sapiens
catctctctcatttt

SEQ ID NO: 215589 - DNA, 15 bp, Homo sapiens
tcatctctctcattt

SEQ ID NO: 215590 - DNA, 15 bp, Homo sapiens
atcatctctctcatt

SEQ ID NO: 215591 - DNA, 15 bp, Homo sapiens
aatcatctctctcat

SEQ ID NO: 215592 - DNA, 15 bp, Homo sapiens
taatcatctctctca

SEQ ID NO: 215593 - DNA, 15 bp, Homo sapiens
ttaatcatctctctc

SEQ ID NO: 215594 - DNA, 15 bp, Homo sapiens
gttaatcatctctct

SEQ ID NO: 215595 - DNA, 15 bp, Homo sapiens
tgttaatcatctctc

SEQ ID NO: 215596 - DNA, 15 bp, Homo sapiens
gtgttaatcatctct

SEQ ID NO: 215597 - DNA, 15 bp, Homo sapiens
cgtgttaatcatctc

SEQ ID NO: 215598 - DNA, 15 bp, Homo sapiens
gcgtgttaatcatct

SEQ ID NO: 215599 - DNA, 15 bp, Homo sapiens
tgcgtgttaatcatc

SEQ ID NO: 215600 - DNA, 15 bp, Homo sapiens
ctgcgtgttaatcat

SEQ ID NO: 215601 - DNA, 15 bp, Homo sapiens
tctgcgtgttaatca

SEQ ID NO: 215602 - DNA, 15 bp, Homo sapiens
ctctgcgtgttaatc

SEQ ID NO: 215603 - DNA, 15 bp, Homo sapiens
tctctgcgtgttaat

SEQ ID NO: 215604 - DNA, 15 bp, Homo sapiens
ttctctgcgtgttaa

SEQ ID NO: 215605 - DNA, 15 bp, Homo sapiens
attctctgcgtgtta

SEQ ID NO: 215606 - DNA, 15 bp, Homo sapiens
aattctctgcgtgtt

SEQ ID NO: 215607 - DNA, 15 bp, Homo sapiens
aaattctctgcgtgt

SEQ ID NO: 215608 - DNA, 15 bp, Homo sapiens
taaattctctgcgtg

SEQ ID NO: 215609 - DNA, 15 bp, Homo sapiens
ttaaattctctgcgt

SEQ ID NO: 215610 - DNA, 15 bp, Homo sapiens
cttaaattctctgcg

SEQ ID NO: 215611 - DNA, 15 bp, Homo sapiens
ccttaaattctctgc

SEQ ID NO: 215612 - DNA, 15 bp, Homo sapiens
cccttaaattctctg

SEQ ID NO: 215613 - DNA, 15 bp, Homo sapiens
tcccttaaattctct

SEQ ID NO: 215614 - DNA, 15 bp, Homo sapiens
gtcccttaaattctc

SEQ ID NO: 215615 - DNA, 15 bp, Homo sapiens
tgtcccttaaattct

SEQ ID NO: 215616 - DNA, 15 bp, Homo sapiens
ttgtcccttaaattc

SEQ ID NO: 215617 - DNA, 15 bp, Homo sapiens
tttgtcccttaaatt

SEQ ID NO: 215618 - DNA, 15 bp, Homo sapiens
gtttgtcccttaaat

SEQ ID NO: 215619 - DNA, 15 bp, Homo sapiens
ggtttgtcccttaaa

SEQ ID NO: 215620 - DNA, 15 bp, Homo sapiens
gggtttgtcccttaa

SEQ ID NO: 215621 - DNA, 15 bp, Homo sapiens
tgggtttgtccctta

SEQ ID NO: 215622 - DNA, 15 bp, Homo sapiens
ttgggtttgtccctt

SEQ ID NO: 215623 - DNA, 15 bp, Homo sapiens
cttgggtttgtccct

SEQ ID NO: 215624 - DNA, 15 bp, Homo sapiens
acttgggtttgtccc

SEQ ID NO: 215625 - DNA, 15 bp, Homo sapiens
tacttgggtttgtcc

SEQ ID NO: 215626 - DNA, 15 bp, Homo sapiens
ttacttgggtttgtc

SEQ ID NO: 215627 - DNA, 15 bp, Homo sapiens
cttacttgggtttgt

SEQ ID NO: 215628 - DNA, 15 bp, Homo sapiens
ccttacttgggtttg

SEQ ID NO: 215629 - DNA, 15 bp, Homo sapiens
cccttacttgggttt

SEQ ID NO: 215630 - DNA, 15 bp, Homo sapiens
gcccttacttgggtt

SEQ ID NO: 215631 - DNA, 15 bp, Homo sapiens
ggcccttacttgggt

SEQ ID NO: 215632 - DNA, 15 bp, Homo sapiens
gggcccttacttggg

SEQ ID NO: 215633 - DNA, 15 bp, Homo sapiens
tgggcccttacttgg

SEQ ID NO: 215634 - DNA, 15 bp, Homo sapiens
atgggcccttacttg

SEQ ID NO: 215635 - DNA, 15 bp, Homo sapiens
catgggcccttactt

SEQ ID NO: 215636 - DNA, 15 bp, Homo sapiens
tcatgggcccttact

SEQ ID NO: 215637 - DNA, 15 bp, Homo sapiens
ctcatgggcccttac

SEQ ID NO: 215638 - DNA, 15 bp, Homo sapiens
gctcatgggccctta

SEQ ID NO: 215639 - DNA, 15 bp, Homo sapiens
tgctcatgggccctt

SEQ ID NO: 215640 - DNA, 15 bp, Homo sapiens
gtgctcatgggccct

SEQ ID NO: 215641 - DNA, 15 bp, Homo sapiens
tgtgctcatgggccc

SEQ ID NO: 215642 - DNA, 15 bp, Homo sapiens
ctgtgctcatgggcc

SEQ ID NO: 215643 - DNA, 15 bp, Homo sapiens
cctgtgctcatgggc

SEQ ID NO: 215644 - DNA, 15 bp, Homo sapiens
tcctgtgctcatggg

SEQ ID NO: 215645 - DNA, 15 bp, Homo sapiens
atcctgtgctcatgg

SEQ ID NO: 215646 - DNA, 15 bp, Homo sapiens
catcctgtgctcatg

SEQ ID NO: 215647 - DNA, 15 bp, Homo sapiens
tcatcctgtgctcat

SEQ ID NO: 215648 - DNA, 15 bp, Homo sapiens
ctcatcctgtgctca

SEQ ID NO: 215649 - DNA, 15 bp, Homo sapiens
actcatcctgtgctc

SEQ ID NO: 215650 - DNA, 15 bp, Homo sapiens
tactcatcctgtgct

SEQ ID NO: 215651 - DNA, 15 bp, Homo sapiens
ttactcatcctgtgc

SEQ ID NO: 215652 - DNA, 15 bp, Homo sapiens
cttactcatcctgtg

SEQ ID NO: 215653 - DNA, 15 bp, Homo sapiens
ccttactcatcctgt

SEQ ID NO: 215654 - DNA, 15 bp, Homo sapiens
cccttactcatcctg

SEQ ID NO: 215655 - DNA, 15 bp, Homo sapiens
acccttactcatcct

SEQ ID NO: 215656 - DNA, 15 bp, Homo sapiens
cacccttactcatcc

SEQ ID NO: 215657 - DNA, 15 bp, Homo sapiens
acacccttactcatc

SEQ ID NO: 215658 - DNA, 15 bp, Homo sapiens
cacacccttactcat

SEQ ID NO: 215659 - DNA, 15 bp, Homo sapiens
gcacacccttactca

SEQ ID NO: 215660 - DNA, 15 bp, Homo sapiens
ggcacacccttactc

SEQ ID NO: 215661 - DNA, 15 bp, Homo sapiens
aggcacacccttact

SEQ ID NO: 215662 - DNA, 15 bp, Homo sapiens
caggcacacccttac

SEQ ID NO: 215663 - DNA, 15 bp, Homo sapiens
acaggcacaccctta

SEQ ID NO: 215664 - DNA, 15 bp, Homo sapiens
cacaggcacaccctt

SEQ ID NO: 215665 - DNA, 15 bp, Homo sapiens
acacaggcacaccct

SEQ ID NO: 215666 - DNA, 15 bp, Homo sapiens
cacacaggcacaccc

SEQ ID NO: 215667 - DNA, 15 bp, Homo sapiens
ccacacaggcacacc

SEQ ID NO: 215668 - DNA, 15 bp, Homo sapiens
accacacaggcacac

SEQ ID NO: 215669 - DNA, 15 bp, Homo sapiens
taccacacaggcaca

SEQ ID NO: 215670 - DNA, 15 bp, Homo sapiens
ataccacacaggcac

SEQ ID NO: 215671 - DNA, 15 bp, Homo sapiens
cataccacacaggca

SEQ ID NO: 215672 - DNA, 15 bp, Homo sapiens
ccataccacacaggc

SEQ ID NO: 215673 - DNA, 15 bp, Homo sapiens
tccataccacacagg

SEQ ID NO: 215674 - DNA, 15 bp, Homo sapiens
gtccataccacacag

SEQ ID NO: 215675 - DNA, 15 bp, Homo sapiens
agtccataccacaca

SEQ ID NO: 215676 - DNA, 15 bp, Homo sapiens
cagtccataccacac

SEQ ID NO: 215677 - DNA, 15 bp, Homo sapiens
ccagtccataccaca

SEQ ID NO: 215678 - DNA, 15 bp, Homo sapiens
tccagtccataccac

SEQ ID NO: 215679 - DNA, 15 bp, Homo sapiens
gtccagtccatacca

SEQ ID NO: 215680 - DNA, 15 bp, Homo sapiens
agtccagtccatacc

SEQ ID NO: 215681 - DNA, 15 bp, Homo sapiens
cagtccagtccatac

SEQ ID NO: 215682 - DNA, 15 bp, Homo sapiens
acagtccagtccata

SEQ ID NO: 215683 - DNA, 15 bp, Homo sapiens
tacagtccagtccat

SEQ ID NO: 215684 - DNA, 15 bp, Homo sapiens
gtacagtccagtcca

SEQ ID NO: 215685 - DNA, 15 bp, Homo sapiens
ggtacagtccagtcc

SEQ ID NO: 215686 - DNA, 15 bp, Homo sapiens
aggtacagtccagtc

SEQ ID NO: 215687 - DNA, 15 bp, Homo sapiens
taggtacagtccagt

SEQ ID NO: 215688 - DNA, 15 bp, Homo sapiens
ttaggtacagtccag

SEQ ID NO: 215689 - DNA, 15 bp, Homo sapiens
cttaggtacagtcca

SEQ ID NO: 215690 - DNA, 15 bp, Homo sapiens
ccttaggtacagtcc

SEQ ID NO: 215691 - DNA, 15 bp, Homo sapiens
gccttaggtacagtc

SEQ ID NO: 215692 - DNA, 15 bp, Homo sapiens
agccttaggtacagt

SEQ ID NO: 215693 - DNA, 15 bp, Homo sapiens
aagccttaggtacag

SEQ ID NO: 215694 - DNA, 15 bp, Homo sapiens
aaagccttaggtaca

SEQ ID NO: 215695 - DNA, 15 bp, Homo sapiens
caaagccttaggtac

SEQ ID NO: 215696 - DNA, 15 bp, Homo sapiens
ccaaagccttaggta

SEQ ID NO: 215697 - DNA, 15 bp, Homo sapiens
gccaaagccttaggt

SEQ ID NO: 215698 - DNA, 15 bp, Homo sapiens
agccaaagccttagg

SEQ ID NO: 215699 - DNA, 15 bp, Homo sapiens
cagccaaagccttag

SEQ ID NO: 215700 - DNA, 15 bp, Homo sapiens
gcagccaaagcctta

SEQ ID NO: 215701 - DNA, 15 bp, Homo sapiens
tgcagccaaagcctt

SEQ ID NO: 215702 - DNA, 15 bp, Homo sapiens
ttgcagccaaagcct

SEQ ID NO: 215703 - DNA, 15 bp, Homo sapiens
tttgcagccaaagcc

SEQ ID NO: 215704 - DNA, 15 bp, Homo sapiens
atttgcagccaaagc

SEQ ID NO: 215705 - DNA, 15 bp, Homo sapiens
gatttgcagccaaag

SEQ ID NO: 215706 - DNA, 15 bp, Homo sapiens
agatttgcagccaaa

SEQ ID NO: 215707 - DNA, 15 bp, Homo sapiens
aagatttgcagccaa

SEQ ID NO: 215708 - DNA, 15 bp, Homo sapiens
aaagatttgcagcca

SEQ ID NO: 215709 - DNA, 15 bp, Homo sapiens
caaagatttgcagcc

SEQ ID NO: 215710 - DNA, 15 bp, Homo sapiens
acaaagatttgcagc

SEQ ID NO: 215711 - DNA, 15 bp, Homo sapiens
gacaaagatttgcag

SEQ ID NO: 215712 - DNA, 15 bp, Homo sapiens
agacaaagatttgca

SEQ ID NO: 215713 - DNA, 15 bp, Homo sapiens
cagacaaagatttgc

SEQ ID NO: 215714 - DNA, 15 bp, Homo sapiens
ccagacaaagatttg

SEQ ID NO: 215715 - DNA, 15 bp, Homo sapiens
accagacaaagattt

SEQ ID NO: 215716 - DNA, 15 bp, Homo sapiens
aaccagacaaagatt

SEQ ID NO: 215717 - DNA, 15 bp, Homo sapiens
aaaccagacaaagat

SEQ ID NO: 215718 - DNA, 15 bp, Homo sapiens
aaaaccagacaaaga

SEQ ID NO: 215719 - DNA, 15 bp, Homo sapiens
taaaaccagacaaag

SEQ ID NO: 215720 - DNA, 15 bp, Homo sapiens
gtaaaaccagacaaa

SEQ ID NO: 215721 - DNA, 15 bp, Homo sapiens
agtaaaaccagacaa

SEQ ID NO: 215722 - DNA, 15 bp, Homo sapiens
aagtaaaaccagaca

SEQ ID NO: 215723 - DNA, 15 bp, Homo sapiens
aaagtaaaaccagac

SEQ ID NO: 215724 - DNA, 15 bp, Homo sapiens
taaagtaaaaccaga

SEQ ID NO: 215725 - DNA, 15 bp, Homo sapiens
gtaaagtaaaaccag

SEQ ID NO: 215726 - DNA, 15 bp, Homo sapiens
ggtaaagtaaaacca

SEQ ID NO: 215727 - DNA, 15 bp, Homo sapiens
tggtaaagtaaaacc

SEQ ID NO: 215728 - DNA, 15 bp, Homo sapiens
gtggtaaagtaaaac

SEQ ID NO: 215729 - DNA, 15 bp, Homo sapiens
tgtggtaaagtaaaa

SEQ ID NO: 215730 - DNA, 15 bp, Homo sapiens
ctgtggtaaagtaaa

SEQ ID NO: 215731 - DNA, 15 bp, Homo sapiens
tctgtggtaaagtaa

SEQ ID NO: 215732 - DNA, 15 bp, Homo sapiens
ttctgtggtaaagta

SEQ ID NO: 215733 - DNA, 15 bp, Homo sapiens
gttctgtggtaaagt

SEQ ID NO: 215734 - DNA, 15 bp, Homo sapiens
tgttctgtggtaaag

SEQ ID NO: 215735 - DNA, 15 bp, Homo sapiens
ctgttctgtggtaaa

SEQ ID NO: 215736 - DNA, 15 bp, Homo sapiens
actgttctgtggtaa

SEQ ID NO: 215737 - DNA, 15 bp, Homo sapiens
tactgttctgtggta

SEQ ID NO: 215738 - DNA, 15 bp, Homo sapiens
atactgttctgtggt

SEQ ID NO: 215739 - DNA, 15 bp, Homo sapiens
aatactgttctgtgg

SEQ ID NO: 215740 - DNA, 15 bp, Homo sapiens
aaatactgttctgtg

SEQ ID NO: 215741 - DNA, 15 bp, Homo sapiens
aaaatactgttctgt

SEQ ID NO: 215742 - DNA, 15 bp, Homo sapiens
aaaaatactgttctg

SEQ ID NO: 215743 - DNA, 15 bp, Homo sapiens
taaaaatactgttct

SEQ ID NO: 215744 - DNA, 15 bp, Homo sapiens
ttaaaaatactgttc

SEQ ID NO: 215745 - DNA, 15 bp, Homo sapiens
gttaaaaatactgtt

SEQ ID NO: 215746 - DNA, 15 bp, Homo sapiens
tgttaaaaatactgt

SEQ ID NO: 215747 - DNA, 15 bp, Homo sapiens
atgttaaaaatactg

SEQ ID NO: 215748 - DNA, 15 bp, Homo sapiens
gatgttaaaaatact

SEQ ID NO: 215749 - DNA, 15 bp, Homo sapiens
agatgttaaaaatac

SEQ ID NO: 215750 - DNA, 15 bp, Homo sapiens
gagatgttaaaaata

SEQ ID NO: 215751 - DNA, 15 bp, Homo sapiens
ggagatgttaaaaat

SEQ ID NO: 215752 - DNA, 15 bp, Homo sapiens
aggagatgttaaaaa

SEQ ID NO: 215753 - DNA, 15 bp, Homo sapiens
gaggagatgttaaaa

SEQ ID NO: 215754 - DNA, 15 bp, Homo sapiens
ggaggagatgttaaa

SEQ ID NO: 215755 - DNA, 15 bp, Homo sapiens
aggaggagatgttaa

SEQ ID NO: 215756 - DNA, 15 bp, Homo sapiens
aaggaggagatgtta

SEQ ID NO: 215757 - DNA, 15 bp, Homo sapiens
gaaggaggagatgtt

SEQ ID NO: 215758 - DNA, 15 bp, Homo sapiens
tgaaggaggagatgt

SEQ ID NO: 215759 - DNA, 15 bp, Homo sapiens
atgaaggaggagatg

SEQ ID NO: 215760 - DNA, 15 bp, Homo sapiens
aatgaaggaggagat

SEQ ID NO: 215761 - DNA, 15 bp, Homo sapiens
gaatgaaggaggaga

SEQ ID NO: 215762 - DNA, 15 bp, Homo sapiens
tgaatgaaggaggag

SEQ ID NO: 215763 - DNA, 15 bp, Homo sapiens
atgaatgaaggagga

SEQ ID NO: 215764 - DNA, 15 bp, Homo sapiens
tatgaatgaaggagg

SEQ ID NO: 215765 - DNA, 15 bp, Homo sapiens
gtatgaatgaaggag

SEQ ID NO: 215766 - DNA, 15 bp, Homo sapiens
tgtatgaatgaagga

SEQ ID NO: 215767 - DNA, 15 bp, Homo sapiens
ttgtatgaatgaagg

SEQ ID NO: 215768 - DNA, 15 bp, Homo sapiens
tttgtatgaatgaag

SEQ ID NO: 215769 - DNA, 15 bp, Homo sapiens
ttttgtatgaatgaa

SEQ ID NO: 215770 - DNA, 15 bp, Homo sapiens
tttttgtatgaatga

SEQ ID NO: 215771 - DNA, 15 bp, Homo sapiens
atttttgtatgaatg

SEQ ID NO: 215772 - DNA, 15 bp, Homo sapiens
aatttttgtatgaat

SEQ ID NO: 215773 - DNA, 15 bp, Homo sapiens
aaatttttgtatgaa

SEQ ID NO: 215774 - DNA, 15 bp, Homo sapiens
taaatttttgtatga

SEQ ID NO: 215775 - DNA, 15 bp, Homo sapiens
ataaatttttgtatg

SEQ ID NO: 215776 - DNA, 15 bp, Homo sapiens
aataaatttttgtat

SEQ ID NO: 215777 - DNA, 15 bp, Homo sapiens
caataaatttttgta

SEQ ID NO: 215778 - DNA, 15 bp, Homo sapiens
ccaataaatttttgt

SEQ ID NO: 215779 - DNA, 15 bp, Homo sapiens
gccaataaatttttg

SEQ ID NO: 215780 - DNA, 15 bp, Homo sapiens
agccaataaattttt

SEQ ID NO: 215781 - DNA, 15 bp, Homo sapiens
aaagccaataaattt

SEQ ID NO: 215782 - DNA, 15 bp, Homo sapiens
gaaagccaataaatt

SEQ ID NO: 215783 - DNA, 15 bp, Homo sapiens
ggaaagccaataaat

SEQ ID NO: 215784 - DNA, 15 bp, Homo sapiens
cggaaagccaataaa

SEQ ID NO: 215785 - DNA, 15 bp, Homo sapiens
gcggaaagccaataa

SEQ ID NO: 215786 - DNA, 15 bp, Homo sapiens
agcggaaagccaata

SEQ ID NO: 215787 - DNA, 15 bp, Homo sapiens
tagcggaaagccaat

SEQ ID NO: 215788 - DNA, 15 bp, Homo sapiens
atagcggaaagccaa

SEQ ID NO: 215789 - DNA, 15 bp, Homo sapiens
tatagcggaaagcca

SEQ ID NO: 215790 - DNA, 15 bp, Homo sapiens
gtatagcggaaagcc

SEQ ID NO: 215791 - DNA, 15 bp, Homo sapiens
ggtatagcggaaagc

SEQ ID NO: 215792 - DNA, 15 bp, Homo sapiens
aggtatagcggaaag

SEQ ID NO: 215793 - DNA, 15 bp, Homo sapiens
caggtatagcggaaa

SEQ ID NO: 215794 - DNA, 15 bp, Homo sapiens
gcaggtatagcggaa

SEQ ID NO: 215795 - DNA, 15 bp, Homo sapiens
agcaggtatagcgga

SEQ ID NO: 215796 - DNA, 15 bp, Homo sapiens
gagcaggtatagcgg

SEQ ID NO: 215797 - DNA, 15 bp, Homo sapiens
agagcaggtatagcg

SEQ ID NO: 215798 - DNA, 15 bp, Homo sapiens
cagagcaggtatagc

SEQ ID NO: 215799 - DNA, 15 bp, Homo sapiens
ccagagcaggtatag

SEQ ID NO: 215800 - DNA, 15 bp, Homo sapiens
gccagagcaggtata

SEQ ID NO: 215801 - DNA, 15 bp, Homo sapiens
tgccagagcaggtat

SEQ ID NO: 215802 - DNA, 15 bp, Homo sapiens
gtgccagagcaggta

SEQ ID NO: 215803 - DNA, 15 bp, Homo sapiens
tgtgccagagcaggt

SEQ ID NO: 215804 - DNA, 15 bp, Homo sapiens
ttgtgccagagcagg

SEQ ID NO: 215805 - DNA, 15 bp, Homo sapiens
tttgtgccagagcag

SEQ ID NO: 215806 - DNA, 15 bp, Homo sapiens
atttgtgccagagca

SEQ ID NO: 215807 - DNA, 15 bp, Homo sapiens
aatttgtgccagagc

SEQ ID NO: 215808 - DNA, 15 bp, Homo sapiens
aaatttgtgccagag

SEQ ID NO: 215809 - DNA, 15 bp, Homo sapiens
gaaatttgtgccaga

SEQ ID NO: 215810 - DNA, 15 bp, Homo sapiens
tgaaatttgtgccag

SEQ ID NO: 215811 - DNA, 15 bp, Homo sapiens
ctgaaatttgtgcca

SEQ ID NO: 215812 - DNA, 15 bp, Homo sapiens
gctgaaatttgtgcc

SEQ ID NO: 215813 - DNA, 15 bp, Homo sapiens
ggctgaaatttgtgc

SEQ ID NO: 215814 - DNA, 15 bp, Homo sapiens
aggctgaaatttgtg

SEQ ID NO: 215815 - DNA, 15 bp, Homo sapiens
aaggctgaaatttgt

SEQ ID NO: 215816 - DNA, 15 bp, Homo sapiens
gaaggctgaaatttg

SEQ ID NO: 215817 - DNA, 15 bp, Homo sapiens
ggaaggctgaaattt

SEQ ID NO: 215818 - DNA, 15 bp, Homo sapiens
tggaaggctgaaatt

SEQ ID NO: 215819 - DNA, 15 bp, Homo sapiens
atggaaggctgaaat

SEQ ID NO: 215820 - DNA, 15 bp, Homo sapiens
catggaaggctgaaa

SEQ ID NO: 215821 - DNA, 15 bp, Homo sapiens
tcatggaaggctgaa

SEQ ID NO: 215822 - DNA, 15 bp, Homo sapiens
ctcatggaaggctga

SEQ ID NO: 215823 - DNA, 15 bp, Homo sapiens
cctcatggaaggctg

SEQ ID NO: 215824 - DNA, 15 bp, Homo sapiens
ccctcatggaaggct

SEQ ID NO: 215825 - DNA, 15 bp, Homo sapiens
gccctcatggaaggc

SEQ ID NO: 215826 - DNA, 15 bp, Homo sapiens
agccctcatggaagg

SEQ ID NO: 215827 - DNA, 15 bp, Homo sapiens
gagccctcatggaag

SEQ ID NO: 215828 - DNA, 15 bp, Homo sapiens
tgagccctcatggaa

SEQ ID NO: 215829 - DNA, 15 bp, Homo sapiens
ctgagccctcatgga

SEQ ID NO: 215830 - DNA, 15 bp, Homo sapiens
actgagccctcatgg

SEQ ID NO: 215831 - DNA, 15 bp, Homo sapiens
gactgagccctcatg

SEQ ID NO: 215832 - DNA, 15 bp, Homo sapiens
agactgagccctcat

SEQ ID NO: 215833 - DNA, 15 bp, Homo sapiens
cagactgagccctca

SEQ ID NO: 215834 - DNA, 15 bp, Homo sapiens
ccagactgagccctc

SEQ ID NO: 215835 - DNA, 15 bp, Homo sapiens
gccagactgagccct

SEQ ID NO: 215836 - DNA, 15 bp, Homo sapiens
tgccagactgagccc

SEQ ID NO: 215837 - DNA, 15 bp, Homo sapiens
gtgccagactgagcc

SEQ ID NO: 215838 - DNA, 15 bp, Homo sapiens
ggtgccagactgagc

SEQ ID NO: 215839 - DNA, 15 bp, Homo sapiens
tggtgccagactgag

SEQ ID NO: 215840 - DNA, 15 bp, Homo sapiens
ctggtgccagactga

SEQ ID NO: 215841 - DNA, 15 bp, Homo sapiens
tctggtgccagactg

SEQ ID NO: 215842 - DNA, 15 bp, Homo sapiens
ctctggtgccagact

SEQ ID NO: 215843 - DNA, 15 bp, Homo sapiens
actctggtgccagac

SEQ ID NO: 215844 - DNA, 15 bp, Homo sapiens
gactctggtgccaga

SEQ ID NO: 215845 - DNA, 15 bp, Homo sapiens
tgactctggtgccag

SEQ ID NO: 215846 - DNA, 15 bp, Homo sapiens
ctgactctggtgcca

SEQ ID NO: 215847 - DNA, 15 bp, Homo sapiens
cctgactctggtgcc

SEQ ID NO: 215848 - DNA, 15 bp, Homo sapiens
acctgactctggtgc

SEQ ID NO: 215849 - DNA, 15 bp, Homo sapiens
aacctgactctggtg

SEQ ID NO: 215850 - DNA, 15 bp, Homo sapiens
aaacctgactctggt

SEQ ID NO: 215851 - DNA, 15 bp, Homo sapiens
caaacctgactctgg

SEQ ID NO: 215852 - DNA, 15 bp, Homo sapiens
gcaaacctgactctg

SEQ ID NO: 215853 - DNA, 15 bp, Homo sapiens
tgcaaacctgactct

SEQ ID NO: 215854 - DNA, 15 bp, Homo sapiens
ttgcaaacctgactc

SEQ ID NO: 215855 - DNA, 15 bp, Homo sapiens
tttgcaaacctgact

SEQ ID NO: 215856 - DNA, 15 bp, Homo sapiens
ctttgcaaacctgac

SEQ ID NO: 215857 - DNA, 15 bp, Homo sapiens
tctttgcaaacctga

SEQ ID NO: 215858 - DNA, 15 bp, Homo sapiens
ctctttgcaaacctg

SEQ ID NO: 215859 - DNA, 15 bp, Homo sapiens
cctctttgcaaacct

SEQ ID NO: 215860 - DNA, 15 bp, Homo sapiens
gcctctttgcaaacc

SEQ ID NO: 215861 - DNA, 15 bp, Homo sapiens
ggcctctttgcaaac

SEQ ID NO: 215862 - DNA, 15 bp, Homo sapiens
tggcctctttgcaaa

SEQ ID NO: 215863 - DNA, 15 bp, Homo sapiens
atggcctctttgcaa

SEQ ID NO: 215864 - DNA, 15 bp, Homo sapiens
catggcctctttgca

SEQ ID NO: 215865 - DNA, 15 bp, Homo sapiens
ccatggcctctttgc

SEQ ID NO: 215866 - DNA, 15 bp, Homo sapiens
accatggcctctttg

SEQ ID NO: 215867 - DNA, 15 bp, Homo sapiens
caccatggcctcttt

SEQ ID NO: 215868 - DNA, 15 bp, Homo sapiens
tcaccatggcctctt

SEQ ID NO: 215869 - DNA, 15 bp, Homo sapiens
ctcaccatggcctct

SEQ ID NO: 215870 - DNA, 15 bp, Homo sapiens
cctcaccatggcctc

SEQ ID NO: 215871 - DNA, 15 bp, Homo sapiens
ccctcaccatggcct

SEQ ID NO: 215872 - DNA, 15 bp, Homo sapiens
tccctcaccatggcc

SEQ ID NO: 215873 - DNA, 15 bp, Homo sapiens
ctccctcaccatggc

SEQ ID NO: 215874 - DNA, 15 bp, Homo sapiens
actccctcaccatgg

SEQ ID NO: 215875 - DNA, 15 bp, Homo sapiens
cactccctcaccatg

SEQ ID NO: 215876 - DNA, 15 bp, Homo sapiens
acactccctcaccat

SEQ ID NO: 215877 - DNA, 15 bp, Homo sapiens
cacactccctcacca

SEQ ID NO: 215878 - DNA, 15 bp, Homo sapiens
ccacactccctcacc

SEQ ID NO: 215879 - DNA, 15 bp, Homo sapiens
accacactccctcac

SEQ ID NO: 215880 - DNA, 15 bp, Homo sapiens
caccacactccctca

SEQ ID NO: 215881 - DNA, 15 bp, Homo sapiens
tcaccacactccctc

SEQ ID NO: 215882 - DNA, 15 bp, Homo sapiens
ttcaccacactccct

SEQ ID NO: 215883 - DNA, 15 bp, Homo sapiens
attcaccacactccc

SEQ ID NO: 215884 - DNA, 15 bp, Homo sapiens
cattcaccacactcc

SEQ ID NO: 215885 - DNA, 15 bp, Homo sapiens
gcattcaccacactc

SEQ ID NO: 215886 - DNA, 15 bp, Homo sapiens
agcattcaccacact

SEQ ID NO: 215887 - DNA, 15 bp, Homo sapiens
cagcattcaccacac

SEQ ID NO: 215888 - DNA, 15 bp, Homo sapiens
ccagcattcaccaca

SEQ ID NO: 215889 - DNA, 15 bp, Homo sapiens
tccagcattcaccac

SEQ ID NO: 215890 - DNA, 15 bp, Homo sapiens
atccagcattcacca

SEQ ID NO: 215891 - DNA, 15 bp, Homo sapiens
gatccagcattcacc

SEQ ID NO: 215892 - DNA, 15 bp, Homo sapiens
ggatccagcattcac

SEQ ID NO: 215893 - DNA, 15 bp, Homo sapiens
gggatccagcattca

SEQ ID NO: 215894 - DNA, 15 bp, Homo sapiens
ggggatccagcattc

SEQ ID NO: 215895 - DNA, 15 bp, Homo sapiens
cggggatccagcatt

SEQ ID NO: 215896 - DNA, 15 bp, Homo sapiens
acggggatccagcat

SEQ ID NO: 215897 - DNA, 15 bp, Homo sapiens
cacggggatccagca

SEQ ID NO: 215898 - DNA, 15 bp, Homo sapiens
tcacggggatccagc

SEQ ID NO: 215899 - DNA, 15 bp, Homo sapiens
ctcacggggatccag

SEQ ID NO: 215900 - DNA, 15 bp, Homo sapiens
cctcacggggatcca

SEQ ID NO: 215901 - DNA, 15 bp, Homo sapiens
ccctcacggggatcc

SEQ ID NO: 215902 - DNA, 15 bp, Homo sapiens
tccctcacggggatc

SEQ ID NO: 215903 - DNA, 15 bp, Homo sapiens
ttccctcacggggat

SEQ ID NO: 215904 - DNA, 15 bp, Homo sapiens
cttccctcacgggga

SEQ ID NO: 215905 - DNA, 15 bp, Homo sapiens
ccttccctcacgggg

SEQ ID NO: 215906 - DNA, 15 bp, Homo sapiens
gccttccctcacggg

SEQ ID NO: 215907 - DNA, 15 bp, Homo sapiens
agccttccctcacgg

SEQ ID NO: 215908 - DNA, 15 bp, Homo sapiens
cagccttccctcacg

SEQ ID NO: 215909 - DNA, 15 bp, Homo sapiens
gcagccttccctcac

SEQ ID NO: 215910 - DNA, 15 bp, Homo sapiens
tgcagccttccctca

SEQ ID NO: 215911 - DNA, 15 bp, Homo sapiens
ctgcagccttccctc

SEQ ID NO: 215912 - DNA, 15 bp, Homo sapiens
gctgcagccttccct

SEQ ID NO: 215913 - DNA, 15 bp, Homo sapiens
agctgcagccttccc

SEQ ID NO: 215914 - DNA, 15 bp, Homo sapiens
gagctgcagccttcc

SEQ ID NO: 215915 - DNA, 15 bp, Homo sapiens
tgagctgcagccttc

SEQ ID NO: 215916 - DNA, 15 bp, Homo sapiens
atgagctgcagcctt

SEQ ID NO: 215917 - DNA, 15 bp, Homo sapiens
catgagctgcagcct

SEQ ID NO: 215918 - DNA, 15 bp, Homo sapiens
gcatgagctgcagcc

SEQ ID NO: 215919 - DNA, 15 bp, Homo sapiens
agcatgagctgcagc

SEQ ID NO: 215920 - DNA, 15 bp, Homo sapiens
cagcatgagctgcag

SEQ ID NO: 215921 - DNA, 15 bp, Homo sapiens
ccagcatgagctgca

SEQ ID NO: 215922 - DNA, 15 bp, Homo sapiens
accagcatgagctgc

SEQ ID NO: 215923 - DNA, 15 bp, Homo sapiens
caccagcatgagctg

SEQ ID NO: 215924 - DNA, 15 bp, Homo sapiens
ccaccagcatgagct

SEQ ID NO: 215925 - DNA, 15 bp, Homo sapiens
accaccagcatgagc

SEQ ID NO: 215926 - DNA, 15 bp, Homo sapiens
caccaccagcatgag

SEQ ID NO: 215927 - DNA, 15 bp, Homo sapiens
gcaccaccagcatga

SEQ ID NO: 215928 - DNA, 15 bp, Homo sapiens
tgcaccaccagcatg

SEQ ID NO: 215929 - DNA, 15 bp, Homo sapiens
ctgcaccaccagcat

SEQ ID NO: 215930 - DNA, 15 bp, Homo sapiens
cctgcaccaccagca

SEQ ID NO: 215931 - DNA, 15 bp, Homo sapiens
acctgcaccaccagc

SEQ ID NO: 215932 - DNA, 15 bp, Homo sapiens
cacctgcaccaccag

SEQ ID NO: 215933 - DNA, 15 bp, Homo sapiens
ccacctgcaccacca

SEQ ID NO: 215934 - DNA, 15 bp, Homo sapiens
gccacctgcaccacc

SEQ ID NO: 215935 - DNA, 15 bp, Homo sapiens
tgccacctgcaccac

SEQ ID NO: 215936 - DNA, 15 bp, Homo sapiens
gtgccacctgcacca

SEQ ID NO: 215937 - DNA, 15 bp, Homo sapiens
agtgccacctgcacc

SEQ ID NO: 215938 - DNA, 15 bp, Homo sapiens
cagtgccacctgcac

SEQ ID NO: 215939 - DNA, 15 bp, Homo sapiens
ccagtgccacctgca

SEQ ID NO: 215940 - DNA, 15 bp, Homo sapiens
tccagtgccacctgc

SEQ ID NO: 215941 - DNA, 15 bp, Homo sapiens
ctccagtgccacctg

SEQ ID NO: 215942 - DNA, 15 bp, Homo sapiens
gctccagtgccacct

SEQ ID NO: 215943 - DNA, 15 bp, Homo sapiens
ggctccagtgccacc

SEQ ID NO: 215944 - DNA, 15 bp, Homo sapiens
cggctccagtgccac

SEQ ID NO: 215945 - DNA, 15 bp, Homo sapiens
ccggctccagtgcca

SEQ ID NO: 215946 - DNA, 15 bp, Homo sapiens
tccggctccagtgcc

SEQ ID NO: 215947 - DNA, 15 bp, Homo sapiens
atccggctccagtgc

SEQ ID NO: 215948 - DNA, 15 bp, Homo sapiens
gatccggctccagtg

SEQ ID NO: 215949 - DNA, 15 bp, Homo sapiens
ggatccggctccagt

SEQ ID NO: 215950 - DNA, 15 bp, Homo sapiens
gggatccggctccag

SEQ ID NO: 215951 - DNA, 15 bp, Homo sapiens
agggatccggctcca

SEQ ID NO: 215952 - DNA, 15 bp, Homo sapiens
cagggatccggctcc

SEQ ID NO: 215953 - DNA, 15 bp, Homo sapiens
tcagggatccggctc

SEQ ID NO: 215954 - DNA, 15 bp, Homo sapiens
ttcagggatccggct

SEQ ID NO: 215955 - DNA, 15 bp, Homo sapiens
cttcagggatccggc

SEQ ID NO: 215956 - DNA, 15 bp, Homo sapiens
ccttcagggatccgg

SEQ ID NO: 215957 - DNA, 15 bp, Homo sapiens
cccttcagggatccg

SEQ ID NO: 215958 - DNA, 15 bp, Homo sapiens
acccttcagggatcc

SEQ ID NO: 215959 - DNA, 15 bp, Homo sapiens
gacccttcagggatc

SEQ ID NO: 215960 - DNA, 15 bp, Homo sapiens
tgacccttcagggat

SEQ ID NO: 215961 - DNA, 15 bp, Homo sapiens
ttgacccttcaggga

SEQ ID NO: 215962 - DNA, 15 bp, Homo sapiens
tttgacccttcaggg

SEQ ID NO: 215963 - DNA, 15 bp, Homo sapiens
ttttgacccttcagg

SEQ ID NO: 215964 - DNA, 15 bp, Homo sapiens
cttttgacccttcag

SEQ ID NO: 215965 - DNA, 15 bp, Homo sapiens
ccttttgacccttca

SEQ ID NO: 215966 - DNA, 15 bp, Homo sapiens
cccttttgacccttc

SEQ ID NO: 215967 - DNA, 15 bp, Homo sapiens
ccccttttgaccctt

SEQ ID NO: 215968 - DNA, 15 bp, Homo sapiens
accccttttgaccct

SEQ ID NO: 215969 - DNA, 15 bp, Homo sapiens
caccccttttgaccc

SEQ ID NO: 215970 - DNA, 15 bp, Homo sapiens
tcaccccttttgacc

SEQ ID NO: 215971 - DNA, 15 bp, Homo sapiens
ctcaccccttttgac

SEQ ID NO: 215972 - DNA, 15 bp, Homo sapiens
gctcaccccttttga

SEQ ID NO: 215973 - DNA, 15 bp, Homo sapiens
ggctcaccccttttg

SEQ ID NO: 215974 - DNA, 15 bp, Homo sapiens
gggctcacccctttt

SEQ ID NO: 215975 - DNA, 15 bp, Homo sapiens
agggctcaccccttt

SEQ ID NO: 215976 - DNA, 15 bp, Homo sapiens
cagggctcacccctt

SEQ ID NO: 215977 - DNA, 15 bp, Homo sapiens
acagggctcacccct

SEQ ID NO: 215978 - DNA, 15 bp, Homo sapiens
cacagggctcacccc

SEQ ID NO: 215979 - DNA, 15 bp, Homo sapiens
ccacagggctcaccc

SEQ ID NO: 215980 - DNA, 15 bp, Homo sapiens
tccacagggctcacc

SEQ ID NO: 215981 - DNA, 15 bp, Homo sapiens
atccacagggctcac

SEQ ID NO: 215982 - DNA, 15 bp, Homo sapiens
aatccacagggctca

SEQ ID NO: 215983 - DNA, 15 bp, Homo sapiens
gaaatccacagggct

SEQ ID NO: 215984 - DNA, 15 bp, Homo sapiens
agaaatccacagggc

SEQ ID NO: 215985 - DNA, 15 bp, Homo sapiens
aagaaatccacaggg

SEQ ID NO: 215986 - DNA, 15 bp, Homo sapiens
aaagaaatccacagg

SEQ ID NO: 215987 - DNA, 15 bp, Homo sapiens
caaagaaatccacag

SEQ ID NO: 215988 - DNA, 15 bp, Homo sapiens
tcaaagaaatccaca

SEQ ID NO: 215989 - DNA, 15 bp, Homo sapiens
gtcaaagaaatccac

SEQ ID NO: 215990 - DNA, 15 bp, Homo sapiens
agtcaaagaaatcca

SEQ ID NO: 215991 - DNA, 15 bp, Homo sapiens
aagtcaaagaaatcc

SEQ ID NO: 215992 - DNA, 15 bp, Homo sapiens
aaagtcaaagaaatc

SEQ ID NO: 215993 - DNA, 15 bp, Homo sapiens
gaaagtcaaagaaat

SEQ ID NO: 215994 - DNA, 15 bp, Homo sapiens
tgaaagtcaaagaaa

SEQ ID NO: 215995 - DNA, 15 bp, Homo sapiens
gtgaaagtcaaagaa

SEQ ID NO: 215996 - DNA, 15 bp, Homo sapiens
ggtgaaagtcaaaga

SEQ ID NO: 215997 - DNA, 15 bp, Homo sapiens
tggtgaaagtcaaag

SEQ ID NO: 215998 - DNA, 15 bp, Homo sapiens
ctggtgaaagtcaaa

SEQ ID NO: 215999 - DNA, 15 bp, Homo sapiens
actggtgaaagtcaa

SEQ ID NO: 216000 - DNA, 15 bp, Homo sapiens
cactggtgaaagtca

SEQ ID NO: 216001 - DNA, 15 bp, Homo sapiens
tcactggtgaaagtc

SEQ ID NO: 216002 - DNA, 15 bp, Homo sapiens
ctcactggtgaaagt

SEQ ID NO: 216003 - DNA, 15 bp, Homo sapiens
cctcactggtgaaag

SEQ ID NO: 216004 - DNA, 15 bp, Homo sapiens
ccctcactggtgaaa

SEQ ID NO: 216005 - DNA, 15 bp, Homo sapiens
accctcactggtgaa

SEQ ID NO: 216006 - DNA, 15 bp, Homo sapiens
gaccctcactggtga

SEQ ID NO: 216007 - DNA, 15 bp, Homo sapiens
tgaccctcactggtg

SEQ ID NO: 216008 - DNA, 15 bp, Homo sapiens
ttgaccctcactggt

SEQ ID NO: 216009 - DNA, 15 bp, Homo sapiens
attgaccctcactgg

SEQ ID NO: 216010 - DNA, 15 bp, Homo sapiens
cattgaccctcactg

SEQ ID NO: 216011 - DNA, 15 bp, Homo sapiens
tcattgaccctcact

SEQ ID NO: 216012 - DNA, 15 bp, Homo sapiens
ctcattgaccctcac

SEQ ID NO: 216013 - DNA, 15 bp, Homo sapiens
tctcattgaccctca

SEQ ID NO: 216014 - DNA, 15 bp, Homo sapiens
atctcattgaccctc

SEQ ID NO: 216015 - DNA, 15 bp, Homo sapiens
aatctcattgaccct

SEQ ID NO: 216016 - DNA, 15 bp, Homo sapiens
caatctcattgaccc

SEQ ID NO: 216017 - DNA, 15 bp, Homo sapiens
acaatctcattgacc

SEQ ID NO: 216018 - DNA, 15 bp, Homo sapiens
aacaatctcattgac

SEQ ID NO: 216019 - DNA, 15 bp, Homo sapiens
taacaatctcattga

SEQ ID NO: 216020 - DNA, 15 bp, Homo sapiens
ttaacaatctcattg

SEQ ID NO: 216021 - DNA, 15 bp, Homo sapiens
cttaacaatctcatt

SEQ ID NO: 216022 - DNA, 15 bp, Homo sapiens
tcttaacaatctcat

SEQ ID NO: 216023 - DNA, 15 bp, Homo sapiens
ttcttaacaatctca

SEQ ID NO: 216024 - DNA, 15 bp, Homo sapiens
tttcttaacaatctc

SEQ ID NO: 216025 - DNA, 15 bp, Homo sapiens
ctttcttaacaatct

SEQ ID NO: 216026 - DNA, 15 bp, Homo sapiens
gctttcttaacaatc

SEQ ID NO: 216027 - DNA, 15 bp, Homo sapiens
tgctttcttaacaat

SEQ ID NO: 216028 - DNA, 15 bp, Homo sapiens
ttgctttcttaacaa

SEQ ID NO: 216029 - DNA, 15 bp, Homo sapiens
tttgctttcttaaca

SEQ ID NO: 216030 - DNA, 15 bp, Homo sapiens
ttttgctttcttaac

SEQ ID NO: 216031 - DNA, 15 bp, Homo sapiens
gttttgctttcttaa

SEQ ID NO: 216032 - DNA, 15 bp, Homo sapiens
tgttttgctttctta

SEQ ID NO: 216033 - DNA, 15 bp, Homo sapiens
ttgttttgctttctt

SEQ ID NO: 216034 - DNA, 15 bp, Homo sapiens
gttgttttgctttct

SEQ ID NO: 216035 - DNA, 15 bp, Homo sapiens
tgttgttttgctttc

SEQ ID NO: 216036 - DNA, 15 bp, Homo sapiens
gtgttgttttgcttt

SEQ ID NO: 216037 - DNA, 15 bp, Homo sapiens
tgtgttgttttgctt

SEQ ID NO: 216038 - DNA, 15 bp, Homo sapiens
ctgtgttgttttgct

SEQ ID NO: 216039 - DNA, 15 bp, Homo sapiens
tctgtgttgttttgc

SEQ ID NO: 216040 - DNA, 15 bp, Homo sapiens
atctgtgttgttttg

SEQ ID NO: 216041 - DNA, 15 bp, Homo sapiens
catctgtgttgtttt

SEQ ID NO: 216042 - DNA, 15 bp, Homo sapiens
acatctgtgttgttt

SEQ ID NO: 216043 - DNA, 15 bp, Homo sapiens
aacatctgtgttgtt

SEQ ID NO: 216044 - DNA, 15 bp, Homo sapiens
caacatctgtgttgt

SEQ ID NO: 216045 - DNA, 15 bp, Homo sapiens
acaacatctgtgttg

SEQ ID NO: 216046 - DNA, 15 bp, Homo sapiens
gacaacatctgtgtt

SEQ ID NO: 216047 - DNA, 15 bp, Homo sapiens
agacaacatctgtgt

SEQ ID NO: 216048 - DNA, 15 bp, Homo sapiens
aagacaacatctgtg

SEQ ID NO: 216049 - DNA, 15 bp, Homo sapiens
caagacaacatctgt

SEQ ID NO: 216050 - DNA, 15 bp, Homo sapiens
tcaagacaacatctg

SEQ ID NO: 216051 - DNA, 15 bp, Homo sapiens
ctcaagacaacatct

SEQ ID NO: 216052 - DNA, 15 bp, Homo sapiens
tctcaagacaacatc

SEQ ID NO: 216053 - DNA, 15 bp, Homo sapiens
atctcaagacaacat

SEQ ID NO: 216054 - DNA, 15 bp, Homo sapiens
tatctcaagacaaca

SEQ ID NO: 216055 - DNA, 15 bp, Homo sapiens
ttatctcaagacaac

SEQ ID NO: 216056 - DNA, 15 bp, Homo sapiens
attatctcaagacaa

SEQ ID NO: 216057 - DNA, 15 bp, Homo sapiens
tattatctcaagaca

SEQ ID NO: 216058 - DNA, 15 bp, Homo sapiens
ttattatctcaagac

SEQ ID NO: 216059 - DNA, 15 bp, Homo sapiens
attattatctcaaga

SEQ ID NO: 216060 - DNA, 15 bp, Homo sapiens
cattattatctcaag

SEQ ID NO: 216061 - DNA, 15 bp, Homo sapiens
acattattatctcaa

SEQ ID NO: 216062 - DNA, 15 bp, Homo sapiens
gacattattatctca

SEQ ID NO: 216063 - DNA, 15 bp, Homo sapiens
agacattattatctc

SEQ ID NO: 216064 - DNA, 15 bp, Homo sapiens
aagacattattatct

SEQ ID NO: 216065 - DNA, 15 bp, Homo sapiens
gaagacattattatc

SEQ ID NO: 216066 - DNA, 15 bp, Homo sapiens
agaagacattattat

SEQ ID NO: 216067 - DNA, 15 bp, Homo sapiens
tagaagacattatta

SEQ ID NO: 216068 - DNA, 15 bp, Homo sapiens
atagaagacattatt

SEQ ID NO: 216069 - DNA, 15 bp, Homo sapiens
catagaagacattat

SEQ ID NO: 216070 - DNA, 15 bp, Homo sapiens
ccatagaagacatta

SEQ ID NO: 216071 - DNA, 15 bp, Homo sapiens
cccatagaagacatt

SEQ ID NO: 216072 - DNA, 15 bp, Homo sapiens
ccccatagaagacat

SEQ ID NO: 216073 - DNA, 15 bp, Homo sapiens
cccccatagaagaca

SEQ ID NO: 216074 - DNA, 15 bp, Homo sapiens
gcccccatagaagac

SEQ ID NO: 216075 - DNA, 15 bp, Homo sapiens
agcccccatagaaga

SEQ ID NO: 216076 - DNA, 15 bp, Homo sapiens
cagcccccatagaag

SEQ ID NO: 216077 - DNA, 15 bp, Homo sapiens
ccagcccccatagaa

SEQ ID NO: 216078 - DNA, 15 bp, Homo sapiens
tccagcccccataga

SEQ ID NO: 216079 - DNA, 15 bp, Homo sapiens
ttccagcccccatag

SEQ ID NO: 216080 - DNA, 15 bp, Homo sapiens
cttccagcccccata

SEQ ID NO: 216081 - DNA, 15 bp, Homo sapiens
ccttccagcccccat

SEQ ID NO: 216082 - DNA, 15 bp, Homo sapiens
cccttccagccccca

SEQ ID NO: 216083 - DNA, 15 bp, Homo sapiens
ccccttccagccccc

SEQ ID NO: 216084 - DNA, 15 bp, Homo sapiens
tccccttccagcccc

SEQ ID NO: 216085 - DNA, 15 bp, Homo sapiens
ttccccttccagccc

SEQ ID NO: 216086 - DNA, 15 bp, Homo sapiens
cttccccttccagcc

SEQ ID NO: 216087 - DNA, 15 bp, Homo sapiens
tcttccccttccagc

SEQ ID NO: 216088 - DNA, 15 bp, Homo sapiens
gtcttccccttccag

SEQ ID NO: 216089 - DNA, 15 bp, Homo sapiens
agtcttccccttcca

SEQ ID NO: 216090 - DNA, 15 bp, Homo sapiens
tagtcttccccttcc

SEQ ID NO: 216091 - DNA, 15 bp, Homo sapiens
gtagtcttccccttc

SEQ ID NO: 216092 - DNA, 15 bp, Homo sapiens
agtagtcttcccctt

SEQ ID NO: 216093 - DNA, 15 bp, Homo sapiens
aagtagtcttcccct

SEQ ID NO: 216094 - DNA, 15 bp, Homo sapiens
gaagtagtcttcccc

SEQ ID NO: 216095 - DNA, 15 bp, Homo sapiens
ggaagtagtcttccc

SEQ ID NO: 216096 - DNA, 15 bp, Homo sapiens
aggaagtagtcttcc

SEQ ID NO: 216097 - DNA, 15 bp, Homo sapiens
aaggaagtagtcttc

SEQ ID NO: 216098 - DNA, 15 bp, Homo sapiens
gaaggaagtagtctt

SEQ ID NO: 216099 - DNA, 15 bp, Homo sapiens
agaaggaagtagtct

SEQ ID NO: 216100 - DNA, 15 bp, Homo sapiens
tagaaggaagtagtc

SEQ ID NO: 216101 - DNA, 15 bp, Homo sapiens
gtagaaggaagtagt

SEQ ID NO: 216102 - DNA, 15 bp, Homo sapiens
agtagaaggaagtag

SEQ ID NO: 216103 - DNA, 15 bp, Homo sapiens
cagtagaaggaagta

SEQ ID NO: 216104 - DNA, 15 bp, Homo sapiens
gcagtagaaggaagt

SEQ ID NO: 216105 - DNA, 15 bp, Homo sapiens
tgcagtagaaggaag

SEQ ID NO: 216106 - DNA, 15 bp, Homo sapiens
ctgcagtagaaggaa

SEQ ID NO: 216107 - DNA, 15 bp, Homo sapiens
tctgcagtagaagga

SEQ ID NO: 216108 - DNA, 15 bp, Homo sapiens
ctctgcagtagaagg

SEQ ID NO: 216109 - DNA, 15 bp, Homo sapiens
actctgcagtagaag

SEQ ID NO: 216110 - DNA, 15 bp, Homo sapiens
aactctgcagtagaa

SEQ ID NO: 216111 - DNA, 15 bp, Homo sapiens
caactctgcagtaga

SEQ ID NO: 216112 - DNA, 15 bp, Homo sapiens
gcaactctgcagtag

SEQ ID NO: 216113 - DNA, 15 bp, Homo sapiens
agcaactctgcagta

SEQ ID NO: 216114 - DNA, 15 bp, Homo sapiens
gagcaactctgcagt

SEQ ID NO: 216115 - DNA, 15 bp, Homo sapiens
ggagcaactctgcag

SEQ ID NO: 216116 - DNA, 15 bp, Homo sapiens
tggagcaactctgca

SEQ ID NO: 216117 - DNA, 15 bp, Homo sapiens
atggagcaactctgc

SEQ ID NO: 216118 - DNA, 15 bp, Homo sapiens
catggagcaactctg

SEQ ID NO: 216119 - DNA, 15 bp, Homo sapiens
gcatggagcaactct

SEQ ID NO: 216120 - DNA, 15 bp, Homo sapiens
agcatggagcaactc

SEQ ID NO: 216121 - DNA, 15 bp, Homo sapiens
cagcatggagcaact

SEQ ID NO: 216122 - DNA, 15 bp, Homo sapiens
gcagcatggagcaac

SEQ ID NO: 216123 - DNA, 15 bp, Homo sapiens
agcagcatggagcaa

SEQ ID NO: 216124 - DNA, 15 bp, Homo sapiens
aagcagcatggagca

SEQ ID NO: 216125 - DNA, 15 bp, Homo sapiens
aaagcagcatggagc

SEQ ID NO: 216126 - DNA, 15 bp, Homo sapiens
gaaagcagcatggag

SEQ ID NO: 216127 - DNA, 15 bp, Homo sapiens
agaaagcagcatgga

SEQ ID NO: 216128 - DNA, 15 bp, Homo sapiens
aagaaagcagcatgg

SEQ ID NO: 216129 - DNA, 15 bp, Homo sapiens
gaagaaagcagcatg

SEQ ID NO: 216130 - DNA, 15 bp, Homo sapiens
ggaagaaagcagcat

SEQ ID NO: 216131 - DNA, 15 bp, Homo sapiens
tggaagaaagcagca

SEQ ID NO: 216132 - DNA, 15 bp, Homo sapiens
gtggaagaaagcagc

SEQ ID NO: 216133 - DNA, 15 bp, Homo sapiens
tgtggaagaaagcag

SEQ ID NO: 216134 - DNA, 15 bp, Homo sapiens
ctgtggaagaaagca

SEQ ID NO: 216135 - DNA, 15 bp, Homo sapiens
tctgtggaagaaagc

SEQ ID NO: 216136 - DNA, 15 bp, Homo sapiens
gtctgtggaagaaag

SEQ ID NO: 216137 - DNA, 15 bp, Homo sapiens
ggtctgtggaagaaa

SEQ ID NO: 216138 - DNA, 15 bp, Homo sapiens
aggtctgtggaagaa

SEQ ID NO: 216139 - DNA, 15 bp, Homo sapiens
taggtctgtggaaga

SEQ ID NO: 216140 - DNA, 15 bp, Homo sapiens
gtaggtctgtggaag

SEQ ID NO: 216141 - DNA, 15 bp, Homo sapiens
agtaggtctgtggaa

SEQ ID NO: 216142 - DNA, 15 bp, Homo sapiens
aagtaggtctgtgga

SEQ ID NO: 216143 - DNA, 15 bp, Homo sapiens
aaagtaggtctgtgg

SEQ ID NO: 216144 - DNA, 15 bp, Homo sapiens
caaagtaggtctgtg

SEQ ID NO: 216145 - DNA, 15 bp, Homo sapiens
acaaagtaggtctgt

SEQ ID NO: 216146 - DNA, 15 bp, Homo sapiens
tacaaagtaggtctg

SEQ ID NO: 216147 - DNA, 15 bp, Homo sapiens
atacaaagtaggtct

SEQ ID NO: 216148 - DNA, 15 bp, Homo sapiens
catacaaagtaggtc

SEQ ID NO: 216149 - DNA, 15 bp, Homo sapiens
tcatacaaagtaggt

SEQ ID NO: 216150 - DNA, 15 bp, Homo sapiens
ttcatacaaagtagg

SEQ ID NO: 216151 - DNA, 15 bp, Homo sapiens
tttcatacaaagtag

SEQ ID NO: 216152 - DNA, 15 bp, Homo sapiens
atttcatacaaagta

SEQ ID NO: 216153 - DNA, 15 bp, Homo sapiens
catttcatacaaagt

SEQ ID NO: 216154 - DNA, 15 bp, Homo sapiens
gcatttcatacaaag

SEQ ID NO: 216155 - DNA, 15 bp, Homo sapiens
agcatttcatacaaa

SEQ ID NO: 216156 - DNA, 15 bp, Homo sapiens
gagcatttcatacaa

SEQ ID NO: 216157 - DNA, 15 bp, Homo sapiens
ggagcatttcataca

SEQ ID NO: 216158 - DNA, 15 bp, Homo sapiens
gggagcatttcatac

SEQ ID NO: 216159 - DNA, 15 bp, Homo sapiens
tgggagcatttcata

SEQ ID NO: 216160 - DNA, 15 bp, Homo sapiens
atgggagcatttcat

SEQ ID NO: 216161 - DNA, 15 bp, Homo sapiens
aatgggagcatttca

SEQ ID NO: 216162 - DNA, 15 bp, Homo sapiens
aaatgggagcatttc

SEQ ID NO: 216163 - DNA, 15 bp, Homo sapiens
gaaatgggagcattt

SEQ ID NO: 216164 - DNA, 15 bp, Homo sapiens
agaaatgggagcatt

SEQ ID NO: 216165 - DNA, 15 bp, Homo sapiens
gagaaatgggagcat

SEQ ID NO: 216166 - DNA, 15 bp, Homo sapiens
tgagaaatgggagca

SEQ ID NO: 216167 - DNA, 15 bp, Homo sapiens
ctgagaaatgggagc

SEQ ID NO: 216168 - DNA, 15 bp, Homo sapiens
cctgagaaatgggag

SEQ ID NO: 216169 - DNA, 15 bp, Homo sapiens
acctgagaaatggga

SEQ ID NO: 216170 - DNA, 15 bp, Homo sapiens
cacctgagaaatggg

SEQ ID NO: 216171 - DNA, 15 bp, Homo sapiens
acacctgagaaatgg

SEQ ID NO: 216172 - DNA, 15 bp, Homo sapiens
aacacctgagaaatg

SEQ ID NO: 216173 - DNA, 15 bp, Homo sapiens
aaacacctgagaaat

SEQ ID NO: 216174 - DNA, 15 bp, Homo sapiens
aaaacacctgagaaa

SEQ ID NO: 216175 - DNA, 15 bp, Homo sapiens
gaaaacacctgagaa

SEQ ID NO: 216176 - DNA, 15 bp, Homo sapiens
ggaaaacacctgaga

SEQ ID NO: 216177 - DNA, 15 bp, Homo sapiens
aggaaaacacctgag

SEQ ID NO: 216178 - DNA, 15 bp, Homo sapiens
aaggaaaacacctga

SEQ ID NO: 216179 - DNA, 15 bp, Homo sapiens
gaaggaaaacacctg

SEQ ID NO: 216180 - DNA, 15 bp, Homo sapiens
ggaaggaaaacacct

SEQ ID NO: 216181 - DNA, 15 bp, Homo sapiens
aggaaggaaaacacc

SEQ ID NO: 216182 - DNA, 15 bp, Homo sapiens
aaggaaggaaaacac

SEQ ID NO: 216183 - DNA, 15 bp, Homo sapiens
caaggaaggaaaaca

SEQ ID NO: 216184 - DNA, 15 bp, Homo sapiens
tcaaggaaggaaaac

SEQ ID NO: 216185 - DNA, 15 bp, Homo sapiens
atcaaggaaggaaaa

SEQ ID NO: 216186 - DNA, 15 bp, Homo sapiens
gatcaaggaaggaaa

SEQ ID NO: 216187 - DNA, 15 bp, Homo sapiens
ggatcaaggaaggaa

SEQ ID NO: 216188 - DNA, 15 bp, Homo sapiens
gggatcaaggaagga

SEQ ID NO: 216189 - DNA, 15 bp, Homo sapiens
ggggatcaaggaagg

SEQ ID NO: 216190 - DNA, 15 bp, Homo sapiens
aggggatcaaggaag

SEQ ID NO: 216191 - DNA, 15 bp, Homo sapiens
aaggggatcaaggaa

SEQ ID NO: 216192 - DNA, 15 bp, Homo sapiens
gaaggggatcaagga

SEQ ID NO: 216193 - DNA, 15 bp, Homo sapiens
agaaggggatcaagg

SEQ ID NO: 216194 - DNA, 15 bp, Homo sapiens
tagaaggggatcaag

SEQ ID NO: 216195 - DNA, 15 bp, Homo sapiens
ttagaaggggatcaa

SEQ ID NO: 216196 - DNA, 15 bp, Homo sapiens
gttagaaggggatca

SEQ ID NO: 216197 - DNA, 15 bp, Homo sapiens
tgttagaaggggatc

SEQ ID NO: 216198 - DNA, 15 bp, Homo sapiens
ttgttagaaggggat

SEQ ID NO: 216199 - DNA, 15 bp, Homo sapiens
attgttagaagggga

SEQ ID NO: 216200 - DNA, 15 bp, Homo sapiens
cattgttagaagggg

SEQ ID NO: 216201 - DNA, 15 bp, Homo sapiens
ccattgttagaaggg

SEQ ID NO: 216202 - DNA, 15 bp, Homo sapiens
gccattgttagaagg

SEQ ID NO: 216203 - DNA, 15 bp, Homo sapiens
ggccattgttagaag

SEQ ID NO: 216204 - DNA, 15 bp, Homo sapiens
aggccattgttagaa

SEQ ID NO: 216205 - DNA, 15 bp, Homo sapiens
gaggccattgttaga

SEQ ID NO: 216206 - DNA, 15 bp, Homo sapiens
ggaggccattgttag

SEQ ID NO: 216207 - DNA, 15 bp, Homo sapiens
aggaggccattgtta

SEQ ID NO: 216208 - DNA, 15 bp, Homo sapiens
caggaggccattgtt

SEQ ID NO: 216209 - DNA, 15 bp, Homo sapiens
tcaggaggccattgt

SEQ ID NO: 216210 - DNA, 15 bp, Homo sapiens
ctcaggaggccattg

SEQ ID NO: 216211 - DNA, 15 bp, Homo sapiens
cctcaggaggccatt

SEQ ID NO: 216212 - DNA, 15 bp, Homo sapiens
acctcaggaggccat

SEQ ID NO: 216213 - DNA, 15 bp, Homo sapiens
aacctcaggaggcca

SEQ ID NO: 216214 - DNA, 15 bp, Homo sapiens
gaacctcaggaggcc

SEQ ID NO: 216215 - DNA, 15 bp, Homo sapiens
ggaacctcaggaggc

SEQ ID NO: 216216 - DNA, 15 bp, Homo sapiens
tggaacctcaggagg

SEQ ID NO: 216217 - DNA, 15 bp, Homo sapiens
gtggaacctcaggag

SEQ ID NO: 216218 - DNA, 15 bp, Homo sapiens
tgtggaacctcagga

SEQ ID NO: 216219 - DNA, 15 bp, Homo sapiens
atgtggaacctcagg

SEQ ID NO: 216220 - DNA, 15 bp, Homo sapiens
aatgtggaacctcag

SEQ ID NO: 216221 - DNA, 15 bp, Homo sapiens
aaatgtggaacctca

SEQ ID NO: 216222 - DNA, 15 bp, Homo sapiens
aaaatgtggaacctc

SEQ ID NO: 216223 - DNA, 15 bp, Homo sapiens
gaaaatgtggaacct

SEQ ID NO: 216224 - DNA, 15 bp, Homo sapiens
agaaaatgtggaacc

SEQ ID NO: 216225 - DNA, 15 bp, Homo sapiens
aagaaaatgtggaac

SEQ ID NO: 216226 - DNA, 15 bp, Homo sapiens
aaagaaaatgtggaa

SEQ ID NO: 216227 - DNA, 15 bp, Homo sapiens
aaaagaaaatgtgga

SEQ ID NO: 216228 - DNA, 15 bp, Homo sapiens
taaaagaaaatgtgg

SEQ ID NO: 216229 - DNA, 15 bp, Homo sapiens
ataaaagaaaatgtg

SEQ ID NO: 216230 - DNA, 15 bp, Homo sapiens
cataaaagaaaatgt

SEQ ID NO: 216231 - DNA, 15 bp, Homo sapiens
gcataaaagaaaatg

SEQ ID NO: 216232 - DNA, 15 bp, Homo sapiens
ggcataaaagaaaat

SEQ ID NO: 216233 - DNA, 15 bp, Homo sapiens
tggcataaaagaaaa

SEQ ID NO: 216234 - DNA, 15 bp, Homo sapiens
ctggcataaaagaaa

SEQ ID NO: 216235 - DNA, 15 bp, Homo sapiens
actggcataaaagaa

SEQ ID NO: 216236 - DNA, 15 bp, Homo sapiens
aactggcataaaaga

SEQ ID NO: 216237 - DNA, 15 bp, Homo sapiens
aaactggcataaaag

SEQ ID NO: 216238 - DNA, 15 bp, Homo sapiens
taaactggcataaaa

SEQ ID NO: 216239 - DNA, 15 bp, Homo sapiens
ataaactggcataaa

SEQ ID NO: 216240 - DNA, 15 bp, Homo sapiens
aataaactggcataa

SEQ ID NO: 216241 - DNA, 15 bp, Homo sapiens
gaataaactggcata

SEQ ID NO: 216242 - DNA, 15 bp, Homo sapiens
tgaataaactggcat

SEQ ID NO: 216243 - DNA, 15 bp, Homo sapiens
atgaataaactggca

SEQ ID NO: 216244 - DNA, 15 bp, Homo sapiens
aatgaataaactggc

SEQ ID NO: 216245 - DNA, 15 bp, Homo sapiens
aaatgaataaactgg

SEQ ID NO: 216246 - DNA, 15 bp, Homo sapiens
aaaatgaataaactg

SEQ ID NO: 216247 - DNA, 15 bp, Homo sapiens
gaaaatgaataaact

SEQ ID NO: 216248 - DNA, 15 bp, Homo sapiens
agaaaatgaataaac

SEQ ID NO: 216249 - DNA, 15 bp, Homo sapiens
gagaaaatgaataaa

SEQ ID NO: 216250 - DNA, 15 bp, Homo sapiens
tgagaaaatgaataa

SEQ ID NO: 216251 - DNA, 15 bp, Homo sapiens
atgagaaaatgaata

SEQ ID NO: 216252 - DNA, 15 bp, Homo sapiens
aatgagaaaatgaat

SEQ ID NO: 216253 - DNA, 15 bp, Homo sapiens
gaatgagaaaatgaa

SEQ ID NO: 216254 - DNA, 15 bp, Homo sapiens
tgaatgagaaaatga

SEQ ID NO: 216255 - DNA, 15 bp, Homo sapiens
atgaatgagaaaatg

SEQ ID NO: 216256 - DNA, 15 bp, Homo sapiens
aatgaatgagaaaat

SEQ ID NO: 216257 - DNA, 15 bp, Homo sapiens
taatgaatgagaaaa

SEQ ID NO: 216258 - DNA, 15 bp, Homo sapiens
ttaatgaatgagaaa

SEQ ID NO: 216259 - DNA, 15 bp, Homo sapiens
attaatgaatgagaa

SEQ ID NO: 216260 - DNA, 15 bp, Homo sapiens
gattaatgaatgaga

SEQ ID NO: 216261 - DNA, 15 bp, Homo sapiens
ggattaatgaatgag

SEQ ID NO: 216262 - DNA, 15 bp, Homo sapiens
tggattaatgaatga

SEQ ID NO: 216263 - DNA, 15 bp, Homo sapiens
ttggattaatgaatg

SEQ ID NO: 216264 - DNA, 15 bp, Homo sapiens
tttggattaatgaat

SEQ ID NO: 216265 - DNA, 15 bp, Homo sapiens
ttttggattaatgaa

SEQ ID NO: 216266 - DNA, 15 bp, Homo sapiens
cttttggattaatga

SEQ ID NO: 216267 - DNA, 15 bp, Homo sapiens
tcttttggattaatg

SEQ ID NO: 216268 - DNA, 15 bp, Homo sapiens
atcttttggattaat

SEQ ID NO: 216269 - DNA, 15 bp, Homo sapiens
tatcttttggattaa

SEQ ID NO: 216270 - DNA, 15 bp, Homo sapiens
atatcttttggatta

SEQ ID NO: 216271 - DNA, 15 bp, Homo sapiens
tatatcttttggatt

SEQ ID NO: 216272 - DNA, 15 bp, Homo sapiens
gtatatcttttggat

SEQ ID NO: 216273 - DNA, 15 bp, Homo sapiens
agtatatcttttgga

SEQ ID NO: 216274 - DNA, 15 bp, Homo sapiens
cagtatatcttttgg

SEQ ID NO: 216275 - DNA, 15 bp, Homo sapiens
tcagtatatcttttg

SEQ ID NO: 216276 - DNA, 15 bp, Homo sapiens
ctcagtatatctttt

SEQ ID NO: 216277 - DNA, 15 bp, Homo sapiens
actcagtatatcttt

SEQ ID NO: 216278 - DNA, 15 bp, Homo sapiens
cactcagtatatctt

SEQ ID NO: 216279 - DNA, 15 bp, Homo sapiens
gcactcagtatatct

SEQ ID NO: 216280 - DNA, 15 bp, Homo sapiens
agcactcagtatatc

SEQ ID NO: 216281 - DNA, 15 bp, Homo sapiens
tagcactcagtatat

SEQ ID NO: 216282 - DNA, 15 bp, Homo sapiens
ctagcactcagtata

SEQ ID NO: 216283 - DNA, 15 bp, Homo sapiens
tctagcactcagtat

SEQ ID NO: 216284 - DNA, 15 bp, Homo sapiens
ttctagcactcagta

SEQ ID NO: 216285 - DNA, 15 bp, Homo sapiens
attctagcactcagt

SEQ ID NO: 216286 - DNA, 15 bp, Homo sapiens
gattctagcactcag

SEQ ID NO: 216287 - DNA, 15 bp, Homo sapiens
agattctagcactca

SEQ ID NO: 216288 - DNA, 15 bp, Homo sapiens
tagattctagcactc

SEQ ID NO: 216289 - DNA, 15 bp, Homo sapiens
ttagattctagcact

SEQ ID NO: 216290 - DNA, 15 bp, Homo sapiens
attagattctagcac

SEQ ID NO: 216291 - DNA, 15 bp, Homo sapiens
cattagattctagca

SEQ ID NO: 216292 - DNA, 15 bp, Homo sapiens
tcattagattctagc

SEQ ID NO: 216293 - DNA, 15 bp, Homo sapiens
ctcattagattctag

SEQ ID NO: 216294 - DNA, 15 bp, Homo sapiens
tctcattagattcta

SEQ ID NO: 216295 - DNA, 15 bp, Homo sapiens
ttctcattagattct

SEQ ID NO: 216296 - DNA, 15 bp, Homo sapiens
tttctcattagattc

SEQ ID NO: 216297 - DNA, 15 bp, Homo sapiens
ctttctcattagatt

SEQ ID NO: 216298 - DNA, 15 bp, Homo sapiens
tctttctcattagat

SEQ ID NO: 216299 - DNA, 15 bp, Homo sapiens
ctctttctcattaga

SEQ ID NO: 216300 - DNA, 15 bp, Homo sapiens
gctctttctcattag

SEQ ID NO: 216301 - DNA, 15 bp, Homo sapiens
tgctctttctcatta

SEQ ID NO: 216302 - DNA, 15 bp, Homo sapiens
ctgctctttctcatt

SEQ ID NO: 216303 - DNA, 15 bp, Homo sapiens
tctgctctttctcat

SEQ ID NO: 216304 - DNA, 15 bp, Homo sapiens
ctctgctctttctca

SEQ ID NO: 216305 - DNA, 15 bp, Homo sapiens
gctctgctctttctc

SEQ ID NO: 216306 - DNA, 15 bp, Homo sapiens
agctctgctctttct

SEQ ID NO: 216307 - DNA, 15 bp, Homo sapiens
tagctctgctctttc

SEQ ID NO: 216308 - DNA, 15 bp, Homo sapiens
atagctctgctcttt

SEQ ID NO: 216309 - DNA, 15 bp, Homo sapiens
aatagctctgctctt

SEQ ID NO: 216310 - DNA, 15 bp, Homo sapiens
caatagctctgctct

SEQ ID NO: 216311 - DNA, 15 bp, Homo sapiens
tcaatagctctgctc

SEQ ID NO: 216312 - DNA, 15 bp, Homo sapiens
ttcaatagctctgct

SEQ ID NO: 216313 - DNA, 15 bp, Homo sapiens
tttcaatagctctgc

SEQ ID NO: 216314 - DNA, 15 bp, Homo sapiens
ttttcaatagctctg

SEQ ID NO: 216315 - DNA, 15 bp, Homo sapiens
attttcaatagctct

SEQ ID NO: 216316 - DNA, 15 bp, Homo sapiens
aattttcaatagctc

SEQ ID NO: 216317 - DNA, 15 bp, Homo sapiens
aaattttcaatagct

SEQ ID NO: 216318 - DNA, 15 bp, Homo sapiens
caaattttcaatagc

SEQ ID NO: 216319 - DNA, 15 bp, Homo sapiens
tcaaattttcaatag

SEQ ID NO: 216320 - DNA, 15 bp, Homo sapiens
ttcaaattttcaata

SEQ ID NO: 216321 - DNA, 15 bp, Homo sapiens
cttcaaattttcaat

SEQ ID NO: 216322 - DNA, 15 bp, Homo sapiens
gcttcaaattttcaa

SEQ ID NO: 216323 - DNA, 15 bp, Homo sapiens
tgcttcaaattttca

SEQ ID NO: 216324 - DNA, 15 bp, Homo sapiens
ttgcttcaaattttc

SEQ ID NO: 216325 - DNA, 15 bp, Homo sapiens
cttgcttcaaatttt

SEQ ID NO: 216326 - DNA, 15 bp, Homo sapiens
ccttgcttcaaattt

SEQ ID NO: 216327 - DNA, 15 bp, Homo sapiens
gccttgcttcaaatt

SEQ ID NO: 216328 - DNA, 15 bp, Homo sapiens
ggccttgcttcaaat

SEQ ID NO: 216329 - DNA, 15 bp, Homo sapiens
tggccttgcttcaaa

SEQ ID NO: 216330 - DNA, 15 bp, Homo sapiens
ctggccttgcttcaa

SEQ ID NO: 216331 - DNA, 15 bp, Homo sapiens
cctggccttgcttca

SEQ ID NO: 216332 - DNA, 15 bp, Homo sapiens
gcctggccttgcttc

SEQ ID NO: 216333 - DNA, 15 bp, Homo sapiens
agcctggccttgctt

SEQ ID NO: 216334 - DNA, 15 bp, Homo sapiens
gagcctggccttgct

SEQ ID NO: 216335 - DNA, 15 bp, Homo sapiens
tgagcctggccttgc

SEQ ID NO: 216336 - DNA, 15 bp, Homo sapiens
ctgagcctggccttg

SEQ ID NO: 216337 - DNA, 15 bp, Homo sapiens
actgagcctggcctt

SEQ ID NO: 216338 - DNA, 15 bp, Homo sapiens
cactgagcctggcct

SEQ ID NO: 216339 - DNA, 15 bp, Homo sapiens
ccactgagcctggcc

SEQ ID NO: 216340 - DNA, 15 bp, Homo sapiens
gccactgagcctggc

SEQ ID NO: 216341 - DNA, 15 bp, Homo sapiens
agccactgagcctgg

SEQ ID NO: 216342 - DNA, 15 bp, Homo sapiens
gagccactgagcctg

SEQ ID NO: 216343 - DNA, 15 bp, Homo sapiens
tgagccactgagcct

SEQ ID NO: 216344 - DNA, 15 bp, Homo sapiens
atgagccactgagcc

SEQ ID NO: 216345 - DNA, 15 bp, Homo sapiens
catgagccactgagc

SEQ ID NO: 216346 - DNA, 15 bp, Homo sapiens
gcatgagccactgag

SEQ ID NO: 216347 - DNA, 15 bp, Homo sapiens
ggcatgagccactga

SEQ ID NO: 216348 - DNA, 15 bp, Homo sapiens
cacaggcatgagcca

SEQ ID NO: 216349 - DNA, 15 bp, Homo sapiens
tcacaggcatgagcc

SEQ ID NO: 216350 - DNA, 15 bp, Homo sapiens
atcacaggcatgagc

SEQ ID NO: 216351 - DNA, 15 bp, Homo sapiens
gatcacaggcatgag

SEQ ID NO: 216352 - DNA, 15 bp, Homo sapiens
tgatcacaggcatga

SEQ ID NO: 216353 - DNA, 15 bp, Homo sapiens
atgatcacaggcatg

SEQ ID NO: 216354 - DNA, 15 bp, Homo sapiens
tatgatcacaggcat

SEQ ID NO: 216355 - DNA, 15 bp, Homo sapiens
ctatgatcacaggca

SEQ ID NO: 216356 - DNA, 15 bp, Homo sapiens
gctatgatcacaggc

SEQ ID NO: 216357 - DNA, 15 bp, Homo sapiens
tgctatgatcacagg

SEQ ID NO: 216358 - DNA, 15 bp, Homo sapiens
gtgctatgatcacag

SEQ ID NO: 216359 - DNA, 15 bp, Homo sapiens
agtgctatgatcaca

SEQ ID NO: 216360 - DNA, 15 bp, Homo sapiens
aagtgctatgatcac

SEQ ID NO: 216361 - DNA, 15 bp, Homo sapiens
aaagtgctatgatca

SEQ ID NO: 216362 - DNA, 15 bp, Homo sapiens
caaagtgctatgatc

SEQ ID NO: 216363 - DNA, 15 bp, Homo sapiens
ccaaagtgctatgat

SEQ ID NO: 216364 - DNA, 15 bp, Homo sapiens
cccaaagtgctatga

SEQ ID NO: 216365 - DNA, 15 bp, Homo sapiens
tcccaaagtgctatg

SEQ ID NO: 216366 - DNA, 15 bp, Homo sapiens
ctcccaaagtgctat

SEQ ID NO: 216367 - DNA, 15 bp, Homo sapiens
agtttcgttcttgtt

SEQ ID NO: 216368 - DNA, 15 bp, Homo sapiens
gagtttcgttcttgt

SEQ ID NO: 216369 - DNA, 15 bp, Homo sapiens
ggagtttcgttcttg

SEQ ID NO: 216370 - DNA, 15 bp, Homo sapiens
tggagtttcgttctt

SEQ ID NO: 216371 - DNA, 15 bp, Homo sapiens
atggagtttcgttct

SEQ ID NO: 216372 - DNA, 15 bp, Homo sapiens
gatggagtttcgttc

SEQ ID NO: 216373 - DNA, 15 bp, Homo sapiens
agatggagtttcgtt

SEQ ID NO: 216374 - DNA, 15 bp, Homo sapiens
gagatggagtttcgt

SEQ ID NO: 216375 - DNA, 15 bp, Homo sapiens
ctgtttttgagatgg

SEQ ID NO: 216376 - DNA, 15 bp, Homo sapiens
tctgtttttgagatg

SEQ ID NO: 216377 - DNA, 15 bp, Homo sapiens
ttctgtttttgagat

SEQ ID NO: 216378 - DNA, 15 bp, Homo sapiens
tttctgtttttgaga

SEQ ID NO: 216379 - DNA, 15 bp, Homo sapiens
ctttctgtttttgag

SEQ ID NO: 216380 - DNA, 15 bp, Homo sapiens
tctttctgtttttga

SEQ ID NO: 216381 - DNA, 15 bp, Homo sapiens
ttctttctgtttttg

SEQ ID NO: 216382 - DNA, 15 bp, Homo sapiens
tttctttctgttttt

SEQ ID NO: 216383 - DNA, 15 bp, Homo sapiens
ctttctttctgtttt

SEQ ID NO: 216384 - DNA, 15 bp, Homo sapiens
tctttctttctgttt

SEQ ID NO: 216385 - DNA, 15 bp, Homo sapiens
ttctttctttctgtt

SEQ ID NO: 216386 - DNA, 15 bp, Homo sapiens
tttctttctttctgt

SEQ ID NO: 216387 - DNA, 15 bp, Homo sapiens
ctttctttctttctg

SEQ ID NO: 216388 - DNA, 15 bp, Homo sapiens
attttctttctttct

SEQ ID NO: 216389 - DNA, 15 bp, Homo sapiens
aattttctttctttc

SEQ ID NO: 216390 - DNA, 15 bp, Homo sapiens
caaattttctttctt

SEQ ID NO: 216391 - DNA, 15 bp, Homo sapiens
tcaaattttctttct

SEQ ID NO: 216392 - DNA, 15 bp, Homo sapiens
ttcaaattttctttc

SEQ ID NO: 216393 - DNA, 15 bp, Homo sapiens
cttcaaattttcttt

SEQ ID NO: 216394 - DNA, 15 bp, Homo sapiens
gcttcaaattttctt

SEQ ID NO: 216395 - DNA, 15 bp, Homo sapiens
tgcttcaaattttct

SEQ ID NO: 216396 - DNA, 15 bp, Homo sapiens
tttgcttcaaatttt

SEQ ID NO: 216397 - DNA, 15 bp, Homo sapiens
ttttgcttcaaattt

SEQ ID NO: 216398 - DNA, 15 bp, Homo sapiens
cttttgcttcaaatt

SEQ ID NO: 216399 - DNA, 15 bp, Homo sapiens
gcttttgcttcaaat

SEQ ID NO: 216400 - DNA, 15 bp, Homo sapiens
ggcttttgcttcaaa

SEQ ID NO: 216401 - DNA, 15 bp, Homo sapiens
aggcttttgcttcaa

SEQ ID NO: 216402 - DNA, 15 bp, Homo sapiens
aaggcttttgcttca

SEQ ID NO: 216403 - DNA, 15 bp, Homo sapiens
gaaggcttttgcttc

SEQ ID NO: 216404 - DNA, 15 bp, Homo sapiens
agaaggcttttgctt

SEQ ID NO: 216405 - DNA, 15 bp, Homo sapiens
cagaaggcttttgct

SEQ ID NO: 216406 - DNA, 15 bp, Homo sapiens
tcagaaggcttttgc

SEQ ID NO: 216407 - DNA, 15 bp, Homo sapiens
ttcagaaggcttttg

SEQ ID NO: 216408 - DNA, 15 bp, Homo sapiens
attcagaaggctttt

SEQ ID NO: 216409 - DNA, 15 bp, Homo sapiens
aattcagaaggcttt

SEQ ID NO: 216410 - DNA, 15 bp, Homo sapiens
caattcagaaggctt

SEQ ID NO: 216411 - DNA, 15 bp, Homo sapiens
gcaattcagaaggct

SEQ ID NO: 216412 - DNA, 15 bp, Homo sapiens
tgcaattcagaaggc

SEQ ID NO: 216413 - DNA, 15 bp, Homo sapiens
ttgcaattcagaagg

SEQ ID NO: 216414 - DNA, 15 bp, Homo sapiens
tttgcaattcagaag

SEQ ID NO: 216415 - DNA, 15 bp, Homo sapiens
ctttgcaattcagaa

SEQ ID NO: 216416 - DNA, 15 bp, Homo sapiens
tctttgcaattcaga

SEQ ID NO: 216417 - DNA, 15 bp, Homo sapiens
gtctttgcaattcag

SEQ ID NO: 216418 - DNA, 15 bp, Homo sapiens
ggtctttgcaattca

SEQ ID NO: 216419 - DNA, 15 bp, Homo sapiens
tggtctttgcaattc

SEQ ID NO: 216420 - DNA, 15 bp, Homo sapiens
atggtctttgcaatt

SEQ ID NO: 216421 - DNA, 15 bp, Homo sapiens
catggtctttgcaat

SEQ ID NO: 216422 - DNA, 15 bp, Homo sapiens
tcatggtctttgcaa

SEQ ID NO: 216423 - DNA, 15 bp, Homo sapiens
ctcatggtctttgca

SEQ ID NO: 216424 - DNA, 15 bp, Homo sapiens
cctcatggtctttgc

SEQ ID NO: 216425 - DNA, 15 bp, Homo sapiens
tcctcatggtctttg

SEQ ID NO: 216426 - DNA, 15 bp, Homo sapiens
ctcctcatggtcttt

SEQ ID NO: 216427 - DNA, 15 bp, Homo sapiens
cctcctcatggtctt

SEQ ID NO: 216428 - DNA, 15 bp, Homo sapiens
tcctcctcatggtct

SEQ ID NO: 216429 - DNA, 15 bp, Homo sapiens
ttcctcctcatggtc

SEQ ID NO: 216430 - DNA, 15 bp, Homo sapiens
tttcctcctcatggt

SEQ ID NO: 216431 - DNA, 15 bp, Homo sapiens
atttcctcctcatgg

SEQ ID NO: 216432 - DNA, 15 bp, Homo sapiens
tatttcctcctcatg

SEQ ID NO: 216433 - DNA, 15 bp, Homo sapiens
ctatttcctcctcat

SEQ ID NO: 216434 - DNA, 15 bp, Homo sapiens
gctatttcctcctca

SEQ ID NO: 216435 - DNA, 15 bp, Homo sapiens
agctatttcctcctc

SEQ ID NO: 216436 - DNA, 15 bp, Homo sapiens
aagctatttcctcct

SEQ ID NO: 216437 - DNA, 15 bp, Homo sapiens
caagctatttcctcc

SEQ ID NO: 216438 - DNA, 15 bp, Homo sapiens
ccaagctatttcctc

SEQ ID NO: 216439 - DNA, 15 bp, Homo sapiens
gccaagctatttcct

SEQ ID NO: 216440 - DNA, 15 bp, Homo sapiens
tgccaagctatttcc

SEQ ID NO: 216441 - DNA, 15 bp, Homo sapiens
atgccaagctatttc

SEQ ID NO: 216442 - DNA, 15 bp, Homo sapiens
catgccaagctattt

SEQ ID NO: 216443 - DNA, 15 bp, Homo sapiens
acatgccaagctatt

SEQ ID NO: 216444 - DNA, 15 bp, Homo sapiens
aacatgccaagctat

SEQ ID NO: 216445 - DNA, 15 bp, Homo sapiens
gaacatgccaagcta

SEQ ID NO: 216446 - DNA, 15 bp, Homo sapiens
agaacatgccaagct

SEQ ID NO: 216447 - DNA, 15 bp, Homo sapiens
gagaacatgccaagc

SEQ ID NO: 216448 - DNA, 15 bp, Homo sapiens
cgagaacatgccaag

SEQ ID NO: 216449 - DNA, 15 bp, Homo sapiens
ccgagaacatgccaa

SEQ ID NO: 216450 - DNA, 15 bp, Homo sapiens
tccgagaacatgcca

SEQ ID NO: 216451 - DNA, 15 bp, Homo sapiens
ttccgagaacatgcc

SEQ ID NO: 216452 - DNA, 15 bp, Homo sapiens
gttccgagaacatgc

SEQ ID NO: 216453 - DNA, 15 bp, Homo sapiens
tgttccgagaacatg

SEQ ID NO: 216454 - DNA, 15 bp, Homo sapiens
ctgttccgagaacat

SEQ ID NO: 216455 - DNA, 15 bp, Homo sapiens
tctgttccgagaaca

SEQ ID NO: 216456 - DNA, 15 bp, Homo sapiens
ttctgttccgagaac

SEQ ID NO: 216457 - DNA, 15 bp, Homo sapiens
tttctgttccgagaa

SEQ ID NO: 216458 - DNA, 15 bp, Homo sapiens
atttctgttccgaga

SEQ ID NO: 216459 - DNA, 15 bp, Homo sapiens
tatttctgttccgag

SEQ ID NO: 216460 - DNA, 15 bp, Homo sapiens
ttatttctgttccga

SEQ ID NO: 216461 - DNA, 15 bp, Homo sapiens
cttatttctgttccg

SEQ ID NO: 216462 - DNA, 15 bp, Homo sapiens
ccttatttctgttcc

SEQ ID NO: 216463 - DNA, 15 bp, Homo sapiens
tccttatttctgttc

SEQ ID NO: 216464 - DNA, 15 bp, Homo sapiens
gtccttatttctgtt

SEQ ID NO: 216465 - DNA, 15 bp, Homo sapiens
agtccttatttctgt

SEQ ID NO: 216466 - DNA, 15 bp, Homo sapiens
aagtccttatttctg

SEQ ID NO: 216467 - DNA, 15 bp, Homo sapiens
aaagtccttatttct

SEQ ID NO: 216468 - DNA, 15 bp, Homo sapiens
caaagtccttatttc

SEQ ID NO: 216469 - DNA, 15 bp, Homo sapiens
tcaaagtccttattt

SEQ ID NO: 216470 - DNA, 15 bp, Homo sapiens
ttcaaagtccttatt

SEQ ID NO: 216471 - DNA, 15 bp, Homo sapiens
cttcaaagtccttat

SEQ ID NO: 216472 - DNA, 15 bp, Homo sapiens
gcttcaaagtcctta

SEQ ID NO: 216473 - DNA, 15 bp, Homo sapiens
agcttcaaagtcctt

SEQ ID NO: 216474 - DNA, 15 bp, Homo sapiens
tagcttcaaagtcct

SEQ ID NO: 216475 - DNA, 15 bp, Homo sapiens
ctagcttcaaagtcc

SEQ ID NO: 216476 - DNA, 15 bp, Homo sapiens
tctagcttcaaagtc

SEQ ID NO: 216477 - DNA, 15 bp, Homo sapiens
ttctagcttcaaagt

SEQ ID NO: 216478 - DNA, 15 bp, Homo sapiens
tttctagcttcaaag

SEQ ID NO: 216479 - DNA, 15 bp, Homo sapiens
atttctagcttcaaa

SEQ ID NO: 216480 - DNA, 15 bp, Homo sapiens
catttctagcttcaa

SEQ ID NO: 216481 - DNA, 15 bp, Homo sapiens
tcatttctagcttca

SEQ ID NO: 216482 - DNA, 15 bp, Homo sapiens
ctcatttctagcttc

SEQ ID NO: 216483 - DNA, 15 bp, Homo sapiens
cctcatttctagctt

SEQ ID NO: 216484 - DNA, 15 bp, Homo sapiens
ccctcatttctagct

SEQ ID NO: 216485 - DNA, 15 bp, Homo sapiens
accctcatttctagc

SEQ ID NO: 216486 - DNA, 15 bp, Homo sapiens
caccctcatttctag

SEQ ID NO: 216487 - DNA, 15 bp, Homo sapiens
acaccctcatttcta

SEQ ID NO: 216488 - DNA, 15 bp, Homo sapiens
tacaccctcatttct

SEQ ID NO: 216489 - DNA, 15 bp, Homo sapiens
atacaccctcatttc

SEQ ID NO: 216490 - DNA, 15 bp, Homo sapiens
aatacaccctcattt

SEQ ID NO: 216491 - DNA, 15 bp, Homo sapiens
taatacaccctcatt

SEQ ID NO: 216492 - DNA, 15 bp, Homo sapiens
ctaatacaccctcat

SEQ ID NO: 216493 - DNA, 15 bp, Homo sapiens
cctaatacaccctca

SEQ ID NO: 216494 - DNA, 15 bp, Homo sapiens
tcctaatacaccctc

SEQ ID NO: 216495 - DNA, 15 bp, Homo sapiens
ctcctaatacaccct

SEQ ID NO: 216496 - DNA, 15 bp, Homo sapiens
tctcctaatacaccc

SEQ ID NO: 216497 - DNA, 15 bp, Homo sapiens
atctcctaatacacc

SEQ ID NO: 216498 - DNA, 15 bp, Homo sapiens
catctcctaatacac

SEQ ID NO: 216499 - DNA, 15 bp, Homo sapiens
tcatctcctaataca

SEQ ID NO: 216500 - DNA, 15 bp, Homo sapiens
gtcatctcctaatac

SEQ ID NO: 216501 - DNA, 15 bp, Homo sapiens
tgtcatctcctaata

SEQ ID NO: 216502 - DNA, 15 bp, Homo sapiens
atgtcatctcctaat

SEQ ID NO: 216503 - DNA, 15 bp, Homo sapiens
gatgtcatctcctaa

SEQ ID NO: 216504 - DNA, 15 bp, Homo sapiens
tgatgtcatctccta

SEQ ID NO: 216505 - DNA, 15 bp, Homo sapiens
ctgatgtcatctcct

SEQ ID NO: 216506 - DNA, 15 bp, Homo sapiens
tctgatgtcatctcc

SEQ ID NO: 216507 - DNA, 15 bp, Homo sapiens
gtctgatgtcatctc

SEQ ID NO: 216508 - DNA, 15 bp, Homo sapiens
tgtctgatgtcatct

SEQ ID NO: 216509 - DNA, 15 bp, Homo sapiens
ctgtctgatgtcatc

SEQ ID NO: 216510 - DNA, 15 bp, Homo sapiens
gctgtctgatgtcat

SEQ ID NO: 216511 - DNA, 15 bp, Homo sapiens
tgctgtctgatgtca

SEQ ID NO: 216512 - DNA, 15 bp, Homo sapiens
ctgctgtctgatgtc

SEQ ID NO: 216513 - DNA, 15 bp, Homo sapiens
cctgctgtctgatgt

SEQ ID NO: 216514 - DNA, 15 bp, Homo sapiens
ccctgctgtctgatg

SEQ ID NO: 216515 - DNA, 15 bp, Homo sapiens
tccctgctgtctgat

SEQ ID NO: 216516 - DNA, 15 bp, Homo sapiens
ctccctgctgtctga

SEQ ID NO: 216517 - DNA, 15 bp, Homo sapiens
cctccctgctgtctg

SEQ ID NO: 216518 - DNA, 15 bp, Homo sapiens
ccctccctgctgtct

SEQ ID NO: 216519 - DNA, 15 bp, Homo sapiens
accctccctgctgtc

SEQ ID NO: 216520 - DNA, 15 bp, Homo sapiens
gaccctccctgctgt

SEQ ID NO: 216521 - DNA, 15 bp, Homo sapiens
ggaccctccctgctg

SEQ ID NO: 216522 - DNA, 15 bp, Homo sapiens
tggaccctccctgct

SEQ ID NO: 216523 - DNA, 15 bp, Homo sapiens
ctggaccctccctgc

SEQ ID NO: 216524 - DNA, 15 bp, Homo sapiens
tctggaccctccctg

SEQ ID NO: 216525 - DNA, 15 bp, Homo sapiens
gtctggaccctccct

SEQ ID NO: 216526 - DNA, 15 bp, Homo sapiens
ggtctggaccctccc

SEQ ID NO: 216527 - DNA, 15 bp, Homo sapiens
aggtctggaccctcc

SEQ ID NO: 216528 - DNA, 15 bp, Homo sapiens
aaggtctggaccctc

SEQ ID NO: 216529 - DNA, 15 bp, Homo sapiens
caaggtctggaccct

SEQ ID NO: 216530 - DNA, 15 bp, Homo sapiens
ccaaggtctggaccc

SEQ ID NO: 216531 - DNA, 15 bp, Homo sapiens
accaaggtctggacc

SEQ ID NO: 216532 - DNA, 15 bp, Homo sapiens
taccaaggtctggac

SEQ ID NO: 216533 - DNA, 15 bp, Homo sapiens
ctaccaaggtctgga

SEQ ID NO: 216534 - DNA, 15 bp, Homo sapiens
cctaccaaggtctgg

SEQ ID NO: 216535 - DNA, 15 bp, Homo sapiens
tcctaccaaggtctg

SEQ ID NO: 216536 - DNA, 15 bp, Homo sapiens
ttcctaccaaggtct

SEQ ID NO: 216537 - DNA, 15 bp, Homo sapiens
cttcctaccaaggtc

SEQ ID NO: 216538 - DNA, 15 bp, Homo sapiens
acttcctaccaaggt

SEQ ID NO: 216539 - DNA, 15 bp, Homo sapiens
aacttcctaccaagg

SEQ ID NO: 216540 - DNA, 15 bp, Homo sapiens
aaacttcctaccaag

SEQ ID NO: 216541 - DNA, 15 bp, Homo sapiens
taaacttcctaccaa

SEQ ID NO: 216542 - DNA, 15 bp, Homo sapiens
ctaaacttcctacca

SEQ ID NO: 216543 - DNA, 15 bp, Homo sapiens
tctaaacttcctacc

SEQ ID NO: 216544 - DNA, 15 bp, Homo sapiens
ttctaaacttcctac

SEQ ID NO: 216545 - DNA, 15 bp, Homo sapiens
attctaaacttccta

SEQ ID NO: 216546 - DNA, 15 bp, Homo sapiens
aattctaaacttcct

SEQ ID NO: 216547 - DNA, 15 bp, Homo sapiens
aaattctaaacttcc

SEQ ID NO: 216548 - DNA, 15 bp, Homo sapiens
taaattctaaacttc

SEQ ID NO: 216549 - DNA, 15 bp, Homo sapiens
ataaattctaaactt

SEQ ID NO: 216550 - DNA, 15 bp, Homo sapiens
aataaattctaaact

SEQ ID NO: 216551 - DNA, 15 bp, Homo sapiens
gaataaattctaaac

SEQ ID NO: 216552 - DNA, 15 bp, Homo sapiens
agaataaattctaaa

SEQ ID NO: 216553 - DNA, 15 bp, Homo sapiens
tagaataaattctaa

SEQ ID NO: 216554 - DNA, 15 bp, Homo sapiens
ttagaataaattcta

SEQ ID NO: 216555 - DNA, 15 bp, Homo sapiens
cttagaataaattct

SEQ ID NO: 216556 - DNA, 15 bp, Homo sapiens
acttagaataaattc

SEQ ID NO: 216557 - DNA, 15 bp, Homo sapiens
cacttagaataaatt

SEQ ID NO: 216558 - DNA, 15 bp, Homo sapiens
gcacttagaataaat

SEQ ID NO: 216559 - DNA, 15 bp, Homo sapiens
tgcacttagaataaa

SEQ ID NO: 216560 - DNA, 15 bp, Homo sapiens
ttgcacttagaataa

SEQ ID NO: 216561 - DNA, 15 bp, Homo sapiens
gttgcacttagaata

SEQ ID NO: 216562 - DNA, 15 bp, Homo sapiens
tgttgcacttagaat

SEQ ID NO: 216563 - DNA, 15 bp, Homo sapiens
ctgttgcacttagaa

SEQ ID NO: 216564 - DNA, 15 bp, Homo sapiens
cctgttgcacttaga

SEQ ID NO: 216565 - DNA, 15 bp, Homo sapiens
tcctgttgcacttag

SEQ ID NO: 216566 - DNA, 15 bp, Homo sapiens
ttcctgttgcactta

SEQ ID NO: 216567 - DNA, 15 bp, Homo sapiens
cttcctgttgcactt

SEQ ID NO: 216568 - DNA, 15 bp, Homo sapiens
gcttcctgttgcact

SEQ ID NO: 216569 - DNA, 15 bp, Homo sapiens
ggcttcctgttgcac

SEQ ID NO: 216570 - DNA, 15 bp, Homo sapiens
tggcttcctgttgca

SEQ ID NO: 216571 - DNA, 15 bp, Homo sapiens
atggcttcctgttgc

SEQ ID NO: 216572 - DNA, 15 bp, Homo sapiens
catggcttcctgttg

SEQ ID NO: 216573 - DNA, 15 bp, Homo sapiens
ccatggcttcctgtt

SEQ ID NO: 216574 - DNA, 15 bp, Homo sapiens
cccatggcttcctgt

SEQ ID NO: 216575 - DNA, 15 bp, Homo sapiens
tcccatggcttcctg

SEQ ID NO: 216576 - DNA, 15 bp, Homo sapiens
ctcccatggcttcct

SEQ ID NO: 216577 - DNA, 15 bp, Homo sapiens
cctcccatggcttcc

SEQ ID NO: 216578 - DNA, 15 bp, Homo sapiens
tcctcccatggcttc

SEQ ID NO: 216579 - DNA, 15 bp, Homo sapiens
ctcctcccatggctt

SEQ ID NO: 216580 - DNA, 15 bp, Homo sapiens
cctcctcccatggct

SEQ ID NO: 216581 - DNA, 15 bp, Homo sapiens
ccctcctcccatggc

SEQ ID NO: 216582 - DNA, 15 bp, Homo sapiens
accctcctcccatgg

SEQ ID NO: 216583 - DNA, 15 bp, Homo sapiens
aaccctcctcccatg

SEQ ID NO: 216584 - DNA, 15 bp, Homo sapiens
aaaccctcctcccat

SEQ ID NO: 216585 - DNA, 15 bp, Homo sapiens
aaaaccctcctccca

SEQ ID NO: 216586 - DNA, 15 bp, Homo sapiens
taaaaccctcctccc

SEQ ID NO: 216587 - DNA, 15 bp, Homo sapiens
ttaaaaccctcctcc

SEQ ID NO: 216588 - DNA, 15 bp, Homo sapiens
tttaaaaccctcctc

SEQ ID NO: 216589 - DNA, 15 bp, Homo sapiens
gtttaaaaccctcct

SEQ ID NO: 216590 - DNA, 15 bp, Homo sapiens
tgtttaaaaccctcc

SEQ ID NO: 216591 - DNA, 15 bp, Homo sapiens
ctgtttaaaaccctc

SEQ ID NO: 216592 - DNA, 15 bp, Homo sapiens
tctgtttaaaaccct

SEQ ID NO: 216593 - DNA, 15 bp, Homo sapiens
ttctgtttaaaaccc

SEQ ID NO: 216594 - DNA, 15 bp, Homo sapiens
cttctgtttaaaacc

SEQ ID NO: 216595 - DNA, 15 bp, Homo sapiens
tcttctgtttaaaac

SEQ ID NO: 216596 - DNA, 15 bp, Homo sapiens
gtcttctgtttaaaa

SEQ ID NO: 216597 - DNA, 15 bp, Homo sapiens
tgtcttctgtttaaa

SEQ ID NO: 216598 - DNA, 15 bp, Homo sapiens
ctgtcttctgtttaa

SEQ ID NO: 216599 - DNA, 15 bp, Homo sapiens
cctgtcttctgttta

SEQ ID NO: 216600 - DNA, 15 bp, Homo sapiens
tcctgtcttctgttt

SEQ ID NO: 216601 - DNA, 15 bp, Homo sapiens
atcctgtcttctgtt

SEQ ID NO: 216602 - DNA, 15 bp, Homo sapiens
gatcctgtcttctgt

SEQ ID NO: 216603 - DNA, 15 bp, Homo sapiens
agatcctgtcttctg

SEQ ID NO: 216604 - DNA, 15 bp, Homo sapiens
cagatcctgtcttct

SEQ ID NO: 216605 - DNA, 15 bp, Homo sapiens
tcagatcctgtcttc

SEQ ID NO: 216606 - DNA, 15 bp, Homo sapiens
atcagatcctgtctt

SEQ ID NO: 216607 - DNA, 15 bp, Homo sapiens
aatcagatcctgtct

SEQ ID NO: 216608 - DNA, 15 bp, Homo sapiens
aaatcagatcctgtc

SEQ ID NO: 216609 - DNA, 15 bp, Homo sapiens
taaatcagatcctgt

SEQ ID NO: 216610 - DNA, 15 bp, Homo sapiens
ataaatcagatcctg

SEQ ID NO: 216611 - DNA, 15 bp, Homo sapiens
gataaatcagatcct

SEQ ID NO: 216612 - DNA, 15 bp, Homo sapiens
agataaatcagatcc

SEQ ID NO: 216613 - DNA, 15 bp, Homo sapiens
tagataaatcagatc

SEQ ID NO: 216614 - DNA, 15 bp, Homo sapiens
atagataaatcagat

SEQ ID NO: 216615 - DNA, 15 bp, Homo sapiens
gatagataaatcaga

SEQ ID NO: 216616 - DNA, 15 bp, Homo sapiens
tgatagataaatcag

SEQ ID NO: 216617 - DNA, 15 bp, Homo sapiens
atgatagataaatca

SEQ ID NO: 216618 - DNA, 15 bp, Homo sapiens
aatgatagataaatc

SEQ ID NO: 216619 - DNA, 15 bp, Homo sapiens
aaatgatagataaat

SEQ ID NO: 216620 - DNA, 15 bp, Homo sapiens
aaaatgatagataaa

SEQ ID NO: 216621 - DNA, 15 bp, Homo sapiens
taaaatgatagataa

SEQ ID NO: 216622 - DNA, 15 bp, Homo sapiens
ttaaaatgatagata

SEQ ID NO: 216623 - DNA, 15 bp, Homo sapiens
attaaaatgatagat

SEQ ID NO: 216624 - DNA, 15 bp, Homo sapiens
aattaaaatgataga

SEQ ID NO: 216625 - DNA, 15 bp, Homo sapiens
aaattaaaatgatag

SEQ ID NO: 216626 - DNA, 15 bp, Homo sapiens
aaaattaaaatgata

SEQ ID NO: 216627 - DNA, 15 bp, Homo sapiens
caaaattaaaatgat

SEQ ID NO: 216628 - DNA, 15 bp, Homo sapiens
acaaaattaaaatga

SEQ ID NO: 216629 - DNA, 15 bp, Homo sapiens
tacaaaattaaaatg

SEQ ID NO: 216630 - DNA, 15 bp, Homo sapiens
ttacaaaattaaaat

SEQ ID NO: 216631 - DNA, 15 bp, Homo sapiens
attacaaaattaaaa

SEQ ID NO: 216632 - DNA, 15 bp, Homo sapiens
aattacaaaattaaa

SEQ ID NO: 216633 - DNA, 15 bp, Homo sapiens
aaattacaaaattaa

SEQ ID NO: 216634 - DNA, 15 bp, Homo sapiens
taaattacaaaatta

SEQ ID NO: 216635 - DNA, 15 bp, Homo sapiens
ctaaattacaaaatt

SEQ ID NO: 216636 - DNA, 15 bp, Homo sapiens
tctaaattacaaaat

SEQ ID NO: 216637 - DNA, 15 bp, Homo sapiens
ttctaaattacaaaa

SEQ ID NO: 216638 - DNA, 15 bp, Homo sapiens
tttctaaattacaaa

SEQ ID NO: 216639 - DNA, 15 bp, Homo sapiens
ttttctaaattacaa

SEQ ID NO: 216640 - DNA, 15 bp, Homo sapiens
attttctaaattaca

SEQ ID NO: 216641 - DNA, 15 bp, Homo sapiens
aattttctaaattac

SEQ ID NO: 216642 - DNA, 15 bp, Homo sapiens
aaattttctaaatta

SEQ ID NO: 216643 - DNA, 15 bp, Homo sapiens
aaaattttctaaatt

SEQ ID NO: 216644 - DNA, 15 bp, Homo sapiens
taaaattttctaaat

SEQ ID NO: 216645 - DNA, 15 bp, Homo sapiens
ttaaaattttctaaa

SEQ ID NO: 216646 - DNA, 15 bp, Homo sapiens
cttaaaattttctaa

SEQ ID NO: 216647 - DNA, 15 bp, Homo sapiens
tcttaaaattttcta

SEQ ID NO: 216648 - DNA, 15 bp, Homo sapiens
ttcttaaaattttct

SEQ ID NO: 216649 - DNA, 15 bp, Homo sapiens
tttcttaaaattttc

SEQ ID NO: 216650 - DNA, 15 bp, Homo sapiens
ttttcttaaaatttt

SEQ ID NO: 216651 - DNA, 15 bp, Homo sapiens
cttttcttaaaattt

SEQ ID NO: 216652 - DNA, 15 bp, Homo sapiens
acttttcttaaaatt

SEQ ID NO: 216653 - DNA, 15 bp, Homo sapiens
cacttttcttaaaat

SEQ ID NO: 216654 - DNA, 15 bp, Homo sapiens
gcacttttcttaaaa

SEQ ID NO: 216655 - DNA, 15 bp, Homo sapiens
tgcacttttcttaaa

SEQ ID NO: 216656 - DNA, 15 bp, Homo sapiens
atgcacttttcttaa

SEQ ID NO: 216657 - DNA, 15 bp, Homo sapiens
catgcacttttctta

SEQ ID NO: 216658 - DNA, 15 bp, Homo sapiens
acatgcacttttctt

SEQ ID NO: 216659 - DNA, 15 bp, Homo sapiens
aacatgcacttttct

SEQ ID NO: 216660 - DNA, 15 bp, Homo sapiens
taacatgcacttttc

SEQ ID NO: 216661 - DNA, 15 bp, Homo sapiens
ctaacatgcactttt

SEQ ID NO: 216662 - DNA, 15 bp, Homo sapiens
gctaacatgcacttt

SEQ ID NO: 216663 - DNA, 15 bp, Homo sapiens
tgctaacatgcactt

SEQ ID NO: 216664 - DNA, 15 bp, Homo sapiens
ttgctaacatgcact

SEQ ID NO: 216665 - DNA, 15 bp, Homo sapiens
tttgctaacatgcac

SEQ ID NO: 216666 - DNA, 15 bp, Homo sapiens
ctttgctaacatgca

SEQ ID NO: 216667 - DNA, 15 bp, Homo sapiens
actttgctaacatgc

SEQ ID NO: 216668 - DNA, 15 bp, Homo sapiens
aactttgctaacatg

SEQ ID NO: 216669 - DNA, 15 bp, Homo sapiens
aaactttgctaacat

SEQ ID NO: 216670 - DNA, 15 bp, Homo sapiens
caaactttgctaaca

SEQ ID NO: 216671 - DNA, 15 bp, Homo sapiens
ccaaactttgctaac

SEQ ID NO: 216672 - DNA, 15 bp, Homo sapiens
accaaactttgctaa

SEQ ID NO: 216673 - DNA, 15 bp, Homo sapiens
caccaaactttgcta

SEQ ID NO: 216674 - DNA, 15 bp, Homo sapiens
gcaccaaactttgct

SEQ ID NO: 216675 - DNA, 15 bp, Homo sapiens
agcaccaaactttgc

SEQ ID NO: 216676 - DNA, 15 bp, Homo sapiens
aagcaccaaactttg

SEQ ID NO: 216677 - DNA, 15 bp, Homo sapiens
caagcaccaaacttt

SEQ ID NO: 216678 - DNA, 15 bp, Homo sapiens
tcaagcaccaaactt

SEQ ID NO: 216679 - DNA, 15 bp, Homo sapiens
atcaagcaccaaact

SEQ ID NO: 216680 - DNA, 15 bp, Homo sapiens
tatcaagcaccaaac

SEQ ID NO: 216681 - DNA, 15 bp, Homo sapiens
gtatcaagcaccaaa

SEQ ID NO: 216682 - DNA, 15 bp, Homo sapiens
tgtatcaagcaccaa

SEQ ID NO: 216683 - DNA, 15 bp, Homo sapiens
gtgtatcaagcacca

SEQ ID NO: 216684 - DNA, 15 bp, Homo sapiens
cgtgtatcaagcacc

SEQ ID NO: 216685 - DNA, 15 bp, Homo sapiens
ccgtgtatcaagcac

SEQ ID NO: 216686 - DNA, 15 bp, Homo sapiens
tccgtgtatcaagca

SEQ ID NO: 216687 - DNA, 15 bp, Homo sapiens
gtccgtgtatcaagc

SEQ ID NO: 216688 - DNA, 15 bp, Homo sapiens
tgtccgtgtatcaag

SEQ ID NO: 216689 - DNA, 15 bp, Homo sapiens
ttgtccgtgtatcaa

SEQ ID NO: 216690 - DNA, 15 bp, Homo sapiens
attgtccgtgtatca

SEQ ID NO: 216691 - DNA, 15 bp, Homo sapiens
aattgtccgtgtatc

SEQ ID NO: 216692 - DNA, 15 bp, Homo sapiens
aaattgtccgtgtat

SEQ ID NO: 216693 - DNA, 15 bp, Homo sapiens
caaattgtccgtgta

SEQ ID NO: 216694 - DNA, 15 bp, Homo sapiens
ccaaattgtccgtgt

SEQ ID NO: 216695 - DNA, 15 bp, Homo sapiens
tccaaattgtccgtg

SEQ ID NO: 216696 - DNA, 15 bp, Homo sapiens
atccaaattgtccgt

SEQ ID NO: 216697 - DNA, 15 bp, Homo sapiens
tatccaaattgtccg

SEQ ID NO: 216698 - DNA, 15 bp, Homo sapiens
ttatccaaattgtcc

SEQ ID NO: 216699 - DNA, 15 bp, Homo sapiens
attatccaaattgtc

SEQ ID NO: 216700 - DNA, 15 bp, Homo sapiens
cattatccaaattgt

SEQ ID NO: 216701 - DNA, 15 bp, Homo sapiens
ccattatccaaattg

SEQ ID NO: 216702 - DNA, 15 bp, Homo sapiens
gccattatccaaatt

SEQ ID NO: 216703 - DNA, 15 bp, Homo sapiens
agccattatccaaat

SEQ ID NO: 216704 - DNA, 15 bp, Homo sapiens
aagccattatccaaa

SEQ ID NO: 216705 - DNA, 15 bp, Homo sapiens
aaagccattatccaa

SEQ ID NO: 216706 - DNA, 15 bp, Homo sapiens
taaagccattatcca

SEQ ID NO: 216707 - DNA, 15 bp, Homo sapiens
ctaaagccattatcc

SEQ ID NO: 216708 - DNA, 15 bp, Homo sapiens
tctaaagccattatc

SEQ ID NO: 216709 - DNA, 15 bp, Homo sapiens
atctaaagccattat

SEQ ID NO: 216710 - DNA, 15 bp, Homo sapiens
aatctaaagccatta

SEQ ID NO: 216711 - DNA, 15 bp, Homo sapiens
caatctaaagccatt

SEQ ID NO: 216712 - DNA, 15 bp, Homo sapiens
tcaatctaaagccat

SEQ ID NO: 216713 - DNA, 15 bp, Homo sapiens
ttcaatctaaagcca

SEQ ID NO: 216714 - DNA, 15 bp, Homo sapiens
cttcaatctaaagcc

SEQ ID NO: 216715 - DNA, 15 bp, Homo sapiens
tcttcaatctaaagc

SEQ ID NO: 216716 - DNA, 15 bp, Homo sapiens
ttcttcaatctaaag

SEQ ID NO: 216717 - DNA, 15 bp, Homo sapiens
tttcttcaatctaaa

SEQ ID NO: 216718 - DNA, 15 bp, Homo sapiens
ctttcttcaatctaa

SEQ ID NO: 216719 - DNA, 15 bp, Homo sapiens
cctttcttcaatcta

SEQ ID NO: 216720 - DNA, 15 bp, Homo sapiens
acctttcttcaatct

SEQ ID NO: 216721 - DNA, 15 bp, Homo sapiens
aacctttcttcaatc

SEQ ID NO: 216722 - DNA, 15 bp, Homo sapiens
taacctttcttcaat

SEQ ID NO: 216723 - DNA, 15 bp, Homo sapiens
ctaacctttcttcaa

SEQ ID NO: 216724 - DNA, 15 bp, Homo sapiens
cctaacctttcttca

SEQ ID NO: 216725 - DNA, 15 bp, Homo sapiens
tcctaacctttcttc

SEQ ID NO: 216726 - DNA, 15 bp, Homo sapiens
ttcctaacctttctt

SEQ ID NO: 216727 - DNA, 15 bp, Homo sapiens
tttcctaacctttct

SEQ ID NO: 216728 - DNA, 15 bp, Homo sapiens
ctttcctaacctttc

SEQ ID NO: 216729 - DNA, 15 bp, Homo sapiens
tctttcctaaccttt

SEQ ID NO: 216730 - DNA, 15 bp, Homo sapiens
ctctttcctaacctt

SEQ ID NO: 216731 - DNA, 15 bp, Homo sapiens
actctttcctaacct

SEQ ID NO: 216732 - DNA, 15 bp, Homo sapiens
aactctttcctaacc

SEQ ID NO: 216733 - DNA, 15 bp, Homo sapiens
caactctttcctaac

SEQ ID NO: 216734 - DNA, 15 bp, Homo sapiens
gcaactctttcctaa

SEQ ID NO: 216735 - DNA, 15 bp, Homo sapiens
agcaactctttccta

SEQ ID NO: 216736 - DNA, 15 bp, Homo sapiens
tagcaactctttcct

SEQ ID NO: 216737 - DNA, 15 bp, Homo sapiens
atagcaactctttcc

SEQ ID NO: 216738 - DNA, 15 bp, Homo sapiens
aatagcaactctttc

SEQ ID NO: 216739 - DNA, 15 bp, Homo sapiens
aaatagcaactcttt

SEQ ID NO: 216740 - DNA, 15 bp, Homo sapiens
taaatagcaactctt

SEQ ID NO: 216741 - DNA, 15 bp, Homo sapiens
ttaaatagcaactct

SEQ ID NO: 216742 - DNA, 15 bp, Homo sapiens
tttaaatagcaactc

SEQ ID NO: 216743 - DNA, 15 bp, Homo sapiens
ctttaaatagcaact

SEQ ID NO: 216744 - DNA, 15 bp, Homo sapiens
tctttaaatagcaac

SEQ ID NO: 216745 - DNA, 15 bp, Homo sapiens
ttctttaaatagcaa

SEQ ID NO: 216746 - DNA, 15 bp, Homo sapiens
cttctttaaatagca

SEQ ID NO: 216747 - DNA, 15 bp, Homo sapiens
ccttctttaaatagc

SEQ ID NO: 216748 - DNA, 15 bp, Homo sapiens
cccttctttaaatag

SEQ ID NO: 216749 - DNA, 15 bp, Homo sapiens
ccccttctttaaata

SEQ ID NO: 216750 - DNA, 15 bp, Homo sapiens
cccccttctttaaat

SEQ ID NO: 216751 - DNA, 15 bp, Homo sapiens
ccccccttctttaaa

SEQ ID NO: 216752 - DNA, 15 bp, Homo sapiens
accccccttctttaa

SEQ ID NO: 216753 - DNA, 15 bp, Homo sapiens
caccccccttcttta

SEQ ID NO: 216754 - DNA, 15 bp, Homo sapiens
tcaccccccttcttt

SEQ ID NO: 216755 - DNA, 15 bp, Homo sapiens
gtcaccccccttctt

SEQ ID NO: 216756 - DNA, 15 bp, Homo sapiens
ggtcaccccccttct

SEQ ID NO: 216757 - DNA, 15 bp, Homo sapiens
gggtcaccccccttc

SEQ ID NO: 216758 - DNA, 15 bp, Homo sapiens
ggggtcacccccctt

SEQ ID NO: 216759 - DNA, 15 bp, Homo sapiens
tggggtcacccccct

SEQ ID NO: 216760 - DNA, 15 bp, Homo sapiens
ctggggtcacccccc

SEQ ID NO: 216761 - DNA, 15 bp, Homo sapiens
cctggggtcaccccc

SEQ ID NO: 216762 - DNA, 15 bp, Homo sapiens
tcctggggtcacccc

SEQ ID NO: 216763 - DNA, 15 bp, Homo sapiens
atcctggggtcaccc

SEQ ID NO: 216764 - DNA, 15 bp, Homo sapiens
aatcctggggtcacc

SEQ ID NO: 216765 - DNA, 15 bp, Homo sapiens
aaatcctggggtcac

SEQ ID NO: 216766 - DNA, 15 bp, Homo sapiens
taaatcctggggtca

SEQ ID NO: 216767 - DNA, 15 bp, Homo sapiens
ataaatcctggggtc

SEQ ID NO: 216768 - DNA, 15 bp, Homo sapiens
aataaatcctggggt

SEQ ID NO: 216769 - DNA, 15 bp, Homo sapiens
aaataaatcctgggg

SEQ ID NO: 216770 - DNA, 15 bp, Homo sapiens
gaaataaatcctggg

SEQ ID NO: 216771 - DNA, 15 bp, Homo sapiens
tgaaataaatcctgg

SEQ ID NO: 216772 - DNA, 15 bp, Homo sapiens
gtgaaataaatcctg

SEQ ID NO: 216773 - DNA, 15 bp, Homo sapiens
tgtgaaataaatcct

SEQ ID NO: 216774 - DNA, 15 bp, Homo sapiens
gtgtgaaataaatcc

SEQ ID NO: 216775 - DNA, 15 bp, Homo sapiens
ggtgtgaaataaatc

SEQ ID NO: 216776 - DNA, 15 bp, Homo sapiens
gggtgtgaaataaat

SEQ ID NO: 216777 - DNA, 15 bp, Homo sapiens
tgggtgtgaaataaa

SEQ ID NO: 216778 - DNA, 15 bp, Homo sapiens
gtgggtgtgaaataa

SEQ ID NO: 216779 - DNA, 15 bp, Homo sapiens
tgtgggtgtgaaata

SEQ ID NO: 216780 - DNA, 15 bp, Homo sapiens
atgtgggtgtgaaat

SEQ ID NO: 216781 - DNA, 15 bp, Homo sapiens
catgtgggtgtgaaa

SEQ ID NO: 216782 - DNA, 15 bp, Homo sapiens
acatgtgggtgtgaa

SEQ ID NO: 216783 - DNA, 15 bp, Homo sapiens
aacatgtgggtgtga

SEQ ID NO: 216784 - DNA, 15 bp, Homo sapiens
aaacatgtgggtgtg

SEQ ID NO: 216785 - DNA, 15 bp, Homo sapiens
caaacatgtgggtgt

SEQ ID NO: 216786 - DNA, 15 bp, Homo sapiens
gcaaacatgtgggtg

SEQ ID NO: 216787 - DNA, 15 bp, Homo sapiens
agcaaacatgtgggt

SEQ ID NO: 216788 - DNA, 15 bp, Homo sapiens
aagcaaacatgtggg

SEQ ID NO: 216789 - DNA, 15 bp, Homo sapiens
aaagcaaacatgtgg

SEQ ID NO: 216790 - DNA, 15 bp, Homo sapiens
aaaagcaaacatgtg

SEQ ID NO: 216791 - DNA, 15 bp, Homo sapiens
gaaaagcaaacatgt

SEQ ID NO: 216792 - DNA, 15 bp, Homo sapiens
agaaaagcaaacatg

SEQ ID NO: 216793 - DNA, 15 bp, Homo sapiens
gagaaaagcaaacat

SEQ ID NO: 216794 - DNA, 15 bp, Homo sapiens
agagaaaagcaaaca

SEQ ID NO: 216795 - DNA, 15 bp, Homo sapiens
cagagaaaagcaaac

SEQ ID NO: 216796 - DNA, 15 bp, Homo sapiens
acagagaaaagcaaa

SEQ ID NO: 216797 - DNA, 15 bp, Homo sapiens
aacagagaaaagcaa

SEQ ID NO: 216798 - DNA, 15 bp, Homo sapiens
gaacagagaaaagca

SEQ ID NO: 216799 - DNA, 15 bp, Homo sapiens
agaacagagaaaagc

SEQ ID NO: 216800 - DNA, 15 bp, Homo sapiens
aagaacagagaaaag

SEQ ID NO: 216801 - DNA, 15 bp, Homo sapiens
taagaacagagaaaa

SEQ ID NO: 216802 - DNA, 15 bp, Homo sapiens
ctaagaacagagaaa

SEQ ID NO: 216803 - DNA, 15 bp, Homo sapiens
gctaagaacagagaa

SEQ ID NO: 216804 - DNA, 15 bp, Homo sapiens
agctaagaacagaga

SEQ ID NO: 216805 - DNA, 15 bp, Homo sapiens
gagctaagaacagag

SEQ ID NO: 216806 - DNA, 15 bp, Homo sapiens
tgagctaagaacaga

SEQ ID NO: 216807 - DNA, 15 bp, Homo sapiens
ctgagctaagaacag

SEQ ID NO: 216808 - DNA, 15 bp, Homo sapiens
actgagctaagaaca

SEQ ID NO: 216809 - DNA, 15 bp, Homo sapiens
gactgagctaagaac

SEQ ID NO: 216810 - DNA, 15 bp, Homo sapiens
ggactgagctaagaa

SEQ ID NO: 216811 - DNA, 15 bp, Homo sapiens
tggactgagctaaga

SEQ ID NO: 216812 - DNA, 15 bp, Homo sapiens
atggactgagctaag

SEQ ID NO: 216813 - DNA, 15 bp, Homo sapiens
tatggactgagctaa

SEQ ID NO: 216814 - DNA, 15 bp, Homo sapiens
atatggactgagcta

SEQ ID NO: 216815 - DNA, 15 bp, Homo sapiens
catatggactgagct

SEQ ID NO: 216816 - DNA, 15 bp, Homo sapiens
tcatatggactgagc

SEQ ID NO: 216817 - DNA, 15 bp, Homo sapiens
gtcatatggactgag

SEQ ID NO: 216818 - DNA, 15 bp, Homo sapiens
ggtcatatggactga

SEQ ID NO: 216819 - DNA, 15 bp, Homo sapiens
tggtcatatggactg

SEQ ID NO: 216820 - DNA, 15 bp, Homo sapiens
ttggtcatatggact

SEQ ID NO: 216821 - DNA, 15 bp, Homo sapiens
gttggtcatatggac

SEQ ID NO: 216822 - DNA, 15 bp, Homo sapiens
agttggtcatatgga

SEQ ID NO: 216823 - DNA, 15 bp, Homo sapiens
cagttggtcatatgg

SEQ ID NO: 216824 - DNA, 15 bp, Homo sapiens
gcagttggtcatatg

SEQ ID NO: 216825 - DNA, 15 bp, Homo sapiens
agcagttggtcatat

SEQ ID NO: 216826 - DNA, 15 bp, Homo sapiens
tagcagttggtcata

SEQ ID NO: 216827 - DNA, 15 bp, Homo sapiens
ctagcagttggtcat

SEQ ID NO: 216828 - DNA, 15 bp, Homo sapiens
actagcagttggtca

SEQ ID NO: 216829 - DNA, 15 bp, Homo sapiens
aactagcagttggtc

SEQ ID NO: 216830 - DNA, 15 bp, Homo sapiens
aaactagcagttggt

SEQ ID NO: 216831 - DNA, 15 bp, Homo sapiens
taaactagcagttgg

SEQ ID NO: 216832 - DNA, 15 bp, Homo sapiens
ctaaactagcagttg

SEQ ID NO: 216833 - DNA, 15 bp, Homo sapiens
cctaaactagcagtt

SEQ ID NO: 216834 - DNA, 15 bp, Homo sapiens
tcctaaactagcagt

SEQ ID NO: 216835 - DNA, 15 bp, Homo sapiens
ctcctaaactagcag

SEQ ID NO: 216836 - DNA, 15 bp, Homo sapiens
tctcctaaactagca

SEQ ID NO: 216837 - DNA, 15 bp, Homo sapiens
ctctcctaaactagc

SEQ ID NO: 216838 - DNA, 15 bp, Homo sapiens
tctctcctaaactag

SEQ ID NO: 216839 - DNA, 15 bp, Homo sapiens
ttctctcctaaacta

SEQ ID NO: 216840 - DNA, 15 bp, Homo sapiens
cttctctcctaaact

SEQ ID NO: 216841 - DNA, 15 bp, Homo sapiens
ccttctctcctaaac

SEQ ID NO: 216842 - DNA, 15 bp, Homo sapiens
cccttctctcctaaa

SEQ ID NO: 216843 - DNA, 15 bp, Homo sapiens
acccttctctcctaa

SEQ ID NO: 216844 - DNA, 15 bp, Homo sapiens
aacccttctctccta

SEQ ID NO: 216845 - DNA, 15 bp, Homo sapiens
aaacccttctctcct

SEQ ID NO: 216846 - DNA, 15 bp, Homo sapiens
taaacccttctctcc

SEQ ID NO: 216847 - DNA, 15 bp, Homo sapiens
ctaaacccttctctc

SEQ ID NO: 216848 - DNA, 15 bp, Homo sapiens
gctaaacccttctct

SEQ ID NO: 216849 - DNA, 15 bp, Homo sapiens
tgctaaacccttctc

SEQ ID NO: 216850 - DNA, 15 bp, Homo sapiens
ctgctaaacccttct

SEQ ID NO: 216851 - DNA, 15 bp, Homo sapiens
cctgctaaacccttc

SEQ ID NO: 216852 - DNA, 15 bp, Homo sapiens
ccctgctaaaccctt

SEQ ID NO: 216853 - DNA, 15 bp, Homo sapiens
tccctgctaaaccct

SEQ ID NO: 216854 - DNA, 15 bp, Homo sapiens
atccctgctaaaccc

SEQ ID NO: 216855 - DNA, 15 bp, Homo sapiens
aatccctgctaaacc

SEQ ID NO: 216856 - DNA, 15 bp, Homo sapiens
gaatccctgctaaac

SEQ ID NO: 216857 - DNA, 15 bp, Homo sapiens
ggaatccctgctaaa

SEQ ID NO: 216858 - DNA, 15 bp, Homo sapiens
gggaatccctgctaa

SEQ ID NO: 216859 - DNA, 15 bp, Homo sapiens
ggggaatccctgcta

SEQ ID NO: 216860 - DNA, 15 bp, Homo sapiens
aggggaatccctgct

SEQ ID NO: 216861 - DNA, 15 bp, Homo sapiens
gaggggaatccctgc

SEQ ID NO: 216862 - DNA, 15 bp, Homo sapiens
agaggggaatccctg

SEQ ID NO: 216863 - DNA, 15 bp, Homo sapiens
aagaggggaatccct

SEQ ID NO: 216864 - DNA, 15 bp, Homo sapiens
gaagaggggaatccc

SEQ ID NO: 216865 - DNA, 15 bp, Homo sapiens
ggaagaggggaatcc

SEQ ID NO: 216866 - DNA, 15 bp, Homo sapiens
gggaagaggggaatc

SEQ ID NO: 216867 - DNA, 15 bp, Homo sapiens
agggaagaggggaat

SEQ ID NO: 216868 - DNA, 15 bp, Homo sapiens
gagggaagaggggaa

SEQ ID NO: 216869 - DNA, 15 bp, Homo sapiens
ggagggaagagggga

SEQ ID NO: 216870 - DNA, 15 bp, Homo sapiens
tggagggaagagggg

SEQ ID NO: 216871 - DNA, 15 bp, Homo sapiens
ttggagggaagaggg

SEQ ID NO: 216872 - DNA, 15 bp, Homo sapiens
attggagggaagagg

SEQ ID NO: 216873 - DNA, 15 bp, Homo sapiens
aattggagggaagag

SEQ ID NO: 216874 - DNA, 15 bp, Homo sapiens
gaattggagggaaga

SEQ ID NO: 216875 - DNA, 15 bp, Homo sapiens
agaattggagggaag

SEQ ID NO: 216876 - DNA, 15 bp, Homo sapiens
gagaattggagggaa

SEQ ID NO: 216877 - DNA, 15 bp, Homo sapiens
agagaattggaggga

SEQ ID NO: 216878 - DNA, 15 bp, Homo sapiens
aagagaattggaggg

SEQ ID NO: 216879 - DNA, 15 bp, Homo sapiens
taagagaattggagg

SEQ ID NO: 216880 - DNA, 15 bp, Homo sapiens
ctaagagaattggag

SEQ ID NO: 216881 - DNA, 15 bp, Homo sapiens
tctaagagaattgga

SEQ ID NO: 216882 - DNA, 15 bp, Homo sapiens
gtctaagagaattgg

SEQ ID NO: 216883 - DNA, 15 bp, Homo sapiens
ggtctaagagaattg

SEQ ID NO: 216884 - DNA, 15 bp, Homo sapiens
gggtctaagagaatt

SEQ ID NO: 216885 - DNA, 15 bp, Homo sapiens
agggtctaagagaat

SEQ ID NO: 216886 - DNA, 15 bp, Homo sapiens
cagggtctaagagaa

SEQ ID NO: 216887 - DNA, 15 bp, Homo sapiens
acagggtctaagaga

SEQ ID NO: 216888 - DNA, 15 bp, Homo sapiens
aacagggtctaagag

SEQ ID NO: 216889 - DNA, 15 bp, Homo sapiens
aaacagggtctaaga

SEQ ID NO: 216890 - DNA, 15 bp, Homo sapiens
aaaacagggtctaag

SEQ ID NO: 216891 - DNA, 15 bp, Homo sapiens
gaaaacagggtctaa

SEQ ID NO: 216892 - DNA, 15 bp, Homo sapiens
agaaaacagggtcta

SEQ ID NO: 216893 - DNA, 15 bp, Homo sapiens
aagaaaacagggtct

SEQ ID NO: 216894 - DNA, 15 bp, Homo sapiens
taagaaaacagggtc

SEQ ID NO: 216895 - DNA, 15 bp, Homo sapiens
ataagaaaacagggt

SEQ ID NO: 216896 - DNA, 15 bp, Homo sapiens
aataagaaaacaggg

SEQ ID NO: 216897 - DNA, 15 bp, Homo sapiens
taataagaaaacagg

SEQ ID NO: 216898 - DNA, 15 bp, Homo sapiens
ttaataagaaaacag

SEQ ID NO: 216899 - DNA, 15 bp, Homo sapiens
tttaataagaaaaca

SEQ ID NO: 216900 - DNA, 15 bp, Homo sapiens
ttttaataagaaaac

SEQ ID NO: 216901 - DNA, 15 bp, Homo sapiens
cttttaataagaaaa

SEQ ID NO: 216902 - DNA, 15 bp, Homo sapiens
tcttttaataagaaa

SEQ ID NO: 216903 - DNA, 15 bp, Homo sapiens
atcttttaataagaa

SEQ ID NO: 216904 - DNA, 15 bp, Homo sapiens
aatcttttaataaga

SEQ ID NO: 216905 - DNA, 15 bp, Homo sapiens
aaatcttttaataag

SEQ ID NO: 216906 - DNA, 15 bp, Homo sapiens
caaatcttttaataa

SEQ ID NO: 216907 - DNA, 15 bp, Homo sapiens
gcaaatcttttaata

SEQ ID NO: 216908 - DNA, 15 bp, Homo sapiens
tgcaaatcttttaat

SEQ ID NO: 216909 - DNA, 15 bp, Homo sapiens
ctgcaaatcttttaa

SEQ ID NO: 216910 - DNA, 15 bp, Homo sapiens
cctgcaaatctttta

SEQ ID NO: 216911 - DNA, 15 bp, Homo sapiens
tcctgcaaatctttt

SEQ ID NO: 216912 - DNA, 15 bp, Homo sapiens
atcctgcaaatcttt

SEQ ID NO: 216913 - DNA, 15 bp, Homo sapiens
gatcctgcaaatctt

SEQ ID NO: 216914 - DNA, 15 bp, Homo sapiens
ggatcctgcaaatct

SEQ ID NO: 216915 - DNA, 15 bp, Homo sapiens
gggatcctgcaaatc

SEQ ID NO: 216916 - DNA, 15 bp, Homo sapiens
tgggatcctgcaaat

SEQ ID NO: 216917 - DNA, 15 bp, Homo sapiens
atgggatcctgcaaa

SEQ ID NO: 216918 - DNA, 15 bp, Homo sapiens
gatgggatcctgcaa

SEQ ID NO: 216919 - DNA, 15 bp, Homo sapiens
agatgggatcctgca

SEQ ID NO: 216920 - DNA, 15 bp, Homo sapiens
gagatgggatcctgc

SEQ ID NO: 216921 - DNA, 15 bp, Homo sapiens
cgagatgggatcctg

SEQ ID NO: 216922 - DNA, 15 bp, Homo sapiens
ccgagatgggatcct

SEQ ID NO: 216923 - DNA, 15 bp, Homo sapiens
accgagatgggatcc

SEQ ID NO: 216924 - DNA, 15 bp, Homo sapiens
gaccgagatgggatc

SEQ ID NO: 216925 - DNA, 15 bp, Homo sapiens
tgaccgagatgggat

SEQ ID NO: 216926 - DNA, 15 bp, Homo sapiens
ctgaccgagatggga

SEQ ID NO: 216927 - DNA, 15 bp, Homo sapiens
actgaccgagatggg

SEQ ID NO: 216928 - DNA, 15 bp, Homo sapiens
cactgaccgagatgg

SEQ ID NO: 216929 - DNA, 15 bp, Homo sapiens
tcactgaccgagatg

SEQ ID NO: 216930 - DNA, 15 bp, Homo sapiens
atcactgaccgagat

SEQ ID NO: 216931 - DNA, 15 bp, Homo sapiens
catcactgaccgaga

SEQ ID NO: 216932 - DNA, 15 bp, Homo sapiens
acatcactgaccgag

SEQ ID NO: 216933 - DNA, 15 bp, Homo sapiens
gacatcactgaccga

SEQ ID NO: 216934 - DNA, 15 bp, Homo sapiens
tgacatcactgaccg

SEQ ID NO: 216935 - DNA, 15 bp, Homo sapiens
ctgacatcactgacc

SEQ ID NO: 216936 - DNA, 15 bp, Homo sapiens
gctgacatcactgac

SEQ ID NO: 216937 - DNA, 15 bp, Homo sapiens
tgctgacatcactga

SEQ ID NO: 216938 - DNA, 15 bp, Homo sapiens
ttgctgacatcactg

SEQ ID NO: 216939 - DNA, 15 bp, Homo sapiens
gttgctgacatcact

SEQ ID NO: 216940 - DNA, 15 bp, Homo sapiens
ggttgctgacatcac

SEQ ID NO: 216941 - DNA, 15 bp, Homo sapiens
gggttgctgacatca

SEQ ID NO: 216942 - DNA, 15 bp, Homo sapiens
tgggttgctgacatc

SEQ ID NO: 216943 - DNA, 15 bp, Homo sapiens
ctgggttgctgacat

SEQ ID NO: 216944 - DNA, 15 bp, Homo sapiens
gctgggttgctgaca

SEQ ID NO: 216945 - DNA, 15 bp, Homo sapiens
ggctgggttgctgac

SEQ ID NO: 216946 - DNA, 15 bp, Homo sapiens
tggctgggttgctga

SEQ ID NO: 216947 - DNA, 15 bp, Homo sapiens
atggctgggttgctg

SEQ ID NO: 216948 - DNA, 15 bp, Homo sapiens
aatggctgggttgct

SEQ ID NO: 216949 - DNA, 15 bp, Homo sapiens
taatggctgggttgc

SEQ ID NO: 216950 - DNA, 15 bp, Homo sapiens
ataatggctgggttg

SEQ ID NO: 216951 - DNA, 15 bp, Homo sapiens
cataatggctgggtt

SEQ ID NO: 216952 - DNA, 15 bp, Homo sapiens
ccataatggctgggt

SEQ ID NO: 216953 - DNA, 15 bp, Homo sapiens
accataatggctggg

SEQ ID NO: 216954 - DNA, 15 bp, Homo sapiens
caccataatggctgg

SEQ ID NO: 216955 - DNA, 15 bp, Homo sapiens
tcaccataatggctg

SEQ ID NO: 216956 - DNA, 15 bp, Homo sapiens
ctcaccataatggct

SEQ ID NO: 216957 - DNA, 15 bp, Homo sapiens
gctcaccataatggc

SEQ ID NO: 216958 - DNA, 15 bp, Homo sapiens
agctcaccataatgg

SEQ ID NO: 216959 - DNA, 15 bp, Homo sapiens
cagctcaccataatg

SEQ ID NO: 216960 - DNA, 15 bp, Homo sapiens
tcagctcaccataat

SEQ ID NO: 216961 - DNA, 15 bp, Homo sapiens
atcagctcaccataa

SEQ ID NO: 216962 - DNA, 15 bp, Homo sapiens
catcagctcaccata

SEQ ID NO: 216963 - DNA, 15 bp, Homo sapiens
gcatcagctcaccat

SEQ ID NO: 216964 - DNA, 15 bp, Homo sapiens
ggcatcagctcacca

SEQ ID NO: 216965 - DNA, 15 bp, Homo sapiens
tggcatcagctcacc

SEQ ID NO: 216966 - DNA, 15 bp, Homo sapiens
atggcatcagctcac

SEQ ID NO: 216967 - DNA, 15 bp, Homo sapiens
catggcatcagctca

SEQ ID NO: 216968 - DNA, 15 bp, Homo sapiens
gcatggcatcagctc

SEQ ID NO: 216969 - DNA, 15 bp, Homo sapiens
agcatggcatcagct

SEQ ID NO: 216970 - DNA, 15 bp, Homo sapiens
gagcatggcatcagc

SEQ ID NO: 216971 - DNA, 15 bp, Homo sapiens
tgagcatggcatcag

SEQ ID NO: 216972 - DNA, 15 bp, Homo sapiens
atgagcatggcatca

SEQ ID NO: 216973 - DNA, 15 bp, Homo sapiens
catgagcatggcatc

SEQ ID NO: 216974 - DNA, 15 bp, Homo sapiens
tcatgagcatggcat

SEQ ID NO: 216975 - DNA, 15 bp, Homo sapiens
ttcatgagcatggca

SEQ ID NO: 216976 - DNA, 15 bp, Homo sapiens
cttcatgagcatggc

SEQ ID NO: 216977 - DNA, 15 bp, Homo sapiens
tcttcatgagcatgg

SEQ ID NO: 216978 - DNA, 15 bp, Homo sapiens
ttcttcatgagcatg

SEQ ID NO: 216979 - DNA, 15 bp, Homo sapiens
tttcttcatgagcat

SEQ ID NO: 216980 - DNA, 15 bp, Homo sapiens
ttttcttcatgagca

SEQ ID NO: 216981 - DNA, 15 bp, Homo sapiens
attttcttcatgagc

SEQ ID NO: 216982 - DNA, 15 bp, Homo sapiens
cattttcttcatgag

SEQ ID NO: 216983 - DNA, 15 bp, Homo sapiens
tcattttcttcatga

SEQ ID NO: 216984 - DNA, 15 bp, Homo sapiens
ttcattttcttcatg

SEQ ID NO: 216985 - DNA, 15 bp, Homo sapiens
cttcattttcttcat

SEQ ID NO: 216986 - DNA, 15 bp, Homo sapiens
tcttcattttcttca

SEQ ID NO: 216987 - DNA, 15 bp, Homo sapiens
atcttcattttcttc

SEQ ID NO: 216988 - DNA, 15 bp, Homo sapiens
gatcttcattttctt

SEQ ID NO: 216989 - DNA, 15 bp, Homo sapiens
tgatcttcattttct

SEQ ID NO: 216990 - DNA, 15 bp, Homo sapiens
ctgatcttcattttc

SEQ ID NO: 216991 - DNA, 15 bp, Homo sapiens
gctgatcttcatttt

SEQ ID NO: 216992 - DNA, 15 bp, Homo sapiens
agctgatcttcattt

SEQ ID NO: 216993 - DNA, 15 bp, Homo sapiens
cagctgatcttcatt

SEQ ID NO: 216994 - DNA, 15 bp, Homo sapiens
tcagctgatcttcat

SEQ ID NO: 216995 - DNA, 15 bp, Homo sapiens
atcagctgatcttca

SEQ ID NO: 216996 - DNA, 15 bp, Homo sapiens
aatcagctgatcttc

SEQ ID NO: 216997 - DNA, 15 bp, Homo sapiens
caatcagctgatctt

SEQ ID NO: 216998 - DNA, 15 bp, Homo sapiens
tcaatcagctgatct

SEQ ID NO: 216999 - DNA, 15 bp, Homo sapiens
gtcaatcagctgatc

SEQ ID NO: 217000 - DNA, 15 bp, Homo sapiens
agtcaatcagctgat

SEQ ID NO: 217001 - DNA, 15 bp, Homo sapiens
aagtcaatcagctga

SEQ ID NO: 217002 - DNA, 15 bp, Homo sapiens
gaagtcaatcagctg

SEQ ID NO: 217003 - DNA, 15 bp, Homo sapiens
ggaagtcaatcagct

SEQ ID NO: 217004 - DNA, 15 bp, Homo sapiens
tggaagtcaatcagc

SEQ ID NO: 217005 - DNA, 15 bp, Homo sapiens
ttggaagtcaatcag

SEQ ID NO: 217006 - DNA, 15 bp, Homo sapiens
cttggaagtcaatca

SEQ ID NO: 217007 - DNA, 15 bp, Homo sapiens
acttggaagtcaatc

SEQ ID NO: 217008 - DNA, 15 bp, Homo sapiens
tacttggaagtcaat

SEQ ID NO: 217009 - DNA, 15 bp, Homo sapiens
atacttggaagtcaa

SEQ ID NO: 217010 - DNA, 15 bp, Homo sapiens
aatacttggaagtca

SEQ ID NO: 217011 - DNA, 15 bp, Homo sapiens
aaatacttggaagtc

SEQ ID NO: 217012 - DNA, 15 bp, Homo sapiens
gaaatacttggaagt

SEQ ID NO: 217013 - DNA, 15 bp, Homo sapiens
agaaatacttggaag

SEQ ID NO: 217014 - DNA, 15 bp, Homo sapiens
cagaaatacttggaa

SEQ ID NO: 217015 - DNA, 15 bp, Homo sapiens
gcagaaatacttgga

SEQ ID NO: 217016 - DNA, 15 bp, Homo sapiens
ggcagaaatacttgg

SEQ ID NO: 217017 - DNA, 15 bp, Homo sapiens
gggcagaaatacttg

SEQ ID NO: 217018 - DNA, 15 bp, Homo sapiens
agggcagaaatactt

SEQ ID NO: 217019 - DNA, 15 bp, Homo sapiens
tagggcagaaatact

SEQ ID NO: 217020 - DNA, 15 bp, Homo sapiens
ttagggcagaaatac

SEQ ID NO: 217021 - DNA, 15 bp, Homo sapiens
cttagggcagaaata

SEQ ID NO: 217022 - DNA, 15 bp, Homo sapiens
gcttagggcagaaat

SEQ ID NO: 217023 - DNA, 15 bp, Homo sapiens
ggcttagggcagaaa

SEQ ID NO: 217024 - DNA, 15 bp, Homo sapiens
tggcttagggcagaa

SEQ ID NO: 217025 - DNA, 15 bp, Homo sapiens
gtggcttagggcaga

SEQ ID NO: 217026 - DNA, 15 bp, Homo sapiens
cgtggcttagggcag

SEQ ID NO: 217027 - DNA, 15 bp, Homo sapiens
gcgtggcttagggca

SEQ ID NO: 217028 - DNA, 15 bp, Homo sapiens
ggcgtggcttagggc

SEQ ID NO: 217029 - DNA, 15 bp, Homo sapiens
tggcgtggcttaggg

SEQ ID NO: 217030 - DNA, 15 bp, Homo sapiens
ttggcgtggcttagg

SEQ ID NO: 217031 - DNA, 15 bp, Homo sapiens
attggcgtggcttag

SEQ ID NO: 217032 - DNA, 15 bp, Homo sapiens
gattggcgtggctta

SEQ ID NO: 217033 - DNA, 15 bp, Homo sapiens
tgattggcgtggctt

SEQ ID NO: 217034 - DNA, 15 bp, Homo sapiens
gtgattggcgtggct

SEQ ID NO: 217035 - DNA, 15 bp, Homo sapiens
agtgattggcgtggc

SEQ ID NO: 217036 - DNA, 15 bp, Homo sapiens
aagtgattggcgtgg

SEQ ID NO: 217037 - DNA, 15 bp, Homo sapiens
gaagtgattggcgtg

SEQ ID NO: 217038 - DNA, 15 bp, Homo sapiens
agaagtgattggcgt

SEQ ID NO: 217039 - DNA, 15 bp, Homo sapiens
aagaagtgattggcg

SEQ ID NO: 217040 - DNA, 15 bp, Homo sapiens
aaagaagtgattggc

SEQ ID NO: 217041 - DNA, 15 bp, Homo sapiens
taaagaagtgattgg

SEQ ID NO: 217042 - DNA, 15 bp, Homo sapiens
ataaagaagtgattg

SEQ ID NO: 217043 - DNA, 15 bp, Homo sapiens
tataaagaagtgatt

SEQ ID NO: 217044 - DNA, 15 bp, Homo sapiens
gtataaagaagtgat

SEQ ID NO: 217045 - DNA, 15 bp, Homo sapiens
ggtataaagaagtga

SEQ ID NO: 217046 - DNA, 15 bp, Homo sapiens
cggtataaagaagtg

SEQ ID NO: 217047 - DNA, 15 bp, Homo sapiens
acggtataaagaagt

SEQ ID NO: 217048 - DNA, 15 bp, Homo sapiens
gacggtataaagaag

SEQ ID NO: 217049 - DNA, 15 bp, Homo sapiens
agacggtataaagaa

SEQ ID NO: 217050 - DNA, 15 bp, Homo sapiens
aagacggtataaaga

SEQ ID NO: 217051 - DNA, 15 bp, Homo sapiens
taagacggtataaag

SEQ ID NO: 217052 - DNA, 15 bp, Homo sapiens
ataagacggtataaa

SEQ ID NO: 217053 - DNA, 15 bp, Homo sapiens
gataagacggtataa

SEQ ID NO: 217054 - DNA, 15 bp, Homo sapiens
agataagacggtata

SEQ ID NO: 217055 - DNA, 15 bp, Homo sapiens
aagataagacggtat

SEQ ID NO: 217056 - DNA, 15 bp, Homo sapiens
aaagataagacggta

SEQ ID NO: 217057 - DNA, 15 bp, Homo sapiens
aaaagataagacggt

SEQ ID NO: 217058 - DNA, 15 bp, Homo sapiens
taaaagataagacgg

SEQ ID NO: 217059 - DNA, 15 bp, Homo sapiens
ttaaaagataagacg

SEQ ID NO: 217060 - DNA, 15 bp, Homo sapiens
attaaaagataagac

SEQ ID NO: 217061 - DNA, 15 bp, Homo sapiens
gattaaaagataaga

SEQ ID NO: 217062 - DNA, 15 bp, Homo sapiens
agattaaaagataag

SEQ ID NO: 217063 - DNA, 15 bp, Homo sapiens
gagattaaaagataa

SEQ ID NO: 217064 - DNA, 15 bp, Homo sapiens
agagattaaaagata

SEQ ID NO: 217065 - DNA, 15 bp, Homo sapiens
aagagattaaaagat

SEQ ID NO: 217066 - DNA, 15 bp, Homo sapiens
caagagattaaaaga

SEQ ID NO: 217067 - DNA, 15 bp, Homo sapiens
acaagagattaaaag

SEQ ID NO: 217068 - DNA, 15 bp, Homo sapiens
gacaagagattaaaa

SEQ ID NO: 217069 - DNA, 15 bp, Homo sapiens
agacaagagattaaa

SEQ ID NO: 217070 - DNA, 15 bp, Homo sapiens
aagacaagagattaa

SEQ ID NO: 217071 - DNA, 15 bp, Homo sapiens
aaagacaagagatta

SEQ ID NO: 217072 - DNA, 15 bp, Homo sapiens
gaaagacaagagatt

SEQ ID NO: 217073 - DNA, 15 bp, Homo sapiens
agaaagacaagagat

SEQ ID NO: 217074 - DNA, 15 bp, Homo sapiens
tgagaaagacaagag

SEQ ID NO: 217075 - DNA, 15 bp, Homo sapiens
gtgagaaagacaaga

SEQ ID NO: 217076 - DNA, 15 bp, Homo sapiens
agtgagaaagacaag

SEQ ID NO: 217077 - DNA, 15 bp, Homo sapiens
tagtgagaaagacaa

SEQ ID NO: 217078 - DNA, 15 bp, Homo sapiens
ttagtgagaaagaca

SEQ ID NO: 217079 - DNA, 15 bp, Homo sapiens
cttagtgagaaagac

SEQ ID NO: 217080 - DNA, 15 bp, Homo sapiens
acttagtgagaaaga

SEQ ID NO: 217081 - DNA, 15 bp, Homo sapiens
aacttagtgagaaag

SEQ ID NO: 217082 - DNA, 15 bp, Homo sapiens
caacttagtgagaaa

SEQ ID NO: 217083 - DNA, 15 bp, Homo sapiens
acaacttagtgagaa

SEQ ID NO: 217084 - DNA, 15 bp, Homo sapiens
tacaacttagtgaga

SEQ ID NO: 217085 - DNA, 15 bp, Homo sapiens
ctacaacttagtgag

SEQ ID NO: 217086 - DNA, 15 bp, Homo sapiens
gctacaacttagtga

SEQ ID NO: 217087 - DNA, 15 bp, Homo sapiens
tgctacaacttagtg

SEQ ID NO: 217088 - DNA, 15 bp, Homo sapiens
ctgctacaacttagt

SEQ ID NO: 217089 - DNA, 15 bp, Homo sapiens
cctgctacaacttag

SEQ ID NO: 217090 - DNA, 15 bp, Homo sapiens
acctgctacaactta

SEQ ID NO: 217091 - DNA, 15 bp, Homo sapiens
cacctgctacaactt

SEQ ID NO: 217092 - DNA, 15 bp, Homo sapiens
ccacctgctacaact

SEQ ID NO: 217093 - DNA, 15 bp, Homo sapiens
cccacctgctacaac

SEQ ID NO: 217094 - DNA, 15 bp, Homo sapiens
tcccacctgctacaa

SEQ ID NO: 217095 - DNA, 15 bp, Homo sapiens
ctcccacctgctaca

SEQ ID NO: 217096 - DNA, 15 bp, Homo sapiens
tctcccacctgctac

SEQ ID NO: 217097 - DNA, 15 bp, Homo sapiens
ttctcccacctgcta

SEQ ID NO: 217098 - DNA, 15 bp, Homo sapiens
tttctcccacctgct

SEQ ID NO: 217099 - DNA, 15 bp, Homo sapiens
atttctcccacctgc

SEQ ID NO: 217100 - DNA, 15 bp, Homo sapiens
catttctcccacctg

SEQ ID NO: 217101 - DNA, 15 bp, Homo sapiens
acatttctcccacct

SEQ ID NO: 217102 - DNA, 15 bp, Homo sapiens
aacatttctcccacc

SEQ ID NO: 217103 - DNA, 15 bp, Homo sapiens
gaacatttctcccac

SEQ ID NO: 217104 - DNA, 15 bp, Homo sapiens
ggaacatttctccca

SEQ ID NO: 217105 - DNA, 15 bp, Homo sapiens
tggaacatttctccc

SEQ ID NO: 217106 - DNA, 15 bp, Homo sapiens
ttggaacatttctcc

SEQ ID NO: 217107 - DNA, 15 bp, Homo sapiens
cttggaacatttctc

SEQ ID NO: 217108 - DNA, 15 bp, Homo sapiens
tcttggaacatttct

SEQ ID NO: 217109 - DNA, 15 bp, Homo sapiens
gtcttggaacatttc

SEQ ID NO: 217110 - DNA, 15 bp, Homo sapiens
ggtcttggaacattt

SEQ ID NO: 217111 - DNA, 15 bp, Homo sapiens
tggtcttggaacatt

SEQ ID NO: 217112 - DNA, 15 bp, Homo sapiens
atggtcttggaacat

SEQ ID NO: 217113 - DNA, 15 bp, Homo sapiens
aatggtcttggaaca

SEQ ID NO: 217114 - DNA, 15 bp, Homo sapiens
taatggtcttggaac

SEQ ID NO: 217115 - DNA, 15 bp, Homo sapiens
ttaatggtcttggaa

SEQ ID NO: 217116 - DNA, 15 bp, Homo sapiens
tttaatggtcttgga

SEQ ID NO: 217117 - DNA, 15 bp, Homo sapiens
ctttaatggtcttgg

SEQ ID NO: 217118 - DNA, 15 bp, Homo sapiens
cctttaatggtcttg

SEQ ID NO: 217119 - DNA, 15 bp, Homo sapiens
tcctttaatggtctt

SEQ ID NO: 217120 - DNA, 15 bp, Homo sapiens
ctcctttaatggtct

SEQ ID NO: 217121 - DNA, 15 bp, Homo sapiens
cctcctttaatggtc

SEQ ID NO: 217122 - DNA, 15 bp, Homo sapiens
tcctcctttaatggt

SEQ ID NO: 217123 - DNA, 15 bp, Homo sapiens
atcctcctttaatgg

SEQ ID NO: 217124 - DNA, 15 bp, Homo sapiens
tatcctcctttaatg

SEQ ID NO: 217125 - DNA, 15 bp, Homo sapiens
ttatcctcctttaat

SEQ ID NO: 217126 - DNA, 15 bp, Homo sapiens
attatcctcctttaa

SEQ ID NO: 217127 - DNA, 15 bp, Homo sapiens
aattatcctccttta

SEQ ID NO: 217128 - DNA, 15 bp, Homo sapiens
caattatcctccttt

SEQ ID NO: 217129 - DNA, 15 bp, Homo sapiens
ccaattatcctcctt

SEQ ID NO: 217130 - DNA, 15 bp, Homo sapiens
cccaattatcctcct

SEQ ID NO: 217131 - DNA, 15 bp, Homo sapiens
tcccaattatcctcc

SEQ ID NO: 217132 - DNA, 15 bp, Homo sapiens
ttcccaattatcctc

SEQ ID NO: 217133 - DNA, 15 bp, Homo sapiens
attcccaattatcct

SEQ ID NO: 217134 - DNA, 15 bp, Homo sapiens
gattcccaattatcc

SEQ ID NO: 217135 - DNA, 15 bp, Homo sapiens
agattcccaattatc

SEQ ID NO: 217136 - DNA, 15 bp, Homo sapiens
gagattcccaattat

SEQ ID NO: 217137 - DNA, 15 bp, Homo sapiens
agagattcccaatta

SEQ ID NO: 217138 - DNA, 15 bp, Homo sapiens
cagagattcccaatt

SEQ ID NO: 217139 - DNA, 15 bp, Homo sapiens
acagagattcccaat

SEQ ID NO: 217140 - DNA, 15 bp, Homo sapiens
tacagagattcccaa

SEQ ID NO: 217141 - DNA, 15 bp, Homo sapiens
atacagagattccca

SEQ ID NO: 217142 - DNA, 15 bp, Homo sapiens
tatacagagattccc

SEQ ID NO: 217143 - DNA, 15 bp, Homo sapiens
ctatacagagattcc

SEQ ID NO: 217144 - DNA, 15 bp, Homo sapiens
tctatacagagattc

SEQ ID NO: 217145 - DNA, 15 bp, Homo sapiens
gtctatacagagatt

SEQ ID NO: 217146 - DNA, 15 bp, Homo sapiens
tgtctatacagagat

SEQ ID NO: 217147 - DNA, 15 bp, Homo sapiens
atgtctatacagaga

SEQ ID NO: 217148 - DNA, 15 bp, Homo sapiens
aatgtctatacagag

SEQ ID NO: 217149 - DNA, 15 bp, Homo sapiens
aaatgtctatacaga

SEQ ID NO: 217150 - DNA, 15 bp, Homo sapiens
taaatgtctatacag

SEQ ID NO: 217151 - DNA, 15 bp, Homo sapiens
ttaaatgtctataca

SEQ ID NO: 217152 - DNA, 15 bp, Homo sapiens
tttaaatgtctatac

SEQ ID NO: 217153 - DNA, 15 bp, Homo sapiens
ctttaaatgtctata

SEQ ID NO: 217154 - DNA, 15 bp, Homo sapiens
actttaaatgtctat

SEQ ID NO: 217155 - DNA, 15 bp, Homo sapiens
aactttaaatgtcta

SEQ ID NO: 217156 - DNA, 15 bp, Homo sapiens
caactttaaatgtct

SEQ ID NO: 217157 - DNA, 15 bp, Homo sapiens
tcaactttaaatgtc

SEQ ID NO: 217158 - DNA, 15 bp, Homo sapiens
ttcaactttaaatgt

SEQ ID NO: 217159 - DNA, 15 bp, Homo sapiens
attcaactttaaatg

SEQ ID NO: 217160 - DNA, 15 bp, Homo sapiens
tattcaactttaaat

SEQ ID NO: 217161 - DNA, 15 bp, Homo sapiens
ttattcaactttaaa

SEQ ID NO: 217162 - DNA, 15 bp, Homo sapiens
cttattcaactttaa

SEQ ID NO: 217163 - DNA, 15 bp, Homo sapiens
gcttattcaacttta

SEQ ID NO: 217164 - DNA, 15 bp, Homo sapiens
tgcttattcaacttt

SEQ ID NO: 217165 - DNA, 15 bp, Homo sapiens
ctgcttattcaactt

SEQ ID NO: 217166 - DNA, 15 bp, Homo sapiens
gctgcttattcaact

SEQ ID NO: 217167 - DNA, 15 bp, Homo sapiens
tgctgcttattcaac

SEQ ID NO: 217168 - DNA, 15 bp, Homo sapiens
ctgctgcttattcaa

SEQ ID NO: 217169 - DNA, 15 bp, Homo sapiens
actgctgcttattca

SEQ ID NO: 217170 - DNA, 15 bp, Homo sapiens
aactgctgcttattc

SEQ ID NO: 217171 - DNA, 15 bp, Homo sapiens
aaactgctgcttatt

SEQ ID NO: 217172 - DNA, 15 bp, Homo sapiens
taaactgctgcttat

SEQ ID NO: 217173 - DNA, 15 bp, Homo sapiens
ataaactgctgctta

SEQ ID NO: 217174 - DNA, 15 bp, Homo sapiens
aataaactgctgctt

SEQ ID NO: 217175 - DNA, 15 bp, Homo sapiens
gaataaactgctgct

SEQ ID NO: 217176 - DNA, 15 bp, Homo sapiens
cgaataaactgctgc

SEQ ID NO: 217177 - DNA, 15 bp, Homo sapiens
ccgaataaactgctg

SEQ ID NO: 217178 - DNA, 15 bp, Homo sapiens
gccgaataaactgct

SEQ ID NO: 217179 - DNA, 15 bp, Homo sapiens
agccgaataaactgc

SEQ ID NO: 217180 - DNA, 15 bp, Homo sapiens
cagccgaataaactg

SEQ ID NO: 217181 - DNA, 15 bp, Homo sapiens
gcagccgaataaact

SEQ ID NO: 217182 - DNA, 15 bp, Homo sapiens
ggcagccgaataaac

SEQ ID NO: 217183 - DNA, 15 bp, Homo sapiens
aggcagccgaataaa

SEQ ID NO: 217184 - DNA, 15 bp, Homo sapiens
caggcagccgaataa

SEQ ID NO: 217185 - DNA, 15 bp, Homo sapiens
ccaggcagccgaata

SEQ ID NO: 217186 - DNA, 15 bp, Homo sapiens
accaggcagccgaat

SEQ ID NO: 217187 - DNA, 15 bp, Homo sapiens
caccaggcagccgaa

SEQ ID NO: 217188 - DNA, 15 bp, Homo sapiens
gcaccaggcagccga

SEQ ID NO: 217189 - DNA, 15 bp, Homo sapiens
agcaccaggcagccg

SEQ ID NO: 217190 - DNA, 15 bp, Homo sapiens
gagcaccaggcagcc

SEQ ID NO: 217191 - DNA, 15 bp, Homo sapiens
tgagcaccaggcagc

SEQ ID NO: 217192 - DNA, 15 bp, Homo sapiens
ctgagcaccaggcag

SEQ ID NO: 217193 - DNA, 15 bp, Homo sapiens
tctgagcaccaggca

SEQ ID NO: 217194 - DNA, 15 bp, Homo sapiens
ctctgagcaccaggc

SEQ ID NO: 217195 - DNA, 15 bp, Homo sapiens
cctctgagcaccagg

SEQ ID NO: 217196 - DNA, 15 bp, Homo sapiens
gcctctgagcaccag

SEQ ID NO: 217197 - DNA, 15 bp, Homo sapiens
tgcctctgagcacca

SEQ ID NO: 217198 - DNA, 15 bp, Homo sapiens
gtgcctctgagcacc

SEQ ID NO: 217199 - DNA, 15 bp, Homo sapiens
tgtgcctctgagcac

SEQ ID NO: 217200 - DNA, 15 bp, Homo sapiens
gtgtgcctctgagca

SEQ ID NO: 217201 - DNA, 15 bp, Homo sapiens
ggtgtgcctctgagc

SEQ ID NO: 217202 - DNA, 15 bp, Homo sapiens
tggtgtgcctctgag

SEQ ID NO: 217203 - DNA, 15 bp, Homo sapiens
ctggtgtgcctctga

SEQ ID NO: 217204 - DNA, 15 bp, Homo sapiens
actggtgtgcctctg

SEQ ID NO: 217205 - DNA, 15 bp, Homo sapiens
tactggtgtgcctct

SEQ ID NO: 217206 - DNA, 15 bp, Homo sapiens
ctactggtgtgcctc

SEQ ID NO: 217207 - DNA, 15 bp, Homo sapiens
gctactggtgtgcct

SEQ ID NO: 217208 - DNA, 15 bp, Homo sapiens
tgctactggtgtgcc

SEQ ID NO: 217209 - DNA, 15 bp, Homo sapiens
atgctactggtgtgc

SEQ ID NO: 217210 - DNA, 15 bp, Homo sapiens
gatgctactggtgtg

SEQ ID NO: 217211 - DNA, 15 bp, Homo sapiens
ggatgctactggtgt

SEQ ID NO: 217212 - DNA, 15 bp, Homo sapiens
tggatgctactggtg

SEQ ID NO: 217213 - DNA, 15 bp, Homo sapiens
ttggatgctactggt

SEQ ID NO: 217214 - DNA, 15 bp, Homo sapiens
tttggatgctactgg

SEQ ID NO: 217215 - DNA, 15 bp, Homo sapiens
ctttggatgctactg

SEQ ID NO: 217216 - DNA, 15 bp, Homo sapiens
tctttggatgctact

SEQ ID NO: 217217 - DNA, 15 bp, Homo sapiens
ctctttggatgctac

SEQ ID NO: 217218 - DNA, 15 bp, Homo sapiens
gctctttggatgcta

SEQ ID NO: 217219 - DNA, 15 bp, Homo sapiens
tgctctttggatgct

SEQ ID NO: 217220 - DNA, 15 bp, Homo sapiens
gtgctctttggatgc

SEQ ID NO: 217221 - DNA, 15 bp, Homo sapiens
ggtgctctttggatg

SEQ ID NO: 217222 - DNA, 15 bp, Homo sapiens
gggtgctctttggat

SEQ ID NO: 217223 - DNA, 15 bp, Homo sapiens
agggtgctctttgga

SEQ ID NO: 217224 - DNA, 15 bp, Homo sapiens
cagggtgctctttgg

SEQ ID NO: 217225 - DNA, 15 bp, Homo sapiens
tcagggtgctctttg

SEQ ID NO: 217226 - DNA, 15 bp, Homo sapiens
ctcagggtgctcttt

SEQ ID NO: 217227 - DNA, 15 bp, Homo sapiens
actcagggtgctctt

SEQ ID NO: 217228 - DNA, 15 bp, Homo sapiens
aactcagggtgctct

SEQ ID NO: 217229 - DNA, 15 bp, Homo sapiens
gaactcagggtgctc

SEQ ID NO: 217230 - DNA, 15 bp, Homo sapiens
cgaactcagggtgct

SEQ ID NO: 217231 - DNA, 15 bp, Homo sapiens
tcgaactcagggtgc

SEQ ID NO: 217232 - DNA, 15 bp, Homo sapiens
ttcgaactcagggtg

SEQ ID NO: 217233 - DNA, 15 bp, Homo sapiens
cttcgaactcagggt

SEQ ID NO: 217234 - DNA, 15 bp, Homo sapiens
ccttcgaactcaggg

SEQ ID NO: 217235 - DNA, 15 bp, Homo sapiens
tccttcgaactcagg

SEQ ID NO: 217236 - DNA, 15 bp, Homo sapiens
ctccttcgaactcag

SEQ ID NO: 217237 - DNA, 15 bp, Homo sapiens
actccttcgaactca

SEQ ID NO: 217238 - DNA, 15 bp, Homo sapiens
gactccttcgaactc

SEQ ID NO: 217239 - DNA, 15 bp, Homo sapiens
cgactccttcgaact

SEQ ID NO: 217240 - DNA, 15 bp, Homo sapiens
ccgactccttcgaac

SEQ ID NO: 217241 - DNA, 15 bp, Homo sapiens
tccgactccttcgaa

SEQ ID NO: 217242 - DNA, 15 bp, Homo sapiens
ctccgactccttcga

SEQ ID NO: 217243 - DNA, 15 bp, Homo sapiens
tctccgactccttcg

SEQ ID NO: 217244 - DNA, 15 bp, Homo sapiens
ctctccgactccttc

SEQ ID NO: 217245 - DNA, 15 bp, Homo sapiens
cctctccgactcctt

SEQ ID NO: 217246 - DNA, 15 bp, Homo sapiens
acctctccgactcct

SEQ ID NO: 217247 - DNA, 15 bp, Homo sapiens
cacctctccgactcc

SEQ ID NO: 217248 - DNA, 15 bp, Homo sapiens
ccacctctccgactc

SEQ ID NO: 217249 - DNA, 15 bp, Homo sapiens
cccacctctccgact

SEQ ID NO: 217250 - DNA, 15 bp, Homo sapiens
tcccacctctccgac

SEQ ID NO: 217251 - DNA, 15 bp, Homo sapiens
gtcccacctctccga

SEQ ID NO: 217252 - DNA, 15 bp, Homo sapiens
tgtcccacctctccg

SEQ ID NO: 217253 - DNA, 15 bp, Homo sapiens
ctgtcccacctctcc

SEQ ID NO: 217254 - DNA, 15 bp, Homo sapiens
cctgtcccacctctc

SEQ ID NO: 217255 - DNA, 15 bp, Homo sapiens
tcctgtcccacctct

SEQ ID NO: 217256 - DNA, 15 bp, Homo sapiens
ctcctgtcccacctc

SEQ ID NO: 217257 - DNA, 15 bp, Homo sapiens
cctcctgtcccacct

SEQ ID NO: 217258 - DNA, 15 bp, Homo sapiens
tcctcctgtcccacc

SEQ ID NO: 217259 - DNA, 15 bp, Homo sapiens
ttcctcctgtcccac

SEQ ID NO: 217260 - DNA, 15 bp, Homo sapiens
cttcctcctgtccca

SEQ ID NO: 217261 - DNA, 15 bp, Homo sapiens
ccttcctcctgtccc

SEQ ID NO: 217262 - DNA, 15 bp, Homo sapiens
cccttcctcctgtcc

SEQ ID NO: 217263 - DNA, 15 bp, Homo sapiens
acccttcctcctgtc

SEQ ID NO: 217264 - DNA, 15 bp, Homo sapiens
cacccttcctcctgt

SEQ ID NO: 217265 - DNA, 15 bp, Homo sapiens
acacccttcctcctg

SEQ ID NO: 217266 - DNA, 15 bp, Homo sapiens
gacacccttcctcct

SEQ ID NO: 217267 - DNA, 15 bp, Homo sapiens
agacacccttcctcc

SEQ ID NO: 217268 - DNA, 15 bp, Homo sapiens
aagacacccttcctc

SEQ ID NO: 217269 - DNA, 15 bp, Homo sapiens
gaagacacccttcct

SEQ ID NO: 217270 - DNA, 15 bp, Homo sapiens
tgaagacacccttcc

SEQ ID NO: 217271 - DNA, 15 bp, Homo sapiens
ttgaagacacccttc

SEQ ID NO: 217272 - DNA, 15 bp, Homo sapiens
attgaagacaccctt

SEQ ID NO: 217273 - DNA, 15 bp, Homo sapiens
tattgaagacaccct

SEQ ID NO: 217274 - DNA, 15 bp, Homo sapiens
ttattgaagacaccc

SEQ ID NO: 217275 - DNA, 15 bp, Homo sapiens
tttattgaagacacc

SEQ ID NO: 217276 - DNA, 15 bp, Homo sapiens
ctttattgaagacac

SEQ ID NO: 217277 - DNA, 15 bp, Homo sapiens
actttattgaagaca

SEQ ID NO: 217278 - DNA, 15 bp, Homo sapiens
cactttattgaagac

SEQ ID NO: 217279 - DNA, 15 bp, Homo sapiens
tcactttattgaaga

SEQ ID NO: 217280 - DNA, 15 bp, Homo sapiens
ttcactttattgaag

SEQ ID NO: 217281 - DNA, 15 bp, Homo sapiens
attcactttattgaa

SEQ ID NO: 217282 - DNA, 15 bp, Homo sapiens
aattcactttattga

SEQ ID NO: 217283 - DNA, 15 bp, Homo sapiens
gaattcactttattg

SEQ ID NO: 217284 - DNA, 15 bp, Homo sapiens
tgaattcactttatt

SEQ ID NO: 217285 - DNA, 15 bp, Homo sapiens
ctgaattcactttat

SEQ ID NO: 217286 - DNA, 15 bp, Homo sapiens
cctgaattcacttta

SEQ ID NO: 217287 - DNA, 15 bp, Homo sapiens
gcctgaattcacttt

SEQ ID NO: 217288 - DNA, 15 bp, Homo sapiens
agcctgaattcactt

SEQ ID NO: 217289 - DNA, 15 bp, Homo sapiens
gagcctgaattcact

SEQ ID NO: 217290 - DNA, 15 bp, Homo sapiens
agagcctgaattcac

SEQ ID NO: 217291 - DNA, 15 bp, Homo sapiens
aagagcctgaattca

SEQ ID NO: 217292 - DNA, 15 bp, Homo sapiens
taagagcctgaattc

SEQ ID NO: 217293 - DNA, 15 bp, Homo sapiens
ctaagagcctgaatt

SEQ ID NO: 217294 - DNA, 15 bp, Homo sapiens
tctaagagcctgaat

SEQ ID NO: 217295 - DNA, 15 bp, Homo sapiens
gtctaagagcctgaa

SEQ ID NO: 217296 - DNA, 15 bp, Homo sapiens
tgtctaagagcctga

SEQ ID NO: 217297 - DNA, 15 bp, Homo sapiens
atgtctaagagcctg

SEQ ID NO: 217298 - DNA, 15 bp, Homo sapiens
aatgtctaagagcct

SEQ ID NO: 217299 - DNA, 15 bp, Homo sapiens
gaatgtctaagagcc

SEQ ID NO: 217300 - DNA, 15 bp, Homo sapiens
agaatgtctaagagc

SEQ ID NO: 217301 - DNA, 15 bp, Homo sapiens
cagaatgtctaagag

SEQ ID NO: 217302 - DNA, 15 bp, Homo sapiens
acagaatgtctaaga

SEQ ID NO: 217303 - DNA, 15 bp, Homo sapiens
aacagaatgtctaag

SEQ ID NO: 217304 - DNA, 15 bp, Homo sapiens
caacagaatgtctaa

SEQ ID NO: 217305 - DNA, 15 bp, Homo sapiens
tcaacagaatgtcta

SEQ ID NO: 217306 - DNA, 15 bp, Homo sapiens
ctcaacagaatgtct

SEQ ID NO: 217307 - DNA, 15 bp, Homo sapiens
tctcaacagaatgtc

SEQ ID NO: 217308 - DNA, 15 bp, Homo sapiens
ttctcaacagaatgt

SEQ ID NO: 217309 - DNA, 15 bp, Homo sapiens
attctcaacagaatg

SEQ ID NO: 217310 - DNA, 15 bp, Homo sapiens
cattctcaacagaat

SEQ ID NO: 217311 - DNA, 15 bp, Homo sapiens
ccattctcaacagaa

SEQ ID NO: 217312 - DNA, 15 bp, Homo sapiens
tccattctcaacaga

SEQ ID NO: 217313 - DNA, 15 bp, Homo sapiens
ttccattctcaacag

SEQ ID NO: 217314 - DNA, 15 bp, Homo sapiens
tttccattctcaaca

SEQ ID NO: 217315 - DNA, 15 bp, Homo sapiens
gtttccattctcaac

SEQ ID NO: 217316 - DNA, 15 bp, Homo sapiens
agtttccattctcaa

SEQ ID NO: 217317 - DNA, 15 bp, Homo sapiens
cagtttccattctca

SEQ ID NO: 217318 - DNA, 15 bp, Homo sapiens
acagtttccattctc

SEQ ID NO: 217319 - DNA, 15 bp, Homo sapiens
cacagtttccattct

SEQ ID NO: 217320 - DNA, 15 bp, Homo sapiens
tcacagtttccattc

SEQ ID NO: 217321 - DNA, 15 bp, Homo sapiens
atcacagtttccatt

SEQ ID NO: 217322 - DNA, 15 bp, Homo sapiens
aatcacagtttccat

SEQ ID NO: 217323 - DNA, 15 bp, Homo sapiens
aaatcacagtttcca

SEQ ID NO: 217324 - DNA, 15 bp, Homo sapiens
aaaatcacagtttcc

SEQ ID NO: 217325 - DNA, 15 bp, Homo sapiens
aaaaatcacagtttc

SEQ ID NO: 217326 - DNA, 15 bp, Homo sapiens
taaaaatcacagttt

SEQ ID NO: 217327 - DNA, 15 bp, Homo sapiens
ctaaaaatcacagtt

SEQ ID NO: 217328 - DNA, 15 bp, Homo sapiens
actaaaaatcacagt

SEQ ID NO: 217329 - DNA, 15 bp, Homo sapiens
tactaaaaatcacag

SEQ ID NO: 217330 - DNA, 15 bp, Homo sapiens
ctactaaaaatcaca

SEQ ID NO: 217331 - DNA, 15 bp, Homo sapiens
gctactaaaaatcac

SEQ ID NO: 217332 - DNA, 15 bp, Homo sapiens
agctactaaaaatca

SEQ ID NO: 217333 - DNA, 15 bp, Homo sapiens
tagctactaaaaatc

SEQ ID NO: 217334 - DNA, 15 bp, Homo sapiens
gtagctactaaaaat

SEQ ID NO: 217335 - DNA, 15 bp, Homo sapiens
tgtagctactaaaaa

SEQ ID NO: 217336 - DNA, 15 bp, Homo sapiens
atgtagctactaaaa

SEQ ID NO: 217337 - DNA, 15 bp, Homo sapiens
aatgtagctactaaa

SEQ ID NO: 217338 - DNA, 15 bp, Homo sapiens
gaatgtagctactaa

SEQ ID NO: 217339 - DNA, 15 bp, Homo sapiens
agaatgtagctacta

SEQ ID NO: 217340 - DNA, 15 bp, Homo sapiens
cagaatgtagctact

SEQ ID NO: 217341 - DNA, 15 bp, Homo sapiens
tcagaatgtagctac

SEQ ID NO: 217342 - DNA, 15 bp, Homo sapiens
atcagaatgtagcta

SEQ ID NO: 217343 - DNA, 15 bp, Homo sapiens
tatcagaatgtagct

SEQ ID NO: 217344 - DNA, 15 bp, Homo sapiens
atatcagaatgtagc

SEQ ID NO: 217345 - DNA, 15 bp, Homo sapiens
aatatcagaatgtag

SEQ ID NO: 217346 - DNA, 15 bp, Homo sapiens
aaatatcagaatgta

SEQ ID NO: 217347 - DNA, 15 bp, Homo sapiens
taaatatcagaatgt

SEQ ID NO: 217348 - DNA, 15 bp, Homo sapiens
gtaaatatcagaatg

SEQ ID NO: 217349 - DNA, 15 bp, Homo sapiens
tgtaaatatcagaat

SEQ ID NO: 217350 - DNA, 15 bp, Homo sapiens
ttgtaaatatcagaa

SEQ ID NO: 217351 - DNA, 15 bp, Homo sapiens
attgtaaatatcaga

SEQ ID NO: 217352 - DNA, 15 bp, Homo sapiens
gattgtaaatatcag

SEQ ID NO: 217353 - DNA, 15 bp, Homo sapiens
tgattgtaaatatca

SEQ ID NO: 217354 - DNA, 15 bp, Homo sapiens
ctgattgtaaatatc

SEQ ID NO: 217355 - DNA, 15 bp, Homo sapiens
cctgattgtaaatat

SEQ ID NO: 217356 - DNA, 15 bp, Homo sapiens
acctgattgtaaata

SEQ ID NO: 217357 - DNA, 15 bp, Homo sapiens
gacctgattgtaaat

SEQ ID NO: 217358 - DNA, 15 bp, Homo sapiens
agacctgattgtaaa

SEQ ID NO: 217359 - DNA, 15 bp, Homo sapiens
aagacctgattgtaa

SEQ ID NO: 217360 - DNA, 15 bp, Homo sapiens
gaagacctgattgta

SEQ ID NO: 217361 - DNA, 15 bp, Homo sapiens
tgaagacctgattgt

SEQ ID NO: 217362 - DNA, 15 bp, Homo sapiens
atgaagacctgattg

SEQ ID NO: 217363 - DNA, 15 bp, Homo sapiens
aatgaagacctgatt

SEQ ID NO: 217364 - DNA, 15 bp, Homo sapiens
taatgaagacctgat

SEQ ID NO: 217365 - DNA, 15 bp, Homo sapiens
ttaatgaagacctga

SEQ ID NO: 217366 - DNA, 15 bp, Homo sapiens
attaatgaagacctg

SEQ ID NO: 217367 - DNA, 15 bp, Homo sapiens
gattaatgaagacct

SEQ ID NO: 217368 - DNA, 15 bp, Homo sapiens
agattaatgaagacc

SEQ ID NO: 217369 - DNA, 15 bp, Homo sapiens
cagattaatgaagac

SEQ ID NO: 217370 - DNA, 15 bp, Homo sapiens
gcagattaatgaaga

SEQ ID NO: 217371 - DNA, 15 bp, Homo sapiens
ggcagattaatgaag

SEQ ID NO: 217372 - DNA, 15 bp, Homo sapiens
tggcagattaatgaa

SEQ ID NO: 217373 - DNA, 15 bp, Homo sapiens
atggcagattaatga

SEQ ID NO: 217374 - DNA, 15 bp, Homo sapiens
aatggcagattaatg

SEQ ID NO: 217375 - DNA, 15 bp, Homo sapiens
aaatggcagattaat

SEQ ID NO: 217376 - DNA, 15 bp, Homo sapiens
gaaatggcagattaa

SEQ ID NO: 217377 - DNA, 15 bp, Homo sapiens
tgaaatggcagatta

SEQ ID NO: 217378 - DNA, 15 bp, Homo sapiens
gtgaaatggcagatt

SEQ ID NO: 217379 - DNA, 15 bp, Homo sapiens
cgtgaaatggcagat

SEQ ID NO: 217380 - DNA, 15 bp, Homo sapiens
ccgtgaaatggcaga

SEQ ID NO: 217381 - DNA, 15 bp, Homo sapiens
gccgtgaaatggcag

SEQ ID NO: 217382 - DNA, 15 bp, Homo sapiens
agccgtgaaatggca

SEQ ID NO: 217383 - DNA, 15 bp, Homo sapiens
aagccgtgaaatggc

SEQ ID NO: 217384 - DNA, 15 bp, Homo sapiens
gaagccgtgaaatgg

SEQ ID NO: 217385 - DNA, 15 bp, Homo sapiens
tgaagccgtgaaatg

SEQ ID NO: 217386 - DNA, 15 bp, Homo sapiens
atgaagccgtgaaat

SEQ ID NO: 217387 - DNA, 15 bp, Homo sapiens
aatgaagccgtgaaa

SEQ ID NO: 217388 - DNA, 15 bp, Homo sapiens
aaatgaagccgtgaa

SEQ ID NO: 217389 - DNA, 15 bp, Homo sapiens
taaatgaagccgtga

SEQ ID NO: 217390 - DNA, 15 bp, Homo sapiens
ctaaatgaagccgtg

SEQ ID NO: 217391 - DNA, 15 bp, Homo sapiens
actaaatgaagccgt

SEQ ID NO: 217392 - DNA, 15 bp, Homo sapiens
aactaaatgaagccg

SEQ ID NO: 217393 - DNA, 15 bp, Homo sapiens
aaactaaatgaagcc

SEQ ID NO: 217394 - DNA, 15 bp, Homo sapiens
taaactaaatgaagc

SEQ ID NO: 217395 - DNA, 15 bp, Homo sapiens
ttaaactaaatgaag

SEQ ID NO: 217396 - DNA, 15 bp, Homo sapiens
cttaaactaaatgaa

SEQ ID NO: 217397 - DNA, 15 bp, Homo sapiens
acttaaactaaatga

SEQ ID NO: 217398 - DNA, 15 bp, Homo sapiens
tacttaaactaaatg

SEQ ID NO: 217399 - DNA, 15 bp, Homo sapiens
cttacttaaactaaa

SEQ ID NO: 217400 - DNA, 15 bp, Homo sapiens
acttacttaaactaa

SEQ ID NO: 217401 - DNA, 15 bp, Homo sapiens
tacttacttaaacta

SEQ ID NO: 217402 - DNA, 15 bp, Homo sapiens
atacttacttaaact

SEQ ID NO: 217403 - DNA, 15 bp, Homo sapiens
catacttacttaaac

SEQ ID NO: 217404 - DNA, 15 bp, Homo sapiens
acatacttacttaaa

SEQ ID NO: 217405 - DNA, 15 bp, Homo sapiens
cacatacttacttaa

SEQ ID NO: 217406 - DNA, 15 bp, Homo sapiens
ccacatacttactta

SEQ ID NO: 217407 - DNA, 15 bp, Homo sapiens
tccacatacttactt

SEQ ID NO: 217408 - DNA, 15 bp, Homo sapiens
ttccacatacttact

SEQ ID NO: 217409 - DNA, 15 bp, Homo sapiens
cttccacatacttac

SEQ ID NO: 217410 - DNA, 15 bp, Homo sapiens
ccttccacatactta

SEQ ID NO: 217411 - DNA, 15 bp, Homo sapiens
accttccacatactt

SEQ ID NO: 217412 - DNA, 15 bp, Homo sapiens
taccttccacatact

SEQ ID NO: 217413 - DNA, 15 bp, Homo sapiens
gtaccttccacatac

SEQ ID NO: 217414 - DNA, 15 bp, Homo sapiens
tgtaccttccacata

SEQ ID NO: 217415 - DNA, 15 bp, Homo sapiens
gtgtaccttccacat

SEQ ID NO: 217416 - DNA, 15 bp, Homo sapiens
tgtgtaccttccaca

SEQ ID NO: 217417 - DNA, 15 bp, Homo sapiens
ttgtgtaccttccac

SEQ ID NO: 217418 - DNA, 15 bp, Homo sapiens
attgtgtaccttcca

SEQ ID NO: 217419 - DNA, 15 bp, Homo sapiens
gattgtgtaccttcc

SEQ ID NO: 217420 - DNA, 15 bp, Homo sapiens
cgattgtgtaccttc

SEQ ID NO: 217421 - DNA, 15 bp, Homo sapiens
ccgattgtgtacctt

SEQ ID NO: 217422 - DNA, 15 bp, Homo sapiens
tccgattgtgtacct

SEQ ID NO: 217423 - DNA, 15 bp, Homo sapiens
gtccgattgtgtacc

SEQ ID NO: 217424 - DNA, 15 bp, Homo sapiens
tgtccgattgtgtac

SEQ ID NO: 217425 - DNA, 15 bp, Homo sapiens
ttgtccgattgtgta

SEQ ID NO: 217426 - DNA, 15 bp, Homo sapiens
cttgtccgattgtgt

SEQ ID NO: 217427 - DNA, 15 bp, Homo sapiens
gcttgtccgattgtg

SEQ ID NO: 217428 - DNA, 15 bp, Homo sapiens
ggcttgtccgattgt

SEQ ID NO: 217429 - DNA, 15 bp, Homo sapiens
tggcttgtccgattg

SEQ ID NO: 217430 - DNA, 15 bp, Homo sapiens
atggcttgtccgatt

SEQ ID NO: 217431 - DNA, 15 bp, Homo sapiens
catggcttgtccgat

SEQ ID NO: 217432 - DNA, 15 bp, Homo sapiens
tcatggcttgtccga

SEQ ID NO: 217433 - DNA, 15 bp, Homo sapiens
ctcatggcttgtccg

SEQ ID NO: 217434 - DNA, 15 bp, Homo sapiens
tctcatggcttgtcc

SEQ ID NO: 217435 - DNA, 15 bp, Homo sapiens
ctctcatggcttgtc

SEQ ID NO: 217436 - DNA, 15 bp, Homo sapiens
tctctcatggcttgt

SEQ ID NO: 217437 - DNA, 15 bp, Homo sapiens
gtctctcatggcttg

SEQ ID NO: 217438 - DNA, 15 bp, Homo sapiens
agtctctcatggctt

SEQ ID NO: 217439 - DNA, 15 bp, Homo sapiens
tagtctctcatggct

SEQ ID NO: 217440 - DNA, 15 bp, Homo sapiens
gtagtctctcatggc

SEQ ID NO: 217441 - DNA, 15 bp, Homo sapiens
tgtagtctctcatgg

SEQ ID NO: 217442 - DNA, 15 bp, Homo sapiens
atgtagtctctcatg

SEQ ID NO: 217443 - DNA, 15 bp, Homo sapiens
aatgtagtctctcat

SEQ ID NO: 217444 - DNA, 15 bp, Homo sapiens
taatgtagtctctca

SEQ ID NO: 217445 - DNA, 15 bp, Homo sapiens
gtaatgtagtctctc

SEQ ID NO: 217446 - DNA, 15 bp, Homo sapiens
ggtaatgtagtctct

SEQ ID NO: 217447 - DNA, 15 bp, Homo sapiens
aggtaatgtagtctc

SEQ ID NO: 217448 - DNA, 15 bp, Homo sapiens
aaggtaatgtagtct

SEQ ID NO: 217449 - DNA, 15 bp, Homo sapiens
gaaggtaatgtagtc

SEQ ID NO: 217450 - DNA, 15 bp, Homo sapiens
tgaaggtaatgtagt

SEQ ID NO: 217451 - DNA, 15 bp, Homo sapiens
ttgaaggtaatgtag

SEQ ID NO: 217452 - DNA, 15 bp, Homo sapiens
attgaaggtaatgta

SEQ ID NO: 217453 - DNA, 15 bp, Homo sapiens
cattgaaggtaatgt

SEQ ID NO: 217454 - DNA, 15 bp, Homo sapiens
acattgaaggtaatg

SEQ ID NO: 217455 - DNA, 15 bp, Homo sapiens
cacattgaaggtaat

SEQ ID NO: 217456 - DNA, 15 bp, Homo sapiens
acacattgaaggtaa

SEQ ID NO: 217457 - DNA, 15 bp, Homo sapiens
aacacattgaaggta

SEQ ID NO: 217458 - DNA, 15 bp, Homo sapiens
aaacacattgaaggt

SEQ ID NO: 217459 - DNA, 15 bp, Homo sapiens
taaacacattgaagg

SEQ ID NO: 217460 - DNA, 15 bp, Homo sapiens
ataaacacattgaag

SEQ ID NO: 217461 - DNA, 15 bp, Homo sapiens
aataaacacattgaa

SEQ ID NO: 217462 - DNA, 15 bp, Homo sapiens
gaataaacacattga

SEQ ID NO: 217463 - DNA, 15 bp, Homo sapiens
agaataaacacattg

SEQ ID NO: 217464 - DNA, 15 bp, Homo sapiens
tagaataaacacatt

SEQ ID NO: 217465 - DNA, 15 bp, Homo sapiens
atagaataaacacat

SEQ ID NO: 217466 - DNA, 15 bp, Homo sapiens
gatagaataaacaca

SEQ ID NO: 217467 - DNA, 15 bp, Homo sapiens
agatagaataaacac

SEQ ID NO: 217468 - DNA, 15 bp, Homo sapiens
cagatagaataaaca

SEQ ID NO: 217469 - DNA, 15 bp, Homo sapiens
acagatagaataaac

SEQ ID NO: 217470 - DNA, 15 bp, Homo sapiens
aacagatagaataaa

SEQ ID NO: 217471 - DNA, 15 bp, Homo sapiens
aaacagatagaataa

SEQ ID NO: 217472 - DNA, 15 bp, Homo sapiens
aaaacagatagaata

SEQ ID NO: 217473 - DNA, 15 bp, Homo sapiens
gaaaacagatagaat

SEQ ID NO: 217474 - DNA, 15 bp, Homo sapiens
agaaaacagatagaa

SEQ ID NO: 217475 - DNA, 15 bp, Homo sapiens
aagaaaacagataga

SEQ ID NO: 217476 - DNA, 15 bp, Homo sapiens
caagaaaacagatag

SEQ ID NO: 217477 - DNA, 15 bp, Homo sapiens
tcaagaaaacagata

SEQ ID NO: 217478 - DNA, 15 bp, Homo sapiens
ctcaagaaaacagat

SEQ ID NO: 217479 - DNA, 15 bp, Homo sapiens
actcaagaaaacaga

SEQ ID NO: 217480 - DNA, 15 bp, Homo sapiens
aactcaagaaaacag

SEQ ID NO: 217481 - DNA, 15 bp, Homo sapiens
caactcaagaaaaca

SEQ ID NO: 217482 - DNA, 15 bp, Homo sapiens
gcaactcaagaaaac

SEQ ID NO: 217483 - DNA, 15 bp, Homo sapiens
agcaactcaagaaaa

SEQ ID NO: 217484 - DNA, 15 bp, Homo sapiens
aagcaactcaagaaa

SEQ ID NO: 217485 - DNA, 15 bp, Homo sapiens
aaagcaactcaagaa

SEQ ID NO: 217486 - DNA, 15 bp, Homo sapiens
gaaagcaactcaaga

SEQ ID NO: 217487 - DNA, 15 bp, Homo sapiens
ggaaagcaactcaag

SEQ ID NO: 217488 - DNA, 15 bp, Homo sapiens
tggaaagcaactcaa

SEQ ID NO: 217489 - DNA, 15 bp, Homo sapiens
gtggaaagcaactca

SEQ ID NO: 217490 - DNA, 15 bp, Homo sapiens
ggtggaaagcaactc

SEQ ID NO: 217491 - DNA, 15 bp, Homo sapiens
aggtggaaagcaact

SEQ ID NO: 217492 - DNA, 15 bp, Homo sapiens
aaggtggaaagcaac

SEQ ID NO: 217493 - DNA, 15 bp, Homo sapiens
taaggtggaaagcaa

SEQ ID NO: 217494 - DNA, 15 bp, Homo sapiens
ataaggtggaaagca

SEQ ID NO: 217495 - DNA, 15 bp, Homo sapiens
aataaggtggaaagc

SEQ ID NO: 217496 - DNA, 15 bp, Homo sapiens
taataaggtggaaag

SEQ ID NO: 217497 - DNA, 15 bp, Homo sapiens
gtaataaggtggaaa

SEQ ID NO: 217498 - DNA, 15 bp, Homo sapiens
ggtaataaggtggaa

SEQ ID NO: 217499 - DNA, 15 bp, Homo sapiens
aggtaataaggtgga

SEQ ID NO: 217500 - DNA, 15 bp, Homo sapiens
gaggtaataaggtgg

SEQ ID NO: 217501 - DNA, 15 bp, Homo sapiens
agaggtaataaggtg

SEQ ID NO: 217502 - DNA, 15 bp, Homo sapiens
tagaggtaataaggt

SEQ ID NO: 217503 - DNA, 15 bp, Homo sapiens
ttagaggtaataagg

SEQ ID NO: 217504 - DNA, 15 bp, Homo sapiens
cttagaggtaataag

SEQ ID NO: 217505 - DNA, 15 bp, Homo sapiens
gcttagaggtaataa

SEQ ID NO: 217506 - DNA, 15 bp, Homo sapiens
agcttagaggtaata

SEQ ID NO: 217507 - DNA, 15 bp, Homo sapiens
tagcttagaggtaat

SEQ ID NO: 217508 - DNA, 15 bp, Homo sapiens
ctagcttagaggtaa

SEQ ID NO: 217509 - DNA, 15 bp, Homo sapiens
actagcttagaggta

SEQ ID NO: 217510 - DNA, 15 bp, Homo sapiens
aactagcttagaggt

SEQ ID NO: 217511 - DNA, 15 bp, Homo sapiens
taactagcttagagg

SEQ ID NO: 217512 - DNA, 15 bp, Homo sapiens
gtaactagcttagag

SEQ ID NO: 217513 - DNA, 15 bp, Homo sapiens
tgtaactagcttaga

SEQ ID NO: 217514 - DNA, 15 bp, Homo sapiens
ttgtaactagcttag

SEQ ID NO: 217515 - DNA, 15 bp, Homo sapiens
attgtaactagctta

SEQ ID NO: 217516 - DNA, 15 bp, Homo sapiens
aattgtaactagctt

SEQ ID NO: 217517 - DNA, 15 bp, Homo sapiens
aaattgtaactagct

SEQ ID NO: 217518 - DNA, 15 bp, Homo sapiens
aaaattgtaactagc

SEQ ID NO: 217519 - DNA, 15 bp, Homo sapiens
aaaaattgtaactag

SEQ ID NO: 217520 - DNA, 15 bp, Homo sapiens
aaaaaattgtaacta

SEQ ID NO: 217521 - DNA, 15 bp, Homo sapiens
aaaaaaattgtaact

SEQ ID NO: 217522 - DNA, 15 bp, Homo sapiens
aaaaaaaattgtaac

SEQ ID NO: 217523 - DNA, 15 bp, Homo sapiens
gaaaaaaaattgtaa

SEQ ID NO: 217524 - DNA, 15 bp, Homo sapiens
tgaaaaaaaattgta

SEQ ID NO: 217525 - DNA, 15 bp, Homo sapiens
ttgaaaaaaaattgt

SEQ ID NO: 217526 - DNA, 15 bp, Homo sapiens
gttgaaaaaaaattg

SEQ ID NO: 217527 - DNA, 15 bp, Homo sapiens
tgttgaaaaaaaatt

SEQ ID NO: 217528 - DNA, 15 bp, Homo sapiens
gtgttgaaaaaaaat

SEQ ID NO: 217529 - DNA, 15 bp, Homo sapiens
tgtgttgaaaaaaaa

SEQ ID NO: 217530 - DNA, 15 bp, Homo sapiens
gtgtgttgaaaaaaa

SEQ ID NO: 217531 - DNA, 15 bp, Homo sapiens
tgtgtgttgaaaaaa

SEQ ID NO: 217532 - DNA, 15 bp, Homo sapiens
ctgtgtgttgaaaaa

SEQ ID NO: 217533 - DNA, 15 bp, Homo sapiens
gctgtgtgttgaaaa

SEQ ID NO: 217534 - DNA, 15 bp, Homo sapiens
agctgtgtgttgaaa

SEQ ID NO: 217535 - DNA, 15 bp, Homo sapiens
gagctgtgtgttgaa

SEQ ID NO: 217536 - DNA, 15 bp, Homo sapiens
tgagctgtgtgttga

SEQ ID NO: 217537 - DNA, 15 bp, Homo sapiens
atgagctgtgtgttg

SEQ ID NO: 217538 - DNA, 15 bp, Homo sapiens
catgagctgtgtgtt

SEQ ID NO: 217539 - DNA, 15 bp, Homo sapiens
acatgagctgtgtgt

SEQ ID NO: 217540 - DNA, 15 bp, Homo sapiens
cacatgagctgtgtg

SEQ ID NO: 217541 - DNA, 15 bp, Homo sapiens
acacatgagctgtgt

SEQ ID NO: 217542 - DNA, 15 bp, Homo sapiens
cacacatgagctgtg

SEQ ID NO: 217543 - DNA, 15 bp, Homo sapiens
acacacatgagctgt

SEQ ID NO: 217544 - DNA, 15 bp, Homo sapiens
aacacacatgagctg

SEQ ID NO: 217545 - DNA, 15 bp, Homo sapiens
aaacacacatgagct

SEQ ID NO: 217546 - DNA, 15 bp, Homo sapiens
caaacacacatgagc

SEQ ID NO: 217547 - DNA, 15 bp, Homo sapiens
tcaaacacacatgag

SEQ ID NO: 217548 - DNA, 15 bp, Homo sapiens
ctcaaacacacatga

SEQ ID NO: 217549 - DNA, 15 bp, Homo sapiens
tctcaaacacacatg

SEQ ID NO: 217550 - DNA, 15 bp, Homo sapiens
ttctcaaacacacat

SEQ ID NO: 217551 - DNA, 15 bp, Homo sapiens
cttctcaaacacaca

SEQ ID NO: 217552 - DNA, 15 bp, Homo sapiens
ccttctcaaacacac

SEQ ID NO: 217553 - DNA, 15 bp, Homo sapiens
accttctcaaacaca

SEQ ID NO: 217554 - DNA, 15 bp, Homo sapiens
aaccttctcaaacac

SEQ ID NO: 217555 - DNA, 15 bp, Homo sapiens
caaccttctcaaaca

SEQ ID NO: 217556 - DNA, 15 bp, Homo sapiens
tcaaccttctcaaac

SEQ ID NO: 217557 - DNA, 15 bp, Homo sapiens
gtcaaccttctcaaa

SEQ ID NO: 217558 - DNA, 15 bp, Homo sapiens
ggtcaaccttctcaa

SEQ ID NO: 217559 - DNA, 15 bp, Homo sapiens
aggtcaaccttctca

SEQ ID NO: 217560 - DNA, 15 bp, Homo sapiens
gaggtcaaccttctc

SEQ ID NO: 217561 - DNA, 15 bp, Homo sapiens
ggaggtcaaccttct

SEQ ID NO: 217562 - DNA, 15 bp, Homo sapiens
gggaggtcaaccttc

SEQ ID NO: 217563 - DNA, 15 bp, Homo sapiens
agggaggtcaacctt

SEQ ID NO: 217564 - DNA, 15 bp, Homo sapiens
gagggaggtcaacct

SEQ ID NO: 217565 - DNA, 15 bp, Homo sapiens
ggagggaggtcaacc

SEQ ID NO: 217566 - DNA, 15 bp, Homo sapiens
gggagggaggtcaac

SEQ ID NO: 217567 - DNA, 15 bp, Homo sapiens
agggagggaggtcaa

SEQ ID NO: 217568 - DNA, 15 bp, Homo sapiens
gagggagggaggtca

SEQ ID NO: 217569 - DNA, 15 bp, Homo sapiens
ggagggagggaggtc

SEQ ID NO: 217570 - DNA, 15 bp, Homo sapiens
aggagggagggaggt

SEQ ID NO: 217571 - DNA, 15 bp, Homo sapiens
gaggagggagggagg

SEQ ID NO: 217572 - DNA, 15 bp, Homo sapiens
agaggagggagggag

SEQ ID NO: 217573 - DNA, 15 bp, Homo sapiens
cagaggagggaggga

SEQ ID NO: 217574 - DNA, 15 bp, Homo sapiens
acagaggagggaggg

SEQ ID NO: 217575 - DNA, 15 bp, Homo sapiens
cacagaggagggagg

SEQ ID NO: 217576 - DNA, 15 bp, Homo sapiens
acacagaggagggag

SEQ ID NO: 217577 - DNA, 15 bp, Homo sapiens
tacacagaggaggga

SEQ ID NO: 217578 - DNA, 15 bp, Homo sapiens
atacacagaggaggg

SEQ ID NO: 217579 - DNA, 15 bp, Homo sapiens
aatacacagaggagg

SEQ ID NO: 217580 - DNA, 15 bp, Homo sapiens
aaatacacagaggag

SEQ ID NO: 217581 - DNA, 15 bp, Homo sapiens
taaatacacagagga

SEQ ID NO: 217582 - DNA, 15 bp, Homo sapiens
ataaatacacagagg

SEQ ID NO: 217583 - DNA, 15 bp, Homo sapiens
aataaatacacagag

SEQ ID NO: 217584 - DNA, 15 bp, Homo sapiens
gaataaatacacaga

SEQ ID NO: 217585 - DNA, 15 bp, Homo sapiens
tgaataaatacacag

SEQ ID NO: 217586 - DNA, 15 bp, Homo sapiens
atgaataaatacaca

SEQ ID NO: 217587 - DNA, 15 bp, Homo sapiens
tatgaataaatacac

SEQ ID NO: 217588 - DNA, 15 bp, Homo sapiens
ttatgaataaataca

SEQ ID NO: 217589 - DNA, 15 bp, Homo sapiens
attatgaataaatac

SEQ ID NO: 217590 - DNA, 15 bp, Homo sapiens
cattatgaataaata

SEQ ID NO: 217591 - DNA, 15 bp, Homo sapiens
tcattatgaataaat

SEQ ID NO: 217592 - DNA, 15 bp, Homo sapiens
ctcattatgaataaa

SEQ ID NO: 217593 - DNA, 15 bp, Homo sapiens
cctcattatgaataa

SEQ ID NO: 217594 - DNA, 15 bp, Homo sapiens
gcctcattatgaata

SEQ ID NO: 217595 - DNA, 15 bp, Homo sapiens
agcctcattatgaat

SEQ ID NO: 217596 - DNA, 15 bp, Homo sapiens
gagcctcattatgaa

SEQ ID NO: 217597 - DNA, 15 bp, Homo sapiens
ggagcctcattatga

SEQ ID NO: 217598 - DNA, 15 bp, Homo sapiens
aggagcctcattatg

SEQ ID NO: 217599 - DNA, 15 bp, Homo sapiens
aaggagcctcattat

SEQ ID NO: 217600 - DNA, 15 bp, Homo sapiens
caaggagcctcatta

SEQ ID NO: 217601 - DNA, 15 bp, Homo sapiens
ccaaggagcctcatt

SEQ ID NO: 217602 - DNA, 15 bp, Homo sapiens
accaaggagcctcat

SEQ ID NO: 217603 - DNA, 15 bp, Homo sapiens
taccaaggagcctca

SEQ ID NO: 217604 - DNA, 15 bp, Homo sapiens
gtaccaaggagcctc

SEQ ID NO: 217605 - DNA, 15 bp, Homo sapiens
ggtaccaaggagcct

SEQ ID NO: 217606 - DNA, 15 bp, Homo sapiens
gggtaccaaggagcc

SEQ ID NO: 217607 - DNA, 15 bp, Homo sapiens
ggggtaccaaggagc

SEQ ID NO: 217608 - DNA, 15 bp, Homo sapiens
cggggtaccaaggag

SEQ ID NO: 217609 - DNA, 15 bp, Homo sapiens
acggggtaccaagga

SEQ ID NO: 217610 - DNA, 15 bp, Homo sapiens
cacggggtaccaagg

SEQ ID NO: 217611 - DNA, 15 bp, Homo sapiens
acacggggtaccaag

SEQ ID NO: 217612 - DNA, 15 bp, Homo sapiens
cacacggggtaccaa

SEQ ID NO: 217613 - DNA, 15 bp, Homo sapiens
acacacggggtacca

SEQ ID NO: 217614 - DNA, 15 bp, Homo sapiens
tacacacggggtacc

SEQ ID NO: 217615 - DNA, 15 bp, Homo sapiens
gtacacacggggtac

SEQ ID NO: 217616 - DNA, 15 bp, Homo sapiens
ggtacacacggggta

SEQ ID NO: 217617 - DNA, 15 bp, Homo sapiens
aggtacacacggggt

SEQ ID NO: 217618 - DNA, 15 bp, Homo sapiens
gaggtacacacgggg

SEQ ID NO: 217619 - DNA, 15 bp, Homo sapiens
agaggtacacacggg

SEQ ID NO: 217620 - DNA, 15 bp, Homo sapiens
aagaggtacacacgg

SEQ ID NO: 217621 - DNA, 15 bp, Homo sapiens
aaagaggtacacacg

SEQ ID NO: 217622 - DNA, 15 bp, Homo sapiens
gaaagaggtacacac

SEQ ID NO: 217623 - DNA, 15 bp, Homo sapiens
tgaaagaggtacaca

SEQ ID NO: 217624 - DNA, 15 bp, Homo sapiens
ctgaaagaggtacac

SEQ ID NO: 217625 - DNA, 15 bp, Homo sapiens
tctgaaagaggtaca

SEQ ID NO: 217626 - DNA, 15 bp, Homo sapiens
ctctgaaagaggtac

SEQ ID NO: 217627 - DNA, 15 bp, Homo sapiens
tctctgaaagaggta

SEQ ID NO: 217628 - DNA, 15 bp, Homo sapiens
atctctgaaagaggt

SEQ ID NO: 217629 - DNA, 15 bp, Homo sapiens
aatctctgaaagagg

SEQ ID NO: 217630 - DNA, 15 bp, Homo sapiens
aaatctctgaaagag

SEQ ID NO: 217631 - DNA, 15 bp, Homo sapiens
caaatctctgaaaga

SEQ ID NO: 217632 - DNA, 15 bp, Homo sapiens
acaaatctctgaaag

SEQ ID NO: 217633 - DNA, 15 bp, Homo sapiens
cacaaatctctgaaa

SEQ ID NO: 217634 - DNA, 15 bp, Homo sapiens
ccacaaatctctgaa

SEQ ID NO: 217635 - DNA, 15 bp, Homo sapiens
gccacaaatctctga

SEQ ID NO: 217636 - DNA, 15 bp, Homo sapiens
tgccacaaatctctg

SEQ ID NO: 217637 - DNA, 15 bp, Homo sapiens
gtgccacaaatctct

SEQ ID NO: 217638 - DNA, 15 bp, Homo sapiens
agtgccacaaatctc

SEQ ID NO: 217639 - DNA, 15 bp, Homo sapiens
aagtgccacaaatct

SEQ ID NO: 217640 - DNA, 15 bp, Homo sapiens
taagtgccacaaatc

SEQ ID NO: 217641 - DNA, 15 bp, Homo sapiens
ttaagtgccacaaat

SEQ ID NO: 217642 - DNA, 15 bp, Homo sapiens
gttaagtgccacaaa

SEQ ID NO: 217643 - DNA, 15 bp, Homo sapiens
ggttaagtgccacaa

SEQ ID NO: 217644 - DNA, 15 bp, Homo sapiens
tggttaagtgccaca

SEQ ID NO: 217645 - DNA, 15 bp, Homo sapiens
gtggttaagtgccac

SEQ ID NO: 217646 - DNA, 15 bp, Homo sapiens
cgtggttaagtgcca

SEQ ID NO: 217647 - DNA, 15 bp, Homo sapiens
acgtggttaagtgcc

SEQ ID NO: 217648 - DNA, 15 bp, Homo sapiens
aacgtggttaagtgc

SEQ ID NO: 217649 - DNA, 15 bp, Homo sapiens
gaacgtggttaagtg

SEQ ID NO: 217650 - DNA, 15 bp, Homo sapiens
agaacgtggttaagt

SEQ ID NO: 217651 - DNA, 15 bp, Homo sapiens
cagaacgtggttaag

SEQ ID NO: 217652 - DNA, 15 bp, Homo sapiens
ccagaacgtggttaa

SEQ ID NO: 217653 - DNA, 15 bp, Homo sapiens
cccagaacgtggtta

SEQ ID NO: 217654 - DNA, 15 bp, Homo sapiens
gcccagaacgtggtt

SEQ ID NO: 217655 - DNA, 15 bp, Homo sapiens
agcccagaacgtggt

SEQ ID NO: 217656 - DNA, 15 bp, Homo sapiens
tagcccagaacgtgg

SEQ ID NO: 217657 - DNA, 15 bp, Homo sapiens
ctagcccagaacgtg

SEQ ID NO: 217658 - DNA, 15 bp, Homo sapiens
actagcccagaacgt

SEQ ID NO: 217659 - DNA, 15 bp, Homo sapiens
tactagcccagaacg

SEQ ID NO: 217660 - DNA, 15 bp, Homo sapiens
atactagcccagaac

SEQ ID NO: 217661 - DNA, 15 bp, Homo sapiens
aatactagcccagaa

SEQ ID NO: 217662 - DNA, 15 bp, Homo sapiens
caatactagcccaga

SEQ ID NO: 217663 - DNA, 15 bp, Homo sapiens
acaatactagcccag

SEQ ID NO: 217664 - DNA, 15 bp, Homo sapiens
aacaatactagccca

SEQ ID NO: 217665 - DNA, 15 bp, Homo sapiens
gaacaatactagccc

SEQ ID NO: 217666 - DNA, 15 bp, Homo sapiens
agaacaatactagcc

SEQ ID NO: 217667 - DNA, 15 bp, Homo sapiens
gagaacaatactagc

SEQ ID NO: 217668 - DNA, 15 bp, Homo sapiens
agagaacaatactag

SEQ ID NO: 217669 - DNA, 15 bp, Homo sapiens
gagagaacaatacta

SEQ ID NO: 217670 - DNA, 15 bp, Homo sapiens
agagagaacaatact

SEQ ID NO: 217671 - DNA, 15 bp, Homo sapiens
aagagagaacaatac

SEQ ID NO: 217672 - DNA, 15 bp, Homo sapiens
gaagagagaacaata

SEQ ID NO: 217673 - DNA, 15 bp, Homo sapiens
ggaagagagaacaat

SEQ ID NO: 217674 - DNA, 15 bp, Homo sapiens
gggaagagagaacaa

SEQ ID NO: 217675 - DNA, 15 bp, Homo sapiens
ggggaagagagaaca

SEQ ID NO: 217676 - DNA, 15 bp, Homo sapiens
aggggaagagagaac

SEQ ID NO: 217677 - DNA, 15 bp, Homo sapiens
aaggggaagagagaa

SEQ ID NO: 217678 - DNA, 15 bp, Homo sapiens
aaaggggaagagaga

SEQ ID NO: 217679 - DNA, 15 bp, Homo sapiens
taaaggggaagagag

SEQ ID NO: 217680 - DNA, 15 bp, Homo sapiens
ataaaggggaagaga

SEQ ID NO: 217681 - DNA, 15 bp, Homo sapiens
tataaaggggaagag

SEQ ID NO: 217682 - DNA, 15 bp, Homo sapiens
gtataaaggggaaga

SEQ ID NO: 217683 - DNA, 15 bp, Homo sapiens
agtataaaggggaag

SEQ ID NO: 217684 - DNA, 15 bp, Homo sapiens
tagtataaaggggaa

SEQ ID NO: 217685 - DNA, 15 bp, Homo sapiens
atagtataaagggga

SEQ ID NO: 217686 - DNA, 15 bp, Homo sapiens
tatagtataaagggg

SEQ ID NO: 217687 - DNA, 15 bp, Homo sapiens
ttatagtataaaggg

SEQ ID NO: 217688 - DNA, 15 bp, Homo sapiens
cttatagtataaagg

SEQ ID NO: 217689 - DNA, 15 bp, Homo sapiens
acttatagtataaag

SEQ ID NO: 217690 - DNA, 15 bp, Homo sapiens
aacttatagtataaa

SEQ ID NO: 217691 - DNA, 15 bp, Homo sapiens
aaacttatagtataa

SEQ ID NO: 217692 - DNA, 15 bp, Homo sapiens
gaaacttatagtata

SEQ ID NO: 217693 - DNA, 15 bp, Homo sapiens
agaaacttatagtat

SEQ ID NO: 217694 - DNA, 15 bp, Homo sapiens
gagaaacttatagta

SEQ ID NO: 217695 - DNA, 15 bp, Homo sapiens
tgagaaacttatagt

SEQ ID NO: 217696 - DNA, 15 bp, Homo sapiens
ttgagaaacttatag

SEQ ID NO: 217697 - DNA, 15 bp, Homo sapiens
tttgagaaacttata

SEQ ID NO: 217698 - DNA, 15 bp, Homo sapiens
ctttgagaaacttat

SEQ ID NO: 217699 - DNA, 15 bp, Homo sapiens
tctttgagaaactta

SEQ ID NO: 217700 - DNA, 15 bp, Homo sapiens
atctttgagaaactt

SEQ ID NO: 217701 - DNA, 15 bp, Homo sapiens
aatctttgagaaact

SEQ ID NO: 217702 - DNA, 15 bp, Homo sapiens
caatctttgagaaac

SEQ ID NO: 217703 - DNA, 15 bp, Homo sapiens
tcaatctttgagaaa

SEQ ID NO: 217704 - DNA, 15 bp, Homo sapiens
ctcaatctttgagaa

SEQ ID NO: 217705 - DNA, 15 bp, Homo sapiens
actcaatctttgaga

SEQ ID NO: 217706 - DNA, 15 bp, Homo sapiens
aactcaatctttgag

SEQ ID NO: 217707 - DNA, 15 bp, Homo sapiens
aaactcaatctttga

SEQ ID NO: 217708 - DNA, 15 bp, Homo sapiens
taaactcaatctttg

SEQ ID NO: 217709 - DNA, 15 bp, Homo sapiens
ataaactcaatcttt

SEQ ID NO: 217710 - DNA, 15 bp, Homo sapiens
tataaactcaatctt

SEQ ID NO: 217711 - DNA, 15 bp, Homo sapiens
ctataaactcaatct

SEQ ID NO: 217712 - DNA, 15 bp, Homo sapiens
gctataaactcaatc

SEQ ID NO: 217713 - DNA, 15 bp, Homo sapiens
agctataaactcaat

SEQ ID NO: 217714 - DNA, 15 bp, Homo sapiens
cagctataaactcaa

SEQ ID NO: 217715 - DNA, 15 bp, Homo sapiens
tcagctataaactca

SEQ ID NO: 217716 - DNA, 15 bp, Homo sapiens
atcagctataaactc

SEQ ID NO: 217717 - DNA, 15 bp, Homo sapiens
aatcagctataaact

SEQ ID NO: 217718 - DNA, 15 bp, Homo sapiens
aaatcagctataaac

SEQ ID NO: 217719 - DNA, 15 bp, Homo sapiens
aaaatcagctataaa

SEQ ID NO: 217720 - DNA, 15 bp, Homo sapiens
aaaaatcagctataa

SEQ ID NO: 217721 - DNA, 15 bp, Homo sapiens
caaaaatcagctata

SEQ ID NO: 217722 - DNA, 15 bp, Homo sapiens
gcaaaaatcagctat

SEQ ID NO: 217723 - DNA, 15 bp, Homo sapiens
ggcaaaaatcagcta

SEQ ID NO: 217724 - DNA, 15 bp, Homo sapiens
aggcaaaaatcagct

SEQ ID NO: 217725 - DNA, 15 bp, Homo sapiens
aaggcaaaaatcagc

SEQ ID NO: 217726 - DNA, 15 bp, Homo sapiens
gaaggcaaaaatcag

SEQ ID NO: 217727 - DNA, 15 bp, Homo sapiens
agaaggcaaaaatca

SEQ ID NO: 217728 - DNA, 15 bp, Homo sapiens
gagaaggcaaaaatc

SEQ ID NO: 217729 - DNA, 15 bp, Homo sapiens
agagaaggcaaaaat

SEQ ID NO: 217730 - DNA, 15 bp, Homo sapiens
aagagaaggcaaaaa

SEQ ID NO: 217731 - DNA, 15 bp, Homo sapiens
taagagaaggcaaaa

SEQ ID NO: 217732 - DNA, 15 bp, Homo sapiens
ataagagaaggcaaa

SEQ ID NO: 217733 - DNA, 15 bp, Homo sapiens
cataagagaaggcaa

SEQ ID NO: 217734 - DNA, 15 bp, Homo sapiens
gcataagagaaggca

SEQ ID NO: 217735 - DNA, 15 bp, Homo sapiens
ggcataagagaaggc

SEQ ID NO: 217736 - DNA, 15 bp, Homo sapiens
aggcataagagaagg

SEQ ID NO: 217737 - DNA, 15 bp, Homo sapiens
taggcataagagaag

SEQ ID NO: 217738 - DNA, 15 bp, Homo sapiens
ttaggcataagagaa

SEQ ID NO: 217739 - DNA, 15 bp, Homo sapiens
gttaggcataagaga

SEQ ID NO: 217740 - DNA, 15 bp, Homo sapiens
cgttaggcataagag

SEQ ID NO: 217741 - DNA, 15 bp, Homo sapiens
acgttaggcataaga

SEQ ID NO: 217742 - DNA, 15 bp, Homo sapiens
tacgttaggcataag

SEQ ID NO: 217743 - DNA, 15 bp, Homo sapiens
atacgttaggcataa

SEQ ID NO: 217744 - DNA, 15 bp, Homo sapiens
aatacgttaggcata

SEQ ID NO: 217745 - DNA, 15 bp, Homo sapiens
aaatacgttaggcat

SEQ ID NO: 217746 - DNA, 15 bp, Homo sapiens
aaaatacgttaggca

SEQ ID NO: 217747 - DNA, 15 bp, Homo sapiens
aaaaatacgttaggc

SEQ ID NO: 217748 - DNA, 15 bp, Homo sapiens
taaaaatacgttagg

SEQ ID NO: 217749 - DNA, 15 bp, Homo sapiens
ataaaaatacgttag

SEQ ID NO: 217750 - DNA, 15 bp, Homo sapiens
tataaaaatacgtta

SEQ ID NO: 217751 - DNA, 15 bp, Homo sapiens
atataaaaatacgtt

SEQ ID NO: 217752 - DNA, 15 bp, Homo sapiens
tatataaaaatacgt

SEQ ID NO: 217753 - DNA, 15 bp, Homo sapiens
atatataaaaatacg

SEQ ID NO: 217754 - DNA, 15 bp, Homo sapiens
aatatataaaaatac

SEQ ID NO: 217755 - DNA, 15 bp, Homo sapiens
caatatataaaaata

SEQ ID NO: 217756 - DNA, 15 bp, Homo sapiens
acaatatataaaaat

SEQ ID NO: 217757 - DNA, 15 bp, Homo sapiens
tacaatatataaaaa

SEQ ID NO: 217758 - DNA, 15 bp, Homo sapiens
atacaatatataaaa

SEQ ID NO: 217759 - DNA, 15 bp, Homo sapiens
tatacaatatataaa

SEQ ID NO: 217760 - DNA, 15 bp, Homo sapiens
atatacaatatataa

SEQ ID NO: 217761 - DNA, 15 bp, Homo sapiens
tatatacaatatata

SEQ ID NO: 217762 - DNA, 15 bp, Homo sapiens
atatatacaatatat

SEQ ID NO: 217763 - DNA, 15 bp, Homo sapiens
aatatatacaatata

SEQ ID NO: 217764 - DNA, 15 bp, Homo sapiens
aaatatatacaatat

SEQ ID NO: 217765 - DNA, 15 bp, Homo sapiens
caaatatatacaata

SEQ ID NO: 217766 - DNA, 15 bp, Homo sapiens
acaaatatatacaat

SEQ ID NO: 217767 - DNA, 15 bp, Homo sapiens
tacaaatatatacaa

SEQ ID NO: 217768 - DNA, 15 bp, Homo sapiens
gtacaaatatataca

SEQ ID NO: 217769 - DNA, 15 bp, Homo sapiens
agtacaaatatatac

SEQ ID NO: 217770 - DNA, 15 bp, Homo sapiens
aagtacaaatatata

SEQ ID NO: 217771 - DNA, 15 bp, Homo sapiens
aaagtacaaatatat

SEQ ID NO: 217772 - DNA, 15 bp, Homo sapiens
taaagtacaaatata

SEQ ID NO: 217773 - DNA, 15 bp, Homo sapiens
ttaaagtacaaatat

SEQ ID NO: 217774 - DNA, 15 bp, Homo sapiens
tttaaagtacaaata

SEQ ID NO: 217775 - DNA, 15 bp, Homo sapiens
ttttaaagtacaaat

SEQ ID NO: 217776 - DNA, 15 bp, Homo sapiens
attttaaagtacaaa

SEQ ID NO: 217777 - DNA, 15 bp, Homo sapiens
aattttaaagtacaa

SEQ ID NO: 217778 - DNA, 15 bp, Homo sapiens
aaattttaaagtaca

SEQ ID NO: 217779 - DNA, 15 bp, Homo sapiens
aaaattttaaagtac

SEQ ID NO: 217780 - DNA, 15 bp, Homo sapiens
aaaaattttaaagta

SEQ ID NO: 217781 - DNA, 15 bp, Homo sapiens
taaaaattttaaagt

SEQ ID NO: 217782 - DNA, 15 bp, Homo sapiens
ataaaaattttaaag

SEQ ID NO: 217783 - DNA, 15 bp, Homo sapiens
aaaataaaaatttta

SEQ ID NO: 217784 - DNA, 15 bp, Homo sapiens
caaaataaaaatttt

SEQ ID NO: 217785 - DNA, 15 bp, Homo sapiens
ccaaaataaaaattt

SEQ ID NO: 217786 - DNA, 15 bp, Homo sapiens
accaaaataaaaatt

SEQ ID NO: 217787 - DNA, 15 bp, Homo sapiens
caccaaaataaaaat

SEQ ID NO: 217788 - DNA, 15 bp, Homo sapiens
ccaccaaaataaaaa

SEQ ID NO: 217789 - DNA, 15 bp, Homo sapiens
tccaccaaaataaaa

SEQ ID NO: 217790 - DNA, 15 bp, Homo sapiens
ttccaccaaaataaa

SEQ ID NO: 217791 - DNA, 15 bp, Homo sapiens
tttccaccaaaataa

SEQ ID NO: 217792 - DNA, 15 bp, Homo sapiens
atttccaccaaaata

SEQ ID NO: 217793 - DNA, 15 bp, Homo sapiens
gatttccaccaaaat

SEQ ID NO: 217794 - DNA, 15 bp, Homo sapiens
agatttccaccaaaa

SEQ ID NO: 217795 - DNA, 15 bp, Homo sapiens
aagatttccaccaaa

SEQ ID NO: 217796 - DNA, 15 bp, Homo sapiens
aaagatttccaccaa

SEQ ID NO: 217797 - DNA, 15 bp, Homo sapiens
caaagatttccacca

SEQ ID NO: 217798 - DNA, 15 bp, Homo sapiens
acaaagatttccacc

SEQ ID NO: 217799 - DNA, 15 bp, Homo sapiens
aacaaagatttccac

SEQ ID NO: 217800 - DNA, 15 bp, Homo sapiens
caacaaagatttcca

SEQ ID NO: 217801 - DNA, 15 bp, Homo sapiens
tcaacaaagatttcc

SEQ ID NO: 217802 - DNA, 15 bp, Homo sapiens
ttcaacaaagatttc

SEQ ID NO: 217803 - DNA, 15 bp, Homo sapiens
tttcaacaaagattt

SEQ ID NO: 217804 - DNA, 15 bp, Homo sapiens
ttttcaacaaagatt

SEQ ID NO: 217805 - DNA, 15 bp, Homo sapiens
tttttcaacaaagat

SEQ ID NO: 217806 - DNA, 15 bp, Homo sapiens
atttttcaacaaaga

SEQ ID NO: 217807 - DNA, 15 bp, Homo sapiens
gatttttcaacaaag

SEQ ID NO: 217808 - DNA, 15 bp, Homo sapiens
agatttttcaacaaa

SEQ ID NO: 217809 - DNA, 15 bp, Homo sapiens
tagatttttcaacaa

SEQ ID NO: 217810 - DNA, 15 bp, Homo sapiens
atagatttttcaaca

SEQ ID NO: 217811 - DNA, 15 bp, Homo sapiens
aatagatttttcaac

SEQ ID NO: 217812 - DNA, 15 bp, Homo sapiens
taatagatttttcaa

SEQ ID NO: 217813 - DNA, 15 bp, Homo sapiens
ataatagatttttca

SEQ ID NO: 217814 - DNA, 15 bp, Homo sapiens
tataatagatttttc

SEQ ID NO: 217815 - DNA, 15 bp, Homo sapiens
atataatagattttt

SEQ ID NO: 217816 - DNA, 15 bp, Homo sapiens
tatataatagatttt

SEQ ID NO: 217817 - DNA, 15 bp, Homo sapiens
gtatataatagattt

SEQ ID NO: 217818 - DNA, 15 bp, Homo sapiens
agtatataatagatt

SEQ ID NO: 217819 - DNA, 15 bp, Homo sapiens
aagtatataatagat

SEQ ID NO: 217820 - DNA, 15 bp, Homo sapiens
aaagtatataataga

SEQ ID NO: 217821 - DNA, 15 bp, Homo sapiens
taaagtatataatag

SEQ ID NO: 217822 - DNA, 15 bp, Homo sapiens
ttaaagtatataata

SEQ ID NO: 217823 - DNA, 15 bp, Homo sapiens
attaaagtatataat

SEQ ID NO: 217824 - DNA, 15 bp, Homo sapiens
cattaaagtatataa

SEQ ID NO: 217825 - DNA, 15 bp, Homo sapiens
gcattaaagtatata

SEQ ID NO: 217826 - DNA, 15 bp, Homo sapiens
ggcattaaagtatat

SEQ ID NO: 217827 - DNA, 15 bp, Homo sapiens
tggcattaaagtata

SEQ ID NO: 217828 - DNA, 15 bp, Homo sapiens
gtggcattaaagtat

SEQ ID NO: 217829 - DNA, 15 bp, Homo sapiens
ggtggcattaaagta

SEQ ID NO: 217830 - DNA, 15 bp, Homo sapiens
aggtggcattaaagt

SEQ ID NO: 217831 - DNA, 15 bp, Homo sapiens
taggtggcattaaag

SEQ ID NO: 217832 - DNA, 15 bp, Homo sapiens
ttaggtggcattaaa

SEQ ID NO: 217833 - DNA, 15 bp, Homo sapiens
cttaggtggcattaa

SEQ ID NO: 217834 - DNA, 15 bp, Homo sapiens
ccttaggtggcatta

SEQ ID NO: 217835 - DNA, 15 bp, Homo sapiens
tccttaggtggcatt

SEQ ID NO: 217836 - DNA, 15 bp, Homo sapiens
atccttaggtggcat

SEQ ID NO: 217837 - DNA, 15 bp, Homo sapiens
catccttaggtggca

SEQ ID NO: 217838 - DNA, 15 bp, Homo sapiens
ccatccttaggtggc

SEQ ID NO: 217839 - DNA, 15 bp, Homo sapiens
cccatccttaggtgg

SEQ ID NO: 217840 - DNA, 15 bp, Homo sapiens
tcccatccttaggtg

SEQ ID NO: 217841 - DNA, 15 bp, Homo sapiens
ctcccatccttaggt

SEQ ID NO: 217842 - DNA, 15 bp, Homo sapiens
tctcccatccttagg

SEQ ID NO: 217843 - DNA, 15 bp, Homo sapiens
ttctcccatccttag

SEQ ID NO: 217844 - DNA, 15 bp, Homo sapiens
tttctcccatcctta

SEQ ID NO: 217845 - DNA, 15 bp, Homo sapiens
ttttctcccatcctt

SEQ ID NO: 217846 - DNA, 15 bp, Homo sapiens
aattttctcccatcc

SEQ ID NO: 217847 - DNA, 15 bp, Homo sapiens
aaattttctcccatc

SEQ ID NO: 217848 - DNA, 15 bp, Homo sapiens
caaattttctcccat

SEQ ID NO: 217849 - DNA, 15 bp, Homo sapiens
tcaaattttctccca

SEQ ID NO: 217850 - DNA, 15 bp, Homo sapiens
ttcaaattttctccc

SEQ ID NO: 217851 - DNA, 15 bp, Homo sapiens
attcaaattttctcc

SEQ ID NO: 217852 - DNA, 15 bp, Homo sapiens
cattcaaattttctc

SEQ ID NO: 217853 - DNA, 15 bp, Homo sapiens
acattcaaattttct

SEQ ID NO: 217854 - DNA, 15 bp, Homo sapiens
aacattcaaattttc

SEQ ID NO: 217855 - DNA, 15 bp, Homo sapiens
aaacattcaaatttt

SEQ ID NO: 217856 - DNA, 15 bp, Homo sapiens
aaaacattcaaattt

SEQ ID NO: 217857 - DNA, 15 bp, Homo sapiens
gaaaacattcaaatt

SEQ ID NO: 217858 - DNA, 15 bp, Homo sapiens
agaaaacattcaaat

SEQ ID NO: 217859 - DNA, 15 bp, Homo sapiens
aagaaaacattcaaa

SEQ ID NO: 217860 - DNA, 15 bp, Homo sapiens
aaagaaaacattcaa

SEQ ID NO: 217861 - DNA, 15 bp, Homo sapiens
aaaagaaaacattca

SEQ ID NO: 217862 - DNA, 15 bp, Homo sapiens
caaaagaaaacattc

SEQ ID NO: 217863 - DNA, 15 bp, Homo sapiens
ccaaaagaaaacatt

SEQ ID NO: 217864 - DNA, 15 bp, Homo sapiens
tccaaaagaaaacat

SEQ ID NO: 217865 - DNA, 15 bp, Homo sapiens
gtccaaaagaaaaca

SEQ ID NO: 217866 - DNA, 15 bp, Homo sapiens
tgtccaaaagaaaac

SEQ ID NO: 217867 - DNA, 15 bp, Homo sapiens
gtgtccaaaagaaaa

SEQ ID NO: 217868 - DNA, 15 bp, Homo sapiens
tgtgtccaaaagaaa

SEQ ID NO: 217869 - DNA, 15 bp, Homo sapiens
ttgtgtccaaaagaa

SEQ ID NO: 217870 - DNA, 15 bp, Homo sapiens
cttgtgtccaaaaga

SEQ ID NO: 217871 - DNA, 15 bp, Homo sapiens
tcttgtgtccaaaag

SEQ ID NO: 217872 - DNA, 15 bp, Homo sapiens
atcttgtgtccaaaa

SEQ ID NO: 217873 - DNA, 15 bp, Homo sapiens
tatcttgtgtccaaa

SEQ ID NO: 217874 - DNA, 15 bp, Homo sapiens
ttatcttgtgtccaa

SEQ ID NO: 217875 - DNA, 15 bp, Homo sapiens
attatcttgtgtcca

SEQ ID NO: 217876 - DNA, 15 bp, Homo sapiens
gattatcttgtgtcc

SEQ ID NO: 217877 - DNA, 15 bp, Homo sapiens
tgattatcttgtgtc

SEQ ID NO: 217878 - DNA, 15 bp, Homo sapiens
atgattatcttgtgt

SEQ ID NO: 217879 - DNA, 15 bp, Homo sapiens
aatgattatcttgtg

SEQ ID NO: 217880 - DNA, 15 bp, Homo sapiens
caatgattatcttgt

SEQ ID NO: 217881 - DNA, 15 bp, Homo sapiens
acaatgattatcttg

SEQ ID NO: 217882 - DNA, 15 bp, Homo sapiens
cacaatgattatctt

SEQ ID NO: 217883 - DNA, 15 bp, Homo sapiens
gcacaatgattatct

SEQ ID NO: 217884 - DNA, 15 bp, Homo sapiens
agcacaatgattatc

SEQ ID NO: 217885 - DNA, 15 bp, Homo sapiens
gagcacaatgattat

SEQ ID NO: 217886 - DNA, 15 bp, Homo sapiens
agagcacaatgatta

SEQ ID NO: 217887 - DNA, 15 bp, Homo sapiens
gagagcacaatgatt

SEQ ID NO: 217888 - DNA, 15 bp, Homo sapiens
ggagagcacaatgat

SEQ ID NO: 217889 - DNA, 15 bp, Homo sapiens
tggagagcacaatga

SEQ ID NO: 217890 - DNA, 15 bp, Homo sapiens
ctggagagcacaatg

SEQ ID NO: 217891 - DNA, 15 bp, Homo sapiens
actggagagcacaat

SEQ ID NO: 217892 - DNA, 15 bp, Homo sapiens
aactggagagcacaa

SEQ ID NO: 217893 - DNA, 15 bp, Homo sapiens
caactggagagcaca

SEQ ID NO: 217894 - DNA, 15 bp, Homo sapiens
acaactggagagcac

SEQ ID NO: 217895 - DNA, 15 bp, Homo sapiens
aacaactggagagca

SEQ ID NO: 217896 - DNA, 15 bp, Homo sapiens
taacaactggagagc

SEQ ID NO: 217897 - DNA, 15 bp, Homo sapiens
ataacaactggagag

SEQ ID NO: 217898 - DNA, 15 bp, Homo sapiens
aataacaactggaga

SEQ ID NO: 217899 - DNA, 15 bp, Homo sapiens
aaataacaactggag

SEQ ID NO: 217900 - DNA, 15 bp, Homo sapiens
aaaataacaactgga

SEQ ID NO: 217901 - DNA, 15 bp, Homo sapiens
aaaaataacaactgg

SEQ ID NO: 217902 - DNA, 15 bp, Homo sapiens
caaaaataacaactg

SEQ ID NO: 217903 - DNA, 15 bp, Homo sapiens
tcaaaaataacaact

SEQ ID NO: 217904 - DNA, 15 bp, Homo sapiens
gtcaaaaataacaac

SEQ ID NO: 217905 - DNA, 15 bp, Homo sapiens
agtcaaaaataacaa

SEQ ID NO: 217906 - DNA, 15 bp, Homo sapiens
gagtcaaaaataaca

SEQ ID NO: 217907 - DNA, 15 bp, Homo sapiens
agagtcaaaaataac

SEQ ID NO: 217908 - DNA, 15 bp, Homo sapiens
aagagtcaaaaataa

SEQ ID NO: 217909 - DNA, 15 bp, Homo sapiens
caagagtcaaaaata

SEQ ID NO: 217910 - DNA, 15 bp, Homo sapiens
tcaagagtcaaaaat

SEQ ID NO: 217911 - DNA, 15 bp, Homo sapiens
ctcaagagtcaaaaa

SEQ ID NO: 217912 - DNA, 15 bp, Homo sapiens
cctcaagagtcaaaa

SEQ ID NO: 217913 - DNA, 15 bp, Homo sapiens
acctcaagagtcaaa

SEQ ID NO: 217914 - DNA, 15 bp, Homo sapiens
tacctcaagagtcaa

SEQ ID NO: 217915 - DNA, 15 bp, Homo sapiens
atacctcaagagtca

SEQ ID NO: 217916 - DNA, 15 bp, Homo sapiens
aatacctcaagagtc

SEQ ID NO: 217917 - DNA, 15 bp, Homo sapiens
aaatacctcaagagt

SEQ ID NO: 217918 - DNA, 15 bp, Homo sapiens
caaatacctcaagag

SEQ ID NO: 217919 - DNA, 15 bp, Homo sapiens
ccaaatacctcaaga

SEQ ID NO: 217920 - DNA, 15 bp, Homo sapiens
cccaaatacctcaag

SEQ ID NO: 217921 - DNA, 15 bp, Homo sapiens
tcccaaatacctcaa

SEQ ID NO: 217922 - DNA, 15 bp, Homo sapiens
atcccaaatacctca

SEQ ID NO: 217923 - DNA, 15 bp, Homo sapiens
aatcccaaatacctc

SEQ ID NO: 217924 - DNA, 15 bp, Homo sapiens
taatcccaaatacct

SEQ ID NO: 217925 - DNA, 15 bp, Homo sapiens
ataatcccaaatacc

SEQ ID NO: 217926 - DNA, 15 bp, Homo sapiens
tataatcccaaatac

SEQ ID NO: 217927 - DNA, 15 bp, Homo sapiens
atataatcccaaata

SEQ ID NO: 217928 - DNA, 15 bp, Homo sapiens
gatataatcccaaat

SEQ ID NO: 217929 - DNA, 15 bp, Homo sapiens
agatataatcccaaa

SEQ ID NO: 217930 - DNA, 15 bp, Homo sapiens
gagatataatcccaa

SEQ ID NO: 217931 - DNA, 15 bp, Homo sapiens
ggagatataatccca

SEQ ID NO: 217932 - DNA, 15 bp, Homo sapiens
aggagatataatccc

SEQ ID NO: 217933 - DNA, 15 bp, Homo sapiens
aaggagatataatcc

SEQ ID NO: 217934 - DNA, 15 bp, Homo sapiens
gaaggagatataatc

SEQ ID NO: 217935 - DNA, 15 bp, Homo sapiens
agaaggagatataat

SEQ ID NO: 217936 - DNA, 15 bp, Homo sapiens
tagaaggagatataa

SEQ ID NO: 217937 - DNA, 15 bp, Homo sapiens
gtagaaggagatata

SEQ ID NO: 217938 - DNA, 15 bp, Homo sapiens
agtagaaggagatat

SEQ ID NO: 217939 - DNA, 15 bp, Homo sapiens
tagtagaaggagata

SEQ ID NO: 217940 - DNA, 15 bp, Homo sapiens
ttagtagaaggagat

SEQ ID NO: 217941 - DNA, 15 bp, Homo sapiens
tttagtagaaggaga

SEQ ID NO: 217942 - DNA, 15 bp, Homo sapiens
gtttagtagaaggag

SEQ ID NO: 217943 - DNA, 15 bp, Homo sapiens
tgtttagtagaagga

SEQ ID NO: 217944 - DNA, 15 bp, Homo sapiens
gtgtttagtagaagg

SEQ ID NO: 217945 - DNA, 15 bp, Homo sapiens
ggtgtttagtagaag

SEQ ID NO: 217946 - DNA, 15 bp, Homo sapiens
aggtgtttagtagaa

SEQ ID NO: 217947 - DNA, 15 bp, Homo sapiens
gaggtgtttagtaga

SEQ ID NO: 217948 - DNA, 15 bp, Homo sapiens
tgaggtgtttagtag

SEQ ID NO: 217949 - DNA, 15 bp, Homo sapiens
ctgaggtgtttagta

SEQ ID NO: 217950 - DNA, 15 bp, Homo sapiens
tctgaggtgtttagt

SEQ ID NO: 217951 - DNA, 15 bp, Homo sapiens
ctctgaggtgtttag

SEQ ID NO: 217952 - DNA, 15 bp, Homo sapiens
gctctgaggtgttta

SEQ ID NO: 217953 - DNA, 15 bp, Homo sapiens
tgctctgaggtgttt

SEQ ID NO: 217954 - DNA, 15 bp, Homo sapiens
atgctctgaggtgtt

SEQ ID NO: 217955 - DNA, 15 bp, Homo sapiens
catgctctgaggtgt

SEQ ID NO: 217956 - DNA, 15 bp, Homo sapiens
gcatgctctgaggtg

SEQ ID NO: 217957 - DNA, 15 bp, Homo sapiens
cgcatgctctgaggt

SEQ ID NO: 217958 - DNA, 15 bp, Homo sapiens
tcgcatgctctgagg

SEQ ID NO: 217959 - DNA, 15 bp, Homo sapiens
gtcgcatgctctgag

SEQ ID NO: 217960 - DNA, 15 bp, Homo sapiens
agtcgcatgctctga

SEQ ID NO: 217961 - DNA, 15 bp, Homo sapiens
aagtcgcatgctctg

SEQ ID NO: 217962 - DNA, 15 bp, Homo sapiens
gaagtcgcatgctct

SEQ ID NO: 217963 - DNA, 15 bp, Homo sapiens
agaagtcgcatgctc

SEQ ID NO: 217964 - DNA, 15 bp, Homo sapiens
tagaagtcgcatgct

SEQ ID NO: 217965 - DNA, 15 bp, Homo sapiens
ttagaagtcgcatgc

SEQ ID NO: 217966 - DNA, 15 bp, Homo sapiens
tttagaagtcgcatg

SEQ ID NO: 217967 - DNA, 15 bp, Homo sapiens
ttttagaagtcgcat

SEQ ID NO: 217968 - DNA, 15 bp, Homo sapiens
gttttagaagtcgca

SEQ ID NO: 217969 - DNA, 15 bp, Homo sapiens
tgttttagaagtcgc

SEQ ID NO: 217970 - DNA, 15 bp, Homo sapiens
atgttttagaagtcg

SEQ ID NO: 217971 - DNA, 15 bp, Homo sapiens
catgttttagaagtc

SEQ ID NO: 217972 - DNA, 15 bp, Homo sapiens
tcatgttttagaagt

SEQ ID NO: 217973 - DNA, 15 bp, Homo sapiens
atcatgttttagaag

SEQ ID NO: 217974 - DNA, 15 bp, Homo sapiens
aatcatgttttagaa

SEQ ID NO: 217975 - DNA, 15 bp, Homo sapiens
aaatcatgttttaga

SEQ ID NO: 217976 - DNA, 15 bp, Homo sapiens
gaaatcatgttttag

SEQ ID NO: 217977 - DNA, 15 bp, Homo sapiens
tgaaatcatgtttta

SEQ ID NO: 217978 - DNA, 15 bp, Homo sapiens
ctgaaatcatgtttt

SEQ ID NO: 217979 - DNA, 15 bp, Homo sapiens
actgaaatcatgttt

SEQ ID NO: 217980 - DNA, 15 bp, Homo sapiens
tactgaaatcatgtt

SEQ ID NO: 217981 - DNA, 15 bp, Homo sapiens
atactgaaatcatgt

SEQ ID NO: 217982 - DNA, 15 bp, Homo sapiens
aatactgaaatcatg

SEQ ID NO: 217983 - DNA, 15 bp, Homo sapiens
gaatactgaaatcat

SEQ ID NO: 217984 - DNA, 15 bp, Homo sapiens
ggaatactgaaatca

SEQ ID NO: 217985 - DNA, 15 bp, Homo sapiens
gggaatactgaaatc

SEQ ID NO: 217986 - DNA, 15 bp, Homo sapiens
agggaatactgaaat

SEQ ID NO: 217987 - DNA, 15 bp, Homo sapiens
aagggaatactgaaa

SEQ ID NO: 217988 - DNA, 15 bp, Homo sapiens
aaagggaatactgaa

SEQ ID NO: 217989 - DNA, 15 bp, Homo sapiens
caaagggaatactga

SEQ ID NO: 217990 - DNA, 15 bp, Homo sapiens
acaaagggaatactg

SEQ ID NO: 217991 - DNA, 15 bp, Homo sapiens
aacaaagggaatact

SEQ ID NO: 217992 - DNA, 15 bp, Homo sapiens
caacaaagggaatac

SEQ ID NO: 217993 - DNA, 15 bp, Homo sapiens
gcaacaaagggaata

SEQ ID NO: 217994 - DNA, 15 bp, Homo sapiens
agcaacaaagggaat

SEQ ID NO: 217995 - DNA, 15 bp, Homo sapiens
cagcaacaaagggaa

SEQ ID NO: 217996 - DNA, 15 bp, Homo sapiens
acagcaacaaaggga

SEQ ID NO: 217997 - DNA, 15 bp, Homo sapiens
aacagcaacaaaggg

SEQ ID NO: 217998 - DNA, 15 bp, Homo sapiens
caacagcaacaaagg

SEQ ID NO: 217999 - DNA, 15 bp, Homo sapiens
acaacagcaacaaag

SEQ ID NO: 218000 - DNA, 15 bp, Homo sapiens
aacaacagcaacaaa

SEQ ID NO: 218001 - DNA, 15 bp, Homo sapiens
caacaacagcaacaa

SEQ ID NO: 218002 - DNA, 15 bp, Homo sapiens
acaacaacagcaaca

SEQ ID NO: 218003 - DNA, 15 bp, Homo sapiens
aacaacaacagcaac

SEQ ID NO: 218004 - DNA, 15 bp, Homo sapiens
caacaacaacagcaa

SEQ ID NO: 218005 - DNA, 15 bp, Homo sapiens
acaacaacaacagca

SEQ ID NO: 218006 - DNA, 15 bp, Homo sapiens
aacaacaacaacagc

SEQ ID NO: 218007 - DNA, 15 bp, Homo sapiens
aaacaacaacaacag

SEQ ID NO: 218008 - DNA, 15 bp, Homo sapiens
gtctcaaaacaacaa

SEQ ID NO: 218009 - DNA, 15 bp, Homo sapiens
tgtctcaaaacaaca

SEQ ID NO: 218010 - DNA, 15 bp, Homo sapiens
ctgtctcaaaacaac

SEQ ID NO: 218011 - DNA, 15 bp, Homo sapiens
actgtctcaaaacaa

SEQ ID NO: 218012 - DNA, 15 bp, Homo sapiens
cactgtctcaaaaca

SEQ ID NO: 218013 - DNA, 15 bp, Homo sapiens
acactgtctcaaaac

SEQ ID NO: 218014 - DNA, 15 bp, Homo sapiens
gacactgtctcaaaa

SEQ ID NO: 218015 - DNA, 15 bp, Homo sapiens
agacactgtctcaaa

SEQ ID NO: 218016 - DNA, 15 bp, Homo sapiens
aagacactgtctcaa

SEQ ID NO: 218017 - DNA, 15 bp, Homo sapiens
caagacactgtctca

SEQ ID NO: 218018 - DNA, 15 bp, Homo sapiens
gcaagacactgtctc

SEQ ID NO: 218019 - DNA, 15 bp, Homo sapiens
agcaagacactgtct

SEQ ID NO: 218020 - DNA, 15 bp, Homo sapiens
gagcaagacactgtc

SEQ ID NO: 218021 - DNA, 15 bp, Homo sapiens
ggagcaagacactgt

SEQ ID NO: 218022 - DNA, 15 bp, Homo sapiens
cggagcaagacactg

SEQ ID NO: 218023 - DNA, 15 bp, Homo sapiens
acggagcaagacact

SEQ ID NO: 218024 - DNA, 15 bp, Homo sapiens
gacggagcaagacac

SEQ ID NO: 218025 - DNA, 15 bp, Homo sapiens
cgacggagcaagaca

SEQ ID NO: 218026 - DNA, 15 bp, Homo sapiens
gcgacggagcaagac

SEQ ID NO: 218027 - DNA, 15 bp, Homo sapiens
ggcgacggagcaaga

SEQ ID NO: 218028 - DNA, 15 bp, Homo sapiens
aggcgacggagcaag

SEQ ID NO: 218029 - DNA, 15 bp, Homo sapiens
taggcgacggagcaa

SEQ ID NO: 218030 - DNA, 15 bp, Homo sapiens
ctaggcgacggagca

SEQ ID NO: 218031 - DNA, 15 bp, Homo sapiens
cctaggcgacggagc

SEQ ID NO: 218032 - DNA, 15 bp, Homo sapiens
gcctaggcgacggag

SEQ ID NO: 218033 - DNA, 15 bp, Homo sapiens
agcctaggcgacgga

SEQ ID NO: 218034 - DNA, 15 bp, Homo sapiens
cagcctaggcgacgg

SEQ ID NO: 218035 - DNA, 15 bp, Homo sapiens
ccagcctaggcgacg

SEQ ID NO: 218036 - DNA, 15 bp, Homo sapiens
tccagcctaggcgac

SEQ ID NO: 218037 - DNA, 15 bp, Homo sapiens
ttccagcctaggcga

SEQ ID NO: 218038 - DNA, 15 bp, Homo sapiens
attccagcctaggcg

SEQ ID NO: 218039 - DNA, 15 bp, Homo sapiens
cattccagcctaggc

SEQ ID NO: 218040 - DNA, 15 bp, Homo sapiens
ggtgccactgcattc

SEQ ID NO: 218041 - DNA, 15 bp, Homo sapiens
tggtgccactgcatt

SEQ ID NO: 218042 - DNA, 15 bp, Homo sapiens
atggtgccactgcat

SEQ ID NO: 218043 - DNA, 15 bp, Homo sapiens
tgatggtgccactgc

SEQ ID NO: 218044 - DNA, 15 bp, Homo sapiens
atgatggtgccactg

SEQ ID NO: 218045 - DNA, 15 bp, Homo sapiens
tatgatggtgccact

SEQ ID NO: 218046 - DNA, 15 bp, Homo sapiens
ctatgatggtgccac

SEQ ID NO: 218047 - DNA, 15 bp, Homo sapiens
gctatgatggtgcca

SEQ ID NO: 218048 - DNA, 15 bp, Homo sapiens
agctatgatggtgcc

SEQ ID NO: 218049 - DNA, 15 bp, Homo sapiens
gagctatgatggtgc

SEQ ID NO: 218050 - DNA, 15 bp, Homo sapiens
tgagctatgatggtg

SEQ ID NO: 218051 - DNA, 15 bp, Homo sapiens
gtgagctatgatggt

SEQ ID NO: 218052 - DNA, 15 bp, Homo sapiens
agtgagctatgatgg

SEQ ID NO: 218053 - DNA, 15 bp, Homo sapiens
cagtgagctatgatg

SEQ ID NO: 218054 - DNA, 15 bp, Homo sapiens
acagtgagctatgat

SEQ ID NO: 218055 - DNA, 15 bp, Homo sapiens
tacagtgagctatga

SEQ ID NO: 218056 - DNA, 15 bp, Homo sapiens
ctacagtgagctatg

SEQ ID NO: 218057 - DNA, 15 bp, Homo sapiens
gctacagtgagctat

SEQ ID NO: 218058 - DNA, 15 bp, Homo sapiens
gaggctacagtgagc

SEQ ID NO: 218059 - DNA, 15 bp, Homo sapiens
tgaggctacagtgag

SEQ ID NO: 218060 - DNA, 15 bp, Homo sapiens
ttgaggctacagtga

SEQ ID NO: 218061 - DNA, 15 bp, Homo sapiens
tttgaggctacagtg

SEQ ID NO: 218062 - DNA, 15 bp, Homo sapiens
gtttgaggctacagt

SEQ ID NO: 218063 - DNA, 15 bp, Homo sapiens
agtttgaggctacag

SEQ ID NO: 218064 - DNA, 15 bp, Homo sapiens
gagtttgaggctaca

SEQ ID NO: 218065 - DNA, 15 bp, Homo sapiens
ggagtttgaggctac

SEQ ID NO: 218066 - DNA, 15 bp, Homo sapiens
aggagtttgaggcta

SEQ ID NO: 218067 - DNA, 15 bp, Homo sapiens
tccaggagtttgagg

SEQ ID NO: 218068 - DNA, 15 bp, Homo sapiens
ctccaggagtttgag

SEQ ID NO: 218069 - DNA, 15 bp, Homo sapiens
gctccaggagtttga

SEQ ID NO: 218070 - DNA, 15 bp, Homo sapiens
ggctccaggagtttg

SEQ ID NO: 218071 - DNA, 15 bp, Homo sapiens
tggctccaggagttt

SEQ ID NO: 218072 - DNA, 15 bp, Homo sapiens
ttggctccaggagtt

SEQ ID NO: 218073 - DNA, 15 bp, Homo sapiens
cttggctccaggagt

SEQ ID NO: 218074 - DNA, 15 bp, Homo sapiens
gcttggctccaggag

SEQ ID NO: 218075 - DNA, 15 bp, Homo sapiens
tgcttggctccagga

SEQ ID NO: 218076 - DNA, 15 bp, Homo sapiens
ctgcttggctccagg

SEQ ID NO: 218077 - DNA, 15 bp, Homo sapiens
actgcttggctccag

SEQ ID NO: 218078 - DNA, 15 bp, Homo sapiens
gactgcttggctcca

SEQ ID NO: 218079 - DNA, 15 bp, Homo sapiens
ggactgcttggctcc

SEQ ID NO: 218080 - DNA, 15 bp, Homo sapiens
aggactgcttggctc

SEQ ID NO: 218081 - DNA, 15 bp, Homo sapiens
caggactgcttggct

SEQ ID NO: 218082 - DNA, 15 bp, Homo sapiens
gcaggactgcttggc

SEQ ID NO: 218083 - DNA, 15 bp, Homo sapiens
ggcaggactgcttgg

SEQ ID NO: 218084 - DNA, 15 bp, Homo sapiens
aggcaggactgcttg

SEQ ID NO: 218085 - DNA, 15 bp, Homo sapiens
gaggcaggactgctt

SEQ ID NO: 218086 - DNA, 15 bp, Homo sapiens
tgaggcaggactgct

SEQ ID NO: 218087 - DNA, 15 bp, Homo sapiens
ctgaggcaggactgc

SEQ ID NO: 218088 - DNA, 15 bp, Homo sapiens
gctgaggcaggactg

SEQ ID NO: 218089 - DNA, 15 bp, Homo sapiens
ggctgaggcaggact

SEQ ID NO: 218090 - DNA, 15 bp, Homo sapiens
aggctgaggcaggac

SEQ ID NO: 218091 - DNA, 15 bp, Homo sapiens
gctcaggaggctgag

SEQ ID NO: 218092 - DNA, 15 bp, Homo sapiens
tgctcaggaggctga

SEQ ID NO: 218093 - DNA, 15 bp, Homo sapiens
ctgctcaggaggctg

SEQ ID NO: 218094 - DNA, 15 bp, Homo sapiens
tcagctgctcaggag

SEQ ID NO: 218095 - DNA, 15 bp, Homo sapiens
ctcagctgctcagga

SEQ ID NO: 218096 - DNA, 15 bp, Homo sapiens
tctcagctgctcagg

SEQ ID NO: 218097 - DNA, 15 bp, Homo sapiens
gtctcagctgctcag

SEQ ID NO: 218098 - DNA, 15 bp, Homo sapiens
agtctcagctgctca

SEQ ID NO: 218099 - DNA, 15 bp, Homo sapiens
tagtctcagctgctc

SEQ ID NO: 218100 - DNA, 15 bp, Homo sapiens
atagtctcagctgct

SEQ ID NO: 218101 - DNA, 15 bp, Homo sapiens
tatagtctcagctgc

SEQ ID NO: 218102 - DNA, 15 bp, Homo sapiens
ctatagtctcagctg

SEQ ID NO: 218103 - DNA, 15 bp, Homo sapiens
cctatagtctcagct

SEQ ID NO: 218104 - DNA, 15 bp, Homo sapiens
acctatagtctcagc

SEQ ID NO: 218105 - DNA, 15 bp, Homo sapiens
cacctatagtctcag

SEQ ID NO: 218106 - DNA, 15 bp, Homo sapiens
gcacctatagtctca

SEQ ID NO: 218107 - DNA, 15 bp, Homo sapiens
tgcacctatagtctc

SEQ ID NO: 218108 - DNA, 15 bp, Homo sapiens
atgcacctatagtct

SEQ ID NO: 218109 - DNA, 15 bp, Homo sapiens
tgtggcatgcaccta

SEQ ID NO: 218110 - DNA, 15 bp, Homo sapiens
ttgtggcatgcacct

SEQ ID NO: 218111 - DNA, 15 bp, Homo sapiens
attgtggcatgcacc

SEQ ID NO: 218112 - DNA, 15 bp, Homo sapiens
cattgtggcatgcac

SEQ ID NO: 218113 - DNA, 15 bp, Homo sapiens
gcattgtggcatgca

SEQ ID NO: 218114 - DNA, 15 bp, Homo sapiens
ggcattgtggcatgc

SEQ ID NO: 218115 - DNA, 15 bp, Homo sapiens
aggcattgtggcatg

SEQ ID NO: 218116 - DNA, 15 bp, Homo sapiens
caggcattgtggcat

SEQ ID NO: 218117 - DNA, 15 bp, Homo sapiens
ccaggcattgtggca

SEQ ID NO: 218118 - DNA, 15 bp, Homo sapiens
gccaggcattgtggc

SEQ ID NO: 218119 - DNA, 15 bp, Homo sapiens
agccaggcattgtgg

SEQ ID NO: 218120 - DNA, 15 bp, Homo sapiens
tagccaggcattgtg

SEQ ID NO: 218121 - DNA, 15 bp, Homo sapiens
ttagccaggcattgt

SEQ ID NO: 218122 - DNA, 15 bp, Homo sapiens
attagccaggcattg

SEQ ID NO: 218123 - DNA, 15 bp, Homo sapiens
aattagccaggcatt

SEQ ID NO: 218124 - DNA, 15 bp, Homo sapiens
aacaaaaattagcca

SEQ ID NO: 218125 - DNA, 15 bp, Homo sapiens
caacaaaaattagcc

SEQ ID NO: 218126 - DNA, 15 bp, Homo sapiens
acaacaaaaattagc

SEQ ID NO: 218127 - DNA, 15 bp, Homo sapiens
aacaacaaaaattag

SEQ ID NO: 218128 - DNA, 15 bp, Homo sapiens
caacaacaaaaatta

SEQ ID NO: 218129 - DNA, 15 bp, Homo sapiens
aacaacaacaaaaat

SEQ ID NO: 218130 - DNA, 15 bp, Homo sapiens
taacaacaacaaaaa

SEQ ID NO: 218131 - DNA, 15 bp, Homo sapiens
ataacaacaacaaaa

SEQ ID NO: 218132 - DNA, 15 bp, Homo sapiens
aataacaacaacaaa

SEQ ID NO: 218133 - DNA, 15 bp, Homo sapiens
caataacaacaacaa

SEQ ID NO: 218134 - DNA, 15 bp, Homo sapiens
tcaataacaacaaca

SEQ ID NO: 218135 - DNA, 15 bp, Homo sapiens
ctcaataacaacaac

SEQ ID NO: 218136 - DNA, 15 bp, Homo sapiens
tctcaataacaacaa

SEQ ID NO: 218137 - DNA, 15 bp, Homo sapiens
gtctcaataacaaca

SEQ ID NO: 218138 - DNA, 15 bp, Homo sapiens
cgtctcaataacaac

SEQ ID NO: 218139 - DNA, 15 bp, Homo sapiens
ccgtctcaataacaa

SEQ ID NO: 218140 - DNA, 15 bp, Homo sapiens
cccgtctcaataaca

SEQ ID NO: 218141 - DNA, 15 bp, Homo sapiens
ccccgtctcaataac

SEQ ID NO: 218142 - DNA, 15 bp, Homo sapiens
accccgtctcaataa

SEQ ID NO: 218143 - DNA, 15 bp, Homo sapiens
gaccccgtctcaata

SEQ ID NO: 218144 - DNA, 15 bp, Homo sapiens
agaccccgtctcaat

SEQ ID NO: 218145 - DNA, 15 bp, Homo sapiens
tagaccccgtctcaa

SEQ ID NO: 218146 - DNA, 15 bp, Homo sapiens
ctagaccccgtctca

SEQ ID NO: 218147 - DNA, 15 bp, Homo sapiens
gctagaccccgtctc

SEQ ID NO: 218148 - DNA, 15 bp, Homo sapiens
agctagaccccgtct

SEQ ID NO: 218149 - DNA, 15 bp, Homo sapiens
tagctagaccccgtc

SEQ ID NO: 218150 - DNA, 15 bp, Homo sapiens
atagctagaccccgt

SEQ ID NO: 218151 - DNA, 15 bp, Homo sapiens
catagctagaccccg

SEQ ID NO: 218152 - DNA, 15 bp, Homo sapiens
acatagctagacccc

SEQ ID NO: 218153 - DNA, 15 bp, Homo sapiens
ctgggcaacatagct

SEQ ID NO: 218154 - DNA, 15 bp, Homo sapiens
acaccagcctgggca

SEQ ID NO: 218155 - DNA, 15 bp, Homo sapiens
gacaccagcctgggc

SEQ ID NO: 218156 - DNA, 15 bp, Homo sapiens
tgacaccagcctggg

SEQ ID NO: 218157 - DNA, 15 bp, Homo sapiens
ttgacaccagcctgg

SEQ ID NO: 218158 - DNA, 15 bp, Homo sapiens
tttgacaccagcctg

SEQ ID NO: 218159 - DNA, 15 bp, Homo sapiens
atttgacaccagcct

SEQ ID NO: 218160 - DNA, 15 bp, Homo sapiens
aatttgacaccagcc

SEQ ID NO: 218161 - DNA, 15 bp, Homo sapiens
aaatttgacaccagc

SEQ ID NO: 218162 - DNA, 15 bp, Homo sapiens
gaaatttgacaccag

SEQ ID NO: 218163 - DNA, 15 bp, Homo sapiens
agaaatttgacacca

SEQ ID NO: 218164 - DNA, 15 bp, Homo sapiens
cagaaatttgacacc

SEQ ID NO: 218165 - DNA, 15 bp, Homo sapiens
ccagaaatttgacac

SEQ ID NO: 218166 - DNA, 15 bp, Homo sapiens
gccagaaatttgaca

SEQ ID NO: 218167 - DNA, 15 bp, Homo sapiens
ggccagaaatttgac

SEQ ID NO: 218168 - DNA, 15 bp, Homo sapiens
aggccagaaatttga

SEQ ID NO: 218169 - DNA, 15 bp, Homo sapiens
gaggccagaaatttg

SEQ ID NO: 218170 - DNA, 15 bp, Homo sapiens
tgaggccagaaattt

SEQ ID NO: 218171 - DNA, 15 bp, Homo sapiens
ttgaggccagaaatt

SEQ ID NO: 218172 - DNA, 15 bp, Homo sapiens
cttgaggccagaaat

SEQ ID NO: 218173 - DNA, 15 bp, Homo sapiens
gcttgaggccagaaa

SEQ ID NO: 218174 - DNA, 15 bp, Homo sapiens
tgcttgaggccagaa

SEQ ID NO: 218175 - DNA, 15 bp, Homo sapiens
ttgcttgaggccaga

SEQ ID NO: 218176 - DNA, 15 bp, Homo sapiens
attgcttgaggccag

SEQ ID NO: 218177 - DNA, 15 bp, Homo sapiens
gattgcttgaggcca

SEQ ID NO: 218178 - DNA, 15 bp, Homo sapiens
ggattgcttgaggcc

SEQ ID NO: 218179 - DNA, 15 bp, Homo sapiens
aggattgcttgaggc

SEQ ID NO: 218180 - DNA, 15 bp, Homo sapiens
aaggcaggaggattg

SEQ ID NO: 218181 - DNA, 15 bp, Homo sapiens
caaggcaggaggatt

SEQ ID NO: 218182 - DNA, 15 bp, Homo sapiens
taactgtaatcccag

SEQ ID NO: 218183 - DNA, 15 bp, Homo sapiens
ataactgtaatccca

SEQ ID NO: 218184 - DNA, 15 bp, Homo sapiens
cataactgtaatccc

SEQ ID NO: 218185 - DNA, 15 bp, Homo sapiens
tcataactgtaatcc

SEQ ID NO: 218186 - DNA, 15 bp, Homo sapiens
ctcataactgtaatc

SEQ ID NO: 218187 - DNA, 15 bp, Homo sapiens
gctcataactgtaat

SEQ ID NO: 218188 - DNA, 15 bp, Homo sapiens
ggctcataactgtaa

SEQ ID NO: 218189 - DNA, 15 bp, Homo sapiens
tggctcataactgta

SEQ ID NO: 218190 - DNA, 15 bp, Homo sapiens
gtggctcataactgt

SEQ ID NO: 218191 - DNA, 15 bp, Homo sapiens
ggtggctcataactg

SEQ ID NO: 218192 - DNA, 15 bp, Homo sapiens
tggtggctcataact

SEQ ID NO: 218193 - DNA, 15 bp, Homo sapiens
gtggtggctcataac

SEQ ID NO: 218194 - DNA, 15 bp, Homo sapiens
tgtggtggctcataa

SEQ ID NO: 218195 - DNA, 15 bp, Homo sapiens
ctgtggtggctcata

SEQ ID NO: 218196 - DNA, 15 bp, Homo sapiens
gctgtggtggctcat

SEQ ID NO: 218197 - DNA, 15 bp, Homo sapiens
ggctgtggtggctca

SEQ ID NO: 218198 - DNA, 15 bp, Homo sapiens
tggctgtggtggctc

SEQ ID NO: 218199 - DNA, 15 bp, Homo sapiens
ctggctgtggtggct

SEQ ID NO: 218200 - DNA, 15 bp, Homo sapiens
gctggctgtggtggc

SEQ ID NO: 218201 - DNA, 15 bp, Homo sapiens
ggctggctgtggtgg

SEQ ID NO: 218202 - DNA, 15 bp, Homo sapiens
aggctggctgtggtg

SEQ ID NO: 218203 - DNA, 15 bp, Homo sapiens
gaggctggctgtggt

SEQ ID NO: 218204 - DNA, 15 bp, Homo sapiens
tgaggctggctgtgg

SEQ ID NO: 218205 - DNA, 15 bp, Homo sapiens
ctgaggctggctgtg

SEQ ID NO: 218206 - DNA, 15 bp, Homo sapiens
actgaggctggctgt

SEQ ID NO: 218207 - DNA, 15 bp, Homo sapiens
aactgaggctggctg

SEQ ID NO: 218208 - DNA, 15 bp, Homo sapiens
aaactgaggctggct

SEQ ID NO: 218209 - DNA, 15 bp, Homo sapiens
aaaactgaggctggc

SEQ ID NO: 218210 - DNA, 15 bp, Homo sapiens
gaaaactgaggctgg

SEQ ID NO: 218211 - DNA, 15 bp, Homo sapiens
ggaaaactgaggctg

SEQ ID NO: 218212 - DNA, 15 bp, Homo sapiens
aggaaaactgaggct

SEQ ID NO: 218213 - DNA, 15 bp, Homo sapiens
aaggaaaactgaggc

SEQ ID NO: 218214 - DNA, 15 bp, Homo sapiens
aaaggaaaactgagg

SEQ ID NO: 218215 - DNA, 15 bp, Homo sapiens
aaaaggaaaactgag

SEQ ID NO: 218216 - DNA, 15 bp, Homo sapiens
aaaaaggaaaactga

SEQ ID NO: 218217 - DNA, 15 bp, Homo sapiens
caaaaaggaaaactg

SEQ ID NO: 218218 - DNA, 15 bp, Homo sapiens
tcaaaaaggaaaact

SEQ ID NO: 218219 - DNA, 15 bp, Homo sapiens
ttcaaaaaggaaaac

SEQ ID NO: 218220 - DNA, 15 bp, Homo sapiens
tttcaaaaaggaaaa

SEQ ID NO: 218221 - DNA, 15 bp, Homo sapiens
atttcaaaaaggaaa

SEQ ID NO: 218222 - DNA, 15 bp, Homo sapiens
aatttcaaaaaggaa

SEQ ID NO: 218223 - DNA, 15 bp, Homo sapiens
taatttcaaaaagga

SEQ ID NO: 218224 - DNA, 15 bp, Homo sapiens
ataatttcaaaaagg

SEQ ID NO: 218225 - DNA, 15 bp, Homo sapiens
aataatttcaaaaag

SEQ ID NO: 218226 - DNA, 15 bp, Homo sapiens
aaataatttcaaaaa

SEQ ID NO: 218227 - DNA, 15 bp, Homo sapiens
aaaataatttcaaaa

SEQ ID NO: 218228 - DNA, 15 bp, Homo sapiens
caaaataatttcaaa

SEQ ID NO: 218229 - DNA, 15 bp, Homo sapiens
acaaaataatttcaa

SEQ ID NO: 218230 - DNA, 15 bp, Homo sapiens
tacaaaataatttca

SEQ ID NO: 218231 - DNA, 15 bp, Homo sapiens
atacaaaataatttc

SEQ ID NO: 218232 - DNA, 15 bp, Homo sapiens
gatacaaaataattt

SEQ ID NO: 218233 - DNA, 15 bp, Homo sapiens
agatacaaaataatt

SEQ ID NO: 218234 - DNA, 15 bp, Homo sapiens
aagatacaaaataat

SEQ ID NO: 218235 - DNA, 15 bp, Homo sapiens
gaagatacaaaataa

SEQ ID NO: 218236 - DNA, 15 bp, Homo sapiens
ggaagatacaaaata

SEQ ID NO: 218237 - DNA, 15 bp, Homo sapiens
aggaagatacaaaat

SEQ ID NO: 218238 - DNA, 15 bp, Homo sapiens
taggaagatacaaaa

SEQ ID NO: 218239 - DNA, 15 bp, Homo sapiens
gtaggaagatacaaa

SEQ ID NO: 218240 - DNA, 15 bp, Homo sapiens
agtaggaagatacaa

SEQ ID NO: 218241 - DNA, 15 bp, Homo sapiens
aagtaggaagataca

SEQ ID NO: 218242 - DNA, 15 bp, Homo sapiens
taagtaggaagatac

SEQ ID NO: 218243 - DNA, 15 bp, Homo sapiens
ataagtaggaagata

SEQ ID NO: 218244 - DNA, 15 bp, Homo sapiens
aataagtaggaagat

SEQ ID NO: 218245 - DNA, 15 bp, Homo sapiens
gaataagtaggaaga

SEQ ID NO: 218246 - DNA, 15 bp, Homo sapiens
agaataagtaggaag

SEQ ID NO: 218247 - DNA, 15 bp, Homo sapiens
tagaataagtaggaa

SEQ ID NO: 218248 - DNA, 15 bp, Homo sapiens
ttagaataagtagga

SEQ ID NO: 218249 - DNA, 15 bp, Homo sapiens
gttagaataagtagg

SEQ ID NO: 218250 - DNA, 15 bp, Homo sapiens
agttagaataagtag

SEQ ID NO: 218251 - DNA, 15 bp, Homo sapiens
cagttagaataagta

SEQ ID NO: 218252 - DNA, 15 bp, Homo sapiens
tcagttagaataagt

SEQ ID NO: 218253 - DNA, 15 bp, Homo sapiens
atcagttagaataag

SEQ ID NO: 218254 - DNA, 15 bp, Homo sapiens
catcagttagaataa

SEQ ID NO: 218255 - DNA, 15 bp, Homo sapiens
gcatcagttagaata

SEQ ID NO: 218256 - DNA, 15 bp, Homo sapiens
agcatcagttagaat

SEQ ID NO: 218257 - DNA, 15 bp, Homo sapiens
cagcatcagttagaa

SEQ ID NO: 218258 - DNA, 15 bp, Homo sapiens
ccagcatcagttaga

SEQ ID NO: 218259 - DNA, 15 bp, Homo sapiens
accagcatcagttag

SEQ ID NO: 218260 - DNA, 15 bp, Homo sapiens
gaccagcatcagtta

SEQ ID NO: 218261 - DNA, 15 bp, Homo sapiens
agaccagcatcagtt

SEQ ID NO: 218262 - DNA, 15 bp, Homo sapiens
tagaccagcatcagt

SEQ ID NO: 218263 - DNA, 15 bp, Homo sapiens
atagaccagcatcag

SEQ ID NO: 218264 - DNA, 15 bp, Homo sapiens
aatagaccagcatca

SEQ ID NO: 218265 - DNA, 15 bp, Homo sapiens
caatagaccagcatc

SEQ ID NO: 218266 - DNA, 15 bp, Homo sapiens
gcaatagaccagcat

SEQ ID NO: 218267 - DNA, 15 bp, Homo sapiens
agcaatagaccagca

SEQ ID NO: 218268 - DNA, 15 bp, Homo sapiens
aagcaatagaccagc

SEQ ID NO: 218269 - DNA, 15 bp, Homo sapiens
caagcaatagaccag

SEQ ID NO: 218270 - DNA, 15 bp, Homo sapiens
ccaagcaatagacca

SEQ ID NO: 218271 - DNA, 15 bp, Homo sapiens
tccaagcaatagacc

SEQ ID NO: 218272 - DNA, 15 bp, Homo sapiens
ctccaagcaatagac

SEQ ID NO: 218273 - DNA, 15 bp, Homo sapiens
cctccaagcaataga

SEQ ID NO: 218274 - DNA, 15 bp, Homo sapiens
gcctccaagcaatag

SEQ ID NO: 218275 - DNA, 15 bp, Homo sapiens
ggcctccaagcaata

SEQ ID NO: 218276 - DNA, 15 bp, Homo sapiens
tggcctccaagcaat

SEQ ID NO: 218277 - DNA, 15 bp, Homo sapiens
ttggcctccaagcaa

SEQ ID NO: 218278 - DNA, 15 bp, Homo sapiens
tttggcctccaagca

SEQ ID NO: 218279 - DNA, 15 bp, Homo sapiens
ttttggcctccaagc

SEQ ID NO: 218280 - DNA, 15 bp, Homo sapiens
gttttggcctccaag

SEQ ID NO: 218281 - DNA, 15 bp, Homo sapiens
agttttggcctccaa

SEQ ID NO: 218282 - DNA, 15 bp, Homo sapiens
aagttttggcctcca

SEQ ID NO: 218283 - DNA, 15 bp, Homo sapiens
gaagttttggcctcc

SEQ ID NO: 218284 - DNA, 15 bp, Homo sapiens
tgaagttttggcctc

SEQ ID NO: 218285 - DNA, 15 bp, Homo sapiens
gtgaagttttggcct

SEQ ID NO: 218286 - DNA, 15 bp, Homo sapiens
agtgaagttttggcc

SEQ ID NO: 218287 - DNA, 15 bp, Homo sapiens
aagtgaagttttggc

SEQ ID NO: 218288 - DNA, 15 bp, Homo sapiens
aaagtgaagttttgg

SEQ ID NO: 218289 - DNA, 15 bp, Homo sapiens
taaagtgaagttttg

SEQ ID NO: 218290 - DNA, 15 bp, Homo sapiens
ataaagtgaagtttt

SEQ ID NO: 218291 - DNA, 15 bp, Homo sapiens
tataaagtgaagttt

SEQ ID NO: 218292 - DNA, 15 bp, Homo sapiens
gtataaagtgaagtt

SEQ ID NO: 218293 - DNA, 15 bp, Homo sapiens
tgtataaagtgaagt

SEQ ID NO: 218294 - DNA, 15 bp, Homo sapiens
ttgtataaagtgaag

SEQ ID NO: 218295 - DNA, 15 bp, Homo sapiens
attgtataaagtgaa

SEQ ID NO: 218296 - DNA, 15 bp, Homo sapiens
aattgtataaagtga

SEQ ID NO: 218297 - DNA, 15 bp, Homo sapiens
aaattgtataaagtg

SEQ ID NO: 218298 - DNA, 15 bp, Homo sapiens
caaattgtataaagt

SEQ ID NO: 218299 - DNA, 15 bp, Homo sapiens
acaaattgtataaag

SEQ ID NO: 218300 - DNA, 15 bp, Homo sapiens
gacaaattgtataaa

SEQ ID NO: 218301 - DNA, 15 bp, Homo sapiens
agacaaattgtataa

SEQ ID NO: 218302 - DNA, 15 bp, Homo sapiens
cagacaaattgtata

SEQ ID NO: 218303 - DNA, 15 bp, Homo sapiens
ccagacaaattgtat

SEQ ID NO: 218304 - DNA, 15 bp, Homo sapiens
cccagacaaattgta

SEQ ID NO: 218305 - DNA, 15 bp, Homo sapiens
tcccagacaaattgt

SEQ ID NO: 218306 - DNA, 15 bp, Homo sapiens
ctcccagacaaattg

SEQ ID NO: 218307 - DNA, 15 bp, Homo sapiens
cctcccagacaaatt

SEQ ID NO: 218308 - DNA, 15 bp, Homo sapiens
ccctcccagacaaat

SEQ ID NO: 218309 - DNA, 15 bp, Homo sapiens
cccctcccagacaaa

SEQ ID NO: 218310 - DNA, 15 bp, Homo sapiens
tcccctcccagacaa

SEQ ID NO: 218311 - DNA, 15 bp, Homo sapiens
ttcccctcccagaca

SEQ ID NO: 218312 - DNA, 15 bp, Homo sapiens
attcccctcccagac

SEQ ID NO: 218313 - DNA, 15 bp, Homo sapiens
aattcccctcccaga

SEQ ID NO: 218314 - DNA, 15 bp, Homo sapiens
caattcccctcccag

SEQ ID NO: 218315 - DNA, 15 bp, Homo sapiens
tcaattcccctccca

SEQ ID NO: 218316 - DNA, 15 bp, Homo sapiens
ttcaattcccctccc

SEQ ID NO: 218317 - DNA, 15 bp, Homo sapiens
cttcaattcccctcc

SEQ ID NO: 218318 - DNA, 15 bp, Homo sapiens
ccttcaattcccctc

SEQ ID NO: 218319 - DNA, 15 bp, Homo sapiens
accttcaattcccct

SEQ ID NO: 218320 - DNA, 15 bp, Homo sapiens
gaccttcaattcccc

SEQ ID NO: 218321 - DNA, 15 bp, Homo sapiens
agaccttcaattccc

SEQ ID NO: 218322 - DNA, 15 bp, Homo sapiens
aagaccttcaattcc

SEQ ID NO: 218323 - DNA, 15 bp, Homo sapiens
aaagaccttcaattc

SEQ ID NO: 218324 - DNA, 15 bp, Homo sapiens
aaaagaccttcaatt

SEQ ID NO: 218325 - DNA, 15 bp, Homo sapiens
gaaaagaccttcaat

SEQ ID NO: 218326 - DNA, 15 bp, Homo sapiens
tgaaaagaccttcaa

SEQ ID NO: 218327 - DNA, 15 bp, Homo sapiens
gtgaaaagaccttca

SEQ ID NO: 218328 - DNA, 15 bp, Homo sapiens
tgtgaaaagaccttc

SEQ ID NO: 218329 - DNA, 15 bp, Homo sapiens
atgtgaaaagacctt

SEQ ID NO: 218330 - DNA, 15 bp, Homo sapiens
tatgtgaaaagacct

SEQ ID NO: 218331 - DNA, 15 bp, Homo sapiens
atatgtgaaaagacc

SEQ ID NO: 218332 - DNA, 15 bp, Homo sapiens
gatatgtgaaaagac

SEQ ID NO: 218333 - DNA, 15 bp, Homo sapiens
agatatgtgaaaaga

SEQ ID NO: 218334 - DNA, 15 bp, Homo sapiens
tagatatgtgaaaag

SEQ ID NO: 218335 - DNA, 15 bp, Homo sapiens
gtagatatgtgaaaa

SEQ ID NO: 218336 - DNA, 15 bp, Homo sapiens
agtagatatgtgaaa

SEQ ID NO: 218337 - DNA, 15 bp, Homo sapiens
tagtagatatgtgaa

SEQ ID NO: 218338 - DNA, 15 bp, Homo sapiens
gtagtagatatgtga

SEQ ID NO: 218339 - DNA, 15 bp, Homo sapiens
tgtagtagatatgtg

SEQ ID NO: 218340 - DNA, 15 bp, Homo sapiens
ctgtagtagatatgt

SEQ ID NO: 218341 - DNA, 15 bp, Homo sapiens
cctgtagtagatatg

SEQ ID NO: 218342 - DNA, 15 bp, Homo sapiens
gcctgtagtagatat

SEQ ID NO: 218343 - DNA, 15 bp, Homo sapiens
agcctgtagtagata

SEQ ID NO: 218344 - DNA, 15 bp, Homo sapiens
cagcctgtagtagat

SEQ ID NO: 218345 - DNA, 15 bp, Homo sapiens
tcagcctgtagtaga

SEQ ID NO: 218346 - DNA, 15 bp, Homo sapiens
ctcagcctgtagtag

SEQ ID NO: 218347 - DNA, 15 bp, Homo sapiens
gctcagcctgtagta

SEQ ID NO: 218348 - DNA, 15 bp, Homo sapiens
tgctcagcctgtagt

SEQ ID NO: 218349 - DNA, 15 bp, Homo sapiens
atgctcagcctgtag

SEQ ID NO: 218350 - DNA, 15 bp, Homo sapiens
gatgctcagcctgta

SEQ ID NO: 218351 - DNA, 15 bp, Homo sapiens
ggatgctcagcctgt

SEQ ID NO: 218352 - DNA, 15 bp, Homo sapiens
aggatgctcagcctg

SEQ ID NO: 218353 - DNA, 15 bp, Homo sapiens
aaggatgctcagcct

SEQ ID NO: 218354 - DNA, 15 bp, Homo sapiens
aaaggatgctcagcc

SEQ ID NO: 218355 - DNA, 15 bp, Homo sapiens
caaaggatgctcagc

SEQ ID NO: 218356 - DNA, 15 bp, Homo sapiens
acaaaggatgctcag

SEQ ID NO: 218357 - DNA, 15 bp, Homo sapiens
cacaaaggatgctca

SEQ ID NO: 218358 - DNA, 15 bp, Homo sapiens
acacaaaggatgctc

SEQ ID NO: 218359 - DNA, 15 bp, Homo sapiens
tacacaaaggatgct

SEQ ID NO: 218360 - DNA, 15 bp, Homo sapiens
ttacacaaaggatgc

SEQ ID NO: 218361 - DNA, 15 bp, Homo sapiens
tttacacaaaggatg

SEQ ID NO: 218362 - DNA, 15 bp, Homo sapiens
ttttacacaaaggat

SEQ ID NO: 218363 - DNA, 15 bp, Homo sapiens
attttacacaaagga

SEQ ID NO: 218364 - DNA, 15 bp, Homo sapiens
aattttacacaaagg

SEQ ID NO: 218365 - DNA, 15 bp, Homo sapiens
gaattttacacaaag

SEQ ID NO: 218366 - DNA, 15 bp, Homo sapiens
agaattttacacaaa

SEQ ID NO: 218367 - DNA, 15 bp, Homo sapiens
aagaattttacacaa

SEQ ID NO: 218368 - DNA, 15 bp, Homo sapiens
caagaattttacaca

SEQ ID NO: 218369 - DNA, 15 bp, Homo sapiens
ccaagaattttacac

SEQ ID NO: 218370 - DNA, 15 bp, Homo sapiens
cccaagaattttaca

SEQ ID NO: 218371 - DNA, 15 bp, Homo sapiens
tcccaagaattttac

SEQ ID NO: 218372 - DNA, 15 bp, Homo sapiens
atcccaagaatttta

SEQ ID NO: 218373 - DNA, 15 bp, Homo sapiens
gatcccaagaatttt

SEQ ID NO: 218374 - DNA, 15 bp, Homo sapiens
tgatcccaagaattt

SEQ ID NO: 218375 - DNA, 15 bp, Homo sapiens
ctgatcccaagaatt

SEQ ID NO: 218376 - DNA, 15 bp, Homo sapiens
tctgatcccaagaat

SEQ ID NO: 218377 - DNA, 15 bp, Homo sapiens
ttctgatcccaagaa

SEQ ID NO: 218378 - DNA, 15 bp, Homo sapiens
cttctgatcccaaga

SEQ ID NO: 218379 - DNA, 15 bp, Homo sapiens
acttctgatcccaag

SEQ ID NO: 218380 - DNA, 15 bp, Homo sapiens
cacttctgatcccaa

SEQ ID NO: 218381 - DNA, 15 bp, Homo sapiens
acacttctgatccca

SEQ ID NO: 218382 - DNA, 15 bp, Homo sapiens
aacacttctgatccc

SEQ ID NO: 218383 - DNA, 15 bp, Homo sapiens
aaacacttctgatcc

SEQ ID NO: 218384 - DNA, 15 bp, Homo sapiens
gaaacacttctgatc

SEQ ID NO: 218385 - DNA, 15 bp, Homo sapiens
tgaaacacttctgat

SEQ ID NO: 218386 - DNA, 15 bp, Homo sapiens
ttgaaacacttctga

SEQ ID NO: 218387 - DNA, 15 bp, Homo sapiens
tttgaaacacttctg

SEQ ID NO: 218388 - DNA, 15 bp, Homo sapiens
ttttgaaacacttct

SEQ ID NO: 218389 - DNA, 15 bp, Homo sapiens
attttgaaacacttc

SEQ ID NO: 218390 - DNA, 15 bp, Homo sapiens
aattttgaaacactt

SEQ ID NO: 218391 - DNA, 15 bp, Homo sapiens
gaattttgaaacact

SEQ ID NO: 218392 - DNA, 15 bp, Homo sapiens
tgaattttgaaacac

SEQ ID NO: 218393 - DNA, 15 bp, Homo sapiens
ctgaattttgaaaca

SEQ ID NO: 218394 - DNA, 15 bp, Homo sapiens
actgaattttgaaac

SEQ ID NO: 218395 - DNA, 15 bp, Homo sapiens
aactgaattttgaaa

SEQ ID NO: 218396 - DNA, 15 bp, Homo sapiens
aaactgaattttgaa

SEQ ID NO: 218397 - DNA, 15 bp, Homo sapiens
aaaactgaattttga

SEQ ID NO: 218398 - DNA, 15 bp, Homo sapiens
aaaaactgaattttg

SEQ ID NO: 218399 - DNA, 15 bp, Homo sapiens
caaaaactgaatttt

SEQ ID NO: 218400 - DNA, 15 bp, Homo sapiens
ccaaaaactgaattt

SEQ ID NO: 218401 - DNA, 15 bp, Homo sapiens
cccaaaaactgaatt

SEQ ID NO: 218402 - DNA, 15 bp, Homo sapiens
tcccaaaaactgaat

SEQ ID NO: 218403 - DNA, 15 bp, Homo sapiens
atcccaaaaactgaa

SEQ ID NO: 218404 - DNA, 15 bp, Homo sapiens
aatcccaaaaactga

SEQ ID NO: 218405 - DNA, 15 bp, Homo sapiens
aaatcccaaaaactg

SEQ ID NO: 218406 - DNA, 15 bp, Homo sapiens
aaaatcccaaaaact

SEQ ID NO: 218407 - DNA, 15 bp, Homo sapiens
caaaatcccaaaaac

SEQ ID NO: 218408 - DNA, 15 bp, Homo sapiens
ccaaaatcccaaaaa

SEQ ID NO: 218409 - DNA, 15 bp, Homo sapiens
tccaaaatcccaaaa

SEQ ID NO: 218410 - DNA, 15 bp, Homo sapiens
ttccaaaatcccaaa

SEQ ID NO: 218411 - DNA, 15 bp, Homo sapiens
attccaaaatcccaa

SEQ ID NO: 218412 - DNA, 15 bp, Homo sapiens
tattccaaaatccca

SEQ ID NO: 218413 - DNA, 15 bp, Homo sapiens
atattccaaaatccc

SEQ ID NO: 218414 - DNA, 15 bp, Homo sapiens
aatattccaaaatcc

SEQ ID NO: 218415 - DNA, 15 bp, Homo sapiens
aaatattccaaaatc

SEQ ID NO: 218416 - DNA, 15 bp, Homo sapiens
caaatattccaaaat

SEQ ID NO: 218417 - DNA, 15 bp, Homo sapiens
acaaatattccaaaa

SEQ ID NO: 218418 - DNA, 15 bp, Homo sapiens
cacaaatattccaaa

SEQ ID NO: 218419 - DNA, 15 bp, Homo sapiens
acacaaatattccaa

SEQ ID NO: 218420 - DNA, 15 bp, Homo sapiens
tacacaaatattcca

SEQ ID NO: 218421 - DNA, 15 bp, Homo sapiens
atacacaaatattcc

SEQ ID NO: 218422 - DNA, 15 bp, Homo sapiens
gatacacaaatattc

SEQ ID NO: 218423 - DNA, 15 bp, Homo sapiens
ggatacacaaatatt

SEQ ID NO: 218424 - DNA, 15 bp, Homo sapiens
tggatacacaaatat

SEQ ID NO: 218425 - DNA, 15 bp, Homo sapiens
atggatacacaaata

SEQ ID NO: 218426 - DNA, 15 bp, Homo sapiens
tatggatacacaaat

SEQ ID NO: 218427 - DNA, 15 bp, Homo sapiens
ttatggatacacaaa

SEQ ID NO: 218428 - DNA, 15 bp, Homo sapiens
attatggatacacaa

SEQ ID NO: 218429 - DNA, 15 bp, Homo sapiens
cattatggatacaca

SEQ ID NO: 218430 - DNA, 15 bp, Homo sapiens
tcattatggatacac

SEQ ID NO: 218431 - DNA, 15 bp, Homo sapiens
ctcattatggataca

SEQ ID NO: 218432 - DNA, 15 bp, Homo sapiens
tctcattatggatac

SEQ ID NO: 218433 - DNA, 15 bp, Homo sapiens
atctcattatggata

SEQ ID NO: 218434 - DNA, 15 bp, Homo sapiens
tatctcattatggat

SEQ ID NO: 218435 - DNA, 15 bp, Homo sapiens
atatctcattatgga

SEQ ID NO: 218436 - DNA, 15 bp, Homo sapiens
gatatctcattatgg

SEQ ID NO: 218437 - DNA, 15 bp, Homo sapiens
agatatctcattatg

SEQ ID NO: 218438 - DNA, 15 bp, Homo sapiens
aagatatctcattat

SEQ ID NO: 218439 - DNA, 15 bp, Homo sapiens
caagatatctcatta

SEQ ID NO: 218440 - DNA, 15 bp, Homo sapiens
acaagatatctcatt

SEQ ID NO: 218441 - DNA, 15 bp, Homo sapiens
cacaagatatctcat

SEQ ID NO: 218442 - DNA, 15 bp, Homo sapiens
tcacaagatatctca

SEQ ID NO: 218443 - DNA, 15 bp, Homo sapiens
ttcacaagatatctc

SEQ ID NO: 218444 - DNA, 15 bp, Homo sapiens
attcacaagatatct

SEQ ID NO: 218445 - DNA, 15 bp, Homo sapiens
cattcacaagatatc

SEQ ID NO: 218446 - DNA, 15 bp, Homo sapiens
tcattcacaagatat

SEQ ID NO: 218447 - DNA, 15 bp, Homo sapiens
ctcattcacaagata

SEQ ID NO: 218448 - DNA, 15 bp, Homo sapiens
tctcattcacaagat

SEQ ID NO: 218449 - DNA, 15 bp, Homo sapiens
ttctcattcacaaga

SEQ ID NO: 218450 - DNA, 15 bp, Homo sapiens
gttctcattcacaag

SEQ ID NO: 218451 - DNA, 15 bp, Homo sapiens
ggttctcattcacaa

SEQ ID NO: 218452 - DNA, 15 bp, Homo sapiens
tggttctcattcaca

SEQ ID NO: 218453 - DNA, 15 bp, Homo sapiens
ttggttctcattcac

SEQ ID NO: 218454 - DNA, 15 bp, Homo sapiens
cttggttctcattca

SEQ ID NO: 218455 - DNA, 15 bp, Homo sapiens
acttggttctcattc

SEQ ID NO: 218456 - DNA, 15 bp, Homo sapiens
cacttggttctcatt

SEQ ID NO: 218457 - DNA, 15 bp, Homo sapiens
acacttggttctcat

SEQ ID NO: 218458 - DNA, 15 bp, Homo sapiens
tacacttggttctca

SEQ ID NO: 218459 - DNA, 15 bp, Homo sapiens
ttacacttggttctc

SEQ ID NO: 218460 - DNA, 15 bp, Homo sapiens
tttacacttggttct

SEQ ID NO: 218461 - DNA, 15 bp, Homo sapiens
gtttacacttggttc

SEQ ID NO: 218462 - DNA, 15 bp, Homo sapiens
tgtttacacttggtt

SEQ ID NO: 218463 - DNA, 15 bp, Homo sapiens
atgtttacacttggt

SEQ ID NO: 218464 - DNA, 15 bp, Homo sapiens
catgtttacacttgg

SEQ ID NO: 218465 - DNA, 15 bp, Homo sapiens
tcatgtttacacttg

SEQ ID NO: 218466 - DNA, 15 bp, Homo sapiens
ttcatgtttacactt

SEQ ID NO: 218467 - DNA, 15 bp, Homo sapiens
tttcatgtttacact

SEQ ID NO: 218468 - DNA, 15 bp, Homo sapiens
atttcatgtttacac

SEQ ID NO: 218469 - DNA, 15 bp, Homo sapiens
aatttcatgtttaca

SEQ ID NO: 218470 - DNA, 15 bp, Homo sapiens
gaatttcatgtttac

SEQ ID NO: 218471 - DNA, 15 bp, Homo sapiens
tgaatttcatgttta

SEQ ID NO: 218472 - DNA, 15 bp, Homo sapiens
atgaatttcatgttt

SEQ ID NO: 218473 - DNA, 15 bp, Homo sapiens
aatgaatttcatgtt

SEQ ID NO: 218474 - DNA, 15 bp, Homo sapiens
aaatgaatttcatgt

SEQ ID NO: 218475 - DNA, 15 bp, Homo sapiens
caaatgaatttcatg

SEQ ID NO: 218476 - DNA, 15 bp, Homo sapiens
acaaatgaatttcat

SEQ ID NO: 218477 - DNA, 15 bp, Homo sapiens
aacaaatgaatttca

SEQ ID NO: 218478 - DNA, 15 bp, Homo sapiens
aaacaaatgaatttc

SEQ ID NO: 218479 - DNA, 15 bp, Homo sapiens
gaaacaaatgaattt

SEQ ID NO: 218480 - DNA, 15 bp, Homo sapiens
tgaaacaaatgaatt

SEQ ID NO: 218481 - DNA, 15 bp, Homo sapiens
ctgaaacaaatgaat

SEQ ID NO: 218482 - DNA, 15 bp, Homo sapiens
tctgaaacaaatgaa

SEQ ID NO: 218483 - DNA, 15 bp, Homo sapiens
atctgaaacaaatga

SEQ ID NO: 218484 - DNA, 15 bp, Homo sapiens
tatctgaaacaaatg

SEQ ID NO: 218485 - DNA, 15 bp, Homo sapiens
atatctgaaacaaat

SEQ ID NO: 218486 - DNA, 15 bp, Homo sapiens
tatatctgaaacaaa

SEQ ID NO: 218487 - DNA, 15 bp, Homo sapiens
gtatatctgaaacaa

SEQ ID NO: 218488 - DNA, 15 bp, Homo sapiens
ggtatatctgaaaca

SEQ ID NO: 218489 - DNA, 15 bp, Homo sapiens
aggtatatctgaaac

SEQ ID NO: 218490 - DNA, 15 bp, Homo sapiens
aaggtatatctgaaa

SEQ ID NO: 218491 - DNA, 15 bp, Homo sapiens
taaggtatatctgaa

SEQ ID NO: 218492 - DNA, 15 bp, Homo sapiens
ctaaggtatatctga

SEQ ID NO: 218493 - DNA, 15 bp, Homo sapiens
tctaaggtatatctg

SEQ ID NO: 218494 - DNA, 15 bp, Homo sapiens
gtctaaggtatatct

SEQ ID NO: 218495 - DNA, 15 bp, Homo sapiens
tgtctaaggtatatc

SEQ ID NO: 218496 - DNA, 15 bp, Homo sapiens
gtgtctaaggtatat

SEQ ID NO: 218497 - DNA, 15 bp, Homo sapiens
tgtgtctaaggtata

SEQ ID NO: 218498 - DNA, 15 bp, Homo sapiens
atgtgtctaaggtat

SEQ ID NO: 218499 - DNA, 15 bp, Homo sapiens
tatgtgtctaaggta

SEQ ID NO: 218500 - DNA, 15 bp, Homo sapiens
ctatgtgtctaaggt

SEQ ID NO: 218501 - DNA, 15 bp, Homo sapiens
gctatgtgtctaagg

SEQ ID NO: 218502 - DNA, 15 bp, Homo sapiens
ggctatgtgtctaag

SEQ ID NO: 218503 - DNA, 15 bp, Homo sapiens
aggctatgtgtctaa

SEQ ID NO: 218504 - DNA, 15 bp, Homo sapiens
caggctatgtgtcta

SEQ ID NO: 218505 - DNA, 15 bp, Homo sapiens
tcaggctatgtgtct

SEQ ID NO: 218506 - DNA, 15 bp, Homo sapiens
ttcaggctatgtgtc

SEQ ID NO: 218507 - DNA, 15 bp, Homo sapiens
cttcaggctatgtgt

SEQ ID NO: 218508 - DNA, 15 bp, Homo sapiens
ccttcaggctatgtg

SEQ ID NO: 218509 - DNA, 15 bp, Homo sapiens
accttcaggctatgt

SEQ ID NO: 218510 - DNA, 15 bp, Homo sapiens
taccttcaggctatg

SEQ ID NO: 218511 - DNA, 15 bp, Homo sapiens
ttaccttcaggctat

SEQ ID NO: 218512 - DNA, 15 bp, Homo sapiens
attaccttcaggcta

SEQ ID NO: 218513 - DNA, 15 bp, Homo sapiens
aattaccttcaggct

SEQ ID NO: 218514 - DNA, 15 bp, Homo sapiens
aaattaccttcaggc

SEQ ID NO: 218515 - DNA, 15 bp, Homo sapiens
aaaattaccttcagg

SEQ ID NO: 218516 - DNA, 15 bp, Homo sapiens
taaaattaccttcag

SEQ ID NO: 218517 - DNA, 15 bp, Homo sapiens
ataaaattaccttca

SEQ ID NO: 218518 - DNA, 15 bp, Homo sapiens
tataaaattaccttc

SEQ ID NO: 218519 - DNA, 15 bp, Homo sapiens
gtataaaattacctt

SEQ ID NO: 218520 - DNA, 15 bp, Homo sapiens
tgtataaaattacct

SEQ ID NO: 218521 - DNA, 15 bp, Homo sapiens
ttgtataaaattacc

SEQ ID NO: 218522 - DNA, 15 bp, Homo sapiens
attgtataaaattac

SEQ ID NO: 218523 - DNA, 15 bp, Homo sapiens
tattgtataaaatta

SEQ ID NO: 218524 - DNA, 15 bp, Homo sapiens
gtattgtataaaatt

SEQ ID NO: 218525 - DNA, 15 bp, Homo sapiens
agtattgtataaaat

SEQ ID NO: 218526 - DNA, 15 bp, Homo sapiens
aagtattgtataaaa

SEQ ID NO: 218527 - DNA, 15 bp, Homo sapiens
taagtattgtataaa

SEQ ID NO: 218528 - DNA, 15 bp, Homo sapiens
ttaagtattgtataa

SEQ ID NO: 218529 - DNA, 15 bp, Homo sapiens
tttaagtattgtata

SEQ ID NO: 218530 - DNA, 15 bp, Homo sapiens
atttaagtattgtat

SEQ ID NO: 218531 - DNA, 15 bp, Homo sapiens
tatttaagtattgta

SEQ ID NO: 218532 - DNA, 15 bp, Homo sapiens
ttatttaagtattgt

SEQ ID NO: 218533 - DNA, 15 bp, Homo sapiens
attatttaagtattg

SEQ ID NO: 218534 - DNA, 15 bp, Homo sapiens
aattatttaagtatt

SEQ ID NO: 218535 - DNA, 15 bp, Homo sapiens
aaattatttaagtat

SEQ ID NO: 218536 - DNA, 15 bp, Homo sapiens
gaaattatttaagta

SEQ ID NO: 218537 - DNA, 15 bp, Homo sapiens
tgaaattatttaagt

SEQ ID NO: 218538 - DNA, 15 bp, Homo sapiens
atgaaattatttaag

SEQ ID NO: 218539 - DNA, 15 bp, Homo sapiens
catgaaattatttaa

SEQ ID NO: 218540 - DNA, 15 bp, Homo sapiens
gcatgaaattattta

SEQ ID NO: 218541 - DNA, 15 bp, Homo sapiens
tgcatgaaattattt

SEQ ID NO: 218542 - DNA, 15 bp, Homo sapiens
gtgcatgaaattatt

SEQ ID NO: 218543 - DNA, 15 bp, Homo sapiens
agtgcatgaaattat

SEQ ID NO: 218544 - DNA, 15 bp, Homo sapiens
tagtgcatgaaatta

SEQ ID NO: 218545 - DNA, 15 bp, Homo sapiens
ttagtgcatgaaatt

SEQ ID NO: 218546 - DNA, 15 bp, Homo sapiens
tttagtgcatgaaat

SEQ ID NO: 218547 - DNA, 15 bp, Homo sapiens
ctttagtgcatgaaa

SEQ ID NO: 218548 - DNA, 15 bp, Homo sapiens
actttagtgcatgaa

SEQ ID NO: 218549 - DNA, 15 bp, Homo sapiens
aactttagtgcatga

SEQ ID NO: 218550 - DNA, 15 bp, Homo sapiens
aaactttagtgcatg

SEQ ID NO: 218551 - DNA, 15 bp, Homo sapiens
caaactttagtgcat

SEQ ID NO: 218552 - DNA, 15 bp, Homo sapiens
acaaactttagtgca

SEQ ID NO: 218553 - DNA, 15 bp, Homo sapiens
tacaaactttagtgc

SEQ ID NO: 218554 - DNA, 15 bp, Homo sapiens
atacaaactttagtg

SEQ ID NO: 218555 - DNA, 15 bp, Homo sapiens
tatacaaactttagt

SEQ ID NO: 218556 - DNA, 15 bp, Homo sapiens
gtatacaaactttag

SEQ ID NO: 218557 - DNA, 15 bp, Homo sapiens
tgtatacaaacttta

SEQ ID NO: 218558 - DNA, 15 bp, Homo sapiens
atgtatacaaacttt

SEQ ID NO: 218559 - DNA, 15 bp, Homo sapiens
aatgtatacaaactt

SEQ ID NO: 218560 - DNA, 15 bp, Homo sapiens
aaatgtatacaaact

SEQ ID NO: 218561 - DNA, 15 bp, Homo sapiens
caaatgtatacaaac

SEQ ID NO: 218562 - DNA, 15 bp, Homo sapiens
tcaaatgtatacaaa

SEQ ID NO: 218563 - DNA, 15 bp, Homo sapiens
ttcaaatgtatacaa

SEQ ID NO: 218564 - DNA, 15 bp, Homo sapiens
gttcaaatgtataca

SEQ ID NO: 218565 - DNA, 15 bp, Homo sapiens
ggttcaaatgtatac

SEQ ID NO: 218566 - DNA, 15 bp, Homo sapiens
tggttcaaatgtata

SEQ ID NO: 218567 - DNA, 15 bp, Homo sapiens
atggttcaaatgtat

SEQ ID NO: 218568 - DNA, 15 bp, Homo sapiens
gatggttcaaatgta

SEQ ID NO: 218569 - DNA, 15 bp, Homo sapiens
tgatggttcaaatgt

SEQ ID NO: 218570 - DNA, 15 bp, Homo sapiens
ctgatggttcaaatg

SEQ ID NO: 218571 - DNA, 15 bp, Homo sapiens
tctgatggttcaaat

SEQ ID NO: 218572 - DNA, 15 bp, Homo sapiens
ttctgatggttcaaa

SEQ ID NO: 218573 - DNA, 15 bp, Homo sapiens
tttctgatggttcaa

SEQ ID NO: 218574 - DNA, 15 bp, Homo sapiens
ctttctgatggttca

SEQ ID NO: 218575 - DNA, 15 bp, Homo sapiens
gctttctgatggttc

SEQ ID NO: 218576 - DNA, 15 bp, Homo sapiens
tgctttctgatggtt

SEQ ID NO: 218577 - DNA, 15 bp, Homo sapiens
ttgctttctgatggt

SEQ ID NO: 218578 - DNA, 15 bp, Homo sapiens
cttgctttctgatgg

SEQ ID NO: 218579 - DNA, 15 bp, Homo sapiens
tcttgctttctgatg

SEQ ID NO: 218580 - DNA, 15 bp, Homo sapiens
ctcttgctttctgat

SEQ ID NO: 218581 - DNA, 15 bp, Homo sapiens
actcttgctttctga

SEQ ID NO: 218582 - DNA, 15 bp, Homo sapiens
tactcttgctttctg

SEQ ID NO: 218583 - DNA, 15 bp, Homo sapiens
atactcttgctttct

SEQ ID NO: 218584 - DNA, 15 bp, Homo sapiens
gatactcttgctttc

SEQ ID NO: 218585 - DNA, 15 bp, Homo sapiens
tgatactcttgcttt

SEQ ID NO: 218586 - DNA, 15 bp, Homo sapiens
ctgatactcttgctt

SEQ ID NO: 218587 - DNA, 15 bp, Homo sapiens
cctgatactcttgct

SEQ ID NO: 218588 - DNA, 15 bp, Homo sapiens
acctgatactcttgc

SEQ ID NO: 218589 - DNA, 15 bp, Homo sapiens
cacctgatactcttg

SEQ ID NO: 218590 - DNA, 15 bp, Homo sapiens
acacctgatactctt

SEQ ID NO: 218591 - DNA, 15 bp, Homo sapiens
cacacctgatactct

SEQ ID NO: 218592 - DNA, 15 bp, Homo sapiens
ccacacctgatactc

SEQ ID NO: 218593 - DNA, 15 bp, Homo sapiens
tccacacctgatact

SEQ ID NO: 218594 - DNA, 15 bp, Homo sapiens
ttccacacctgatac

SEQ ID NO: 218595 - DNA, 15 bp, Homo sapiens
attccacacctgata

SEQ ID NO: 218596 - DNA, 15 bp, Homo sapiens
gattccacacctgat

SEQ ID NO: 218597 - DNA, 15 bp, Homo sapiens
tgattccacacctga

SEQ ID NO: 218598 - DNA, 15 bp, Homo sapiens
atgattccacacctg

SEQ ID NO: 218599 - DNA, 15 bp, Homo sapiens
aatgattccacacct

SEQ ID NO: 218600 - DNA, 15 bp, Homo sapiens
aaatgattccacacc

SEQ ID NO: 218601 - DNA, 15 bp, Homo sapiens
gaaatgattccacac

SEQ ID NO: 218602 - DNA, 15 bp, Homo sapiens
tgaaatgattccaca

SEQ ID NO: 218603 - DNA, 15 bp, Homo sapiens
ctgaaatgattccac

SEQ ID NO: 218604 - DNA, 15 bp, Homo sapiens
gctgaaatgattcca

SEQ ID NO: 218605 - DNA, 15 bp, Homo sapiens
tgctgaaatgattcc

SEQ ID NO: 218606 - DNA, 15 bp, Homo sapiens
gtgctgaaatgattc

SEQ ID NO: 218607 - DNA, 15 bp, Homo sapiens
agtgctgaaatgatt

SEQ ID NO: 218608 - DNA, 15 bp, Homo sapiens
gagtgctgaaatgat

SEQ ID NO: 218609 - DNA, 15 bp, Homo sapiens
tgagtgctgaaatga

SEQ ID NO: 218610 - DNA, 15 bp, Homo sapiens
ttgagtgctgaaatg

SEQ ID NO: 218611 - DNA, 15 bp, Homo sapiens
cttgagtgctgaaat

SEQ ID NO: 218612 - DNA, 15 bp, Homo sapiens
acttgagtgctgaaa

SEQ ID NO: 218613 - DNA, 15 bp, Homo sapiens
aacttgagtgctgaa

SEQ ID NO: 218614 - DNA, 15 bp, Homo sapiens
aaacttgagtgctga

SEQ ID NO: 218615 - DNA, 15 bp, Homo sapiens
gaaacttgagtgctg

SEQ ID NO: 218616 - DNA, 15 bp, Homo sapiens
tgaaacttgagtgct

SEQ ID NO: 218617 - DNA, 15 bp, Homo sapiens
ctgaaacttgagtgc

SEQ ID NO: 218618 - DNA, 15 bp, Homo sapiens
tctgaaacttgagtg

SEQ ID NO: 218619 - DNA, 15 bp, Homo sapiens
atctgaaacttgagt

SEQ ID NO: 218620 - DNA, 15 bp, Homo sapiens
aatctgaaacttgag

SEQ ID NO: 218621 - DNA, 15 bp, Homo sapiens
aaatctgaaacttga

SEQ ID NO: 218622 - DNA, 15 bp, Homo sapiens
aaaatctgaaacttg

SEQ ID NO: 218623 - DNA, 15 bp, Homo sapiens
caaaatctgaaactt

SEQ ID NO: 218624 - DNA, 15 bp, Homo sapiens
ccaaaatctgaaact

SEQ ID NO: 218625 - DNA, 15 bp, Homo sapiens
tccaaaatctgaaac

SEQ ID NO: 218626 - DNA, 15 bp, Homo sapiens
ctccaaaatctgaaa

SEQ ID NO: 218627 - DNA, 15 bp, Homo sapiens
gctccaaaatctgaa

SEQ ID NO: 218628 - DNA, 15 bp, Homo sapiens
tgctccaaaatctga

SEQ ID NO: 218629 - DNA, 15 bp, Homo sapiens
atgctccaaaatctg

SEQ ID NO: 218630 - DNA, 15 bp, Homo sapiens
aatgctccaaaatct

SEQ ID NO: 218631 - DNA, 15 bp, Homo sapiens
aaatgctccaaaatc

SEQ ID NO: 218632 - DNA, 15 bp, Homo sapiens
gaaatgctccaaaat

SEQ ID NO: 218633 - DNA, 15 bp, Homo sapiens
tgaaatgctccaaaa

SEQ ID NO: 218634 - DNA, 15 bp, Homo sapiens
ctgaaatgctccaaa

SEQ ID NO: 218635 - DNA, 15 bp, Homo sapiens
tctgaaatgctccaa

SEQ ID NO: 218636 - DNA, 15 bp, Homo sapiens
atctgaaatgctcca

SEQ ID NO: 218637 - DNA, 15 bp, Homo sapiens
aatctgaaatgctcc

SEQ ID NO: 218638 - DNA, 15 bp, Homo sapiens
aaatctgaaatgctc

SEQ ID NO: 218639 - DNA, 15 bp, Homo sapiens
caaatctgaaatgct

SEQ ID NO: 218640 - DNA, 15 bp, Homo sapiens
ccaaatctgaaatgc

SEQ ID NO: 218641 - DNA, 15 bp, Homo sapiens
cccaaatctgaaatg

SEQ ID NO: 218642 - DNA, 15 bp, Homo sapiens
tcccaaatctgaaat

SEQ ID NO: 218643 - DNA, 15 bp, Homo sapiens
atcccaaatctgaaa

SEQ ID NO: 218644 - DNA, 15 bp, Homo sapiens
aatcccaaatctgaa

SEQ ID NO: 218645 - DNA, 15 bp, Homo sapiens
aaatcccaaatctga

SEQ ID NO: 218646 - DNA, 15 bp, Homo sapiens
aaaatcccaaatctg

SEQ ID NO: 218647 - DNA, 15 bp, Homo sapiens
gaaaatcccaaatct

SEQ ID NO: 218648 - DNA, 15 bp, Homo sapiens
tgaaaatcccaaatc

SEQ ID NO: 218649 - DNA, 15 bp, Homo sapiens
ctgaaaatcccaaat

SEQ ID NO: 218650 - DNA, 15 bp, Homo sapiens
tctgaaaatcccaaa

SEQ ID NO: 218651 - DNA, 15 bp, Homo sapiens
atctgaaaatcccaa

SEQ ID NO: 218652 - DNA, 15 bp, Homo sapiens
aatctgaaaatccca

SEQ ID NO: 218653 - DNA, 15 bp, Homo sapiens
taatctgaaaatccc

SEQ ID NO: 218654 - DNA, 15 bp, Homo sapiens
ctaatctgaaaatcc

SEQ ID NO: 218655 - DNA, 15 bp, Homo sapiens
cctaatctgaaaatc

SEQ ID NO: 218656 - DNA, 15 bp, Homo sapiens
ccctaatctgaaaat

SEQ ID NO: 218657 - DNA, 15 bp, Homo sapiens
tccctaatctgaaaa

SEQ ID NO: 218658 - DNA, 15 bp, Homo sapiens
atccctaatctgaaa

SEQ ID NO: 218659 - DNA, 15 bp, Homo sapiens
catccctaatctgaa

SEQ ID NO: 218660 - DNA, 15 bp, Homo sapiens
gcatccctaatctga

SEQ ID NO: 218661 - DNA, 15 bp, Homo sapiens
agcatccctaatctg

SEQ ID NO: 218662 - DNA, 15 bp, Homo sapiens
gagcatccctaatct

SEQ ID NO: 218663 - DNA, 15 bp, Homo sapiens
tgagcatccctaatc

SEQ ID NO: 218664 - DNA, 15 bp, Homo sapiens
ttgagcatccctaat

SEQ ID NO: 218665 - DNA, 15 bp, Homo sapiens
gttgagcatccctaa

SEQ ID NO: 218666 - DNA, 15 bp, Homo sapiens
ggttgagcatcccta

SEQ ID NO: 218667 - DNA, 15 bp, Homo sapiens
aggttgagcatccct

SEQ ID NO: 218668 - DNA, 15 bp, Homo sapiens
caggttgagcatccc

SEQ ID NO: 218669 - DNA, 15 bp, Homo sapiens
acaggttgagcatcc

SEQ ID NO: 218670 - DNA, 15 bp, Homo sapiens
tacaggttgagcatc

SEQ ID NO: 218671 - DNA, 15 bp, Homo sapiens
ctacaggttgagcat

SEQ ID NO: 218672 - DNA, 15 bp, Homo sapiens
tctacaggttgagca

SEQ ID NO: 218673 - DNA, 15 bp, Homo sapiens
ttctacaggttgagc

SEQ ID NO: 218674 - DNA, 15 bp, Homo sapiens
attctacaggttgag

SEQ ID NO: 218675 - DNA, 15 bp, Homo sapiens
cattctacaggttga

SEQ ID NO: 218676 - DNA, 15 bp, Homo sapiens
gcattctacaggttg

SEQ ID NO: 218677 - DNA, 15 bp, Homo sapiens
tgcattctacaggtt

SEQ ID NO: 218678 - DNA, 15 bp, Homo sapiens
ttgcattctacaggt

SEQ ID NO: 218679 - DNA, 15 bp, Homo sapiens
tttgcattctacagg

SEQ ID NO: 218680 - DNA, 15 bp, Homo sapiens
ttttgcattctacag

SEQ ID NO: 218681 - DNA, 15 bp, Homo sapiens
attttgcattctaca

SEQ ID NO: 218682 - DNA, 15 bp, Homo sapiens
tattttgcattctac

SEQ ID NO: 218683 - DNA, 15 bp, Homo sapiens
gtattttgcattcta

SEQ ID NO: 218684 - DNA, 15 bp, Homo sapiens
tgtattttgcattct

SEQ ID NO: 218685 - DNA, 15 bp, Homo sapiens
atgtattttgcattc

SEQ ID NO: 218686 - DNA, 15 bp, Homo sapiens
tatgtattttgcatt

SEQ ID NO: 218687 - DNA, 15 bp, Homo sapiens
ttatgtattttgcat

SEQ ID NO: 218688 - DNA, 15 bp, Homo sapiens
cttatgtattttgca

SEQ ID NO: 218689 - DNA, 15 bp, Homo sapiens
gcttatgtattttgc

SEQ ID NO: 218690 - DNA, 15 bp, Homo sapiens
agcttatgtattttg

SEQ ID NO: 218691 - DNA, 15 bp, Homo sapiens
aagcttatgtatttt

SEQ ID NO: 218692 - DNA, 15 bp, Homo sapiens
aaagcttatgtattt

SEQ ID NO: 218693 - DNA, 15 bp, Homo sapiens
caaagcttatgtatt

SEQ ID NO: 218694 - DNA, 15 bp, Homo sapiens
acaaagcttatgtat

SEQ ID NO: 218695 - DNA, 15 bp, Homo sapiens
cacaaagcttatgta

SEQ ID NO: 218696 - DNA, 15 bp, Homo sapiens
tcacaaagcttatgt

SEQ ID NO: 218697 - DNA, 15 bp, Homo sapiens
gtcacaaagcttatg

SEQ ID NO: 218698 - DNA, 15 bp, Homo sapiens
tgtcacaaagcttat

SEQ ID NO: 218699 - DNA, 15 bp, Homo sapiens
ctgtcacaaagctta

SEQ ID NO: 218700 - DNA, 15 bp, Homo sapiens
cctgtcacaaagctt

SEQ ID NO: 218701 - DNA, 15 bp, Homo sapiens
acctgtcacaaagct

SEQ ID NO: 218702 - DNA, 15 bp, Homo sapiens
aacctgtcacaaagc

SEQ ID NO: 218703 - DNA, 15 bp, Homo sapiens
caacctgtcacaaag

SEQ ID NO: 218704 - DNA, 15 bp, Homo sapiens
acaacctgtcacaaa

SEQ ID NO: 218705 - DNA, 15 bp, Homo sapiens
gacaacctgtcacaa

SEQ ID NO: 218706 - DNA, 15 bp, Homo sapiens
tgacaacctgtcaca

SEQ ID NO: 218707 - DNA, 15 bp, Homo sapiens
atgacaacctgtcac

SEQ ID NO: 218708 - DNA, 15 bp, Homo sapiens
catgacaacctgtca

SEQ ID NO: 218709 - DNA, 15 bp, Homo sapiens
acatgacaacctgtc

SEQ ID NO: 218710 - DNA, 15 bp, Homo sapiens
tacatgacaacctgt

SEQ ID NO: 218711 - DNA, 15 bp, Homo sapiens
ttacatgacaacctg

SEQ ID NO: 218712 - DNA, 15 bp, Homo sapiens
cttacatgacaacct

SEQ ID NO: 218713 - DNA, 15 bp, Homo sapiens
tcttacatgacaacc

SEQ ID NO: 218714 - DNA, 15 bp, Homo sapiens
ctcttacatgacaac

SEQ ID NO: 218715 - DNA, 15 bp, Homo sapiens
gctcttacatgacaa

SEQ ID NO: 218716 - DNA, 15 bp, Homo sapiens
tgctcttacatgaca

SEQ ID NO: 218717 - DNA, 15 bp, Homo sapiens
gtgctcttacatgac

SEQ ID NO: 218718 - DNA, 15 bp, Homo sapiens
agtgctcttacatga

SEQ ID NO: 218719 - DNA, 15 bp, Homo sapiens
aagtgctcttacatg

SEQ ID NO: 218720 - DNA, 15 bp, Homo sapiens
aaagtgctcttacat

SEQ ID NO: 218721 - DNA, 15 bp, Homo sapiens
aaaagtgctcttaca

SEQ ID NO: 218722 - DNA, 15 bp, Homo sapiens
taaaagtgctcttac

SEQ ID NO: 218723 - DNA, 15 bp, Homo sapiens
ctaaaagtgctctta

SEQ ID NO: 218724 - DNA, 15 bp, Homo sapiens
gctaaaagtgctctt

SEQ ID NO: 218725 - DNA, 15 bp, Homo sapiens
agctaaaagtgctct

SEQ ID NO: 218726 - DNA, 15 bp, Homo sapiens
gagctaaaagtgctc

SEQ ID NO: 218727 - DNA, 15 bp, Homo sapiens
tgagctaaaagtgct

SEQ ID NO: 218728 - DNA, 15 bp, Homo sapiens
ttgagctaaaagtgc

SEQ ID NO: 218729 - DNA, 15 bp, Homo sapiens
attgagctaaaagtg

SEQ ID NO: 218730 - DNA, 15 bp, Homo sapiens
cattgagctaaaagt

SEQ ID NO: 218731 - DNA, 15 bp, Homo sapiens
ccattgagctaaaag

SEQ ID NO: 218732 - DNA, 15 bp, Homo sapiens
gccattgagctaaaa

SEQ ID NO: 218733 - DNA, 15 bp, Homo sapiens
ggccattgagctaaa

SEQ ID NO: 218734 - DNA, 15 bp, Homo sapiens
tggccattgagctaa

SEQ ID NO: 218735 - DNA, 15 bp, Homo sapiens
ttggccattgagcta

SEQ ID NO: 218736 - DNA, 15 bp, Homo sapiens
cttggccattgagct

SEQ ID NO: 218737 - DNA, 15 bp, Homo sapiens
gcttggccattgagc

SEQ ID NO: 218738 - DNA, 15 bp, Homo sapiens
ggcttggccattgag

SEQ ID NO: 218739 - DNA, 15 bp, Homo sapiens
aggcttggccattga

SEQ ID NO: 218740 - DNA, 15 bp, Homo sapiens
aaggcttggccattg

SEQ ID NO: 218741 - DNA, 15 bp, Homo sapiens
caaggcttggccatt

SEQ ID NO: 218742 - DNA, 15 bp, Homo sapiens
tcaaggcttggccat

SEQ ID NO: 218743 - DNA, 15 bp, Homo sapiens
ctcaaggcttggcca

SEQ ID NO: 218744 - DNA, 15 bp, Homo sapiens
gctcaaggcttggcc

SEQ ID NO: 218745 - DNA, 15 bp, Homo sapiens
ggctcaaggcttggc

SEQ ID NO: 218746 - DNA, 15 bp, Homo sapiens
tggctcaaggcttgg

SEQ ID NO: 218747 - DNA, 15 bp, Homo sapiens
ctggctcaaggcttg

SEQ ID NO: 218748 - DNA, 15 bp, Homo sapiens
gctggctcaaggctt

SEQ ID NO: 218749 - DNA, 15 bp, Homo sapiens
tgctggctcaaggct

SEQ ID NO: 218750 - DNA, 15 bp, Homo sapiens
ttgctggctcaaggc

SEQ ID NO: 218751 - DNA, 15 bp, Homo sapiens
cttgctggctcaagg

SEQ ID NO: 218752 - DNA, 15 bp, Homo sapiens
acttgctggctcaag

SEQ ID NO: 218753 - DNA, 15 bp, Homo sapiens
tacttgctggctcaa

SEQ ID NO: 218754 - DNA, 15 bp, Homo sapiens
ctacttgctggctca

SEQ ID NO: 218755 - DNA, 15 bp, Homo sapiens
gctacttgctggctc

SEQ ID NO: 218756 - DNA, 15 bp, Homo sapiens
ggctacttgctggct

SEQ ID NO: 218757 - DNA, 15 bp, Homo sapiens
tggctacttgctggc

SEQ ID NO: 218758 - DNA, 15 bp, Homo sapiens
ctggctacttgctgg

SEQ ID NO: 218759 - DNA, 15 bp, Homo sapiens
tctggctacttgctg

SEQ ID NO: 218760 - DNA, 15 bp, Homo sapiens
atctggctacttgct

SEQ ID NO: 218761 - DNA, 15 bp, Homo sapiens
tatctggctacttgc

SEQ ID NO: 218762 - DNA, 15 bp, Homo sapiens
atatctggctacttg

SEQ ID NO: 218763 - DNA, 15 bp, Homo sapiens
gatatctggctactt

SEQ ID NO: 218764 - DNA, 15 bp, Homo sapiens
agatatctggctact

SEQ ID NO: 218765 - DNA, 15 bp, Homo sapiens
cagatatctggctac

SEQ ID NO: 218766 - DNA, 15 bp, Homo sapiens
gcagatatctggcta

SEQ ID NO: 218767 - DNA, 15 bp, Homo sapiens
agcagatatctggct

SEQ ID NO: 218768 - DNA, 15 bp, Homo sapiens
cagcagatatctggc

SEQ ID NO: 218769 - DNA, 15 bp, Homo sapiens
gcagcagatatctgg

SEQ ID NO: 218770 - DNA, 15 bp, Homo sapiens
tgcagcagatatctg

SEQ ID NO: 218771 - DNA, 15 bp, Homo sapiens
atgcagcagatatct

SEQ ID NO: 218772 - DNA, 15 bp, Homo sapiens
tatgcagcagatatc

SEQ ID NO: 218773 - DNA, 15 bp, Homo sapiens
ctatgcagcagatat

SEQ ID NO: 218774 - DNA, 15 bp, Homo sapiens
tctatgcagcagata

SEQ ID NO: 218775 - DNA, 15 bp, Homo sapiens
ctctatgcagcagat

SEQ ID NO: 218776 - DNA, 15 bp, Homo sapiens
tctctatgcagcaga

SEQ ID NO: 218777 - DNA, 15 bp, Homo sapiens
ttctctatgcagcag

SEQ ID NO: 218778 - DNA, 15 bp, Homo sapiens
cttctctatgcagca

SEQ ID NO: 218779 - DNA, 15 bp, Homo sapiens
acttctctatgcagc

SEQ ID NO: 218780 - DNA, 15 bp, Homo sapiens
tacttctctatgcag

SEQ ID NO: 218781 - DNA, 15 bp, Homo sapiens
atacttctctatgca

SEQ ID NO: 218782 - DNA, 15 bp, Homo sapiens
catacttctctatgc

SEQ ID NO: 218783 - DNA, 15 bp, Homo sapiens
acatacttctctatg

SEQ ID NO: 218784 - DNA, 15 bp, Homo sapiens
cacatacttctctat

SEQ ID NO: 218785 - DNA, 15 bp, Homo sapiens
ccacatacttctcta

SEQ ID NO: 218786 - DNA, 15 bp, Homo sapiens
accacatacttctct

SEQ ID NO: 218787 - DNA, 15 bp, Homo sapiens
aaccacatacttctc

SEQ ID NO: 218788 - DNA, 15 bp, Homo sapiens
caaccacatacttct

SEQ ID NO: 218789 - DNA, 15 bp, Homo sapiens
gcaaccacatacttc

SEQ ID NO: 218790 - DNA, 15 bp, Homo sapiens
agcaaccacatactt

SEQ ID NO: 218791 - DNA, 15 bp, Homo sapiens
tagcaaccacatact

SEQ ID NO: 218792 - DNA, 15 bp, Homo sapiens
ctagcaaccacatac

SEQ ID NO: 218793 - DNA, 15 bp, Homo sapiens
cctagcaaccacata

SEQ ID NO: 218794 - DNA, 15 bp, Homo sapiens
acctagcaaccacat

SEQ ID NO: 218795 - DNA, 15 bp, Homo sapiens
cacctagcaaccaca

SEQ ID NO: 218796 - DNA, 15 bp, Homo sapiens
acacctagcaaccac

SEQ ID NO: 218797 - DNA, 15 bp, Homo sapiens
gacacctagcaacca

SEQ ID NO: 218798 - DNA, 15 bp, Homo sapiens
agacacctagcaacc

SEQ ID NO: 218799 - DNA, 15 bp, Homo sapiens
gagacacctagcaac

SEQ ID NO: 218800 - DNA, 15 bp, Homo sapiens
agagacacctagcaa

SEQ ID NO: 218801 - DNA, 15 bp, Homo sapiens
gagagacacctagca

SEQ ID NO: 218802 - DNA, 15 bp, Homo sapiens
ggagagacacctagc

SEQ ID NO: 218803 - DNA, 15 bp, Homo sapiens
gggagagacacctag

SEQ ID NO: 218804 - DNA, 15 bp, Homo sapiens
tgggagagacaccta

SEQ ID NO: 218805 - DNA, 15 bp, Homo sapiens
atgggagagacacct

SEQ ID NO: 218806 - DNA, 15 bp, Homo sapiens
gatgggagagacacc

SEQ ID NO: 218807 - DNA, 15 bp, Homo sapiens
tgatgggagagacac

SEQ ID NO: 218808 - DNA, 15 bp, Homo sapiens
ttgatgggagagaca

SEQ ID NO: 218809 - DNA, 15 bp, Homo sapiens
gttgatgggagagac

SEQ ID NO: 218810 - DNA, 15 bp, Homo sapiens
ggttgatgggagaga

SEQ ID NO: 218811 - DNA, 15 bp, Homo sapiens
tggttgatgggagag

SEQ ID NO: 218812 - DNA, 15 bp, Homo sapiens
gtggttgatgggaga

SEQ ID NO: 218813 - DNA, 15 bp, Homo sapiens
tgtggttgatgggag

SEQ ID NO: 218814 - DNA, 15 bp, Homo sapiens
ttgtggttgatggga

SEQ ID NO: 218815 - DNA, 15 bp, Homo sapiens
cttgtggttgatggg

SEQ ID NO: 218816 - DNA, 15 bp, Homo sapiens
ccttgtggttgatgg

SEQ ID NO: 218817 - DNA, 15 bp, Homo sapiens
tccttgtggttgatg

SEQ ID NO: 218818 - DNA, 15 bp, Homo sapiens
gtccttgtggttgat

SEQ ID NO: 218819 - DNA, 15 bp, Homo sapiens
agtccttgtggttga

SEQ ID NO: 218820 - DNA, 15 bp, Homo sapiens
gagtccttgtggttg

SEQ ID NO: 218821 - DNA, 15 bp, Homo sapiens
agagtccttgtggtt

SEQ ID NO: 218822 - DNA, 15 bp, Homo sapiens
aagagtccttgtggt

SEQ ID NO: 218823 - DNA, 15 bp, Homo sapiens
aaagagtccttgtgg

SEQ ID NO: 218824 - DNA, 15 bp, Homo sapiens
gaaagagtccttgtg

SEQ ID NO: 218825 - DNA, 15 bp, Homo sapiens
ggaaagagtccttgt

SEQ ID NO: 218826 - DNA, 15 bp, Homo sapiens
gggaaagagtccttg

SEQ ID NO: 218827 - DNA, 15 bp, Homo sapiens
agggaaagagtcctt

SEQ ID NO: 218828 - DNA, 15 bp, Homo sapiens
tagggaaagagtcct

SEQ ID NO: 218829 - DNA, 15 bp, Homo sapiens
ttagggaaagagtcc

SEQ ID NO: 218830 - DNA, 15 bp, Homo sapiens
gttagggaaagagtc

SEQ ID NO: 218831 - DNA, 15 bp, Homo sapiens
agttagggaaagagt

SEQ ID NO: 218832 - DNA, 15 bp, Homo sapiens
aagttagggaaagag

SEQ ID NO: 218833 - DNA, 15 bp, Homo sapiens
gaagttagggaaaga

SEQ ID NO: 218834 - DNA, 15 bp, Homo sapiens
ggaagttagggaaag

SEQ ID NO: 218835 - DNA, 15 bp, Homo sapiens
aggaagttagggaaa

SEQ ID NO: 218836 - DNA, 15 bp, Homo sapiens
aaggaagttagggaa

SEQ ID NO: 218837 - DNA, 15 bp, Homo sapiens
caaggaagttaggga

SEQ ID NO: 218838 - DNA, 15 bp, Homo sapiens
tcaaggaagttaggg

SEQ ID NO: 218839 - DNA, 15 bp, Homo sapiens
atcaaggaagttagg

SEQ ID NO: 218840 - DNA, 15 bp, Homo sapiens
tatcaaggaagttag

SEQ ID NO: 218841 - DNA, 15 bp, Homo sapiens
ctatcaaggaagtta

SEQ ID NO: 218842 - DNA, 15 bp, Homo sapiens
tctatcaaggaagtt

SEQ ID NO: 218843 - DNA, 15 bp, Homo sapiens
ttctatcaaggaagt

SEQ ID NO: 218844 - DNA, 15 bp, Homo sapiens
tttctatcaaggaag

SEQ ID NO: 218845 - DNA, 15 bp, Homo sapiens
ttttctatcaaggaa

SEQ ID NO: 218846 - DNA, 15 bp, Homo sapiens
gttttctatcaagga

SEQ ID NO: 218847 - DNA, 15 bp, Homo sapiens
tgttttctatcaagg

SEQ ID NO: 218848 - DNA, 15 bp, Homo sapiens
atgttttctatcaag

SEQ ID NO: 218849 - DNA, 15 bp, Homo sapiens
aatgttttctatcaa

SEQ ID NO: 218850 - DNA, 15 bp, Homo sapiens
aaatgttttctatca

SEQ ID NO: 218851 - DNA, 15 bp, Homo sapiens
aaaatgttttctatc

SEQ ID NO: 218852 - DNA, 15 bp, Homo sapiens
taaaatgttttctat

SEQ ID NO: 218853 - DNA, 15 bp, Homo sapiens
ttaaaatgttttcta

SEQ ID NO: 218854 - DNA, 15 bp, Homo sapiens
gttaaaatgttttct

SEQ ID NO: 218855 - DNA, 15 bp, Homo sapiens
tgttaaaatgttttc

SEQ ID NO: 218856 - DNA, 15 bp, Homo sapiens
ctgttaaaatgtttt

SEQ ID NO: 218857 - DNA, 15 bp, Homo sapiens
tctgttaaaatgttt

SEQ ID NO: 218858 - DNA, 15 bp, Homo sapiens
ttctgttaaaatgtt

SEQ ID NO: 218859 - DNA, 15 bp, Homo sapiens
cttctgttaaaatgt

SEQ ID NO: 218860 - DNA, 15 bp, Homo sapiens
gcttctgttaaaatg

SEQ ID NO: 218861 - DNA, 15 bp, Homo sapiens
tgcttctgttaaaat

SEQ ID NO: 218862 - DNA, 15 bp, Homo sapiens
ttgcttctgttaaaa

SEQ ID NO: 218863 - DNA, 15 bp, Homo sapiens
attgcttctgttaaa

SEQ ID NO: 218864 - DNA, 15 bp, Homo sapiens
gattgcttctgttaa

SEQ ID NO: 218865 - DNA, 15 bp, Homo sapiens
tgattgcttctgtta

SEQ ID NO: 218866 - DNA, 15 bp, Homo sapiens
gtgattgcttctgtt

SEQ ID NO: 218867 - DNA, 15 bp, Homo sapiens
ggtgattgcttctgt

SEQ ID NO: 218868 - DNA, 15 bp, Homo sapiens
gggtgattgcttctg

SEQ ID NO: 218869 - DNA, 15 bp, Homo sapiens
agggtgattgcttct

SEQ ID NO: 218870 - DNA, 15 bp, Homo sapiens
gagggtgattgcttc

SEQ ID NO: 218871 - DNA, 15 bp, Homo sapiens
tgagggtgattgctt

SEQ ID NO: 218872 - DNA, 15 bp, Homo sapiens
atgagggtgattgct

SEQ ID NO: 218873 - DNA, 15 bp, Homo sapiens
aatgagggtgattgc

SEQ ID NO: 218874 - DNA, 15 bp, Homo sapiens
gaatgagggtgattg

SEQ ID NO: 218875 - DNA, 15 bp, Homo sapiens
agaatgagggtgatt

SEQ ID NO: 218876 - DNA, 15 bp, Homo sapiens
aagaatgagggtgat

SEQ ID NO: 218877 - DNA, 15 bp, Homo sapiens
gaagaatgagggtga

SEQ ID NO: 218878 - DNA, 15 bp, Homo sapiens
tgaagaatgagggtg

SEQ ID NO: 218879 - DNA, 15 bp, Homo sapiens
gtgaagaatgagggt

SEQ ID NO: 218880 - DNA, 15 bp, Homo sapiens
agtgaagaatgaggg

SEQ ID NO: 218881 - DNA, 15 bp, Homo sapiens
gagtgaagaatgagg

SEQ ID NO: 218882 - DNA, 15 bp, Homo sapiens
tgagtgaagaatgag

SEQ ID NO: 218883 - DNA, 15 bp, Homo sapiens
gtgagtgaagaatga

SEQ ID NO: 218884 - DNA, 15 bp, Homo sapiens
agtgagtgaagaatg

SEQ ID NO: 218885 - DNA, 15 bp, Homo sapiens
gagtgagtgaagaat

SEQ ID NO: 218886 - DNA, 15 bp, Homo sapiens
tgagtgagtgaagaa

SEQ ID NO: 218887 - DNA, 15 bp, Homo sapiens
ctgagtgagtgaaga

SEQ ID NO: 218888 - DNA, 15 bp, Homo sapiens
gctgagtgagtgaag

SEQ ID NO: 218889 - DNA, 15 bp, Homo sapiens
agctgagtgagtgaa

SEQ ID NO: 218890 - DNA, 15 bp, Homo sapiens
gagctgagtgagtga

SEQ ID NO: 218891 - DNA, 15 bp, Homo sapiens
agagctgagtgagtg

SEQ ID NO: 218892 - DNA, 15 bp, Homo sapiens
cagagctgagtgagt

SEQ ID NO: 218893 - DNA, 15 bp, Homo sapiens
tcagagctgagtgag

SEQ ID NO: 218894 - DNA, 15 bp, Homo sapiens
ctcagagctgagtga

SEQ ID NO: 218895 - DNA, 15 bp, Homo sapiens
tctcagagctgagtg

SEQ ID NO: 218896 - DNA, 15 bp, Homo sapiens
ctctcagagctgagt

SEQ ID NO: 218897 - DNA, 15 bp, Homo sapiens
gctctcagagctgag

SEQ ID NO: 218898 - DNA, 15 bp, Homo sapiens
tgctctcagagctga

SEQ ID NO: 218899 - DNA, 15 bp, Homo sapiens
gtgctctcagagctg

SEQ ID NO: 218900 - DNA, 15 bp, Homo sapiens
ggtgctctcagagct

SEQ ID NO: 218901 - DNA, 15 bp, Homo sapiens
tggtgctctcagagc

SEQ ID NO: 218902 - DNA, 15 bp, Homo sapiens
ttggtgctctcagag

SEQ ID NO: 218903 - DNA, 15 bp, Homo sapiens
attggtgctctcaga

SEQ ID NO: 218904 - DNA, 15 bp, Homo sapiens
gattggtgctctcag

SEQ ID NO: 218905 - DNA, 15 bp, Homo sapiens
agattggtgctctca

SEQ ID NO: 218906 - DNA, 15 bp, Homo sapiens
gagattggtgctctc

SEQ ID NO: 218907 - DNA, 15 bp, Homo sapiens
agagattggtgctct

SEQ ID NO: 218908 - DNA, 15 bp, Homo sapiens
tagagattggtgctc

SEQ ID NO: 218909 - DNA, 15 bp, Homo sapiens
ttagagattggtgct

SEQ ID NO: 218910 - DNA, 15 bp, Homo sapiens
cttagagattggtgc

SEQ ID NO: 218911 - DNA, 15 bp, Homo sapiens
gcttagagattggtg

SEQ ID NO: 218912 - DNA, 15 bp, Homo sapiens
agcttagagattggt

SEQ ID NO: 218913 - DNA, 15 bp, Homo sapiens
tagcttagagattgg

SEQ ID NO: 218914 - DNA, 15 bp, Homo sapiens
ctagcttagagattg

SEQ ID NO: 218915 - DNA, 15 bp, Homo sapiens
cctagcttagagatt

SEQ ID NO: 218916 - DNA, 15 bp, Homo sapiens
gcctagcttagagat

SEQ ID NO: 218917 - DNA, 15 bp, Homo sapiens
tgcctagcttagaga

SEQ ID NO: 218918 - DNA, 15 bp, Homo sapiens
atgcctagcttagag

SEQ ID NO: 218919 - DNA, 15 bp, Homo sapiens
catgcctagcttaga

SEQ ID NO: 218920 - DNA, 15 bp, Homo sapiens
gcatgcctagcttag

SEQ ID NO: 218921 - DNA, 15 bp, Homo sapiens
tgcatgcctagctta

SEQ ID NO: 218922 - DNA, 15 bp, Homo sapiens
gtgcatgcctagctt

SEQ ID NO: 218923 - DNA, 15 bp, Homo sapiens
agtgcatgcctagct

SEQ ID NO: 218924 - DNA, 15 bp, Homo sapiens
aagtgcatgcctagc

SEQ ID NO: 218925 - DNA, 15 bp, Homo sapiens
caagtgcatgcctag

SEQ ID NO: 218926 - DNA, 15 bp, Homo sapiens
gcaagtgcatgccta

SEQ ID NO: 218927 - DNA, 15 bp, Homo sapiens
ggcaagtgcatgcct

SEQ ID NO: 218928 - DNA, 15 bp, Homo sapiens
aggcaagtgcatgcc

SEQ ID NO: 218929 - DNA, 15 bp, Homo sapiens
gaggcaagtgcatgc

SEQ ID NO: 218930 - DNA, 15 bp, Homo sapiens
tgaggcaagtgcatg

SEQ ID NO: 218931 - DNA, 15 bp, Homo sapiens
ctgaggcaagtgcat

SEQ ID NO: 218932 - DNA, 15 bp, Homo sapiens
tctgaggcaagtgca

SEQ ID NO: 218933 - DNA, 15 bp, Homo sapiens
ctctgaggcaagtgc

SEQ ID NO: 218934 - DNA, 15 bp, Homo sapiens
gctctgaggcaagtg

SEQ ID NO: 218935 - DNA, 15 bp, Homo sapiens
ggctctgaggcaagt

SEQ ID NO: 218936 - DNA, 15 bp, Homo sapiens
aggctctgaggcaag

SEQ ID NO: 218937 - DNA, 15 bp, Homo sapiens
aaggctctgaggcaa

SEQ ID NO: 218938 - DNA, 15 bp, Homo sapiens
aaaggctctgaggca

SEQ ID NO: 218939 - DNA, 15 bp, Homo sapiens
caaaggctctgaggc

SEQ ID NO: 218940 - DNA, 15 bp, Homo sapiens
gcaaaggctctgagg

SEQ ID NO: 218941 - DNA, 15 bp, Homo sapiens
tgcaaaggctctgag

SEQ ID NO: 218942 - DNA, 15 bp, Homo sapiens
gtgcaaaggctctga

SEQ ID NO: 218943 - DNA, 15 bp, Homo sapiens
agtgcaaaggctctg

SEQ ID NO: 218944 - DNA, 15 bp, Homo sapiens
aagtgcaaaggctct

SEQ ID NO: 218945 - DNA, 15 bp, Homo sapiens
aaagtgcaaaggctc

SEQ ID NO: 218946 - DNA, 15 bp, Homo sapiens
gaaagtgcaaaggct

SEQ ID NO: 218947 - DNA, 15 bp, Homo sapiens
ggaaagtgcaaaggc

SEQ ID NO: 218948 - DNA, 15 bp, Homo sapiens
tggaaagtgcaaagg

SEQ ID NO: 218949 - DNA, 15 bp, Homo sapiens
atggaaagtgcaaag

SEQ ID NO: 218950 - DNA, 15 bp, Homo sapiens
aatggaaagtgcaaa

SEQ ID NO: 218951 - DNA, 15 bp, Homo sapiens
aaatggaaagtgcaa

SEQ ID NO: 218952 - DNA, 15 bp, Homo sapiens
aaaatggaaagtgca

SEQ ID NO: 218953 - DNA, 15 bp, Homo sapiens
gaaaatggaaagtgc

SEQ ID NO: 218954 - DNA, 15 bp, Homo sapiens
agaaaatggaaagtg

SEQ ID NO: 218955 - DNA, 15 bp, Homo sapiens
gagaaaatggaaagt

SEQ ID NO: 218956 - DNA, 15 bp, Homo sapiens
agagaaaatggaaag

SEQ ID NO: 218957 - DNA, 15 bp, Homo sapiens
cagagaaaatggaaa

SEQ ID NO: 218958 - DNA, 15 bp, Homo sapiens
gcagagaaaatggaa

SEQ ID NO: 218959 - DNA, 15 bp, Homo sapiens
ggcagagaaaatgga

SEQ ID NO: 218960 - DNA, 15 bp, Homo sapiens
aggcagagaaaatgg

SEQ ID NO: 218961 - DNA, 15 bp, Homo sapiens
taggcagagaaaatg

SEQ ID NO: 218962 - DNA, 15 bp, Homo sapiens
ctaggcagagaaaat

SEQ ID NO: 218963 - DNA, 15 bp, Homo sapiens
tctaggcagagaaaa

SEQ ID NO: 218964 - DNA, 15 bp, Homo sapiens
atctaggcagagaaa

SEQ ID NO: 218965 - DNA, 15 bp, Homo sapiens
aatctaggcagagaa

SEQ ID NO: 218966 - DNA, 15 bp, Homo sapiens
caatctaggcagaga

SEQ ID NO: 218967 - DNA, 15 bp, Homo sapiens
gcaatctaggcagag

SEQ ID NO: 218968 - DNA, 15 bp, Homo sapiens
agcaatctaggcaga

SEQ ID NO: 218969 - DNA, 15 bp, Homo sapiens
gagcaatctaggcag

SEQ ID NO: 218970 - DNA, 15 bp, Homo sapiens
agagcaatctaggca

SEQ ID NO: 218971 - DNA, 15 bp, Homo sapiens
aagagcaatctaggc

SEQ ID NO: 218972 - DNA, 15 bp, Homo sapiens
aaagagcaatctagg

SEQ ID NO: 218973 - DNA, 15 bp, Homo sapiens
aaaagagcaatctag

SEQ ID NO: 218974 - DNA, 15 bp, Homo sapiens
caaaagagcaatcta

SEQ ID NO: 218975 - DNA, 15 bp, Homo sapiens
gcaaaagagcaatct

SEQ ID NO: 218976 - DNA, 15 bp, Homo sapiens
ggcaaaagagcaatc

SEQ ID NO: 218977 - DNA, 15 bp, Homo sapiens
tggcaaaagagcaat

SEQ ID NO: 218978 - DNA, 15 bp, Homo sapiens
ctggcaaaagagcaa

SEQ ID NO: 218979 - DNA, 15 bp, Homo sapiens
tctggcaaaagagca

SEQ ID NO: 218980 - DNA, 15 bp, Homo sapiens
atctggcaaaagagc

SEQ ID NO: 218981 - DNA, 15 bp, Homo sapiens
tatctggcaaaagag

SEQ ID NO: 218982 - DNA, 15 bp, Homo sapiens
atatctggcaaaaga

SEQ ID NO: 218983 - DNA, 15 bp, Homo sapiens
aatatctggcaaaag

SEQ ID NO: 218984 - DNA, 15 bp, Homo sapiens
gaatatctggcaaaa

SEQ ID NO: 218985 - DNA, 15 bp, Homo sapiens
agaatatctggcaaa

SEQ ID NO: 218986 - DNA, 15 bp, Homo sapiens
gagaatatctggcaa

SEQ ID NO: 218987 - DNA, 15 bp, Homo sapiens
tgagaatatctggca

SEQ ID NO: 218988 - DNA, 15 bp, Homo sapiens
atgagaatatctggc

SEQ ID NO: 218989 - DNA, 15 bp, Homo sapiens
catgagaatatctgg

SEQ ID NO: 218990 - DNA, 15 bp, Homo sapiens
gcatgagaatatctg

SEQ ID NO: 218991 - DNA, 15 bp, Homo sapiens
ggcatgagaatatct

SEQ ID NO: 218992 - DNA, 15 bp, Homo sapiens
aggcatgagaatatc

SEQ ID NO: 218993 - DNA, 15 bp, Homo sapiens
aaggcatgagaatat

SEQ ID NO: 218994 - DNA, 15 bp, Homo sapiens
caaggcatgagaata

SEQ ID NO: 218995 - DNA, 15 bp, Homo sapiens
gcaaggcatgagaat

SEQ ID NO: 218996 - DNA, 15 bp, Homo sapiens
agcaaggcatgagaa

SEQ ID NO: 218997 - DNA, 15 bp, Homo sapiens
gagcaaggcatgaga

SEQ ID NO: 218998 - DNA, 15 bp, Homo sapiens
ggagcaaggcatgag

SEQ ID NO: 218999 - DNA, 15 bp, Homo sapiens
gggagcaaggcatga

SEQ ID NO: 219000 - DNA, 15 bp, Homo sapiens
agggagcaaggcatg

SEQ ID NO: 219001 - DNA, 15 bp, Homo sapiens
gagggagcaaggcat

SEQ ID NO: 219002 - DNA, 15 bp, Homo sapiens
tgagggagcaaggca

SEQ ID NO: 219003 - DNA, 15 bp, Homo sapiens
gtgagggagcaaggc

SEQ ID NO: 219004 - DNA, 15 bp, Homo sapiens
agtgagggagcaagg

SEQ ID NO: 219005 - DNA, 15 bp, Homo sapiens
aagtgagggagcaag

SEQ ID NO: 219006 - DNA, 15 bp, Homo sapiens
gaagtgagggagcaa

SEQ ID NO: 219007 - DNA, 15 bp, Homo sapiens
ggaagtgagggagca

SEQ ID NO: 219008 - DNA, 15 bp, Homo sapiens
gggaagtgagggagc

SEQ ID NO: 219009 - DNA, 15 bp, Homo sapiens
agggaagtgagggag

SEQ ID NO: 219010 - DNA, 15 bp, Homo sapiens
gagggaagtgaggga

SEQ ID NO: 219011 - DNA, 15 bp, Homo sapiens
ggagggaagtgaggg

SEQ ID NO: 219012 - DNA, 15 bp, Homo sapiens
cggagggaagtgagg

SEQ ID NO: 219013 - DNA, 15 bp, Homo sapiens
ccggagggaagtgag

SEQ ID NO: 219014 - DNA, 15 bp, Homo sapiens
accggagggaagtga

SEQ ID NO: 219015 - DNA, 15 bp, Homo sapiens
aaccggagggaagtg

SEQ ID NO: 219016 - DNA, 15 bp, Homo sapiens
aaaccggagggaagt

SEQ ID NO: 219017 - DNA, 15 bp, Homo sapiens
aaaaccggagggaag

SEQ ID NO: 219018 - DNA, 15 bp, Homo sapiens
aaaaaccggagggaa

SEQ ID NO: 219019 - DNA, 15 bp, Homo sapiens
aaaaaaccggaggga

SEQ ID NO: 219020 - DNA, 15 bp, Homo sapiens
aaaaaaaccggaggg

SEQ ID NO: 219021 - DNA, 15 bp, Homo sapiens
aaaaaaaaccggagg

SEQ ID NO: 219022 - DNA, 15 bp, Homo sapiens
aaaaaaaaaccggag

SEQ ID NO: 219023 - DNA, 15 bp, Homo sapiens
aaaaaaaaaaccgga

SEQ ID NO: 219024 - DNA, 15 bp, Homo sapiens
aaaaaaaaaaaccgg

SEQ ID NO: 219025 - DNA, 15 bp, Homo sapiens
taaaaaaaaaaaccg

SEQ ID NO: 219026 - DNA, 15 bp, Homo sapiens
ttaaaaaaaaaaacc

SEQ ID NO: 219027 - DNA, 15 bp, Homo sapiens
tttaaaaaaaaaaac

SEQ ID NO: 219028 - DNA, 15 bp, Homo sapiens
atatttaaaaaaaaa

SEQ ID NO: 219029 - DNA, 15 bp, Homo sapiens
gatatttaaaaaaaa

SEQ ID NO: 219030 - DNA, 15 bp, Homo sapiens
cgatatttaaaaaaa

SEQ ID NO: 219031 - DNA, 15 bp, Homo sapiens
gcgatatttaaaaaa

SEQ ID NO: 219032 - DNA, 15 bp, Homo sapiens
agcgatatttaaaaa

SEQ ID NO: 219033 - DNA, 15 bp, Homo sapiens
cagcgatatttaaaa

SEQ ID NO: 219034 - DNA, 15 bp, Homo sapiens
acagcgatatttaaa

SEQ ID NO: 219035 - DNA, 15 bp, Homo sapiens
gacagcgatatttaa

SEQ ID NO: 219036 - DNA, 15 bp, Homo sapiens
agacagcgatattta

SEQ ID NO: 219037 - DNA, 15 bp, Homo sapiens
aagacagcgatattt

SEQ ID NO: 219038 - DNA, 15 bp, Homo sapiens
aaagacagcgatatt

SEQ ID NO: 219039 - DNA, 15 bp, Homo sapiens
gaaagacagcgatat

SEQ ID NO: 219040 - DNA, 15 bp, Homo sapiens
tgaaagacagcgata

SEQ ID NO: 219041 - DNA, 15 bp, Homo sapiens
ctgaaagacagcgat

SEQ ID NO: 219042 - DNA, 15 bp, Homo sapiens
tctgaaagacagcga

SEQ ID NO: 219043 - DNA, 15 bp, Homo sapiens
atctgaaagacagcg

SEQ ID NO: 219044 - DNA, 15 bp, Homo sapiens
catctgaaagacagc

SEQ ID NO: 219045 - DNA, 15 bp, Homo sapiens
gcatctgaaagacag

SEQ ID NO: 219046 - DNA, 15 bp, Homo sapiens
ggcatctgaaagaca

SEQ ID NO: 219047 - DNA, 15 bp, Homo sapiens
aggcatctgaaagac

SEQ ID NO: 219048 - DNA, 15 bp, Homo sapiens
aaggcatctgaaaga

SEQ ID NO: 219049 - DNA, 15 bp, Homo sapiens
gaaggcatctgaaag

SEQ ID NO: 219050 - DNA, 15 bp, Homo sapiens
ggaaggcatctgaaa

SEQ ID NO: 219051 - DNA, 15 bp, Homo sapiens
gggaaggcatctgaa

SEQ ID NO: 219052 - DNA, 15 bp, Homo sapiens
agggaaggcatctga

SEQ ID NO: 219053 - DNA, 15 bp, Homo sapiens
cagggaaggcatctg

SEQ ID NO: 219054 - DNA, 15 bp, Homo sapiens
tcagggaaggcatct

SEQ ID NO: 219055 - DNA, 15 bp, Homo sapiens
gtcagggaaggcatc

SEQ ID NO: 219056 - DNA, 15 bp, Homo sapiens
ggtcagggaaggcat

SEQ ID NO: 219057 - DNA, 15 bp, Homo sapiens
tggtcagggaaggca

SEQ ID NO: 219058 - DNA, 15 bp, Homo sapiens
aagtggtcagggaag

SEQ ID NO: 219059 - DNA, 15 bp, Homo sapiens
taagtggtcagggaa

SEQ ID NO: 219060 - DNA, 15 bp, Homo sapiens
gtaagtggtcaggga

SEQ ID NO: 219061 - DNA, 15 bp, Homo sapiens
tgtaagtggtcaggg

SEQ ID NO: 219062 - DNA, 15 bp, Homo sapiens
gtgtaagtggtcagg

SEQ ID NO: 219063 - DNA, 15 bp, Homo sapiens
tgtgtaagtggtcag

SEQ ID NO: 219064 - DNA, 15 bp, Homo sapiens
ttgtgtaagtggtca

SEQ ID NO: 219065 - DNA, 15 bp, Homo sapiens
tttgtgtaagtggtc

SEQ ID NO: 219066 - DNA, 15 bp, Homo sapiens
ttttgtgtaagtggt

SEQ ID NO: 219067 - DNA, 15 bp, Homo sapiens
attttgtgtaagtgg

SEQ ID NO: 219068 - DNA, 15 bp, Homo sapiens
tattttgtgtaagtg

SEQ ID NO: 219069 - DNA, 15 bp, Homo sapiens
atattttgtgtaagt

SEQ ID NO: 219070 - DNA, 15 bp, Homo sapiens
aatattttgtgtaag

SEQ ID NO: 219071 - DNA, 15 bp, Homo sapiens
taatattttgtgtaa

SEQ ID NO: 219072 - DNA, 15 bp, Homo sapiens
gtaatattttgtgta

SEQ ID NO: 219073 - DNA, 15 bp, Homo sapiens
ggtaatattttgtgt

SEQ ID NO: 219074 - DNA, 15 bp, Homo sapiens
tggtaatattttgtg

SEQ ID NO: 219075 - DNA, 15 bp, Homo sapiens
ttggtaatattttgt

SEQ ID NO: 219076 - DNA, 15 bp, Homo sapiens
gttggtaatattttg

SEQ ID NO: 219077 - DNA, 15 bp, Homo sapiens
ggttggtaatatttt

SEQ ID NO: 219078 - DNA, 15 bp, Homo sapiens
gggttggtaatattt

SEQ ID NO: 219079 - DNA, 15 bp, Homo sapiens
agggttggtaatatt

SEQ ID NO: 219080 - DNA, 15 bp, Homo sapiens
gagggttggtaatat

SEQ ID NO: 219081 - DNA, 15 bp, Homo sapiens
tgagggttggtaata

SEQ ID NO: 219082 - DNA, 15 bp, Homo sapiens
atgagggttggtaat

SEQ ID NO: 219083 - DNA, 15 bp, Homo sapiens
gatgagggttggtaa

SEQ ID NO: 219084 - DNA, 15 bp, Homo sapiens
agatgagggttggta

SEQ ID NO: 219085 - DNA, 15 bp, Homo sapiens
aagatgagggttggt

SEQ ID NO: 219086 - DNA, 15 bp, Homo sapiens
gaagatgagggttgg

SEQ ID NO: 219087 - DNA, 15 bp, Homo sapiens
tgaagatgagggttg

SEQ ID NO: 219088 - DNA, 15 bp, Homo sapiens
ttgaagatgagggtt

SEQ ID NO: 219089 - DNA, 15 bp, Homo sapiens
gttgaagatgagggt

SEQ ID NO: 219090 - DNA, 15 bp, Homo sapiens
ggttgaagatgaggg

SEQ ID NO: 219091 - DNA, 15 bp, Homo sapiens
gggttgaagatgagg

SEQ ID NO: 219092 - DNA, 15 bp, Homo sapiens
tgggttgaagatgag

SEQ ID NO: 219093 - DNA, 15 bp, Homo sapiens
gtgggttgaagatga

SEQ ID NO: 219094 - DNA, 15 bp, Homo sapiens
ggtgggttgaagatg

SEQ ID NO: 219095 - DNA, 15 bp, Homo sapiens
tggtgggttgaagat

SEQ ID NO: 219096 - DNA, 15 bp, Homo sapiens
atggtgggttgaaga

SEQ ID NO: 219097 - DNA, 15 bp, Homo sapiens
gatggtgggttgaag

SEQ ID NO: 219098 - DNA, 15 bp, Homo sapiens
ggatggtgggttgaa

SEQ ID NO: 219099 - DNA, 15 bp, Homo sapiens
aggatggtgggttga

SEQ ID NO: 219100 - DNA, 15 bp, Homo sapiens
gaggatggtgggttg

SEQ ID NO: 219101 - DNA, 15 bp, Homo sapiens
agaggatggtgggtt

SEQ ID NO: 219102 - DNA, 15 bp, Homo sapiens
gagaggatggtgggt

SEQ ID NO: 219103 - DNA, 15 bp, Homo sapiens
ggagaggatggtggg

SEQ ID NO: 219104 - DNA, 15 bp, Homo sapiens
gggagaggatggtgg

SEQ ID NO: 219105 - DNA, 15 bp, Homo sapiens
tgggagaggatggtg

SEQ ID NO: 219106 - DNA, 15 bp, Homo sapiens
gtgggagaggatggt

SEQ ID NO: 219107 - DNA, 15 bp, Homo sapiens
agtgggagaggatgg

SEQ ID NO: 219108 - DNA, 15 bp, Homo sapiens
gagtgggagaggatg

SEQ ID NO: 219109 - DNA, 15 bp, Homo sapiens
tgagtgggagaggat

SEQ ID NO: 219110 - DNA, 15 bp, Homo sapiens
atgagtgggagagga

SEQ ID NO: 219111 - DNA, 15 bp, Homo sapiens
gatgagtgggagagg

SEQ ID NO: 219112 - DNA, 15 bp, Homo sapiens
ggatgagtgggagag

SEQ ID NO: 219113 - DNA, 15 bp, Homo sapiens
aggatgagtgggaga

SEQ ID NO: 219114 - DNA, 15 bp, Homo sapiens
caggatgagtgggag

SEQ ID NO: 219115 - DNA, 15 bp, Homo sapiens
acaggatgagtggga

SEQ ID NO: 219116 - DNA, 15 bp, Homo sapiens
cacaggatgagtggg

SEQ ID NO: 219117 - DNA, 15 bp, Homo sapiens
acacaggatgagtgg

SEQ ID NO: 219118 - DNA, 15 bp, Homo sapiens
cacacaggatgagtg

SEQ ID NO: 219119 - DNA, 15 bp, Homo sapiens
ccacacaggatgagt

SEQ ID NO: 219120 - DNA, 15 bp, Homo sapiens
accacacaggatgag

SEQ ID NO: 219121 - DNA, 15 bp, Homo sapiens
taccacacaggatga

SEQ ID NO: 219122 - DNA, 15 bp, Homo sapiens
ctaccacacaggatg

SEQ ID NO: 219123 - DNA, 15 bp, Homo sapiens
tctaccacacaggat

SEQ ID NO: 219124 - DNA, 15 bp, Homo sapiens
atctaccacacagga

SEQ ID NO: 219125 - DNA, 15 bp, Homo sapiens
aatctaccacacagg

SEQ ID NO: 219126 - DNA, 15 bp, Homo sapiens
aaatctaccacacag

SEQ ID NO: 219127 - DNA, 15 bp, Homo sapiens
aaaatctaccacaca

SEQ ID NO: 219128 - DNA, 15 bp, Homo sapiens
aaaaatctaccacac

SEQ ID NO: 219129 - DNA, 15 bp, Homo sapiens
taaaaatctaccaca

SEQ ID NO: 219130 - DNA, 15 bp, Homo sapiens
ataaaaatctaccac

SEQ ID NO: 219131 - DNA, 15 bp, Homo sapiens
tataaaaatctacca

SEQ ID NO: 219132 - DNA, 15 bp, Homo sapiens
ctataaaaatctacc

SEQ ID NO: 219133 - DNA, 15 bp, Homo sapiens
actataaaaatctac

SEQ ID NO: 219134 - DNA, 15 bp, Homo sapiens
tactataaaaatcta

SEQ ID NO: 219135 - DNA, 15 bp, Homo sapiens
ttactataaaaatct

SEQ ID NO: 219136 - DNA, 15 bp, Homo sapiens
attactataaaaatc

SEQ ID NO: 219137 - DNA, 15 bp, Homo sapiens
cattactataaaaat

SEQ ID NO: 219138 - DNA, 15 bp, Homo sapiens
tcattactataaaaa

SEQ ID NO: 219139 - DNA, 15 bp, Homo sapiens
ttcattactataaaa

SEQ ID NO: 219140 - DNA, 15 bp, Homo sapiens
attcattactataaa

SEQ ID NO: 219141 - DNA, 15 bp, Homo sapiens
gattcattactataa

SEQ ID NO: 219142 - DNA, 15 bp, Homo sapiens
tgattcattactata

SEQ ID NO: 219143 - DNA, 15 bp, Homo sapiens
atgattcattactat

SEQ ID NO: 219144 - DNA, 15 bp, Homo sapiens
catgattcattacta

SEQ ID NO: 219145 - DNA, 15 bp, Homo sapiens
gcatgattcattact

SEQ ID NO: 219146 - DNA, 15 bp, Homo sapiens
ggcatgattcattac

SEQ ID NO: 219147 - DNA, 15 bp, Homo sapiens
aggcatgattcatta

SEQ ID NO: 219148 - DNA, 15 bp, Homo sapiens
gaggcatgattcatt

SEQ ID NO: 219149 - DNA, 15 bp, Homo sapiens
ggaggcatgattcat

SEQ ID NO: 219150 - DNA, 15 bp, Homo sapiens
gggaggcatgattca

SEQ ID NO: 219151 - DNA, 15 bp, Homo sapiens
agggaggcatgattc

SEQ ID NO: 219152 - DNA, 15 bp, Homo sapiens
cagggaggcatgatt

SEQ ID NO: 219153 - DNA, 15 bp, Homo sapiens
acagggaggcatgat

SEQ ID NO: 219154 - DNA, 15 bp, Homo sapiens
cacagggaggcatga

SEQ ID NO: 219155 - DNA, 15 bp, Homo sapiens
acacagggaggcatg

SEQ ID NO: 219156 - DNA, 15 bp, Homo sapiens
gacacagggaggcat

SEQ ID NO: 219157 - DNA, 15 bp, Homo sapiens
ggacacagggaggca

SEQ ID NO: 219158 - DNA, 15 bp, Homo sapiens
tggacacagggaggc

SEQ ID NO: 219159 - DNA, 15 bp, Homo sapiens
gtggacacagggagg

SEQ ID NO: 219160 - DNA, 15 bp, Homo sapiens
tgtggacacagggag

SEQ ID NO: 219161 - DNA, 15 bp, Homo sapiens
gtgtggacacaggga

SEQ ID NO: 219162 - DNA, 15 bp, Homo sapiens
agtgtggacacaggg

SEQ ID NO: 219163 - DNA, 15 bp, Homo sapiens
gagtgtggacacagg

SEQ ID NO: 219164 - DNA, 15 bp, Homo sapiens
ggagtgtggacacag

SEQ ID NO: 219165 - DNA, 15 bp, Homo sapiens
aggagtgtggacaca

SEQ ID NO: 219166 - DNA, 15 bp, Homo sapiens
taggagtgtggacac

SEQ ID NO: 219167 - DNA, 15 bp, Homo sapiens
ataggagtgtggaca

SEQ ID NO: 219168 - DNA, 15 bp, Homo sapiens
cataggagtgtggac

SEQ ID NO: 219169 - DNA, 15 bp, Homo sapiens
gcataggagtgtgga

SEQ ID NO: 219170 - DNA, 15 bp, Homo sapiens
tgcataggagtgtgg

SEQ ID NO: 219171 - DNA, 15 bp, Homo sapiens
ctgcataggagtgtg

SEQ ID NO: 219172 - DNA, 15 bp, Homo sapiens
tctgcataggagtgt

SEQ ID NO: 219173 - DNA, 15 bp, Homo sapiens
ctctgcataggagtg

SEQ ID NO: 219174 - DNA, 15 bp, Homo sapiens
cctctgcataggagt

SEQ ID NO: 219175 - DNA, 15 bp, Homo sapiens
ccctctgcataggag

SEQ ID NO: 219176 - DNA, 15 bp, Homo sapiens
tccctctgcatagga

SEQ ID NO: 219177 - DNA, 15 bp, Homo sapiens
ttccctctgcatagg

SEQ ID NO: 219178 - DNA, 15 bp, Homo sapiens
tttccctctgcatag

SEQ ID NO: 219179 - DNA, 15 bp, Homo sapiens
atttccctctgcata

SEQ ID NO: 219180 - DNA, 15 bp, Homo sapiens
aatttccctctgcat

SEQ ID NO: 219181 - DNA, 15 bp, Homo sapiens
aaatttccctctgca

SEQ ID NO: 219182 - DNA, 15 bp, Homo sapiens
aaaatttccctctgc

SEQ ID NO: 219183 - DNA, 15 bp, Homo sapiens
aaaaatttccctctg

SEQ ID NO: 219184 - DNA, 15 bp, Homo sapiens
caaaaatttccctct

SEQ ID NO: 219185 - DNA, 15 bp, Homo sapiens
gcaaaaatttccctc

SEQ ID NO: 219186 - DNA, 15 bp, Homo sapiens
agcaaaaatttccct

SEQ ID NO: 219187 - DNA, 15 bp, Homo sapiens
gagcaaaaatttccc

SEQ ID NO: 219188 - DNA, 15 bp, Homo sapiens
agagcaaaaatttcc

SEQ ID NO: 219189 - DNA, 15 bp, Homo sapiens
aagagcaaaaatttc

SEQ ID NO: 219190 - DNA, 15 bp, Homo sapiens
aaagagcaaaaattt

SEQ ID NO: 219191 - DNA, 15 bp, Homo sapiens
aaaagagcaaaaatt

SEQ ID NO: 219192 - DNA, 15 bp, Homo sapiens
gaaaagagcaaaaat

SEQ ID NO: 219193 - DNA, 15 bp, Homo sapiens
tgaaaagagcaaaaa

SEQ ID NO: 219194 - DNA, 15 bp, Homo sapiens
atgaaaagagcaaaa

SEQ ID NO: 219195 - DNA, 15 bp, Homo sapiens
gatgaaaagagcaaa

SEQ ID NO: 219196 - DNA, 15 bp, Homo sapiens
tgatgaaaagagcaa

SEQ ID NO: 219197 - DNA, 15 bp, Homo sapiens
ttgatgaaaagagca

SEQ ID NO: 219198 - DNA, 15 bp, Homo sapiens
tttgatgaaaagagc

SEQ ID NO: 219199 - DNA, 15 bp, Homo sapiens
ttttgatgaaaagag

SEQ ID NO: 219200 - DNA, 15 bp, Homo sapiens
cttttgatgaaaaga

SEQ ID NO: 219201 - DNA, 15 bp, Homo sapiens
tcttttgatgaaaag

SEQ ID NO: 219202 - DNA, 15 bp, Homo sapiens
atcttttgatgaaaa

SEQ ID NO: 219203 - DNA, 15 bp, Homo sapiens
tatcttttgatgaaa

SEQ ID NO: 219204 - DNA, 15 bp, Homo sapiens
ttatcttttgatgaa

SEQ ID NO: 219205 - DNA, 15 bp, Homo sapiens
tttatcttttgatga

SEQ ID NO: 219206 - DNA, 15 bp, Homo sapiens
ctttatcttttgatg

SEQ ID NO: 219207 - DNA, 15 bp, Homo sapiens
actttatcttttgat

SEQ ID NO: 219208 - DNA, 15 bp, Homo sapiens
tactttatcttttga

SEQ ID NO: 219209 - DNA, 15 bp, Homo sapiens
gtactttatcttttg

SEQ ID NO: 219210 - DNA, 15 bp, Homo sapiens
tgtactttatctttt

SEQ ID NO: 219211 - DNA, 15 bp, Homo sapiens
atgtactttatcttt

SEQ ID NO: 219212 - DNA, 15 bp, Homo sapiens
aatgtactttatctt

SEQ ID NO: 219213 - DNA, 15 bp, Homo sapiens
aaatgtactttatct

SEQ ID NO: 219214 - DNA, 15 bp, Homo sapiens
aaaatgtactttatc

SEQ ID NO: 219215 - DNA, 15 bp, Homo sapiens
aaaaatgtactttat

SEQ ID NO: 219216 - DNA, 15 bp, Homo sapiens
gaaaaatgtacttta

SEQ ID NO: 219217 - DNA, 15 bp, Homo sapiens
ggaaaaatgtacttt

SEQ ID NO: 219218 - DNA, 15 bp, Homo sapiens
tggaaaaatgtactt

SEQ ID NO: 219219 - DNA, 15 bp, Homo sapiens
atggaaaaatgtact

SEQ ID NO: 219220 - DNA, 15 bp, Homo sapiens
aatggaaaaatgtac

SEQ ID NO: 219221 - DNA, 15 bp, Homo sapiens
gaatggaaaaatgta

SEQ ID NO: 219222 - DNA, 15 bp, Homo sapiens
agaatggaaaaatgt

SEQ ID NO: 219223 - DNA, 15 bp, Homo sapiens
gagaatggaaaaatg

SEQ ID NO: 219224 - DNA, 15 bp, Homo sapiens
agagaatggaaaaat

SEQ ID NO: 219225 - DNA, 15 bp, Homo sapiens
aagagaatggaaaaa

SEQ ID NO: 219226 - DNA, 15 bp, Homo sapiens
caagagaatggaaaa

SEQ ID NO: 219227 - DNA, 15 bp, Homo sapiens
tcaagagaatggaaa

SEQ ID NO: 219228 - DNA, 15 bp, Homo sapiens
ttcaagagaatggaa

SEQ ID NO: 219229 - DNA, 15 bp, Homo sapiens
attcaagagaatgga

SEQ ID NO: 219230 - DNA, 15 bp, Homo sapiens
gattcaagagaatgg

SEQ ID NO: 219231 - DNA, 15 bp, Homo sapiens
agattcaagagaatg

SEQ ID NO: 219232 - DNA, 15 bp, Homo sapiens
cagattcaagagaat

SEQ ID NO: 219233 - DNA, 15 bp, Homo sapiens
acagattcaagagaa

SEQ ID NO: 219234 - DNA, 15 bp, Homo sapiens
aacagattcaagaga

SEQ ID NO: 219235 - DNA, 15 bp, Homo sapiens
gaacagattcaagag

SEQ ID NO: 219236 - DNA, 15 bp, Homo sapiens
agaacagattcaaga

SEQ ID NO: 219237 - DNA, 15 bp, Homo sapiens
cagaacagattcaag

SEQ ID NO: 219238 - DNA, 15 bp, Homo sapiens
ccagaacagattcaa

SEQ ID NO: 219239 - DNA, 15 bp, Homo sapiens
gccagaacagattca

SEQ ID NO: 219240 - DNA, 15 bp, Homo sapiens
agccagaacagattc

SEQ ID NO: 219241 - DNA, 15 bp, Homo sapiens
aagccagaacagatt

SEQ ID NO: 219242 - DNA, 15 bp, Homo sapiens
gaagccagaacagat

SEQ ID NO: 219243 - DNA, 15 bp, Homo sapiens
tgaagccagaacaga

SEQ ID NO: 219244 - DNA, 15 bp, Homo sapiens
atgaagccagaacag

SEQ ID NO: 219245 - DNA, 15 bp, Homo sapiens
catgaagccagaaca

SEQ ID NO: 219246 - DNA, 15 bp, Homo sapiens
tcatgaagccagaac

SEQ ID NO: 219247 - DNA, 15 bp, Homo sapiens
gtcatgaagccagaa

SEQ ID NO: 219248 - DNA, 15 bp, Homo sapiens
tgtcatgaagccaga

SEQ ID NO: 219249 - DNA, 15 bp, Homo sapiens
atgtcatgaagccag

SEQ ID NO: 219250 - DNA, 15 bp, Homo sapiens
catgtcatgaagcca

SEQ ID NO: 219251 - DNA, 15 bp, Homo sapiens
gcatgtcatgaagcc

SEQ ID NO: 219252 - DNA, 15 bp, Homo sapiens
agcatgtcatgaagc

SEQ ID NO: 219253 - DNA, 15 bp, Homo sapiens
aagcatgtcatgaag

SEQ ID NO: 219254 - DNA, 15 bp, Homo sapiens
gaagcatgtcatgaa

SEQ ID NO: 219255 - DNA, 15 bp, Homo sapiens
tgaagcatgtcatga

SEQ ID NO: 219256 - DNA, 15 bp, Homo sapiens
ttgaagcatgtcatg

SEQ ID NO: 219257 - DNA, 15 bp, Homo sapiens
tttgaagcatgtcat

SEQ ID NO: 219258 - DNA, 15 bp, Homo sapiens
gtttgaagcatgtca

SEQ ID NO: 219259 - DNA, 15 bp, Homo sapiens
tgtttgaagcatgtc

SEQ ID NO: 219260 - DNA, 15 bp, Homo sapiens
ttgtttgaagcatgt

SEQ ID NO: 219261 - DNA, 15 bp, Homo sapiens
attgtttgaagcatg

SEQ ID NO: 219262 - DNA, 15 bp, Homo sapiens
tattgtttgaagcat

SEQ ID NO: 219263 - DNA, 15 bp, Homo sapiens
ctattgtttgaagca

SEQ ID NO: 219264 - DNA, 15 bp, Homo sapiens
tctattgtttgaagc

SEQ ID NO: 219265 - DNA, 15 bp, Homo sapiens
gtctattgtttgaag

SEQ ID NO: 219266 - DNA, 15 bp, Homo sapiens
agtctattgtttgaa

SEQ ID NO: 219267 - DNA, 15 bp, Homo sapiens
cagtctattgtttga

SEQ ID NO: 219268 - DNA, 15 bp, Homo sapiens
acagtctattgtttg

SEQ ID NO: 219269 - DNA, 15 bp, Homo sapiens
cacagtctattgttt

SEQ ID NO: 219270 - DNA, 15 bp, Homo sapiens
tcacagtctattgtt

SEQ ID NO: 219271 - DNA, 15 bp, Homo sapiens
gtcacagtctattgt

SEQ ID NO: 219272 - DNA, 15 bp, Homo sapiens
tgtcacagtctattg

SEQ ID NO: 219273 - DNA, 15 bp, Homo sapiens
gtgtcacagtctatt

SEQ ID NO: 219274 - DNA, 15 bp, Homo sapiens
ggtgtcacagtctat

SEQ ID NO: 219275 - DNA, 15 bp, Homo sapiens
cggtgtcacagtcta

SEQ ID NO: 219276 - DNA, 15 bp, Homo sapiens
acggtgtcacagtct

SEQ ID NO: 219277 - DNA, 15 bp, Homo sapiens
cacggtgtcacagtc

SEQ ID NO: 219278 - DNA, 15 bp, Homo sapiens
tcacggtgtcacagt

SEQ ID NO: 219279 - DNA, 15 bp, Homo sapiens
atcacggtgtcacag

SEQ ID NO: 219280 - DNA, 15 bp, Homo sapiens
catcacggtgtcaca

SEQ ID NO: 219281 - DNA, 15 bp, Homo sapiens
acatcacggtgtcac

SEQ ID NO: 219282 - DNA, 15 bp, Homo sapiens
cacatcacggtgtca

SEQ ID NO: 219283 - DNA, 15 bp, Homo sapiens
gcacatcacggtgtc

SEQ ID NO: 219284 - DNA, 15 bp, Homo sapiens
tgcacatcacggtgt

SEQ ID NO: 219285 - DNA, 15 bp, Homo sapiens
ttgcacatcacggtg

SEQ ID NO: 219286 - DNA, 15 bp, Homo sapiens
tttgcacatcacggt

SEQ ID NO: 219287 - DNA, 15 bp, Homo sapiens
gtttgcacatcacgg

SEQ ID NO: 219288 - DNA, 15 bp, Homo sapiens
agtttgcacatcacg

SEQ ID NO: 219289 - DNA, 15 bp, Homo sapiens
gagtttgcacatcac

SEQ ID NO: 219290 - DNA, 15 bp, Homo sapiens
agagtttgcacatca

SEQ ID NO: 219291 - DNA, 15 bp, Homo sapiens
tagagtttgcacatc

SEQ ID NO: 219292 - DNA, 15 bp, Homo sapiens
ctagagtttgcacat

SEQ ID NO: 219293 - DNA, 15 bp, Homo sapiens
tctagagtttgcaca

SEQ ID NO: 219294 - DNA, 15 bp, Homo sapiens
ctctagagtttgcac

SEQ ID NO: 219295 - DNA, 15 bp, Homo sapiens
gctctagagtttgca

SEQ ID NO: 219296 - DNA, 15 bp, Homo sapiens
agctctagagtttgc

SEQ ID NO: 219297 - DNA, 15 bp, Homo sapiens
aagctctagagtttg

SEQ ID NO: 219298 - DNA, 15 bp, Homo sapiens
aaagctctagagttt

SEQ ID NO: 219299 - DNA, 15 bp, Homo sapiens
caaagctctagagtt

SEQ ID NO: 219300 - DNA, 15 bp, Homo sapiens
gcaaagctctagagt

SEQ ID NO: 219301 - DNA, 15 bp, Homo sapiens
agcaaagctctagag

SEQ ID NO: 219302 - DNA, 15 bp, Homo sapiens
cagcaaagctctaga

SEQ ID NO: 219303 - DNA, 15 bp, Homo sapiens
acagcaaagctctag

SEQ ID NO: 219304 - DNA, 15 bp, Homo sapiens
cacagcaaagctcta

SEQ ID NO: 219305 - DNA, 15 bp, Homo sapiens
acacagcaaagctct

SEQ ID NO: 219306 - DNA, 15 bp, Homo sapiens
tacacagcaaagctc

SEQ ID NO: 219307 - DNA, 15 bp, Homo sapiens
ttacacagcaaagct

SEQ ID NO: 219308 - DNA, 15 bp, Homo sapiens
gttacacagcaaagc

SEQ ID NO: 219309 - DNA, 15 bp, Homo sapiens
tgttacacagcaaag

SEQ ID NO: 219310 - DNA, 15 bp, Homo sapiens
atgttacacagcaaa

SEQ ID NO: 219311 - DNA, 15 bp, Homo sapiens
tatgttacacagcaa

SEQ ID NO: 219312 - DNA, 15 bp, Homo sapiens
ctatgttacacagca

SEQ ID NO: 219313 - DNA, 15 bp, Homo sapiens
cctatgttacacagc

SEQ ID NO: 219314 - DNA, 15 bp, Homo sapiens
tcctatgttacacag

SEQ ID NO: 219315 - DNA, 15 bp, Homo sapiens
ttcctatgttacaca

SEQ ID NO: 219316 - DNA, 15 bp, Homo sapiens
gttcctatgttacac

SEQ ID NO: 219317 - DNA, 15 bp, Homo sapiens
ggttcctatgttaca

SEQ ID NO: 219318 - DNA, 15 bp, Homo sapiens
gggttcctatgttac

SEQ ID NO: 219319 - DNA, 15 bp, Homo sapiens
agggttcctatgtta

SEQ ID NO: 219320 - DNA, 15 bp, Homo sapiens
aagggttcctatgtt

SEQ ID NO: 219321 - DNA, 15 bp, Homo sapiens
taagggttcctatgt

SEQ ID NO: 219322 - DNA, 15 bp, Homo sapiens
ctaagggttcctatg

SEQ ID NO: 219323 - DNA, 15 bp, Homo sapiens
tctaagggttcctat

SEQ ID NO: 219324 - DNA, 15 bp, Homo sapiens
gtctaagggttccta

SEQ ID NO: 219325 - DNA, 15 bp, Homo sapiens
tgtctaagggttcct

SEQ ID NO: 219326 - DNA, 15 bp, Homo sapiens
atgtctaagggttcc

SEQ ID NO: 219327 - DNA, 15 bp, Homo sapiens
tatgtctaagggttc

SEQ ID NO: 219328 - DNA, 15 bp, Homo sapiens
atatgtctaagggtt

SEQ ID NO: 219329 - DNA, 15 bp, Homo sapiens
catatgtctaagggt

SEQ ID NO: 219330 - DNA, 15 bp, Homo sapiens
acatatgtctaaggg

SEQ ID NO: 219331 - DNA, 15 bp, Homo sapiens
tacatatgtctaagg

SEQ ID NO: 219332 - DNA, 15 bp, Homo sapiens
ttacatatgtctaag

SEQ ID NO: 219333 - DNA, 15 bp, Homo sapiens
gttacatatgtctaa

SEQ ID NO: 219334 - DNA, 15 bp, Homo sapiens
ggttacatatgtcta

SEQ ID NO: 219335 - DNA, 15 bp, Homo sapiens
tggttacatatgtct

SEQ ID NO: 219336 - DNA, 15 bp, Homo sapiens
atggttacatatgtc

SEQ ID NO: 219337 - DNA, 15 bp, Homo sapiens
aatggttacatatgt

SEQ ID NO: 219338 - DNA, 15 bp, Homo sapiens
aaatggttacatatg

SEQ ID NO: 219339 - DNA, 15 bp, Homo sapiens
caaatggttacatat

SEQ ID NO: 219340 - DNA, 15 bp, Homo sapiens
acaaatggttacata

SEQ ID NO: 219341 - DNA, 15 bp, Homo sapiens
tacaaatggttacat

SEQ ID NO: 219342 - DNA, 15 bp, Homo sapiens
atacaaatggttaca

SEQ ID NO: 219343 - DNA, 15 bp, Homo sapiens
aatacaaatggttac

SEQ ID NO: 219344 - DNA, 15 bp, Homo sapiens
aaatacaaatggtta

SEQ ID NO: 219345 - DNA, 15 bp, Homo sapiens
taaatacaaatggtt

SEQ ID NO: 219346 - DNA, 15 bp, Homo sapiens
ttaaatacaaatggt

SEQ ID NO: 219347 - DNA, 15 bp, Homo sapiens
tttaaatacaaatgg

SEQ ID NO: 219348 - DNA, 15 bp, Homo sapiens
atttaaatacaaatg

SEQ ID NO: 219349 - DNA, 15 bp, Homo sapiens
gatttaaatacaaat

SEQ ID NO: 219350 - DNA, 15 bp, Homo sapiens
tgatttaaatacaaa

SEQ ID NO: 219351 - DNA, 15 bp, Homo sapiens
gtgatttaaatacaa

SEQ ID NO: 219352 - DNA, 15 bp, Homo sapiens
tgtgatttaaataca

SEQ ID NO: 219353 - DNA, 15 bp, Homo sapiens
ttgtgatttaaatac

SEQ ID NO: 219354 - DNA, 15 bp, Homo sapiens
attgtgatttaaata

SEQ ID NO: 219355 - DNA, 15 bp, Homo sapiens
aattgtgatttaaat

SEQ ID NO: 219356 - DNA, 15 bp, Homo sapiens
taattgtgatttaaa

SEQ ID NO: 219357 - DNA, 15 bp, Homo sapiens
ctaattgtgatttaa

SEQ ID NO: 219358 - DNA, 15 bp, Homo sapiens
tctaattgtgattta

SEQ ID NO: 219359 - DNA, 15 bp, Homo sapiens
atctaattgtgattt

SEQ ID NO: 219360 - DNA, 15 bp, Homo sapiens
tatctaattgtgatt

SEQ ID NO: 219361 - DNA, 15 bp, Homo sapiens
ttatctaattgtgat

SEQ ID NO: 219362 - DNA, 15 bp, Homo sapiens
tttatctaattgtga

SEQ ID NO: 219363 - DNA, 15 bp, Homo sapiens
ttttatctaattgtg

SEQ ID NO: 219364 - DNA, 15 bp, Homo sapiens
attttatctaattgt

SEQ ID NO: 219365 - DNA, 15 bp, Homo sapiens
aattttatctaattg

SEQ ID NO: 219366 - DNA, 15 bp, Homo sapiens
aaattttatctaatt

SEQ ID NO: 219367 - DNA, 15 bp, Homo sapiens
taaattttatctaat

SEQ ID NO: 219368 - DNA, 15 bp, Homo sapiens
ttaaattttatctaa

SEQ ID NO: 219369 - DNA, 15 bp, Homo sapiens
tttaaattttatcta

SEQ ID NO: 219370 - DNA, 15 bp, Homo sapiens
ttttaaattttatct

SEQ ID NO: 219371 - DNA, 15 bp, Homo sapiens
attttaaattttatc

SEQ ID NO: 219372 - DNA, 15 bp, Homo sapiens
aattttaaattttat

SEQ ID NO: 219373 - DNA, 15 bp, Homo sapiens
aaattttaaatttta

SEQ ID NO: 219374 - DNA, 15 bp, Homo sapiens
taaattttaaatttt

SEQ ID NO: 219375 - DNA, 15 bp, Homo sapiens
ctaaattttaaattt

SEQ ID NO: 219376 - DNA, 15 bp, Homo sapiens
actaaattttaaatt

SEQ ID NO: 219377 - DNA, 15 bp, Homo sapiens
aactaaattttaaat

SEQ ID NO: 219378 - DNA, 15 bp, Homo sapiens
gaactaaattttaaa

SEQ ID NO: 219379 - DNA, 15 bp, Homo sapiens
ggaactaaattttaa

SEQ ID NO: 219380 - DNA, 15 bp, Homo sapiens
aggaactaaatttta

SEQ ID NO: 219381 - DNA, 15 bp, Homo sapiens
gaggaactaaatttt

SEQ ID NO: 219382 - DNA, 15 bp, Homo sapiens
tgaggaactaaattt

SEQ ID NO: 219383 - DNA, 15 bp, Homo sapiens
ctgaggaactaaatt

SEQ ID NO: 219384 - DNA, 15 bp, Homo sapiens
gctgaggaactaaat

SEQ ID NO: 219385 - DNA, 15 bp, Homo sapiens
agctgaggaactaaa

SEQ ID NO: 219386 - DNA, 15 bp, Homo sapiens
cagctgaggaactaa

SEQ ID NO: 219387 - DNA, 15 bp, Homo sapiens
acagctgaggaacta

SEQ ID NO: 219388 - DNA, 15 bp, Homo sapiens
tacagctgaggaact

SEQ ID NO: 219389 - DNA, 15 bp, Homo sapiens
gtacagctgaggaac

SEQ ID NO: 219390 - DNA, 15 bp, Homo sapiens
agtacagctgaggaa

SEQ ID NO: 219391 - DNA, 15 bp, Homo sapiens
tagtacagctgagga

SEQ ID NO: 219392 - DNA, 15 bp, Homo sapiens
ctagtacagctgagg

SEQ ID NO: 219393 - DNA, 15 bp, Homo sapiens
actagtacagctgag

SEQ ID NO: 219394 - DNA, 15 bp, Homo sapiens
gactagtacagctga

SEQ ID NO: 219395 - DNA, 15 bp, Homo sapiens
tgactagtacagctg

SEQ ID NO: 219396 - DNA, 15 bp, Homo sapiens
atgactagtacagct

SEQ ID NO: 219397 - DNA, 15 bp, Homo sapiens
tatgactagtacagc

SEQ ID NO: 219398 - DNA, 15 bp, Homo sapiens
atatgactagtacag

SEQ ID NO: 219399 - DNA, 15 bp, Homo sapiens
aatatgactagtaca

SEQ ID NO: 219400 - DNA, 15 bp, Homo sapiens
aaatatgactagtac

SEQ ID NO: 219401 - DNA, 15 bp, Homo sapiens
gaaatatgactagta

SEQ ID NO: 219402 - DNA, 15 bp, Homo sapiens
tgaaatatgactagt

SEQ ID NO: 219403 - DNA, 15 bp, Homo sapiens
ctgaaatatgactag

SEQ ID NO: 219404 - DNA, 15 bp, Homo sapiens
tctgaaatatgacta

SEQ ID NO: 219405 - DNA, 15 bp, Homo sapiens
atctgaaatatgact

SEQ ID NO: 219406 - DNA, 15 bp, Homo sapiens
tatctgaaatatgac

SEQ ID NO: 219407 - DNA, 15 bp, Homo sapiens
gtatctgaaatatga

SEQ ID NO: 219408 - DNA, 15 bp, Homo sapiens
agtatctgaaatatg

SEQ ID NO: 219409 - DNA, 15 bp, Homo sapiens
tagtatctgaaatat

SEQ ID NO: 219410 - DNA, 15 bp, Homo sapiens
ttagtatctgaaata

SEQ ID NO: 219411 - DNA, 15 bp, Homo sapiens
tttagtatctgaaat

SEQ ID NO: 219412 - DNA, 15 bp, Homo sapiens
atttagtatctgaaa

SEQ ID NO: 219413 - DNA, 15 bp, Homo sapiens
tatttagtatctgaa

SEQ ID NO: 219414 - DNA, 15 bp, Homo sapiens
ttatttagtatctga

SEQ ID NO: 219415 - DNA, 15 bp, Homo sapiens
tttatttagtatctg

SEQ ID NO: 219416 - DNA, 15 bp, Homo sapiens
gtttatttagtatct

SEQ ID NO: 219417 - DNA, 15 bp, Homo sapiens
tgtttatttagtatc

SEQ ID NO: 219418 - DNA, 15 bp, Homo sapiens
atgtttatttagtat

SEQ ID NO: 219419 - DNA, 15 bp, Homo sapiens
tatgtttatttagta

SEQ ID NO: 219420 - DNA, 15 bp, Homo sapiens
atatgtttatttagt

SEQ ID NO: 219421 - DNA, 15 bp, Homo sapiens
catatgtttatttag

SEQ ID NO: 219422 - DNA, 15 bp, Homo sapiens
acatatgtttattta

SEQ ID NO: 219423 - DNA, 15 bp, Homo sapiens
cacatatgtttattt

SEQ ID NO: 219424 - DNA, 15 bp, Homo sapiens
tcacatatgtttatt

SEQ ID NO: 219425 - DNA, 15 bp, Homo sapiens
gtcacatatgtttat

SEQ ID NO: 219426 - DNA, 15 bp, Homo sapiens
agtcacatatgttta

SEQ ID NO: 219427 - DNA, 15 bp, Homo sapiens
tagtcacatatgttt

SEQ ID NO: 219428 - DNA, 15 bp, Homo sapiens
ctagtcacatatgtt

SEQ ID NO: 219429 - DNA, 15 bp, Homo sapiens
gctagtcacatatgt

SEQ ID NO: 219430 - DNA, 15 bp, Homo sapiens
tgctagtcacatatg

SEQ ID NO: 219431 - DNA, 15 bp, Homo sapiens
ctgctagtcacatat

SEQ ID NO: 219432 - DNA, 15 bp, Homo sapiens
cctgctagtcacata

SEQ ID NO: 219433 - DNA, 15 bp, Homo sapiens
acctgctagtcacat

SEQ ID NO: 219434 - DNA, 15 bp, Homo sapiens
tacctgctagtcaca

SEQ ID NO: 219435 - DNA, 15 bp, Homo sapiens
gtacctgctagtcac

SEQ ID NO: 219436 - DNA, 15 bp, Homo sapiens
ggtacctgctagtca

SEQ ID NO: 219437 - DNA, 15 bp, Homo sapiens
tggtacctgctagtc

SEQ ID NO: 219438 - DNA, 15 bp, Homo sapiens
atggtacctgctagt

SEQ ID NO: 219439 - DNA, 15 bp, Homo sapiens
tatggtacctgctag

SEQ ID NO: 219440 - DNA, 15 bp, Homo sapiens
atatggtacctgcta

SEQ ID NO: 219441 - DNA, 15 bp, Homo sapiens
aatatggtacctgct

SEQ ID NO: 219442 - DNA, 15 bp, Homo sapiens
caatatggtacctgc

SEQ ID NO: 219443 - DNA, 15 bp, Homo sapiens
ccaatatggtacctg

SEQ ID NO: 219444 - DNA, 15 bp, Homo sapiens
tccaatatggtacct

SEQ ID NO: 219445 - DNA, 15 bp, Homo sapiens
ctccaatatggtacc

SEQ ID NO: 219446 - DNA, 15 bp, Homo sapiens
tctccaatatggtac

SEQ ID NO: 219447 - DNA, 15 bp, Homo sapiens
ctctccaatatggta

SEQ ID NO: 219448 - DNA, 15 bp, Homo sapiens
gctctccaatatggt

SEQ ID NO: 219449 - DNA, 15 bp, Homo sapiens
tgctctccaatatgg

SEQ ID NO: 219450 - DNA, 15 bp, Homo sapiens
ttgctctccaatatg

SEQ ID NO: 219451 - DNA, 15 bp, Homo sapiens
attgctctccaatat

SEQ ID NO: 219452 - DNA, 15 bp, Homo sapiens
aattgctctccaata

SEQ ID NO: 219453 - DNA, 15 bp, Homo sapiens
taattgctctccaat

SEQ ID NO: 219454 - DNA, 15 bp, Homo sapiens
ctaattgctctccaa

SEQ ID NO: 219455 - DNA, 15 bp, Homo sapiens
tctaattgctctcca

SEQ ID NO: 219456 - DNA, 15 bp, Homo sapiens
ctctaattgctctcc

SEQ ID NO: 219457 - DNA, 15 bp, Homo sapiens
tctctaattgctctc

SEQ ID NO: 219458 - DNA, 15 bp, Homo sapiens
gtctctaattgctct

SEQ ID NO: 219459 - DNA, 15 bp, Homo sapiens
cgtctctaattgctc

SEQ ID NO: 219460 - DNA, 15 bp, Homo sapiens
tcgtctctaattgct

SEQ ID NO: 219461 - DNA, 15 bp, Homo sapiens
gtcgtctctaattgc

SEQ ID NO: 219462 - DNA, 15 bp, Homo sapiens
tgtcgtctctaattg

SEQ ID NO: 219463 - DNA, 15 bp, Homo sapiens
atgtcgtctctaatt

SEQ ID NO: 219464 - DNA, 15 bp, Homo sapiens
tatgtcgtctctaat

SEQ ID NO: 219465 - DNA, 15 bp, Homo sapiens
ctatgtcgtctctaa

SEQ ID NO: 219466 - DNA, 15 bp, Homo sapiens
cctatgtcgtctcta

SEQ ID NO: 219467 - DNA, 15 bp, Homo sapiens
ccctatgtcgtctct

SEQ ID NO: 219468 - DNA, 15 bp, Homo sapiens
tccctatgtcgtctc

SEQ ID NO: 219469 - DNA, 15 bp, Homo sapiens
ctccctatgtcgtct

SEQ ID NO: 219470 - DNA, 15 bp, Homo sapiens
tctccctatgtcgtc

SEQ ID NO: 219471 - DNA, 15 bp, Homo sapiens
ttctccctatgtcgt

SEQ ID NO: 219472 - DNA, 15 bp, Homo sapiens
tttctccctatgtcg

SEQ ID NO: 219473 - DNA, 15 bp, Homo sapiens
gtttctccctatgtc

SEQ ID NO: 219474 - DNA, 15 bp, Homo sapiens
agtttctccctatgt

SEQ ID NO: 219475 - DNA, 15 bp, Homo sapiens
cagtttctccctatg

SEQ ID NO: 219476 - DNA, 15 bp, Homo sapiens
tcagtttctccctat

SEQ ID NO: 219477 - DNA, 15 bp, Homo sapiens
ctcagtttctcccta

SEQ ID NO: 219478 - DNA, 15 bp, Homo sapiens
cctcagtttctccct

SEQ ID NO: 219479 - DNA, 15 bp, Homo sapiens
acctcagtttctccc

SEQ ID NO: 219480 - DNA, 15 bp, Homo sapiens
tacctcagtttctcc

SEQ ID NO: 219481 - DNA, 15 bp, Homo sapiens
gtacctcagtttctc

SEQ ID NO: 219482 - DNA, 15 bp, Homo sapiens
ggtacctcagtttct

SEQ ID NO: 219483 - DNA, 15 bp, Homo sapiens
gggtacctcagtttc

SEQ ID NO: 219484 - DNA, 15 bp, Homo sapiens
ggggtacctcagttt

SEQ ID NO: 219485 - DNA, 15 bp, Homo sapiens
tggggtacctcagtt

SEQ ID NO: 219486 - DNA, 15 bp, Homo sapiens
ctggggtacctcagt

SEQ ID NO: 219487 - DNA, 15 bp, Homo sapiens
tctggggtacctcag

SEQ ID NO: 219488 - DNA, 15 bp, Homo sapiens
gtctggggtacctca

SEQ ID NO: 219489 - DNA, 15 bp, Homo sapiens
tgtctggggtacctc

SEQ ID NO: 219490 - DNA, 15 bp, Homo sapiens
ttgtctggggtacct

SEQ ID NO: 219491 - DNA, 15 bp, Homo sapiens
attgtctggggtacc

SEQ ID NO: 219492 - DNA, 15 bp, Homo sapiens
tattgtctggggtac

SEQ ID NO: 219493 - DNA, 15 bp, Homo sapiens
ctattgtctggggta

SEQ ID NO: 219494 - DNA, 15 bp, Homo sapiens
cctattgtctggggt

SEQ ID NO: 219495 - DNA, 15 bp, Homo sapiens
gcctattgtctgggg

SEQ ID NO: 219496 - DNA, 15 bp, Homo sapiens
tgcctattgtctggg

SEQ ID NO: 219497 - DNA, 15 bp, Homo sapiens
ctgcctattgtctgg

SEQ ID NO: 219498 - DNA, 15 bp, Homo sapiens
actgcctattgtctg

SEQ ID NO: 219499 - DNA, 15 bp, Homo sapiens
cactgcctattgtct

SEQ ID NO: 219500 - DNA, 15 bp, Homo sapiens
tcactgcctattgtc

SEQ ID NO: 219501 - DNA, 15 bp, Homo sapiens
atcactgcctattgt

SEQ ID NO: 219502 - DNA, 15 bp, Homo sapiens
catcactgcctattg

SEQ ID NO: 219503 - DNA, 15 bp, Homo sapiens
tcatcactgcctatt

SEQ ID NO: 219504 - DNA, 15 bp, Homo sapiens
atcatcactgcctat

SEQ ID NO: 219505 - DNA, 15 bp, Homo sapiens
aatcatcactgccta

SEQ ID NO: 219506 - DNA, 15 bp, Homo sapiens
aaatcatcactgcct

SEQ ID NO: 219507 - DNA, 15 bp, Homo sapiens
gaaatcatcactgcc

SEQ ID NO: 219508 - DNA, 15 bp, Homo sapiens
ggaaatcatcactgc

SEQ ID NO: 219509 - DNA, 15 bp, Homo sapiens
tggaaatcatcactg

SEQ ID NO: 219510 - DNA, 15 bp, Homo sapiens
ctggaaatcatcact

SEQ ID NO: 219511 - DNA, 15 bp, Homo sapiens
tctggaaatcatcac

SEQ ID NO: 219512 - DNA, 15 bp, Homo sapiens
gtctggaaatcatca

SEQ ID NO: 219513 - DNA, 15 bp, Homo sapiens
tgtctggaaatcatc

SEQ ID NO: 219514 - DNA, 15 bp, Homo sapiens
atgtctggaaatcat

SEQ ID NO: 219515 - DNA, 15 bp, Homo sapiens
catgtctggaaatca

SEQ ID NO: 219516 - DNA, 15 bp, Homo sapiens
acatgtctggaaatc

SEQ ID NO: 219517 - DNA, 15 bp, Homo sapiens
cacatgtctggaaat

SEQ ID NO: 219518 - DNA, 15 bp, Homo sapiens
tcacatgtctggaaa

SEQ ID NO: 219519 - DNA, 15 bp, Homo sapiens
ctcacatgtctggaa

SEQ ID NO: 219520 - DNA, 15 bp, Homo sapiens
actcacatgtctgga

SEQ ID NO: 219521 - DNA, 15 bp, Homo sapiens
cactcacatgtctgg

SEQ ID NO: 219522 - DNA, 15 bp, Homo sapiens
tcactcacatgtctg

SEQ ID NO: 219523 - DNA, 15 bp, Homo sapiens
ctcactcacatgtct

SEQ ID NO: 219524 - DNA, 15 bp, Homo sapiens
cctcactcacatgtc

SEQ ID NO: 219525 - DNA, 15 bp, Homo sapiens
gcctcactcacatgt

SEQ ID NO: 219526 - DNA, 15 bp, Homo sapiens
agcctcactcacatg

SEQ ID NO: 219527 - DNA, 15 bp, Homo sapiens
cagcctcactcacat

SEQ ID NO: 219528 - DNA, 15 bp, Homo sapiens
acagcctcactcaca

SEQ ID NO: 219529 - DNA, 15 bp, Homo sapiens
aacagcctcactcac

SEQ ID NO: 219530 - DNA, 15 bp, Homo sapiens
aaacagcctcactca

SEQ ID NO: 219531 - DNA, 15 bp, Homo sapiens
aaaacagcctcactc

SEQ ID NO: 219532 - DNA, 15 bp, Homo sapiens
caaaacagcctcact

SEQ ID NO: 219533 - DNA, 15 bp, Homo sapiens
acaaaacagcctcac

SEQ ID NO: 219534 - DNA, 15 bp, Homo sapiens
gacaaaacagcctca

SEQ ID NO: 219535 - DNA, 15 bp, Homo sapiens
ggacaaaacagcctc

SEQ ID NO: 219536 - DNA, 15 bp, Homo sapiens
gggacaaaacagcct

SEQ ID NO: 219537 - DNA, 15 bp, Homo sapiens
cgggacaaaacagcc

SEQ ID NO: 219538 - DNA, 15 bp, Homo sapiens
gcgggacaaaacagc

SEQ ID NO: 219539 - DNA, 15 bp, Homo sapiens
ggcgggacaaaacag

SEQ ID NO: 219540 - DNA, 15 bp, Homo sapiens
gggcgggacaaaaca

SEQ ID NO: 219541 - DNA, 15 bp, Homo sapiens
agggcgggacaaaac

SEQ ID NO: 219542 - DNA, 15 bp, Homo sapiens
gagggcgggacaaaa

SEQ ID NO: 219543 - DNA, 15 bp, Homo sapiens
ggagggcgggacaaa

SEQ ID NO: 219544 - DNA, 15 bp, Homo sapiens
gggagggcgggacaa

SEQ ID NO: 219545 - DNA, 15 bp, Homo sapiens
ggggagggcgggaca

SEQ ID NO: 219546 - DNA, 15 bp, Homo sapiens
tggggagggcgggac

SEQ ID NO: 219547 - DNA, 15 bp, Homo sapiens
atggggagggcggga

SEQ ID NO: 219548 - DNA, 15 bp, Homo sapiens
gatggggagggcggg

SEQ ID NO: 219549 - DNA, 15 bp, Homo sapiens
ggatggggagggcgg

SEQ ID NO: 219550 - DNA, 15 bp, Homo sapiens
tggatggggagggcg

SEQ ID NO: 219551 - DNA, 15 bp, Homo sapiens
ttggatggggagggc

SEQ ID NO: 219552 - DNA, 15 bp, Homo sapiens
cttggatggggaggg

SEQ ID NO: 219553 - DNA, 15 bp, Homo sapiens
gcttggatggggagg

SEQ ID NO: 219554 - DNA, 15 bp, Homo sapiens
agcttggatggggag

SEQ ID NO: 219555 - DNA, 15 bp, Homo sapiens
cagcttggatgggga

SEQ ID NO: 219556 - DNA, 15 bp, Homo sapiens
gcagcttggatgggg

SEQ ID NO: 219557 - DNA, 15 bp, Homo sapiens
tgcagcttggatggg

SEQ ID NO: 219558 - DNA, 15 bp, Homo sapiens
ctgcagcttggatgg

SEQ ID NO: 219559 - DNA, 15 bp, Homo sapiens
cctgcagcttggatg

SEQ ID NO: 219560 - DNA, 15 bp, Homo sapiens
tcctgcagcttggat

SEQ ID NO: 219561 - DNA, 15 bp, Homo sapiens
atcctgcagcttgga

SEQ ID NO: 219562 - DNA, 15 bp, Homo sapiens
catcctgcagcttgg

SEQ ID NO: 219563 - DNA, 15 bp, Homo sapiens
tcatcctgcagcttg

SEQ ID NO: 219564 - DNA, 15 bp, Homo sapiens
gtcatcctgcagctt

SEQ ID NO: 219565 - DNA, 15 bp, Homo sapiens
agtcatcctgcagct

SEQ ID NO: 219566 - DNA, 15 bp, Homo sapiens
tagtcatcctgcagc

SEQ ID NO: 219567 - DNA, 15 bp, Homo sapiens
atagtcatcctgcag

SEQ ID NO: 219568 - DNA, 15 bp, Homo sapiens
tatagtcatcctgca

SEQ ID NO: 219569 - DNA, 15 bp, Homo sapiens
ttatagtcatcctgc

SEQ ID NO: 219570 - DNA, 15 bp, Homo sapiens
gttatagtcatcctg

SEQ ID NO: 219571 - DNA, 15 bp, Homo sapiens
ggttatagtcatcct

SEQ ID NO: 219572 - DNA, 15 bp, Homo sapiens
aggttatagtcatcc

SEQ ID NO: 219573 - DNA, 15 bp, Homo sapiens
gaggttatagtcatc

SEQ ID NO: 219574 - DNA, 15 bp, Homo sapiens
tgaggttatagtcat

SEQ ID NO: 219575 - DNA, 15 bp, Homo sapiens
gtgaggttatagtca

SEQ ID NO: 219576 - DNA, 15 bp, Homo sapiens
agtgaggttatagtc

SEQ ID NO: 219577 - DNA, 15 bp, Homo sapiens
tagtgaggttatagt

SEQ ID NO: 219578 - DNA, 15 bp, Homo sapiens
ctagtgaggttatag

SEQ ID NO: 219579 - DNA, 15 bp, Homo sapiens
actagtgaggttata

SEQ ID NO: 219580 - DNA, 15 bp, Homo sapiens
tactagtgaggttat

SEQ ID NO: 219581 - DNA, 15 bp, Homo sapiens
ttactagtgaggtta

SEQ ID NO: 219582 - DNA, 15 bp, Homo sapiens
attactagtgaggtt

SEQ ID NO: 219583 - DNA, 15 bp, Homo sapiens
gattactagtgaggt

SEQ ID NO: 219584 - DNA, 15 bp, Homo sapiens
ggattactagtgagg

SEQ ID NO: 219585 - DNA, 15 bp, Homo sapiens
gggattactagtgag

SEQ ID NO: 219586 - DNA, 15 bp, Homo sapiens
tgggattactagtga

SEQ ID NO: 219587 - DNA, 15 bp, Homo sapiens
ctgggattactagtg

SEQ ID NO: 219588 - DNA, 15 bp, Homo sapiens
cctgggattactagt

SEQ ID NO: 219589 - DNA, 15 bp, Homo sapiens
acctgggattactag

SEQ ID NO: 219590 - DNA, 15 bp, Homo sapiens
cacctgggattacta

SEQ ID NO: 219591 - DNA, 15 bp, Homo sapiens
ccacctgggattact

SEQ ID NO: 219592 - DNA, 15 bp, Homo sapiens
accacctgggattac

SEQ ID NO: 219593 - DNA, 15 bp, Homo sapiens
taccacctgggatta

SEQ ID NO: 219594 - DNA, 15 bp, Homo sapiens
gtaccacctgggatt

SEQ ID NO: 219595 - DNA, 15 bp, Homo sapiens
ggtaccacctgggat

SEQ ID NO: 219596 - DNA, 15 bp, Homo sapiens
tggtaccacctggga

SEQ ID NO: 219597 - DNA, 15 bp, Homo sapiens
ctggtaccacctggg

SEQ ID NO: 219598 - DNA, 15 bp, Homo sapiens
gctggtaccacctgg

SEQ ID NO: 219599 - DNA, 15 bp, Homo sapiens
ggctggtaccacctg

SEQ ID NO: 219600 - DNA, 15 bp, Homo sapiens
tggctggtaccacct

SEQ ID NO: 219601 - DNA, 15 bp, Homo sapiens
ttggctggtaccacc

SEQ ID NO: 219602 - DNA, 15 bp, Homo sapiens
tttggctggtaccac

SEQ ID NO: 219603 - DNA, 15 bp, Homo sapiens
ctttggctggtacca

SEQ ID NO: 219604 - DNA, 15 bp, Homo sapiens
tctttggctggtacc

SEQ ID NO: 219605 - DNA, 15 bp, Homo sapiens
ttctttggctggtac

SEQ ID NO: 219606 - DNA, 15 bp, Homo sapiens
gttctttggctggta

SEQ ID NO: 219607 - DNA, 15 bp, Homo sapiens
tgttctttggctggt

SEQ ID NO: 219608 - DNA, 15 bp, Homo sapiens
ctgttctttggctgg

SEQ ID NO: 219609 - DNA, 15 bp, Homo sapiens
cctgttctttggctg

SEQ ID NO: 219610 - DNA, 15 bp, Homo sapiens
acctgttctttggct

SEQ ID NO: 219611 - DNA, 15 bp, Homo sapiens
gacctgttctttggc

SEQ ID NO: 219612 - DNA, 15 bp, Homo sapiens
tgacctgttctttgg

SEQ ID NO: 219613 - DNA, 15 bp, Homo sapiens
ttgacctgttctttg

SEQ ID NO: 219614 - DNA, 15 bp, Homo sapiens
tttgacctgttcttt

SEQ ID NO: 219615 - DNA, 15 bp, Homo sapiens
atttgacctgttctt

SEQ ID NO: 219616 - DNA, 15 bp, Homo sapiens
aatttgacctgttct

SEQ ID NO: 219617 - DNA, 15 bp, Homo sapiens
caatttgacctgttc

SEQ ID NO: 219618 - DNA, 15 bp, Homo sapiens
gcaatttgacctgtt

SEQ ID NO: 219619 - DNA, 15 bp, Homo sapiens
ggcaatttgacctgt

SEQ ID NO: 219620 - DNA, 15 bp, Homo sapiens
tggcaatttgacctg

SEQ ID NO: 219621 - DNA, 15 bp, Homo sapiens
ttggcaatttgacct

SEQ ID NO: 219622 - DNA, 15 bp, Homo sapiens
gttggcaatttgacc

SEQ ID NO: 219623 - DNA, 15 bp, Homo sapiens
ggttggcaatttgac

SEQ ID NO: 219624 - DNA, 15 bp, Homo sapiens
gggttggcaatttga

SEQ ID NO: 219625 - DNA, 15 bp, Homo sapiens
tgggttggcaatttg

SEQ ID NO: 219626 - DNA, 15 bp, Homo sapiens
gtgggttggcaattt

SEQ ID NO: 219627 - DNA, 15 bp, Homo sapiens
tgtgggttggcaatt

SEQ ID NO: 219628 - DNA, 15 bp, Homo sapiens
gtgtgggttggcaat

SEQ ID NO: 219629 - DNA, 15 bp, Homo sapiens
tgtgtgggttggcaa

SEQ ID NO: 219630 - DNA, 15 bp, Homo sapiens
ttgtgtgggttggca

SEQ ID NO: 219631 - DNA, 15 bp, Homo sapiens
attgtgtgggttggc

SEQ ID NO: 219632 - DNA, 15 bp, Homo sapiens
gattgtgtgggttgg

SEQ ID NO: 219633 - DNA, 15 bp, Homo sapiens
tgattgtgtgggttg

SEQ ID NO: 219634 - DNA, 15 bp, Homo sapiens
atgattgtgtgggtt

SEQ ID NO: 219635 - DNA, 15 bp, Homo sapiens
catgattgtgtgggt

SEQ ID NO: 219636 - DNA, 15 bp, Homo sapiens
tcatgattgtgtggg

SEQ ID NO: 219637 - DNA, 15 bp, Homo sapiens
ttcatgattgtgtgg

SEQ ID NO: 219638 - DNA, 15 bp, Homo sapiens
tttcatgattgtgtg

SEQ ID NO: 219639 - DNA, 15 bp, Homo sapiens
ttttcatgattgtgt

SEQ ID NO: 219640 - DNA, 15 bp, Homo sapiens
tttttcatgattgtg

SEQ ID NO: 219641 - DNA, 15 bp, Homo sapiens
atttttcatgattgt

SEQ ID NO: 219642 - DNA, 15 bp, Homo sapiens
tatttttcatgattg

SEQ ID NO: 219643 - DNA, 15 bp, Homo sapiens
ttatttttcatgatt

SEQ ID NO: 219644 - DNA, 15 bp, Homo sapiens
attatttttcatgat

SEQ ID NO: 219645 - DNA, 15 bp, Homo sapiens
aattatttttcatga

SEQ ID NO: 219646 - DNA, 15 bp, Homo sapiens
caattatttttcatg

SEQ ID NO: 219647 - DNA, 15 bp, Homo sapiens
acaattatttttcat

SEQ ID NO: 219648 - DNA, 15 bp, Homo sapiens
gacaattatttttca

SEQ ID NO: 219649 - DNA, 15 bp, Homo sapiens
tgacaattatttttc

SEQ ID NO: 219650 - DNA, 15 bp, Homo sapiens
atgacaattattttt

SEQ ID NO: 219651 - DNA, 15 bp, Homo sapiens
aatgacaattatttt

SEQ ID NO: 219652 - DNA, 15 bp, Homo sapiens
caatgacaattattt

SEQ ID NO: 219653 - DNA, 15 bp, Homo sapiens
acaatgacaattatt

SEQ ID NO: 219654 - DNA, 15 bp, Homo sapiens
aacaatgacaattat

SEQ ID NO: 219655 - DNA, 15 bp, Homo sapiens
aaacaatgacaatta

SEQ ID NO: 219656 - DNA, 15 bp, Homo sapiens
aaaacaatgacaatt

SEQ ID NO: 219657 - DNA, 15 bp, Homo sapiens
taaaacaatgacaat

SEQ ID NO: 219658 - DNA, 15 bp, Homo sapiens
ttaaaacaatgacaa

SEQ ID NO: 219659 - DNA, 15 bp, Homo sapiens
cttaaaacaatgaca

SEQ ID NO: 219660 - DNA, 15 bp, Homo sapiens
gcttaaaacaatgac

SEQ ID NO: 219661 - DNA, 15 bp, Homo sapiens
agcttaaaacaatga

SEQ ID NO: 219662 - DNA, 15 bp, Homo sapiens
tagcttaaaacaatg

SEQ ID NO: 219663 - DNA, 15 bp, Homo sapiens
atagcttaaaacaat

SEQ ID NO: 219664 - DNA, 15 bp, Homo sapiens
tatagcttaaaacaa

SEQ ID NO: 219665 - DNA, 15 bp, Homo sapiens
ttatagcttaaaaca

SEQ ID NO: 219666 - DNA, 15 bp, Homo sapiens
cttatagcttaaaac

SEQ ID NO: 219667 - DNA, 15 bp, Homo sapiens
acttatagcttaaaa

SEQ ID NO: 219668 - DNA, 15 bp, Homo sapiens
aacttatagcttaaa

SEQ ID NO: 219669 - DNA, 15 bp, Homo sapiens
aaacttatagcttaa

SEQ ID NO: 219670 - DNA, 15 bp, Homo sapiens
aaaacttatagctta

SEQ ID NO: 219671 - DNA, 15 bp, Homo sapiens
taaaacttatagctt

SEQ ID NO: 219672 - DNA, 15 bp, Homo sapiens
ataaaacttatagct

SEQ ID NO: 219673 - DNA, 15 bp, Homo sapiens
tataaaacttatagc

SEQ ID NO: 219674 - DNA, 15 bp, Homo sapiens
atataaaacttatag

SEQ ID NO: 219675 - DNA, 15 bp, Homo sapiens
tatataaaacttata

SEQ ID NO: 219676 - DNA, 15 bp, Homo sapiens
ctatataaaacttat

SEQ ID NO: 219677 - DNA, 15 bp, Homo sapiens
cctatataaaactta

SEQ ID NO: 219678 - DNA, 15 bp, Homo sapiens
acctatataaaactt

SEQ ID NO: 219679 - DNA, 15 bp, Homo sapiens
aacctatataaaact

SEQ ID NO: 219680 - DNA, 15 bp, Homo sapiens
aaacctatataaaac

SEQ ID NO: 219681 - DNA, 15 bp, Homo sapiens
caaacctatataaaa

SEQ ID NO: 219682 - DNA, 15 bp, Homo sapiens
tcaaacctatataaa

SEQ ID NO: 219683 - DNA, 15 bp, Homo sapiens
atcaaacctatataa

SEQ ID NO: 219684 - DNA, 15 bp, Homo sapiens
tatcaaacctatata

SEQ ID NO: 219685 - DNA, 15 bp, Homo sapiens
gtatcaaacctatat

SEQ ID NO: 219686 - DNA, 15 bp, Homo sapiens
tgtatcaaacctata

SEQ ID NO: 219687 - DNA, 15 bp, Homo sapiens
gtgtatcaaacctat

SEQ ID NO: 219688 - DNA, 15 bp, Homo sapiens
tgtgtatcaaaccta

SEQ ID NO: 219689 - DNA, 15 bp, Homo sapiens
ctgtgtatcaaacct

SEQ ID NO: 219690 - DNA, 15 bp, Homo sapiens
actgtgtatcaaacc

SEQ ID NO: 219691 - DNA, 15 bp, Homo sapiens
gactgtgtatcaaac

SEQ ID NO: 219692 - DNA, 15 bp, Homo sapiens
tgactgtgtatcaaa

SEQ ID NO: 219693 - DNA, 15 bp, Homo sapiens
atgactgtgtatcaa

SEQ ID NO: 219694 - DNA, 15 bp, Homo sapiens
catgactgtgtatca

SEQ ID NO: 219695 - DNA, 15 bp, Homo sapiens
tcatgactgtgtatc

SEQ ID NO: 219696 - DNA, 15 bp, Homo sapiens
atcatgactgtgtat

SEQ ID NO: 219697 - DNA, 15 bp, Homo sapiens
tatcatgactgtgta

SEQ ID NO: 219698 - DNA, 15 bp, Homo sapiens
ttatcatgactgtgt

SEQ ID NO: 219699 - DNA, 15 bp, Homo sapiens
attatcatgactgtg

SEQ ID NO: 219700 - DNA, 15 bp, Homo sapiens
cattatcatgactgt

SEQ ID NO: 219701 - DNA, 15 bp, Homo sapiens
ccattatcatgactg

SEQ ID NO: 219702 - DNA, 15 bp, Homo sapiens
tccattatcatgact

SEQ ID NO: 219703 - DNA, 15 bp, Homo sapiens
ttccattatcatgac

SEQ ID NO: 219704 - DNA, 15 bp, Homo sapiens
tttccattatcatga

SEQ ID NO: 219705 - DNA, 15 bp, Homo sapiens
gtttccattatcatg

SEQ ID NO: 219706 - DNA, 15 bp, Homo sapiens
tgtttccattatcat

SEQ ID NO: 219707 - DNA, 15 bp, Homo sapiens
gtgtttccattatca

SEQ ID NO: 219708 - DNA, 15 bp, Homo sapiens
ggtgtttccattatc

SEQ ID NO: 219709 - DNA, 15 bp, Homo sapiens
gggtgtttccattat

SEQ ID NO: 219710 - DNA, 15 bp, Homo sapiens
agggtgtttccatta

SEQ ID NO: 219711 - DNA, 15 bp, Homo sapiens
aagggtgtttccatt

SEQ ID NO: 219712 - DNA, 15 bp, Homo sapiens
gaagggtgtttccat

SEQ ID NO: 219713 - DNA, 15 bp, Homo sapiens
tgaagggtgtttcca

SEQ ID NO: 219714 - DNA, 15 bp, Homo sapiens
ttgaagggtgtttcc

SEQ ID NO: 219715 - DNA, 15 bp, Homo sapiens
attgaagggtgtttc

SEQ ID NO: 219716 - DNA, 15 bp, Homo sapiens
aattgaagggtgttt

SEQ ID NO: 219717 - DNA, 15 bp, Homo sapiens
gaattgaagggtgtt

SEQ ID NO: 219718 - DNA, 15 bp, Homo sapiens
agaattgaagggtgt

SEQ ID NO: 219719 - DNA, 15 bp, Homo sapiens
tagaattgaagggtg

SEQ ID NO: 219720 - DNA, 15 bp, Homo sapiens
ttagaattgaagggt

SEQ ID NO: 219721 - DNA, 15 bp, Homo sapiens
attagaattgaaggg

SEQ ID NO: 219722 - DNA, 15 bp, Homo sapiens
cattagaattgaagg

SEQ ID NO: 219723 - DNA, 15 bp, Homo sapiens
tcattagaattgaag

SEQ ID NO: 219724 - DNA, 15 bp, Homo sapiens
gtcattagaattgaa

SEQ ID NO: 219725 - DNA, 15 bp, Homo sapiens
agtcattagaattga

SEQ ID NO: 219726 - DNA, 15 bp, Homo sapiens
cagtcattagaattg

SEQ ID NO: 219727 - DNA, 15 bp, Homo sapiens
tcagtcattagaatt

SEQ ID NO: 219728 - DNA, 15 bp, Homo sapiens
gtcagtcattagaat

SEQ ID NO: 219729 - DNA, 15 bp, Homo sapiens
tgtcagtcattagaa

SEQ ID NO: 219730 - DNA, 15 bp, Homo sapiens
ctgtcagtcattaga

SEQ ID NO: 219731 - DNA, 15 bp, Homo sapiens
actgtcagtcattag

SEQ ID NO: 219732 - DNA, 15 bp, Homo sapiens
tactgtcagtcatta

SEQ ID NO: 219733 - DNA, 15 bp, Homo sapiens
ttactgtcagtcatt

SEQ ID NO: 219734 - DNA, 15 bp, Homo sapiens
attactgtcagtcat

SEQ ID NO: 219735 - DNA, 15 bp, Homo sapiens
aattactgtcagtca

SEQ ID NO: 219736 - DNA, 15 bp, Homo sapiens
aaattactgtcagtc

SEQ ID NO: 219737 - DNA, 15 bp, Homo sapiens
caaattactgtcagt

SEQ ID NO: 219738 - DNA, 15 bp, Homo sapiens
ccaaattactgtcag

SEQ ID NO: 219739 - DNA, 15 bp, Homo sapiens
tccaaattactgtca

SEQ ID NO: 219740 - DNA, 15 bp, Homo sapiens
ttccaaattactgtc

SEQ ID NO: 219741 - DNA, 15 bp, Homo sapiens
tttccaaattactgt

SEQ ID NO: 219742 - DNA, 15 bp, Homo sapiens
gtttccaaattactg

SEQ ID NO: 219743 - DNA, 15 bp, Homo sapiens
ggtttccaaattact

SEQ ID NO: 219744 - DNA, 15 bp, Homo sapiens
tggtttccaaattac

SEQ ID NO: 219745 - DNA, 15 bp, Homo sapiens
atggtttccaaatta

SEQ ID NO: 219746 - DNA, 15 bp, Homo sapiens
catggtttccaaatt

SEQ ID NO: 219747 - DNA, 15 bp, Homo sapiens
gcatggtttccaaat

SEQ ID NO: 219748 - DNA, 15 bp, Homo sapiens
ggcatggtttccaaa

SEQ ID NO: 219749 - DNA, 15 bp, Homo sapiens
gggcatggtttccaa

SEQ ID NO: 219750 - DNA, 15 bp, Homo sapiens
agggcatggtttcca

SEQ ID NO: 219751 - DNA, 15 bp, Homo sapiens
tagggcatggtttcc

SEQ ID NO: 219752 - DNA, 15 bp, Homo sapiens
ttagggcatggtttc

SEQ ID NO: 219753 - DNA, 15 bp, Homo sapiens
cttagggcatggttt

SEQ ID NO: 219754 - DNA, 15 bp, Homo sapiens
ccttagggcatggtt

SEQ ID NO: 219755 - DNA, 15 bp, Homo sapiens
cccttagggcatggt

SEQ ID NO: 219756 - DNA, 15 bp, Homo sapiens
ccccttagggcatgg

SEQ ID NO: 219757 - DNA, 15 bp, Homo sapiens
accccttagggcatg

SEQ ID NO: 219758 - DNA, 15 bp, Homo sapiens
aaccccttagggcat

SEQ ID NO: 219759 - DNA, 15 bp, Homo sapiens
taaccccttagggca

SEQ ID NO: 219760 - DNA, 15 bp, Homo sapiens
gtaaccccttagggc

SEQ ID NO: 219761 - DNA, 15 bp, Homo sapiens
ggtaaccccttaggg

SEQ ID NO: 219762 - DNA, 15 bp, Homo sapiens
aggtaaccccttagg

SEQ ID NO: 219763 - DNA, 15 bp, Homo sapiens
gaggtaaccccttag

SEQ ID NO: 219764 - DNA, 15 bp, Homo sapiens
tgaggtaacccctta

SEQ ID NO: 219765 - DNA, 15 bp, Homo sapiens
atgaggtaacccctt

SEQ ID NO: 219766 - DNA, 15 bp, Homo sapiens
catgaggtaacccct

SEQ ID NO: 219767 - DNA, 15 bp, Homo sapiens
ccatgaggtaacccc

SEQ ID NO: 219768 - DNA, 15 bp, Homo sapiens
cccatgaggtaaccc

SEQ ID NO: 219769 - DNA, 15 bp, Homo sapiens
acccatgaggtaacc

SEQ ID NO: 219770 - DNA, 15 bp, Homo sapiens
cacccatgaggtaac

SEQ ID NO: 219771 - DNA, 15 bp, Homo sapiens
tcacccatgaggtaa

SEQ ID NO: 219772 - DNA, 15 bp, Homo sapiens
ctcacccatgaggta

SEQ ID NO: 219773 - DNA, 15 bp, Homo sapiens
tctcacccatgaggt

SEQ ID NO: 219774 - DNA, 15 bp, Homo sapiens
ttctcacccatgagg

SEQ ID NO: 219775 - DNA, 15 bp, Homo sapiens
attctcacccatgag

SEQ ID NO: 219776 - DNA, 15 bp, Homo sapiens
cattctcacccatga

SEQ ID NO: 219777 - DNA, 15 bp, Homo sapiens
acattctcacccatg

SEQ ID NO: 219778 - DNA, 15 bp, Homo sapiens
gacattctcacccat

SEQ ID NO: 219779 - DNA, 15 bp, Homo sapiens
tgacattctcaccca

SEQ ID NO: 219780 - DNA, 15 bp, Homo sapiens
gtgacattctcaccc

SEQ ID NO: 219781 - DNA, 15 bp, Homo sapiens
tgtgacattctcacc

SEQ ID NO: 219782 - DNA, 15 bp, Homo sapiens
ttgtgacattctcac

SEQ ID NO: 219783 - DNA, 15 bp, Homo sapiens
tttgtgacattctca

SEQ ID NO: 219784 - DNA, 15 bp, Homo sapiens
ttttgtgacattctc

SEQ ID NO: 219785 - DNA, 15 bp, Homo sapiens
attttgtgacattct

SEQ ID NO: 219786 - DNA, 15 bp, Homo sapiens
cattttgtgacattc

SEQ ID NO: 219787 - DNA, 15 bp, Homo sapiens
tcattttgtgacatt

SEQ ID NO: 219788 - DNA, 15 bp, Homo sapiens
ctcattttgtgacat

SEQ ID NO: 219789 - DNA, 15 bp, Homo sapiens
cctcattttgtgaca

SEQ ID NO: 219790 - DNA, 15 bp, Homo sapiens
tcctcattttgtgac

SEQ ID NO: 219791 - DNA, 15 bp, Homo sapiens
ttcctcattttgtga

SEQ ID NO: 219792 - DNA, 15 bp, Homo sapiens
cttcctcattttgtg

SEQ ID NO: 219793 - DNA, 15 bp, Homo sapiens
tcttcctcattttgt

SEQ ID NO: 219794 - DNA, 15 bp, Homo sapiens
gtcttcctcattttg

SEQ ID NO: 219795 - DNA, 15 bp, Homo sapiens
tgtcttcctcatttt

SEQ ID NO: 219796 - DNA, 15 bp, Homo sapiens
ctgtcttcctcattt

SEQ ID NO: 219797 - DNA, 15 bp, Homo sapiens
tctgtcttcctcatt

SEQ ID NO: 219798 - DNA, 15 bp, Homo sapiens
ctctgtcttcctcat

SEQ ID NO: 219799 - DNA, 15 bp, Homo sapiens
actctgtcttcctca

SEQ ID NO: 219800 - DNA, 15 bp, Homo sapiens
cactctgtcttcctc

SEQ ID NO: 219801 - DNA, 15 bp, Homo sapiens
tcactctgtcttcct

SEQ ID NO: 219802 - DNA, 15 bp, Homo sapiens
ttcactctgtcttcc

SEQ ID NO: 219803 - DNA, 15 bp, Homo sapiens
attcactctgtcttc

SEQ ID NO: 219804 - DNA, 15 bp, Homo sapiens
gattcactctgtctt

SEQ ID NO: 219805 - DNA, 15 bp, Homo sapiens
ggattcactctgtct

SEQ ID NO: 219806 - DNA, 15 bp, Homo sapiens
tggattcactctgtc

SEQ ID NO: 219807 - DNA, 15 bp, Homo sapiens
atggattcactctgt

SEQ ID NO: 219808 - DNA, 15 bp, Homo sapiens
tatggattcactctg

SEQ ID NO: 219809 - DNA, 15 bp, Homo sapiens
gtatggattcactct

SEQ ID NO: 219810 - DNA, 15 bp, Homo sapiens
ggtatggattcactc

SEQ ID NO: 219811 - DNA, 15 bp, Homo sapiens
tggtatggattcact

SEQ ID NO: 219812 - DNA, 15 bp, Homo sapiens
atggtatggattcac

SEQ ID NO: 219813 - DNA, 15 bp, Homo sapiens
gatggtatggattca

SEQ ID NO: 219814 - DNA, 15 bp, Homo sapiens
ggatggtatggattc

SEQ ID NO: 219815 - DNA, 15 bp, Homo sapiens
tggatggtatggatt

SEQ ID NO: 219816 - DNA, 15 bp, Homo sapiens
atggatggtatggat

SEQ ID NO: 219817 - DNA, 15 bp, Homo sapiens
catggatggtatgga

SEQ ID NO: 219818 - DNA, 15 bp, Homo sapiens
tcatggatggtatgg

SEQ ID NO: 219819 - DNA, 15 bp, Homo sapiens
gtcatggatggtatg

SEQ ID NO: 219820 - DNA, 15 bp, Homo sapiens
tgtcatggatggtat

SEQ ID NO: 219821 - DNA, 15 bp, Homo sapiens
ctgtcatggatggta

SEQ ID NO: 219822 - DNA, 15 bp, Homo sapiens
actgtcatggatggt

SEQ ID NO: 219823 - DNA, 15 bp, Homo sapiens
gactgtcatggatgg

SEQ ID NO: 219824 - DNA, 15 bp, Homo sapiens
tgactgtcatggatg

SEQ ID NO: 219825 - DNA, 15 bp, Homo sapiens
ctgactgtcatggat

SEQ ID NO: 219826 - DNA, 15 bp, Homo sapiens
tctgactgtcatgga

SEQ ID NO: 219827 - DNA, 15 bp, Homo sapiens
atctgactgtcatgg

SEQ ID NO: 219828 - DNA, 15 bp, Homo sapiens
gatctgactgtcatg

SEQ ID NO: 219829 - DNA, 15 bp, Homo sapiens
tgatctgactgtcat

SEQ ID NO: 219830 - DNA, 15 bp, Homo sapiens
ctgatctgactgtca

SEQ ID NO: 219831 - DNA, 15 bp, Homo sapiens
actgatctgactgtc

SEQ ID NO: 219832 - DNA, 15 bp, Homo sapiens
aactgatctgactgt

SEQ ID NO: 219833 - DNA, 15 bp, Homo sapiens
gaactgatctgactg

SEQ ID NO: 219834 - DNA, 15 bp, Homo sapiens
ggaactgatctgact

SEQ ID NO: 219835 - DNA, 15 bp, Homo sapiens
aggaactgatctgac

SEQ ID NO: 219836 - DNA, 15 bp, Homo sapiens
aaggaactgatctga

SEQ ID NO: 219837 - DNA, 15 bp, Homo sapiens
taaggaactgatctg

SEQ ID NO: 219838 - DNA, 15 bp, Homo sapiens
ataaggaactgatct

SEQ ID NO: 219839 - DNA, 15 bp, Homo sapiens
aataaggaactgatc

SEQ ID NO: 219840 - DNA, 15 bp, Homo sapiens
aaataaggaactgat

SEQ ID NO: 219841 - DNA, 15 bp, Homo sapiens
taaataaggaactga

SEQ ID NO: 219842 - DNA, 15 bp, Homo sapiens
ataaataaggaactg

SEQ ID NO: 219843 - DNA, 15 bp, Homo sapiens
gataaataaggaact

SEQ ID NO: 219844 - DNA, 15 bp, Homo sapiens
agataaataaggaac

SEQ ID NO: 219845 - DNA, 15 bp, Homo sapiens
tagataaataaggaa

SEQ ID NO: 219846 - DNA, 15 bp, Homo sapiens
ttagataaataagga

SEQ ID NO: 219847 - DNA, 15 bp, Homo sapiens
tttagataaataagg

SEQ ID NO: 219848 - DNA, 15 bp, Homo sapiens
ttttagataaataag

SEQ ID NO: 219849 - DNA, 15 bp, Homo sapiens
tttttagataaataa

SEQ ID NO: 219850 - DNA, 15 bp, Homo sapiens
ctttttagataaata

SEQ ID NO: 219851 - DNA, 15 bp, Homo sapiens
tctttttagataaat

SEQ ID NO: 219852 - DNA, 15 bp, Homo sapiens
ctctttttagataaa

SEQ ID NO: 219853 - DNA, 15 bp, Homo sapiens
tctctttttagataa

SEQ ID NO: 219854 - DNA, 15 bp, Homo sapiens
ttctctttttagata

SEQ ID NO: 219855 - DNA, 15 bp, Homo sapiens
tttctctttttagat

SEQ ID NO: 219856 - DNA, 15 bp, Homo sapiens
ttttctctttttaga

SEQ ID NO: 219857 - DNA, 15 bp, Homo sapiens
cttttctctttttag

SEQ ID NO: 219858 - DNA, 15 bp, Homo sapiens
ccttttctcttttta

SEQ ID NO: 219859 - DNA, 15 bp, Homo sapiens
tccttttctcttttt

SEQ ID NO: 219860 - DNA, 15 bp, Homo sapiens
atccttttctctttt

SEQ ID NO: 219861 - DNA, 15 bp, Homo sapiens
tatccttttctcttt

SEQ ID NO: 219862 - DNA, 15 bp, Homo sapiens
atatccttttctctt

SEQ ID NO: 219863 - DNA, 15 bp, Homo sapiens
aatatccttttctct

SEQ ID NO: 219864 - DNA, 15 bp, Homo sapiens
aaatatccttttctc

SEQ ID NO: 219865 - DNA, 15 bp, Homo sapiens
caaatatccttttct

SEQ ID NO: 219866 - DNA, 15 bp, Homo sapiens
gcaaatatccttttc

SEQ ID NO: 219867 - DNA, 15 bp, Homo sapiens
agcaaatatcctttt

SEQ ID NO: 219868 - DNA, 15 bp, Homo sapiens
tagcaaatatccttt

SEQ ID NO: 219869 - DNA, 15 bp, Homo sapiens
atagcaaatatcctt

SEQ ID NO: 219870 - DNA, 15 bp, Homo sapiens
aatagcaaatatcct

SEQ ID NO: 219871 - DNA, 15 bp, Homo sapiens
taatagcaaatatcc

SEQ ID NO: 219872 - DNA, 15 bp, Homo sapiens
gtaatagcaaatatc

SEQ ID NO: 219873 - DNA, 15 bp, Homo sapiens
agtaatagcaaatat

SEQ ID NO: 219874 - DNA, 15 bp, Homo sapiens
tagtaatagcaaata

SEQ ID NO: 219875 - DNA, 15 bp, Homo sapiens
ttagtaatagcaaat

SEQ ID NO: 219876 - DNA, 15 bp, Homo sapiens
tttagtaatagcaaa

SEQ ID NO: 219877 - DNA, 15 bp, Homo sapiens
ttttagtaatagcaa

SEQ ID NO: 219878 - DNA, 15 bp, Homo sapiens
attttagtaatagca

SEQ ID NO: 219879 - DNA, 15 bp, Homo sapiens
tattttagtaatagc

SEQ ID NO: 219880 - DNA, 15 bp, Homo sapiens
ttattttagtaatag

SEQ ID NO: 219881 - DNA, 15 bp, Homo sapiens
tttattttagtaata

SEQ ID NO: 219882 - DNA, 15 bp, Homo sapiens
ttttattttagtaat

SEQ ID NO: 219883 - DNA, 15 bp, Homo sapiens
tttttattttagtaa

SEQ ID NO: 219884 - DNA, 15 bp, Homo sapiens
gtttttattttagta

SEQ ID NO: 219885 - DNA, 15 bp, Homo sapiens
ggtttttattttagt

SEQ ID NO: 219886 - DNA, 15 bp, Homo sapiens
tggtttttattttag

SEQ ID NO: 219887 - DNA, 15 bp, Homo sapiens
ttggtttttatttta

SEQ ID NO: 219888 - DNA, 15 bp, Homo sapiens
gttggtttttatttt

SEQ ID NO: 219889 - DNA, 15 bp, Homo sapiens
agttggtttttattt

SEQ ID NO: 219890 - DNA, 15 bp, Homo sapiens
cagttggtttttatt

SEQ ID NO: 219891 - DNA, 15 bp, Homo sapiens
gcagttggtttttat

SEQ ID NO: 219892 - DNA, 15 bp, Homo sapiens
tgcagttggttttta

SEQ ID NO: 219893 - DNA, 15 bp, Homo sapiens
ctgcagttggttttt

SEQ ID NO: 219894 - DNA, 15 bp, Homo sapiens
tctgcagttggtttt

SEQ ID NO: 219895 - DNA, 15 bp, Homo sapiens
gtctgcagttggttt

SEQ ID NO: 219896 - DNA, 15 bp, Homo sapiens
agtctgcagttggtt

SEQ ID NO: 219897 - DNA, 15 bp, Homo sapiens
cagtctgcagttggt

SEQ ID NO: 219898 - DNA, 15 bp, Homo sapiens
tcagtctgcagttgg

SEQ ID NO: 219899 - DNA, 15 bp, Homo sapiens
ttcagtctgcagttg

SEQ ID NO: 219900 - DNA, 15 bp, Homo sapiens
tttcagtctgcagtt

SEQ ID NO: 219901 - DNA, 15 bp, Homo sapiens
atttcagtctgcagt

SEQ ID NO: 219902 - DNA, 15 bp, Homo sapiens
tatttcagtctgcag

SEQ ID NO: 219903 - DNA, 15 bp, Homo sapiens
gtatttcagtctgca

SEQ ID NO: 219904 - DNA, 15 bp, Homo sapiens
agtatttcagtctgc

SEQ ID NO: 219905 - DNA, 15 bp, Homo sapiens
aagtatttcagtctg

SEQ ID NO: 219906 - DNA, 15 bp, Homo sapiens
taagtatttcagtct

SEQ ID NO: 219907 - DNA, 15 bp, Homo sapiens
ataagtatttcagtc

SEQ ID NO: 219908 - DNA, 15 bp, Homo sapiens
aataagtatttcagt

SEQ ID NO: 219909 - DNA, 15 bp, Homo sapiens
taataagtatttcag

SEQ ID NO: 219910 - DNA, 15 bp, Homo sapiens
ttaataagtatttca

SEQ ID NO: 219911 - DNA, 15 bp, Homo sapiens
attaataagtatttc

SEQ ID NO: 219912 - DNA, 15 bp, Homo sapiens
tattaataagtattt

SEQ ID NO: 219913 - DNA, 15 bp, Homo sapiens
ctattaataagtatt

SEQ ID NO: 219914 - DNA, 15 bp, Homo sapiens
gctattaataagtat

SEQ ID NO: 219915 - DNA, 15 bp, Homo sapiens
tgctattaataagta

SEQ ID NO: 219916 - DNA, 15 bp, Homo sapiens
gtgctattaataagt

SEQ ID NO: 219917 - DNA, 15 bp, Homo sapiens
tgtgctattaataag

SEQ ID NO: 219918 - DNA, 15 bp, Homo sapiens
ctgtgctattaataa

SEQ ID NO: 219919 - DNA, 15 bp, Homo sapiens
tctgtgctattaata

SEQ ID NO: 219920 - DNA, 15 bp, Homo sapiens
gtctgtgctattaat

SEQ ID NO: 219921 - DNA, 15 bp, Homo sapiens
agtctgtgctattaa

SEQ ID NO: 219922 - DNA, 15 bp, Homo sapiens
aagtctgtgctatta

SEQ ID NO: 219923 - DNA, 15 bp, Homo sapiens
taagtctgtgctatt

SEQ ID NO: 219924 - DNA, 15 bp, Homo sapiens
ctaagtctgtgctat

SEQ ID NO: 219925 - DNA, 15 bp, Homo sapiens
actaagtctgtgcta

SEQ ID NO: 219926 - DNA, 15 bp, Homo sapiens
aactaagtctgtgct

SEQ ID NO: 219927 - DNA, 15 bp, Homo sapiens
aaactaagtctgtgc

SEQ ID NO: 219928 - DNA, 15 bp, Homo sapiens
aaaactaagtctgtg

SEQ ID NO: 219929 - DNA, 15 bp, Homo sapiens
taaaactaagtctgt

SEQ ID NO: 219930 - DNA, 15 bp, Homo sapiens
gtaaaactaagtctg

SEQ ID NO: 219931 - DNA, 15 bp, Homo sapiens
tgtaaaactaagtct

SEQ ID NO: 219932 - DNA, 15 bp, Homo sapiens
atgtaaaactaagtc

SEQ ID NO: 219933 - DNA, 15 bp, Homo sapiens
gatgtaaaactaagt

SEQ ID NO: 219934 - DNA, 15 bp, Homo sapiens
tgatgtaaaactaag

SEQ ID NO: 219935 - DNA, 15 bp, Homo sapiens
ttgatgtaaaactaa

SEQ ID NO: 219936 - DNA, 15 bp, Homo sapiens
tttgatgtaaaacta

SEQ ID NO: 219937 - DNA, 15 bp, Homo sapiens
ttttgatgtaaaact

SEQ ID NO: 219938 - DNA, 15 bp, Homo sapiens
tttttgatgtaaaac

SEQ ID NO: 219939 - DNA, 15 bp, Homo sapiens
ttttttgatgtaaaa

SEQ ID NO: 219940 - DNA, 15 bp, Homo sapiens
attttttgatgtaaa

SEQ ID NO: 219941 - DNA, 15 bp, Homo sapiens
aattttttgatgtaa

SEQ ID NO: 219942 - DNA, 15 bp, Homo sapiens
gtaattttttgatgt

SEQ ID NO: 219943 - DNA, 15 bp, Homo sapiens
agtaattttttgatg

SEQ ID NO: 219944 - DNA, 15 bp, Homo sapiens
tagtaattttttgat

SEQ ID NO: 219945 - DNA, 15 bp, Homo sapiens
gtagtaattttttga

SEQ ID NO: 219946 - DNA, 15 bp, Homo sapiens
ggtagtaattttttg

SEQ ID NO: 219947 - DNA, 15 bp, Homo sapiens
tggtagtaatttttt

SEQ ID NO: 219948 - DNA, 15 bp, Homo sapiens
ctggtagtaattttt

SEQ ID NO: 219949 - DNA, 15 bp, Homo sapiens
gctggtagtaatttt

SEQ ID NO: 219950 - DNA, 15 bp, Homo sapiens
tgctggtagtaattt

SEQ ID NO: 219951 - DNA, 15 bp, Homo sapiens
ttgctggtagtaatt

SEQ ID NO: 219952 - DNA, 15 bp, Homo sapiens
attgctggtagtaat

SEQ ID NO: 219953 - DNA, 15 bp, Homo sapiens
aattgctggtagtaa

SEQ ID NO: 219954 - DNA, 15 bp, Homo sapiens
aaattgctggtagta

SEQ ID NO: 219955 - DNA, 15 bp, Homo sapiens
caaattgctggtagt

SEQ ID NO: 219956 - DNA, 15 bp, Homo sapiens
gcaaattgctggtag

SEQ ID NO: 219957 - DNA, 15 bp, Homo sapiens
tgcaaattgctggta

SEQ ID NO: 219958 - DNA, 15 bp, Homo sapiens
ttgcaaattgctggt

SEQ ID NO: 219959 - DNA, 15 bp, Homo sapiens
tttgcaaattgctgg

SEQ ID NO: 219960 - DNA, 15 bp, Homo sapiens
ctttgcaaattgctg

SEQ ID NO: 219961 - DNA, 15 bp, Homo sapiens
actttgcaaattgct

SEQ ID NO: 219962 - DNA, 15 bp, Homo sapiens
tactttgcaaattgc

SEQ ID NO: 219963 - DNA, 15 bp, Homo sapiens
ctactttgcaaattg

SEQ ID NO: 219964 - DNA, 15 bp, Homo sapiens
tctactttgcaaatt

SEQ ID NO: 219965 - DNA, 15 bp, Homo sapiens
atctactttgcaaat

SEQ ID NO: 219966 - DNA, 15 bp, Homo sapiens
tatctactttgcaaa

SEQ ID NO: 219967 - DNA, 15 bp, Homo sapiens
ttatctactttgcaa

SEQ ID NO: 219968 - DNA, 15 bp, Homo sapiens
attatctactttgca

SEQ ID NO: 219969 - DNA, 15 bp, Homo sapiens
aattatctactttgc

SEQ ID NO: 219970 - DNA, 15 bp, Homo sapiens
aaattatctactttg

SEQ ID NO: 219971 - DNA, 15 bp, Homo sapiens
taaattatctacttt

SEQ ID NO: 219972 - DNA, 15 bp, Homo sapiens
ttaaattatctactt

SEQ ID NO: 219973 - DNA, 15 bp, Homo sapiens
tttaaattatctact

SEQ ID NO: 219974 - DNA, 15 bp, Homo sapiens
ttttaaattatctac

SEQ ID NO: 219975 - DNA, 15 bp, Homo sapiens
tttttaaattatcta

SEQ ID NO: 219976 - DNA, 15 bp, Homo sapiens
atttttaaattatct

SEQ ID NO: 219977 - DNA, 15 bp, Homo sapiens
tatttttaaattatc

SEQ ID NO: 219978 - DNA, 15 bp, Homo sapiens
gtatttttaaattat

SEQ ID NO: 219979 - DNA, 15 bp, Homo sapiens
tgtatttttaaatta

SEQ ID NO: 219980 - DNA, 15 bp, Homo sapiens
ctgtatttttaaatt

SEQ ID NO: 219981 - DNA, 15 bp, Homo sapiens
tctgtatttttaaat

SEQ ID NO: 219982 - DNA, 15 bp, Homo sapiens
gttctgtatttttaa

SEQ ID NO: 219983 - DNA, 15 bp, Homo sapiens
agttctgtattttta

SEQ ID NO: 219984 - DNA, 15 bp, Homo sapiens
tagttctgtattttt

SEQ ID NO: 219985 - DNA, 15 bp, Homo sapiens
ttagttctgtatttt

SEQ ID NO: 219986 - DNA, 15 bp, Homo sapiens
gttagttctgtattt

SEQ ID NO: 219987 - DNA, 15 bp, Homo sapiens
agttagttctgtatt

SEQ ID NO: 219988 - DNA, 15 bp, Homo sapiens
cagttagttctgtat

SEQ ID NO: 219989 - DNA, 15 bp, Homo sapiens
tcagttagttctgta

SEQ ID NO: 219990 - DNA, 15 bp, Homo sapiens
ttcagttagttctgt

SEQ ID NO: 219991 - DNA, 15 bp, Homo sapiens
tttcagttagttctg

SEQ ID NO: 219992 - DNA, 15 bp, Homo sapiens
atttcagttagttct

SEQ ID NO: 219993 - DNA, 15 bp, Homo sapiens
gatttcagttagttc

SEQ ID NO: 219994 - DNA, 15 bp, Homo sapiens
ggatttcagttagtt

SEQ ID NO: 219995 - DNA, 15 bp, Homo sapiens
tggatttcagttagt

SEQ ID NO: 219996 - DNA, 15 bp, Homo sapiens
atggatttcagttag

SEQ ID NO: 219997 - DNA, 15 bp, Homo sapiens
aatggatttcagtta

SEQ ID NO: 219998 - DNA, 15 bp, Homo sapiens
taatggatttcagtt

SEQ ID NO: 219999 - DNA, 15 bp, Homo sapiens
ataatggatttcagt

SEQ ID NO: 220000 - DNA, 15 bp, Homo sapiens
aataatggatttcag

SEQ ID NO: 220001 - DNA, 15 bp, Homo sapiens
aaataatggatttca

SEQ ID NO: 220002 - DNA, 15 bp, Homo sapiens
gaaataatggatttc

SEQ ID NO: 220003 - DNA, 15 bp, Homo sapiens
tgaaataatggattt

SEQ ID NO: 220004 - DNA, 15 bp, Homo sapiens
ctgaaataatggatt

SEQ ID NO: 220005 - DNA, 15 bp, Homo sapiens
actgaaataatggat

SEQ ID NO: 220006 - DNA, 15 bp, Homo sapiens
aactgaaataatgga

SEQ ID NO: 220007 - DNA, 15 bp, Homo sapiens
aaactgaaataatgg

SEQ ID NO: 220008 - DNA, 15 bp, Homo sapiens
taaactgaaataatg

SEQ ID NO: 220009 - DNA, 15 bp, Homo sapiens
ttaaactgaaataat

SEQ ID NO: 220010 - DNA, 15 bp, Homo sapiens
cttaaactgaaataa

SEQ ID NO: 220011 - DNA, 15 bp, Homo sapiens
tcttaaactgaaata

SEQ ID NO: 220012 - DNA, 15 bp, Homo sapiens
atcttaaactgaaat

SEQ ID NO: 220013 - DNA, 15 bp, Homo sapiens
catcttaaactgaaa

SEQ ID NO: 220014 - DNA, 15 bp, Homo sapiens
tcatcttaaactgaa

SEQ ID NO: 220015 - DNA, 15 bp, Homo sapiens
ttcatcttaaactga

SEQ ID NO: 220016 - DNA, 15 bp, Homo sapiens
gttcatcttaaactg

SEQ ID NO: 220017 - DNA, 15 bp, Homo sapiens
tgttcatcttaaact

SEQ ID NO: 220018 - DNA, 15 bp, Homo sapiens
ctgttcatcttaaac

SEQ ID NO: 220019 - DNA, 15 bp, Homo sapiens
tctgttcatcttaaa

SEQ ID NO: 220020 - DNA, 15 bp, Homo sapiens
atctgttcatcttaa

SEQ ID NO: 220021 - DNA, 15 bp, Homo sapiens
aatctgttcatctta

SEQ ID NO: 220022 - DNA, 15 bp, Homo sapiens
caatctgttcatctt

SEQ ID NO: 220023 - DNA, 15 bp, Homo sapiens
ccaatctgttcatct

SEQ ID NO: 220024 - DNA, 15 bp, Homo sapiens
cccaatctgttcatc

SEQ ID NO: 220025 - DNA, 15 bp, Homo sapiens
acccaatctgttcat

SEQ ID NO: 220026 - DNA, 15 bp, Homo sapiens
cacccaatctgttca

SEQ ID NO: 220027 - DNA, 15 bp, Homo sapiens
tcacccaatctgttc

SEQ ID NO: 220028 - DNA, 15 bp, Homo sapiens
gtcacccaatctgtt

SEQ ID NO: 220029 - DNA, 15 bp, Homo sapiens
agtcacccaatctgt

SEQ ID NO: 220030 - DNA, 15 bp, Homo sapiens
aagtcacccaatctg

SEQ ID NO: 220031 - DNA, 15 bp, Homo sapiens
aaagtcacccaatct

SEQ ID NO: 220032 - DNA, 15 bp, Homo sapiens
caaagtcacccaatc

SEQ ID NO: 220033 - DNA, 15 bp, Homo sapiens
acaaagtcacccaat

SEQ ID NO: 220034 - DNA, 15 bp, Homo sapiens
aacaaagtcacccaa

SEQ ID NO: 220035 - DNA, 15 bp, Homo sapiens
taacaaagtcaccca

SEQ ID NO: 220036 - DNA, 15 bp, Homo sapiens
ataacaaagtcaccc

SEQ ID NO: 220037 - DNA, 15 bp, Homo sapiens
tataacaaagtcacc

SEQ ID NO: 220038 - DNA, 15 bp, Homo sapiens
atataacaaagtcac

SEQ ID NO: 220039 - DNA, 15 bp, Homo sapiens
gatataacaaagtca

SEQ ID NO: 220040 - DNA, 15 bp, Homo sapiens
agatataacaaagtc

SEQ ID NO: 220041 - DNA, 15 bp, Homo sapiens
aagatataacaaagt

SEQ ID NO: 220042 - DNA, 15 bp, Homo sapiens
caagatataacaaag

SEQ ID NO: 220043 - DNA, 15 bp, Homo sapiens
gcaagatataacaaa

SEQ ID NO: 220044 - DNA, 15 bp, Homo sapiens
agcaagatataacaa

SEQ ID NO: 220045 - DNA, 15 bp, Homo sapiens
gagcaagatataaca

SEQ ID NO: 220046 - DNA, 15 bp, Homo sapiens
agagcaagatataac

SEQ ID NO: 220047 - DNA, 15 bp, Homo sapiens
cagagcaagatataa

SEQ ID NO: 220048 - DNA, 15 bp, Homo sapiens
tcagagcaagatata

SEQ ID NO: 220049 - DNA, 15 bp, Homo sapiens
gtcagagcaagatat

SEQ ID NO: 220050 - DNA, 15 bp, Homo sapiens
tgtcagagcaagata

SEQ ID NO: 220051 - DNA, 15 bp, Homo sapiens
atgtcagagcaagat

SEQ ID NO: 220052 - DNA, 15 bp, Homo sapiens
catgtcagagcaaga

SEQ ID NO: 220053 - DNA, 15 bp, Homo sapiens
acatgtcagagcaag

SEQ ID NO: 220054 - DNA, 15 bp, Homo sapiens
aacatgtcagagcaa

SEQ ID NO: 220055 - DNA, 15 bp, Homo sapiens
aaacatgtcagagca

SEQ ID NO: 220056 - DNA, 15 bp, Homo sapiens
aaaacatgtcagagc

SEQ ID NO: 220057 - DNA, 15 bp, Homo sapiens
caaaacatgtcagag

SEQ ID NO: 220058 - DNA, 15 bp, Homo sapiens
acaaaacatgtcaga

SEQ ID NO: 220059 - DNA, 15 bp, Homo sapiens
tacaaaacatgtcag

SEQ ID NO: 220060 - DNA, 15 bp, Homo sapiens
ttacaaaacatgtca

SEQ ID NO: 220061 - DNA, 15 bp, Homo sapiens
gttacaaaacatgtc

SEQ ID NO: 220062 - DNA, 15 bp, Homo sapiens
tgttacaaaacatgt

SEQ ID NO: 220063 - DNA, 15 bp, Homo sapiens
atgttacaaaacatg

SEQ ID NO: 220064 - DNA, 15 bp, Homo sapiens
aatgttacaaaacat

SEQ ID NO: 220065 - DNA, 15 bp, Homo sapiens
taatgttacaaaaca

SEQ ID NO: 220066 - DNA, 15 bp, Homo sapiens
ttaatgttacaaaac

SEQ ID NO: 220067 - DNA, 15 bp, Homo sapiens
tttaatgttacaaaa

SEQ ID NO: 220068 - DNA, 15 bp, Homo sapiens
atttaatgttacaaa

SEQ ID NO: 220069 - DNA, 15 bp, Homo sapiens
tatttaatgttacaa

SEQ ID NO: 220070 - DNA, 15 bp, Homo sapiens
gtatttaatgttaca

SEQ ID NO: 220071 - DNA, 15 bp, Homo sapiens
tgtatttaatgttac

SEQ ID NO: 220072 - DNA, 15 bp, Homo sapiens
atgtatttaatgtta

SEQ ID NO: 220073 - DNA, 15 bp, Homo sapiens
tatgtatttaatgtt

SEQ ID NO: 220074 - DNA, 15 bp, Homo sapiens
ctatgtatttaatgt

SEQ ID NO: 220075 - DNA, 15 bp, Homo sapiens
actatgtatttaatg

SEQ ID NO: 220076 - DNA, 15 bp, Homo sapiens
tactatgtatttaat

SEQ ID NO: 220077 - DNA, 15 bp, Homo sapiens
atactatgtatttaa

SEQ ID NO: 220078 - DNA, 15 bp, Homo sapiens
aatactatgtattta

SEQ ID NO: 220079 - DNA, 15 bp, Homo sapiens
aaatactatgtattt

SEQ ID NO: 220080 - DNA, 15 bp, Homo sapiens
taaatactatgtatt

SEQ ID NO: 220081 - DNA, 15 bp, Homo sapiens
ttaaatactatgtat

SEQ ID NO: 220082 - DNA, 15 bp, Homo sapiens
attaaatactatgta

SEQ ID NO: 220083 - DNA, 15 bp, Homo sapiens
aattaaatactatgt

SEQ ID NO: 220084 - DNA, 15 bp, Homo sapiens
gaattaaatactatg

SEQ ID NO: 220085 - DNA, 15 bp, Homo sapiens
agaattaaatactat

SEQ ID NO: 220086 - DNA, 15 bp, Homo sapiens
cagaattaaatacta

SEQ ID NO: 220087 - DNA, 15 bp, Homo sapiens
tcagaattaaatact

SEQ ID NO: 220088 - DNA, 15 bp, Homo sapiens
ctcagaattaaatac

SEQ ID NO: 220089 - DNA, 15 bp, Homo sapiens
tctcagaattaaata

SEQ ID NO: 220090 - DNA, 15 bp, Homo sapiens
ctctcagaattaaat

SEQ ID NO: 220091 - DNA, 15 bp, Homo sapiens
gctctcagaattaaa

SEQ ID NO: 220092 - DNA, 15 bp, Homo sapiens
tgctctcagaattaa

SEQ ID NO: 220093 - DNA, 15 bp, Homo sapiens
atgctctcagaatta

SEQ ID NO: 220094 - DNA, 15 bp, Homo sapiens
aatgctctcagaatt

SEQ ID NO: 220095 - DNA, 15 bp, Homo sapiens
aaatgctctcagaat

SEQ ID NO: 220096 - DNA, 15 bp, Homo sapiens
gaaatgctctcagaa

SEQ ID NO: 220097 - DNA, 15 bp, Homo sapiens
agaaatgctctcaga

SEQ ID NO: 220098 - DNA, 15 bp, Homo sapiens
gagaaatgctctcag

SEQ ID NO: 220099 - DNA, 15 bp, Homo sapiens
ggagaaatgctctca

SEQ ID NO: 220100 - DNA, 15 bp, Homo sapiens
gggagaaatgctctc

SEQ ID NO: 220101 - DNA, 15 bp, Homo sapiens
tgggagaaatgctct

SEQ ID NO: 220102 - DNA, 15 bp, Homo sapiens
atgggagaaatgctc

SEQ ID NO: 220103 - DNA, 15 bp, Homo sapiens
tatgggagaaatgct

SEQ ID NO: 220104 - DNA, 15 bp, Homo sapiens
ttatgggagaaatgc

SEQ ID NO: 220105 - DNA, 15 bp, Homo sapiens
attatgggagaaatg

SEQ ID NO: 220106 - DNA, 15 bp, Homo sapiens
aattatgggagaaat

SEQ ID NO: 220107 - DNA, 15 bp, Homo sapiens
aaattatgggagaaa

SEQ ID NO: 220108 - DNA, 15 bp, Homo sapiens
taaattatgggagaa

SEQ ID NO: 220109 - DNA, 15 bp, Homo sapiens
ataaattatgggaga

SEQ ID NO: 220110 - DNA, 15 bp, Homo sapiens
aataaattatgggag

SEQ ID NO: 220111 - DNA, 15 bp, Homo sapiens
taataaattatggga

SEQ ID NO: 220112 - DNA, 15 bp, Homo sapiens
ataataaattatggg

SEQ ID NO: 220113 - DNA, 15 bp, Homo sapiens
cataataaattatgg

SEQ ID NO: 220114 - DNA, 15 bp, Homo sapiens
gcataataaattatg

SEQ ID NO: 220115 - DNA, 15 bp, Homo sapiens
agcataataaattat

SEQ ID NO: 220116 - DNA, 15 bp, Homo sapiens
gagcataataaatta

SEQ ID NO: 220117 - DNA, 15 bp, Homo sapiens
tgagcataataaatt

SEQ ID NO: 220118 - DNA, 15 bp, Homo sapiens
ttgagcataataaat

SEQ ID NO: 220119 - DNA, 15 bp, Homo sapiens
cttgagcataataaa

SEQ ID NO: 220120 - DNA, 15 bp, Homo sapiens
gcttgagcataataa

SEQ ID NO: 220121 - DNA, 15 bp, Homo sapiens
tgcttgagcataata

SEQ ID NO: 220122 - DNA, 15 bp, Homo sapiens
atgcttgagcataat

SEQ ID NO: 220123 - DNA, 15 bp, Homo sapiens
aatgcttgagcataa

SEQ ID NO: 220124 - DNA, 15 bp, Homo sapiens
aaatgcttgagcata

SEQ ID NO: 220125 - DNA, 15 bp, Homo sapiens
taaatgcttgagcat

SEQ ID NO: 220126 - DNA, 15 bp, Homo sapiens
ataaatgcttgagca

SEQ ID NO: 220127 - DNA, 15 bp, Homo sapiens
aataaatgcttgagc

SEQ ID NO: 220128 - DNA, 15 bp, Homo sapiens
caataaatgcttgag

SEQ ID NO: 220129 - DNA, 15 bp, Homo sapiens
tcaataaatgcttga

SEQ ID NO: 220130 - DNA, 15 bp, Homo sapiens
ctcaataaatgcttg

SEQ ID NO: 220131 - DNA, 15 bp, Homo sapiens
actcaataaatgctt

SEQ ID NO: 220132 - DNA, 15 bp, Homo sapiens
cactcaataaatgct

SEQ ID NO: 220133 - DNA, 15 bp, Homo sapiens
gcactcaataaatgc

SEQ ID NO: 220134 - DNA, 15 bp, Homo sapiens
agcactcaataaatg

SEQ ID NO: 220135 - DNA, 15 bp, Homo sapiens
aagcactcaataaat

SEQ ID NO: 220136 - DNA, 15 bp, Homo sapiens
aaagcactcaataaa

SEQ ID NO: 220137 - DNA, 15 bp, Homo sapiens
gaaagcactcaataa

SEQ ID NO: 220138 - DNA, 15 bp, Homo sapiens
agaaagcactcaata

SEQ ID NO: 220139 - DNA, 15 bp, Homo sapiens
tagaaagcactcaat

SEQ ID NO: 220140 - DNA, 15 bp, Homo sapiens
atagaaagcactcaa

SEQ ID NO: 220141 - DNA, 15 bp, Homo sapiens
tatagaaagcactca

SEQ ID NO: 220142 - DNA, 15 bp, Homo sapiens
atatagaaagcactc

SEQ ID NO: 220143 - DNA, 15 bp, Homo sapiens
tatatagaaagcact

SEQ ID NO: 220144 - DNA, 15 bp, Homo sapiens
atatatagaaagcac

SEQ ID NO: 220145 - DNA, 15 bp, Homo sapiens
catatatagaaagca

SEQ ID NO: 220146 - DNA, 15 bp, Homo sapiens
acatatatagaaagc

SEQ ID NO: 220147 - DNA, 15 bp, Homo sapiens
gacatatatagaaag

SEQ ID NO: 220148 - DNA, 15 bp, Homo sapiens
agacatatatagaaa

SEQ ID NO: 220149 - DNA, 15 bp, Homo sapiens
tagacatatatagaa

SEQ ID NO: 220150 - DNA, 15 bp, Homo sapiens
ctagacatatataga

SEQ ID NO: 220151 - DNA, 15 bp, Homo sapiens
cctagacatatatag

SEQ ID NO: 220152 - DNA, 15 bp, Homo sapiens
gcctagacatatata

SEQ ID NO: 220153 - DNA, 15 bp, Homo sapiens
tgcctagacatatat

SEQ ID NO: 220154 - DNA, 15 bp, Homo sapiens
ctgcctagacatata

SEQ ID NO: 220155 - DNA, 15 bp, Homo sapiens
cctgcctagacatat

SEQ ID NO: 220156 - DNA, 15 bp, Homo sapiens
acctgcctagacata

SEQ ID NO: 220157 - DNA, 15 bp, Homo sapiens
tacctgcctagacat

SEQ ID NO: 220158 - DNA, 15 bp, Homo sapiens
gtacctgcctagaca

SEQ ID NO: 220159 - DNA, 15 bp, Homo sapiens
tgtacctgcctagac

SEQ ID NO: 220160 - DNA, 15 bp, Homo sapiens
ctgtacctgcctaga

SEQ ID NO: 220161 - DNA, 15 bp, Homo sapiens
actgtacctgcctag

SEQ ID NO: 220162 - DNA, 15 bp, Homo sapiens
tactgtacctgccta

SEQ ID NO: 220163 - DNA, 15 bp, Homo sapiens
ctactgtacctgcct

SEQ ID NO: 220164 - DNA, 15 bp, Homo sapiens
tctactgtacctgcc

SEQ ID NO: 220165 - DNA, 15 bp, Homo sapiens
ctctactgtacctgc

SEQ ID NO: 220166 - DNA, 15 bp, Homo sapiens
cctctactgtacctg

SEQ ID NO: 220167 - DNA, 15 bp, Homo sapiens
tcctctactgtacct

SEQ ID NO: 220168 - DNA, 15 bp, Homo sapiens
atcctctactgtacc

SEQ ID NO: 220169 - DNA, 15 bp, Homo sapiens
aatcctctactgtac

SEQ ID NO: 220170 - DNA, 15 bp, Homo sapiens
aaatcctctactgta

SEQ ID NO: 220171 - DNA, 15 bp, Homo sapiens
gaaatcctctactgt

SEQ ID NO: 220172 - DNA, 15 bp, Homo sapiens
tgaaatcctctactg

SEQ ID NO: 220173 - DNA, 15 bp, Homo sapiens
ctgaaatcctctact

SEQ ID NO: 220174 - DNA, 15 bp, Homo sapiens
tctgaaatcctctac

SEQ ID NO: 220175 - DNA, 15 bp, Homo sapiens
atctgaaatcctcta

SEQ ID NO: 220176 - DNA, 15 bp, Homo sapiens
catctgaaatcctct

SEQ ID NO: 220177 - DNA, 15 bp, Homo sapiens
tcatctgaaatcctc

SEQ ID NO: 220178 - DNA, 15 bp, Homo sapiens
atcatctgaaatcct

SEQ ID NO: 220179 - DNA, 15 bp, Homo sapiens
aatcatctgaaatcc

SEQ ID NO: 220180 - DNA, 15 bp, Homo sapiens
taatcatctgaaatc

SEQ ID NO: 220181 - DNA, 15 bp, Homo sapiens
ttaatcatctgaaat

SEQ ID NO: 220182 - DNA, 15 bp, Homo sapiens
cttaatcatctgaaa

SEQ ID NO: 220183 - DNA, 15 bp, Homo sapiens
tcttaatcatctgaa

SEQ ID NO: 220184 - DNA, 15 bp, Homo sapiens
gtcttaatcatctga

SEQ ID NO: 220185 - DNA, 15 bp, Homo sapiens
ggtcttaatcatctg

SEQ ID NO: 220186 - DNA, 15 bp, Homo sapiens
aggtcttaatcatct

SEQ ID NO: 220187 - DNA, 15 bp, Homo sapiens
caggtcttaatcatc

SEQ ID NO: 220188 - DNA, 15 bp, Homo sapiens
tcaggtcttaatcat

SEQ ID NO: 220189 - DNA, 15 bp, Homo sapiens
ttcaggtcttaatca

SEQ ID NO: 220190 - DNA, 15 bp, Homo sapiens
gttcaggtcttaatc

SEQ ID NO: 220191 - DNA, 15 bp, Homo sapiens
ggttcaggtcttaat

SEQ ID NO: 220192 - DNA, 15 bp, Homo sapiens
aggttcaggtcttaa

SEQ ID NO: 220193 - DNA, 15 bp, Homo sapiens
aaggttcaggtctta

SEQ ID NO: 220194 - DNA, 15 bp, Homo sapiens
taaggttcaggtctt

SEQ ID NO: 220195 - DNA, 15 bp, Homo sapiens
gtaaggttcaggtct

SEQ ID NO: 220196 - DNA, 15 bp, Homo sapiens
ggtaaggttcaggtc

SEQ ID NO: 220197 - DNA, 15 bp, Homo sapiens
tggtaaggttcaggt

SEQ ID NO: 220198 - DNA, 15 bp, Homo sapiens
atggtaaggttcagg

SEQ ID NO: 220199 - DNA, 15 bp, Homo sapiens
catggtaaggttcag

SEQ ID NO: 220200 - DNA, 15 bp, Homo sapiens
gcatggtaaggttca

SEQ ID NO: 220201 - DNA, 15 bp, Homo sapiens
tgcatggtaaggttc

SEQ ID NO: 220202 - DNA, 15 bp, Homo sapiens
ttgcatggtaaggtt

SEQ ID NO: 220203 - DNA, 15 bp, Homo sapiens
cttgcatggtaaggt

SEQ ID NO: 220204 - DNA, 15 bp, Homo sapiens
tcttgcatggtaagg

SEQ ID NO: 220205 - DNA, 15 bp, Homo sapiens
ttcttgcatggtaag

SEQ ID NO: 220206 - DNA, 15 bp, Homo sapiens
gttcttgcatggtaa

SEQ ID NO: 220207 - DNA, 15 bp, Homo sapiens
agttcttgcatggta

SEQ ID NO: 220208 - DNA, 15 bp, Homo sapiens
gagttcttgcatggt

SEQ ID NO: 220209 - DNA, 15 bp, Homo sapiens
tgagttcttgcatgg

SEQ ID NO: 220210 - DNA, 15 bp, Homo sapiens
gtgagttcttgcatg

SEQ ID NO: 220211 - DNA, 15 bp, Homo sapiens
tgtgagttcttgcat

SEQ ID NO: 220212 - DNA, 15 bp, Homo sapiens
ttgtgagttcttgca

SEQ ID NO: 220213 - DNA, 15 bp, Homo sapiens
attgtgagttcttgc

SEQ ID NO: 220214 - DNA, 15 bp, Homo sapiens
aattgtgagttcttg

SEQ ID NO: 220215 - DNA, 15 bp, Homo sapiens
aaattgtgagttctt

SEQ ID NO: 220216 - DNA, 15 bp, Homo sapiens
taaattgtgagttct

SEQ ID NO: 220217 - DNA, 15 bp, Homo sapiens
ttaaattgtgagttc

SEQ ID NO: 220218 - DNA, 15 bp, Homo sapiens
attaaattgtgagtt

SEQ ID NO: 220219 - DNA, 15 bp, Homo sapiens
cattaaattgtgagt

SEQ ID NO: 220220 - DNA, 15 bp, Homo sapiens
ccattaaattgtgag

SEQ ID NO: 220221 - DNA, 15 bp, Homo sapiens
tccattaaattgtga

SEQ ID NO: 220222 - DNA, 15 bp, Homo sapiens
ctccattaaattgtg

SEQ ID NO: 220223 - DNA, 15 bp, Homo sapiens
cctccattaaattgt

SEQ ID NO: 220224 - DNA, 15 bp, Homo sapiens
ccctccattaaattg

SEQ ID NO: 220225 - DNA, 15 bp, Homo sapiens
cccctccattaaatt

SEQ ID NO: 220226 - DNA, 15 bp, Homo sapiens
tcccctccattaaat

SEQ ID NO: 220227 - DNA, 15 bp, Homo sapiens
gtcccctccattaaa

SEQ ID NO: 220228 - DNA, 15 bp, Homo sapiens
tgtcccctccattaa

SEQ ID NO: 220229 - DNA, 15 bp, Homo sapiens
ctgtcccctccatta

SEQ ID NO: 220230 - DNA, 15 bp, Homo sapiens
tctgtcccctccatt

SEQ ID NO: 220231 - DNA, 15 bp, Homo sapiens
atctgtcccctccat

SEQ ID NO: 220232 - DNA, 15 bp, Homo sapiens
catctgtcccctcca

SEQ ID NO: 220233 - DNA, 15 bp, Homo sapiens
gcatctgtcccctcc

SEQ ID NO: 220234 - DNA, 15 bp, Homo sapiens
tgcatctgtcccctc

SEQ ID NO: 220235 - DNA, 15 bp, Homo sapiens
atgcatctgtcccct

SEQ ID NO: 220236 - DNA, 15 bp, Homo sapiens
catgcatctgtcccc

SEQ ID NO: 220237 - DNA, 15 bp, Homo sapiens
ccatgcatctgtccc

SEQ ID NO: 220238 - DNA, 15 bp, Homo sapiens
accatgcatctgtcc

SEQ ID NO: 220239 - DNA, 15 bp, Homo sapiens
gaccatgcatctgtc

SEQ ID NO: 220240 - DNA, 15 bp, Homo sapiens
tgaccatgcatctgt

SEQ ID NO: 220241 - DNA, 15 bp, Homo sapiens
ttgaccatgcatctg

SEQ ID NO: 220242 - DNA, 15 bp, Homo sapiens
tttgaccatgcatct

SEQ ID NO: 220243 - DNA, 15 bp, Homo sapiens
ttttgaccatgcatc

SEQ ID NO: 220244 - DNA, 15 bp, Homo sapiens
attttgaccatgcat

SEQ ID NO: 220245 - DNA, 15 bp, Homo sapiens
tattttgaccatgca

SEQ ID NO: 220246 - DNA, 15 bp, Homo sapiens
atattttgaccatgc

SEQ ID NO: 220247 - DNA, 15 bp, Homo sapiens
tatattttgaccatg

SEQ ID NO: 220248 - DNA, 15 bp, Homo sapiens
atatattttgaccat

SEQ ID NO: 220249 - DNA, 15 bp, Homo sapiens
catatattttgacca

SEQ ID NO: 220250 - DNA, 15 bp, Homo sapiens
gcatatattttgacc

SEQ ID NO: 220251 - DNA, 15 bp, Homo sapiens
tgcatatattttgac

SEQ ID NO: 220252 - DNA, 15 bp, Homo sapiens
gtgcatatattttga

SEQ ID NO: 220253 - DNA, 15 bp, Homo sapiens
tgtgcatatattttg

SEQ ID NO: 220254 - DNA, 15 bp, Homo sapiens
atgtgcatatatttt

SEQ ID NO: 220255 - DNA, 15 bp, Homo sapiens
aatgtgcatatattt

SEQ ID NO: 220256 - DNA, 15 bp, Homo sapiens
taatgtgcatatatt

SEQ ID NO: 220257 - DNA, 15 bp, Homo sapiens
ttaatgtgcatatat

SEQ ID NO: 220258 - DNA, 15 bp, Homo sapiens
gttaatgtgcatata

SEQ ID NO: 220259 - DNA, 15 bp, Homo sapiens
tgttaatgtgcatat

SEQ ID NO: 220260 - DNA, 15 bp, Homo sapiens
gtgttaatgtgcata

SEQ ID NO: 220261 - DNA, 15 bp, Homo sapiens
tgtgttaatgtgcat

SEQ ID NO: 220262 - DNA, 15 bp, Homo sapiens
ctgtgttaatgtgca

SEQ ID NO: 220263 - DNA, 15 bp, Homo sapiens
actgtgttaatgtgc

SEQ ID NO: 220264 - DNA, 15 bp, Homo sapiens
tactgtgttaatgtg

SEQ ID NO: 220265 - DNA, 15 bp, Homo sapiens
gtactgtgttaatgt

SEQ ID NO: 220266 - DNA, 15 bp, Homo sapiens
tgtactgtgttaatg

SEQ ID NO: 220267 - DNA, 15 bp, Homo sapiens
ttgtactgtgttaat

SEQ ID NO: 220268 - DNA, 15 bp, Homo sapiens
cttgtactgtgttaa

SEQ ID NO: 220269 - DNA, 15 bp, Homo sapiens
gcttgtactgtgtta

SEQ ID NO: 220270 - DNA, 15 bp, Homo sapiens
agcttgtactgtgtt

SEQ ID NO: 220271 - DNA, 15 bp, Homo sapiens
gagcttgtactgtgt

SEQ ID NO: 220272 - DNA, 15 bp, Homo sapiens
agagcttgtactgtg

SEQ ID NO: 220273 - DNA, 15 bp, Homo sapiens
cagagcttgtactgt

SEQ ID NO: 220274 - DNA, 15 bp, Homo sapiens
acagagcttgtactg

SEQ ID NO: 220275 - DNA, 15 bp, Homo sapiens
aacagagcttgtact

SEQ ID NO: 220276 - DNA, 15 bp, Homo sapiens
taacagagcttgtac

SEQ ID NO: 220277 - DNA, 15 bp, Homo sapiens
ctaacagagcttgta

SEQ ID NO: 220278 - DNA, 15 bp, Homo sapiens
tctaacagagcttgt

SEQ ID NO: 220279 - DNA, 15 bp, Homo sapiens
ctctaacagagcttg

SEQ ID NO: 220280 - DNA, 15 bp, Homo sapiens
cctctaacagagctt

SEQ ID NO: 220281 - DNA, 15 bp, Homo sapiens
tcctctaacagagct

SEQ ID NO: 220282 - DNA, 15 bp, Homo sapiens
ttcctctaacagagc

SEQ ID NO: 220283 - DNA, 15 bp, Homo sapiens
attcctctaacagag

SEQ ID NO: 220284 - DNA, 15 bp, Homo sapiens
tattcctctaacaga

SEQ ID NO: 220285 - DNA, 15 bp, Homo sapiens
ctattcctctaacag

SEQ ID NO: 220286 - DNA, 15 bp, Homo sapiens
cctattcctctaaca

SEQ ID NO: 220287 - DNA, 15 bp, Homo sapiens
tcctattcctctaac

SEQ ID NO: 220288 - DNA, 15 bp, Homo sapiens
ttcctattcctctaa

SEQ ID NO: 220289 - DNA, 15 bp, Homo sapiens
cttcctattcctcta

SEQ ID NO: 220290 - DNA, 15 bp, Homo sapiens
acttcctattcctct

SEQ ID NO: 220291 - DNA, 15 bp, Homo sapiens
cacttcctattcctc

SEQ ID NO: 220292 - DNA, 15 bp, Homo sapiens
gcacttcctattcct

SEQ ID NO: 220293 - DNA, 15 bp, Homo sapiens
agcacttcctattcc

SEQ ID NO: 220294 - DNA, 15 bp, Homo sapiens
gagcacttcctattc

SEQ ID NO: 220295 - DNA, 15 bp, Homo sapiens
agagcacttcctatt

SEQ ID NO: 220296 - DNA, 15 bp, Homo sapiens
tagagcacttcctat

SEQ ID NO: 220297 - DNA, 15 bp, Homo sapiens
ctagagcacttccta

SEQ ID NO: 220298 - DNA, 15 bp, Homo sapiens
tctagagcacttcct

SEQ ID NO: 220299 - DNA, 15 bp, Homo sapiens
ttctagagcacttcc

SEQ ID NO: 220300 - DNA, 15 bp, Homo sapiens
tttctagagcacttc

SEQ ID NO: 220301 - DNA, 15 bp, Homo sapiens
gtttctagagcactt

SEQ ID NO: 220302 - DNA, 15 bp, Homo sapiens
tgtttctagagcact

SEQ ID NO: 220303 - DNA, 15 bp, Homo sapiens
gtgtttctagagcac

SEQ ID NO: 220304 - DNA, 15 bp, Homo sapiens
agtgtttctagagca

SEQ ID NO: 220305 - DNA, 15 bp, Homo sapiens
cagtgtttctagagc

SEQ ID NO: 220306 - DNA, 15 bp, Homo sapiens
tcagtgtttctagag

SEQ ID NO: 220307 - DNA, 15 bp, Homo sapiens
ctcagtgtttctaga

SEQ ID NO: 220308 - DNA, 15 bp, Homo sapiens
cctcagtgtttctag

SEQ ID NO: 220309 - DNA, 15 bp, Homo sapiens
acctcagtgtttcta

SEQ ID NO: 220310 - DNA, 15 bp, Homo sapiens
cacctcagtgtttct

SEQ ID NO: 220311 - DNA, 15 bp, Homo sapiens
ccacctcagtgtttc

SEQ ID NO: 220312 - DNA, 15 bp, Homo sapiens
cccacctcagtgttt

SEQ ID NO: 220313 - DNA, 15 bp, Homo sapiens
tcccacctcagtgtt

SEQ ID NO: 220314 - DNA, 15 bp, Homo sapiens
ctcccacctcagtgt

SEQ ID NO: 220315 - DNA, 15 bp, Homo sapiens
gctcccacctcagtg

SEQ ID NO: 220316 - DNA, 15 bp, Homo sapiens
tgctcccacctcagt

SEQ ID NO: 220317 - DNA, 15 bp, Homo sapiens
ggcagaaagtagatt

SEQ ID NO: 220318 - DNA, 15 bp, Homo sapiens
aggcagaaagtagat

SEQ ID NO: 220319 - DNA, 15 bp, Homo sapiens
gaggcagaaagtaga

SEQ ID NO: 220320 - DNA, 15 bp, Homo sapiens
agaggcagaaagtag

SEQ ID NO: 220321 - DNA, 15 bp, Homo sapiens
gagaggcagaaagta

SEQ ID NO: 220322 - DNA, 15 bp, Homo sapiens
agagaggcagaaagt

SEQ ID NO: 220323 - DNA, 15 bp, Homo sapiens
tagagaggcagaaag

SEQ ID NO: 220324 - DNA, 15 bp, Homo sapiens
ctagagaggcagaaa

SEQ ID NO: 220325 - DNA, 15 bp, Homo sapiens
tctagagaggcagaa

SEQ ID NO: 220326 - DNA, 15 bp, Homo sapiens
gtctagagaggcaga

SEQ ID NO: 220327 - DNA, 15 bp, Homo sapiens
agtctagagaggcag

SEQ ID NO: 220328 - DNA, 15 bp, Homo sapiens
aagtctagagaggca

SEQ ID NO: 220329 - DNA, 15 bp, Homo sapiens
caagtctagagaggc

SEQ ID NO: 220330 - DNA, 15 bp, Homo sapiens
gcaagtctagagagg

SEQ ID NO: 220331 - DNA, 15 bp, Homo sapiens
ggcaagtctagagag

SEQ ID NO: 220332 - DNA, 15 bp, Homo sapiens
aggcaagtctagaga

SEQ ID NO: 220333 - DNA, 15 bp, Homo sapiens
caggcaagtctagag

SEQ ID NO: 220334 - DNA, 15 bp, Homo sapiens
acaggcaagtctaga

SEQ ID NO: 220335 - DNA, 15 bp, Homo sapiens
aacaggcaagtctag

SEQ ID NO: 220336 - DNA, 15 bp, Homo sapiens
aaacaggcaagtcta

SEQ ID NO: 220337 - DNA, 15 bp, Homo sapiens
caaacaggcaagtct

SEQ ID NO: 220338 - DNA, 15 bp, Homo sapiens
ccaaacaggcaagtc

SEQ ID NO: 220339 - DNA, 15 bp, Homo sapiens
cccaaacaggcaagt

SEQ ID NO: 220340 - DNA, 15 bp, Homo sapiens
tcccaaacaggcaag

SEQ ID NO: 220341 - DNA, 15 bp, Homo sapiens
gtcccaaacaggcaa

SEQ ID NO: 220342 - DNA, 15 bp, Homo sapiens
tgtcccaaacaggca

SEQ ID NO: 220343 - DNA, 15 bp, Homo sapiens
atgtcccaaacaggc

SEQ ID NO: 220344 - DNA, 15 bp, Homo sapiens
aatgtcccaaacagg

SEQ ID NO: 220345 - DNA, 15 bp, Homo sapiens
caatgtcccaaacag

SEQ ID NO: 220346 - DNA, 15 bp, Homo sapiens
gcaatgtcccaaaca

SEQ ID NO: 220347 - DNA, 15 bp, Homo sapiens
tgcaatgtcccaaac

SEQ ID NO: 220348 - DNA, 15 bp, Homo sapiens
atgcaatgtcccaaa

SEQ ID NO: 220349 - DNA, 15 bp, Homo sapiens
catgcaatgtcccaa

SEQ ID NO: 220350 - DNA, 15 bp, Homo sapiens
ccatgcaatgtccca

SEQ ID NO: 220351 - DNA, 15 bp, Homo sapiens
accatgcaatgtccc

SEQ ID NO: 220352 - DNA, 15 bp, Homo sapiens
taccatgcaatgtcc

SEQ ID NO: 220353 - DNA, 15 bp, Homo sapiens
ttaccatgcaatgtc

SEQ ID NO: 220354 - DNA, 15 bp, Homo sapiens
attaccatgcaatgt

SEQ ID NO: 220355 - DNA, 15 bp, Homo sapiens
cattaccatgcaatg

SEQ ID NO: 220356 - DNA, 15 bp, Homo sapiens
ccattaccatgcaat

SEQ ID NO: 220357 - DNA, 15 bp, Homo sapiens
tccattaccatgcaa

SEQ ID NO: 220358 - DNA, 15 bp, Homo sapiens
ttccattaccatgca

SEQ ID NO: 220359 - DNA, 15 bp, Homo sapiens
attccattaccatgc

SEQ ID NO: 220360 - DNA, 15 bp, Homo sapiens
gattccattaccatg

SEQ ID NO: 220361 - DNA, 15 bp, Homo sapiens
agattccattaccat

SEQ ID NO: 220362 - DNA, 15 bp, Homo sapiens
aagattccattacca

SEQ ID NO: 220363 - DNA, 15 bp, Homo sapiens
taagattccattacc

SEQ ID NO: 220364 - DNA, 15 bp, Homo sapiens
gtaagattccattac

SEQ ID NO: 220365 - DNA, 15 bp, Homo sapiens
tgtaagattccatta

SEQ ID NO: 220366 - DNA, 15 bp, Homo sapiens
gtgtaagattccatt

SEQ ID NO: 220367 - DNA, 15 bp, Homo sapiens
agtgtaagattccat

SEQ ID NO: 220368 - DNA, 15 bp, Homo sapiens
tagtgtaagattcca

SEQ ID NO: 220369 - DNA, 15 bp, Homo sapiens
atagtgtaagattcc

SEQ ID NO: 220370 - DNA, 15 bp, Homo sapiens
catagtgtaagattc

SEQ ID NO: 220371 - DNA, 15 bp, Homo sapiens
gcatagtgtaagatt

SEQ ID NO: 220372 - DNA, 15 bp, Homo sapiens
ggcatagtgtaagat

SEQ ID NO: 220373 - DNA, 15 bp, Homo sapiens
gggcatagtgtaaga

SEQ ID NO: 220374 - DNA, 15 bp, Homo sapiens
agggcatagtgtaag

SEQ ID NO: 220375 - DNA, 15 bp, Homo sapiens
aagggcatagtgtaa

SEQ ID NO: 220376 - DNA, 15 bp, Homo sapiens
aaagggcatagtgta

SEQ ID NO: 220377 - DNA, 15 bp, Homo sapiens
gaaagggcatagtgt

SEQ ID NO: 220378 - DNA, 15 bp, Homo sapiens
tgaaagggcatagtg

SEQ ID NO: 220379 - DNA, 15 bp, Homo sapiens
atgaaagggcatagt

SEQ ID NO: 220380 - DNA, 15 bp, Homo sapiens
catgaaagggcatag

SEQ ID NO: 220381 - DNA, 15 bp, Homo sapiens
acatgaaagggcata

SEQ ID NO: 220382 - DNA, 15 bp, Homo sapiens
gacatgaaagggcat

SEQ ID NO: 220383 - DNA, 15 bp, Homo sapiens
agacatgaaagggca

SEQ ID NO: 220384 - DNA, 15 bp, Homo sapiens
tagacatgaaagggc

SEQ ID NO: 220385 - DNA, 15 bp, Homo sapiens
ctagacatgaaaggg

SEQ ID NO: 220386 - DNA, 15 bp, Homo sapiens
gctagacatgaaagg

SEQ ID NO: 220387 - DNA, 15 bp, Homo sapiens
agctagacatgaaag

SEQ ID NO: 220388 - DNA, 15 bp, Homo sapiens
aagctagacatgaaa

SEQ ID NO: 220389 - DNA, 15 bp, Homo sapiens
gaagctagacatgaa

SEQ ID NO: 220390 - DNA, 15 bp, Homo sapiens
agaagctagacatga

SEQ ID NO: 220391 - DNA, 15 bp, Homo sapiens
aagaagctagacatg

SEQ ID NO: 220392 - DNA, 15 bp, Homo sapiens
aaagaagctagacat

SEQ ID NO: 220393 - DNA, 15 bp, Homo sapiens
gaaagaagctagaca

SEQ ID NO: 220394 - DNA, 15 bp, Homo sapiens
tgaaagaagctagac

SEQ ID NO: 220395 - DNA, 15 bp, Homo sapiens
ttgaaagaagctaga

SEQ ID NO: 220396 - DNA, 15 bp, Homo sapiens
attgaaagaagctag

SEQ ID NO: 220397 - DNA, 15 bp, Homo sapiens
cattgaaagaagcta

SEQ ID NO: 220398 - DNA, 15 bp, Homo sapiens
tcattgaaagaagct

SEQ ID NO: 220399 - DNA, 15 bp, Homo sapiens
ctcattgaaagaagc

SEQ ID NO: 220400 - DNA, 15 bp, Homo sapiens
gctcattgaaagaag

SEQ ID NO: 220401 - DNA, 15 bp, Homo sapiens
tgctcattgaaagaa

SEQ ID NO: 220402 - DNA, 15 bp, Homo sapiens
atgctcattgaaaga

SEQ ID NO: 220403 - DNA, 15 bp, Homo sapiens
catgctcattgaaag

SEQ ID NO: 220404 - DNA, 15 bp, Homo sapiens
tcatgctcattgaaa

SEQ ID NO: 220405 - DNA, 15 bp, Homo sapiens
atcatgctcattgaa

SEQ ID NO: 220406 - DNA, 15 bp, Homo sapiens
aatcatgctcattga

SEQ ID NO: 220407 - DNA, 15 bp, Homo sapiens
aaatcatgctcattg

SEQ ID NO: 220408 - DNA, 15 bp, Homo sapiens
aaaatcatgctcatt

SEQ ID NO: 220409 - DNA, 15 bp, Homo sapiens
taaaatcatgctcat

SEQ ID NO: 220410 - DNA, 15 bp, Homo sapiens
ttaaaatcatgctca

SEQ ID NO: 220411 - DNA, 15 bp, Homo sapiens
tttaaaatcatgctc

SEQ ID NO: 220412 - DNA, 15 bp, Homo sapiens
ttttaaaatcatgct

SEQ ID NO: 220413 - DNA, 15 bp, Homo sapiens
attttaaaatcatgc

SEQ ID NO: 220414 - DNA, 15 bp, Homo sapiens
aattttaaaatcatg

SEQ ID NO: 220415 - DNA, 15 bp, Homo sapiens
gaattttaaaatcat

SEQ ID NO: 220416 - DNA, 15 bp, Homo sapiens
agaattttaaaatca

SEQ ID NO: 220417 - DNA, 15 bp, Homo sapiens
aagaattttaaaatc

SEQ ID NO: 220418 - DNA, 15 bp, Homo sapiens
gaagaattttaaaat

SEQ ID NO: 220419 - DNA, 15 bp, Homo sapiens
ggaagaattttaaaa

SEQ ID NO: 220420 - DNA, 15 bp, Homo sapiens
tggaagaattttaaa

SEQ ID NO: 220421 - DNA, 15 bp, Homo sapiens
atggaagaattttaa

SEQ ID NO: 220422 - DNA, 15 bp, Homo sapiens
catggaagaatttta

SEQ ID NO: 220423 - DNA, 15 bp, Homo sapiens
acatggaagaatttt

SEQ ID NO: 220424 - DNA, 15 bp, Homo sapiens
aacatggaagaattt

SEQ ID NO: 220425 - DNA, 15 bp, Homo sapiens
taacatggaagaatt

SEQ ID NO: 220426 - DNA, 15 bp, Homo sapiens
ataacatggaagaat

SEQ ID NO: 220427 - DNA, 15 bp, Homo sapiens
tataacatggaagaa

SEQ ID NO: 220428 - DNA, 15 bp, Homo sapiens
ctataacatggaaga

SEQ ID NO: 220429 - DNA, 15 bp, Homo sapiens
gctataacatggaag

SEQ ID NO: 220430 - DNA, 15 bp, Homo sapiens
tgctataacatggaa

SEQ ID NO: 220431 - DNA, 15 bp, Homo sapiens
gtgctataacatgga

SEQ ID NO: 220432 - DNA, 15 bp, Homo sapiens
tgtgctataacatgg

SEQ ID NO: 220433 - DNA, 15 bp, Homo sapiens
atgtgctataacatg

SEQ ID NO: 220434 - DNA, 15 bp, Homo sapiens
tatgtgctataacat

SEQ ID NO: 220435 - DNA, 15 bp, Homo sapiens
atatgtgctataaca

SEQ ID NO: 220436 - DNA, 15 bp, Homo sapiens
gatatgtgctataac

SEQ ID NO: 220437 - DNA, 15 bp, Homo sapiens
tgatatgtgctataa

SEQ ID NO: 220438 - DNA, 15 bp, Homo sapiens
ctgatatgtgctata

SEQ ID NO: 220439 - DNA, 15 bp, Homo sapiens
actgatatgtgctat

SEQ ID NO: 220440 - DNA, 15 bp, Homo sapiens
tactgatatgtgcta

SEQ ID NO: 220441 - DNA, 15 bp, Homo sapiens
atactgatatgtgct

SEQ ID NO: 220442 - DNA, 15 bp, Homo sapiens
aatactgatatgtgc

SEQ ID NO: 220443 - DNA, 15 bp, Homo sapiens
aaatactgatatgtg

SEQ ID NO: 220444 - DNA, 15 bp, Homo sapiens
gaaatactgatatgt

SEQ ID NO: 220445 - DNA, 15 bp, Homo sapiens
tgaaatactgatatg

SEQ ID NO: 220446 - DNA, 15 bp, Homo sapiens
atgaaatactgatat

SEQ ID NO: 220447 - DNA, 15 bp, Homo sapiens
aatgaaatactgata

SEQ ID NO: 220448 - DNA, 15 bp, Homo sapiens
gaatgaaatactgat

SEQ ID NO: 220449 - DNA, 15 bp, Homo sapiens
tgaatgaaatactga

SEQ ID NO: 220450 - DNA, 15 bp, Homo sapiens
atgaatgaaatactg

SEQ ID NO: 220451 - DNA, 15 bp, Homo sapiens
aatgaatgaaatact

SEQ ID NO: 220452 - DNA, 15 bp, Homo sapiens
aaatgaatgaaatac

SEQ ID NO: 220453 - DNA, 15 bp, Homo sapiens
aaaatgaatgaaata

SEQ ID NO: 220454 - DNA, 15 bp, Homo sapiens
aaaaatgaatgaaat

SEQ ID NO: 220455 - DNA, 15 bp, Homo sapiens
taaaaatgaatgaaa

SEQ ID NO: 220456 - DNA, 15 bp, Homo sapiens
ataaaaatgaatgaa

SEQ ID NO: 220457 - DNA, 15 bp, Homo sapiens
aataaaaatgaatga

SEQ ID NO: 220458 - DNA, 15 bp, Homo sapiens
taataaaaatgaatg

SEQ ID NO: 220459 - DNA, 15 bp, Homo sapiens
gtaataaaaatgaat

SEQ ID NO: 220460 - DNA, 15 bp, Homo sapiens
agtaataaaaatgaa

SEQ ID NO: 220461 - DNA, 15 bp, Homo sapiens
cagtaataaaaatga

SEQ ID NO: 220462 - DNA, 15 bp, Homo sapiens
attcagtaataaaaa

SEQ ID NO: 220463 - DNA, 15 bp, Homo sapiens
tattcagtaataaaa

SEQ ID NO: 220464 - DNA, 15 bp, Homo sapiens
ttattcagtaataaa

SEQ ID NO: 220465 - DNA, 15 bp, Homo sapiens
cttattcagtaataa

SEQ ID NO: 220466 - DNA, 15 bp, Homo sapiens
tcttattcagtaata

SEQ ID NO: 220467 - DNA, 15 bp, Homo sapiens
atcttattcagtaat

SEQ ID NO: 220468 - DNA, 15 bp, Homo sapiens
catcttattcagtaa

SEQ ID NO: 220469 - DNA, 15 bp, Homo sapiens
acatcttattcagta

SEQ ID NO: 220470 - DNA, 15 bp, Homo sapiens
gacatcttattcagt

SEQ ID NO: 220471 - DNA, 15 bp, Homo sapiens
tgacatcttattcag

SEQ ID NO: 220472 - DNA, 15 bp, Homo sapiens
atgacatcttattca

SEQ ID NO: 220473 - DNA, 15 bp, Homo sapiens
aatgacatcttattc

SEQ ID NO: 220474 - DNA, 15 bp, Homo sapiens
caatgacatcttatt

SEQ ID NO: 220475 - DNA, 15 bp, Homo sapiens
acaatgacatcttat

SEQ ID NO: 220476 - DNA, 15 bp, Homo sapiens
tacaatgacatctta

SEQ ID NO: 220477 - DNA, 15 bp, Homo sapiens
atacaatgacatctt

SEQ ID NO: 220478 - DNA, 15 bp, Homo sapiens
aatacaatgacatct

SEQ ID NO: 220479 - DNA, 15 bp, Homo sapiens
taatacaatgacatc

SEQ ID NO: 220480 - DNA, 15 bp, Homo sapiens
ataatacaatgacat

SEQ ID NO: 220481 - DNA, 15 bp, Homo sapiens
cataatacaatgaca

SEQ ID NO: 220482 - DNA, 15 bp, Homo sapiens
ccataatacaatgac

SEQ ID NO: 220483 - DNA, 15 bp, Homo sapiens
tccataatacaatga

SEQ ID NO: 220484 - DNA, 15 bp, Homo sapiens
atccataatacaatg

SEQ ID NO: 220485 - DNA, 15 bp, Homo sapiens
tatccataatacaat

SEQ ID NO: 220486 - DNA, 15 bp, Homo sapiens
atatccataatacaa

SEQ ID NO: 220487 - DNA, 15 bp, Homo sapiens
tatatccataataca

SEQ ID NO: 220488 - DNA, 15 bp, Homo sapiens
atatatccataatac

SEQ ID NO: 220489 - DNA, 15 bp, Homo sapiens
gatatatccataata

SEQ ID NO: 220490 - DNA, 15 bp, Homo sapiens
tgatatatccataat

SEQ ID NO: 220491 - DNA, 15 bp, Homo sapiens
gtgatatatccataa

SEQ ID NO: 220492 - DNA, 15 bp, Homo sapiens
tgtgatatatccata

SEQ ID NO: 220493 - DNA, 15 bp, Homo sapiens
atgtgatatatccat

SEQ ID NO: 220494 - DNA, 15 bp, Homo sapiens
aatgtgatatatcca

SEQ ID NO: 220495 - DNA, 15 bp, Homo sapiens
aaatgtgatatatcc

SEQ ID NO: 220496 - DNA, 15 bp, Homo sapiens
aaaatgtgatatatc

SEQ ID NO: 220497 - DNA, 15 bp, Homo sapiens
acaaaatgtgatata

SEQ ID NO: 220498 - DNA, 15 bp, Homo sapiens
aacaaaatgtgatat

SEQ ID NO: 220499 - DNA, 15 bp, Homo sapiens
aaacaaaatgtgata

SEQ ID NO: 220500 - DNA, 15 bp, Homo sapiens
taaacaaaatgtgat

SEQ ID NO: 220501 - DNA, 15 bp, Homo sapiens
ataaacaaaatgtga

SEQ ID NO: 220502 - DNA, 15 bp, Homo sapiens
ctgaatggataaaca

SEQ ID NO: 220503 - DNA, 15 bp, Homo sapiens
gctgaatggataaac

SEQ ID NO: 220504 - DNA, 15 bp, Homo sapiens
tgctgaatggataaa

SEQ ID NO: 220505 - DNA, 15 bp, Homo sapiens
ctgctgaatggataa

SEQ ID NO: 220506 - DNA, 15 bp, Homo sapiens
actgctgaatggata

SEQ ID NO: 220507 - DNA, 15 bp, Homo sapiens
aactgctgaatggat

SEQ ID NO: 220508 - DNA, 15 bp, Homo sapiens
caactgctgaatgga

SEQ ID NO: 220509 - DNA, 15 bp, Homo sapiens
tcaactgctgaatgg

SEQ ID NO: 220510 - DNA, 15 bp, Homo sapiens
atcaactgctgaatg

SEQ ID NO: 220511 - DNA, 15 bp, Homo sapiens
catcaactgctgaat

SEQ ID NO: 220512 - DNA, 15 bp, Homo sapiens
ccatcaactgctgaa

SEQ ID NO: 220513 - DNA, 15 bp, Homo sapiens
tccatcaactgctga

SEQ ID NO: 220514 - DNA, 15 bp, Homo sapiens
atccatcaactgctg

SEQ ID NO: 220515 - DNA, 15 bp, Homo sapiens
tatccatcaactgct

SEQ ID NO: 220516 - DNA, 15 bp, Homo sapiens
atatccatcaactgc

SEQ ID NO: 220517 - DNA, 15 bp, Homo sapiens
aatatccatcaactg

SEQ ID NO: 220518 - DNA, 15 bp, Homo sapiens
aaatatccatcaact

SEQ ID NO: 220519 - DNA, 15 bp, Homo sapiens
caaatatccatcaac

SEQ ID NO: 220520 - DNA, 15 bp, Homo sapiens
ccaaatatccatcaa

SEQ ID NO: 220521 - DNA, 15 bp, Homo sapiens
cccaaatatccatca

SEQ ID NO: 220522 - DNA, 15 bp, Homo sapiens
acccaaatatccatc

SEQ ID NO: 220523 - DNA, 15 bp, Homo sapiens
aacccaaatatccat

SEQ ID NO: 220524 - DNA, 15 bp, Homo sapiens
caacccaaatatcca

SEQ ID NO: 220525 - DNA, 15 bp, Homo sapiens
acaacccaaatatcc

SEQ ID NO: 220526 - DNA, 15 bp, Homo sapiens
cacaacccaaatatc

SEQ ID NO: 220527 - DNA, 15 bp, Homo sapiens
acacaacccaaatat

SEQ ID NO: 220528 - DNA, 15 bp, Homo sapiens
gacacaacccaaata

SEQ ID NO: 220529 - DNA, 15 bp, Homo sapiens
ggacacaacccaaat

SEQ ID NO: 220530 - DNA, 15 bp, Homo sapiens
tggacacaacccaaa

SEQ ID NO: 220531 - DNA, 15 bp, Homo sapiens
atggacacaacccaa

SEQ ID NO: 220532 - DNA, 15 bp, Homo sapiens
gatggacacaaccca

SEQ ID NO: 220533 - DNA, 15 bp, Homo sapiens
agatggacacaaccc

SEQ ID NO: 220534 - DNA, 15 bp, Homo sapiens
aagatggacacaacc

SEQ ID NO: 220535 - DNA, 15 bp, Homo sapiens
aaagatggacacaac

SEQ ID NO: 220536 - DNA, 15 bp, Homo sapiens
aaaagatggacacaa

SEQ ID NO: 220537 - DNA, 15 bp, Homo sapiens
caaaagatggacaca

SEQ ID NO: 220538 - DNA, 15 bp, Homo sapiens
ccaaaagatggacac

SEQ ID NO: 220539 - DNA, 15 bp, Homo sapiens
gccaaaagatggaca

SEQ ID NO: 220540 - DNA, 15 bp, Homo sapiens
agccaaaagatggac

SEQ ID NO: 220541 - DNA, 15 bp, Homo sapiens
tagccaaaagatgga

SEQ ID NO: 220542 - DNA, 15 bp, Homo sapiens
atagccaaaagatgg

SEQ ID NO: 220543 - DNA, 15 bp, Homo sapiens
aatagccaaaagatg

SEQ ID NO: 220544 - DNA, 15 bp, Homo sapiens
taatagccaaaagat

SEQ ID NO: 220545 - DNA, 15 bp, Homo sapiens
ataatagccaaaaga

SEQ ID NO: 220546 - DNA, 15 bp, Homo sapiens
cataatagccaaaag

SEQ ID NO: 220547 - DNA, 15 bp, Homo sapiens
tcataatagccaaaa

SEQ ID NO: 220548 - DNA, 15 bp, Homo sapiens
ttcataatagccaaa

SEQ ID NO: 220549 - DNA, 15 bp, Homo sapiens
attcataatagccaa

SEQ ID NO: 220550 - DNA, 15 bp, Homo sapiens
tattcataatagcca

SEQ ID NO: 220551 - DNA, 15 bp, Homo sapiens
ttattcataatagcc

SEQ ID NO: 220552 - DNA, 15 bp, Homo sapiens
cttattcataatagc

SEQ ID NO: 220553 - DNA, 15 bp, Homo sapiens
ccttattcataatag

SEQ ID NO: 220554 - DNA, 15 bp, Homo sapiens
gccttattcataata

SEQ ID NO: 220555 - DNA, 15 bp, Homo sapiens
agccttattcataat

SEQ ID NO: 220556 - DNA, 15 bp, Homo sapiens
tagccttattcataa

SEQ ID NO: 220557 - DNA, 15 bp, Homo sapiens
gtagccttattcata

SEQ ID NO: 220558 - DNA, 15 bp, Homo sapiens
agtagccttattcat

SEQ ID NO: 220559 - DNA, 15 bp, Homo sapiens
tagtagccttattca

SEQ ID NO: 220560 - DNA, 15 bp, Homo sapiens
atagtagccttattc

SEQ ID NO: 220561 - DNA, 15 bp, Homo sapiens
tatagtagccttatt

SEQ ID NO: 220562 - DNA, 15 bp, Homo sapiens
ttatagtagccttat

SEQ ID NO: 220563 - DNA, 15 bp, Homo sapiens
tttatagtagcctta

SEQ ID NO: 220564 - DNA, 15 bp, Homo sapiens
gtttatagtagcctt

SEQ ID NO: 220565 - DNA, 15 bp, Homo sapiens
tgtttatagtagcct

SEQ ID NO: 220566 - DNA, 15 bp, Homo sapiens
atgtttatagtagcc

SEQ ID NO: 220567 - DNA, 15 bp, Homo sapiens
aatgtttatagtagc

SEQ ID NO: 220568 - DNA, 15 bp, Homo sapiens
gaatgtttatagtag

SEQ ID NO: 220569 - DNA, 15 bp, Homo sapiens
tgaatgtttatagta

SEQ ID NO: 220570 - DNA, 15 bp, Homo sapiens
atgaatgtttatagt

SEQ ID NO: 220571 - DNA, 15 bp, Homo sapiens
catgaatgtttatag

SEQ ID NO: 220572 - DNA, 15 bp, Homo sapiens
acatgaatgtttata

SEQ ID NO: 220573 - DNA, 15 bp, Homo sapiens
tacatgaatgtttat

SEQ ID NO: 220574 - DNA, 15 bp, Homo sapiens
atacatgaatgttta

SEQ ID NO: 220575 - DNA, 15 bp, Homo sapiens
catacatgaatgttt

SEQ ID NO: 220576 - DNA, 15 bp, Homo sapiens
tcatacatgaatgtt

SEQ ID NO: 220577 - DNA, 15 bp, Homo sapiens
ctcatacatgaatgt

SEQ ID NO: 220578 - DNA, 15 bp, Homo sapiens
actcatacatgaatg

SEQ ID NO: 220579 - DNA, 15 bp, Homo sapiens
cactcatacatgaat

SEQ ID NO: 220580 - DNA, 15 bp, Homo sapiens
acactcatacatgaa

SEQ ID NO: 220581 - DNA, 15 bp, Homo sapiens
aacactcatacatga

SEQ ID NO: 220582 - DNA, 15 bp, Homo sapiens
aaacactcatacatg

SEQ ID NO: 220583 - DNA, 15 bp, Homo sapiens
taaacactcatacat

SEQ ID NO: 220584 - DNA, 15 bp, Homo sapiens
ataaacactcataca

SEQ ID NO: 220585 - DNA, 15 bp, Homo sapiens
cataaacactcatac

SEQ ID NO: 220586 - DNA, 15 bp, Homo sapiens
acataaacactcata

SEQ ID NO: 220587 - DNA, 15 bp, Homo sapiens
cacataaacactcat

SEQ ID NO: 220588 - DNA, 15 bp, Homo sapiens
ccacataaacactca

SEQ ID NO: 220589 - DNA, 15 bp, Homo sapiens
tccacataaacactc

SEQ ID NO: 220590 - DNA, 15 bp, Homo sapiens
gtccacataaacact

SEQ ID NO: 220591 - DNA, 15 bp, Homo sapiens
tgtccacataaacac

SEQ ID NO: 220592 - DNA, 15 bp, Homo sapiens
atgtccacataaaca

SEQ ID NO: 220593 - DNA, 15 bp, Homo sapiens
catgtccacataaac

SEQ ID NO: 220594 - DNA, 15 bp, Homo sapiens
acatgtccacataaa

SEQ ID NO: 220595 - DNA, 15 bp, Homo sapiens
aacatgtccacataa

SEQ ID NO: 220596 - DNA, 15 bp, Homo sapiens
aaacatgtccacata

SEQ ID NO: 220597 - DNA, 15 bp, Homo sapiens
aaaacatgtccacat

SEQ ID NO: 220598 - DNA, 15 bp, Homo sapiens
aaaaacatgtccaca

SEQ ID NO: 220599 - DNA, 15 bp, Homo sapiens
gaaaaacatgtccac

SEQ ID NO: 220600 - DNA, 15 bp, Homo sapiens
agaaaaacatgtcca

SEQ ID NO: 220601 - DNA, 15 bp, Homo sapiens
aagaaaaacatgtcc

SEQ ID NO: 220602 - DNA, 15 bp, Homo sapiens
aaagaaaaacatgtc

SEQ ID NO: 220603 - DNA, 15 bp, Homo sapiens
aaaagaaaaacatgt

SEQ ID NO: 220604 - DNA, 15 bp, Homo sapiens
aaaaagaaaaacatg

SEQ ID NO: 220605 - DNA, 15 bp, Homo sapiens
gaaaaagaaaaacat

SEQ ID NO: 220606 - DNA, 15 bp, Homo sapiens
agaaaaagaaaaaca

SEQ ID NO: 220607 - DNA, 15 bp, Homo sapiens
aagaaaaagaaaaac

SEQ ID NO: 220608 - DNA, 15 bp, Homo sapiens
gaagaaaaagaaaaa

SEQ ID NO: 220609 - DNA, 15 bp, Homo sapiens
cgaagaaaaagaaaa

SEQ ID NO: 220610 - DNA, 15 bp, Homo sapiens
ccgaagaaaaagaaa

SEQ ID NO: 220611 - DNA, 15 bp, Homo sapiens
accgaagaaaaagaa

SEQ ID NO: 220612 - DNA, 15 bp, Homo sapiens
taccgaagaaaaaga

SEQ ID NO: 220613 - DNA, 15 bp, Homo sapiens
ataccgaagaaaaag

SEQ ID NO: 220614 - DNA, 15 bp, Homo sapiens
tataccgaagaaaaa

SEQ ID NO: 220615 - DNA, 15 bp, Homo sapiens
atataccgaagaaaa

SEQ ID NO: 220616 - DNA, 15 bp, Homo sapiens
tatataccgaagaaa

SEQ ID NO: 220617 - DNA, 15 bp, Homo sapiens
gtatataccgaagaa

SEQ ID NO: 220618 - DNA, 15 bp, Homo sapiens
ggtatataccgaaga

SEQ ID NO: 220619 - DNA, 15 bp, Homo sapiens
aggtatataccgaag

SEQ ID NO: 220620 - DNA, 15 bp, Homo sapiens
taggtatataccgaa

SEQ ID NO: 220621 - DNA, 15 bp, Homo sapiens
ataggtatataccga

SEQ ID NO: 220622 - DNA, 15 bp, Homo sapiens
cataggtatataccg

SEQ ID NO: 220623 - DNA, 15 bp, Homo sapiens
acataggtatatacc

SEQ ID NO: 220624 - DNA, 15 bp, Homo sapiens
cacataggtatatac

SEQ ID NO: 220625 - DNA, 15 bp, Homo sapiens
acacataggtatata

SEQ ID NO: 220626 - DNA, 15 bp, Homo sapiens
tacacataggtatat

SEQ ID NO: 220627 - DNA, 15 bp, Homo sapiens
ctacacataggtata

SEQ ID NO: 220628 - DNA, 15 bp, Homo sapiens
tctacacataggtat

SEQ ID NO: 220629 - DNA, 15 bp, Homo sapiens
ttctacacataggta

SEQ ID NO: 220630 - DNA, 15 bp, Homo sapiens
attctacacataggt

SEQ ID NO: 220631 - DNA, 15 bp, Homo sapiens
aattctacacatagg

SEQ ID NO: 220632 - DNA, 15 bp, Homo sapiens
caattctacacatag

SEQ ID NO: 220633 - DNA, 15 bp, Homo sapiens
gcaattctacacata

SEQ ID NO: 220634 - DNA, 15 bp, Homo sapiens
agcaattctacacat

SEQ ID NO: 220635 - DNA, 15 bp, Homo sapiens
cagcaattctacaca

SEQ ID NO: 220636 - DNA, 15 bp, Homo sapiens
ccagcaattctacac

SEQ ID NO: 220637 - DNA, 15 bp, Homo sapiens
cccagcaattctaca

SEQ ID NO: 220638 - DNA, 15 bp, Homo sapiens
acccagcaattctac

SEQ ID NO: 220639 - DNA, 15 bp, Homo sapiens
gacccagcaattcta

SEQ ID NO: 220640 - DNA, 15 bp, Homo sapiens
tgacccagcaattct

SEQ ID NO: 220641 - DNA, 15 bp, Homo sapiens
atgacccagcaattc

SEQ ID NO: 220642 - DNA, 15 bp, Homo sapiens
catgacccagcaatt

SEQ ID NO: 220643 - DNA, 15 bp, Homo sapiens
acatgacccagcaat

SEQ ID NO: 220644 - DNA, 15 bp, Homo sapiens
aacatgacccagcaa

SEQ ID NO: 220645 - DNA, 15 bp, Homo sapiens
caacatgacccagca

SEQ ID NO: 220646 - DNA, 15 bp, Homo sapiens
tcaacatgacccagc

SEQ ID NO: 220647 - DNA, 15 bp, Homo sapiens
gtcaacatgacccag

SEQ ID NO: 220648 - DNA, 15 bp, Homo sapiens
tgtcaacatgaccca

SEQ ID NO: 220649 - DNA, 15 bp, Homo sapiens
ttgtcaacatgaccc

SEQ ID NO: 220650 - DNA, 15 bp, Homo sapiens
gttgtcaacatgacc

SEQ ID NO: 220651 - DNA, 15 bp, Homo sapiens
agttgtcaacatgac

SEQ ID NO: 220652 - DNA, 15 bp, Homo sapiens
gagttgtcaacatga

SEQ ID NO: 220653 - DNA, 15 bp, Homo sapiens
agagttgtcaacatg

SEQ ID NO: 220654 - DNA, 15 bp, Homo sapiens
cagagttgtcaacat

SEQ ID NO: 220655 - DNA, 15 bp, Homo sapiens
acagagttgtcaaca

SEQ ID NO: 220656 - DNA, 15 bp, Homo sapiens
cacagagttgtcaac

SEQ ID NO: 220657 - DNA, 15 bp, Homo sapiens
acacagagttgtcaa

SEQ ID NO: 220658 - DNA, 15 bp, Homo sapiens
aacacagagttgtca

SEQ ID NO: 220659 - DNA, 15 bp, Homo sapiens
aaacacagagttgtc

SEQ ID NO: 220660 - DNA, 15 bp, Homo sapiens
taaacacagagttgt

SEQ ID NO: 220661 - DNA, 15 bp, Homo sapiens
ctaaacacagagttg

SEQ ID NO: 220662 - DNA, 15 bp, Homo sapiens
gctaaacacagagtt

SEQ ID NO: 220663 - DNA, 15 bp, Homo sapiens
tgctaaacacagagt

SEQ ID NO: 220664 - DNA, 15 bp, Homo sapiens
atgctaaacacagag

SEQ ID NO: 220665 - DNA, 15 bp, Homo sapiens
aatgctaaacacaga

SEQ ID NO: 220666 - DNA, 15 bp, Homo sapiens
aaatgctaaacacag

SEQ ID NO: 220667 - DNA, 15 bp, Homo sapiens
aaaatgctaaacaca

SEQ ID NO: 220668 - DNA, 15 bp, Homo sapiens
caaaatgctaaacac

SEQ ID NO: 220669 - DNA, 15 bp, Homo sapiens
tcaaaatgctaaaca

SEQ ID NO: 220670 - DNA, 15 bp, Homo sapiens
ctcaaaatgctaaac

SEQ ID NO: 220671 - DNA, 15 bp, Homo sapiens
cctcaaaatgctaaa

SEQ ID NO: 220672 - DNA, 15 bp, Homo sapiens
tcctcaaaatgctaa

SEQ ID NO: 220673 - DNA, 15 bp, Homo sapiens
gtcctcaaaatgcta

SEQ ID NO: 220674 - DNA, 15 bp, Homo sapiens
tgtcctcaaaatgct

SEQ ID NO: 220675 - DNA, 15 bp, Homo sapiens
atgtcctcaaaatgc

SEQ ID NO: 220676 - DNA, 15 bp, Homo sapiens
catgtcctcaaaatg

SEQ ID NO: 220677 - DNA, 15 bp, Homo sapiens
gcatgtcctcaaaat

SEQ ID NO: 220678 - DNA, 15 bp, Homo sapiens
ggcatgtcctcaaaa

SEQ ID NO: 220679 - DNA, 15 bp, Homo sapiens
tggcatgtcctcaaa

SEQ ID NO: 220680 - DNA, 15 bp, Homo sapiens
ttggcatgtcctcaa

SEQ ID NO: 220681 - DNA, 15 bp, Homo sapiens
tttggcatgtcctca

SEQ ID NO: 220682 - DNA, 15 bp, Homo sapiens
gtttggcatgtcctc

SEQ ID NO: 220683 - DNA, 15 bp, Homo sapiens
agtttggcatgtcct

SEQ ID NO: 220684 - DNA, 15 bp, Homo sapiens
cagtttggcatgtcc

SEQ ID NO: 220685 - DNA, 15 bp, Homo sapiens
tcagtttggcatgtc

SEQ ID NO: 220686 - DNA, 15 bp, Homo sapiens
atcagtttggcatgt

SEQ ID NO: 220687 - DNA, 15 bp, Homo sapiens
aatcagtttggcatg

SEQ ID NO: 220688 - DNA, 15 bp, Homo sapiens
aaatcagtttggcat

SEQ ID NO: 220689 - DNA, 15 bp, Homo sapiens
gaaatcagtttggca

SEQ ID NO: 220690 - DNA, 15 bp, Homo sapiens
ggaaatcagtttggc

SEQ ID NO: 220691 - DNA, 15 bp, Homo sapiens
tggaaatcagtttgg

SEQ ID NO: 220692 - DNA, 15 bp, Homo sapiens
ctggaaatcagtttg

SEQ ID NO: 220693 - DNA, 15 bp, Homo sapiens
tctggaaatcagttt

SEQ ID NO: 220694 - DNA, 15 bp, Homo sapiens
ctctggaaatcagtt

SEQ ID NO: 220695 - DNA, 15 bp, Homo sapiens
actctggaaatcagt

SEQ ID NO: 220696 - DNA, 15 bp, Homo sapiens
cactctggaaatcag

SEQ ID NO: 220697 - DNA, 15 bp, Homo sapiens
ccactctggaaatca

SEQ ID NO: 220698 - DNA, 15 bp, Homo sapiens
gccactctggaaatc

SEQ ID NO: 220699 - DNA, 15 bp, Homo sapiens
agccactctggaaat

SEQ ID NO: 220700 - DNA, 15 bp, Homo sapiens
cagccactctggaaa

SEQ ID NO: 220701 - DNA, 15 bp, Homo sapiens
acagccactctggaa

SEQ ID NO: 220702 - DNA, 15 bp, Homo sapiens
cacagccactctgga

SEQ ID NO: 220703 - DNA, 15 bp, Homo sapiens
tcacagccactctgg

SEQ ID NO: 220704 - DNA, 15 bp, Homo sapiens
atcacagccactctg

SEQ ID NO: 220705 - DNA, 15 bp, Homo sapiens
tatcacagccactct

SEQ ID NO: 220706 - DNA, 15 bp, Homo sapiens
atatcacagccactc

SEQ ID NO: 220707 - DNA, 15 bp, Homo sapiens
catatcacagccact

SEQ ID NO: 220708 - DNA, 15 bp, Homo sapiens
ccatatcacagccac

SEQ ID NO: 220709 - DNA, 15 bp, Homo sapiens
accatatcacagcca

SEQ ID NO: 220710 - DNA, 15 bp, Homo sapiens
aaccatatcacagcc

SEQ ID NO: 220711 - DNA, 15 bp, Homo sapiens
aaaccatatcacagc

SEQ ID NO: 220712 - DNA, 15 bp, Homo sapiens
caaaccatatcacag

SEQ ID NO: 220713 - DNA, 15 bp, Homo sapiens
ccaaaccatatcaca

SEQ ID NO: 220714 - DNA, 15 bp, Homo sapiens
gccaaaccatatcac

SEQ ID NO: 220715 - DNA, 15 bp, Homo sapiens
gtggggacacagagc

SEQ ID NO: 220716 - DNA, 15 bp, Homo sapiens
ggtggggacacagag

SEQ ID NO: 220717 - DNA, 15 bp, Homo sapiens
gggtggggacacaga

SEQ ID NO: 220718 - DNA, 15 bp, Homo sapiens
tgggtggggacacag

SEQ ID NO: 220719 - DNA, 15 bp, Homo sapiens
ttgggtggggacaca

SEQ ID NO: 220720 - DNA, 15 bp, Homo sapiens
gtgagatttgggtgg

SEQ ID NO: 220721 - DNA, 15 bp, Homo sapiens
agtgagatttgggtg

SEQ ID NO: 220722 - DNA, 15 bp, Homo sapiens
cagtgagatttgggt

SEQ ID NO: 220723 - DNA, 15 bp, Homo sapiens
tcagtgagatttggg

SEQ ID NO: 220724 - DNA, 15 bp, Homo sapiens
ttcagtgagatttgg

SEQ ID NO: 220725 - DNA, 15 bp, Homo sapiens
attcagtgagatttg

SEQ ID NO: 220726 - DNA, 15 bp, Homo sapiens
aattcagtgagattt

SEQ ID NO: 220727 - DNA, 15 bp, Homo sapiens
caattcagtgagatt

SEQ ID NO: 220728 - DNA, 15 bp, Homo sapiens
acaattcagtgagat

SEQ ID NO: 220729 - DNA, 15 bp, Homo sapiens
tacaattcagtgaga

SEQ ID NO: 220730 - DNA, 15 bp, Homo sapiens
ttacaattcagtgag

SEQ ID NO: 220731 - DNA, 15 bp, Homo sapiens
attacaattcagtga

SEQ ID NO: 220732 - DNA, 15 bp, Homo sapiens
tattacaattcagtg

SEQ ID NO: 220733 - DNA, 15 bp, Homo sapiens
ttattacaattcagt

SEQ ID NO: 220734 - DNA, 15 bp, Homo sapiens
attattacaattcag

SEQ ID NO: 220735 - DNA, 15 bp, Homo sapiens
cggggattattacaa

SEQ ID NO: 220736 - DNA, 15 bp, Homo sapiens
gcggggattattaca

SEQ ID NO: 220737 - DNA, 15 bp, Homo sapiens
tgcggggattattac

SEQ ID NO: 220738 - DNA, 15 bp, Homo sapiens
atgcggggattatta

SEQ ID NO: 220739 - DNA, 15 bp, Homo sapiens
catgcggggattatt

SEQ ID NO: 220740 - DNA, 15 bp, Homo sapiens
acatgcggggattat

SEQ ID NO: 220741 - DNA, 15 bp, Homo sapiens
gacatgcggggatta

SEQ ID NO: 220742 - DNA, 15 bp, Homo sapiens
tgacatgcggggatt

SEQ ID NO: 220743 - DNA, 15 bp, Homo sapiens
atgacatgcggggat

SEQ ID NO: 220744 - DNA, 15 bp, Homo sapiens
catgacatgcgggga

SEQ ID NO: 220745 - DNA, 15 bp, Homo sapiens
ccatgacatgcgggg

SEQ ID NO: 220746 - DNA, 15 bp, Homo sapiens
cccatgacatgcggg

SEQ ID NO: 220747 - DNA, 15 bp, Homo sapiens
tcccatgacatgcgg

SEQ ID NO: 220748 - DNA, 15 bp, Homo sapiens
ctcccatgacatgcg

SEQ ID NO: 220749 - DNA, 15 bp, Homo sapiens
cctcccatgacatgc

SEQ ID NO: 220750 - DNA, 15 bp, Homo sapiens
ccctcccatgacatg

SEQ ID NO: 220751 - DNA, 15 bp, Homo sapiens
tccctcccatgacat

SEQ ID NO: 220752 - DNA, 15 bp, Homo sapiens
gtccctcccatgaca

SEQ ID NO: 220753 - DNA, 15 bp, Homo sapiens
ggtccctcccatgac

SEQ ID NO: 220754 - DNA, 15 bp, Homo sapiens
gggtccctcccatga

SEQ ID NO: 220755 - DNA, 15 bp, Homo sapiens
tgggtccctcccatg

SEQ ID NO: 220756 - DNA, 15 bp, Homo sapiens
tacctcccactgggt

SEQ ID NO: 220757 - DNA, 15 bp, Homo sapiens
ttacctcccactggg

SEQ ID NO: 220758 - DNA, 15 bp, Homo sapiens
attacctcccactgg

SEQ ID NO: 220759 - DNA, 15 bp, Homo sapiens
aattacctcccactg

SEQ ID NO: 220760 - DNA, 15 bp, Homo sapiens
taattacctcccact

SEQ ID NO: 220761 - DNA, 15 bp, Homo sapiens
ttaattacctcccac

SEQ ID NO: 220762 - DNA, 15 bp, Homo sapiens
tttaattacctccca

SEQ ID NO: 220763 - DNA, 15 bp, Homo sapiens
atttaattacctccc

SEQ ID NO: 220764 - DNA, 15 bp, Homo sapiens
gatttaattacctcc

SEQ ID NO: 220765 - DNA, 15 bp, Homo sapiens
tgatttaattacctc

SEQ ID NO: 220766 - DNA, 15 bp, Homo sapiens
atgatttaattacct

SEQ ID NO: 220767 - DNA, 15 bp, Homo sapiens
catgatttaattacc

SEQ ID NO: 220768 - DNA, 15 bp, Homo sapiens
ccatgatttaattac

SEQ ID NO: 220769 - DNA, 15 bp, Homo sapiens
cccatgatttaatta

SEQ ID NO: 220770 - DNA, 15 bp, Homo sapiens
ccccatgatttaatt

SEQ ID NO: 220771 - DNA, 15 bp, Homo sapiens
cccccatgatttaat

SEQ ID NO: 220772 - DNA, 15 bp, Homo sapiens
gcccccatgatttaa

SEQ ID NO: 220773 - DNA, 15 bp, Homo sapiens
tgcccccatgattta

SEQ ID NO: 220774 - DNA, 15 bp, Homo sapiens
ctgcccccatgattt

SEQ ID NO: 220775 - DNA, 15 bp, Homo sapiens
cctgcccccatgatt

SEQ ID NO: 220776 - DNA, 15 bp, Homo sapiens
acctgcccccatgat

SEQ ID NO: 220777 - DNA, 15 bp, Homo sapiens
aacctgcccccatga

SEQ ID NO: 220778 - DNA, 15 bp, Homo sapiens
aaacctgcccccatg

SEQ ID NO: 220779 - DNA, 15 bp, Homo sapiens
aaaacctgcccccat

SEQ ID NO: 220780 - DNA, 15 bp, Homo sapiens
aaaaacctgccccca

SEQ ID NO: 220781 - DNA, 15 bp, Homo sapiens
gaaaaacctgccccc

SEQ ID NO: 220782 - DNA, 15 bp, Homo sapiens
ggaaaaacctgcccc

SEQ ID NO: 220783 - DNA, 15 bp, Homo sapiens
tgggaaaaacctgcc

SEQ ID NO: 220784 - DNA, 15 bp, Homo sapiens
atgggaaaaacctgc

SEQ ID NO: 220785 - DNA, 15 bp, Homo sapiens
catgggaaaaacctg

SEQ ID NO: 220786 - DNA, 15 bp, Homo sapiens
acagcatgggaaaaa

SEQ ID NO: 220787 - DNA, 15 bp, Homo sapiens
aacagcatgggaaaa

SEQ ID NO: 220788 - DNA, 15 bp, Homo sapiens
aaacagcatgggaaa

SEQ ID NO: 220789 - DNA, 15 bp, Homo sapiens
aaaacagcatgggaa

SEQ ID NO: 220790 - DNA, 15 bp, Homo sapiens
aaaaacagcatggga

SEQ ID NO: 220791 - DNA, 15 bp, Homo sapiens
caaaaacagcatggg

SEQ ID NO: 220792 - DNA, 15 bp, Homo sapiens
acaaaaacagcatgg

SEQ ID NO: 220793 - DNA, 15 bp, Homo sapiens
cacaaaaacagcatg

SEQ ID NO: 220794 - DNA, 15 bp, Homo sapiens
tcacaaaaacagcat

SEQ ID NO: 220795 - DNA, 15 bp, Homo sapiens
atcacaaaaacagca

SEQ ID NO: 220796 - DNA, 15 bp, Homo sapiens
tatcacaaaaacagc

SEQ ID NO: 220797 - DNA, 15 bp, Homo sapiens
ctatcacaaaaacag

SEQ ID NO: 220798 - DNA, 15 bp, Homo sapiens
cctatcacaaaaaca

SEQ ID NO: 220799 - DNA, 15 bp, Homo sapiens
ccctatcacaaaaac

SEQ ID NO: 220800 - DNA, 15 bp, Homo sapiens
tccctatcacaaaaa

SEQ ID NO: 220801 - DNA, 15 bp, Homo sapiens
ttccctatcacaaaa

SEQ ID NO: 220802 - DNA, 15 bp, Homo sapiens
attccctatcacaaa

SEQ ID NO: 220803 - DNA, 15 bp, Homo sapiens
tattccctatcacaa

SEQ ID NO: 220804 - DNA, 15 bp, Homo sapiens
ttattccctatcaca

SEQ ID NO: 220805 - DNA, 15 bp, Homo sapiens
cttattccctatcac

SEQ ID NO: 220806 - DNA, 15 bp, Homo sapiens
acttattccctatca

SEQ ID NO: 220807 - DNA, 15 bp, Homo sapiens
gacttattccctatc

SEQ ID NO: 220808 - DNA, 15 bp, Homo sapiens
agacttattccctat

SEQ ID NO: 220809 - DNA, 15 bp, Homo sapiens
gagacttattcccta

SEQ ID NO: 220810 - DNA, 15 bp, Homo sapiens
tgagacttattccct

SEQ ID NO: 220811 - DNA, 15 bp, Homo sapiens
gtgagacttattccc

SEQ ID NO: 220812 - DNA, 15 bp, Homo sapiens
tgtgagacttattcc

SEQ ID NO: 220813 - DNA, 15 bp, Homo sapiens
ttgtgagacttattc

SEQ ID NO: 220814 - DNA, 15 bp, Homo sapiens
cttgtgagacttatt

SEQ ID NO: 220815 - DNA, 15 bp, Homo sapiens
tcttgtgagacttat

SEQ ID NO: 220816 - DNA, 15 bp, Homo sapiens
atcttgtgagactta

SEQ ID NO: 220817 - DNA, 15 bp, Homo sapiens
gatcttgtgagactt

SEQ ID NO: 220818 - DNA, 15 bp, Homo sapiens
agatcttgtgagact

SEQ ID NO: 220819 - DNA, 15 bp, Homo sapiens
cagatcttgtgagac

SEQ ID NO: 220820 - DNA, 15 bp, Homo sapiens
tcagatcttgtgaga

SEQ ID NO: 220821 - DNA, 15 bp, Homo sapiens
atcagatcttgtgag

SEQ ID NO: 220822 - DNA, 15 bp, Homo sapiens
catcagatcttgtga

SEQ ID NO: 220823 - DNA, 15 bp, Homo sapiens
ccatcagatcttgtg

SEQ ID NO: 220824 - DNA, 15 bp, Homo sapiens
accatcagatcttgt

SEQ ID NO: 220825 - DNA, 15 bp, Homo sapiens
aaccatcagatcttg

SEQ ID NO: 220826 - DNA, 15 bp, Homo sapiens
aaaccatcagatctt

SEQ ID NO: 220827 - DNA, 15 bp, Homo sapiens
aaaaccatcagatct

SEQ ID NO: 220828 - DNA, 15 bp, Homo sapiens
taaaaccatcagatc

SEQ ID NO: 220829 - DNA, 15 bp, Homo sapiens
tcctttataaaacca

SEQ ID NO: 220830 - DNA, 15 bp, Homo sapiens
ctcctttataaaacc

SEQ ID NO: 220831 - DNA, 15 bp, Homo sapiens
tctcctttataaaac

SEQ ID NO: 220832 - DNA, 15 bp, Homo sapiens
ctctcctttataaaa

SEQ ID NO: 220833 - DNA, 15 bp, Homo sapiens
actctcctttataaa

SEQ ID NO: 220834 - DNA, 15 bp, Homo sapiens
aactctcctttataa

SEQ ID NO: 220835 - DNA, 15 bp, Homo sapiens
gaactctcctttata

SEQ ID NO: 220836 - DNA, 15 bp, Homo sapiens
ggaactctcctttat

SEQ ID NO: 220837 - DNA, 15 bp, Homo sapiens
gggaactctccttta

SEQ ID NO: 220838 - DNA, 15 bp, Homo sapiens
ggggaactctccttt

SEQ ID NO: 220839 - DNA, 15 bp, Homo sapiens
tggggaactctcctt

SEQ ID NO: 220840 - DNA, 15 bp, Homo sapiens
ctggggaactctcct

SEQ ID NO: 220841 - DNA, 15 bp, Homo sapiens
gctggggaactctcc

SEQ ID NO: 220842 - DNA, 15 bp, Homo sapiens
tgctggggaactctc

SEQ ID NO: 220843 - DNA, 15 bp, Homo sapiens
gtgctggggaactct

SEQ ID NO: 220844 - DNA, 15 bp, Homo sapiens
tgtgctggggaactc

SEQ ID NO: 220845 - DNA, 15 bp, Homo sapiens
atgtgctggggaact

SEQ ID NO: 220846 - DNA, 15 bp, Homo sapiens
catgtgctggggaac

SEQ ID NO: 220847 - DNA, 15 bp, Homo sapiens
gcatgtgctggggaa

SEQ ID NO: 220848 - DNA, 15 bp, Homo sapiens
agcatgtgctgggga

SEQ ID NO: 220849 - DNA, 15 bp, Homo sapiens
cagcatgtgctgggg

SEQ ID NO: 220850 - DNA, 15 bp, Homo sapiens
acagcatgtgctggg

SEQ ID NO: 220851 - DNA, 15 bp, Homo sapiens
gacagcatgtgctgg

SEQ ID NO: 220852 - DNA, 15 bp, Homo sapiens
agacagcatgtgctg

SEQ ID NO: 220853 - DNA, 15 bp, Homo sapiens
aagacagcatgtgct

SEQ ID NO: 220854 - DNA, 15 bp, Homo sapiens
caagacagcatgtgc

SEQ ID NO: 220855 - DNA, 15 bp, Homo sapiens
gcaagacagcatgtg

SEQ ID NO: 220856 - DNA, 15 bp, Homo sapiens
ggcaagacagcatgt

SEQ ID NO: 220857 - DNA, 15 bp, Homo sapiens
aggcaagacagcatg

SEQ ID NO: 220858 - DNA, 15 bp, Homo sapiens
gaggcaagacagcat

SEQ ID NO: 220859 - DNA, 15 bp, Homo sapiens
ggaggcaagacagca

SEQ ID NO: 220860 - DNA, 15 bp, Homo sapiens
gggaggcaagacagc

SEQ ID NO: 220861 - DNA, 15 bp, Homo sapiens
cgggaggcaagacag

SEQ ID NO: 220862 - DNA, 15 bp, Homo sapiens
gcgggaggcaagaca

SEQ ID NO: 220863 - DNA, 15 bp, Homo sapiens
ggcgggaggcaagac

SEQ ID NO: 220864 - DNA, 15 bp, Homo sapiens
tggcgggaggcaaga

SEQ ID NO: 220865 - DNA, 15 bp, Homo sapiens
atggcgggaggcaag

SEQ ID NO: 220866 - DNA, 15 bp, Homo sapiens
catggcgggaggcaa

SEQ ID NO: 220867 - DNA, 15 bp, Homo sapiens
acatggcgggaggca

SEQ ID NO: 220868 - DNA, 15 bp, Homo sapiens
tacatggcgggaggc

SEQ ID NO: 220869 - DNA, 15 bp, Homo sapiens
ttacatggcgggagg

SEQ ID NO: 220870 - DNA, 15 bp, Homo sapiens
cttacatggcgggag

SEQ ID NO: 220871 - DNA, 15 bp, Homo sapiens
tcttacatggcggga

SEQ ID NO: 220872 - DNA, 15 bp, Homo sapiens
gtcttacatggcggg

SEQ ID NO: 220873 - DNA, 15 bp, Homo sapiens
cgtcttacatggcgg

SEQ ID NO: 220874 - DNA, 15 bp, Homo sapiens
acgtcttacatggcg

SEQ ID NO: 220875 - DNA, 15 bp, Homo sapiens
gacgtcttacatggc

SEQ ID NO: 220876 - DNA, 15 bp, Homo sapiens
ggacgtcttacatgg

SEQ ID NO: 220877 - DNA, 15 bp, Homo sapiens
gggacgtcttacatg

SEQ ID NO: 220878 - DNA, 15 bp, Homo sapiens
agggacgtcttacat

SEQ ID NO: 220879 - DNA, 15 bp, Homo sapiens
aagggacgtcttaca

SEQ ID NO: 220880 - DNA, 15 bp, Homo sapiens
aaagggacgtcttac

SEQ ID NO: 220881 - DNA, 15 bp, Homo sapiens
caaagggacgtctta

SEQ ID NO: 220882 - DNA, 15 bp, Homo sapiens
gcaaagggacgtctt

SEQ ID NO: 220883 - DNA, 15 bp, Homo sapiens
agcaaagggacgtct

SEQ ID NO: 220884 - DNA, 15 bp, Homo sapiens
gagcaaagggacgtc

SEQ ID NO: 220885 - DNA, 15 bp, Homo sapiens
agagcaaagggacgt

SEQ ID NO: 220886 - DNA, 15 bp, Homo sapiens
aagagcaaagggacg

SEQ ID NO: 220887 - DNA, 15 bp, Homo sapiens
gaagagcaaagggac

SEQ ID NO: 220888 - DNA, 15 bp, Homo sapiens
ggaagagcaaaggga

SEQ ID NO: 220889 - DNA, 15 bp, Homo sapiens
aggaagagcaaaggg

SEQ ID NO: 220890 - DNA, 15 bp, Homo sapiens
aaggaagagcaaagg

SEQ ID NO: 220891 - DNA, 15 bp, Homo sapiens
gaaggaagagcaaag

SEQ ID NO: 220892 - DNA, 15 bp, Homo sapiens
cgaaggaagagcaaa

SEQ ID NO: 220893 - DNA, 15 bp, Homo sapiens
acgaaggaagagcaa

SEQ ID NO: 220894 - DNA, 15 bp, Homo sapiens
gacgaaggaagagca

SEQ ID NO: 220895 - DNA, 15 bp, Homo sapiens
agacgaaggaagagc

SEQ ID NO: 220896 - DNA, 15 bp, Homo sapiens
aagacgaaggaagag

SEQ ID NO: 220897 - DNA, 15 bp, Homo sapiens
gaagacgaaggaaga

SEQ ID NO: 220898 - DNA, 15 bp, Homo sapiens
agaagacgaaggaag

SEQ ID NO: 220899 - DNA, 15 bp, Homo sapiens
cagaagacgaaggaa

SEQ ID NO: 220900 - DNA, 15 bp, Homo sapiens
gcagaagacgaagga

SEQ ID NO: 220901 - DNA, 15 bp, Homo sapiens
tgcagaagacgaagg

SEQ ID NO: 220902 - DNA, 15 bp, Homo sapiens
ttgcagaagacgaag

SEQ ID NO: 220903 - DNA, 15 bp, Homo sapiens
attgcagaagacgaa

SEQ ID NO: 220904 - DNA, 15 bp, Homo sapiens
cattgcagaagacga

SEQ ID NO: 220905 - DNA, 15 bp, Homo sapiens
tcattgcagaagacg

SEQ ID NO: 220906 - DNA, 15 bp, Homo sapiens
atcattgcagaagac

SEQ ID NO: 220907 - DNA, 15 bp, Homo sapiens
aatcattgcagaaga

SEQ ID NO: 220908 - DNA, 15 bp, Homo sapiens
caatcattgcagaag

SEQ ID NO: 220909 - DNA, 15 bp, Homo sapiens
acaatcattgcagaa

SEQ ID NO: 220910 - DNA, 15 bp, Homo sapiens
cacaatcattgcaga

SEQ ID NO: 220911 - DNA, 15 bp, Homo sapiens
tcacaatcattgcag

SEQ ID NO: 220912 - DNA, 15 bp, Homo sapiens
ctcacaatcattgca

SEQ ID NO: 220913 - DNA, 15 bp, Homo sapiens
cctcacaatcattgc

SEQ ID NO: 220914 - DNA, 15 bp, Homo sapiens
gcctcacaatcattg

SEQ ID NO: 220915 - DNA, 15 bp, Homo sapiens
ggcctcacaatcatt

SEQ ID NO: 220916 - DNA, 15 bp, Homo sapiens
aggcctcacaatcat

SEQ ID NO: 220917 - DNA, 15 bp, Homo sapiens
gaggcctcacaatca

SEQ ID NO: 220918 - DNA, 15 bp, Homo sapiens
ggaggcctcacaatc

SEQ ID NO: 220919 - DNA, 15 bp, Homo sapiens
gggaggcctcacaat

SEQ ID NO: 220920 - DNA, 15 bp, Homo sapiens
ggggaggcctcacaa

SEQ ID NO: 220921 - DNA, 15 bp, Homo sapiens
tggggaggcctcaca

SEQ ID NO: 220922 - DNA, 15 bp, Homo sapiens
ccatggctggggagg

SEQ ID NO: 220923 - DNA, 15 bp, Homo sapiens
cccatggctggggag

SEQ ID NO: 220924 - DNA, 15 bp, Homo sapiens
ccccatggctgggga

SEQ ID NO: 220925 - DNA, 15 bp, Homo sapiens
tccccatggctgggg

SEQ ID NO: 220926 - DNA, 15 bp, Homo sapiens
ttccccatggctggg

SEQ ID NO: 220927 - DNA, 15 bp, Homo sapiens
gttccccatggctgg

SEQ ID NO: 220928 - DNA, 15 bp, Homo sapiens
agttccccatggctg

SEQ ID NO: 220929 - DNA, 15 bp, Homo sapiens
tagttccccatggct

SEQ ID NO: 220930 - DNA, 15 bp, Homo sapiens
atagttccccatggc

SEQ ID NO: 220931 - DNA, 15 bp, Homo sapiens
catagttccccatgg

SEQ ID NO: 220932 - DNA, 15 bp, Homo sapiens
tcatagttccccatg

SEQ ID NO: 220933 - DNA, 15 bp, Homo sapiens
ctcatagttccccat

SEQ ID NO: 220934 - DNA, 15 bp, Homo sapiens
actcatagttcccca

SEQ ID NO: 220935 - DNA, 15 bp, Homo sapiens
gactcatagttcccc

SEQ ID NO: 220936 - DNA, 15 bp, Homo sapiens
ggactcatagttccc

SEQ ID NO: 220937 - DNA, 15 bp, Homo sapiens
tggactcatagttcc

SEQ ID NO: 220938 - DNA, 15 bp, Homo sapiens
atggactcatagttc

SEQ ID NO: 220939 - DNA, 15 bp, Homo sapiens
aatggactcatagtt

SEQ ID NO: 220940 - DNA, 15 bp, Homo sapiens
caatggactcatagt

SEQ ID NO: 220941 - DNA, 15 bp, Homo sapiens
tcaatggactcatag

SEQ ID NO: 220942 - DNA, 15 bp, Homo sapiens
ttcaatggactcata

SEQ ID NO: 220943 - DNA, 15 bp, Homo sapiens
attcaatggactcat

SEQ ID NO: 220944 - DNA, 15 bp, Homo sapiens
gattcaatggactca

SEQ ID NO: 220945 - DNA, 15 bp, Homo sapiens
agattcaatggactc

SEQ ID NO: 220946 - DNA, 15 bp, Homo sapiens
gagattcaatggact

SEQ ID NO: 220947 - DNA, 15 bp, Homo sapiens
agagattcaatggac

SEQ ID NO: 220948 - DNA, 15 bp, Homo sapiens
aagagattcaatgga

SEQ ID NO: 220949 - DNA, 15 bp, Homo sapiens
aaagagattcaatgg

SEQ ID NO: 220950 - DNA, 15 bp, Homo sapiens
gaaagagattcaatg

SEQ ID NO: 220951 - DNA, 15 bp, Homo sapiens
ggaaagagattcaat

SEQ ID NO: 220952 - DNA, 15 bp, Homo sapiens
aggaaagagattcaa

SEQ ID NO: 220953 - DNA, 15 bp, Homo sapiens
aaggaaagagattca

SEQ ID NO: 220954 - DNA, 15 bp, Homo sapiens
aaaggaaagagattc

SEQ ID NO: 220955 - DNA, 15 bp, Homo sapiens
caaaggaaagagatt

SEQ ID NO: 220956 - DNA, 15 bp, Homo sapiens
acaaaggaaagagat

SEQ ID NO: 220957 - DNA, 15 bp, Homo sapiens
tacaaaggaaagaga

SEQ ID NO: 220958 - DNA, 15 bp, Homo sapiens
ttacaaaggaaagag

SEQ ID NO: 220959 - DNA, 15 bp, Homo sapiens
tttacaaaggaaaga

SEQ ID NO: 220960 - DNA, 15 bp, Homo sapiens
atttacaaaggaaag

SEQ ID NO: 220961 - DNA, 15 bp, Homo sapiens
aatttacaaaggaaa

SEQ ID NO: 220962 - DNA, 15 bp, Homo sapiens
taatttacaaaggaa

SEQ ID NO: 220963 - DNA, 15 bp, Homo sapiens
gtaatttacaaagga

SEQ ID NO: 220964 - DNA, 15 bp, Homo sapiens
ggtaatttacaaagg

SEQ ID NO: 220965 - DNA, 15 bp, Homo sapiens
gggtaatttacaaag

SEQ ID NO: 220966 - DNA, 15 bp, Homo sapiens
tgggtaatttacaaa

SEQ ID NO: 220967 - DNA, 15 bp, Homo sapiens
ctgggtaatttacaa

SEQ ID NO: 220968 - DNA, 15 bp, Homo sapiens
actgggtaatttaca

SEQ ID NO: 220969 - DNA, 15 bp, Homo sapiens
gactgggtaatttac

SEQ ID NO: 220970 - DNA, 15 bp, Homo sapiens
atacctgagactggg

SEQ ID NO: 220971 - DNA, 15 bp, Homo sapiens
catacctgagactgg

SEQ ID NO: 220972 - DNA, 15 bp, Homo sapiens
acatacctgagactg

SEQ ID NO: 220973 - DNA, 15 bp, Homo sapiens
aacatacctgagact

SEQ ID NO: 220974 - DNA, 15 bp, Homo sapiens
aaacatacctgagac

SEQ ID NO: 220975 - DNA, 15 bp, Homo sapiens
aaaacatacctgaga

SEQ ID NO: 220976 - DNA, 15 bp, Homo sapiens
aaaaacatacctgag

SEQ ID NO: 220977 - DNA, 15 bp, Homo sapiens
taaaaacatacctga

SEQ ID NO: 220978 - DNA, 15 bp, Homo sapiens
gtaaaaacatacctg

SEQ ID NO: 220979 - DNA, 15 bp, Homo sapiens
agtaaaaacatacct

SEQ ID NO: 220980 - DNA, 15 bp, Homo sapiens
tagtaaaaacatacc

SEQ ID NO: 220981 - DNA, 15 bp, Homo sapiens
ctagtaaaaacatac

SEQ ID NO: 220982 - DNA, 15 bp, Homo sapiens
gctagtaaaaacata

SEQ ID NO: 220983 - DNA, 15 bp, Homo sapiens
tgctagtaaaaacat

SEQ ID NO: 220984 - DNA, 15 bp, Homo sapiens
ctgctagtaaaaaca

SEQ ID NO: 220985 - DNA, 15 bp, Homo sapiens
gctgctagtaaaaac

SEQ ID NO: 220986 - DNA, 15 bp, Homo sapiens
cgctgctagtaaaaa

SEQ ID NO: 220987 - DNA, 15 bp, Homo sapiens
acgctgctagtaaaa

SEQ ID NO: 220988 - DNA, 15 bp, Homo sapiens
cacgctgctagtaaa

SEQ ID NO: 220989 - DNA, 15 bp, Homo sapiens
tcacgctgctagtaa

SEQ ID NO: 220990 - DNA, 15 bp, Homo sapiens
ctcacgctgctagta

SEQ ID NO: 220991 - DNA, 15 bp, Homo sapiens
tctcacgctgctagt

SEQ ID NO: 220992 - DNA, 15 bp, Homo sapiens
ttctcacgctgctag

SEQ ID NO: 220993 - DNA, 15 bp, Homo sapiens
attctcacgctgcta

SEQ ID NO: 220994 - DNA, 15 bp, Homo sapiens
cattctcacgctgct

SEQ ID NO: 220995 - DNA, 15 bp, Homo sapiens
ccattctcacgctgc

SEQ ID NO: 220996 - DNA, 15 bp, Homo sapiens
tccattctcacgctg

SEQ ID NO: 220997 - DNA, 15 bp, Homo sapiens
gtccattctcacgct

SEQ ID NO: 220998 - DNA, 15 bp, Homo sapiens
agtccattctcacgc

SEQ ID NO: 220999 - DNA, 15 bp, Homo sapiens
tagtccattctcacg

SEQ ID NO: 221000 - DNA, 15 bp, Homo sapiens
ttagtccattctcac

SEQ ID NO: 221001 - DNA, 15 bp, Homo sapiens
attagtccattctca

SEQ ID NO: 221002 - DNA, 15 bp, Homo sapiens
tattagtccattctc

SEQ ID NO: 221003 - DNA, 15 bp, Homo sapiens
gtattagtccattct

SEQ ID NO: 221004 - DNA, 15 bp, Homo sapiens
tgtattagtccattc

SEQ ID NO: 221005 - DNA, 15 bp, Homo sapiens
ctgtattagtccatt

SEQ ID NO: 221006 - DNA, 15 bp, Homo sapiens
cctgtattagtccat

SEQ ID NO: 221007 - DNA, 15 bp, Homo sapiens
acctgtattagtcca

SEQ ID NO: 221008 - DNA, 15 bp, Homo sapiens
aacctgtattagtcc

SEQ ID NO: 221009 - DNA, 15 bp, Homo sapiens
caacctgtattagtc

SEQ ID NO: 221010 - DNA, 15 bp, Homo sapiens
gcaacctgtattagt

SEQ ID NO: 221011 - DNA, 15 bp, Homo sapiens
tgcaacctgtattag

SEQ ID NO: 221012 - DNA, 15 bp, Homo sapiens
ttgcaacctgtatta

SEQ ID NO: 221013 - DNA, 15 bp, Homo sapiens
attgcaacctgtatt

SEQ ID NO: 221014 - DNA, 15 bp, Homo sapiens
aattgcaacctgtat

SEQ ID NO: 221015 - DNA, 15 bp, Homo sapiens
aaattgcaacctgta

SEQ ID NO: 221016 - DNA, 15 bp, Homo sapiens
aaaattgcaacctgt

SEQ ID NO: 221017 - DNA, 15 bp, Homo sapiens
taaaattgcaacctg

SEQ ID NO: 221018 - DNA, 15 bp, Homo sapiens
gtaaaattgcaacct

SEQ ID NO: 221019 - DNA, 15 bp, Homo sapiens
ggtaaaattgcaacc

SEQ ID NO: 221020 - DNA, 15 bp, Homo sapiens
tggtaaaattgcaac

SEQ ID NO: 221021 - DNA, 15 bp, Homo sapiens
atggtaaaattgcaa

SEQ ID NO: 221022 - DNA, 15 bp, Homo sapiens
aatggtaaaattgca

SEQ ID NO: 221023 - DNA, 15 bp, Homo sapiens
gaatggtaaaattgc

SEQ ID NO: 221024 - DNA, 15 bp, Homo sapiens
ggaatggtaaaattg

SEQ ID NO: 221025 - DNA, 15 bp, Homo sapiens
tggaatggtaaaatt

SEQ ID NO: 221026 - DNA, 15 bp, Homo sapiens
gtggaatggtaaaat

SEQ ID NO: 221027 - DNA, 15 bp, Homo sapiens
ggtggaatggtaaaa

SEQ ID NO: 221028 - DNA, 15 bp, Homo sapiens
tggtggaatggtaaa

SEQ ID NO: 221029 - DNA, 15 bp, Homo sapiens
ttggtggaatggtaa

SEQ ID NO: 221030 - DNA, 15 bp, Homo sapiens
gttggtggaatggta

SEQ ID NO: 221031 - DNA, 15 bp, Homo sapiens
tgttggtggaatggt

SEQ ID NO: 221032 - DNA, 15 bp, Homo sapiens
ttgttggtggaatgg

SEQ ID NO: 221033 - DNA, 15 bp, Homo sapiens
cttgttggtggaatg

SEQ ID NO: 221034 - DNA, 15 bp, Homo sapiens
gcttgttggtggaat

SEQ ID NO: 221035 - DNA, 15 bp, Homo sapiens
tgcttgttggtggaa

SEQ ID NO: 221036 - DNA, 15 bp, Homo sapiens
atgcttgttggtgga

SEQ ID NO: 221037 - DNA, 15 bp, Homo sapiens
gatgcttgttggtgg

SEQ ID NO: 221038 - DNA, 15 bp, Homo sapiens
tgatgcttgttggtg

SEQ ID NO: 221039 - DNA, 15 bp, Homo sapiens
ttgatgcttgttggt

SEQ ID NO: 221040 - DNA, 15 bp, Homo sapiens
cttgatgcttgttgg

SEQ ID NO: 221041 - DNA, 15 bp, Homo sapiens
ccttgatgcttgttg

SEQ ID NO: 221042 - DNA, 15 bp, Homo sapiens
accttgatgcttgtt

SEQ ID NO: 221043 - DNA, 15 bp, Homo sapiens
aaccttgatgcttgt

SEQ ID NO: 221044 - DNA, 15 bp, Homo sapiens
gaaccttgatgcttg

SEQ ID NO: 221045 - DNA, 15 bp, Homo sapiens
ggaaccttgatgctt

SEQ ID NO: 221046 - DNA, 15 bp, Homo sapiens
aggaaccttgatgct

SEQ ID NO: 221047 - DNA, 15 bp, Homo sapiens
caggaaccttgatgc

SEQ ID NO: 221048 - DNA, 15 bp, Homo sapiens
acaggaaccttgatg

SEQ ID NO: 221049 - DNA, 15 bp, Homo sapiens
aacaggaaccttgat

SEQ ID NO: 221050 - DNA, 15 bp, Homo sapiens
aaacaggaaccttga

SEQ ID NO: 221051 - DNA, 15 bp, Homo sapiens
gaaacaggaaccttg

SEQ ID NO: 221052 - DNA, 15 bp, Homo sapiens
agaaacaggaacctt

SEQ ID NO: 221053 - DNA, 15 bp, Homo sapiens
aagaaacaggaacct

SEQ ID NO: 221054 - DNA, 15 bp, Homo sapiens
gaagaaacaggaacc

SEQ ID NO: 221055 - DNA, 15 bp, Homo sapiens
tgaagaaacaggaac

SEQ ID NO: 221056 - DNA, 15 bp, Homo sapiens
gtgaagaaacaggaa

SEQ ID NO: 221057 - DNA, 15 bp, Homo sapiens
tgtgaagaaacagga

SEQ ID NO: 221058 - DNA, 15 bp, Homo sapiens
atgtgaagaaacagg

SEQ ID NO: 221059 - DNA, 15 bp, Homo sapiens
gatgtgaagaaacag

SEQ ID NO: 221060 - DNA, 15 bp, Homo sapiens
ggatgtgaagaaaca

SEQ ID NO: 221061 - DNA, 15 bp, Homo sapiens
aggatgtgaagaaac

SEQ ID NO: 221062 - DNA, 15 bp, Homo sapiens
gaggatgtgaagaaa

SEQ ID NO: 221063 - DNA, 15 bp, Homo sapiens
tgaggatgtgaagaa

SEQ ID NO: 221064 - DNA, 15 bp, Homo sapiens
gtgaggatgtgaaga

SEQ ID NO: 221065 - DNA, 15 bp, Homo sapiens
ggtgaggatgtgaag

SEQ ID NO: 221066 - DNA, 15 bp, Homo sapiens
tggtgaggatgtgaa

SEQ ID NO: 221067 - DNA, 15 bp, Homo sapiens
ttggtgaggatgtga

SEQ ID NO: 221068 - DNA, 15 bp, Homo sapiens
tttggtgaggatgtg

SEQ ID NO: 221069 - DNA, 15 bp, Homo sapiens
ttttggtgaggatgt

SEQ ID NO: 221070 - DNA, 15 bp, Homo sapiens
cttttggtgaggatg

SEQ ID NO: 221071 - DNA, 15 bp, Homo sapiens
acttttggtgaggat

SEQ ID NO: 221072 - DNA, 15 bp, Homo sapiens
aacttttggtgagga

SEQ ID NO: 221073 - DNA, 15 bp, Homo sapiens
caacttttggtgagg

SEQ ID NO: 221074 - DNA, 15 bp, Homo sapiens
acaacttttggtgag

SEQ ID NO: 221075 - DNA, 15 bp, Homo sapiens
aacaacttttggtga

SEQ ID NO: 221076 - DNA, 15 bp, Homo sapiens
taacaacttttggtg

SEQ ID NO: 221077 - DNA, 15 bp, Homo sapiens
ataacaacttttggt

SEQ ID NO: 221078 - DNA, 15 bp, Homo sapiens
aataacaacttttgg

SEQ ID NO: 221079 - DNA, 15 bp, Homo sapiens
taataacaacttttg

SEQ ID NO: 221080 - DNA, 15 bp, Homo sapiens
ataataacaactttt

SEQ ID NO: 221081 - DNA, 15 bp, Homo sapiens
gataataacaacttt

SEQ ID NO: 221082 - DNA, 15 bp, Homo sapiens
agataataacaactt

SEQ ID NO: 221083 - DNA, 15 bp, Homo sapiens
cagataataacaact

SEQ ID NO: 221084 - DNA, 15 bp, Homo sapiens
ccagataataacaac

SEQ ID NO: 221085 - DNA, 15 bp, Homo sapiens
tccagataataacaa

SEQ ID NO: 221086 - DNA, 15 bp, Homo sapiens
ttccagataataaca

SEQ ID NO: 221087 - DNA, 15 bp, Homo sapiens
gttccagataataac

SEQ ID NO: 221088 - DNA, 15 bp, Homo sapiens
tgttccagataataa

SEQ ID NO: 221089 - DNA, 15 bp, Homo sapiens
ctgttccagataata

SEQ ID NO: 221090 - DNA, 15 bp, Homo sapiens
tctgttccagataat

SEQ ID NO: 221091 - DNA, 15 bp, Homo sapiens
ttctgttccagataa

SEQ ID NO: 221092 - DNA, 15 bp, Homo sapiens
gttctgttccagata

SEQ ID NO: 221093 - DNA, 15 bp, Homo sapiens
agttctgttccagat

SEQ ID NO: 221094 - DNA, 15 bp, Homo sapiens
cagttctgttccaga

SEQ ID NO: 221095 - DNA, 15 bp, Homo sapiens
acagttctgttccag

SEQ ID NO: 221096 - DNA, 15 bp, Homo sapiens
aacagttctgttcca

SEQ ID NO: 221097 - DNA, 15 bp, Homo sapiens
aaacagttctgttcc

SEQ ID NO: 221098 - DNA, 15 bp, Homo sapiens
aaaacagttctgttc

SEQ ID NO: 221099 - DNA, 15 bp, Homo sapiens
caaaacagttctgtt

SEQ ID NO: 221100 - DNA, 15 bp, Homo sapiens
tcaaaacagttctgt

SEQ ID NO: 221101 - DNA, 15 bp, Homo sapiens
ttcaaaacagttctg

SEQ ID NO: 221102 - DNA, 15 bp, Homo sapiens
attcaaaacagttct

SEQ ID NO: 221103 - DNA, 15 bp, Homo sapiens
cattcaaaacagttc

SEQ ID NO: 221104 - DNA, 15 bp, Homo sapiens
tcattcaaaacagtt

SEQ ID NO: 221105 - DNA, 15 bp, Homo sapiens
ttcattcaaaacagt

SEQ ID NO: 221106 - DNA, 15 bp, Homo sapiens
tttcattcaaaacag

SEQ ID NO: 221107 - DNA, 15 bp, Homo sapiens
ttttcattcaaaaca

SEQ ID NO: 221108 - DNA, 15 bp, Homo sapiens
attttcattcaaaac

SEQ ID NO: 221109 - DNA, 15 bp, Homo sapiens
tattttcattcaaaa

SEQ ID NO: 221110 - DNA, 15 bp, Homo sapiens
atattttcattcaaa

SEQ ID NO: 221111 - DNA, 15 bp, Homo sapiens
tatattttcattcaa

SEQ ID NO: 221112 - DNA, 15 bp, Homo sapiens
ttatattttcattca

SEQ ID NO: 221113 - DNA, 15 bp, Homo sapiens
tttatattttcattc

SEQ ID NO: 221114 - DNA, 15 bp, Homo sapiens
gtttatattttcatt

SEQ ID NO: 221115 - DNA, 15 bp, Homo sapiens
agtttatattttcat

SEQ ID NO: 221116 - DNA, 15 bp, Homo sapiens
gagtttatattttca

SEQ ID NO: 221117 - DNA, 15 bp, Homo sapiens
tgagtttatattttc

SEQ ID NO: 221118 - DNA, 15 bp, Homo sapiens
atgagtttatatttt

SEQ ID NO: 221119 - DNA, 15 bp, Homo sapiens
aatgagtttatattt

SEQ ID NO: 221120 - DNA, 15 bp, Homo sapiens
taatgagtttatatt

SEQ ID NO: 221121 - DNA, 15 bp, Homo sapiens
ttaatgagtttatat

SEQ ID NO: 221122 - DNA, 15 bp, Homo sapiens
tttaatgagtttata

SEQ ID NO: 221123 - DNA, 15 bp, Homo sapiens
ttttaatgagtttat

SEQ ID NO: 221124 - DNA, 15 bp, Homo sapiens
gttttaatgagttta

SEQ ID NO: 221125 - DNA, 15 bp, Homo sapiens
tgttttaatgagttt

SEQ ID NO: 221126 - DNA, 15 bp, Homo sapiens
ctgttttaatgagtt

SEQ ID NO: 221127 - DNA, 15 bp, Homo sapiens
tctgttttaatgagt

SEQ ID NO: 221128 - DNA, 15 bp, Homo sapiens
ttctgttttaatgag

SEQ ID NO: 221129 - DNA, 15 bp, Homo sapiens
tttctgttttaatga

SEQ ID NO: 221130 - DNA, 15 bp, Homo sapiens
ttttctgttttaatg

SEQ ID NO: 221131 - DNA, 15 bp, Homo sapiens
tttttctgttttaat

SEQ ID NO: 221132 - DNA, 15 bp, Homo sapiens
atttttctgttttaa

SEQ ID NO: 221133 - DNA, 15 bp, Homo sapiens
aatttttctgtttta

SEQ ID NO: 221134 - DNA, 15 bp, Homo sapiens
gaatttttctgtttt

SEQ ID NO: 221135 - DNA, 15 bp, Homo sapiens
ggaatttttctgttt

SEQ ID NO: 221136 - DNA, 15 bp, Homo sapiens
tggaatttttctgtt

SEQ ID NO: 221137 - DNA, 15 bp, Homo sapiens
ttggaatttttctgt

SEQ ID NO: 221138 - DNA, 15 bp, Homo sapiens
attggaatttttctg

SEQ ID NO: 221139 - DNA, 15 bp, Homo sapiens
aattggaatttttct

SEQ ID NO: 221140 - DNA, 15 bp, Homo sapiens
taattggaatttttc

SEQ ID NO: 221141 - DNA, 15 bp, Homo sapiens
ataattggaattttt

SEQ ID NO: 221142 - DNA, 15 bp, Homo sapiens
tataattggaatttt

SEQ ID NO: 221143 - DNA, 15 bp, Homo sapiens
atataattggaattt

SEQ ID NO: 221144 - DNA, 15 bp, Homo sapiens
aatataattggaatt

SEQ ID NO: 221145 - DNA, 15 bp, Homo sapiens
taatataattggaat

SEQ ID NO: 221146 - DNA, 15 bp, Homo sapiens
ataatataattggaa

SEQ ID NO: 221147 - DNA, 15 bp, Homo sapiens
cataatataattgga

SEQ ID NO: 221148 - DNA, 15 bp, Homo sapiens
acataatataattgg

SEQ ID NO: 221149 - DNA, 15 bp, Homo sapiens
aacataatataattg

SEQ ID NO: 221150 - DNA, 15 bp, Homo sapiens
taacataatataatt

SEQ ID NO: 221151 - DNA, 15 bp, Homo sapiens
ataacataatataat

SEQ ID NO: 221152 - DNA, 15 bp, Homo sapiens
tataacataatataa

SEQ ID NO: 221153 - DNA, 15 bp, Homo sapiens
atataacataatata

SEQ ID NO: 221154 - DNA, 15 bp, Homo sapiens
catataacataatat

SEQ ID NO: 221155 - DNA, 15 bp, Homo sapiens
gcatataacataata

SEQ ID NO: 221156 - DNA, 15 bp, Homo sapiens
tgcatataacataat

SEQ ID NO: 221157 - DNA, 15 bp, Homo sapiens
atgcatataacataa

SEQ ID NO: 221158 - DNA, 15 bp, Homo sapiens
aatgcatataacata

SEQ ID NO: 221159 - DNA, 15 bp, Homo sapiens
aaatgcatataacat

SEQ ID NO: 221160 - DNA, 15 bp, Homo sapiens
taaatgcatataaca

SEQ ID NO: 221161 - DNA, 15 bp, Homo sapiens
ttaaatgcatataac

SEQ ID NO: 221162 - DNA, 15 bp, Homo sapiens
cttaaatgcatataa

SEQ ID NO: 221163 - DNA, 15 bp, Homo sapiens
ccttaaatgcatata

SEQ ID NO: 221164 - DNA, 15 bp, Homo sapiens
accttaaatgcatat

SEQ ID NO: 221165 - DNA, 15 bp, Homo sapiens
caccttaaatgcata

SEQ ID NO: 221166 - DNA, 15 bp, Homo sapiens
ccaccttaaatgcat

SEQ ID NO: 221167 - DNA, 15 bp, Homo sapiens
gccaccttaaatgca

SEQ ID NO: 221168 - DNA, 15 bp, Homo sapiens
ggccaccttaaatgc

SEQ ID NO: 221169 - DNA, 15 bp, Homo sapiens
gggccaccttaaatg

SEQ ID NO: 221170 - DNA, 15 bp, Homo sapiens
tgggccaccttaaat

SEQ ID NO: 221171 - DNA, 15 bp, Homo sapiens
atgggccaccttaaa

SEQ ID NO: 221172 - DNA, 15 bp, Homo sapiens
tatgggccaccttaa

SEQ ID NO: 221173 - DNA, 15 bp, Homo sapiens
atatgggccacctta

SEQ ID NO: 221174 - DNA, 15 bp, Homo sapiens
tatatgggccacctt

SEQ ID NO: 221175 - DNA, 15 bp, Homo sapiens
atatatgggccacct

SEQ ID NO: 221176 - DNA, 15 bp, Homo sapiens
gatatatgggccacc

SEQ ID NO: 221177 - DNA, 15 bp, Homo sapiens
tgatatatgggccac

SEQ ID NO: 221178 - DNA, 15 bp, Homo sapiens
ctgatatatgggcca

SEQ ID NO: 221179 - DNA, 15 bp, Homo sapiens
actgatatatgggcc

SEQ ID NO: 221180 - DNA, 15 bp, Homo sapiens
gactgatatatgggc

SEQ ID NO: 221181 - DNA, 15 bp, Homo sapiens
tgactgatatatggg

SEQ ID NO: 221182 - DNA, 15 bp, Homo sapiens
gtgactgatatatgg

SEQ ID NO: 221183 - DNA, 15 bp, Homo sapiens
cgtgactgatatatg

SEQ ID NO: 221184 - DNA, 15 bp, Homo sapiens
acgtgactgatatat

SEQ ID NO: 221185 - DNA, 15 bp, Homo sapiens
cacgtgactgatata

SEQ ID NO: 221186 - DNA, 15 bp, Homo sapiens
tcacgtgactgatat

SEQ ID NO: 221187 - DNA, 15 bp, Homo sapiens
atcacgtgactgata

SEQ ID NO: 221188 - DNA, 15 bp, Homo sapiens
tatcacgtgactgat

SEQ ID NO: 221189 - DNA, 15 bp, Homo sapiens
atatcacgtgactga

SEQ ID NO: 221190 - DNA, 15 bp, Homo sapiens
aatatcacgtgactg

SEQ ID NO: 221191 - DNA, 15 bp, Homo sapiens
taatatcacgtgact

SEQ ID NO: 221192 - DNA, 15 bp, Homo sapiens
ctaatatcacgtgac

SEQ ID NO: 221193 - DNA, 15 bp, Homo sapiens
tctaatatcacgtga

SEQ ID NO: 221194 - DNA, 15 bp, Homo sapiens
ttctaatatcacgtg

SEQ ID NO: 221195 - DNA, 15 bp, Homo sapiens
gttctaatatcacgt

SEQ ID NO: 221196 - DNA, 15 bp, Homo sapiens
agttctaatatcacg

SEQ ID NO: 221197 - DNA, 15 bp, Homo sapiens
aagttctaatatcac

SEQ ID NO: 221198 - DNA, 15 bp, Homo sapiens
taagttctaatatca

SEQ ID NO: 221199 - DNA, 15 bp, Homo sapiens
ttaagttctaatatc

SEQ ID NO: 221200 - DNA, 15 bp, Homo sapiens
tttaagttctaatat

SEQ ID NO: 221201 - DNA, 15 bp, Homo sapiens
ctttaagttctaata

SEQ ID NO: 221202 - DNA, 15 bp, Homo sapiens
gctttaagttctaat

SEQ ID NO: 221203 - DNA, 15 bp, Homo sapiens
agctttaagttctaa

SEQ ID NO: 221204 - DNA, 15 bp, Homo sapiens
cagctttaagttcta

SEQ ID NO: 221205 - DNA, 15 bp, Homo sapiens
tcagctttaagttct

SEQ ID NO: 221206 - DNA, 15 bp, Homo sapiens
ttcagctttaagttc

SEQ ID NO: 221207 - DNA, 15 bp, Homo sapiens
attcagctttaagtt

SEQ ID NO: 221208 - DNA, 15 bp, Homo sapiens
cattcagctttaagt

SEQ ID NO: 221209 - DNA, 15 bp, Homo sapiens
gcattcagctttaag

SEQ ID NO: 221210 - DNA, 15 bp, Homo sapiens
ggcattcagctttaa

SEQ ID NO: 221211 - DNA, 15 bp, Homo sapiens
tggcattcagcttta

SEQ ID NO: 221212 - DNA, 15 bp, Homo sapiens
gtggcattcagcttt

SEQ ID NO: 221213 - DNA, 15 bp, Homo sapiens
agtggcattcagctt

SEQ ID NO: 221214 - DNA, 15 bp, Homo sapiens
aagtggcattcagct

SEQ ID NO: 221215 - DNA, 15 bp, Homo sapiens
aaagtggcattcagc

SEQ ID NO: 221216 - DNA, 15 bp, Homo sapiens
caaagtggcattcag

SEQ ID NO: 221217 - DNA, 15 bp, Homo sapiens
acaaagtggcattca

SEQ ID NO: 221218 - DNA, 15 bp, Homo sapiens
tacaaagtggcattc

SEQ ID NO: 221219 - DNA, 15 bp, Homo sapiens
ctacaaagtggcatt

SEQ ID NO: 221220 - DNA, 15 bp, Homo sapiens
gctacaaagtggcat

SEQ ID NO: 221221 - DNA, 15 bp, Homo sapiens
agctacaaagtggca

SEQ ID NO: 221222 - DNA, 15 bp, Homo sapiens
gagctacaaagtggc

SEQ ID NO: 221223 - DNA, 15 bp, Homo sapiens
agagctacaaagtgg

SEQ ID NO: 221224 - DNA, 15 bp, Homo sapiens
cagagctacaaagtg

SEQ ID NO: 221225 - DNA, 15 bp, Homo sapiens
acagagctacaaagt

SEQ ID NO: 221226 - DNA, 15 bp, Homo sapiens
cacagagctacaaag

SEQ ID NO: 221227 - DNA, 15 bp, Homo sapiens
acacagagctacaaa

SEQ ID NO: 221228 - DNA, 15 bp, Homo sapiens
tacacagagctacaa

SEQ ID NO: 221229 - DNA, 15 bp, Homo sapiens
gtacacagagctaca

SEQ ID NO: 221230 - DNA, 15 bp, Homo sapiens
tgtacacagagctac

SEQ ID NO: 221231 - DNA, 15 bp, Homo sapiens
ttgtacacagagcta

SEQ ID NO: 221232 - DNA, 15 bp, Homo sapiens
tttgtacacagagct

SEQ ID NO: 221233 - DNA, 15 bp, Homo sapiens
ttttgtacacagagc

SEQ ID NO: 221234 - DNA, 15 bp, Homo sapiens
gttttgtacacagag

SEQ ID NO: 221235 - DNA, 15 bp, Homo sapiens
tgttttgtacacaga

SEQ ID NO: 221236 - DNA, 15 bp, Homo sapiens
ctgttttgtacacag

SEQ ID NO: 221237 - DNA, 15 bp, Homo sapiens
gctgttttgtacaca

SEQ ID NO: 221238 - DNA, 15 bp, Homo sapiens
agctgttttgtacac

SEQ ID NO: 221239 - DNA, 15 bp, Homo sapiens
gagctgttttgtaca

SEQ ID NO: 221240 - DNA, 15 bp, Homo sapiens
tgagctgttttgtac

SEQ ID NO: 221241 - DNA, 15 bp, Homo sapiens
atgagctgttttgta

SEQ ID NO: 221242 - DNA, 15 bp, Homo sapiens
aatgagctgttttgt

SEQ ID NO: 221243 - DNA, 15 bp, Homo sapiens
caatgagctgttttg

SEQ ID NO: 221244 - DNA, 15 bp, Homo sapiens
ccaatgagctgtttt

SEQ ID NO: 221245 - DNA, 15 bp, Homo sapiens
tccaatgagctgttt

SEQ ID NO: 221246 - DNA, 15 bp, Homo sapiens
ctccaatgagctgtt

SEQ ID NO: 221247 - DNA, 15 bp, Homo sapiens
actccaatgagctgt

SEQ ID NO: 221248 - DNA, 15 bp, Homo sapiens
gactccaatgagctg

SEQ ID NO: 221249 - DNA, 15 bp, Homo sapiens
agactccaatgagct

SEQ ID NO: 221250 - DNA, 15 bp, Homo sapiens
tagactccaatgagc

SEQ ID NO: 221251 - DNA, 15 bp, Homo sapiens
ttagactccaatgag

SEQ ID NO: 221252 - DNA, 15 bp, Homo sapiens
attagactccaatga

SEQ ID NO: 221253 - DNA, 15 bp, Homo sapiens
cattagactccaatg

SEQ ID NO: 221254 - DNA, 15 bp, Homo sapiens
tcattagactccaat

SEQ ID NO: 221255 - DNA, 15 bp, Homo sapiens
atcattagactccaa

SEQ ID NO: 221256 - DNA, 15 bp, Homo sapiens
gatcattagactcca

SEQ ID NO: 221257 - DNA, 15 bp, Homo sapiens
agatcattagactcc

SEQ ID NO: 221258 - DNA, 15 bp, Homo sapiens
aagatcattagactc

SEQ ID NO: 221259 - DNA, 15 bp, Homo sapiens
taagatcattagact

SEQ ID NO: 221260 - DNA, 15 bp, Homo sapiens
ataagatcattagac

SEQ ID NO: 221261 - DNA, 15 bp, Homo sapiens
gataagatcattaga

SEQ ID NO: 221262 - DNA, 15 bp, Homo sapiens
tgataagatcattag

SEQ ID NO: 221263 - DNA, 15 bp, Homo sapiens
atgataagatcatta

SEQ ID NO: 221264 - DNA, 15 bp, Homo sapiens
aatgataagatcatt

SEQ ID NO: 221265 - DNA, 15 bp, Homo sapiens
taatgataagatcat

SEQ ID NO: 221266 - DNA, 15 bp, Homo sapiens
ttaatgataagatca

SEQ ID NO: 221267 - DNA, 15 bp, Homo sapiens
attaatgataagatc

SEQ ID NO: 221268 - DNA, 15 bp, Homo sapiens
cattaatgataagat

SEQ ID NO: 221269 - DNA, 15 bp, Homo sapiens
acattaatgataaga

SEQ ID NO: 221270 - DNA, 15 bp, Homo sapiens
aacattaatgataag

SEQ ID NO: 221271 - DNA, 15 bp, Homo sapiens
gaacattaatgataa

SEQ ID NO: 221272 - DNA, 15 bp, Homo sapiens
tgaacattaatgata

SEQ ID NO: 221273 - DNA, 15 bp, Homo sapiens
gtgaacattaatgat

SEQ ID NO: 221274 - DNA, 15 bp, Homo sapiens
ggtgaacattaatga

SEQ ID NO: 221275 - DNA, 15 bp, Homo sapiens
tggtgaacattaatg

SEQ ID NO: 221276 - DNA, 15 bp, Homo sapiens
ctggtgaacattaat

SEQ ID NO: 221277 - DNA, 15 bp, Homo sapiens
cctggtgaacattaa

SEQ ID NO: 221278 - DNA, 15 bp, Homo sapiens
acctggtgaacatta

SEQ ID NO: 221279 - DNA, 15 bp, Homo sapiens
cacctggtgaacatt

SEQ ID NO: 221280 - DNA, 15 bp, Homo sapiens
ccacctggtgaacat

SEQ ID NO: 221281 - DNA, 15 bp, Homo sapiens
accacctggtgaaca

SEQ ID NO: 221282 - DNA, 15 bp, Homo sapiens
aaccacctggtgaac

SEQ ID NO: 221283 - DNA, 15 bp, Homo sapiens
caaccacctggtgaa

SEQ ID NO: 221284 - DNA, 15 bp, Homo sapiens
ccaaccacctggtga

SEQ ID NO: 221285 - DNA, 15 bp, Homo sapiens
cccaaccacctggtg

SEQ ID NO: 221286 - DNA, 15 bp, Homo sapiens
tcccaaccacctggt

SEQ ID NO: 221287 - DNA, 15 bp, Homo sapiens
ttcccaaccacctgg

SEQ ID NO: 221288 - DNA, 15 bp, Homo sapiens
tttcccaaccacctg

SEQ ID NO: 221289 - DNA, 15 bp, Homo sapiens
atttcccaaccacct

SEQ ID NO: 221290 - DNA, 15 bp, Homo sapiens
catttcccaaccacc

SEQ ID NO: 221291 - DNA, 15 bp, Homo sapiens
gcatttcccaaccac

SEQ ID NO: 221292 - DNA, 15 bp, Homo sapiens
tgcatttcccaacca

SEQ ID NO: 221293 - DNA, 15 bp, Homo sapiens
ctgcatttcccaacc

SEQ ID NO: 221294 - DNA, 15 bp, Homo sapiens
cctgcatttcccaac

SEQ ID NO: 221295 - DNA, 15 bp, Homo sapiens
acctgcatttcccaa

SEQ ID NO: 221296 - DNA, 15 bp, Homo sapiens
aacctgcatttccca

SEQ ID NO: 221297 - DNA, 15 bp, Homo sapiens
aaacctgcatttccc

SEQ ID NO: 221298 - DNA, 15 bp, Homo sapiens
aaaacctgcatttcc

SEQ ID NO: 221299 - DNA, 15 bp, Homo sapiens
gaaaacctgcatttc

SEQ ID NO: 221300 - DNA, 15 bp, Homo sapiens
agaaaacctgcattt

SEQ ID NO: 221301 - DNA, 15 bp, Homo sapiens
aagaaaacctgcatt

SEQ ID NO: 221302 - DNA, 15 bp, Homo sapiens
aaagaaaacctgcat

SEQ ID NO: 221303 - DNA, 15 bp, Homo sapiens
aaaagaaaacctgca

SEQ ID NO: 221304 - DNA, 15 bp, Homo sapiens
taaaagaaaacctgc

SEQ ID NO: 221305 - DNA, 15 bp, Homo sapiens
ataaaagaaaacctg

SEQ ID NO: 221306 - DNA, 15 bp, Homo sapiens
cataaaagaaaacct

SEQ ID NO: 221307 - DNA, 15 bp, Homo sapiens
acataaaagaaaacc

SEQ ID NO: 221308 - DNA, 15 bp, Homo sapiens
gacataaaagaaaac

SEQ ID NO: 221309 - DNA, 15 bp, Homo sapiens
agacataaaagaaaa

SEQ ID NO: 221310 - DNA, 15 bp, Homo sapiens
tagacataaaagaaa

SEQ ID NO: 221311 - DNA, 15 bp, Homo sapiens
ttagacataaaagaa

SEQ ID NO: 221312 - DNA, 15 bp, Homo sapiens
attagacataaaaga

SEQ ID NO: 221313 - DNA, 15 bp, Homo sapiens
aattagacataaaag

SEQ ID NO: 221314 - DNA, 15 bp, Homo sapiens
caattagacataaaa

SEQ ID NO: 221315 - DNA, 15 bp, Homo sapiens
tcaattagacataaa

SEQ ID NO: 221316 - DNA, 15 bp, Homo sapiens
ctcaattagacataa

SEQ ID NO: 221317 - DNA, 15 bp, Homo sapiens
tctcaattagacata

SEQ ID NO: 221318 - DNA, 15 bp, Homo sapiens
ctctcaattagacat

SEQ ID NO: 221319 - DNA, 15 bp, Homo sapiens
tctctcaattagaca

SEQ ID NO: 221320 - DNA, 15 bp, Homo sapiens
ctctctcaattagac

SEQ ID NO: 221321 - DNA, 15 bp, Homo sapiens
actctctcaattaga

SEQ ID NO: 221322 - DNA, 15 bp, Homo sapiens
aactctctcaattag

SEQ ID NO: 221323 - DNA, 15 bp, Homo sapiens
taactctctcaatta

SEQ ID NO: 221324 - DNA, 15 bp, Homo sapiens
ttaactctctcaatt

SEQ ID NO: 221325 - DNA, 15 bp, Homo sapiens
tttaactctctcaat

SEQ ID NO: 221326 - DNA, 15 bp, Homo sapiens
ctttaactctctcaa

SEQ ID NO: 221327 - DNA, 15 bp, Homo sapiens
actttaactctctca

SEQ ID NO: 221328 - DNA, 15 bp, Homo sapiens
cactttaactctctc

SEQ ID NO: 221329 - DNA, 15 bp, Homo sapiens
acactttaactctct

SEQ ID NO: 221330 - DNA, 15 bp, Homo sapiens
cacactttaactctc

SEQ ID NO: 221331 - DNA, 15 bp, Homo sapiens
tcacactttaactct

SEQ ID NO: 221332 - DNA, 15 bp, Homo sapiens
ttcacactttaactc

SEQ ID NO: 221333 - DNA, 15 bp, Homo sapiens
tttcacactttaact

SEQ ID NO: 221334 - DNA, 15 bp, Homo sapiens
atttcacactttaac

SEQ ID NO: 221335 - DNA, 15 bp, Homo sapiens
catttcacactttaa

SEQ ID NO: 221336 - DNA, 15 bp, Homo sapiens
tcatttcacacttta

SEQ ID NO: 221337 - DNA, 15 bp, Homo sapiens
atcatttcacacttt

SEQ ID NO: 221338 - DNA, 15 bp, Homo sapiens
aatcatttcacactt

SEQ ID NO: 221339 - DNA, 15 bp, Homo sapiens
taatcatttcacact

SEQ ID NO: 221340 - DNA, 15 bp, Homo sapiens
ataatcatttcacac

SEQ ID NO: 221341 - DNA, 15 bp, Homo sapiens
tataatcatttcaca

SEQ ID NO: 221342 - DNA, 15 bp, Homo sapiens
atataatcatttcac

SEQ ID NO: 221343 - DNA, 15 bp, Homo sapiens
catataatcatttca

SEQ ID NO: 221344 - DNA, 15 bp, Homo sapiens
acatataatcatttc

SEQ ID NO: 221345 - DNA, 15 bp, Homo sapiens
tacatataatcattt

SEQ ID NO: 221346 - DNA, 15 bp, Homo sapiens
atacatataatcatt

SEQ ID NO: 221347 - DNA, 15 bp, Homo sapiens
tatacatataatcat

SEQ ID NO: 221348 - DNA, 15 bp, Homo sapiens
ttatacatataatca

SEQ ID NO: 221349 - DNA, 15 bp, Homo sapiens
tttatacatataatc

SEQ ID NO: 221350 - DNA, 15 bp, Homo sapiens
ttttatacatataat

SEQ ID NO: 221351 - DNA, 15 bp, Homo sapiens
gttttatacatataa

SEQ ID NO: 221352 - DNA, 15 bp, Homo sapiens
agttttatacatata

SEQ ID NO: 221353 - DNA, 15 bp, Homo sapiens
cagttttatacatat

SEQ ID NO: 221354 - DNA, 15 bp, Homo sapiens
acagttttatacata

SEQ ID NO: 221355 - DNA, 15 bp, Homo sapiens
aacagttttatacat

SEQ ID NO: 221356 - DNA, 15 bp, Homo sapiens
caacagttttataca

SEQ ID NO: 221357 - DNA, 15 bp, Homo sapiens
tcaacagttttatac

SEQ ID NO: 221358 - DNA, 15 bp, Homo sapiens
ttcaacagttttata

SEQ ID NO: 221359 - DNA, 15 bp, Homo sapiens
tttcaacagttttat

SEQ ID NO: 221360 - DNA, 15 bp, Homo sapiens
ctttcaacagtttta

SEQ ID NO: 221361 - DNA, 15 bp, Homo sapiens
actttcaacagtttt

SEQ ID NO: 221362 - DNA, 15 bp, Homo sapiens
aactttcaacagttt

SEQ ID NO: 221363 - DNA, 15 bp, Homo sapiens
taactttcaacagtt

SEQ ID NO: 221364 - DNA, 15 bp, Homo sapiens
ttaactttcaacagt

SEQ ID NO: 221365 - DNA, 15 bp, Homo sapiens
tttaactttcaacag

SEQ ID NO: 221366 - DNA, 15 bp, Homo sapiens
atttaactttcaaca

SEQ ID NO: 221367 - DNA, 15 bp, Homo sapiens
gatttaactttcaac

SEQ ID NO: 221368 - DNA, 15 bp, Homo sapiens
agatttaactttcaa

SEQ ID NO: 221369 - DNA, 15 bp, Homo sapiens
tagatttaactttca

SEQ ID NO: 221370 - DNA, 15 bp, Homo sapiens
atagatttaactttc

SEQ ID NO: 221371 - DNA, 15 bp, Homo sapiens
aatagatttaacttt

SEQ ID NO: 221372 - DNA, 15 bp, Homo sapiens
aaatagatttaactt

SEQ ID NO: 221373 - DNA, 15 bp, Homo sapiens
gaaatagatttaact

SEQ ID NO: 221374 - DNA, 15 bp, Homo sapiens
agaaatagatttaac

SEQ ID NO: 221375 - DNA, 15 bp, Homo sapiens
cagaaatagatttaa

SEQ ID NO: 221376 - DNA, 15 bp, Homo sapiens
tcagaaatagattta

SEQ ID NO: 221377 - DNA, 15 bp, Homo sapiens
gtcagaaatagattt

SEQ ID NO: 221378 - DNA, 15 bp, Homo sapiens
tgtcagaaatagatt

SEQ ID NO: 221379 - DNA, 15 bp, Homo sapiens
atgtcagaaatagat

SEQ ID NO: 221380 - DNA, 15 bp, Homo sapiens
tatgtcagaaataga

SEQ ID NO: 221381 - DNA, 15 bp, Homo sapiens
gtatgtcagaaatag

SEQ ID NO: 221382 - DNA, 15 bp, Homo sapiens
tgtatgtcagaaata

SEQ ID NO: 221383 - DNA, 15 bp, Homo sapiens
ttgtatgtcagaaat

SEQ ID NO: 221384 - DNA, 15 bp, Homo sapiens
attgtatgtcagaaa

SEQ ID NO: 221385 - DNA, 15 bp, Homo sapiens
aattgtatgtcagaa

SEQ ID NO: 221386 - DNA, 15 bp, Homo sapiens
taattgtatgtcaga

SEQ ID NO: 221387 - DNA, 15 bp, Homo sapiens
ttaattgtatgtcag

SEQ ID NO: 221388 - DNA, 15 bp, Homo sapiens
tttaattgtatgtca

SEQ ID NO: 221389 - DNA, 15 bp, Homo sapiens
atttaattgtatgtc

SEQ ID NO: 221390 - DNA, 15 bp, Homo sapiens
tatttaattgtatgt

SEQ ID NO: 221391 - DNA, 15 bp, Homo sapiens
atatttaattgtatg

SEQ ID NO: 221392 - DNA, 15 bp, Homo sapiens
tatatttaattgtat

SEQ ID NO: 221393 - DNA, 15 bp, Homo sapiens
ttatatttaattgta

SEQ ID NO: 221394 - DNA, 15 bp, Homo sapiens
attatatttaattgt

SEQ ID NO: 221395 - DNA, 15 bp, Homo sapiens
aattatatttaattg

SEQ ID NO: 221396 - DNA, 15 bp, Homo sapiens
caattatatttaatt

SEQ ID NO: 221397 - DNA, 15 bp, Homo sapiens
tcaattatatttaat

SEQ ID NO: 221398 - DNA, 15 bp, Homo sapiens
ttcaattatatttaa

SEQ ID NO: 221399 - DNA, 15 bp, Homo sapiens
tttcaattatattta

SEQ ID NO: 221400 - DNA, 15 bp, Homo sapiens
atttcaattatattt

SEQ ID NO: 221401 - DNA, 15 bp, Homo sapiens
tatttcaattatatt

SEQ ID NO: 221402 - DNA, 15 bp, Homo sapiens
ctatttcaattatat

SEQ ID NO: 221403 - DNA, 15 bp, Homo sapiens
cctatttcaattata

SEQ ID NO: 221404 - DNA, 15 bp, Homo sapiens
tcctatttcaattat

SEQ ID NO: 221405 - DNA, 15 bp, Homo sapiens
gtcctatttcaatta

SEQ ID NO: 221406 - DNA, 15 bp, Homo sapiens
tgtcctatttcaatt

SEQ ID NO: 221407 - DNA, 15 bp, Homo sapiens
ttgtcctatttcaat

SEQ ID NO: 221408 - DNA, 15 bp, Homo sapiens
tttgtcctatttcaa

SEQ ID NO: 221409 - DNA, 15 bp, Homo sapiens
atttgtcctatttca

SEQ ID NO: 221410 - DNA, 15 bp, Homo sapiens
aatttgtcctatttc

SEQ ID NO: 221411 - DNA, 15 bp, Homo sapiens
caatttgtcctattt

SEQ ID NO: 221412 - DNA, 15 bp, Homo sapiens
tcaatttgtcctatt

SEQ ID NO: 221413 - DNA, 15 bp, Homo sapiens
ttcaatttgtcctat

SEQ ID NO: 221414 - DNA, 15 bp, Homo sapiens
attcaatttgtccta

SEQ ID NO: 221415 - DNA, 15 bp, Homo sapiens
tattcaatttgtcct

SEQ ID NO: 221416 - DNA, 15 bp, Homo sapiens
ttattcaatttgtcc

SEQ ID NO: 221417 - DNA, 15 bp, Homo sapiens
gttattcaatttgtc

SEQ ID NO: 221418 - DNA, 15 bp, Homo sapiens
tgttattcaatttgt

SEQ ID NO: 221419 - DNA, 15 bp, Homo sapiens
ttgttattcaatttg

SEQ ID NO: 221420 - DNA, 15 bp, Homo sapiens
tttgttattcaattt

SEQ ID NO: 221421 - DNA, 15 bp, Homo sapiens
ttttgttattcaatt

SEQ ID NO: 221422 - DNA, 15 bp, Homo sapiens
attttgttattcaat

SEQ ID NO: 221423 - DNA, 15 bp, Homo sapiens
aattttgttattcaa

SEQ ID NO: 221424 - DNA, 15 bp, Homo sapiens
taattttgttattca

SEQ ID NO: 221425 - DNA, 15 bp, Homo sapiens
ttaattttgttattc

SEQ ID NO: 221426 - DNA, 15 bp, Homo sapiens
tttaattttgttatt

SEQ ID NO: 221427 - DNA, 15 bp, Homo sapiens
atttaattttgttat

SEQ ID NO: 221428 - DNA, 15 bp, Homo sapiens
taaatttaattttgt

SEQ ID NO: 221429 - DNA, 15 bp, Homo sapiens
gtaaatttaattttg

SEQ ID NO: 221430 - DNA, 15 bp, Homo sapiens
tgtaaatttaatttt

SEQ ID NO: 221431 - DNA, 15 bp, Homo sapiens
ttgtaaatttaattt

SEQ ID NO: 221432 - DNA, 15 bp, Homo sapiens
tttgtaaatttaatt

SEQ ID NO: 221433 - DNA, 15 bp, Homo sapiens
ttttgtaaatttaat

SEQ ID NO: 221434 - DNA, 15 bp, Homo sapiens
gttttgtaaatttaa

SEQ ID NO: 221435 - DNA, 15 bp, Homo sapiens
tgttttgtaaattta

SEQ ID NO: 221436 - DNA, 15 bp, Homo sapiens
ctgttttgtaaattt

SEQ ID NO: 221437 - DNA, 15 bp, Homo sapiens
cctgttttgtaaatt

SEQ ID NO: 221438 - DNA, 15 bp, Homo sapiens
tcctgttttgtaaat

SEQ ID NO: 221439 - DNA, 15 bp, Homo sapiens
atcctgttttgtaaa

SEQ ID NO: 221440 - DNA, 15 bp, Homo sapiens
tatcctgttttgtaa

SEQ ID NO: 221441 - DNA, 15 bp, Homo sapiens
atatcctgttttgta

SEQ ID NO: 221442 - DNA, 15 bp, Homo sapiens
catatcctgttttgt

SEQ ID NO: 221443 - DNA, 15 bp, Homo sapiens
tcatatcctgttttg

SEQ ID NO: 221444 - DNA, 15 bp, Homo sapiens
ttcatatcctgtttt

SEQ ID NO: 221445 - DNA, 15 bp, Homo sapiens
attcatatcctgttt

SEQ ID NO: 221446 - DNA, 15 bp, Homo sapiens
cattcatatcctgtt

SEQ ID NO: 221447 - DNA, 15 bp, Homo sapiens
ccattcatatcctgt

SEQ ID NO: 221448 - DNA, 15 bp, Homo sapiens
tccattcatatcctg

SEQ ID NO: 221449 - DNA, 15 bp, Homo sapiens
ttccattcatatcct

SEQ ID NO: 221450 - DNA, 15 bp, Homo sapiens
tttccattcatatcc

SEQ ID NO: 221451 - DNA, 15 bp, Homo sapiens
atttccattcatatc

SEQ ID NO: 221452 - DNA, 15 bp, Homo sapiens
aatttccattcatat

SEQ ID NO: 221453 - DNA, 15 bp, Homo sapiens
taatttccattcata

SEQ ID NO: 221454 - DNA, 15 bp, Homo sapiens
ataatttccattcat

SEQ ID NO: 221455 - DNA, 15 bp, Homo sapiens
gataatttccattca

SEQ ID NO: 221456 - DNA, 15 bp, Homo sapiens
tgataatttccattc

SEQ ID NO: 221457 - DNA, 15 bp, Homo sapiens
atgataatttccatt

SEQ ID NO: 221458 - DNA, 15 bp, Homo sapiens
tatgataatttccat

SEQ ID NO: 221459 - DNA, 15 bp, Homo sapiens
atatgataatttcca

SEQ ID NO: 221460 - DNA, 15 bp, Homo sapiens
catatgataatttcc

SEQ ID NO: 221461 - DNA, 15 bp, Homo sapiens
acatatgataatttc

SEQ ID NO: 221462 - DNA, 15 bp, Homo sapiens
tacatatgataattt

SEQ ID NO: 221463 - DNA, 15 bp, Homo sapiens
atacatatgataatt

SEQ ID NO: 221464 - DNA, 15 bp, Homo sapiens
catacatatgataat

SEQ ID NO: 221465 - DNA, 15 bp, Homo sapiens
gcatacatatgataa

SEQ ID NO: 221466 - DNA, 15 bp, Homo sapiens
agcatacatatgata

SEQ ID NO: 221467 - DNA, 15 bp, Homo sapiens
cagcatacatatgat

SEQ ID NO: 221468 - DNA, 15 bp, Homo sapiens
gcagcatacatatga

SEQ ID NO: 221469 - DNA, 15 bp, Homo sapiens
agcagcatacatatg

SEQ ID NO: 221470 - DNA, 15 bp, Homo sapiens
aagcagcatacatat

SEQ ID NO: 221471 - DNA, 15 bp, Homo sapiens
aaagcagcatacata

SEQ ID NO: 221472 - DNA, 15 bp, Homo sapiens
caaagcagcatacat

SEQ ID NO: 221473 - DNA, 15 bp, Homo sapiens
acaaagcagcataca

SEQ ID NO: 221474 - DNA, 15 bp, Homo sapiens
tacaaagcagcatac

SEQ ID NO: 221475 - DNA, 15 bp, Homo sapiens
ctacaaagcagcata

SEQ ID NO: 221476 - DNA, 15 bp, Homo sapiens
cctacaaagcagcat

SEQ ID NO: 221477 - DNA, 15 bp, Homo sapiens
tcctacaaagcagca

SEQ ID NO: 221478 - DNA, 15 bp, Homo sapiens
atcctacaaagcagc

SEQ ID NO: 221479 - DNA, 15 bp, Homo sapiens
tatcctacaaagcag

SEQ ID NO: 221480 - DNA, 15 bp, Homo sapiens
atatcctacaaagca

SEQ ID NO: 221481 - DNA, 15 bp, Homo sapiens
aatatcctacaaagc

SEQ ID NO: 221482 - DNA, 15 bp, Homo sapiens
aaatatcctacaaag

SEQ ID NO: 221483 - DNA, 15 bp, Homo sapiens
caaatatcctacaaa

SEQ ID NO: 221484 - DNA, 15 bp, Homo sapiens
ccaaatatcctacaa

SEQ ID NO: 221485 - DNA, 15 bp, Homo sapiens
cccaaatatcctaca

SEQ ID NO: 221486 - DNA, 15 bp, Homo sapiens
acccaaatatcctac

SEQ ID NO: 221487 - DNA, 15 bp, Homo sapiens
cacccaaatatccta

SEQ ID NO: 221488 - DNA, 15 bp, Homo sapiens
ccacccaaatatcct

SEQ ID NO: 221489 - DNA, 15 bp, Homo sapiens
accacccaaatatcc

SEQ ID NO: 221490 - DNA, 15 bp, Homo sapiens
caccacccaaatatc

SEQ ID NO: 221491 - DNA, 15 bp, Homo sapiens
gcaccacccaaatat

SEQ ID NO: 221492 - DNA, 15 bp, Homo sapiens
tgcaccacccaaata

SEQ ID NO: 221493 - DNA, 15 bp, Homo sapiens
atgcaccacccaaat

SEQ ID NO: 221494 - DNA, 15 bp, Homo sapiens
aatgcaccacccaaa

SEQ ID NO: 221495 - DNA, 15 bp, Homo sapiens
caatgcaccacccaa

SEQ ID NO: 221496 - DNA, 15 bp, Homo sapiens
ccaatgcaccaccca

SEQ ID NO: 221497 - DNA, 15 bp, Homo sapiens
gccaatgcaccaccc

SEQ ID NO: 221498 - DNA, 15 bp, Homo sapiens
tgccaatgcaccacc

SEQ ID NO: 221499 - DNA, 15 bp, Homo sapiens
atgccaatgcaccac

SEQ ID NO: 221500 - DNA, 15 bp, Homo sapiens
catgccaatgcacca

SEQ ID NO: 221501 - DNA, 15 bp, Homo sapiens
tcatgccaatgcacc

SEQ ID NO: 221502 - DNA, 15 bp, Homo sapiens
ctcatgccaatgcac

SEQ ID NO: 221503 - DNA, 15 bp, Homo sapiens
cctcatgccaatgca

SEQ ID NO: 221504 - DNA, 15 bp, Homo sapiens
ccctcatgccaatgc

SEQ ID NO: 221505 - DNA, 15 bp, Homo sapiens
gccctcatgccaatg

SEQ ID NO: 221506 - DNA, 15 bp, Homo sapiens
ggccctcatgccaat

SEQ ID NO: 221507 - DNA, 15 bp, Homo sapiens
tggccctcatgccaa

SEQ ID NO: 221508 - DNA, 15 bp, Homo sapiens
ctggccctcatgcca

SEQ ID NO: 221509 - DNA, 15 bp, Homo sapiens
tctggccctcatgcc

SEQ ID NO: 221510 - DNA, 15 bp, Homo sapiens
ctctggccctcatgc

SEQ ID NO: 221511 - DNA, 15 bp, Homo sapiens
gctctggccctcatg

SEQ ID NO: 221512 - DNA, 15 bp, Homo sapiens
ggctctggccctcat

SEQ ID NO: 221513 - DNA, 15 bp, Homo sapiens
gggctctggccctca

SEQ ID NO: 221514 - DNA, 15 bp, Homo sapiens
agggctctggccctc

SEQ ID NO: 221515 - DNA, 15 bp, Homo sapiens
cagggctctggccct

SEQ ID NO: 221516 - DNA, 15 bp, Homo sapiens
acagggctctggccc

SEQ ID NO: 221517 - DNA, 15 bp, Homo sapiens
tacagggctctggcc

SEQ ID NO: 221518 - DNA, 15 bp, Homo sapiens
atacagggctctggc

SEQ ID NO: 221519 - DNA, 15 bp, Homo sapiens
aatacagggctctgg

SEQ ID NO: 221520 - DNA, 15 bp, Homo sapiens
aaatacagggctctg

SEQ ID NO: 221521 - DNA, 15 bp, Homo sapiens
caaatacagggctct

SEQ ID NO: 221522 - DNA, 15 bp, Homo sapiens
acaaatacagggctc

SEQ ID NO: 221523 - DNA, 15 bp, Homo sapiens
tacaaatacagggct

SEQ ID NO: 221524 - DNA, 15 bp, Homo sapiens
gtacaaatacagggc

SEQ ID NO: 221525 - DNA, 15 bp, Homo sapiens
agtacaaatacaggg

SEQ ID NO: 221526 - DNA, 15 bp, Homo sapiens
aagtacaaatacagg

SEQ ID NO: 221527 - DNA, 15 bp, Homo sapiens
taagtacaaatacag

SEQ ID NO: 221528 - DNA, 15 bp, Homo sapiens
gtaagtacaaataca

SEQ ID NO: 221529 - DNA, 15 bp, Homo sapiens
agtaagtacaaatac

SEQ ID NO: 221530 - DNA, 15 bp, Homo sapiens
aagtaagtacaaata

SEQ ID NO: 221531 - DNA, 15 bp, Homo sapiens
caagtaagtacaaat

SEQ ID NO: 221532 - DNA, 15 bp, Homo sapiens
ccaagtaagtacaaa

SEQ ID NO: 221533 - DNA, 15 bp, Homo sapiens
gccaagtaagtacaa

SEQ ID NO: 221534 - DNA, 15 bp, Homo sapiens
tgccaagtaagtaca

SEQ ID NO: 221535 - DNA, 15 bp, Homo sapiens
atgccaagtaagtac

SEQ ID NO: 221536 - DNA, 15 bp, Homo sapiens
catgccaagtaagta

SEQ ID NO: 221537 - DNA, 15 bp, Homo sapiens
ccatgccaagtaagt

SEQ ID NO: 221538 - DNA, 15 bp, Homo sapiens
accatgccaagtaag

SEQ ID NO: 221539 - DNA, 15 bp, Homo sapiens
aaccatgccaagtaa

SEQ ID NO: 221540 - DNA, 15 bp, Homo sapiens
gaaccatgccaagta

SEQ ID NO: 221541 - DNA, 15 bp, Homo sapiens
ggaaccatgccaagt

SEQ ID NO: 221542 - DNA, 15 bp, Homo sapiens
gggaaccatgccaag

SEQ ID NO: 221543 - DNA, 15 bp, Homo sapiens
tgggaaccatgccaa

SEQ ID NO: 221544 - DNA, 15 bp, Homo sapiens
gtgggaaccatgcca

SEQ ID NO: 221545 - DNA, 15 bp, Homo sapiens
ggtgggaaccatgcc

SEQ ID NO: 221546 - DNA, 15 bp, Homo sapiens
aggtgggaaccatgc

SEQ ID NO: 221547 - DNA, 15 bp, Homo sapiens
caggtgggaaccatg

SEQ ID NO: 221548 - DNA, 15 bp, Homo sapiens
gcaggtgggaaccat

SEQ ID NO: 221549 - DNA, 15 bp, Homo sapiens
ggcaggtgggaacca

SEQ ID NO: 221550 - DNA, 15 bp, Homo sapiens
gggcaggtgggaacc

SEQ ID NO: 221551 - DNA, 15 bp, Homo sapiens
tgggcaggtgggaac

SEQ ID NO: 221552 - DNA, 15 bp, Homo sapiens
ctgggcaggtgggaa

SEQ ID NO: 221553 - DNA, 15 bp, Homo sapiens
cctgggcaggtggga

SEQ ID NO: 221554 - DNA, 15 bp, Homo sapiens
gcctgggcaggtggg

SEQ ID NO: 221555 - DNA, 15 bp, Homo sapiens
agcctgggcaggtgg

SEQ ID NO: 221556 - DNA, 15 bp, Homo sapiens
aagcctgggcaggtg

SEQ ID NO: 221557 - DNA, 15 bp, Homo sapiens
caagcctgggcaggt

SEQ ID NO: 221558 - DNA, 15 bp, Homo sapiens
gcaagcctgggcagg

SEQ ID NO: 221559 - DNA, 15 bp, Homo sapiens
ggcaagcctgggcag

SEQ ID NO: 221560 - DNA, 15 bp, Homo sapiens
aggcaagcctgggca

SEQ ID NO: 221561 - DNA, 15 bp, Homo sapiens
gaggcaagcctgggc

SEQ ID NO: 221562 - DNA, 15 bp, Homo sapiens
ggaggcaagcctggg

SEQ ID NO: 221563 - DNA, 15 bp, Homo sapiens
aggaggcaagcctgg

SEQ ID NO: 221564 - DNA, 15 bp, Homo sapiens
caggaggcaagcctg

SEQ ID NO: 221565 - DNA, 15 bp, Homo sapiens
acaggaggcaagcct

SEQ ID NO: 221566 - DNA, 15 bp, Homo sapiens
tacaggaggcaagcc

SEQ ID NO: 221567 - DNA, 15 bp, Homo sapiens
gtacaggaggcaagc

SEQ ID NO: 221568 - DNA, 15 bp, Homo sapiens
agtacaggaggcaag

SEQ ID NO: 221569 - DNA, 15 bp, Homo sapiens
aagtacaggaggcaa

SEQ ID NO: 221570 - DNA, 15 bp, Homo sapiens
gaagtacaggaggca

SEQ ID NO: 221571 - DNA, 15 bp, Homo sapiens
ggaagtacaggaggc

SEQ ID NO: 221572 - DNA, 15 bp, Homo sapiens
gggaagtacaggagg

SEQ ID NO: 221573 - DNA, 15 bp, Homo sapiens
agggaagtacaggag

SEQ ID NO: 221574 - DNA, 15 bp, Homo sapiens
tagggaagtacagga

SEQ ID NO: 221575 - DNA, 15 bp, Homo sapiens
gtagggaagtacagg

SEQ ID NO: 221576 - DNA, 15 bp, Homo sapiens
tgtagggaagtacag

SEQ ID NO: 221577 - DNA, 15 bp, Homo sapiens
atgtagggaagtaca

SEQ ID NO: 221578 - DNA, 15 bp, Homo sapiens
aatgtagggaagtac

SEQ ID NO: 221579 - DNA, 15 bp, Homo sapiens
caatgtagggaagta

SEQ ID NO: 221580 - DNA, 15 bp, Homo sapiens
ccaatgtagggaagt

SEQ ID NO: 221581 - DNA, 15 bp, Homo sapiens
gccaatgtagggaag

SEQ ID NO: 221582 - DNA, 15 bp, Homo sapiens
tgccaatgtagggaa

SEQ ID NO: 221583 - DNA, 15 bp, Homo sapiens
atgccaatgtaggga

SEQ ID NO: 221584 - DNA, 15 bp, Homo sapiens
tatgccaatgtaggg

SEQ ID NO: 221585 - DNA, 15 bp, Homo sapiens
atatgccaatgtagg

SEQ ID NO: 221586 - DNA, 15 bp, Homo sapiens
gatatgccaatgtag

SEQ ID NO: 221587 - DNA, 15 bp, Homo sapiens
tgatatgccaatgta

SEQ ID NO: 221588 - DNA, 15 bp, Homo sapiens
ttgatatgccaatgt

SEQ ID NO: 221589 - DNA, 15 bp, Homo sapiens
tttgatatgccaatg

SEQ ID NO: 221590 - DNA, 15 bp, Homo sapiens
ctttgatatgccaat

SEQ ID NO: 221591 - DNA, 15 bp, Homo sapiens
cctttgatatgccaa

SEQ ID NO: 221592 - DNA, 15 bp, Homo sapiens
tcctttgatatgcca

SEQ ID NO: 221593 - DNA, 15 bp, Homo sapiens
ctcctttgatatgcc

SEQ ID NO: 221594 - DNA, 15 bp, Homo sapiens
actcctttgatatgc

SEQ ID NO: 221595 - DNA, 15 bp, Homo sapiens
aactcctttgatatg

SEQ ID NO: 221596 - DNA, 15 bp, Homo sapiens
gaactcctttgatat

SEQ ID NO: 221597 - DNA, 15 bp, Homo sapiens
cgaactcctttgata

SEQ ID NO: 221598 - DNA, 15 bp, Homo sapiens
gcgaactcctttgat

SEQ ID NO: 221599 - DNA, 15 bp, Homo sapiens
cgcgaactcctttga

SEQ ID NO: 221600 - DNA, 15 bp, Homo sapiens
tcgcgaactcctttg

SEQ ID NO: 221601 - DNA, 15 bp, Homo sapiens
ctcgcgaactccttt

SEQ ID NO: 221602 - DNA, 15 bp, Homo sapiens
tctcgcgaactcctt

SEQ ID NO: 221603 - DNA, 15 bp, Homo sapiens
gtctcgcgaactcct

SEQ ID NO: 221604 - DNA, 15 bp, Homo sapiens
tgtctcgcgaactcc

SEQ ID NO: 221605 - DNA, 15 bp, Homo sapiens
atgtctcgcgaactc

SEQ ID NO: 221606 - DNA, 15 bp, Homo sapiens
aatgtctcgcgaact

SEQ ID NO: 221607 - DNA, 15 bp, Homo sapiens
gaatgtctcgcgaac

SEQ ID NO: 221608 - DNA, 15 bp, Homo sapiens
agaatgtctcgcgaa

SEQ ID NO: 221609 - DNA, 15 bp, Homo sapiens
gagaatgtctcgcga

SEQ ID NO: 221610 - DNA, 15 bp, Homo sapiens
ggagaatgtctcgcg

SEQ ID NO: 221611 - DNA, 15 bp, Homo sapiens
tggagaatgtctcgc

SEQ ID NO: 221612 - DNA, 15 bp, Homo sapiens
ctggagaatgtctcg

SEQ ID NO: 221613 - DNA, 15 bp, Homo sapiens
gctggagaatgtctc

SEQ ID NO: 221614 - DNA, 15 bp, Homo sapiens
ggctggagaatgtct

SEQ ID NO: 221615 - DNA, 15 bp, Homo sapiens
tggctggagaatgtc

SEQ ID NO: 221616 - DNA, 15 bp, Homo sapiens
ctggctggagaatgt

SEQ ID NO: 221617 - DNA, 15 bp, Homo sapiens
gctggctggagaatg

SEQ ID NO: 221618 - DNA, 15 bp, Homo sapiens
tgctggctggagaat

SEQ ID NO: 221619 - DNA, 15 bp, Homo sapiens
gtgctggctggagaa

SEQ ID NO: 221620 - DNA, 15 bp, Homo sapiens
ggtgctggctggaga

SEQ ID NO: 221621 - DNA, 15 bp, Homo sapiens
gggtgctggctggag

SEQ ID NO: 221622 - DNA, 15 bp, Homo sapiens
agggtgctggctgga

SEQ ID NO: 221623 - DNA, 15 bp, Homo sapiens
cagggtgctggctgg

SEQ ID NO: 221624 - DNA, 15 bp, Homo sapiens
gcagggtgctggctg

SEQ ID NO: 221625 - DNA, 15 bp, Homo sapiens
cgcagggtgctggct

SEQ ID NO: 221626 - DNA, 15 bp, Homo sapiens
gcgcagggtgctggc

SEQ ID NO: 221627 - DNA, 15 bp, Homo sapiens
tgcgcagggtgctgg

SEQ ID NO: 221628 - DNA, 15 bp, Homo sapiens
ctgcgcagggtgctg

SEQ ID NO: 221629 - DNA, 15 bp, Homo sapiens
tctgcgcagggtgct

SEQ ID NO: 221630 - DNA, 15 bp, Homo sapiens
ctctgcgcagggtgc

SEQ ID NO: 221631 - DNA, 15 bp, Homo sapiens
tctctgcgcagggtg

SEQ ID NO: 221632 - DNA, 15 bp, Homo sapiens
ctctctgcgcagggt

SEQ ID NO: 221633 - DNA, 15 bp, Homo sapiens
cctctctgcgcaggg

SEQ ID NO: 221634 - DNA, 15 bp, Homo sapiens
tcctctctgcgcagg

SEQ ID NO: 221635 - DNA, 15 bp, Homo sapiens
atcctctctgcgcag

SEQ ID NO: 221636 - DNA, 15 bp, Homo sapiens
aatcctctctgcgca

SEQ ID NO: 221637 - DNA, 15 bp, Homo sapiens
aaatcctctctgcgc

SEQ ID NO: 221638 - DNA, 15 bp, Homo sapiens
gaaatcctctctgcg

SEQ ID NO: 221639 - DNA, 15 bp, Homo sapiens
agaaatcctctctgc

SEQ ID NO: 221640 - DNA, 15 bp, Homo sapiens
aagaaatcctctctg

SEQ ID NO: 221641 - DNA, 15 bp, Homo sapiens
aaagaaatcctctct

SEQ ID NO: 221642 - DNA, 15 bp, Homo sapiens
aaaagaaatcctctc

SEQ ID NO: 221643 - DNA, 15 bp, Homo sapiens
aaaaagaaatcctct

SEQ ID NO: 221644 - DNA, 15 bp, Homo sapiens
gaaaaagaaatcctc

SEQ ID NO: 221645 - DNA, 15 bp, Homo sapiens
agaaaaagaaatcct

SEQ ID NO: 221646 - DNA, 15 bp, Homo sapiens
aagaaaaagaaatcc

SEQ ID NO: 221647 - DNA, 15 bp, Homo sapiens
aaagaaaaagaaatc

SEQ ID NO: 221648 - DNA, 15 bp, Homo sapiens
aaaaaaaagaaaaag

SEQ ID NO: 221649 - DNA, 15 bp, Homo sapiens
caaaaaaaaaagaaa

SEQ ID NO: 221650 - DNA, 15 bp, Homo sapiens
gaaaacaaaaaaaaa

SEQ ID NO: 221651 - DNA, 15 bp, Homo sapiens
agaaaacaaaaaaaa

SEQ ID NO: 221652 - DNA, 15 bp, Homo sapiens
cagaaaacaaaaaaa

SEQ ID NO: 221653 - DNA, 15 bp, Homo sapiens
tcagaaaacaaaaaa

SEQ ID NO: 221654 - DNA, 15 bp, Homo sapiens
ttcagaaaacaaaaa

SEQ ID NO: 221655 - DNA, 15 bp, Homo sapiens
cttcagaaaacaaaa

SEQ ID NO: 221656 - DNA, 15 bp, Homo sapiens
gcttcagaaaacaaa

SEQ ID NO: 221657 - DNA, 15 bp, Homo sapiens
tgcttcagaaaacaa

SEQ ID NO: 221658 - DNA, 15 bp, Homo sapiens
gtgcttcagaaaaca

SEQ ID NO: 221659 - DNA, 15 bp, Homo sapiens
cgtgcttcagaaaac

SEQ ID NO: 221660 - DNA, 15 bp, Homo sapiens
ccgtgcttcagaaaa

SEQ ID NO: 221661 - DNA, 15 bp, Homo sapiens
tccgtgcttcagaaa

SEQ ID NO: 221662 - DNA, 15 bp, Homo sapiens
ctccgtgcttcagaa

SEQ ID NO: 221663 - DNA, 15 bp, Homo sapiens
actccgtgcttcaga

SEQ ID NO: 221664 - DNA, 15 bp, Homo sapiens
aactccgtgcttcag

SEQ ID NO: 221665 - DNA, 15 bp, Homo sapiens
aaactccgtgcttca

SEQ ID NO: 221666 - DNA, 15 bp, Homo sapiens
taaactccgtgcttc

SEQ ID NO: 221667 - DNA, 15 bp, Homo sapiens
ttaaactccgtgctt

SEQ ID NO: 221668 - DNA, 15 bp, Homo sapiens
attaaactccgtgct

SEQ ID NO: 221669 - DNA, 15 bp, Homo sapiens
cattaaactccgtgc

SEQ ID NO: 221670 - DNA, 15 bp, Homo sapiens
acattaaactccgtg

SEQ ID NO: 221671 - DNA, 15 bp, Homo sapiens
cacattaaactccgt

SEQ ID NO: 221672 - DNA, 15 bp, Homo sapiens
ccacattaaactccg

SEQ ID NO: 221673 - DNA, 15 bp, Homo sapiens
accacattaaactcc

SEQ ID NO: 221674 - DNA, 15 bp, Homo sapiens
aaccacattaaactc

SEQ ID NO: 221675 - DNA, 15 bp, Homo sapiens
taaccacattaaact

SEQ ID NO: 221676 - DNA, 15 bp, Homo sapiens
ctaaccacattaaac

SEQ ID NO: 221677 - DNA, 15 bp, Homo sapiens
cctaaccacattaaa

SEQ ID NO: 221678 - DNA, 15 bp, Homo sapiens
tcctaaccacattaa

SEQ ID NO: 221679 - DNA, 15 bp, Homo sapiens
ttcctaaccacatta

SEQ ID NO: 221680 - DNA, 15 bp, Homo sapiens
cttcctaaccacatt

SEQ ID NO: 221681 - DNA, 15 bp, Homo sapiens
gcttcctaaccacat

SEQ ID NO: 221682 - DNA, 15 bp, Homo sapiens
tgcttcctaaccaca

SEQ ID NO: 221683 - DNA, 15 bp, Homo sapiens
ttgcttcctaaccac

SEQ ID NO: 221684 - DNA, 15 bp, Homo sapiens
tttgcttcctaacca

SEQ ID NO: 221685 - DNA, 15 bp, Homo sapiens
ttttgcttcctaacc

SEQ ID NO: 221686 - DNA, 15 bp, Homo sapiens
attttgcttcctaac

SEQ ID NO: 221687 - DNA, 15 bp, Homo sapiens
tattttgcttcctaa

SEQ ID NO: 221688 - DNA, 15 bp, Homo sapiens
gtattttgcttccta

SEQ ID NO: 221689 - DNA, 15 bp, Homo sapiens
tgtattttgcttcct

SEQ ID NO: 221690 - DNA, 15 bp, Homo sapiens
ttgtattttgcttcc

SEQ ID NO: 221691 - DNA, 15 bp, Homo sapiens
attgtattttgcttc

SEQ ID NO: 221692 - DNA, 15 bp, Homo sapiens
gattgtattttgctt

SEQ ID NO: 221693 - DNA, 15 bp, Homo sapiens
agattgtattttgct

SEQ ID NO: 221694 - DNA, 15 bp, Homo sapiens
tagattgtattttgc

SEQ ID NO: 221695 - DNA, 15 bp, Homo sapiens
ttagattgtattttg

SEQ ID NO: 221696 - DNA, 15 bp, Homo sapiens
cttagattgtatttt

SEQ ID NO: 221697 - DNA, 15 bp, Homo sapiens
tcttagattgtattt

SEQ ID NO: 221698 - DNA, 15 bp, Homo sapiens
gtcttagattgtatt

SEQ ID NO: 221699 - DNA, 15 bp, Homo sapiens
agtcttagattgtat

SEQ ID NO: 221700 - DNA, 15 bp, Homo sapiens
gagtcttagattgta

SEQ ID NO: 221701 - DNA, 15 bp, Homo sapiens
tgagtcttagattgt

SEQ ID NO: 221702 - DNA, 15 bp, Homo sapiens
ctgagtcttagattg

SEQ ID NO: 221703 - DNA, 15 bp, Homo sapiens
tctgagtcttagatt

SEQ ID NO: 221704 - DNA, 15 bp, Homo sapiens
gtctgagtcttagat

SEQ ID NO: 221705 - DNA, 15 bp, Homo sapiens
agtctgagtcttaga

SEQ ID NO: 221706 - DNA, 15 bp, Homo sapiens
aagtctgagtcttag

SEQ ID NO: 221707 - DNA, 15 bp, Homo sapiens
caagtctgagtctta

SEQ ID NO: 221708 - DNA, 15 bp, Homo sapiens
gcaagtctgagtctt

SEQ ID NO: 221709 - DNA, 15 bp, Homo sapiens
agcaagtctgagtct

SEQ ID NO: 221710 - DNA, 15 bp, Homo sapiens
aagcaagtctgagtc

SEQ ID NO: 221711 - DNA, 15 bp, Homo sapiens
aaagcaagtctgagt

SEQ ID NO: 221712 - DNA, 15 bp, Homo sapiens
aaaagcaagtctgag

SEQ ID NO: 221713 - DNA, 15 bp, Homo sapiens
taaaagcaagtctga

SEQ ID NO: 221714 - DNA, 15 bp, Homo sapiens
ttaaaagcaagtctg

SEQ ID NO: 221715 - DNA, 15 bp, Homo sapiens
attaaaagcaagtct

SEQ ID NO: 221716 - DNA, 15 bp, Homo sapiens
cattaaaagcaagtc

SEQ ID NO: 221717 - DNA, 15 bp, Homo sapiens
tcattaaaagcaagt

SEQ ID NO: 221718 - DNA, 15 bp, Homo sapiens
ttcattaaaagcaag

SEQ ID NO: 221719 - DNA, 15 bp, Homo sapiens
attcattaaaagcaa

SEQ ID NO: 221720 - DNA, 15 bp, Homo sapiens
gattcattaaaagca

SEQ ID NO: 221721 - DNA, 15 bp, Homo sapiens
ggattcattaaaagc

SEQ ID NO: 221722 - DNA, 15 bp, Homo sapiens
tggattcattaaaag

SEQ ID NO: 221723 - DNA, 15 bp, Homo sapiens
ctggattcattaaaa

SEQ ID NO: 221724 - DNA, 15 bp, Homo sapiens
cctggattcattaaa

SEQ ID NO: 221725 - DNA, 15 bp, Homo sapiens
tcctggattcattaa

SEQ ID NO: 221726 - DNA, 15 bp, Homo sapiens
ctcctggattcatta

SEQ ID NO: 221727 - DNA, 15 bp, Homo sapiens
tctcctggattcatt

SEQ ID NO: 221728 - DNA, 15 bp, Homo sapiens
gtctcctggattcat

SEQ ID NO: 221729 - DNA, 15 bp, Homo sapiens
ggtctcctggattca

SEQ ID NO: 221730 - DNA, 15 bp, Homo sapiens
aggtctcctggattc

SEQ ID NO: 221731 - DNA, 15 bp, Homo sapiens
caggtctcctggatt

SEQ ID NO: 221732 - DNA, 15 bp, Homo sapiens
tcaggtctcctggat

SEQ ID NO: 221733 - DNA, 15 bp, Homo sapiens
gtcaggtctcctgga

SEQ ID NO: 221734 - DNA, 15 bp, Homo sapiens
tgtcaggtctcctgg

SEQ ID NO: 221735 - DNA, 15 bp, Homo sapiens
ttgtcaggtctcctg

SEQ ID NO: 221736 - DNA, 15 bp, Homo sapiens
attgtcaggtctcct

SEQ ID NO: 221737 - DNA, 15 bp, Homo sapiens
cattgtcaggtctcc

SEQ ID NO: 221738 - DNA, 15 bp, Homo sapiens
tcattgtcaggtctc

SEQ ID NO: 221739 - DNA, 15 bp, Homo sapiens
atcattgtcaggtct

SEQ ID NO: 221740 - DNA, 15 bp, Homo sapiens
tatcattgtcaggtc

SEQ ID NO: 221741 - DNA, 15 bp, Homo sapiens
gtatcattgtcaggt

SEQ ID NO: 221742 - DNA, 15 bp, Homo sapiens
tgtatcattgtcagg

SEQ ID NO: 221743 - DNA, 15 bp, Homo sapiens
atgtatcattgtcag

SEQ ID NO: 221744 - DNA, 15 bp, Homo sapiens
aatgtatcattgtca

SEQ ID NO: 221745 - DNA, 15 bp, Homo sapiens
taatgtatcattgtc

SEQ ID NO: 221746 - DNA, 15 bp, Homo sapiens
ataatgtatcattgt

SEQ ID NO: 221747 - DNA, 15 bp, Homo sapiens
tataatgtatcattg

SEQ ID NO: 221748 - DNA, 15 bp, Homo sapiens
ttataatgtatcatt

SEQ ID NO: 221749 - DNA, 15 bp, Homo sapiens
tttataatgtatcat

SEQ ID NO: 221750 - DNA, 15 bp, Homo sapiens
ttttataatgtatca

SEQ ID NO: 221751 - DNA, 15 bp, Homo sapiens
tttttataatgtatc

SEQ ID NO: 221752 - DNA, 15 bp, Homo sapiens
ttttttataatgtat

SEQ ID NO: 221753 - DNA, 15 bp, Homo sapiens
gttttttataatgta

SEQ ID NO: 221754 - DNA, 15 bp, Homo sapiens
tgttttttataatgt

SEQ ID NO: 221755 - DNA, 15 bp, Homo sapiens
ttgttttttataatg

SEQ ID NO: 221756 - DNA, 15 bp, Homo sapiens
tttgttttttataat

SEQ ID NO: 221757 - DNA, 15 bp, Homo sapiens
ttttgttttttataa

SEQ ID NO: 221758 - DNA, 15 bp, Homo sapiens
tttttgttttttata

SEQ ID NO: 221759 - DNA, 15 bp, Homo sapiens
atttttgttttttat

SEQ ID NO: 221760 - DNA, 15 bp, Homo sapiens
tatttttgtttttta

SEQ ID NO: 221761 - DNA, 15 bp, Homo sapiens
tttatttttgttttt

SEQ ID NO: 221762 - DNA, 15 bp, Homo sapiens
ttttatttttgtttt

SEQ ID NO: 221763 - DNA, 15 bp, Homo sapiens
tttttatttttgttt

SEQ ID NO: 221764 - DNA, 15 bp, Homo sapiens
atttttatttttgtt

SEQ ID NO: 221765 - DNA, 15 bp, Homo sapiens
gatttttatttttgt

SEQ ID NO: 221766 - DNA, 15 bp, Homo sapiens
agatttttatttttg

SEQ ID NO: 221767 - DNA, 15 bp, Homo sapiens
cagatttttattttt

SEQ ID NO: 221768 - DNA, 15 bp, Homo sapiens
tcagatttttatttt

SEQ ID NO: 221769 - DNA, 15 bp, Homo sapiens
gtcagatttttattt

SEQ ID NO: 221770 - DNA, 15 bp, Homo sapiens
tgtcagatttttatt

SEQ ID NO: 221771 - DNA, 15 bp, Homo sapiens
ttgtcagatttttat

SEQ ID NO: 221772 - DNA, 15 bp, Homo sapiens
attgtcagattttta

SEQ ID NO: 221773 - DNA, 15 bp, Homo sapiens
tattgtcagattttt

SEQ ID NO: 221774 - DNA, 15 bp, Homo sapiens
gtattgtcagatttt

SEQ ID NO: 221775 - DNA, 15 bp, Homo sapiens
ggtattgtcagattt

SEQ ID NO: 221776 - DNA, 15 bp, Homo sapiens
gggtattgtcagatt

SEQ ID NO: 221777 - DNA, 15 bp, Homo sapiens
ggggtattgtcagat

SEQ ID NO: 221778 - DNA, 15 bp, Homo sapiens
gggggtattgtcaga

SEQ ID NO: 221779 - DNA, 15 bp, Homo sapiens
ggggggtattgtcag

SEQ ID NO: 221780 - DNA, 15 bp, Homo sapiens
tggggggtattgtca

SEQ ID NO: 221781 - DNA, 15 bp, Homo sapiens
ttggggggtattgtc

SEQ ID NO: 221782 - DNA, 15 bp, Homo sapiens
gttggggggtattgt

SEQ ID NO: 221783 - DNA, 15 bp, Homo sapiens
agttggggggtattg

SEQ ID NO: 221784 - DNA, 15 bp, Homo sapiens
aagttggggggtatt

SEQ ID NO: 221785 - DNA, 15 bp, Homo sapiens
caagttggggggtat

SEQ ID NO: 221786 - DNA, 15 bp, Homo sapiens
acaagttggggggta

SEQ ID NO: 221787 - DNA, 15 bp, Homo sapiens
gacaagttggggggt

SEQ ID NO: 221788 - DNA, 15 bp, Homo sapiens
tgacaagttgggggg

SEQ ID NO: 221789 - DNA, 15 bp, Homo sapiens
ctgacaagttggggg

SEQ ID NO: 221790 - DNA, 15 bp, Homo sapiens
actgacaagttgggg

SEQ ID NO: 221791 - DNA, 15 bp, Homo sapiens
cactgacaagttggg

SEQ ID NO: 221792 - DNA, 15 bp, Homo sapiens
ccactgacaagttgg

SEQ ID NO: 221793 - DNA, 15 bp, Homo sapiens
gccactgacaagttg

SEQ ID NO: 221794 - DNA, 15 bp, Homo sapiens
agccactgacaagtt

SEQ ID NO: 221795 - DNA, 15 bp, Homo sapiens
aagccactgacaagt

SEQ ID NO: 221796 - DNA, 15 bp, Homo sapiens
gaagccactgacaag

SEQ ID NO: 221797 - DNA, 15 bp, Homo sapiens
ggaagccactgacaa

SEQ ID NO: 221798 - DNA, 15 bp, Homo sapiens
gggaagccactgaca

SEQ ID NO: 221799 - DNA, 15 bp, Homo sapiens
tgggaagccactgac

SEQ ID NO: 221800 - DNA, 15 bp, Homo sapiens
atgggaagccactga

SEQ ID NO: 221801 - DNA, 15 bp, Homo sapiens
tatgggaagccactg

SEQ ID NO: 221802 - DNA, 15 bp, Homo sapiens
ctatgggaagccact

SEQ ID NO: 221803 - DNA, 15 bp, Homo sapiens
gctatgggaagccac

SEQ ID NO: 221804 - DNA, 15 bp, Homo sapiens
ggctatgggaagcca

SEQ ID NO: 221805 - DNA, 15 bp, Homo sapiens
gggctatgggaagcc

SEQ ID NO: 221806 - DNA, 15 bp, Homo sapiens
tgggctatgggaagc

SEQ ID NO: 221807 - DNA, 15 bp, Homo sapiens
atgggctatgggaag

SEQ ID NO: 221808 - DNA, 15 bp, Homo sapiens
catgggctatgggaa

SEQ ID NO: 221809 - DNA, 15 bp, Homo sapiens
tcatgggctatggga

SEQ ID NO: 221810 - DNA, 15 bp, Homo sapiens
atcatgggctatggg

SEQ ID NO: 221811 - DNA, 15 bp, Homo sapiens
aatcatgggctatgg

SEQ ID NO: 221812 - DNA, 15 bp, Homo sapiens
caatcatgggctatg

SEQ ID NO: 221813 - DNA, 15 bp, Homo sapiens
ccaatcatgggctat

SEQ ID NO: 221814 - DNA, 15 bp, Homo sapiens
cccaatcatgggcta

SEQ ID NO: 221815 - DNA, 15 bp, Homo sapiens
acccaatcatgggct

SEQ ID NO: 221816 - DNA, 15 bp, Homo sapiens
aacccaatcatgggc

SEQ ID NO: 221817 - DNA, 15 bp, Homo sapiens
caacccaatcatggg

SEQ ID NO: 221818 - DNA, 15 bp, Homo sapiens
tcaacccaatcatgg

SEQ ID NO: 221819 - DNA, 15 bp, Homo sapiens
ctcaacccaatcatg

SEQ ID NO: 221820 - DNA, 15 bp, Homo sapiens
actcaacccaatcat

SEQ ID NO: 221821 - DNA, 15 bp, Homo sapiens
cactcaacccaatca

SEQ ID NO: 221822 - DNA, 15 bp, Homo sapiens
tcactcaacccaatc

SEQ ID NO: 221823 - DNA, 15 bp, Homo sapiens
ctcactcaacccaat

SEQ ID NO: 221824 - DNA, 15 bp, Homo sapiens
actcactcaacccaa

SEQ ID NO: 221825 - DNA, 15 bp, Homo sapiens
gactcactcaaccca

SEQ ID NO: 221826 - DNA, 15 bp, Homo sapiens
agactcactcaaccc

SEQ ID NO: 221827 - DNA, 15 bp, Homo sapiens
gagactcactcaacc

SEQ ID NO: 221828 - DNA, 15 bp, Homo sapiens
tgagactcactcaac

SEQ ID NO: 221829 - DNA, 15 bp, Homo sapiens
ctgagactcactcaa

SEQ ID NO: 221830 - DNA, 15 bp, Homo sapiens
actgagactcactca

SEQ ID NO: 221831 - DNA, 15 bp, Homo sapiens
cactgagactcactc

SEQ ID NO: 221832 - DNA, 15 bp, Homo sapiens
gcactgagactcact

SEQ ID NO: 221833 - DNA, 15 bp, Homo sapiens
tgcactgagactcac

SEQ ID NO: 221834 - DNA, 15 bp, Homo sapiens
atgcactgagactca

SEQ ID NO: 221835 - DNA, 15 bp, Homo sapiens
tatgcactgagactc

SEQ ID NO: 221836 - DNA, 15 bp, Homo sapiens
ctatgcactgagact

SEQ ID NO: 221837 - DNA, 15 bp, Homo sapiens
cctatgcactgagac

SEQ ID NO: 221838 - DNA, 15 bp, Homo sapiens
tcctatgcactgaga

SEQ ID NO: 221839 - DNA, 15 bp, Homo sapiens
ttcctatgcactgag

SEQ ID NO: 221840 - DNA, 15 bp, Homo sapiens
cttcctatgcactga

SEQ ID NO: 221841 - DNA, 15 bp, Homo sapiens
gcttcctatgcactg

SEQ ID NO: 221842 - DNA, 15 bp, Homo sapiens
tgcttcctatgcact

SEQ ID NO: 221843 - DNA, 15 bp, Homo sapiens
ctgcttcctatgcac

SEQ ID NO: 221844 - DNA, 15 bp, Homo sapiens
actgcttcctatgca

SEQ ID NO: 221845 - DNA, 15 bp, Homo sapiens
cactgcttcctatgc

SEQ ID NO: 221846 - DNA, 15 bp, Homo sapiens
gcactgcttcctatg

SEQ ID NO: 221847 - DNA, 15 bp, Homo sapiens
tgcactgcttcctat

SEQ ID NO: 221848 - DNA, 15 bp, Homo sapiens
ctgcactgcttccta

SEQ ID NO: 221849 - DNA, 15 bp, Homo sapiens
actgcactgcttcct

SEQ ID NO: 221850 - DNA, 15 bp, Homo sapiens
cactgcactgcttcc

SEQ ID NO: 221851 - DNA, 15 bp, Homo sapiens
ccactgcactgcttc

SEQ ID NO: 221852 - DNA, 15 bp, Homo sapiens
accactgcactgctt

SEQ ID NO: 221853 - DNA, 15 bp, Homo sapiens
gaccactgcactgct

SEQ ID NO: 221854 - DNA, 15 bp, Homo sapiens
agaccactgcactgc

SEQ ID NO: 221855 - DNA, 15 bp, Homo sapiens
aagaccactgcactg

SEQ ID NO: 221856 - DNA, 15 bp, Homo sapiens
aaagaccactgcact

SEQ ID NO: 221857 - DNA, 15 bp, Homo sapiens
caaagaccactgcac

SEQ ID NO: 221858 - DNA, 15 bp, Homo sapiens
acaaagaccactgca

SEQ ID NO: 221859 - DNA, 15 bp, Homo sapiens
cacaaagaccactgc

SEQ ID NO: 221860 - DNA, 15 bp, Homo sapiens
ccacaaagaccactg

SEQ ID NO: 221861 - DNA, 15 bp, Homo sapiens
gccacaaagaccact

SEQ ID NO: 221862 - DNA, 15 bp, Homo sapiens
ggccacaaagaccac

SEQ ID NO: 221863 - DNA, 15 bp, Homo sapiens
aggccacaaagacca

SEQ ID NO: 221864 - DNA, 15 bp, Homo sapiens
caggccacaaagacc

SEQ ID NO: 221865 - DNA, 15 bp, Homo sapiens
tcaggccacaaagac

SEQ ID NO: 221866 - DNA, 15 bp, Homo sapiens
gtcaggccacaaaga

SEQ ID NO: 221867 - DNA, 15 bp, Homo sapiens
ggtcaggccacaaag

SEQ ID NO: 221868 - DNA, 15 bp, Homo sapiens
aggtcaggccacaaa

SEQ ID NO: 221869 - DNA, 15 bp, Homo sapiens
gaggtcaggccacaa

SEQ ID NO: 221870 - DNA, 15 bp, Homo sapiens
ggaggtcaggccaca

SEQ ID NO: 221871 - DNA, 15 bp, Homo sapiens
cggaggtcaggccac

SEQ ID NO: 221872 - DNA, 15 bp, Homo sapiens
gcggaggtcaggcca

SEQ ID NO: 221873 - DNA, 15 bp, Homo sapiens
ggcggaggtcaggcc

SEQ ID NO: 221874 - DNA, 15 bp, Homo sapiens
gggcggaggtcaggc

SEQ ID NO: 221875 - DNA, 15 bp, Homo sapiens
tgggcggaggtcagg

SEQ ID NO: 221876 - DNA, 15 bp, Homo sapiens
gtgggcggaggtcag

SEQ ID NO: 221877 - DNA, 15 bp, Homo sapiens
tgtgggcggaggtca

SEQ ID NO: 221878 - DNA, 15 bp, Homo sapiens
gtgtgggcggaggtc

SEQ ID NO: 221879 - DNA, 15 bp, Homo sapiens
ggtgtgggcggaggt

SEQ ID NO: 221880 - DNA, 15 bp, Homo sapiens
aggtgtgggcggagg

SEQ ID NO: 221881 - DNA, 15 bp, Homo sapiens
aaggtgtgggcggag

SEQ ID NO: 221882 - DNA, 15 bp, Homo sapiens
gaaggtgtgggcgga

SEQ ID NO: 221883 - DNA, 15 bp, Homo sapiens
tgaaggtgtgggcgg

SEQ ID NO: 221884 - DNA, 15 bp, Homo sapiens
ctgaaggtgtgggcg

SEQ ID NO: 221885 - DNA, 15 bp, Homo sapiens
gctgaaggtgtgggc

SEQ ID NO: 221886 - DNA, 15 bp, Homo sapiens
agctgaaggtgtggg

SEQ ID NO: 221887 - DNA, 15 bp, Homo sapiens
aagctgaaggtgtgg

SEQ ID NO: 221888 - DNA, 15 bp, Homo sapiens
gaagctgaaggtgtg

SEQ ID NO: 221889 - DNA, 15 bp, Homo sapiens
tgaagctgaaggtgt

SEQ ID NO: 221890 - DNA, 15 bp, Homo sapiens
ctgaagctgaaggtg

SEQ ID NO: 221891 - DNA, 15 bp, Homo sapiens
gctgaagctgaaggt

SEQ ID NO: 221892 - DNA, 15 bp, Homo sapiens
agctgaagctgaagg

SEQ ID NO: 221893 - DNA, 15 bp, Homo sapiens
cagctgaagctgaag

SEQ ID NO: 221894 - DNA, 15 bp, Homo sapiens
gcagctgaagctgaa

SEQ ID NO: 221895 - DNA, 15 bp, Homo sapiens
agcagctgaagctga

SEQ ID NO: 221896 - DNA, 15 bp, Homo sapiens
tagcagctgaagctg

SEQ ID NO: 221897 - DNA, 15 bp, Homo sapiens
gtagcagctgaagct

SEQ ID NO: 221898 - DNA, 15 bp, Homo sapiens
ggtagcagctgaagc

SEQ ID NO: 221899 - DNA, 15 bp, Homo sapiens
cggtagcagctgaag

SEQ ID NO: 221900 - DNA, 15 bp, Homo sapiens
gcggtagcagctgaa

SEQ ID NO: 221901 - DNA, 15 bp, Homo sapiens
agcggtagcagctga

SEQ ID NO: 221902 - DNA, 15 bp, Homo sapiens
gagcggtagcagctg

SEQ ID NO: 221903 - DNA, 15 bp, Homo sapiens
agagcggtagcagct

SEQ ID NO: 221904 - DNA, 15 bp, Homo sapiens
gagagcggtagcagc

SEQ ID NO: 221905 - DNA, 15 bp, Homo sapiens
agagagcggtagcag

SEQ ID NO: 221906 - DNA, 15 bp, Homo sapiens
cagagagcggtagca

SEQ ID NO: 221907 - DNA, 15 bp, Homo sapiens
tcagagagcggtagc

SEQ ID NO: 221908 - DNA, 15 bp, Homo sapiens
ctcagagagcggtag

SEQ ID NO: 221909 - DNA, 15 bp, Homo sapiens
actcagagagcggta

SEQ ID NO: 221910 - DNA, 15 bp, Homo sapiens
tactcagagagcggt

SEQ ID NO: 221911 - DNA, 15 bp, Homo sapiens
gtactcagagagcgg

SEQ ID NO: 221912 - DNA, 15 bp, Homo sapiens
agtactcagagagcg

SEQ ID NO: 221913 - DNA, 15 bp, Homo sapiens
cagtactcagagagc

SEQ ID NO: 221914 - DNA, 15 bp, Homo sapiens
tcagtactcagagag

SEQ ID NO: 221915 - DNA, 15 bp, Homo sapiens
ttcagtactcagaga

SEQ ID NO: 221916 - DNA, 15 bp, Homo sapiens
cttcagtactcagag

SEQ ID NO: 221917 - DNA, 15 bp, Homo sapiens
acttcagtactcaga

SEQ ID NO: 221918 - DNA, 15 bp, Homo sapiens
aacttcagtactcag

SEQ ID NO: 221919 - DNA, 15 bp, Homo sapiens
aaacttcagtactca

SEQ ID NO: 221920 - DNA, 15 bp, Homo sapiens
aaaacttcagtactc

SEQ ID NO: 221921 - DNA, 15 bp, Homo sapiens
aaaaacttcagtact

SEQ ID NO: 221922 - DNA, 15 bp, Homo sapiens
taaaaacttcagtac

SEQ ID NO: 221923 - DNA, 15 bp, Homo sapiens
ataaaaacttcagta

SEQ ID NO: 221924 - DNA, 15 bp, Homo sapiens
tataaaaacttcagt

SEQ ID NO: 221925 - DNA, 15 bp, Homo sapiens
ctataaaaacttcag

SEQ ID NO: 221926 - DNA, 15 bp, Homo sapiens
actataaaaacttca

SEQ ID NO: 221927 - DNA, 15 bp, Homo sapiens
aactataaaaacttc

SEQ ID NO: 221928 - DNA, 15 bp, Homo sapiens
gaactataaaaactt

SEQ ID NO: 221929 - DNA, 15 bp, Homo sapiens
ggaactataaaaact

SEQ ID NO: 221930 - DNA, 15 bp, Homo sapiens
gggaactataaaaac

SEQ ID NO: 221931 - DNA, 15 bp, Homo sapiens
agggaactataaaaa

SEQ ID NO: 221932 - DNA, 15 bp, Homo sapiens
cagggaactataaaa

SEQ ID NO: 221933 - DNA, 15 bp, Homo sapiens
tcagggaactataaa

SEQ ID NO: 221934 - DNA, 15 bp, Homo sapiens
ctcagggaactataa

SEQ ID NO: 221935 - DNA, 15 bp, Homo sapiens
cctcagggaactata

SEQ ID NO: 221936 - DNA, 15 bp, Homo sapiens
ccctcagggaactat

SEQ ID NO: 221937 - DNA, 15 bp, Homo sapiens
gccctcagggaacta

SEQ ID NO: 221938 - DNA, 15 bp, Homo sapiens
cgccctcagggaact

SEQ ID NO: 221939 - DNA, 15 bp, Homo sapiens
gcgccctcagggaac

SEQ ID NO: 221940 - DNA, 15 bp, Homo sapiens
tgcgccctcagggaa

SEQ ID NO: 221941 - DNA, 15 bp, Homo sapiens
gtgcgccctcaggga

SEQ ID NO: 221942 - DNA, 15 bp, Homo sapiens
tgtgcgccctcaggg

SEQ ID NO: 221943 - DNA, 15 bp, Homo sapiens
gtgtgcgccctcagg

SEQ ID NO: 221944 - DNA, 15 bp, Homo sapiens
agtgtgcgccctcag

SEQ ID NO: 221945 - DNA, 15 bp, Homo sapiens
cagtgtgcgccctca

SEQ ID NO: 221946 - DNA, 15 bp, Homo sapiens
acagtgtgcgccctc

SEQ ID NO: 221947 - DNA, 15 bp, Homo sapiens
cacagtgtgcgccct

SEQ ID NO: 221948 - DNA, 15 bp, Homo sapiens
tcacagtgtgcgccc

SEQ ID NO: 221949 - DNA, 15 bp, Homo sapiens
gtcacagtgtgcgcc

SEQ ID NO: 221950 - DNA, 15 bp, Homo sapiens
tgtcacagtgtgcgc

SEQ ID NO: 221951 - DNA, 15 bp, Homo sapiens
gtgtcacagtgtgcg

SEQ ID NO: 221952 - DNA, 15 bp, Homo sapiens
agtgtcacagtgtgc

SEQ ID NO: 221953 - DNA, 15 bp, Homo sapiens
gagtgtcacagtgtg

SEQ ID NO: 221954 - DNA, 15 bp, Homo sapiens
ggagtgtcacagtgt

SEQ ID NO: 221955 - DNA, 15 bp, Homo sapiens
aggagtgtcacagtg

SEQ ID NO: 221956 - DNA, 15 bp, Homo sapiens
caggagtgtcacagt

SEQ ID NO: 221957 - DNA, 15 bp, Homo sapiens
gcaggagtgtcacag

SEQ ID NO: 221958 - DNA, 15 bp, Homo sapiens
tgcaggagtgtcaca

SEQ ID NO: 221959 - DNA, 15 bp, Homo sapiens
atgcaggagtgtcac

SEQ ID NO: 221960 - DNA, 15 bp, Homo sapiens
aatgcaggagtgtca

SEQ ID NO: 221961 - DNA, 15 bp, Homo sapiens
gaatgcaggagtgtc

SEQ ID NO: 221962 - DNA, 15 bp, Homo sapiens
agaatgcaggagtgt

SEQ ID NO: 221963 - DNA, 15 bp, Homo sapiens
gagaatgcaggagtg

SEQ ID NO: 221964 - DNA, 15 bp, Homo sapiens
agagaatgcaggagt

SEQ ID NO: 221965 - DNA, 15 bp, Homo sapiens
cagagaatgcaggag

SEQ ID NO: 221966 - DNA, 15 bp, Homo sapiens
gcagagaatgcagga

SEQ ID NO: 221967 - DNA, 15 bp, Homo sapiens
agcagagaatgcagg

SEQ ID NO: 221968 - DNA, 15 bp, Homo sapiens
tagcagagaatgcag

SEQ ID NO: 221969 - DNA, 15 bp, Homo sapiens
ctagcagagaatgca

SEQ ID NO: 221970 - DNA, 15 bp, Homo sapiens
actagcagagaatgc

SEQ ID NO: 221971 - DNA, 15 bp, Homo sapiens
cactagcagagaatg

SEQ ID NO: 221972 - DNA, 15 bp, Homo sapiens
acactagcagagaat

SEQ ID NO: 221973 - DNA, 15 bp, Homo sapiens
aacactagcagagaa

SEQ ID NO: 221974 - DNA, 15 bp, Homo sapiens
aaacactagcagaga

SEQ ID NO: 221975 - DNA, 15 bp, Homo sapiens
taaacactagcagag

SEQ ID NO: 221976 - DNA, 15 bp, Homo sapiens
ctaaacactagcaga

SEQ ID NO: 221977 - DNA, 15 bp, Homo sapiens
actaaacactagcag

SEQ ID NO: 221978 - DNA, 15 bp, Homo sapiens
aactaaacactagca

SEQ ID NO: 221979 - DNA, 15 bp, Homo sapiens
aaactaaacactagc

SEQ ID NO: 221980 - DNA, 15 bp, Homo sapiens
gaaactaaacactag

SEQ ID NO: 221981 - DNA, 15 bp, Homo sapiens
ggaaactaaacacta

SEQ ID NO: 221982 - DNA, 15 bp, Homo sapiens
aggaaactaaacact

SEQ ID NO: 221983 - DNA, 15 bp, Homo sapiens
aaggaaactaaacac

SEQ ID NO: 221984 - DNA, 15 bp, Homo sapiens
aaaggaaactaaaca

SEQ ID NO: 221985 - DNA, 15 bp, Homo sapiens
caaaggaaactaaac

SEQ ID NO: 221986 - DNA, 15 bp, Homo sapiens
gcaaaggaaactaaa

SEQ ID NO: 221987 - DNA, 15 bp, Homo sapiens
agcaaaggaaactaa

SEQ ID NO: 221988 - DNA, 15 bp, Homo sapiens
cagcaaaggaaacta

SEQ ID NO: 221989 - DNA, 15 bp, Homo sapiens
ccagcaaaggaaact

SEQ ID NO: 221990 - DNA, 15 bp, Homo sapiens
cccagcaaaggaaac

SEQ ID NO: 221991 - DNA, 15 bp, Homo sapiens
tcccagcaaaggaaa

SEQ ID NO: 221992 - DNA, 15 bp, Homo sapiens
ctcccagcaaaggaa

SEQ ID NO: 221993 - DNA, 15 bp, Homo sapiens
actcccagcaaagga

SEQ ID NO: 221994 - DNA, 15 bp, Homo sapiens
tactcccagcaaagg

SEQ ID NO: 221995 - DNA, 15 bp, Homo sapiens
gtactcccagcaaag

SEQ ID NO: 221996 - DNA, 15 bp, Homo sapiens
ggtactcccagcaaa

SEQ ID NO: 221997 - DNA, 15 bp, Homo sapiens
aggtactcccagcaa

SEQ ID NO: 221998 - DNA, 15 bp, Homo sapiens
aaggtactcccagca

SEQ ID NO: 221999 - DNA, 15 bp, Homo sapiens
aaaggtactcccagc

SEQ ID NO: 222000 - DNA, 15 bp, Homo sapiens
gaaaggtactcccag

SEQ ID NO: 222001 - DNA, 15 bp, Homo sapiens
ggaaaggtactccca

SEQ ID NO: 222002 - DNA, 15 bp, Homo sapiens
gggaaaggtactccc

SEQ ID NO: 222003 - DNA, 15 bp, Homo sapiens
agggaaaggtactcc

SEQ ID NO: 222004 - DNA, 15 bp, Homo sapiens
gagggaaaggtactc

SEQ ID NO: 222005 - DNA, 15 bp, Homo sapiens
agagggaaaggtact

SEQ ID NO: 222006 - DNA, 15 bp, Homo sapiens
gagagggaaaggtac

SEQ ID NO: 222007 - DNA, 15 bp, Homo sapiens
agagagggaaaggta

SEQ ID NO: 222008 - DNA, 15 bp, Homo sapiens
cagagagggaaaggt

SEQ ID NO: 222009 - DNA, 15 bp, Homo sapiens
gcagagagggaaagg

SEQ ID NO: 222010 - DNA, 15 bp, Homo sapiens
tgcagagagggaaag

SEQ ID NO: 222011 - DNA, 15 bp, Homo sapiens
ttgcagagagggaaa

SEQ ID NO: 222012 - DNA, 15 bp, Homo sapiens
cttgcagagagggaa

SEQ ID NO: 222013 - DNA, 15 bp, Homo sapiens
tcttgcagagaggga

SEQ ID NO: 222014 - DNA, 15 bp, Homo sapiens
gtcttgcagagaggg

SEQ ID NO: 222015 - DNA, 15 bp, Homo sapiens
agtcttgcagagagg

SEQ ID NO: 222016 - DNA, 15 bp, Homo sapiens
gagtcttgcagagag

SEQ ID NO: 222017 - DNA, 15 bp, Homo sapiens
tgagtcttgcagaga

SEQ ID NO: 222018 - DNA, 15 bp, Homo sapiens
ttgagtcttgcagag

SEQ ID NO: 222019 - DNA, 15 bp, Homo sapiens
attgagtcttgcaga

SEQ ID NO: 222020 - DNA, 15 bp, Homo sapiens
aattgagtcttgcag

SEQ ID NO: 222021 - DNA, 15 bp, Homo sapiens
aaattgagtcttgca

SEQ ID NO: 222022 - DNA, 15 bp, Homo sapiens
taaattgagtcttgc

SEQ ID NO: 222023 - DNA, 15 bp, Homo sapiens
gtaaattgagtcttg

SEQ ID NO: 222024 - DNA, 15 bp, Homo sapiens
cgtaaattgagtctt

SEQ ID NO: 222025 - DNA, 15 bp, Homo sapiens
gcgtaaattgagtct

SEQ ID NO: 222026 - DNA, 15 bp, Homo sapiens
tgcgtaaattgagtc

SEQ ID NO: 222027 - DNA, 15 bp, Homo sapiens
gtgcgtaaattgagt

SEQ ID NO: 222028 - DNA, 15 bp, Homo sapiens
ggtgcgtaaattgag

SEQ ID NO: 222029 - DNA, 15 bp, Homo sapiens
tggtgcgtaaattga

SEQ ID NO: 222030 - DNA, 15 bp, Homo sapiens
gtggtgcgtaaattg

SEQ ID NO: 222031 - DNA, 15 bp, Homo sapiens
ggtggtgcgtaaatt

SEQ ID NO: 222032 - DNA, 15 bp, Homo sapiens
aggtggtgcgtaaat

SEQ ID NO: 222033 - DNA, 15 bp, Homo sapiens
gaggtggtgcgtaaa

SEQ ID NO: 222034 - DNA, 15 bp, Homo sapiens
ggaggtggtgcgtaa

SEQ ID NO: 222035 - DNA, 15 bp, Homo sapiens
gggaggtggtgcgta

SEQ ID NO: 222036 - DNA, 15 bp, Homo sapiens
ggggaggtggtgcgt

SEQ ID NO: 222037 - DNA, 15 bp, Homo sapiens
gggggaggtggtgcg

SEQ ID NO: 222038 - DNA, 15 bp, Homo sapiens
tgggggaggtggtgc

SEQ ID NO: 222039 - DNA, 15 bp, Homo sapiens
ctgggggaggtggtg

SEQ ID NO: 222040 - DNA, 15 bp, Homo sapiens
cctgggggaggtggt

SEQ ID NO: 222041 - DNA, 15 bp, Homo sapiens
tcctgggggaggtgg

SEQ ID NO: 222042 - DNA, 15 bp, Homo sapiens
ttcctgggggaggtg

SEQ ID NO: 222043 - DNA, 15 bp, Homo sapiens
cttcctgggggaggt

SEQ ID NO: 222044 - DNA, 15 bp, Homo sapiens
gcttcctgggggagg

SEQ ID NO: 222045 - DNA, 15 bp, Homo sapiens
tgcttcctgggggag

SEQ ID NO: 222046 - DNA, 15 bp, Homo sapiens
atgcttcctggggga

SEQ ID NO: 222047 - DNA, 15 bp, Homo sapiens
aatgcttcctggggg

SEQ ID NO: 222048 - DNA, 15 bp, Homo sapiens
taatgcttcctgggg

SEQ ID NO: 222049 - DNA, 15 bp, Homo sapiens
gtaatgcttcctggg

SEQ ID NO: 222050 - DNA, 15 bp, Homo sapiens
tgtaatgcttcctgg

SEQ ID NO: 222051 - DNA, 15 bp, Homo sapiens
ctgtaatgcttcctg

SEQ ID NO: 222052 - DNA, 15 bp, Homo sapiens
tctgtaatgcttcct

SEQ ID NO: 222053 - DNA, 15 bp, Homo sapiens
atctgtaatgcttcc

SEQ ID NO: 222054 - DNA, 15 bp, Homo sapiens
gatctgtaatgcttc

SEQ ID NO: 222055 - DNA, 15 bp, Homo sapiens
ggatctgtaatgctt

SEQ ID NO: 222056 - DNA, 15 bp, Homo sapiens
gggatctgtaatgct

SEQ ID NO: 222057 - DNA, 15 bp, Homo sapiens
ggggatctgtaatgc

SEQ ID NO: 222058 - DNA, 15 bp, Homo sapiens
gggggatctgtaatg

SEQ ID NO: 222059 - DNA, 15 bp, Homo sapiens
tgggggatctgtaat

SEQ ID NO: 222060 - DNA, 15 bp, Homo sapiens
ttgggggatctgtaa

SEQ ID NO: 222061 - DNA, 15 bp, Homo sapiens
cttgggggatctgta

SEQ ID NO: 222062 - DNA, 15 bp, Homo sapiens
ccttgggggatctgt

SEQ ID NO: 222063 - DNA, 15 bp, Homo sapiens
gccttgggggatctg

SEQ ID NO: 222064 - DNA, 15 bp, Homo sapiens
agccttgggggatct

SEQ ID NO: 222065 - DNA, 15 bp, Homo sapiens
gagccttgggggatc

SEQ ID NO: 222066 - DNA, 15 bp, Homo sapiens
agagccttgggggat

SEQ ID NO: 222067 - DNA, 15 bp, Homo sapiens
tagagccttggggga

SEQ ID NO: 222068 - DNA, 15 bp, Homo sapiens
gtagagccttggggg

SEQ ID NO: 222069 - DNA, 15 bp, Homo sapiens
agtagagccttgggg

SEQ ID NO: 222070 - DNA, 15 bp, Homo sapiens
tagtagagccttggg

SEQ ID NO: 222071 - DNA, 15 bp, Homo sapiens
ctagtagagccttgg

SEQ ID NO: 222072 - DNA, 15 bp, Homo sapiens
cctagtagagccttg

SEQ ID NO: 222073 - DNA, 15 bp, Homo sapiens
acctagtagagcctt

SEQ ID NO: 222074 - DNA, 15 bp, Homo sapiens
gacctagtagagcct

SEQ ID NO: 222075 - DNA, 15 bp, Homo sapiens
ggacctagtagagcc

SEQ ID NO: 222076 - DNA, 15 bp, Homo sapiens
gggacctagtagagc

SEQ ID NO: 222077 - DNA, 15 bp, Homo sapiens
tgggacctagtagag

SEQ ID NO: 222078 - DNA, 15 bp, Homo sapiens
ctgggacctagtaga

SEQ ID NO: 222079 - DNA, 15 bp, Homo sapiens
tctgggacctagtag

SEQ ID NO: 222080 - DNA, 15 bp, Homo sapiens
gtctgggacctagta

SEQ ID NO: 222081 - DNA, 15 bp, Homo sapiens
tgtctgggacctagt

SEQ ID NO: 222082 - DNA, 15 bp, Homo sapiens
atgtctgggacctag

SEQ ID NO: 222083 - DNA, 15 bp, Homo sapiens
catgtctgggaccta

SEQ ID NO: 222084 - DNA, 15 bp, Homo sapiens
ccatgtctgggacct

SEQ ID NO: 222085 - DNA, 15 bp, Homo sapiens
gccatgtctgggacc

SEQ ID NO: 222086 - DNA, 15 bp, Homo sapiens
tgccatgtctgggac

SEQ ID NO: 222087 - DNA, 15 bp, Homo sapiens
atgccatgtctggga

SEQ ID NO: 222088 - DNA, 15 bp, Homo sapiens
aatgccatgtctggg

SEQ ID NO: 222089 - DNA, 15 bp, Homo sapiens
taatgccatgtctgg

SEQ ID NO: 222090 - DNA, 15 bp, Homo sapiens
ctaatgccatgtctg

SEQ ID NO: 222091 - DNA, 15 bp, Homo sapiens
actaatgccatgtct

SEQ ID NO: 222092 - DNA, 15 bp, Homo sapiens
gactaatgccatgtc

SEQ ID NO: 222093 - DNA, 15 bp, Homo sapiens
agactaatgccatgt

SEQ ID NO: 222094 - DNA, 15 bp, Homo sapiens
cagactaatgccatg

SEQ ID NO: 222095 - DNA, 15 bp, Homo sapiens
ccagactaatgccat

SEQ ID NO: 222096 - DNA, 15 bp, Homo sapiens
cccagactaatgcca

SEQ ID NO: 222097 - DNA, 15 bp, Homo sapiens
acccagactaatgcc

SEQ ID NO: 222098 - DNA, 15 bp, Homo sapiens
cacccagactaatgc

SEQ ID NO: 222099 - DNA, 15 bp, Homo sapiens
gcacccagactaatg

SEQ ID NO: 222100 - DNA, 15 bp, Homo sapiens
agcacccagactaat

SEQ ID NO: 222101 - DNA, 15 bp, Homo sapiens
aagcacccagactaa

SEQ ID NO: 222102 - DNA, 15 bp, Homo sapiens
aaagcacccagacta

SEQ ID NO: 222103 - DNA, 15 bp, Homo sapiens
caaagcacccagact

SEQ ID NO: 222104 - DNA, 15 bp, Homo sapiens
acaaagcacccagac

SEQ ID NO: 222105 - DNA, 15 bp, Homo sapiens
aacaaagcacccaga

SEQ ID NO: 222106 - DNA, 15 bp, Homo sapiens
aaacaaagcacccag

SEQ ID NO: 222107 - DNA, 15 bp, Homo sapiens
taaacaaagcaccca

SEQ ID NO: 222108 - DNA, 15 bp, Homo sapiens
gtaaacaaagcaccc

SEQ ID NO: 222109 - DNA, 15 bp, Homo sapiens
ggtaaacaaagcacc

SEQ ID NO: 222110 - DNA, 15 bp, Homo sapiens
tggtaaacaaagcac

SEQ ID NO: 222111 - DNA, 15 bp, Homo sapiens
atggtaaacaaagca

SEQ ID NO: 222112 - DNA, 15 bp, Homo sapiens
catggtaaacaaagc

SEQ ID NO: 222113 - DNA, 15 bp, Homo sapiens
gcatggtaaacaaag

SEQ ID NO: 222114 - DNA, 15 bp, Homo sapiens
agcatggtaaacaaa

SEQ ID NO: 222115 - DNA, 15 bp, Homo sapiens
cagcatggtaaacaa

SEQ ID NO: 222116 - DNA, 15 bp, Homo sapiens
tcagcatggtaaaca

SEQ ID NO: 222117 - DNA, 15 bp, Homo sapiens
ttcagcatggtaaac

SEQ ID NO: 222118 - DNA, 15 bp, Homo sapiens
gttcagcatggtaaa

SEQ ID NO: 222119 - DNA, 15 bp, Homo sapiens
tgttcagcatggtaa

SEQ ID NO: 222120 - DNA, 15 bp, Homo sapiens
ttgttcagcatggta

SEQ ID NO: 222121 - DNA, 15 bp, Homo sapiens
tttgttcagcatggt

SEQ ID NO: 222122 - DNA, 15 bp, Homo sapiens
ttttgttcagcatgg

SEQ ID NO: 222123 - DNA, 15 bp, Homo sapiens
tttttgttcagcatg

SEQ ID NO: 222124 - DNA, 15 bp, Homo sapiens
gtttttgttcagcat

SEQ ID NO: 222125 - DNA, 15 bp, Homo sapiens
tgtttttgttcagca

SEQ ID NO: 222126 - DNA, 15 bp, Homo sapiens
ctgtttttgttcagc

SEQ ID NO: 222127 - DNA, 15 bp, Homo sapiens
tctgtttttgttcag

SEQ ID NO: 222128 - DNA, 15 bp, Homo sapiens
ttctgtttttgttca

SEQ ID NO: 222129 - DNA, 15 bp, Homo sapiens
tttctgtttttgttc

SEQ ID NO: 222130 - DNA, 15 bp, Homo sapiens
ttttctgtttttgtt

SEQ ID NO: 222131 - DNA, 15 bp, Homo sapiens
tttttctgtttttgt

SEQ ID NO: 222132 - DNA, 15 bp, Homo sapiens
ctttttctgtttttg

SEQ ID NO: 222133 - DNA, 15 bp, Homo sapiens
actttttctgttttt

SEQ ID NO: 222134 - DNA, 15 bp, Homo sapiens
gactttttctgtttt

SEQ ID NO: 222135 - DNA, 15 bp, Homo sapiens
ggactttttctgttt

SEQ ID NO: 222136 - DNA, 15 bp, Homo sapiens
gggactttttctgtt

SEQ ID NO: 222137 - DNA, 15 bp, Homo sapiens
agggactttttctgt

SEQ ID NO: 222138 - DNA, 15 bp, Homo sapiens
cagggactttttctg

SEQ ID NO: 222139 - DNA, 15 bp, Homo sapiens
ccagggactttttct

SEQ ID NO: 222140 - DNA, 15 bp, Homo sapiens
accagggactttttc

SEQ ID NO: 222141 - DNA, 15 bp, Homo sapiens
gaccagggacttttt

SEQ ID NO: 222142 - DNA, 15 bp, Homo sapiens
agaccagggactttt

SEQ ID NO: 222143 - DNA, 15 bp, Homo sapiens
tagaccagggacttt

SEQ ID NO: 222144 - DNA, 15 bp, Homo sapiens
ctagaccagggactt

SEQ ID NO: 222145 - DNA, 15 bp, Homo sapiens
actagaccagggact

SEQ ID NO: 222146 - DNA, 15 bp, Homo sapiens
cactagaccagggac

SEQ ID NO: 222147 - DNA, 15 bp, Homo sapiens
ccactagaccaggga

SEQ ID NO: 222148 - DNA, 15 bp, Homo sapiens
tccactagaccaggg

SEQ ID NO: 222149 - DNA, 15 bp, Homo sapiens
ctccactagaccagg

SEQ ID NO: 222150 - DNA, 15 bp, Homo sapiens
gctccactagaccag

SEQ ID NO: 222151 - DNA, 15 bp, Homo sapiens
agctccactagacca

SEQ ID NO: 222152 - DNA, 15 bp, Homo sapiens
aagctccactagacc

SEQ ID NO: 222153 - DNA, 15 bp, Homo sapiens
taagctccactagac

SEQ ID NO: 222154 - DNA, 15 bp, Homo sapiens
ataagctccactaga

SEQ ID NO: 222155 - DNA, 15 bp, Homo sapiens
tataagctccactag

SEQ ID NO: 222156 - DNA, 15 bp, Homo sapiens
atataagctccacta

SEQ ID NO: 222157 - DNA, 15 bp, Homo sapiens
aatataagctccact

SEQ ID NO: 222158 - DNA, 15 bp, Homo sapiens
aaatataagctccac

SEQ ID NO: 222159 - DNA, 15 bp, Homo sapiens
aaaatataagctcca

SEQ ID NO: 222160 - DNA, 15 bp, Homo sapiens
taaaatataagctcc

SEQ ID NO: 222161 - DNA, 15 bp, Homo sapiens
ataaaatataagctc

SEQ ID NO: 222162 - DNA, 15 bp, Homo sapiens
gataaaatataagct

SEQ ID NO: 222163 - DNA, 15 bp, Homo sapiens
agataaaatataagc

SEQ ID NO: 222164 - DNA, 15 bp, Homo sapiens
tagataaaatataag

SEQ ID NO: 222165 - DNA, 15 bp, Homo sapiens
ttagataaaatataa

SEQ ID NO: 222166 - DNA, 15 bp, Homo sapiens
cttagataaaatata

SEQ ID NO: 222167 - DNA, 15 bp, Homo sapiens
tcttagataaaatat

SEQ ID NO: 222168 - DNA, 15 bp, Homo sapiens
ctcttagataaaata

SEQ ID NO: 222169 - DNA, 15 bp, Homo sapiens
tctcttagataaaat

SEQ ID NO: 222170 - DNA, 15 bp, Homo sapiens
ctctcttagataaaa

SEQ ID NO: 222171 - DNA, 15 bp, Homo sapiens
cctctcttagataaa

SEQ ID NO: 222172 - DNA, 15 bp, Homo sapiens
ccctctcttagataa

SEQ ID NO: 222173 - DNA, 15 bp, Homo sapiens
tccctctcttagata

SEQ ID NO: 222174 - DNA, 15 bp, Homo sapiens
gtccctctcttagat

SEQ ID NO: 222175 - DNA, 15 bp, Homo sapiens
agtccctctcttaga

SEQ ID NO: 222176 - DNA, 15 bp, Homo sapiens
tagtccctctcttag

SEQ ID NO: 222177 - DNA, 15 bp, Homo sapiens
ttagtccctctctta

SEQ ID NO: 222178 - DNA, 15 bp, Homo sapiens
tttagtccctctctt

SEQ ID NO: 222179 - DNA, 15 bp, Homo sapiens
gtttagtccctctct

SEQ ID NO: 222180 - DNA, 15 bp, Homo sapiens
tgtttagtccctctc

SEQ ID NO: 222181 - DNA, 15 bp, Homo sapiens
ttgtttagtccctct

SEQ ID NO: 222182 - DNA, 15 bp, Homo sapiens
cttgtttagtccctc

SEQ ID NO: 222183 - DNA, 15 bp, Homo sapiens
tcttgtttagtccct

SEQ ID NO: 222184 - DNA, 15 bp, Homo sapiens
ttcttgtttagtccc

SEQ ID NO: 222185 - DNA, 15 bp, Homo sapiens
tttcttgtttagtcc

SEQ ID NO: 222186 - DNA, 15 bp, Homo sapiens
atttcttgtttagtc

SEQ ID NO: 222187 - DNA, 15 bp, Homo sapiens
tatttcttgtttagt

SEQ ID NO: 222188 - DNA, 15 bp, Homo sapiens
atatttcttgtttag

SEQ ID NO: 222189 - DNA, 15 bp, Homo sapiens
tatatttcttgttta

SEQ ID NO: 222190 - DNA, 15 bp, Homo sapiens
ctatatttcttgttt

SEQ ID NO: 222191 - DNA, 15 bp, Homo sapiens
tctatatttcttgtt

SEQ ID NO: 222192 - DNA, 15 bp, Homo sapiens
ttctatatttcttgt

SEQ ID NO: 222193 - DNA, 15 bp, Homo sapiens
tttctatatttcttg

SEQ ID NO: 222194 - DNA, 15 bp, Homo sapiens
atttctatatttctt

SEQ ID NO: 222195 - DNA, 15 bp, Homo sapiens
catttctatatttct

SEQ ID NO: 222196 - DNA, 15 bp, Homo sapiens
acatttctatatttc

SEQ ID NO: 222197 - DNA, 15 bp, Homo sapiens
gacatttctatattt

SEQ ID NO: 222198 - DNA, 15 bp, Homo sapiens
tgacatttctatatt

SEQ ID NO: 222199 - DNA, 15 bp, Homo sapiens
gtgacatttctatat

SEQ ID NO: 222200 - DNA, 15 bp, Homo sapiens
ggtgacatttctata

SEQ ID NO: 222201 - DNA, 15 bp, Homo sapiens
aggtgacatttctat

SEQ ID NO: 222202 - DNA, 15 bp, Homo sapiens
gaggtgacatttcta

SEQ ID NO: 222203 - DNA, 15 bp, Homo sapiens
agaggtgacatttct

SEQ ID NO: 222204 - DNA, 15 bp, Homo sapiens
aagaggtgacatttc

SEQ ID NO: 222205 - DNA, 15 bp, Homo sapiens
aaagaggtgacattt

SEQ ID NO: 222206 - DNA, 15 bp, Homo sapiens
aaaagaggtgacatt

SEQ ID NO: 222207 - DNA, 15 bp, Homo sapiens
caaaagaggtgacat

SEQ ID NO: 222208 - DNA, 15 bp, Homo sapiens
gcaaaagaggtgaca

SEQ ID NO: 222209 - DNA, 15 bp, Homo sapiens
tgcaaaagaggtgac

SEQ ID NO: 222210 - DNA, 15 bp, Homo sapiens
atgcaaaagaggtga

SEQ ID NO: 222211 - DNA, 15 bp, Homo sapiens
tatgcaaaagaggtg

SEQ ID NO: 222212 - DNA, 15 bp, Homo sapiens
ctatgcaaaagaggt

SEQ ID NO: 222213 - DNA, 15 bp, Homo sapiens
actatgcaaaagagg

SEQ ID NO: 222214 - DNA, 15 bp, Homo sapiens
tactatgcaaaagag

SEQ ID NO: 222215 - DNA, 15 bp, Homo sapiens
ctactatgcaaaaga

SEQ ID NO: 222216 - DNA, 15 bp, Homo sapiens
tctactatgcaaaag

SEQ ID NO: 222217 - DNA, 15 bp, Homo sapiens
ttctactatgcaaaa

SEQ ID NO: 222218 - DNA, 15 bp, Homo sapiens
cttctactatgcaaa

SEQ ID NO: 222219 - DNA, 15 bp, Homo sapiens
ccttctactatgcaa

SEQ ID NO: 222220 - DNA, 15 bp, Homo sapiens
accttctactatgca

SEQ ID NO: 222221 - DNA, 15 bp, Homo sapiens
caccttctactatgc

SEQ ID NO: 222222 - DNA, 15 bp, Homo sapiens
gcaccttctactatg

SEQ ID NO: 222223 - DNA, 15 bp, Homo sapiens
ggcaccttctactat

SEQ ID NO: 222224 - DNA, 15 bp, Homo sapiens
tggcaccttctacta

SEQ ID NO: 222225 - DNA, 15 bp, Homo sapiens
ctggcaccttctact

SEQ ID NO: 222226 - DNA, 15 bp, Homo sapiens
cctggcaccttctac

SEQ ID NO: 222227 - DNA, 15 bp, Homo sapiens
acctggcaccttcta

SEQ ID NO: 222228 - DNA, 15 bp, Homo sapiens
gacctggcaccttct

SEQ ID NO: 222229 - DNA, 15 bp, Homo sapiens
agacctggcaccttc

SEQ ID NO: 222230 - DNA, 15 bp, Homo sapiens
tagacctggcacctt

SEQ ID NO: 222231 - DNA, 15 bp, Homo sapiens
ctagacctggcacct

SEQ ID NO: 222232 - DNA, 15 bp, Homo sapiens
cctagacctggcacc

SEQ ID NO: 222233 - DNA, 15 bp, Homo sapiens
tcctagacctggcac

SEQ ID NO: 222234 - DNA, 15 bp, Homo sapiens
ttcctagacctggca

SEQ ID NO: 222235 - DNA, 15 bp, Homo sapiens
tttcctagacctggc

SEQ ID NO: 222236 - DNA, 15 bp, Homo sapiens
atttcctagacctgg

SEQ ID NO: 222237 - DNA, 15 bp, Homo sapiens
tatttcctagacctg

SEQ ID NO: 222238 - DNA, 15 bp, Homo sapiens
gtatttcctagacct

SEQ ID NO: 222239 - DNA, 15 bp, Homo sapiens
tgtatttcctagacc

SEQ ID NO: 222240 - DNA, 15 bp, Homo sapiens
ttgtatttcctagac

SEQ ID NO: 222241 - DNA, 15 bp, Homo sapiens
tttgtatttcctaga

SEQ ID NO: 222242 - DNA, 15 bp, Homo sapiens
ctttgtatttcctag

SEQ ID NO: 222243 - DNA, 15 bp, Homo sapiens
tctttgtatttccta

SEQ ID NO: 222244 - DNA, 15 bp, Homo sapiens
atctttgtatttcct

SEQ ID NO: 222245 - DNA, 15 bp, Homo sapiens
tatctttgtatttcc

SEQ ID NO: 222246 - DNA, 15 bp, Homo sapiens
ctatctttgtatttc

SEQ ID NO: 222247 - DNA, 15 bp, Homo sapiens
actatctttgtattt

SEQ ID NO: 222248 - DNA, 15 bp, Homo sapiens
aactatctttgtatt

SEQ ID NO: 222249 - DNA, 15 bp, Homo sapiens
taactatctttgtat

SEQ ID NO: 222250 - DNA, 15 bp, Homo sapiens
ttaactatctttgta

SEQ ID NO: 222251 - DNA, 15 bp, Homo sapiens
cttaactatctttgt

SEQ ID NO: 222252 - DNA, 15 bp, Homo sapiens
gcttaactatctttg

SEQ ID NO: 222253 - DNA, 15 bp, Homo sapiens
tgcttaactatcttt

SEQ ID NO: 222254 - DNA, 15 bp, Homo sapiens
ctgcttaactatctt

SEQ ID NO: 222255 - DNA, 15 bp, Homo sapiens
tctgcttaactatct

SEQ ID NO: 222256 - DNA, 15 bp, Homo sapiens
ttctgcttaactatc

SEQ ID NO: 222257 - DNA, 15 bp, Homo sapiens
attctgcttaactat

SEQ ID NO: 222258 - DNA, 15 bp, Homo sapiens
tattctgcttaacta

SEQ ID NO: 222259 - DNA, 15 bp, Homo sapiens
ttattctgcttaact

SEQ ID NO: 222260 - DNA, 15 bp, Homo sapiens
attattctgcttaac

SEQ ID NO: 222261 - DNA, 15 bp, Homo sapiens
cattattctgcttaa

SEQ ID NO: 222262 - DNA, 15 bp, Homo sapiens
tcattattctgctta

SEQ ID NO: 222263 - DNA, 15 bp, Homo sapiens
ctcattattctgctt

SEQ ID NO: 222264 - DNA, 15 bp, Homo sapiens
tctcattattctgct

SEQ ID NO: 222265 - DNA, 15 bp, Homo sapiens
ttctcattattctgc

SEQ ID NO: 222266 - DNA, 15 bp, Homo sapiens
attctcattattctg

SEQ ID NO: 222267 - DNA, 15 bp, Homo sapiens
cattctcattattct

SEQ ID NO: 222268 - DNA, 15 bp, Homo sapiens
ccattctcattattc

SEQ ID NO: 222269 - DNA, 15 bp, Homo sapiens
cccattctcattatt

SEQ ID NO: 222270 - DNA, 15 bp, Homo sapiens
tcccattctcattat

SEQ ID NO: 222271 - DNA, 15 bp, Homo sapiens
ttcccattctcatta

SEQ ID NO: 222272 - DNA, 15 bp, Homo sapiens
tttcccattctcatt

SEQ ID NO: 222273 - DNA, 15 bp, Homo sapiens
atttcccattctcat

SEQ ID NO: 222274 - DNA, 15 bp, Homo sapiens
catttcccattctca

SEQ ID NO: 222275 - DNA, 15 bp, Homo sapiens
acatttcccattctc

SEQ ID NO: 222276 - DNA, 15 bp, Homo sapiens
tacatttcccattct

SEQ ID NO: 222277 - DNA, 15 bp, Homo sapiens
ctacatttcccattc

SEQ ID NO: 222278 - DNA, 15 bp, Homo sapiens
cctacatttcccatt

SEQ ID NO: 222279 - DNA, 15 bp, Homo sapiens
ccctacatttcccat

SEQ ID NO: 222280 - DNA, 15 bp, Homo sapiens
cccctacatttccca

SEQ ID NO: 222281 - DNA, 15 bp, Homo sapiens
tcccctacatttccc

SEQ ID NO: 222282 - DNA, 15 bp, Homo sapiens
atcccctacatttcc

SEQ ID NO: 222283 - DNA, 15 bp, Homo sapiens
catcccctacatttc

SEQ ID NO: 222284 - DNA, 15 bp, Homo sapiens
tcatcccctacattt

SEQ ID NO: 222285 - DNA, 15 bp, Homo sapiens
ctcatcccctacatt

SEQ ID NO: 222286 - DNA, 15 bp, Homo sapiens
tctcatcccctacat

SEQ ID NO: 222287 - DNA, 15 bp, Homo sapiens
ttctcatcccctaca

SEQ ID NO: 222288 - DNA, 15 bp, Homo sapiens
tttctcatcccctac

SEQ ID NO: 222289 - DNA, 15 bp, Homo sapiens
ctttctcatccccta

SEQ ID NO: 222290 - DNA, 15 bp, Homo sapiens
cctttctcatcccct

SEQ ID NO: 222291 - DNA, 15 bp, Homo sapiens
acctttctcatcccc

SEQ ID NO: 222292 - DNA, 15 bp, Homo sapiens
cacctttctcatccc

SEQ ID NO: 222293 - DNA, 15 bp, Homo sapiens
ccacctttctcatcc

SEQ ID NO: 222294 - DNA, 15 bp, Homo sapiens
tccacctttctcatc

SEQ ID NO: 222295 - DNA, 15 bp, Homo sapiens
ttccacctttctcat

SEQ ID NO: 222296 - DNA, 15 bp, Homo sapiens
attccacctttctca

SEQ ID NO: 222297 - DNA, 15 bp, Homo sapiens
cattccacctttctc

SEQ ID NO: 222298 - DNA, 15 bp, Homo sapiens
gcattccacctttct

SEQ ID NO: 222299 - DNA, 15 bp, Homo sapiens
agcattccacctttc

SEQ ID NO: 222300 - DNA, 15 bp, Homo sapiens
tagcattccaccttt

SEQ ID NO: 222301 - DNA, 15 bp, Homo sapiens
gtagcattccacctt

SEQ ID NO: 222302 - DNA, 15 bp, Homo sapiens
tgtagcattccacct

SEQ ID NO: 222303 - DNA, 15 bp, Homo sapiens
atgtagcattccacc

SEQ ID NO: 222304 - DNA, 15 bp, Homo sapiens
aatgtagcattccac

SEQ ID NO: 222305 - DNA, 15 bp, Homo sapiens
gaatgtagcattcca

SEQ ID NO: 222306 - DNA, 15 bp, Homo sapiens
tgaatgtagcattcc

SEQ ID NO: 222307 - DNA, 15 bp, Homo sapiens
ttgaatgtagcattc

SEQ ID NO: 222308 - DNA, 15 bp, Homo sapiens
attgaatgtagcatt

SEQ ID NO: 222309 - DNA, 15 bp, Homo sapiens
tattgaatgtagcat

SEQ ID NO: 222310 - DNA, 15 bp, Homo sapiens
ttattgaatgtagca

SEQ ID NO: 222311 - DNA, 15 bp, Homo sapiens
cttattgaatgtagc

SEQ ID NO: 222312 - DNA, 15 bp, Homo sapiens
ccttattgaatgtag

SEQ ID NO: 222313 - DNA, 15 bp, Homo sapiens
accttattgaatgta

SEQ ID NO: 222314 - DNA, 15 bp, Homo sapiens
taccttattgaatgt

SEQ ID NO: 222315 - DNA, 15 bp, Homo sapiens
ctaccttattgaatg

SEQ ID NO: 222316 - DNA, 15 bp, Homo sapiens
cctaccttattgaat

SEQ ID NO: 222317 - DNA, 15 bp, Homo sapiens
acctaccttattgaa

SEQ ID NO: 222318 - DNA, 15 bp, Homo sapiens
cacctaccttattga

SEQ ID NO: 222319 - DNA, 15 bp, Homo sapiens
ccacctaccttattg

SEQ ID NO: 222320 - DNA, 15 bp, Homo sapiens
cccacctaccttatt

SEQ ID NO: 222321 - DNA, 15 bp, Homo sapiens
acccacctaccttat

SEQ ID NO: 222322 - DNA, 15 bp, Homo sapiens
cacccacctacctta

SEQ ID NO: 222323 - DNA, 15 bp, Homo sapiens
ccacccacctacctt

SEQ ID NO: 222324 - DNA, 15 bp, Homo sapiens
cccacccacctacct

SEQ ID NO: 222325 - DNA, 15 bp, Homo sapiens
gcccacccacctacc

SEQ ID NO: 222326 - DNA, 15 bp, Homo sapiens
ggcccacccacctac

SEQ ID NO: 222327 - DNA, 15 bp, Homo sapiens
aggcccacccaccta

SEQ ID NO: 222328 - DNA, 15 bp, Homo sapiens
gaggcccacccacct

SEQ ID NO: 222329 - DNA, 15 bp, Homo sapiens
tgaggcccacccacc

SEQ ID NO: 222330 - DNA, 15 bp, Homo sapiens
gtgaggcccacccac

SEQ ID NO: 222331 - DNA, 15 bp, Homo sapiens
ggtgaggcccaccca

SEQ ID NO: 222332 - DNA, 15 bp, Homo sapiens
aggtgaggcccaccc

SEQ ID NO: 222333 - DNA, 15 bp, Homo sapiens
aaggtgaggcccacc

SEQ ID NO: 222334 - DNA, 15 bp, Homo sapiens
gaaggtgaggcccac

SEQ ID NO: 222335 - DNA, 15 bp, Homo sapiens
agaaggtgaggccca

SEQ ID NO: 222336 - DNA, 15 bp, Homo sapiens
tagaaggtgaggccc

SEQ ID NO: 222337 - DNA, 15 bp, Homo sapiens
ctagaaggtgaggcc

SEQ ID NO: 222338 - DNA, 15 bp, Homo sapiens
tctagaaggtgaggc

SEQ ID NO: 222339 - DNA, 15 bp, Homo sapiens
gtctagaaggtgagg

SEQ ID NO: 222340 - DNA, 15 bp, Homo sapiens
tgtctagaaggtgag

SEQ ID NO: 222341 - DNA, 15 bp, Homo sapiens
ctgtctagaaggtga

SEQ ID NO: 222342 - DNA, 15 bp, Homo sapiens
gctgtctagaaggtg

SEQ ID NO: 222343 - DNA, 15 bp, Homo sapiens
ggctgtctagaaggt

SEQ ID NO: 222344 - DNA, 15 bp, Homo sapiens
aggctgtctagaagg

SEQ ID NO: 222345 - DNA, 15 bp, Homo sapiens
aaggctgtctagaag

SEQ ID NO: 222346 - DNA, 15 bp, Homo sapiens
taaggctgtctagaa

SEQ ID NO: 222347 - DNA, 15 bp, Homo sapiens
ttaaggctgtctaga

SEQ ID NO: 222348 - DNA, 15 bp, Homo sapiens
tttaaggctgtctag

SEQ ID NO: 222349 - DNA, 15 bp, Homo sapiens
ttttaaggctgtcta

SEQ ID NO: 222350 - DNA, 15 bp, Homo sapiens
tttttaaggctgtct

SEQ ID NO: 222351 - DNA, 15 bp, Homo sapiens
ctttttaaggctgtc

SEQ ID NO: 222352 - DNA, 15 bp, Homo sapiens
cctttttaaggctgt

SEQ ID NO: 222353 - DNA, 15 bp, Homo sapiens
tcctttttaaggctg

SEQ ID NO: 222354 - DNA, 15 bp, Homo sapiens
atcctttttaaggct

SEQ ID NO: 222355 - DNA, 15 bp, Homo sapiens
catcctttttaaggc

SEQ ID NO: 222356 - DNA, 15 bp, Homo sapiens
tcatcctttttaagg

SEQ ID NO: 222357 - DNA, 15 bp, Homo sapiens
ctcatcctttttaag

SEQ ID NO: 222358 - DNA, 15 bp, Homo sapiens
cctcatcctttttaa

SEQ ID NO: 222359 - DNA, 15 bp, Homo sapiens
ccctcatccttttta

SEQ ID NO: 222360 - DNA, 15 bp, Homo sapiens
tccctcatccttttt

SEQ ID NO: 222361 - DNA, 15 bp, Homo sapiens
ttccctcatcctttt

SEQ ID NO: 222362 - DNA, 15 bp, Homo sapiens
attccctcatccttt

SEQ ID NO: 222363 - DNA, 15 bp, Homo sapiens
gattccctcatcctt

SEQ ID NO: 222364 - DNA, 15 bp, Homo sapiens
agattccctcatcct

SEQ ID NO: 222365 - DNA, 15 bp, Homo sapiens
cagattccctcatcc

SEQ ID NO: 222366 - DNA, 15 bp, Homo sapiens
acagattccctcatc

SEQ ID NO: 222367 - DNA, 15 bp, Homo sapiens
cacagattccctcat

SEQ ID NO: 222368 - DNA, 15 bp, Homo sapiens
tcacagattccctca

SEQ ID NO: 222369 - DNA, 15 bp, Homo sapiens
atcacagattccctc

SEQ ID NO: 222370 - DNA, 15 bp, Homo sapiens
tatcacagattccct

SEQ ID NO: 222371 - DNA, 15 bp, Homo sapiens
atatcacagattccc

SEQ ID NO: 222372 - DNA, 15 bp, Homo sapiens
catatcacagattcc

SEQ ID NO: 222373 - DNA, 15 bp, Homo sapiens
ccatatcacagattc

SEQ ID NO: 222374 - DNA, 15 bp, Homo sapiens
gccatatcacagatt

SEQ ID NO: 222375 - DNA, 15 bp, Homo sapiens
agccatatcacagat

SEQ ID NO: 222376 - DNA, 15 bp, Homo sapiens
tagccatatcacaga

SEQ ID NO: 222377 - DNA, 15 bp, Homo sapiens
ttagccatatcacag

SEQ ID NO: 222378 - DNA, 15 bp, Homo sapiens
tttagccatatcaca

SEQ ID NO: 222379 - DNA, 15 bp, Homo sapiens
atttagccatatcac

SEQ ID NO: 222380 - DNA, 15 bp, Homo sapiens
gatttagccatatca

SEQ ID NO: 222381 - DNA, 15 bp, Homo sapiens
agatttagccatatc

SEQ ID NO: 222382 - DNA, 15 bp, Homo sapiens
tagatttagccatat

SEQ ID NO: 222383 - DNA, 15 bp, Homo sapiens
ctagatttagccata

SEQ ID NO: 222384 - DNA, 15 bp, Homo sapiens
cctagatttagccat

SEQ ID NO: 222385 - DNA, 15 bp, Homo sapiens
ccctagatttagcca

SEQ ID NO: 222386 - DNA, 15 bp, Homo sapiens
tccctagatttagcc

SEQ ID NO: 222387 - DNA, 15 bp, Homo sapiens
ttccctagatttagc

SEQ ID NO: 222388 - DNA, 15 bp, Homo sapiens
tttccctagatttag

SEQ ID NO: 222389 - DNA, 15 bp, Homo sapiens
ctttccctagattta

SEQ ID NO: 222390 - DNA, 15 bp, Homo sapiens
tctttccctagattt

SEQ ID NO: 222391 - DNA, 15 bp, Homo sapiens
ctctttccctagatt

SEQ ID NO: 222392 - DNA, 15 bp, Homo sapiens
gctctttccctagat

SEQ ID NO: 222393 - DNA, 15 bp, Homo sapiens
agctctttccctaga

SEQ ID NO: 222394 - DNA, 15 bp, Homo sapiens
aagctctttccctag

SEQ ID NO: 222395 - DNA, 15 bp, Homo sapiens
aaagctctttcccta

SEQ ID NO: 222396 - DNA, 15 bp, Homo sapiens
gaaagctctttccct

SEQ ID NO: 222397 - DNA, 15 bp, Homo sapiens
ggaaagctctttccc

SEQ ID NO: 222398 - DNA, 15 bp, Homo sapiens
tggaaagctctttcc

SEQ ID NO: 222399 - DNA, 15 bp, Homo sapiens
ctggaaagctctttc

SEQ ID NO: 222400 - DNA, 15 bp, Homo sapiens
cctggaaagctcttt

SEQ ID NO: 222401 - DNA, 15 bp, Homo sapiens
gcctggaaagctctt

SEQ ID NO: 222402 - DNA, 15 bp, Homo sapiens
tgcctggaaagctct

SEQ ID NO: 222403 - DNA, 15 bp, Homo sapiens
ctgcctggaaagctc

SEQ ID NO: 222404 - DNA, 15 bp, Homo sapiens
tctgcctggaaagct

SEQ ID NO: 222405 - DNA, 15 bp, Homo sapiens
ctctgcctggaaagc

SEQ ID NO: 222406 - DNA, 15 bp, Homo sapiens
gctctgcctggaaag

SEQ ID NO: 222407 - DNA, 15 bp, Homo sapiens
tgctctgcctggaaa

SEQ ID NO: 222408 - DNA, 15 bp, Homo sapiens
ttgctctgcctggaa

SEQ ID NO: 222409 - DNA, 15 bp, Homo sapiens
tttgctctgcctgga

SEQ ID NO: 222410 - DNA, 15 bp, Homo sapiens
gtttgctctgcctgg

SEQ ID NO: 222411 - DNA, 15 bp, Homo sapiens
tgtttgctctgcctg

SEQ ID NO: 222412 - DNA, 15 bp, Homo sapiens
ctgtttgctctgcct

SEQ ID NO: 222413 - DNA, 15 bp, Homo sapiens
tctgtttgctctgcc

SEQ ID NO: 222414 - DNA, 15 bp, Homo sapiens
gtctgtttgctctgc

SEQ ID NO: 222415 - DNA, 15 bp, Homo sapiens
tgtctgtttgctctg

SEQ ID NO: 222416 - DNA, 15 bp, Homo sapiens
ctgtctgtttgctct

SEQ ID NO: 222417 - DNA, 15 bp, Homo sapiens
gctgtctgtttgctc

SEQ ID NO: 222418 - DNA, 15 bp, Homo sapiens
ggctgtctgtttgct

SEQ ID NO: 222419 - DNA, 15 bp, Homo sapiens
tggctgtctgtttgc

SEQ ID NO: 222420 - DNA, 15 bp, Homo sapiens
ttggctgtctgtttg

SEQ ID NO: 222421 - DNA, 15 bp, Homo sapiens
tttggctgtctgttt

SEQ ID NO: 222422 - DNA, 15 bp, Homo sapiens
ctttggctgtctgtt

SEQ ID NO: 222423 - DNA, 15 bp, Homo sapiens
tctttggctgtctgt

SEQ ID NO: 222424 - DNA, 15 bp, Homo sapiens
ctctttggctgtctg

SEQ ID NO: 222425 - DNA, 15 bp, Homo sapiens
tctctttggctgtct

SEQ ID NO: 222426 - DNA, 15 bp, Homo sapiens
atctctttggctgtc

SEQ ID NO: 222427 - DNA, 15 bp, Homo sapiens
aatctctttggctgt

SEQ ID NO: 222428 - DNA, 15 bp, Homo sapiens
taatctctttggctg

SEQ ID NO: 222429 - DNA, 15 bp, Homo sapiens
gtaatctctttggct

SEQ ID NO: 222430 - DNA, 15 bp, Homo sapiens
agtaatctctttggc

SEQ ID NO: 222431 - DNA, 15 bp, Homo sapiens
gagtaatctctttgg

SEQ ID NO: 222432 - DNA, 15 bp, Homo sapiens
agagtaatctctttg

SEQ ID NO: 222433 - DNA, 15 bp, Homo sapiens
tagagtaatctcttt

SEQ ID NO: 222434 - DNA, 15 bp, Homo sapiens
atagagtaatctctt

SEQ ID NO: 222435 - DNA, 15 bp, Homo sapiens
aatagagtaatctct

SEQ ID NO: 222436 - DNA, 15 bp, Homo sapiens
caatagagtaatctc

SEQ ID NO: 222437 - DNA, 15 bp, Homo sapiens
acaatagagtaatct

SEQ ID NO: 222438 - DNA, 15 bp, Homo sapiens
cacaatagagtaatc

SEQ ID NO: 222439 - DNA, 15 bp, Homo sapiens
tcacaatagagtaat

SEQ ID NO: 222440 - DNA, 15 bp, Homo sapiens
ctcacaatagagtaa

SEQ ID NO: 222441 - DNA, 15 bp, Homo sapiens
tctcacaatagagta

SEQ ID NO: 222442 - DNA, 15 bp, Homo sapiens
ctctcacaatagagt

SEQ ID NO: 222443 - DNA, 15 bp, Homo sapiens
actctcacaatagag

SEQ ID NO: 222444 - DNA, 15 bp, Homo sapiens
gactctcacaataga

SEQ ID NO: 222445 - DNA, 15 bp, Homo sapiens
agactctcacaatag

SEQ ID NO: 222446 - DNA, 15 bp, Homo sapiens
gagactctcacaata

SEQ ID NO: 222447 - DNA, 15 bp, Homo sapiens
ggagactctcacaat

SEQ ID NO: 222448 - DNA, 15 bp, Homo sapiens
tggagactctcacaa

SEQ ID NO: 222449 - DNA, 15 bp, Homo sapiens
atggagactctcaca

SEQ ID NO: 222450 - DNA, 15 bp, Homo sapiens
catggagactctcac

SEQ ID NO: 222451 - DNA, 15 bp, Homo sapiens
acatggagactctca

SEQ ID NO: 222452 - DNA, 15 bp, Homo sapiens
aacatggagactctc

SEQ ID NO: 222453 - DNA, 15 bp, Homo sapiens
taacatggagactct

SEQ ID NO: 222454 - DNA, 15 bp, Homo sapiens
ttaacatggagactc

SEQ ID NO: 222455 - DNA, 15 bp, Homo sapiens
tttaacatggagact

SEQ ID NO: 222456 - DNA, 15 bp, Homo sapiens
gtttaacatggagac

SEQ ID NO: 222457 - DNA, 15 bp, Homo sapiens
tgtttaacatggaga

SEQ ID NO: 222458 - DNA, 15 bp, Homo sapiens
ttgtttaacatggag

SEQ ID NO: 222459 - DNA, 15 bp, Homo sapiens
tttgtttaacatgga

SEQ ID NO: 222460 - DNA, 15 bp, Homo sapiens
atttgtttaacatgg

SEQ ID NO: 222461 - DNA, 15 bp, Homo sapiens
tatttgtttaacatg

SEQ ID NO: 222462 - DNA, 15 bp, Homo sapiens
ttatttgtttaacat

SEQ ID NO: 222463 - DNA, 15 bp, Homo sapiens
tttatttgtttaaca

SEQ ID NO: 222464 - DNA, 15 bp, Homo sapiens
ttttatttgtttaac

SEQ ID NO: 222465 - DNA, 15 bp, Homo sapiens
attttatttgtttaa

SEQ ID NO: 222466 - DNA, 15 bp, Homo sapiens
aattttatttgttta

SEQ ID NO: 222467 - DNA, 15 bp, Homo sapiens
gaattttatttgttt

SEQ ID NO: 222468 - DNA, 15 bp, Homo sapiens
ggaattttatttgtt

SEQ ID NO: 222469 - DNA, 15 bp, Homo sapiens
tggaattttatttgt

SEQ ID NO: 222470 - DNA, 15 bp, Homo sapiens
atggaattttatttg

SEQ ID NO: 222471 - DNA, 15 bp, Homo sapiens
gatggaattttattt

SEQ ID NO: 222472 - DNA, 15 bp, Homo sapiens
ggatggaattttatt

SEQ ID NO: 222473 - DNA, 15 bp, Homo sapiens
tggatggaattttat

SEQ ID NO: 222474 - DNA, 15 bp, Homo sapiens
atggatggaatttta

SEQ ID NO: 222475 - DNA, 15 bp, Homo sapiens
tatggatggaatttt

SEQ ID NO: 222476 - DNA, 15 bp, Homo sapiens
ttatggatggaattt

SEQ ID NO: 222477 - DNA, 15 bp, Homo sapiens
tttatggatggaatt

SEQ ID NO: 222478 - DNA, 15 bp, Homo sapiens
ctttatggatggaat

SEQ ID NO: 222479 - DNA, 15 bp, Homo sapiens
cctttatggatggaa

SEQ ID NO: 222480 - DNA, 15 bp, Homo sapiens
tcctttatggatgga

SEQ ID NO: 222481 - DNA, 15 bp, Homo sapiens
ttcctttatggatgg

SEQ ID NO: 222482 - DNA, 15 bp, Homo sapiens
cttcctttatggatg

SEQ ID NO: 222483 - DNA, 15 bp, Homo sapiens
acttcctttatggat

SEQ ID NO: 222484 - DNA, 15 bp, Homo sapiens
aacttcctttatgga

SEQ ID NO: 222485 - DNA, 15 bp, Homo sapiens
caacttcctttatgg

SEQ ID NO: 222486 - DNA, 15 bp, Homo sapiens
tcaacttcctttatg

SEQ ID NO: 222487 - DNA, 15 bp, Homo sapiens
atcaacttcctttat

SEQ ID NO: 222488 - DNA, 15 bp, Homo sapiens
tatcaacttccttta

SEQ ID NO: 222489 - DNA, 15 bp, Homo sapiens
ctatcaacttccttt

SEQ ID NO: 222490 - DNA, 15 bp, Homo sapiens
cctatcaacttcctt

SEQ ID NO: 222491 - DNA, 15 bp, Homo sapiens
acctatcaacttcct

SEQ ID NO: 222492 - DNA, 15 bp, Homo sapiens
aacctatcaacttcc

SEQ ID NO: 222493 - DNA, 15 bp, Homo sapiens
caacctatcaacttc

SEQ ID NO: 222494 - DNA, 15 bp, Homo sapiens
ccaacctatcaactt

SEQ ID NO: 222495 - DNA, 15 bp, Homo sapiens
accaacctatcaact

SEQ ID NO: 222496 - DNA, 15 bp, Homo sapiens
aaccaacctatcaac

SEQ ID NO: 222497 - DNA, 15 bp, Homo sapiens
aaaccaacctatcaa

SEQ ID NO: 222498 - DNA, 15 bp, Homo sapiens
aaaaccaacctatca

SEQ ID NO: 222499 - DNA, 15 bp, Homo sapiens
gaaaaccaacctatc

SEQ ID NO: 222500 - DNA, 15 bp, Homo sapiens
ggaaaaccaacctat

SEQ ID NO: 222501 - DNA, 15 bp, Homo sapiens
tggaaaaccaaccta

SEQ ID NO: 222502 - DNA, 15 bp, Homo sapiens
ttggaaaaccaacct

SEQ ID NO: 222503 - DNA, 15 bp, Homo sapiens
tttggaaaaccaacc

SEQ ID NO: 222504 - DNA, 15 bp, Homo sapiens
ctttggaaaaccaac

SEQ ID NO: 222505 - DNA, 15 bp, Homo sapiens
actttggaaaaccaa

SEQ ID NO: 222506 - DNA, 15 bp, Homo sapiens
tactttggaaaacca

SEQ ID NO: 222507 - DNA, 15 bp, Homo sapiens
atactttggaaaacc

SEQ ID NO: 222508 - DNA, 15 bp, Homo sapiens
gatactttggaaaac

SEQ ID NO: 222509 - DNA, 15 bp, Homo sapiens
ggatactttggaaaa

SEQ ID NO: 222510 - DNA, 15 bp, Homo sapiens
aggatactttggaaa

SEQ ID NO: 222511 - DNA, 15 bp, Homo sapiens
aaggatactttggaa

SEQ ID NO: 222512 - DNA, 15 bp, Homo sapiens
aaaggatactttgga

SEQ ID NO: 222513 - DNA, 15 bp, Homo sapiens
gaaaggatactttgg

SEQ ID NO: 222514 - DNA, 15 bp, Homo sapiens
agaaaggatactttg

SEQ ID NO: 222515 - DNA, 15 bp, Homo sapiens
tagaaaggatacttt

SEQ ID NO: 222516 - DNA, 15 bp, Homo sapiens
atagaaaggatactt

SEQ ID NO: 222517 - DNA, 15 bp, Homo sapiens
tatagaaaggatact

SEQ ID NO: 222518 - DNA, 15 bp, Homo sapiens
ctatagaaaggatac

SEQ ID NO: 222519 - DNA, 15 bp, Homo sapiens
tctatagaaaggata

SEQ ID NO: 222520 - DNA, 15 bp, Homo sapiens
gtctatagaaaggat

SEQ ID NO: 222521 - DNA, 15 bp, Homo sapiens
ggtctatagaaagga

SEQ ID NO: 222522 - DNA, 15 bp, Homo sapiens
tggtctatagaaagg

SEQ ID NO: 222523 - DNA, 15 bp, Homo sapiens
ttggtctatagaaag

SEQ ID NO: 222524 - DNA, 15 bp, Homo sapiens
attggtctatagaaa

SEQ ID NO: 222525 - DNA, 15 bp, Homo sapiens
tattggtctatagaa

SEQ ID NO: 222526 - DNA, 15 bp, Homo sapiens
atattggtctataga

SEQ ID NO: 222527 - DNA, 15 bp, Homo sapiens
catattggtctatag

SEQ ID NO: 222528 - DNA, 15 bp, Homo sapiens
acatattggtctata

SEQ ID NO: 222529 - DNA, 15 bp, Homo sapiens
tacatattggtctat

SEQ ID NO: 222530 - DNA, 15 bp, Homo sapiens
gtacatattggtcta

SEQ ID NO: 222531 - DNA, 15 bp, Homo sapiens
tgtacatattggtct

SEQ ID NO: 222532 - DNA, 15 bp, Homo sapiens
atgtacatattggtc

SEQ ID NO: 222533 - DNA, 15 bp, Homo sapiens
tatgtacatattggt

SEQ ID NO: 222534 - DNA, 15 bp, Homo sapiens
atatgtacatattgg

SEQ ID NO: 222535 - DNA, 15 bp, Homo sapiens
aatatgtacatattg

SEQ ID NO: 222536 - DNA, 15 bp, Homo sapiens
aaatatgtacatatt

SEQ ID NO: 222537 - DNA, 15 bp, Homo sapiens
gaaatatgtacatat

SEQ ID NO: 222538 - DNA, 15 bp, Homo sapiens
ggaaatatgtacata

SEQ ID NO: 222539 - DNA, 15 bp, Homo sapiens
tggaaatatgtacat

SEQ ID NO: 222540 - DNA, 15 bp, Homo sapiens
atggaaatatgtaca

SEQ ID NO: 222541 - DNA, 15 bp, Homo sapiens
aatggaaatatgtac

SEQ ID NO: 222542 - DNA, 15 bp, Homo sapiens
aaatggaaatatgta

SEQ ID NO: 222543 - DNA, 15 bp, Homo sapiens
gaaatggaaatatgt

SEQ ID NO: 222544 - DNA, 15 bp, Homo sapiens
tgaaatggaaatatg

SEQ ID NO: 222545 - DNA, 15 bp, Homo sapiens
ttgaaatggaaatat

SEQ ID NO: 222546 - DNA, 15 bp, Homo sapiens
attgaaatggaaata

SEQ ID NO: 222547 - DNA, 15 bp, Homo sapiens
aattgaaatggaaat

SEQ ID NO: 222548 - DNA, 15 bp, Homo sapiens
aaattgaaatggaaa

SEQ ID NO: 222549 - DNA, 15 bp, Homo sapiens
aaaattgaaatggaa

SEQ ID NO: 222550 - DNA, 15 bp, Homo sapiens
aaaaattgaaatgga

SEQ ID NO: 222551 - DNA, 15 bp, Homo sapiens
caaaaattgaaatgg

SEQ ID NO: 222552 - DNA, 15 bp, Homo sapiens
tcaaaaattgaaatg

SEQ ID NO: 222553 - DNA, 15 bp, Homo sapiens
ttcaaaaattgaaat

SEQ ID NO: 222554 - DNA, 15 bp, Homo sapiens
tttcaaaaattgaaa

SEQ ID NO: 222555 - DNA, 15 bp, Homo sapiens
atttcaaaaattgaa

SEQ ID NO: 222556 - DNA, 15 bp, Homo sapiens
gatttcaaaaattga

SEQ ID NO: 222557 - DNA, 15 bp, Homo sapiens
agatttcaaaaattg

SEQ ID NO: 222558 - DNA, 15 bp, Homo sapiens
tagatttcaaaaatt

SEQ ID NO: 222559 - DNA, 15 bp, Homo sapiens
ttagatttcaaaaat

SEQ ID NO: 222560 - DNA, 15 bp, Homo sapiens
tttagatttcaaaaa

SEQ ID NO: 222561 - DNA, 15 bp, Homo sapiens
ttttagatttcaaaa

SEQ ID NO: 222562 - DNA, 15 bp, Homo sapiens
tttttagatttcaaa

SEQ ID NO: 222563 - DNA, 15 bp, Homo sapiens
ctttttagatttcaa

SEQ ID NO: 222564 - DNA, 15 bp, Homo sapiens
tctttttagatttca

SEQ ID NO: 222565 - DNA, 15 bp, Homo sapiens
ttctttttagatttc

SEQ ID NO: 222566 - DNA, 15 bp, Homo sapiens
cttctttttagattt

SEQ ID NO: 222567 - DNA, 15 bp, Homo sapiens
acttctttttagatt

SEQ ID NO: 222568 - DNA, 15 bp, Homo sapiens
aacttctttttagat

SEQ ID NO: 222569 - DNA, 15 bp, Homo sapiens
gaacttctttttaga

SEQ ID NO: 222570 - DNA, 15 bp, Homo sapiens
ggaacttctttttag

SEQ ID NO: 222571 - DNA, 15 bp, Homo sapiens
tggaacttcttttta

SEQ ID NO: 222572 - DNA, 15 bp, Homo sapiens
ttggaacttcttttt

SEQ ID NO: 222573 - DNA, 15 bp, Homo sapiens
cttggaacttctttt

SEQ ID NO: 222574 - DNA, 15 bp, Homo sapiens
tcttggaacttcttt

SEQ ID NO: 222575 - DNA, 15 bp, Homo sapiens
gtcttggaacttctt

SEQ ID NO: 222576 - DNA, 15 bp, Homo sapiens
tgtcttggaacttct

SEQ ID NO: 222577 - DNA, 15 bp, Homo sapiens
ttgtcttggaacttc

SEQ ID NO: 222578 - DNA, 15 bp, Homo sapiens
tttgtcttggaactt

SEQ ID NO: 222579 - DNA, 15 bp, Homo sapiens
atttgtcttggaact

SEQ ID NO: 222580 - DNA, 15 bp, Homo sapiens
gatttgtcttggaac

SEQ ID NO: 222581 - DNA, 15 bp, Homo sapiens
agatttgtcttggaa

SEQ ID NO: 222582 - DNA, 15 bp, Homo sapiens
gagatttgtcttgga

SEQ ID NO: 222583 - DNA, 15 bp, Homo sapiens
agagatttgtcttgg

SEQ ID NO: 222584 - DNA, 15 bp, Homo sapiens
gagagatttgtcttg

SEQ ID NO: 222585 - DNA, 15 bp, Homo sapiens
ggagagatttgtctt

SEQ ID NO: 222586 - DNA, 15 bp, Homo sapiens
aggagagatttgtct

SEQ ID NO: 222587 - DNA, 15 bp, Homo sapiens
aaggagagatttgtc

SEQ ID NO: 222588 - DNA, 15 bp, Homo sapiens
aaaggagagatttgt

SEQ ID NO: 222589 - DNA, 15 bp, Homo sapiens
caaaggagagatttg

SEQ ID NO: 222590 - DNA, 15 bp, Homo sapiens
gcaaaggagagattt

SEQ ID NO: 222591 - DNA, 15 bp, Homo sapiens
ggcaaaggagagatt

SEQ ID NO: 222592 - DNA, 15 bp, Homo sapiens
gggcaaaggagagat

SEQ ID NO: 222593 - DNA, 15 bp, Homo sapiens
agggcaaaggagaga

SEQ ID NO: 222594 - DNA, 15 bp, Homo sapiens
gagggcaaaggagag

SEQ ID NO: 222595 - DNA, 15 bp, Homo sapiens
agagggcaaaggaga

SEQ ID NO: 222596 - DNA, 15 bp, Homo sapiens
aagagggcaaaggag

SEQ ID NO: 222597 - DNA, 15 bp, Homo sapiens
gaagagggcaaagga

SEQ ID NO: 222598 - DNA, 15 bp, Homo sapiens
ggaagagggcaaagg

SEQ ID NO: 222599 - DNA, 15 bp, Homo sapiens
gggaagagggcaaag

SEQ ID NO: 222600 - DNA, 15 bp, Homo sapiens
agggaagagggcaaa

SEQ ID NO: 222601 - DNA, 15 bp, Homo sapiens
gagggaagagggcaa

SEQ ID NO: 222602 - DNA, 15 bp, Homo sapiens
ggagggaagagggca

SEQ ID NO: 222603 - DNA, 15 bp, Homo sapiens
gggagggaagagggc

SEQ ID NO: 222604 - DNA, 15 bp, Homo sapiens
ggggagggaagaggg

SEQ ID NO: 222605 - DNA, 15 bp, Homo sapiens
tggggagggaagagg

SEQ ID NO: 222606 - DNA, 15 bp, Homo sapiens
gtggggagggaagag

SEQ ID NO: 222607 - DNA, 15 bp, Homo sapiens
tgtggggagggaaga

SEQ ID NO: 222608 - DNA, 15 bp, Homo sapiens
gtgtggggagggaag

SEQ ID NO: 222609 - DNA, 15 bp, Homo sapiens
ggtgtggggagggaa

SEQ ID NO: 222610 - DNA, 15 bp, Homo sapiens
gggtgtggggaggga

SEQ ID NO: 222611 - DNA, 15 bp, Homo sapiens
ggggtgtggggaggg

SEQ ID NO: 222612 - DNA, 15 bp, Homo sapiens
aggggtgtggggagg

SEQ ID NO: 222613 - DNA, 15 bp, Homo sapiens
caggggtgtggggag

SEQ ID NO: 222614 - DNA, 15 bp, Homo sapiens
gcaggggtgtgggga

SEQ ID NO: 222615 - DNA, 15 bp, Homo sapiens
tgcaggggtgtgggg

SEQ ID NO: 222616 - DNA, 15 bp, Homo sapiens
gtgcaggggtgtggg

SEQ ID NO: 222617 - DNA, 15 bp, Homo sapiens
tgtgcaggggtgtgg

SEQ ID NO: 222618 - DNA, 15 bp, Homo sapiens
ttgtgcaggggtgtg

SEQ ID NO: 222619 - DNA, 15 bp, Homo sapiens
attgtgcaggggtgt

SEQ ID NO: 222620 - DNA, 15 bp, Homo sapiens
cattgtgcaggggtg

SEQ ID NO: 222621 - DNA, 15 bp, Homo sapiens
gcattgtgcaggggt

SEQ ID NO: 222622 - DNA, 15 bp, Homo sapiens
tgcattgtgcagggg

SEQ ID NO: 222623 - DNA, 15 bp, Homo sapiens
gtgcattgtgcaggg

SEQ ID NO: 222624 - DNA, 15 bp, Homo sapiens
tgtgcattgtgcagg

SEQ ID NO: 222625 - DNA, 15 bp, Homo sapiens
atgtgcattgtgcag

SEQ ID NO: 222626 - DNA, 15 bp, Homo sapiens
aatgtgcattgtgca

SEQ ID NO: 222627 - DNA, 15 bp, Homo sapiens
aaatgtgcattgtgc

SEQ ID NO: 222628 - DNA, 15 bp, Homo sapiens
aaaatgtgcattgtg

SEQ ID NO: 222629 - DNA, 15 bp, Homo sapiens
caaaatgtgcattgt

SEQ ID NO: 222630 - DNA, 15 bp, Homo sapiens
acaaaatgtgcattg

SEQ ID NO: 222631 - DNA, 15 bp, Homo sapiens
cacaaaatgtgcatt

SEQ ID NO: 222632 - DNA, 15 bp, Homo sapiens
ccacaaaatgtgcat

SEQ ID NO: 222633 - DNA, 15 bp, Homo sapiens
tccacaaaatgtgca

SEQ ID NO: 222634 - DNA, 15 bp, Homo sapiens
gtccacaaaatgtgc

SEQ ID NO: 222635 - DNA, 15 bp, Homo sapiens
agtccacaaaatgtg

SEQ ID NO: 222636 - DNA, 15 bp, Homo sapiens
tagtccacaaaatgt

SEQ ID NO: 222637 - DNA, 15 bp, Homo sapiens
atagtccacaaaatg

SEQ ID NO: 222638 - DNA, 15 bp, Homo sapiens
aatagtccacaaaat

SEQ ID NO: 222639 - DNA, 15 bp, Homo sapiens
taatagtccacaaaa

SEQ ID NO: 222640 - DNA, 15 bp, Homo sapiens
ttaatagtccacaaa

SEQ ID NO: 222641 - DNA, 15 bp, Homo sapiens
attaatagtccacaa

SEQ ID NO: 222642 - DNA, 15 bp, Homo sapiens
tattaatagtccaca

SEQ ID NO: 222643 - DNA, 15 bp, Homo sapiens
ctattaatagtccac

SEQ ID NO: 222644 - DNA, 15 bp, Homo sapiens
actattaatagtcca

SEQ ID NO: 222645 - DNA, 15 bp, Homo sapiens
gactattaatagtcc

SEQ ID NO: 222646 - DNA, 15 bp, Homo sapiens
agactattaatagtc

SEQ ID NO: 222647 - DNA, 15 bp, Homo sapiens
tagactattaatagt

SEQ ID NO: 222648 - DNA, 15 bp, Homo sapiens
ctagactattaatag

SEQ ID NO: 222649 - DNA, 15 bp, Homo sapiens
tctagactattaata

SEQ ID NO: 222650 - DNA, 15 bp, Homo sapiens
ttctagactattaat

SEQ ID NO: 222651 - DNA, 15 bp, Homo sapiens
attctagactattaa

SEQ ID NO: 222652 - DNA, 15 bp, Homo sapiens
aattctagactatta

SEQ ID NO: 222653 - DNA, 15 bp, Homo sapiens
gaattctagactatt

SEQ ID NO: 222654 - DNA, 15 bp, Homo sapiens
ggaattctagactat

SEQ ID NO: 222655 - DNA, 15 bp, Homo sapiens
aggaattctagacta

SEQ ID NO: 222656 - DNA, 15 bp, Homo sapiens
taggaattctagact

SEQ ID NO: 222657 - DNA, 15 bp, Homo sapiens
ttaggaattctagac

SEQ ID NO: 222658 - DNA, 15 bp, Homo sapiens
attaggaattctaga

SEQ ID NO: 222659 - DNA, 15 bp, Homo sapiens
gattaggaattctag

SEQ ID NO: 222660 - DNA, 15 bp, Homo sapiens
tgattaggaattcta

SEQ ID NO: 222661 - DNA, 15 bp, Homo sapiens
ctgattaggaattct

SEQ ID NO: 222662 - DNA, 15 bp, Homo sapiens
tctgattaggaattc

SEQ ID NO: 222663 - DNA, 15 bp, Homo sapiens
ttctgattaggaatt

SEQ ID NO: 222664 - DNA, 15 bp, Homo sapiens
tttctgattaggaat

SEQ ID NO: 222665 - DNA, 15 bp, Homo sapiens
atttctgattaggaa

SEQ ID NO: 222666 - DNA, 15 bp, Homo sapiens
aatttctgattagga

SEQ ID NO: 222667 - DNA, 15 bp, Homo sapiens
taatttctgattagg

SEQ ID NO: 222668 - DNA, 15 bp, Homo sapiens
gtaatttctgattag

SEQ ID NO: 222669 - DNA, 15 bp, Homo sapiens
agtaatttctgatta

SEQ ID NO: 222670 - DNA, 15 bp, Homo sapiens
cagtaatttctgatt

SEQ ID NO: 222671 - DNA, 15 bp, Homo sapiens
acagtaatttctgat

SEQ ID NO: 222672 - DNA, 15 bp, Homo sapiens
tacagtaatttctga

SEQ ID NO: 222673 - DNA, 15 bp, Homo sapiens
gtacagtaatttctg

SEQ ID NO: 222674 - DNA, 15 bp, Homo sapiens
tgtacagtaatttct

SEQ ID NO: 222675 - DNA, 15 bp, Homo sapiens
gtgtacagtaatttc

SEQ ID NO: 222676 - DNA, 15 bp, Homo sapiens
ggtgtacagtaattt

SEQ ID NO: 222677 - DNA, 15 bp, Homo sapiens
aggtgtacagtaatt

SEQ ID NO: 222678 - DNA, 15 bp, Homo sapiens
taggtgtacagtaat

SEQ ID NO: 222679 - DNA, 15 bp, Homo sapiens
ttaggtgtacagtaa

SEQ ID NO: 222680 - DNA, 15 bp, Homo sapiens
cttaggtgtacagta

SEQ ID NO: 222681 - DNA, 15 bp, Homo sapiens
acttaggtgtacagt

SEQ ID NO: 222682 - DNA, 15 bp, Homo sapiens
aacttaggtgtacag

SEQ ID NO: 222683 - DNA, 15 bp, Homo sapiens
caacttaggtgtaca

SEQ ID NO: 222684 - DNA, 15 bp, Homo sapiens
gcaacttaggtgtac

SEQ ID NO: 222685 - DNA, 15 bp, Homo sapiens
tgcaacttaggtgta

SEQ ID NO: 222686 - DNA, 15 bp, Homo sapiens
gtgcaacttaggtgt

SEQ ID NO: 222687 - DNA, 15 bp, Homo sapiens
tgtgcaacttaggtg

SEQ ID NO: 222688 - DNA, 15 bp, Homo sapiens
ctgtgcaacttaggt

SEQ ID NO: 222689 - DNA, 15 bp, Homo sapiens
tctgtgcaacttagg

SEQ ID NO: 222690 - DNA, 15 bp, Homo sapiens
atctgtgcaacttag

SEQ ID NO: 222691 - DNA, 15 bp, Homo sapiens
gatctgtgcaactta

SEQ ID NO: 222692 - DNA, 15 bp, Homo sapiens
tgatctgtgcaactt

SEQ ID NO: 222693 - DNA, 15 bp, Homo sapiens
atgatctgtgcaact

SEQ ID NO: 222694 - DNA, 15 bp, Homo sapiens
tatgatctgtgcaac

SEQ ID NO: 222695 - DNA, 15 bp, Homo sapiens
atatgatctgtgcaa

SEQ ID NO: 222696 - DNA, 15 bp, Homo sapiens
aatatgatctgtgca

SEQ ID NO: 222697 - DNA, 15 bp, Homo sapiens
caatatgatctgtgc

SEQ ID NO: 222698 - DNA, 15 bp, Homo sapiens
acaatatgatctgtg

SEQ ID NO: 222699 - DNA, 15 bp, Homo sapiens
gacaatatgatctgt

SEQ ID NO: 222700 - DNA, 15 bp, Homo sapiens
agacaatatgatctg

SEQ ID NO: 222701 - DNA, 15 bp, Homo sapiens
aagacaatatgatct

SEQ ID NO: 222702 - DNA, 15 bp, Homo sapiens
gaagacaatatgatc

SEQ ID NO: 222703 - DNA, 15 bp, Homo sapiens
agaagacaatatgat

SEQ ID NO: 222704 - DNA, 15 bp, Homo sapiens
aagaagacaatatga

SEQ ID NO: 222705 - DNA, 15 bp, Homo sapiens
aaagaagacaatatg

SEQ ID NO: 222706 - DNA, 15 bp, Homo sapiens
gaaagaagacaatat

SEQ ID NO: 222707 - DNA, 15 bp, Homo sapiens
agaaagaagacaata

SEQ ID NO: 222708 - DNA, 15 bp, Homo sapiens
gagaaagaagacaat

SEQ ID NO: 222709 - DNA, 15 bp, Homo sapiens
ggagaaagaagacaa

SEQ ID NO: 222710 - DNA, 15 bp, Homo sapiens
tggagaaagaagaca

SEQ ID NO: 222711 - DNA, 15 bp, Homo sapiens
ttggagaaagaagac

SEQ ID NO: 222712 - DNA, 15 bp, Homo sapiens
gttggagaaagaaga

SEQ ID NO: 222713 - DNA, 15 bp, Homo sapiens
tgttggagaaagaag

SEQ ID NO: 222714 - DNA, 15 bp, Homo sapiens
ttgttggagaaagaa

SEQ ID NO: 222715 - DNA, 15 bp, Homo sapiens
tttgttggagaaaga

SEQ ID NO: 222716 - DNA, 15 bp, Homo sapiens
ttttgttggagaaag

SEQ ID NO: 222717 - DNA, 15 bp, Homo sapiens
cttttgttggagaaa

SEQ ID NO: 222718 - DNA, 15 bp, Homo sapiens
tcttttgttggagaa

SEQ ID NO: 222719 - DNA, 15 bp, Homo sapiens
atcttttgttggaga

SEQ ID NO: 222720 - DNA, 15 bp, Homo sapiens
gatcttttgttggag

SEQ ID NO: 222721 - DNA, 15 bp, Homo sapiens
agatcttttgttgga

SEQ ID NO: 222722 - DNA, 15 bp, Homo sapiens
cagatcttttgttgg

SEQ ID NO: 222723 - DNA, 15 bp, Homo sapiens
ccagatcttttgttg

SEQ ID NO: 222724 - DNA, 15 bp, Homo sapiens
tccagatcttttgtt

SEQ ID NO: 222725 - DNA, 15 bp, Homo sapiens
atccagatcttttgt

SEQ ID NO: 222726 - DNA, 15 bp, Homo sapiens
aatccagatcttttg

SEQ ID NO: 222727 - DNA, 15 bp, Homo sapiens
aaatccagatctttt

SEQ ID NO: 222728 - DNA, 15 bp, Homo sapiens
caaatccagatcttt

SEQ ID NO: 222729 - DNA, 15 bp, Homo sapiens
gcaaatccagatctt

SEQ ID NO: 222730 - DNA, 15 bp, Homo sapiens
ggcaaatccagatct

SEQ ID NO: 222731 - DNA, 15 bp, Homo sapiens
aggcaaatccagatc

SEQ ID NO: 222732 - DNA, 15 bp, Homo sapiens
caggcaaatccagat

SEQ ID NO: 222733 - DNA, 15 bp, Homo sapiens
acaggcaaatccaga

SEQ ID NO: 222734 - DNA, 15 bp, Homo sapiens
tacaggcaaatccag

SEQ ID NO: 222735 - DNA, 15 bp, Homo sapiens
tttacaggcaaatcc

SEQ ID NO: 222736 - DNA, 15 bp, Homo sapiens
ttttacaggcaaatc

SEQ ID NO: 222737 - DNA, 15 bp, Homo sapiens
attttacaggcaaat

SEQ ID NO: 222738 - DNA, 15 bp, Homo sapiens
tattttacaggcaaa

SEQ ID NO: 222739 - DNA, 15 bp, Homo sapiens
atattttacaggcaa

SEQ ID NO: 222740 - DNA, 15 bp, Homo sapiens
tatattttacaggca

SEQ ID NO: 222741 - DNA, 15 bp, Homo sapiens
atatattttacaggc

SEQ ID NO: 222742 - DNA, 15 bp, Homo sapiens
catatattttacagg

SEQ ID NO: 222743 - DNA, 15 bp, Homo sapiens
gcatatattttacag

SEQ ID NO: 222744 - DNA, 15 bp, Homo sapiens
ggcatatattttaca

SEQ ID NO: 222745 - DNA, 15 bp, Homo sapiens
gggcatatattttac

SEQ ID NO: 222746 - DNA, 15 bp, Homo sapiens
ggggcatatatttta

SEQ ID NO: 222747 - DNA, 15 bp, Homo sapiens
cggggcatatatttt

SEQ ID NO: 222748 - DNA, 15 bp, Homo sapiens
acggggcatatattt

SEQ ID NO: 222749 - DNA, 15 bp, Homo sapiens
tacggggcatatatt

SEQ ID NO: 222750 - DNA, 15 bp, Homo sapiens
ttacggggcatatat

SEQ ID NO: 222751 - DNA, 15 bp, Homo sapiens
attacggggcatata

SEQ ID NO: 222752 - DNA, 15 bp, Homo sapiens
tattacggggcatat

SEQ ID NO: 222753 - DNA, 15 bp, Homo sapiens
ctattacggggcata

SEQ ID NO: 222754 - DNA, 15 bp, Homo sapiens
actattacggggcat

SEQ ID NO: 222755 - DNA, 15 bp, Homo sapiens
aactattacggggca

SEQ ID NO: 222756 - DNA, 15 bp, Homo sapiens
aaactattacggggc

SEQ ID NO: 222757 - DNA, 15 bp, Homo sapiens
aaaactattacgggg

SEQ ID NO: 222758 - DNA, 15 bp, Homo sapiens
taaaactattacggg

SEQ ID NO: 222759 - DNA, 15 bp, Homo sapiens
ataaaactattacgg

SEQ ID NO: 222760 - DNA, 15 bp, Homo sapiens
tataaaactattacg

SEQ ID NO: 222761 - DNA, 15 bp, Homo sapiens
atataaaactattac

SEQ ID NO: 222762 - DNA, 15 bp, Homo sapiens
aatataaaactatta

SEQ ID NO: 222763 - DNA, 15 bp, Homo sapiens
aaatataaaactatt

SEQ ID NO: 222764 - DNA, 15 bp, Homo sapiens
gaaatataaaactat

SEQ ID NO: 222765 - DNA, 15 bp, Homo sapiens
ggaaatataaaacta

SEQ ID NO: 222766 - DNA, 15 bp, Homo sapiens
tggaaatataaaact

SEQ ID NO: 222767 - DNA, 15 bp, Homo sapiens
ctggaaatataaaac

SEQ ID NO: 222768 - DNA, 15 bp, Homo sapiens
tctggaaatataaaa

SEQ ID NO: 222769 - DNA, 15 bp, Homo sapiens
ctctggaaatataaa

SEQ ID NO: 222770 - DNA, 15 bp, Homo sapiens
cctctggaaatataa

SEQ ID NO: 222771 - DNA, 15 bp, Homo sapiens
ccctctggaaatata

SEQ ID NO: 222772 - DNA, 15 bp, Homo sapiens
gccctctggaaatat

SEQ ID NO: 222773 - DNA, 15 bp, Homo sapiens
ggccctctggaaata

SEQ ID NO: 222774 - DNA, 15 bp, Homo sapiens
tggccctctggaaat

SEQ ID NO: 222775 - DNA, 15 bp, Homo sapiens
ctggccctctggaaa

SEQ ID NO: 222776 - DNA, 15 bp, Homo sapiens
actggccctctggaa

SEQ ID NO: 222777 - DNA, 15 bp, Homo sapiens
aactggccctctgga

SEQ ID NO: 222778 - DNA, 15 bp, Homo sapiens
gaactggccctctgg

SEQ ID NO: 222779 - DNA, 15 bp, Homo sapiens
agaactggccctctg

SEQ ID NO: 222780 - DNA, 15 bp, Homo sapiens
cagaactggccctct

SEQ ID NO: 222781 - DNA, 15 bp, Homo sapiens
gcagaactggccctc

SEQ ID NO: 222782 - DNA, 15 bp, Homo sapiens
ggcagaactggccct

SEQ ID NO: 222783 - DNA, 15 bp, Homo sapiens
aggcagaactggccc

SEQ ID NO: 222784 - DNA, 15 bp, Homo sapiens
gaggcagaactggcc

SEQ ID NO: 222785 - DNA, 15 bp, Homo sapiens
agaggcagaactggc

SEQ ID NO: 222786 - DNA, 15 bp, Homo sapiens
cagaggcagaactgg

SEQ ID NO: 222787 - DNA, 15 bp, Homo sapiens
gcagaggcagaactg

SEQ ID NO: 222788 - DNA, 15 bp, Homo sapiens
agcagaggcagaact

SEQ ID NO: 222789 - DNA, 15 bp, Homo sapiens
gagcagaggcagaac

SEQ ID NO: 222790 - DNA, 15 bp, Homo sapiens
agagcagaggcagaa

SEQ ID NO: 222791 - DNA, 15 bp, Homo sapiens
aagagcagaggcaga

SEQ ID NO: 222792 - DNA, 15 bp, Homo sapiens
gaagagcagaggcag

SEQ ID NO: 222793 - DNA, 15 bp, Homo sapiens
ggaagagcagaggca

SEQ ID NO: 222794 - DNA, 15 bp, Homo sapiens
aggaagagcagaggc

SEQ ID NO: 222795 - DNA, 15 bp, Homo sapiens
aaggaagagcagagg

SEQ ID NO: 222796 - DNA, 15 bp, Homo sapiens
gaaggaagagcagag

SEQ ID NO: 222797 - DNA, 15 bp, Homo sapiens
agaaggaagagcaga

SEQ ID NO: 222798 - DNA, 15 bp, Homo sapiens
gagaaggaagagcag

SEQ ID NO: 222799 - DNA, 15 bp, Homo sapiens
agagaaggaagagca

SEQ ID NO: 222800 - DNA, 15 bp, Homo sapiens
cagagaaggaagagc

SEQ ID NO: 222801 - DNA, 15 bp, Homo sapiens
tcagagaaggaagag

SEQ ID NO: 222802 - DNA, 15 bp, Homo sapiens
ctcagagaaggaaga

SEQ ID NO: 222803 - DNA, 15 bp, Homo sapiens
actcagagaaggaag

SEQ ID NO: 222804 - DNA, 15 bp, Homo sapiens
gactcagagaaggaa

SEQ ID NO: 222805 - DNA, 15 bp, Homo sapiens
tgactcagagaagga

SEQ ID NO: 222806 - DNA, 15 bp, Homo sapiens
atgactcagagaagg

SEQ ID NO: 222807 - DNA, 15 bp, Homo sapiens
aatgactcagagaag

SEQ ID NO: 222808 - DNA, 15 bp, Homo sapiens
aaatgactcagagaa

SEQ ID NO: 222809 - DNA, 15 bp, Homo sapiens
caaatgactcagaga

SEQ ID NO: 222810 - DNA, 15 bp, Homo sapiens
gcaaatgactcagag

SEQ ID NO: 222811 - DNA, 15 bp, Homo sapiens
ggcaaatgactcaga

SEQ ID NO: 222812 - DNA, 15 bp, Homo sapiens
aggcaaatgactcag

SEQ ID NO: 222813 - DNA, 15 bp, Homo sapiens
aaggcaaatgactca

SEQ ID NO: 222814 - DNA, 15 bp, Homo sapiens
aaaggcaaatgactc

SEQ ID NO: 222815 - DNA, 15 bp, Homo sapiens
taaaggcaaatgact

SEQ ID NO: 222816 - DNA, 15 bp, Homo sapiens
ataaaggcaaatgac

SEQ ID NO: 222817 - DNA, 15 bp, Homo sapiens
cataaaggcaaatga

SEQ ID NO: 222818 - DNA, 15 bp, Homo sapiens
acataaaggcaaatg

SEQ ID NO: 222819 - DNA, 15 bp, Homo sapiens
gacataaaggcaaat

SEQ ID NO: 222820 - DNA, 15 bp, Homo sapiens
ggacataaaggcaaa

SEQ ID NO: 222821 - DNA, 15 bp, Homo sapiens
gggacataaaggcaa

SEQ ID NO: 222822 - DNA, 15 bp, Homo sapiens
cgggacataaaggca

SEQ ID NO: 222823 - DNA, 15 bp, Homo sapiens
acgggacataaaggc

SEQ ID NO: 222824 - DNA, 15 bp, Homo sapiens
gacgggacataaagg

SEQ ID NO: 222825 - DNA, 15 bp, Homo sapiens
agacgggacataaag

SEQ ID NO: 222826 - DNA, 15 bp, Homo sapiens
aagacgggacataaa

SEQ ID NO: 222827 - DNA, 15 bp, Homo sapiens
gaagacgggacataa

SEQ ID NO: 222828 - DNA, 15 bp, Homo sapiens
agaagacgggacata

SEQ ID NO: 222829 - DNA, 15 bp, Homo sapiens
gagaagacgggacat

SEQ ID NO: 222830 - DNA, 15 bp, Homo sapiens
agagaagacgggaca

SEQ ID NO: 222831 - DNA, 15 bp, Homo sapiens
gagagaagacgggac

SEQ ID NO: 222832 - DNA, 15 bp, Homo sapiens
tgagagaagacggga

SEQ ID NO: 222833 - DNA, 15 bp, Homo sapiens
ctgagagaagacggg

SEQ ID NO: 222834 - DNA, 15 bp, Homo sapiens
actgagagaagacgg

SEQ ID NO: 222835 - DNA, 15 bp, Homo sapiens
aactgagagaagacg

SEQ ID NO: 222836 - DNA, 15 bp, Homo sapiens
aaactgagagaagac

SEQ ID NO: 222837 - DNA, 15 bp, Homo sapiens
aaaactgagagaaga

SEQ ID NO: 222838 - DNA, 15 bp, Homo sapiens
aaaaactgagagaag

SEQ ID NO: 222839 - DNA, 15 bp, Homo sapiens
taaaaactgagagaa

SEQ ID NO: 222840 - DNA, 15 bp, Homo sapiens
ttaaaaactgagaga

SEQ ID NO: 222841 - DNA, 15 bp, Homo sapiens
attaaaaactgagag

SEQ ID NO: 222842 - DNA, 15 bp, Homo sapiens
gattaaaaactgaga

SEQ ID NO: 222843 - DNA, 15 bp, Homo sapiens
agattaaaaactgag

SEQ ID NO: 222844 - DNA, 15 bp, Homo sapiens
aagattaaaaactga

SEQ ID NO: 222845 - DNA, 15 bp, Homo sapiens
aaagattaaaaactg

SEQ ID NO: 222846 - DNA, 15 bp, Homo sapiens
gaaagattaaaaact

SEQ ID NO: 222847 - DNA, 15 bp, Homo sapiens
ggaaagattaaaaac

SEQ ID NO: 222848 - DNA, 15 bp, Homo sapiens
tggaaagattaaaaa

SEQ ID NO: 222849 - DNA, 15 bp, Homo sapiens
gtggaaagattaaaa

SEQ ID NO: 222850 - DNA, 15 bp, Homo sapiens
tgtggaaagattaaa

SEQ ID NO: 222851 - DNA, 15 bp, Homo sapiens
atgtggaaagattaa

SEQ ID NO: 222852 - DNA, 15 bp, Homo sapiens
aatgtggaaagatta

SEQ ID NO: 222853 - DNA, 15 bp, Homo sapiens
taatgtggaaagatt

SEQ ID NO: 222854 - DNA, 15 bp, Homo sapiens
ataatgtggaaagat

SEQ ID NO: 222855 - DNA, 15 bp, Homo sapiens
aataatgtggaaaga

SEQ ID NO: 222856 - DNA, 15 bp, Homo sapiens
caataatgtggaaag

SEQ ID NO: 222857 - DNA, 15 bp, Homo sapiens
gcaataatgtggaaa

SEQ ID NO: 222858 - DNA, 15 bp, Homo sapiens
ggcaataatgtggaa

SEQ ID NO: 222859 - DNA, 15 bp, Homo sapiens
aggcaataatgtgga

SEQ ID NO: 222860 - DNA, 15 bp, Homo sapiens
taggcaataatgtgg

SEQ ID NO: 222861 - DNA, 15 bp, Homo sapiens
ataggcaataatgtg

SEQ ID NO: 222862 - DNA, 15 bp, Homo sapiens
aataggcaataatgt

SEQ ID NO: 222863 - DNA, 15 bp, Homo sapiens
caataggcaataatg

SEQ ID NO: 222864 - DNA, 15 bp, Homo sapiens
ccaataggcaataat

SEQ ID NO: 222865 - DNA, 15 bp, Homo sapiens
accaataggcaataa

SEQ ID NO: 222866 - DNA, 15 bp, Homo sapiens
caccaataggcaata

SEQ ID NO: 222867 - DNA, 15 bp, Homo sapiens
acaccaataggcaat

SEQ ID NO: 222868 - DNA, 15 bp, Homo sapiens
aacaccaataggcaa

SEQ ID NO: 222869 - DNA, 15 bp, Homo sapiens
aaacaccaataggca

SEQ ID NO: 222870 - DNA, 15 bp, Homo sapiens
aaaacaccaataggc

SEQ ID NO: 222871 - DNA, 15 bp, Homo sapiens
gaaaacaccaatagg

SEQ ID NO: 222872 - DNA, 15 bp, Homo sapiens
agaaaacaccaatag

SEQ ID NO: 222873 - DNA, 15 bp, Homo sapiens
cagaaaacaccaata

SEQ ID NO: 222874 - DNA, 15 bp, Homo sapiens
ccagaaaacaccaat

SEQ ID NO: 222875 - DNA, 15 bp, Homo sapiens
accagaaaacaccaa

SEQ ID NO: 222876 - DNA, 15 bp, Homo sapiens
aaccagaaaacacca

SEQ ID NO: 222877 - DNA, 15 bp, Homo sapiens
caaccagaaaacacc

SEQ ID NO: 222878 - DNA, 15 bp, Homo sapiens
tcaaccagaaaacac

SEQ ID NO: 222879 - DNA, 15 bp, Homo sapiens
atcaaccagaaaaca

SEQ ID NO: 222880 - DNA, 15 bp, Homo sapiens
gatcaaccagaaaac

SEQ ID NO: 222881 - DNA, 15 bp, Homo sapiens
agatcaaccagaaaa

SEQ ID NO: 222882 - DNA, 15 bp, Homo sapiens
aagatcaaccagaaa

SEQ ID NO: 222883 - DNA, 15 bp, Homo sapiens
aaagatcaaccagaa

SEQ ID NO: 222884 - DNA, 15 bp, Homo sapiens
aaaagatcaaccaga

SEQ ID NO: 222885 - DNA, 15 bp, Homo sapiens
caaaagatcaaccag

SEQ ID NO: 222886 - DNA, 15 bp, Homo sapiens
acaaaagatcaacca

SEQ ID NO: 222887 - DNA, 15 bp, Homo sapiens
cacaaaagatcaacc

SEQ ID NO: 222888 - DNA, 15 bp, Homo sapiens
gcacaaaagatcaac

SEQ ID NO: 222889 - DNA, 15 bp, Homo sapiens
agcacaaaagatcaa

SEQ ID NO: 222890 - DNA, 15 bp, Homo sapiens
tagcacaaaagatca

SEQ ID NO: 222891 - DNA, 15 bp, Homo sapiens
ttagcacaaaagatc

SEQ ID NO: 222892 - DNA, 15 bp, Homo sapiens
tttagcacaaaagat

SEQ ID NO: 222893 - DNA, 15 bp, Homo sapiens
atttagcacaaaaga

SEQ ID NO: 222894 - DNA, 15 bp, Homo sapiens
aatttagcacaaaag

SEQ ID NO: 222895 - DNA, 15 bp, Homo sapiens
gaatttagcacaaaa

SEQ ID NO: 222896 - DNA, 15 bp, Homo sapiens
agaatttagcacaaa

SEQ ID NO: 222897 - DNA, 15 bp, Homo sapiens
tagaatttagcacaa

SEQ ID NO: 222898 - DNA, 15 bp, Homo sapiens
ttagaatttagcaca

SEQ ID NO: 222899 - DNA, 15 bp, Homo sapiens
tttagaatttagcac

SEQ ID NO: 222900 - DNA, 15 bp, Homo sapiens
atttagaatttagca

SEQ ID NO: 222901 - DNA, 15 bp, Homo sapiens
catttagaatttagc

SEQ ID NO: 222902 - DNA, 15 bp, Homo sapiens
gcatttagaatttag

SEQ ID NO: 222903 - DNA, 15 bp, Homo sapiens
ggcatttagaattta

SEQ ID NO: 222904 - DNA, 15 bp, Homo sapiens
tggcatttagaattt

SEQ ID NO: 222905 - DNA, 15 bp, Homo sapiens
atggcatttagaatt

SEQ ID NO: 222906 - DNA, 15 bp, Homo sapiens
aatggcatttagaat

SEQ ID NO: 222907 - DNA, 15 bp, Homo sapiens
caatggcatttagaa

SEQ ID NO: 222908 - DNA, 15 bp, Homo sapiens
acaatggcatttaga

SEQ ID NO: 222909 - DNA, 15 bp, Homo sapiens
cacaatggcatttag

SEQ ID NO: 222910 - DNA, 15 bp, Homo sapiens
acacaatggcattta

SEQ ID NO: 222911 - DNA, 15 bp, Homo sapiens
cacacaatggcattt

SEQ ID NO: 222912 - DNA, 15 bp, Homo sapiens
tcacacaatggcatt

SEQ ID NO: 222913 - DNA, 15 bp, Homo sapiens
ttcacacaatggcat

SEQ ID NO: 222914 - DNA, 15 bp, Homo sapiens
attcacacaatggca

SEQ ID NO: 222915 - DNA, 15 bp, Homo sapiens
aattcacacaatggc

SEQ ID NO: 222916 - DNA, 15 bp, Homo sapiens
gaattcacacaatgg

SEQ ID NO: 222917 - DNA, 15 bp, Homo sapiens
agaattcacacaatg

SEQ ID NO: 222918 - DNA, 15 bp, Homo sapiens
aagaattcacacaat

SEQ ID NO: 222919 - DNA, 15 bp, Homo sapiens
gaagaattcacacaa

SEQ ID NO: 222920 - DNA, 15 bp, Homo sapiens
ggaagaattcacaca

SEQ ID NO: 222921 - DNA, 15 bp, Homo sapiens
aggaagaattcacac

SEQ ID NO: 222922 - DNA, 15 bp, Homo sapiens
gaggaagaattcaca

SEQ ID NO: 222923 - DNA, 15 bp, Homo sapiens
ggaggaagaattcac

SEQ ID NO: 222924 - DNA, 15 bp, Homo sapiens
aggaggaagaattca

SEQ ID NO: 222925 - DNA, 15 bp, Homo sapiens
taggaggaagaattc

SEQ ID NO: 222926 - DNA, 15 bp, Homo sapiens
ataggaggaagaatt

SEQ ID NO: 222927 - DNA, 15 bp, Homo sapiens
aataggaggaagaat

SEQ ID NO: 222928 - DNA, 15 bp, Homo sapiens
aaataggaggaagaa

SEQ ID NO: 222929 - DNA, 15 bp, Homo sapiens
caaataggaggaaga

SEQ ID NO: 222930 - DNA, 15 bp, Homo sapiens
tcaaataggaggaag

SEQ ID NO: 222931 - DNA, 15 bp, Homo sapiens
atcaaataggaggaa

SEQ ID NO: 222932 - DNA, 15 bp, Homo sapiens
tatcaaataggagga

SEQ ID NO: 222933 - DNA, 15 bp, Homo sapiens
ttatcaaataggagg

SEQ ID NO: 222934 - DNA, 15 bp, Homo sapiens
tttatcaaataggag

SEQ ID NO: 222935 - DNA, 15 bp, Homo sapiens
gtttatcaaatagga

SEQ ID NO: 222936 - DNA, 15 bp, Homo sapiens
ggtttatcaaatagg

SEQ ID NO: 222937 - DNA, 15 bp, Homo sapiens
tggtttatcaaatag

SEQ ID NO: 222938 - DNA, 15 bp, Homo sapiens
ctggtttatcaaata

SEQ ID NO: 222939 - DNA, 15 bp, Homo sapiens
tctggtttatcaaat

SEQ ID NO: 222940 - DNA, 15 bp, Homo sapiens
ctctggtttatcaaa

SEQ ID NO: 222941 - DNA, 15 bp, Homo sapiens
actctggtttatcaa

SEQ ID NO: 222942 - DNA, 15 bp, Homo sapiens
cactctggtttatca

SEQ ID NO: 222943 - DNA, 15 bp, Homo sapiens
tcactctggtttatc

SEQ ID NO: 222944 - DNA, 15 bp, Homo sapiens
ttcactctggtttat

SEQ ID NO: 222945 - DNA, 15 bp, Homo sapiens
cttcactctggttta

SEQ ID NO: 222946 - DNA, 15 bp, Homo sapiens
tcttcactctggttt

SEQ ID NO: 222947 - DNA, 15 bp, Homo sapiens
gtcttcactctggtt

SEQ ID NO: 222948 - DNA, 15 bp, Homo sapiens
ggtcttcactctggt

SEQ ID NO: 222949 - DNA, 15 bp, Homo sapiens
aggtcttcactctgg

SEQ ID NO: 222950 - DNA, 15 bp, Homo sapiens
caggtcttcactctg

SEQ ID NO: 222951 - DNA, 15 bp, Homo sapiens
acaggtcttcactct

SEQ ID NO: 222952 - DNA, 15 bp, Homo sapiens
aacaggtcttcactc

SEQ ID NO: 222953 - DNA, 15 bp, Homo sapiens
gaacaggtcttcact

SEQ ID NO: 222954 - DNA, 15 bp, Homo sapiens
agaacaggtcttcac

SEQ ID NO: 222955 - DNA, 15 bp, Homo sapiens
tagaacaggtcttca

SEQ ID NO: 222956 - DNA, 15 bp, Homo sapiens
ttagaacaggtcttc

SEQ ID NO: 222957 - DNA, 15 bp, Homo sapiens
cttagaacaggtctt

SEQ ID NO: 222958 - DNA, 15 bp, Homo sapiens
tcttagaacaggtct

SEQ ID NO: 222959 - DNA, 15 bp, Homo sapiens
atcttagaacaggtc

SEQ ID NO: 222960 - DNA, 15 bp, Homo sapiens
gatcttagaacaggt

SEQ ID NO: 222961 - DNA, 15 bp, Homo sapiens
agatcttagaacagg

SEQ ID NO: 222962 - DNA, 15 bp, Homo sapiens
aagatcttagaacag

SEQ ID NO: 222963 - DNA, 15 bp, Homo sapiens
gaagatcttagaaca

SEQ ID NO: 222964 - DNA, 15 bp, Homo sapiens
tgaagatcttagaac

SEQ ID NO: 222965 - DNA, 15 bp, Homo sapiens
atgaagatcttagaa

SEQ ID NO: 222966 - DNA, 15 bp, Homo sapiens
gatgaagatcttaga

SEQ ID NO: 222967 - DNA, 15 bp, Homo sapiens
agatgaagatcttag

SEQ ID NO: 222968 - DNA, 15 bp, Homo sapiens
aagatgaagatctta

SEQ ID NO: 222969 - DNA, 15 bp, Homo sapiens
gaagatgaagatctt

SEQ ID NO: 222970 - DNA, 15 bp, Homo sapiens
agaagatgaagatct

SEQ ID NO: 222971 - DNA, 15 bp, Homo sapiens
gagaagatgaagatc

SEQ ID NO: 222972 - DNA, 15 bp, Homo sapiens
agagaagatgaagat

SEQ ID NO: 222973 - DNA, 15 bp, Homo sapiens
aagagaagatgaaga

SEQ ID NO: 222974 - DNA, 15 bp, Homo sapiens
gaagagaagatgaag

SEQ ID NO: 222975 - DNA, 15 bp, Homo sapiens
tgaagagaagatgaa

SEQ ID NO: 222976 - DNA, 15 bp, Homo sapiens
ctgaagagaagatga

SEQ ID NO: 222977 - DNA, 15 bp, Homo sapiens
actgaagagaagatg

SEQ ID NO: 222978 - DNA, 15 bp, Homo sapiens
cactgaagagaagat

SEQ ID NO: 222979 - DNA, 15 bp, Homo sapiens
ccactgaagagaaga

SEQ ID NO: 222980 - DNA, 15 bp, Homo sapiens
gccactgaagagaag

SEQ ID NO: 222981 - DNA, 15 bp, Homo sapiens
agccactgaagagaa

SEQ ID NO: 222982 - DNA, 15 bp, Homo sapiens
aagccactgaagaga

SEQ ID NO: 222983 - DNA, 15 bp, Homo sapiens
caagccactgaagag

SEQ ID NO: 222984 - DNA, 15 bp, Homo sapiens
gcaagccactgaaga

SEQ ID NO: 222985 - DNA, 15 bp, Homo sapiens
tgcaagccactgaag

SEQ ID NO: 222986 - DNA, 15 bp, Homo sapiens
atgcaagccactgaa

SEQ ID NO: 222987 - DNA, 15 bp, Homo sapiens
aatgcaagccactga

SEQ ID NO: 222988 - DNA, 15 bp, Homo sapiens
taatgcaagccactg

SEQ ID NO: 222989 - DNA, 15 bp, Homo sapiens
ttaatgcaagccact

SEQ ID NO: 222990 - DNA, 15 bp, Homo sapiens
tttaatgcaagccac

SEQ ID NO: 222991 - DNA, 15 bp, Homo sapiens
atttaatgcaagcca

SEQ ID NO: 222992 - DNA, 15 bp, Homo sapiens
gatttaatgcaagcc

SEQ ID NO: 222993 - DNA, 15 bp, Homo sapiens
agatttaatgcaagc

SEQ ID NO: 222994 - DNA, 15 bp, Homo sapiens
cagatttaatgcaag

SEQ ID NO: 222995 - DNA, 15 bp, Homo sapiens
acagatttaatgcaa

SEQ ID NO: 222996 - DNA, 15 bp, Homo sapiens
tacagatttaatgca

SEQ ID NO: 222997 - DNA, 15 bp, Homo sapiens
gtacagatttaatgc

SEQ ID NO: 222998 - DNA, 15 bp, Homo sapiens
tgtacagatttaatg

SEQ ID NO: 222999 - DNA, 15 bp, Homo sapiens
atgtacagatttaat

SEQ ID NO: 223000 - DNA, 15 bp, Homo sapiens
aatgtacagatttaa

SEQ ID NO: 223001 - DNA, 15 bp, Homo sapiens
gaatgtacagattta

SEQ ID NO: 223002 - DNA, 15 bp, Homo sapiens
ggaatgtacagattt

SEQ ID NO: 223003 - DNA, 15 bp, Homo sapiens
aggaatgtacagatt

SEQ ID NO: 223004 - DNA, 15 bp, Homo sapiens
caggaatgtacagat

SEQ ID NO: 223005 - DNA, 15 bp, Homo sapiens
ccaggaatgtacaga

SEQ ID NO: 223006 - DNA, 15 bp, Homo sapiens
tccaggaatgtacag

SEQ ID NO: 223007 - DNA, 15 bp, Homo sapiens
ttccaggaatgtaca

SEQ ID NO: 223008 - DNA, 15 bp, Homo sapiens
gttccaggaatgtac

SEQ ID NO: 223009 - DNA, 15 bp, Homo sapiens
agttccaggaatgta

SEQ ID NO: 223010 - DNA, 15 bp, Homo sapiens
aagttccaggaatgt

SEQ ID NO: 223011 - DNA, 15 bp, Homo sapiens
gaagttccaggaatg

SEQ ID NO: 223012 - DNA, 15 bp, Homo sapiens
ggaagttccaggaat

SEQ ID NO: 223013 - DNA, 15 bp, Homo sapiens
gggaagttccaggaa

SEQ ID NO: 223014 - DNA, 15 bp, Homo sapiens
ggggaagttccagga

SEQ ID NO: 223015 - DNA, 15 bp, Homo sapiens
aggggaagttccagg

SEQ ID NO: 223016 - DNA, 15 bp, Homo sapiens
aaggggaagttccag

SEQ ID NO: 223017 - DNA, 15 bp, Homo sapiens
gaaggggaagttcca

SEQ ID NO: 223018 - DNA, 15 bp, Homo sapiens
ggaaggggaagttcc

SEQ ID NO: 223019 - DNA, 15 bp, Homo sapiens
gggaaggggaagttc

SEQ ID NO: 223020 - DNA, 15 bp, Homo sapiens
ggggaaggggaagtt

SEQ ID NO: 223021 - DNA, 15 bp, Homo sapiens
tggggaaggggaagt

SEQ ID NO: 223022 - DNA, 15 bp, Homo sapiens
ctggggaaggggaag

SEQ ID NO: 223023 - DNA, 15 bp, Homo sapiens
cctggggaaggggaa

SEQ ID NO: 223024 - DNA, 15 bp, Homo sapiens
tcctggggaagggga

SEQ ID NO: 223025 - DNA, 15 bp, Homo sapiens
ttcctggggaagggg

SEQ ID NO: 223026 - DNA, 15 bp, Homo sapiens
cttcctggggaaggg

SEQ ID NO: 223027 - DNA, 15 bp, Homo sapiens
tcttcctggggaagg

SEQ ID NO: 223028 - DNA, 15 bp, Homo sapiens
ttcttcctggggaag

SEQ ID NO: 223029 - DNA, 15 bp, Homo sapiens
tttcttcctggggaa

SEQ ID NO: 223030 - DNA, 15 bp, Homo sapiens
atttcttcctgggga

SEQ ID NO: 223031 - DNA, 15 bp, Homo sapiens
gatttcttcctgggg

SEQ ID NO: 223032 - DNA, 15 bp, Homo sapiens
agatttcttcctggg

SEQ ID NO: 223033 - DNA, 15 bp, Homo sapiens
tagatttcttcctgg

SEQ ID NO: 223034 - DNA, 15 bp, Homo sapiens
ctagatttcttcctg

SEQ ID NO: 223035 - DNA, 15 bp, Homo sapiens
gctagatttcttcct

SEQ ID NO: 223036 - DNA, 15 bp, Homo sapiens
tgctagatttcttcc

SEQ ID NO: 223037 - DNA, 15 bp, Homo sapiens
gtgctagatttcttc

SEQ ID NO: 223038 - DNA, 15 bp, Homo sapiens
tgtgctagatttctt

SEQ ID NO: 223039 - DNA, 15 bp, Homo sapiens
ctgtgctagatttct

SEQ ID NO: 223040 - DNA, 15 bp, Homo sapiens
cctgtgctagatttc

SEQ ID NO: 223041 - DNA, 15 bp, Homo sapiens
gcctgtgctagattt

SEQ ID NO: 223042 - DNA, 15 bp, Homo sapiens
ggcctgtgctagatt

SEQ ID NO: 223043 - DNA, 15 bp, Homo sapiens
aggcctgtgctagat

SEQ ID NO: 223044 - DNA, 15 bp, Homo sapiens
aaggcctgtgctaga

SEQ ID NO: 223045 - DNA, 15 bp, Homo sapiens
caaggcctgtgctag

SEQ ID NO: 223046 - DNA, 15 bp, Homo sapiens
gcaaggcctgtgcta

SEQ ID NO: 223047 - DNA, 15 bp, Homo sapiens
tgcaaggcctgtgct

SEQ ID NO: 223048 - DNA, 15 bp, Homo sapiens
gtgcaaggcctgtgc

SEQ ID NO: 223049 - DNA, 15 bp, Homo sapiens
tgtgcaaggcctgtg

SEQ ID NO: 223050 - DNA, 15 bp, Homo sapiens
ctgtgcaaggcctgt

SEQ ID NO: 223051 - DNA, 15 bp, Homo sapiens
gctgtgcaaggcctg

SEQ ID NO: 223052 - DNA, 15 bp, Homo sapiens
tgctgtgcaaggcct

SEQ ID NO: 223053 - DNA, 15 bp, Homo sapiens
atgctgtgcaaggcc

SEQ ID NO: 223054 - DNA, 15 bp, Homo sapiens
aatgctgtgcaaggc

SEQ ID NO: 223055 - DNA, 15 bp, Homo sapiens
aaatgctgtgcaagg

SEQ ID NO: 223056 - DNA, 15 bp, Homo sapiens
aaaatgctgtgcaag

SEQ ID NO: 223057 - DNA, 15 bp, Homo sapiens
taaaatgctgtgcaa

SEQ ID NO: 223058 - DNA, 15 bp, Homo sapiens
ttaaaatgctgtgca

SEQ ID NO: 223059 - DNA, 15 bp, Homo sapiens
cttaaaatgctgtgc

SEQ ID NO: 223060 - DNA, 15 bp, Homo sapiens
tcttaaaatgctgtg

SEQ ID NO: 223061 - DNA, 15 bp, Homo sapiens
ttcttaaaatgctgt

SEQ ID NO: 223062 - DNA, 15 bp, Homo sapiens
attcttaaaatgctg

SEQ ID NO: 223063 - DNA, 15 bp, Homo sapiens
gattcttaaaatgct

SEQ ID NO: 223064 - DNA, 15 bp, Homo sapiens
agattcttaaaatgc

SEQ ID NO: 223065 - DNA, 15 bp, Homo sapiens
aagattcttaaaatg

SEQ ID NO: 223066 - DNA, 15 bp, Homo sapiens
aaagattcttaaaat

SEQ ID NO: 223067 - DNA, 15 bp, Homo sapiens
taaagattcttaaaa

SEQ ID NO: 223068 - DNA, 15 bp, Homo sapiens
gtaaagattcttaaa

SEQ ID NO: 223069 - DNA, 15 bp, Homo sapiens
ggtaaagattcttaa

SEQ ID NO: 223070 - DNA, 15 bp, Homo sapiens
tggtaaagattctta

SEQ ID NO: 223071 - DNA, 15 bp, Homo sapiens
gtggtaaagattctt

SEQ ID NO: 223072 - DNA, 15 bp, Homo sapiens
agtggtaaagattct

SEQ ID NO: 223073 - DNA, 15 bp, Homo sapiens
gagtggtaaagattc

SEQ ID NO: 223074 - DNA, 15 bp, Homo sapiens
ggagtggtaaagatt

SEQ ID NO: 223075 - DNA, 15 bp, Homo sapiens
aggagtggtaaagat

SEQ ID NO: 223076 - DNA, 15 bp, Homo sapiens
caggagtggtaaaga

SEQ ID NO: 223077 - DNA, 15 bp, Homo sapiens
tcaggagtggtaaag

SEQ ID NO: 223078 - DNA, 15 bp, Homo sapiens
ctcaggagtggtaaa

SEQ ID NO: 223079 - DNA, 15 bp, Homo sapiens
gctcaggagtggtaa

SEQ ID NO: 223080 - DNA, 15 bp, Homo sapiens
ggctcaggagtggta

SEQ ID NO: 223081 - DNA, 15 bp, Homo sapiens
tggctcaggagtggt

SEQ ID NO: 223082 - DNA, 15 bp, Homo sapiens
ctggctcaggagtgg

SEQ ID NO: 223083 - DNA, 15 bp, Homo sapiens
cctggctcaggagtg

SEQ ID NO: 223084 - DNA, 15 bp, Homo sapiens
gcctggctcaggagt

SEQ ID NO: 223085 - DNA, 15 bp, Homo sapiens
cgcctggctcaggag

SEQ ID NO: 223086 - DNA, 15 bp, Homo sapiens
acgcctggctcagga

SEQ ID NO: 223087 - DNA, 15 bp, Homo sapiens
cacgcctggctcagg

SEQ ID NO: 223088 - DNA, 15 bp, Homo sapiens
ccacgcctggctcag

SEQ ID NO: 223089 - DNA, 15 bp, Homo sapiens
accacgcctggctca

SEQ ID NO: 223090 - DNA, 15 bp, Homo sapiens
caccacgcctggctc

SEQ ID NO: 223091 - DNA, 15 bp, Homo sapiens
ggccaccacgcctgg

SEQ ID NO: 223092 - DNA, 15 bp, Homo sapiens
gggccaccacgcctg

SEQ ID NO: 223093 - DNA, 15 bp, Homo sapiens
tgggccaccacgcct

SEQ ID NO: 223094 - DNA, 15 bp, Homo sapiens
atgggccaccacgcc

SEQ ID NO: 223095 - DNA, 15 bp, Homo sapiens
catgggccaccacgc

SEQ ID NO: 223096 - DNA, 15 bp, Homo sapiens
gcatgggccaccacg

SEQ ID NO: 223097 - DNA, 15 bp, Homo sapiens
ggcatgggccaccac

SEQ ID NO: 223098 - DNA, 15 bp, Homo sapiens
aggcatgggccacca

SEQ ID NO: 223099 - DNA, 15 bp, Homo sapiens
taggcatgggccacc

SEQ ID NO: 223100 - DNA, 15 bp, Homo sapiens
ataggcatgggccac

SEQ ID NO: 223101 - DNA, 15 bp, Homo sapiens
tataggcatgggcca

SEQ ID NO: 223102 - DNA, 15 bp, Homo sapiens
ttataggcatgggcc

SEQ ID NO: 223103 - DNA, 15 bp, Homo sapiens
attataggcatgggc

SEQ ID NO: 223104 - DNA, 15 bp, Homo sapiens
gattataggcatggg

SEQ ID NO: 223105 - DNA, 15 bp, Homo sapiens
ggattataggcatgg

SEQ ID NO: 223106 - DNA, 15 bp, Homo sapiens
gggattataggcatg

SEQ ID NO: 223107 - DNA, 15 bp, Homo sapiens
tgggattataggcat

SEQ ID NO: 223108 - DNA, 15 bp, Homo sapiens
ctgggattataggca

SEQ ID NO: 223109 - DNA, 15 bp, Homo sapiens
tgtgatccgcccgcc

SEQ ID NO: 223110 - DNA, 15 bp, Homo sapiens
ttgtgatccgcccgc

SEQ ID NO: 223111 - DNA, 15 bp, Homo sapiens
cttgtgatccgcccg

SEQ ID NO: 223112 - DNA, 15 bp, Homo sapiens
ccttgtgatccgccc

SEQ ID NO: 223113 - DNA, 15 bp, Homo sapiens
ctgaccttgtgatcc

SEQ ID NO: 223114 - DNA, 15 bp, Homo sapiens
tctcctgaccttgtg

SEQ ID NO: 223115 - DNA, 15 bp, Homo sapiens
atctcctgaccttgt

SEQ ID NO: 223116 - DNA, 15 bp, Homo sapiens
gatctcctgaccttg

SEQ ID NO: 223117 - DNA, 15 bp, Homo sapiens
cgatctcctgacctt

SEQ ID NO: 223118 - DNA, 15 bp, Homo sapiens
ctgtgttagccagga

SEQ ID NO: 223119 - DNA, 15 bp, Homo sapiens
actgtgttagccagg

SEQ ID NO: 223120 - DNA, 15 bp, Homo sapiens
cactgtgttagccag

SEQ ID NO: 223121 - DNA, 15 bp, Homo sapiens
tcactgtgttagcca

SEQ ID NO: 223122 - DNA, 15 bp, Homo sapiens
ttcactgtgttagcc

SEQ ID NO: 223123 - DNA, 15 bp, Homo sapiens
tttcactgtgttagc

SEQ ID NO: 223124 - DNA, 15 bp, Homo sapiens
atttcactgtgttag

SEQ ID NO: 223125 - DNA, 15 bp, Homo sapiens
catttcactgtgtta

SEQ ID NO: 223126 - DNA, 15 bp, Homo sapiens
gcatttcactgtgtt

SEQ ID NO: 223127 - DNA, 15 bp, Homo sapiens
ggcatttcactgtgt

SEQ ID NO: 223128 - DNA, 15 bp, Homo sapiens
tggcatttcactgtg

SEQ ID NO: 223129 - DNA, 15 bp, Homo sapiens
atggcatttcactgt

SEQ ID NO: 223130 - DNA, 15 bp, Homo sapiens
gatggcatttcactg

SEQ ID NO: 223131 - DNA, 15 bp, Homo sapiens
agatggcatttcact

SEQ ID NO: 223132 - DNA, 15 bp, Homo sapiens
atttttttgtatttt

SEQ ID NO: 223133 - DNA, 15 bp, Homo sapiens
aatttttttgtattt

SEQ ID NO: 223134 - DNA, 15 bp, Homo sapiens
taatttttttgtatt

SEQ ID NO: 223135 - DNA, 15 bp, Homo sapiens
ctaatttttttgtat

SEQ ID NO: 223136 - DNA, 15 bp, Homo sapiens
gctaatttttttgta

SEQ ID NO: 223137 - DNA, 15 bp, Homo sapiens
ggctaatttttttgt

SEQ ID NO: 223138 - DNA, 15 bp, Homo sapiens
tggctaatttttttg

SEQ ID NO: 223139 - DNA, 15 bp, Homo sapiens
gtctggctaattttt

SEQ ID NO: 223140 - DNA, 15 bp, Homo sapiens
cgtctggctaatttt

SEQ ID NO: 223141 - DNA, 15 bp, Homo sapiens
acgtctggctaattt

SEQ ID NO: 223142 - DNA, 15 bp, Homo sapiens
cacgtctggctaatt

SEQ ID NO: 223143 - DNA, 15 bp, Homo sapiens
ccacgtctggctaat

SEQ ID NO: 223144 - DNA, 15 bp, Homo sapiens
accacgtctggctaa

SEQ ID NO: 223145 - DNA, 15 bp, Homo sapiens
caccacgtctggcta

SEQ ID NO: 223146 - DNA, 15 bp, Homo sapiens
tcaccacgtctggct

SEQ ID NO: 223147 - DNA, 15 bp, Homo sapiens
atcaccacgtctggc

SEQ ID NO: 223148 - DNA, 15 bp, Homo sapiens
catcaccacgtctgg

SEQ ID NO: 223149 - DNA, 15 bp, Homo sapiens
ccatcaccacgtctg

SEQ ID NO: 223150 - DNA, 15 bp, Homo sapiens
cccatcaccacgtct

SEQ ID NO: 223151 - DNA, 15 bp, Homo sapiens
ccccatcaccacgtc

SEQ ID NO: 223152 - DNA, 15 bp, Homo sapiens
gccccatcaccacgt

SEQ ID NO: 223153 - DNA, 15 bp, Homo sapiens
ggccccatcaccacg

SEQ ID NO: 223154 - DNA, 15 bp, Homo sapiens
gggccccatcaccac

SEQ ID NO: 223155 - DNA, 15 bp, Homo sapiens
agggccccatcacca

SEQ ID NO: 223156 - DNA, 15 bp, Homo sapiens
cagggccccatcacc

SEQ ID NO: 223157 - DNA, 15 bp, Homo sapiens
acagggccccatcac

SEQ ID NO: 223158 - DNA, 15 bp, Homo sapiens
tacagggccccatca

SEQ ID NO: 223159 - DNA, 15 bp, Homo sapiens
ctacagggccccatc

SEQ ID NO: 223160 - DNA, 15 bp, Homo sapiens
actacagggccccat

SEQ ID NO: 223161 - DNA, 15 bp, Homo sapiens
gactacagggcccca

SEQ ID NO: 223162 - DNA, 15 bp, Homo sapiens
ggactacagggcccc

SEQ ID NO: 223163 - DNA, 15 bp, Homo sapiens
gggactacagggccc

SEQ ID NO: 223164 - DNA, 15 bp, Homo sapiens
tgggactacagggcc

SEQ ID NO: 223165 - DNA, 15 bp, Homo sapiens
ctgggactacagggc

SEQ ID NO: 223166 - DNA, 15 bp, Homo sapiens
gctgggactacaggg

SEQ ID NO: 223167 - DNA, 15 bp, Homo sapiens
cgcctcagcctcctg

SEQ ID NO: 223168 - DNA, 15 bp, Homo sapiens
ccgcctcagcctcct

SEQ ID NO: 223169 - DNA, 15 bp, Homo sapiens
cattctcccgcctca

SEQ ID NO: 223170 - DNA, 15 bp, Homo sapiens
ccattctcccgcctc

SEQ ID NO: 223171 - DNA, 15 bp, Homo sapiens
gccattctcccgcct

SEQ ID NO: 223172 - DNA, 15 bp, Homo sapiens
cgccattctcccgcc

SEQ ID NO: 223173 - DNA, 15 bp, Homo sapiens
acgccattctcccgc

SEQ ID NO: 223174 - DNA, 15 bp, Homo sapiens
cacgccattctcccg

SEQ ID NO: 223175 - DNA, 15 bp, Homo sapiens
tcacgccattctccc

SEQ ID NO: 223176 - DNA, 15 bp, Homo sapiens
acctcctgggttcac

SEQ ID NO: 223177 - DNA, 15 bp, Homo sapiens
tacctcctgggttca

SEQ ID NO: 223178 - DNA, 15 bp, Homo sapiens
ctacctcctgggttc

SEQ ID NO: 223179 - DNA, 15 bp, Homo sapiens
tctacctcctgggtt

SEQ ID NO: 223180 - DNA, 15 bp, Homo sapiens
ctctacctcctgggt

SEQ ID NO: 223181 - DNA, 15 bp, Homo sapiens
cctctacctcctggg

SEQ ID NO: 223182 - DNA, 15 bp, Homo sapiens
acctctacctcctgg

SEQ ID NO: 223183 - DNA, 15 bp, Homo sapiens
cacctctacctcctg

SEQ ID NO: 223184 - DNA, 15 bp, Homo sapiens
tcacctctacctcct

SEQ ID NO: 223185 - DNA, 15 bp, Homo sapiens
ttcacctctacctcc

SEQ ID NO: 223186 - DNA, 15 bp, Homo sapiens
cttcacctctacctc

SEQ ID NO: 223187 - DNA, 15 bp, Homo sapiens
ccttcacctctacct

SEQ ID NO: 223188 - DNA, 15 bp, Homo sapiens
accttcacctctacc

SEQ ID NO: 223189 - DNA, 15 bp, Homo sapiens
aaccttcacctctac

SEQ ID NO: 223190 - DNA, 15 bp, Homo sapiens
taaccttcacctcta

SEQ ID NO: 223191 - DNA, 15 bp, Homo sapiens
gtaaccttcacctct

SEQ ID NO: 223192 - DNA, 15 bp, Homo sapiens
cgtaaccttcacctc

SEQ ID NO: 223193 - DNA, 15 bp, Homo sapiens
ccgtaaccttcacct

SEQ ID NO: 223194 - DNA, 15 bp, Homo sapiens
accgtaaccttcacc

SEQ ID NO: 223195 - DNA, 15 bp, Homo sapiens
caccgtaaccttcac

SEQ ID NO: 223196 - DNA, 15 bp, Homo sapiens
tcaccgtaaccttca

SEQ ID NO: 223197 - DNA, 15 bp, Homo sapiens
ctcaccgtaaccttc

SEQ ID NO: 223198 - DNA, 15 bp, Homo sapiens
gctcaccgtaacctt

SEQ ID NO: 223199 - DNA, 15 bp, Homo sapiens
agctcaccgtaacct

SEQ ID NO: 223200 - DNA, 15 bp, Homo sapiens
cagctcaccgtaacc

SEQ ID NO: 223201 - DNA, 15 bp, Homo sapiens
tcagctcaccgtaac

SEQ ID NO: 223202 - DNA, 15 bp, Homo sapiens
ctcagctcaccgtaa

SEQ ID NO: 223203 - DNA, 15 bp, Homo sapiens
tctcagctcaccgta

SEQ ID NO: 223204 - DNA, 15 bp, Homo sapiens
atctcagctcaccgt

SEQ ID NO: 223205 - DNA, 15 bp, Homo sapiens
gatctcagctcaccg

SEQ ID NO: 223206 - DNA, 15 bp, Homo sapiens
cgatctcagctcacc

SEQ ID NO: 223207 - DNA, 15 bp, Homo sapiens
gcgatctcagctcac

SEQ ID NO: 223208 - DNA, 15 bp, Homo sapiens
tgcgatctcagctca

SEQ ID NO: 223209 - DNA, 15 bp, Homo sapiens
gtgcgatctcagctc

SEQ ID NO: 223210 - DNA, 15 bp, Homo sapiens
ggtgcgatctcagct

SEQ ID NO: 223211 - DNA, 15 bp, Homo sapiens
tggtgcgatctcagc

SEQ ID NO: 223212 - DNA, 15 bp, Homo sapiens
gtggtgcgatctcag

SEQ ID NO: 223213 - DNA, 15 bp, Homo sapiens
agtggtgcgatctca

SEQ ID NO: 223214 - DNA, 15 bp, Homo sapiens
cagtggtgcgatctc

SEQ ID NO: 223215 - DNA, 15 bp, Homo sapiens
cgctgtgttgcccag

SEQ ID NO: 223216 - DNA, 15 bp, Homo sapiens
tcgctgtgttgccca

SEQ ID NO: 223217 - DNA, 15 bp, Homo sapiens
ctcgctgtgttgccc

SEQ ID NO: 223218 - DNA, 15 bp, Homo sapiens
tctcgctgtgttgcc

SEQ ID NO: 223219 - DNA, 15 bp, Homo sapiens
gtctcgctgtgttgc

SEQ ID NO: 223220 - DNA, 15 bp, Homo sapiens
agtctcgctgtgttg

SEQ ID NO: 223221 - DNA, 15 bp, Homo sapiens
gagtctcgctgtgtt

SEQ ID NO: 223222 - DNA, 15 bp, Homo sapiens
agagtctcgctgtgt

SEQ ID NO: 223223 - DNA, 15 bp, Homo sapiens
cagagtctcgctgtg

SEQ ID NO: 223224 - DNA, 15 bp, Homo sapiens
acagagtctcgctgt

SEQ ID NO: 223225 - DNA, 15 bp, Homo sapiens
gacagagtctcgctg

SEQ ID NO: 223226 - DNA, 15 bp, Homo sapiens
tgttttttgagacag

SEQ ID NO: 223227 - DNA, 15 bp, Homo sapiens
ttgttttttgagaca

SEQ ID NO: 223228 - DNA, 15 bp, Homo sapiens
ttttgttttttgaga

SEQ ID NO: 223229 - DNA, 15 bp, Homo sapiens
gtttgttttgttttt

SEQ ID NO: 223230 - DNA, 15 bp, Homo sapiens
tgtttgttttgtttt

SEQ ID NO: 223231 - DNA, 15 bp, Homo sapiens
gtttgtttgttttgt

SEQ ID NO: 223232 - DNA, 15 bp, Homo sapiens
gttgggtttttttgt

SEQ ID NO: 223233 - DNA, 15 bp, Homo sapiens
tgttgggtttttttg

SEQ ID NO: 223234 - DNA, 15 bp, Homo sapiens
ttgttgggttttttt

SEQ ID NO: 223235 - DNA, 15 bp, Homo sapiens
tttgttgggtttttt

SEQ ID NO: 223236 - DNA, 15 bp, Homo sapiens
gtttgttgggttttt

SEQ ID NO: 223237 - DNA, 15 bp, Homo sapiens
agtttgttgggtttt

SEQ ID NO: 223238 - DNA, 15 bp, Homo sapiens
tagtttgttgggttt

SEQ ID NO: 223239 - DNA, 15 bp, Homo sapiens
gtagtttgttgggtt

SEQ ID NO: 223240 - DNA, 15 bp, Homo sapiens
agtagtttgttgggt

SEQ ID NO: 223241 - DNA, 15 bp, Homo sapiens
gagtagtttgttggg

SEQ ID NO: 223242 - DNA, 15 bp, Homo sapiens
ggagtagtttgttgg

SEQ ID NO: 223243 - DNA, 15 bp, Homo sapiens
aggagtagtttgttg

SEQ ID NO: 223244 - DNA, 15 bp, Homo sapiens
aaggagtagtttgtt

SEQ ID NO: 223245 - DNA, 15 bp, Homo sapiens
caaggagtagtttgt

SEQ ID NO: 223246 - DNA, 15 bp, Homo sapiens
gcaaggagtagtttg

SEQ ID NO: 223247 - DNA, 15 bp, Homo sapiens
agcaaggagtagttt

SEQ ID NO: 223248 - DNA, 15 bp, Homo sapiens
cagcaaggagtagtt

SEQ ID NO: 223249 - DNA, 15 bp, Homo sapiens
ccagcaaggagtagt

SEQ ID NO: 223250 - DNA, 15 bp, Homo sapiens
cccagcaaggagtag

SEQ ID NO: 223251 - DNA, 15 bp, Homo sapiens
acccagcaaggagta

SEQ ID NO: 223252 - DNA, 15 bp, Homo sapiens
cacccagcaaggagt

SEQ ID NO: 223253 - DNA, 15 bp, Homo sapiens
acacccagcaaggag

SEQ ID NO: 223254 - DNA, 15 bp, Homo sapiens
cacacccagcaagga

SEQ ID NO: 223255 - DNA, 15 bp, Homo sapiens
ccacacccagcaagg

SEQ ID NO: 223256 - DNA, 15 bp, Homo sapiens
accacacccagcaag

SEQ ID NO: 223257 - DNA, 15 bp, Homo sapiens
ctgtgagccaccaca

SEQ ID NO: 223258 - DNA, 15 bp, Homo sapiens
gctgtgagccaccac

SEQ ID NO: 223259 - DNA, 15 bp, Homo sapiens
agctgtgagccacca

SEQ ID NO: 223260 - DNA, 15 bp, Homo sapiens
cagctgtgagccacc

SEQ ID NO: 223261 - DNA, 15 bp, Homo sapiens
acagctgtgagccac

SEQ ID NO: 223262 - DNA, 15 bp, Homo sapiens
tacagctgtgagcca

SEQ ID NO: 223263 - DNA, 15 bp, Homo sapiens
ttacagctgtgagcc

SEQ ID NO: 223264 - DNA, 15 bp, Homo sapiens
attacagctgtgagc

SEQ ID NO: 223265 - DNA, 15 bp, Homo sapiens
gattacagctgtgag

SEQ ID NO: 223266 - DNA, 15 bp, Homo sapiens
ggattacagctgtga

SEQ ID NO: 223267 - DNA, 15 bp, Homo sapiens
gggattacagctgtg

SEQ ID NO: 223268 - DNA, 15 bp, Homo sapiens
tgggattacagctgt

SEQ ID NO: 223269 - DNA, 15 bp, Homo sapiens
ctgggattacagctg

SEQ ID NO: 223270 - DNA, 15 bp, Homo sapiens
gctgggattacagct

SEQ ID NO: 223271 - DNA, 15 bp, Homo sapiens
tgctgggattacagc

SEQ ID NO: 223272 - DNA, 15 bp, Homo sapiens
cttggcctcccaagt

SEQ ID NO: 223273 - DNA, 15 bp, Homo sapiens
ccttggcctcccaag

SEQ ID NO: 223274 - DNA, 15 bp, Homo sapiens
agacctcaggtgatc

SEQ ID NO: 223275 - DNA, 15 bp, Homo sapiens
cagacctcaggtgat

SEQ ID NO: 223276 - DNA, 15 bp, Homo sapiens
ccagacctcaggtga

SEQ ID NO: 223277 - DNA, 15 bp, Homo sapiens
tccagacctcaggtg

SEQ ID NO: 223278 - DNA, 15 bp, Homo sapiens
ctccagacctcaggt

SEQ ID NO: 223279 - DNA, 15 bp, Homo sapiens
actccagacctcagg

SEQ ID NO: 223280 - DNA, 15 bp, Homo sapiens
aactccagacctcag

SEQ ID NO: 223281 - DNA, 15 bp, Homo sapiens
aaactccagacctca

SEQ ID NO: 223282 - DNA, 15 bp, Homo sapiens
caaactccagacctc

SEQ ID NO: 223283 - DNA, 15 bp, Homo sapiens
tcaaactccagacct

SEQ ID NO: 223284 - DNA, 15 bp, Homo sapiens
ctcaaactccagacc

SEQ ID NO: 223285 - DNA, 15 bp, Homo sapiens
tctcaaactccagac

SEQ ID NO: 223286 - DNA, 15 bp, Homo sapiens
gtctcaaactccaga

SEQ ID NO: 223287 - DNA, 15 bp, Homo sapiens
ggtctcaaactccag

SEQ ID NO: 223288 - DNA, 15 bp, Homo sapiens
tggtctcaaactcca

SEQ ID NO: 223289 - DNA, 15 bp, Homo sapiens
ggttggccaggctgg

SEQ ID NO: 223290 - DNA, 15 bp, Homo sapiens
tggttggccaggctg

SEQ ID NO: 223291 - DNA, 15 bp, Homo sapiens
atggttggccaggct

SEQ ID NO: 223292 - DNA, 15 bp, Homo sapiens
catggttggccaggc

SEQ ID NO: 223293 - DNA, 15 bp, Homo sapiens
ccatggttggccagg

SEQ ID NO: 223294 - DNA, 15 bp, Homo sapiens
gccatggttggccag

SEQ ID NO: 223295 - DNA, 15 bp, Homo sapiens
ggccatggttggcca

SEQ ID NO: 223296 - DNA, 15 bp, Homo sapiens
tggccatggttggcc

SEQ ID NO: 223297 - DNA, 15 bp, Homo sapiens
ttggccatggttggc

SEQ ID NO: 223298 - DNA, 15 bp, Homo sapiens
gttggccatggttgg

SEQ ID NO: 223299 - DNA, 15 bp, Homo sapiens
tgttggccatggttg

SEQ ID NO: 223300 - DNA, 15 bp, Homo sapiens
atgttggccatggtt

SEQ ID NO: 223301 - DNA, 15 bp, Homo sapiens
catgttggccatggt

SEQ ID NO: 223302 - DNA, 15 bp, Homo sapiens
ccatgttggccatgg

SEQ ID NO: 223303 - DNA, 15 bp, Homo sapiens
taccatgttggccat

SEQ ID NO: 223304 - DNA, 15 bp, Homo sapiens
attttaccatgttgg

SEQ ID NO: 223305 - DNA, 15 bp, Homo sapiens
gattttaccatgttg

SEQ ID NO: 223306 - DNA, 15 bp, Homo sapiens
ggattttaccatgtt

SEQ ID NO: 223307 - DNA, 15 bp, Homo sapiens
gggattttaccatgt

SEQ ID NO: 223308 - DNA, 15 bp, Homo sapiens
tgggattttaccatg

SEQ ID NO: 223309 - DNA, 15 bp, Homo sapiens
atgggattttaccat

SEQ ID NO: 223310 - DNA, 15 bp, Homo sapiens
gatgggattttacca

SEQ ID NO: 223311 - DNA, 15 bp, Homo sapiens
agatgggattttacc

SEQ ID NO: 223312 - DNA, 15 bp, Homo sapiens
gagatgggattttac

SEQ ID NO: 223313 - DNA, 15 bp, Homo sapiens
agagatgggatttta

SEQ ID NO: 223314 - DNA, 15 bp, Homo sapiens
tagagatgggatttt

SEQ ID NO: 223315 - DNA, 15 bp, Homo sapiens
atagagatgggattt

SEQ ID NO: 223316 - DNA, 15 bp, Homo sapiens
aatagagatgggatt

SEQ ID NO: 223317 - DNA, 15 bp, Homo sapiens
taatagagatgggat

SEQ ID NO: 223318 - DNA, 15 bp, Homo sapiens
ttaatagagatggga

SEQ ID NO: 223319 - DNA, 15 bp, Homo sapiens
cttttaatagagatg

SEQ ID NO: 223320 - DNA, 15 bp, Homo sapiens
acttttaatagagat

SEQ ID NO: 223321 - DNA, 15 bp, Homo sapiens
tacttttaatagaga

SEQ ID NO: 223322 - DNA, 15 bp, Homo sapiens
ctacttttaatagag

SEQ ID NO: 223323 - DNA, 15 bp, Homo sapiens
tctacttttaataga

SEQ ID NO: 223324 - DNA, 15 bp, Homo sapiens
ttctacttttaatag

SEQ ID NO: 223325 - DNA, 15 bp, Homo sapiens
tttctacttttaata

SEQ ID NO: 223326 - DNA, 15 bp, Homo sapiens
ttttctacttttaat

SEQ ID NO: 223327 - DNA, 15 bp, Homo sapiens
tttttctacttttaa

SEQ ID NO: 223328 - DNA, 15 bp, Homo sapiens
atttttctactttta

SEQ ID NO: 223329 - DNA, 15 bp, Homo sapiens
aatttttctactttt

SEQ ID NO: 223330 - DNA, 15 bp, Homo sapiens
taatttttctacttt

SEQ ID NO: 223331 - DNA, 15 bp, Homo sapiens
ctaatttttctactt

SEQ ID NO: 223332 - DNA, 15 bp, Homo sapiens
gctaatttttctact

SEQ ID NO: 223333 - DNA, 15 bp, Homo sapiens
agctaatttttctac

SEQ ID NO: 223334 - DNA, 15 bp, Homo sapiens
cagctaatttttcta

SEQ ID NO: 223335 - DNA, 15 bp, Homo sapiens
ccagctaatttttct

SEQ ID NO: 223336 - DNA, 15 bp, Homo sapiens
cccagctaatttttc

SEQ ID NO: 223337 - DNA, 15 bp, Homo sapiens
gcacccagctaattt

SEQ ID NO: 223338 - DNA, 15 bp, Homo sapiens
tgcacccagctaatt

SEQ ID NO: 223339 - DNA, 15 bp, Homo sapiens
ctgcacccagctaat

SEQ ID NO: 223340 - DNA, 15 bp, Homo sapiens
actgcacccagctaa

SEQ ID NO: 223341 - DNA, 15 bp, Homo sapiens
cactgcacccagcta

SEQ ID NO: 223342 - DNA, 15 bp, Homo sapiens
ccactgcacccagct

SEQ ID NO: 223343 - DNA, 15 bp, Homo sapiens
tgccactgcacccag

SEQ ID NO: 223344 - DNA, 15 bp, Homo sapiens
ctgccactgcaccca

SEQ ID NO: 223345 - DNA, 15 bp, Homo sapiens
cctgccactgcaccc

SEQ ID NO: 223346 - DNA, 15 bp, Homo sapiens
gcctgccactgcacc

SEQ ID NO: 223347 - DNA, 15 bp, Homo sapiens
tgcctgccactgcac

SEQ ID NO: 223348 - DNA, 15 bp, Homo sapiens
gtgcctgccactgca

SEQ ID NO: 223349 - DNA, 15 bp, Homo sapiens
ggtgcctgccactgc

SEQ ID NO: 223350 - DNA, 15 bp, Homo sapiens
aggtgcctgccactg

SEQ ID NO: 223351 - DNA, 15 bp, Homo sapiens
caggtgcctgccact

SEQ ID NO: 223352 - DNA, 15 bp, Homo sapiens
acaggtgcctgccac

SEQ ID NO: 223353 - DNA, 15 bp, Homo sapiens
tacaggtgcctgcca

SEQ ID NO: 223354 - DNA, 15 bp, Homo sapiens
tcaggttcaagtgat

SEQ ID NO: 223355 - DNA, 15 bp, Homo sapiens
ctcaggttcaagtga

SEQ ID NO: 223356 - DNA, 15 bp, Homo sapiens
tctcaggttcaagtg

SEQ ID NO: 223357 - DNA, 15 bp, Homo sapiens
ctctcaggttcaagt

SEQ ID NO: 223358 - DNA, 15 bp, Homo sapiens
ttgcaacctctgcct

SEQ ID NO: 223359 - DNA, 15 bp, Homo sapiens
cttgcaacctctgcc

SEQ ID NO: 223360 - DNA, 15 bp, Homo sapiens
acttgcaacctctgc

SEQ ID NO: 223361 - DNA, 15 bp, Homo sapiens
cacttgcaacctctg

SEQ ID NO: 223362 - DNA, 15 bp, Homo sapiens
tcacttgcaacctct

SEQ ID NO: 223363 - DNA, 15 bp, Homo sapiens
ctcacttgcaacctc

SEQ ID NO: 223364 - DNA, 15 bp, Homo sapiens
gctcacttgcaacct

SEQ ID NO: 223365 - DNA, 15 bp, Homo sapiens
ggctcacttgcaacc

SEQ ID NO: 223366 - DNA, 15 bp, Homo sapiens
tggctcacttgcaac

SEQ ID NO: 223367 - DNA, 15 bp, Homo sapiens
ttggctcacttgcaa

SEQ ID NO: 223368 - DNA, 15 bp, Homo sapiens
cttggctcacttgca

SEQ ID NO: 223369 - DNA, 15 bp, Homo sapiens
tcttggctcacttgc

SEQ ID NO: 223370 - DNA, 15 bp, Homo sapiens
atcttggctcacttg

SEQ ID NO: 223371 - DNA, 15 bp, Homo sapiens
aatcttggctcactt

SEQ ID NO: 223372 - DNA, 15 bp, Homo sapiens
taatcttggctcact

SEQ ID NO: 223373 - DNA, 15 bp, Homo sapiens
ataatcttggctcac

SEQ ID NO: 223374 - DNA, 15 bp, Homo sapiens
cataatcttggctca

SEQ ID NO: 223375 - DNA, 15 bp, Homo sapiens
gcataatcttggctc

SEQ ID NO: 223376 - DNA, 15 bp, Homo sapiens
ggcataatcttggct

SEQ ID NO: 223377 - DNA, 15 bp, Homo sapiens
tggcataatcttggc

SEQ ID NO: 223378 - DNA, 15 bp, Homo sapiens
gtggcataatcttgg

SEQ ID NO: 223379 - DNA, 15 bp, Homo sapiens
agtggcataatcttg

SEQ ID NO: 223380 - DNA, 15 bp, Homo sapiens
aagtggcataatctt

SEQ ID NO: 223381 - DNA, 15 bp, Homo sapiens
gaagtggcataatct

SEQ ID NO: 223382 - DNA, 15 bp, Homo sapiens
tgaagtggcataatc

SEQ ID NO: 223383 - DNA, 15 bp, Homo sapiens
gtgaagtggcataat

SEQ ID NO: 223384 - DNA, 15 bp, Homo sapiens
agtgaagtggcataa

SEQ ID NO: 223385 - DNA, 15 bp, Homo sapiens
gagtgaagtggcata

SEQ ID NO: 223386 - DNA, 15 bp, Homo sapiens
ggagtgaagtggcat

SEQ ID NO: 223387 - DNA, 15 bp, Homo sapiens
tggagtgaagtggca

SEQ ID NO: 223388 - DNA, 15 bp, Homo sapiens
ctggagtgaagtggc

SEQ ID NO: 223389 - DNA, 15 bp, Homo sapiens
gctggagtgaagtgg

SEQ ID NO: 223390 - DNA, 15 bp, Homo sapiens
ggctggagtgaagtg

SEQ ID NO: 223391 - DNA, 15 bp, Homo sapiens
aggctggagtgaagt

SEQ ID NO: 223392 - DNA, 15 bp, Homo sapiens
caggctggagtgaag

SEQ ID NO: 223393 - DNA, 15 bp, Homo sapiens
ccaggctggagtgaa

SEQ ID NO: 223394 - DNA, 15 bp, Homo sapiens
cccaggctggagtga

SEQ ID NO: 223395 - DNA, 15 bp, Homo sapiens
ggagtcttactctgt

SEQ ID NO: 223396 - DNA, 15 bp, Homo sapiens
tggagtcttactctg

SEQ ID NO: 223397 - DNA, 15 bp, Homo sapiens
atggagtcttactct

SEQ ID NO: 223398 - DNA, 15 bp, Homo sapiens
gatggagtcttactc

SEQ ID NO: 223399 - DNA, 15 bp, Homo sapiens
agatggagtcttact

SEQ ID NO: 223400 - DNA, 15 bp, Homo sapiens
tgagatggagtctta

SEQ ID NO: 223401 - DNA, 15 bp, Homo sapiens
attcctttttttttt

SEQ ID NO: 223402 - DNA, 15 bp, Homo sapiens
cattccttttttttt

SEQ ID NO: 223403 - DNA, 15 bp, Homo sapiens
acattcctttttttt

SEQ ID NO: 223404 - DNA, 15 bp, Homo sapiens
aacattccttttttt

SEQ ID NO: 223405 - DNA, 15 bp, Homo sapiens
aaacattcctttttt

SEQ ID NO: 223406 - DNA, 15 bp, Homo sapiens
taaacattccttttt

SEQ ID NO: 223407 - DNA, 15 bp, Homo sapiens
gtaaacattcctttt

SEQ ID NO: 223408 - DNA, 15 bp, Homo sapiens
agtaaacattccttt

SEQ ID NO: 223409 - DNA, 15 bp, Homo sapiens
cagtaaacattcctt

SEQ ID NO: 223410 - DNA, 15 bp, Homo sapiens
gcagtaaacattcct

SEQ ID NO: 223411 - DNA, 15 bp, Homo sapiens
agcagtaaacattcc

SEQ ID NO: 223412 - DNA, 15 bp, Homo sapiens
gagcagtaaacattc

SEQ ID NO: 223413 - DNA, 15 bp, Homo sapiens
ggagcagtaaacatt

SEQ ID NO: 223414 - DNA, 15 bp, Homo sapiens
gggagcagtaaacat

SEQ ID NO: 223415 - DNA, 15 bp, Homo sapiens
tgggagcagtaaaca

SEQ ID NO: 223416 - DNA, 15 bp, Homo sapiens
atgggagcagtaaac

SEQ ID NO: 223417 - DNA, 15 bp, Homo sapiens
tatgggagcagtaaa

SEQ ID NO: 223418 - DNA, 15 bp, Homo sapiens
atatgggagcagtaa

SEQ ID NO: 223419 - DNA, 15 bp, Homo sapiens
aatatgggagcagta

SEQ ID NO: 223420 - DNA, 15 bp, Homo sapiens
aaatatgggagcagt

SEQ ID NO: 223421 - DNA, 15 bp, Homo sapiens
taaatatgggagcag

SEQ ID NO: 223422 - DNA, 15 bp, Homo sapiens
gtaaatatgggagca

SEQ ID NO: 223423 - DNA, 15 bp, Homo sapiens
agtaaatatgggagc

SEQ ID NO: 223424 - DNA, 15 bp, Homo sapiens
cagtaaatatgggag

SEQ ID NO: 223425 - DNA, 15 bp, Homo sapiens
tcagtaaatatggga

SEQ ID NO: 223426 - DNA, 15 bp, Homo sapiens
atcagtaaatatggg

SEQ ID NO: 223427 - DNA, 15 bp, Homo sapiens
aatcagtaaatatgg

SEQ ID NO: 223428 - DNA, 15 bp, Homo sapiens
aaatcagtaaatatg

SEQ ID NO: 223429 - DNA, 15 bp, Homo sapiens
caaatcagtaaatat

SEQ ID NO: 223430 - DNA, 15 bp, Homo sapiens
tcaaatcagtaaata

SEQ ID NO: 223431 - DNA, 15 bp, Homo sapiens
atcaaatcagtaaat

SEQ ID NO: 223432 - DNA, 15 bp, Homo sapiens
aatcaaatcagtaaa

SEQ ID NO: 223433 - DNA, 15 bp, Homo sapiens
aaatcaaatcagtaa

SEQ ID NO: 223434 - DNA, 15 bp, Homo sapiens
caaatcaaatcagta

SEQ ID NO: 223435 - DNA, 15 bp, Homo sapiens
ccaaatcaaatcagt

SEQ ID NO: 223436 - DNA, 15 bp, Homo sapiens
tccaaatcaaatcag

SEQ ID NO: 223437 - DNA, 15 bp, Homo sapiens
atccaaatcaaatca

SEQ ID NO: 223438 - DNA, 15 bp, Homo sapiens
aatccaaatcaaatc

SEQ ID NO: 223439 - DNA, 15 bp, Homo sapiens
aaatccaaatcaaat

SEQ ID NO: 223440 - DNA, 15 bp, Homo sapiens
aaaatccaaatcaaa

SEQ ID NO: 223441 - DNA, 15 bp, Homo sapiens
caaaatccaaatcaa

SEQ ID NO: 223442 - DNA, 15 bp, Homo sapiens
ccaaaatccaaatca

SEQ ID NO: 223443 - DNA, 15 bp, Homo sapiens
tccaaaatccaaatc

SEQ ID NO: 223444 - DNA, 15 bp, Homo sapiens
ttccaaaatccaaat

SEQ ID NO: 223445 - DNA, 15 bp, Homo sapiens
tttccaaaatccaaa

SEQ ID NO: 223446 - DNA, 15 bp, Homo sapiens
atttccaaaatccaa

SEQ ID NO: 223447 - DNA, 15 bp, Homo sapiens
tatttccaaaatcca

SEQ ID NO: 223448 - DNA, 15 bp, Homo sapiens
atatttccaaaatcc

SEQ ID NO: 223449 - DNA, 15 bp, Homo sapiens
gatatttccaaaatc

SEQ ID NO: 223450 - DNA, 15 bp, Homo sapiens
agatatttccaaaat

SEQ ID NO: 223451 - DNA, 15 bp, Homo sapiens
aagatatttccaaaa

SEQ ID NO: 223452 - DNA, 15 bp, Homo sapiens
caagatatttccaaa

SEQ ID NO: 223453 - DNA, 15 bp, Homo sapiens
tcaagatatttccaa

SEQ ID NO: 223454 - DNA, 15 bp, Homo sapiens
gtcaagatatttcca

SEQ ID NO: 223455 - DNA, 15 bp, Homo sapiens
ggtcaagatatttcc

SEQ ID NO: 223456 - DNA, 15 bp, Homo sapiens
tggtcaagatatttc

SEQ ID NO: 223457 - DNA, 15 bp, Homo sapiens
gtggtcaagatattt

SEQ ID NO: 223458 - DNA, 15 bp, Homo sapiens
agtggtcaagatatt

SEQ ID NO: 223459 - DNA, 15 bp, Homo sapiens
tagtggtcaagatat

SEQ ID NO: 223460 - DNA, 15 bp, Homo sapiens
ttagtggtcaagata

SEQ ID NO: 223461 - DNA, 15 bp, Homo sapiens
tttagtggtcaagat

SEQ ID NO: 223462 - DNA, 15 bp, Homo sapiens
ttttagtggtcaaga

SEQ ID NO: 223463 - DNA, 15 bp, Homo sapiens
attttagtggtcaag

SEQ ID NO: 223464 - DNA, 15 bp, Homo sapiens
aattttagtggtcaa

SEQ ID NO: 223465 - DNA, 15 bp, Homo sapiens
taattttagtggtca

SEQ ID NO: 223466 - DNA, 15 bp, Homo sapiens
ttaattttagtggtc

SEQ ID NO: 223467 - DNA, 15 bp, Homo sapiens
tttaattttagtggt

SEQ ID NO: 223468 - DNA, 15 bp, Homo sapiens
ttttaattttagtgg

SEQ ID NO: 223469 - DNA, 15 bp, Homo sapiens
tttttaattttagtg

SEQ ID NO: 223470 - DNA, 15 bp, Homo sapiens
ttttttaattttagt

SEQ ID NO: 223471 - DNA, 15 bp, Homo sapiens
tttttttaattttag

SEQ ID NO: 223472 - DNA, 15 bp, Homo sapiens
attttttttaatttt

SEQ ID NO: 223473 - DNA, 15 bp, Homo sapiens
tattttttttaattt

SEQ ID NO: 223474 - DNA, 15 bp, Homo sapiens
ttattttttttaatt

SEQ ID NO: 223475 - DNA, 15 bp, Homo sapiens
attattttttttaat

SEQ ID NO: 223476 - DNA, 15 bp, Homo sapiens
aattattttttttaa

SEQ ID NO: 223477 - DNA, 15 bp, Homo sapiens
aaattatttttttta

SEQ ID NO: 223478 - DNA, 15 bp, Homo sapiens
aaaattatttttttt

SEQ ID NO: 223479 - DNA, 15 bp, Homo sapiens
caaaattattttttt

SEQ ID NO: 223480 - DNA, 15 bp, Homo sapiens
gcaaaattatttttt

SEQ ID NO: 223481 - DNA, 15 bp, Homo sapiens
agcaaaattattttt

SEQ ID NO: 223482 - DNA, 15 bp, Homo sapiens
tagcaaaattatttt

SEQ ID NO: 223483 - DNA, 15 bp, Homo sapiens
atagcaaaattattt

SEQ ID NO: 223484 - DNA, 15 bp, Homo sapiens
tatagcaaaattatt

SEQ ID NO: 223485 - DNA, 15 bp, Homo sapiens
atatagcaaaattat

SEQ ID NO: 223486 - DNA, 15 bp, Homo sapiens
aatatagcaaaatta

SEQ ID NO: 223487 - DNA, 15 bp, Homo sapiens
taatatagcaaaatt

SEQ ID NO: 223488 - DNA, 15 bp, Homo sapiens
gtaatatagcaaaat

SEQ ID NO: 223489 - DNA, 15 bp, Homo sapiens
ggtaatatagcaaaa

SEQ ID NO: 223490 - DNA, 15 bp, Homo sapiens
aggtaatatagcaaa

SEQ ID NO: 223491 - DNA, 15 bp, Homo sapiens
caggtaatatagcaa

SEQ ID NO: 223492 - DNA, 15 bp, Homo sapiens
gcaggtaatatagca

SEQ ID NO: 223493 - DNA, 15 bp, Homo sapiens
agcaggtaatatagc

SEQ ID NO: 223494 - DNA, 15 bp, Homo sapiens
cagcaggtaatatag

SEQ ID NO: 223495 - DNA, 15 bp, Homo sapiens
ccagcaggtaatata

SEQ ID NO: 223496 - DNA, 15 bp, Homo sapiens
accagcaggtaatat

SEQ ID NO: 223497 - DNA, 15 bp, Homo sapiens
aaccagcaggtaata

SEQ ID NO: 223498 - DNA, 15 bp, Homo sapiens
aaaccagcaggtaat

SEQ ID NO: 223499 - DNA, 15 bp, Homo sapiens
aaaaccagcaggtaa

SEQ ID NO: 223500 - DNA, 15 bp, Homo sapiens
gaaaaccagcaggta

SEQ ID NO: 223501 - DNA, 15 bp, Homo sapiens
tgaaaaccagcaggt

SEQ ID NO: 223502 - DNA, 15 bp, Homo sapiens
gtgaaaaccagcagg

SEQ ID NO: 223503 - DNA, 15 bp, Homo sapiens
agtgaaaaccagcag

SEQ ID NO: 223504 - DNA, 15 bp, Homo sapiens
tagtgaaaaccagca

SEQ ID NO: 223505 - DNA, 15 bp, Homo sapiens
atagtgaaaaccagc

SEQ ID NO: 223506 - DNA, 15 bp, Homo sapiens
aatagtgaaaaccag

SEQ ID NO: 223507 - DNA, 15 bp, Homo sapiens
aaatagtgaaaacca

SEQ ID NO: 223508 - DNA, 15 bp, Homo sapiens
aaaatagtgaaaacc

SEQ ID NO: 223509 - DNA, 15 bp, Homo sapiens
aaaaatagtgaaaac

SEQ ID NO: 223510 - DNA, 15 bp, Homo sapiens
aaaaaatagtgaaaa

SEQ ID NO: 223511 - DNA, 15 bp, Homo sapiens
taaaaaatagtgaaa

SEQ ID NO: 223512 - DNA, 15 bp, Homo sapiens
ttaaaaaatagtgaa

SEQ ID NO: 223513 - DNA, 15 bp, Homo sapiens
cttaaaaaatagtga

SEQ ID NO: 223514 - DNA, 15 bp, Homo sapiens
acttaaaaaatagtg

SEQ ID NO: 223515 - DNA, 15 bp, Homo sapiens
tacttaaaaaatagt

SEQ ID NO: 223516 - DNA, 15 bp, Homo sapiens
ttacttaaaaaatag

SEQ ID NO: 223517 - DNA, 15 bp, Homo sapiens
gttacttaaaaaata

SEQ ID NO: 223518 - DNA, 15 bp, Homo sapiens
tgttacttaaaaaat

SEQ ID NO: 223519 - DNA, 15 bp, Homo sapiens
atgttacttaaaaaa

SEQ ID NO: 223520 - DNA, 15 bp, Homo sapiens
catgttacttaaaaa

SEQ ID NO: 223521 - DNA, 15 bp, Homo sapiens
tcatgttacttaaaa

SEQ ID NO: 223522 - DNA, 15 bp, Homo sapiens
atcatgttacttaaa

SEQ ID NO: 223523 - DNA, 15 bp, Homo sapiens
aatcatgttacttaa

SEQ ID NO: 223524 - DNA, 15 bp, Homo sapiens
aaatcatgttactta

SEQ ID NO: 223525 - DNA, 15 bp, Homo sapiens
aaaatcatgttactt

SEQ ID NO: 223526 - DNA, 15 bp, Homo sapiens
aaaaatcatgttact

SEQ ID NO: 223527 - DNA, 15 bp, Homo sapiens
gaaaaatcatgttac

SEQ ID NO: 223528 - DNA, 15 bp, Homo sapiens
tgaaaaatcatgtta

SEQ ID NO: 223529 - DNA, 15 bp, Homo sapiens
atgaaaaatcatgtt

SEQ ID NO: 223530 - DNA, 15 bp, Homo sapiens
catgaaaaatcatgt

SEQ ID NO: 223531 - DNA, 15 bp, Homo sapiens
acatgaaaaatcatg

SEQ ID NO: 223532 - DNA, 15 bp, Homo sapiens
gacatgaaaaatcat

SEQ ID NO: 223533 - DNA, 15 bp, Homo sapiens
cgacatgaaaaatca

SEQ ID NO: 223534 - DNA, 15 bp, Homo sapiens
acgacatgaaaaatc

SEQ ID NO: 223535 - DNA, 15 bp, Homo sapiens
aacgacatgaaaaat

SEQ ID NO: 223536 - DNA, 15 bp, Homo sapiens
taacgacatgaaaaa

SEQ ID NO: 223537 - DNA, 15 bp, Homo sapiens
ataacgacatgaaaa

SEQ ID NO: 223538 - DNA, 15 bp, Homo sapiens
aataacgacatgaaa

SEQ ID NO: 223539 - DNA, 15 bp, Homo sapiens
taataacgacatgaa

SEQ ID NO: 223540 - DNA, 15 bp, Homo sapiens
ataataacgacatga

SEQ ID NO: 223541 - DNA, 15 bp, Homo sapiens
tataataacgacatg

SEQ ID NO: 223542 - DNA, 15 bp, Homo sapiens
atataataacgacat

SEQ ID NO: 223543 - DNA, 15 bp, Homo sapiens
tatataataacgaca

SEQ ID NO: 223544 - DNA, 15 bp, Homo sapiens
atatataataacgac

SEQ ID NO: 223545 - DNA, 15 bp, Homo sapiens
aatatataataacga

SEQ ID NO: 223546 - DNA, 15 bp, Homo sapiens
aaatatataataacg

SEQ ID NO: 223547 - DNA, 15 bp, Homo sapiens
aaaatatataataac

SEQ ID NO: 223548 - DNA, 15 bp, Homo sapiens
aaaaatatataataa

SEQ ID NO: 223549 - DNA, 15 bp, Homo sapiens
taaaaatatataata

SEQ ID NO: 223550 - DNA, 15 bp, Homo sapiens
ctaaaaatatataat

SEQ ID NO: 223551 - DNA, 15 bp, Homo sapiens
cctaaaaatatataa

SEQ ID NO: 223552 - DNA, 15 bp, Homo sapiens
acctaaaaatatata

SEQ ID NO: 223553 - DNA, 15 bp, Homo sapiens
cacctaaaaatatat

SEQ ID NO: 223554 - DNA, 15 bp, Homo sapiens
tcacctaaaaatata

SEQ ID NO: 223555 - DNA, 15 bp, Homo sapiens
atcacctaaaaatat

SEQ ID NO: 223556 - DNA, 15 bp, Homo sapiens
aatcacctaaaaata

SEQ ID NO: 223557 - DNA, 15 bp, Homo sapiens
taatcacctaaaaat

SEQ ID NO: 223558 - DNA, 15 bp, Homo sapiens
ataatcacctaaaaa

SEQ ID NO: 223559 - DNA, 15 bp, Homo sapiens
cataatcacctaaaa

SEQ ID NO: 223560 - DNA, 15 bp, Homo sapiens
ccataatcacctaaa

SEQ ID NO: 223561 - DNA, 15 bp, Homo sapiens
tccataatcacctaa

SEQ ID NO: 223562 - DNA, 15 bp, Homo sapiens
ttccataatcaccta

SEQ ID NO: 223563 - DNA, 15 bp, Homo sapiens
cttccataatcacct

SEQ ID NO: 223564 - DNA, 15 bp, Homo sapiens
acttccataatcacc

SEQ ID NO: 223565 - DNA, 15 bp, Homo sapiens
tacttccataatcac

SEQ ID NO: 223566 - DNA, 15 bp, Homo sapiens
ttacttccataatca

SEQ ID NO: 223567 - DNA, 15 bp, Homo sapiens
tttacttccataatc

SEQ ID NO: 223568 - DNA, 15 bp, Homo sapiens
atttacttccataat

SEQ ID NO: 223569 - DNA, 15 bp, Homo sapiens
catttacttccataa

SEQ ID NO: 223570 - DNA, 15 bp, Homo sapiens
gcatttacttccata

SEQ ID NO: 223571 - DNA, 15 bp, Homo sapiens
agcatttacttccat

SEQ ID NO: 223572 - DNA, 15 bp, Homo sapiens
tagcatttacttcca

SEQ ID NO: 223573 - DNA, 15 bp, Homo sapiens
ctagcatttacttcc

SEQ ID NO: 223574 - DNA, 15 bp, Homo sapiens
cctagcatttacttc

SEQ ID NO: 223575 - DNA, 15 bp, Homo sapiens
tcctagcatttactt

SEQ ID NO: 223576 - DNA, 15 bp, Homo sapiens
ttcctagcatttact

SEQ ID NO: 223577 - DNA, 15 bp, Homo sapiens
attcctagcatttac

SEQ ID NO: 223578 - DNA, 15 bp, Homo sapiens
tattcctagcattta

SEQ ID NO: 223579 - DNA, 15 bp, Homo sapiens
atattcctagcattt

SEQ ID NO: 223580 - DNA, 15 bp, Homo sapiens
aatattcctagcatt

SEQ ID NO: 223581 - DNA, 15 bp, Homo sapiens
aaatattcctagcat

SEQ ID NO: 223582 - DNA, 15 bp, Homo sapiens
aaaatattcctagca

SEQ ID NO: 223583 - DNA, 15 bp, Homo sapiens
aaaaatattcctagc

SEQ ID NO: 223584 - DNA, 15 bp, Homo sapiens
taaaaatattcctag

SEQ ID NO: 223585 - DNA, 15 bp, Homo sapiens
ataaaaatattccta

SEQ ID NO: 223586 - DNA, 15 bp, Homo sapiens
aataaaaatattcct

SEQ ID NO: 223587 - DNA, 15 bp, Homo sapiens
gaataaaaatattcc

SEQ ID NO: 223588 - DNA, 15 bp, Homo sapiens
ggaataaaaatattc

SEQ ID NO: 223589 - DNA, 15 bp, Homo sapiens
aggaataaaaatatt

SEQ ID NO: 223590 - DNA, 15 bp, Homo sapiens
gaggaataaaaatat

SEQ ID NO: 223591 - DNA, 15 bp, Homo sapiens
agaggaataaaaata

SEQ ID NO: 223592 - DNA, 15 bp, Homo sapiens
tagaggaataaaaat

SEQ ID NO: 223593 - DNA, 15 bp, Homo sapiens
ctagaggaataaaaa

SEQ ID NO: 223594 - DNA, 15 bp, Homo sapiens
tctagaggaataaaa

SEQ ID NO: 223595 - DNA, 15 bp, Homo sapiens
ctctagaggaataaa

SEQ ID NO: 223596 - DNA, 15 bp, Homo sapiens
gctctagaggaataa

SEQ ID NO: 223597 - DNA, 15 bp, Homo sapiens
agctctagaggaata

SEQ ID NO: 223598 - DNA, 15 bp, Homo sapiens
aagctctagaggaat

SEQ ID NO: 223599 - DNA, 15 bp, Homo sapiens
gaagctctagaggaa

SEQ ID NO: 223600 - DNA, 15 bp, Homo sapiens
agaagctctagagga

SEQ ID NO: 223601 - DNA, 15 bp, Homo sapiens
aagaagctctagagg

SEQ ID NO: 223602 - DNA, 15 bp, Homo sapiens
caagaagctctagag

SEQ ID NO: 223603 - DNA, 15 bp, Homo sapiens
gcaagaagctctaga

SEQ ID NO: 223604 - DNA, 15 bp, Homo sapiens
agcaagaagctctag

SEQ ID NO: 223605 - DNA, 15 bp, Homo sapiens
gagcaagaagctcta

SEQ ID NO: 223606 - DNA, 15 bp, Homo sapiens
agagcaagaagctct

SEQ ID NO: 223607 - DNA, 15 bp, Homo sapiens
tagagcaagaagctc

SEQ ID NO: 223608 - DNA, 15 bp, Homo sapiens
ttagagcaagaagct

SEQ ID NO: 223609 - DNA, 15 bp, Homo sapiens
gttagagcaagaagc

SEQ ID NO: 223610 - DNA, 15 bp, Homo sapiens
tgttagagcaagaag

SEQ ID NO: 223611 - DNA, 15 bp, Homo sapiens
ttgttagagcaagaa

SEQ ID NO: 223612 - DNA, 15 bp, Homo sapiens
gttgttagagcaaga

SEQ ID NO: 223613 - DNA, 15 bp, Homo sapiens
tgttgttagagcaag

SEQ ID NO: 223614 - DNA, 15 bp, Homo sapiens
atgttgttagagcaa

SEQ ID NO: 223615 - DNA, 15 bp, Homo sapiens
ttatgttgttagagc

SEQ ID NO: 223616 - DNA, 15 bp, Homo sapiens
attatgttgttagag

SEQ ID NO: 223617 - DNA, 15 bp, Homo sapiens
tattatgttgttaga

SEQ ID NO: 223618 - DNA, 15 bp, Homo sapiens
ttattatgttgttag

SEQ ID NO: 223619 - DNA, 15 bp, Homo sapiens
attattatgttgtta

SEQ ID NO: 223620 - DNA, 15 bp, Homo sapiens
gattattatgttgtt

SEQ ID NO: 223621 - DNA, 15 bp, Homo sapiens
agattattatgttgt

SEQ ID NO: 223622 - DNA, 15 bp, Homo sapiens
tagattattatgttg

SEQ ID NO: 223623 - DNA, 15 bp, Homo sapiens
ttagattattatgtt

SEQ ID NO: 223624 - DNA, 15 bp, Homo sapiens
cttagattattatgt

SEQ ID NO: 223625 - DNA, 15 bp, Homo sapiens
acttagattattatg

SEQ ID NO: 223626 - DNA, 15 bp, Homo sapiens
aacttagattattat

SEQ ID NO: 223627 - DNA, 15 bp, Homo sapiens
taacttagattatta

SEQ ID NO: 223628 - DNA, 15 bp, Homo sapiens
ttaacttagattatt

SEQ ID NO: 223629 - DNA, 15 bp, Homo sapiens
tttaacttagattat

SEQ ID NO: 223630 - DNA, 15 bp, Homo sapiens
ctttaacttagatta

SEQ ID NO: 223631 - DNA, 15 bp, Homo sapiens
tctttaacttagatt

SEQ ID NO: 223632 - DNA, 15 bp, Homo sapiens
ttctttaacttagat

SEQ ID NO: 223633 - DNA, 15 bp, Homo sapiens
gttctttaacttaga

SEQ ID NO: 223634 - DNA, 15 bp, Homo sapiens
agttctttaacttag

SEQ ID NO: 223635 - DNA, 15 bp, Homo sapiens
cagttctttaactta

SEQ ID NO: 223636 - DNA, 15 bp, Homo sapiens
ccagttctttaactt

SEQ ID NO: 223637 - DNA, 15 bp, Homo sapiens
gccagttctttaact

SEQ ID NO: 223638 - DNA, 15 bp, Homo sapiens
agccagttctttaac

SEQ ID NO: 223639 - DNA, 15 bp, Homo sapiens
gagccagttctttaa

SEQ ID NO: 223640 - DNA, 15 bp, Homo sapiens
tgagccagttcttta

SEQ ID NO: 223641 - DNA, 15 bp, Homo sapiens
ttgagccagttcttt

SEQ ID NO: 223642 - DNA, 15 bp, Homo sapiens
cttgagccagttctt

SEQ ID NO: 223643 - DNA, 15 bp, Homo sapiens
tcttgagccagttct

SEQ ID NO: 223644 - DNA, 15 bp, Homo sapiens
gtcttgagccagttc

SEQ ID NO: 223645 - DNA, 15 bp, Homo sapiens
agtcttgagccagtt

SEQ ID NO: 223646 - DNA, 15 bp, Homo sapiens
aagtcttgagccagt

SEQ ID NO: 223647 - DNA, 15 bp, Homo sapiens
caagtcttgagccag

SEQ ID NO: 223648 - DNA, 15 bp, Homo sapiens
acaagtcttgagcca

SEQ ID NO: 223649 - DNA, 15 bp, Homo sapiens
tacaagtcttgagcc

SEQ ID NO: 223650 - DNA, 15 bp, Homo sapiens
ttacaagtcttgagc

SEQ ID NO: 223651 - DNA, 15 bp, Homo sapiens
tttacaagtcttgag

SEQ ID NO: 223652 - DNA, 15 bp, Homo sapiens
atttacaagtcttga

SEQ ID NO: 223653 - DNA, 15 bp, Homo sapiens
catttacaagtcttg

SEQ ID NO: 223654 - DNA, 15 bp, Homo sapiens
acatttacaagtctt

SEQ ID NO: 223655 - DNA, 15 bp, Homo sapiens
cacatttacaagtct

SEQ ID NO: 223656 - DNA, 15 bp, Homo sapiens
acacatttacaagtc

SEQ ID NO: 223657 - DNA, 15 bp, Homo sapiens
tacacatttacaagt

SEQ ID NO: 223658 - DNA, 15 bp, Homo sapiens
atacacatttacaag

SEQ ID NO: 223659 - DNA, 15 bp, Homo sapiens
aatacacatttacaa

SEQ ID NO: 223660 - DNA, 15 bp, Homo sapiens
aaatacacatttaca

SEQ ID NO: 223661 - DNA, 15 bp, Homo sapiens
aaaatacacatttac

SEQ ID NO: 223662 - DNA, 15 bp, Homo sapiens
aaaaatacacattta

SEQ ID NO: 223663 - DNA, 15 bp, Homo sapiens
aaaaaatacacattt

SEQ ID NO: 223664 - DNA, 15 bp, Homo sapiens
aaaaaaatacacatt

SEQ ID NO: 223665 - DNA, 15 bp, Homo sapiens
caaaaaaatacacat

SEQ ID NO: 223666 - DNA, 15 bp, Homo sapiens
ccaaaaaaatacaca

SEQ ID NO: 223667 - DNA, 15 bp, Homo sapiens
tccaaaaaaatacac

SEQ ID NO: 223668 - DNA, 15 bp, Homo sapiens
atccaaaaaaataca

SEQ ID NO: 223669 - DNA, 15 bp, Homo sapiens
aatccaaaaaaatac

SEQ ID NO: 223670 - DNA, 15 bp, Homo sapiens
taatccaaaaaaata

SEQ ID NO: 223671 - DNA, 15 bp, Homo sapiens
ttaatccaaaaaaat

SEQ ID NO: 223672 - DNA, 15 bp, Homo sapiens
tttaatccaaaaaaa

SEQ ID NO: 223673 - DNA, 15 bp, Homo sapiens
ttttaatccaaaaaa

SEQ ID NO: 223674 - DNA, 15 bp, Homo sapiens
tttttaatccaaaaa

SEQ ID NO: 223675 - DNA, 15 bp, Homo sapiens
atttttaatccaaaa

SEQ ID NO: 223676 - DNA, 15 bp, Homo sapiens
gatttttaatccaaa

SEQ ID NO: 223677 - DNA, 15 bp, Homo sapiens
agatttttaatccaa

SEQ ID NO: 223678 - DNA, 15 bp, Homo sapiens
aagatttttaatcca

SEQ ID NO: 223679 - DNA, 15 bp, Homo sapiens
aaagatttttaatcc

SEQ ID NO: 223680 - DNA, 15 bp, Homo sapiens
aaaagatttttaatc

SEQ ID NO: 223681 - DNA, 15 bp, Homo sapiens
aaaaagatttttaat

SEQ ID NO: 223682 - DNA, 15 bp, Homo sapiens
aaaaaagatttttaa

SEQ ID NO: 223683 - DNA, 15 bp, Homo sapiens
aaaaaaagattttta

SEQ ID NO: 223684 - DNA, 15 bp, Homo sapiens
aaaaaaaagattttt

SEQ ID NO: 223685 - DNA, 15 bp, Homo sapiens
aaaaaaaaagatttt

SEQ ID NO: 223686 - DNA, 15 bp, Homo sapiens
gaaaaaaaaagattt

SEQ ID NO: 223687 - DNA, 15 bp, Homo sapiens
ggaaaaaaaaagatt

SEQ ID NO: 223688 - DNA, 15 bp, Homo sapiens
tggaaaaaaaaagat

SEQ ID NO: 223689 - DNA, 15 bp, Homo sapiens
atggaaaaaaaaaga

SEQ ID NO: 223690 - DNA, 15 bp, Homo sapiens
aatggaaaaaaaaag

SEQ ID NO: 223691 - DNA, 15 bp, Homo sapiens
aaatggaaaaaaaaa

SEQ ID NO: 223692 - DNA, 15 bp, Homo sapiens
aaaatggaaaaaaaa

SEQ ID NO: 223693 - DNA, 15 bp, Homo sapiens
aaaaatggaaaaaaa

SEQ ID NO: 223694 - DNA, 15 bp, Homo sapiens
gaaaaatggaaaaaa

SEQ ID NO: 223695 - DNA, 15 bp, Homo sapiens
agaaaaatggaaaaa

SEQ ID NO: 223696 - DNA, 15 bp, Homo sapiens
aagaaaaatggaaaa

SEQ ID NO: 223697 - DNA, 15 bp, Homo sapiens
caagaaaaatggaaa

SEQ ID NO: 223698 - DNA, 15 bp, Homo sapiens
acaagaaaaatggaa

SEQ ID NO: 223699 - DNA, 15 bp, Homo sapiens
tacaagaaaaatgga

SEQ ID NO: 223700 - DNA, 15 bp, Homo sapiens
atacaagaaaaatgg

SEQ ID NO: 223701 - DNA, 15 bp, Homo sapiens
gatacaagaaaaatg

SEQ ID NO: 223702 - DNA, 15 bp, Homo sapiens
agatacaagaaaaat

SEQ ID NO: 223703 - DNA, 15 bp, Homo sapiens
gagatacaagaaaaa

SEQ ID NO: 223704 - DNA, 15 bp, Homo sapiens
agagatacaagaaaa

SEQ ID NO: 223705 - DNA, 15 bp, Homo sapiens
aagagatacaagaaa

SEQ ID NO: 223706 - DNA, 15 bp, Homo sapiens
aaagagatacaagaa

SEQ ID NO: 223707 - DNA, 15 bp, Homo sapiens
aaaagagatacaaga

SEQ ID NO: 223708 - DNA, 15 bp, Homo sapiens
aaaaagagatacaag

SEQ ID NO: 223709 - DNA, 15 bp, Homo sapiens
taaaaagagatacaa

SEQ ID NO: 223710 - DNA, 15 bp, Homo sapiens
ataaaaagagataca

SEQ ID NO: 223711 - DNA, 15 bp, Homo sapiens
aataaaaagagatac

SEQ ID NO: 223712 - DNA, 15 bp, Homo sapiens
aaataaaaagagata

SEQ ID NO: 223713 - DNA, 15 bp, Homo sapiens
gaaataaaaagagat

SEQ ID NO: 223714 - DNA, 15 bp, Homo sapiens
ggaaataaaaagaga

SEQ ID NO: 223715 - DNA, 15 bp, Homo sapiens
tggaaataaaaagag

SEQ ID NO: 223716 - DNA, 15 bp, Homo sapiens
atggaaataaaaaga

SEQ ID NO: 223717 - DNA, 15 bp, Homo sapiens
tatggaaataaaaag

SEQ ID NO: 223718 - DNA, 15 bp, Homo sapiens
atatggaaataaaaa

SEQ ID NO: 223719 - DNA, 15 bp, Homo sapiens
tatatggaaataaaa

SEQ ID NO: 223720 - DNA, 15 bp, Homo sapiens
atatatggaaataaa

SEQ ID NO: 223721 - DNA, 15 bp, Homo sapiens
aatatatggaaataa

SEQ ID NO: 223722 - DNA, 15 bp, Homo sapiens
taatatatggaaata

SEQ ID NO: 223723 - DNA, 15 bp, Homo sapiens
ttaatatatggaaat

SEQ ID NO: 223724 - DNA, 15 bp, Homo sapiens
tttaatatatggaaa

SEQ ID NO: 223725 - DNA, 15 bp, Homo sapiens
ttttaatatatggaa

SEQ ID NO: 223726 - DNA, 15 bp, Homo sapiens
gttttaatatatgga

SEQ ID NO: 223727 - DNA, 15 bp, Homo sapiens
agttttaatatatgg

SEQ ID NO: 223728 - DNA, 15 bp, Homo sapiens
aagttttaatatatg

SEQ ID NO: 223729 - DNA, 15 bp, Homo sapiens
aaagttttaatatat

SEQ ID NO: 223730 - DNA, 15 bp, Homo sapiens
taaagttttaatata

SEQ ID NO: 223731 - DNA, 15 bp, Homo sapiens
ttaaagttttaatat

SEQ ID NO: 223732 - DNA, 15 bp, Homo sapiens
cttaaagttttaata

SEQ ID NO: 223733 - DNA, 15 bp, Homo sapiens
acttaaagttttaat

SEQ ID NO: 223734 - DNA, 15 bp, Homo sapiens
cacttaaagttttaa

SEQ ID NO: 223735 - DNA, 15 bp, Homo sapiens
gcacttaaagtttta

SEQ ID NO: 223736 - DNA, 15 bp, Homo sapiens
ggcacttaaagtttt

SEQ ID NO: 223737 - DNA, 15 bp, Homo sapiens
tggcacttaaagttt

SEQ ID NO: 223738 - DNA, 15 bp, Homo sapiens
ctggcacttaaagtt

SEQ ID NO: 223739 - DNA, 15 bp, Homo sapiens
tctggcacttaaagt

SEQ ID NO: 223740 - DNA, 15 bp, Homo sapiens
atctggcacttaaag

SEQ ID NO: 223741 - DNA, 15 bp, Homo sapiens
catctggcacttaaa

SEQ ID NO: 223742 - DNA, 15 bp, Homo sapiens
acatctggcacttaa

SEQ ID NO: 223743 - DNA, 15 bp, Homo sapiens
tacatctggcactta

SEQ ID NO: 223744 - DNA, 15 bp, Homo sapiens
atacatctggcactt

SEQ ID NO: 223745 - DNA, 15 bp, Homo sapiens
tatacatctggcact

SEQ ID NO: 223746 - DNA, 15 bp, Homo sapiens
atatacatctggcac

SEQ ID NO: 223747 - DNA, 15 bp, Homo sapiens
tatatacatctggca

SEQ ID NO: 223748 - DNA, 15 bp, Homo sapiens
ttatatacatctggc

SEQ ID NO: 223749 - DNA, 15 bp, Homo sapiens
attatatacatctgg

SEQ ID NO: 223750 - DNA, 15 bp, Homo sapiens
gattatatacatctg

SEQ ID NO: 223751 - DNA, 15 bp, Homo sapiens
agattatatacatct

SEQ ID NO: 223752 - DNA, 15 bp, Homo sapiens
aagattatatacatc

SEQ ID NO: 223753 - DNA, 15 bp, Homo sapiens
aaagattatatacat

SEQ ID NO: 223754 - DNA, 15 bp, Homo sapiens
aaaagattatataca

SEQ ID NO: 223755 - DNA, 15 bp, Homo sapiens
aaaaagattatatac

SEQ ID NO: 223756 - DNA, 15 bp, Homo sapiens
aaaaaagattatata

SEQ ID NO: 223757 - DNA, 15 bp, Homo sapiens
aaaaaaagattatat

SEQ ID NO: 223758 - DNA, 15 bp, Homo sapiens
aaaaaaaagattata

SEQ ID NO: 223759 - DNA, 15 bp, Homo sapiens
aaaaaaaaagattat

SEQ ID NO: 223760 - DNA, 15 bp, Homo sapiens
aaaaaaaaaagatta

SEQ ID NO: 223761 - DNA, 15 bp, Homo sapiens
aaattaaaaaaaaaa

SEQ ID NO: 223762 - DNA, 15 bp, Homo sapiens
gaaattaaaaaaaaa

SEQ ID NO: 223763 - DNA, 15 bp, Homo sapiens
ggaaattaaaaaaaa

SEQ ID NO: 223764 - DNA, 15 bp, Homo sapiens
aggaaattaaaaaaa

SEQ ID NO: 223765 - DNA, 15 bp, Homo sapiens
caggaaattaaaaaa

SEQ ID NO: 223766 - DNA, 15 bp, Homo sapiens
tcaggaaattaaaaa

SEQ ID NO: 223767 - DNA, 15 bp, Homo sapiens
ttcaggaaattaaaa

SEQ ID NO: 223768 - DNA, 15 bp, Homo sapiens
attcaggaaattaaa

SEQ ID NO: 223769 - DNA, 15 bp, Homo sapiens
cattcaggaaattaa

SEQ ID NO: 223770 - DNA, 15 bp, Homo sapiens
acattcaggaaatta

SEQ ID NO: 223771 - DNA, 15 bp, Homo sapiens
gacattcaggaaatt

SEQ ID NO: 223772 - DNA, 15 bp, Homo sapiens
tgacattcaggaaat

SEQ ID NO: 223773 - DNA, 15 bp, Homo sapiens
gtgacattcaggaaa

SEQ ID NO: 223774 - DNA, 15 bp, Homo sapiens
tgtgacattcaggaa

SEQ ID NO: 223775 - DNA, 15 bp, Homo sapiens
gtgtgacattcagga

SEQ ID NO: 223776 - DNA, 15 bp, Homo sapiens
tgtgtgacattcagg

SEQ ID NO: 223777 - DNA, 15 bp, Homo sapiens
atgtgtgacattcag

SEQ ID NO: 223778 - DNA, 15 bp, Homo sapiens
gatgtgtgacattca

SEQ ID NO: 223779 - DNA, 15 bp, Homo sapiens
ggatgtgtgacattc

SEQ ID NO: 223780 - DNA, 15 bp, Homo sapiens
aggatgtgtgacatt

SEQ ID NO: 223781 - DNA, 15 bp, Homo sapiens
caggatgtgtgacat

SEQ ID NO: 223782 - DNA, 15 bp, Homo sapiens
gcaggatgtgtgaca

SEQ ID NO: 223783 - DNA, 15 bp, Homo sapiens
cgcaggatgtgtgac

SEQ ID NO: 223784 - DNA, 15 bp, Homo sapiens
tcgcaggatgtgtga

SEQ ID NO: 223785 - DNA, 15 bp, Homo sapiens
atcgcaggatgtgtg

SEQ ID NO: 223786 - DNA, 15 bp, Homo sapiens
aatcgcaggatgtgt

SEQ ID NO: 223787 - DNA, 15 bp, Homo sapiens
aaatcgcaggatgtg

SEQ ID NO: 223788 - DNA, 15 bp, Homo sapiens
gaaatcgcaggatgt

SEQ ID NO: 223789 - DNA, 15 bp, Homo sapiens
agaaatcgcaggatg

SEQ ID NO: 223790 - DNA, 15 bp, Homo sapiens
aagaaatcgcaggat

SEQ ID NO: 223791 - DNA, 15 bp, Homo sapiens
gaagaaatcgcagga

SEQ ID NO: 223792 - DNA, 15 bp, Homo sapiens
tgaagaaatcgcagg

SEQ ID NO: 223793 - DNA, 15 bp, Homo sapiens
gtgaagaaatcgcag

SEQ ID NO: 223794 - DNA, 15 bp, Homo sapiens
tgtgaagaaatcgca

SEQ ID NO: 223795 - DNA, 15 bp, Homo sapiens
ttgtgaagaaatcgc

SEQ ID NO: 223796 - DNA, 15 bp, Homo sapiens
cttgtgaagaaatcg

SEQ ID NO: 223797 - DNA, 15 bp, Homo sapiens
gcttgtgaagaaatc

SEQ ID NO: 223798 - DNA, 15 bp, Homo sapiens
agcttgtgaagaaat

SEQ ID NO: 223799 - DNA, 15 bp, Homo sapiens
cagcttgtgaagaaa

SEQ ID NO: 223800 - DNA, 15 bp, Homo sapiens
gcagcttgtgaagaa

SEQ ID NO: 223801 - DNA, 15 bp, Homo sapiens
cgcagcttgtgaaga

SEQ ID NO: 223802 - DNA, 15 bp, Homo sapiens
acgcagcttgtgaag

SEQ ID NO: 223803 - DNA, 15 bp, Homo sapiens
aacgcagcttgtgaa

SEQ ID NO: 223804 - DNA, 15 bp, Homo sapiens
aaacgcagcttgtga

SEQ ID NO: 223805 - DNA, 15 bp, Homo sapiens
caaacgcagcttgtg

SEQ ID NO: 223806 - DNA, 15 bp, Homo sapiens
acaaacgcagcttgt

SEQ ID NO: 223807 - DNA, 15 bp, Homo sapiens
aacaaacgcagcttg

SEQ ID NO: 223808 - DNA, 15 bp, Homo sapiens
taacaaacgcagctt

SEQ ID NO: 223809 - DNA, 15 bp, Homo sapiens
ttaacaaacgcagct

SEQ ID NO: 223810 - DNA, 15 bp, Homo sapiens
tttaacaaacgcagc

SEQ ID NO: 223811 - DNA, 15 bp, Homo sapiens
atttaacaaacgcag

SEQ ID NO: 223812 - DNA, 15 bp, Homo sapiens
tatttaacaaacgca

SEQ ID NO: 223813 - DNA, 15 bp, Homo sapiens
ctatttaacaaacgc

SEQ ID NO: 223814 - DNA, 15 bp, Homo sapiens
cctatttaacaaacg

SEQ ID NO: 223815 - DNA, 15 bp, Homo sapiens
tcctatttaacaaac

SEQ ID NO: 223816 - DNA, 15 bp, Homo sapiens
ctcctatttaacaaa

SEQ ID NO: 223817 - DNA, 15 bp, Homo sapiens
tctcctatttaacaa

SEQ ID NO: 223818 - DNA, 15 bp, Homo sapiens
atctcctatttaaca

SEQ ID NO: 223819 - DNA, 15 bp, Homo sapiens
catctcctatttaac

SEQ ID NO: 223820 - DNA, 15 bp, Homo sapiens
tcatctcctatttaa

SEQ ID NO: 223821 - DNA, 15 bp, Homo sapiens
atcatctcctattta

SEQ ID NO: 223822 - DNA, 15 bp, Homo sapiens
catcatctcctattt

SEQ ID NO: 223823 - DNA, 15 bp, Homo sapiens
ccatcatctcctatt

SEQ ID NO: 223824 - DNA, 15 bp, Homo sapiens
tccatcatctcctat

SEQ ID NO: 223825 - DNA, 15 bp, Homo sapiens
ttccatcatctccta

SEQ ID NO: 223826 - DNA, 15 bp, Homo sapiens
cttccatcatctcct

SEQ ID NO: 223827 - DNA, 15 bp, Homo sapiens
ccttccatcatctcc

SEQ ID NO: 223828 - DNA, 15 bp, Homo sapiens
accttccatcatctc

SEQ ID NO: 223829 - DNA, 15 bp, Homo sapiens
aaccttccatcatct

SEQ ID NO: 223830 - DNA, 15 bp, Homo sapiens
aaaccttccatcatc

SEQ ID NO: 223831 - DNA, 15 bp, Homo sapiens
caaaccttccatcat

SEQ ID NO: 223832 - DNA, 15 bp, Homo sapiens
acaaaccttccatca

SEQ ID NO: 223833 - DNA, 15 bp, Homo sapiens
aacaaaccttccatc

SEQ ID NO: 223834 - DNA, 15 bp, Homo sapiens
taacaaaccttccat

SEQ ID NO: 223835 - DNA, 15 bp, Homo sapiens
ataacaaaccttcca

SEQ ID NO: 223836 - DNA, 15 bp, Homo sapiens
gataacaaaccttcc

SEQ ID NO: 223837 - DNA, 15 bp, Homo sapiens
ggataacaaaccttc

SEQ ID NO: 223838 - DNA, 15 bp, Homo sapiens
gggataacaaacctt

SEQ ID NO: 223839 - DNA, 15 bp, Homo sapiens
ggggataacaaacct

SEQ ID NO: 223840 - DNA, 15 bp, Homo sapiens
cggggataacaaacc

SEQ ID NO: 223841 - DNA, 15 bp, Homo sapiens
gcggggataacaaac

SEQ ID NO: 223842 - DNA, 15 bp, Homo sapiens
ggcggggataacaaa

SEQ ID NO: 223843 - DNA, 15 bp, Homo sapiens
gggcggggataacaa

SEQ ID NO: 223844 - DNA, 15 bp, Homo sapiens
ggggcggggataaca

SEQ ID NO: 223845 - DNA, 15 bp, Homo sapiens
gggggcggggataac

SEQ ID NO: 223846 - DNA, 15 bp, Homo sapiens
tgggggcggggataa

SEQ ID NO: 223847 - DNA, 15 bp, Homo sapiens
gtgggggcggggata

SEQ ID NO: 223848 - DNA, 15 bp, Homo sapiens
ggtgggggcggggat

SEQ ID NO: 223849 - DNA, 15 bp, Homo sapiens
gggtgggggcgggga

SEQ ID NO: 223850 - DNA, 15 bp, Homo sapiens
tgggtgggggcgggg

SEQ ID NO: 223851 - DNA, 15 bp, Homo sapiens
gtgggtgggggcggg

SEQ ID NO: 223852 - DNA, 15 bp, Homo sapiens
ggtgggtgggggcgg

SEQ ID NO: 223853 - DNA, 15 bp, Homo sapiens
tggtgggtgggggcg

SEQ ID NO: 223854 - DNA, 15 bp, Homo sapiens
ttggtgggtgggggc

SEQ ID NO: 223855 - DNA, 15 bp, Homo sapiens
gttggtgggtggggg

SEQ ID NO: 223856 - DNA, 15 bp, Homo sapiens
tgttggtgggtgggg

SEQ ID NO: 223857 - DNA, 15 bp, Homo sapiens
atgttggtgggtggg

SEQ ID NO: 223858 - DNA, 15 bp, Homo sapiens
tatgttggtgggtgg

SEQ ID NO: 223859 - DNA, 15 bp, Homo sapiens
ctatgttggtgggtg

SEQ ID NO: 223860 - DNA, 15 bp, Homo sapiens
actatgttggtgggt

SEQ ID NO: 223861 - DNA, 15 bp, Homo sapiens
gactatgttggtggg

SEQ ID NO: 223862 - DNA, 15 bp, Homo sapiens
tgactatgttggtgg

SEQ ID NO: 223863 - DNA, 15 bp, Homo sapiens
atgactatgttggtg

SEQ ID NO: 223864 - DNA, 15 bp, Homo sapiens
aatgactatgttggt

SEQ ID NO: 223865 - DNA, 15 bp, Homo sapiens
aaatgactatgttgg

SEQ ID NO: 223866 - DNA, 15 bp, Homo sapiens
taaatgactatgttg

SEQ ID NO: 223867 - DNA, 15 bp, Homo sapiens
ttaaatgactatgtt

SEQ ID NO: 223868 - DNA, 15 bp, Homo sapiens
attaaatgactatgt

SEQ ID NO: 223869 - DNA, 15 bp, Homo sapiens
cattaaatgactatg

SEQ ID NO: 223870 - DNA, 15 bp, Homo sapiens
gcattaaatgactat

SEQ ID NO: 223871 - DNA, 15 bp, Homo sapiens
agcattaaatgacta

SEQ ID NO: 223872 - DNA, 15 bp, Homo sapiens
gagcattaaatgact

SEQ ID NO: 223873 - DNA, 15 bp, Homo sapiens
tgagcattaaatgac

SEQ ID NO: 223874 - DNA, 15 bp, Homo sapiens
atgagcattaaatga

SEQ ID NO: 223875 - DNA, 15 bp, Homo sapiens
gatgagcattaaatg

SEQ ID NO: 223876 - DNA, 15 bp, Homo sapiens
tgatgagcattaaat

SEQ ID NO: 223877 - DNA, 15 bp, Homo sapiens
ctgatgagcattaaa

SEQ ID NO: 223878 - DNA, 15 bp, Homo sapiens
actgatgagcattaa

SEQ ID NO: 223879 - DNA, 15 bp, Homo sapiens
cactgatgagcatta

SEQ ID NO: 223880 - DNA, 15 bp, Homo sapiens
tcactgatgagcatt

SEQ ID NO: 223881 - DNA, 15 bp, Homo sapiens
atcactgatgagcat

SEQ ID NO: 223882 - DNA, 15 bp, Homo sapiens
tatcactgatgagca

SEQ ID NO: 223883 - DNA, 15 bp, Homo sapiens
ttatcactgatgagc

SEQ ID NO: 223884 - DNA, 15 bp, Homo sapiens
attatcactgatgag

SEQ ID NO: 223885 - DNA, 15 bp, Homo sapiens
aattatcactgatga

SEQ ID NO: 223886 - DNA, 15 bp, Homo sapiens
caattatcactgatg

SEQ ID NO: 223887 - DNA, 15 bp, Homo sapiens
gcaattatcactgat

SEQ ID NO: 223888 - DNA, 15 bp, Homo sapiens
agcaattatcactga

SEQ ID NO: 223889 - DNA, 15 bp, Homo sapiens
cagcaattatcactg

SEQ ID NO: 223890 - DNA, 15 bp, Homo sapiens
acagcaattatcact

SEQ ID NO: 223891 - DNA, 15 bp, Homo sapiens
cacagcaattatcac

SEQ ID NO: 223892 - DNA, 15 bp, Homo sapiens
acacagcaattatca

SEQ ID NO: 223893 - DNA, 15 bp, Homo sapiens
cacacagcaattatc

SEQ ID NO: 223894 - DNA, 15 bp, Homo sapiens
tcacacagcaattat

SEQ ID NO: 223895 - DNA, 15 bp, Homo sapiens
ttcacacagcaatta

SEQ ID NO: 223896 - DNA, 15 bp, Homo sapiens
attcacacagcaatt

SEQ ID NO: 223897 - DNA, 15 bp, Homo sapiens
aattcacacagcaat

SEQ ID NO: 223898 - DNA, 15 bp, Homo sapiens
aaattcacacagcaa

SEQ ID NO: 223899 - DNA, 15 bp, Homo sapiens
taaattcacacagca

SEQ ID NO: 223900 - DNA, 15 bp, Homo sapiens
ctaaattcacacagc

SEQ ID NO: 223901 - DNA, 15 bp, Homo sapiens
actaaattcacacag

SEQ ID NO: 223902 - DNA, 15 bp, Homo sapiens
aactaaattcacaca

SEQ ID NO: 223903 - DNA, 15 bp, Homo sapiens
caactaaattcacac

SEQ ID NO: 223904 - DNA, 15 bp, Homo sapiens
tcaactaaattcaca

SEQ ID NO: 223905 - DNA, 15 bp, Homo sapiens
atcaactaaattcac

SEQ ID NO: 223906 - DNA, 15 bp, Homo sapiens
aatcaactaaattca

SEQ ID NO: 223907 - DNA, 15 bp, Homo sapiens
aaatcaactaaattc

SEQ ID NO: 223908 - DNA, 15 bp, Homo sapiens
caaatcaactaaatt

SEQ ID NO: 223909 - DNA, 15 bp, Homo sapiens
acaaatcaactaaat

SEQ ID NO: 223910 - DNA, 15 bp, Homo sapiens
cacaaatcaactaaa

SEQ ID NO: 223911 - DNA, 15 bp, Homo sapiens
gcacaaatcaactaa

SEQ ID NO: 223912 - DNA, 15 bp, Homo sapiens
agcacaaatcaacta

SEQ ID NO: 223913 - DNA, 15 bp, Homo sapiens
aagcacaaatcaact

SEQ ID NO: 223914 - DNA, 15 bp, Homo sapiens
caagcacaaatcaac

SEQ ID NO: 223915 - DNA, 15 bp, Homo sapiens
gcaagcacaaatcaa

SEQ ID NO: 223916 - DNA, 15 bp, Homo sapiens
agcaagcacaaatca

SEQ ID NO: 223917 - DNA, 15 bp, Homo sapiens
aagcaagcacaaatc

SEQ ID NO: 223918 - DNA, 15 bp, Homo sapiens
gaagcaagcacaaat

SEQ ID NO: 223919 - DNA, 15 bp, Homo sapiens
cgaagcaagcacaaa

SEQ ID NO: 223920 - DNA, 15 bp, Homo sapiens
gcgaagcaagcacaa

SEQ ID NO: 223921 - DNA, 15 bp, Homo sapiens
agcgaagcaagcaca

SEQ ID NO: 223922 - DNA, 15 bp, Homo sapiens
cagcgaagcaagcac

SEQ ID NO: 223923 - DNA, 15 bp, Homo sapiens
acagcgaagcaagca

SEQ ID NO: 223924 - DNA, 15 bp, Homo sapiens
gacagcgaagcaagc

SEQ ID NO: 223925 - DNA, 15 bp, Homo sapiens
tgacagcgaagcaag

SEQ ID NO: 223926 - DNA, 15 bp, Homo sapiens
ctgacagcgaagcaa

SEQ ID NO: 223927 - DNA, 15 bp, Homo sapiens
actgacagcgaagca

SEQ ID NO: 223928 - DNA, 15 bp, Homo sapiens
gactgacagcgaagc

SEQ ID NO: 223929 - DNA, 15 bp, Homo sapiens
agactgacagcgaag

SEQ ID NO: 223930 - DNA, 15 bp, Homo sapiens
aagactgacagcgaa

SEQ ID NO: 223931 - DNA, 15 bp, Homo sapiens
aaagactgacagcga

SEQ ID NO: 223932 - DNA, 15 bp, Homo sapiens
caaagactgacagcg

SEQ ID NO: 223933 - DNA, 15 bp, Homo sapiens
ccaaagactgacagc

SEQ ID NO: 223934 - DNA, 15 bp, Homo sapiens
accaaagactgacag

SEQ ID NO: 223935 - DNA, 15 bp, Homo sapiens
aaccaaagactgaca

SEQ ID NO: 223936 - DNA, 15 bp, Homo sapiens
aaaccaaagactgac

SEQ ID NO: 223937 - DNA, 15 bp, Homo sapiens
aaaaccaaagactga

SEQ ID NO: 223938 - DNA, 15 bp, Homo sapiens
taaaaccaaagactg

SEQ ID NO: 223939 - DNA, 15 bp, Homo sapiens
ataaaaccaaagact

SEQ ID NO: 223940 - DNA, 15 bp, Homo sapiens
cataaaaccaaagac

SEQ ID NO: 223941 - DNA, 15 bp, Homo sapiens
ccataaaaccaaaga

SEQ ID NO: 223942 - DNA, 15 bp, Homo sapiens
tccataaaaccaaag

SEQ ID NO: 223943 - DNA, 15 bp, Homo sapiens
atccataaaaccaaa

SEQ ID NO: 223944 - DNA, 15 bp, Homo sapiens
gatccataaaaccaa

SEQ ID NO: 223945 - DNA, 15 bp, Homo sapiens
agatccataaaacca

SEQ ID NO: 223946 - DNA, 15 bp, Homo sapiens
tagatccataaaacc

SEQ ID NO: 223947 - DNA, 15 bp, Homo sapiens
ctagatccataaaac

SEQ ID NO: 223948 - DNA, 15 bp, Homo sapiens
cctagatccataaaa

SEQ ID NO: 223949 - DNA, 15 bp, Homo sapiens
tcctagatccataaa

SEQ ID NO: 223950 - DNA, 15 bp, Homo sapiens
ttcctagatccataa

SEQ ID NO: 223951 - DNA, 15 bp, Homo sapiens
cttcctagatccata

SEQ ID NO: 223952 - DNA, 15 bp, Homo sapiens
ccttcctagatccat

SEQ ID NO: 223953 - DNA, 15 bp, Homo sapiens
tccttcctagatcca

SEQ ID NO: 223954 - DNA, 15 bp, Homo sapiens
gtccttcctagatcc

SEQ ID NO: 223955 - DNA, 15 bp, Homo sapiens
tgtccttcctagatc

SEQ ID NO: 223956 - DNA, 15 bp, Homo sapiens
atgtccttcctagat

SEQ ID NO: 223957 - DNA, 15 bp, Homo sapiens
tatgtccttcctaga

SEQ ID NO: 223958 - DNA, 15 bp, Homo sapiens
atatgtccttcctag

SEQ ID NO: 223959 - DNA, 15 bp, Homo sapiens
tatatgtccttccta

SEQ ID NO: 223960 - DNA, 15 bp, Homo sapiens
ttatatgtccttcct

SEQ ID NO: 223961 - DNA, 15 bp, Homo sapiens
tttatatgtccttcc

SEQ ID NO: 223962 - DNA, 15 bp, Homo sapiens
atttatatgtccttc

SEQ ID NO: 223963 - DNA, 15 bp, Homo sapiens
catttatatgtcctt

SEQ ID NO: 223964 - DNA, 15 bp, Homo sapiens
acatttatatgtcct

SEQ ID NO: 223965 - DNA, 15 bp, Homo sapiens
tacatttatatgtcc

SEQ ID NO: 223966 - DNA, 15 bp, Homo sapiens
gtacatttatatgtc

SEQ ID NO: 223967 - DNA, 15 bp, Homo sapiens
ggtacatttatatgt

SEQ ID NO: 223968 - DNA, 15 bp, Homo sapiens
aggtacatttatatg

SEQ ID NO: 223969 - DNA, 15 bp, Homo sapiens
aaggtacatttatat

SEQ ID NO: 223970 - DNA, 15 bp, Homo sapiens
aaaggtacatttata

SEQ ID NO: 223971 - DNA, 15 bp, Homo sapiens
caaaggtacatttat

SEQ ID NO: 223972 - DNA, 15 bp, Homo sapiens
gcaaaggtacattta

SEQ ID NO: 223973 - DNA, 15 bp, Homo sapiens
tgcaaaggtacattt

SEQ ID NO: 223974 - DNA, 15 bp, Homo sapiens
atgcaaaggtacatt

SEQ ID NO: 223975 - DNA, 15 bp, Homo sapiens
aatgcaaaggtacat

SEQ ID NO: 223976 - DNA, 15 bp, Homo sapiens
aaatgcaaaggtaca

SEQ ID NO: 223977 - DNA, 15 bp, Homo sapiens
aaaatgcaaaggtac

SEQ ID NO: 223978 - DNA, 15 bp, Homo sapiens
taaaatgcaaaggta

SEQ ID NO: 223979 - DNA, 15 bp, Homo sapiens
ctaaaatgcaaaggt

SEQ ID NO: 223980 - DNA, 15 bp, Homo sapiens
tctaaaatgcaaagg

SEQ ID NO: 223981 - DNA, 15 bp, Homo sapiens
ctctaaaatgcaaag

SEQ ID NO: 223982 - DNA, 15 bp, Homo sapiens
tctctaaaatgcaaa

SEQ ID NO: 223983 - DNA, 15 bp, Homo sapiens
ttctctaaaatgcaa

SEQ ID NO: 223984 - DNA, 15 bp, Homo sapiens
tttctctaaaatgca

SEQ ID NO: 223985 - DNA, 15 bp, Homo sapiens
ctttctctaaaatgc

SEQ ID NO: 223986 - DNA, 15 bp, Homo sapiens
actttctctaaaatg

SEQ ID NO: 223987 - DNA, 15 bp, Homo sapiens
aactttctctaaaat

SEQ ID NO: 223988 - DNA, 15 bp, Homo sapiens
aaactttctctaaaa

SEQ ID NO: 223989 - DNA, 15 bp, Homo sapiens
aaaactttctctaaa

SEQ ID NO: 223990 - DNA, 15 bp, Homo sapiens
taaaactttctctaa

SEQ ID NO: 223991 - DNA, 15 bp, Homo sapiens
ataaaactttctcta

SEQ ID NO: 223992 - DNA, 15 bp, Homo sapiens
aataaaactttctct

SEQ ID NO: 223993 - DNA, 15 bp, Homo sapiens
aaataaaactttctc

SEQ ID NO: 223994 - DNA, 15 bp, Homo sapiens
aaaataaaactttct

SEQ ID NO: 223995 - DNA, 15 bp, Homo sapiens
taaaataaaactttc

SEQ ID NO: 223996 - DNA, 15 bp, Homo sapiens
ataaaataaaacttt

SEQ ID NO: 223997 - DNA, 15 bp, Homo sapiens
gataaaataaaactt

SEQ ID NO: 223998 - DNA, 15 bp, Homo sapiens
ggataaaataaaact

SEQ ID NO: 223999 - DNA, 15 bp, Homo sapiens
aggataaaataaaac

SEQ ID NO: 224000 - DNA, 15 bp, Homo sapiens
taggataaaataaaa

SEQ ID NO: 224001 - DNA, 15 bp, Homo sapiens
ataggataaaataaa

SEQ ID NO: 224002 - DNA, 15 bp, Homo sapiens
tataggataaaataa

SEQ ID NO: 224003 - DNA, 15 bp, Homo sapiens
atataggataaaata

SEQ ID NO: 224004 - DNA, 15 bp, Homo sapiens
gatataggataaaat

SEQ ID NO: 224005 - DNA, 15 bp, Homo sapiens
ggatataggataaaa

SEQ ID NO: 224006 - DNA, 15 bp, Homo sapiens
aggatataggataaa

SEQ ID NO: 224007 - DNA, 15 bp, Homo sapiens
caggatataggataa

SEQ ID NO: 224008 - DNA, 15 bp, Homo sapiens
acaggatataggata

SEQ ID NO: 224009 - DNA, 15 bp, Homo sapiens
cacaggatataggat

SEQ ID NO: 224010 - DNA, 15 bp, Homo sapiens
acacaggatatagga

SEQ ID NO: 224011 - DNA, 15 bp, Homo sapiens
aacacaggatatagg

SEQ ID NO: 224012 - DNA, 15 bp, Homo sapiens
taacacaggatatag

SEQ ID NO: 224013 - DNA, 15 bp, Homo sapiens
gtaacacaggatata

SEQ ID NO: 224014 - DNA, 15 bp, Homo sapiens
tgtaacacaggatat

SEQ ID NO: 224015 - DNA, 15 bp, Homo sapiens
atgtaacacaggata

SEQ ID NO: 224016 - DNA, 15 bp, Homo sapiens
gatgtaacacaggat

SEQ ID NO: 224017 - DNA, 15 bp, Homo sapiens
tgatgtaacacagga

SEQ ID NO: 224018 - DNA, 15 bp, Homo sapiens
gtgatgtaacacagg

SEQ ID NO: 224019 - DNA, 15 bp, Homo sapiens
agtgatgtaacacag

SEQ ID NO: 224020 - DNA, 15 bp, Homo sapiens
tagtgatgtaacaca

SEQ ID NO: 224021 - DNA, 15 bp, Homo sapiens
atagtgatgtaacac

SEQ ID NO: 224022 - DNA, 15 bp, Homo sapiens
tatagtgatgtaaca

SEQ ID NO: 224023 - DNA, 15 bp, Homo sapiens
atatagtgatgtaac

SEQ ID NO: 224024 - DNA, 15 bp, Homo sapiens
gatatagtgatgtaa

SEQ ID NO: 224025 - DNA, 15 bp, Homo sapiens
agatatagtgatgta

SEQ ID NO: 224026 - DNA, 15 bp, Homo sapiens
aagatatagtgatgt

SEQ ID NO: 224027 - DNA, 15 bp, Homo sapiens
taagatatagtgatg

SEQ ID NO: 224028 - DNA, 15 bp, Homo sapiens
ttaagatatagtgat

SEQ ID NO: 224029 - DNA, 15 bp, Homo sapiens
attaagatatagtga

SEQ ID NO: 224030 - DNA, 15 bp, Homo sapiens
aattaagatatagtg

SEQ ID NO: 224031 - DNA, 15 bp, Homo sapiens
caattaagatatagt

SEQ ID NO: 224032 - DNA, 15 bp, Homo sapiens
acaattaagatatag

SEQ ID NO: 224033 - DNA, 15 bp, Homo sapiens
cacaattaagatata

SEQ ID NO: 224034 - DNA, 15 bp, Homo sapiens
ccacaattaagatat

SEQ ID NO: 224035 - DNA, 15 bp, Homo sapiens
tccacaattaagata

SEQ ID NO: 224036 - DNA, 15 bp, Homo sapiens
atccacaattaagat

SEQ ID NO: 224037 - DNA, 15 bp, Homo sapiens
aatccacaattaaga

SEQ ID NO: 224038 - DNA, 15 bp, Homo sapiens
aaatccacaattaag

SEQ ID NO: 224039 - DNA, 15 bp, Homo sapiens
aaaatccacaattaa

SEQ ID NO: 224040 - DNA, 15 bp, Homo sapiens
aaaaatccacaatta

SEQ ID NO: 224041 - DNA, 15 bp, Homo sapiens
aaaaaatccacaatt

SEQ ID NO: 224042 - DNA, 15 bp, Homo sapiens
caaaaaatccacaat

SEQ ID NO: 224043 - DNA, 15 bp, Homo sapiens
ccaaaaaatccacaa

SEQ ID NO: 224044 - DNA, 15 bp, Homo sapiens
accaaaaaatccaca

SEQ ID NO: 224045 - DNA, 15 bp, Homo sapiens
aaccaaaaaatccac

SEQ ID NO: 224046 - DNA, 15 bp, Homo sapiens
gaaccaaaaaatcca

SEQ ID NO: 224047 - DNA, 15 bp, Homo sapiens
tgaaccaaaaaatcc

SEQ ID NO: 224048 - DNA, 15 bp, Homo sapiens
gtgaaccaaaaaatc

SEQ ID NO: 224049 - DNA, 15 bp, Homo sapiens
agtgaaccaaaaaat

SEQ ID NO: 224050 - DNA, 15 bp, Homo sapiens
aagtgaaccaaaaaa

SEQ ID NO: 224051 - DNA, 15 bp, Homo sapiens
aaagtgaaccaaaaa

SEQ ID NO: 224052 - DNA, 15 bp, Homo sapiens
caaagtgaaccaaaa

SEQ ID NO: 224053 - DNA, 15 bp, Homo sapiens
gcaaagtgaaccaaa

SEQ ID NO: 224054 - DNA, 15 bp, Homo sapiens
agcaaagtgaaccaa

SEQ ID NO: 224055 - DNA, 15 bp, Homo sapiens
gagcaaagtgaacca

SEQ ID NO: 224056 - DNA, 15 bp, Homo sapiens
cgagcaaagtgaacc

SEQ ID NO: 224057 - DNA, 15 bp, Homo sapiens
acgagcaaagtgaac

SEQ ID NO: 224058 - DNA, 15 bp, Homo sapiens
aacgagcaaagtgaa

SEQ ID NO: 224059 - DNA, 15 bp, Homo sapiens
gaacgagcaaagtga

SEQ ID NO: 224060 - DNA, 15 bp, Homo sapiens
tgaacgagcaaagtg

SEQ ID NO: 224061 - DNA, 15 bp, Homo sapiens
atgaacgagcaaagt

SEQ ID NO: 224062 - DNA, 15 bp, Homo sapiens
aatgaacgagcaaag

SEQ ID NO: 224063 - DNA, 15 bp, Homo sapiens
aaatgaacgagcaaa

SEQ ID NO: 224064 - DNA, 15 bp, Homo sapiens
taaatgaacgagcaa

SEQ ID NO: 224065 - DNA, 15 bp, Homo sapiens
ttaaatgaacgagca

SEQ ID NO: 224066 - DNA, 15 bp, Homo sapiens
tttaaatgaacgagc

SEQ ID NO: 224067 - DNA, 15 bp, Homo sapiens
atttaaatgaacgag

SEQ ID NO: 224068 - DNA, 15 bp, Homo sapiens
aatttaaatgaacga

SEQ ID NO: 224069 - DNA, 15 bp, Homo sapiens
aaatttaaatgaacg

SEQ ID NO: 224070 - DNA, 15 bp, Homo sapiens
aaaatttaaatgaac

SEQ ID NO: 224071 - DNA, 15 bp, Homo sapiens
aaaaatttaaatgaa

SEQ ID NO: 224072 - DNA, 15 bp, Homo sapiens
aaaaaatttaaatga

SEQ ID NO: 224073 - DNA, 15 bp, Homo sapiens
taaaaaatttaaatg

SEQ ID NO: 224074 - DNA, 15 bp, Homo sapiens
ataaaaaatttaaat

SEQ ID NO: 224075 - DNA, 15 bp, Homo sapiens
gataaaaaatttaaa

SEQ ID NO: 224076 - DNA, 15 bp, Homo sapiens
tgataaaaaatttaa

SEQ ID NO: 224077 - DNA, 15 bp, Homo sapiens
ttgataaaaaattta

SEQ ID NO: 224078 - DNA, 15 bp, Homo sapiens
tttgataaaaaattt

SEQ ID NO: 224079 - DNA, 15 bp, Homo sapiens
ctttgataaaaaatt

SEQ ID NO: 224080 - DNA, 15 bp, Homo sapiens
actttgataaaaaat

SEQ ID NO: 224081 - DNA, 15 bp, Homo sapiens
tactttgataaaaaa

SEQ ID NO: 224082 - DNA, 15 bp, Homo sapiens
ttactttgataaaaa

SEQ ID NO: 224083 - DNA, 15 bp, Homo sapiens
attactttgataaaa

SEQ ID NO: 224084 - DNA, 15 bp, Homo sapiens
tattactttgataaa

SEQ ID NO: 224085 - DNA, 15 bp, Homo sapiens
ttattactttgataa

SEQ ID NO: 224086 - DNA, 15 bp, Homo sapiens
attattactttgata

SEQ ID NO: 224087 - DNA, 15 bp, Homo sapiens
aattattactttgat

SEQ ID NO: 224088 - DNA, 15 bp, Homo sapiens
caattattactttga

SEQ ID NO: 224089 - DNA, 15 bp, Homo sapiens
acaattattactttg

SEQ ID NO: 224090 - DNA, 15 bp, Homo sapiens
tacaattattacttt

SEQ ID NO: 224091 - DNA, 15 bp, Homo sapiens
atacaattattactt

SEQ ID NO: 224092 - DNA, 15 bp, Homo sapiens
tatacaattattact

SEQ ID NO: 224093 - DNA, 15 bp, Homo sapiens
ctatacaattattac

SEQ ID NO: 224094 - DNA, 15 bp, Homo sapiens
actatacaattatta

SEQ ID NO: 224095 - DNA, 15 bp, Homo sapiens
aactatacaattatt

SEQ ID NO: 224096 - DNA, 15 bp, Homo sapiens
aaactatacaattat

SEQ ID NO: 224097 - DNA, 15 bp, Homo sapiens
taaactatacaatta

SEQ ID NO: 224098 - DNA, 15 bp, Homo sapiens
ttaaactatacaatt

SEQ ID NO: 224099 - DNA, 15 bp, Homo sapiens
tttaaactatacaat

SEQ ID NO: 224100 - DNA, 15 bp, Homo sapiens
ttttaaactatacaa

SEQ ID NO: 224101 - DNA, 15 bp, Homo sapiens
tttttaaactataca

SEQ ID NO: 224102 - DNA, 15 bp, Homo sapiens
atttttaaactatac

SEQ ID NO: 224103 - DNA, 15 bp, Homo sapiens
gatttttaaactata

SEQ ID NO: 224104 - DNA, 15 bp, Homo sapiens
tgatttttaaactat

SEQ ID NO: 224105 - DNA, 15 bp, Homo sapiens
ttgatttttaaacta

SEQ ID NO: 224106 - DNA, 15 bp, Homo sapiens
tttgatttttaaact

SEQ ID NO: 224107 - DNA, 15 bp, Homo sapiens
ttttgatttttaaac

SEQ ID NO: 224108 - DNA, 15 bp, Homo sapiens
tattttgatttttaa

SEQ ID NO: 224109 - DNA, 15 bp, Homo sapiens
ttattttgattttta

SEQ ID NO: 224110 - DNA, 15 bp, Homo sapiens
attattttgattttt

SEQ ID NO: 224111 - DNA, 15 bp, Homo sapiens
tattattttgatttt

SEQ ID NO: 224112 - DNA, 15 bp, Homo sapiens
atattattttgattt

SEQ ID NO: 224113 - DNA, 15 bp, Homo sapiens
aatattattttgatt

SEQ ID NO: 224114 - DNA, 15 bp, Homo sapiens
aaatattattttgat

SEQ ID NO: 224115 - DNA, 15 bp, Homo sapiens
taaatattattttga

SEQ ID NO: 224116 - DNA, 15 bp, Homo sapiens
gtaaatattattttg

SEQ ID NO: 224117 - DNA, 15 bp, Homo sapiens
tgtaaatattatttt

SEQ ID NO: 224118 - DNA, 15 bp, Homo sapiens
ttgtaaatattattt

SEQ ID NO: 224119 - DNA, 15 bp, Homo sapiens
attgtaaatattatt

SEQ ID NO: 224120 - DNA, 15 bp, Homo sapiens
cattgtaaatattat

SEQ ID NO: 224121 - DNA, 15 bp, Homo sapiens
gcattgtaaatatta

SEQ ID NO: 224122 - DNA, 15 bp, Homo sapiens
agcattgtaaatatt

SEQ ID NO: 224123 - DNA, 15 bp, Homo sapiens
aagcattgtaaatat

SEQ ID NO: 224124 - DNA, 15 bp, Homo sapiens
taagcattgtaaata

SEQ ID NO: 224125 - DNA, 15 bp, Homo sapiens
gtaagcattgtaaat

SEQ ID NO: 224126 - DNA, 15 bp, Homo sapiens
tgtaagcattgtaaa

SEQ ID NO: 224127 - DNA, 15 bp, Homo sapiens
gtgtaagcattgtaa

SEQ ID NO: 224128 - DNA, 15 bp, Homo sapiens
tgtgtaagcattgta

SEQ ID NO: 224129 - DNA, 15 bp, Homo sapiens
gtgtgtaagcattgt

SEQ ID NO: 224130 - DNA, 15 bp, Homo sapiens
tgtgtgtaagcattg

SEQ ID NO: 224131 - DNA, 15 bp, Homo sapiens
ttgtgtgtaagcatt

SEQ ID NO: 224132 - DNA, 15 bp, Homo sapiens
tttgtgtgtaagcat

SEQ ID NO: 224133 - DNA, 15 bp, Homo sapiens
ttttgtgtgtaagca

SEQ ID NO: 224134 - DNA, 15 bp, Homo sapiens
tttttgtgtgtaagc

SEQ ID NO: 224135 - DNA, 15 bp, Homo sapiens
ttttttgtgtgtaag

SEQ ID NO: 224136 - DNA, 15 bp, Homo sapiens
tttttttgtgtgtaa

SEQ ID NO: 224137 - DNA, 15 bp, Homo sapiens
atttttttgtgtgta

SEQ ID NO: 224138 - DNA, 15 bp, Homo sapiens
ctatttttttgtgtg

SEQ ID NO: 224139 - DNA, 15 bp, Homo sapiens
gctatttttttgtgt

SEQ ID NO: 224140 - DNA, 15 bp, Homo sapiens
tgctatttttttgtg

SEQ ID NO: 224141 - DNA, 15 bp, Homo sapiens
atgctatttttttgt

SEQ ID NO: 224142 - DNA, 15 bp, Homo sapiens
aatgctatttttttg

SEQ ID NO: 224143 - DNA, 15 bp, Homo sapiens
aaatgctattttttt

SEQ ID NO: 224144 - DNA, 15 bp, Homo sapiens
aaaatgctatttttt

SEQ ID NO: 224145 - DNA, 15 bp, Homo sapiens
aaaaatgctattttt

SEQ ID NO: 224146 - DNA, 15 bp, Homo sapiens
caaaaatgctatttt

SEQ ID NO: 224147 - DNA, 15 bp, Homo sapiens
acaaaaatgctattt

SEQ ID NO: 224148 - DNA, 15 bp, Homo sapiens
gacaaaaatgctatt

SEQ ID NO: 224149 - DNA, 15 bp, Homo sapiens
tgacaaaaatgctat

SEQ ID NO: 224150 - DNA, 15 bp, Homo sapiens
gtgacaaaaatgcta

SEQ ID NO: 224151 - DNA, 15 bp, Homo sapiens
agtgacaaaaatgct

SEQ ID NO: 224152 - DNA, 15 bp, Homo sapiens
gagtgacaaaaatgc

SEQ ID NO: 224153 - DNA, 15 bp, Homo sapiens
cggagtgacaaaaat

SEQ ID NO: 224154 - DNA, 15 bp, Homo sapiens
acggagtgacaaaaa

SEQ ID NO: 224155 - DNA, 15 bp, Homo sapiens
gacggagtgacaaaa

SEQ ID NO: 224156 - DNA, 15 bp, Homo sapiens
agacggagtgacaaa

SEQ ID NO: 224157 - DNA, 15 bp, Homo sapiens
gagacggagtgacaa

SEQ ID NO: 224158 - DNA, 15 bp, Homo sapiens
agagacggagtgaca

SEQ ID NO: 224159 - DNA, 15 bp, Homo sapiens
gagagacggagtgac

SEQ ID NO: 224160 - DNA, 15 bp, Homo sapiens
tgagagacggagtga

SEQ ID NO: 224161 - DNA, 15 bp, Homo sapiens
gtgagagacggagtg

SEQ ID NO: 224162 - DNA, 15 bp, Homo sapiens
agtgagagacggagt

SEQ ID NO: 224163 - DNA, 15 bp, Homo sapiens
tagtgagagacggag

SEQ ID NO: 224164 - DNA, 15 bp, Homo sapiens
ctagtgagagacgga

SEQ ID NO: 224165 - DNA, 15 bp, Homo sapiens
actagtgagagacgg

SEQ ID NO: 224166 - DNA, 15 bp, Homo sapiens
aactagtgagagacg

SEQ ID NO: 224167 - DNA, 15 bp, Homo sapiens
gaactagtgagagac

SEQ ID NO: 224168 - DNA, 15 bp, Homo sapiens
agaactagtgagaga

SEQ ID NO: 224169 - DNA, 15 bp, Homo sapiens
aagaactagtgagag

SEQ ID NO: 224170 - DNA, 15 bp, Homo sapiens
caagaactagtgaga

SEQ ID NO: 224171 - DNA, 15 bp, Homo sapiens
acaagaactagtgag

SEQ ID NO: 224172 - DNA, 15 bp, Homo sapiens
gacaagaactagtga

SEQ ID NO: 224173 - DNA, 15 bp, Homo sapiens
tgacaagaactagtg

SEQ ID NO: 224174 - DNA, 15 bp, Homo sapiens
ctgacaagaactagt

SEQ ID NO: 224175 - DNA, 15 bp, Homo sapiens
gctgacaagaactag

SEQ ID NO: 224176 - DNA, 15 bp, Homo sapiens
agctgacaagaacta

SEQ ID NO: 224177 - DNA, 15 bp, Homo sapiens
gagctgacaagaact

SEQ ID NO: 224178 - DNA, 15 bp, Homo sapiens
agagctgacaagaac

SEQ ID NO: 224179 - DNA, 15 bp, Homo sapiens
aagagctgacaagaa

SEQ ID NO: 224180 - DNA, 15 bp, Homo sapiens
gaagagctgacaaga

SEQ ID NO: 224181 - DNA, 15 bp, Homo sapiens
agaagagctgacaag

SEQ ID NO: 224182 - DNA, 15 bp, Homo sapiens
gagaagagctgacaa

SEQ ID NO: 224183 - DNA, 15 bp, Homo sapiens
tgagaagagctgaca

SEQ ID NO: 224184 - DNA, 15 bp, Homo sapiens
atgagaagagctgac

SEQ ID NO: 224185 - DNA, 15 bp, Homo sapiens
gatgagaagagctga

SEQ ID NO: 224186 - DNA, 15 bp, Homo sapiens
ggatgagaagagctg

SEQ ID NO: 224187 - DNA, 15 bp, Homo sapiens
gggatgagaagagct

SEQ ID NO: 224188 - DNA, 15 bp, Homo sapiens
agggatgagaagagc

SEQ ID NO: 224189 - DNA, 15 bp, Homo sapiens
gagggatgagaagag

SEQ ID NO: 224190 - DNA, 15 bp, Homo sapiens
ggagggatgagaaga

SEQ ID NO: 224191 - DNA, 15 bp, Homo sapiens
gggagggatgagaag

SEQ ID NO: 224192 - DNA, 15 bp, Homo sapiens
ggggagggatgagaa

SEQ ID NO: 224193 - DNA, 15 bp, Homo sapiens
tggggagggatgaga

SEQ ID NO: 224194 - DNA, 15 bp, Homo sapiens
gtggggagggatgag

SEQ ID NO: 224195 - DNA, 15 bp, Homo sapiens
ggtggggagggatga

SEQ ID NO: 224196 - DNA, 15 bp, Homo sapiens
aggtggggagggatg

SEQ ID NO: 224197 - DNA, 15 bp, Homo sapiens
caggtggggagggat

SEQ ID NO: 224198 - DNA, 15 bp, Homo sapiens
acaggtggggaggga

SEQ ID NO: 224199 - DNA, 15 bp, Homo sapiens
cacaggtggggaggg

SEQ ID NO: 224200 - DNA, 15 bp, Homo sapiens
tcacaggtggggagg

SEQ ID NO: 224201 - DNA, 15 bp, Homo sapiens
ctcacaggtggggag

SEQ ID NO: 224202 - DNA, 15 bp, Homo sapiens
cctcacaggtgggga

SEQ ID NO: 224203 - DNA, 15 bp, Homo sapiens
ccctcacaggtgggg

SEQ ID NO: 224204 - DNA, 15 bp, Homo sapiens
accctcacaggtggg

SEQ ID NO: 224205 - DNA, 15 bp, Homo sapiens
aaccctcacaggtgg

SEQ ID NO: 224206 - DNA, 15 bp, Homo sapiens
taaccctcacaggtg

SEQ ID NO: 224207 - DNA, 15 bp, Homo sapiens
ttaaccctcacaggt

SEQ ID NO: 224208 - DNA, 15 bp, Homo sapiens
cttaaccctcacagg

SEQ ID NO: 224209 - DNA, 15 bp, Homo sapiens
gcttaaccctcacag

SEQ ID NO: 224210 - DNA, 15 bp, Homo sapiens
agcttaaccctcaca

SEQ ID NO: 224211 - DNA, 15 bp, Homo sapiens
tagcttaaccctcac

SEQ ID NO: 224212 - DNA, 15 bp, Homo sapiens
gtagcttaaccctca

SEQ ID NO: 224213 - DNA, 15 bp, Homo sapiens
tgtagcttaaccctc

SEQ ID NO: 224214 - DNA, 15 bp, Homo sapiens
gtgtagcttaaccct

SEQ ID NO: 224215 - DNA, 15 bp, Homo sapiens
agtgtagcttaaccc

SEQ ID NO: 224216 - DNA, 15 bp, Homo sapiens
aagtgtagcttaacc

SEQ ID NO: 224217 - DNA, 15 bp, Homo sapiens
aaagtgtagcttaac

SEQ ID NO: 224218 - DNA, 15 bp, Homo sapiens
caaagtgtagcttaa

SEQ ID NO: 224219 - DNA, 15 bp, Homo sapiens
ccaaagtgtagctta

SEQ ID NO: 224220 - DNA, 15 bp, Homo sapiens
accaaagtgtagctt

SEQ ID NO: 224221 - DNA, 15 bp, Homo sapiens
aaccaaagtgtagct

SEQ ID NO: 224222 - DNA, 15 bp, Homo sapiens
taaccaaagtgtagc

SEQ ID NO: 224223 - DNA, 15 bp, Homo sapiens
ctaaccaaagtgtag

SEQ ID NO: 224224 - DNA, 15 bp, Homo sapiens
actaaccaaagtgta

SEQ ID NO: 224225 - DNA, 15 bp, Homo sapiens
gactaaccaaagtgt

SEQ ID NO: 224226 - DNA, 15 bp, Homo sapiens
ggactaaccaaagtg

SEQ ID NO: 224227 - DNA, 15 bp, Homo sapiens
tggactaaccaaagt

SEQ ID NO: 224228 - DNA, 15 bp, Homo sapiens
ttggactaaccaaag

SEQ ID NO: 224229 - DNA, 15 bp, Homo sapiens
cttggactaaccaaa

SEQ ID NO: 224230 - DNA, 15 bp, Homo sapiens
gcttggactaaccaa

SEQ ID NO: 224231 - DNA, 15 bp, Homo sapiens
tgcttggactaacca

SEQ ID NO: 224232 - DNA, 15 bp, Homo sapiens
gtgcttggactaacc

SEQ ID NO: 224233 - DNA, 15 bp, Homo sapiens
tgtgcttggactaac

SEQ ID NO: 224234 - DNA, 15 bp, Homo sapiens
gtgtgcttggactaa

SEQ ID NO: 224235 - DNA, 15 bp, Homo sapiens
agtgtgcttggacta

SEQ ID NO: 224236 - DNA, 15 bp, Homo sapiens
aagtgtgcttggact

SEQ ID NO: 224237 - DNA, 15 bp, Homo sapiens
aaagtgtgcttggac

SEQ ID NO: 224238 - DNA, 15 bp, Homo sapiens
gaaagtgtgcttgga

SEQ ID NO: 224239 - DNA, 15 bp, Homo sapiens
ggaaagtgtgcttgg

SEQ ID NO: 224240 - DNA, 15 bp, Homo sapiens
tggaaagtgtgcttg

SEQ ID NO: 224241 - DNA, 15 bp, Homo sapiens
ctggaaagtgtgctt

SEQ ID NO: 224242 - DNA, 15 bp, Homo sapiens
actggaaagtgtgct

SEQ ID NO: 224243 - DNA, 15 bp, Homo sapiens
tactggaaagtgtgc

SEQ ID NO: 224244 - DNA, 15 bp, Homo sapiens
atactggaaagtgtg

SEQ ID NO: 224245 - DNA, 15 bp, Homo sapiens
catactggaaagtgt

SEQ ID NO: 224246 - DNA, 15 bp, Homo sapiens
gcatactggaaagtg

SEQ ID NO: 224247 - DNA, 15 bp, Homo sapiens
agcatactggaaagt

SEQ ID NO: 224248 - DNA, 15 bp, Homo sapiens
aagcatactggaaag

SEQ ID NO: 224249 - DNA, 15 bp, Homo sapiens
taagcatactggaaa

SEQ ID NO: 224250 - DNA, 15 bp, Homo sapiens
gtaagcatactggaa

SEQ ID NO: 224251 - DNA, 15 bp, Homo sapiens
ggtaagcatactgga

SEQ ID NO: 224252 - DNA, 15 bp, Homo sapiens
tggtaagcatactgg

SEQ ID NO: 224253 - DNA, 15 bp, Homo sapiens
atggtaagcatactg

SEQ ID NO: 224254 - DNA, 15 bp, Homo sapiens
catggtaagcatact

SEQ ID NO: 224255 - DNA, 15 bp, Homo sapiens
acatggtaagcatac

SEQ ID NO: 224256 - DNA, 15 bp, Homo sapiens
aacatggtaagcata

SEQ ID NO: 224257 - DNA, 15 bp, Homo sapiens
taacatggtaagcat

SEQ ID NO: 224258 - DNA, 15 bp, Homo sapiens
ataacatggtaagca

SEQ ID NO: 224259 - DNA, 15 bp, Homo sapiens
cataacatggtaagc

SEQ ID NO: 224260 - DNA, 15 bp, Homo sapiens
tcataacatggtaag

SEQ ID NO: 224261 - DNA, 15 bp, Homo sapiens
gtcataacatggtaa

SEQ ID NO: 224262 - DNA, 15 bp, Homo sapiens
agtcataacatggta

SEQ ID NO: 224263 - DNA, 15 bp, Homo sapiens
aagtcataacatggt

SEQ ID NO: 224264 - DNA, 15 bp, Homo sapiens
taagtcataacatgg

SEQ ID NO: 224265 - DNA, 15 bp, Homo sapiens
ataagtcataacatg

SEQ ID NO: 224266 - DNA, 15 bp, Homo sapiens
gataagtcataacat

SEQ ID NO: 224267 - DNA, 15 bp, Homo sapiens
agataagtcataaca

SEQ ID NO: 224268 - DNA, 15 bp, Homo sapiens
gagataagtcataac

SEQ ID NO: 224269 - DNA, 15 bp, Homo sapiens
ggagataagtcataa

SEQ ID NO: 224270 - DNA, 15 bp, Homo sapiens
aggagataagtcata

SEQ ID NO: 224271 - DNA, 15 bp, Homo sapiens
gaggagataagtcat

SEQ ID NO: 224272 - DNA, 15 bp, Homo sapiens
agaggagataagtca

SEQ ID NO: 224273 - DNA, 15 bp, Homo sapiens
tagaggagataagtc

SEQ ID NO: 224274 - DNA, 15 bp, Homo sapiens
atagaggagataagt

SEQ ID NO: 224275 - DNA, 15 bp, Homo sapiens
tatagaggagataag

SEQ ID NO: 224276 - DNA, 15 bp, Homo sapiens
gtatagaggagataa

SEQ ID NO: 224277 - DNA, 15 bp, Homo sapiens
tgtatagaggagata

SEQ ID NO: 224278 - DNA, 15 bp, Homo sapiens
gtgtatagaggagat

SEQ ID NO: 224279 - DNA, 15 bp, Homo sapiens
cgtgtatagaggaga

SEQ ID NO: 224280 - DNA, 15 bp, Homo sapiens
tcgtgtatagaggag

SEQ ID NO: 224281 - DNA, 15 bp, Homo sapiens
ctcgtgtatagagga

SEQ ID NO: 224282 - DNA, 15 bp, Homo sapiens
actcgtgtatagagg

SEQ ID NO: 224283 - DNA, 15 bp, Homo sapiens
tactcgtgtatagag

SEQ ID NO: 224284 - DNA, 15 bp, Homo sapiens
ctactcgtgtataga

SEQ ID NO: 224285 - DNA, 15 bp, Homo sapiens
cctactcgtgtatag

SEQ ID NO: 224286 - DNA, 15 bp, Homo sapiens
tcctactcgtgtata

SEQ ID NO: 224287 - DNA, 15 bp, Homo sapiens
ttcctactcgtgtat

SEQ ID NO: 224288 - DNA, 15 bp, Homo sapiens
tttcctactcgtgta

SEQ ID NO: 224289 - DNA, 15 bp, Homo sapiens
ttttcctactcgtgt

SEQ ID NO: 224290 - DNA, 15 bp, Homo sapiens
attttcctactcgtg

SEQ ID NO: 224291 - DNA, 15 bp, Homo sapiens
aattttcctactcgt

SEQ ID NO: 224292 - DNA, 15 bp, Homo sapiens
taattttcctactcg

SEQ ID NO: 224293 - DNA, 15 bp, Homo sapiens
ataattttcctactc

SEQ ID NO: 224294 - DNA, 15 bp, Homo sapiens
gataattttcctact

SEQ ID NO: 224295 - DNA, 15 bp, Homo sapiens
tgataattttcctac

SEQ ID NO: 224296 - DNA, 15 bp, Homo sapiens
ctgataattttccta

SEQ ID NO: 224297 - DNA, 15 bp, Homo sapiens
actgataattttcct

SEQ ID NO: 224298 - DNA, 15 bp, Homo sapiens
tactgataattttcc

SEQ ID NO: 224299 - DNA, 15 bp, Homo sapiens
ttactgataattttc

SEQ ID NO: 224300 - DNA, 15 bp, Homo sapiens
attactgataatttt

SEQ ID NO: 224301 - DNA, 15 bp, Homo sapiens
tattactgataattt

SEQ ID NO: 224302 - DNA, 15 bp, Homo sapiens
ctattactgataatt

SEQ ID NO: 224303 - DNA, 15 bp, Homo sapiens
actattactgataat

SEQ ID NO: 224304 - DNA, 15 bp, Homo sapiens
cactattactgataa

SEQ ID NO: 224305 - DNA, 15 bp, Homo sapiens
ccactattactgata

SEQ ID NO: 224306 - DNA, 15 bp, Homo sapiens
accactattactgat

SEQ ID NO: 224307 - DNA, 15 bp, Homo sapiens
aaccactattactga

SEQ ID NO: 224308 - DNA, 15 bp, Homo sapiens
aaaccactattactg

SEQ ID NO: 224309 - DNA, 15 bp, Homo sapiens
gaaaccactattact

SEQ ID NO: 224310 - DNA, 15 bp, Homo sapiens
agaaaccactattac

SEQ ID NO: 224311 - DNA, 15 bp, Homo sapiens
tagaaaccactatta

SEQ ID NO: 224312 - DNA, 15 bp, Homo sapiens
ctagaaaccactatt

SEQ ID NO: 224313 - DNA, 15 bp, Homo sapiens
tctagaaaccactat

SEQ ID NO: 224314 - DNA, 15 bp, Homo sapiens
ctctagaaaccacta

SEQ ID NO: 224315 - DNA, 15 bp, Homo sapiens
actctagaaaccact

SEQ ID NO: 224316 - DNA, 15 bp, Homo sapiens
tactctagaaaccac

SEQ ID NO: 224317 - DNA, 15 bp, Homo sapiens
ctactctagaaacca

SEQ ID NO: 224318 - DNA, 15 bp, Homo sapiens
actactctagaaacc

SEQ ID NO: 224319 - DNA, 15 bp, Homo sapiens
tactactctagaaac

SEQ ID NO: 224320 - DNA, 15 bp, Homo sapiens
gtactactctagaaa

SEQ ID NO: 224321 - DNA, 15 bp, Homo sapiens
agtactactctagaa

SEQ ID NO: 224322 - DNA, 15 bp, Homo sapiens
aagtactactctaga

SEQ ID NO: 224323 - DNA, 15 bp, Homo sapiens
caagtactactctag

SEQ ID NO: 224324 - DNA, 15 bp, Homo sapiens
tcaagtactactcta

SEQ ID NO: 224325 - DNA, 15 bp, Homo sapiens
ctcaagtactactct

SEQ ID NO: 224326 - DNA, 15 bp, Homo sapiens
cctcaagtactactc

SEQ ID NO: 224327 - DNA, 15 bp, Homo sapiens
tcctcaagtactact

SEQ ID NO: 224328 - DNA, 15 bp, Homo sapiens
ctcctcaagtactac

SEQ ID NO: 224329 - DNA, 15 bp, Homo sapiens
cctcctcaagtacta

SEQ ID NO: 224330 - DNA, 15 bp, Homo sapiens
ccctcctcaagtact

SEQ ID NO: 224331 - DNA, 15 bp, Homo sapiens
accctcctcaagtac

SEQ ID NO: 224332 - DNA, 15 bp, Homo sapiens
taccctcctcaagta

SEQ ID NO: 224333 - DNA, 15 bp, Homo sapiens
ttaccctcctcaagt

SEQ ID NO: 224334 - DNA, 15 bp, Homo sapiens
gttaccctcctcaag

SEQ ID NO: 224335 - DNA, 15 bp, Homo sapiens
cgttaccctcctcaa

SEQ ID NO: 224336 - DNA, 15 bp, Homo sapiens
ccgttaccctcctca

SEQ ID NO: 224337 - DNA, 15 bp, Homo sapiens
cccgttaccctcctc

SEQ ID NO: 224338 - DNA, 15 bp, Homo sapiens
acccgttaccctcct

SEQ ID NO: 224339 - DNA, 15 bp, Homo sapiens
cacccgttaccctcc

SEQ ID NO: 224340 - DNA, 15 bp, Homo sapiens
ccacccgttaccctc

SEQ ID NO: 224341 - DNA, 15 bp, Homo sapiens
gccacccgttaccct

SEQ ID NO: 224342 - DNA, 15 bp, Homo sapiens
cgccacccgttaccc

SEQ ID NO: 224343 - DNA, 15 bp, Homo sapiens
acgccacccgttacc

SEQ ID NO: 224344 - DNA, 15 bp, Homo sapiens
cacgccacccgttac

SEQ ID NO: 224345 - DNA, 15 bp, Homo sapiens
acacgccacccgtta

SEQ ID NO: 224346 - DNA, 15 bp, Homo sapiens
cacacgccacccgtt

SEQ ID NO: 224347 - DNA, 15 bp, Homo sapiens
gcacacgccacccgt

SEQ ID NO: 224348 - DNA, 15 bp, Homo sapiens
tgcacacgccacccg

SEQ ID NO: 224349 - DNA, 15 bp, Homo sapiens
atgcacacgccaccc

SEQ ID NO: 224350 - DNA, 15 bp, Homo sapiens
catgcacacgccacc

SEQ ID NO: 224351 - DNA, 15 bp, Homo sapiens
gcatgcacacgccac

SEQ ID NO: 224352 - DNA, 15 bp, Homo sapiens
agcatgcacacgcca

SEQ ID NO: 224353 - DNA, 15 bp, Homo sapiens
aagcatgcacacgcc

SEQ ID NO: 224354 - DNA, 15 bp, Homo sapiens
gaagcatgcacacgc

SEQ ID NO: 224355 - DNA, 15 bp, Homo sapiens
tgaagcatgcacacg

SEQ ID NO: 224356 - DNA, 15 bp, Homo sapiens
atgaagcatgcacac

SEQ ID NO: 224357 - DNA, 15 bp, Homo sapiens
catgaagcatgcaca

SEQ ID NO: 224358 - DNA, 15 bp, Homo sapiens
ccatgaagcatgcac

SEQ ID NO: 224359 - DNA, 15 bp, Homo sapiens
gccatgaagcatgca

SEQ ID NO: 224360 - DNA, 15 bp, Homo sapiens
ggccatgaagcatgc

SEQ ID NO: 224361 - DNA, 15 bp, Homo sapiens
aggccatgaagcatg

SEQ ID NO: 224362 - DNA, 15 bp, Homo sapiens
aaggccatgaagcat

SEQ ID NO: 224363 - DNA, 15 bp, Homo sapiens
taaggccatgaagca

SEQ ID NO: 224364 - DNA, 15 bp, Homo sapiens
ataaggccatgaagc

SEQ ID NO: 224365 - DNA, 15 bp, Homo sapiens
aataaggccatgaag

SEQ ID NO: 224366 - DNA, 15 bp, Homo sapiens
gaataaggccatgaa

SEQ ID NO: 224367 - DNA, 15 bp, Homo sapiens
tgaataaggccatga

SEQ ID NO: 224368 - DNA, 15 bp, Homo sapiens
ttgaataaggccatg

SEQ ID NO: 224369 - DNA, 15 bp, Homo sapiens
attgaataaggccat

SEQ ID NO: 224370 - DNA, 15 bp, Homo sapiens
gattgaataaggcca

SEQ ID NO: 224371 - DNA, 15 bp, Homo sapiens
tgattgaataaggcc

SEQ ID NO: 224372 - DNA, 15 bp, Homo sapiens
ttgattgaataaggc

SEQ ID NO: 224373 - DNA, 15 bp, Homo sapiens
cttgattgaataagg

SEQ ID NO: 224374 - DNA, 15 bp, Homo sapiens
gcttgattgaataag

SEQ ID NO: 224375 - DNA, 15 bp, Homo sapiens
tgcttgattgaataa

SEQ ID NO: 224376 - DNA, 15 bp, Homo sapiens
gtgcttgattgaata

SEQ ID NO: 224377 - DNA, 15 bp, Homo sapiens
agtgcttgattgaat

SEQ ID NO: 224378 - DNA, 15 bp, Homo sapiens
gagtgcttgattgaa

SEQ ID NO: 224379 - DNA, 15 bp, Homo sapiens
agagtgcttgattga

SEQ ID NO: 224380 - DNA, 15 bp, Homo sapiens
tagagtgcttgattg

SEQ ID NO: 224381 - DNA, 15 bp, Homo sapiens
gtagagtgcttgatt

SEQ ID NO: 224382 - DNA, 15 bp, Homo sapiens
agtagagtgcttgat

SEQ ID NO: 224383 - DNA, 15 bp, Homo sapiens
gagtagagtgcttga

SEQ ID NO: 224384 - DNA, 15 bp, Homo sapiens
agagtagagtgcttg

SEQ ID NO: 224385 - DNA, 15 bp, Homo sapiens
aagagtagagtgctt

SEQ ID NO: 224386 - DNA, 15 bp, Homo sapiens
caagagtagagtgct

SEQ ID NO: 224387 - DNA, 15 bp, Homo sapiens
tcaagagtagagtgc

SEQ ID NO: 224388 - DNA, 15 bp, Homo sapiens
atcaagagtagagtg

SEQ ID NO: 224389 - DNA, 15 bp, Homo sapiens
aatcaagagtagagt

SEQ ID NO: 224390 - DNA, 15 bp, Homo sapiens
aaatcaagagtagag

SEQ ID NO: 224391 - DNA, 15 bp, Homo sapiens
taaatcaagagtaga

SEQ ID NO: 224392 - DNA, 15 bp, Homo sapiens
gtaaatcaagagtag

SEQ ID NO: 224393 - DNA, 15 bp, Homo sapiens
agtaaatcaagagta

SEQ ID NO: 224394 - DNA, 15 bp, Homo sapiens
cagtaaatcaagagt

SEQ ID NO: 224395 - DNA, 15 bp, Homo sapiens
gcagtaaatcaagag

SEQ ID NO: 224396 - DNA, 15 bp, Homo sapiens
agcagtaaatcaaga

SEQ ID NO: 224397 - DNA, 15 bp, Homo sapiens
tagcagtaaatcaag

SEQ ID NO: 224398 - DNA, 15 bp, Homo sapiens
ttagcagtaaatcaa

SEQ ID NO: 224399 - DNA, 15 bp, Homo sapiens
tttagcagtaaatca

SEQ ID NO: 224400 - DNA, 15 bp, Homo sapiens
atttagcagtaaatc

SEQ ID NO: 224401 - DNA, 15 bp, Homo sapiens
gatttagcagtaaat

SEQ ID NO: 224402 - DNA, 15 bp, Homo sapiens
ggatttagcagtaaa

SEQ ID NO: 224403 - DNA, 15 bp, Homo sapiens
aggatttagcagtaa

SEQ ID NO: 224404 - DNA, 15 bp, Homo sapiens
gaggatttagcagta

SEQ ID NO: 224405 - DNA, 15 bp, Homo sapiens
ggaggatttagcagt

SEQ ID NO: 224406 - DNA, 15 bp, Homo sapiens
aggaggatttagcag

SEQ ID NO: 224407 - DNA, 15 bp, Homo sapiens
aaggaggatttagca

SEQ ID NO: 224408 - DNA, 15 bp, Homo sapiens
caaggaggatttagc

SEQ ID NO: 224409 - DNA, 15 bp, Homo sapiens
tcaaggaggatttag

SEQ ID NO: 224410 - DNA, 15 bp, Homo sapiens
ttcaaggaggattta

SEQ ID NO: 224411 - DNA, 15 bp, Homo sapiens
attcaaggaggattt

SEQ ID NO: 224412 - DNA, 15 bp, Homo sapiens
gattcaaggaggatt

SEQ ID NO: 224413 - DNA, 15 bp, Homo sapiens
agattcaaggaggat

SEQ ID NO: 224414 - DNA, 15 bp, Homo sapiens
aagattcaaggagga

SEQ ID NO: 224415 - DNA, 15 bp, Homo sapiens
aaagattcaaggagg

SEQ ID NO: 224416 - DNA, 15 bp, Homo sapiens
taaagattcaaggag

SEQ ID NO: 224417 - DNA, 15 bp, Homo sapiens
ctaaagattcaagga

SEQ ID NO: 224418 - DNA, 15 bp, Homo sapiens
tctaaagattcaagg

SEQ ID NO: 224419 - DNA, 15 bp, Homo sapiens
atctaaagattcaag

SEQ ID NO: 224420 - DNA, 15 bp, Homo sapiens
aatctaaagattcaa

SEQ ID NO: 224421 - DNA, 15 bp, Homo sapiens
aaatctaaagattca

SEQ ID NO: 224422 - DNA, 15 bp, Homo sapiens
gaaatctaaagattc

SEQ ID NO: 224423 - DNA, 15 bp, Homo sapiens
ggaaatctaaagatt

SEQ ID NO: 224424 - DNA, 15 bp, Homo sapiens
aggaaatctaaagat

SEQ ID NO: 224425 - DNA, 15 bp, Homo sapiens
taggaaatctaaaga

SEQ ID NO: 224426 - DNA, 15 bp, Homo sapiens
ttaggaaatctaaag

SEQ ID NO: 224427 - DNA, 15 bp, Homo sapiens
tttaggaaatctaaa

SEQ ID NO: 224428 - DNA, 15 bp, Homo sapiens
ctttaggaaatctaa

SEQ ID NO: 224429 - DNA, 15 bp, Homo sapiens
cctttaggaaatcta

SEQ ID NO: 224430 - DNA, 15 bp, Homo sapiens
gcctttaggaaatct

SEQ ID NO: 224431 - DNA, 15 bp, Homo sapiens
agcctttaggaaatc

SEQ ID NO: 224432 - DNA, 15 bp, Homo sapiens
tagcctttaggaaat

SEQ ID NO: 224433 - DNA, 15 bp, Homo sapiens
atagcctttaggaaa

SEQ ID NO: 224434 - DNA, 15 bp, Homo sapiens
gatagcctttaggaa

SEQ ID NO: 224435 - DNA, 15 bp, Homo sapiens
tgatagcctttagga

SEQ ID NO: 224436 - DNA, 15 bp, Homo sapiens
atgatagcctttagg

SEQ ID NO: 224437 - DNA, 15 bp, Homo sapiens
catgatagcctttag

SEQ ID NO: 224438 - DNA, 15 bp, Homo sapiens
tcatgatagccttta

SEQ ID NO: 224439 - DNA, 15 bp, Homo sapiens
ctcatgatagccttt

SEQ ID NO: 224440 - DNA, 15 bp, Homo sapiens
tctcatgatagcctt

SEQ ID NO: 224441 - DNA, 15 bp, Homo sapiens
atctcatgatagcct

SEQ ID NO: 224442 - DNA, 15 bp, Homo sapiens
aatctcatgatagcc

SEQ ID NO: 224443 - DNA, 15 bp, Homo sapiens
aaatctcatgatagc

SEQ ID NO: 224444 - DNA, 15 bp, Homo sapiens
aaaatctcatgatag

SEQ ID NO: 224445 - DNA, 15 bp, Homo sapiens
gaaaatctcatgata

SEQ ID NO: 224446 - DNA, 15 bp, Homo sapiens
agaaaatctcatgat

SEQ ID NO: 224447 - DNA, 15 bp, Homo sapiens
cagaaaatctcatga

SEQ ID NO: 224448 - DNA, 15 bp, Homo sapiens
ccagaaaatctcatg

SEQ ID NO: 224449 - DNA, 15 bp, Homo sapiens
tccagaaaatctcat

SEQ ID NO: 224450 - DNA, 15 bp, Homo sapiens
atccagaaaatctca

SEQ ID NO: 224451 - DNA, 15 bp, Homo sapiens
tatccagaaaatctc

SEQ ID NO: 224452 - DNA, 15 bp, Homo sapiens
atatccagaaaatct

SEQ ID NO: 224453 - DNA, 15 bp, Homo sapiens
tatatccagaaaatc

SEQ ID NO: 224454 - DNA, 15 bp, Homo sapiens
ctatatccagaaaat

SEQ ID NO: 224455 - DNA, 15 bp, Homo sapiens
tttctatatccagaa

SEQ ID NO: 224456 - DNA, 15 bp, Homo sapiens
ttttctatatccaga

SEQ ID NO: 224457 - DNA, 15 bp, Homo sapiens
attttctatatccag

SEQ ID NO: 224458 - DNA, 15 bp, Homo sapiens
cattttctatatcca

SEQ ID NO: 224459 - DNA, 15 bp, Homo sapiens
acattttctatatcc

SEQ ID NO: 224460 - DNA, 15 bp, Homo sapiens
tacattttctatatc

SEQ ID NO: 224461 - DNA, 15 bp, Homo sapiens
ctacattttctatat

SEQ ID NO: 224462 - DNA, 15 bp, Homo sapiens
gctacattttctata

SEQ ID NO: 224463 - DNA, 15 bp, Homo sapiens
ggctacattttctat

SEQ ID NO: 224464 - DNA, 15 bp, Homo sapiens
gggctacattttcta

SEQ ID NO: 224465 - DNA, 15 bp, Homo sapiens
tgggctacattttct

SEQ ID NO: 224466 - DNA, 15 bp, Homo sapiens
atgggctacattttc

SEQ ID NO: 224467 - DNA, 15 bp, Homo sapiens
aatgggctacatttt

SEQ ID NO: 224468 - DNA, 15 bp, Homo sapiens
taatgggctacattt

SEQ ID NO: 224469 - DNA, 15 bp, Homo sapiens
ctaatgggctacatt

SEQ ID NO: 224470 - DNA, 15 bp, Homo sapiens
actaatgggctacat

SEQ ID NO: 224471 - DNA, 15 bp, Homo sapiens
gactaatgggctaca

SEQ ID NO: 224472 - DNA, 15 bp, Homo sapiens
agactaatgggctac

SEQ ID NO: 224473 - DNA, 15 bp, Homo sapiens
gagactaatgggcta

SEQ ID NO: 224474 - DNA, 15 bp, Homo sapiens
agagactaatgggct

SEQ ID NO: 224475 - DNA, 15 bp, Homo sapiens
cagagactaatgggc

SEQ ID NO: 224476 - DNA, 15 bp, Homo sapiens
acagagactaatggg

SEQ ID NO: 224477 - DNA, 15 bp, Homo sapiens
gacagagactaatgg

SEQ ID NO: 224478 - DNA, 15 bp, Homo sapiens
tgacagagactaatg

SEQ ID NO: 224479 - DNA, 15 bp, Homo sapiens
ctgacagagactaat

SEQ ID NO: 224480 - DNA, 15 bp, Homo sapiens
gctgacagagactaa

SEQ ID NO: 224481 - DNA, 15 bp, Homo sapiens
agctgacagagacta

SEQ ID NO: 224482 - DNA, 15 bp, Homo sapiens
aagctgacagagact

SEQ ID NO: 224483 - DNA, 15 bp, Homo sapiens
gaagctgacagagac

SEQ ID NO: 224484 - DNA, 15 bp, Homo sapiens
tgaagctgacagaga

SEQ ID NO: 224485 - DNA, 15 bp, Homo sapiens
atgaagctgacagag

SEQ ID NO: 224486 - DNA, 15 bp, Homo sapiens
aatgaagctgacaga

SEQ ID NO: 224487 - DNA, 15 bp, Homo sapiens
taatgaagctgacag

SEQ ID NO: 224488 - DNA, 15 bp, Homo sapiens
gtaatgaagctgaca

SEQ ID NO: 224489 - DNA, 15 bp, Homo sapiens
ggtaatgaagctgac

SEQ ID NO: 224490 - DNA, 15 bp, Homo sapiens
tggtaatgaagctga

SEQ ID NO: 224491 - DNA, 15 bp, Homo sapiens
ctggtaatgaagctg

SEQ ID NO: 224492 - DNA, 15 bp, Homo sapiens
cctggtaatgaagct

SEQ ID NO: 224493 - DNA, 15 bp, Homo sapiens
ccctggtaatgaagc

SEQ ID NO: 224494 - DNA, 15 bp, Homo sapiens
accctggtaatgaag

SEQ ID NO: 224495 - DNA, 15 bp, Homo sapiens
aaccctggtaatgaa

SEQ ID NO: 224496 - DNA, 15 bp, Homo sapiens
aaaccctggtaatga

SEQ ID NO: 224497 - DNA, 15 bp, Homo sapiens
aaaaccctggtaatg

SEQ ID NO: 224498 - DNA, 15 bp, Homo sapiens
aaaaaccctggtaat

SEQ ID NO: 224499 - DNA, 15 bp, Homo sapiens
aaaaaaccctggtaa

SEQ ID NO: 224500 - DNA, 15 bp, Homo sapiens
aaaaaaaccctggta

SEQ ID NO: 224501 - DNA, 15 bp, Homo sapiens
caaaaaaaccctggt

SEQ ID NO: 224502 - DNA, 15 bp, Homo sapiens
acaaaaaaaccctgg

SEQ ID NO: 224503 - DNA, 15 bp, Homo sapiens
cacaaaaaaaccctg

SEQ ID NO: 224504 - DNA, 15 bp, Homo sapiens
acacaaaaaaaccct

SEQ ID NO: 224505 - DNA, 15 bp, Homo sapiens
cacacaaaaaaaccc

SEQ ID NO: 224506 - DNA, 15 bp, Homo sapiens
acacacaaaaaaacc

SEQ ID NO: 224507 - DNA, 15 bp, Homo sapiens
tacacacaaaaaaac

SEQ ID NO: 224508 - DNA, 15 bp, Homo sapiens
atacacacaaaaaaa

SEQ ID NO: 224509 - DNA, 15 bp, Homo sapiens
catacacacaaaaaa

SEQ ID NO: 224510 - DNA, 15 bp, Homo sapiens
acatacacacaaaaa

SEQ ID NO: 224511 - DNA, 15 bp, Homo sapiens
aacatacacacaaaa

SEQ ID NO: 224512 - DNA, 15 bp, Homo sapiens
caacatacacacaaa

SEQ ID NO: 224513 - DNA, 15 bp, Homo sapiens
gcaacatacacacaa

SEQ ID NO: 224514 - DNA, 15 bp, Homo sapiens
agcaacatacacaca

SEQ ID NO: 224515 - DNA, 15 bp, Homo sapiens
aagcaacatacacac

SEQ ID NO: 224516 - DNA, 15 bp, Homo sapiens
taagcaacatacaca

SEQ ID NO: 224517 - DNA, 15 bp, Homo sapiens
ctaagcaacatacac

SEQ ID NO: 224518 - DNA, 15 bp, Homo sapiens
tctaagcaacataca

SEQ ID NO: 224519 - DNA, 15 bp, Homo sapiens
atctaagcaacatac

SEQ ID NO: 224520 - DNA, 15 bp, Homo sapiens
gatctaagcaacata

SEQ ID NO: 224521 - DNA, 15 bp, Homo sapiens
ggatctaagcaacat

SEQ ID NO: 224522 - DNA, 15 bp, Homo sapiens
tggatctaagcaaca

SEQ ID NO: 224523 - DNA, 15 bp, Homo sapiens
atggatctaagcaac

SEQ ID NO: 224524 - DNA, 15 bp, Homo sapiens
tatggatctaagcaa

SEQ ID NO: 224525 - DNA, 15 bp, Homo sapiens
atatggatctaagca

SEQ ID NO: 224526 - DNA, 15 bp, Homo sapiens
aatatggatctaagc

SEQ ID NO: 224527 - DNA, 15 bp, Homo sapiens
aaatatggatctaag

SEQ ID NO: 224528 - DNA, 15 bp, Homo sapiens
aaaatatggatctaa

SEQ ID NO: 224529 - DNA, 15 bp, Homo sapiens
aaaaatatggatcta

SEQ ID NO: 224530 - DNA, 15 bp, Homo sapiens
taaaaatatggatct

SEQ ID NO: 224531 - DNA, 15 bp, Homo sapiens
ataaaaatatggatc

SEQ ID NO: 224532 - DNA, 15 bp, Homo sapiens
tataaaaatatggat

SEQ ID NO: 224533 - DNA, 15 bp, Homo sapiens
atataaaaatatgga

SEQ ID NO: 224534 - DNA, 15 bp, Homo sapiens
tatataaaaatatgg

SEQ ID NO: 224535 - DNA, 15 bp, Homo sapiens
ttatataaaaatatg

SEQ ID NO: 224536 - DNA, 15 bp, Homo sapiens
cttatataaaaatat

SEQ ID NO: 224537 - DNA, 15 bp, Homo sapiens
tcttatataaaaata

SEQ ID NO: 224538 - DNA, 15 bp, Homo sapiens
atcttatataaaaat

SEQ ID NO: 224539 - DNA, 15 bp, Homo sapiens
tatcttatataaaaa

SEQ ID NO: 224540 - DNA, 15 bp, Homo sapiens
ttatcttatataaaa

SEQ ID NO: 224541 - DNA, 15 bp, Homo sapiens
attatcttatataaa

SEQ ID NO: 224542 - DNA, 15 bp, Homo sapiens
aattatcttatataa

SEQ ID NO: 224543 - DNA, 15 bp, Homo sapiens
taattatcttatata

SEQ ID NO: 224544 - DNA, 15 bp, Homo sapiens
ataattatcttatat

SEQ ID NO: 224545 - DNA, 15 bp, Homo sapiens
aataattatcttata

SEQ ID NO: 224546 - DNA, 15 bp, Homo sapiens
gaataattatcttat

SEQ ID NO: 224547 - DNA, 15 bp, Homo sapiens
agaataattatctta

SEQ ID NO: 224548 - DNA, 15 bp, Homo sapiens
cagaataattatctt

SEQ ID NO: 224549 - DNA, 15 bp, Homo sapiens
ccagaataattatct

SEQ ID NO: 224550 - DNA, 15 bp, Homo sapiens
accagaataattatc

SEQ ID NO: 224551 - DNA, 15 bp, Homo sapiens
taccagaataattat

SEQ ID NO: 224552 - DNA, 15 bp, Homo sapiens
ataccagaataatta

SEQ ID NO: 224553 - DNA, 15 bp, Homo sapiens
aataccagaataatt

SEQ ID NO: 224554 - DNA, 15 bp, Homo sapiens
aaataccagaataat

SEQ ID NO: 224555 - DNA, 15 bp, Homo sapiens
gaaataccagaataa

SEQ ID NO: 224556 - DNA, 15 bp, Homo sapiens
agaaataccagaata

SEQ ID NO: 224557 - DNA, 15 bp, Homo sapiens
tagaaataccagaat

SEQ ID NO: 224558 - DNA, 15 bp, Homo sapiens
ctagaaataccagaa

SEQ ID NO: 224559 - DNA, 15 bp, Homo sapiens
tctagaaataccaga

SEQ ID NO: 224560 - DNA, 15 bp, Homo sapiens
atctagaaataccag

SEQ ID NO: 224561 - DNA, 15 bp, Homo sapiens
aatctagaaatacca

SEQ ID NO: 224562 - DNA, 15 bp, Homo sapiens
aaatctagaaatacc

SEQ ID NO: 224563 - DNA, 15 bp, Homo sapiens
aaaatctagaaatac

SEQ ID NO: 224564 - DNA, 15 bp, Homo sapiens
aaaaatctagaaata

SEQ ID NO: 224565 - DNA, 15 bp, Homo sapiens
aaaaaatctagaaat

SEQ ID NO: 224566 - DNA, 15 bp, Homo sapiens
gaaaaaatctagaaa

SEQ ID NO: 224567 - DNA, 15 bp, Homo sapiens
tgaaaaaatctagaa

SEQ ID NO: 224568 - DNA, 15 bp, Homo sapiens
atgaaaaaatctaga

SEQ ID NO: 224569 - DNA, 15 bp, Homo sapiens
aatgaaaaaatctag

SEQ ID NO: 224570 - DNA, 15 bp, Homo sapiens
gaatgaaaaaatcta

SEQ ID NO: 224571 - DNA, 15 bp, Homo sapiens
agaatgaaaaaatct

SEQ ID NO: 224572 - DNA, 15 bp, Homo sapiens
aagaatgaaaaaatc

SEQ ID NO: 224573 - DNA, 15 bp, Homo sapiens
taagaatgaaaaaat

SEQ ID NO: 224574 - DNA, 15 bp, Homo sapiens
gtaagaatgaaaaaa

SEQ ID NO: 224575 - DNA, 15 bp, Homo sapiens
ggtaagaatgaaaaa

SEQ ID NO: 224576 - DNA, 15 bp, Homo sapiens
aggtaagaatgaaaa

SEQ ID NO: 224577 - DNA, 15 bp, Homo sapiens
aaggtaagaatgaaa

SEQ ID NO: 224578 - DNA, 15 bp, Homo sapiens
aaaggtaagaatgaa

SEQ ID NO: 224579 - DNA, 15 bp, Homo sapiens
aaaaggtaagaatga

SEQ ID NO: 224580 - DNA, 15 bp, Homo sapiens
taaaaggtaagaatg

SEQ ID NO: 224581 - DNA, 15 bp, Homo sapiens
ataaaaggtaagaat

SEQ ID NO: 224582 - DNA, 15 bp, Homo sapiens
aataaaaggtaagaa

SEQ ID NO: 224583 - DNA, 15 bp, Homo sapiens
caataaaaggtaaga

SEQ ID NO: 224584 - DNA, 15 bp, Homo sapiens
tcaataaaaggtaag

SEQ ID NO: 224585 - DNA, 15 bp, Homo sapiens
gtcaataaaaggtaa

SEQ ID NO: 224586 - DNA, 15 bp, Homo sapiens
agtcaataaaaggta

SEQ ID NO: 224587 - DNA, 15 bp, Homo sapiens
tagtcaataaaaggt

SEQ ID NO: 224588 - DNA, 15 bp, Homo sapiens
atagtcaataaaagg

SEQ ID NO: 224589 - DNA, 15 bp, Homo sapiens
catagtcaataaaag

SEQ ID NO: 224590 - DNA, 15 bp, Homo sapiens
ccatagtcaataaaa

SEQ ID NO: 224591 - DNA, 15 bp, Homo sapiens
tccatagtcaataaa

SEQ ID NO: 224592 - DNA, 15 bp, Homo sapiens
ttccatagtcaataa

SEQ ID NO: 224593 - DNA, 15 bp, Homo sapiens
cttccatagtcaata

SEQ ID NO: 224594 - DNA, 15 bp, Homo sapiens
tcttccatagtcaat

SEQ ID NO: 224595 - DNA, 15 bp, Homo sapiens
ttcttccatagtcaa

SEQ ID NO: 224596 - DNA, 15 bp, Homo sapiens
tttcttccatagtca

SEQ ID NO: 224597 - DNA, 15 bp, Homo sapiens
ttttcttccatagtc

SEQ ID NO: 224598 - DNA, 15 bp, Homo sapiens
cttttcttccatagt

SEQ ID NO: 224599 - DNA, 15 bp, Homo sapiens
ccttttcttccatag

SEQ ID NO: 224600 - DNA, 15 bp, Homo sapiens
tccttttcttccata

SEQ ID NO: 224601 - DNA, 15 bp, Homo sapiens
atccttttcttccat

SEQ ID NO: 224602 - DNA, 15 bp, Homo sapiens
gatccttttcttcca

SEQ ID NO: 224603 - DNA, 15 bp, Homo sapiens
agatccttttcttcc

SEQ ID NO: 224604 - DNA, 15 bp, Homo sapiens
tagatccttttcttc

SEQ ID NO: 224605 - DNA, 15 bp, Homo sapiens
ctagatccttttctt

SEQ ID NO: 224606 - DNA, 15 bp, Homo sapiens
gctagatccttttct

SEQ ID NO: 224607 - DNA, 15 bp, Homo sapiens
ggctagatccttttc

SEQ ID NO: 224608 - DNA, 15 bp, Homo sapiens
aggctagatcctttt

SEQ ID NO: 224609 - DNA, 15 bp, Homo sapiens
caggctagatccttt

SEQ ID NO: 224610 - DNA, 15 bp, Homo sapiens
gcaggctagatcctt

SEQ ID NO: 224611 - DNA, 15 bp, Homo sapiens
tgcaggctagatcct

SEQ ID NO: 224612 - DNA, 15 bp, Homo sapiens
ttgcaggctagatcc

SEQ ID NO: 224613 - DNA, 15 bp, Homo sapiens
tttgcaggctagatc

SEQ ID NO: 224614 - DNA, 15 bp, Homo sapiens
atttgcaggctagat

SEQ ID NO: 224615 - DNA, 15 bp, Homo sapiens
tatttgcaggctaga

SEQ ID NO: 224616 - DNA, 15 bp, Homo sapiens
gtatttgcaggctag

SEQ ID NO: 224617 - DNA, 15 bp, Homo sapiens
agtatttgcaggcta

SEQ ID NO: 224618 - DNA, 15 bp, Homo sapiens
cagtatttgcaggct

SEQ ID NO: 224619 - DNA, 15 bp, Homo sapiens
acagtatttgcaggc

SEQ ID NO: 224620 - DNA, 15 bp, Homo sapiens
tacagtatttgcagg

SEQ ID NO: 224621 - DNA, 15 bp, Homo sapiens
ctacagtatttgcag

SEQ ID NO: 224622 - DNA, 15 bp, Homo sapiens
gctacagtatttgca

SEQ ID NO: 224623 - DNA, 15 bp, Homo sapiens
tgctacagtatttgc

SEQ ID NO: 224624 - DNA, 15 bp, Homo sapiens
atgctacagtatttg

SEQ ID NO: 224625 - DNA, 15 bp, Homo sapiens
gatgctacagtattt

SEQ ID NO: 224626 - DNA, 15 bp, Homo sapiens
agatgctacagtatt

SEQ ID NO: 224627 - DNA, 15 bp, Homo sapiens
gagatgctacagtat

SEQ ID NO: 224628 - DNA, 15 bp, Homo sapiens
tgagatgctacagta

SEQ ID NO: 224629 - DNA, 15 bp, Homo sapiens
ttgagatgctacagt

SEQ ID NO: 224630 - DNA, 15 bp, Homo sapiens
gttgagatgctacag

SEQ ID NO: 224631 - DNA, 15 bp, Homo sapiens
tgttgagatgctaca

SEQ ID NO: 224632 - DNA, 15 bp, Homo sapiens
atgttgagatgctac

SEQ ID NO: 224633 - DNA, 15 bp, Homo sapiens
tatgttgagatgcta

SEQ ID NO: 224634 - DNA, 15 bp, Homo sapiens
ctatgttgagatgct

SEQ ID NO: 224635 - DNA, 15 bp, Homo sapiens
actatgttgagatgc

SEQ ID NO: 224636 - DNA, 15 bp, Homo sapiens
cactatgttgagatg

SEQ ID NO: 224637 - DNA, 15 bp, Homo sapiens
tcactatgttgagat

SEQ ID NO: 224638 - DNA, 15 bp, Homo sapiens
atcactatgttgaga

SEQ ID NO: 224639 - DNA, 15 bp, Homo sapiens
catcactatgttgag

SEQ ID NO: 224640 - DNA, 15 bp, Homo sapiens
acatcactatgttga

SEQ ID NO: 224641 - DNA, 15 bp, Homo sapiens
gacatcactatgttg

SEQ ID NO: 224642 - DNA, 15 bp, Homo sapiens
tgacatcactatgtt

SEQ ID NO: 224643 - DNA, 15 bp, Homo sapiens
ttgacatcactatgt

SEQ ID NO: 224644 - DNA, 15 bp, Homo sapiens
tttgacatcactatg

SEQ ID NO: 224645 - DNA, 15 bp, Homo sapiens
atttgacatcactat

SEQ ID NO: 224646 - DNA, 15 bp, Homo sapiens
tatttgacatcacta

SEQ ID NO: 224647 - DNA, 15 bp, Homo sapiens
gtatttgacatcact

SEQ ID NO: 224648 - DNA, 15 bp, Homo sapiens
agtatttgacatcac

SEQ ID NO: 224649 - DNA, 15 bp, Homo sapiens
tagtatttgacatca

SEQ ID NO: 224650 - DNA, 15 bp, Homo sapiens
gtagtatttgacatc

SEQ ID NO: 224651 - DNA, 15 bp, Homo sapiens
agtagtatttgacat

SEQ ID NO: 224652 - DNA, 15 bp, Homo sapiens
tagtagtatttgaca

SEQ ID NO: 224653 - DNA, 15 bp, Homo sapiens
ttagtagtatttgac

SEQ ID NO: 224654 - DNA, 15 bp, Homo sapiens
tttagtagtatttga

SEQ ID NO: 224655 - DNA, 15 bp, Homo sapiens
ttttagtagtatttg

SEQ ID NO: 224656 - DNA, 15 bp, Homo sapiens
tttttagtagtattt

SEQ ID NO: 224657 - DNA, 15 bp, Homo sapiens
atttttagtagtatt

SEQ ID NO: 224658 - DNA, 15 bp, Homo sapiens
aatttttagtagtat

SEQ ID NO: 224659 - DNA, 15 bp, Homo sapiens
aaatttttagtagta

SEQ ID NO: 224660 - DNA, 15 bp, Homo sapiens
taaatttttagtagt

SEQ ID NO: 224661 - DNA, 15 bp, Homo sapiens
ctaaatttttagtag

SEQ ID NO: 224662 - DNA, 15 bp, Homo sapiens
actaaatttttagta

SEQ ID NO: 224663 - DNA, 15 bp, Homo sapiens
aactaaatttttagt

SEQ ID NO: 224664 - DNA, 15 bp, Homo sapiens
caactaaatttttag

SEQ ID NO: 224665 - DNA, 15 bp, Homo sapiens
acaactaaattttta

SEQ ID NO: 224666 - DNA, 15 bp, Homo sapiens
gacaactaaattttt

SEQ ID NO: 224667 - DNA, 15 bp, Homo sapiens
agacaactaaatttt

SEQ ID NO: 224668 - DNA, 15 bp, Homo sapiens
aagacaactaaattt

SEQ ID NO: 224669 - DNA, 15 bp, Homo sapiens
gaagacaactaaatt

SEQ ID NO: 224670 - DNA, 15 bp, Homo sapiens
tgaagacaactaaat

SEQ ID NO: 224671 - DNA, 15 bp, Homo sapiens
ttgaagacaactaaa

SEQ ID NO: 224672 - DNA, 15 bp, Homo sapiens
tttgaagacaactaa

SEQ ID NO: 224673 - DNA, 15 bp, Homo sapiens
ttttgaagacaacta

SEQ ID NO: 224674 - DNA, 15 bp, Homo sapiens
cttttgaagacaact

SEQ ID NO: 224675 - DNA, 15 bp, Homo sapiens
ccttttgaagacaac

SEQ ID NO: 224676 - DNA, 15 bp, Homo sapiens
tccttttgaagacaa

SEQ ID NO: 224677 - DNA, 15 bp, Homo sapiens
ttccttttgaagaca

SEQ ID NO: 224678 - DNA, 15 bp, Homo sapiens
tttccttttgaagac

SEQ ID NO: 224679 - DNA, 15 bp, Homo sapiens
ctttccttttgaaga

SEQ ID NO: 224680 - DNA, 15 bp, Homo sapiens
tctttccttttgaag

SEQ ID NO: 224681 - DNA, 15 bp, Homo sapiens
atctttccttttgaa

SEQ ID NO: 224682 - DNA, 15 bp, Homo sapiens
aatctttccttttga

SEQ ID NO: 224683 - DNA, 15 bp, Homo sapiens
aaatctttccttttg

SEQ ID NO: 224684 - DNA, 15 bp, Homo sapiens
aaaatctttcctttt

SEQ ID NO: 224685 - DNA, 15 bp, Homo sapiens
taaaatctttccttt

SEQ ID NO: 224686 - DNA, 15 bp, Homo sapiens
ataaaatctttcctt

SEQ ID NO: 224687 - DNA, 15 bp, Homo sapiens
aataaaatctttcct

SEQ ID NO: 224688 - DNA, 15 bp, Homo sapiens
gaataaaatctttcc

SEQ ID NO: 224689 - DNA, 15 bp, Homo sapiens
tgaataaaatctttc

SEQ ID NO: 224690 - DNA, 15 bp, Homo sapiens
atgaataaaatcttt

SEQ ID NO: 224691 - DNA, 15 bp, Homo sapiens
aatgaataaaatctt

SEQ ID NO: 224692 - DNA, 15 bp, Homo sapiens
gaatgaataaaatct

SEQ ID NO: 224693 - DNA, 15 bp, Homo sapiens
agaatgaataaaatc

SEQ ID NO: 224694 - DNA, 15 bp, Homo sapiens
tagaatgaataaaat

SEQ ID NO: 224695 - DNA, 15 bp, Homo sapiens
ttagaatgaataaaa

SEQ ID NO: 224696 - DNA, 15 bp, Homo sapiens
gttagaatgaataaa

SEQ ID NO: 224697 - DNA, 15 bp, Homo sapiens
tgttagaatgaataa

SEQ ID NO: 224698 - DNA, 15 bp, Homo sapiens
atgttagaatgaata

SEQ ID NO: 224699 - DNA, 15 bp, Homo sapiens
tatgttagaatgaat

SEQ ID NO: 224700 - DNA, 15 bp, Homo sapiens
atatgttagaatgaa

SEQ ID NO: 224701 - DNA, 15 bp, Homo sapiens
tatatgttagaatga

SEQ ID NO: 224702 - DNA, 15 bp, Homo sapiens
ttatatgttagaatg

SEQ ID NO: 224703 - DNA, 15 bp, Homo sapiens
attatatgttagaat

SEQ ID NO: 224704 - DNA, 15 bp, Homo sapiens
cattatatgttagaa

SEQ ID NO: 224705 - DNA, 15 bp, Homo sapiens
tcattatatgttaga

SEQ ID NO: 224706 - DNA, 15 bp, Homo sapiens
ttcattatatgttag

SEQ ID NO: 224707 - DNA, 15 bp, Homo sapiens
tttcattatatgtta

SEQ ID NO: 224708 - DNA, 15 bp, Homo sapiens
ctttcattatatgtt

SEQ ID NO: 224709 - DNA, 15 bp, Homo sapiens
actttcattatatgt

SEQ ID NO: 224710 - DNA, 15 bp, Homo sapiens
aactttcattatatg

SEQ ID NO: 224711 - DNA, 15 bp, Homo sapiens
gaactttcattatat

SEQ ID NO: 224712 - DNA, 15 bp, Homo sapiens
tgaactttcattata

SEQ ID NO: 224713 - DNA, 15 bp, Homo sapiens
ctgaactttcattat

SEQ ID NO: 224714 - DNA, 15 bp, Homo sapiens
actgaactttcatta

SEQ ID NO: 224715 - DNA, 15 bp, Homo sapiens
tactgaactttcatt

SEQ ID NO: 224716 - DNA, 15 bp, Homo sapiens
atactgaactttcat

SEQ ID NO: 224717 - DNA, 15 bp, Homo sapiens
aatactgaactttca

SEQ ID NO: 224718 - DNA, 15 bp, Homo sapiens
aaatactgaactttc

SEQ ID NO: 224719 - DNA, 15 bp, Homo sapiens
aaaatactgaacttt

SEQ ID NO: 224720 - DNA, 15 bp, Homo sapiens
taaaatactgaactt

SEQ ID NO: 224721 - DNA, 15 bp, Homo sapiens
ctaaaatactgaact

SEQ ID NO: 224722 - DNA, 15 bp, Homo sapiens
tctaaaatactgaac

SEQ ID NO: 224723 - DNA, 15 bp, Homo sapiens
ttctaaaatactgaa

SEQ ID NO: 224724 - DNA, 15 bp, Homo sapiens
tttctaaaatactga

SEQ ID NO: 224725 - DNA, 15 bp, Homo sapiens
ttttctaaaatactg

SEQ ID NO: 224726 - DNA, 15 bp, Homo sapiens
attttctaaaatact

SEQ ID NO: 224727 - DNA, 15 bp, Homo sapiens
tattttctaaaatac

SEQ ID NO: 224728 - DNA, 15 bp, Homo sapiens
ttattttctaaaata

SEQ ID NO: 224729 - DNA, 15 bp, Homo sapiens
cttttattttctaaa

SEQ ID NO: 224730 - DNA, 15 bp, Homo sapiens
acttttattttctaa

SEQ ID NO: 224731 - DNA, 15 bp, Homo sapiens
gacttttattttcta

SEQ ID NO: 224732 - DNA, 15 bp, Homo sapiens
agacttttattttct

SEQ ID NO: 224733 - DNA, 15 bp, Homo sapiens
cagacttttattttc

SEQ ID NO: 224734 - DNA, 15 bp, Homo sapiens
tcagacttttatttt

SEQ ID NO: 224735 - DNA, 15 bp, Homo sapiens
gtcagacttttattt

SEQ ID NO: 224736 - DNA, 15 bp, Homo sapiens
agtcagacttttatt

SEQ ID NO: 224737 - DNA, 15 bp, Homo sapiens
aagtcagacttttat

SEQ ID NO: 224738 - DNA, 15 bp, Homo sapiens
aaagtcagactttta

SEQ ID NO: 224739 - DNA, 15 bp, Homo sapiens
aaaagtcagactttt

SEQ ID NO: 224740 - DNA, 15 bp, Homo sapiens
gaaaagtcagacttt

SEQ ID NO: 224741 - DNA, 15 bp, Homo sapiens
tgaaaagtcagactt

SEQ ID NO: 224742 - DNA, 15 bp, Homo sapiens
atgaaaagtcagact

SEQ ID NO: 224743 - DNA, 15 bp, Homo sapiens
tatgaaaagtcagac

SEQ ID NO: 224744 - DNA, 15 bp, Homo sapiens
ttatgaaaagtcaga

SEQ ID NO: 224745 - DNA, 15 bp, Homo sapiens
attatgaaaagtcag

SEQ ID NO: 224746 - DNA, 15 bp, Homo sapiens
ctattatgaaaagtc

SEQ ID NO: 224747 - DNA, 15 bp, Homo sapiens
cctattatgaaaagt

SEQ ID NO: 224748 - DNA, 15 bp, Homo sapiens
acctattatgaaaag

SEQ ID NO: 224749 - DNA, 15 bp, Homo sapiens
aacctattatgaaaa

SEQ ID NO: 224750 - DNA, 15 bp, Homo sapiens
caacctattatgaaa

SEQ ID NO: 224751 - DNA, 15 bp, Homo sapiens
gcaacctattatgaa

SEQ ID NO: 224752 - DNA, 15 bp, Homo sapiens
ggcaacctattatga

SEQ ID NO: 224753 - DNA, 15 bp, Homo sapiens
tggcaacctattatg

SEQ ID NO: 224754 - DNA, 15 bp, Homo sapiens
ctggcaacctattat

SEQ ID NO: 224755 - DNA, 15 bp, Homo sapiens
cctggcaacctatta

SEQ ID NO: 224756 - DNA, 15 bp, Homo sapiens
ccctggcaacctatt

SEQ ID NO: 224757 - DNA, 15 bp, Homo sapiens
tccctggcaacctat

SEQ ID NO: 224758 - DNA, 15 bp, Homo sapiens
ttccctggcaaccta

SEQ ID NO: 224759 - DNA, 15 bp, Homo sapiens
gttccctggcaacct

SEQ ID NO: 224760 - DNA, 15 bp, Homo sapiens
agttccctggcaacc

SEQ ID NO: 224761 - DNA, 15 bp, Homo sapiens
tagttccctggcaac

SEQ ID NO: 224762 - DNA, 15 bp, Homo sapiens
gtagttccctggcaa

SEQ ID NO: 224763 - DNA, 15 bp, Homo sapiens
tgtagttccctggca

SEQ ID NO: 224764 - DNA, 15 bp, Homo sapiens
gtgtagttccctggc

SEQ ID NO: 224765 - DNA, 15 bp, Homo sapiens
ggtgtagttccctgg

SEQ ID NO: 224766 - DNA, 15 bp, Homo sapiens
cggtgtagttccctg

SEQ ID NO: 224767 - DNA, 15 bp, Homo sapiens
tcggtgtagttccct

SEQ ID NO: 224768 - DNA, 15 bp, Homo sapiens
ttcggtgtagttccc

SEQ ID NO: 224769 - DNA, 15 bp, Homo sapiens
cttcggtgtagttcc

SEQ ID NO: 224770 - DNA, 15 bp, Homo sapiens
ccttcggtgtagttc

SEQ ID NO: 224771 - DNA, 15 bp, Homo sapiens
gccttcggtgtagtt

SEQ ID NO: 224772 - DNA, 15 bp, Homo sapiens
tgccttcggtgtagt

SEQ ID NO: 224773 - DNA, 15 bp, Homo sapiens
ttgccttcggtgtag

SEQ ID NO: 224774 - DNA, 15 bp, Homo sapiens
tttgccttcggtgta

SEQ ID NO: 224775 - DNA, 15 bp, Homo sapiens
ttttgccttcggtgt

SEQ ID NO: 224776 - DNA, 15 bp, Homo sapiens
attttgccttcggtg

SEQ ID NO: 224777 - DNA, 15 bp, Homo sapiens
tattttgccttcggt

SEQ ID NO: 224778 - DNA, 15 bp, Homo sapiens
gtattttgccttcgg

SEQ ID NO: 224779 - DNA, 15 bp, Homo sapiens
agtattttgccttcg

SEQ ID NO: 224780 - DNA, 15 bp, Homo sapiens
tagtattttgccttc

SEQ ID NO: 224781 - DNA, 15 bp, Homo sapiens
ctagtattttgcctt

SEQ ID NO: 224782 - DNA, 15 bp, Homo sapiens
tctagtattttgcct

SEQ ID NO: 224783 - DNA, 15 bp, Homo sapiens
ctctagtattttgcc

SEQ ID NO: 224784 - DNA, 15 bp, Homo sapiens
gctctagtattttgc

SEQ ID NO: 224785 - DNA, 15 bp, Homo sapiens
ggctctagtattttg

SEQ ID NO: 224786 - DNA, 15 bp, Homo sapiens
tggctctagtatttt

SEQ ID NO: 224787 - DNA, 15 bp, Homo sapiens
ctggctctagtattt

SEQ ID NO: 224788 - DNA, 15 bp, Homo sapiens
actggctctagtatt

SEQ ID NO: 224789 - DNA, 15 bp, Homo sapiens
tactggctctagtat

SEQ ID NO: 224790 - DNA, 15 bp, Homo sapiens
ctactggctctagta

SEQ ID NO: 224791 - DNA, 15 bp, Homo sapiens
cctactggctctagt

SEQ ID NO: 224792 - DNA, 15 bp, Homo sapiens
acctactggctctag

SEQ ID NO: 224793 - DNA, 15 bp, Homo sapiens
cacctactggctcta

SEQ ID NO: 224794 - DNA, 15 bp, Homo sapiens
ccacctactggctct

SEQ ID NO: 224795 - DNA, 15 bp, Homo sapiens
accacctactggctc

SEQ ID NO: 224796 - DNA, 15 bp, Homo sapiens
aaccacctactggct

SEQ ID NO: 224797 - DNA, 15 bp, Homo sapiens
taaccacctactggc

SEQ ID NO: 224798 - DNA, 15 bp, Homo sapiens
ataaccacctactgg

SEQ ID NO: 224799 - DNA, 15 bp, Homo sapiens
cataaccacctactg

SEQ ID NO: 224800 - DNA, 15 bp, Homo sapiens
acataaccacctact

SEQ ID NO: 224801 - DNA, 15 bp, Homo sapiens
cacataaccacctac

SEQ ID NO: 224802 - DNA, 15 bp, Homo sapiens
acacataaccaccta

SEQ ID NO: 224803 - DNA, 15 bp, Homo sapiens
aacacataaccacct

SEQ ID NO: 224804 - DNA, 15 bp, Homo sapiens
aaacacataaccacc

SEQ ID NO: 224805 - DNA, 15 bp, Homo sapiens
taaacacataaccac

SEQ ID NO: 224806 - DNA, 15 bp, Homo sapiens
ttaaacacataacca

SEQ ID NO: 224807 - DNA, 15 bp, Homo sapiens
attaaacacataacc

SEQ ID NO: 224808 - DNA, 15 bp, Homo sapiens
aattaaacacataac

SEQ ID NO: 224809 - DNA, 15 bp, Homo sapiens
aaattaaacacataa

SEQ ID NO: 224810 - DNA, 15 bp, Homo sapiens
aaaattaaacacata

SEQ ID NO: 224811 - DNA, 15 bp, Homo sapiens
taaaattaaacacat

SEQ ID NO: 224812 - DNA, 15 bp, Homo sapiens
ttaaaattaaacaca

SEQ ID NO: 224813 - DNA, 15 bp, Homo sapiens
cttaaaattaaacac

SEQ ID NO: 224814 - DNA, 15 bp, Homo sapiens
tcttaaaattaaaca

SEQ ID NO: 224815 - DNA, 15 bp, Homo sapiens
ctcttaaaattaaac

SEQ ID NO: 224816 - DNA, 15 bp, Homo sapiens
cctcttaaaattaaa

SEQ ID NO: 224817 - DNA, 15 bp, Homo sapiens
tcctcttaaaattaa

SEQ ID NO: 224818 - DNA, 15 bp, Homo sapiens
atcctcttaaaatta

SEQ ID NO: 224819 - DNA, 15 bp, Homo sapiens
tatcctcttaaaatt

SEQ ID NO: 224820 - DNA, 15 bp, Homo sapiens
ttatcctcttaaaat

SEQ ID NO: 224821 - DNA, 15 bp, Homo sapiens
gttatcctcttaaaa

SEQ ID NO: 224822 - DNA, 15 bp, Homo sapiens
tgttatcctcttaaa

SEQ ID NO: 224823 - DNA, 15 bp, Homo sapiens
ttgttatcctcttaa

SEQ ID NO: 224824 - DNA, 15 bp, Homo sapiens
gttgttatcctctta

SEQ ID NO: 224825 - DNA, 15 bp, Homo sapiens
tgttgttatcctctt

SEQ ID NO: 224826 - DNA, 15 bp, Homo sapiens
atgttgttatcctct

SEQ ID NO: 224827 - DNA, 15 bp, Homo sapiens
aatgttgttatcctc

SEQ ID NO: 224828 - DNA, 15 bp, Homo sapiens
taatgttgttatcct

SEQ ID NO: 224829 - DNA, 15 bp, Homo sapiens
ttaatgttgttatcc

SEQ ID NO: 224830 - DNA, 15 bp, Homo sapiens
gttaatgttgttatc

SEQ ID NO: 224831 - DNA, 15 bp, Homo sapiens
tgttaatgttgttat

SEQ ID NO: 224832 - DNA, 15 bp, Homo sapiens
ttgttaatgttgtta

SEQ ID NO: 224833 - DNA, 15 bp, Homo sapiens
tttgttaatgttgtt

SEQ ID NO: 224834 - DNA, 15 bp, Homo sapiens
atttgttaatgttgt

SEQ ID NO: 224835 - DNA, 15 bp, Homo sapiens
aatttgttaatgttg

SEQ ID NO: 224836 - DNA, 15 bp, Homo sapiens
gaatttgttaatgtt

SEQ ID NO: 224837 - DNA, 15 bp, Homo sapiens
ggaatttgttaatgt

SEQ ID NO: 224838 - DNA, 15 bp, Homo sapiens
tggaatttgttaatg

SEQ ID NO: 224839 - DNA, 15 bp, Homo sapiens
atggaatttgttaat

SEQ ID NO: 224840 - DNA, 15 bp, Homo sapiens
aatggaatttgttaa

SEQ ID NO: 224841 - DNA, 15 bp, Homo sapiens
aaatggaatttgtta

SEQ ID NO: 224842 - DNA, 15 bp, Homo sapiens
caaatggaatttgtt

SEQ ID NO: 224843 - DNA, 15 bp, Homo sapiens
ccaaatggaatttgt

SEQ ID NO: 224844 - DNA, 15 bp, Homo sapiens
gccaaatggaatttg

SEQ ID NO: 224845 - DNA, 15 bp, Homo sapiens
tgccaaatggaattt

SEQ ID NO: 224846 - DNA, 15 bp, Homo sapiens
ttgccaaatggaatt

SEQ ID NO: 224847 - DNA, 15 bp, Homo sapiens
gttgccaaatggaat

SEQ ID NO: 224848 - DNA, 15 bp, Homo sapiens
tgttgccaaatggaa

SEQ ID NO: 224849 - DNA, 15 bp, Homo sapiens
ctgttgccaaatgga

SEQ ID NO: 224850 - DNA, 15 bp, Homo sapiens
gctgttgccaaatgg

SEQ ID NO: 224851 - DNA, 15 bp, Homo sapiens
cgctgttgccaaatg

SEQ ID NO: 224852 - DNA, 15 bp, Homo sapiens
acgctgttgccaaat

SEQ ID NO: 224853 - DNA, 15 bp, Homo sapiens
aacgctgttgccaaa

SEQ ID NO: 224854 - DNA, 15 bp, Homo sapiens
taacgctgttgccaa

SEQ ID NO: 224855 - DNA, 15 bp, Homo sapiens
ttaacgctgttgcca

SEQ ID NO: 224856 - DNA, 15 bp, Homo sapiens
tttaacgctgttgcc

SEQ ID NO: 224857 - DNA, 15 bp, Homo sapiens
ttttaacgctgttgc

SEQ ID NO: 224858 - DNA, 15 bp, Homo sapiens
attttaacgctgttg

SEQ ID NO: 224859 - DNA, 15 bp, Homo sapiens
aattttaacgctgtt

SEQ ID NO: 224860 - DNA, 15 bp, Homo sapiens
caattttaacgctgt

SEQ ID NO: 224861 - DNA, 15 bp, Homo sapiens
gcaattttaacgctg

SEQ ID NO: 224862 - DNA, 15 bp, Homo sapiens
tgcaattttaacgct

SEQ ID NO: 224863 - DNA, 15 bp, Homo sapiens
gtgcaattttaacgc

SEQ ID NO: 224864 - DNA, 15 bp, Homo sapiens
ggtgcaattttaacg

SEQ ID NO: 224865 - DNA, 15 bp, Homo sapiens
aggtgcaattttaac

SEQ ID NO: 224866 - DNA, 15 bp, Homo sapiens
caggtgcaattttaa

SEQ ID NO: 224867 - DNA, 15 bp, Homo sapiens
ccaggtgcaatttta

SEQ ID NO: 224868 - DNA, 15 bp, Homo sapiens
cccaggtgcaatttt

SEQ ID NO: 224869 - DNA, 15 bp, Homo sapiens
tcccaggtgcaattt

SEQ ID NO: 224870 - DNA, 15 bp, Homo sapiens
tttcccaggtgcaat

SEQ ID NO: 224871 - DNA, 15 bp, Homo sapiens
ttttcccaggtgcaa

SEQ ID NO: 224872 - DNA, 15 bp, Homo sapiens
attttcccaggtgca

SEQ ID NO: 224873 - DNA, 15 bp, Homo sapiens
gattttcccaggtgc

SEQ ID NO: 224874 - DNA, 15 bp, Homo sapiens
agattttcccaggtg

SEQ ID NO: 224875 - DNA, 15 bp, Homo sapiens
aagattttcccaggt

SEQ ID NO: 224876 - DNA, 15 bp, Homo sapiens
gaagattttcccagg

SEQ ID NO: 224877 - DNA, 15 bp, Homo sapiens
tgaagattttcccag

SEQ ID NO: 224878 - DNA, 15 bp, Homo sapiens
atgaagattttccca

SEQ ID NO: 224879 - DNA, 15 bp, Homo sapiens
aatgaagattttccc

SEQ ID NO: 224880 - DNA, 15 bp, Homo sapiens
taatgaagattttcc

SEQ ID NO: 224881 - DNA, 15 bp, Homo sapiens
gtaatgaagattttc

SEQ ID NO: 224882 - DNA, 15 bp, Homo sapiens
agtaatgaagatttt

SEQ ID NO: 224883 - DNA, 15 bp, Homo sapiens
gagtaatgaagattt

SEQ ID NO: 224884 - DNA, 15 bp, Homo sapiens
agagtaatgaagatt

SEQ ID NO: 224885 - DNA, 15 bp, Homo sapiens
aagagtaatgaagat

SEQ ID NO: 224886 - DNA, 15 bp, Homo sapiens
taagagtaatgaaga

SEQ ID NO: 224887 - DNA, 15 bp, Homo sapiens
gataagagtaatgaa

SEQ ID NO: 224888 - DNA, 15 bp, Homo sapiens
agataagagtaatga

SEQ ID NO: 224889 - DNA, 15 bp, Homo sapiens
aagataagagtaatg

SEQ ID NO: 224890 - DNA, 15 bp, Homo sapiens
caagataagagtaat

SEQ ID NO: 224891 - DNA, 15 bp, Homo sapiens
gcaagataagagtaa

SEQ ID NO: 224892 - DNA, 15 bp, Homo sapiens
tgcaagataagagta

SEQ ID NO: 224893 - DNA, 15 bp, Homo sapiens
ctgcaagataagagt

SEQ ID NO: 224894 - DNA, 15 bp, Homo sapiens
gctgcaagataagag

SEQ ID NO: 224895 - DNA, 15 bp, Homo sapiens
tgctgcaagataaga

SEQ ID NO: 224896 - DNA, 15 bp, Homo sapiens
ctgctgcaagataag

SEQ ID NO: 224897 - DNA, 15 bp, Homo sapiens
actgctgcaagataa

SEQ ID NO: 224898 - DNA, 15 bp, Homo sapiens
gactgctgcaagata

SEQ ID NO: 224899 - DNA, 15 bp, Homo sapiens
tgactgctgcaagat

SEQ ID NO: 224900 - DNA, 15 bp, Homo sapiens
gtgactgctgcaaga

SEQ ID NO: 224901 - DNA, 15 bp, Homo sapiens
agtgactgctgcaag

SEQ ID NO: 224902 - DNA, 15 bp, Homo sapiens
cagtgactgctgcaa

SEQ ID NO: 224903 - DNA, 15 bp, Homo sapiens
tcagtgactgctgca

SEQ ID NO: 224904 - DNA, 15 bp, Homo sapiens
ttcagtgactgctgc

SEQ ID NO: 224905 - DNA, 15 bp, Homo sapiens
cttcagtgactgctg

SEQ ID NO: 224906 - DNA, 15 bp, Homo sapiens
ccttcagtgactgct

SEQ ID NO: 224907 - DNA, 15 bp, Homo sapiens
tccttcagtgactgc

SEQ ID NO: 224908 - DNA, 15 bp, Homo sapiens
ctccttcagtgactg

SEQ ID NO: 224909 - DNA, 15 bp, Homo sapiens
actccttcagtgact

SEQ ID NO: 224910 - DNA, 15 bp, Homo sapiens
aactccttcagtgac

SEQ ID NO: 224911 - DNA, 15 bp, Homo sapiens
aaactccttcagtga

SEQ ID NO: 224912 - DNA, 15 bp, Homo sapiens
caaactccttcagtg

SEQ ID NO: 224913 - DNA, 15 bp, Homo sapiens
ccaaactccttcagt

SEQ ID NO: 224914 - DNA, 15 bp, Homo sapiens
accaaactccttcag

SEQ ID NO: 224915 - DNA, 15 bp, Homo sapiens
acaaccaaactcctt

SEQ ID NO: 224916 - DNA, 15 bp, Homo sapiens
aacaaccaaactcct

SEQ ID NO: 224917 - DNA, 15 bp, Homo sapiens
aaacaaccaaactcc

SEQ ID NO: 224918 - DNA, 15 bp, Homo sapiens
aaaacaaccaaactc

SEQ ID NO: 224919 - DNA, 15 bp, Homo sapiens
aaaaacaaccaaact

SEQ ID NO: 224920 - DNA, 15 bp, Homo sapiens
taaaaacaaccaaac

SEQ ID NO: 224921 - DNA, 15 bp, Homo sapiens
ataaaaacaaccaaa

SEQ ID NO: 224922 - DNA, 15 bp, Homo sapiens
tataaaaacaaccaa

SEQ ID NO: 224923 - DNA, 15 bp, Homo sapiens
ctataaaaacaacca

SEQ ID NO: 224924 - DNA, 15 bp, Homo sapiens
cctataaaaacaacc

SEQ ID NO: 224925 - DNA, 15 bp, Homo sapiens
acctataaaaacaac

SEQ ID NO: 224926 - DNA, 15 bp, Homo sapiens
cacctataaaaacaa

SEQ ID NO: 224927 - DNA, 15 bp, Homo sapiens
gcacctataaaaaca

SEQ ID NO: 224928 - DNA, 15 bp, Homo sapiens
tgcacctataaaaac

SEQ ID NO: 224929 - DNA, 15 bp, Homo sapiens
ctgcacctataaaaa

SEQ ID NO: 224930 - DNA, 15 bp, Homo sapiens
cctgcacctataaaa

SEQ ID NO: 224931 - DNA, 15 bp, Homo sapiens
ccctgcacctataaa

SEQ ID NO: 224932 - DNA, 15 bp, Homo sapiens
cccctgcacctataa

SEQ ID NO: 224933 - DNA, 15 bp, Homo sapiens
acccctgcacctata

SEQ ID NO: 224934 - DNA, 15 bp, Homo sapiens
cacccctgcacctat

SEQ ID NO: 224935 - DNA, 15 bp, Homo sapiens
tcacccctgcaccta

SEQ ID NO: 224936 - DNA, 15 bp, Homo sapiens
ttcacccctgcacct

SEQ ID NO: 224937 - DNA, 15 bp, Homo sapiens
tttcacccctgcacc

SEQ ID NO: 224938 - DNA, 15 bp, Homo sapiens
ctttcacccctgcac

SEQ ID NO: 224939 - DNA, 15 bp, Homo sapiens
actttcacccctgca

SEQ ID NO: 224940 - DNA, 15 bp, Homo sapiens
aactttcacccctgc

SEQ ID NO: 224941 - DNA, 15 bp, Homo sapiens
aaactttcacccctg

SEQ ID NO: 224942 - DNA, 15 bp, Homo sapiens
taaactttcacccct

SEQ ID NO: 224943 - DNA, 15 bp, Homo sapiens
ctaaactttcacccc

SEQ ID NO: 224944 - DNA, 15 bp, Homo sapiens
gctaaactttcaccc

SEQ ID NO: 224945 - DNA, 15 bp, Homo sapiens
agctaaactttcacc

SEQ ID NO: 224946 - DNA, 15 bp, Homo sapiens
gagctaaactttcac

SEQ ID NO: 224947 - DNA, 15 bp, Homo sapiens
ggagctaaactttca

SEQ ID NO: 224948 - DNA, 15 bp, Homo sapiens
tggagctaaactttc

SEQ ID NO: 224949 - DNA, 15 bp, Homo sapiens
gtggagctaaacttt

SEQ ID NO: 224950 - DNA, 15 bp, Homo sapiens
agtggagctaaactt

SEQ ID NO: 224951 - DNA, 15 bp, Homo sapiens
aagtggagctaaact

SEQ ID NO: 224952 - DNA, 15 bp, Homo sapiens
gaagtggagctaaac

SEQ ID NO: 224953 - DNA, 15 bp, Homo sapiens
tgaagtggagctaaa

SEQ ID NO: 224954 - DNA, 15 bp, Homo sapiens
ttgaagtggagctaa

SEQ ID NO: 224955 - DNA, 15 bp, Homo sapiens
cttgaagtggagcta

SEQ ID NO: 224956 - DNA, 15 bp, Homo sapiens
ccttgaagtggagct

SEQ ID NO: 224957 - DNA, 15 bp, Homo sapiens
tccttgaagtggagc

SEQ ID NO: 224958 - DNA, 15 bp, Homo sapiens
ttccttgaagtggag

SEQ ID NO: 224959 - DNA, 15 bp, Homo sapiens
gttccttgaagtgga

SEQ ID NO: 224960 - DNA, 15 bp, Homo sapiens
tgttccttgaagtgg

SEQ ID NO: 224961 - DNA, 15 bp, Homo sapiens
ttgttccttgaagtg

SEQ ID NO: 224962 - DNA, 15 bp, Homo sapiens
tttgttccttgaagt

SEQ ID NO: 224963 - DNA, 15 bp, Homo sapiens
ctttgttccttgaag

SEQ ID NO: 224964 - DNA, 15 bp, Homo sapiens
cctttgttccttgaa

SEQ ID NO: 224965 - DNA, 15 bp, Homo sapiens
acctttgttccttga

SEQ ID NO: 224966 - DNA, 15 bp, Homo sapiens
cacctttgttccttg

SEQ ID NO: 224967 - DNA, 15 bp, Homo sapiens
gcacctttgttcctt

SEQ ID NO: 224968 - DNA, 15 bp, Homo sapiens
agcacctttgttcct

SEQ ID NO: 224969 - DNA, 15 bp, Homo sapiens
tagcacctttgttcc

SEQ ID NO: 224970 - DNA, 15 bp, Homo sapiens
ttagcacctttgttc

SEQ ID NO: 224971 - DNA, 15 bp, Homo sapiens
tttagcacctttgtt

SEQ ID NO: 224972 - DNA, 15 bp, Homo sapiens
ctttagcacctttgt

SEQ ID NO: 224973 - DNA, 15 bp, Homo sapiens
tctttagcacctttg

SEQ ID NO: 224974 - DNA, 15 bp, Homo sapiens
ctctttagcaccttt

SEQ ID NO: 224975 - DNA, 15 bp, Homo sapiens
tctctttagcacctt

SEQ ID NO: 224976 - DNA, 15 bp, Homo sapiens
ttctctttagcacct

SEQ ID NO: 224977 - DNA, 15 bp, Homo sapiens
tttctctttagcacc

SEQ ID NO: 224978 - DNA, 15 bp, Homo sapiens
gtttctctttagcac

SEQ ID NO: 224979 - DNA, 15 bp, Homo sapiens
agtttctctttagca

SEQ ID NO: 224980 - DNA, 15 bp, Homo sapiens
tagtttctctttagc

SEQ ID NO: 224981 - DNA, 15 bp, Homo sapiens
atagtttctctttag

SEQ ID NO: 224982 - DNA, 15 bp, Homo sapiens
aatagtttctcttta

SEQ ID NO: 224983 - DNA, 15 bp, Homo sapiens
gaatagtttctcttt

SEQ ID NO: 224984 - DNA, 15 bp, Homo sapiens
agaatagtttctctt

SEQ ID NO: 224985 - DNA, 15 bp, Homo sapiens
cagaatagtttctct

SEQ ID NO: 224986 - DNA, 15 bp, Homo sapiens
tcagaatagtttctc

SEQ ID NO: 224987 - DNA, 15 bp, Homo sapiens
ctcagaatagtttct

SEQ ID NO: 224988 - DNA, 15 bp, Homo sapiens
tctcagaatagtttc

SEQ ID NO: 224989 - DNA, 15 bp, Homo sapiens
ttctcagaatagttt

SEQ ID NO: 224990 - DNA, 15 bp, Homo sapiens
attctcagaatagtt

SEQ ID NO: 224991 - DNA, 15 bp, Homo sapiens
gattctcagaatagt

SEQ ID NO: 224992 - DNA, 15 bp, Homo sapiens
tgattctcagaatag

SEQ ID NO: 224993 - DNA, 15 bp, Homo sapiens
atgattctcagaata

SEQ ID NO: 224994 - DNA, 15 bp, Homo sapiens
tatgattctcagaat

SEQ ID NO: 224995 - DNA, 15 bp, Homo sapiens
ctatgattctcagaa

SEQ ID NO: 224996 - DNA, 15 bp, Homo sapiens
tctatgattctcaga

SEQ ID NO: 224997 - DNA, 15 bp, Homo sapiens
atctatgattctcag

SEQ ID NO: 224998 - DNA, 15 bp, Homo sapiens
aatctatgattctca

SEQ ID NO: 224999 - DNA, 15 bp, Homo sapiens
aaatctatgattctc

SEQ ID NO: 225000 - DNA, 15 bp, Homo sapiens
caaatctatgattct

SEQ ID NO: 225001 - DNA, 15 bp, Homo sapiens
gcaaatctatgattc

SEQ ID NO: 225002 - DNA, 15 bp, Homo sapiens
tgcaaatctatgatt

SEQ ID NO: 225003 - DNA, 15 bp, Homo sapiens
atgcaaatctatgat

SEQ ID NO: 225004 - DNA, 15 bp, Homo sapiens
catgcaaatctatga

SEQ ID NO: 225005 - DNA, 15 bp, Homo sapiens
tcatgcaaatctatg

SEQ ID NO: 225006 - DNA, 15 bp, Homo sapiens
ttcatgcaaatctat

SEQ ID NO: 225007 - DNA, 15 bp, Homo sapiens
tttcatgcaaatcta

SEQ ID NO: 225008 - DNA, 15 bp, Homo sapiens
ttttcatgcaaatct

SEQ ID NO: 225009 - DNA, 15 bp, Homo sapiens
tttttcatgcaaatc

SEQ ID NO: 225010 - DNA, 15 bp, Homo sapiens
gtttttcatgcaaat

SEQ ID NO: 225011 - DNA, 15 bp, Homo sapiens
ggtttttcatgcaaa

SEQ ID NO: 225012 - DNA, 15 bp, Homo sapiens
aggtttttcatgcaa

SEQ ID NO: 225013 - DNA, 15 bp, Homo sapiens
gaggtttttcatgca

SEQ ID NO: 225014 - DNA, 15 bp, Homo sapiens
tgaggtttttcatgc

SEQ ID NO: 225015 - DNA, 15 bp, Homo sapiens
gtgaggtttttcatg

SEQ ID NO: 225016 - DNA, 15 bp, Homo sapiens
tgtgaggtttttcat

SEQ ID NO: 225017 - DNA, 15 bp, Homo sapiens
ttgtgaggtttttca

SEQ ID NO: 225018 - DNA, 15 bp, Homo sapiens
tttgtgaggtttttc

SEQ ID NO: 225019 - DNA, 15 bp, Homo sapiens
ttttgtgaggttttt

SEQ ID NO: 225020 - DNA, 15 bp, Homo sapiens
cttttgtgaggtttt

SEQ ID NO: 225021 - DNA, 15 bp, Homo sapiens
tcttttgtgaggttt

SEQ ID NO: 225022 - DNA, 15 bp, Homo sapiens
ttcttttgtgaggtt

SEQ ID NO: 225023 - DNA, 15 bp, Homo sapiens
tttcttttgtgaggt

SEQ ID NO: 225024 - DNA, 15 bp, Homo sapiens
ttttcttttgtgagg

SEQ ID NO: 225025 - DNA, 15 bp, Homo sapiens
tttttcttttgtgag

SEQ ID NO: 225026 - DNA, 15 bp, Homo sapiens
atttttcttttgtga

SEQ ID NO: 225027 - DNA, 15 bp, Homo sapiens
tatttttcttttgtg

SEQ ID NO: 225028 - DNA, 15 bp, Homo sapiens
ctatttttcttttgt

SEQ ID NO: 225029 - DNA, 15 bp, Homo sapiens
actatttttcttttg

SEQ ID NO: 225030 - DNA, 15 bp, Homo sapiens
tactatttttctttt

SEQ ID NO: 225031 - DNA, 15 bp, Homo sapiens
ttactatttttcttt

SEQ ID NO: 225032 - DNA, 15 bp, Homo sapiens
caattactatttttc

SEQ ID NO: 225033 - DNA, 15 bp, Homo sapiens
gcaattactattttt

SEQ ID NO: 225034 - DNA, 15 bp, Homo sapiens
ggcaattactatttt

SEQ ID NO: 225035 - DNA, 15 bp, Homo sapiens
aggcaattactattt

SEQ ID NO: 225036 - DNA, 15 bp, Homo sapiens
gaggcaattactatt

SEQ ID NO: 225037 - DNA, 15 bp, Homo sapiens
tgaggcaattactat

SEQ ID NO: 225038 - DNA, 15 bp, Homo sapiens
ctgaggcaattacta

SEQ ID NO: 225039 - DNA, 15 bp, Homo sapiens
gctgaggcaattact

SEQ ID NO: 225040 - DNA, 15 bp, Homo sapiens
tgctgaggcaattac

SEQ ID NO: 225041 - DNA, 15 bp, Homo sapiens
atgctgaggcaatta

SEQ ID NO: 225042 - DNA, 15 bp, Homo sapiens
catgctgaggcaatt

SEQ ID NO: 225043 - DNA, 15 bp, Homo sapiens
tcatgctgaggcaat

SEQ ID NO: 225044 - DNA, 15 bp, Homo sapiens
ctcatgctgaggcaa

SEQ ID NO: 225045 - DNA, 15 bp, Homo sapiens
tctcatgctgaggca

SEQ ID NO: 225046 - DNA, 15 bp, Homo sapiens
ctctcatgctgaggc

SEQ ID NO: 225047 - DNA, 15 bp, Homo sapiens
tctctcatgctgagg

SEQ ID NO: 225048 - DNA, 15 bp, Homo sapiens
atctctcatgctgag

SEQ ID NO: 225049 - DNA, 15 bp, Homo sapiens
catctctcatgctga

SEQ ID NO: 225050 - DNA, 15 bp, Homo sapiens
ccatctctcatgctg

SEQ ID NO: 225051 - DNA, 15 bp, Homo sapiens
tccatctctcatgct

SEQ ID NO: 225052 - DNA, 15 bp, Homo sapiens
ttccatctctcatgc

SEQ ID NO: 225053 - DNA, 15 bp, Homo sapiens
gttccatctctcatg

SEQ ID NO: 225054 - DNA, 15 bp, Homo sapiens
tgttccatctctcat

SEQ ID NO: 225055 - DNA, 15 bp, Homo sapiens
atgttccatctctca

SEQ ID NO: 225056 - DNA, 15 bp, Homo sapiens
tatgttccatctctc

SEQ ID NO: 225057 - DNA, 15 bp, Homo sapiens
atatgttccatctct

SEQ ID NO: 225058 - DNA, 15 bp, Homo sapiens
aatatgttccatctc

SEQ ID NO: 225059 - DNA, 15 bp, Homo sapiens
aaatatgttccatct

SEQ ID NO: 225060 - DNA, 15 bp, Homo sapiens
aaaatatgttccatc

SEQ ID NO: 225061 - DNA, 15 bp, Homo sapiens
taaaatatgttccat

SEQ ID NO: 225062 - DNA, 15 bp, Homo sapiens
ttaaaatatgttcca

SEQ ID NO: 225063 - DNA, 15 bp, Homo sapiens
cttaaaatatgttcc

SEQ ID NO: 225064 - DNA, 15 bp, Homo sapiens
tcttaaaatatgttc

SEQ ID NO: 225065 - DNA, 15 bp, Homo sapiens
atcttaaaatatgtt

SEQ ID NO: 225066 - DNA, 15 bp, Homo sapiens
tatcttaaaatatgt

SEQ ID NO: 225067 - DNA, 15 bp, Homo sapiens
ttatcttaaaatatg

SEQ ID NO: 225068 - DNA, 15 bp, Homo sapiens
attatcttaaaatat

SEQ ID NO: 225069 - DNA, 15 bp, Homo sapiens
aattatcttaaaata

SEQ ID NO: 225070 - DNA, 15 bp, Homo sapiens
caattatcttaaaat

SEQ ID NO: 225071 - DNA, 15 bp, Homo sapiens
ccaattatcttaaaa

SEQ ID NO: 225072 - DNA, 15 bp, Homo sapiens
tccaattatcttaaa

SEQ ID NO: 225073 - DNA, 15 bp, Homo sapiens
ctccaattatcttaa

SEQ ID NO: 225074 - DNA, 15 bp, Homo sapiens
tctccaattatctta

SEQ ID NO: 225075 - DNA, 15 bp, Homo sapiens
gtctccaattatctt

SEQ ID NO: 225076 - DNA, 15 bp, Homo sapiens
agtctccaattatct

SEQ ID NO: 225077 - DNA, 15 bp, Homo sapiens
cagtctccaattatc

SEQ ID NO: 225078 - DNA, 15 bp, Homo sapiens
acagtctccaattat

SEQ ID NO: 225079 - DNA, 15 bp, Homo sapiens
aacagtctccaatta

SEQ ID NO: 225080 - DNA, 15 bp, Homo sapiens
aaacagtctccaatt

SEQ ID NO: 225081 - DNA, 15 bp, Homo sapiens
aaaacagtctccaat

SEQ ID NO: 225082 - DNA, 15 bp, Homo sapiens
taaaacagtctccaa

SEQ ID NO: 225083 - DNA, 15 bp, Homo sapiens
ataaaacagtctcca

SEQ ID NO: 225084 - DNA, 15 bp, Homo sapiens
tataaaacagtctcc

SEQ ID NO: 225085 - DNA, 15 bp, Homo sapiens
atataaaacagtctc

SEQ ID NO: 225086 - DNA, 15 bp, Homo sapiens
catataaaacagtct

SEQ ID NO: 225087 - DNA, 15 bp, Homo sapiens
acatataaaacagtc

SEQ ID NO: 225088 - DNA, 15 bp, Homo sapiens
cacatataaaacagt

SEQ ID NO: 225089 - DNA, 15 bp, Homo sapiens
gcacatataaaacag

SEQ ID NO: 225090 - DNA, 15 bp, Homo sapiens
ggcacatataaaaca

SEQ ID NO: 225091 - DNA, 15 bp, Homo sapiens
gggcacatataaaac

SEQ ID NO: 225092 - DNA, 15 bp, Homo sapiens
agggcacatataaaa

SEQ ID NO: 225093 - DNA, 15 bp, Homo sapiens
gagggcacatataaa

SEQ ID NO: 225094 - DNA, 15 bp, Homo sapiens
tgagggcacatataa

SEQ ID NO: 225095 - DNA, 15 bp, Homo sapiens
atgagggcacatata

SEQ ID NO: 225096 - DNA, 15 bp, Homo sapiens
aatgagggcacatat

SEQ ID NO: 225097 - DNA, 15 bp, Homo sapiens
caatgagggcacata

SEQ ID NO: 225098 - DNA, 15 bp, Homo sapiens
ccaatgagggcacat

SEQ ID NO: 225099 - DNA, 15 bp, Homo sapiens
accaatgagggcaca

SEQ ID NO: 225100 - DNA, 15 bp, Homo sapiens
aaccaatgagggcac

SEQ ID NO: 225101 - DNA, 15 bp, Homo sapiens
aaaccaatgagggca

SEQ ID NO: 225102 - DNA, 15 bp, Homo sapiens
taaaccaatgagggc

SEQ ID NO: 225103 - DNA, 15 bp, Homo sapiens
ataaaccaatgaggg

SEQ ID NO: 225104 - DNA, 15 bp, Homo sapiens
aataaaccaatgagg

SEQ ID NO: 225105 - DNA, 15 bp, Homo sapiens
aaataaaccaatgag

SEQ ID NO: 225106 - DNA, 15 bp, Homo sapiens
aaaataaaccaatga

SEQ ID NO: 225107 - DNA, 15 bp, Homo sapiens
aaaaataaaccaatg

SEQ ID NO: 225108 - DNA, 15 bp, Homo sapiens
caaaaataaaccaat

SEQ ID NO: 225109 - DNA, 15 bp, Homo sapiens
tcaaaaataaaccaa

SEQ ID NO: 225110 - DNA, 15 bp, Homo sapiens
atcaaaaataaacca

SEQ ID NO: 225111 - DNA, 15 bp, Homo sapiens
aatcaaaaataaacc

SEQ ID NO: 225112 - DNA, 15 bp, Homo sapiens
aaatcaaaaataaac

SEQ ID NO: 225113 - DNA, 15 bp, Homo sapiens
gaaatcaaaaataaa

SEQ ID NO: 225114 - DNA, 15 bp, Homo sapiens
tgaaatcaaaaataa

SEQ ID NO: 225115 - DNA, 15 bp, Homo sapiens
atgaaatcaaaaata

SEQ ID NO: 225116 - DNA, 15 bp, Homo sapiens
catgaaatcaaaaat

SEQ ID NO: 225117 - DNA, 15 bp, Homo sapiens
acatgaaatcaaaaa

SEQ ID NO: 225118 - DNA, 15 bp, Homo sapiens
tacatgaaatcaaaa

SEQ ID NO: 225119 - DNA, 15 bp, Homo sapiens
atacatgaaatcaaa

SEQ ID NO: 225120 - DNA, 15 bp, Homo sapiens
catacatgaaatcaa

SEQ ID NO: 225121 - DNA, 15 bp, Homo sapiens
acatacatgaaatca

SEQ ID NO: 225122 - DNA, 15 bp, Homo sapiens
tacatacatgaaatc

SEQ ID NO: 225123 - DNA, 15 bp, Homo sapiens
gtacatacatgaaat

SEQ ID NO: 225124 - DNA, 15 bp, Homo sapiens
agtacatacatgaaa

SEQ ID NO: 225125 - DNA, 15 bp, Homo sapiens
aagtacatacatgaa

SEQ ID NO: 225126 - DNA, 15 bp, Homo sapiens
aaagtacatacatga

SEQ ID NO: 225127 - DNA, 15 bp, Homo sapiens
caaagtacatacatg

SEQ ID NO: 225128 - DNA, 15 bp, Homo sapiens
acaaagtacatacat

SEQ ID NO: 225129 - DNA, 15 bp, Homo sapiens
aacaaagtacataca

SEQ ID NO: 225130 - DNA, 15 bp, Homo sapiens
aaacaaagtacatac

SEQ ID NO: 225131 - DNA, 15 bp, Homo sapiens
gaaacaaagtacata

SEQ ID NO: 225132 - DNA, 15 bp, Homo sapiens
agaaacaaagtacat

SEQ ID NO: 225133 - DNA, 15 bp, Homo sapiens
tagaaacaaagtaca

SEQ ID NO: 225134 - DNA, 15 bp, Homo sapiens
atagaaacaaagtac

SEQ ID NO: 225135 - DNA, 15 bp, Homo sapiens
gatagaaacaaagta

SEQ ID NO: 225136 - DNA, 15 bp, Homo sapiens
cgatagaaacaaagt

SEQ ID NO: 225137 - DNA, 15 bp, Homo sapiens
gcgatagaaacaaag

SEQ ID NO: 225138 - DNA, 15 bp, Homo sapiens
agcgatagaaacaaa

SEQ ID NO: 225139 - DNA, 15 bp, Homo sapiens
aagcgatagaaacaa

SEQ ID NO: 225140 - DNA, 15 bp, Homo sapiens
gaagcgatagaaaca

SEQ ID NO: 225141 - DNA, 15 bp, Homo sapiens
tgaagcgatagaaac

SEQ ID NO: 225142 - DNA, 15 bp, Homo sapiens
atgaagcgatagaaa

SEQ ID NO: 225143 - DNA, 15 bp, Homo sapiens
aatgaagcgatagaa

SEQ ID NO: 225144 - DNA, 15 bp, Homo sapiens
aaatgaagcgataga

SEQ ID NO: 225145 - DNA, 15 bp, Homo sapiens
aaaatgaagcgatag

SEQ ID NO: 225146 - DNA, 15 bp, Homo sapiens
aaaaatgaagcgata

SEQ ID NO: 225147 - DNA, 15 bp, Homo sapiens
aaaaaatgaagcgat

SEQ ID NO: 225148 - DNA, 15 bp, Homo sapiens
aaaaaaatgaagcga

SEQ ID NO: 225149 - DNA, 15 bp, Homo sapiens
aaaaaaaatgaagcg

SEQ ID NO: 225150 - DNA, 15 bp, Homo sapiens
aaaaaaaaatgaagc

SEQ ID NO: 225151 - DNA, 15 bp, Homo sapiens
gaaaaaaaaatgaag

SEQ ID NO: 225152 - DNA, 15 bp, Homo sapiens
agaaaaaaaaatgaa

SEQ ID NO: 225153 - DNA, 15 bp, Homo sapiens
aagaaaaaaaaatga

SEQ ID NO: 225154 - DNA, 15 bp, Homo sapiens
taagaaaaaaaaatg

SEQ ID NO: 225155 - DNA, 15 bp, Homo sapiens
ttaagaaaaaaaaat

SEQ ID NO: 225156 - DNA, 15 bp, Homo sapiens
attaagaaaaaaaaa

SEQ ID NO: 225157 - DNA, 15 bp, Homo sapiens
cattaagaaaaaaaa

SEQ ID NO: 225158 - DNA, 15 bp, Homo sapiens
acattaagaaaaaaa

SEQ ID NO: 225159 - DNA, 15 bp, Homo sapiens
tacattaagaaaaaa

SEQ ID NO: 225160 - DNA, 15 bp, Homo sapiens
atacattaagaaaaa

SEQ ID NO: 225161 - DNA, 15 bp, Homo sapiens
aatacattaagaaaa

SEQ ID NO: 225162 - DNA, 15 bp, Homo sapiens
gaatacattaagaaa

SEQ ID NO: 225163 - DNA, 15 bp, Homo sapiens
agaatacattaagaa

SEQ ID NO: 225164 - DNA, 15 bp, Homo sapiens
tagaatacattaaga

SEQ ID NO: 225165 - DNA, 15 bp, Homo sapiens
ttagaatacattaag

SEQ ID NO: 225166 - DNA, 15 bp, Homo sapiens
tttagaatacattaa

SEQ ID NO: 225167 - DNA, 15 bp, Homo sapiens
atttagaatacatta

SEQ ID NO: 225168 - DNA, 15 bp, Homo sapiens
tatttagaatacatt

SEQ ID NO: 225169 - DNA, 15 bp, Homo sapiens
ttatttagaatacat

SEQ ID NO: 225170 - DNA, 15 bp, Homo sapiens
cattatttagaatac

SEQ ID NO: 225171 - DNA, 15 bp, Homo sapiens
acattatttagaata

SEQ ID NO: 225172 - DNA, 15 bp, Homo sapiens
tacattatttagaat

SEQ ID NO: 225173 - DNA, 15 bp, Homo sapiens
ttacattatttagaa

SEQ ID NO: 225174 - DNA, 15 bp, Homo sapiens
tttacattatttaga

SEQ ID NO: 225175 - DNA, 15 bp, Homo sapiens
ttttacattatttag

SEQ ID NO: 225176 - DNA, 15 bp, Homo sapiens
gttttacattattta

SEQ ID NO: 225177 - DNA, 15 bp, Homo sapiens
ggttttacattattt

SEQ ID NO: 225178 - DNA, 15 bp, Homo sapiens
gggttttacattatt

SEQ ID NO: 225179 - DNA, 15 bp, Homo sapiens
agggttttacattat

SEQ ID NO: 225180 - DNA, 15 bp, Homo sapiens
aagggttttacatta

SEQ ID NO: 225181 - DNA, 15 bp, Homo sapiens
gaagggttttacatt

SEQ ID NO: 225182 - DNA, 15 bp, Homo sapiens
agaagggttttacat

SEQ ID NO: 225183 - DNA, 15 bp, Homo sapiens
cagaagggttttaca

SEQ ID NO: 225184 - DNA, 15 bp, Homo sapiens
tcagaagggttttac

SEQ ID NO: 225185 - DNA, 15 bp, Homo sapiens
ctcagaagggtttta

SEQ ID NO: 225186 - DNA, 15 bp, Homo sapiens
cctcagaagggtttt

SEQ ID NO: 225187 - DNA, 15 bp, Homo sapiens
tcctcagaagggttt

SEQ ID NO: 225188 - DNA, 15 bp, Homo sapiens
atcctcagaagggtt

SEQ ID NO: 225189 - DNA, 15 bp, Homo sapiens
gatcctcagaagggt

SEQ ID NO: 225190 - DNA, 15 bp, Homo sapiens
agatcctcagaaggg

SEQ ID NO: 225191 - DNA, 15 bp, Homo sapiens
aagatcctcagaagg

SEQ ID NO: 225192 - DNA, 15 bp, Homo sapiens
taagatcctcagaag

SEQ ID NO: 225193 - DNA, 15 bp, Homo sapiens
ataagatcctcagaa

SEQ ID NO: 225194 - DNA, 15 bp, Homo sapiens
aataagatcctcaga

SEQ ID NO: 225195 - DNA, 15 bp, Homo sapiens
caataagatcctcag

SEQ ID NO: 225196 - DNA, 15 bp, Homo sapiens
gcaataagatcctca

SEQ ID NO: 225197 - DNA, 15 bp, Homo sapiens
agcaataagatcctc

SEQ ID NO: 225198 - DNA, 15 bp, Homo sapiens
tagcaataagatcct

SEQ ID NO: 225199 - DNA, 15 bp, Homo sapiens
gtagcaataagatcc

SEQ ID NO: 225200 - DNA, 15 bp, Homo sapiens
agtagcaataagatc

SEQ ID NO: 225201 - DNA, 15 bp, Homo sapiens
aagtagcaataagat

SEQ ID NO: 225202 - DNA, 15 bp, Homo sapiens
caagtagcaataaga

SEQ ID NO: 225203 - DNA, 15 bp, Homo sapiens
acaagtagcaataag

SEQ ID NO: 225204 - DNA, 15 bp, Homo sapiens
cacaagtagcaataa

SEQ ID NO: 225205 - DNA, 15 bp, Homo sapiens
tcacaagtagcaata

SEQ ID NO: 225206 - DNA, 15 bp, Homo sapiens
ttcacaagtagcaat

SEQ ID NO: 225207 - DNA, 15 bp, Homo sapiens
tttcacaagtagcaa

SEQ ID NO: 225208 - DNA, 15 bp, Homo sapiens
atttcacaagtagca

SEQ ID NO: 225209 - DNA, 15 bp, Homo sapiens
aatttcacaagtagc

SEQ ID NO: 225210 - DNA, 15 bp, Homo sapiens
taatttcacaagtag

SEQ ID NO: 225211 - DNA, 15 bp, Homo sapiens
gtaatttcacaagta

SEQ ID NO: 225212 - DNA, 15 bp, Homo sapiens
ggtaatttcacaagt

SEQ ID NO: 225213 - DNA, 15 bp, Homo sapiens
aggtaatttcacaag

SEQ ID NO: 225214 - DNA, 15 bp, Homo sapiens
aaggtaatttcacaa

SEQ ID NO: 225215 - DNA, 15 bp, Homo sapiens
aaaggtaatttcaca

SEQ ID NO: 225216 - DNA, 15 bp, Homo sapiens
gaaaggtaatttcac

SEQ ID NO: 225217 - DNA, 15 bp, Homo sapiens
agaaaggtaatttca

SEQ ID NO: 225218 - DNA, 15 bp, Homo sapiens
gagaaaggtaatttc

SEQ ID NO: 225219 - DNA, 15 bp, Homo sapiens
agagaaaggtaattt

SEQ ID NO: 225220 - DNA, 15 bp, Homo sapiens
cagagaaaggtaatt

SEQ ID NO: 225221 - DNA, 15 bp, Homo sapiens
acagagaaaggtaat

SEQ ID NO: 225222 - DNA, 15 bp, Homo sapiens
tacagagaaaggtaa

SEQ ID NO: 225223 - DNA, 15 bp, Homo sapiens
atacagagaaaggta

SEQ ID NO: 225224 - DNA, 15 bp, Homo sapiens
gatacagagaaaggt

SEQ ID NO: 225225 - DNA, 15 bp, Homo sapiens
tgatacagagaaagg

SEQ ID NO: 225226 - DNA, 15 bp, Homo sapiens
atgatacagagaaag

SEQ ID NO: 225227 - DNA, 15 bp, Homo sapiens
aatgatacagagaaa

SEQ ID NO: 225228 - DNA, 15 bp, Homo sapiens
caatgatacagagaa

SEQ ID NO: 225229 - DNA, 15 bp, Homo sapiens
ccaatgatacagaga

SEQ ID NO: 225230 - DNA, 15 bp, Homo sapiens
tccaatgatacagag

SEQ ID NO: 225231 - DNA, 15 bp, Homo sapiens
atccaatgatacaga

SEQ ID NO: 225232 - DNA, 15 bp, Homo sapiens
catccaatgatacag

SEQ ID NO: 225233 - DNA, 15 bp, Homo sapiens
acatccaatgataca

SEQ ID NO: 225234 - DNA, 15 bp, Homo sapiens
tacatccaatgatac

SEQ ID NO: 225235 - DNA, 15 bp, Homo sapiens
ttacatccaatgata

SEQ ID NO: 225236 - DNA, 15 bp, Homo sapiens
attacatccaatgat

SEQ ID NO: 225237 - DNA, 15 bp, Homo sapiens
aattacatccaatga

SEQ ID NO: 225238 - DNA, 15 bp, Homo sapiens
aaattacatccaatg

SEQ ID NO: 225239 - DNA, 15 bp, Homo sapiens
aaaattacatccaat

SEQ ID NO: 225240 - DNA, 15 bp, Homo sapiens
aaaaattacatccaa

SEQ ID NO: 225241 - DNA, 15 bp, Homo sapiens
aaaaaattacatcca

SEQ ID NO: 225242 - DNA, 15 bp, Homo sapiens
aaaaaaattacatcc

SEQ ID NO: 225243 - DNA, 15 bp, Homo sapiens
caaaaaaattacatc

SEQ ID NO: 225244 - DNA, 15 bp, Homo sapiens
acaaaaaaattacat

SEQ ID NO: 225245 - DNA, 15 bp, Homo sapiens
gacaaaaaaattaca

SEQ ID NO: 225246 - DNA, 15 bp, Homo sapiens
tgacaaaaaaattac

SEQ ID NO: 225247 - DNA, 15 bp, Homo sapiens
ctgacaaaaaaatta

SEQ ID NO: 225248 - DNA, 15 bp, Homo sapiens
actgacaaaaaaatt

SEQ ID NO: 225249 - DNA, 15 bp, Homo sapiens
gactgacaaaaaaat

SEQ ID NO: 225250 - DNA, 15 bp, Homo sapiens
tgactgacaaaaaaa

SEQ ID NO: 225251 - DNA, 15 bp, Homo sapiens
ctgactgacaaaaaa

SEQ ID NO: 225252 - DNA, 15 bp, Homo sapiens
actgactgacaaaaa

SEQ ID NO: 225253 - DNA, 15 bp, Homo sapiens
gactgactgacaaaa

SEQ ID NO: 225254 - DNA, 15 bp, Homo sapiens
agactgactgacaaa

SEQ ID NO: 225255 - DNA, 15 bp, Homo sapiens
aagactgactgacaa

SEQ ID NO: 225256 - DNA, 15 bp, Homo sapiens
taagactgactgaca

SEQ ID NO: 225257 - DNA, 15 bp, Homo sapiens
gtaagactgactgac

SEQ ID NO: 225258 - DNA, 15 bp, Homo sapiens
tgtaagactgactga

SEQ ID NO: 225259 - DNA, 15 bp, Homo sapiens
ttgtaagactgactg

SEQ ID NO: 225260 - DNA, 15 bp, Homo sapiens
cttgtaagactgact

SEQ ID NO: 225261 - DNA, 15 bp, Homo sapiens
tcttgtaagactgac

SEQ ID NO: 225262 - DNA, 15 bp, Homo sapiens
ttcttgtaagactga

SEQ ID NO: 225263 - DNA, 15 bp, Homo sapiens
tttcttgtaagactg

SEQ ID NO: 225264 - DNA, 15 bp, Homo sapiens
ttttcttgtaagact

SEQ ID NO: 225265 - DNA, 15 bp, Homo sapiens
tttttcttgtaagac

SEQ ID NO: 225266 - DNA, 15 bp, Homo sapiens
ttttttcttgtaaga

SEQ ID NO: 225267 - DNA, 15 bp, Homo sapiens
cttttttcttgtaag

SEQ ID NO: 225268 - DNA, 15 bp, Homo sapiens
acttttttcttgtaa

SEQ ID NO: 225269 - DNA, 15 bp, Homo sapiens
tacttttttcttgta

SEQ ID NO: 225270 - DNA, 15 bp, Homo sapiens
atacttttttcttgt

SEQ ID NO: 225271 - DNA, 15 bp, Homo sapiens
gatacttttttcttg

SEQ ID NO: 225272 - DNA, 15 bp, Homo sapiens
agatacttttttctt

SEQ ID NO: 225273 - DNA, 15 bp, Homo sapiens
aagatacttttttct

SEQ ID NO: 225274 - DNA, 15 bp, Homo sapiens
taagatacttttttc

SEQ ID NO: 225275 - DNA, 15 bp, Homo sapiens
ctaagatactttttt

SEQ ID NO: 225276 - DNA, 15 bp, Homo sapiens
gctaagatacttttt

SEQ ID NO: 225277 - DNA, 15 bp, Homo sapiens
tgctaagatactttt

SEQ ID NO: 225278 - DNA, 15 bp, Homo sapiens
ttgctaagatacttt

SEQ ID NO: 225279 - DNA, 15 bp, Homo sapiens
tttgctaagatactt

SEQ ID NO: 225280 - DNA, 15 bp, Homo sapiens
ctttgctaagatact

SEQ ID NO: 225281 - DNA, 15 bp, Homo sapiens
cctttgctaagatac

SEQ ID NO: 225282 - DNA, 15 bp, Homo sapiens
gcctttgctaagata

SEQ ID NO: 225283 - DNA, 15 bp, Homo sapiens
agcctttgctaagat

SEQ ID NO: 225284 - DNA, 15 bp, Homo sapiens
tagcctttgctaaga

SEQ ID NO: 225285 - DNA, 15 bp, Homo sapiens
atagcctttgctaag

SEQ ID NO: 225286 - DNA, 15 bp, Homo sapiens
aatagcctttgctaa

SEQ ID NO: 225287 - DNA, 15 bp, Homo sapiens
taatagcctttgcta

SEQ ID NO: 225288 - DNA, 15 bp, Homo sapiens
ataatagcctttgct

SEQ ID NO: 225289 - DNA, 15 bp, Homo sapiens
tataatagcctttgc

SEQ ID NO: 225290 - DNA, 15 bp, Homo sapiens
atataatagcctttg

SEQ ID NO: 225291 - DNA, 15 bp, Homo sapiens
aatataatagccttt

SEQ ID NO: 225292 - DNA, 15 bp, Homo sapiens
aaatataatagcctt

SEQ ID NO: 225293 - DNA, 15 bp, Homo sapiens
aaaatataatagcct

SEQ ID NO: 225294 - DNA, 15 bp, Homo sapiens
taaaatataatagcc

SEQ ID NO: 225295 - DNA, 15 bp, Homo sapiens
ataaaatataatagc

SEQ ID NO: 225296 - DNA, 15 bp, Homo sapiens
gataaaatataatag

SEQ ID NO: 225297 - DNA, 15 bp, Homo sapiens
tgataaaatataata

SEQ ID NO: 225298 - DNA, 15 bp, Homo sapiens
ttgataaaatataat

SEQ ID NO: 225299 - DNA, 15 bp, Homo sapiens
attgataaaatataa

SEQ ID NO: 225300 - DNA, 15 bp, Homo sapiens
agattgataaaatat

SEQ ID NO: 225301 - DNA, 15 bp, Homo sapiens
cagattgataaaata

SEQ ID NO: 225302 - DNA, 15 bp, Homo sapiens
tcagattgataaaat

SEQ ID NO: 225303 - DNA, 15 bp, Homo sapiens
gtcagattgataaaa

SEQ ID NO: 225304 - DNA, 15 bp, Homo sapiens
tgtcagattgataaa

SEQ ID NO: 225305 - DNA, 15 bp, Homo sapiens
atgtcagattgataa

SEQ ID NO: 225306 - DNA, 15 bp, Homo sapiens
gatgtcagattgata

SEQ ID NO: 225307 - DNA, 15 bp, Homo sapiens
tgatgtcagattgat

SEQ ID NO: 225308 - DNA, 15 bp, Homo sapiens
ctgatgtcagattga

SEQ ID NO: 225309 - DNA, 15 bp, Homo sapiens
actgatgtcagattg

SEQ ID NO: 225310 - DNA, 15 bp, Homo sapiens
cactgatgtcagatt

SEQ ID NO: 225311 - DNA, 15 bp, Homo sapiens
tcactgatgtcagat

SEQ ID NO: 225312 - DNA, 15 bp, Homo sapiens
ttcactgatgtcaga

SEQ ID NO: 225313 - DNA, 15 bp, Homo sapiens
tttcactgatgtcag

SEQ ID NO: 225314 - DNA, 15 bp, Homo sapiens
ttttcactgatgtca

SEQ ID NO: 225315 - DNA, 15 bp, Homo sapiens
attttcactgatgtc

SEQ ID NO: 225316 - DNA, 15 bp, Homo sapiens
gattttcactgatgt

SEQ ID NO: 225317 - DNA, 15 bp, Homo sapiens
ggattttcactgatg

SEQ ID NO: 225318 - DNA, 15 bp, Homo sapiens
aggattttcactgat

SEQ ID NO: 225319 - DNA, 15 bp, Homo sapiens
taggattttcactga

SEQ ID NO: 225320 - DNA, 15 bp, Homo sapiens
ttaggattttcactg

SEQ ID NO: 225321 - DNA, 15 bp, Homo sapiens
tttaggattttcact

SEQ ID NO: 225322 - DNA, 15 bp, Homo sapiens
ttttaggattttcac

SEQ ID NO: 225323 - DNA, 15 bp, Homo sapiens
cttttaggattttca

SEQ ID NO: 225324 - DNA, 15 bp, Homo sapiens
acttttaggattttc

SEQ ID NO: 225325 - DNA, 15 bp, Homo sapiens
tacttttaggatttt

SEQ ID NO: 225326 - DNA, 15 bp, Homo sapiens
gtacttttaggattt

SEQ ID NO: 225327 - DNA, 15 bp, Homo sapiens
tgtacttttaggatt

SEQ ID NO: 225328 - DNA, 15 bp, Homo sapiens
atgtacttttaggat

SEQ ID NO: 225329 - DNA, 15 bp, Homo sapiens
aatgtacttttagga

SEQ ID NO: 225330 - DNA, 15 bp, Homo sapiens
aaatgtacttttagg

SEQ ID NO: 225331 - DNA, 15 bp, Homo sapiens
aaaatgtacttttag

SEQ ID NO: 225332 - DNA, 15 bp, Homo sapiens
caaaatgtactttta

SEQ ID NO: 225333 - DNA, 15 bp, Homo sapiens
acaaaatgtactttt

SEQ ID NO: 225334 - DNA, 15 bp, Homo sapiens
cacaaaatgtacttt

SEQ ID NO: 225335 - DNA, 15 bp, Homo sapiens
acacaaaatgtactt

SEQ ID NO: 225336 - DNA, 15 bp, Homo sapiens
tacacaaaatgtact

SEQ ID NO: 225337 - DNA, 15 bp, Homo sapiens
ttacacaaaatgtac

SEQ ID NO: 225338 - DNA, 15 bp, Homo sapiens
tttacacaaaatgta

SEQ ID NO: 225339 - DNA, 15 bp, Homo sapiens
atttacacaaaatgt

SEQ ID NO: 225340 - DNA, 15 bp, Homo sapiens
aatttacacaaaatg

SEQ ID NO: 225341 - DNA, 15 bp, Homo sapiens
gaatttacacaaaat

SEQ ID NO: 225342 - DNA, 15 bp, Homo sapiens
tgaatttacacaaaa

SEQ ID NO: 225343 - DNA, 15 bp, Homo sapiens
ttgaatttacacaaa

SEQ ID NO: 225344 - DNA, 15 bp, Homo sapiens
tttgaatttacacaa

SEQ ID NO: 225345 - DNA, 15 bp, Homo sapiens
atttgaatttacaca

SEQ ID NO: 225346 - DNA, 15 bp, Homo sapiens
tatttgaatttacac

SEQ ID NO: 225347 - DNA, 15 bp, Homo sapiens
gtatttgaatttaca

SEQ ID NO: 225348 - DNA, 15 bp, Homo sapiens
tgtatttgaatttac

SEQ ID NO: 225349 - DNA, 15 bp, Homo sapiens
gtgtatttgaattta

SEQ ID NO: 225350 - DNA, 15 bp, Homo sapiens
agtgtatttgaattt

SEQ ID NO: 225351 - DNA, 15 bp, Homo sapiens
cagtgtatttgaatt

SEQ ID NO: 225352 - DNA, 15 bp, Homo sapiens
acagtgtatttgaat

SEQ ID NO: 225353 - DNA, 15 bp, Homo sapiens
tacagtgtatttgaa

SEQ ID NO: 225354 - DNA, 15 bp, Homo sapiens
ttacagtgtatttga

SEQ ID NO: 225355 - DNA, 15 bp, Homo sapiens
gttacagtgtatttg

SEQ ID NO: 225356 - DNA, 15 bp, Homo sapiens
tgttacagtgtattt

SEQ ID NO: 225357 - DNA, 15 bp, Homo sapiens
ttgttacagtgtatt

SEQ ID NO: 225358 - DNA, 15 bp, Homo sapiens
attgttacagtgtat

SEQ ID NO: 225359 - DNA, 15 bp, Homo sapiens
aattgttacagtgta

SEQ ID NO: 225360 - DNA, 15 bp, Homo sapiens
aaattgttacagtgt

SEQ ID NO: 225361 - DNA, 15 bp, Homo sapiens
gaaattgttacagtg

SEQ ID NO: 225362 - DNA, 15 bp, Homo sapiens
ggaaattgttacagt

SEQ ID NO: 225363 - DNA, 15 bp, Homo sapiens
gggaaattgttacag

SEQ ID NO: 225364 - DNA, 15 bp, Homo sapiens
agggaaattgttaca

SEQ ID NO: 225365 - DNA, 15 bp, Homo sapiens
aagggaaattgttac

SEQ ID NO: 225366 - DNA, 15 bp, Homo sapiens
taagggaaattgtta

SEQ ID NO: 225367 - DNA, 15 bp, Homo sapiens
ttaagggaaattgtt

SEQ ID NO: 225368 - DNA, 15 bp, Homo sapiens
cttaagggaaattgt

SEQ ID NO: 225369 - DNA, 15 bp, Homo sapiens
acttaagggaaattg

SEQ ID NO: 225370 - DNA, 15 bp, Homo sapiens
cacttaagggaaatt

SEQ ID NO: 225371 - DNA, 15 bp, Homo sapiens
tcacttaagggaaat

SEQ ID NO: 225372 - DNA, 15 bp, Homo sapiens
ttcacttaagggaaa

SEQ ID NO: 225373 - DNA, 15 bp, Homo sapiens
attcacttaagggaa

SEQ ID NO: 225374 - DNA, 15 bp, Homo sapiens
tattcacttaaggga

SEQ ID NO: 225375 - DNA, 15 bp, Homo sapiens
atattcacttaaggg

SEQ ID NO: 225376 - DNA, 15 bp, Homo sapiens
aatattcacttaagg

SEQ ID NO: 225377 - DNA, 15 bp, Homo sapiens
aaatattcacttaag

SEQ ID NO: 225378 - DNA, 15 bp, Homo sapiens
aaaatattcacttaa

SEQ ID NO: 225379 - DNA, 15 bp, Homo sapiens
taaaatattcactta

SEQ ID NO: 225380 - DNA, 15 bp, Homo sapiens
ttaaaatattcactt

SEQ ID NO: 225381 - DNA, 15 bp, Homo sapiens
tttaaaatattcact

SEQ ID NO: 225382 - DNA, 15 bp, Homo sapiens
ctttaaaatattcac

SEQ ID NO: 225383 - DNA, 15 bp, Homo sapiens
gctttaaaatattca

SEQ ID NO: 225384 - DNA, 15 bp, Homo sapiens
agctttaaaatattc

SEQ ID NO: 225385 - DNA, 15 bp, Homo sapiens
cagctttaaaatatt

SEQ ID NO: 225386 - DNA, 15 bp, Homo sapiens
acagctttaaaatat

SEQ ID NO: 225387 - DNA, 15 bp, Homo sapiens
aacagctttaaaata

SEQ ID NO: 225388 - DNA, 15 bp, Homo sapiens
aaacagctttaaaat

SEQ ID NO: 225389 - DNA, 15 bp, Homo sapiens
gaaacagctttaaaa

SEQ ID NO: 225390 - DNA, 15 bp, Homo sapiens
agaaacagctttaaa

SEQ ID NO: 225391 - DNA, 15 bp, Homo sapiens
aagaaacagctttaa

SEQ ID NO: 225392 - DNA, 15 bp, Homo sapiens
aaagaaacagcttta

SEQ ID NO: 225393 - DNA, 15 bp, Homo sapiens
aaaagaaacagcttt

SEQ ID NO: 225394 - DNA, 15 bp, Homo sapiens
aaaaagaaacagctt

SEQ ID NO: 225395 - DNA, 15 bp, Homo sapiens
aaaaaagaaacagct

SEQ ID NO: 225396 - DNA, 15 bp, Homo sapiens
aaaaaaagaaacagc

SEQ ID NO: 225397 - DNA, 15 bp, Homo sapiens
caaaaaaagaaacag

SEQ ID NO: 225398 - DNA, 15 bp, Homo sapiens
acaaaaaaagaaaca

SEQ ID NO: 225399 - DNA, 15 bp, Homo sapiens
tacaaaaaaagaaac

SEQ ID NO: 225400 - DNA, 15 bp, Homo sapiens
atacaaaaaaagaaa

SEQ ID NO: 225401 - DNA, 15 bp, Homo sapiens
tatacaaaaaaagaa

SEQ ID NO: 225402 - DNA, 15 bp, Homo sapiens
gtatacaaaaaaaga

SEQ ID NO: 225403 - DNA, 15 bp, Homo sapiens
agtatacaaaaaaag

SEQ ID NO: 225404 - DNA, 15 bp, Homo sapiens
aagtatacaaaaaaa

SEQ ID NO: 225405 - DNA, 15 bp, Homo sapiens
taagtatacaaaaaa

SEQ ID NO: 225406 - DNA, 15 bp, Homo sapiens
ttaagtatacaaaaa

SEQ ID NO: 225407 - DNA, 15 bp, Homo sapiens
gttaagtatacaaaa

SEQ ID NO: 225408 - DNA, 15 bp, Homo sapiens
cgttaagtatacaaa

SEQ ID NO: 225409 - DNA, 15 bp, Homo sapiens
acgttaagtatacaa

SEQ ID NO: 225410 - DNA, 15 bp, Homo sapiens
aacgttaagtataca

SEQ ID NO: 225411 - DNA, 15 bp, Homo sapiens
aaacgttaagtatac

SEQ ID NO: 225412 - DNA, 15 bp, Homo sapiens
taaacgttaagtata

SEQ ID NO: 225413 - DNA, 15 bp, Homo sapiens
gtaaacgttaagtat

SEQ ID NO: 225414 - DNA, 15 bp, Homo sapiens
tgtaaacgttaagta

SEQ ID NO: 225415 - DNA, 15 bp, Homo sapiens
ctgtaaacgttaagt

SEQ ID NO: 225416 - DNA, 15 bp, Homo sapiens
tctgtaaacgttaag

SEQ ID NO: 225417 - DNA, 15 bp, Homo sapiens
ttctgtaaacgttaa

SEQ ID NO: 225418 - DNA, 15 bp, Homo sapiens
tttctgtaaacgtta

SEQ ID NO: 225419 - DNA, 15 bp, Homo sapiens
atttctgtaaacgtt

SEQ ID NO: 225420 - DNA, 15 bp, Homo sapiens
aatttctgtaaacgt

SEQ ID NO: 225421 - DNA, 15 bp, Homo sapiens
taatttctgtaaacg

SEQ ID NO: 225422 - DNA, 15 bp, Homo sapiens
ataatttctgtaaac

SEQ ID NO: 225423 - DNA, 15 bp, Homo sapiens
gataatttctgtaaa

SEQ ID NO: 225424 - DNA, 15 bp, Homo sapiens
agataatttctgtaa

SEQ ID NO: 225425 - DNA, 15 bp, Homo sapiens
aagataatttctgta

SEQ ID NO: 225426 - DNA, 15 bp, Homo sapiens
aaagataatttctgt

SEQ ID NO: 225427 - DNA, 15 bp, Homo sapiens
aaaagataatttctg

SEQ ID NO: 225428 - DNA, 15 bp, Homo sapiens
aaaaagataatttct

SEQ ID NO: 225429 - DNA, 15 bp, Homo sapiens
aaaaaagataatttc

SEQ ID NO: 225430 - DNA, 15 bp, Homo sapiens
gaaaaaagataattt

SEQ ID NO: 225431 - DNA, 15 bp, Homo sapiens
ggaaaaaagataatt

SEQ ID NO: 225432 - DNA, 15 bp, Homo sapiens
aggaaaaaagataat

SEQ ID NO: 225433 - DNA, 15 bp, Homo sapiens
aaggaaaaaagataa

SEQ ID NO: 225434 - DNA, 15 bp, Homo sapiens
aaaggaaaaaagata

SEQ ID NO: 225435 - DNA, 15 bp, Homo sapiens
caaaggaaaaaagat

SEQ ID NO: 225436 - DNA, 15 bp, Homo sapiens
acaaaggaaaaaaga

SEQ ID NO: 225437 - DNA, 15 bp, Homo sapiens
tacaaaggaaaaaag

SEQ ID NO: 225438 - DNA, 15 bp, Homo sapiens
atacaaaggaaaaaa

SEQ ID NO: 225439 - DNA, 15 bp, Homo sapiens
aatacaaaggaaaaa

SEQ ID NO: 225440 - DNA, 15 bp, Homo sapiens
aaatacaaaggaaaa

SEQ ID NO: 225441 - DNA, 15 bp, Homo sapiens
aaaatacaaaggaaa

SEQ ID NO: 225442 - DNA, 15 bp, Homo sapiens
aaaaatacaaaggaa

SEQ ID NO: 225443 - DNA, 15 bp, Homo sapiens
gaaaaatacaaagga

SEQ ID NO: 225444 - DNA, 15 bp, Homo sapiens
agaaaaatacaaagg

SEQ ID NO: 225445 - DNA, 15 bp, Homo sapiens
aagaaaaatacaaag

SEQ ID NO: 225446 - DNA, 15 bp, Homo sapiens
gaagaaaaatacaaa

SEQ ID NO: 225447 - DNA, 15 bp, Homo sapiens
tgaagaaaaatacaa

SEQ ID NO: 225448 - DNA, 15 bp, Homo sapiens
atgaagaaaaataca

SEQ ID NO: 225449 - DNA, 15 bp, Homo sapiens
aatgaagaaaaatac

SEQ ID NO: 225450 - DNA, 15 bp, Homo sapiens
gaatgaagaaaaata

SEQ ID NO: 225451 - DNA, 15 bp, Homo sapiens
tgaatgaagaaaaat

SEQ ID NO: 225452 - DNA, 15 bp, Homo sapiens
atgaatgaagaaaaa

SEQ ID NO: 225453 - DNA, 15 bp, Homo sapiens
tatgaatgaagaaaa

SEQ ID NO: 225454 - DNA, 15 bp, Homo sapiens
atatgaatgaagaaa

SEQ ID NO: 225455 - DNA, 15 bp, Homo sapiens
gatatgaatgaagaa

SEQ ID NO: 225456 - DNA, 15 bp, Homo sapiens
agatatgaatgaaga

SEQ ID NO: 225457 - DNA, 15 bp, Homo sapiens
tagatatgaatgaag

SEQ ID NO: 225458 - DNA, 15 bp, Homo sapiens
atagatatgaatgaa

SEQ ID NO: 225459 - DNA, 15 bp, Homo sapiens
tatagatatgaatga

SEQ ID NO: 225460 - DNA, 15 bp, Homo sapiens
ttatagatatgaatg

SEQ ID NO: 225461 - DNA, 15 bp, Homo sapiens
tttatagatatgaat

SEQ ID NO: 225462 - DNA, 15 bp, Homo sapiens
ttttatagatatgaa

SEQ ID NO: 225463 - DNA, 15 bp, Homo sapiens
aattttatagatatg

SEQ ID NO: 225464 - DNA, 15 bp, Homo sapiens
aaattttatagatat

SEQ ID NO: 225465 - DNA, 15 bp, Homo sapiens
taaattttatagata

SEQ ID NO: 225466 - DNA, 15 bp, Homo sapiens
gtaaattttatagat

SEQ ID NO: 225467 - DNA, 15 bp, Homo sapiens
tgtaaattttataga

SEQ ID NO: 225468 - DNA, 15 bp, Homo sapiens
atgtaaattttatag

SEQ ID NO: 225469 - DNA, 15 bp, Homo sapiens
aatgtaaattttata

SEQ ID NO: 225470 - DNA, 15 bp, Homo sapiens
aaatgtaaattttat

SEQ ID NO: 225471 - DNA, 15 bp, Homo sapiens
aaaatgtaaatttta

SEQ ID NO: 225472 - DNA, 15 bp, Homo sapiens
caaaatgtaaatttt

SEQ ID NO: 225473 - DNA, 15 bp, Homo sapiens
ccaaaatgtaaattt

SEQ ID NO: 225474 - DNA, 15 bp, Homo sapiens
gccaaaatgtaaatt

SEQ ID NO: 225475 - DNA, 15 bp, Homo sapiens
agccaaaatgtaaat

SEQ ID NO: 225476 - DNA, 15 bp, Homo sapiens
aagccaaaatgtaaa

SEQ ID NO: 225477 - DNA, 15 bp, Homo sapiens
gaagccaaaatgtaa

SEQ ID NO: 225478 - DNA, 15 bp, Homo sapiens
agaagccaaaatgta

SEQ ID NO: 225479 - DNA, 15 bp, Homo sapiens
tagaagccaaaatgt

SEQ ID NO: 225480 - DNA, 15 bp, Homo sapiens
ttagaagccaaaatg

SEQ ID NO: 225481 - DNA, 15 bp, Homo sapiens
gttagaagccaaaat

SEQ ID NO: 225482 - DNA, 15 bp, Homo sapiens
agttagaagccaaaa

SEQ ID NO: 225483 - DNA, 15 bp, Homo sapiens
aagttagaagccaaa

SEQ ID NO: 225484 - DNA, 15 bp, Homo sapiens
taagttagaagccaa

SEQ ID NO: 225485 - DNA, 15 bp, Homo sapiens
ctaagttagaagcca

SEQ ID NO: 225486 - DNA, 15 bp, Homo sapiens
gctaagttagaagcc

SEQ ID NO: 225487 - DNA, 15 bp, Homo sapiens
agctaagttagaagc

SEQ ID NO: 225488 - DNA, 15 bp, Homo sapiens
cagctaagttagaag

SEQ ID NO: 225489 - DNA, 15 bp, Homo sapiens
tcagctaagttagaa

SEQ ID NO: 225490 - DNA, 15 bp, Homo sapiens
ttcagctaagttaga

SEQ ID NO: 225491 - DNA, 15 bp, Homo sapiens
tttcagctaagttag

SEQ ID NO: 225492 - DNA, 15 bp, Homo sapiens
atttcagctaagtta

SEQ ID NO: 225493 - DNA, 15 bp, Homo sapiens
catttcagctaagtt

SEQ ID NO: 225494 - DNA, 15 bp, Homo sapiens
gcatttcagctaagt

SEQ ID NO: 225495 - DNA, 15 bp, Homo sapiens
agcatttcagctaag

SEQ ID NO: 225496 - DNA, 15 bp, Homo sapiens
aagcatttcagctaa

SEQ ID NO: 225497 - DNA, 15 bp, Homo sapiens
caagcatttcagcta

SEQ ID NO: 225498 - DNA, 15 bp, Homo sapiens
gcaagcatttcagct

SEQ ID NO: 225499 - DNA, 15 bp, Homo sapiens
agcaagcatttcagc

SEQ ID NO: 225500 - DNA, 15 bp, Homo sapiens
tagcaagcatttcag

SEQ ID NO: 225501 - DNA, 15 bp, Homo sapiens
atagcaagcatttca

SEQ ID NO: 225502 - DNA, 15 bp, Homo sapiens
aatagcaagcatttc

SEQ ID NO: 225503 - DNA, 15 bp, Homo sapiens
taatagcaagcattt

SEQ ID NO: 225504 - DNA, 15 bp, Homo sapiens
ctaatagcaagcatt

SEQ ID NO: 225505 - DNA, 15 bp, Homo sapiens
actaatagcaagcat

SEQ ID NO: 225506 - DNA, 15 bp, Homo sapiens
gactaatagcaagca

SEQ ID NO: 225507 - DNA, 15 bp, Homo sapiens
tgactaatagcaagc

SEQ ID NO: 225508 - DNA, 15 bp, Homo sapiens
atgactaatagcaag

SEQ ID NO: 225509 - DNA, 15 bp, Homo sapiens
aatgactaatagcaa

SEQ ID NO: 225510 - DNA, 15 bp, Homo sapiens
aaatgactaatagca

SEQ ID NO: 225511 - DNA, 15 bp, Homo sapiens
aaaatgactaatagc

SEQ ID NO: 225512 - DNA, 15 bp, Homo sapiens
gaaaatgactaatag

SEQ ID NO: 225513 - DNA, 15 bp, Homo sapiens
agaaaatgactaata

SEQ ID NO: 225514 - DNA, 15 bp, Homo sapiens
aagaaaatgactaat

SEQ ID NO: 225515 - DNA, 15 bp, Homo sapiens
caagaaaatgactaa

SEQ ID NO: 225516 - DNA, 15 bp, Homo sapiens
gcaagaaaatgacta

SEQ ID NO: 225517 - DNA, 15 bp, Homo sapiens
agcaagaaaatgact

SEQ ID NO: 225518 - DNA, 15 bp, Homo sapiens
tagcaagaaaatgac

SEQ ID NO: 225519 - DNA, 15 bp, Homo sapiens
ttagcaagaaaatga

SEQ ID NO: 225520 - DNA, 15 bp, Homo sapiens
cttagcaagaaaatg

SEQ ID NO: 225521 - DNA, 15 bp, Homo sapiens
acttagcaagaaaat

SEQ ID NO: 225522 - DNA, 15 bp, Homo sapiens
cacttagcaagaaaa

SEQ ID NO: 225523 - DNA, 15 bp, Homo sapiens
acacttagcaagaaa

SEQ ID NO: 225524 - DNA, 15 bp, Homo sapiens
cacacttagcaagaa

SEQ ID NO: 225525 - DNA, 15 bp, Homo sapiens
ccacacttagcaaga

SEQ ID NO: 225526 - DNA, 15 bp, Homo sapiens
accacacttagcaag

SEQ ID NO: 225527 - DNA, 15 bp, Homo sapiens
gaccacacttagcaa

SEQ ID NO: 225528 - DNA, 15 bp, Homo sapiens
tgaccacacttagca

SEQ ID NO: 225529 - DNA, 15 bp, Homo sapiens
ctgaccacacttagc

SEQ ID NO: 225530 - DNA, 15 bp, Homo sapiens
tctgaccacacttag

SEQ ID NO: 225531 - DNA, 15 bp, Homo sapiens
ttctgaccacactta

SEQ ID NO: 225532 - DNA, 15 bp, Homo sapiens
cttctgaccacactt

SEQ ID NO: 225533 - DNA, 15 bp, Homo sapiens
acttctgaccacact

SEQ ID NO: 225534 - DNA, 15 bp, Homo sapiens
cacttctgaccacac

SEQ ID NO: 225535 - DNA, 15 bp, Homo sapiens
ccacttctgaccaca

SEQ ID NO: 225536 - DNA, 15 bp, Homo sapiens
accacttctgaccac

SEQ ID NO: 225537 - DNA, 15 bp, Homo sapiens
taccacttctgacca

SEQ ID NO: 225538 - DNA, 15 bp, Homo sapiens
ataccacttctgacc

SEQ ID NO: 225539 - DNA, 15 bp, Homo sapiens
tataccacttctgac

SEQ ID NO: 225540 - DNA, 15 bp, Homo sapiens
ctataccacttctga

SEQ ID NO: 225541 - DNA, 15 bp, Homo sapiens
actataccacttctg

SEQ ID NO: 225542 - DNA, 15 bp, Homo sapiens
aactataccacttct

SEQ ID NO: 225543 - DNA, 15 bp, Homo sapiens
caactataccacttc

SEQ ID NO: 225544 - DNA, 15 bp, Homo sapiens
tcaactataccactt

SEQ ID NO: 225545 - DNA, 15 bp, Homo sapiens
ttcaactataccact

SEQ ID NO: 225546 - DNA, 15 bp, Homo sapiens
cttcaactataccac

SEQ ID NO: 225547 - DNA, 15 bp, Homo sapiens
tcttcaactatacca

SEQ ID NO: 225548 - DNA, 15 bp, Homo sapiens
atcttcaactatacc

SEQ ID NO: 225549 - DNA, 15 bp, Homo sapiens
catcttcaactatac

SEQ ID NO: 225550 - DNA, 15 bp, Homo sapiens
acatcttcaactata

SEQ ID NO: 225551 - DNA, 15 bp, Homo sapiens
gacatcttcaactat

SEQ ID NO: 225552 - DNA, 15 bp, Homo sapiens
ggacatcttcaacta

SEQ ID NO: 225553 - DNA, 15 bp, Homo sapiens
gggacatcttcaact

SEQ ID NO: 225554 - DNA, 15 bp, Homo sapiens
tgggacatcttcaac

SEQ ID NO: 225555 - DNA, 15 bp, Homo sapiens
atgggacatcttcaa

SEQ ID NO: 225556 - DNA, 15 bp, Homo sapiens
tatgggacatcttca

SEQ ID NO: 225557 - DNA, 15 bp, Homo sapiens
ttatgggacatcttc

SEQ ID NO: 225558 - DNA, 15 bp, Homo sapiens
attatgggacatctt

SEQ ID NO: 225559 - DNA, 15 bp, Homo sapiens
aattatgggacatct

SEQ ID NO: 225560 - DNA, 15 bp, Homo sapiens
aaattatgggacatc

SEQ ID NO: 225561 - DNA, 15 bp, Homo sapiens
caaattatgggacat

SEQ ID NO: 225562 - DNA, 15 bp, Homo sapiens
ccaaattatgggaca

SEQ ID NO: 225563 - DNA, 15 bp, Homo sapiens
accaaattatgggac

SEQ ID NO: 225564 - DNA, 15 bp, Homo sapiens
caccaaattatggga

SEQ ID NO: 225565 - DNA, 15 bp, Homo sapiens
tcaccaaattatggg

SEQ ID NO: 225566 - DNA, 15 bp, Homo sapiens
ttcaccaaattatgg

SEQ ID NO: 225567 - DNA, 15 bp, Homo sapiens
gttcaccaaattatg

SEQ ID NO: 225568 - DNA, 15 bp, Homo sapiens
tgttcaccaaattat

SEQ ID NO: 225569 - DNA, 15 bp, Homo sapiens
gtgttcaccaaatta

SEQ ID NO: 225570 - DNA, 15 bp, Homo sapiens
cgtgttcaccaaatt

SEQ ID NO: 225571 - DNA, 15 bp, Homo sapiens
acgtgttcaccaaat

SEQ ID NO: 225572 - DNA, 15 bp, Homo sapiens
cacgtgttcaccaaa

SEQ ID NO: 225573 - DNA, 15 bp, Homo sapiens
tcacgtgttcaccaa

SEQ ID NO: 225574 - DNA, 15 bp, Homo sapiens
ctcacgtgttcacca

SEQ ID NO: 225575 - DNA, 15 bp, Homo sapiens
cctcacgtgttcacc

SEQ ID NO: 225576 - DNA, 15 bp, Homo sapiens
acctcacgtgttcac

SEQ ID NO: 225577 - DNA, 15 bp, Homo sapiens
aacctcacgtgttca

SEQ ID NO: 225578 - DNA, 15 bp, Homo sapiens
taacctcacgtgttc

SEQ ID NO: 225579 - DNA, 15 bp, Homo sapiens
gtaacctcacgtgtt

SEQ ID NO: 225580 - DNA, 15 bp, Homo sapiens
tgtaacctcacgtgt

SEQ ID NO: 225581 - DNA, 15 bp, Homo sapiens
ttgtaacctcacgtg

SEQ ID NO: 225582 - DNA, 15 bp, Homo sapiens
tttgtaacctcacgt

SEQ ID NO: 225583 - DNA, 15 bp, Homo sapiens
gtttgtaacctcacg

SEQ ID NO: 225584 - DNA, 15 bp, Homo sapiens
agtttgtaacctcac

SEQ ID NO: 225585 - DNA, 15 bp, Homo sapiens
gagtttgtaacctca

SEQ ID NO: 225586 - DNA, 15 bp, Homo sapiens
tgagtttgtaacctc

SEQ ID NO: 225587 - DNA, 15 bp, Homo sapiens
ttgagtttgtaacct

SEQ ID NO: 225588 - DNA, 15 bp, Homo sapiens
gttgagtttgtaacc

SEQ ID NO: 225589 - DNA, 15 bp, Homo sapiens
agttgagtttgtaac

SEQ ID NO: 225590 - DNA, 15 bp, Homo sapiens
aagttgagtttgtaa

SEQ ID NO: 225591 - DNA, 15 bp, Homo sapiens
aaagttgagtttgta

SEQ ID NO: 225592 - DNA, 15 bp, Homo sapiens
aaaagttgagtttgt

SEQ ID NO: 225593 - DNA, 15 bp, Homo sapiens
caaaagttgagtttg

SEQ ID NO: 225594 - DNA, 15 bp, Homo sapiens
gcaaaagttgagttt

SEQ ID NO: 225595 - DNA, 15 bp, Homo sapiens
agcaaaagttgagtt

SEQ ID NO: 225596 - DNA, 15 bp, Homo sapiens
aagcaaaagttgagt

SEQ ID NO: 225597 - DNA, 15 bp, Homo sapiens
gaagcaaaagttgag

SEQ ID NO: 225598 - DNA, 15 bp, Homo sapiens
agaagcaaaagttga

SEQ ID NO: 225599 - DNA, 15 bp, Homo sapiens
gagaagcaaaagttg

SEQ ID NO: 225600 - DNA, 15 bp, Homo sapiens
agagaagcaaaagtt

SEQ ID NO: 225601 - DNA, 15 bp, Homo sapiens
aagagaagcaaaagt

SEQ ID NO: 225602 - DNA, 15 bp, Homo sapiens
aaagagaagcaaaag

SEQ ID NO: 225603 - DNA, 15 bp, Homo sapiens
aaaagagaagcaaaa

SEQ ID NO: 225604 - DNA, 15 bp, Homo sapiens
caaaagagaagcaaa

SEQ ID NO: 225605 - DNA, 15 bp, Homo sapiens
tcaaaagagaagcaa

SEQ ID NO: 225606 - DNA, 15 bp, Homo sapiens
ttcaaaagagaagca

SEQ ID NO: 225607 - DNA, 15 bp, Homo sapiens
tttcaaaagagaagc

SEQ ID NO: 225608 - DNA, 15 bp, Homo sapiens
ctttcaaaagagaag

SEQ ID NO: 225609 - DNA, 15 bp, Homo sapiens
cctttcaaaagagaa

SEQ ID NO: 225610 - DNA, 15 bp, Homo sapiens
gcctttcaaaagaga

SEQ ID NO: 225611 - DNA, 15 bp, Homo sapiens
ggcctttcaaaagag

SEQ ID NO: 225612 - DNA, 15 bp, Homo sapiens
gggcctttcaaaaga

SEQ ID NO: 225613 - DNA, 15 bp, Homo sapiens
agggcctttcaaaag

SEQ ID NO: 225614 - DNA, 15 bp, Homo sapiens
cagggcctttcaaaa

SEQ ID NO: 225615 - DNA, 15 bp, Homo sapiens
tcagggcctttcaaa

SEQ ID NO: 225616 - DNA, 15 bp, Homo sapiens
ctcagggcctttcaa

SEQ ID NO: 225617 - DNA, 15 bp, Homo sapiens
tctcagggcctttca

SEQ ID NO: 225618 - DNA, 15 bp, Homo sapiens
gtctcagggcctttc

SEQ ID NO: 225619 - DNA, 15 bp, Homo sapiens
cgtctcagggccttt

SEQ ID NO: 225620 - DNA, 15 bp, Homo sapiens
ccgtctcagggcctt

SEQ ID NO: 225621 - DNA, 15 bp, Homo sapiens
cccgtctcagggcct

SEQ ID NO: 225622 - DNA, 15 bp, Homo sapiens
tcccgtctcagggcc

SEQ ID NO: 225623 - DNA, 15 bp, Homo sapiens
ctcccgtctcagggc

SEQ ID NO: 225624 - DNA, 15 bp, Homo sapiens
actcccgtctcaggg

SEQ ID NO: 225625 - DNA, 15 bp, Homo sapiens
aactcccgtctcagg

SEQ ID NO: 225626 - DNA, 15 bp, Homo sapiens
taactcccgtctcag

SEQ ID NO: 225627 - DNA, 15 bp, Homo sapiens
ttaactcccgtctca

SEQ ID NO: 225628 - DNA, 15 bp, Homo sapiens
tttaactcccgtctc

SEQ ID NO: 225629 - DNA, 15 bp, Homo sapiens
ctttaactcccgtct

SEQ ID NO: 225630 - DNA, 15 bp, Homo sapiens
cctttaactcccgtc

SEQ ID NO: 225631 - DNA, 15 bp, Homo sapiens
tcctttaactcccgt

SEQ ID NO: 225632 - DNA, 15 bp, Homo sapiens
ctcctttaactcccg

SEQ ID NO: 225633 - DNA, 15 bp, Homo sapiens
tctcctttaactccc

SEQ ID NO: 225634 - DNA, 15 bp, Homo sapiens
ttctcctttaactcc

SEQ ID NO: 225635 - DNA, 15 bp, Homo sapiens
tttctcctttaactc

SEQ ID NO: 225636 - DNA, 15 bp, Homo sapiens
ctttctcctttaact

SEQ ID NO: 225637 - DNA, 15 bp, Homo sapiens
tctttctcctttaac

SEQ ID NO: 225638 - DNA, 15 bp, Homo sapiens
ttctttctcctttaa

SEQ ID NO: 225639 - DNA, 15 bp, Homo sapiens
attctttctccttta

SEQ ID NO: 225640 - DNA, 15 bp, Homo sapiens
tattctttctccttt

SEQ ID NO: 225641 - DNA, 15 bp, Homo sapiens
atattctttctcctt

SEQ ID NO: 225642 - DNA, 15 bp, Homo sapiens
aatattctttctcct

SEQ ID NO: 225643 - DNA, 15 bp, Homo sapiens
gaatattctttctcc

SEQ ID NO: 225644 - DNA, 15 bp, Homo sapiens
agaatattctttctc

SEQ ID NO: 225645 - DNA, 15 bp, Homo sapiens
cagaatattctttct

SEQ ID NO: 225646 - DNA, 15 bp, Homo sapiens
acagaatattctttc

SEQ ID NO: 225647 - DNA, 15 bp, Homo sapiens
gacagaatattcttt

SEQ ID NO: 225648 - DNA, 15 bp, Homo sapiens
ggacagaatattctt

SEQ ID NO: 225649 - DNA, 15 bp, Homo sapiens
aggacagaatattct

SEQ ID NO: 225650 - DNA, 15 bp, Homo sapiens
caggacagaatattc

SEQ ID NO: 225651 - DNA, 15 bp, Homo sapiens
tcaggacagaatatt

SEQ ID NO: 225652 - DNA, 15 bp, Homo sapiens
ttcaggacagaatat

SEQ ID NO: 225653 - DNA, 15 bp, Homo sapiens
attcaggacagaata

SEQ ID NO: 225654 - DNA, 15 bp, Homo sapiens
cattcaggacagaat

SEQ ID NO: 225655 - DNA, 15 bp, Homo sapiens
gcattcaggacagaa

SEQ ID NO: 225656 - DNA, 15 bp, Homo sapiens
agcattcaggacaga

SEQ ID NO: 225657 - DNA, 15 bp, Homo sapiens
cagcattcaggacag

SEQ ID NO: 225658 - DNA, 15 bp, Homo sapiens
acagcattcaggaca

SEQ ID NO: 225659 - DNA, 15 bp, Homo sapiens
gacagcattcaggac

SEQ ID NO: 225660 - DNA, 15 bp, Homo sapiens
cgacagcattcagga

SEQ ID NO: 225661 - DNA, 15 bp, Homo sapiens
tcgacagcattcagg

SEQ ID NO: 225662 - DNA, 15 bp, Homo sapiens
gtcgacagcattcag

SEQ ID NO: 225663 - DNA, 15 bp, Homo sapiens
ggtcgacagcattca

SEQ ID NO: 225664 - DNA, 15 bp, Homo sapiens
tggtcgacagcattc

SEQ ID NO: 225665 - DNA, 15 bp, Homo sapiens
ctggtcgacagcatt

SEQ ID NO: 225666 - DNA, 15 bp, Homo sapiens
cctggtcgacagcat

SEQ ID NO: 225667 - DNA, 15 bp, Homo sapiens
gcctggtcgacagca

SEQ ID NO: 225668 - DNA, 15 bp, Homo sapiens
ggcctggtcgacagc

SEQ ID NO: 225669 - DNA, 15 bp, Homo sapiens
gggcctggtcgacag

SEQ ID NO: 225670 - DNA, 15 bp, Homo sapiens
cgggcctggtcgaca

SEQ ID NO: 225671 - DNA, 15 bp, Homo sapiens
tcgggcctggtcgac

SEQ ID NO: 225672 - DNA, 15 bp, Homo sapiens
ctcgggcctggtcga

SEQ ID NO: 225673 - DNA, 15 bp, Homo sapiens
actcgggcctggtcg

SEQ ID NO: 225674 - DNA, 15 bp, Homo sapiens
aactcgggcctggtc

SEQ ID NO: 225675 - DNA, 15 bp, Homo sapiens
aaactcgggcctggt

SEQ ID NO: 225676 - DNA, 15 bp, Homo sapiens
aaaactcgggcctgg

SEQ ID NO: 225677 - DNA, 15 bp, Homo sapiens
gaaaactcgggcctg

SEQ ID NO: 225678 - DNA, 15 bp, Homo sapiens
agaaaactcgggcct

SEQ ID NO: 225679 - DNA, 15 bp, Homo sapiens
aagaaaactcgggcc

SEQ ID NO: 225680 - DNA, 15 bp, Homo sapiens
caagaaaactcgggc

SEQ ID NO: 225681 - DNA, 15 bp, Homo sapiens
ccaagaaaactcggg

SEQ ID NO: 225682 - DNA, 15 bp, Homo sapiens
gccaagaaaactcgg

SEQ ID NO: 225683 - DNA, 15 bp, Homo sapiens
agccaagaaaactcg

SEQ ID NO: 225684 - DNA, 15 bp, Homo sapiens
cagccaagaaaactc

SEQ ID NO: 225685 - DNA, 15 bp, Homo sapiens
tcagccaagaaaact

SEQ ID NO: 225686 - DNA, 15 bp, Homo sapiens
atcagccaagaaaac

SEQ ID NO: 225687 - DNA, 15 bp, Homo sapiens
gatcagccaagaaaa

SEQ ID NO: 225688 - DNA, 15 bp, Homo sapiens
tgatcagccaagaaa

SEQ ID NO: 225689 - DNA, 15 bp, Homo sapiens
ctgatcagccaagaa

SEQ ID NO: 225690 - DNA, 15 bp, Homo sapiens
gctgatcagccaaga

SEQ ID NO: 225691 - DNA, 15 bp, Homo sapiens
ggctgatcagccaag

SEQ ID NO: 225692 - DNA, 15 bp, Homo sapiens
tggctgatcagccaa

SEQ ID NO: 225693 - DNA, 15 bp, Homo sapiens
ttggctgatcagcca

SEQ ID NO: 225694 - DNA, 15 bp, Homo sapiens
attggctgatcagcc

SEQ ID NO: 225695 - DNA, 15 bp, Homo sapiens
aattggctgatcagc

SEQ ID NO: 225696 - DNA, 15 bp, Homo sapiens
caattggctgatcag

SEQ ID NO: 225697 - DNA, 15 bp, Homo sapiens
tcaattggctgatca

SEQ ID NO: 225698 - DNA, 15 bp, Homo sapiens
ctcaattggctgatc

SEQ ID NO: 225699 - DNA, 15 bp, Homo sapiens
cctcaattggctgat

SEQ ID NO: 225700 - DNA, 15 bp, Homo sapiens
gcctcaattggctga

SEQ ID NO: 225701 - DNA, 15 bp, Homo sapiens
ggcctcaattggctg

SEQ ID NO: 225702 - DNA, 15 bp, Homo sapiens
gggcctcaattggct

SEQ ID NO: 225703 - DNA, 15 bp, Homo sapiens
ggggcctcaattggc

SEQ ID NO: 225704 - DNA, 15 bp, Homo sapiens
aggggcctcaattgg

SEQ ID NO: 225705 - DNA, 15 bp, Homo sapiens
caggggcctcaattg

SEQ ID NO: 225706 - DNA, 15 bp, Homo sapiens
tcaggggcctcaatt

SEQ ID NO: 225707 - DNA, 15 bp, Homo sapiens
ttcaggggcctcaat

SEQ ID NO: 225708 - DNA, 15 bp, Homo sapiens
cttcaggggcctcaa

SEQ ID NO: 225709 - DNA, 15 bp, Homo sapiens
tcttcaggggcctca

SEQ ID NO: 225710 - DNA, 15 bp, Homo sapiens
ctcttcaggggcctc

SEQ ID NO: 225711 - DNA, 15 bp, Homo sapiens
gctcttcaggggcct

SEQ ID NO: 225712 - DNA, 15 bp, Homo sapiens
ggctcttcaggggcc

SEQ ID NO: 225713 - DNA, 15 bp, Homo sapiens
tggctcttcaggggc

SEQ ID NO: 225714 - DNA, 15 bp, Homo sapiens
ttggctcttcagggg

SEQ ID NO: 225715 - DNA, 15 bp, Homo sapiens
cttggctcttcaggg

SEQ ID NO: 225716 - DNA, 15 bp, Homo sapiens
tcttggctcttcagg

SEQ ID NO: 225717 - DNA, 15 bp, Homo sapiens
ttcttggctcttcag

SEQ ID NO: 225718 - DNA, 15 bp, Homo sapiens
cttcttggctcttca

SEQ ID NO: 225719 - DNA, 15 bp, Homo sapiens
tcttcttggctcttc

SEQ ID NO: 225720 - DNA, 15 bp, Homo sapiens
ttcttcttggctctt

SEQ ID NO: 225721 - DNA, 15 bp, Homo sapiens
tttcttcttggctct

SEQ ID NO: 225722 - DNA, 15 bp, Homo sapiens
gtttcttcttggctc

SEQ ID NO: 225723 - DNA, 15 bp, Homo sapiens
ggtttcttcttggct

SEQ ID NO: 225724 - DNA, 15 bp, Homo sapiens
aggtttcttcttggc

SEQ ID NO: 225725 - DNA, 15 bp, Homo sapiens
taggtttcttcttgg

SEQ ID NO: 225726 - DNA, 15 bp, Homo sapiens
gtaggtttcttcttg

SEQ ID NO: 225727 - DNA, 15 bp, Homo sapiens
tgtaggtttcttctt

SEQ ID NO: 225728 - DNA, 15 bp, Homo sapiens
ttgtaggtttcttct

SEQ ID NO: 225729 - DNA, 15 bp, Homo sapiens
attgtaggtttcttc

SEQ ID NO: 225730 - DNA, 15 bp, Homo sapiens
tgattgtaggtttct

SEQ ID NO: 225731 - DNA, 15 bp, Homo sapiens
ttgattgtaggtttc

SEQ ID NO: 225732 - DNA, 15 bp, Homo sapiens
tttgattgtaggttt

SEQ ID NO: 225733 - DNA, 15 bp, Homo sapiens
ttttgattgtaggtt

SEQ ID NO: 225734 - DNA, 15 bp, Homo sapiens
tttttgattgtaggt

SEQ ID NO: 225735 - DNA, 15 bp, Homo sapiens
gtttttgattgtagg

SEQ ID NO: 225736 - DNA, 15 bp, Homo sapiens
tgtttttgattgtag

SEQ ID NO: 225737 - DNA, 15 bp, Homo sapiens
ctgtttttgattgta

SEQ ID NO: 225738 - DNA, 15 bp, Homo sapiens
cctgtttttgattgt

SEQ ID NO: 225739 - DNA, 15 bp, Homo sapiens
acctgtttttgattg

SEQ ID NO: 225740 - DNA, 15 bp, Homo sapiens
cacctgtttttgatt

SEQ ID NO: 225741 - DNA, 15 bp, Homo sapiens
tcacctgtttttgat

SEQ ID NO: 225742 - DNA, 15 bp, Homo sapiens
ctcacctgtttttga

SEQ ID NO: 225743 - DNA, 15 bp, Homo sapiens
tctcacctgtttttg

SEQ ID NO: 225744 - DNA, 15 bp, Homo sapiens
gtctcacctgttttt

SEQ ID NO: 225745 - DNA, 15 bp, Homo sapiens
agtctcacctgtttt

SEQ ID NO: 225746 - DNA, 15 bp, Homo sapiens
cagtctcacctgttt

SEQ ID NO: 225747 - DNA, 15 bp, Homo sapiens
ccagtctcacctgtt

SEQ ID NO: 225748 - DNA, 15 bp, Homo sapiens
accagtctcacctgt

SEQ ID NO: 225749 - DNA, 15 bp, Homo sapiens
aaccagtctcacctg

SEQ ID NO: 225750 - DNA, 15 bp, Homo sapiens
aaaccagtctcacct

SEQ ID NO: 225751 - DNA, 15 bp, Homo sapiens
gaaaccagtctcacc

SEQ ID NO: 225752 - DNA, 15 bp, Homo sapiens
agaaaccagtctcac

SEQ ID NO: 225753 - DNA, 15 bp, Homo sapiens
gagaaaccagtctca

SEQ ID NO: 225754 - DNA, 15 bp, Homo sapiens
ggagaaaccagtctc

SEQ ID NO: 225755 - DNA, 15 bp, Homo sapiens
tggagaaaccagtct

SEQ ID NO: 225756 - DNA, 15 bp, Homo sapiens
gtggagaaaccagtc

SEQ ID NO: 225757 - DNA, 15 bp, Homo sapiens
agtggagaaaccagt

SEQ ID NO: 225758 - DNA, 15 bp, Homo sapiens
tagtggagaaaccag

SEQ ID NO: 225759 - DNA, 15 bp, Homo sapiens
gtagtggagaaacca

SEQ ID NO: 225760 - DNA, 15 bp, Homo sapiens
tgtagtggagaaacc

SEQ ID NO: 225761 - DNA, 15 bp, Homo sapiens
atgtagtggagaaac

SEQ ID NO: 225762 - DNA, 15 bp, Homo sapiens
gatgtagtggagaaa

SEQ ID NO: 225763 - DNA, 15 bp, Homo sapiens
tgatgtagtggagaa

SEQ ID NO: 225764 - DNA, 15 bp, Homo sapiens
atgatgtagtggaga

SEQ ID NO: 225765 - DNA, 15 bp, Homo sapiens
tatgatgtagtggag

SEQ ID NO: 225766 - DNA, 15 bp, Homo sapiens
ttatgatgtagtgga

SEQ ID NO: 225767 - DNA, 15 bp, Homo sapiens
tttatgatgtagtgg

SEQ ID NO: 225768 - DNA, 15 bp, Homo sapiens
ttttatgatgtagtg

SEQ ID NO: 225769 - DNA, 15 bp, Homo sapiens
tttttatgatgtagt

SEQ ID NO: 225770 - DNA, 15 bp, Homo sapiens
gtttttatgatgtag

SEQ ID NO: 225771 - DNA, 15 bp, Homo sapiens
tgtttttatgatgta

SEQ ID NO: 225772 - DNA, 15 bp, Homo sapiens
gtgtttttatgatgt

SEQ ID NO: 225773 - DNA, 15 bp, Homo sapiens
tgtgtttttatgatg

SEQ ID NO: 225774 - DNA, 15 bp, Homo sapiens
atgtgtttttatgat

SEQ ID NO: 225775 - DNA, 15 bp, Homo sapiens
catgtgtttttatga

SEQ ID NO: 225776 - DNA, 15 bp, Homo sapiens
gcatgtgtttttatg

SEQ ID NO: 225777 - DNA, 15 bp, Homo sapiens
agcatgtgtttttat

SEQ ID NO: 225778 - DNA, 15 bp, Homo sapiens
tagcatgtgttttta

SEQ ID NO: 225779 - DNA, 15 bp, Homo sapiens
ctagcatgtgttttt

SEQ ID NO: 225780 - DNA, 15 bp, Homo sapiens
cctagcatgtgtttt

SEQ ID NO: 225781 - DNA, 15 bp, Homo sapiens
tcctagcatgtgttt

SEQ ID NO: 225782 - DNA, 15 bp, Homo sapiens
ctcctagcatgtgtt

SEQ ID NO: 225783 - DNA, 15 bp, Homo sapiens
tctcctagcatgtgt

SEQ ID NO: 225784 - DNA, 15 bp, Homo sapiens
ttctcctagcatgtg

SEQ ID NO: 225785 - DNA, 15 bp, Homo sapiens
gttctcctagcatgt

SEQ ID NO: 225786 - DNA, 15 bp, Homo sapiens
tgttctcctagcatg

SEQ ID NO: 225787 - DNA, 15 bp, Homo sapiens
ttgttctcctagcat

SEQ ID NO: 225788 - DNA, 15 bp, Homo sapiens
tttgttctcctagca

SEQ ID NO: 225789 - DNA, 15 bp, Homo sapiens
ttttgttctcctagc

SEQ ID NO: 225790 - DNA, 15 bp, Homo sapiens
tttttgttctcctag

SEQ ID NO: 225791 - DNA, 15 bp, Homo sapiens
ttttttgttctccta

SEQ ID NO: 225792 - DNA, 15 bp, Homo sapiens
gttttttgttctcct

SEQ ID NO: 225793 - DNA, 15 bp, Homo sapiens
ggttttttgttctcc

SEQ ID NO: 225794 - DNA, 15 bp, Homo sapiens
gggttttttgttctc

SEQ ID NO: 225795 - DNA, 15 bp, Homo sapiens
tgggttttttgttct

SEQ ID NO: 225796 - DNA, 15 bp, Homo sapiens
ttgggttttttgttc

SEQ ID NO: 225797 - DNA, 15 bp, Homo sapiens
tttgggttttttgtt

SEQ ID NO: 225798 - DNA, 15 bp, Homo sapiens
ttttgggttttttgt

SEQ ID NO: 225799 - DNA, 15 bp, Homo sapiens
attttgggttttttg

SEQ ID NO: 225800 - DNA, 15 bp, Homo sapiens
gattttgggtttttt

SEQ ID NO: 225801 - DNA, 15 bp, Homo sapiens
tgattttgggttttt

SEQ ID NO: 225802 - DNA, 15 bp, Homo sapiens
ttgattttgggtttt

SEQ ID NO: 225803 - DNA, 15 bp, Homo sapiens
cttgattttgggttt

SEQ ID NO: 225804 - DNA, 15 bp, Homo sapiens
acttgattttgggtt

SEQ ID NO: 225805 - DNA, 15 bp, Homo sapiens
tacttgattttgggt

SEQ ID NO: 225806 - DNA, 15 bp, Homo sapiens
ctacttgattttggg

SEQ ID NO: 225807 - DNA, 15 bp, Homo sapiens
cctacttgattttgg

SEQ ID NO: 225808 - DNA, 15 bp, Homo sapiens
tcctacttgattttg

SEQ ID NO: 225809 - DNA, 15 bp, Homo sapiens
ttcctacttgatttt

SEQ ID NO: 225810 - DNA, 15 bp, Homo sapiens
tttcctacttgattt

SEQ ID NO: 225811 - DNA, 15 bp, Homo sapiens
atttcctacttgatt

SEQ ID NO: 225812 - DNA, 15 bp, Homo sapiens
aatttcctacttgat

SEQ ID NO: 225813 - DNA, 15 bp, Homo sapiens
aaatttcctacttga

SEQ ID NO: 225814 - DNA, 15 bp, Homo sapiens
gaaatttcctacttg

SEQ ID NO: 225815 - DNA, 15 bp, Homo sapiens
ggaaatttcctactt

SEQ ID NO: 225816 - DNA, 15 bp, Homo sapiens
aggaaatttcctact

SEQ ID NO: 225817 - DNA, 15 bp, Homo sapiens
aaggaaatttcctac

SEQ ID NO: 225818 - DNA, 15 bp, Homo sapiens
taaggaaatttccta

SEQ ID NO: 225819 - DNA, 15 bp, Homo sapiens
gtaaggaaatttcct

SEQ ID NO: 225820 - DNA, 15 bp, Homo sapiens
tgtaaggaaatttcc

SEQ ID NO: 225821 - DNA, 15 bp, Homo sapiens
ctgtaaggaaatttc

SEQ ID NO: 225822 - DNA, 15 bp, Homo sapiens
gctgtaaggaaattt

SEQ ID NO: 225823 - DNA, 15 bp, Homo sapiens
tgctgtaaggaaatt

SEQ ID NO: 225824 - DNA, 15 bp, Homo sapiens
atgctgtaaggaaat

SEQ ID NO: 225825 - DNA, 15 bp, Homo sapiens
aatgctgtaaggaaa

SEQ ID NO: 225826 - DNA, 15 bp, Homo sapiens
aaatgctgtaaggaa

SEQ ID NO: 225827 - DNA, 15 bp, Homo sapiens
aaaatgctgtaagga

SEQ ID NO: 225828 - DNA, 15 bp, Homo sapiens
taaaatgctgtaagg

SEQ ID NO: 225829 - DNA, 15 bp, Homo sapiens
ctaaaatgctgtaag

SEQ ID NO: 225830 - DNA, 15 bp, Homo sapiens
cctaaaatgctgtaa

SEQ ID NO: 225831 - DNA, 15 bp, Homo sapiens
tcctaaaatgctgta

SEQ ID NO: 225832 - DNA, 15 bp, Homo sapiens
atcctaaaatgctgt

SEQ ID NO: 225833 - DNA, 15 bp, Homo sapiens
gatcctaaaatgctg

SEQ ID NO: 225834 - DNA, 15 bp, Homo sapiens
agatcctaaaatgct

SEQ ID NO: 225835 - DNA, 15 bp, Homo sapiens
tagatcctaaaatgc

SEQ ID NO: 225836 - DNA, 15 bp, Homo sapiens
ttagatcctaaaatg

SEQ ID NO: 225837 - DNA, 15 bp, Homo sapiens
attagatcctaaaat

SEQ ID NO: 225838 - DNA, 15 bp, Homo sapiens
tattagatcctaaaa

SEQ ID NO: 225839 - DNA, 15 bp, Homo sapiens
atattagatcctaaa

SEQ ID NO: 225840 - DNA, 15 bp, Homo sapiens
aatattagatcctaa

SEQ ID NO: 225841 - DNA, 15 bp, Homo sapiens
aaatattagatccta

SEQ ID NO: 225842 - DNA, 15 bp, Homo sapiens
taaatattagatcct

SEQ ID NO: 225843 - DNA, 15 bp, Homo sapiens
ttaaatattagatcc

SEQ ID NO: 225844 - DNA, 15 bp, Homo sapiens
tttaaatattagatc

SEQ ID NO: 225845 - DNA, 15 bp, Homo sapiens
atttaaatattagat

SEQ ID NO: 225846 - DNA, 15 bp, Homo sapiens
gatttaaatattaga

SEQ ID NO: 225847 - DNA, 15 bp, Homo sapiens
agatttaaatattag

SEQ ID NO: 225848 - DNA, 15 bp, Homo sapiens
aagatttaaatatta

SEQ ID NO: 225849 - DNA, 15 bp, Homo sapiens
aaagatttaaatatt

SEQ ID NO: 225850 - DNA, 15 bp, Homo sapiens
aaaagatttaaatat

SEQ ID NO: 225851 - DNA, 15 bp, Homo sapiens
gaaaagatttaaata

SEQ ID NO: 225852 - DNA, 15 bp, Homo sapiens
agaaaagatttaaat

SEQ ID NO: 225853 - DNA, 15 bp, Homo sapiens
aagaaaagatttaaa

SEQ ID NO: 225854 - DNA, 15 bp, Homo sapiens
gaagaaaagatttaa

SEQ ID NO: 225855 - DNA, 15 bp, Homo sapiens
agaagaaaagattta

SEQ ID NO: 225856 - DNA, 15 bp, Homo sapiens
tagaagaaaagattt

SEQ ID NO: 225857 - DNA, 15 bp, Homo sapiens
ttagaagaaaagatt

SEQ ID NO: 225858 - DNA, 15 bp, Homo sapiens
cttagaagaaaagat

SEQ ID NO: 225859 - DNA, 15 bp, Homo sapiens
acttagaagaaaaga

SEQ ID NO: 225860 - DNA, 15 bp, Homo sapiens
cacttagaagaaaag

SEQ ID NO: 225861 - DNA, 15 bp, Homo sapiens
acacttagaagaaaa

SEQ ID NO: 225862 - DNA, 15 bp, Homo sapiens
aacacttagaagaaa

SEQ ID NO: 225863 - DNA, 15 bp, Homo sapiens
taacacttagaagaa

SEQ ID NO: 225864 - DNA, 15 bp, Homo sapiens
gtaacacttagaaga

SEQ ID NO: 225865 - DNA, 15 bp, Homo sapiens
agtaacacttagaag

SEQ ID NO: 225866 - DNA, 15 bp, Homo sapiens
aagtaacacttagaa

SEQ ID NO: 225867 - DNA, 15 bp, Homo sapiens
aaagtaacacttaga

SEQ ID NO: 225868 - DNA, 15 bp, Homo sapiens
taaagtaacacttag

SEQ ID NO: 225869 - DNA, 15 bp, Homo sapiens
ataaagtaacactta

SEQ ID NO: 225870 - DNA, 15 bp, Homo sapiens
aataaagtaacactt

SEQ ID NO: 225871 - DNA, 15 bp, Homo sapiens
gaataaagtaacact

SEQ ID NO: 225872 - DNA, 15 bp, Homo sapiens
tgaataaagtaacac

SEQ ID NO: 225873 - DNA, 15 bp, Homo sapiens
ttgaataaagtaaca

SEQ ID NO: 225874 - DNA, 15 bp, Homo sapiens
tttgaataaagtaac

SEQ ID NO: 225875 - DNA, 15 bp, Homo sapiens
atttgaataaagtaa

SEQ ID NO: 225876 - DNA, 15 bp, Homo sapiens
tatttgaataaagta

SEQ ID NO: 225877 - DNA, 15 bp, Homo sapiens
atatttgaataaagt

SEQ ID NO: 225878 - DNA, 15 bp, Homo sapiens
catatttgaataaag

SEQ ID NO: 225879 - DNA, 15 bp, Homo sapiens
acatatttgaataaa

SEQ ID NO: 225880 - DNA, 15 bp, Homo sapiens
gacatatttgaataa

SEQ ID NO: 225881 - DNA, 15 bp, Homo sapiens
tgacatatttgaata

SEQ ID NO: 225882 - DNA, 15 bp, Homo sapiens
atgacatatttgaat

SEQ ID NO: 225883 - DNA, 15 bp, Homo sapiens
aatgacatatttgaa

SEQ ID NO: 225884 - DNA, 15 bp, Homo sapiens
taatgacatatttga

SEQ ID NO: 225885 - DNA, 15 bp, Homo sapiens
ttaatgacatatttg

SEQ ID NO: 225886 - DNA, 15 bp, Homo sapiens
attaatgacatattt

SEQ ID NO: 225887 - DNA, 15 bp, Homo sapiens
aattaatgacatatt

SEQ ID NO: 225888 - DNA, 15 bp, Homo sapiens
gaattaatgacatat

SEQ ID NO: 225889 - DNA, 15 bp, Homo sapiens
tgaattaatgacata

SEQ ID NO: 225890 - DNA, 15 bp, Homo sapiens
gtgaattaatgacat

SEQ ID NO: 225891 - DNA, 15 bp, Homo sapiens
tgtgaattaatgaca

SEQ ID NO: 225892 - DNA, 15 bp, Homo sapiens
ctgtgaattaatgac

SEQ ID NO: 225893 - DNA, 15 bp, Homo sapiens
tctgtgaattaatga

SEQ ID NO: 225894 - DNA, 15 bp, Homo sapiens
atctgtgaattaatg

SEQ ID NO: 225895 - DNA, 15 bp, Homo sapiens
tatctgtgaattaat

SEQ ID NO: 225896 - DNA, 15 bp, Homo sapiens
atatctgtgaattaa

SEQ ID NO: 225897 - DNA, 15 bp, Homo sapiens
gatatctgtgaatta

SEQ ID NO: 225898 - DNA, 15 bp, Homo sapiens
agatatctgtgaatt

SEQ ID NO: 225899 - DNA, 15 bp, Homo sapiens
tagatatctgtgaat

SEQ ID NO: 225900 - DNA, 15 bp, Homo sapiens
ctagatatctgtgaa

SEQ ID NO: 225901 - DNA, 15 bp, Homo sapiens
tctagatatctgtga

SEQ ID NO: 225902 - DNA, 15 bp, Homo sapiens
atctagatatctgtg

SEQ ID NO: 225903 - DNA, 15 bp, Homo sapiens
aatctagatatctgt

SEQ ID NO: 225904 - DNA, 15 bp, Homo sapiens
gaatctagatatctg

SEQ ID NO: 225905 - DNA, 15 bp, Homo sapiens
agaatctagatatct

SEQ ID NO: 225906 - DNA, 15 bp, Homo sapiens
aagaatctagatatc

SEQ ID NO: 225907 - DNA, 15 bp, Homo sapiens
taagaatctagatat

SEQ ID NO: 225908 - DNA, 15 bp, Homo sapiens
ttaagaatctagata

SEQ ID NO: 225909 - DNA, 15 bp, Homo sapiens
tttaagaatctagat

SEQ ID NO: 225910 - DNA, 15 bp, Homo sapiens
atttaagaatctaga

SEQ ID NO: 225911 - DNA, 15 bp, Homo sapiens
aatttaagaatctag

SEQ ID NO: 225912 - DNA, 15 bp, Homo sapiens
taatttaagaatcta

SEQ ID NO: 225913 - DNA, 15 bp, Homo sapiens
ttaatttaagaatct

SEQ ID NO: 225914 - DNA, 15 bp, Homo sapiens
cttaatttaagaatc

SEQ ID NO: 225915 - DNA, 15 bp, Homo sapiens
tcttaatttaagaat

SEQ ID NO: 225916 - DNA, 15 bp, Homo sapiens
ttcttaatttaagaa

SEQ ID NO: 225917 - DNA, 15 bp, Homo sapiens
tttcttaatttaaga

SEQ ID NO: 225918 - DNA, 15 bp, Homo sapiens
ttttcttaatttaag

SEQ ID NO: 225919 - DNA, 15 bp, Homo sapiens
attttcttaatttaa

SEQ ID NO: 225920 - DNA, 15 bp, Homo sapiens
tattttcttaattta

SEQ ID NO: 225921 - DNA, 15 bp, Homo sapiens
ttattttcttaattt

SEQ ID NO: 225922 - DNA, 15 bp, Homo sapiens
tttattttcttaatt

SEQ ID NO: 225923 - DNA, 15 bp, Homo sapiens
ttttattttcttaat

SEQ ID NO: 225924 - DNA, 15 bp, Homo sapiens
attttattttcttaa

SEQ ID NO: 225925 - DNA, 15 bp, Homo sapiens
aattttattttctta

SEQ ID NO: 225926 - DNA, 15 bp, Homo sapiens
aaattttattttctt

SEQ ID NO: 225927 - DNA, 15 bp, Homo sapiens
aaaattttattttct

SEQ ID NO: 225928 - DNA, 15 bp, Homo sapiens
aaaaattttattttc

SEQ ID NO: 225929 - DNA, 15 bp, Homo sapiens
caaaaattttatttt

SEQ ID NO: 225930 - DNA, 15 bp, Homo sapiens
acaaaaattttattt

SEQ ID NO: 225931 - DNA, 15 bp, Homo sapiens
tacaaaaattttatt

SEQ ID NO: 225932 - DNA, 15 bp, Homo sapiens
atacaaaaattttat

SEQ ID NO: 225933 - DNA, 15 bp, Homo sapiens
tatacaaaaatttta

SEQ ID NO: 225934 - DNA, 15 bp, Homo sapiens
gtatacaaaaatttt

SEQ ID NO: 225935 - DNA, 15 bp, Homo sapiens
ggtatacaaaaattt

SEQ ID NO: 225936 - DNA, 15 bp, Homo sapiens
aggtatacaaaaatt

SEQ ID NO: 225937 - DNA, 15 bp, Homo sapiens
gaggtatacaaaaat

SEQ ID NO: 225938 - DNA, 15 bp, Homo sapiens
tgaggtatacaaaaa

SEQ ID NO: 225939 - DNA, 15 bp, Homo sapiens
ttgaggtatacaaaa

SEQ ID NO: 225940 - DNA, 15 bp, Homo sapiens
attgaggtatacaaa

SEQ ID NO: 225941 - DNA, 15 bp, Homo sapiens
tattgaggtatacaa

SEQ ID NO: 225942 - DNA, 15 bp, Homo sapiens
atattgaggtataca

SEQ ID NO: 225943 - DNA, 15 bp, Homo sapiens
gatattgaggtatac

SEQ ID NO: 225944 - DNA, 15 bp, Homo sapiens
tgatattgaggtata

SEQ ID NO: 225945 - DNA, 15 bp, Homo sapiens
ttgatattgaggtat

SEQ ID NO: 225946 - DNA, 15 bp, Homo sapiens
attgatattgaggta

SEQ ID NO: 225947 - DNA, 15 bp, Homo sapiens
aattgatattgaggt

SEQ ID NO: 225948 - DNA, 15 bp, Homo sapiens
aaattgatattgagg

SEQ ID NO: 225949 - DNA, 15 bp, Homo sapiens
aaaattgatattgag

SEQ ID NO: 225950 - DNA, 15 bp, Homo sapiens
taaaattgatattga

SEQ ID NO: 225951 - DNA, 15 bp, Homo sapiens
ttaaaattgatattg

SEQ ID NO: 225952 - DNA, 15 bp, Homo sapiens
tttaaaattgatatt

SEQ ID NO: 225953 - DNA, 15 bp, Homo sapiens
ctttaaaattgatat

SEQ ID NO: 225954 - DNA, 15 bp, Homo sapiens
cctttaaaattgata

SEQ ID NO: 225955 - DNA, 15 bp, Homo sapiens
tcctttaaaattgat

SEQ ID NO: 225956 - DNA, 15 bp, Homo sapiens
ttcctttaaaattga

SEQ ID NO: 225957 - DNA, 15 bp, Homo sapiens
tttcctttaaaattg

SEQ ID NO: 225958 - DNA, 15 bp, Homo sapiens
atttcctttaaaatt

SEQ ID NO: 225959 - DNA, 15 bp, Homo sapiens
aatttcctttaaaat

SEQ ID NO: 225960 - DNA, 15 bp, Homo sapiens
taatttcctttaaaa

SEQ ID NO: 225961 - DNA, 15 bp, Homo sapiens
ttaatttcctttaaa

SEQ ID NO: 225962 - DNA, 15 bp, Homo sapiens
gttaatttcctttaa

SEQ ID NO: 225963 - DNA, 15 bp, Homo sapiens
agttaatttccttta

SEQ ID NO: 225964 - DNA, 15 bp, Homo sapiens
cagttaatttccttt

SEQ ID NO: 225965 - DNA, 15 bp, Homo sapiens
gcagttaatttcctt

SEQ ID NO: 225966 - DNA, 15 bp, Homo sapiens
tgcagttaatttcct

SEQ ID NO: 225967 - DNA, 15 bp, Homo sapiens
ctgcagttaatttcc

SEQ ID NO: 225968 - DNA, 15 bp, Homo sapiens
tctgcagttaatttc

SEQ ID NO: 225969 - DNA, 15 bp, Homo sapiens
ttctgcagttaattt

SEQ ID NO: 225970 - DNA, 15 bp, Homo sapiens
tttctgcagttaatt

SEQ ID NO: 225971 - DNA, 15 bp, Homo sapiens
ttttctgcagttaat

SEQ ID NO: 225972 - DNA, 15 bp, Homo sapiens
tttttctgcagttaa

SEQ ID NO: 225973 - DNA, 15 bp, Homo sapiens
ttttttctgcagtta

SEQ ID NO: 225974 - DNA, 15 bp, Homo sapiens
attttttctgcagtt

SEQ ID NO: 225975 - DNA, 15 bp, Homo sapiens
tattttttctgcagt

SEQ ID NO: 225976 - DNA, 15 bp, Homo sapiens
ctattttttctgcag

SEQ ID NO: 225977 - DNA, 15 bp, Homo sapiens
tctattttttctgca

SEQ ID NO: 225978 - DNA, 15 bp, Homo sapiens
atctattttttctgc

SEQ ID NO: 225979 - DNA, 15 bp, Homo sapiens
aatctattttttctg

SEQ ID NO: 225980 - DNA, 15 bp, Homo sapiens
caatctattttttct

SEQ ID NO: 225981 - DNA, 15 bp, Homo sapiens
acaatctattttttc

SEQ ID NO: 225982 - DNA, 15 bp, Homo sapiens
gacaatctatttttt

SEQ ID NO: 225983 - DNA, 15 bp, Homo sapiens
agacaatctattttt

SEQ ID NO: 225984 - DNA, 15 bp, Homo sapiens
tagacaatctatttt

SEQ ID NO: 225985 - DNA, 15 bp, Homo sapiens
ttagacaatctattt

SEQ ID NO: 225986 - DNA, 15 bp, Homo sapiens
tttagacaatctatt

SEQ ID NO: 225987 - DNA, 15 bp, Homo sapiens
ttttagacaatctat

SEQ ID NO: 225988 - DNA, 15 bp, Homo sapiens
tttttagacaatcta

SEQ ID NO: 225989 - DNA, 15 bp, Homo sapiens
ctttttagacaatct

SEQ ID NO: 225990 - DNA, 15 bp, Homo sapiens
actttttagacaatc

SEQ ID NO: 225991 - DNA, 15 bp, Homo sapiens
cactttttagacaat

SEQ ID NO: 225992 - DNA, 15 bp, Homo sapiens
acactttttagacaa

SEQ ID NO: 225993 - DNA, 15 bp, Homo sapiens
tacactttttagaca

SEQ ID NO: 225994 - DNA, 15 bp, Homo sapiens
gtacactttttagac

SEQ ID NO: 225995 - DNA, 15 bp, Homo sapiens
agtacactttttaga

SEQ ID NO: 225996 - DNA, 15 bp, Homo sapiens
cagtacactttttag

SEQ ID NO: 225997 - DNA, 15 bp, Homo sapiens
acagtacacttttta

SEQ ID NO: 225998 - DNA, 15 bp, Homo sapiens
tacagtacacttttt

SEQ ID NO: 225999 - DNA, 15 bp, Homo sapiens
ttacagtacactttt

SEQ ID NO: 226000 - DNA, 15 bp, Homo sapiens
gttacagtacacttt

SEQ ID NO: 226001 - DNA, 15 bp, Homo sapiens
agttacagtacactt

SEQ ID NO: 226002 - DNA, 15 bp, Homo sapiens
tagttacagtacact

SEQ ID NO: 226003 - DNA, 15 bp, Homo sapiens
atagttacagtacac

SEQ ID NO: 226004 - DNA, 15 bp, Homo sapiens
tatagttacagtaca

SEQ ID NO: 226005 - DNA, 15 bp, Homo sapiens
ttatagttacagtac

SEQ ID NO: 226006 - DNA, 15 bp, Homo sapiens
tttatagttacagta

SEQ ID NO: 226007 - DNA, 15 bp, Homo sapiens
ttttatagttacagt

SEQ ID NO: 226008 - DNA, 15 bp, Homo sapiens
cttttatagttacag

SEQ ID NO: 226009 - DNA, 15 bp, Homo sapiens
acttttatagttaca

SEQ ID NO: 226010 - DNA, 15 bp, Homo sapiens
tacttttatagttac

SEQ ID NO: 226011 - DNA, 15 bp, Homo sapiens
ttacttttatagtta

SEQ ID NO: 226012 - DNA, 15 bp, Homo sapiens
attacttttatagtt

SEQ ID NO: 226013 - DNA, 15 bp, Homo sapiens
aattacttttatagt

SEQ ID NO: 226014 - DNA, 15 bp, Homo sapiens
aaattacttttatag

SEQ ID NO: 226015 - DNA, 15 bp, Homo sapiens
gaaattacttttata

SEQ ID NO: 226016 - DNA, 15 bp, Homo sapiens
agaaattacttttat

SEQ ID NO: 226017 - DNA, 15 bp, Homo sapiens
tagaaattactttta

SEQ ID NO: 226018 - DNA, 15 bp, Homo sapiens
atagaaattactttt

SEQ ID NO: 226019 - DNA, 15 bp, Homo sapiens
tatagaaattacttt

SEQ ID NO: 226020 - DNA, 15 bp, Homo sapiens
ttatagaaattactt

SEQ ID NO: 226021 - DNA, 15 bp, Homo sapiens
cttatagaaattact

SEQ ID NO: 226022 - DNA, 15 bp, Homo sapiens
tcttatagaaattac

SEQ ID NO: 226023 - DNA, 15 bp, Homo sapiens
ttcttatagaaatta

SEQ ID NO: 226024 - DNA, 15 bp, Homo sapiens
tttcttatagaaatt

SEQ ID NO: 226025 - DNA, 15 bp, Homo sapiens
atttcttatagaaat

SEQ ID NO: 226026 - DNA, 15 bp, Homo sapiens
tatttcttatagaaa

SEQ ID NO: 226027 - DNA, 15 bp, Homo sapiens
ttatttcttatagaa

SEQ ID NO: 226028 - DNA, 15 bp, Homo sapiens
tttatttcttataga

SEQ ID NO: 226029 - DNA, 15 bp, Homo sapiens
ttttatttcttatag

SEQ ID NO: 226030 - DNA, 15 bp, Homo sapiens
tttttatttcttata

SEQ ID NO: 226031 - DNA, 15 bp, Homo sapiens
atttttatttcttat

SEQ ID NO: 226032 - DNA, 15 bp, Homo sapiens
aatttttatttctta

SEQ ID NO: 226033 - DNA, 15 bp, Homo sapiens
aaatttttatttctt

SEQ ID NO: 226034 - DNA, 15 bp, Homo sapiens
taaatttttatttct

SEQ ID NO: 226035 - DNA, 15 bp, Homo sapiens
ataaatttttatttc

SEQ ID NO: 226036 - DNA, 15 bp, Homo sapiens
tataaatttttattt

SEQ ID NO: 226037 - DNA, 15 bp, Homo sapiens
atataaatttttatt

SEQ ID NO: 226038 - DNA, 15 bp, Homo sapiens
aatataaatttttat

SEQ ID NO: 226039 - DNA, 15 bp, Homo sapiens
taatataaattttta

SEQ ID NO: 226040 - DNA, 15 bp, Homo sapiens
ataatataaattttt

SEQ ID NO: 226041 - DNA, 15 bp, Homo sapiens
tataatataaatttt

SEQ ID NO: 226042 - DNA, 15 bp, Homo sapiens
atataatataaattt

SEQ ID NO: 226043 - DNA, 15 bp, Homo sapiens
aatataatataaatt

SEQ ID NO: 226044 - DNA, 15 bp, Homo sapiens
aaatataatataaat

SEQ ID NO: 226045 - DNA, 15 bp, Homo sapiens
taaatataatataaa

SEQ ID NO: 226046 - DNA, 15 bp, Homo sapiens
ttaaatataatataa

SEQ ID NO: 226047 - DNA, 15 bp, Homo sapiens
tttaaatataatata

SEQ ID NO: 226048 - DNA, 15 bp, Homo sapiens
gtttaaatataatat

SEQ ID NO: 226049 - DNA, 15 bp, Homo sapiens
tgtttaaatataata

SEQ ID NO: 226050 - DNA, 15 bp, Homo sapiens
ttgtttaaatataat

SEQ ID NO: 226051 - DNA, 15 bp, Homo sapiens
cttgtttaaatataa

SEQ ID NO: 226052 - DNA, 15 bp, Homo sapiens
acttgtttaaatata

SEQ ID NO: 226053 - DNA, 15 bp, Homo sapiens
aacttgtttaaatat

SEQ ID NO: 226054 - DNA, 15 bp, Homo sapiens
taacttgtttaaata

SEQ ID NO: 226055 - DNA, 15 bp, Homo sapiens
gtaacttgtttaaat

SEQ ID NO: 226056 - DNA, 15 bp, Homo sapiens
tgtaacttgtttaaa

SEQ ID NO: 226057 - DNA, 15 bp, Homo sapiens
atgtaacttgtttaa

SEQ ID NO: 226058 - DNA, 15 bp, Homo sapiens
catgtaacttgttta

SEQ ID NO: 226059 - DNA, 15 bp, Homo sapiens
tcatgtaacttgttt

SEQ ID NO: 226060 - DNA, 15 bp, Homo sapiens
atcatgtaacttgtt

SEQ ID NO: 226061 - DNA, 15 bp, Homo sapiens
tatcatgtaacttgt

SEQ ID NO: 226062 - DNA, 15 bp, Homo sapiens
ttatcatgtaacttg

SEQ ID NO: 226063 - DNA, 15 bp, Homo sapiens
tttatcatgtaactt

SEQ ID NO: 226064 - DNA, 15 bp, Homo sapiens
atttatcatgtaact

SEQ ID NO: 226065 - DNA, 15 bp, Homo sapiens
tatttatcatgtaac

SEQ ID NO: 226066 - DNA, 15 bp, Homo sapiens
ttatttatcatgtaa

SEQ ID NO: 226067 - DNA, 15 bp, Homo sapiens
attatttatcatgta

SEQ ID NO: 226068 - DNA, 15 bp, Homo sapiens
aattatttatcatgt

SEQ ID NO: 226069 - DNA, 15 bp, Homo sapiens
caattatttatcatg

SEQ ID NO: 226070 - DNA, 15 bp, Homo sapiens
gcaattatttatcat

SEQ ID NO: 226071 - DNA, 15 bp, Homo sapiens
tgcaattatttatca

SEQ ID NO: 226072 - DNA, 15 bp, Homo sapiens
ttgcaattatttatc

SEQ ID NO: 226073 - DNA, 15 bp, Homo sapiens
cttgcaattatttat

SEQ ID NO: 226074 - DNA, 15 bp, Homo sapiens
acttgcaattattta

SEQ ID NO: 226075 - DNA, 15 bp, Homo sapiens
tacttgcaattattt

SEQ ID NO: 226076 - DNA, 15 bp, Homo sapiens
ctacttgcaattatt

SEQ ID NO: 226077 - DNA, 15 bp, Homo sapiens
actacttgcaattat

SEQ ID NO: 226078 - DNA, 15 bp, Homo sapiens
tactacttgcaatta

SEQ ID NO: 226079 - DNA, 15 bp, Homo sapiens
ctactacttgcaatt

SEQ ID NO: 226080 - DNA, 15 bp, Homo sapiens
tctactacttgcaat

SEQ ID NO: 226081 - DNA, 15 bp, Homo sapiens
ttctactacttgcaa

SEQ ID NO: 226082 - DNA, 15 bp, Homo sapiens
tttctactacttgca

SEQ ID NO: 226083 - DNA, 15 bp, Homo sapiens
ctttctactacttgc

SEQ ID NO: 226084 - DNA, 15 bp, Homo sapiens
actttctactacttg

SEQ ID NO: 226085 - DNA, 15 bp, Homo sapiens
aactttctactactt

SEQ ID NO: 226086 - DNA, 15 bp, Homo sapiens
taactttctactact

SEQ ID NO: 226087 - DNA, 15 bp, Homo sapiens
ataactttctactac

SEQ ID NO: 226088 - DNA, 15 bp, Homo sapiens
aataactttctacta

SEQ ID NO: 226089 - DNA, 15 bp, Homo sapiens
taataactttctact

SEQ ID NO: 226090 - DNA, 15 bp, Homo sapiens
ttaataactttctac

SEQ ID NO: 226091 - DNA, 15 bp, Homo sapiens
tttaataactttcta

SEQ ID NO: 226092 - DNA, 15 bp, Homo sapiens
ttttaataactttct

SEQ ID NO: 226093 - DNA, 15 bp, Homo sapiens
attttaataactttc

SEQ ID NO: 226094 - DNA, 15 bp, Homo sapiens
tattttaataacttt

SEQ ID NO: 226095 - DNA, 15 bp, Homo sapiens
atattttaataactt

SEQ ID NO: 226096 - DNA, 15 bp, Homo sapiens
tatattttaataact

SEQ ID NO: 226097 - DNA, 15 bp, Homo sapiens
ttatattttaataac

SEQ ID NO: 226098 - DNA, 15 bp, Homo sapiens
attatattttaataa

SEQ ID NO: 226099 - DNA, 15 bp, Homo sapiens
tattatattttaata

SEQ ID NO: 226100 - DNA, 15 bp, Homo sapiens
ttattatattttaat

SEQ ID NO: 226101 - DNA, 15 bp, Homo sapiens
tttattatattttaa

SEQ ID NO: 226102 - DNA, 15 bp, Homo sapiens
tatttattatatttt

SEQ ID NO: 226103 - DNA, 15 bp, Homo sapiens
atatttattatattt

SEQ ID NO: 226104 - DNA, 15 bp, Homo sapiens
tatatttattatatt

SEQ ID NO: 226105 - DNA, 15 bp, Homo sapiens
gtatatttattatat

SEQ ID NO: 226106 - DNA, 15 bp, Homo sapiens
tgtatatttattata

SEQ ID NO: 226107 - DNA, 15 bp, Homo sapiens
ttgtatatttattat

SEQ ID NO: 226108 - DNA, 15 bp, Homo sapiens
tttgtatatttatta

SEQ ID NO: 226109 - DNA, 15 bp, Homo sapiens
ttttgtatatttatt

SEQ ID NO: 226110 - DNA, 15 bp, Homo sapiens
attttgtatatttat

SEQ ID NO: 226111 - DNA, 15 bp, Homo sapiens
tattttgtatattta

SEQ ID NO: 226112 - DNA, 15 bp, Homo sapiens
aatattttgtatatt

SEQ ID NO: 226113 - DNA, 15 bp, Homo sapiens
aaatattttgtatat

SEQ ID NO: 226114 - DNA, 15 bp, Homo sapiens
gaaatattttgtata

SEQ ID NO: 226115 - DNA, 15 bp, Homo sapiens
tgaaatattttgtat

SEQ ID NO: 226116 - DNA, 15 bp, Homo sapiens
ttgaaatattttgta

SEQ ID NO: 226117 - DNA, 15 bp, Homo sapiens
cttgaaatattttgt

SEQ ID NO: 226118 - DNA, 15 bp, Homo sapiens
ccttgaaatattttg

SEQ ID NO: 226119 - DNA, 15 bp, Homo sapiens
accttgaaatatttt

SEQ ID NO: 226120 - DNA, 15 bp, Homo sapiens
gaccttgaaatattt

SEQ ID NO: 226121 - DNA, 15 bp, Homo sapiens
agaccttgaaatatt

SEQ ID NO: 226122 - DNA, 15 bp, Homo sapiens
tagaccttgaaatat

SEQ ID NO: 226123 - DNA, 15 bp, Homo sapiens
atagaccttgaaata

SEQ ID NO: 226124 - DNA, 15 bp, Homo sapiens
tatagaccttgaaat

SEQ ID NO: 226125 - DNA, 15 bp, Homo sapiens
ttatagaccttgaaa

SEQ ID NO: 226126 - DNA, 15 bp, Homo sapiens
cttatagaccttgaa

SEQ ID NO: 226127 - DNA, 15 bp, Homo sapiens
acttatagaccttga

SEQ ID NO: 226128 - DNA, 15 bp, Homo sapiens
tacttatagaccttg

SEQ ID NO: 226129 - DNA, 15 bp, Homo sapiens
ttacttatagacctt

SEQ ID NO: 226130 - DNA, 15 bp, Homo sapiens
cttacttatagacct

SEQ ID NO: 226131 - DNA, 15 bp, Homo sapiens
tcttacttatagacc

SEQ ID NO: 226132 - DNA, 15 bp, Homo sapiens
atcttacttatagac

SEQ ID NO: 226133 - DNA, 15 bp, Homo sapiens
aatcttacttataga

SEQ ID NO: 226134 - DNA, 15 bp, Homo sapiens
taatcttacttatag

SEQ ID NO: 226135 - DNA, 15 bp, Homo sapiens
gtaatcttacttata

SEQ ID NO: 226136 - DNA, 15 bp, Homo sapiens
agtaatcttacttat

SEQ ID NO: 226137 - DNA, 15 bp, Homo sapiens
aagtaatcttactta

SEQ ID NO: 226138 - DNA, 15 bp, Homo sapiens
aaagtaatcttactt

SEQ ID NO: 226139 - DNA, 15 bp, Homo sapiens
aaaagtaatcttact

SEQ ID NO: 226140 - DNA, 15 bp, Homo sapiens
caaaagtaatcttac

SEQ ID NO: 226141 - DNA, 15 bp, Homo sapiens
tcaaaagtaatctta

SEQ ID NO: 226142 - DNA, 15 bp, Homo sapiens
atcaaaagtaatctt

SEQ ID NO: 226143 - DNA, 15 bp, Homo sapiens
tatcaaaagtaatct

SEQ ID NO: 226144 - DNA, 15 bp, Homo sapiens
ttatcaaaagtaatc

SEQ ID NO: 226145 - DNA, 15 bp, Homo sapiens
attatcaaaagtaat

SEQ ID NO: 226146 - DNA, 15 bp, Homo sapiens
cattatcaaaagtaa

SEQ ID NO: 226147 - DNA, 15 bp, Homo sapiens
tcattatcaaaagta

SEQ ID NO: 226148 - DNA, 15 bp, Homo sapiens
gtcattatcaaaagt

SEQ ID NO: 226149 - DNA, 15 bp, Homo sapiens
tgtcattatcaaaag

SEQ ID NO: 226150 - DNA, 15 bp, Homo sapiens
gtgtcattatcaaaa

SEQ ID NO: 226151 - DNA, 15 bp, Homo sapiens
tgtgtcattatcaaa

SEQ ID NO: 226152 - DNA, 15 bp, Homo sapiens
gtgtgtcattatcaa

SEQ ID NO: 226153 - DNA, 15 bp, Homo sapiens
ggtgtgtcattatca

SEQ ID NO: 226154 - DNA, 15 bp, Homo sapiens
tggtgtgtcattatc

SEQ ID NO: 226155 - DNA, 15 bp, Homo sapiens
ttggtgtgtcattat

SEQ ID NO: 226156 - DNA, 15 bp, Homo sapiens
tttggtgtgtcatta

SEQ ID NO: 226157 - DNA, 15 bp, Homo sapiens
ctttggtgtgtcatt

SEQ ID NO: 226158 - DNA, 15 bp, Homo sapiens
actttggtgtgtcat

SEQ ID NO: 226159 - DNA, 15 bp, Homo sapiens
gactttggtgtgtca

SEQ ID NO: 226160 - DNA, 15 bp, Homo sapiens
ggactttggtgtgtc

SEQ ID NO: 226161 - DNA, 15 bp, Homo sapiens
aggactttggtgtgt

SEQ ID NO: 226162 - DNA, 15 bp, Homo sapiens
aaggactttggtgtg

SEQ ID NO: 226163 - DNA, 15 bp, Homo sapiens
aaaggactttggtgt

SEQ ID NO: 226164 - DNA, 15 bp, Homo sapiens
gaaaggactttggtg

SEQ ID NO: 226165 - DNA, 15 bp, Homo sapiens
agaaaggactttggt

SEQ ID NO: 226166 - DNA, 15 bp, Homo sapiens
aagaaaggactttgg

SEQ ID NO: 226167 - DNA, 15 bp, Homo sapiens
aaagaaaggactttg

SEQ ID NO: 226168 - DNA, 15 bp, Homo sapiens
aaaagaaaggacttt

SEQ ID NO: 226169 - DNA, 15 bp, Homo sapiens
taaaagaaaggactt

SEQ ID NO: 226170 - DNA, 15 bp, Homo sapiens
gtaaaagaaaggact

SEQ ID NO: 226171 - DNA, 15 bp, Homo sapiens
tgtaaaagaaaggac

SEQ ID NO: 226172 - DNA, 15 bp, Homo sapiens
ttgtaaaagaaagga

SEQ ID NO: 226173 - DNA, 15 bp, Homo sapiens
cttgtaaaagaaagg

SEQ ID NO: 226174 - DNA, 15 bp, Homo sapiens
gcttgtaaaagaaag

SEQ ID NO: 226175 - DNA, 15 bp, Homo sapiens
tgcttgtaaaagaaa

SEQ ID NO: 226176 - DNA, 15 bp, Homo sapiens
ctgcttgtaaaagaa

SEQ ID NO: 226177 - DNA, 15 bp, Homo sapiens
tctgcttgtaaaaga

SEQ ID NO: 226178 - DNA, 15 bp, Homo sapiens
gtctgcttgtaaaag

SEQ ID NO: 226179 - DNA, 15 bp, Homo sapiens
tgtctgcttgtaaaa

SEQ ID NO: 226180 - DNA, 15 bp, Homo sapiens
ttgtctgcttgtaaa

SEQ ID NO: 226181 - DNA, 15 bp, Homo sapiens
gttgtctgcttgtaa

SEQ ID NO: 226182 - DNA, 15 bp, Homo sapiens
tgttgtctgcttgta

SEQ ID NO: 226183 - DNA, 15 bp, Homo sapiens
atgttgtctgcttgt

SEQ ID NO: 226184 - DNA, 15 bp, Homo sapiens
aatgttgtctgcttg

SEQ ID NO: 226185 - DNA, 15 bp, Homo sapiens
aaatgttgtctgctt

SEQ ID NO: 226186 - DNA, 15 bp, Homo sapiens
gaaatgttgtctgct

SEQ ID NO: 226187 - DNA, 15 bp, Homo sapiens
agaaatgttgtctgc

SEQ ID NO: 226188 - DNA, 15 bp, Homo sapiens
aagaaatgttgtctg

SEQ ID NO: 226189 - DNA, 15 bp, Homo sapiens
aaagaaatgttgtct

SEQ ID NO: 226190 - DNA, 15 bp, Homo sapiens
taaagaaatgttgtc

SEQ ID NO: 226191 - DNA, 15 bp, Homo sapiens
ttaaagaaatgttgt

SEQ ID NO: 226192 - DNA, 15 bp, Homo sapiens
attaaagaaatgttg

SEQ ID NO: 226193 - DNA, 15 bp, Homo sapiens
aattaaagaaatgtt

SEQ ID NO: 226194 - DNA, 15 bp, Homo sapiens
aaattaaagaaatgt

SEQ ID NO: 226195 - DNA, 15 bp, Homo sapiens
taaattaaagaaatg

SEQ ID NO: 226196 - DNA, 15 bp, Homo sapiens
ttaaattaaagaaat

SEQ ID NO: 226197 - DNA, 15 bp, Homo sapiens
tttaaattaaagaaa

SEQ ID NO: 226198 - DNA, 15 bp, Homo sapiens
ttttaaattaaagaa

SEQ ID NO: 226199 - DNA, 15 bp, Homo sapiens
tttttaaattaaaga

SEQ ID NO: 226200 - DNA, 15 bp, Homo sapiens
atttttaaattaaag

SEQ ID NO: 226201 - DNA, 15 bp, Homo sapiens
tatttttaaattaaa

SEQ ID NO: 226202 - DNA, 15 bp, Homo sapiens
ttatttttaaattaa

SEQ ID NO: 226203 - DNA, 15 bp, Homo sapiens
attatttttaaatta

SEQ ID NO: 226204 - DNA, 15 bp, Homo sapiens
tattatttttaaatt

SEQ ID NO: 226205 - DNA, 15 bp, Homo sapiens
gtattatttttaaat

SEQ ID NO: 226206 - DNA, 15 bp, Homo sapiens
ggtattatttttaaa

SEQ ID NO: 226207 - DNA, 15 bp, Homo sapiens
gggtattatttttaa

SEQ ID NO: 226208 - DNA, 15 bp, Homo sapiens
agggtattattttta

SEQ ID NO: 226209 - DNA, 15 bp, Homo sapiens
cagggtattattttt

SEQ ID NO: 226210 - DNA, 15 bp, Homo sapiens
acagggtattatttt

SEQ ID NO: 226211 - DNA, 15 bp, Homo sapiens
cacagggtattattt

SEQ ID NO: 226212 - DNA, 15 bp, Homo sapiens
acacagggtattatt

SEQ ID NO: 226213 - DNA, 15 bp, Homo sapiens
cacacagggtattat

SEQ ID NO: 226214 - DNA, 15 bp, Homo sapiens
acacacagggtatta

SEQ ID NO: 226215 - DNA, 15 bp, Homo sapiens
aacacacagggtatt

SEQ ID NO: 226216 - DNA, 15 bp, Homo sapiens
aaacacacagggtat

SEQ ID NO: 226217 - DNA, 15 bp, Homo sapiens
taaacacacagggta

SEQ ID NO: 226218 - DNA, 15 bp, Homo sapiens
ataaacacacagggt

SEQ ID NO: 226219 - DNA, 15 bp, Homo sapiens
aataaacacacaggg

SEQ ID NO: 226220 - DNA, 15 bp, Homo sapiens
aaataaacacacagg

SEQ ID NO: 226221 - DNA, 15 bp, Homo sapiens
taaataaacacacag

SEQ ID NO: 226222 - DNA, 15 bp, Homo sapiens
gtaaataaacacaca

SEQ ID NO: 226223 - DNA, 15 bp, Homo sapiens
agtaaataaacacac

SEQ ID NO: 226224 - DNA, 15 bp, Homo sapiens
aagtaaataaacaca

SEQ ID NO: 226225 - DNA, 15 bp, Homo sapiens
aaagtaaataaacac

SEQ ID NO: 226226 - DNA, 15 bp, Homo sapiens
caaagtaaataaaca

SEQ ID NO: 226227 - DNA, 15 bp, Homo sapiens
ccaaagtaaataaac

SEQ ID NO: 226228 - DNA, 15 bp, Homo sapiens
gccaaagtaaataaa

SEQ ID NO: 226229 - DNA, 15 bp, Homo sapiens
agccaaagtaaataa

SEQ ID NO: 226230 - DNA, 15 bp, Homo sapiens
aagccaaagtaaata

SEQ ID NO: 226231 - DNA, 15 bp, Homo sapiens
taagccaaagtaaat

SEQ ID NO: 226232 - DNA, 15 bp, Homo sapiens
ttaagccaaagtaaa

SEQ ID NO: 226233 - DNA, 15 bp, Homo sapiens
tttaagccaaagtaa

SEQ ID NO: 226234 - DNA, 15 bp, Homo sapiens
ttttaagccaaagta

SEQ ID NO: 226235 - DNA, 15 bp, Homo sapiens
attttaagccaaagt

SEQ ID NO: 226236 - DNA, 15 bp, Homo sapiens
aattttaagccaaag

SEQ ID NO: 226237 - DNA, 15 bp, Homo sapiens
aaattttaagccaaa

SEQ ID NO: 226238 - DNA, 15 bp, Homo sapiens
taaattttaagccaa

SEQ ID NO: 226239 - DNA, 15 bp, Homo sapiens
ttaaattttaagcca

SEQ ID NO: 226240 - DNA, 15 bp, Homo sapiens
tttaaattttaagcc

SEQ ID NO: 226241 - DNA, 15 bp, Homo sapiens
atttaaattttaagc

SEQ ID NO: 226242 - DNA, 15 bp, Homo sapiens
tatttaaattttaag

SEQ ID NO: 226243 - DNA, 15 bp, Homo sapiens
ttatttaaattttaa

SEQ ID NO: 226244 - DNA, 15 bp, Homo sapiens
attatttaaatttta

SEQ ID NO: 226245 - DNA, 15 bp, Homo sapiens
tattatttaaatttt

SEQ ID NO: 226246 - DNA, 15 bp, Homo sapiens
ttattatttaaattt

SEQ ID NO: 226247 - DNA, 15 bp, Homo sapiens
gttattatttaaatt

SEQ ID NO: 226248 - DNA, 15 bp, Homo sapiens
agttattatttaaat

SEQ ID NO: 226249 - DNA, 15 bp, Homo sapiens
tagttattatttaaa

SEQ ID NO: 226250 - DNA, 15 bp, Homo sapiens
gtagttattatttaa

SEQ ID NO: 226251 - DNA, 15 bp, Homo sapiens
ggtagttattattta

SEQ ID NO: 226252 - DNA, 15 bp, Homo sapiens
aggtagttattattt

SEQ ID NO: 226253 - DNA, 15 bp, Homo sapiens
aaggtagttattatt

SEQ ID NO: 226254 - DNA, 15 bp, Homo sapiens
taaggtagttattat

SEQ ID NO: 226255 - DNA, 15 bp, Homo sapiens
gtaaggtagttatta

SEQ ID NO: 226256 - DNA, 15 bp, Homo sapiens
agtaaggtagttatt

SEQ ID NO: 226257 - DNA, 15 bp, Homo sapiens
tagtaaggtagttat

SEQ ID NO: 226258 - DNA, 15 bp, Homo sapiens
ctagtaaggtagtta

SEQ ID NO: 226259 - DNA, 15 bp, Homo sapiens
gctagtaaggtagtt

SEQ ID NO: 226260 - DNA, 15 bp, Homo sapiens
tgctagtaaggtagt

SEQ ID NO: 226261 - DNA, 15 bp, Homo sapiens
ttgctagtaaggtag

SEQ ID NO: 226262 - DNA, 15 bp, Homo sapiens
tttgctagtaaggta

SEQ ID NO: 226263 - DNA, 15 bp, Homo sapiens
atttgctagtaaggt

SEQ ID NO: 226264 - DNA, 15 bp, Homo sapiens
aatttgctagtaagg

SEQ ID NO: 226265 - DNA, 15 bp, Homo sapiens
aaatttgctagtaag

SEQ ID NO: 226266 - DNA, 15 bp, Homo sapiens
taaatttgctagtaa

SEQ ID NO: 226267 - DNA, 15 bp, Homo sapiens
gtaaatttgctagta

SEQ ID NO: 226268 - DNA, 15 bp, Homo sapiens
agtaaatttgctagt

SEQ ID NO: 226269 - DNA, 15 bp, Homo sapiens
tagtaaatttgctag

SEQ ID NO: 226270 - DNA, 15 bp, Homo sapiens
ctagtaaatttgcta

SEQ ID NO: 226271 - DNA, 15 bp, Homo sapiens
gctagtaaatttgct

SEQ ID NO: 226272 - DNA, 15 bp, Homo sapiens
tgctagtaaatttgc

SEQ ID NO: 226273 - DNA, 15 bp, Homo sapiens
ttgctagtaaatttg

SEQ ID NO: 226274 - DNA, 15 bp, Homo sapiens
tttgctagtaaattt

SEQ ID NO: 226275 - DNA, 15 bp, Homo sapiens
ttttgctagtaaatt

SEQ ID NO: 226276 - DNA, 15 bp, Homo sapiens
tttttgctagtaaat

SEQ ID NO: 226277 - DNA, 15 bp, Homo sapiens
ttttttgctagtaaa

SEQ ID NO: 226278 - DNA, 15 bp, Homo sapiens
attttttgctagtaa

SEQ ID NO: 226279 - DNA, 15 bp, Homo sapiens
tattttttgctagta

SEQ ID NO: 226280 - DNA, 15 bp, Homo sapiens
atattttttgctagt

SEQ ID NO: 226281 - DNA, 15 bp, Homo sapiens
tatattttttgctag

SEQ ID NO: 226282 - DNA, 15 bp, Homo sapiens
atatattttttgcta

SEQ ID NO: 226283 - DNA, 15 bp, Homo sapiens
tatatattttttgct

SEQ ID NO: 226284 - DNA, 15 bp, Homo sapiens
atatatattttttgc

SEQ ID NO: 226285 - DNA, 15 bp, Homo sapiens
aatatatattttttg

SEQ ID NO: 226286 - DNA, 15 bp, Homo sapiens
gaaatatatattttt

SEQ ID NO: 226287 - DNA, 15 bp, Homo sapiens
agaaatatatatttt

SEQ ID NO: 226288 - DNA, 15 bp, Homo sapiens
aagaaatatatattt

SEQ ID NO: 226289 - DNA, 15 bp, Homo sapiens
taagaaatatatatt

SEQ ID NO: 226290 - DNA, 15 bp, Homo sapiens
ataagaaatatatat

SEQ ID NO: 226291 - DNA, 15 bp, Homo sapiens
tataagaaatatata

SEQ ID NO: 226292 - DNA, 15 bp, Homo sapiens
atataagaaatatat

SEQ ID NO: 226293 - DNA, 15 bp, Homo sapiens
aatataagaaatata

SEQ ID NO: 226294 - DNA, 15 bp, Homo sapiens
aaatataagaaatat

SEQ ID NO: 226295 - DNA, 15 bp, Homo sapiens
taaatataagaaata

SEQ ID NO: 226296 - DNA, 15 bp, Homo sapiens
ttaaatataagaaat

SEQ ID NO: 226297 - DNA, 15 bp, Homo sapiens
tttaaatataagaaa

SEQ ID NO: 226298 - DNA, 15 bp, Homo sapiens
gtttaaatataagaa

SEQ ID NO: 226299 - DNA, 15 bp, Homo sapiens
tgtttaaatataaga

SEQ ID NO: 226300 - DNA, 15 bp, Homo sapiens
atgtttaaatataag

SEQ ID NO: 226301 - DNA, 15 bp, Homo sapiens
catgtttaaatataa

SEQ ID NO: 226302 - DNA, 15 bp, Homo sapiens
acatgtttaaatata

SEQ ID NO: 226303 - DNA, 15 bp, Homo sapiens
aacatgtttaaatat

SEQ ID NO: 226304 - DNA, 15 bp, Homo sapiens
taacatgtttaaata

SEQ ID NO: 226305 - DNA, 15 bp, Homo sapiens
ataacatgtttaaat

SEQ ID NO: 226306 - DNA, 15 bp, Homo sapiens
cataacatgtttaaa

SEQ ID NO: 226307 - DNA, 15 bp, Homo sapiens
acataacatgtttaa

SEQ ID NO: 226308 - DNA, 15 bp, Homo sapiens
cacataacatgttta

SEQ ID NO: 226309 - DNA, 15 bp, Homo sapiens
tcacataacatgttt

SEQ ID NO: 226310 - DNA, 15 bp, Homo sapiens
atcacataacatgtt

SEQ ID NO: 226311 - DNA, 15 bp, Homo sapiens
tatcacataacatgt

SEQ ID NO: 226312 - DNA, 15 bp, Homo sapiens
ttatcacataacatg

SEQ ID NO: 226313 - DNA, 15 bp, Homo sapiens
tttatcacataacat

SEQ ID NO: 226314 - DNA, 15 bp, Homo sapiens
atttatcacataaca

SEQ ID NO: 226315 - DNA, 15 bp, Homo sapiens
tatttatcacataac

SEQ ID NO: 226316 - DNA, 15 bp, Homo sapiens
ttatttatcacataa

SEQ ID NO: 226317 - DNA, 15 bp, Homo sapiens
attatttatcacata

SEQ ID NO: 226318 - DNA, 15 bp, Homo sapiens
aattatttatcacat

SEQ ID NO: 226319 - DNA, 15 bp, Homo sapiens
caattatttatcaca

SEQ ID NO: 226320 - DNA, 15 bp, Homo sapiens
gcaattatttatcac

SEQ ID NO: 226321 - DNA, 15 bp, Homo sapiens
tctacttgcaattat

SEQ ID NO: 226322 - DNA, 15 bp, Homo sapiens
ttctacttgcaatta

SEQ ID NO: 226323 - DNA, 15 bp, Homo sapiens
cttctacttgcaatt

SEQ ID NO: 226324 - DNA, 15 bp, Homo sapiens
tcttctacttgcaat

SEQ ID NO: 226325 - DNA, 15 bp, Homo sapiens
gtcttctacttgcaa

SEQ ID NO: 226326 - DNA, 15 bp, Homo sapiens
tgtcttctacttgca

SEQ ID NO: 226327 - DNA, 15 bp, Homo sapiens
atgtcttctacttgc

SEQ ID NO: 226328 - DNA, 15 bp, Homo sapiens
aatgtcttctacttg

SEQ ID NO: 226329 - DNA, 15 bp, Homo sapiens
aaatgtcttctactt

SEQ ID NO: 226330 - DNA, 15 bp, Homo sapiens
taaatgtcttctact

SEQ ID NO: 226331 - DNA, 15 bp, Homo sapiens
ataaatgtcttctac

SEQ ID NO: 226332 - DNA, 15 bp, Homo sapiens
aataaatgtcttcta

SEQ ID NO: 226333 - DNA, 15 bp, Homo sapiens
taataaatgtcttct

SEQ ID NO: 226334 - DNA, 15 bp, Homo sapiens
ttaataaatgtcttc

SEQ ID NO: 226335 - DNA, 15 bp, Homo sapiens
tttaataaatgtctt

SEQ ID NO: 226336 - DNA, 15 bp, Homo sapiens
ttttaataaatgtct

SEQ ID NO: 226337 - DNA, 15 bp, Homo sapiens
attttaataaatgtc

SEQ ID NO: 226338 - DNA, 15 bp, Homo sapiens
tattttaataaatgt

SEQ ID NO: 226339 - DNA, 15 bp, Homo sapiens
atattttaataaatg

SEQ ID NO: 226340 - DNA, 15 bp, Homo sapiens
tatattttaataaat

SEQ ID NO: 226341 - DNA, 15 bp, Homo sapiens
ttatattttaataaa

SEQ ID NO: 226342 - DNA, 15 bp, Homo sapiens
ctattatattttaat

SEQ ID NO: 226343 - DNA, 15 bp, Homo sapiens
actattatattttaa

SEQ ID NO: 226344 - DNA, 15 bp, Homo sapiens
tactattatatttta

SEQ ID NO: 226345 - DNA, 15 bp, Homo sapiens
ttactattatatttt

SEQ ID NO: 226346 - DNA, 15 bp, Homo sapiens
tttactattatattt

SEQ ID NO: 226347 - DNA, 15 bp, Homo sapiens
atttactattatatt

SEQ ID NO: 226348 - DNA, 15 bp, Homo sapiens
tatttactattatat

SEQ ID NO: 226349 - DNA, 15 bp, Homo sapiens
atatttactattata

SEQ ID NO: 226350 - DNA, 15 bp, Homo sapiens
tatatttactattat

SEQ ID NO: 226351 - DNA, 15 bp, Homo sapiens
atatatttactatta

SEQ ID NO: 226352 - DNA, 15 bp, Homo sapiens
tatatatttactatt

SEQ ID NO: 226353 - DNA, 15 bp, Homo sapiens
ttatatatttactat

SEQ ID NO: 226354 - DNA, 15 bp, Homo sapiens
tttatatatttacta

SEQ ID NO: 226355 - DNA, 15 bp, Homo sapiens
ttttatatatttact

SEQ ID NO: 226356 - DNA, 15 bp, Homo sapiens
attttatatatttac

SEQ ID NO: 226357 - DNA, 15 bp, Homo sapiens
tattttatatattta

SEQ ID NO: 226358 - DNA, 15 bp, Homo sapiens
atattttatatattt

SEQ ID NO: 226359 - DNA, 15 bp, Homo sapiens
aatattttatatatt

SEQ ID NO: 226360 - DNA, 15 bp, Homo sapiens
aaatattttatatat

SEQ ID NO: 226361 - DNA, 15 bp, Homo sapiens
taaatattttatata

SEQ ID NO: 226362 - DNA, 15 bp, Homo sapiens
ttaaatattttatat

SEQ ID NO: 226363 - DNA, 15 bp, Homo sapiens
tttaaatattttata

SEQ ID NO: 226364 - DNA, 15 bp, Homo sapiens
atatttaaatatttt

SEQ ID NO: 226365 - DNA, 15 bp, Homo sapiens
gatatttaaatattt

SEQ ID NO: 226366 - DNA, 15 bp, Homo sapiens
agatatttaaatatt

SEQ ID NO: 226367 - DNA, 15 bp, Homo sapiens
tagatatttaaatat

SEQ ID NO: 226368 - DNA, 15 bp, Homo sapiens
atagatatttaaata

SEQ ID NO: 226369 - DNA, 15 bp, Homo sapiens
tatagatatttaaat

SEQ ID NO: 226370 - DNA, 15 bp, Homo sapiens
atatagatatttaaa

SEQ ID NO: 226371 - DNA, 15 bp, Homo sapiens
catatagatatttaa

SEQ ID NO: 226372 - DNA, 15 bp, Homo sapiens
acatatagatattta

SEQ ID NO: 226373 - DNA, 15 bp, Homo sapiens
tacatatagatattt

SEQ ID NO: 226374 - DNA, 15 bp, Homo sapiens
ttacatatagatatt

SEQ ID NO: 226375 - DNA, 15 bp, Homo sapiens
cttacatatagatat

SEQ ID NO: 226376 - DNA, 15 bp, Homo sapiens
ccttacatatagata

SEQ ID NO: 226377 - DNA, 15 bp, Homo sapiens
accttacatatagat

SEQ ID NO: 226378 - DNA, 15 bp, Homo sapiens
aaccttacatataga

SEQ ID NO: 226379 - DNA, 15 bp, Homo sapiens
taaccttacatatag

SEQ ID NO: 226380 - DNA, 15 bp, Homo sapiens
gtaaccttacatata

SEQ ID NO: 226381 - DNA, 15 bp, Homo sapiens
agtaaccttacatat

SEQ ID NO: 226382 - DNA, 15 bp, Homo sapiens
aagtaaccttacata

SEQ ID NO: 226383 - DNA, 15 bp, Homo sapiens
aaagtaaccttacat

SEQ ID NO: 226384 - DNA, 15 bp, Homo sapiens
aaaagtaaccttaca

SEQ ID NO: 226385 - DNA, 15 bp, Homo sapiens
taaaagtaaccttac

SEQ ID NO: 226386 - DNA, 15 bp, Homo sapiens
ttaaaagtaacctta

SEQ ID NO: 226387 - DNA, 15 bp, Homo sapiens
tttaaaagtaacctt

SEQ ID NO: 226388 - DNA, 15 bp, Homo sapiens
ttttaaaagtaacct

SEQ ID NO: 226389 - DNA, 15 bp, Homo sapiens
tttttaaaagtaacc

SEQ ID NO: 226390 - DNA, 15 bp, Homo sapiens
atttttaaaagtaac

SEQ ID NO: 226391 - DNA, 15 bp, Homo sapiens
catttttaaaagtaa

SEQ ID NO: 226392 - DNA, 15 bp, Homo sapiens
ctcatttttaaaagt

SEQ ID NO: 226393 - DNA, 15 bp, Homo sapiens
tctcatttttaaaag

SEQ ID NO: 226394 - DNA, 15 bp, Homo sapiens
ctctcatttttaaaa

SEQ ID NO: 226395 - DNA, 15 bp, Homo sapiens
tctctcatttttaaa

SEQ ID NO: 226396 - DNA, 15 bp, Homo sapiens
gtctctcatttttaa

SEQ ID NO: 226397 - DNA, 15 bp, Homo sapiens
ggtctctcattttta

SEQ ID NO: 226398 - DNA, 15 bp, Homo sapiens
tggtctctcattttt

SEQ ID NO: 226399 - DNA, 15 bp, Homo sapiens
ttggtctctcatttt

SEQ ID NO: 226400 - DNA, 15 bp, Homo sapiens
tttggtctctcattt

SEQ ID NO: 226401 - DNA, 15 bp, Homo sapiens
atttggtctctcatt

SEQ ID NO: 226402 - DNA, 15 bp, Homo sapiens
tatttggtctctcat

SEQ ID NO: 226403 - DNA, 15 bp, Homo sapiens
gtatttggtctctca

SEQ ID NO: 226404 - DNA, 15 bp, Homo sapiens
agtatttggtctctc

SEQ ID NO: 226405 - DNA, 15 bp, Homo sapiens
aagtatttggtctct

SEQ ID NO: 226406 - DNA, 15 bp, Homo sapiens
aaagtatttggtctc

SEQ ID NO: 226407 - DNA, 15 bp, Homo sapiens
aaaagtatttggtct

SEQ ID NO: 226408 - DNA, 15 bp, Homo sapiens
gaaaagtatttggtc

SEQ ID NO: 226409 - DNA, 15 bp, Homo sapiens
agaaaagtatttggt

SEQ ID NO: 226410 - DNA, 15 bp, Homo sapiens
aagaaaagtatttgg

SEQ ID NO: 226411 - DNA, 15 bp, Homo sapiens
aaagaaaagtatttg

SEQ ID NO: 226412 - DNA, 15 bp, Homo sapiens
aaaagaaaagtattt

SEQ ID NO: 226413 - DNA, 15 bp, Homo sapiens
taaaagaaaagtatt

SEQ ID NO: 226414 - DNA, 15 bp, Homo sapiens
gtaaaagaaaagtat

SEQ ID NO: 226415 - DNA, 15 bp, Homo sapiens
tgtaaaagaaaagta

SEQ ID NO: 226416 - DNA, 15 bp, Homo sapiens
ttgtaaaagaaaagt

SEQ ID NO: 226417 - DNA, 15 bp, Homo sapiens
cttgtaaaagaaaag

SEQ ID NO: 226418 - DNA, 15 bp, Homo sapiens
gcttgtaaaagaaaa

SEQ ID NO: 226419 - DNA, 15 bp, Homo sapiens
caaatgttgtctgct

SEQ ID NO: 226420 - DNA, 15 bp, Homo sapiens
acaaatgttgtctgc

SEQ ID NO: 226421 - DNA, 15 bp, Homo sapiens
aacaaatgttgtctg

SEQ ID NO: 226422 - DNA, 15 bp, Homo sapiens
aaacaaatgttgtct

SEQ ID NO: 226423 - DNA, 15 bp, Homo sapiens
taaacaaatgttgtc

SEQ ID NO: 226424 - DNA, 15 bp, Homo sapiens
ttaaacaaatgttgt

SEQ ID NO: 226425 - DNA, 15 bp, Homo sapiens
attaaacaaatgttg

SEQ ID NO: 226426 - DNA, 15 bp, Homo sapiens
aattaaacaaatgtt

SEQ ID NO: 226427 - DNA, 15 bp, Homo sapiens
aaattaaacaaatgt

SEQ ID NO: 226428 - DNA, 15 bp, Homo sapiens
taaattaaacaaatg

SEQ ID NO: 226429 - DNA, 15 bp, Homo sapiens
ttaaattaaacaaat

SEQ ID NO: 226430 - DNA, 15 bp, Homo sapiens
tttaaattaaacaaa

SEQ ID NO: 226431 - DNA, 15 bp, Homo sapiens
ttttaaattaaacaa

SEQ ID NO: 226432 - DNA, 15 bp, Homo sapiens
tttttaaattaaaca

SEQ ID NO: 226433 - DNA, 15 bp, Homo sapiens
atttttaaattaaac

SEQ ID NO: 226434 - DNA, 15 bp, Homo sapiens
gttatttttaaatta

SEQ ID NO: 226435 - DNA, 15 bp, Homo sapiens
ggttatttttaaatt

SEQ ID NO: 226436 - DNA, 15 bp, Homo sapiens
aggttatttttaaat

SEQ ID NO: 226437 - DNA, 15 bp, Homo sapiens
caggttatttttaaa

SEQ ID NO: 226438 - DNA, 15 bp, Homo sapiens
acaggttatttttaa

SEQ ID NO: 226439 - DNA, 15 bp, Homo sapiens
tacaggttattttta

SEQ ID NO: 226440 - DNA, 15 bp, Homo sapiens
ttacaggttattttt

SEQ ID NO: 226441 - DNA, 15 bp, Homo sapiens
gttacaggttatttt

SEQ ID NO: 226442 - DNA, 15 bp, Homo sapiens
tgttacaggttattt

SEQ ID NO: 226443 - DNA, 15 bp, Homo sapiens
atgttacaggttatt

SEQ ID NO: 226444 - DNA, 15 bp, Homo sapiens
aatgttacaggttat

SEQ ID NO: 226445 - DNA, 15 bp, Homo sapiens
aaatgttacaggtta

SEQ ID NO: 226446 - DNA, 15 bp, Homo sapiens
taaatgttacaggtt

SEQ ID NO: 226447 - DNA, 15 bp, Homo sapiens
ataaatgttacaggt

SEQ ID NO: 226448 - DNA, 15 bp, Homo sapiens
tataaatgttacagg

SEQ ID NO: 226449 - DNA, 15 bp, Homo sapiens
atataaatgttacag

SEQ ID NO: 226450 - DNA, 15 bp, Homo sapiens
tatataaatgttaca

SEQ ID NO: 226451 - DNA, 15 bp, Homo sapiens
gtatataaatgttac

SEQ ID NO: 226452 - DNA, 15 bp, Homo sapiens
agtatataaatgtta

SEQ ID NO: 226453 - DNA, 15 bp, Homo sapiens
aagtatataaatgtt

SEQ ID NO: 226454 - DNA, 15 bp, Homo sapiens
aaagtatataaatgt

SEQ ID NO: 226455 - DNA, 15 bp, Homo sapiens
taaagtatataaatg

SEQ ID NO: 226456 - DNA, 15 bp, Homo sapiens
ctaaagtatataaat

SEQ ID NO: 226457 - DNA, 15 bp, Homo sapiens
gctaaagtatataaa

SEQ ID NO: 226458 - DNA, 15 bp, Homo sapiens
agctaaagtatataa

SEQ ID NO: 226459 - DNA, 15 bp, Homo sapiens
aagctaaagtatata

SEQ ID NO: 226460 - DNA, 15 bp, Homo sapiens
taagctaaagtatat

SEQ ID NO: 226461 - DNA, 15 bp, Homo sapiens
ttaagctaaagtata

SEQ ID NO: 226462 - DNA, 15 bp, Homo sapiens
tttaagctaaagtat

SEQ ID NO: 226463 - DNA, 15 bp, Homo sapiens
ttttaagctaaagta

SEQ ID NO: 226464 - DNA, 15 bp, Homo sapiens
attttaagctaaagt

SEQ ID NO: 226465 - DNA, 15 bp, Homo sapiens
aattttaagctaaag

SEQ ID NO: 226466 - DNA, 15 bp, Homo sapiens
caattttaagctaaa

SEQ ID NO: 226467 - DNA, 15 bp, Homo sapiens
tcaattttaagctaa

SEQ ID NO: 226468 - DNA, 15 bp, Homo sapiens
ttcaattttaagcta

SEQ ID NO: 226469 - DNA, 15 bp, Homo sapiens
tttcaattttaagct

SEQ ID NO: 226470 - DNA, 15 bp, Homo sapiens
atttcaattttaagc

SEQ ID NO: 226471 - DNA, 15 bp, Homo sapiens
tatttcaattttaag

SEQ ID NO: 226472 - DNA, 15 bp, Homo sapiens
ctatttcaattttaa

SEQ ID NO: 226473 - DNA, 15 bp, Homo sapiens
actatttcaatttta

SEQ ID NO: 226474 - DNA, 15 bp, Homo sapiens
tactatttcaatttt

SEQ ID NO: 226475 - DNA, 15 bp, Homo sapiens
ttactatttcaattt

SEQ ID NO: 226476 - DNA, 15 bp, Homo sapiens
gttactatttcaatt

SEQ ID NO: 226477 - DNA, 15 bp, Homo sapiens
agttactatttcaat

SEQ ID NO: 226478 - DNA, 15 bp, Homo sapiens
tagttactatttcaa

SEQ ID NO: 226479 - DNA, 15 bp, Homo sapiens
gtagttactatttca

SEQ ID NO: 226480 - DNA, 15 bp, Homo sapiens
ggtagttactatttc

SEQ ID NO: 226481 - DNA, 15 bp, Homo sapiens
gggtagttactattt

SEQ ID NO: 226482 - DNA, 15 bp, Homo sapiens
agggtagttactatt

SEQ ID NO: 226483 - DNA, 15 bp, Homo sapiens
tagggtagttactat

SEQ ID NO: 226484 - DNA, 15 bp, Homo sapiens
gtagggtagttacta

SEQ ID NO: 226485 - DNA, 15 bp, Homo sapiens
agtagggtagttact

SEQ ID NO: 226486 - DNA, 15 bp, Homo sapiens
tagtagggtagttac

SEQ ID NO: 226487 - DNA, 15 bp, Homo sapiens
ttagtagggtagtta

SEQ ID NO: 226488 - DNA, 15 bp, Homo sapiens
gttagtagggtagtt

SEQ ID NO: 226489 - DNA, 15 bp, Homo sapiens
tgttagtagggtagt

SEQ ID NO: 226490 - DNA, 15 bp, Homo sapiens
ttgttagtagggtag

SEQ ID NO: 226491 - DNA, 15 bp, Homo sapiens
tttgttagtagggta

SEQ ID NO: 226492 - DNA, 15 bp, Homo sapiens
atttgttagtagggt

SEQ ID NO: 226493 - DNA, 15 bp, Homo sapiens
tatttgttagtaggg

SEQ ID NO: 226494 - DNA, 15 bp, Homo sapiens
ctatttgttagtagg

SEQ ID NO: 226495 - DNA, 15 bp, Homo sapiens
gctatttgttagtag

SEQ ID NO: 226496 - DNA, 15 bp, Homo sapiens
tgctatttgttagta

SEQ ID NO: 226497 - DNA, 15 bp, Homo sapiens
ttgctatttgttagt

SEQ ID NO: 226498 - DNA, 15 bp, Homo sapiens
attgctatttgttag

SEQ ID NO: 226499 - DNA, 15 bp, Homo sapiens
tattgctatttgtta

SEQ ID NO: 226500 - DNA, 15 bp, Homo sapiens
atattgctatttgtt

SEQ ID NO: 226501 - DNA, 15 bp, Homo sapiens
tatattgctatttgt

SEQ ID NO: 226502 - DNA, 15 bp, Homo sapiens
atatattgctatttg

SEQ ID NO: 226503 - DNA, 15 bp, Homo sapiens
gatatattgctattt

SEQ ID NO: 226504 - DNA, 15 bp, Homo sapiens
tgatatattgctatt

SEQ ID NO: 226505 - DNA, 15 bp, Homo sapiens
gtgatatattgctat

SEQ ID NO: 226506 - DNA, 15 bp, Homo sapiens
tgtgatatattgcta

SEQ ID NO: 226507 - DNA, 15 bp, Homo sapiens
atgtgatatattgct

SEQ ID NO: 226508 - DNA, 15 bp, Homo sapiens
tatgtgatatattgc

SEQ ID NO: 226509 - DNA, 15 bp, Homo sapiens
ctatgtgatatattg

SEQ ID NO: 226510 - DNA, 15 bp, Homo sapiens
actatgtgatatatt

SEQ ID NO: 226511 - DNA, 15 bp, Homo sapiens
tactatgtgatatat

SEQ ID NO: 226512 - DNA, 15 bp, Homo sapiens
ttactatgtgatata

SEQ ID NO: 226513 - DNA, 15 bp, Homo sapiens
tttactatgtgatat

SEQ ID NO: 226514 - DNA, 15 bp, Homo sapiens
gtttactatgtgata

SEQ ID NO: 226515 - DNA, 15 bp, Homo sapiens
agtttactatgtgat

SEQ ID NO: 226516 - DNA, 15 bp, Homo sapiens
aagtttactatgtga

SEQ ID NO: 226517 - DNA, 15 bp, Homo sapiens
taagtttactatgtg

SEQ ID NO: 226518 - DNA, 15 bp, Homo sapiens
ttaagtttactatgt

SEQ ID NO: 226519 - DNA, 15 bp, Homo sapiens
cttaagtttactatg

SEQ ID NO: 226520 - DNA, 15 bp, Homo sapiens
tcttaagtttactat

SEQ ID NO: 226521 - DNA, 15 bp, Homo sapiens
ctcttaagtttacta

SEQ ID NO: 226522 - DNA, 15 bp, Homo sapiens
tctcttaagtttact

SEQ ID NO: 226523 - DNA, 15 bp, Homo sapiens
ttctcttaagtttac

SEQ ID NO: 226524 - DNA, 15 bp, Homo sapiens
tttctcttaagttta

SEQ ID NO: 226525 - DNA, 15 bp, Homo sapiens
ttttctcttaagttt

SEQ ID NO: 226526 - DNA, 15 bp, Homo sapiens
attttctcttaagtt

SEQ ID NO: 226527 - DNA, 15 bp, Homo sapiens
cattttctcttaagt

SEQ ID NO: 226528 - DNA, 15 bp, Homo sapiens
acattttctcttaag

SEQ ID NO: 226529 - DNA, 15 bp, Homo sapiens
cacattttctcttaa

SEQ ID NO: 226530 - DNA, 15 bp, Homo sapiens
acacattttctctta

SEQ ID NO: 226531 - DNA, 15 bp, Homo sapiens
tacacattttctctt

SEQ ID NO: 226532 - DNA, 15 bp, Homo sapiens
ttacacattttctct

SEQ ID NO: 226533 - DNA, 15 bp, Homo sapiens
attacacattttctc

SEQ ID NO: 226534 - DNA, 15 bp, Homo sapiens
cattacacattttct

SEQ ID NO: 226535 - DNA, 15 bp, Homo sapiens
tcattacacattttc

SEQ ID NO: 226536 - DNA, 15 bp, Homo sapiens
ttcattacacatttt

SEQ ID NO: 226537 - DNA, 15 bp, Homo sapiens
attcattacacattt

SEQ ID NO: 226538 - DNA, 15 bp, Homo sapiens
aattcattacacatt

SEQ ID NO: 226539 - DNA, 15 bp, Homo sapiens
gaattcattacacat

SEQ ID NO: 226540 - DNA, 15 bp, Homo sapiens
agaattcattacaca

SEQ ID NO: 226541 - DNA, 15 bp, Homo sapiens
cagaattcattacac

SEQ ID NO: 226542 - DNA, 15 bp, Homo sapiens
ccagaattcattaca

SEQ ID NO: 226543 - DNA, 15 bp, Homo sapiens
cccagaattcattac

SEQ ID NO: 226544 - DNA, 15 bp, Homo sapiens
acccagaattcatta

SEQ ID NO: 226545 - DNA, 15 bp, Homo sapiens
gacccagaattcatt

SEQ ID NO: 226546 - DNA, 15 bp, Homo sapiens
ggacccagaattcat

SEQ ID NO: 226547 - DNA, 15 bp, Homo sapiens
tggacccagaattca

SEQ ID NO: 226548 - DNA, 15 bp, Homo sapiens
ttggacccagaattc

SEQ ID NO: 226549 - DNA, 15 bp, Homo sapiens
attggacccagaatt

SEQ ID NO: 226550 - DNA, 15 bp, Homo sapiens
tattggacccagaat

SEQ ID NO: 226551 - DNA, 15 bp, Homo sapiens
atattggacccagaa

SEQ ID NO: 226552 - DNA, 15 bp, Homo sapiens
tatattggacccaga

SEQ ID NO: 226553 - DNA, 15 bp, Homo sapiens
atatattggacccag

SEQ ID NO: 226554 - DNA, 15 bp, Homo sapiens
tatatattggaccca

SEQ ID NO: 226555 - DNA, 15 bp, Homo sapiens
atatatattggaccc

SEQ ID NO: 226556 - DNA, 15 bp, Homo sapiens
gatatatattggacc

SEQ ID NO: 226557 - DNA, 15 bp, Homo sapiens
agatatatattggac

SEQ ID NO: 226558 - DNA, 15 bp, Homo sapiens
cagatatatattgga

SEQ ID NO: 226559 - DNA, 15 bp, Homo sapiens
acagatatatattgg

SEQ ID NO: 226560 - DNA, 15 bp, Homo sapiens
tacagatatatattg

SEQ ID NO: 226561 - DNA, 15 bp, Homo sapiens
atacagatatatatt

SEQ ID NO: 226562 - DNA, 15 bp, Homo sapiens
aatacagatatatat

SEQ ID NO: 226563 - DNA, 15 bp, Homo sapiens
caatacagatatata

SEQ ID NO: 226564 - DNA, 15 bp, Homo sapiens
acaatacagatatat

SEQ ID NO: 226565 - DNA, 15 bp, Homo sapiens
cacaatacagatata

SEQ ID NO: 226566 - DNA, 15 bp, Homo sapiens
tcacaatacagatat

SEQ ID NO: 226567 - DNA, 15 bp, Homo sapiens
atcacaatacagata

SEQ ID NO: 226568 - DNA, 15 bp, Homo sapiens
aatcacaatacagat

SEQ ID NO: 226569 - DNA, 15 bp, Homo sapiens
aaatcacaatacaga

SEQ ID NO: 226570 - DNA, 15 bp, Homo sapiens
aaaatcacaatacag

SEQ ID NO: 226571 - DNA, 15 bp, Homo sapiens
aaaaatcacaataca

SEQ ID NO: 226572 - DNA, 15 bp, Homo sapiens
gaaaaatcacaatac

SEQ ID NO: 226573 - DNA, 15 bp, Homo sapiens
tgaaaaatcacaata

SEQ ID NO: 226574 - DNA, 15 bp, Homo sapiens
gtgaaaaatcacaat

SEQ ID NO: 226575 - DNA, 15 bp, Homo sapiens
agtgaaaaatcacaa

SEQ ID NO: 226576 - DNA, 15 bp, Homo sapiens
cagtgaaaaatcaca

SEQ ID NO: 226577 - DNA, 15 bp, Homo sapiens
gcagtgaaaaatcac

SEQ ID NO: 226578 - DNA, 15 bp, Homo sapiens
agcagtgaaaaatca

SEQ ID NO: 226579 - DNA, 15 bp, Homo sapiens
cagcagtgaaaaatc

SEQ ID NO: 226580 - DNA, 15 bp, Homo sapiens
tcagcagtgaaaaat

SEQ ID NO: 226581 - DNA, 15 bp, Homo sapiens
gtcagcagtgaaaaa

SEQ ID NO: 226582 - DNA, 15 bp, Homo sapiens
tgtcagcagtgaaaa

SEQ ID NO: 226583 - DNA, 15 bp, Homo sapiens
ttgtcagcagtgaaa

SEQ ID NO: 226584 - DNA, 15 bp, Homo sapiens
attgtcagcagtgaa

SEQ ID NO: 226585 - DNA, 15 bp, Homo sapiens
tattgtcagcagtga

SEQ ID NO: 226586 - DNA, 15 bp, Homo sapiens
ttattgtcagcagtg

SEQ ID NO: 226587 - DNA, 15 bp, Homo sapiens
tttattgtcagcagt

SEQ ID NO: 226588 - DNA, 15 bp, Homo sapiens
ttttattgtcagcag

SEQ ID NO: 226589 - DNA, 15 bp, Homo sapiens
attttattgtcagca

SEQ ID NO: 226590 - DNA, 15 bp, Homo sapiens
gattttattgtcagc

SEQ ID NO: 226591 - DNA, 15 bp, Homo sapiens
tgattttattgtcag

SEQ ID NO: 226592 - DNA, 15 bp, Homo sapiens
atgattttattgtca

SEQ ID NO: 226593 - DNA, 15 bp, Homo sapiens
aatgattttattgtc

SEQ ID NO: 226594 - DNA, 15 bp, Homo sapiens
gaatgattttattgt

SEQ ID NO: 226595 - DNA, 15 bp, Homo sapiens
agaatgattttattg

SEQ ID NO: 226596 - DNA, 15 bp, Homo sapiens
cagaatgattttatt

SEQ ID NO: 226597 - DNA, 15 bp, Homo sapiens
tcagaatgattttat

SEQ ID NO: 226598 - DNA, 15 bp, Homo sapiens
atcagaatgatttta

SEQ ID NO: 226599 - DNA, 15 bp, Homo sapiens
catcagaatgatttt

SEQ ID NO: 226600 - DNA, 15 bp, Homo sapiens
gcatcagaatgattt

SEQ ID NO: 226601 - DNA, 15 bp, Homo sapiens
tgcatcagaatgatt

SEQ ID NO: 226602 - DNA, 15 bp, Homo sapiens
atgcatcagaatgat

SEQ ID NO: 226603 - DNA, 15 bp, Homo sapiens
aatgcatcagaatga

SEQ ID NO: 226604 - DNA, 15 bp, Homo sapiens
aaatgcatcagaatg

SEQ ID NO: 226605 - DNA, 15 bp, Homo sapiens
aaaatgcatcagaat

SEQ ID NO: 226606 - DNA, 15 bp, Homo sapiens
aaaaatgcatcagaa

SEQ ID NO: 226607 - DNA, 15 bp, Homo sapiens
taaaaatgcatcaga

SEQ ID NO: 226608 - DNA, 15 bp, Homo sapiens
ttaaaaatgcatcag

SEQ ID NO: 226609 - DNA, 15 bp, Homo sapiens
tttaaaaatgcatca

SEQ ID NO: 226610 - DNA, 15 bp, Homo sapiens
ttttaaaaatgcatc

SEQ ID NO: 226611 - DNA, 15 bp, Homo sapiens
tttttaaaaatgcat

SEQ ID NO: 226612 - DNA, 15 bp, Homo sapiens
atttttaaaaatgca

SEQ ID NO: 226613 - DNA, 15 bp, Homo sapiens
tatttttaaaaatgc

SEQ ID NO: 226614 - DNA, 15 bp, Homo sapiens
ttatttttaaaaatg

SEQ ID NO: 226615 - DNA, 15 bp, Homo sapiens
tttatttttaaaaat

SEQ ID NO: 226616 - DNA, 15 bp, Homo sapiens
gtttatttttaaaaa

SEQ ID NO: 226617 - DNA, 15 bp, Homo sapiens
tgtttatttttaaaa

SEQ ID NO: 226618 - DNA, 15 bp, Homo sapiens
atgtttatttttaaa

SEQ ID NO: 226619 - DNA, 15 bp, Homo sapiens
catgtttatttttaa

SEQ ID NO: 226620 - DNA, 15 bp, Homo sapiens
gcatgtttattttta

SEQ ID NO: 226621 - DNA, 15 bp, Homo sapiens
ggcatgtttattttt

SEQ ID NO: 226622 - DNA, 15 bp, Homo sapiens
tggcatgtttatttt

SEQ ID NO: 226623 - DNA, 15 bp, Homo sapiens
atggcatgtttattt

SEQ ID NO: 226624 - DNA, 15 bp, Homo sapiens
aatggcatgtttatt

SEQ ID NO: 226625 - DNA, 15 bp, Homo sapiens
gaatggcatgtttat

SEQ ID NO: 226626 - DNA, 15 bp, Homo sapiens
tgaatggcatgttta

SEQ ID NO: 226627 - DNA, 15 bp, Homo sapiens
ttgaatggcatgttt

SEQ ID NO: 226628 - DNA, 15 bp, Homo sapiens
tttgaatggcatgtt

SEQ ID NO: 226629 - DNA, 15 bp, Homo sapiens
ttttgaatggcatgt

SEQ ID NO: 226630 - DNA, 15 bp, Homo sapiens
attttgaatggcatg

SEQ ID NO: 226631 - DNA, 15 bp, Homo sapiens
gattttgaatggcat

SEQ ID NO: 226632 - DNA, 15 bp, Homo sapiens
cgattttgaatggca

SEQ ID NO: 226633 - DNA, 15 bp, Homo sapiens
acgattttgaatggc

SEQ ID NO: 226634 - DNA, 15 bp, Homo sapiens
aacgattttgaatgg

SEQ ID NO: 226635 - DNA, 15 bp, Homo sapiens
aaacgattttgaatg

SEQ ID NO: 226636 - DNA, 15 bp, Homo sapiens
aaaacgattttgaat

SEQ ID NO: 226637 - DNA, 15 bp, Homo sapiens
aaaaacgattttgaa

SEQ ID NO: 226638 - DNA, 15 bp, Homo sapiens
gaaaaacgattttga

SEQ ID NO: 226639 - DNA, 15 bp, Homo sapiens
tgaaaaacgattttg

SEQ ID NO: 226640 - DNA, 15 bp, Homo sapiens
atgaaaaacgatttt

SEQ ID NO: 226641 - DNA, 15 bp, Homo sapiens
gatgaaaaacgattt

SEQ ID NO: 226642 - DNA, 15 bp, Homo sapiens
tgatgaaaaacgatt

SEQ ID NO: 226643 - DNA, 15 bp, Homo sapiens
atgatgaaaaacgat

SEQ ID NO: 226644 - DNA, 15 bp, Homo sapiens
aatgatgaaaaacga

SEQ ID NO: 226645 - DNA, 15 bp, Homo sapiens
gaatgatgaaaaacg

SEQ ID NO: 226646 - DNA, 15 bp, Homo sapiens
tgaatgatgaaaaac

SEQ ID NO: 226647 - DNA, 15 bp, Homo sapiens
gtgaatgatgaaaaa

SEQ ID NO: 226648 - DNA, 15 bp, Homo sapiens
agtgaatgatgaaaa

SEQ ID NO: 226649 - DNA, 15 bp, Homo sapiens
aagtgaatgatgaaa

SEQ ID NO: 226650 - DNA, 15 bp, Homo sapiens
gaagtgaatgatgaa

SEQ ID NO: 226651 - DNA, 15 bp, Homo sapiens
tgaagtgaatgatga

SEQ ID NO: 226652 - DNA, 15 bp, Homo sapiens
gtgaagtgaatgatg

SEQ ID NO: 226653 - DNA, 15 bp, Homo sapiens
tgtgaagtgaatgat

SEQ ID NO: 226654 - DNA, 15 bp, Homo sapiens
atgtgaagtgaatga

SEQ ID NO: 226655 - DNA, 15 bp, Homo sapiens
tatgtgaagtgaatg

SEQ ID NO: 226656 - DNA, 15 bp, Homo sapiens
ctatgtgaagtgaat

SEQ ID NO: 226657 - DNA, 15 bp, Homo sapiens
actatgtgaagtgaa

SEQ ID NO: 226658 - DNA, 15 bp, Homo sapiens
tactatgtgaagtga

SEQ ID NO: 226659 - DNA, 15 bp, Homo sapiens
ttactatgtgaagtg

SEQ ID NO: 226660 - DNA, 15 bp, Homo sapiens
gttactatgtgaagt

SEQ ID NO: 226661 - DNA, 15 bp, Homo sapiens
tgttactatgtgaag

SEQ ID NO: 226662 - DNA, 15 bp, Homo sapiens
ctgttactatgtgaa

SEQ ID NO: 226663 - DNA, 15 bp, Homo sapiens
gctgttactatgtga

SEQ ID NO: 226664 - DNA, 15 bp, Homo sapiens
tgctgttactatgtg

SEQ ID NO: 226665 - DNA, 15 bp, Homo sapiens
ttgctgttactatgt

SEQ ID NO: 226666 - DNA, 15 bp, Homo sapiens
tttgctgttactatg

SEQ ID NO: 226667 - DNA, 15 bp, Homo sapiens
gtttgctgttactat

SEQ ID NO: 226668 - DNA, 15 bp, Homo sapiens
ggtttgctgttacta

SEQ ID NO: 226669 - DNA, 15 bp, Homo sapiens
aggtttgctgttact

SEQ ID NO: 226670 - DNA, 15 bp, Homo sapiens
caggtttgctgttac

SEQ ID NO: 226671 - DNA, 15 bp, Homo sapiens
tcaggtttgctgtta

SEQ ID NO: 226672 - DNA, 15 bp, Homo sapiens
ttcaggtttgctgtt

SEQ ID NO: 226673 - DNA, 15 bp, Homo sapiens
tttcaggtttgctgt

SEQ ID NO: 226674 - DNA, 15 bp, Homo sapiens
ctttcaggtttgctg

SEQ ID NO: 226675 - DNA, 15 bp, Homo sapiens
tctttcaggtttgct

SEQ ID NO: 226676 - DNA, 15 bp, Homo sapiens
atctttcaggtttgc

SEQ ID NO: 226677 - DNA, 15 bp, Homo sapiens
aatctttcaggtttg

SEQ ID NO: 226678 - DNA, 15 bp, Homo sapiens
caatctttcaggttt

SEQ ID NO: 226679 - DNA, 15 bp, Homo sapiens
gcaatctttcaggtt

SEQ ID NO: 226680 - DNA, 15 bp, Homo sapiens
ggcaatctttcaggt

SEQ ID NO: 226681 - DNA, 15 bp, Homo sapiens
aggcaatctttcagg

SEQ ID NO: 226682 - DNA, 15 bp, Homo sapiens
gaggcaatctttcag

SEQ ID NO: 226683 - DNA, 15 bp, Homo sapiens
tgaggcaatctttca

SEQ ID NO: 226684 - DNA, 15 bp, Homo sapiens
atgaggcaatctttc

SEQ ID NO: 226685 - DNA, 15 bp, Homo sapiens
catgaggcaatcttt

SEQ ID NO: 226686 - DNA, 15 bp, Homo sapiens
gcatgaggcaatctt

SEQ ID NO: 226687 - DNA, 15 bp, Homo sapiens
agcatgaggcaatct

SEQ ID NO: 226688 - DNA, 15 bp, Homo sapiens
cagcatgaggcaatc

SEQ ID NO: 226689 - DNA, 15 bp, Homo sapiens
acagcatgaggcaat

SEQ ID NO: 226690 - DNA, 15 bp, Homo sapiens
cacagcatgaggcaa

SEQ ID NO: 226691 - DNA, 15 bp, Homo sapiens
acacagcatgaggca

SEQ ID NO: 226692 - DNA, 15 bp, Homo sapiens
gacacagcatgaggc

SEQ ID NO: 226693 - DNA, 15 bp, Homo sapiens
ggacacagcatgagg

SEQ ID NO: 226694 - DNA, 15 bp, Homo sapiens
tggacacagcatgag

SEQ ID NO: 226695 - DNA, 15 bp, Homo sapiens
ctggacacagcatga

SEQ ID NO: 226696 - DNA, 15 bp, Homo sapiens
gctggacacagcatg

SEQ ID NO: 226697 - DNA, 15 bp, Homo sapiens
tgctggacacagcat

SEQ ID NO: 226698 - DNA, 15 bp, Homo sapiens
ctgctggacacagca

SEQ ID NO: 226699 - DNA, 15 bp, Homo sapiens
actgctggacacagc

SEQ ID NO: 226700 - DNA, 15 bp, Homo sapiens
cactgctggacacag

SEQ ID NO: 226701 - DNA, 15 bp, Homo sapiens
acactgctggacaca

SEQ ID NO: 226702 - DNA, 15 bp, Homo sapiens
tacactgctggacac

SEQ ID NO: 226703 - DNA, 15 bp, Homo sapiens
ttacactgctggaca

SEQ ID NO: 226704 - DNA, 15 bp, Homo sapiens
tttacactgctggac

SEQ ID NO: 226705 - DNA, 15 bp, Homo sapiens
atttacactgctgga

SEQ ID NO: 226706 - DNA, 15 bp, Homo sapiens
gatttacactgctgg

SEQ ID NO: 226707 - DNA, 15 bp, Homo sapiens
tgatttacactgctg

SEQ ID NO: 226708 - DNA, 15 bp, Homo sapiens
atgatttacactgct

SEQ ID NO: 226709 - DNA, 15 bp, Homo sapiens
catgatttacactgc

SEQ ID NO: 226710 - DNA, 15 bp, Homo sapiens
tcatgatttacactg

SEQ ID NO: 226711 - DNA, 15 bp, Homo sapiens
ttcatgatttacact

SEQ ID NO: 226712 - DNA, 15 bp, Homo sapiens
gttcatgatttacac

SEQ ID NO: 226713 - DNA, 15 bp, Homo sapiens
tgttcatgatttaca

SEQ ID NO: 226714 - DNA, 15 bp, Homo sapiens
atgttcatgatttac

SEQ ID NO: 226715 - DNA, 15 bp, Homo sapiens
aatgttcatgattta

SEQ ID NO: 226716 - DNA, 15 bp, Homo sapiens
aaatgttcatgattt

SEQ ID NO: 226717 - DNA, 15 bp, Homo sapiens
taaatgttcatgatt

SEQ ID NO: 226718 - DNA, 15 bp, Homo sapiens
ataaatgttcatgat

SEQ ID NO: 226719 - DNA, 15 bp, Homo sapiens
aataaatgttcatga

SEQ ID NO: 226720 - DNA, 15 bp, Homo sapiens
taataaatgttcatg

SEQ ID NO: 226721 - DNA, 15 bp, Homo sapiens
gtaataaatgttcat

SEQ ID NO: 226722 - DNA, 15 bp, Homo sapiens
agtaataaatgttca

SEQ ID NO: 226723 - DNA, 15 bp, Homo sapiens
aagtaataaatgttc

SEQ ID NO: 226724 - DNA, 15 bp, Homo sapiens
caagtaataaatgtt

SEQ ID NO: 226725 - DNA, 15 bp, Homo sapiens
acaagtaataaatgt

SEQ ID NO: 226726 - DNA, 15 bp, Homo sapiens
tacaagtaataaatg

SEQ ID NO: 226727 - DNA, 15 bp, Homo sapiens
ttacaagtaataaat

SEQ ID NO: 226728 - DNA, 15 bp, Homo sapiens
cttacaagtaataaa

SEQ ID NO: 226729 - DNA, 15 bp, Homo sapiens
ccttacaagtaataa

SEQ ID NO: 226730 - DNA, 15 bp, Homo sapiens
cccttacaagtaata

SEQ ID NO: 226731 - DNA, 15 bp, Homo sapiens
tcccttacaagtaat

SEQ ID NO: 226732 - DNA, 15 bp, Homo sapiens
ttcccttacaagtaa

SEQ ID NO: 226733 - DNA, 15 bp, Homo sapiens
cttcccttacaagta

SEQ ID NO: 226734 - DNA, 15 bp, Homo sapiens
gcttcccttacaagt

SEQ ID NO: 226735 - DNA, 15 bp, Homo sapiens
tgcttcccttacaag

SEQ ID NO: 226736 - DNA, 15 bp, Homo sapiens
atgcttcccttacaa

SEQ ID NO: 226737 - DNA, 15 bp, Homo sapiens
tatgcttcccttaca

SEQ ID NO: 226738 - DNA, 15 bp, Homo sapiens
ctatgcttcccttac

SEQ ID NO: 226739 - DNA, 15 bp, Homo sapiens
actatgcttccctta

SEQ ID NO: 226740 - DNA, 15 bp, Homo sapiens
aactatgcttccctt

SEQ ID NO: 226741 - DNA, 15 bp, Homo sapiens
taactatgcttccct

SEQ ID NO: 226742 - DNA, 15 bp, Homo sapiens
ctaactatgcttccc

SEQ ID NO: 226743 - DNA, 15 bp, Homo sapiens
tctaactatgcttcc

SEQ ID NO: 226744 - DNA, 15 bp, Homo sapiens
ttctaactatgcttc

SEQ ID NO: 226745 - DNA, 15 bp, Homo sapiens
tttctaactatgctt

SEQ ID NO: 226746 - DNA, 15 bp, Homo sapiens
ttttctaactatgct

SEQ ID NO: 226747 - DNA, 15 bp, Homo sapiens
attttctaactatgc

SEQ ID NO: 226748 - DNA, 15 bp, Homo sapiens
cattttctaactatg

SEQ ID NO: 226749 - DNA, 15 bp, Homo sapiens
gcattttctaactat

SEQ ID NO: 226750 - DNA, 15 bp, Homo sapiens
agcattttctaacta

SEQ ID NO: 226751 - DNA, 15 bp, Homo sapiens
aagcattttctaact

SEQ ID NO: 226752 - DNA, 15 bp, Homo sapiens
aaagcattttctaac

SEQ ID NO: 226753 - DNA, 15 bp, Homo sapiens
gaaagcattttctaa

SEQ ID NO: 226754 - DNA, 15 bp, Homo sapiens
agaaagcattttcta

SEQ ID NO: 226755 - DNA, 15 bp, Homo sapiens
aagaaagcattttct

SEQ ID NO: 226756 - DNA, 15 bp, Homo sapiens
aaagaaagcattttc

SEQ ID NO: 226757 - DNA, 15 bp, Homo sapiens
caaagaaagcatttt

SEQ ID NO: 226758 - DNA, 15 bp, Homo sapiens
tcaaagaaagcattt

SEQ ID NO: 226759 - DNA, 15 bp, Homo sapiens
gtcaaagaaagcatt

SEQ ID NO: 226760 - DNA, 15 bp, Homo sapiens
agtcaaagaaagcat

SEQ ID NO: 226761 - DNA, 15 bp, Homo sapiens
tagtcaaagaaagca

SEQ ID NO: 226762 - DNA, 15 bp, Homo sapiens
atagtcaaagaaagc

SEQ ID NO: 226763 - DNA, 15 bp, Homo sapiens
tatagtcaaagaaag

SEQ ID NO: 226764 - DNA, 15 bp, Homo sapiens
ttatagtcaaagaaa

SEQ ID NO: 226765 - DNA, 15 bp, Homo sapiens
gttatagtcaaagaa

SEQ ID NO: 226766 - DNA, 15 bp, Homo sapiens
agttatagtcaaaga

SEQ ID NO: 226767 - DNA, 15 bp, Homo sapiens
cagttatagtcaaag

SEQ ID NO: 226768 - DNA, 15 bp, Homo sapiens
ccagttatagtcaaa

SEQ ID NO: 226769 - DNA, 15 bp, Homo sapiens
tccagttatagtcaa

SEQ ID NO: 226770 - DNA, 15 bp, Homo sapiens
ttccagttatagtca

SEQ ID NO: 226771 - DNA, 15 bp, Homo sapiens
gttccagttatagtc

SEQ ID NO: 226772 - DNA, 15 bp, Homo sapiens
agttccagttatagt

SEQ ID NO: 226773 - DNA, 15 bp, Homo sapiens
cagttccagttatag

SEQ ID NO: 226774 - DNA, 15 bp, Homo sapiens
ccagttccagttata

SEQ ID NO: 226775 - DNA, 15 bp, Homo sapiens
tccagttccagttat

SEQ ID NO: 226776 - DNA, 15 bp, Homo sapiens
atccagttccagtta

SEQ ID NO: 226777 - DNA, 15 bp, Homo sapiens
gatccagttccagtt

SEQ ID NO: 226778 - DNA, 15 bp, Homo sapiens
tgatccagttccagt

SEQ ID NO: 226779 - DNA, 15 bp, Homo sapiens
ctgatccagttccag

SEQ ID NO: 226780 - DNA, 15 bp, Homo sapiens
tctgatccagttcca

SEQ ID NO: 226781 - DNA, 15 bp, Homo sapiens
gtctgatccagttcc

SEQ ID NO: 226782 - DNA, 15 bp, Homo sapiens
tgtctgatccagttc

SEQ ID NO: 226783 - DNA, 15 bp, Homo sapiens
atgtctgatccagtt

SEQ ID NO: 226784 - DNA, 15 bp, Homo sapiens
tatgtctgatccagt

SEQ ID NO: 226785 - DNA, 15 bp, Homo sapiens
atatgtctgatccag

SEQ ID NO: 226786 - DNA, 15 bp, Homo sapiens
catatgtctgatcca

SEQ ID NO: 226787 - DNA, 15 bp, Homo sapiens
ccatatgtctgatcc

SEQ ID NO: 226788 - DNA, 15 bp, Homo sapiens
tccatatgtctgatc

SEQ ID NO: 226789 - DNA, 15 bp, Homo sapiens
gtccatatgtctgat

SEQ ID NO: 226790 - DNA, 15 bp, Homo sapiens
tgtccatatgtctga

SEQ ID NO: 226791 - DNA, 15 bp, Homo sapiens
ctgtccatatgtctg

SEQ ID NO: 226792 - DNA, 15 bp, Homo sapiens
cctgtccatatgtct

SEQ ID NO: 226793 - DNA, 15 bp, Homo sapiens
acctgtccatatgtc

SEQ ID NO: 226794 - DNA, 15 bp, Homo sapiens
tacctgtccatatgt

SEQ ID NO: 226795 - DNA, 15 bp, Homo sapiens
ctacctgtccatatg

SEQ ID NO: 226796 - DNA, 15 bp, Homo sapiens
gctacctgtccatat

SEQ ID NO: 226797 - DNA, 15 bp, Homo sapiens
ggctacctgtccata

SEQ ID NO: 226798 - DNA, 15 bp, Homo sapiens
cggctacctgtccat

SEQ ID NO: 226799 - DNA, 15 bp, Homo sapiens
acggctacctgtcca

SEQ ID NO: 226800 - DNA, 15 bp, Homo sapiens
aacggctacctgtcc

SEQ ID NO: 226801 - DNA, 15 bp, Homo sapiens
aaacggctacctgtc

SEQ ID NO: 226802 - DNA, 15 bp, Homo sapiens
aaaacggctacctgt

SEQ ID NO: 226803 - DNA, 15 bp, Homo sapiens
gaaaacggctacctg

SEQ ID NO: 226804 - DNA, 15 bp, Homo sapiens
ggaaaacggctacct

SEQ ID NO: 226805 - DNA, 15 bp, Homo sapiens
aggaaaacggctacc

SEQ ID NO: 226806 - DNA, 15 bp, Homo sapiens
taggaaaacggctac

SEQ ID NO: 226807 - DNA, 15 bp, Homo sapiens
gtaggaaaacggcta

SEQ ID NO: 226808 - DNA, 15 bp, Homo sapiens
agtaggaaaacggct

SEQ ID NO: 226809 - DNA, 15 bp, Homo sapiens
cagtaggaaaacggc

SEQ ID NO: 226810 - DNA, 15 bp, Homo sapiens
tcagtaggaaaacgg

SEQ ID NO: 226811 - DNA, 15 bp, Homo sapiens
ttcagtaggaaaacg

SEQ ID NO: 226812 - DNA, 15 bp, Homo sapiens
attcagtaggaaaac

SEQ ID NO: 226813 - DNA, 15 bp, Homo sapiens
gattcagtaggaaaa

SEQ ID NO: 226814 - DNA, 15 bp, Homo sapiens
agattcagtaggaaa

SEQ ID NO: 226815 - DNA, 15 bp, Homo sapiens
aagattcagtaggaa

SEQ ID NO: 226816 - DNA, 15 bp, Homo sapiens
taagattcagtagga

SEQ ID NO: 226817 - DNA, 15 bp, Homo sapiens
gtaagattcagtagg

SEQ ID NO: 226818 - DNA, 15 bp, Homo sapiens
agtaagattcagtag

SEQ ID NO: 226819 - DNA, 15 bp, Homo sapiens
gagtaagattcagta

SEQ ID NO: 226820 - DNA, 15 bp, Homo sapiens
tgagtaagattcagt

SEQ ID NO: 226821 - DNA, 15 bp, Homo sapiens
ttgagtaagattcag

SEQ ID NO: 226822 - DNA, 15 bp, Homo sapiens
cttgagtaagattca

SEQ ID NO: 226823 - DNA, 15 bp, Homo sapiens
ccttgagtaagattc

SEQ ID NO: 226824 - DNA, 15 bp, Homo sapiens
tccttgagtaagatt

SEQ ID NO: 226825 - DNA, 15 bp, Homo sapiens
ttccttgagtaagat

SEQ ID NO: 226826 - DNA, 15 bp, Homo sapiens
gttccttgagtaaga

SEQ ID NO: 226827 - DNA, 15 bp, Homo sapiens
ggttccttgagtaag

SEQ ID NO: 226828 - DNA, 15 bp, Homo sapiens
aggttccttgagtaa

SEQ ID NO: 226829 - DNA, 15 bp, Homo sapiens
aaggttccttgagta

SEQ ID NO: 226830 - DNA, 15 bp, Homo sapiens
gaaggttccttgagt

SEQ ID NO: 226831 - DNA, 15 bp, Homo sapiens
agaaggttccttgag

SEQ ID NO: 226832 - DNA, 15 bp, Homo sapiens
aagaaggttccttga

SEQ ID NO: 226833 - DNA, 15 bp, Homo sapiens
gaagaaggttccttg

SEQ ID NO: 226834 - DNA, 15 bp, Homo sapiens
tgaagaaggttcctt

SEQ ID NO: 226835 - DNA, 15 bp, Homo sapiens
ctgaagaaggttcct

SEQ ID NO: 226836 - DNA, 15 bp, Homo sapiens
actgaagaaggttcc

SEQ ID NO: 226837 - DNA, 15 bp, Homo sapiens
gactgaagaaggttc

SEQ ID NO: 226838 - DNA, 15 bp, Homo sapiens
ggactgaagaaggtt

SEQ ID NO: 226839 - DNA, 15 bp, Homo sapiens
cggactgaagaaggt

SEQ ID NO: 226840 - DNA, 15 bp, Homo sapiens
tcggactgaagaagg

SEQ ID NO: 226841 - DNA, 15 bp, Homo sapiens
ttcggactgaagaag

SEQ ID NO: 226842 - DNA, 15 bp, Homo sapiens
attcggactgaagaa

SEQ ID NO: 226843 - DNA, 15 bp, Homo sapiens
tattcggactgaaga

SEQ ID NO: 226844 - DNA, 15 bp, Homo sapiens
ttattcggactgaag

SEQ ID NO: 226845 - DNA, 15 bp, Homo sapiens
tttattcggactgaa

SEQ ID NO: 226846 - DNA, 15 bp, Homo sapiens
atttattcggactga

SEQ ID NO: 226847 - DNA, 15 bp, Homo sapiens
aatttattcggactg

SEQ ID NO: 226848 - DNA, 15 bp, Homo sapiens
aaatttattcggact

SEQ ID NO: 226849 - DNA, 15 bp, Homo sapiens
gaaatttattcggac

SEQ ID NO: 226850 - DNA, 15 bp, Homo sapiens
ggaaatttattcgga

SEQ ID NO: 226851 - DNA, 15 bp, Homo sapiens
gggaaatttattcgg

SEQ ID NO: 226852 - DNA, 15 bp, Homo sapiens
tgggaaatttattcg

SEQ ID NO: 226853 - DNA, 15 bp, Homo sapiens
atgggaaatttattc

SEQ ID NO: 226854 - DNA, 15 bp, Homo sapiens
gatgggaaatttatt

SEQ ID NO: 226855 - DNA, 15 bp, Homo sapiens
tgatgggaaatttat

SEQ ID NO: 226856 - DNA, 15 bp, Homo sapiens
ttgatgggaaattta

SEQ ID NO: 226857 - DNA, 15 bp, Homo sapiens
cttgatgggaaattt

SEQ ID NO: 226858 - DNA, 15 bp, Homo sapiens
tcttgatgggaaatt

SEQ ID NO: 226859 - DNA, 15 bp, Homo sapiens
gtcttgatgggaaat

SEQ ID NO: 226860 - DNA, 15 bp, Homo sapiens
ggtcttgatgggaaa

SEQ ID NO: 226861 - DNA, 15 bp, Homo sapiens
tggtcttgatgggaa

SEQ ID NO: 226862 - DNA, 15 bp, Homo sapiens
atggtcttgatggga

SEQ ID NO: 226863 - DNA, 15 bp, Homo sapiens
tatggtcttgatggg

SEQ ID NO: 226864 - DNA, 15 bp, Homo sapiens
ttatggtcttgatgg

SEQ ID NO: 226865 - DNA, 15 bp, Homo sapiens
attatggtcttgatg

SEQ ID NO: 226866 - DNA, 15 bp, Homo sapiens
gattatggtcttgat

SEQ ID NO: 226867 - DNA, 15 bp, Homo sapiens
agattatggtcttga

SEQ ID NO: 226868 - DNA, 15 bp, Homo sapiens
aagattatggtcttg

SEQ ID NO: 226869 - DNA, 15 bp, Homo sapiens
aaagattatggtctt

SEQ ID NO: 226870 - DNA, 15 bp, Homo sapiens
aaaagattatggtct

SEQ ID NO: 226871 - DNA, 15 bp, Homo sapiens
aaaaagattatggtc

SEQ ID NO: 226872 - DNA, 15 bp, Homo sapiens
caaaaagattatggt

SEQ ID NO: 226873 - DNA, 15 bp, Homo sapiens
tcaaaaagattatgg

SEQ ID NO: 226874 - DNA, 15 bp, Homo sapiens
gtcaaaaagattatg

SEQ ID NO: 226875 - DNA, 15 bp, Homo sapiens
agtcaaaaagattat

SEQ ID NO: 226876 - DNA, 15 bp, Homo sapiens
gagtcaaaaagatta

SEQ ID NO: 226877 - DNA, 15 bp, Homo sapiens
agagtcaaaaagatt

SEQ ID NO: 226878 - DNA, 15 bp, Homo sapiens
gagagtcaaaaagat

SEQ ID NO: 226879 - DNA, 15 bp, Homo sapiens
agagagtcaaaaaga

SEQ ID NO: 226880 - DNA, 15 bp, Homo sapiens
cagagagtcaaaaag

SEQ ID NO: 226881 - DNA, 15 bp, Homo sapiens
tcagagagtcaaaaa

SEQ ID NO: 226882 - DNA, 15 bp, Homo sapiens
ttcagagagtcaaaa

SEQ ID NO: 226883 - DNA, 15 bp, Homo sapiens
tttcagagagtcaaa

SEQ ID NO: 226884 - DNA, 15 bp, Homo sapiens
gtttcagagagtcaa

SEQ ID NO: 226885 - DNA, 15 bp, Homo sapiens
agtttcagagagtca

SEQ ID NO: 226886 - DNA, 15 bp, Homo sapiens
tagtttcagagagtc

SEQ ID NO: 226887 - DNA, 15 bp, Homo sapiens
ctagtttcagagagt

SEQ ID NO: 226888 - DNA, 15 bp, Homo sapiens
actagtttcagagag

SEQ ID NO: 226889 - DNA, 15 bp, Homo sapiens
aactagtttcagaga

SEQ ID NO: 226890 - DNA, 15 bp, Homo sapiens
caactagtttcagag

SEQ ID NO: 226891 - DNA, 15 bp, Homo sapiens
acaactagtttcaga

SEQ ID NO: 226892 - DNA, 15 bp, Homo sapiens
tacaactagtttcag

SEQ ID NO: 226893 - DNA, 15 bp, Homo sapiens
atacaactagtttca

SEQ ID NO: 226894 - DNA, 15 bp, Homo sapiens
tatacaactagtttc

SEQ ID NO: 226895 - DNA, 15 bp, Homo sapiens
atatacaactagttt

SEQ ID NO: 226896 - DNA, 15 bp, Homo sapiens
tatatacaactagtt

SEQ ID NO: 226897 - DNA, 15 bp, Homo sapiens
atatatacaactagt

SEQ ID NO: 226898 - DNA, 15 bp, Homo sapiens
catatatacaactag

SEQ ID NO: 226899 - DNA, 15 bp, Homo sapiens
acatatatacaacta

SEQ ID NO: 226900 - DNA, 15 bp, Homo sapiens
cacatatatacaact

SEQ ID NO: 226901 - DNA, 15 bp, Homo sapiens
acacatatatacaac

SEQ ID NO: 226902 - DNA, 15 bp, Homo sapiens
cacacatatatacaa

SEQ ID NO: 226903 - DNA, 15 bp, Homo sapiens
acacacatatataca

SEQ ID NO: 226904 - DNA, 15 bp, Homo sapiens
cacacacatatatac

SEQ ID NO: 226905 - DNA, 15 bp, Homo sapiens
acacacacatatata

SEQ ID NO: 226906 - DNA, 15 bp, Homo sapiens
tacacacacacatat

SEQ ID NO: 226907 - DNA, 15 bp, Homo sapiens
atacacacacacata

SEQ ID NO: 226908 - DNA, 15 bp, Homo sapiens
tatacacacacacat

SEQ ID NO: 226909 - DNA, 15 bp, Homo sapiens
tgtgtgtatatacac

SEQ ID NO: 226910 - DNA, 15 bp, Homo sapiens
catgtgtgtatatac

SEQ ID NO: 226911 - DNA, 15 bp, Homo sapiens
acatgtgtgtatata

SEQ ID NO: 226912 - DNA, 15 bp, Homo sapiens
tacatgtgtgtatat

SEQ ID NO: 226913 - DNA, 15 bp, Homo sapiens
gtacatgtgtgtata

SEQ ID NO: 226914 - DNA, 15 bp, Homo sapiens
tgtacatgtgtgtat

SEQ ID NO: 226915 - DNA, 15 bp, Homo sapiens
gtgtacatgtgtgta

SEQ ID NO: 226916 - DNA, 15 bp, Homo sapiens
tgtgtacatgtgtgt

SEQ ID NO: 226917 - DNA, 15 bp, Homo sapiens
gtgtgtacatgtgtg

SEQ ID NO: 226918 - DNA, 15 bp, Homo sapiens
tgtgtgtacatgtgt

SEQ ID NO: 226919 - DNA, 15 bp, Homo sapiens
gtgtgtgtacatgtg

SEQ ID NO: 226920 - DNA, 15 bp, Homo sapiens
tgtgtgtgtacatgt

SEQ ID NO: 226921 - DNA, 15 bp, Homo sapiens
gtgtgtgtgtacatg

SEQ ID NO: 226922 - DNA, 15 bp, Homo sapiens
tgtgtgtgtgtacat

SEQ ID NO: 226923 - DNA, 15 bp, Homo sapiens
gtgtgtgtgtgtaca

SEQ ID NO: 226924 - DNA, 15 bp, Homo sapiens
ctgtgtgtgtgtgta

SEQ ID NO: 226925 - DNA, 15 bp, Homo sapiens
gctgtgtgtgtgtgt

SEQ ID NO: 226926 - DNA, 15 bp, Homo sapiens
tgctgtgtgtgtgtg

SEQ ID NO: 226927 - DNA, 15 bp, Homo sapiens
gtgctgtgtgtgtgt

SEQ ID NO: 226928 - DNA, 15 bp, Homo sapiens
tgtgctgtgtgtgtg

SEQ ID NO: 226929 - DNA, 15 bp, Homo sapiens
gtgtgctgtgtgtgt

SEQ ID NO: 226930 - DNA, 15 bp, Homo sapiens
agtgtgctgtgtgtg

SEQ ID NO: 226931 - DNA, 15 bp, Homo sapiens
aagtgtgctgtgtgt

SEQ ID NO: 226932 - DNA, 15 bp, Homo sapiens
taagtgtgctgtgtg

SEQ ID NO: 226933 - DNA, 15 bp, Homo sapiens
ttaagtgtgctgtgt

SEQ ID NO: 226934 - DNA, 15 bp, Homo sapiens
gttaagtgtgctgtg

SEQ ID NO: 226935 - DNA, 15 bp, Homo sapiens
agttaagtgtgctgt

SEQ ID NO: 226936 - DNA, 15 bp, Homo sapiens
aagttaagtgtgctg

SEQ ID NO: 226937 - DNA, 15 bp, Homo sapiens
caagttaagtgtgct

SEQ ID NO: 226938 - DNA, 15 bp, Homo sapiens
acaagttaagtgtgc

SEQ ID NO: 226939 - DNA, 15 bp, Homo sapiens
gacaagttaagtgtg

SEQ ID NO: 226940 - DNA, 15 bp, Homo sapiens
agacaagttaagtgt

SEQ ID NO: 226941 - DNA, 15 bp, Homo sapiens
tagacaagttaagtg

SEQ ID NO: 226942 - DNA, 15 bp, Homo sapiens
ctagacaagttaagt

SEQ ID NO: 226943 - DNA, 15 bp, Homo sapiens
gctagacaagttaag

SEQ ID NO: 226944 - DNA, 15 bp, Homo sapiens
tgctagacaagttaa

SEQ ID NO: 226945 - DNA, 15 bp, Homo sapiens
atgctagacaagtta

SEQ ID NO: 226946 - DNA, 15 bp, Homo sapiens
aatgctagacaagtt

SEQ ID NO: 226947 - DNA, 15 bp, Homo sapiens
aaatgctagacaagt

SEQ ID NO: 226948 - DNA, 15 bp, Homo sapiens
gaaatgctagacaag

SEQ ID NO: 226949 - DNA, 15 bp, Homo sapiens
agaaatgctagacaa

SEQ ID NO: 226950 - DNA, 15 bp, Homo sapiens
aagaaatgctagaca

SEQ ID NO: 226951 - DNA, 15 bp, Homo sapiens
aaagaaatgctagac

SEQ ID NO: 226952 - DNA, 15 bp, Homo sapiens
aaaagaaatgctaga

SEQ ID NO: 226953 - DNA, 15 bp, Homo sapiens
aaaaagaaatgctag

SEQ ID NO: 226954 - DNA, 15 bp, Homo sapiens
caaaaagaaatgcta

SEQ ID NO: 226955 - DNA, 15 bp, Homo sapiens
acaaaaagaaatgct

SEQ ID NO: 226956 - DNA, 15 bp, Homo sapiens
aacaaaaagaaatgc

SEQ ID NO: 226957 - DNA, 15 bp, Homo sapiens
aaacaaaaagaaatg

SEQ ID NO: 226958 - DNA, 15 bp, Homo sapiens
aaaacaaaaagaaat

SEQ ID NO: 226959 - DNA, 15 bp, Homo sapiens
gaaaacaaaaagaaa

SEQ ID NO: 226960 - DNA, 15 bp, Homo sapiens
agaaaacaaaaagaa

SEQ ID NO: 226961 - DNA, 15 bp, Homo sapiens
cagaaaacaaaaaga

SEQ ID NO: 226962 - DNA, 15 bp, Homo sapiens
gcagaaaacaaaaag

SEQ ID NO: 226963 - DNA, 15 bp, Homo sapiens
agcagaaaacaaaaa

SEQ ID NO: 226964 - DNA, 15 bp, Homo sapiens
ccagcagaaaacaaa

SEQ ID NO: 226965 - DNA, 15 bp, Homo sapiens
accagcagaaaacaa

SEQ ID NO: 226966 - DNA, 15 bp, Homo sapiens
caccagcagaaaaca

SEQ ID NO: 226967 - DNA, 15 bp, Homo sapiens
ccaccagcagaaaac

SEQ ID NO: 226968 - DNA, 15 bp, Homo sapiens
accaccagcagaaaa

SEQ ID NO: 226969 - DNA, 15 bp, Homo sapiens
taccaccagcagaaa

SEQ ID NO: 226970 - DNA, 15 bp, Homo sapiens
ttaccaccagcagaa

SEQ ID NO: 226971 - DNA, 15 bp, Homo sapiens
gttaccaccagcaga

SEQ ID NO: 226972 - DNA, 15 bp, Homo sapiens
tgttaccaccagcag

SEQ ID NO: 226973 - DNA, 15 bp, Homo sapiens
gtgttaccaccagca

SEQ ID NO: 226974 - DNA, 15 bp, Homo sapiens
agtgttaccaccagc

SEQ ID NO: 226975 - DNA, 15 bp, Homo sapiens
cagtgttaccaccag

SEQ ID NO: 226976 - DNA, 15 bp, Homo sapiens
acagtgttaccacca

SEQ ID NO: 226977 - DNA, 15 bp, Homo sapiens
gacagtgttaccacc

SEQ ID NO: 226978 - DNA, 15 bp, Homo sapiens
agacagtgttaccac

SEQ ID NO: 226979 - DNA, 15 bp, Homo sapiens
aagacagtgttacca

SEQ ID NO: 226980 - DNA, 15 bp, Homo sapiens
aaagacagtgttacc

SEQ ID NO: 226981 - DNA, 15 bp, Homo sapiens
gaaagacagtgttac

SEQ ID NO: 226982 - DNA, 15 bp, Homo sapiens
ggaaagacagtgtta

SEQ ID NO: 226983 - DNA, 15 bp, Homo sapiens
tggaaagacagtgtt

SEQ ID NO: 226984 - DNA, 15 bp, Homo sapiens
ctggaaagacagtgt

SEQ ID NO: 226985 - DNA, 15 bp, Homo sapiens
actggaaagacagtg

SEQ ID NO: 226986 - DNA, 15 bp, Homo sapiens
aactggaaagacagt

SEQ ID NO: 226987 - DNA, 15 bp, Homo sapiens
taactggaaagacag

SEQ ID NO: 226988 - DNA, 15 bp, Homo sapiens
ctaactggaaagaca

SEQ ID NO: 226989 - DNA, 15 bp, Homo sapiens
gctaactggaaagac

SEQ ID NO: 226990 - DNA, 15 bp, Homo sapiens
ggctaactggaaaga

SEQ ID NO: 226991 - DNA, 15 bp, Homo sapiens
aggctaactggaaag

SEQ ID NO: 226992 - DNA, 15 bp, Homo sapiens
gaggctaactggaaa

SEQ ID NO: 226993 - DNA, 15 bp, Homo sapiens
ggaggctaactggaa

SEQ ID NO: 226994 - DNA, 15 bp, Homo sapiens
aggaggctaactgga

SEQ ID NO: 226995 - DNA, 15 bp, Homo sapiens
taggaggctaactgg

SEQ ID NO: 226996 - DNA, 15 bp, Homo sapiens
gtaggaggctaactg

SEQ ID NO: 226997 - DNA, 15 bp, Homo sapiens
tgtaggaggctaact

SEQ ID NO: 226998 - DNA, 15 bp, Homo sapiens
ttgtaggaggctaac

SEQ ID NO: 226999 - DNA, 15 bp, Homo sapiens
tttgtaggaggctaa

SEQ ID NO: 227000 - DNA, 15 bp, Homo sapiens
ctttgtaggaggcta

SEQ ID NO: 227001 - DNA, 15 bp, Homo sapiens
gctttgtaggaggct

SEQ ID NO: 227002 - DNA, 15 bp, Homo sapiens
agctttgtaggaggc

SEQ ID NO: 227003 - DNA, 15 bp, Homo sapiens
tagctttgtaggagg

SEQ ID NO: 227004 - DNA, 15 bp, Homo sapiens
ttagctttgtaggag

SEQ ID NO: 227005 - DNA, 15 bp, Homo sapiens
cttagctttgtagga

SEQ ID NO: 227006 - DNA, 15 bp, Homo sapiens
acttagctttgtagg

SEQ ID NO: 227007 - DNA, 15 bp, Homo sapiens
gacttagctttgtag

SEQ ID NO: 227008 - DNA, 15 bp, Homo sapiens
tgacttagctttgta

SEQ ID NO: 227009 - DNA, 15 bp, Homo sapiens
atgacttagctttgt

SEQ ID NO: 227010 - DNA, 15 bp, Homo sapiens
aatgacttagctttg

SEQ ID NO: 227011 - DNA, 15 bp, Homo sapiens
caatgacttagcttt

SEQ ID NO: 227012 - DNA, 15 bp, Homo sapiens
acaatgacttagctt

SEQ ID NO: 227013 - DNA, 15 bp, Homo sapiens
aacaatgacttagct

SEQ ID NO: 227014 - DNA, 15 bp, Homo sapiens
caacaatgacttagc

SEQ ID NO: 227015 - DNA, 15 bp, Homo sapiens
tcaacaatgacttag

SEQ ID NO: 227016 - DNA, 15 bp, Homo sapiens
ctcaacaatgactta

SEQ ID NO: 227017 - DNA, 15 bp, Homo sapiens
actcaacaatgactt

SEQ ID NO: 227018 - DNA, 15 bp, Homo sapiens
gactcaacaatgact

SEQ ID NO: 227019 - DNA, 15 bp, Homo sapiens
agactcaacaatgac

SEQ ID NO: 227020 - DNA, 15 bp, Homo sapiens
aagactcaacaatga

SEQ ID NO: 227021 - DNA, 15 bp, Homo sapiens
gaagactcaacaatg

SEQ ID NO: 227022 - DNA, 15 bp, Homo sapiens
ggaagactcaacaat

SEQ ID NO: 227023 - DNA, 15 bp, Homo sapiens
tggaagactcaacaa

SEQ ID NO: 227024 - DNA, 15 bp, Homo sapiens
gtggaagactcaaca

SEQ ID NO: 227025 - DNA, 15 bp, Homo sapiens
agtggaagactcaac

SEQ ID NO: 227026 - DNA, 15 bp, Homo sapiens
aagtggaagactcaa

SEQ ID NO: 227027 - DNA, 15 bp, Homo sapiens
aaagtggaagactca

SEQ ID NO: 227028 - DNA, 15 bp, Homo sapiens
aaaagtggaagactc

SEQ ID NO: 227029 - DNA, 15 bp, Homo sapiens
gaaaagtggaagact

SEQ ID NO: 227030 - DNA, 15 bp, Homo sapiens
tgaaaagtggaagac

SEQ ID NO: 227031 - DNA, 15 bp, Homo sapiens
gtgaaaagtggaaga

SEQ ID NO: 227032 - DNA, 15 bp, Homo sapiens
ggtgaaaagtggaag

SEQ ID NO: 227033 - DNA, 15 bp, Homo sapiens
tggtgaaaagtggaa

SEQ ID NO: 227034 - DNA, 15 bp, Homo sapiens
ttggtgaaaagtgga

SEQ ID NO: 227035 - DNA, 15 bp, Homo sapiens
tttggtgaaaagtgg

SEQ ID NO: 227036 - DNA, 15 bp, Homo sapiens
atttggtgaaaagtg

SEQ ID NO: 227037 - DNA, 15 bp, Homo sapiens
gatttggtgaaaagt

SEQ ID NO: 227038 - DNA, 15 bp, Homo sapiens
ggatttggtgaaaag

SEQ ID NO: 227039 - DNA, 15 bp, Homo sapiens
tggatttggtgaaaa

SEQ ID NO: 227040 - DNA, 15 bp, Homo sapiens
ctggatttggtgaaa

SEQ ID NO: 227041 - DNA, 15 bp, Homo sapiens
actggatttggtgaa

SEQ ID NO: 227042 - DNA, 15 bp, Homo sapiens
cactggatttggtga

SEQ ID NO: 227043 - DNA, 15 bp, Homo sapiens
ccactggatttggtg

SEQ ID NO: 227044 - DNA, 15 bp, Homo sapiens
accactggatttggt

SEQ ID NO: 227045 - DNA, 15 bp, Homo sapiens
gaccactggatttgg

SEQ ID NO: 227046 - DNA, 15 bp, Homo sapiens
agaccactggatttg

SEQ ID NO: 227047 - DNA, 15 bp, Homo sapiens
tagaccactggattt

SEQ ID NO: 227048 - DNA, 15 bp, Homo sapiens
gtagaccactggatt

SEQ ID NO: 227049 - DNA, 15 bp, Homo sapiens
tgtagaccactggat

SEQ ID NO: 227050 - DNA, 15 bp, Homo sapiens
ttgtagaccactgga

SEQ ID NO: 227051 - DNA, 15 bp, Homo sapiens
tttgtagaccactgg

SEQ ID NO: 227052 - DNA, 15 bp, Homo sapiens
atttgtagaccactg

SEQ ID NO: 227053 - DNA, 15 bp, Homo sapiens
gatttgtagaccact

SEQ ID NO: 227054 - DNA, 15 bp, Homo sapiens
tgatttgtagaccac

SEQ ID NO: 227055 - DNA, 15 bp, Homo sapiens
gtgatttgtagacca

SEQ ID NO: 227056 - DNA, 15 bp, Homo sapiens
agtgatttgtagacc

SEQ ID NO: 227057 - DNA, 15 bp, Homo sapiens
gagtgatttgtagac

SEQ ID NO: 227058 - DNA, 15 bp, Homo sapiens
tgagtgatttgtaga

SEQ ID NO: 227059 - DNA, 15 bp, Homo sapiens
atgagtgatttgtag

SEQ ID NO: 227060 - DNA, 15 bp, Homo sapiens
tatgagtgatttgta

SEQ ID NO: 227061 - DNA, 15 bp, Homo sapiens
ttatgagtgatttgt

SEQ ID NO: 227062 - DNA, 15 bp, Homo sapiens
attatgagtgatttg

SEQ ID NO: 227063 - DNA, 15 bp, Homo sapiens
aattatgagtgattt

SEQ ID NO: 227064 - DNA, 15 bp, Homo sapiens
taattatgagtgatt

SEQ ID NO: 227065 - DNA, 15 bp, Homo sapiens
ataattatgagtgat

SEQ ID NO: 227066 - DNA, 15 bp, Homo sapiens
aataattatgagtga

SEQ ID NO: 227067 - DNA, 15 bp, Homo sapiens
taataattatgagtg

SEQ ID NO: 227068 - DNA, 15 bp, Homo sapiens
ataataattatgagt

SEQ ID NO: 227069 - DNA, 15 bp, Homo sapiens
aataataattatgag

SEQ ID NO: 227070 - DNA, 15 bp, Homo sapiens
aaataataattatga

SEQ ID NO: 227071 - DNA, 15 bp, Homo sapiens
gaaataataattatg

SEQ ID NO: 227072 - DNA, 15 bp, Homo sapiens
agaaataataattat

SEQ ID NO: 227073 - DNA, 15 bp, Homo sapiens
aagaaataataatta

SEQ ID NO: 227074 - DNA, 15 bp, Homo sapiens
aaagaaataataatt

SEQ ID NO: 227075 - DNA, 15 bp, Homo sapiens
aaaagaaataataat

SEQ ID NO: 227076 - DNA, 15 bp, Homo sapiens
gaaaagaaataataa

SEQ ID NO: 227077 - DNA, 15 bp, Homo sapiens
agaaaagaaataata

SEQ ID NO: 227078 - DNA, 15 bp, Homo sapiens
aagaaaagaaataat

SEQ ID NO: 227079 - DNA, 15 bp, Homo sapiens
aaagaaaagaaataa

SEQ ID NO: 227080 - DNA, 15 bp, Homo sapiens
aaaagaaaagaaata

SEQ ID NO: 227081 - DNA, 15 bp, Homo sapiens
aaaaagaaaagaaat

SEQ ID NO: 227082 - DNA, 15 bp, Homo sapiens
gaaaaagaaaagaaa

SEQ ID NO: 227083 - DNA, 15 bp, Homo sapiens
agaaaaagaaaagaa

SEQ ID NO: 227084 - DNA, 15 bp, Homo sapiens
aagaaaaagaaaaga

SEQ ID NO: 227085 - DNA, 15 bp, Homo sapiens
aaagaaaaagaaaag

SEQ ID NO: 227086 - DNA, 15 bp, Homo sapiens
tcaaaaaaaaagaaa

SEQ ID NO: 227087 - DNA, 15 bp, Homo sapiens
ctcaaaaaaaaagaa

SEQ ID NO: 227088 - DNA, 15 bp, Homo sapiens
tctcaaaaaaaaaga

SEQ ID NO: 227089 - DNA, 15 bp, Homo sapiens
gtctcaaaaaaaaag

SEQ ID NO: 227090 - DNA, 15 bp, Homo sapiens
gagtgagactctgtc

SEQ ID NO: 227091 - DNA, 15 bp, Homo sapiens
agagtgagactctgt

SEQ ID NO: 227092 - DNA, 15 bp, Homo sapiens
tagagtgagactctg

SEQ ID NO: 227093 - DNA, 15 bp, Homo sapiens
gtagagtgagactct

SEQ ID NO: 227094 - DNA, 15 bp, Homo sapiens
ggtagagtgagactc

SEQ ID NO: 227095 - DNA, 15 bp, Homo sapiens
tggtagagtgagact

SEQ ID NO: 227096 - DNA, 15 bp, Homo sapiens
gtggtagagtgagac

SEQ ID NO: 227097 - DNA, 15 bp, Homo sapiens
ggtggtagagtgaga

SEQ ID NO: 227098 - DNA, 15 bp, Homo sapiens
aggtggtagagtgag

SEQ ID NO: 227099 - DNA, 15 bp, Homo sapiens
taggtggtagagtga

SEQ ID NO: 227100 - DNA, 15 bp, Homo sapiens
ctaggtggtagagtg

SEQ ID NO: 227101 - DNA, 15 bp, Homo sapiens
cctaggtggtagagt

SEQ ID NO: 227102 - DNA, 15 bp, Homo sapiens
gcctaggtggtagag

SEQ ID NO: 227103 - DNA, 15 bp, Homo sapiens
agcctaggtggtaga

SEQ ID NO: 227104 - DNA, 15 bp, Homo sapiens
cagcctaggtggtag

SEQ ID NO: 227105 - DNA, 15 bp, Homo sapiens
ccagcctaggtggta

SEQ ID NO: 227106 - DNA, 15 bp, Homo sapiens
tccagcctaggtggt

SEQ ID NO: 227107 - DNA, 15 bp, Homo sapiens
ctccagcctaggtgg

SEQ ID NO: 227108 - DNA, 15 bp, Homo sapiens
actccagcctaggtg

SEQ ID NO: 227109 - DNA, 15 bp, Homo sapiens
cactccagcctaggt

SEQ ID NO: 227110 - DNA, 15 bp, Homo sapiens
acactccagcctagg

SEQ ID NO: 227111 - DNA, 15 bp, Homo sapiens
tacactccagcctag

SEQ ID NO: 227112 - DNA, 15 bp, Homo sapiens
ctacactccagccta

SEQ ID NO: 227113 - DNA, 15 bp, Homo sapiens
cgcaccactacactc

SEQ ID NO: 227114 - DNA, 15 bp, Homo sapiens
tcgcaccactacact

SEQ ID NO: 227115 - DNA, 15 bp, Homo sapiens
atcgcaccactacac

SEQ ID NO: 227116 - DNA, 15 bp, Homo sapiens
gatcgcaccactaca

SEQ ID NO: 227117 - DNA, 15 bp, Homo sapiens
agatcgcaccactac

SEQ ID NO: 227118 - DNA, 15 bp, Homo sapiens
gagatcgcaccacta

SEQ ID NO: 227119 - DNA, 15 bp, Homo sapiens
attgcagtgagccga

SEQ ID NO: 227120 - DNA, 15 bp, Homo sapiens
gattgcagtgagccg

SEQ ID NO: 227121 - DNA, 15 bp, Homo sapiens
agattgcagtgagcc

SEQ ID NO: 227122 - DNA, 15 bp, Homo sapiens
gcagagattgcagtg

SEQ ID NO: 227123 - DNA, 15 bp, Homo sapiens
ggcagagattgcagt

SEQ ID NO: 227124 - DNA, 15 bp, Homo sapiens
aggcagagattgcag

SEQ ID NO: 227125 - DNA, 15 bp, Homo sapiens
gaggcagagattgca

SEQ ID NO: 227126 - DNA, 15 bp, Homo sapiens
ggaggcagagattgc

SEQ ID NO: 227127 - DNA, 15 bp, Homo sapiens
gggaggcagagattg

SEQ ID NO: 227128 - DNA, 15 bp, Homo sapiens
tgggaggcagagatt

SEQ ID NO: 227129 - DNA, 15 bp, Homo sapiens
ctgggaggcagagat

SEQ ID NO: 227130 - DNA, 15 bp, Homo sapiens
cctgggaggcagaga

SEQ ID NO: 227131 - DNA, 15 bp, Homo sapiens
tatgagaattgcttg

SEQ ID NO: 227132 - DNA, 15 bp, Homo sapiens
gtatgagaattgctt

SEQ ID NO: 227133 - DNA, 15 bp, Homo sapiens
ggtatgagaattgct

SEQ ID NO: 227134 - DNA, 15 bp, Homo sapiens
aggtatgagaattgc

SEQ ID NO: 227135 - DNA, 15 bp, Homo sapiens
gaggtatgagaattg

SEQ ID NO: 227136 - DNA, 15 bp, Homo sapiens
tgaggtatgagaatt

SEQ ID NO: 227137 - DNA, 15 bp, Homo sapiens
ctgaggtatgagaat

SEQ ID NO: 227138 - DNA, 15 bp, Homo sapiens
gctgaggtatgagaa

SEQ ID NO: 227139 - DNA, 15 bp, Homo sapiens
agctgaggtatgaga

SEQ ID NO: 227140 - DNA, 15 bp, Homo sapiens
aagctgaggtatgag

SEQ ID NO: 227141 - DNA, 15 bp, Homo sapiens
gaagctgaggtatga

SEQ ID NO: 227142 - DNA, 15 bp, Homo sapiens
ggaagctgaggtatg

SEQ ID NO: 227143 - DNA, 15 bp, Homo sapiens
gggaagctgaggtat

SEQ ID NO: 227144 - DNA, 15 bp, Homo sapiens
tgggaagctgaggta

SEQ ID NO: 227145 - DNA, 15 bp, Homo sapiens
atgggaagctgaggt

SEQ ID NO: 227146 - DNA, 15 bp, Homo sapiens
tatgggaagctgagg

SEQ ID NO: 227147 - DNA, 15 bp, Homo sapiens
atatgggaagctgag

SEQ ID NO: 227148 - DNA, 15 bp, Homo sapiens
tatatgggaagctga

SEQ ID NO: 227149 - DNA, 15 bp, Homo sapiens
ctatatgggaagctg

SEQ ID NO: 227150 - DNA, 15 bp, Homo sapiens
gctatatgggaagct

SEQ ID NO: 227151 - DNA, 15 bp, Homo sapiens
agctatatgggaagc

SEQ ID NO: 227152 - DNA, 15 bp, Homo sapiens
cagctatatgggaag

SEQ ID NO: 227153 - DNA, 15 bp, Homo sapiens
ccagctatatgggaa

SEQ ID NO: 227154 - DNA, 15 bp, Homo sapiens
cccagctatatggga

SEQ ID NO: 227155 - DNA, 15 bp, Homo sapiens
tcccagctatatggg

SEQ ID NO: 227156 - DNA, 15 bp, Homo sapiens
gtcccagctatatgg

SEQ ID NO: 227157 - DNA, 15 bp, Homo sapiens
agtcccagctatatg

SEQ ID NO: 227158 - DNA, 15 bp, Homo sapiens
tagtcccagctatat

SEQ ID NO: 227159 - DNA, 15 bp, Homo sapiens
gtagtcccagctata

SEQ ID NO: 227160 - DNA, 15 bp, Homo sapiens
tgtagtcccagctat

SEQ ID NO: 227161 - DNA, 15 bp, Homo sapiens
gacacctgtagtccc

SEQ ID NO: 227162 - DNA, 15 bp, Homo sapiens
ggacacctgtagtcc

SEQ ID NO: 227163 - DNA, 15 bp, Homo sapiens
tggacacctgtagtc

SEQ ID NO: 227164 - DNA, 15 bp, Homo sapiens
gtggacacctgtagt

SEQ ID NO: 227165 - DNA, 15 bp, Homo sapiens
ggtggacacctgtag

SEQ ID NO: 227166 - DNA, 15 bp, Homo sapiens
tggtggacacctgta

SEQ ID NO: 227167 - DNA, 15 bp, Homo sapiens
gtggtggacacctgt

SEQ ID NO: 227168 - DNA, 15 bp, Homo sapiens
ggtggtggacacctg

SEQ ID NO: 227169 - DNA, 15 bp, Homo sapiens
tggtggtggacacct

SEQ ID NO: 227170 - DNA, 15 bp, Homo sapiens
gtggtggtggacacc

SEQ ID NO: 227171 - DNA, 15 bp, Homo sapiens
cgtggtggtggacac

SEQ ID NO: 227172 - DNA, 15 bp, Homo sapiens
gcgtggtggtggaca

SEQ ID NO: 227173 - DNA, 15 bp, Homo sapiens
ggcgtggtggtggac

SEQ ID NO: 227174 - DNA, 15 bp, Homo sapiens
gggcgtggtggtgga

SEQ ID NO: 227175 - DNA, 15 bp, Homo sapiens
tgggcgtggtggtgg

SEQ ID NO: 227176 - DNA, 15 bp, Homo sapiens
ctgggcgtggtggtg

SEQ ID NO: 227177 - DNA, 15 bp, Homo sapiens
gctgggcgtggtggt

SEQ ID NO: 227178 - DNA, 15 bp, Homo sapiens
ctagctgggcgtggt

SEQ ID NO: 227179 - DNA, 15 bp, Homo sapiens
actagctgggcgtgg

SEQ ID NO: 227180 - DNA, 15 bp, Homo sapiens
aactagctgggcgtg

SEQ ID NO: 227181 - DNA, 15 bp, Homo sapiens
aaactagctgggcgt

SEQ ID NO: 227182 - DNA, 15 bp, Homo sapiens
aaaactagctgggcg

SEQ ID NO: 227183 - DNA, 15 bp, Homo sapiens
gaaaactagctgggc

SEQ ID NO: 227184 - DNA, 15 bp, Homo sapiens
tgaaaactagctggg

SEQ ID NO: 227185 - DNA, 15 bp, Homo sapiens
atgaaaactagctgg

SEQ ID NO: 227186 - DNA, 15 bp, Homo sapiens
tatgaaaactagctg

SEQ ID NO: 227187 - DNA, 15 bp, Homo sapiens
atatgaaaactagct

SEQ ID NO: 227188 - DNA, 15 bp, Homo sapiens
aatatgaaaactagc

SEQ ID NO: 227189 - DNA, 15 bp, Homo sapiens
aaatatgaaaactag

SEQ ID NO: 227190 - DNA, 15 bp, Homo sapiens
aaaatatgaaaacta

SEQ ID NO: 227191 - DNA, 15 bp, Homo sapiens
aaaaatatgaaaact

SEQ ID NO: 227192 - DNA, 15 bp, Homo sapiens
taaaaatatgaaaac

SEQ ID NO: 227193 - DNA, 15 bp, Homo sapiens
aaaacctcgtctcta

SEQ ID NO: 227194 - DNA, 15 bp, Homo sapiens
caaaacctcgtctct

SEQ ID NO: 227195 - DNA, 15 bp, Homo sapiens
gcaaaacctcgtctc

SEQ ID NO: 227196 - DNA, 15 bp, Homo sapiens
ggcaaaacctcgtct

SEQ ID NO: 227197 - DNA, 15 bp, Homo sapiens
tggcaaaacctcgtc

SEQ ID NO: 227198 - DNA, 15 bp, Homo sapiens
atggcaaaacctcgt

SEQ ID NO: 227199 - DNA, 15 bp, Homo sapiens
catggcaaaacctcg

SEQ ID NO: 227200 - DNA, 15 bp, Homo sapiens
tgccaacatggcaaa

SEQ ID NO: 227201 - DNA, 15 bp, Homo sapiens
ttgccaacatggcaa

SEQ ID NO: 227202 - DNA, 15 bp, Homo sapiens
cttgccaacatggca

SEQ ID NO: 227203 - DNA, 15 bp, Homo sapiens
ccttgccaacatggc

SEQ ID NO: 227204 - DNA, 15 bp, Homo sapiens
gccttgccaacatgg

SEQ ID NO: 227205 - DNA, 15 bp, Homo sapiens
agccttgccaacatg

SEQ ID NO: 227206 - DNA, 15 bp, Homo sapiens
cagccttgccaacat

SEQ ID NO: 227207 - DNA, 15 bp, Homo sapiens
ccagccttgccaaca

SEQ ID NO: 227208 - DNA, 15 bp, Homo sapiens
accagccttgccaac

SEQ ID NO: 227209 - DNA, 15 bp, Homo sapiens
gaccagccttgccaa

SEQ ID NO: 227210 - DNA, 15 bp, Homo sapiens
agaccagccttgcca

SEQ ID NO: 227211 - DNA, 15 bp, Homo sapiens
aagaccagccttgcc

SEQ ID NO: 227212 - DNA, 15 bp, Homo sapiens
caagaccagccttgc

SEQ ID NO: 227213 - DNA, 15 bp, Homo sapiens
tcaagaccagccttg

SEQ ID NO: 227214 - DNA, 15 bp, Homo sapiens
ttcaagaccagcctt

SEQ ID NO: 227215 - DNA, 15 bp, Homo sapiens
aagagttcaagacca

SEQ ID NO: 227216 - DNA, 15 bp, Homo sapiens
caagagttcaagacc

SEQ ID NO: 227217 - DNA, 15 bp, Homo sapiens
ccaagagttcaagac

SEQ ID NO: 227218 - DNA, 15 bp, Homo sapiens
gccaagagttcaaga

SEQ ID NO: 227219 - DNA, 15 bp, Homo sapiens
cgccaagagttcaag

SEQ ID NO: 227220 - DNA, 15 bp, Homo sapiens
acgccaagagttcaa

SEQ ID NO: 227221 - DNA, 15 bp, Homo sapiens
gacgccaagagttca

SEQ ID NO: 227222 - DNA, 15 bp, Homo sapiens
tgacgccaagagttc

SEQ ID NO: 227223 - DNA, 15 bp, Homo sapiens
ctgacgccaagagtt

SEQ ID NO: 227224 - DNA, 15 bp, Homo sapiens
cctgacgccaagagt

SEQ ID NO: 227225 - DNA, 15 bp, Homo sapiens
acctgacgccaagag

SEQ ID NO: 227226 - DNA, 15 bp, Homo sapiens
cacctgacgccaaga

SEQ ID NO: 227227 - DNA, 15 bp, Homo sapiens
tcacctgacgccaag

SEQ ID NO: 227228 - DNA, 15 bp, Homo sapiens
atcacctgacgccaa

SEQ ID NO: 227229 - DNA, 15 bp, Homo sapiens
gatcacctgacgcca

SEQ ID NO: 227230 - DNA, 15 bp, Homo sapiens
agatcacctgacgcc

SEQ ID NO: 227231 - DNA, 15 bp, Homo sapiens
cagatcacctgacgc

SEQ ID NO: 227232 - DNA, 15 bp, Homo sapiens
gcagatcacctgacg

SEQ ID NO: 227233 - DNA, 15 bp, Homo sapiens
ggcagatcacctgac

SEQ ID NO: 227234 - DNA, 15 bp, Homo sapiens
aggcagatcacctga

SEQ ID NO: 227235 - DNA, 15 bp, Homo sapiens
caggcagatcacctg

SEQ ID NO: 227236 - DNA, 15 bp, Homo sapiens
gcaggcagatcacct

SEQ ID NO: 227237 - DNA, 15 bp, Homo sapiens
ggcaggcagatcacc

SEQ ID NO: 227238 - DNA, 15 bp, Homo sapiens
tacgtctgtaatccc

SEQ ID NO: 227239 - DNA, 15 bp, Homo sapiens
ttacgtctgtaatcc

SEQ ID NO: 227240 - DNA, 15 bp, Homo sapiens
cttacgtctgtaatc

SEQ ID NO: 227241 - DNA, 15 bp, Homo sapiens
gcttacgtctgtaat

SEQ ID NO: 227242 - DNA, 15 bp, Homo sapiens
ggcttacgtctgtaa

SEQ ID NO: 227243 - DNA, 15 bp, Homo sapiens
tggcttacgtctgta

SEQ ID NO: 227244 - DNA, 15 bp, Homo sapiens
gtggcttacgtctgt

SEQ ID NO: 227245 - DNA, 15 bp, Homo sapiens
agtggcttacgtctg

SEQ ID NO: 227246 - DNA, 15 bp, Homo sapiens
tagtggcttacgtct

SEQ ID NO: 227247 - DNA, 15 bp, Homo sapiens
gtagtggcttacgtc

SEQ ID NO: 227248 - DNA, 15 bp, Homo sapiens
tgtagtggcttacgt

SEQ ID NO: 227249 - DNA, 15 bp, Homo sapiens
gtgtagtggcttacg

SEQ ID NO: 227250 - DNA, 15 bp, Homo sapiens
agtgtagtggcttac

SEQ ID NO: 227251 - DNA, 15 bp, Homo sapiens
gagtgtagtggctta

SEQ ID NO: 227252 - DNA, 15 bp, Homo sapiens
tgagtgtagtggctt

SEQ ID NO: 227253 - DNA, 15 bp, Homo sapiens
ctgagtgtagtggct

SEQ ID NO: 227254 - DNA, 15 bp, Homo sapiens
gctgagtgtagtggc

SEQ ID NO: 227255 - DNA, 15 bp, Homo sapiens
ggctgagtgtagtgg

SEQ ID NO: 227256 - DNA, 15 bp, Homo sapiens
aggctgagtgtagtg

SEQ ID NO: 227257 - DNA, 15 bp, Homo sapiens
aaggctgagtgtagt

SEQ ID NO: 227258 - DNA, 15 bp, Homo sapiens
taaggctgagtgtag

SEQ ID NO: 227259 - DNA, 15 bp, Homo sapiens
ataaggctgagtgta

SEQ ID NO: 227260 - DNA, 15 bp, Homo sapiens
tataaggctgagtgt

SEQ ID NO: 227261 - DNA, 15 bp, Homo sapiens
atataaggctgagtg

SEQ ID NO: 227262 - DNA, 15 bp, Homo sapiens
aatataaggctgagt

SEQ ID NO: 227263 - DNA, 15 bp, Homo sapiens
aaatataaggctgag

SEQ ID NO: 227264 - DNA, 15 bp, Homo sapiens
caaatataaggctga

SEQ ID NO: 227265 - DNA, 15 bp, Homo sapiens
acaaatataaggctg

SEQ ID NO: 227266 - DNA, 15 bp, Homo sapiens
aacaaatataaggct

SEQ ID NO: 227267 - DNA, 15 bp, Homo sapiens
taacaaatataaggc

SEQ ID NO: 227268 - DNA, 15 bp, Homo sapiens
ataacaaatataagg

SEQ ID NO: 227269 - DNA, 15 bp, Homo sapiens
aataacaaatataag

SEQ ID NO: 227270 - DNA, 15 bp, Homo sapiens
aaataacaaatataa

SEQ ID NO: 227271 - DNA, 15 bp, Homo sapiens
gaaataacaaatata

SEQ ID NO: 227272 - DNA, 15 bp, Homo sapiens
agaaataacaaatat

SEQ ID NO: 227273 - DNA, 15 bp, Homo sapiens
tagaaataacaaata

SEQ ID NO: 227274 - DNA, 15 bp, Homo sapiens
atagaaataacaaat

SEQ ID NO: 227275 - DNA, 15 bp, Homo sapiens
gatagaaataacaaa

SEQ ID NO: 227276 - DNA, 15 bp, Homo sapiens
agatagaaataacaa

SEQ ID NO: 227277 - DNA, 15 bp, Homo sapiens
aagatagaaataaca

SEQ ID NO: 227278 - DNA, 15 bp, Homo sapiens
aaagatagaaataac

SEQ ID NO: 227279 - DNA, 15 bp, Homo sapiens
caaagatagaaataa

SEQ ID NO: 227280 - DNA, 15 bp, Homo sapiens
tcaaagatagaaata

SEQ ID NO: 227281 - DNA, 15 bp, Homo sapiens
ttcaaagatagaaat

SEQ ID NO: 227282 - DNA, 15 bp, Homo sapiens
cttcaaagatagaaa

SEQ ID NO: 227283 - DNA, 15 bp, Homo sapiens
tcttcaaagatagaa

SEQ ID NO: 227284 - DNA, 15 bp, Homo sapiens
ttcttcaaagataga

SEQ ID NO: 227285 - DNA, 15 bp, Homo sapiens
attcttcaaagatag

SEQ ID NO: 227286 - DNA, 15 bp, Homo sapiens
aattcttcaaagata

SEQ ID NO: 227287 - DNA, 15 bp, Homo sapiens
taattcttcaaagat

SEQ ID NO: 227288 - DNA, 15 bp, Homo sapiens
ataattcttcaaaga

SEQ ID NO: 227289 - DNA, 15 bp, Homo sapiens
aataattcttcaaag

SEQ ID NO: 227290 - DNA, 15 bp, Homo sapiens
gaataattcttcaaa

SEQ ID NO: 227291 - DNA, 15 bp, Homo sapiens
ggaataattcttcaa

SEQ ID NO: 227292 - DNA, 15 bp, Homo sapiens
aggaataattcttca

SEQ ID NO: 227293 - DNA, 15 bp, Homo sapiens
aaggaataattcttc

SEQ ID NO: 227294 - DNA, 15 bp, Homo sapiens
aaaggaataattctt

SEQ ID NO: 227295 - DNA, 15 bp, Homo sapiens
aaaaggaataattct

SEQ ID NO: 227296 - DNA, 15 bp, Homo sapiens
caaaaggaataattc

SEQ ID NO: 227297 - DNA, 15 bp, Homo sapiens
tcaaaaggaataatt

SEQ ID NO: 227298 - DNA, 15 bp, Homo sapiens
ctcaaaaggaataat

SEQ ID NO: 227299 - DNA, 15 bp, Homo sapiens
actcaaaaggaataa

SEQ ID NO: 227300 - DNA, 15 bp, Homo sapiens
tactcaaaaggaata

SEQ ID NO: 227301 - DNA, 15 bp, Homo sapiens
gtactcaaaaggaat

SEQ ID NO: 227302 - DNA, 15 bp, Homo sapiens
agtactcaaaaggaa

SEQ ID NO: 227303 - DNA, 15 bp, Homo sapiens
gagtactcaaaagga

SEQ ID NO: 227304 - DNA, 15 bp, Homo sapiens
agagtactcaaaagg

SEQ ID NO: 227305 - DNA, 15 bp, Homo sapiens
cagagtactcaaaag

SEQ ID NO: 227306 - DNA, 15 bp, Homo sapiens
acagagtactcaaaa

SEQ ID NO: 227307 - DNA, 15 bp, Homo sapiens
aacagagtactcaaa

SEQ ID NO: 227308 - DNA, 15 bp, Homo sapiens
aaacagagtactcaa

SEQ ID NO: 227309 - DNA, 15 bp, Homo sapiens
aaaacagagtactca

SEQ ID NO: 227310 - DNA, 15 bp, Homo sapiens
taaaacagagtactc

SEQ ID NO: 227311 - DNA, 15 bp, Homo sapiens
ataaaacagagtact

SEQ ID NO: 227312 - DNA, 15 bp, Homo sapiens
tataaaacagagtac

SEQ ID NO: 227313 - DNA, 15 bp, Homo sapiens
atataaaacagagta

SEQ ID NO: 227314 - DNA, 15 bp, Homo sapiens
tatataaaacagagt

SEQ ID NO: 227315 - DNA, 15 bp, Homo sapiens
atatataaaacagag

SEQ ID NO: 227316 - DNA, 15 bp, Homo sapiens
tatatataaaacaga

SEQ ID NO: 227317 - DNA, 15 bp, Homo sapiens
atatatataaaacag

SEQ ID NO: 227318 - DNA, 15 bp, Homo sapiens
tatatatataaaaca

SEQ ID NO: 227319 - DNA, 15 bp, Homo sapiens
atatatatataaaac

SEQ ID NO: 227320 - DNA, 15 bp, Homo sapiens
atatgtatatatata

SEQ ID NO: 227321 - DNA, 15 bp, Homo sapiens
tatatgtatatatat

SEQ ID NO: 227322 - DNA, 15 bp, Homo sapiens
tatatatatgtatat

SEQ ID NO: 227323 - DNA, 15 bp, Homo sapiens
atatatatatgtata

SEQ ID NO: 227324 - DNA, 15 bp, Homo sapiens
tatatatatatgtat

SEQ ID NO: 227325 - DNA, 15 bp, Homo sapiens
atatatatatatgta

SEQ ID NO: 227326 - DNA, 15 bp, Homo sapiens
tatatatatatatgt

SEQ ID NO: 227327 - DNA, 15 bp, Homo sapiens
atatatatatatatg

SEQ ID NO: 227328 - DNA, 15 bp, Homo sapiens
atgtgtgtatatata

SEQ ID NO: 227329 - DNA, 15 bp, Homo sapiens
tatgtgtgtatatat

SEQ ID NO: 227330 - DNA, 15 bp, Homo sapiens
atatgtgtgtatata

SEQ ID NO: 227331 - DNA, 15 bp, Homo sapiens
tatatgtgtgtatat

SEQ ID NO: 227332 - DNA, 15 bp, Homo sapiens
tatatatgtgtgtat

SEQ ID NO: 227333 - DNA, 15 bp, Homo sapiens
atatatatgtgtgta

SEQ ID NO: 227334 - DNA, 15 bp, Homo sapiens
tatatatatgtgtgt

SEQ ID NO: 227335 - DNA, 15 bp, Homo sapiens
atatatatatgtgtg

SEQ ID NO: 227336 - DNA, 15 bp, Homo sapiens
tatatatatatgtgt

SEQ ID NO: 227337 - DNA, 15 bp, Homo sapiens
atatatatatatgtg

SEQ ID NO: 227338 - DNA, 15 bp, Homo sapiens
gtatatatatatatg

SEQ ID NO: 227339 - DNA, 15 bp, Homo sapiens
atatgtgtatatata

SEQ ID NO: 227340 - DNA, 15 bp, Homo sapiens
tatatgtgtatatat

SEQ ID NO: 227341 - DNA, 15 bp, Homo sapiens
atatatgtgtatata

SEQ ID NO: 227342 - DNA, 15 bp, Homo sapiens
tatatatgtgtatat

SEQ ID NO: 227343 - DNA, 15 bp, Homo sapiens
atatatatgtgtata

SEQ ID NO: 227344 - DNA, 15 bp, Homo sapiens
tatatatatgtgtat

SEQ ID NO: 227345 - DNA, 15 bp, Homo sapiens
atatatatatgtgta

SEQ ID NO: 227346 - DNA, 15 bp, Homo sapiens
ttatatatatatatg

SEQ ID NO: 227347 - DNA, 15 bp, Homo sapiens
ttttttatatatata

SEQ ID NO: 227348 - DNA, 15 bp, Homo sapiens
attttttatatatat

SEQ ID NO: 227349 - DNA, 15 bp, Homo sapiens
cattttttatatata

SEQ ID NO: 227350 - DNA, 15 bp, Homo sapiens
acattttttatatat

SEQ ID NO: 227351 - DNA, 15 bp, Homo sapiens
tacattttttatata

SEQ ID NO: 227352 - DNA, 15 bp, Homo sapiens
atacattttttatat

SEQ ID NO: 227353 - DNA, 15 bp, Homo sapiens
tatacattttttata

SEQ ID NO: 227354 - DNA, 15 bp, Homo sapiens
gtatacattttttat

SEQ ID NO: 227355 - DNA, 15 bp, Homo sapiens
tgtatacatttttta

SEQ ID NO: 227356 - DNA, 15 bp, Homo sapiens
gtgtatacatttttt

SEQ ID NO: 227357 - DNA, 15 bp, Homo sapiens
tgtgtatacattttt

SEQ ID NO: 227358 - DNA, 15 bp, Homo sapiens
gtgtgtatacatttt

SEQ ID NO: 227359 - DNA, 15 bp, Homo sapiens
tgtgtgtatacattt

SEQ ID NO: 227360 - DNA, 15 bp, Homo sapiens
gtgtgtgtatacatt

SEQ ID NO: 227361 - DNA, 15 bp, Homo sapiens
tgtgtgtgtatacat

SEQ ID NO: 227362 - DNA, 15 bp, Homo sapiens
cgtgtgtgtgtatac

SEQ ID NO: 227363 - DNA, 15 bp, Homo sapiens
acgtgtgtgtgtata

SEQ ID NO: 227364 - DNA, 15 bp, Homo sapiens
tacgtgtgtgtgtat

SEQ ID NO: 227365 - DNA, 15 bp, Homo sapiens
gtacgtgtgtgtgta

SEQ ID NO: 227366 - DNA, 15 bp, Homo sapiens
tgtacgtgtgtgtgt

SEQ ID NO: 227367 - DNA, 15 bp, Homo sapiens
atgtacgtgtgtgtg

SEQ ID NO: 227368 - DNA, 15 bp, Homo sapiens
tatgtacgtgtgtgt

SEQ ID NO: 227369 - DNA, 15 bp, Homo sapiens
gtatgtacgtgtgtg

SEQ ID NO: 227370 - DNA, 15 bp, Homo sapiens
agtatgtacgtgtgt

SEQ ID NO: 227371 - DNA, 15 bp, Homo sapiens
gagtatgtacgtgtg

SEQ ID NO: 227372 - DNA, 15 bp, Homo sapiens
tgagtatgtacgtgt

SEQ ID NO: 227373 - DNA, 15 bp, Homo sapiens
atgagtatgtacgtg

SEQ ID NO: 227374 - DNA, 15 bp, Homo sapiens
catgagtatgtacgt

SEQ ID NO: 227375 - DNA, 15 bp, Homo sapiens
acatgagtatgtacg

SEQ ID NO: 227376 - DNA, 15 bp, Homo sapiens
cacatgagtatgtac

SEQ ID NO: 227377 - DNA, 15 bp, Homo sapiens
gcacatgagtatgta

SEQ ID NO: 227378 - DNA, 15 bp, Homo sapiens
tgcacatgagtatgt

SEQ ID NO: 227379 - DNA, 15 bp, Homo sapiens
gtgcacatgagtatg

SEQ ID NO: 227380 - DNA, 15 bp, Homo sapiens
tgtgcacatgagtat

SEQ ID NO: 227381 - DNA, 15 bp, Homo sapiens
gtgtgcacatgagta

SEQ ID NO: 227382 - DNA, 15 bp, Homo sapiens
tgtgtgcacatgagt

SEQ ID NO: 227383 - DNA, 15 bp, Homo sapiens
gtgtgtgcacatgag

SEQ ID NO: 227384 - DNA, 15 bp, Homo sapiens
tgtgtgtgcacatga

SEQ ID NO: 227385 - DNA, 15 bp, Homo sapiens
atgtgtgtgcacatg

SEQ ID NO: 227386 - DNA, 15 bp, Homo sapiens
tatgtgtgtgcacat

SEQ ID NO: 227387 - DNA, 15 bp, Homo sapiens
gtatgtgtgtgcaca

SEQ ID NO: 227388 - DNA, 15 bp, Homo sapiens
agtatgtgtgtgcac

SEQ ID NO: 227389 - DNA, 15 bp, Homo sapiens
cagtatgtgtgtgca

SEQ ID NO: 227390 - DNA, 15 bp, Homo sapiens
gcagtatgtgtgtgc

SEQ ID NO: 227391 - DNA, 15 bp, Homo sapiens
ggcagtatgtgtgtg

SEQ ID NO: 227392 - DNA, 15 bp, Homo sapiens
tggcagtatgtgtgt

SEQ ID NO: 227393 - DNA, 15 bp, Homo sapiens
atggcagtatgtgtg

SEQ ID NO: 227394 - DNA, 15 bp, Homo sapiens
aatggcagtatgtgt

SEQ ID NO: 227395 - DNA, 15 bp, Homo sapiens
taatggcagtatgtg

SEQ ID NO: 227396 - DNA, 15 bp, Homo sapiens
ttaatggcagtatgt

SEQ ID NO: 227397 - DNA, 15 bp, Homo sapiens
attaatggcagtatg

SEQ ID NO: 227398 - DNA, 15 bp, Homo sapiens
aattaatggcagtat

SEQ ID NO: 227399 - DNA, 15 bp, Homo sapiens
gaattaatggcagta

SEQ ID NO: 227400 - DNA, 15 bp, Homo sapiens
ggaattaatggcagt

SEQ ID NO: 227401 - DNA, 15 bp, Homo sapiens
tggaattaatggcag

SEQ ID NO: 227402 - DNA, 15 bp, Homo sapiens
gtggaattaatggca

SEQ ID NO: 227403 - DNA, 15 bp, Homo sapiens
tgtggaattaatggc

SEQ ID NO: 227404 - DNA, 15 bp, Homo sapiens
atgtggaattaatgg

SEQ ID NO: 227405 - DNA, 15 bp, Homo sapiens
aatgtggaattaatg

SEQ ID NO: 227406 - DNA, 15 bp, Homo sapiens
gaatgtggaattaat

SEQ ID NO: 227407 - DNA, 15 bp, Homo sapiens
agaatgtggaattaa

SEQ ID NO: 227408 - DNA, 15 bp, Homo sapiens
gagaatgtggaatta

SEQ ID NO: 227409 - DNA, 15 bp, Homo sapiens
tgagaatgtggaatt

SEQ ID NO: 227410 - DNA, 15 bp, Homo sapiens
ctgagaatgtggaat

SEQ ID NO: 227411 - DNA, 15 bp, Homo sapiens
gctgagaatgtggaa

SEQ ID NO: 227412 - DNA, 15 bp, Homo sapiens
ggctgagaatgtgga

SEQ ID NO: 227413 - DNA, 15 bp, Homo sapiens
aggctgagaatgtgg

SEQ ID NO: 227414 - DNA, 15 bp, Homo sapiens
aaggctgagaatgtg

SEQ ID NO: 227415 - DNA, 15 bp, Homo sapiens
aaaggctgagaatgt

SEQ ID NO: 227416 - DNA, 15 bp, Homo sapiens
aaaaggctgagaatg

SEQ ID NO: 227417 - DNA, 15 bp, Homo sapiens
caaaaggctgagaat

SEQ ID NO: 227418 - DNA, 15 bp, Homo sapiens
acaaaaggctgagaa

SEQ ID NO: 227419 - DNA, 15 bp, Homo sapiens
cacaaaaggctgaga

SEQ ID NO: 227420 - DNA, 15 bp, Homo sapiens
acacaaaaggctgag

SEQ ID NO: 227421 - DNA, 15 bp, Homo sapiens
cacacaaaaggctga

SEQ ID NO: 227422 - DNA, 15 bp, Homo sapiens
acacacaaaaggctg

SEQ ID NO: 227423 - DNA, 15 bp, Homo sapiens
tacacacaaaaggct

SEQ ID NO: 227424 - DNA, 15 bp, Homo sapiens
ctacacacaaaaggc

SEQ ID NO: 227425 - DNA, 15 bp, Homo sapiens
tctacacacaaaagg

SEQ ID NO: 227426 - DNA, 15 bp, Homo sapiens
gtctacacacaaaag

SEQ ID NO: 227427 - DNA, 15 bp, Homo sapiens
agtctacacacaaaa

SEQ ID NO: 227428 - DNA, 15 bp, Homo sapiens
aagtctacacacaaa

SEQ ID NO: 227429 - DNA, 15 bp, Homo sapiens
taagtctacacacaa

SEQ ID NO: 227430 - DNA, 15 bp, Homo sapiens
ctaagtctacacaca

SEQ ID NO: 227431 - DNA, 15 bp, Homo sapiens
tctaagtctacacac

SEQ ID NO: 227432 - DNA, 15 bp, Homo sapiens
ttctaagtctacaca

SEQ ID NO: 227433 - DNA, 15 bp, Homo sapiens
attctaagtctacac

SEQ ID NO: 227434 - DNA, 15 bp, Homo sapiens
tattctaagtctaca

SEQ ID NO: 227435 - DNA, 15 bp, Homo sapiens
ctattctaagtctac

SEQ ID NO: 227436 - DNA, 15 bp, Homo sapiens
actattctaagtcta

SEQ ID NO: 227437 - DNA, 15 bp, Homo sapiens
aactattctaagtct

SEQ ID NO: 227438 - DNA, 15 bp, Homo sapiens
aaactattctaagtc

SEQ ID NO: 227439 - DNA, 15 bp, Homo sapiens
aaaactattctaagt

SEQ ID NO: 227440 - DNA, 15 bp, Homo sapiens
taaaactattctaag

SEQ ID NO: 227441 - DNA, 15 bp, Homo sapiens
ctaaaactattctaa

SEQ ID NO: 227442 - DNA, 15 bp, Homo sapiens
cctaaaactattcta

SEQ ID NO: 227443 - DNA, 15 bp, Homo sapiens
gcctaaaactattct

SEQ ID NO: 227444 - DNA, 15 bp, Homo sapiens
tgcctaaaactattc

SEQ ID NO: 227445 - DNA, 15 bp, Homo sapiens
ctgcctaaaactatt

SEQ ID NO: 227446 - DNA, 15 bp, Homo sapiens
tctgcctaaaactat

SEQ ID NO: 227447 - DNA, 15 bp, Homo sapiens
ttctgcctaaaacta

SEQ ID NO: 227448 - DNA, 15 bp, Homo sapiens
attctgcctaaaact

SEQ ID NO: 227449 - DNA, 15 bp, Homo sapiens
gattctgcctaaaac

SEQ ID NO: 227450 - DNA, 15 bp, Homo sapiens
agattctgcctaaaa

SEQ ID NO: 227451 - DNA, 15 bp, Homo sapiens
cagattctgcctaaa

SEQ ID NO: 227452 - DNA, 15 bp, Homo sapiens
acagattctgcctaa

SEQ ID NO: 227453 - DNA, 15 bp, Homo sapiens
aacagattctgccta

SEQ ID NO: 227454 - DNA, 15 bp, Homo sapiens
caacagattctgcct

SEQ ID NO: 227455 - DNA, 15 bp, Homo sapiens
gcaacagattctgcc

SEQ ID NO: 227456 - DNA, 15 bp, Homo sapiens
agcaacagattctgc

SEQ ID NO: 227457 - DNA, 15 bp, Homo sapiens
tagcaacagattctg

SEQ ID NO: 227458 - DNA, 15 bp, Homo sapiens
gtagcaacagattct

SEQ ID NO: 227459 - DNA, 15 bp, Homo sapiens
agtagcaacagattc

SEQ ID NO: 227460 - DNA, 15 bp, Homo sapiens
aagtagcaacagatt

SEQ ID NO: 227461 - DNA, 15 bp, Homo sapiens
aaagtagcaacagat

SEQ ID NO: 227462 - DNA, 15 bp, Homo sapiens
aaaagtagcaacaga

SEQ ID NO: 227463 - DNA, 15 bp, Homo sapiens
caaaagtagcaacag

SEQ ID NO: 227464 - DNA, 15 bp, Homo sapiens
ccaaaagtagcaaca

SEQ ID NO: 227465 - DNA, 15 bp, Homo sapiens
accaaaagtagcaac

SEQ ID NO: 227466 - DNA, 15 bp, Homo sapiens
taccaaaagtagcaa

SEQ ID NO: 227467 - DNA, 15 bp, Homo sapiens
ctaccaaaagtagca

SEQ ID NO: 227468 - DNA, 15 bp, Homo sapiens
gctaccaaaagtagc

SEQ ID NO: 227469 - DNA, 15 bp, Homo sapiens
tgctaccaaaagtag

SEQ ID NO: 227470 - DNA, 15 bp, Homo sapiens
atgctaccaaaagta

SEQ ID NO: 227471 - DNA, 15 bp, Homo sapiens
aatgctaccaaaagt

SEQ ID NO: 227472 - DNA, 15 bp, Homo sapiens
caatgctaccaaaag

SEQ ID NO: 227473 - DNA, 15 bp, Homo sapiens
ccaatgctaccaaaa

SEQ ID NO: 227474 - DNA, 15 bp, Homo sapiens
accaatgctaccaaa

SEQ ID NO: 227475 - DNA, 15 bp, Homo sapiens
gaccaatgctaccaa

SEQ ID NO: 227476 - DNA, 15 bp, Homo sapiens
ggaccaatgctacca

SEQ ID NO: 227477 - DNA, 15 bp, Homo sapiens
gggaccaatgctacc

SEQ ID NO: 227478 - DNA, 15 bp, Homo sapiens
tgggaccaatgctac

SEQ ID NO: 227479 - DNA, 15 bp, Homo sapiens
atgggaccaatgcta

SEQ ID NO: 227480 - DNA, 15 bp, Homo sapiens
aatgggaccaatgct

SEQ ID NO: 227481 - DNA, 15 bp, Homo sapiens
caatgggaccaatgc

SEQ ID NO: 227482 - DNA, 15 bp, Homo sapiens
gcaatgggaccaatg

SEQ ID NO: 227483 - DNA, 15 bp, Homo sapiens
tgcaatgggaccaat

SEQ ID NO: 227484 - DNA, 15 bp, Homo sapiens
atgcaatgggaccaa

SEQ ID NO: 227485 - DNA, 15 bp, Homo sapiens
aatgcaatgggacca

SEQ ID NO: 227486 - DNA, 15 bp, Homo sapiens
caatgcaatgggacc

SEQ ID NO: 227487 - DNA, 15 bp, Homo sapiens
acaatgcaatgggac

SEQ ID NO: 227488 - DNA, 15 bp, Homo sapiens
aacaatgcaatggga

SEQ ID NO: 227489 - DNA, 15 bp, Homo sapiens
gaacaatgcaatggg

SEQ ID NO: 227490 - DNA, 15 bp, Homo sapiens
agaacaatgcaatgg

SEQ ID NO: 227491 - DNA, 15 bp, Homo sapiens
cagaacaatgcaatg

SEQ ID NO: 227492 - DNA, 15 bp, Homo sapiens
acagaacaatgcaat

SEQ ID NO: 227493 - DNA, 15 bp, Homo sapiens
gacagaacaatgcaa

SEQ ID NO: 227494 - DNA, 15 bp, Homo sapiens
tgacagaacaatgca

SEQ ID NO: 227495 - DNA, 15 bp, Homo sapiens
atgacagaacaatgc

SEQ ID NO: 227496 - DNA, 15 bp, Homo sapiens
gatgacagaacaatg

SEQ ID NO: 227497 - DNA, 15 bp, Homo sapiens
agatgacagaacaat

SEQ ID NO: 227498 - DNA, 15 bp, Homo sapiens
cagatgacagaacaa

SEQ ID NO: 227499 - DNA, 15 bp, Homo sapiens
acagatgacagaaca

SEQ ID NO: 227500 - DNA, 15 bp, Homo sapiens
gatgattcctgagga

SEQ ID NO: 227501 - DNA, 15 bp, Homo sapiens
agatgattcctgagg

SEQ ID NO: 227502 - DNA, 15 bp, Homo sapiens
aagatgattcctgag

SEQ ID NO: 227503 - DNA, 15 bp, Homo sapiens
aaagatgattcctga

SEQ ID NO: 227504 - DNA, 15 bp, Homo sapiens
taaagatgattcctg

SEQ ID NO: 227505 - DNA, 15 bp, Homo sapiens
ttaaagatgattcct

SEQ ID NO: 227506 - DNA, 15 bp, Homo sapiens
tttaaagatgattcc

SEQ ID NO: 227507 - DNA, 15 bp, Homo sapiens
ttttaaagatgattc

SEQ ID NO: 227508 - DNA, 15 bp, Homo sapiens
tttttaaagatgatt

SEQ ID NO: 227509 - DNA, 15 bp, Homo sapiens
atttttaaagatgat

SEQ ID NO: 227510 - DNA, 15 bp, Homo sapiens
aatttttaaagatga

SEQ ID NO: 227511 - DNA, 15 bp, Homo sapiens
taatttttaaagatg

SEQ ID NO: 227512 - DNA, 15 bp, Homo sapiens
ataatttttaaagat

SEQ ID NO: 227513 - DNA, 15 bp, Homo sapiens
aataatttttaaaga

SEQ ID NO: 227514 - DNA, 15 bp, Homo sapiens
gaataatttttaaag

SEQ ID NO: 227515 - DNA, 15 bp, Homo sapiens
ggaataatttttaaa

SEQ ID NO: 227516 - DNA, 15 bp, Homo sapiens
tggaataatttttaa

SEQ ID NO: 227517 - DNA, 15 bp, Homo sapiens
ctggaataattttta

SEQ ID NO: 227518 - DNA, 15 bp, Homo sapiens
actggaataattttt

SEQ ID NO: 227519 - DNA, 15 bp, Homo sapiens
aactggaataatttt

SEQ ID NO: 227520 - DNA, 15 bp, Homo sapiens
taactggaataattt

SEQ ID NO: 227521 - DNA, 15 bp, Homo sapiens
ttaactggaataatt

SEQ ID NO: 227522 - DNA, 15 bp, Homo sapiens
tttaactggaataat

SEQ ID NO: 227523 - DNA, 15 bp, Homo sapiens
ctttaactggaataa

SEQ ID NO: 227524 - DNA, 15 bp, Homo sapiens
tctttaactggaata

SEQ ID NO: 227525 - DNA, 15 bp, Homo sapiens
ttctttaactggaat

SEQ ID NO: 227526 - DNA, 15 bp, Homo sapiens
attctttaactggaa

SEQ ID NO: 227527 - DNA, 15 bp, Homo sapiens
aattctttaactgga

SEQ ID NO: 227528 - DNA, 15 bp, Homo sapiens
taattctttaactgg

SEQ ID NO: 227529 - DNA, 15 bp, Homo sapiens
gtaattctttaactg

SEQ ID NO: 227530 - DNA, 15 bp, Homo sapiens
agtaattctttaact

SEQ ID NO: 227531 - DNA, 15 bp, Homo sapiens
cagtaattctttaac

SEQ ID NO: 227532 - DNA, 15 bp, Homo sapiens
acagtaattctttaa

SEQ ID NO: 227533 - DNA, 15 bp, Homo sapiens
aacagtaattcttta

SEQ ID NO: 227534 - DNA, 15 bp, Homo sapiens
taacagtaattcttt

SEQ ID NO: 227535 - DNA, 15 bp, Homo sapiens
gtaacagtaattctt

SEQ ID NO: 227536 - DNA, 15 bp, Homo sapiens
agtaacagtaattct

SEQ ID NO: 227537 - DNA, 15 bp, Homo sapiens
tagtaacagtaattc

SEQ ID NO: 227538 - DNA, 15 bp, Homo sapiens
gtagtaacagtaatt

SEQ ID NO: 227539 - DNA, 15 bp, Homo sapiens
tgtagtaacagtaat

SEQ ID NO: 227540 - DNA, 15 bp, Homo sapiens
ttgtagtaacagtaa

SEQ ID NO: 227541 - DNA, 15 bp, Homo sapiens
gttgtagtaacagta

SEQ ID NO: 227542 - DNA, 15 bp, Homo sapiens
agttgtagtaacagt

SEQ ID NO: 227543 - DNA, 15 bp, Homo sapiens
tagttgtagtaacag

SEQ ID NO: 227544 - DNA, 15 bp, Homo sapiens
gtagttgtagtaaca

SEQ ID NO: 227545 - DNA, 15 bp, Homo sapiens
agtagttgtagtaac

SEQ ID NO: 227546 - DNA, 15 bp, Homo sapiens
tagtagttgtagtaa

SEQ ID NO: 227547 - DNA, 15 bp, Homo sapiens
atagtagttgtagta

SEQ ID NO: 227548 - DNA, 15 bp, Homo sapiens
aatagtagttgtagt

SEQ ID NO: 227549 - DNA, 15 bp, Homo sapiens
aaatagtagttgtag

SEQ ID NO: 227550 - DNA, 15 bp, Homo sapiens
aaaatagtagttgta

SEQ ID NO: 227551 - DNA, 15 bp, Homo sapiens
taaaatagtagttgt

SEQ ID NO: 227552 - DNA, 15 bp, Homo sapiens
ataaaatagtagttg

SEQ ID NO: 227553 - DNA, 15 bp, Homo sapiens
aataaaatagtagtt

SEQ ID NO: 227554 - DNA, 15 bp, Homo sapiens
aaataaaatagtagt

SEQ ID NO: 227555 - DNA, 15 bp, Homo sapiens
taaataaaatagtag

SEQ ID NO: 227556 - DNA, 15 bp, Homo sapiens
ttaaataaaatagta

SEQ ID NO: 227557 - DNA, 15 bp, Homo sapiens
cttaaataaaatagt

SEQ ID NO: 227558 - DNA, 15 bp, Homo sapiens
gcttaaataaaatag

SEQ ID NO: 227559 - DNA, 15 bp, Homo sapiens
agcttaaataaaata

SEQ ID NO: 227560 - DNA, 15 bp, Homo sapiens
cagcttaaataaaat

SEQ ID NO: 227561 - DNA, 15 bp, Homo sapiens
gcagcttaaataaaa

SEQ ID NO: 227562 - DNA, 15 bp, Homo sapiens
ggcagcttaaataaa

SEQ ID NO: 227563 - DNA, 15 bp, Homo sapiens
aggcagcttaaataa

SEQ ID NO: 227564 - DNA, 15 bp, Homo sapiens
caggcagcttaaata

SEQ ID NO: 227565 - DNA, 15 bp, Homo sapiens
tcaggcagcttaaat

SEQ ID NO: 227566 - DNA, 15 bp, Homo sapiens
ttcaggcagcttaaa

SEQ ID NO: 227567 - DNA, 15 bp, Homo sapiens
attcaggcagcttaa

SEQ ID NO: 227568 - DNA, 15 bp, Homo sapiens
tattcaggcagctta

SEQ ID NO: 227569 - DNA, 15 bp, Homo sapiens
atattcaggcagctt

SEQ ID NO: 227570 - DNA, 15 bp, Homo sapiens
gatattcaggcagct

SEQ ID NO: 227571 - DNA, 15 bp, Homo sapiens
tgatattcaggcagc

SEQ ID NO: 227572 - DNA, 15 bp, Homo sapiens
atgatattcaggcag

SEQ ID NO: 227573 - DNA, 15 bp, Homo sapiens
aatgatattcaggca

SEQ ID NO: 227574 - DNA, 15 bp, Homo sapiens
aaatgatattcaggc

SEQ ID NO: 227575 - DNA, 15 bp, Homo sapiens
gaaatgatattcagg

SEQ ID NO: 227576 - DNA, 15 bp, Homo sapiens
agaaatgatattcag

SEQ ID NO: 227577 - DNA, 15 bp, Homo sapiens
cagaaatgatattca

SEQ ID NO: 227578 - DNA, 15 bp, Homo sapiens
acagaaatgatattc

SEQ ID NO: 227579 - DNA, 15 bp, Homo sapiens
aacagaaatgatatt

SEQ ID NO: 227580 - DNA, 15 bp, Homo sapiens
aaacagaaatgatat

SEQ ID NO: 227581 - DNA, 15 bp, Homo sapiens
gaaacagaaatgata

SEQ ID NO: 227582 - DNA, 15 bp, Homo sapiens
tgaaacagaaatgat

SEQ ID NO: 227583 - DNA, 15 bp, Homo sapiens
ctgaaacagaaatga

SEQ ID NO: 227584 - DNA, 15 bp, Homo sapiens
gctgaaacagaaatg

SEQ ID NO: 227585 - DNA, 15 bp, Homo sapiens
ggctgaaacagaaat

SEQ ID NO: 227586 - DNA, 15 bp, Homo sapiens
aggctgaaacagaaa

SEQ ID NO: 227587 - DNA, 15 bp, Homo sapiens
caggctgaaacagaa

SEQ ID NO: 227588 - DNA, 15 bp, Homo sapiens
ccaggctgaaacaga

SEQ ID NO: 227589 - DNA, 15 bp, Homo sapiens
tccaggctgaaacag

SEQ ID NO: 227590 - DNA, 15 bp, Homo sapiens
ctccaggctgaaaca

SEQ ID NO: 227591 - DNA, 15 bp, Homo sapiens
gctccaggctgaaac

SEQ ID NO: 227592 - DNA, 15 bp, Homo sapiens
tgctccaggctgaaa

SEQ ID NO: 227593 - DNA, 15 bp, Homo sapiens
ctgctccaggctgaa

SEQ ID NO: 227594 - DNA, 15 bp, Homo sapiens
actgctccaggctga

SEQ ID NO: 227595 - DNA, 15 bp, Homo sapiens
gactgctccaggctg

SEQ ID NO: 227596 - DNA, 15 bp, Homo sapiens
tgactgctccaggct

SEQ ID NO: 227597 - DNA, 15 bp, Homo sapiens
ttgactgctccaggc

SEQ ID NO: 227598 - DNA, 15 bp, Homo sapiens
attgactgctccagg

SEQ ID NO: 227599 - DNA, 15 bp, Homo sapiens
aattgactgctccag

SEQ ID NO: 227600 - DNA, 15 bp, Homo sapiens
aaattgactgctcca

SEQ ID NO: 227601 - DNA, 15 bp, Homo sapiens
aaaattgactgctcc

SEQ ID NO: 227602 - DNA, 15 bp, Homo sapiens
caaaattgactgctc

SEQ ID NO: 227603 - DNA, 15 bp, Homo sapiens
gcaaaattgactgct

SEQ ID NO: 227604 - DNA, 15 bp, Homo sapiens
agcaaaattgactgc

SEQ ID NO: 227605 - DNA, 15 bp, Homo sapiens
aagcaaaattgactg

SEQ ID NO: 227606 - DNA, 15 bp, Homo sapiens
taagcaaaattgact

SEQ ID NO: 227607 - DNA, 15 bp, Homo sapiens
ttaagcaaaattgac

SEQ ID NO: 227608 - DNA, 15 bp, Homo sapiens
attaagcaaaattga

SEQ ID NO: 227609 - DNA, 15 bp, Homo sapiens
aattaagcaaaattg

SEQ ID NO: 227610 - DNA, 15 bp, Homo sapiens
aaattaagcaaaatt

SEQ ID NO: 227611 - DNA, 15 bp, Homo sapiens
taaattaagcaaaat

SEQ ID NO: 227612 - DNA, 15 bp, Homo sapiens
ttaaattaagcaaaa

SEQ ID NO: 227613 - DNA, 15 bp, Homo sapiens
tttaaattaagcaaa

SEQ ID NO: 227614 - DNA, 15 bp, Homo sapiens
atttaaattaagcaa

SEQ ID NO: 227615 - DNA, 15 bp, Homo sapiens
tatttaaattaagca

SEQ ID NO: 227616 - DNA, 15 bp, Homo sapiens
atatttaaattaagc

SEQ ID NO: 227617 - DNA, 15 bp, Homo sapiens
aatatttaaattaag

SEQ ID NO: 227618 - DNA, 15 bp, Homo sapiens
aaatatttaaattaa

SEQ ID NO: 227619 - DNA, 15 bp, Homo sapiens
aaaatatttaaatta

SEQ ID NO: 227620 - DNA, 15 bp, Homo sapiens
taaaatatttaaatt

SEQ ID NO: 227621 - DNA, 15 bp, Homo sapiens
ataaaatatttaaat

SEQ ID NO: 227622 - DNA, 15 bp, Homo sapiens
aataaaatatttaaa

SEQ ID NO: 227623 - DNA, 15 bp, Homo sapiens
taataaaatatttaa

SEQ ID NO: 227624 - DNA, 15 bp, Homo sapiens
ttaataaaatattta

SEQ ID NO: 227625 - DNA, 15 bp, Homo sapiens
attaataaaatattt

SEQ ID NO: 227626 - DNA, 15 bp, Homo sapiens
tattaataaaatatt

SEQ ID NO: 227627 - DNA, 15 bp, Homo sapiens
ttattaataaaatat

SEQ ID NO: 227628 - DNA, 15 bp, Homo sapiens
attattaataaaata

SEQ ID NO: 227629 - DNA, 15 bp, Homo sapiens
gattattaataaaat

SEQ ID NO: 227630 - DNA, 15 bp, Homo sapiens
tgattattaataaaa

SEQ ID NO: 227631 - DNA, 15 bp, Homo sapiens
atgattattaataaa

SEQ ID NO: 227632 - DNA, 15 bp, Homo sapiens
tatgattattaataa

SEQ ID NO: 227633 - DNA, 15 bp, Homo sapiens
ctatgattattaata

SEQ ID NO: 227634 - DNA, 15 bp, Homo sapiens
tctatgattattaat

SEQ ID NO: 227635 - DNA, 15 bp, Homo sapiens
ttctatgattattaa

SEQ ID NO: 227636 - DNA, 15 bp, Homo sapiens
tttctatgattatta

SEQ ID NO: 227637 - DNA, 15 bp, Homo sapiens
ttttctatgattatt

SEQ ID NO: 227638 - DNA, 15 bp, Homo sapiens
tttttctatgattat

SEQ ID NO: 227639 - DNA, 15 bp, Homo sapiens
gtttttctatgatta

SEQ ID NO: 227640 - DNA, 15 bp, Homo sapiens
ggtttttctatgatt

SEQ ID NO: 227641 - DNA, 15 bp, Homo sapiens
gggtttttctatgat

SEQ ID NO: 227642 - DNA, 15 bp, Homo sapiens
tgggtttttctatga

SEQ ID NO: 227643 - DNA, 15 bp, Homo sapiens
ctgggtttttctatg

SEQ ID NO: 227644 - DNA, 15 bp, Homo sapiens
gctgggtttttctat

SEQ ID NO: 227645 - DNA, 15 bp, Homo sapiens
agctgggtttttcta

SEQ ID NO: 227646 - DNA, 15 bp, Homo sapiens
tagctgggtttttct

SEQ ID NO: 227647 - DNA, 15 bp, Homo sapiens
atagctgggtttttc

SEQ ID NO: 227648 - DNA, 15 bp, Homo sapiens
aatagctgggttttt

SEQ ID NO: 227649 - DNA, 15 bp, Homo sapiens
taatagctgggtttt

SEQ ID NO: 227650 - DNA, 15 bp, Homo sapiens
gtaatagctgggttt

SEQ ID NO: 227651 - DNA, 15 bp, Homo sapiens
agtaatagctgggtt

SEQ ID NO: 227652 - DNA, 15 bp, Homo sapiens
aagtaatagctgggt

SEQ ID NO: 227653 - DNA, 15 bp, Homo sapiens
taagtaatagctggg

SEQ ID NO: 227654 - DNA, 15 bp, Homo sapiens
ttaagtaatagctgg

SEQ ID NO: 227655 - DNA, 15 bp, Homo sapiens
attaagtaatagctg

SEQ ID NO: 227656 - DNA, 15 bp, Homo sapiens
aattaagtaatagct

SEQ ID NO: 227657 - DNA, 15 bp, Homo sapiens
aaattaagtaatagc

SEQ ID NO: 227658 - DNA, 15 bp, Homo sapiens
taaattaagtaatag

SEQ ID NO: 227659 - DNA, 15 bp, Homo sapiens
ctaaattaagtaata

SEQ ID NO: 227660 - DNA, 15 bp, Homo sapiens
actaaattaagtaat

SEQ ID NO: 227661 - DNA, 15 bp, Homo sapiens
gactaaattaagtaa

SEQ ID NO: 227662 - DNA, 15 bp, Homo sapiens
agactaaattaagta

SEQ ID NO: 227663 - DNA, 15 bp, Homo sapiens
tagactaaattaagt

SEQ ID NO: 227664 - DNA, 15 bp, Homo sapiens
atagactaaattaag

SEQ ID NO: 227665 - DNA, 15 bp, Homo sapiens
aatagactaaattaa

SEQ ID NO: 227666 - DNA, 15 bp, Homo sapiens
aaatagactaaatta

SEQ ID NO: 227667 - DNA, 15 bp, Homo sapiens
caaatagactaaatt

SEQ ID NO: 227668 - DNA, 15 bp, Homo sapiens
acaaatagactaaat

SEQ ID NO: 227669 - DNA, 15 bp, Homo sapiens
cacaaatagactaaa

SEQ ID NO: 227670 - DNA, 15 bp, Homo sapiens
gcacaaatagactaa

SEQ ID NO: 227671 - DNA, 15 bp, Homo sapiens
tgcacaaatagacta

SEQ ID NO: 227672 - DNA, 15 bp, Homo sapiens
atgcacaaatagact

SEQ ID NO: 227673 - DNA, 15 bp, Homo sapiens
catgcacaaatagac

SEQ ID NO: 227674 - DNA, 15 bp, Homo sapiens
acatgcacaaataga

SEQ ID NO: 227675 - DNA, 15 bp, Homo sapiens
tacatgcacaaatag

SEQ ID NO: 227676 - DNA, 15 bp, Homo sapiens
atacatgcacaaata

SEQ ID NO: 227677 - DNA, 15 bp, Homo sapiens
tatacatgcacaaat

SEQ ID NO: 227678 - DNA, 15 bp, Homo sapiens
ctatacatgcacaaa

SEQ ID NO: 227679 - DNA, 15 bp, Homo sapiens
actatacatgcacaa

SEQ ID NO: 227680 - DNA, 15 bp, Homo sapiens
aactatacatgcaca

SEQ ID NO: 227681 - DNA, 15 bp, Homo sapiens
caactatacatgcac

SEQ ID NO: 227682 - DNA, 15 bp, Homo sapiens
tcaactatacatgca

SEQ ID NO: 227683 - DNA, 15 bp, Homo sapiens
ctcaactatacatgc

SEQ ID NO: 227684 - DNA, 15 bp, Homo sapiens
actcaactatacatg

SEQ ID NO: 227685 - DNA, 15 bp, Homo sapiens
tactcaactatacat

SEQ ID NO: 227686 - DNA, 15 bp, Homo sapiens
atactcaactataca

SEQ ID NO: 227687 - DNA, 15 bp, Homo sapiens
tatactcaactatac

SEQ ID NO: 227688 - DNA, 15 bp, Homo sapiens
ctatactcaactata

SEQ ID NO: 227689 - DNA, 15 bp, Homo sapiens
actatactcaactat

SEQ ID NO: 227690 - DNA, 15 bp, Homo sapiens
cactatactcaacta

SEQ ID NO: 227691 - DNA, 15 bp, Homo sapiens
ccactatactcaact

SEQ ID NO: 227692 - DNA, 15 bp, Homo sapiens
cccactatactcaac

SEQ ID NO: 227693 - DNA, 15 bp, Homo sapiens
acccactatactcaa

SEQ ID NO: 227694 - DNA, 15 bp, Homo sapiens
tacccactatactca

SEQ ID NO: 227695 - DNA, 15 bp, Homo sapiens
atacccactatactc

SEQ ID NO: 227696 - DNA, 15 bp, Homo sapiens
tatacccactatact

SEQ ID NO: 227697 - DNA, 15 bp, Homo sapiens
ctatacccactatac

SEQ ID NO: 227698 - DNA, 15 bp, Homo sapiens
actatacccactata

SEQ ID NO: 227699 - DNA, 15 bp, Homo sapiens
aactatacccactat

SEQ ID NO: 227700 - DNA, 15 bp, Homo sapiens
caactatacccacta

SEQ ID NO: 227701 - DNA, 15 bp, Homo sapiens
acaactatacccact

SEQ ID NO: 227702 - DNA, 15 bp, Homo sapiens
cacaactatacccac

SEQ ID NO: 227703 - DNA, 15 bp, Homo sapiens
acacaactataccca

SEQ ID NO: 227704 - DNA, 15 bp, Homo sapiens
tacacaactataccc

SEQ ID NO: 227705 - DNA, 15 bp, Homo sapiens
atacacaactatacc

SEQ ID NO: 227706 - DNA, 15 bp, Homo sapiens
catacacaactatac

SEQ ID NO: 227707 - DNA, 15 bp, Homo sapiens
acatacacaactata

SEQ ID NO: 227708 - DNA, 15 bp, Homo sapiens
cacatacacaactat

SEQ ID NO: 227709 - DNA, 15 bp, Homo sapiens
acacatacacaacta

SEQ ID NO: 227710 - DNA, 15 bp, Homo sapiens
cacacatacacaact

SEQ ID NO: 227711 - DNA, 15 bp, Homo sapiens
acacacatacacaac

SEQ ID NO: 227712 - DNA, 15 bp, Homo sapiens
tacacacatacacaa

SEQ ID NO: 227713 - DNA, 15 bp, Homo sapiens
atacacacatacaca

SEQ ID NO: 227714 - DNA, 15 bp, Homo sapiens
catacacacatacac

SEQ ID NO: 227715 - DNA, 15 bp, Homo sapiens
acatacacacataca

SEQ ID NO: 227716 - DNA, 15 bp, Homo sapiens
cacatacacacatac

SEQ ID NO: 227717 - DNA, 15 bp, Homo sapiens
gcacatacacacata

SEQ ID NO: 227718 - DNA, 15 bp, Homo sapiens
tgcacatacacacat

SEQ ID NO: 227719 - DNA, 15 bp, Homo sapiens
atgcacatacacaca

SEQ ID NO: 227720 - DNA, 15 bp, Homo sapiens
tatgcacatacacac

SEQ ID NO: 227721 - DNA, 15 bp, Homo sapiens
atatgcacatacaca

SEQ ID NO: 227722 - DNA, 15 bp, Homo sapiens
tatatgcacatacac

SEQ ID NO: 227723 - DNA, 15 bp, Homo sapiens
gtatatgcacataca

SEQ ID NO: 227724 - DNA, 15 bp, Homo sapiens
tgtatatgcacatac

SEQ ID NO: 227725 - DNA, 15 bp, Homo sapiens
ttgtatatgcacata

SEQ ID NO: 227726 - DNA, 15 bp, Homo sapiens
gttgtatatgcacat

SEQ ID NO: 227727 - DNA, 15 bp, Homo sapiens
agttgtatatgcaca

SEQ ID NO: 227728 - DNA, 15 bp, Homo sapiens
aagttgtatatgcac

SEQ ID NO: 227729 - DNA, 15 bp, Homo sapiens
aaagttgtatatgca

SEQ ID NO: 227730 - DNA, 15 bp, Homo sapiens
taaagttgtatatgc

SEQ ID NO: 227731 - DNA, 15 bp, Homo sapiens
ataaagttgtatatg

SEQ ID NO: 227732 - DNA, 15 bp, Homo sapiens
tataaagttgtatat

SEQ ID NO: 227733 - DNA, 15 bp, Homo sapiens
atataaagttgtata

SEQ ID NO: 227734 - DNA, 15 bp, Homo sapiens
tatataaagttgtat

SEQ ID NO: 227735 - DNA, 15 bp, Homo sapiens
ctatataaagttgta

SEQ ID NO: 227736 - DNA, 15 bp, Homo sapiens
actatataaagttgt

SEQ ID NO: 227737 - DNA, 15 bp, Homo sapiens
aactatataaagttg

SEQ ID NO: 227738 - DNA, 15 bp, Homo sapiens
caactatataaagtt

SEQ ID NO: 227739 - DNA, 15 bp, Homo sapiens
acaactatataaagt

SEQ ID NO: 227740 - DNA, 15 bp, Homo sapiens
cacaactatataaag

SEQ ID NO: 227741 - DNA, 15 bp, Homo sapiens
acacaactatataaa

SEQ ID NO: 227742 - DNA, 15 bp, Homo sapiens
tacacaactatataa

SEQ ID NO: 227743 - DNA, 15 bp, Homo sapiens
atacacaactatata

SEQ ID NO: 227744 - DNA, 15 bp, Homo sapiens
catacacaactatat

SEQ ID NO: 227745 - DNA, 15 bp, Homo sapiens
tcatacacaactata

SEQ ID NO: 227746 - DNA, 15 bp, Homo sapiens
ttcatacacaactat

SEQ ID NO: 227747 - DNA, 15 bp, Homo sapiens
attcatacacaacta

SEQ ID NO: 227748 - DNA, 15 bp, Homo sapiens
cattcatacacaact

SEQ ID NO: 227749 - DNA, 15 bp, Homo sapiens
acattcatacacaac

SEQ ID NO: 227750 - DNA, 15 bp, Homo sapiens
tacattcatacacaa

SEQ ID NO: 227751 - DNA, 15 bp, Homo sapiens
atacattcatacaca

SEQ ID NO: 227752 - DNA, 15 bp, Homo sapiens
tatacattcatacac

SEQ ID NO: 227753 - DNA, 15 bp, Homo sapiens
atatacattcataca

SEQ ID NO: 227754 - DNA, 15 bp, Homo sapiens
catatacattcatac

SEQ ID NO: 227755 - DNA, 15 bp, Homo sapiens
acatatacattcata

SEQ ID NO: 227756 - DNA, 15 bp, Homo sapiens
cacatatacattcat

SEQ ID NO: 227757 - DNA, 15 bp, Homo sapiens
tcacatatacattca

SEQ ID NO: 227758 - DNA, 15 bp, Homo sapiens
atcacatatacattc

SEQ ID NO: 227759 - DNA, 15 bp, Homo sapiens
catcacatatacatt

SEQ ID NO: 227760 - DNA, 15 bp, Homo sapiens
tcatcacatatacat

SEQ ID NO: 227761 - DNA, 15 bp, Homo sapiens
ttcatcacatataca

SEQ ID NO: 227762 - DNA, 15 bp, Homo sapiens
attcatcacatatac

SEQ ID NO: 227763 - DNA, 15 bp, Homo sapiens
tattcatcacatata

SEQ ID NO: 227764 - DNA, 15 bp, Homo sapiens
ctattcatcacatat

SEQ ID NO: 227765 - DNA, 15 bp, Homo sapiens
actattcatcacata

SEQ ID NO: 227766 - DNA, 15 bp, Homo sapiens
aactattcatcacat

SEQ ID NO: 227767 - DNA, 15 bp, Homo sapiens
taactattcatcaca

SEQ ID NO: 227768 - DNA, 15 bp, Homo sapiens
ttaactattcatcac

SEQ ID NO: 227769 - DNA, 15 bp, Homo sapiens
attaactattcatca

SEQ ID NO: 227770 - DNA, 15 bp, Homo sapiens
tattaactattcatc

SEQ ID NO: 227771 - DNA, 15 bp, Homo sapiens
ttattaactattcat

SEQ ID NO: 227772 - DNA, 15 bp, Homo sapiens
attattaactattca

SEQ ID NO: 227773 - DNA, 15 bp, Homo sapiens
tattattaactattc

SEQ ID NO: 227774 - DNA, 15 bp, Homo sapiens
ttattattaactatt

SEQ ID NO: 227775 - DNA, 15 bp, Homo sapiens
attattattaactat

SEQ ID NO: 227776 - DNA, 15 bp, Homo sapiens
aattattattaacta

SEQ ID NO: 227777 - DNA, 15 bp, Homo sapiens
aaattattattaact

SEQ ID NO: 227778 - DNA, 15 bp, Homo sapiens
aaaattattattaac

SEQ ID NO: 227779 - DNA, 15 bp, Homo sapiens
aaaaattattattaa

SEQ ID NO: 227780 - DNA, 15 bp, Homo sapiens
gaaaaattattatta

SEQ ID NO: 227781 - DNA, 15 bp, Homo sapiens
tgaaaaattattatt

SEQ ID NO: 227782 - DNA, 15 bp, Homo sapiens
ctgaaaaattattat

SEQ ID NO: 227783 - DNA, 15 bp, Homo sapiens
tctgaaaaattatta

SEQ ID NO: 227784 - DNA, 15 bp, Homo sapiens
atctgaaaaattatt

SEQ ID NO: 227785 - DNA, 15 bp, Homo sapiens
catctgaaaaattat

SEQ ID NO: 227786 - DNA, 15 bp, Homo sapiens
tcatctgaaaaatta

SEQ ID NO: 227787 - DNA, 15 bp, Homo sapiens
ctttttcatctgaaa

SEQ ID NO: 227788 - DNA, 15 bp, Homo sapiens
actttttcatctgaa

SEQ ID NO: 227789 - DNA, 15 bp, Homo sapiens
tactttttcatctga

SEQ ID NO: 227790 - DNA, 15 bp, Homo sapiens
atactttttcatctg

SEQ ID NO: 227791 - DNA, 15 bp, Homo sapiens
catactttttcatct

SEQ ID NO: 227792 - DNA, 15 bp, Homo sapiens
acatactttttcatc

SEQ ID NO: 227793 - DNA, 15 bp, Homo sapiens
tacatactttttcat

SEQ ID NO: 227794 - DNA, 15 bp, Homo sapiens
atacatactttttca

SEQ ID NO: 227795 - DNA, 15 bp, Homo sapiens
catacatactttttc

SEQ ID NO: 227796 - DNA, 15 bp, Homo sapiens
ccatacatacttttt

SEQ ID NO: 227797 - DNA, 15 bp, Homo sapiens
cccatacatactttt

SEQ ID NO: 227798 - DNA, 15 bp, Homo sapiens
acccatacatacttt

SEQ ID NO: 227799 - DNA, 15 bp, Homo sapiens
aacccatacatactt

SEQ ID NO: 227800 - DNA, 15 bp, Homo sapiens
taacccatacatact

SEQ ID NO: 227801 - DNA, 15 bp, Homo sapiens
ttaacccatacatac

SEQ ID NO: 227802 - DNA, 15 bp, Homo sapiens
attaacccatacata

SEQ ID NO: 227803 - DNA, 15 bp, Homo sapiens
cattaacccatacat

SEQ ID NO: 227804 - DNA, 15 bp, Homo sapiens
acattaacccataca

SEQ ID NO: 227805 - DNA, 15 bp, Homo sapiens
aacattaacccatac

SEQ ID NO: 227806 - DNA, 15 bp, Homo sapiens
aaacattaacccata

SEQ ID NO: 227807 - DNA, 15 bp, Homo sapiens
aaaacattaacccat

SEQ ID NO: 227808 - DNA, 15 bp, Homo sapiens
gaaaacattaaccca

SEQ ID NO: 227809 - DNA, 15 bp, Homo sapiens
ggaaaacattaaccc

SEQ ID NO: 227810 - DNA, 15 bp, Homo sapiens
aggaaaacattaacc

SEQ ID NO: 227811 - DNA, 15 bp, Homo sapiens
gaggaaaacattaac

SEQ ID NO: 227812 - DNA, 15 bp, Homo sapiens
agaggaaaacattaa

SEQ ID NO: 227813 - DNA, 15 bp, Homo sapiens
aagaggaaaacatta

SEQ ID NO: 227814 - DNA, 15 bp, Homo sapiens
aaagaggaaaacatt

SEQ ID NO: 227815 - DNA, 15 bp, Homo sapiens
caaagaggaaaacat

SEQ ID NO: 227816 - DNA, 15 bp, Homo sapiens
ccaaagaggaaaaca

SEQ ID NO: 227817 - DNA, 15 bp, Homo sapiens
accaaagaggaaaac

SEQ ID NO: 227818 - DNA, 15 bp, Homo sapiens
gaccaaagaggaaaa

SEQ ID NO: 227819 - DNA, 15 bp, Homo sapiens
ggaccaaagaggaaa

SEQ ID NO: 227820 - DNA, 15 bp, Homo sapiens
aggaccaaagaggaa

SEQ ID NO: 227821 - DNA, 15 bp, Homo sapiens
aaggaccaaagagga

SEQ ID NO: 227822 - DNA, 15 bp, Homo sapiens
aaaggaccaaagagg

SEQ ID NO: 227823 - DNA, 15 bp, Homo sapiens
caaaggaccaaagag

SEQ ID NO: 227824 - DNA, 15 bp, Homo sapiens
tcaaaggaccaaaga

SEQ ID NO: 227825 - DNA, 15 bp, Homo sapiens
gtcaaaggaccaaag

SEQ ID NO: 227826 - DNA, 15 bp, Homo sapiens
tgtcaaaggaccaaa

SEQ ID NO: 227827 - DNA, 15 bp, Homo sapiens
ctgtcaaaggaccaa

SEQ ID NO: 227828 - DNA, 15 bp, Homo sapiens
tctgtcaaaggacca

SEQ ID NO: 227829 - DNA, 15 bp, Homo sapiens
atctgtcaaaggacc

SEQ ID NO: 227830 - DNA, 15 bp, Homo sapiens
catctgtcaaaggac

SEQ ID NO: 227831 - DNA, 15 bp, Homo sapiens
ccatctgtcaaagga

SEQ ID NO: 227832 - DNA, 15 bp, Homo sapiens
gccatctgtcaaagg

SEQ ID NO: 227833 - DNA, 15 bp, Homo sapiens
agccatctgtcaaag

SEQ ID NO: 227834 - DNA, 15 bp, Homo sapiens
tagccatctgtcaaa

SEQ ID NO: 227835 - DNA, 15 bp, Homo sapiens
atagccatctgtcaa

SEQ ID NO: 227836 - DNA, 15 bp, Homo sapiens
catagccatctgtca

SEQ ID NO: 227837 - DNA, 15 bp, Homo sapiens
acatagccatctgtc

SEQ ID NO: 227838 - DNA, 15 bp, Homo sapiens
tacatagccatctgt

SEQ ID NO: 227839 - DNA, 15 bp, Homo sapiens
atacatagccatctg

SEQ ID NO: 227840 - DNA, 15 bp, Homo sapiens
tatacatagccatct

SEQ ID NO: 227841 - DNA, 15 bp, Homo sapiens
atatacatagccatc

SEQ ID NO: 227842 - DNA, 15 bp, Homo sapiens
aatatacatagccat

SEQ ID NO: 227843 - DNA, 15 bp, Homo sapiens
aaatatacatagcca

SEQ ID NO: 227844 - DNA, 15 bp, Homo sapiens
taaatatacatagcc

SEQ ID NO: 227845 - DNA, 15 bp, Homo sapiens
ctaaatatacatagc

SEQ ID NO: 227846 - DNA, 15 bp, Homo sapiens
actaaatatacatag

SEQ ID NO: 227847 - DNA, 15 bp, Homo sapiens
tactaaatatacata

SEQ ID NO: 227848 - DNA, 15 bp, Homo sapiens
gtactaaatatacat

SEQ ID NO: 227849 - DNA, 15 bp, Homo sapiens
tgtactaaatataca

SEQ ID NO: 227850 - DNA, 15 bp, Homo sapiens
atgtactaaatatac

SEQ ID NO: 227851 - DNA, 15 bp, Homo sapiens
tatgtactaaatata

SEQ ID NO: 227852 - DNA, 15 bp, Homo sapiens
ttatgtactaaatat

SEQ ID NO: 227853 - DNA, 15 bp, Homo sapiens
attatgtactaaata

SEQ ID NO: 227854 - DNA, 15 bp, Homo sapiens
tattatgtactaaat

SEQ ID NO: 227855 - DNA, 15 bp, Homo sapiens
atattatgtactaaa

SEQ ID NO: 227856 - DNA, 15 bp, Homo sapiens
catattatgtactaa

SEQ ID NO: 227857 - DNA, 15 bp, Homo sapiens
ccatattatgtacta

SEQ ID NO: 227858 - DNA, 15 bp, Homo sapiens
accatattatgtact

SEQ ID NO: 227859 - DNA, 15 bp, Homo sapiens
taccatattatgtac

SEQ ID NO: 227860 - DNA, 15 bp, Homo sapiens
ataccatattatgta

SEQ ID NO: 227861 - DNA, 15 bp, Homo sapiens
cataccatattatgt

SEQ ID NO: 227862 - DNA, 15 bp, Homo sapiens
acataccatattatg

SEQ ID NO: 227863 - DNA, 15 bp, Homo sapiens
tacataccatattat

SEQ ID NO: 227864 - DNA, 15 bp, Homo sapiens
ttacataccatatta

SEQ ID NO: 227865 - DNA, 15 bp, Homo sapiens
attacataccatatt

SEQ ID NO: 227866 - DNA, 15 bp, Homo sapiens
tattacataccatat

SEQ ID NO: 227867 - DNA, 15 bp, Homo sapiens
atattacataccata

SEQ ID NO: 227868 - DNA, 15 bp, Homo sapiens
aatattacataccat

SEQ ID NO: 227869 - DNA, 15 bp, Homo sapiens
aaatattacatacca

SEQ ID NO: 227870 - DNA, 15 bp, Homo sapiens
taaatattacatacc

SEQ ID NO: 227871 - DNA, 15 bp, Homo sapiens
ttaaatattacatac

SEQ ID NO: 227872 - DNA, 15 bp, Homo sapiens
gttaaatattacata

SEQ ID NO: 227873 - DNA, 15 bp, Homo sapiens
agttaaatattacat

SEQ ID NO: 227874 - DNA, 15 bp, Homo sapiens
gagttaaatattaca

SEQ ID NO: 227875 - DNA, 15 bp, Homo sapiens
tgagttaaatattac

SEQ ID NO: 227876 - DNA, 15 bp, Homo sapiens
ctgagttaaatatta

SEQ ID NO: 227877 - DNA, 15 bp, Homo sapiens
cctgagttaaatatt

SEQ ID NO: 227878 - DNA, 15 bp, Homo sapiens
ccctgagttaaatat

SEQ ID NO: 227879 - DNA, 15 bp, Homo sapiens
accctgagttaaata

SEQ ID NO: 227880 - DNA, 15 bp, Homo sapiens
taccctgagttaaat

SEQ ID NO: 227881 - DNA, 15 bp, Homo sapiens
ataccctgagttaaa

SEQ ID NO: 227882 - DNA, 15 bp, Homo sapiens
tataccctgagttaa

SEQ ID NO: 227883 - DNA, 15 bp, Homo sapiens
gtataccctgagtta

SEQ ID NO: 227884 - DNA, 15 bp, Homo sapiens
agtataccctgagtt

SEQ ID NO: 227885 - DNA, 15 bp, Homo sapiens
cagtataccctgagt

SEQ ID NO: 227886 - DNA, 15 bp, Homo sapiens
acagtataccctgag

SEQ ID NO: 227887 - DNA, 15 bp, Homo sapiens
aacagtataccctga

SEQ ID NO: 227888 - DNA, 15 bp, Homo sapiens
aaacagtataccctg

SEQ ID NO: 227889 - DNA, 15 bp, Homo sapiens
taaacagtataccct

SEQ ID NO: 227890 - DNA, 15 bp, Homo sapiens
ttaaacagtataccc

SEQ ID NO: 227891 - DNA, 15 bp, Homo sapiens
attaaacagtatacc

SEQ ID NO: 227892 - DNA, 15 bp, Homo sapiens
aattaaacagtatac

SEQ ID NO: 227893 - DNA, 15 bp, Homo sapiens
aaattaaacagtata

SEQ ID NO: 227894 - DNA, 15 bp, Homo sapiens
aaaattaaacagtat

SEQ ID NO: 227895 - DNA, 15 bp, Homo sapiens
aaaaattaaacagta

SEQ ID NO: 227896 - DNA, 15 bp, Homo sapiens
taaaaattaaacagt

SEQ ID NO: 227897 - DNA, 15 bp, Homo sapiens
ttaaaaattaaacag

SEQ ID NO: 227898 - DNA, 15 bp, Homo sapiens
tttaaaaattaaaca

SEQ ID NO: 227899 - DNA, 15 bp, Homo sapiens
atttaaaaattaaac

SEQ ID NO: 227900 - DNA, 15 bp, Homo sapiens
tatttaaaaattaaa

SEQ ID NO: 227901 - DNA, 15 bp, Homo sapiens
atatttaaaaattaa

SEQ ID NO: 227902 - DNA, 15 bp, Homo sapiens
aatatttaaaaatta

SEQ ID NO: 227903 - DNA, 15 bp, Homo sapiens
aaatatttaaaaatt

SEQ ID NO: 227904 - DNA, 15 bp, Homo sapiens
gaaatatttaaaaat

SEQ ID NO: 227905 - DNA, 15 bp, Homo sapiens
ggaaatatttaaaaa

SEQ ID NO: 227906 - DNA, 15 bp, Homo sapiens
aggaaatatttaaaa

SEQ ID NO: 227907 - DNA, 15 bp, Homo sapiens
caggaaatatttaaa

SEQ ID NO: 227908 - DNA, 15 bp, Homo sapiens
tcaggaaatatttaa

SEQ ID NO: 227909 - DNA, 15 bp, Homo sapiens
atcaggaaatattta

SEQ ID NO: 227910 - DNA, 15 bp, Homo sapiens
tatcaggaaatattt

SEQ ID NO: 227911 - DNA, 15 bp, Homo sapiens
atatcaggaaatatt

SEQ ID NO: 227912 - DNA, 15 bp, Homo sapiens
aatatcaggaaatat

SEQ ID NO: 227913 - DNA, 15 bp, Homo sapiens
aaatatcaggaaata

SEQ ID NO: 227914 - DNA, 15 bp, Homo sapiens
aaaatatcaggaaat

SEQ ID NO: 227915 - DNA, 15 bp, Homo sapiens
taaaatatcaggaaa

SEQ ID NO: 227916 - DNA, 15 bp, Homo sapiens
ctaaaatatcaggaa

SEQ ID NO: 227917 - DNA, 15 bp, Homo sapiens
tctaaaatatcagga

SEQ ID NO: 227918 - DNA, 15 bp, Homo sapiens
ttctaaaatatcagg

SEQ ID NO: 227919 - DNA, 15 bp, Homo sapiens
tttctaaaatatcag

SEQ ID NO: 227920 - DNA, 15 bp, Homo sapiens
ctttctaaaatatca

SEQ ID NO: 227921 - DNA, 15 bp, Homo sapiens
gctttctaaaatatc

SEQ ID NO: 227922 - DNA, 15 bp, Homo sapiens
ggctttctaaaatat

SEQ ID NO: 227923 - DNA, 15 bp, Homo sapiens
tggctttctaaaata

SEQ ID NO: 227924 - DNA, 15 bp, Homo sapiens
ttggctttctaaaat

SEQ ID NO: 227925 - DNA, 15 bp, Homo sapiens
cttggctttctaaaa

SEQ ID NO: 227926 - DNA, 15 bp, Homo sapiens
acttggctttctaaa

SEQ ID NO: 227927 - DNA, 15 bp, Homo sapiens
tacttggctttctaa

SEQ ID NO: 227928 - DNA, 15 bp, Homo sapiens
atacttggctttcta

SEQ ID NO: 227929 - DNA, 15 bp, Homo sapiens
aatacttggctttct

SEQ ID NO: 227930 - DNA, 15 bp, Homo sapiens
taatacttggctttc

SEQ ID NO: 227931 - DNA, 15 bp, Homo sapiens
ttaatacttggcttt

SEQ ID NO: 227932 - DNA, 15 bp, Homo sapiens
cttaatacttggctt

SEQ ID NO: 227933 - DNA, 15 bp, Homo sapiens
tcttaatacttggct

SEQ ID NO: 227934 - DNA, 15 bp, Homo sapiens
gtcttaatacttggc

SEQ ID NO: 227935 - DNA, 15 bp, Homo sapiens
agtcttaatacttgg

SEQ ID NO: 227936 - DNA, 15 bp, Homo sapiens
tagtcttaatacttg

SEQ ID NO: 227937 - DNA, 15 bp, Homo sapiens
atagtcttaatactt

SEQ ID NO: 227938 - DNA, 15 bp, Homo sapiens
aatagtcttaatact

SEQ ID NO: 227939 - DNA, 15 bp, Homo sapiens
aaatagtcttaatac

SEQ ID NO: 227940 - DNA, 15 bp, Homo sapiens
aaaatagtcttaata

SEQ ID NO: 227941 - DNA, 15 bp, Homo sapiens
aaaaatagtcttaat

SEQ ID NO: 227942 - DNA, 15 bp, Homo sapiens
gaaaaatagtcttaa

SEQ ID NO: 227943 - DNA, 15 bp, Homo sapiens
agaaaaatagtctta

SEQ ID NO: 227944 - DNA, 15 bp, Homo sapiens
aagaaaaatagtctt

SEQ ID NO: 227945 - DNA, 15 bp, Homo sapiens
gaagaaaaatagtct

SEQ ID NO: 227946 - DNA, 15 bp, Homo sapiens
ggaagaaaaatagtc

SEQ ID NO: 227947 - DNA, 15 bp, Homo sapiens
gggaagaaaaatagt

SEQ ID NO: 227948 - DNA, 15 bp, Homo sapiens
agggaagaaaaatag

SEQ ID NO: 227949 - DNA, 15 bp, Homo sapiens
cagggaagaaaaata

SEQ ID NO: 227950 - DNA, 15 bp, Homo sapiens
acagggaagaaaaat

SEQ ID NO: 227951 - DNA, 15 bp, Homo sapiens
tacagggaagaaaaa

SEQ ID NO: 227952 - DNA, 15 bp, Homo sapiens
ttacagggaagaaaa

SEQ ID NO: 227953 - DNA, 15 bp, Homo sapiens
ttttacagggaagaa

SEQ ID NO: 227954 - DNA, 15 bp, Homo sapiens
attttacagggaaga

SEQ ID NO: 227955 - DNA, 15 bp, Homo sapiens
gattttacagggaag

SEQ ID NO: 227956 - DNA, 15 bp, Homo sapiens
agattttacagggaa

SEQ ID NO: 227957 - DNA, 15 bp, Homo sapiens
gagattttacaggga

SEQ ID NO: 227958 - DNA, 15 bp, Homo sapiens
tgagattttacaggg

SEQ ID NO: 227959 - DNA, 15 bp, Homo sapiens
atgagattttacagg

SEQ ID NO: 227960 - DNA, 15 bp, Homo sapiens
tatgagattttacag

SEQ ID NO: 227961 - DNA, 15 bp, Homo sapiens
atatgagattttaca

SEQ ID NO: 227962 - DNA, 15 bp, Homo sapiens
tatatgagattttac

SEQ ID NO: 227963 - DNA, 15 bp, Homo sapiens
atatatgagatttta

SEQ ID NO: 227964 - DNA, 15 bp, Homo sapiens
aatatatgagatttt

SEQ ID NO: 227965 - DNA, 15 bp, Homo sapiens
aaatatatgagattt

SEQ ID NO: 227966 - DNA, 15 bp, Homo sapiens
aaaatatatgagatt

SEQ ID NO: 227967 - DNA, 15 bp, Homo sapiens
caaaatatatgagat

SEQ ID NO: 227968 - DNA, 15 bp, Homo sapiens
acaaaatatatgaga

SEQ ID NO: 227969 - DNA, 15 bp, Homo sapiens
cacaaaatatatgag

SEQ ID NO: 227970 - DNA, 15 bp, Homo sapiens
tcacaaaatatatga

SEQ ID NO: 227971 - DNA, 15 bp, Homo sapiens
atcacaaaatatatg

SEQ ID NO: 227972 - DNA, 15 bp, Homo sapiens
tatcacaaaatatat

SEQ ID NO: 227973 - DNA, 15 bp, Homo sapiens
gtatcacaaaatata

SEQ ID NO: 227974 - DNA, 15 bp, Homo sapiens
tgtatcacaaaatat

SEQ ID NO: 227975 - DNA, 15 bp, Homo sapiens
ttgtatcacaaaata

SEQ ID NO: 227976 - DNA, 15 bp, Homo sapiens
gttgtatcacaaaat

SEQ ID NO: 227977 - DNA, 15 bp, Homo sapiens
cgttgtatcacaaaa

SEQ ID NO: 227978 - DNA, 15 bp, Homo sapiens
tcgttgtatcacaaa

SEQ ID NO: 227979 - DNA, 15 bp, Homo sapiens
ttcgttgtatcacaa

SEQ ID NO: 227980 - DNA, 15 bp, Homo sapiens
cttcgttgtatcaca

SEQ ID NO: 227981 - DNA, 15 bp, Homo sapiens
tcttcgttgtatcac

SEQ ID NO: 227982 - DNA, 15 bp, Homo sapiens
ttcttcgttgtatca

SEQ ID NO: 227983 - DNA, 15 bp, Homo sapiens
attcttcgttgtatc

SEQ ID NO: 227984 - DNA, 15 bp, Homo sapiens
aattcttcgttgtat

SEQ ID NO: 227985 - DNA, 15 bp, Homo sapiens
aaattcttcgttgta

SEQ ID NO: 227986 - DNA, 15 bp, Homo sapiens
taaattcttcgttgt

SEQ ID NO: 227987 - DNA, 15 bp, Homo sapiens
ataaattcttcgttg

SEQ ID NO: 227988 - DNA, 15 bp, Homo sapiens
tataaattcttcgtt

SEQ ID NO: 227989 - DNA, 15 bp, Homo sapiens
ttataaattcttcgt

SEQ ID NO: 227990 - DNA, 15 bp, Homo sapiens
cttataaattcttcg

SEQ ID NO: 227991 - DNA, 15 bp, Homo sapiens
acttataaattcttc

SEQ ID NO: 227992 - DNA, 15 bp, Homo sapiens
cacttataaattctt

SEQ ID NO: 227993 - DNA, 15 bp, Homo sapiens
tcacttataaattct

SEQ ID NO: 227994 - DNA, 15 bp, Homo sapiens
gtcacttataaattc

SEQ ID NO: 227995 - DNA, 15 bp, Homo sapiens
tgtcacttataaatt

SEQ ID NO: 227996 - DNA, 15 bp, Homo sapiens
atgtcacttataaat

SEQ ID NO: 227997 - DNA, 15 bp, Homo sapiens
tatgtcacttataaa

SEQ ID NO: 227998 - DNA, 15 bp, Homo sapiens
atatgtcacttataa

SEQ ID NO: 227999 - DNA, 15 bp, Homo sapiens
aatatgtcacttata

SEQ ID NO: 228000 - DNA, 15 bp, Homo sapiens
gaatatgtcacttat

SEQ ID NO: 228001 - DNA, 15 bp, Homo sapiens
tgaatatgtcactta

SEQ ID NO: 228002 - DNA, 15 bp, Homo sapiens
ctgaatatgtcactt

SEQ ID NO: 228003 - DNA, 15 bp, Homo sapiens
actgaatatgtcact

SEQ ID NO: 228004 - DNA, 15 bp, Homo sapiens
gactgaatatgtcac

SEQ ID NO: 228005 - DNA, 15 bp, Homo sapiens
ggactgaatatgtca

SEQ ID NO: 228006 - DNA, 15 bp, Homo sapiens
tggactgaatatgtc

SEQ ID NO: 228007 - DNA, 15 bp, Homo sapiens
gtggactgaatatgt

SEQ ID NO: 228008 - DNA, 15 bp, Homo sapiens
agtggactgaatatg

SEQ ID NO: 228009 - DNA, 15 bp, Homo sapiens
tagtggactgaatat

SEQ ID NO: 228010 - DNA, 15 bp, Homo sapiens
atagtggactgaata

SEQ ID NO: 228011 - DNA, 15 bp, Homo sapiens
catagtggactgaat

SEQ ID NO: 228012 - DNA, 15 bp, Homo sapiens
acatagtggactgaa

SEQ ID NO: 228013 - DNA, 15 bp, Homo sapiens
gacatagtggactga

SEQ ID NO: 228014 - DNA, 15 bp, Homo sapiens
tgacatagtggactg

SEQ ID NO: 228015 - DNA, 15 bp, Homo sapiens
ctgacatagtggact

SEQ ID NO: 228016 - DNA, 15 bp, Homo sapiens
actgacatagtggac

SEQ ID NO: 228017 - DNA, 15 bp, Homo sapiens
gactgacatagtgga

SEQ ID NO: 228018 - DNA, 15 bp, Homo sapiens
ggactgacatagtgg

SEQ ID NO: 228019 - DNA, 15 bp, Homo sapiens
tggactgacatagtg

SEQ ID NO: 228020 - DNA, 15 bp, Homo sapiens
gtggactgacatagt

SEQ ID NO: 228021 - DNA, 15 bp, Homo sapiens
agtggactgacatag

SEQ ID NO: 228022 - DNA, 15 bp, Homo sapiens
aagtggactgacata

SEQ ID NO: 228023 - DNA, 15 bp, Homo sapiens
aaagtggactgacat

SEQ ID NO: 228024 - DNA, 15 bp, Homo sapiens
taaagtggactgaca

SEQ ID NO: 228025 - DNA, 15 bp, Homo sapiens
ataaagtggactgac

SEQ ID NO: 228026 - DNA, 15 bp, Homo sapiens
cataaagtggactga

SEQ ID NO: 228027 - DNA, 15 bp, Homo sapiens
gcataaagtggactg

SEQ ID NO: 228028 - DNA, 15 bp, Homo sapiens
ggcataaagtggact

SEQ ID NO: 228029 - DNA, 15 bp, Homo sapiens
tggcataaagtggac

SEQ ID NO: 228030 - DNA, 15 bp, Homo sapiens
ctggcataaagtgga

SEQ ID NO: 228031 - DNA, 15 bp, Homo sapiens
actggcataaagtgg

SEQ ID NO: 228032 - DNA, 15 bp, Homo sapiens
tactggcataaagtg

SEQ ID NO: 228033 - DNA, 15 bp, Homo sapiens
atactggcataaagt

SEQ ID NO: 228034 - DNA, 15 bp, Homo sapiens
aatactggcataaag

SEQ ID NO: 228035 - DNA, 15 bp, Homo sapiens
taatactggcataaa

SEQ ID NO: 228036 - DNA, 15 bp, Homo sapiens
ctaatactggcataa

SEQ ID NO: 228037 - DNA, 15 bp, Homo sapiens
gctaatactggcata

SEQ ID NO: 228038 - DNA, 15 bp, Homo sapiens
tgctaatactggcat

SEQ ID NO: 228039 - DNA, 15 bp, Homo sapiens
ttgctaatactggca

SEQ ID NO: 228040 - DNA, 15 bp, Homo sapiens
tttgctaatactggc

SEQ ID NO: 228041 - DNA, 15 bp, Homo sapiens
gtttgctaatactgg

SEQ ID NO: 228042 - DNA, 15 bp, Homo sapiens
agtttgctaatactg

SEQ ID NO: 228043 - DNA, 15 bp, Homo sapiens
aagtttgctaatact

SEQ ID NO: 228044 - DNA, 15 bp, Homo sapiens
taagtttgctaatac

SEQ ID NO: 228045 - DNA, 15 bp, Homo sapiens
ataagtttgctaata

SEQ ID NO: 228046 - DNA, 15 bp, Homo sapiens
cataagtttgctaat

SEQ ID NO: 228047 - DNA, 15 bp, Homo sapiens
gcataagtttgctaa

SEQ ID NO: 228048 - DNA, 15 bp, Homo sapiens
tgcataagtttgcta

SEQ ID NO: 228049 - DNA, 15 bp, Homo sapiens
ttgcataagtttgct

SEQ ID NO: 228050 - DNA, 15 bp, Homo sapiens
tttgcataagtttgc

SEQ ID NO: 228051 - DNA, 15 bp, Homo sapiens
atttgcataagtttg

SEQ ID NO: 228052 - DNA, 15 bp, Homo sapiens
tatttgcataagttt

SEQ ID NO: 228053 - DNA, 15 bp, Homo sapiens
gtatttgcataagtt

SEQ ID NO: 228054 - DNA, 15 bp, Homo sapiens
tgtatttgcataagt

SEQ ID NO: 228055 - DNA, 15 bp, Homo sapiens
ttgtatttgcataag

SEQ ID NO: 228056 - DNA, 15 bp, Homo sapiens
attgtatttgcataa

SEQ ID NO: 228057 - DNA, 15 bp, Homo sapiens
aattgtatttgcata

SEQ ID NO: 228058 - DNA, 15 bp, Homo sapiens
aaattgtatttgcat

SEQ ID NO: 228059 - DNA, 15 bp, Homo sapiens
gaaattgtatttgca

SEQ ID NO: 228060 - DNA, 15 bp, Homo sapiens
tgaaattgtatttgc

SEQ ID NO: 228061 - DNA, 15 bp, Homo sapiens
atgaaattgtatttg

SEQ ID NO: 228062 - DNA, 15 bp, Homo sapiens
tatgaaattgtattt

SEQ ID NO: 228063 - DNA, 15 bp, Homo sapiens
ctatgaaattgtatt

SEQ ID NO: 228064 - DNA, 15 bp, Homo sapiens
actatgaaattgtat

SEQ ID NO: 228065 - DNA, 15 bp, Homo sapiens
aactatgaaattgta

SEQ ID NO: 228066 - DNA, 15 bp, Homo sapiens
taactatgaaattgt

SEQ ID NO: 228067 - DNA, 15 bp, Homo sapiens
ataactatgaaattg

SEQ ID NO: 228068 - DNA, 15 bp, Homo sapiens
aataactatgaaatt

SEQ ID NO: 228069 - DNA, 15 bp, Homo sapiens
taataactatgaaat

SEQ ID NO: 228070 - DNA, 15 bp, Homo sapiens
ttaataactatgaaa

SEQ ID NO: 228071 - DNA, 15 bp, Homo sapiens
tttaataactatgaa

SEQ ID NO: 228072 - DNA, 15 bp, Homo sapiens
atttaataactatga

SEQ ID NO: 228073 - DNA, 15 bp, Homo sapiens
catttaataactatg

SEQ ID NO: 228074 - DNA, 15 bp, Homo sapiens
tcatttaataactat

SEQ ID NO: 228075 - DNA, 15 bp, Homo sapiens
ctcatttaataacta

SEQ ID NO: 228076 - DNA, 15 bp, Homo sapiens
actcatttaataact

SEQ ID NO: 228077 - DNA, 15 bp, Homo sapiens
cactcatttaataac

SEQ ID NO: 228078 - DNA, 15 bp, Homo sapiens
tcactcatttaataa

SEQ ID NO: 228079 - DNA, 15 bp, Homo sapiens
ttcactcatttaata

SEQ ID NO: 228080 - DNA, 15 bp, Homo sapiens
cttcactcatttaat

SEQ ID NO: 228081 - DNA, 15 bp, Homo sapiens
tcttcactcatttaa

SEQ ID NO: 228082 - DNA, 15 bp, Homo sapiens
atcttcactcattta

SEQ ID NO: 228083 - DNA, 15 bp, Homo sapiens
aatcttcactcattt

SEQ ID NO: 228084 - DNA, 15 bp, Homo sapiens
aaatcttcactcatt

SEQ ID NO: 228085 - DNA, 15 bp, Homo sapiens
caaatcttcactcat

SEQ ID NO: 228086 - DNA, 15 bp, Homo sapiens
tcaaatcttcactca

SEQ ID NO: 228087 - DNA, 15 bp, Homo sapiens
ttcaaatcttcactc

SEQ ID NO: 228088 - DNA, 15 bp, Homo sapiens
tttcaaatcttcact

SEQ ID NO: 228089 - DNA, 15 bp, Homo sapiens
atttcaaatcttcac

SEQ ID NO: 228090 - DNA, 15 bp, Homo sapiens
aatttcaaatcttca

SEQ ID NO: 228091 - DNA, 15 bp, Homo sapiens
taatttcaaatcttc

SEQ ID NO: 228092 - DNA, 15 bp, Homo sapiens
ataatttcaaatctt

SEQ ID NO: 228093 - DNA, 15 bp, Homo sapiens
aataatttcaaatct

SEQ ID NO: 228094 - DNA, 15 bp, Homo sapiens
taataatttcaaatc

SEQ ID NO: 228095 - DNA, 15 bp, Homo sapiens
ataataatttcaaat

SEQ ID NO: 228096 - DNA, 15 bp, Homo sapiens
tataataatttcaaa

SEQ ID NO: 228097 - DNA, 15 bp, Homo sapiens
atataataatttcaa

SEQ ID NO: 228098 - DNA, 15 bp, Homo sapiens
tatataataatttca

SEQ ID NO: 228099 - DNA, 15 bp, Homo sapiens
ctatataataatttc

SEQ ID NO: 228100 - DNA, 15 bp, Homo sapiens
actatataataattt

SEQ ID NO: 228101 - DNA, 15 bp, Homo sapiens
aactatataataatt

SEQ ID NO: 228102 - DNA, 15 bp, Homo sapiens
aaactatataataat

SEQ ID NO: 228103 - DNA, 15 bp, Homo sapiens
taaactatataataa

SEQ ID NO: 228104 - DNA, 15 bp, Homo sapiens
ctaaactatataata

SEQ ID NO: 228105 - DNA, 15 bp, Homo sapiens
actaaactatataat

SEQ ID NO: 228106 - DNA, 15 bp, Homo sapiens
tactaaactatataa

SEQ ID NO: 228107 - DNA, 15 bp, Homo sapiens
ctactaaactatata

SEQ ID NO: 228108 - DNA, 15 bp, Homo sapiens
tctactaaactatat

SEQ ID NO: 228109 - DNA, 15 bp, Homo sapiens
ttctactaaactata

SEQ ID NO: 228110 - DNA, 15 bp, Homo sapiens
cttctactaaactat

SEQ ID NO: 228111 - DNA, 15 bp, Homo sapiens
acttctactaaacta

SEQ ID NO: 228112 - DNA, 15 bp, Homo sapiens
aacttctactaaact

SEQ ID NO: 228113 - DNA, 15 bp, Homo sapiens
taacttctactaaac

SEQ ID NO: 228114 - DNA, 15 bp, Homo sapiens
gtaacttctactaaa

SEQ ID NO: 228115 - DNA, 15 bp, Homo sapiens
agtaacttctactaa

SEQ ID NO: 228116 - DNA, 15 bp, Homo sapiens
aagtaacttctacta

SEQ ID NO: 228117 - DNA, 15 bp, Homo sapiens
aaagtaacttctact

SEQ ID NO: 228118 - DNA, 15 bp, Homo sapiens
aaaagtaacttctac

SEQ ID NO: 228119 - DNA, 15 bp, Homo sapiens
taaaagtaacttcta

SEQ ID NO: 228120 - DNA, 15 bp, Homo sapiens
ataaaagtaacttct

SEQ ID NO: 228121 - DNA, 15 bp, Homo sapiens
tataaaagtaacttc

SEQ ID NO: 228122 - DNA, 15 bp, Homo sapiens
atataaaagtaactt

SEQ ID NO: 228123 - DNA, 15 bp, Homo sapiens
aatataaaagtaact

SEQ ID NO: 228124 - DNA, 15 bp, Homo sapiens
gaatataaaagtaac

SEQ ID NO: 228125 - DNA, 15 bp, Homo sapiens
agaatataaaagtaa

SEQ ID NO: 228126 - DNA, 15 bp, Homo sapiens
gagaatataaaagta

SEQ ID NO: 228127 - DNA, 15 bp, Homo sapiens
ggagaatataaaagt

SEQ ID NO: 228128 - DNA, 15 bp, Homo sapiens
tggagaatataaaag

SEQ ID NO: 228129 - DNA, 15 bp, Homo sapiens
atggagaatataaaa

SEQ ID NO: 228130 - DNA, 15 bp, Homo sapiens
tatggagaatataaa

SEQ ID NO: 228131 - DNA, 15 bp, Homo sapiens
atatggagaatataa

SEQ ID NO: 228132 - DNA, 15 bp, Homo sapiens
tatatggagaatata

SEQ ID NO: 228133 - DNA, 15 bp, Homo sapiens
ttatatggagaatat

SEQ ID NO: 228134 - DNA, 15 bp, Homo sapiens
gttatatggagaata

SEQ ID NO: 228135 - DNA, 15 bp, Homo sapiens
agttatatggagaat

SEQ ID NO: 228136 - DNA, 15 bp, Homo sapiens
aagttatatggagaa

SEQ ID NO: 228137 - DNA, 15 bp, Homo sapiens
taagttatatggaga

SEQ ID NO: 228138 - DNA, 15 bp, Homo sapiens
ttaagttatatggag

SEQ ID NO: 228139 - DNA, 15 bp, Homo sapiens
cttaagttatatgga

SEQ ID NO: 228140 - DNA, 15 bp, Homo sapiens
ccttaagttatatgg

SEQ ID NO: 228141 - DNA, 15 bp, Homo sapiens
accttaagttatatg

SEQ ID NO: 228142 - DNA, 15 bp, Homo sapiens
aaccttaagttatat

SEQ ID NO: 228143 - DNA, 15 bp, Homo sapiens
taaccttaagttata

SEQ ID NO: 228144 - DNA, 15 bp, Homo sapiens
gtaaccttaagttat

SEQ ID NO: 228145 - DNA, 15 bp, Homo sapiens
tgtaaccttaagtta

SEQ ID NO: 228146 - DNA, 15 bp, Homo sapiens
ttgtaaccttaagtt

SEQ ID NO: 228147 - DNA, 15 bp, Homo sapiens
gttgtaaccttaagt

SEQ ID NO: 228148 - DNA, 15 bp, Homo sapiens
tgttgtaaccttaag

SEQ ID NO: 228149 - DNA, 15 bp, Homo sapiens
atgttgtaaccttaa

SEQ ID NO: 228150 - DNA, 15 bp, Homo sapiens
aatgttgtaacctta

SEQ ID NO: 228151 - DNA, 15 bp, Homo sapiens
taatgttgtaacctt

SEQ ID NO: 228152 - DNA, 15 bp, Homo sapiens
ataatgttgtaacct

SEQ ID NO: 228153 - DNA, 15 bp, Homo sapiens
aataatgttgtaacc

SEQ ID NO: 228154 - DNA, 15 bp, Homo sapiens
aaataatgttgtaac

SEQ ID NO: 228155 - DNA, 15 bp, Homo sapiens
aaaataatgttgtaa

SEQ ID NO: 228156 - DNA, 15 bp, Homo sapiens
gaaaataatgttgta

SEQ ID NO: 228157 - DNA, 15 bp, Homo sapiens
agaaaataatgttgt

SEQ ID NO: 228158 - DNA, 15 bp, Homo sapiens
aagaaaataatgttg

SEQ ID NO: 228159 - DNA, 15 bp, Homo sapiens
caagaaaataatgtt

SEQ ID NO: 228160 - DNA, 15 bp, Homo sapiens
acaagaaaataatgt

SEQ ID NO: 228161 - DNA, 15 bp, Homo sapiens
tacaagaaaataatg

SEQ ID NO: 228162 - DNA, 15 bp, Homo sapiens
atacaagaaaataat

SEQ ID NO: 228163 - DNA, 15 bp, Homo sapiens
catacaagaaaataa

SEQ ID NO: 228164 - DNA, 15 bp, Homo sapiens
acatacaagaaaata

SEQ ID NO: 228165 - DNA, 15 bp, Homo sapiens
tacatacaagaaaat

SEQ ID NO: 228166 - DNA, 15 bp, Homo sapiens
ttacatacaagaaaa

SEQ ID NO: 228167 - DNA, 15 bp, Homo sapiens
attacatacaagaaa

SEQ ID NO: 228168 - DNA, 15 bp, Homo sapiens
tattacatacaagaa

SEQ ID NO: 228169 - DNA, 15 bp, Homo sapiens
ttattacatacaaga

SEQ ID NO: 228170 - DNA, 15 bp, Homo sapiens
tttattacatacaag

SEQ ID NO: 228171 - DNA, 15 bp, Homo sapiens
ttttattacatacaa

SEQ ID NO: 228172 - DNA, 15 bp, Homo sapiens
attttattacataca

SEQ ID NO: 228173 - DNA, 15 bp, Homo sapiens
cattttattacatac

SEQ ID NO: 228174 - DNA, 15 bp, Homo sapiens
tcattttattacata

SEQ ID NO: 228175 - DNA, 15 bp, Homo sapiens
ctcattttattacat

SEQ ID NO: 228176 - DNA, 15 bp, Homo sapiens
cctcattttattaca

SEQ ID NO: 228177 - DNA, 15 bp, Homo sapiens
tcctcattttattac

SEQ ID NO: 228178 - DNA, 15 bp, Homo sapiens
gtcctcattttatta

SEQ ID NO: 228179 - DNA, 15 bp, Homo sapiens
tgtcctcattttatt

SEQ ID NO: 228180 - DNA, 15 bp, Homo sapiens
ttgtcctcattttat

SEQ ID NO: 228181 - DNA, 15 bp, Homo sapiens
tttgtcctcatttta

SEQ ID NO: 228182 - DNA, 15 bp, Homo sapiens
atttgtcctcatttt

SEQ ID NO: 228183 - DNA, 15 bp, Homo sapiens
aatttgtcctcattt

SEQ ID NO: 228184 - DNA, 15 bp, Homo sapiens
taatttgtcctcatt

SEQ ID NO: 228185 - DNA, 15 bp, Homo sapiens
gtaatttgtcctcat

SEQ ID NO: 228186 - DNA, 15 bp, Homo sapiens
tgtaatttgtcctca

SEQ ID NO: 228187 - DNA, 15 bp, Homo sapiens
gtgtaatttgtcctc

SEQ ID NO: 228188 - DNA, 15 bp, Homo sapiens
tgtgtaatttgtcct

SEQ ID NO: 228189 - DNA, 15 bp, Homo sapiens
atgtgtaatttgtcc

SEQ ID NO: 228190 - DNA, 15 bp, Homo sapiens
aatgtgtaatttgtc

SEQ ID NO: 228191 - DNA, 15 bp, Homo sapiens
taatgtgtaatttgt

SEQ ID NO: 228192 - DNA, 15 bp, Homo sapiens
ctaatgtgtaatttg

SEQ ID NO: 228193 - DNA, 15 bp, Homo sapiens
actaatgtgtaattt

SEQ ID NO: 228194 - DNA, 15 bp, Homo sapiens
aactaatgtgtaatt

SEQ ID NO: 228195 - DNA, 15 bp, Homo sapiens
taactaatgtgtaat

SEQ ID NO: 228196 - DNA, 15 bp, Homo sapiens
ttaactaatgtgtaa

SEQ ID NO: 228197 - DNA, 15 bp, Homo sapiens
attaactaatgtgta

SEQ ID NO: 228198 - DNA, 15 bp, Homo sapiens
tattaactaatgtgt

SEQ ID NO: 228199 - DNA, 15 bp, Homo sapiens
ctattaactaatgtg

SEQ ID NO: 228200 - DNA, 15 bp, Homo sapiens
tctattaactaatgt

SEQ ID NO: 228201 - DNA, 15 bp, Homo sapiens
ttctattaactaatg

SEQ ID NO: 228202 - DNA, 15 bp, Homo sapiens
cttctattaactaat

SEQ ID NO: 228203 - DNA, 15 bp, Homo sapiens
acttctattaactaa

SEQ ID NO: 228204 - DNA, 15 bp, Homo sapiens
tacttctattaacta

SEQ ID NO: 228205 - DNA, 15 bp, Homo sapiens
ttacttctattaact

SEQ ID NO: 228206 - DNA, 15 bp, Homo sapiens
gttacttctattaac

SEQ ID NO: 228207 - DNA, 15 bp, Homo sapiens
agttacttctattaa

SEQ ID NO: 228208 - DNA, 15 bp, Homo sapiens
cagttacttctatta

SEQ ID NO: 228209 - DNA, 15 bp, Homo sapiens
ccagttacttctatt

SEQ ID NO: 228210 - DNA, 15 bp, Homo sapiens
cccagttacttctat

SEQ ID NO: 228211 - DNA, 15 bp, Homo sapiens
gcccagttacttcta

SEQ ID NO: 228212 - DNA, 15 bp, Homo sapiens
agcccagttacttct

SEQ ID NO: 228213 - DNA, 15 bp, Homo sapiens
tagcccagttacttc

SEQ ID NO: 228214 - DNA, 15 bp, Homo sapiens
ctagcccagttactt

SEQ ID NO: 228215 - DNA, 15 bp, Homo sapiens
actagcccagttact

SEQ ID NO: 228216 - DNA, 15 bp, Homo sapiens
tactagcccagttac

SEQ ID NO: 228217 - DNA, 15 bp, Homo sapiens
ttactagcccagtta

SEQ ID NO: 228218 - DNA, 15 bp, Homo sapiens
tttactagcccagtt

SEQ ID NO: 228219 - DNA, 15 bp, Homo sapiens
ttttactagcccagt

SEQ ID NO: 228220 - DNA, 15 bp, Homo sapiens
gttttactagcccag

SEQ ID NO: 228221 - DNA, 15 bp, Homo sapiens
agttttactagccca

SEQ ID NO: 228222 - DNA, 15 bp, Homo sapiens
tagttttactagccc

SEQ ID NO: 228223 - DNA, 15 bp, Homo sapiens
ttagttttactagcc

SEQ ID NO: 228224 - DNA, 15 bp, Homo sapiens
attagttttactagc

SEQ ID NO: 228225 - DNA, 15 bp, Homo sapiens
cattagttttactag

SEQ ID NO: 228226 - DNA, 15 bp, Homo sapiens
ccattagttttacta

SEQ ID NO: 228227 - DNA, 15 bp, Homo sapiens
cccattagttttact

SEQ ID NO: 228228 - DNA, 15 bp, Homo sapiens
acccattagttttac

SEQ ID NO: 228229 - DNA, 15 bp, Homo sapiens
cacccattagtttta

SEQ ID NO: 228230 - DNA, 15 bp, Homo sapiens
acacccattagtttt

SEQ ID NO: 228231 - DNA, 15 bp, Homo sapiens
aacacccattagttt

SEQ ID NO: 228232 - DNA, 15 bp, Homo sapiens
aaacacccattagtt

SEQ ID NO: 228233 - DNA, 15 bp, Homo sapiens
aaaacacccattagt

SEQ ID NO: 228234 - DNA, 15 bp, Homo sapiens
gaaaacacccattag

SEQ ID NO: 228235 - DNA, 15 bp, Homo sapiens
agaaaacacccatta

SEQ ID NO: 228236 - DNA, 15 bp, Homo sapiens
gagaaaacacccatt

SEQ ID NO: 228237 - DNA, 15 bp, Homo sapiens
ggagaaaacacccat

SEQ ID NO: 228238 - DNA, 15 bp, Homo sapiens
gggagaaaacaccca

SEQ ID NO: 228239 - DNA, 15 bp, Homo sapiens
tgggagaaaacaccc

SEQ ID NO: 228240 - DNA, 15 bp, Homo sapiens
ctgggagaaaacacc

SEQ ID NO: 228241 - DNA, 15 bp, Homo sapiens
cctgggagaaaacac

SEQ ID NO: 228242 - DNA, 15 bp, Homo sapiens
ccctgggagaaaaca

SEQ ID NO: 228243 - DNA, 15 bp, Homo sapiens
gccctgggagaaaac

SEQ ID NO: 228244 - DNA, 15 bp, Homo sapiens
agccctgggagaaaa

SEQ ID NO: 228245 - DNA, 15 bp, Homo sapiens
aagccctgggagaaa

SEQ ID NO: 228246 - DNA, 15 bp, Homo sapiens
aaagccctgggagaa

SEQ ID NO: 228247 - DNA, 15 bp, Homo sapiens
aaaagccctgggaga

SEQ ID NO: 228248 - DNA, 15 bp, Homo sapiens
caaaagccctgggag

SEQ ID NO: 228249 - DNA, 15 bp, Homo sapiens
acaaaagccctggga

SEQ ID NO: 228250 - DNA, 15 bp, Homo sapiens
aacaaaagccctggg

SEQ ID NO: 228251 - DNA, 15 bp, Homo sapiens
aaacaaaagccctgg

SEQ ID NO: 228252 - DNA, 15 bp, Homo sapiens
aaaacaaaagccctg

SEQ ID NO: 228253 - DNA, 15 bp, Homo sapiens
gaaaacaaaagccct

SEQ ID NO: 228254 - DNA, 15 bp, Homo sapiens
ggaaaacaaaagccc

SEQ ID NO: 228255 - DNA, 15 bp, Homo sapiens
aggaaaacaaaagcc

SEQ ID NO: 228256 - DNA, 15 bp, Homo sapiens
gaggaaaacaaaagc

SEQ ID NO: 228257 - DNA, 15 bp, Homo sapiens
tgaggaaaacaaaag

SEQ ID NO: 228258 - DNA, 15 bp, Homo sapiens
gtgaggaaaacaaaa

SEQ ID NO: 228259 - DNA, 15 bp, Homo sapiens
agtgaggaaaacaaa

SEQ ID NO: 228260 - DNA, 15 bp, Homo sapiens
tagtgaggaaaacaa

SEQ ID NO: 228261 - DNA, 15 bp, Homo sapiens
ttagtgaggaaaaca

SEQ ID NO: 228262 - DNA, 15 bp, Homo sapiens
gttagtgaggaaaac

SEQ ID NO: 228263 - DNA, 15 bp, Homo sapiens
tgttagtgaggaaaa

SEQ ID NO: 228264 - DNA, 15 bp, Homo sapiens
ttgttagtgaggaaa

SEQ ID NO: 228265 - DNA, 15 bp, Homo sapiens
gttgttagtgaggaa

SEQ ID NO: 228266 - DNA, 15 bp, Homo sapiens
agttgttagtgagga

SEQ ID NO: 228267 - DNA, 15 bp, Homo sapiens
aagttgttagtgagg

SEQ ID NO: 228268 - DNA, 15 bp, Homo sapiens
aaagttgttagtgag

SEQ ID NO: 228269 - DNA, 15 bp, Homo sapiens
taaagttgttagtga

SEQ ID NO: 228270 - DNA, 15 bp, Homo sapiens
ataaagttgttagtg

SEQ ID NO: 228271 - DNA, 15 bp, Homo sapiens
aataaagttgttagt

SEQ ID NO: 228272 - DNA, 15 bp, Homo sapiens
taataaagttgttag

SEQ ID NO: 228273 - DNA, 15 bp, Homo sapiens
ttaataaagttgtta

SEQ ID NO: 228274 - DNA, 15 bp, Homo sapiens
attaataaagttgtt

SEQ ID NO: 228275 - DNA, 15 bp, Homo sapiens
aattaataaagttgt

SEQ ID NO: 228276 - DNA, 15 bp, Homo sapiens
caattaataaagttg

SEQ ID NO: 228277 - DNA, 15 bp, Homo sapiens
ccaattaataaagtt

SEQ ID NO: 228278 - DNA, 15 bp, Homo sapiens
tccaattaataaagt

SEQ ID NO: 228279 - DNA, 15 bp, Homo sapiens
ctccaattaataaag

SEQ ID NO: 228280 - DNA, 15 bp, Homo sapiens
gctccaattaataaa

SEQ ID NO: 228281 - DNA, 15 bp, Homo sapiens
ggctccaattaataa

SEQ ID NO: 228282 - DNA, 15 bp, Homo sapiens
aggctccaattaata

SEQ ID NO: 228283 - DNA, 15 bp, Homo sapiens
gaggctccaattaat

SEQ ID NO: 228284 - DNA, 15 bp, Homo sapiens
tgaggctccaattaa

SEQ ID NO: 228285 - DNA, 15 bp, Homo sapiens
atgaggctccaatta

SEQ ID NO: 228286 - DNA, 15 bp, Homo sapiens
aatgaggctccaatt

SEQ ID NO: 228287 - DNA, 15 bp, Homo sapiens
gaatgaggctccaat

SEQ ID NO: 228288 - DNA, 15 bp, Homo sapiens
tgaatgaggctccaa

SEQ ID NO: 228289 - DNA, 15 bp, Homo sapiens
atgaatgaggctcca

SEQ ID NO: 228290 - DNA, 15 bp, Homo sapiens
aatgaatgaggctcc

SEQ ID NO: 228291 - DNA, 15 bp, Homo sapiens
caatgaatgaggctc

SEQ ID NO: 228292 - DNA, 15 bp, Homo sapiens
acaatgaatgaggct

SEQ ID NO: 228293 - DNA, 15 bp, Homo sapiens
tacaatgaatgaggc

SEQ ID NO: 228294 - DNA, 15 bp, Homo sapiens
ttacaatgaatgagg

SEQ ID NO: 228295 - DNA, 15 bp, Homo sapiens
tttacaatgaatgag

SEQ ID NO: 228296 - DNA, 15 bp, Homo sapiens
atttacaatgaatga

SEQ ID NO: 228297 - DNA, 15 bp, Homo sapiens
catttacaatgaatg

SEQ ID NO: 228298 - DNA, 15 bp, Homo sapiens
tcatttacaatgaat

SEQ ID NO: 228299 - DNA, 15 bp, Homo sapiens
gtcatttacaatgaa

SEQ ID NO: 228300 - DNA, 15 bp, Homo sapiens
tgtcatttacaatga

SEQ ID NO: 228301 - DNA, 15 bp, Homo sapiens
ctgtcatttacaatg

SEQ ID NO: 228302 - DNA, 15 bp, Homo sapiens
cctgtcatttacaat

SEQ ID NO: 228303 - DNA, 15 bp, Homo sapiens
gcctgtcatttacaa

SEQ ID NO: 228304 - DNA, 15 bp, Homo sapiens
tgcctgtcatttaca

SEQ ID NO: 228305 - DNA, 15 bp, Homo sapiens
gtgcctgtcatttac

SEQ ID NO: 228306 - DNA, 15 bp, Homo sapiens
tgtgcctgtcattta

SEQ ID NO: 228307 - DNA, 15 bp, Homo sapiens
gtgtgcctgtcattt

SEQ ID NO: 228308 - DNA, 15 bp, Homo sapiens
tgtgtgcctgtcatt

SEQ ID NO: 228309 - DNA, 15 bp, Homo sapiens
ctgtgtgcctgtcat

SEQ ID NO: 228310 - DNA, 15 bp, Homo sapiens
gctgtgtgcctgtca

SEQ ID NO: 228311 - DNA, 15 bp, Homo sapiens
agctgtgtgcctgtc

SEQ ID NO: 228312 - DNA, 15 bp, Homo sapiens
aagctgtgtgcctgt

SEQ ID NO: 228313 - DNA, 15 bp, Homo sapiens
gaagctgtgtgcctg

SEQ ID NO: 228314 - DNA, 15 bp, Homo sapiens
ggaagctgtgtgcct

SEQ ID NO: 228315 - DNA, 15 bp, Homo sapiens
gggaagctgtgtgcc

SEQ ID NO: 228316 - DNA, 15 bp, Homo sapiens
agggaagctgtgtgc

SEQ ID NO: 228317 - DNA, 15 bp, Homo sapiens
tagggaagctgtgtg

SEQ ID NO: 228318 - DNA, 15 bp, Homo sapiens
ttagggaagctgtgt

SEQ ID NO: 228319 - DNA, 15 bp, Homo sapiens
cttagggaagctgtg

SEQ ID NO: 228320 - DNA, 15 bp, Homo sapiens
acttagggaagctgt

SEQ ID NO: 228321 - DNA, 15 bp, Homo sapiens
cacttagggaagctg

SEQ ID NO: 228322 - DNA, 15 bp, Homo sapiens
acacttagggaagct

SEQ ID NO: 228323 - DNA, 15 bp, Homo sapiens
tacacttagggaagc

SEQ ID NO: 228324 - DNA, 15 bp, Homo sapiens
ctacacttagggaag

SEQ ID NO: 228325 - DNA, 15 bp, Homo sapiens
cctacacttagggaa

SEQ ID NO: 228326 - DNA, 15 bp, Homo sapiens
gcctacacttaggga

SEQ ID NO: 228327 - DNA, 15 bp, Homo sapiens
tgcctacacttaggg

SEQ ID NO: 228328 - DNA, 15 bp, Homo sapiens
atgcctacacttagg

SEQ ID NO: 228329 - DNA, 15 bp, Homo sapiens
catgcctacacttag

SEQ ID NO: 228330 - DNA, 15 bp, Homo sapiens
tcatgcctacactta

SEQ ID NO: 228331 - DNA, 15 bp, Homo sapiens
ttcatgcctacactt

SEQ ID NO: 228332 - DNA, 15 bp, Homo sapiens
cttcatgcctacact

SEQ ID NO: 228333 - DNA, 15 bp, Homo sapiens
ccttcatgcctacac

SEQ ID NO: 228334 - DNA, 15 bp, Homo sapiens
cccttcatgcctaca

SEQ ID NO: 228335 - DNA, 15 bp, Homo sapiens
ccccttcatgcctac

SEQ ID NO: 228336 - DNA, 15 bp, Homo sapiens
tccccttcatgccta

SEQ ID NO: 228337 - DNA, 15 bp, Homo sapiens
ttccccttcatgcct

SEQ ID NO: 228338 - DNA, 15 bp, Homo sapiens
cttccccttcatgcc

SEQ ID NO: 228339 - DNA, 15 bp, Homo sapiens
ccttccccttcatgc

SEQ ID NO: 228340 - DNA, 15 bp, Homo sapiens
gccttccccttcatg

SEQ ID NO: 228341 - DNA, 15 bp, Homo sapiens
tgccttccccttcat

SEQ ID NO: 228342 - DNA, 15 bp, Homo sapiens
atgccttccccttca

SEQ ID NO: 228343 - DNA, 15 bp, Homo sapiens
aatgccttccccttc

SEQ ID NO: 228344 - DNA, 15 bp, Homo sapiens
caatgccttcccctt

SEQ ID NO: 228345 - DNA, 15 bp, Homo sapiens
ccaatgccttcccct

SEQ ID NO: 228346 - DNA, 15 bp, Homo sapiens
gccaatgccttcccc

SEQ ID NO: 228347 - DNA, 15 bp, Homo sapiens
ggccaatgccttccc

SEQ ID NO: 228348 - DNA, 15 bp, Homo sapiens
aggccaatgccttcc

SEQ ID NO: 228349 - DNA, 15 bp, Homo sapiens
gaggccaatgccttc

SEQ ID NO: 228350 - DNA, 15 bp, Homo sapiens
ggaggccaatgcctt

SEQ ID NO: 228351 - DNA, 15 bp, Homo sapiens
tggaggccaatgcct

SEQ ID NO: 228352 - DNA, 15 bp, Homo sapiens
atggaggccaatgcc

SEQ ID NO: 228353 - DNA, 15 bp, Homo sapiens
tatggaggccaatgc

SEQ ID NO: 228354 - DNA, 15 bp, Homo sapiens
ttatggaggccaatg

SEQ ID NO: 228355 - DNA, 15 bp, Homo sapiens
gttatggaggccaat

SEQ ID NO: 228356 - DNA, 15 bp, Homo sapiens
ggttatggaggccaa

SEQ ID NO: 228357 - DNA, 15 bp, Homo sapiens
cggttatggaggcca

SEQ ID NO: 228358 - DNA, 15 bp, Homo sapiens
tcggttatggaggcc

SEQ ID NO: 228359 - DNA, 15 bp, Homo sapiens
ctcggttatggaggc

SEQ ID NO: 228360 - DNA, 15 bp, Homo sapiens
gctcggttatggagg

SEQ ID NO: 228361 - DNA, 15 bp, Homo sapiens
ggctcggttatggag

SEQ ID NO: 228362 - DNA, 15 bp, Homo sapiens
tggctcggttatgga

SEQ ID NO: 228363 - DNA, 15 bp, Homo sapiens
gtggctcggttatgg

SEQ ID NO: 228364 - DNA, 15 bp, Homo sapiens
cgtggctcggttatg

SEQ ID NO: 228365 - DNA, 15 bp, Homo sapiens
ccgtggctcggttat

SEQ ID NO: 228366 - DNA, 15 bp, Homo sapiens
accgtggctcggtta

SEQ ID NO: 228367 - DNA, 15 bp, Homo sapiens
taccgtggctcggtt

SEQ ID NO: 228368 - DNA, 15 bp, Homo sapiens
ctaccgtggctcggt

SEQ ID NO: 228369 - DNA, 15 bp, Homo sapiens
tctaccgtggctcgg

SEQ ID NO: 228370 - DNA, 15 bp, Homo sapiens
ctctaccgtggctcg

SEQ ID NO: 228371 - DNA, 15 bp, Homo sapiens
tctctaccgtggctc

SEQ ID NO: 228372 - DNA, 15 bp, Homo sapiens
gtctctaccgtggct

SEQ ID NO: 228373 - DNA, 15 bp, Homo sapiens
cgtctctaccgtggc

SEQ ID NO: 228374 - DNA, 15 bp, Homo sapiens
acgtctctaccgtgg

SEQ ID NO: 228375 - DNA, 15 bp, Homo sapiens
tacgtctctaccgtg

SEQ ID NO: 228376 - DNA, 15 bp, Homo sapiens
ctacgtctctaccgt

SEQ ID NO: 228377 - DNA, 15 bp, Homo sapiens
gctacgtctctaccg

SEQ ID NO: 228378 - DNA, 15 bp, Homo sapiens
agctacgtctctacc

SEQ ID NO: 228379 - DNA, 15 bp, Homo sapiens
cagctacgtctctac

SEQ ID NO: 228380 - DNA, 15 bp, Homo sapiens
tcagctacgtctcta

SEQ ID NO: 228381 - DNA, 15 bp, Homo sapiens
gtcagctacgtctct

SEQ ID NO: 228382 - DNA, 15 bp, Homo sapiens
ggtcagctacgtctc

SEQ ID NO: 228383 - DNA, 15 bp, Homo sapiens
tggtcagctacgtct

SEQ ID NO: 228384 - DNA, 15 bp, Homo sapiens
gtggtcagctacgtc

SEQ ID NO: 228385 - DNA, 15 bp, Homo sapiens
tgtggtcagctacgt

SEQ ID NO: 228386 - DNA, 15 bp, Homo sapiens
ctgtggtcagctacg

SEQ ID NO: 228387 - DNA, 15 bp, Homo sapiens
cctgtggtcagctac

SEQ ID NO: 228388 - DNA, 15 bp, Homo sapiens
ccctgtggtcagcta

SEQ ID NO: 228389 - DNA, 15 bp, Homo sapiens
tccctgtggtcagct

SEQ ID NO: 228390 - DNA, 15 bp, Homo sapiens
gtccctgtggtcagc

SEQ ID NO: 228391 - DNA, 15 bp, Homo sapiens
agtccctgtggtcag

SEQ ID NO: 228392 - DNA, 15 bp, Homo sapiens
cagtccctgtggtca

SEQ ID NO: 228393 - DNA, 15 bp, Homo sapiens
ccagtccctgtggtc

SEQ ID NO: 228394 - DNA, 15 bp, Homo sapiens
tccagtccctgtggt

SEQ ID NO: 228395 - DNA, 15 bp, Homo sapiens
ttccagtccctgtgg

SEQ ID NO: 228396 - DNA, 15 bp, Homo sapiens
attccagtccctgtg

SEQ ID NO: 228397 - DNA, 15 bp, Homo sapiens
tattccagtccctgt

SEQ ID NO: 228398 - DNA, 15 bp, Homo sapiens
gtattccagtccctg

SEQ ID NO: 228399 - DNA, 15 bp, Homo sapiens
ggtattccagtccct

SEQ ID NO: 228400 - DNA, 15 bp, Homo sapiens
tggtattccagtccc

SEQ ID NO: 228401 - DNA, 15 bp, Homo sapiens
gtggtattccagtcc

SEQ ID NO: 228402 - DNA, 15 bp, Homo sapiens
ggtggtattccagtc

SEQ ID NO: 228403 - DNA, 15 bp, Homo sapiens
gggtggtattccagt

SEQ ID NO: 228404 - DNA, 15 bp, Homo sapiens
tgggtggtattccag

SEQ ID NO: 228405 - DNA, 15 bp, Homo sapiens
ctgggtggtattcca

SEQ ID NO: 228406 - DNA, 15 bp, Homo sapiens
tctgggtggtattcc

SEQ ID NO: 228407 - DNA, 15 bp, Homo sapiens
ttctgggtggtattc

SEQ ID NO: 228408 - DNA, 15 bp, Homo sapiens
cttctgggtggtatt

SEQ ID NO: 228409 - DNA, 15 bp, Homo sapiens
ccttctgggtggtat

SEQ ID NO: 228410 - DNA, 15 bp, Homo sapiens
gccttctgggtggta

SEQ ID NO: 228411 - DNA, 15 bp, Homo sapiens
agccttctgggtggt

SEQ ID NO: 228412 - DNA, 15 bp, Homo sapiens
aagccttctgggtgg

SEQ ID NO: 228413 - DNA, 15 bp, Homo sapiens
aaagccttctgggtg

SEQ ID NO: 228414 - DNA, 15 bp, Homo sapiens
aaaagccttctgggt

SEQ ID NO: 228415 - DNA, 15 bp, Homo sapiens
gaaaagccttctggg

SEQ ID NO: 228416 - DNA, 15 bp, Homo sapiens
agaaaagccttctgg

SEQ ID NO: 228417 - DNA, 15 bp, Homo sapiens
gagaaaagccttctg

SEQ ID NO: 228418 - DNA, 15 bp, Homo sapiens
ggagaaaagccttct

SEQ ID NO: 228419 - DNA, 15 bp, Homo sapiens
tggagaaaagccttc

SEQ ID NO: 228420 - DNA, 15 bp, Homo sapiens
atggagaaaagcctt

SEQ ID NO: 228421 - DNA, 15 bp, Homo sapiens
catggagaaaagcct

SEQ ID NO: 228422 - DNA, 15 bp, Homo sapiens
acatggagaaaagcc

SEQ ID NO: 228423 - DNA, 15 bp, Homo sapiens
gacatggagaaaagc

SEQ ID NO: 228424 - DNA, 15 bp, Homo sapiens
agacatggagaaaag

SEQ ID NO: 228425 - DNA, 15 bp, Homo sapiens
aagacatggagaaaa

SEQ ID NO: 228426 - DNA, 15 bp, Homo sapiens
gaagacatggagaaa

SEQ ID NO: 228427 - DNA, 15 bp, Homo sapiens
agaagacatggagaa

SEQ ID NO: 228428 - DNA, 15 bp, Homo sapiens
aagaagacatggaga

SEQ ID NO: 228429 - DNA, 15 bp, Homo sapiens
gaagaagacatggag

SEQ ID NO: 228430 - DNA, 15 bp, Homo sapiens
agaagaagacatgga

SEQ ID NO: 228431 - DNA, 15 bp, Homo sapiens
gagaagaagacatgg

SEQ ID NO: 228432 - DNA, 15 bp, Homo sapiens
agagaagaagacatg

SEQ ID NO: 228433 - DNA, 15 bp, Homo sapiens
cagagaagaagacat

SEQ ID NO: 228434 - DNA, 15 bp, Homo sapiens
gcagagaagaagaca

SEQ ID NO: 228435 - DNA, 15 bp, Homo sapiens
agcagagaagaagac

SEQ ID NO: 228436 - DNA, 15 bp, Homo sapiens
aagcagagaagaaga

SEQ ID NO: 228437 - DNA, 15 bp, Homo sapiens
gaagcagagaagaag

SEQ ID NO: 228438 - DNA, 15 bp, Homo sapiens
agaagcagagaagaa

SEQ ID NO: 228439 - DNA, 15 bp, Homo sapiens
gagaagcagagaaga

SEQ ID NO: 228440 - DNA, 15 bp, Homo sapiens
agagaagcagagaag

SEQ ID NO: 228441 - DNA, 15 bp, Homo sapiens
cagagaagcagagaa

SEQ ID NO: 228442 - DNA, 15 bp, Homo sapiens
acagagaagcagaga

SEQ ID NO: 228443 - DNA, 15 bp, Homo sapiens
tacagagaagcagag

SEQ ID NO: 228444 - DNA, 15 bp, Homo sapiens
gtacagagaagcaga

SEQ ID NO: 228445 - DNA, 15 bp, Homo sapiens
tgtacagagaagcag

SEQ ID NO: 228446 - DNA, 15 bp, Homo sapiens
ctgtacagagaagca

SEQ ID NO: 228447 - DNA, 15 bp, Homo sapiens
cctgtacagagaagc

SEQ ID NO: 228448 - DNA, 15 bp, Homo sapiens
acctgtacagagaag

SEQ ID NO: 228449 - DNA, 15 bp, Homo sapiens
aacctgtacagagaa

SEQ ID NO: 228450 - DNA, 15 bp, Homo sapiens
aaacctgtacagaga

SEQ ID NO: 228451 - DNA, 15 bp, Homo sapiens
aaaacctgtacagag

SEQ ID NO: 228452 - DNA, 15 bp, Homo sapiens
gaaaacctgtacaga

SEQ ID NO: 228453 - DNA, 15 bp, Homo sapiens
tgaaaacctgtacag

SEQ ID NO: 228454 - DNA, 15 bp, Homo sapiens
atgaaaacctgtaca

SEQ ID NO: 228455 - DNA, 15 bp, Homo sapiens
aatgaaaacctgtac

SEQ ID NO: 228456 - DNA, 15 bp, Homo sapiens
aaatgaaaacctgta

SEQ ID NO: 228457 - DNA, 15 bp, Homo sapiens
aaaatgaaaacctgt

SEQ ID NO: 228458 - DNA, 15 bp, Homo sapiens
gaaaatgaaaacctg

SEQ ID NO: 228459 - DNA, 15 bp, Homo sapiens
agaaaatgaaaacct

SEQ ID NO: 228460 - DNA, 15 bp, Homo sapiens
aagaaaatgaaaacc

SEQ ID NO: 228461 - DNA, 15 bp, Homo sapiens
taagaaaatgaaaac

SEQ ID NO: 228462 - DNA, 15 bp, Homo sapiens
ctaagaaaatgaaaa

SEQ ID NO: 228463 - DNA, 15 bp, Homo sapiens
gctaagaaaatgaaa

SEQ ID NO: 228464 - DNA, 15 bp, Homo sapiens
agctaagaaaatgaa

SEQ ID NO: 228465 - DNA, 15 bp, Homo sapiens
aagctaagaaaatga

SEQ ID NO: 228466 - DNA, 15 bp, Homo sapiens
aaagctaagaaaatg

SEQ ID NO: 228467 - DNA, 15 bp, Homo sapiens
gaaagctaagaaaat

SEQ ID NO: 228468 - DNA, 15 bp, Homo sapiens
ggaaagctaagaaaa

SEQ ID NO: 228469 - DNA, 15 bp, Homo sapiens
aggaaagctaagaaa

SEQ ID NO: 228470 - DNA, 15 bp, Homo sapiens
taggaaagctaagaa

SEQ ID NO: 228471 - DNA, 15 bp, Homo sapiens
ataggaaagctaaga

SEQ ID NO: 228472 - DNA, 15 bp, Homo sapiens
cataggaaagctaag

SEQ ID NO: 228473 - DNA, 15 bp, Homo sapiens
tcataggaaagctaa

SEQ ID NO: 228474 - DNA, 15 bp, Homo sapiens
gtcataggaaagcta

SEQ ID NO: 228475 - DNA, 15 bp, Homo sapiens
agtcataggaaagct

SEQ ID NO: 228476 - DNA, 15 bp, Homo sapiens
cagtcataggaaagc

SEQ ID NO: 228477 - DNA, 15 bp, Homo sapiens
acagtcataggaaag

SEQ ID NO: 228478 - DNA, 15 bp, Homo sapiens
tacagtcataggaaa

SEQ ID NO: 228479 - DNA, 15 bp, Homo sapiens
atacagtcataggaa

SEQ ID NO: 228480 - DNA, 15 bp, Homo sapiens
tatacagtcatagga

SEQ ID NO: 228481 - DNA, 15 bp, Homo sapiens
ctatacagtcatagg

SEQ ID NO: 228482 - DNA, 15 bp, Homo sapiens
gctatacagtcatag

SEQ ID NO: 228483 - DNA, 15 bp, Homo sapiens
agctatacagtcata

SEQ ID NO: 228484 - DNA, 15 bp, Homo sapiens
gagctatacagtcat

SEQ ID NO: 228485 - DNA, 15 bp, Homo sapiens
tgagctatacagtca

SEQ ID NO: 228486 - DNA, 15 bp, Homo sapiens
gtgagctatacagtc

SEQ ID NO: 228487 - DNA, 15 bp, Homo sapiens
tgtgagctatacagt

SEQ ID NO: 228488 - DNA, 15 bp, Homo sapiens
ttgtgagctatacag

SEQ ID NO: 228489 - DNA, 15 bp, Homo sapiens
gttgtgagctataca

SEQ ID NO: 228490 - DNA, 15 bp, Homo sapiens
ggttgtgagctatac

SEQ ID NO: 228491 - DNA, 15 bp, Homo sapiens
aggttgtgagctata

SEQ ID NO: 228492 - DNA, 15 bp, Homo sapiens
gaggttgtgagctat

SEQ ID NO: 228493 - DNA, 15 bp, Homo sapiens
tgaggttgtgagcta

SEQ ID NO: 228494 - DNA, 15 bp, Homo sapiens
atgaggttgtgagct

SEQ ID NO: 228495 - DNA, 15 bp, Homo sapiens
tatgaggttgtgagc

SEQ ID NO: 228496 - DNA, 15 bp, Homo sapiens
gtatgaggttgtgag

SEQ ID NO: 228497 - DNA, 15 bp, Homo sapiens
ggtatgaggttgtga

SEQ ID NO: 228498 - DNA, 15 bp, Homo sapiens
tggtatgaggttgtg

SEQ ID NO: 228499 - DNA, 15 bp, Homo sapiens
ctggtatgaggttgt

SEQ ID NO: 228500 - DNA, 15 bp, Homo sapiens
cctggtatgaggttg

SEQ ID NO: 228501 - DNA, 15 bp, Homo sapiens
tcctggtatgaggtt

SEQ ID NO: 228502 - DNA, 15 bp, Homo sapiens
ttcctggtatgaggt

SEQ ID NO: 228503 - DNA, 15 bp, Homo sapiens
cttcctggtatgagg

SEQ ID NO: 228504 - DNA, 15 bp, Homo sapiens
ccttcctggtatgag

SEQ ID NO: 228505 - DNA, 15 bp, Homo sapiens
cccttcctggtatga

SEQ ID NO: 228506 - DNA, 15 bp, Homo sapiens
gcccttcctggtatg

SEQ ID NO: 228507 - DNA, 15 bp, Homo sapiens
agcccttcctggtat

SEQ ID NO: 228508 - DNA, 15 bp, Homo sapiens
gagcccttcctggta

SEQ ID NO: 228509 - DNA, 15 bp, Homo sapiens
tgagcccttcctggt

SEQ ID NO: 228510 - DNA, 15 bp, Homo sapiens
gtgagcccttcctgg

SEQ ID NO: 228511 - DNA, 15 bp, Homo sapiens
ggtgagcccttcctg

SEQ ID NO: 228512 - DNA, 15 bp, Homo sapiens
gggtgagcccttcct

SEQ ID NO: 228513 - DNA, 15 bp, Homo sapiens
agggtgagcccttcc

SEQ ID NO: 228514 - DNA, 15 bp, Homo sapiens
aagggtgagcccttc

SEQ ID NO: 228515 - DNA, 15 bp, Homo sapiens
gaagggtgagccctt

SEQ ID NO: 228516 - DNA, 15 bp, Homo sapiens
agaagggtgagccct

SEQ ID NO: 228517 - DNA, 15 bp, Homo sapiens
aagaagggtgagccc

SEQ ID NO: 228518 - DNA, 15 bp, Homo sapiens
aaagaagggtgagcc

SEQ ID NO: 228519 - DNA, 15 bp, Homo sapiens
taaagaagggtgagc

SEQ ID NO: 228520 - DNA, 15 bp, Homo sapiens
ctaaagaagggtgag

SEQ ID NO: 228521 - DNA, 15 bp, Homo sapiens
tctaaagaagggtga

SEQ ID NO: 228522 - DNA, 15 bp, Homo sapiens
atctaaagaagggtg

SEQ ID NO: 228523 - DNA, 15 bp, Homo sapiens
gatctaaagaagggt

SEQ ID NO: 228524 - DNA, 15 bp, Homo sapiens
ggatctaaagaaggg

SEQ ID NO: 228525 - DNA, 15 bp, Homo sapiens
tggatctaaagaagg

SEQ ID NO: 228526 - DNA, 15 bp, Homo sapiens
ctggatctaaagaag

SEQ ID NO: 228527 - DNA, 15 bp, Homo sapiens
tctggatctaaagaa

SEQ ID NO: 228528 - DNA, 15 bp, Homo sapiens
ttctggatctaaaga

SEQ ID NO: 228529 - DNA, 15 bp, Homo sapiens
attctggatctaaag

SEQ ID NO: 228530 - DNA, 15 bp, Homo sapiens
tattctggatctaaa

SEQ ID NO: 228531 - DNA, 15 bp, Homo sapiens
atattctggatctaa

SEQ ID NO: 228532 - DNA, 15 bp, Homo sapiens
aatattctggatcta

SEQ ID NO: 228533 - DNA, 15 bp, Homo sapiens
gaatattctggatct

SEQ ID NO: 228534 - DNA, 15 bp, Homo sapiens
ggaatattctggatc

SEQ ID NO: 228535 - DNA, 15 bp, Homo sapiens
tggaatattctggat

SEQ ID NO: 228536 - DNA, 15 bp, Homo sapiens
ctggaatattctgga

SEQ ID NO: 228537 - DNA, 15 bp, Homo sapiens
cctggaatattctgg

SEQ ID NO: 228538 - DNA, 15 bp, Homo sapiens
tcctggaatattctg

SEQ ID NO: 228539 - DNA, 15 bp, Homo sapiens
ctcctggaatattct

SEQ ID NO: 228540 - DNA, 15 bp, Homo sapiens
tctcctggaatattc

SEQ ID NO: 228541 - DNA, 15 bp, Homo sapiens
ctctcctggaatatt

SEQ ID NO: 228542 - DNA, 15 bp, Homo sapiens
cctctcctggaatat

SEQ ID NO: 228543 - DNA, 15 bp, Homo sapiens
ccctctcctggaata

SEQ ID NO: 228544 - DNA, 15 bp, Homo sapiens
gccctctcctggaat

SEQ ID NO: 228545 - DNA, 15 bp, Homo sapiens
agccctctcctggaa

SEQ ID NO: 228546 - DNA, 15 bp, Homo sapiens
gagccctctcctgga

SEQ ID NO: 228547 - DNA, 15 bp, Homo sapiens
agagccctctcctgg

SEQ ID NO: 228548 - DNA, 15 bp, Homo sapiens
cagagccctctcctg

SEQ ID NO: 228549 - DNA, 15 bp, Homo sapiens
ccagagccctctcct

SEQ ID NO: 228550 - DNA, 15 bp, Homo sapiens
accagagccctctcc

SEQ ID NO: 228551 - DNA, 15 bp, Homo sapiens
aaccagagccctctc

SEQ ID NO: 228552 - DNA, 15 bp, Homo sapiens
caaccagagccctct

SEQ ID NO: 228553 - DNA, 15 bp, Homo sapiens
tcaaccagagccctc

SEQ ID NO: 228554 - DNA, 15 bp, Homo sapiens
gtcaaccagagccct

SEQ ID NO: 228555 - DNA, 15 bp, Homo sapiens
agtcaaccagagccc

SEQ ID NO: 228556 - DNA, 15 bp, Homo sapiens
aagtcaaccagagcc

SEQ ID NO: 228557 - DNA, 15 bp, Homo sapiens
caagtcaaccagagc

SEQ ID NO: 228558 - DNA, 15 bp, Homo sapiens
ccaagtcaaccagag

SEQ ID NO: 228559 - DNA, 15 bp, Homo sapiens
gccaagtcaaccaga

SEQ ID NO: 228560 - DNA, 15 bp, Homo sapiens
ggccaagtcaaccag

SEQ ID NO: 228561 - DNA, 15 bp, Homo sapiens
gggccaagtcaacca

SEQ ID NO: 228562 - DNA, 15 bp, Homo sapiens
cgggccaagtcaacc

SEQ ID NO: 228563 - DNA, 15 bp, Homo sapiens
tcgggccaagtcaac

SEQ ID NO: 228564 - DNA, 15 bp, Homo sapiens
ctcgggccaagtcaa

SEQ ID NO: 228565 - DNA, 15 bp, Homo sapiens
actcgggccaagtca

SEQ ID NO: 228566 - DNA, 15 bp, Homo sapiens
tactcgggccaagtc

SEQ ID NO: 228567 - DNA, 15 bp, Homo sapiens
ttactcgggccaagt

SEQ ID NO: 228568 - DNA, 15 bp, Homo sapiens
gttactcgggccaag

SEQ ID NO: 228569 - DNA, 15 bp, Homo sapiens
tgttactcgggccaa

SEQ ID NO: 228570 - DNA, 15 bp, Homo sapiens
atgttactcgggcca

SEQ ID NO: 228571 - DNA, 15 bp, Homo sapiens
catgttactcgggcc

SEQ ID NO: 228572 - DNA, 15 bp, Homo sapiens
ccatgttactcgggc

SEQ ID NO: 228573 - DNA, 15 bp, Homo sapiens
cccatgttactcggg

SEQ ID NO: 228574 - DNA, 15 bp, Homo sapiens
tcccatgttactcgg

SEQ ID NO: 228575 - DNA, 15 bp, Homo sapiens
gtcccatgttactcg

SEQ ID NO: 228576 - DNA, 15 bp, Homo sapiens
agtcccatgttactc

SEQ ID NO: 228577 - DNA, 15 bp, Homo sapiens
gagtcccatgttact

SEQ ID NO: 228578 - DNA, 15 bp, Homo sapiens
tgagtcccatgttac

SEQ ID NO: 228579 - DNA, 15 bp, Homo sapiens
ctgagtcccatgtta

SEQ ID NO: 228580 - DNA, 15 bp, Homo sapiens
cctgagtcccatgtt

SEQ ID NO: 228581 - DNA, 15 bp, Homo sapiens
ccctgagtcccatgt

SEQ ID NO: 228582 - DNA, 15 bp, Homo sapiens
tccctgagtcccatg

SEQ ID NO: 228583 - DNA, 15 bp, Homo sapiens
gtccctgagtcccat

SEQ ID NO: 228584 - DNA, 15 bp, Homo sapiens
agtccctgagtccca

SEQ ID NO: 228585 - DNA, 15 bp, Homo sapiens
cagtccctgagtccc

SEQ ID NO: 228586 - DNA, 15 bp, Homo sapiens
gcagtccctgagtcc

SEQ ID NO: 228587 - DNA, 15 bp, Homo sapiens
agcagtccctgagtc

SEQ ID NO: 228588 - DNA, 15 bp, Homo sapiens
tagcagtccctgagt

SEQ ID NO: 228589 - DNA, 15 bp, Homo sapiens
ctagcagtccctgag

SEQ ID NO: 228590 - DNA, 15 bp, Homo sapiens
cctagcagtccctga

SEQ ID NO: 228591 - DNA, 15 bp, Homo sapiens
tcctagcagtccctg

SEQ ID NO: 228592 - DNA, 15 bp, Homo sapiens
atcctagcagtccct

SEQ ID NO: 228593 - DNA, 15 bp, Homo sapiens
aatcctagcagtccc

SEQ ID NO: 228594 - DNA, 15 bp, Homo sapiens
caatcctagcagtcc

SEQ ID NO: 228595 - DNA, 15 bp, Homo sapiens
ccaatcctagcagtc

SEQ ID NO: 228596 - DNA, 15 bp, Homo sapiens
gccaatcctagcagt

SEQ ID NO: 228597 - DNA, 15 bp, Homo sapiens
tgccaatcctagcag

SEQ ID NO: 228598 - DNA, 15 bp, Homo sapiens
ctgccaatcctagca

SEQ ID NO: 228599 - DNA, 15 bp, Homo sapiens
tctgccaatcctagc

SEQ ID NO: 228600 - DNA, 15 bp, Homo sapiens
gtctgccaatcctag

SEQ ID NO: 228601 - DNA, 15 bp, Homo sapiens
ggtctgccaatccta

SEQ ID NO: 228602 - DNA, 15 bp, Homo sapiens
aggtctgccaatcct

SEQ ID NO: 228603 - DNA, 15 bp, Homo sapiens
aaggtctgccaatcc

SEQ ID NO: 228604 - DNA, 15 bp, Homo sapiens
gaaggtctgccaatc

SEQ ID NO: 228605 - DNA, 15 bp, Homo sapiens
agaaggtctgccaat

SEQ ID NO: 228606 - DNA, 15 bp, Homo sapiens
aagaaggtctgccaa

SEQ ID NO: 228607 - DNA, 15 bp, Homo sapiens
gaagaaggtctgcca

SEQ ID NO: 228608 - DNA, 15 bp, Homo sapiens
tgaagaaggtctgcc

SEQ ID NO: 228609 - DNA, 15 bp, Homo sapiens
atgaagaaggtctgc

SEQ ID NO: 228610 - DNA, 15 bp, Homo sapiens
tatgaagaaggtctg

SEQ ID NO: 228611 - DNA, 15 bp, Homo sapiens
ttatgaagaaggtct

SEQ ID NO: 228612 - DNA, 15 bp, Homo sapiens
attatgaagaaggtc

SEQ ID NO: 228613 - DNA, 15 bp, Homo sapiens
tattatgaagaaggt

SEQ ID NO: 228614 - DNA, 15 bp, Homo sapiens
atattatgaagaagg

SEQ ID NO: 228615 - DNA, 15 bp, Homo sapiens
gatattatgaagaag

SEQ ID NO: 228616 - DNA, 15 bp, Homo sapiens
tgatattatgaagaa

SEQ ID NO: 228617 - DNA, 15 bp, Homo sapiens
atgatattatgaaga

SEQ ID NO: 228618 - DNA, 15 bp, Homo sapiens
catgatattatgaag

SEQ ID NO: 228619 - DNA, 15 bp, Homo sapiens
gcatgatattatgaa

SEQ ID NO: 228620 - DNA, 15 bp, Homo sapiens
agcatgatattatga

SEQ ID NO: 228621 - DNA, 15 bp, Homo sapiens
tagcatgatattatg

SEQ ID NO: 228622 - DNA, 15 bp, Homo sapiens
ttagcatgatattat

SEQ ID NO: 228623 - DNA, 15 bp, Homo sapiens
tttagcatgatatta

SEQ ID NO: 228624 - DNA, 15 bp, Homo sapiens
atttagcatgatatt

SEQ ID NO: 228625 - DNA, 15 bp, Homo sapiens
catttagcatgatat

SEQ ID NO: 228626 - DNA, 15 bp, Homo sapiens
ccatttagcatgata

SEQ ID NO: 228627 - DNA, 15 bp, Homo sapiens
tccatttagcatgat

SEQ ID NO: 228628 - DNA, 15 bp, Homo sapiens
ctccatttagcatga

SEQ ID NO: 228629 - DNA, 15 bp, Homo sapiens
cctccatttagcatg

SEQ ID NO: 228630 - DNA, 15 bp, Homo sapiens
tcctccatttagcat

SEQ ID NO: 228631 - DNA, 15 bp, Homo sapiens
ttcctccatttagca

SEQ ID NO: 228632 - DNA, 15 bp, Homo sapiens
cttcctccatttagc

SEQ ID NO: 228633 - DNA, 15 bp, Homo sapiens
tcttcctccatttag

SEQ ID NO: 228634 - DNA, 15 bp, Homo sapiens
ttcttcctccattta

SEQ ID NO: 228635 - DNA, 15 bp, Homo sapiens
attcttcctccattt

SEQ ID NO: 228636 - DNA, 15 bp, Homo sapiens
gattcttcctccatt

SEQ ID NO: 228637 - DNA, 15 bp, Homo sapiens
ggattcttcctccat

SEQ ID NO: 228638 - DNA, 15 bp, Homo sapiens
tggattcttcctcca

SEQ ID NO: 228639 - DNA, 15 bp, Homo sapiens
ttggattcttcctcc

SEQ ID NO: 228640 - DNA, 15 bp, Homo sapiens
attggattcttcctc

SEQ ID NO: 228641 - DNA, 15 bp, Homo sapiens
gattggattcttcct

SEQ ID NO: 228642 - DNA, 15 bp, Homo sapiens
ggattggattcttcc

SEQ ID NO: 228643 - DNA, 15 bp, Homo sapiens
gggattggattcttc

SEQ ID NO: 228644 - DNA, 15 bp, Homo sapiens
tgggattggattctt

SEQ ID NO: 228645 - DNA, 15 bp, Homo sapiens
atgggattggattct

SEQ ID NO: 228646 - DNA, 15 bp, Homo sapiens
tatgggattggattc

SEQ ID NO: 228647 - DNA, 15 bp, Homo sapiens
ttatgggattggatt

SEQ ID NO: 228648 - DNA, 15 bp, Homo sapiens
tttatgggattggat

SEQ ID NO: 228649 - DNA, 15 bp, Homo sapiens
ctttatgggattgga

SEQ ID NO: 228650 - DNA, 15 bp, Homo sapiens
cctttatgggattgg

SEQ ID NO: 228651 - DNA, 15 bp, Homo sapiens
tcctttatgggattg

SEQ ID NO: 228652 - DNA, 15 bp, Homo sapiens
ttcctttatgggatt

SEQ ID NO: 228653 - DNA, 15 bp, Homo sapiens
cttcctttatgggat

SEQ ID NO: 228654 - DNA, 15 bp, Homo sapiens
ccttcctttatggga

SEQ ID NO: 228655 - DNA, 15 bp, Homo sapiens
cccttcctttatggg

SEQ ID NO: 228656 - DNA, 15 bp, Homo sapiens
ccccttcctttatgg

SEQ ID NO: 228657 - DNA, 15 bp, Homo sapiens
tccccttcctttatg

SEQ ID NO: 228658 - DNA, 15 bp, Homo sapiens
ttccccttcctttat

SEQ ID NO: 228659 - DNA, 15 bp, Homo sapiens
tttccccttccttta

SEQ ID NO: 228660 - DNA, 15 bp, Homo sapiens
ctttccccttccttt

SEQ ID NO: 228661 - DNA, 15 bp, Homo sapiens
actttccccttcctt

SEQ ID NO: 228662 - DNA, 15 bp, Homo sapiens
cactttccccttcct

SEQ ID NO: 228663 - DNA, 15 bp, Homo sapiens
tcactttccccttcc

SEQ ID NO: 228664 - DNA, 15 bp, Homo sapiens
ttcactttccccttc

SEQ ID NO: 228665 - DNA, 15 bp, Homo sapiens
ttttcactttcccct

SEQ ID NO: 228666 - DNA, 15 bp, Homo sapiens
tttttcactttcccc

SEQ ID NO: 228667 - DNA, 15 bp, Homo sapiens
atttttcactttccc

SEQ ID NO: 228668 - DNA, 15 bp, Homo sapiens
catttttcactttcc

SEQ ID NO: 228669 - DNA, 15 bp, Homo sapiens
ctaccatttttcact

SEQ ID NO: 228670 - DNA, 15 bp, Homo sapiens
actaccatttttcac

SEQ ID NO: 228671 - DNA, 15 bp, Homo sapiens
tactaccatttttca

SEQ ID NO: 228672 - DNA, 15 bp, Homo sapiens
ttactaccatttttc

SEQ ID NO: 228673 - DNA, 15 bp, Homo sapiens
tttactaccattttt

SEQ ID NO: 228674 - DNA, 15 bp, Homo sapiens
atttactaccatttt

SEQ ID NO: 228675 - DNA, 15 bp, Homo sapiens
catttactaccattt

SEQ ID NO: 228676 - DNA, 15 bp, Homo sapiens
gcatttactaccatt

SEQ ID NO: 228677 - DNA, 15 bp, Homo sapiens
tgcatttactaccat

SEQ ID NO: 228678 - DNA, 15 bp, Homo sapiens
ctgcatttactacca

SEQ ID NO: 228679 - DNA, 15 bp, Homo sapiens
tctgcatttactacc

SEQ ID NO: 228680 - DNA, 15 bp, Homo sapiens
gtctgcatttactac

SEQ ID NO: 228681 - DNA, 15 bp, Homo sapiens
tgtctgcatttacta

SEQ ID NO: 228682 - DNA, 15 bp, Homo sapiens
atgtctgcatttact

SEQ ID NO: 228683 - DNA, 15 bp, Homo sapiens
aatgtctgcatttac

SEQ ID NO: 228684 - DNA, 15 bp, Homo sapiens
gaatgtctgcattta

SEQ ID NO: 228685 - DNA, 15 bp, Homo sapiens
ggaatgtctgcattt

SEQ ID NO: 228686 - DNA, 15 bp, Homo sapiens
gggaatgtctgcatt

SEQ ID NO: 228687 - DNA, 15 bp, Homo sapiens
tgggaatgtctgcat

SEQ ID NO: 228688 - DNA, 15 bp, Homo sapiens
ttgggaatgtctgca

SEQ ID NO: 228689 - DNA, 15 bp, Homo sapiens
gttgggaatgtctgc

SEQ ID NO: 228690 - DNA, 15 bp, Homo sapiens
tgttgggaatgtctg

SEQ ID NO: 228691 - DNA, 15 bp, Homo sapiens
ttgttgggaatgtct

SEQ ID NO: 228692 - DNA, 15 bp, Homo sapiens
cttgttgggaatgtc

SEQ ID NO: 228693 - DNA, 15 bp, Homo sapiens
gcttgttgggaatgt

SEQ ID NO: 228694 - DNA, 15 bp, Homo sapiens
ggcttgttgggaatg

SEQ ID NO: 228695 - DNA, 15 bp, Homo sapiens
tggcttgttgggaat

SEQ ID NO: 228696 - DNA, 15 bp, Homo sapiens
ctggcttgttgggaa

SEQ ID NO: 228697 - DNA, 15 bp, Homo sapiens
tctggcttgttggga

SEQ ID NO: 228698 - DNA, 15 bp, Homo sapiens
ttctggcttgttggg

SEQ ID NO: 228699 - DNA, 15 bp, Homo sapiens
attctggcttgttgg

SEQ ID NO: 228700 - DNA, 15 bp, Homo sapiens
aattctggcttgttg

SEQ ID NO: 228701 - DNA, 15 bp, Homo sapiens
aaattctggcttgtt

SEQ ID NO: 228702 - DNA, 15 bp, Homo sapiens
gaaattctggcttgt

SEQ ID NO: 228703 - DNA, 15 bp, Homo sapiens
tgaaattctggcttg

SEQ ID NO: 228704 - DNA, 15 bp, Homo sapiens
gtgaaattctggctt

SEQ ID NO: 228705 - DNA, 15 bp, Homo sapiens
tgtgaaattctggct

SEQ ID NO: 228706 - DNA, 15 bp, Homo sapiens
ctgtgaaattctggc

SEQ ID NO: 228707 - DNA, 15 bp, Homo sapiens
cctgtgaaattctgg

SEQ ID NO: 228708 - DNA, 15 bp, Homo sapiens
acctgtgaaattctg

SEQ ID NO: 228709 - DNA, 15 bp, Homo sapiens
cacctgtgaaattct

SEQ ID NO: 228710 - DNA, 15 bp, Homo sapiens
gcacctgtgaaattc

SEQ ID NO: 228711 - DNA, 15 bp, Homo sapiens
agcacctgtgaaatt

SEQ ID NO: 228712 - DNA, 15 bp, Homo sapiens
cagcacctgtgaaat

SEQ ID NO: 228713 - DNA, 15 bp, Homo sapiens
tcagcacctgtgaaa

SEQ ID NO: 228714 - DNA, 15 bp, Homo sapiens
gtcagcacctgtgaa

SEQ ID NO: 228715 - DNA, 15 bp, Homo sapiens
ggtcagcacctgtga

SEQ ID NO: 228716 - DNA, 15 bp, Homo sapiens
tggtcagcacctgtg

SEQ ID NO: 228717 - DNA, 15 bp, Homo sapiens
atggtcagcacctgt

SEQ ID NO: 228718 - DNA, 15 bp, Homo sapiens
catggtcagcacctg

SEQ ID NO: 228719 - DNA, 15 bp, Homo sapiens
acatggtcagcacct

SEQ ID NO: 228720 - DNA, 15 bp, Homo sapiens
cacatggtcagcacc

SEQ ID NO: 228721 - DNA, 15 bp, Homo sapiens
gcacatggtcagcac

SEQ ID NO: 228722 - DNA, 15 bp, Homo sapiens
ggcacatggtcagca

SEQ ID NO: 228723 - DNA, 15 bp, Homo sapiens
tggcacatggtcagc

SEQ ID NO: 228724 - DNA, 15 bp, Homo sapiens
gtggcacatggtcag

SEQ ID NO: 228725 - DNA, 15 bp, Homo sapiens
tgtggcacatggtca

SEQ ID NO: 228726 - DNA, 15 bp, Homo sapiens
gtgtggcacatggtc

SEQ ID NO: 228727 - DNA, 15 bp, Homo sapiens
tgtgtggcacatggt

SEQ ID NO: 228728 - DNA, 15 bp, Homo sapiens
gtgtgtggcacatgg

SEQ ID NO: 228729 - DNA, 15 bp, Homo sapiens
agtgtgtggcacatg

SEQ ID NO: 228730 - DNA, 15 bp, Homo sapiens
cagtgtgtggcacat

SEQ ID NO: 228731 - DNA, 15 bp, Homo sapiens
acagtgtgtggcaca

SEQ ID NO: 228732 - DNA, 15 bp, Homo sapiens
cacagtgtgtggcac

SEQ ID NO: 228733 - DNA, 15 bp, Homo sapiens
gcacagtgtgtggca

SEQ ID NO: 228734 - DNA, 15 bp, Homo sapiens
ggcacagtgtgtggc

SEQ ID NO: 228735 - DNA, 15 bp, Homo sapiens
tggcacagtgtgtgg

SEQ ID NO: 228736 - DNA, 15 bp, Homo sapiens
ttggcacagtgtgtg

SEQ ID NO: 228737 - DNA, 15 bp, Homo sapiens
cttggcacagtgtgt

SEQ ID NO: 228738 - DNA, 15 bp, Homo sapiens
tcttggcacagtgtg

SEQ ID NO: 228739 - DNA, 15 bp, Homo sapiens
ttcttggcacagtgt

SEQ ID NO: 228740 - DNA, 15 bp, Homo sapiens
tttcttggcacagtg

SEQ ID NO: 228741 - DNA, 15 bp, Homo sapiens
gtttcttggcacagt

SEQ ID NO: 228742 - DNA, 15 bp, Homo sapiens
agtttcttggcacag

SEQ ID NO: 228743 - DNA, 15 bp, Homo sapiens
aagtttcttggcaca

SEQ ID NO: 228744 - DNA, 15 bp, Homo sapiens
taagtttcttggcac

SEQ ID NO: 228745 - DNA, 15 bp, Homo sapiens
gtaagtttcttggca

SEQ ID NO: 228746 - DNA, 15 bp, Homo sapiens
ggtaagtttcttggc

SEQ ID NO: 228747 - DNA, 15 bp, Homo sapiens
aggtaagtttcttgg

SEQ ID NO: 228748 - DNA, 15 bp, Homo sapiens
taggtaagtttcttg

SEQ ID NO: 228749 - DNA, 15 bp, Homo sapiens
gtaggtaagtttctt

SEQ ID NO: 228750 - DNA, 15 bp, Homo sapiens
ggtaggtaagtttct

SEQ ID NO: 228751 - DNA, 15 bp, Homo sapiens
aggtaggtaagtttc

SEQ ID NO: 228752 - DNA, 15 bp, Homo sapiens
aaggtaggtaagttt

SEQ ID NO: 228753 - DNA, 15 bp, Homo sapiens
caaggtaggtaagtt

SEQ ID NO: 228754 - DNA, 15 bp, Homo sapiens
acaaggtaggtaagt

SEQ ID NO: 228755 - DNA, 15 bp, Homo sapiens
aacaaggtaggtaag

SEQ ID NO: 228756 - DNA, 15 bp, Homo sapiens
aaacaaggtaggtaa

SEQ ID NO: 228757 - DNA, 15 bp, Homo sapiens
taaacaaggtaggta

SEQ ID NO: 228758 - DNA, 15 bp, Homo sapiens
ttaaacaaggtaggt

SEQ ID NO: 228759 - DNA, 15 bp, Homo sapiens
attaaacaaggtagg

SEQ ID NO: 228760 - DNA, 15 bp, Homo sapiens
aattaaacaaggtag

SEQ ID NO: 228761 - DNA, 15 bp, Homo sapiens
caattaaacaaggta

SEQ ID NO: 228762 - DNA, 15 bp, Homo sapiens
gcaattaaacaaggt

SEQ ID NO: 228763 - DNA, 15 bp, Homo sapiens
tgcaattaaacaagg

SEQ ID NO: 228764 - DNA, 15 bp, Homo sapiens
atgcaattaaacaag

SEQ ID NO: 228765 - DNA, 15 bp, Homo sapiens
aatgcaattaaacaa

SEQ ID NO: 228766 - DNA, 15 bp, Homo sapiens
gaatgcaattaaaca

SEQ ID NO: 228767 - DNA, 15 bp, Homo sapiens
agaatgcaattaaac

SEQ ID NO: 228768 - DNA, 15 bp, Homo sapiens
gagaatgcaattaaa

SEQ ID NO: 228769 - DNA, 15 bp, Homo sapiens
tgagaatgcaattaa

SEQ ID NO: 228770 - DNA, 15 bp, Homo sapiens
atgagaatgcaatta

SEQ ID NO: 228771 - DNA, 15 bp, Homo sapiens
tatgagaatgcaatt

SEQ ID NO: 228772 - DNA, 15 bp, Homo sapiens
ttatgagaatgcaat

SEQ ID NO: 228773 - DNA, 15 bp, Homo sapiens
attatgagaatgcaa

SEQ ID NO: 228774 - DNA, 15 bp, Homo sapiens
tattatgagaatgca

SEQ ID NO: 228775 - DNA, 15 bp, Homo sapiens
ttattatgagaatgc

SEQ ID NO: 228776 - DNA, 15 bp, Homo sapiens
attattatgagaatg

SEQ ID NO: 228777 - DNA, 15 bp, Homo sapiens
aattattatgagaat

SEQ ID NO: 228778 - DNA, 15 bp, Homo sapiens
gaattattatgagaa

SEQ ID NO: 228779 - DNA, 15 bp, Homo sapiens
ggaattattatgaga

SEQ ID NO: 228780 - DNA, 15 bp, Homo sapiens
aggaattattatgag

SEQ ID NO: 228781 - DNA, 15 bp, Homo sapiens
aaggaattattatga

SEQ ID NO: 228782 - DNA, 15 bp, Homo sapiens
caaggaattattatg

SEQ ID NO: 228783 - DNA, 15 bp, Homo sapiens
tcaaggaattattat

SEQ ID NO: 228784 - DNA, 15 bp, Homo sapiens
ttcaaggaattatta

SEQ ID NO: 228785 - DNA, 15 bp, Homo sapiens
cttcaaggaattatt

SEQ ID NO: 228786 - DNA, 15 bp, Homo sapiens
ccttcaaggaattat

SEQ ID NO: 228787 - DNA, 15 bp, Homo sapiens
cccttcaaggaatta

SEQ ID NO: 228788 - DNA, 15 bp, Homo sapiens
acccttcaaggaatt

SEQ ID NO: 228789 - DNA, 15 bp, Homo sapiens
cacccttcaaggaat

SEQ ID NO: 228790 - DNA, 15 bp, Homo sapiens
tcacccttcaaggaa

SEQ ID NO: 228791 - DNA, 15 bp, Homo sapiens
ttcacccttcaagga

SEQ ID NO: 228792 - DNA, 15 bp, Homo sapiens
attcacccttcaagg

SEQ ID NO: 228793 - DNA, 15 bp, Homo sapiens
tattcacccttcaag

SEQ ID NO: 228794 - DNA, 15 bp, Homo sapiens
gtattcacccttcaa

SEQ ID NO: 228795 - DNA, 15 bp, Homo sapiens
agtattcacccttca

SEQ ID NO: 228796 - DNA, 15 bp, Homo sapiens
aagtattcacccttc

SEQ ID NO: 228797 - DNA, 15 bp, Homo sapiens
taagtattcaccctt

SEQ ID NO: 228798 - DNA, 15 bp, Homo sapiens
gtaagtattcaccct

SEQ ID NO: 228799 - DNA, 15 bp, Homo sapiens
ggtaagtattcaccc

SEQ ID NO: 228800 - DNA, 15 bp, Homo sapiens
tggtaagtattcacc

SEQ ID NO: 228801 - DNA, 15 bp, Homo sapiens
gtggtaagtattcac

SEQ ID NO: 228802 - DNA, 15 bp, Homo sapiens
ggtggtaagtattca

SEQ ID NO: 228803 - DNA, 15 bp, Homo sapiens
gggtggtaagtattc

SEQ ID NO: 228804 - DNA, 15 bp, Homo sapiens
tgggtggtaagtatt

SEQ ID NO: 228805 - DNA, 15 bp, Homo sapiens
atgggtggtaagtat

SEQ ID NO: 228806 - DNA, 15 bp, Homo sapiens
aatgggtggtaagta

SEQ ID NO: 228807 - DNA, 15 bp, Homo sapiens
gaatgggtggtaagt

SEQ ID NO: 228808 - DNA, 15 bp, Homo sapiens
agaatgggtggtaag

SEQ ID NO: 228809 - DNA, 15 bp, Homo sapiens
tagaatgggtggtaa

SEQ ID NO: 228810 - DNA, 15 bp, Homo sapiens
gtagaatgggtggta

SEQ ID NO: 228811 - DNA, 15 bp, Homo sapiens
tgtagaatgggtggt

SEQ ID NO: 228812 - DNA, 15 bp, Homo sapiens
ctgtagaatgggtgg

SEQ ID NO: 228813 - DNA, 15 bp, Homo sapiens
tctgtagaatgggtg

SEQ ID NO: 228814 - DNA, 15 bp, Homo sapiens
atctgtagaatgggt

SEQ ID NO: 228815 - DNA, 15 bp, Homo sapiens
catctgtagaatggg

SEQ ID NO: 228816 - DNA, 15 bp, Homo sapiens
tcatctgtagaatgg

SEQ ID NO: 228817 - DNA, 15 bp, Homo sapiens
ctcatctgtagaatg

SEQ ID NO: 228818 - DNA, 15 bp, Homo sapiens
cctcatctgtagaat

SEQ ID NO: 228819 - DNA, 15 bp, Homo sapiens
tcctcatctgtagaa

SEQ ID NO: 228820 - DNA, 15 bp, Homo sapiens
ttcctcatctgtaga

SEQ ID NO: 228821 - DNA, 15 bp, Homo sapiens
tttcctcatctgtag

SEQ ID NO: 228822 - DNA, 15 bp, Homo sapiens
gtttcctcatctgta

SEQ ID NO: 228823 - DNA, 15 bp, Homo sapiens
agtttcctcatctgt

SEQ ID NO: 228824 - DNA, 15 bp, Homo sapiens
cagtttcctcatctg

SEQ ID NO: 228825 - DNA, 15 bp, Homo sapiens
tcagtttcctcatct

SEQ ID NO: 228826 - DNA, 15 bp, Homo sapiens
ctcagtttcctcatc

SEQ ID NO: 228827 - DNA, 15 bp, Homo sapiens
ctctcagtttcctca

SEQ ID NO: 228828 - DNA, 15 bp, Homo sapiens
actctcagtttcctc

SEQ ID NO: 228829 - DNA, 15 bp, Homo sapiens
gactctcagtttcct

SEQ ID NO: 228830 - DNA, 15 bp, Homo sapiens
agactctcagtttcc

SEQ ID NO: 228831 - DNA, 15 bp, Homo sapiens
cagactctcagtttc

SEQ ID NO: 228832 - DNA, 15 bp, Homo sapiens
tcagactctcagttt

SEQ ID NO: 228833 - DNA, 15 bp, Homo sapiens
ctcagactctcagtt

SEQ ID NO: 228834 - DNA, 15 bp, Homo sapiens
tctcagactctcagt

SEQ ID NO: 228835 - DNA, 15 bp, Homo sapiens
ctctcagactctcag

SEQ ID NO: 228836 - DNA, 15 bp, Homo sapiens
cctctcagactctca

SEQ ID NO: 228837 - DNA, 15 bp, Homo sapiens
gcctctcagactctc

SEQ ID NO: 228838 - DNA, 15 bp, Homo sapiens
agcctctcagactct

SEQ ID NO: 228839 - DNA, 15 bp, Homo sapiens
aagcctctcagactc

SEQ ID NO: 228840 - DNA, 15 bp, Homo sapiens
taagcctctcagact

SEQ ID NO: 228841 - DNA, 15 bp, Homo sapiens
ctaagcctctcagac

SEQ ID NO: 228842 - DNA, 15 bp, Homo sapiens
tctaagcctctcaga

SEQ ID NO: 228843 - DNA, 15 bp, Homo sapiens
ctctaagcctctcag

SEQ ID NO: 228844 - DNA, 15 bp, Homo sapiens
cctctaagcctctca

SEQ ID NO: 228845 - DNA, 15 bp, Homo sapiens
gcctctaagcctctc

SEQ ID NO: 228846 - DNA, 15 bp, Homo sapiens
tgcctctaagcctct

SEQ ID NO: 228847 - DNA, 15 bp, Homo sapiens
atgcctctaagcctc

SEQ ID NO: 228848 - DNA, 15 bp, Homo sapiens
tatgcctctaagcct

SEQ ID NO: 228849 - DNA, 15 bp, Homo sapiens
gtatgcctctaagcc

SEQ ID NO: 228850 - DNA, 15 bp, Homo sapiens
agtatgcctctaagc

SEQ ID NO: 228851 - DNA, 15 bp, Homo sapiens
cagtatgcctctaag

SEQ ID NO: 228852 - DNA, 15 bp, Homo sapiens
acagtatgcctctaa

SEQ ID NO: 228853 - DNA, 15 bp, Homo sapiens
gacagtatgcctcta

SEQ ID NO: 228854 - DNA, 15 bp, Homo sapiens
agacagtatgcctct

SEQ ID NO: 228855 - DNA, 15 bp, Homo sapiens
aagacagtatgcctc

SEQ ID NO: 228856 - DNA, 15 bp, Homo sapiens
gaagacagtatgcct

SEQ ID NO: 228857 - DNA, 15 bp, Homo sapiens
agaagacagtatgcc

SEQ ID NO: 228858 - DNA, 15 bp, Homo sapiens
tagaagacagtatgc

SEQ ID NO: 228859 - DNA, 15 bp, Homo sapiens
atagaagacagtatg

SEQ ID NO: 228860 - DNA, 15 bp, Homo sapiens
catagaagacagtat

SEQ ID NO: 228861 - DNA, 15 bp, Homo sapiens
acatagaagacagta

SEQ ID NO: 228862 - DNA, 15 bp, Homo sapiens
cacatagaagacagt

SEQ ID NO: 228863 - DNA, 15 bp, Homo sapiens
tcacatagaagacag

SEQ ID NO: 228864 - DNA, 15 bp, Homo sapiens
gtcacatagaagaca

SEQ ID NO: 228865 - DNA, 15 bp, Homo sapiens
tgtcacatagaagac

SEQ ID NO: 228866 - DNA, 15 bp, Homo sapiens
ctgtcacatagaaga

SEQ ID NO: 228867 - DNA, 15 bp, Homo sapiens
tctgtcacatagaag

SEQ ID NO: 228868 - DNA, 15 bp, Homo sapiens
ctctgtcacatagaa

SEQ ID NO: 228869 - DNA, 15 bp, Homo sapiens
gctctgtcacataga

SEQ ID NO: 228870 - DNA, 15 bp, Homo sapiens
ggctctgtcacatag

SEQ ID NO: 228871 - DNA, 15 bp, Homo sapiens
tggctctgtcacata

SEQ ID NO: 228872 - DNA, 15 bp, Homo sapiens
ttggctctgtcacat

SEQ ID NO: 228873 - DNA, 15 bp, Homo sapiens
tttggctctgtcaca

SEQ ID NO: 228874 - DNA, 15 bp, Homo sapiens
ttttggctctgtcac

SEQ ID NO: 228875 - DNA, 15 bp, Homo sapiens
attttggctctgtca

SEQ ID NO: 228876 - DNA, 15 bp, Homo sapiens
tattttggctctgtc

SEQ ID NO: 228877 - DNA, 15 bp, Homo sapiens
gtattttggctctgt

SEQ ID NO: 228878 - DNA, 15 bp, Homo sapiens
tgtattttggctctg

SEQ ID NO: 228879 - DNA, 15 bp, Homo sapiens
ttgtattttggctct

SEQ ID NO: 228880 - DNA, 15 bp, Homo sapiens
tttgtattttggctc

SEQ ID NO: 228881 - DNA, 15 bp, Homo sapiens
gtttgtattttggct

SEQ ID NO: 228882 - DNA, 15 bp, Homo sapiens
agtttgtattttggc

SEQ ID NO: 228883 - DNA, 15 bp, Homo sapiens
tagtttgtattttgg

SEQ ID NO: 228884 - DNA, 15 bp, Homo sapiens
ttagtttgtattttg

SEQ ID NO: 228885 - DNA, 15 bp, Homo sapiens
cttagtttgtatttt

SEQ ID NO: 228886 - DNA, 15 bp, Homo sapiens
ccttagtttgtattt

SEQ ID NO: 228887 - DNA, 15 bp, Homo sapiens
gccttagtttgtatt

SEQ ID NO: 228888 - DNA, 15 bp, Homo sapiens
agccttagtttgtat

SEQ ID NO: 228889 - DNA, 15 bp, Homo sapiens
aagccttagtttgta

SEQ ID NO: 228890 - DNA, 15 bp, Homo sapiens
taagccttagtttgt

SEQ ID NO: 228891 - DNA, 15 bp, Homo sapiens
ataagccttagtttg

SEQ ID NO: 228892 - DNA, 15 bp, Homo sapiens
cataagccttagttt

SEQ ID NO: 228893 - DNA, 15 bp, Homo sapiens
acataagccttagtt

SEQ ID NO: 228894 - DNA, 15 bp, Homo sapiens
gacataagccttagt

SEQ ID NO: 228895 - DNA, 15 bp, Homo sapiens
tgacataagccttag

SEQ ID NO: 228896 - DNA, 15 bp, Homo sapiens
gtgacataagcctta

SEQ ID NO: 228897 - DNA, 15 bp, Homo sapiens
tgtgacataagcctt

SEQ ID NO: 228898 - DNA, 15 bp, Homo sapiens
ttgtgacataagcct

SEQ ID NO: 228899 - DNA, 15 bp, Homo sapiens
tttgtgacataagcc

SEQ ID NO: 228900 - DNA, 15 bp, Homo sapiens
ttttgtgacataagc

SEQ ID NO: 228901 - DNA, 15 bp, Homo sapiens
gttttgtgacataag

SEQ ID NO: 228902 - DNA, 15 bp, Homo sapiens
agttttgtgacataa

SEQ ID NO: 228903 - DNA, 15 bp, Homo sapiens
aagttttgtgacata

SEQ ID NO: 228904 - DNA, 15 bp, Homo sapiens
caagttttgtgacat

SEQ ID NO: 228905 - DNA, 15 bp, Homo sapiens
tcaagttttgtgaca

SEQ ID NO: 228906 - DNA, 15 bp, Homo sapiens
atcaagttttgtgac

SEQ ID NO: 228907 - DNA, 15 bp, Homo sapiens
catcaagttttgtga

SEQ ID NO: 228908 - DNA, 15 bp, Homo sapiens
gcatcaagttttgtg

SEQ ID NO: 228909 - DNA, 15 bp, Homo sapiens
agcatcaagttttgt

SEQ ID NO: 228910 - DNA, 15 bp, Homo sapiens
gagcatcaagttttg

SEQ ID NO: 228911 - DNA, 15 bp, Homo sapiens
agagcatcaagtttt

SEQ ID NO: 228912 - DNA, 15 bp, Homo sapiens
aagagcatcaagttt

SEQ ID NO: 228913 - DNA, 15 bp, Homo sapiens
taagagcatcaagtt

SEQ ID NO: 228914 - DNA, 15 bp, Homo sapiens
ttaagagcatcaagt

SEQ ID NO: 228915 - DNA, 15 bp, Homo sapiens
gttaagagcatcaag

SEQ ID NO: 228916 - DNA, 15 bp, Homo sapiens
agttaagagcatcaa

SEQ ID NO: 228917 - DNA, 15 bp, Homo sapiens
cagttaagagcatca

SEQ ID NO: 228918 - DNA, 15 bp, Homo sapiens
gcagttaagagcatc

SEQ ID NO: 228919 - DNA, 15 bp, Homo sapiens
ggcagttaagagcat

SEQ ID NO: 228920 - DNA, 15 bp, Homo sapiens
tggcagttaagagca

SEQ ID NO: 228921 - DNA, 15 bp, Homo sapiens
atggcagttaagagc

SEQ ID NO: 228922 - DNA, 15 bp, Homo sapiens
tatggcagttaagag

SEQ ID NO: 228923 - DNA, 15 bp, Homo sapiens
ctatggcagttaaga

SEQ ID NO: 228924 - DNA, 15 bp, Homo sapiens
actatggcagttaag

SEQ ID NO: 228925 - DNA, 15 bp, Homo sapiens
cactatggcagttaa

SEQ ID NO: 228926 - DNA, 15 bp, Homo sapiens
acactatggcagtta

SEQ ID NO: 228927 - DNA, 15 bp, Homo sapiens
tacactatggcagtt

SEQ ID NO: 228928 - DNA, 15 bp, Homo sapiens
gtacactatggcagt

SEQ ID NO: 228929 - DNA, 15 bp, Homo sapiens
agtacactatggcag

SEQ ID NO: 228930 - DNA, 15 bp, Homo sapiens
tagtacactatggca

SEQ ID NO: 228931 - DNA, 15 bp, Homo sapiens
atagtacactatggc

SEQ ID NO: 228932 - DNA, 15 bp, Homo sapiens
gatagtacactatgg

SEQ ID NO: 228933 - DNA, 15 bp, Homo sapiens
agatagtacactatg

SEQ ID NO: 228934 - DNA, 15 bp, Homo sapiens
aagatagtacactat

SEQ ID NO: 228935 - DNA, 15 bp, Homo sapiens
taagatagtacacta

SEQ ID NO: 228936 - DNA, 15 bp, Homo sapiens
ttaagatagtacact

SEQ ID NO: 228937 - DNA, 15 bp, Homo sapiens
tttaagatagtacac

SEQ ID NO: 228938 - DNA, 15 bp, Homo sapiens
gtttaagatagtaca

SEQ ID NO: 228939 - DNA, 15 bp, Homo sapiens
agtttaagatagtac

SEQ ID NO: 228940 - DNA, 15 bp, Homo sapiens
tagtttaagatagta

SEQ ID NO: 228941 - DNA, 15 bp, Homo sapiens
gtagtttaagatagt

SEQ ID NO: 228942 - DNA, 15 bp, Homo sapiens
agtagtttaagatag

SEQ ID NO: 228943 - DNA, 15 bp, Homo sapiens
aagtagtttaagata

SEQ ID NO: 228944 - DNA, 15 bp, Homo sapiens
gaagtagtttaagat

SEQ ID NO: 228945 - DNA, 15 bp, Homo sapiens
ggaagtagtttaaga

SEQ ID NO: 228946 - DNA, 15 bp, Homo sapiens
cggaagtagtttaag

SEQ ID NO: 228947 - DNA, 15 bp, Homo sapiens
acggaagtagtttaa

SEQ ID NO: 228948 - DNA, 15 bp, Homo sapiens
tacggaagtagttta

SEQ ID NO: 228949 - DNA, 15 bp, Homo sapiens
ttacggaagtagttt

SEQ ID NO: 228950 - DNA, 15 bp, Homo sapiens
attacggaagtagtt

SEQ ID NO: 228951 - DNA, 15 bp, Homo sapiens
tattacggaagtagt

SEQ ID NO: 228952 - DNA, 15 bp, Homo sapiens
ttattacggaagtag

SEQ ID NO: 228953 - DNA, 15 bp, Homo sapiens
attattacggaagta

SEQ ID NO: 228954 - DNA, 15 bp, Homo sapiens
aattattacggaagt

SEQ ID NO: 228955 - DNA, 15 bp, Homo sapiens
taattattacggaag

SEQ ID NO: 228956 - DNA, 15 bp, Homo sapiens
ctaattattacggaa

SEQ ID NO: 228957 - DNA, 15 bp, Homo sapiens
actaattattacgga

SEQ ID NO: 228958 - DNA, 15 bp, Homo sapiens
tactaattattacgg

SEQ ID NO: 228959 - DNA, 15 bp, Homo sapiens
atactaattattacg

SEQ ID NO: 228960 - DNA, 15 bp, Homo sapiens
aatactaattattac

SEQ ID NO: 228961 - DNA, 15 bp, Homo sapiens
aaatactaattatta

SEQ ID NO: 228962 - DNA, 15 bp, Homo sapiens
caaatactaattatt

SEQ ID NO: 228963 - DNA, 15 bp, Homo sapiens
acaaatactaattat

SEQ ID NO: 228964 - DNA, 15 bp, Homo sapiens
tacaaatactaatta

SEQ ID NO: 228965 - DNA, 15 bp, Homo sapiens
ctacaaatactaatt

SEQ ID NO: 228966 - DNA, 15 bp, Homo sapiens
gctacaaatactaat

SEQ ID NO: 228967 - DNA, 15 bp, Homo sapiens
agctacaaatactaa

SEQ ID NO: 228968 - DNA, 15 bp, Homo sapiens
tagctacaaatacta

SEQ ID NO: 228969 - DNA, 15 bp, Homo sapiens
atagctacaaatact

SEQ ID NO: 228970 - DNA, 15 bp, Homo sapiens
aatagctacaaatac

SEQ ID NO: 228971 - DNA, 15 bp, Homo sapiens
gaatagctacaaata

SEQ ID NO: 228972 - DNA, 15 bp, Homo sapiens
tgaatagctacaaat

SEQ ID NO: 228973 - DNA, 15 bp, Homo sapiens
ttgaatagctacaaa

SEQ ID NO: 228974 - DNA, 15 bp, Homo sapiens
attgaatagctacaa

SEQ ID NO: 228975 - DNA, 15 bp, Homo sapiens
tattgaatagctaca

SEQ ID NO: 228976 - DNA, 15 bp, Homo sapiens
ctattgaatagctac

SEQ ID NO: 228977 - DNA, 15 bp, Homo sapiens
tctattgaatagcta

SEQ ID NO: 228978 - DNA, 15 bp, Homo sapiens
ttctattgaatagct

SEQ ID NO: 228979 - DNA, 15 bp, Homo sapiens
tttctattgaatagc

SEQ ID NO: 228980 - DNA, 15 bp, Homo sapiens
gtttctattgaatag

SEQ ID NO: 228981 - DNA, 15 bp, Homo sapiens
tgtttctattgaata

SEQ ID NO: 228982 - DNA, 15 bp, Homo sapiens
ttgtttctattgaat

SEQ ID NO: 228983 - DNA, 15 bp, Homo sapiens
gttgtttctattgaa

SEQ ID NO: 228984 - DNA, 15 bp, Homo sapiens
tgttgtttctattga

SEQ ID NO: 228985 - DNA, 15 bp, Homo sapiens
atgttgtttctattg

SEQ ID NO: 228986 - DNA, 15 bp, Homo sapiens
aatgttgtttctatt

SEQ ID NO: 228987 - DNA, 15 bp, Homo sapiens
aaatgttgtttctat

SEQ ID NO: 228988 - DNA, 15 bp, Homo sapiens
aaaatgttgtttcta

SEQ ID NO: 228989 - DNA, 15 bp, Homo sapiens
taaaatgttgtttct

SEQ ID NO: 228990 - DNA, 15 bp, Homo sapiens
ataaaatgttgtttc

SEQ ID NO: 228991 - DNA, 15 bp, Homo sapiens
aataaaatgttgttt

SEQ ID NO: 228992 - DNA, 15 bp, Homo sapiens
aaataaaatgttgtt

SEQ ID NO: 228993 - DNA, 15 bp, Homo sapiens
aaaataaaatgttgt

SEQ ID NO: 228994 - DNA, 15 bp, Homo sapiens
gaaaataaaatgttg

SEQ ID NO: 228995 - DNA, 15 bp, Homo sapiens
tgaaaataaaatgtt

SEQ ID NO: 228996 - DNA, 15 bp, Homo sapiens
atgaaaataaaatgt

SEQ ID NO: 228997 - DNA, 15 bp, Homo sapiens
aatgaaaataaaatg

SEQ ID NO: 228998 - DNA, 15 bp, Homo sapiens
gaagaaaatgaaaat

SEQ ID NO: 228999 - DNA, 15 bp, Homo sapiens
cgaagaaaatgaaaa

SEQ ID NO: 229000 - DNA, 15 bp, Homo sapiens
tcgaagaaaatgaaa

SEQ ID NO: 229001 - DNA, 15 bp, Homo sapiens
atcgaagaaaatgaa

SEQ ID NO: 229002 - DNA, 15 bp, Homo sapiens
aatcgaagaaaatga

SEQ ID NO: 229003 - DNA, 15 bp, Homo sapiens
aaatcgaagaaaatg

SEQ ID NO: 229004 - DNA, 15 bp, Homo sapiens
aaaatcgaagaaaat

SEQ ID NO: 229005 - DNA, 15 bp, Homo sapiens
taaaatcgaagaaaa

SEQ ID NO: 229006 - DNA, 15 bp, Homo sapiens
ttaaaatcgaagaaa

SEQ ID NO: 229007 - DNA, 15 bp, Homo sapiens
tttaaaatcgaagaa

SEQ ID NO: 229008 - DNA, 15 bp, Homo sapiens
ttttaaaatcgaaga

SEQ ID NO: 229009 - DNA, 15 bp, Homo sapiens
attttaaaatcgaag

SEQ ID NO: 229010 - DNA, 15 bp, Homo sapiens
tattttaaaatcgaa

SEQ ID NO: 229011 - DNA, 15 bp, Homo sapiens
ttattttaaaatcga

SEQ ID NO: 229012 - DNA, 15 bp, Homo sapiens
attattttaaaatcg

SEQ ID NO: 229013 - DNA, 15 bp, Homo sapiens
aattattttaaaatc

SEQ ID NO: 229014 - DNA, 15 bp, Homo sapiens
gaattattttaaaat

SEQ ID NO: 229015 - DNA, 15 bp, Homo sapiens
tgaattattttaaaa

SEQ ID NO: 229016 - DNA, 15 bp, Homo sapiens
gtgaattattttaaa

SEQ ID NO: 229017 - DNA, 15 bp, Homo sapiens
tgtgaattattttaa

SEQ ID NO: 229018 - DNA, 15 bp, Homo sapiens
gtgtgaattatttta

SEQ ID NO: 229019 - DNA, 15 bp, Homo sapiens
tgtgtgaattatttt

SEQ ID NO: 229020 - DNA, 15 bp, Homo sapiens
tactgtgtgaattat

SEQ ID NO: 229021 - DNA, 15 bp, Homo sapiens
ttactgtgtgaatta

SEQ ID NO: 229022 - DNA, 15 bp, Homo sapiens
attactgtgtgaatt

SEQ ID NO: 229023 - DNA, 15 bp, Homo sapiens
aattactgtgtgaat

SEQ ID NO: 229024 - DNA, 15 bp, Homo sapiens
caattactgtgtgaa

SEQ ID NO: 229025 - DNA, 15 bp, Homo sapiens
tcaattactgtgtga

SEQ ID NO: 229026 - DNA, 15 bp, Homo sapiens
ttcaattactgtgtg

SEQ ID NO: 229027 - DNA, 15 bp, Homo sapiens
attcaattactgtgt

SEQ ID NO: 229028 - DNA, 15 bp, Homo sapiens
tattcaattactgtg

SEQ ID NO: 229029 - DNA, 15 bp, Homo sapiens
atattcaattactgt

SEQ ID NO: 229030 - DNA, 15 bp, Homo sapiens
catattcaattactg

SEQ ID NO: 229031 - DNA, 15 bp, Homo sapiens
acatattcaattact

SEQ ID NO: 229032 - DNA, 15 bp, Homo sapiens
aacatattcaattac

SEQ ID NO: 229033 - DNA, 15 bp, Homo sapiens
aaacatattcaatta

SEQ ID NO: 229034 - DNA, 15 bp, Homo sapiens
taaacatattcaatt

SEQ ID NO: 229035 - DNA, 15 bp, Homo sapiens
ataaacatattcaat

SEQ ID NO: 229036 - DNA, 15 bp, Homo sapiens
tataaacatattcaa

SEQ ID NO: 229037 - DNA, 15 bp, Homo sapiens
ttataaacatattca

SEQ ID NO: 229038 - DNA, 15 bp, Homo sapiens
gttataaacatattc

SEQ ID NO: 229039 - DNA, 15 bp, Homo sapiens
agttataaacatatt

SEQ ID NO: 229040 - DNA, 15 bp, Homo sapiens
gagttataaacatat

SEQ ID NO: 229041 - DNA, 15 bp, Homo sapiens
agagttataaacata

SEQ ID NO: 229042 - DNA, 15 bp, Homo sapiens
aagagttataaacat

SEQ ID NO: 229043 - DNA, 15 bp, Homo sapiens
aaagagttataaaca

SEQ ID NO: 229044 - DNA, 15 bp, Homo sapiens
caaagagttataaac

SEQ ID NO: 229045 - DNA, 15 bp, Homo sapiens
gcaaagagttataaa

SEQ ID NO: 229046 - DNA, 15 bp, Homo sapiens
agcaaagagttataa

SEQ ID NO: 229047 - DNA, 15 bp, Homo sapiens
aagcaaagagttata

SEQ ID NO: 229048 - DNA, 15 bp, Homo sapiens
aaagcaaagagttat

SEQ ID NO: 229049 - DNA, 15 bp, Homo sapiens
aaaagcaaagagtta

SEQ ID NO: 229050 - DNA, 15 bp, Homo sapiens
aaaaagcaaagagtt

SEQ ID NO: 229051 - DNA, 15 bp, Homo sapiens
aaaaaagcaaagagt

SEQ ID NO: 229052 - DNA, 15 bp, Homo sapiens
gaaaaaagcaaagag

SEQ ID NO: 229053 - DNA, 15 bp, Homo sapiens
agaaaaaagcaaaga

SEQ ID NO: 229054 - DNA, 15 bp, Homo sapiens
aagaaaaaagcaaag

SEQ ID NO: 229055 - DNA, 15 bp, Homo sapiens
aaagaaaaaagcaaa

SEQ ID NO: 229056 - DNA, 15 bp, Homo sapiens
taaagaaaaaagcaa

SEQ ID NO: 229057 - DNA, 15 bp, Homo sapiens
ataaagaaaaaagca

SEQ ID NO: 229058 - DNA, 15 bp, Homo sapiens
aataaagaaaaaagc

SEQ ID NO: 229059 - DNA, 15 bp, Homo sapiens
caataaagaaaaaag

SEQ ID NO: 229060 - DNA, 15 bp, Homo sapiens
acaataaagaaaaaa

SEQ ID NO: 229061 - DNA, 15 bp, Homo sapiens
aacaataaagaaaaa

SEQ ID NO: 229062 - DNA, 15 bp, Homo sapiens
caacaataaagaaaa

SEQ ID NO: 229063 - DNA, 15 bp, Homo sapiens
gcaacaataaagaaa

SEQ ID NO: 229064 - DNA, 15 bp, Homo sapiens
agcaacaataaagaa

SEQ ID NO: 229065 - DNA, 15 bp, Homo sapiens
gagcaacaataaaga

SEQ ID NO: 229066 - DNA, 15 bp, Homo sapiens
agagcaacaataaag

SEQ ID NO: 229067 - DNA, 15 bp, Homo sapiens
aagagcaacaataaa

SEQ ID NO: 229068 - DNA, 15 bp, Homo sapiens
aaagagcaacaataa

SEQ ID NO: 229069 - DNA, 15 bp, Homo sapiens
gaaagagcaacaata

SEQ ID NO: 229070 - DNA, 15 bp, Homo sapiens
agaaagagcaacaat

SEQ ID NO: 229071 - DNA, 15 bp, Homo sapiens
aagaaagagcaacaa

SEQ ID NO: 229072 - DNA, 15 bp, Homo sapiens
gaagaaagagcaaca

SEQ ID NO: 229073 - DNA, 15 bp, Homo sapiens
tgaagaaagagcaac

SEQ ID NO: 229074 - DNA, 15 bp, Homo sapiens
gtgaagaaagagcaa

SEQ ID NO: 229075 - DNA, 15 bp, Homo sapiens
agtgaagaaagagca

SEQ ID NO: 229076 - DNA, 15 bp, Homo sapiens
cagtgaagaaagagc

SEQ ID NO: 229077 - DNA, 15 bp, Homo sapiens
tcagtgaagaaagag

SEQ ID NO: 229078 - DNA, 15 bp, Homo sapiens
ttcagtgaagaaaga

SEQ ID NO: 229079 - DNA, 15 bp, Homo sapiens
tttcagtgaagaaag

SEQ ID NO: 229080 - DNA, 15 bp, Homo sapiens
atttcagtgaagaaa

SEQ ID NO: 229081 - DNA, 15 bp, Homo sapiens
tatttcagtgaagaa

SEQ ID NO: 229082 - DNA, 15 bp, Homo sapiens
gtatttcagtgaaga

SEQ ID NO: 229083 - DNA, 15 bp, Homo sapiens
ggtatttcagtgaag

SEQ ID NO: 229084 - DNA, 15 bp, Homo sapiens
tggtatttcagtgaa

SEQ ID NO: 229085 - DNA, 15 bp, Homo sapiens
gtggtatttcagtga

SEQ ID NO: 229086 - DNA, 15 bp, Homo sapiens
cgtggtatttcagtg

SEQ ID NO: 229087 - DNA, 15 bp, Homo sapiens
gcgtggtatttcagt

SEQ ID NO: 229088 - DNA, 15 bp, Homo sapiens
agcgtggtatttcag

SEQ ID NO: 229089 - DNA, 15 bp, Homo sapiens
cagcgtggtatttca

SEQ ID NO: 229090 - DNA, 15 bp, Homo sapiens
gcagcgtggtatttc

SEQ ID NO: 229091 - DNA, 15 bp, Homo sapiens
tgcagcgtggtattt

SEQ ID NO: 229092 - DNA, 15 bp, Homo sapiens
atgcagcgtggtatt

SEQ ID NO: 229093 - DNA, 15 bp, Homo sapiens
tatgcagcgtggtat

SEQ ID NO: 229094 - DNA, 15 bp, Homo sapiens
ttatgcagcgtggta

SEQ ID NO: 229095 - DNA, 15 bp, Homo sapiens
attatgcagcgtggt

SEQ ID NO: 229096 - DNA, 15 bp, Homo sapiens
cattatgcagcgtgg

SEQ ID NO: 229097 - DNA, 15 bp, Homo sapiens
ccattatgcagcgtg

SEQ ID NO: 229098 - DNA, 15 bp, Homo sapiens
tccattatgcagcgt

SEQ ID NO: 229099 - DNA, 15 bp, Homo sapiens
ttccattatgcagcg

SEQ ID NO: 229100 - DNA, 15 bp, Homo sapiens
attccattatgcagc

SEQ ID NO: 229101 - DNA, 15 bp, Homo sapiens
gattccattatgcag

SEQ ID NO: 229102 - DNA, 15 bp, Homo sapiens
tgattccattatgca

SEQ ID NO: 229103 - DNA, 15 bp, Homo sapiens
atgattccattatgc

SEQ ID NO: 229104 - DNA, 15 bp, Homo sapiens
tatgattccattatg

SEQ ID NO: 229105 - DNA, 15 bp, Homo sapiens
tttatgattccatta

SEQ ID NO: 229106 - DNA, 15 bp, Homo sapiens
gtttatgattccatt

SEQ ID NO: 229107 - DNA, 15 bp, Homo sapiens
tgtttatgattccat

SEQ ID NO: 229108 - DNA, 15 bp, Homo sapiens
ctgtttatgattcca

SEQ ID NO: 229109 - DNA, 15 bp, Homo sapiens
actgtttatgattcc

SEQ ID NO: 229110 - DNA, 15 bp, Homo sapiens
aactgtttatgattc

SEQ ID NO: 229111 - DNA, 15 bp, Homo sapiens
gaactgtttatgatt

SEQ ID NO: 229112 - DNA, 15 bp, Homo sapiens
tgaactgtttatgat

SEQ ID NO: 229113 - DNA, 15 bp, Homo sapiens
gtgaactgtttatga

SEQ ID NO: 229114 - DNA, 15 bp, Homo sapiens
agtgaactgtttatg

SEQ ID NO: 229115 - DNA, 15 bp, Homo sapiens
cagtgaactgtttat

SEQ ID NO: 229116 - DNA, 15 bp, Homo sapiens
tcagtgaactgttta

SEQ ID NO: 229117 - DNA, 15 bp, Homo sapiens
atcagtgaactgttt

SEQ ID NO: 229118 - DNA, 15 bp, Homo sapiens
aatcagtgaactgtt

SEQ ID NO: 229119 - DNA, 15 bp, Homo sapiens
aaatcagtgaactgt

SEQ ID NO: 229120 - DNA, 15 bp, Homo sapiens
gaaatcagtgaactg

SEQ ID NO: 229121 - DNA, 15 bp, Homo sapiens
ggaaatcagtgaact

SEQ ID NO: 229122 - DNA, 15 bp, Homo sapiens
aggaaatcagtgaac

SEQ ID NO: 229123 - DNA, 15 bp, Homo sapiens
taggaaatcagtgaa

SEQ ID NO: 229124 - DNA, 15 bp, Homo sapiens
ttaggaaatcagtga

SEQ ID NO: 229125 - DNA, 15 bp, Homo sapiens
gttaggaaatcagtg

SEQ ID NO: 229126 - DNA, 15 bp, Homo sapiens
tgttaggaaatcagt

SEQ ID NO: 229127 - DNA, 15 bp, Homo sapiens
gtgttaggaaatcag

SEQ ID NO: 229128 - DNA, 15 bp, Homo sapiens
ggtgttaggaaatca

SEQ ID NO: 229129 - DNA, 15 bp, Homo sapiens
cggtgttaggaaatc

SEQ ID NO: 229130 - DNA, 15 bp, Homo sapiens
tcggtgttaggaaat

SEQ ID NO: 229131 - DNA, 15 bp, Homo sapiens
ctcggtgttaggaaa

SEQ ID NO: 229132 - DNA, 15 bp, Homo sapiens
cctcggtgttaggaa

SEQ ID NO: 229133 - DNA, 15 bp, Homo sapiens
ccctcggtgttagga

SEQ ID NO: 229134 - DNA, 15 bp, Homo sapiens
tccctcggtgttagg

SEQ ID NO: 229135 - DNA, 15 bp, Homo sapiens
ctccctcggtgttag

SEQ ID NO: 229136 - DNA, 15 bp, Homo sapiens
tctccctcggtgtta

SEQ ID NO: 229137 - DNA, 15 bp, Homo sapiens
ttctccctcggtgtt

SEQ ID NO: 229138 - DNA, 15 bp, Homo sapiens
cttctccctcggtgt

SEQ ID NO: 229139 - DNA, 15 bp, Homo sapiens
ccttctccctcggtg

SEQ ID NO: 229140 - DNA, 15 bp, Homo sapiens
accttctccctcggt

SEQ ID NO: 229141 - DNA, 15 bp, Homo sapiens
caccttctccctcgg

SEQ ID NO: 229142 - DNA, 15 bp, Homo sapiens
acaccttctccctcg

SEQ ID NO: 229143 - DNA, 15 bp, Homo sapiens
gacaccttctccctc

SEQ ID NO: 229144 - DNA, 15 bp, Homo sapiens
agacaccttctccct

SEQ ID NO: 229145 - DNA, 15 bp, Homo sapiens
tagacaccttctccc

SEQ ID NO: 229146 - DNA, 15 bp, Homo sapiens
ctagacaccttctcc

SEQ ID NO: 229147 - DNA, 15 bp, Homo sapiens
cctagacaccttctc

SEQ ID NO: 229148 - DNA, 15 bp, Homo sapiens
gcctagacaccttct

SEQ ID NO: 229149 - DNA, 15 bp, Homo sapiens
tgcctagacaccttc

SEQ ID NO: 229150 - DNA, 15 bp, Homo sapiens
ttgcctagacacctt

SEQ ID NO: 229151 - DNA, 15 bp, Homo sapiens
attgcctagacacct

SEQ ID NO: 229152 - DNA, 15 bp, Homo sapiens
tattgcctagacacc

SEQ ID NO: 229153 - DNA, 15 bp, Homo sapiens
atattgcctagacac

SEQ ID NO: 229154 - DNA, 15 bp, Homo sapiens
aatattgcctagaca

SEQ ID NO: 229155 - DNA, 15 bp, Homo sapiens
taatattgcctagac

SEQ ID NO: 229156 - DNA, 15 bp, Homo sapiens
ctaatattgcctaga

SEQ ID NO: 229157 - DNA, 15 bp, Homo sapiens
tctaatattgcctag

SEQ ID NO: 229158 - DNA, 15 bp, Homo sapiens
gtctaatattgccta

SEQ ID NO: 229159 - DNA, 15 bp, Homo sapiens
agtctaatattgcct

SEQ ID NO: 229160 - DNA, 15 bp, Homo sapiens
aagtctaatattgcc

SEQ ID NO: 229161 - DNA, 15 bp, Homo sapiens
aaagtctaatattgc

SEQ ID NO: 229162 - DNA, 15 bp, Homo sapiens
caaagtctaatattg

SEQ ID NO: 229163 - DNA, 15 bp, Homo sapiens
acaaagtctaatatt

SEQ ID NO: 229164 - DNA, 15 bp, Homo sapiens
gacaaagtctaatat

SEQ ID NO: 229165 - DNA, 15 bp, Homo sapiens
agacaaagtctaata

SEQ ID NO: 229166 - DNA, 15 bp, Homo sapiens
aagacaaagtctaat

SEQ ID NO: 229167 - DNA, 15 bp, Homo sapiens
aaagacaaagtctaa

SEQ ID NO: 229168 - DNA, 15 bp, Homo sapiens
aaaagacaaagtcta

SEQ ID NO: 229169 - DNA, 15 bp, Homo sapiens
aaaaagacaaagtct

SEQ ID NO: 229170 - DNA, 15 bp, Homo sapiens
taaaaagacaaagtc

SEQ ID NO: 229171 - DNA, 15 bp, Homo sapiens
ttaaaaagacaaagt

SEQ ID NO: 229172 - DNA, 15 bp, Homo sapiens
attaaaaagacaaag

SEQ ID NO: 229173 - DNA, 15 bp, Homo sapiens
aattaaaaagacaaa

SEQ ID NO: 229174 - DNA, 15 bp, Homo sapiens
aaattaaaaagacaa

SEQ ID NO: 229175 - DNA, 15 bp, Homo sapiens
aaaattaaaaagaca

SEQ ID NO: 229176 - DNA, 15 bp, Homo sapiens
gaaaattaaaaagac

SEQ ID NO: 229177 - DNA, 15 bp, Homo sapiens
tgaaaattaaaaaga

SEQ ID NO: 229178 - DNA, 15 bp, Homo sapiens
atgaaaattaaaaag

SEQ ID NO: 229179 - DNA, 15 bp, Homo sapiens
tatgaaaattaaaaa

SEQ ID NO: 229180 - DNA, 15 bp, Homo sapiens
atatgaaaattaaaa

SEQ ID NO: 229181 - DNA, 15 bp, Homo sapiens
tatatgaaaattaaa

SEQ ID NO: 229182 - DNA, 15 bp, Homo sapiens
ttatatgaaaattaa

SEQ ID NO: 229183 - DNA, 15 bp, Homo sapiens
tttatatgaaaatta

SEQ ID NO: 229184 - DNA, 15 bp, Homo sapiens
ttttatatgaaaatt

SEQ ID NO: 229185 - DNA, 15 bp, Homo sapiens
tttttatatgaaaat

SEQ ID NO: 229186 - DNA, 15 bp, Homo sapiens
atttttatatgaaaa

SEQ ID NO: 229187 - DNA, 15 bp, Homo sapiens
aatttttatatgaaa

SEQ ID NO: 229188 - DNA, 15 bp, Homo sapiens
aaatttttatatgaa

SEQ ID NO: 229189 - DNA, 15 bp, Homo sapiens
caaatttttatatga

SEQ ID NO: 229190 - DNA, 15 bp, Homo sapiens
tcaaatttttatatg

SEQ ID NO: 229191 - DNA, 15 bp, Homo sapiens
ttcaaatttttatat

SEQ ID NO: 229192 - DNA, 15 bp, Homo sapiens
cttcaaatttttata

SEQ ID NO: 229193 - DNA, 15 bp, Homo sapiens
acttcaaatttttat

SEQ ID NO: 229194 - DNA, 15 bp, Homo sapiens
tacttcaaattttta

SEQ ID NO: 229195 - DNA, 15 bp, Homo sapiens
atacttcaaattttt

SEQ ID NO: 229196 - DNA, 15 bp, Homo sapiens
tatacttcaaatttt

SEQ ID NO: 229197 - DNA, 15 bp, Homo sapiens
ttatacttcaaattt

SEQ ID NO: 229198 - DNA, 15 bp, Homo sapiens
cttatacttcaaatt

SEQ ID NO: 229199 - DNA, 15 bp, Homo sapiens
acttatacttcaaat

SEQ ID NO: 229200 - DNA, 15 bp, Homo sapiens
tacttatacttcaaa

SEQ ID NO: 229201 - DNA, 15 bp, Homo sapiens
ttacttatacttcaa

SEQ ID NO: 229202 - DNA, 15 bp, Homo sapiens
attacttatacttca

SEQ ID NO: 229203 - DNA, 15 bp, Homo sapiens
aattacttatacttc

SEQ ID NO: 229204 - DNA, 15 bp, Homo sapiens
caattacttatactt

SEQ ID NO: 229205 - DNA, 15 bp, Homo sapiens
gcaattacttatact

SEQ ID NO: 229206 - DNA, 15 bp, Homo sapiens
agcaattacttatac

SEQ ID NO: 229207 - DNA, 15 bp, Homo sapiens
aagcaattacttata

SEQ ID NO: 229208 - DNA, 15 bp, Homo sapiens
aaagcaattacttat

SEQ ID NO: 229209 - DNA, 15 bp, Homo sapiens
gaaagcaattactta

SEQ ID NO: 229210 - DNA, 15 bp, Homo sapiens
tgaaagcaattactt

SEQ ID NO: 229211 - DNA, 15 bp, Homo sapiens
ctgaaagcaattact

SEQ ID NO: 229212 - DNA, 15 bp, Homo sapiens
cctgaaagcaattac

SEQ ID NO: 229213 - DNA, 15 bp, Homo sapiens
gcctgaaagcaatta

SEQ ID NO: 229214 - DNA, 15 bp, Homo sapiens
ggcctgaaagcaatt

SEQ ID NO: 229215 - DNA, 15 bp, Homo sapiens
aggcctgaaagcaat

SEQ ID NO: 229216 - DNA, 15 bp, Homo sapiens
taggcctgaaagcaa

SEQ ID NO: 229217 - DNA, 15 bp, Homo sapiens
ataggcctgaaagca

SEQ ID NO: 229218 - DNA, 15 bp, Homo sapiens
tataggcctgaaagc

SEQ ID NO: 229219 - DNA, 15 bp, Homo sapiens
ctataggcctgaaag

SEQ ID NO: 229220 - DNA, 15 bp, Homo sapiens
tctataggcctgaaa

SEQ ID NO: 229221 - DNA, 15 bp, Homo sapiens
gtctataggcctgaa

SEQ ID NO: 229222 - DNA, 15 bp, Homo sapiens
ggtctataggcctga

SEQ ID NO: 229223 - DNA, 15 bp, Homo sapiens
tggtctataggcctg

SEQ ID NO: 229224 - DNA, 15 bp, Homo sapiens
gtggtctataggcct

SEQ ID NO: 229225 - DNA, 15 bp, Homo sapiens
cgtggtctataggcc

SEQ ID NO: 229226 - DNA, 15 bp, Homo sapiens
tcgtggtctataggc

SEQ ID NO: 229227 - DNA, 15 bp, Homo sapiens
gtcgtggtctatagg

SEQ ID NO: 229228 - DNA, 15 bp, Homo sapiens
tgtcgtggtctatag

SEQ ID NO: 229229 - DNA, 15 bp, Homo sapiens
ttgtcgtggtctata

SEQ ID NO: 229230 - DNA, 15 bp, Homo sapiens
attgtcgtggtctat

SEQ ID NO: 229231 - DNA, 15 bp, Homo sapiens
tattgtcgtggtcta

SEQ ID NO: 229232 - DNA, 15 bp, Homo sapiens
ttattgtcgtggtct

SEQ ID NO: 229233 - DNA, 15 bp, Homo sapiens
attattgtcgtggtc

SEQ ID NO: 229234 - DNA, 15 bp, Homo sapiens
aattattgtcgtggt

SEQ ID NO: 229235 - DNA, 15 bp, Homo sapiens
aaattattgtcgtgg

SEQ ID NO: 229236 - DNA, 15 bp, Homo sapiens
gaaattattgtcgtg

SEQ ID NO: 229237 - DNA, 15 bp, Homo sapiens
tgaaattattgtcgt

SEQ ID NO: 229238 - DNA, 15 bp, Homo sapiens
atgaaattattgtcg

SEQ ID NO: 229239 - DNA, 15 bp, Homo sapiens
aatgaaattattgtc

SEQ ID NO: 229240 - DNA, 15 bp, Homo sapiens
taatgaaattattgt

SEQ ID NO: 229241 - DNA, 15 bp, Homo sapiens
ctaatgaaattattg

SEQ ID NO: 229242 - DNA, 15 bp, Homo sapiens
gctaatgaaattatt

SEQ ID NO: 229243 - DNA, 15 bp, Homo sapiens
agctaatgaaattat

SEQ ID NO: 229244 - DNA, 15 bp, Homo sapiens
aagctaatgaaatta

SEQ ID NO: 229245 - DNA, 15 bp, Homo sapiens
gaagctaatgaaatt

SEQ ID NO: 229246 - DNA, 15 bp, Homo sapiens
agaagctaatgaaat

SEQ ID NO: 229247 - DNA, 15 bp, Homo sapiens
gagaagctaatgaaa

SEQ ID NO: 229248 - DNA, 15 bp, Homo sapiens
tgagaagctaatgaa

SEQ ID NO: 229249 - DNA, 15 bp, Homo sapiens
ttgagaagctaatga

SEQ ID NO: 229250 - DNA, 15 bp, Homo sapiens
cttgagaagctaatg

SEQ ID NO: 229251 - DNA, 15 bp, Homo sapiens
acttgagaagctaat

SEQ ID NO: 229252 - DNA, 15 bp, Homo sapiens
gacttgagaagctaa

SEQ ID NO: 229253 - DNA, 15 bp, Homo sapiens
ggacttgagaagcta

SEQ ID NO: 229254 - DNA, 15 bp, Homo sapiens
tggacttgagaagct

SEQ ID NO: 229255 - DNA, 15 bp, Homo sapiens
ttggacttgagaagc

SEQ ID NO: 229256 - DNA, 15 bp, Homo sapiens
tttggacttgagaag

SEQ ID NO: 229257 - DNA, 15 bp, Homo sapiens
atttggacttgagaa

SEQ ID NO: 229258 - DNA, 15 bp, Homo sapiens
aatttggacttgaga

SEQ ID NO: 229259 - DNA, 15 bp, Homo sapiens
taatttggacttgag

SEQ ID NO: 229260 - DNA, 15 bp, Homo sapiens
ctaatttggacttga

SEQ ID NO: 229261 - DNA, 15 bp, Homo sapiens
tctaatttggacttg

SEQ ID NO: 229262 - DNA, 15 bp, Homo sapiens
atctaatttggactt

SEQ ID NO: 229263 - DNA, 15 bp, Homo sapiens
aatctaatttggact

SEQ ID NO: 229264 - DNA, 15 bp, Homo sapiens
taatctaatttggac

SEQ ID NO: 229265 - DNA, 15 bp, Homo sapiens
ctaatctaatttgga

SEQ ID NO: 229266 - DNA, 15 bp, Homo sapiens
actaatctaatttgg

SEQ ID NO: 229267 - DNA, 15 bp, Homo sapiens
tactaatctaatttg

SEQ ID NO: 229268 - DNA, 15 bp, Homo sapiens
ttactaatctaattt

SEQ ID NO: 229269 - DNA, 15 bp, Homo sapiens
tttactaatctaatt

SEQ ID NO: 229270 - DNA, 15 bp, Homo sapiens
ctttactaatctaat

SEQ ID NO: 229271 - DNA, 15 bp, Homo sapiens
actttactaatctaa

SEQ ID NO: 229272 - DNA, 15 bp, Homo sapiens
aactttactaatcta

SEQ ID NO: 229273 - DNA, 15 bp, Homo sapiens
caactttactaatct

SEQ ID NO: 229274 - DNA, 15 bp, Homo sapiens
acaactttactaatc

SEQ ID NO: 229275 - DNA, 15 bp, Homo sapiens
tacaactttactaat

SEQ ID NO: 229276 - DNA, 15 bp, Homo sapiens
ttacaactttactaa

SEQ ID NO: 229277 - DNA, 15 bp, Homo sapiens
attacaactttacta

SEQ ID NO: 229278 - DNA, 15 bp, Homo sapiens
cattacaactttact

SEQ ID NO: 229279 - DNA, 15 bp, Homo sapiens
gcattacaactttac

SEQ ID NO: 229280 - DNA, 15 bp, Homo sapiens
tgcattacaacttta

SEQ ID NO: 229281 - DNA, 15 bp, Homo sapiens
atgcattacaacttt

SEQ ID NO: 229282 - DNA, 15 bp, Homo sapiens
catgcattacaactt

SEQ ID NO: 229283 - DNA, 15 bp, Homo sapiens
tcatgcattacaact

SEQ ID NO: 229284 - DNA, 15 bp, Homo sapiens
ttcatgcattacaac

SEQ ID NO: 229285 - DNA, 15 bp, Homo sapiens
tttcatgcattacaa

SEQ ID NO: 229286 - DNA, 15 bp, Homo sapiens
ttttcatgcattaca

SEQ ID NO: 229287 - DNA, 15 bp, Homo sapiens
tttttcatgcattac

SEQ ID NO: 229288 - DNA, 15 bp, Homo sapiens
ctttttcatgcatta

SEQ ID NO: 229289 - DNA, 15 bp, Homo sapiens
gctttttcatgcatt

SEQ ID NO: 229290 - DNA, 15 bp, Homo sapiens
cgctttttcatgcat

SEQ ID NO: 229291 - DNA, 15 bp, Homo sapiens
gcgctttttcatgca

SEQ ID NO: 229292 - DNA, 15 bp, Homo sapiens
tgcgctttttcatgc

SEQ ID NO: 229293 - DNA, 15 bp, Homo sapiens
ctgcgctttttcatg

SEQ ID NO: 229294 - DNA, 15 bp, Homo sapiens
tctgcgctttttcat

SEQ ID NO: 229295 - DNA, 15 bp, Homo sapiens
ttctgcgctttttca

SEQ ID NO: 229296 - DNA, 15 bp, Homo sapiens
tttctgcgctttttc

SEQ ID NO: 229297 - DNA, 15 bp, Homo sapiens
ttttctgcgcttttt

SEQ ID NO: 229298 - DNA, 15 bp, Homo sapiens
tttttctgcgctttt

SEQ ID NO: 229299 - DNA, 15 bp, Homo sapiens
atttttctgcgcttt

SEQ ID NO: 229300 - DNA, 15 bp, Homo sapiens
tatttttctgcgctt

SEQ ID NO: 229301 - DNA, 15 bp, Homo sapiens
atatttttctgcgct

SEQ ID NO: 229302 - DNA, 15 bp, Homo sapiens
tatatttttctgcgc

SEQ ID NO: 229303 - DNA, 15 bp, Homo sapiens
ttatatttttctgcg

SEQ ID NO: 229304 - DNA, 15 bp, Homo sapiens
attatatttttctgc

SEQ ID NO: 229305 - DNA, 15 bp, Homo sapiens
cattatatttttctg

SEQ ID NO: 229306 - DNA, 15 bp, Homo sapiens
acattatatttttct

SEQ ID NO: 229307 - DNA, 15 bp, Homo sapiens
aacattatatttttc

SEQ ID NO: 229308 - DNA, 15 bp, Homo sapiens
taacattatattttt

SEQ ID NO: 229309 - DNA, 15 bp, Homo sapiens
gtaacattatatttt

SEQ ID NO: 229310 - DNA, 15 bp, Homo sapiens
agtaacattatattt

SEQ ID NO: 229311 - DNA, 15 bp, Homo sapiens
aagtaacattatatt

SEQ ID NO: 229312 - DNA, 15 bp, Homo sapiens
aaagtaacattatat

SEQ ID NO: 229313 - DNA, 15 bp, Homo sapiens
gaaagtaacattata

SEQ ID NO: 229314 - DNA, 15 bp, Homo sapiens
agaaagtaacattat

SEQ ID NO: 229315 - DNA, 15 bp, Homo sapiens
aagaaagtaacatta

SEQ ID NO: 229316 - DNA, 15 bp, Homo sapiens
aaagaaagtaacatt

SEQ ID NO: 229317 - DNA, 15 bp, Homo sapiens
aaaagaaagtaacat

SEQ ID NO: 229318 - DNA, 15 bp, Homo sapiens
gaaaagaaagtaaca

SEQ ID NO: 229319 - DNA, 15 bp, Homo sapiens
ggaaaagaaagtaac

SEQ ID NO: 229320 - DNA, 15 bp, Homo sapiens
cggaaaagaaagtaa

SEQ ID NO: 229321 - DNA, 15 bp, Homo sapiens
ccggaaaagaaagta

SEQ ID NO: 229322 - DNA, 15 bp, Homo sapiens
accggaaaagaaagt

SEQ ID NO: 229323 - DNA, 15 bp, Homo sapiens
caccggaaaagaaag

SEQ ID NO: 229324 - DNA, 15 bp, Homo sapiens
acaccggaaaagaaa

SEQ ID NO: 229325 - DNA, 15 bp, Homo sapiens
aacaccggaaaagaa

SEQ ID NO: 229326 - DNA, 15 bp, Homo sapiens
gaacaccggaaaaga

SEQ ID NO: 229327 - DNA, 15 bp, Homo sapiens
agaacaccggaaaag

SEQ ID NO: 229328 - DNA, 15 bp, Homo sapiens
aagaacaccggaaaa

SEQ ID NO: 229329 - DNA, 15 bp, Homo sapiens
taagaacaccggaaa

SEQ ID NO: 229330 - DNA, 15 bp, Homo sapiens
ttaagaacaccggaa

SEQ ID NO: 229331 - DNA, 15 bp, Homo sapiens
gttaagaacaccgga

SEQ ID NO: 229332 - DNA, 15 bp, Homo sapiens
agttaagaacaccgg

SEQ ID NO: 229333 - DNA, 15 bp, Homo sapiens
tagttaagaacaccg

SEQ ID NO: 229334 - DNA, 15 bp, Homo sapiens
gtagttaagaacacc

SEQ ID NO: 229335 - DNA, 15 bp, Homo sapiens
tgtagttaagaacac

SEQ ID NO: 229336 - DNA, 15 bp, Homo sapiens
ctgtagttaagaaca

SEQ ID NO: 229337 - DNA, 15 bp, Homo sapiens
tctgtagttaagaac

SEQ ID NO: 229338 - DNA, 15 bp, Homo sapiens
ctctgtagttaagaa

SEQ ID NO: 229339 - DNA, 15 bp, Homo sapiens
gctctgtagttaaga

SEQ ID NO: 229340 - DNA, 15 bp, Homo sapiens
tgctctgtagttaag

SEQ ID NO: 229341 - DNA, 15 bp, Homo sapiens
ctgctctgtagttaa

SEQ ID NO: 229342 - DNA, 15 bp, Homo sapiens
actgctctgtagtta

SEQ ID NO: 229343 - DNA, 15 bp, Homo sapiens
tactgctctgtagtt

SEQ ID NO: 229344 - DNA, 15 bp, Homo sapiens
ttactgctctgtagt

SEQ ID NO: 229345 - DNA, 15 bp, Homo sapiens
attactgctctgtag

SEQ ID NO: 229346 - DNA, 15 bp, Homo sapiens
cattactgctctgta

SEQ ID NO: 229347 - DNA, 15 bp, Homo sapiens
acattactgctctgt

SEQ ID NO: 229348 - DNA, 15 bp, Homo sapiens
cacattactgctctg

SEQ ID NO: 229349 - DNA, 15 bp, Homo sapiens
tcacattactgctct

SEQ ID NO: 229350 - DNA, 15 bp, Homo sapiens
atcacattactgctc

SEQ ID NO: 229351 - DNA, 15 bp, Homo sapiens
aatcacattactgct

SEQ ID NO: 229352 - DNA, 15 bp, Homo sapiens
aaatcacattactgc

SEQ ID NO: 229353 - DNA, 15 bp, Homo sapiens
aaaatcacattactg

SEQ ID NO: 229354 - DNA, 15 bp, Homo sapiens
aaaaatcacattact

SEQ ID NO: 229355 - DNA, 15 bp, Homo sapiens
gaaaaatcacattac

SEQ ID NO: 229356 - DNA, 15 bp, Homo sapiens
tgaaaaatcacatta

SEQ ID NO: 229357 - DNA, 15 bp, Homo sapiens
gtgaaaaatcacatt

SEQ ID NO: 229358 - DNA, 15 bp, Homo sapiens
tgtgaaaaatcacat

SEQ ID NO: 229359 - DNA, 15 bp, Homo sapiens
ttgtgaaaaatcaca

SEQ ID NO: 229360 - DNA, 15 bp, Homo sapiens
tttgtgaaaaatcac

SEQ ID NO: 229361 - DNA, 15 bp, Homo sapiens
atttgtgaaaaatca

SEQ ID NO: 229362 - DNA, 15 bp, Homo sapiens
aatttgtgaaaaatc

SEQ ID NO: 229363 - DNA, 15 bp, Homo sapiens
taatttgtgaaaaat

SEQ ID NO: 229364 - DNA, 15 bp, Homo sapiens
ttaatttgtgaaaaa

SEQ ID NO: 229365 - DNA, 15 bp, Homo sapiens
tttaatttgtgaaaa

SEQ ID NO: 229366 - DNA, 15 bp, Homo sapiens
ctttaatttgtgaaa

SEQ ID NO: 229367 - DNA, 15 bp, Homo sapiens
actttaatttgtgaa

SEQ ID NO: 229368 - DNA, 15 bp, Homo sapiens
aactttaatttgtga

SEQ ID NO: 229369 - DNA, 15 bp, Homo sapiens
gaactttaatttgtg

SEQ ID NO: 229370 - DNA, 15 bp, Homo sapiens
agaactttaatttgt

SEQ ID NO: 229371 - DNA, 15 bp, Homo sapiens
tagaactttaatttg

SEQ ID NO: 229372 - DNA, 15 bp, Homo sapiens
atagaactttaattt

SEQ ID NO: 229373 - DNA, 15 bp, Homo sapiens
tatagaactttaatt

SEQ ID NO: 229374 - DNA, 15 bp, Homo sapiens
ttatagaactttaat

SEQ ID NO: 229375 - DNA, 15 bp, Homo sapiens
attatagaactttaa

SEQ ID NO: 229376 - DNA, 15 bp, Homo sapiens
tattatagaacttta

SEQ ID NO: 229377 - DNA, 15 bp, Homo sapiens
atattatagaacttt

SEQ ID NO: 229378 - DNA, 15 bp, Homo sapiens
gatattatagaactt

SEQ ID NO: 229379 - DNA, 15 bp, Homo sapiens
agatattatagaact

SEQ ID NO: 229380 - DNA, 15 bp, Homo sapiens
cagatattatagaac

SEQ ID NO: 229381 - DNA, 15 bp, Homo sapiens
acagatattatagaa

SEQ ID NO: 229382 - DNA, 15 bp, Homo sapiens
tacagatattataga

SEQ ID NO: 229383 - DNA, 15 bp, Homo sapiens
atacagatattatag

SEQ ID NO: 229384 - DNA, 15 bp, Homo sapiens
catacagatattata

SEQ ID NO: 229385 - DNA, 15 bp, Homo sapiens
tcatacagatattat

SEQ ID NO: 229386 - DNA, 15 bp, Homo sapiens
ttcatacagatatta

SEQ ID NO: 229387 - DNA, 15 bp, Homo sapiens
attcatacagatatt

SEQ ID NO: 229388 - DNA, 15 bp, Homo sapiens
tattcatacagatat

SEQ ID NO: 229389 - DNA, 15 bp, Homo sapiens
atattcatacagata

SEQ ID NO: 229390 - DNA, 15 bp, Homo sapiens
ttatattcatacaga

SEQ ID NO: 229391 - DNA, 15 bp, Homo sapiens
attatattcatacag

SEQ ID NO: 229392 - DNA, 15 bp, Homo sapiens
cattatattcataca

SEQ ID NO: 229393 - DNA, 15 bp, Homo sapiens
gcattatattcatac

SEQ ID NO: 229394 - DNA, 15 bp, Homo sapiens
tgcattatattcata

SEQ ID NO: 229395 - DNA, 15 bp, Homo sapiens
atgcattatattcat

SEQ ID NO: 229396 - DNA, 15 bp, Homo sapiens
gatgcattatattca

SEQ ID NO: 229397 - DNA, 15 bp, Homo sapiens
agatgcattatattc

SEQ ID NO: 229398 - DNA, 15 bp, Homo sapiens
tagatgcattatatt

SEQ ID NO: 229399 - DNA, 15 bp, Homo sapiens
ctagatgcattatat

SEQ ID NO: 229400 - DNA, 15 bp, Homo sapiens
actagatgcattata

SEQ ID NO: 229401 - DNA, 15 bp, Homo sapiens
gactagatgcattat

SEQ ID NO: 229402 - DNA, 15 bp, Homo sapiens
agactagatgcatta

SEQ ID NO: 229403 - DNA, 15 bp, Homo sapiens
aagactagatgcatt

SEQ ID NO: 229404 - DNA, 15 bp, Homo sapiens
gaagactagatgcat

SEQ ID NO: 229405 - DNA, 15 bp, Homo sapiens
tgaagactagatgca

SEQ ID NO: 229406 - DNA, 15 bp, Homo sapiens
ttgaagactagatgc

SEQ ID NO: 229407 - DNA, 15 bp, Homo sapiens
gttgaagactagatg

SEQ ID NO: 229408 - DNA, 15 bp, Homo sapiens
agttgaagactagat

SEQ ID NO: 229409 - DNA, 15 bp, Homo sapiens
aagttgaagactaga

SEQ ID NO: 229410 - DNA, 15 bp, Homo sapiens
aaagttgaagactag

SEQ ID NO: 229411 - DNA, 15 bp, Homo sapiens
aaaagttgaagacta

SEQ ID NO: 229412 - DNA, 15 bp, Homo sapiens
gaaaagttgaagact

SEQ ID NO: 229413 - DNA, 15 bp, Homo sapiens
agaaaagttgaagac

SEQ ID NO: 229414 - DNA, 15 bp, Homo sapiens
tagaaaagttgaaga

SEQ ID NO: 229415 - DNA, 15 bp, Homo sapiens
ttagaaaagttgaag

SEQ ID NO: 229416 - DNA, 15 bp, Homo sapiens
tttagaaaagttgaa

SEQ ID NO: 229417 - DNA, 15 bp, Homo sapiens
ttttagaaaagttga

SEQ ID NO: 229418 - DNA, 15 bp, Homo sapiens
attttagaaaagttg

SEQ ID NO: 229419 - DNA, 15 bp, Homo sapiens
tattttagaaaagtt

SEQ ID NO: 229420 - DNA, 15 bp, Homo sapiens
gtattttagaaaagt

SEQ ID NO: 229421 - DNA, 15 bp, Homo sapiens
tgtattttagaaaag

SEQ ID NO: 229422 - DNA, 15 bp, Homo sapiens
ttgtattttagaaaa

SEQ ID NO: 229423 - DNA, 15 bp, Homo sapiens
gttgtattttagaaa

SEQ ID NO: 229424 - DNA, 15 bp, Homo sapiens
cgttgtattttagaa

SEQ ID NO: 229425 - DNA, 15 bp, Homo sapiens
tcgttgtattttaga

SEQ ID NO: 229426 - DNA, 15 bp, Homo sapiens
ctcgttgtattttag

SEQ ID NO: 229427 - DNA, 15 bp, Homo sapiens
gctcgttgtatttta

SEQ ID NO: 229428 - DNA, 15 bp, Homo sapiens
ggctcgttgtatttt

SEQ ID NO: 229429 - DNA, 15 bp, Homo sapiens
tggctcgttgtattt

SEQ ID NO: 229430 - DNA, 15 bp, Homo sapiens
ctggctcgttgtatt

SEQ ID NO: 229431 - DNA, 15 bp, Homo sapiens
gctggctcgttgtat

SEQ ID NO: 229432 - DNA, 15 bp, Homo sapiens
agctggctcgttgta

SEQ ID NO: 229433 - DNA, 15 bp, Homo sapiens
cagctggctcgttgt

SEQ ID NO: 229434 - DNA, 15 bp, Homo sapiens
tcagctggctcgttg

SEQ ID NO: 229435 - DNA, 15 bp, Homo sapiens
ctcagctggctcgtt

SEQ ID NO: 229436 - DNA, 15 bp, Homo sapiens
actcagctggctcgt

SEQ ID NO: 229437 - DNA, 15 bp, Homo sapiens
tactcagctggctcg

SEQ ID NO: 229438 - DNA, 15 bp, Homo sapiens
ttactcagctggctc

SEQ ID NO: 229439 - DNA, 15 bp, Homo sapiens
cttactcagctggct

SEQ ID NO: 229440 - DNA, 15 bp, Homo sapiens
gcttactcagctggc

SEQ ID NO: 229441 - DNA, 15 bp, Homo sapiens
ggcttactcagctgg

SEQ ID NO: 229442 - DNA, 15 bp, Homo sapiens
gggcttactcagctg

SEQ ID NO: 229443 - DNA, 15 bp, Homo sapiens
tgggcttactcagct

SEQ ID NO: 229444 - DNA, 15 bp, Homo sapiens
atgggcttactcagc

SEQ ID NO: 229445 - DNA, 15 bp, Homo sapiens
gatgggcttactcag

SEQ ID NO: 229446 - DNA, 15 bp, Homo sapiens
cgatgggcttactca

SEQ ID NO: 229447 - DNA, 15 bp, Homo sapiens
tcgatgggcttactc

SEQ ID NO: 229448 - DNA, 15 bp, Homo sapiens
atcgatgggcttact

SEQ ID NO: 229449 - DNA, 15 bp, Homo sapiens
aatcgatgggcttac

SEQ ID NO: 229450 - DNA, 15 bp, Homo sapiens
caatcgatgggctta

SEQ ID NO: 229451 - DNA, 15 bp, Homo sapiens
ccaatcgatgggctt

SEQ ID NO: 229452 - DNA, 15 bp, Homo sapiens
cccaatcgatgggct

SEQ ID NO: 229453 - DNA, 15 bp, Homo sapiens
acccaatcgatgggc

SEQ ID NO: 229454 - DNA, 15 bp, Homo sapiens
tacccaatcgatggg

SEQ ID NO: 229455 - DNA, 15 bp, Homo sapiens
ttacccaatcgatgg

SEQ ID NO: 229456 - DNA, 15 bp, Homo sapiens
tttacccaatcgatg

SEQ ID NO: 229457 - DNA, 15 bp, Homo sapiens
ttttacccaatcgat

SEQ ID NO: 229458 - DNA, 15 bp, Homo sapiens
tttttacccaatcga

SEQ ID NO: 229459 - DNA, 15 bp, Homo sapiens
atttttacccaatcg

SEQ ID NO: 229460 - DNA, 15 bp, Homo sapiens
aatttttacccaatc

SEQ ID NO: 229461 - DNA, 15 bp, Homo sapiens
aaatttttacccaat

SEQ ID NO: 229462 - DNA, 15 bp, Homo sapiens
caaatttttacccaa

SEQ ID NO: 229463 - DNA, 15 bp, Homo sapiens
ccaaatttttaccca

SEQ ID NO: 229464 - DNA, 15 bp, Homo sapiens
tccaaatttttaccc

SEQ ID NO: 229465 - DNA, 15 bp, Homo sapiens
ttccaaatttttacc

SEQ ID NO: 229466 - DNA, 15 bp, Homo sapiens
tttccaaatttttac

SEQ ID NO: 229467 - DNA, 15 bp, Homo sapiens
ttttccaaattttta

SEQ ID NO: 229468 - DNA, 15 bp, Homo sapiens
attttccaaattttt

SEQ ID NO: 229469 - DNA, 15 bp, Homo sapiens
cattttccaaatttt

SEQ ID NO: 229470 - DNA, 15 bp, Homo sapiens
acattttccaaattt

SEQ ID NO: 229471 - DNA, 15 bp, Homo sapiens
aacattttccaaatt

SEQ ID NO: 229472 - DNA, 15 bp, Homo sapiens
aaacattttccaaat

SEQ ID NO: 229473 - DNA, 15 bp, Homo sapiens
aaaacattttccaaa

SEQ ID NO: 229474 - DNA, 15 bp, Homo sapiens
aaaaacattttccaa

SEQ ID NO: 229475 - DNA, 15 bp, Homo sapiens
gaaaaacattttcca

SEQ ID NO: 229476 - DNA, 15 bp, Homo sapiens
tgaaaaacattttcc

SEQ ID NO: 229477 - DNA, 15 bp, Homo sapiens
atgaaaaacattttc

SEQ ID NO: 229478 - DNA, 15 bp, Homo sapiens
catgaaaaacatttt

SEQ ID NO: 229479 - DNA, 15 bp, Homo sapiens
gcatgaaaaacattt

SEQ ID NO: 229480 - DNA, 15 bp, Homo sapiens
agcatgaaaaacatt

SEQ ID NO: 229481 - DNA, 15 bp, Homo sapiens
tagcatgaaaaacat

SEQ ID NO: 229482 - DNA, 15 bp, Homo sapiens
ttagcatgaaaaaca

SEQ ID NO: 229483 - DNA, 15 bp, Homo sapiens
gttagcatgaaaaac

SEQ ID NO: 229484 - DNA, 15 bp, Homo sapiens
agttagcatgaaaaa

SEQ ID NO: 229485 - DNA, 15 bp, Homo sapiens
gagttagcatgaaaa

SEQ ID NO: 229486 - DNA, 15 bp, Homo sapiens
ggagttagcatgaaa

SEQ ID NO: 229487 - DNA, 15 bp, Homo sapiens
aggagttagcatgaa

SEQ ID NO: 229488 - DNA, 15 bp, Homo sapiens
taggagttagcatga

SEQ ID NO: 229489 - DNA, 15 bp, Homo sapiens
gtaggagttagcatg

SEQ ID NO: 229490 - DNA, 15 bp, Homo sapiens
agtaggagttagcat

SEQ ID NO: 229491 - DNA, 15 bp, Homo sapiens
cagtaggagttagca

SEQ ID NO: 229492 - DNA, 15 bp, Homo sapiens
acagtaggagttagc

SEQ ID NO: 229493 - DNA, 15 bp, Homo sapiens
tacagtaggagttag

SEQ ID NO: 229494 - DNA, 15 bp, Homo sapiens
ctacagtaggagtta

SEQ ID NO: 229495 - DNA, 15 bp, Homo sapiens
actacagtaggagtt

SEQ ID NO: 229496 - DNA, 15 bp, Homo sapiens
tactacagtaggagt

SEQ ID NO: 229497 - DNA, 15 bp, Homo sapiens
ttactacagtaggag

SEQ ID NO: 229498 - DNA, 15 bp, Homo sapiens
attactacagtagga

SEQ ID NO: 229499 - DNA, 15 bp, Homo sapiens
tattactacagtagg

SEQ ID NO: 229500 - DNA, 15 bp, Homo sapiens
ttattactacagtag

SEQ ID NO: 229501 - DNA, 15 bp, Homo sapiens
tttattactacagta

SEQ ID NO: 229502 - DNA, 15 bp, Homo sapiens
ttttattactacagt

SEQ ID NO: 229503 - DNA, 15 bp, Homo sapiens
attttattactacag

SEQ ID NO: 229504 - DNA, 15 bp, Homo sapiens
gattttattactaca

SEQ ID NO: 229505 - DNA, 15 bp, Homo sapiens
agattttattactac

SEQ ID NO: 229506 - DNA, 15 bp, Homo sapiens
gagattttattacta

SEQ ID NO: 229507 - DNA, 15 bp, Homo sapiens
tgagattttattact

SEQ ID NO: 229508 - DNA, 15 bp, Homo sapiens
atgagattttattac

SEQ ID NO: 229509 - DNA, 15 bp, Homo sapiens
aatgagattttatta

SEQ ID NO: 229510 - DNA, 15 bp, Homo sapiens
aaatgagattttatt

SEQ ID NO: 229511 - DNA, 15 bp, Homo sapiens
taaatgagattttat

SEQ ID NO: 229512 - DNA, 15 bp, Homo sapiens
ttaaatgagatttta

SEQ ID NO: 229513 - DNA, 15 bp, Homo sapiens
tttaaatgagatttt

SEQ ID NO: 229514 - DNA, 15 bp, Homo sapiens
atttaaatgagattt

SEQ ID NO: 229515 - DNA, 15 bp, Homo sapiens
tatttaaatgagatt

SEQ ID NO: 229516 - DNA, 15 bp, Homo sapiens
ttatttaaatgagat

SEQ ID NO: 229517 - DNA, 15 bp, Homo sapiens
tttatttaaatgaga

SEQ ID NO: 229518 - DNA, 15 bp, Homo sapiens
gtttatttaaatgag

SEQ ID NO: 229519 - DNA, 15 bp, Homo sapiens
tgtttatttaaatga

SEQ ID NO: 229520 - DNA, 15 bp, Homo sapiens
ttgtttatttaaatg

SEQ ID NO: 229521 - DNA, 15 bp, Homo sapiens
attgtttatttaaat

SEQ ID NO: 229522 - DNA, 15 bp, Homo sapiens
tattgtttatttaaa

SEQ ID NO: 229523 - DNA, 15 bp, Homo sapiens
ctattgtttatttaa

SEQ ID NO: 229524 - DNA, 15 bp, Homo sapiens
actattgtttattta

SEQ ID NO: 229525 - DNA, 15 bp, Homo sapiens
gactattgtttattt

SEQ ID NO: 229526 - DNA, 15 bp, Homo sapiens
agactattgtttatt

SEQ ID NO: 229527 - DNA, 15 bp, Homo sapiens
aagactattgtttat

SEQ ID NO: 229528 - DNA, 15 bp, Homo sapiens
gaagactattgttta

SEQ ID NO: 229529 - DNA, 15 bp, Homo sapiens
tgaagactattgttt

SEQ ID NO: 229530 - DNA, 15 bp, Homo sapiens
atgaagactattgtt

SEQ ID NO: 229531 - DNA, 15 bp, Homo sapiens
catgaagactattgt

SEQ ID NO: 229532 - DNA, 15 bp, Homo sapiens
tcatgaagactattg

SEQ ID NO: 229533 - DNA, 15 bp, Homo sapiens
ttcatgaagactatt

SEQ ID NO: 229534 - DNA, 15 bp, Homo sapiens
cttcatgaagactat

SEQ ID NO: 229535 - DNA, 15 bp, Homo sapiens
tcttcatgaagacta

SEQ ID NO: 229536 - DNA, 15 bp, Homo sapiens
ttcttcatgaagact

SEQ ID NO: 229537 - DNA, 15 bp, Homo sapiens
attcttcatgaagac

SEQ ID NO: 229538 - DNA, 15 bp, Homo sapiens
aattcttcatgaaga

SEQ ID NO: 229539 - DNA, 15 bp, Homo sapiens
taattcttcatgaag

SEQ ID NO: 229540 - DNA, 15 bp, Homo sapiens
ataattcttcatgaa

SEQ ID NO: 229541 - DNA, 15 bp, Homo sapiens
tataattcttcatga

SEQ ID NO: 229542 - DNA, 15 bp, Homo sapiens
atataattcttcatg

SEQ ID NO: 229543 - DNA, 15 bp, Homo sapiens
catataattcttcat

SEQ ID NO: 229544 - DNA, 15 bp, Homo sapiens
tcatataattcttca

SEQ ID NO: 229545 - DNA, 15 bp, Homo sapiens
atcatataattcttc

SEQ ID NO: 229546 - DNA, 15 bp, Homo sapiens
tatcatataattctt

SEQ ID NO: 229547 - DNA, 15 bp, Homo sapiens
ttatcatataattct

SEQ ID NO: 229548 - DNA, 15 bp, Homo sapiens
tttatcatataattc

SEQ ID NO: 229549 - DNA, 15 bp, Homo sapiens
ctttatcatataatt

SEQ ID NO: 229550 - DNA, 15 bp, Homo sapiens
tctttatcatataat

SEQ ID NO: 229551 - DNA, 15 bp, Homo sapiens
atctttatcatataa

SEQ ID NO: 229552 - DNA, 15 bp, Homo sapiens
aatctttatcatata

SEQ ID NO: 229553 - DNA, 15 bp, Homo sapiens
aaatctttatcatat

SEQ ID NO: 229554 - DNA, 15 bp, Homo sapiens
caaatctttatcata

SEQ ID NO: 229555 - DNA, 15 bp, Homo sapiens
acaaatctttatcat

SEQ ID NO: 229556 - DNA, 15 bp, Homo sapiens
aacaaatctttatca

SEQ ID NO: 229557 - DNA, 15 bp, Homo sapiens
aaacaaatctttatc

SEQ ID NO: 229558 - DNA, 15 bp, Homo sapiens
caaacaaatctttat

SEQ ID NO: 229559 - DNA, 15 bp, Homo sapiens
tcaaacaaatcttta

SEQ ID NO: 229560 - DNA, 15 bp, Homo sapiens
atcaaacaaatcttt

SEQ ID NO: 229561 - DNA, 15 bp, Homo sapiens
tatcaaacaaatctt

SEQ ID NO: 229562 - DNA, 15 bp, Homo sapiens
ctatcaaacaaatct

SEQ ID NO: 229563 - DNA, 15 bp, Homo sapiens
tctatcaaacaaatc

SEQ ID NO: 229564 - DNA, 15 bp, Homo sapiens
gtctatcaaacaaat

SEQ ID NO: 229565 - DNA, 15 bp, Homo sapiens
tgtctatcaaacaaa

SEQ ID NO: 229566 - DNA, 15 bp, Homo sapiens
atgtctatcaaacaa

SEQ ID NO: 229567 - DNA, 15 bp, Homo sapiens
tatgtctatcaaaca

SEQ ID NO: 229568 - DNA, 15 bp, Homo sapiens
ctatgtctatcaaac

SEQ ID NO: 229569 - DNA, 15 bp, Homo sapiens
gctatgtctatcaaa

SEQ ID NO: 229570 - DNA, 15 bp, Homo sapiens
tgctatgtctatcaa

SEQ ID NO: 229571 - DNA, 15 bp, Homo sapiens
atgctatgtctatca

SEQ ID NO: 229572 - DNA, 15 bp, Homo sapiens
aatgctatgtctatc

SEQ ID NO: 229573 - DNA, 15 bp, Homo sapiens
aaatgctatgtctat

SEQ ID NO: 229574 - DNA, 15 bp, Homo sapiens
aaaatgctatgtcta

SEQ ID NO: 229575 - DNA, 15 bp, Homo sapiens
gaaaatgctatgtct

SEQ ID NO: 229576 - DNA, 15 bp, Homo sapiens
tgaaaatgctatgtc

SEQ ID NO: 229577 - DNA, 15 bp, Homo sapiens
ttgaaaatgctatgt

SEQ ID NO: 229578 - DNA, 15 bp, Homo sapiens
attgaaaatgctatg

SEQ ID NO: 229579 - DNA, 15 bp, Homo sapiens
aattgaaaatgctat

SEQ ID NO: 229580 - DNA, 15 bp, Homo sapiens
taattgaaaatgcta

SEQ ID NO: 229581 - DNA, 15 bp, Homo sapiens
ttaattgaaaatgct

SEQ ID NO: 229582 - DNA, 15 bp, Homo sapiens
attaattgaaaatgc

SEQ ID NO: 229583 - DNA, 15 bp, Homo sapiens
aattaattgaaaatg

SEQ ID NO: 229584 - DNA, 15 bp, Homo sapiens
caattaattgaaaat

SEQ ID NO: 229585 - DNA, 15 bp, Homo sapiens
acaattaattgaaaa

SEQ ID NO: 229586 - DNA, 15 bp, Homo sapiens
aacaattaattgaaa

SEQ ID NO: 229587 - DNA, 15 bp, Homo sapiens
aaacaattaattgaa

SEQ ID NO: 229588 - DNA, 15 bp, Homo sapiens
taaacaattaattga

SEQ ID NO: 229589 - DNA, 15 bp, Homo sapiens
gtaaacaattaattg

SEQ ID NO: 229590 - DNA, 15 bp, Homo sapiens
ggtaaacaattaatt

SEQ ID NO: 229591 - DNA, 15 bp, Homo sapiens
tggtaaacaattaat

SEQ ID NO: 229592 - DNA, 15 bp, Homo sapiens
atggtaaacaattaa

SEQ ID NO: 229593 - DNA, 15 bp, Homo sapiens
gatggtaaacaatta

SEQ ID NO: 229594 - DNA, 15 bp, Homo sapiens
agatggtaaacaatt

SEQ ID NO: 229595 - DNA, 15 bp, Homo sapiens
cagatggtaaacaat

SEQ ID NO: 229596 - DNA, 15 bp, Homo sapiens
acagatggtaaacaa

SEQ ID NO: 229597 - DNA, 15 bp, Homo sapiens
aacagatggtaaaca

SEQ ID NO: 229598 - DNA, 15 bp, Homo sapiens
taacagatggtaaac

SEQ ID NO: 229599 - DNA, 15 bp, Homo sapiens
ataacagatggtaaa

SEQ ID NO: 229600 - DNA, 15 bp, Homo sapiens
cataacagatggtaa

SEQ ID NO: 229601 - DNA, 15 bp, Homo sapiens
acataacagatggta

SEQ ID NO: 229602 - DNA, 15 bp, Homo sapiens
aacataacagatggt

SEQ ID NO: 229603 - DNA, 15 bp, Homo sapiens
gaacataacagatgg

SEQ ID NO: 229604 - DNA, 15 bp, Homo sapiens
agaacataacagatg

SEQ ID NO: 229605 - DNA, 15 bp, Homo sapiens
gagaacataacagat

SEQ ID NO: 229606 - DNA, 15 bp, Homo sapiens
agagaacataacaga

SEQ ID NO: 229607 - DNA, 15 bp, Homo sapiens
tagagaacataacag

SEQ ID NO: 229608 - DNA, 15 bp, Homo sapiens
ttagagaacataaca

SEQ ID NO: 229609 - DNA, 15 bp, Homo sapiens
attagagaacataac

SEQ ID NO: 229610 - DNA, 15 bp, Homo sapiens
gattagagaacataa

SEQ ID NO: 229611 - DNA, 15 bp, Homo sapiens
tgattagagaacata

SEQ ID NO: 229612 - DNA, 15 bp, Homo sapiens
ctgattagagaacat

SEQ ID NO: 229613 - DNA, 15 bp, Homo sapiens
actgattagagaaca

SEQ ID NO: 229614 - DNA, 15 bp, Homo sapiens
cactgattagagaac

SEQ ID NO: 229615 - DNA, 15 bp, Homo sapiens
acactgattagagaa

SEQ ID NO: 229616 - DNA, 15 bp, Homo sapiens
aacactgattagaga

SEQ ID NO: 229617 - DNA, 15 bp, Homo sapiens
taacactgattagag

SEQ ID NO: 229618 - DNA, 15 bp, Homo sapiens
gtaacactgattaga

SEQ ID NO: 229619 - DNA, 15 bp, Homo sapiens
tgtaacactgattag

SEQ ID NO: 229620 - DNA, 15 bp, Homo sapiens
ctgtaacactgatta

SEQ ID NO: 229621 - DNA, 15 bp, Homo sapiens
gctgtaacactgatt

SEQ ID NO: 229622 - DNA, 15 bp, Homo sapiens
ggctgtaacactgat

SEQ ID NO: 229623 - DNA, 15 bp, Homo sapiens
tggctgtaacactga

SEQ ID NO: 229624 - DNA, 15 bp, Homo sapiens
atggctgtaacactg

SEQ ID NO: 229625 - DNA, 15 bp, Homo sapiens
aatggctgtaacact

SEQ ID NO: 229626 - DNA, 15 bp, Homo sapiens
gaatggctgtaacac

SEQ ID NO: 229627 - DNA, 15 bp, Homo sapiens
tgaatggctgtaaca

SEQ ID NO: 229628 - DNA, 15 bp, Homo sapiens
atgaatggctgtaac

SEQ ID NO: 229629 - DNA, 15 bp, Homo sapiens
tatgaatggctgtaa

SEQ ID NO: 229630 - DNA, 15 bp, Homo sapiens
ttatgaatggctgta

SEQ ID NO: 229631 - DNA, 15 bp, Homo sapiens
tttatgaatggctgt

SEQ ID NO: 229632 - DNA, 15 bp, Homo sapiens
atttatgaatggctg

SEQ ID NO: 229633 - DNA, 15 bp, Homo sapiens
gatttatgaatggct

SEQ ID NO: 229634 - DNA, 15 bp, Homo sapiens
tgatttatgaatggc

SEQ ID NO: 229635 - DNA, 15 bp, Homo sapiens
gtgatttatgaatgg

SEQ ID NO: 229636 - DNA, 15 bp, Homo sapiens
tgtgatttatgaatg

SEQ ID NO: 229637 - DNA, 15 bp, Homo sapiens
atgtgatttatgaat

SEQ ID NO: 229638 - DNA, 15 bp, Homo sapiens
aatgtgatttatgaa

SEQ ID NO: 229639 - DNA, 15 bp, Homo sapiens
aaatgtgatttatga

SEQ ID NO: 229640 - DNA, 15 bp, Homo sapiens
caaatgtgatttatg

SEQ ID NO: 229641 - DNA, 15 bp, Homo sapiens
gcaaatgtgatttat

SEQ ID NO: 229642 - DNA, 15 bp, Homo sapiens
ggcaaatgtgattta

SEQ ID NO: 229643 - DNA, 15 bp, Homo sapiens
gaggcaaatgtgatt

SEQ ID NO: 229644 - DNA, 15 bp, Homo sapiens
tgaggcaaatgtgat

SEQ ID NO: 229645 - DNA, 15 bp, Homo sapiens
atgaggcaaatgtga

SEQ ID NO: 229646 - DNA, 15 bp, Homo sapiens
tatgaggcaaatgtg

SEQ ID NO: 229647 - DNA, 15 bp, Homo sapiens
ttatgaggcaaatgt

SEQ ID NO: 229648 - DNA, 15 bp, Homo sapiens
tttatgaggcaaatg

SEQ ID NO: 229649 - DNA, 15 bp, Homo sapiens
ttttatgaggcaaat

SEQ ID NO: 229650 - DNA, 15 bp, Homo sapiens
tttttatgaggcaaa

SEQ ID NO: 229651 - DNA, 15 bp, Homo sapiens
ctttttatgaggcaa

SEQ ID NO: 229652 - DNA, 15 bp, Homo sapiens
tctttttatgaggca

SEQ ID NO: 229653 - DNA, 15 bp, Homo sapiens
atctttttatgaggc

SEQ ID NO: 229654 - DNA, 15 bp, Homo sapiens
catctttttatgagg

SEQ ID NO: 229655 - DNA, 15 bp, Homo sapiens
ccatctttttatgag

SEQ ID NO: 229656 - DNA, 15 bp, Homo sapiens
gccatctttttatga

SEQ ID NO: 229657 - DNA, 15 bp, Homo sapiens
tgccatctttttatg

SEQ ID NO: 229658 - DNA, 15 bp, Homo sapiens
ttgccatctttttat

SEQ ID NO: 229659 - DNA, 15 bp, Homo sapiens
attgccatcttttta

SEQ ID NO: 229660 - DNA, 15 bp, Homo sapiens
gattgccatcttttt

SEQ ID NO: 229661 - DNA, 15 bp, Homo sapiens
cgattgccatctttt

SEQ ID NO: 229662 - DNA, 15 bp, Homo sapiens
acgattgccatcttt

SEQ ID NO: 229663 - DNA, 15 bp, Homo sapiens
aacgattgccatctt

SEQ ID NO: 229664 - DNA, 15 bp, Homo sapiens
aaacgattgccatct

SEQ ID NO: 229665 - DNA, 15 bp, Homo sapiens
taaacgattgccatc

SEQ ID NO: 229666 - DNA, 15 bp, Homo sapiens
gtaaacgattgccat

SEQ ID NO: 229667 - DNA, 15 bp, Homo sapiens
tgtaaacgattgcca

SEQ ID NO: 229668 - DNA, 15 bp, Homo sapiens
gtgtaaacgattgcc

SEQ ID NO: 229669 - DNA, 15 bp, Homo sapiens
cgtgtaaacgattgc

SEQ ID NO: 229670 - DNA, 15 bp, Homo sapiens
acgtgtaaacgattg

SEQ ID NO: 229671 - DNA, 15 bp, Homo sapiens
cacgtgtaaacgatt

SEQ ID NO: 229672 - DNA, 15 bp, Homo sapiens
acacgtgtaaacgat

SEQ ID NO: 229673 - DNA, 15 bp, Homo sapiens
cacacgtgtaaacga

SEQ ID NO: 229674 - DNA, 15 bp, Homo sapiens
acacacgtgtaaacg

SEQ ID NO: 229675 - DNA, 15 bp, Homo sapiens
tacacacgtgtaaac

SEQ ID NO: 229676 - DNA, 15 bp, Homo sapiens
atacacacgtgtaaa

SEQ ID NO: 229677 - DNA, 15 bp, Homo sapiens
aatacacacgtgtaa

SEQ ID NO: 229678 - DNA, 15 bp, Homo sapiens
aaatacacacgtgta

SEQ ID NO: 229679 - DNA, 15 bp, Homo sapiens
aaaatacacacgtgt

SEQ ID NO: 229680 - DNA, 15 bp, Homo sapiens
taaaatacacacgtg

SEQ ID NO: 229681 - DNA, 15 bp, Homo sapiens
ataaaatacacacgt

SEQ ID NO: 229682 - DNA, 15 bp, Homo sapiens
aataaaatacacacg

SEQ ID NO: 229683 - DNA, 15 bp, Homo sapiens
taataaaatacacac

SEQ ID NO: 229684 - DNA, 15 bp, Homo sapiens
ataataaaatacaca

SEQ ID NO: 229685 - DNA, 15 bp, Homo sapiens
ttataataaaataca

SEQ ID NO: 229686 - DNA, 15 bp, Homo sapiens
attataataaaatac

SEQ ID NO: 229687 - DNA, 15 bp, Homo sapiens
gattataataaaata

SEQ ID NO: 229688 - DNA, 15 bp, Homo sapiens
tgattataataaaat

SEQ ID NO: 229689 - DNA, 15 bp, Homo sapiens
ctgattataataaaa

SEQ ID NO: 229690 - DNA, 15 bp, Homo sapiens
gctgattataataaa

SEQ ID NO: 229691 - DNA, 15 bp, Homo sapiens
tgctgattataataa

SEQ ID NO: 229692 - DNA, 15 bp, Homo sapiens
atgctgattataata

SEQ ID NO: 229693 - DNA, 15 bp, Homo sapiens
gatgctgattataat

SEQ ID NO: 229694 - DNA, 15 bp, Homo sapiens
agatgctgattataa

SEQ ID NO: 229695 - DNA, 15 bp, Homo sapiens
cagatgctgattata

SEQ ID NO: 229696 - DNA, 15 bp, Homo sapiens
tcagatgctgattat

SEQ ID NO: 229697 - DNA, 15 bp, Homo sapiens
ctcagatgctgatta

SEQ ID NO: 229698 - DNA, 15 bp, Homo sapiens
tctcagatgctgatt

SEQ ID NO: 229699 - DNA, 15 bp, Homo sapiens
gtctcagatgctgat

SEQ ID NO: 229700 - DNA, 15 bp, Homo sapiens
tgtctcagatgctga

SEQ ID NO: 229701 - DNA, 15 bp, Homo sapiens
atgtctcagatgctg

SEQ ID NO: 229702 - DNA, 15 bp, Homo sapiens
aatgtctcagatgct

SEQ ID NO: 229703 - DNA, 15 bp, Homo sapiens
taatgtctcagatgc

SEQ ID NO: 229704 - DNA, 15 bp, Homo sapiens
gtaatgtctcagatg

SEQ ID NO: 229705 - DNA, 15 bp, Homo sapiens
agtaatgtctcagat

SEQ ID NO: 229706 - DNA, 15 bp, Homo sapiens
aagtaatgtctcaga

SEQ ID NO: 229707 - DNA, 15 bp, Homo sapiens
aaagtaatgtctcag

SEQ ID NO: 229708 - DNA, 15 bp, Homo sapiens
gaaagtaatgtctca

SEQ ID NO: 229709 - DNA, 15 bp, Homo sapiens
agaaagtaatgtctc

SEQ ID NO: 229710 - DNA, 15 bp, Homo sapiens
cagaaagtaatgtct

SEQ ID NO: 229711 - DNA, 15 bp, Homo sapiens
tcagaaagtaatgtc

SEQ ID NO: 229712 - DNA, 15 bp, Homo sapiens
atcagaaagtaatgt

SEQ ID NO: 229713 - DNA, 15 bp, Homo sapiens
aatcagaaagtaatg

SEQ ID NO: 229714 - DNA, 15 bp, Homo sapiens
aaatcagaaagtaat

SEQ ID NO: 229715 - DNA, 15 bp, Homo sapiens
taaatcagaaagtaa

SEQ ID NO: 229716 - DNA, 15 bp, Homo sapiens
ttaaatcagaaagta

SEQ ID NO: 229717 - DNA, 15 bp, Homo sapiens
tttaaatcagaaagt

SEQ ID NO: 229718 - DNA, 15 bp, Homo sapiens
gtttaaatcagaaag

SEQ ID NO: 229719 - DNA, 15 bp, Homo sapiens
tgtttaaatcagaaa

SEQ ID NO: 229720 - DNA, 15 bp, Homo sapiens
atgtttaaatcagaa

SEQ ID NO: 229721 - DNA, 15 bp, Homo sapiens
tatgtttaaatcaga

SEQ ID NO: 229722 - DNA, 15 bp, Homo sapiens
ttatgtttaaatcag

SEQ ID NO: 229723 - DNA, 15 bp, Homo sapiens
tttatgtttaaatca

SEQ ID NO: 229724 - DNA, 15 bp, Homo sapiens
ctttatgtttaaatc

SEQ ID NO: 229725 - DNA, 15 bp, Homo sapiens
cctttatgtttaaat

SEQ ID NO: 229726 - DNA, 15 bp, Homo sapiens
tcctttatgtttaaa

SEQ ID NO: 229727 - DNA, 15 bp, Homo sapiens
gtcctttatgtttaa

SEQ ID NO: 229728 - DNA, 15 bp, Homo sapiens
ggtcctttatgttta

SEQ ID NO: 229729 - DNA, 15 bp, Homo sapiens
cggtcctttatgttt

SEQ ID NO: 229730 - DNA, 15 bp, Homo sapiens
ccggtcctttatgtt

SEQ ID NO: 229731 - DNA, 15 bp, Homo sapiens
tccggtcctttatgt

SEQ ID NO: 229732 - DNA, 15 bp, Homo sapiens
ctccggtcctttatg

SEQ ID NO: 229733 - DNA, 15 bp, Homo sapiens
cctccggtcctttat

SEQ ID NO: 229734 - DNA, 15 bp, Homo sapiens
tcctccggtccttta

SEQ ID NO: 229735 - DNA, 15 bp, Homo sapiens
atcctccggtccttt

SEQ ID NO: 229736 - DNA, 15 bp, Homo sapiens
tatcctccggtcctt

SEQ ID NO: 229737 - DNA, 15 bp, Homo sapiens
gtatcctccggtcct

SEQ ID NO: 229738 - DNA, 15 bp, Homo sapiens
tgtatcctccggtcc

SEQ ID NO: 229739 - DNA, 15 bp, Homo sapiens
ttgtatcctccggtc

SEQ ID NO: 229740 - DNA, 15 bp, Homo sapiens
cttgtatcctccggt

SEQ ID NO: 229741 - DNA, 15 bp, Homo sapiens
tcttgtatcctccgg

SEQ ID NO: 229742 - DNA, 15 bp, Homo sapiens
gtcttgtatcctccg

SEQ ID NO: 229743 - DNA, 15 bp, Homo sapiens
agtcttgtatcctcc

SEQ ID NO: 229744 - DNA, 15 bp, Homo sapiens
gagtcttgtatcctc

SEQ ID NO: 229745 - DNA, 15 bp, Homo sapiens
agagtcttgtatcct

SEQ ID NO: 229746 - DNA, 15 bp, Homo sapiens
aagagtcttgtatcc

SEQ ID NO: 229747 - DNA, 15 bp, Homo sapiens
aaagagtcttgtatc

SEQ ID NO: 229748 - DNA, 15 bp, Homo sapiens
caaagagtcttgtat

SEQ ID NO: 229749 - DNA, 15 bp, Homo sapiens
tcaaagagtcttgta

SEQ ID NO: 229750 - DNA, 15 bp, Homo sapiens
ctcaaagagtcttgt

SEQ ID NO: 229751 - DNA, 15 bp, Homo sapiens
gctcaaagagtcttg

SEQ ID NO: 229752 - DNA, 15 bp, Homo sapiens
cgctcaaagagtctt

SEQ ID NO: 229753 - DNA, 15 bp, Homo sapiens
acgctcaaagagtct

SEQ ID NO: 229754 - DNA, 15 bp, Homo sapiens
cacgctcaaagagtc

SEQ ID NO: 229755 - DNA, 15 bp, Homo sapiens
ccacgctcaaagagt

SEQ ID NO: 229756 - DNA, 15 bp, Homo sapiens
accacgctcaaagag

SEQ ID NO: 229757 - DNA, 15 bp, Homo sapiens
taccacgctcaaaga

SEQ ID NO: 229758 - DNA, 15 bp, Homo sapiens
ataccacgctcaaag

SEQ ID NO: 229759 - DNA, 15 bp, Homo sapiens
tataccacgctcaaa

SEQ ID NO: 229760 - DNA, 15 bp, Homo sapiens
ttataccacgctcaa

SEQ ID NO: 229761 - DNA, 15 bp, Homo sapiens
attataccacgctca

SEQ ID NO: 229762 - DNA, 15 bp, Homo sapiens
cattataccacgctc

SEQ ID NO: 229763 - DNA, 15 bp, Homo sapiens
acattataccacgct

SEQ ID NO: 229764 - DNA, 15 bp, Homo sapiens
tacattataccacgc

SEQ ID NO: 229765 - DNA, 15 bp, Homo sapiens
gtacattataccacg

SEQ ID NO: 229766 - DNA, 15 bp, Homo sapiens
agtacattataccac

SEQ ID NO: 229767 - DNA, 15 bp, Homo sapiens
aagtacattatacca

SEQ ID NO: 229768 - DNA, 15 bp, Homo sapiens
taagtacattatacc

SEQ ID NO: 229769 - DNA, 15 bp, Homo sapiens
ataagtacattatac

SEQ ID NO: 229770 - DNA, 15 bp, Homo sapiens
cataagtacattata

SEQ ID NO: 229771 - DNA, 15 bp, Homo sapiens
acataagtacattat

SEQ ID NO: 229772 - DNA, 15 bp, Homo sapiens
aacataagtacatta

SEQ ID NO: 229773 - DNA, 15 bp, Homo sapiens
aaacataagtacatt

SEQ ID NO: 229774 - DNA, 15 bp, Homo sapiens
aaaacataagtacat

SEQ ID NO: 229775 - DNA, 15 bp, Homo sapiens
caaaacataagtaca

SEQ ID NO: 229776 - DNA, 15 bp, Homo sapiens
acaaaacataagtac

SEQ ID NO: 229777 - DNA, 15 bp, Homo sapiens
cacaaaacataagta

SEQ ID NO: 229778 - DNA, 15 bp, Homo sapiens
tcacaaaacataagt

SEQ ID NO: 229779 - DNA, 15 bp, Homo sapiens
atcacaaaacataag

SEQ ID NO: 229780 - DNA, 15 bp, Homo sapiens
aatcacaaaacataa

SEQ ID NO: 229781 - DNA, 15 bp, Homo sapiens
caatcacaaaacata

SEQ ID NO: 229782 - DNA, 15 bp, Homo sapiens
acaatcacaaaacat

SEQ ID NO: 229783 - DNA, 15 bp, Homo sapiens
aacaatcacaaaaca

SEQ ID NO: 229784 - DNA, 15 bp, Homo sapiens
caacaatcacaaaac

SEQ ID NO: 229785 - DNA, 15 bp, Homo sapiens
acaacaatcacaaaa

SEQ ID NO: 229786 - DNA, 15 bp, Homo sapiens
aacaacaatcacaaa

SEQ ID NO: 229787 - DNA, 15 bp, Homo sapiens
caacaacaatcacaa

SEQ ID NO: 229788 - DNA, 15 bp, Homo sapiens
acaacaacaatcaca

SEQ ID NO: 229789 - DNA, 15 bp, Homo sapiens
aacaacaacaatcac

SEQ ID NO: 229790 - DNA, 15 bp, Homo sapiens
gaacaacaacaatca

SEQ ID NO: 229791 - DNA, 15 bp, Homo sapiens
agaacaacaacaatc

SEQ ID NO: 229792 - DNA, 15 bp, Homo sapiens
aagaacaacaacaat

SEQ ID NO: 229793 - DNA, 15 bp, Homo sapiens
taagaacaacaacaa

SEQ ID NO: 229794 - DNA, 15 bp, Homo sapiens
ctaagaacaacaaca

SEQ ID NO: 229795 - DNA, 15 bp, Homo sapiens
actaagaacaacaac

SEQ ID NO: 229796 - DNA, 15 bp, Homo sapiens
tactaagaacaacaa

SEQ ID NO: 229797 - DNA, 15 bp, Homo sapiens
ctactaagaacaaca

SEQ ID NO: 229798 - DNA, 15 bp, Homo sapiens
tctactaagaacaac

SEQ ID NO: 229799 - DNA, 15 bp, Homo sapiens
ttctactaagaacaa

SEQ ID NO: 229800 - DNA, 15 bp, Homo sapiens
tttctactaagaaca

SEQ ID NO: 229801 - DNA, 15 bp, Homo sapiens
ttttctactaagaac

SEQ ID NO: 229802 - DNA, 15 bp, Homo sapiens
gttttctactaagaa

SEQ ID NO: 229803 - DNA, 15 bp, Homo sapiens
agttttctactaaga

SEQ ID NO: 229804 - DNA, 15 bp, Homo sapiens
cagttttctactaag

SEQ ID NO: 229805 - DNA, 15 bp, Homo sapiens
ccagttttctactaa

SEQ ID NO: 229806 - DNA, 15 bp, Homo sapiens
tccagttttctacta

SEQ ID NO: 229807 - DNA, 15 bp, Homo sapiens
ttccagttttctact

SEQ ID NO: 229808 - DNA, 15 bp, Homo sapiens
attccagttttctac

SEQ ID NO: 229809 - DNA, 15 bp, Homo sapiens
gattccagttttcta

SEQ ID NO: 229810 - DNA, 15 bp, Homo sapiens
agattccagttttct

SEQ ID NO: 229811 - DNA, 15 bp, Homo sapiens
aagattccagttttc

SEQ ID NO: 229812 - DNA, 15 bp, Homo sapiens
gaagattccagtttt

SEQ ID NO: 229813 - DNA, 15 bp, Homo sapiens
ggaagattccagttt

SEQ ID NO: 229814 - DNA, 15 bp, Homo sapiens
tggaagattccagtt

SEQ ID NO: 229815 - DNA, 15 bp, Homo sapiens
ttggaagattccagt

SEQ ID NO: 229816 - DNA, 15 bp, Homo sapiens
cttggaagattccag

SEQ ID NO: 229817 - DNA, 15 bp, Homo sapiens
tcttggaagattcca

SEQ ID NO: 229818 - DNA, 15 bp, Homo sapiens
ttcttggaagattcc

SEQ ID NO: 229819 - DNA, 15 bp, Homo sapiens
attcttggaagattc

SEQ ID NO: 229820 - DNA, 15 bp, Homo sapiens
aattcttggaagatt

SEQ ID NO: 229821 - DNA, 15 bp, Homo sapiens
taattcttggaagat

SEQ ID NO: 229822 - DNA, 15 bp, Homo sapiens
ctaattcttggaaga

SEQ ID NO: 229823 - DNA, 15 bp, Homo sapiens
tctaattcttggaag

SEQ ID NO: 229824 - DNA, 15 bp, Homo sapiens
ctctaattcttggaa

SEQ ID NO: 229825 - DNA, 15 bp, Homo sapiens
cctctaattcttgga

SEQ ID NO: 229826 - DNA, 15 bp, Homo sapiens
acctctaattcttgg

SEQ ID NO: 229827 - DNA, 15 bp, Homo sapiens
aacctctaattcttg

SEQ ID NO: 229828 - DNA, 15 bp, Homo sapiens
aaacctctaattctt

SEQ ID NO: 229829 - DNA, 15 bp, Homo sapiens
aaaacctctaattct

SEQ ID NO: 229830 - DNA, 15 bp, Homo sapiens
caaaacctctaattc

SEQ ID NO: 229831 - DNA, 15 bp, Homo sapiens
gcaaaacctctaatt

SEQ ID NO: 229832 - DNA, 15 bp, Homo sapiens
ggcaaaacctctaat

SEQ ID NO: 229833 - DNA, 15 bp, Homo sapiens
tggcaaaacctctaa

SEQ ID NO: 229834 - DNA, 15 bp, Homo sapiens
atggcaaaacctcta

SEQ ID NO: 229835 - DNA, 15 bp, Homo sapiens
aatggcaaaacctct

SEQ ID NO: 229836 - DNA, 15 bp, Homo sapiens
aaatggcaaaacctc

SEQ ID NO: 229837 - DNA, 15 bp, Homo sapiens
aaaatggcaaaacct

SEQ ID NO: 229838 - DNA, 15 bp, Homo sapiens
aaaaatggcaaaacc

SEQ ID NO: 229839 - DNA, 15 bp, Homo sapiens
aaaaaatggcaaaac

SEQ ID NO: 229840 - DNA, 15 bp, Homo sapiens
taaaaaatggcaaaa

SEQ ID NO: 229841 - DNA, 15 bp, Homo sapiens
ttaaaaaatggcaaa

SEQ ID NO: 229842 - DNA, 15 bp, Homo sapiens
cttaaaaaatggcaa

SEQ ID NO: 229843 - DNA, 15 bp, Homo sapiens
tcttaaaaaatggca

SEQ ID NO: 229844 - DNA, 15 bp, Homo sapiens
ttcttaaaaaatggc

SEQ ID NO: 229845 - DNA, 15 bp, Homo sapiens
cttcttaaaaaatgg

SEQ ID NO: 229846 - DNA, 15 bp, Homo sapiens
acttcttaaaaaatg

SEQ ID NO: 229847 - DNA, 15 bp, Homo sapiens
tacttcttaaaaaat

SEQ ID NO: 229848 - DNA, 15 bp, Homo sapiens
atacttcttaaaaaa

SEQ ID NO: 229849 - DNA, 15 bp, Homo sapiens
tatacttcttaaaaa

SEQ ID NO: 229850 - DNA, 15 bp, Homo sapiens
ttatacttcttaaaa

SEQ ID NO: 229851 - DNA, 15 bp, Homo sapiens
attatacttcttaaa

SEQ ID NO: 229852 - DNA, 15 bp, Homo sapiens
gattatacttcttaa

SEQ ID NO: 229853 - DNA, 15 bp, Homo sapiens
ggattatacttctta

SEQ ID NO: 229854 - DNA, 15 bp, Homo sapiens
aggattatacttctt

SEQ ID NO: 229855 - DNA, 15 bp, Homo sapiens
taggattatacttct

SEQ ID NO: 229856 - DNA, 15 bp, Homo sapiens
ctaggattatacttc

SEQ ID NO: 229857 - DNA, 15 bp, Homo sapiens
gctaggattatactt

SEQ ID NO: 229858 - DNA, 15 bp, Homo sapiens
tgctaggattatact

SEQ ID NO: 229859 - DNA, 15 bp, Homo sapiens
ttgctaggattatac

SEQ ID NO: 229860 - DNA, 15 bp, Homo sapiens
tttgctaggattata

SEQ ID NO: 229861 - DNA, 15 bp, Homo sapiens
ctttgctaggattat

SEQ ID NO: 229862 - DNA, 15 bp, Homo sapiens
cctttgctaggatta

SEQ ID NO: 229863 - DNA, 15 bp, Homo sapiens
gcctttgctaggatt

SEQ ID NO: 229864 - DNA, 15 bp, Homo sapiens
tgcctttgctaggat

SEQ ID NO: 229865 - DNA, 15 bp, Homo sapiens
atgcctttgctagga

SEQ ID NO: 229866 - DNA, 15 bp, Homo sapiens
catgcctttgctagg

SEQ ID NO: 229867 - DNA, 15 bp, Homo sapiens
tcatgcctttgctag

SEQ ID NO: 229868 - DNA, 15 bp, Homo sapiens
ttcatgcctttgcta

SEQ ID NO: 229869 - DNA, 15 bp, Homo sapiens
attcatgcctttgct

SEQ ID NO: 229870 - DNA, 15 bp, Homo sapiens
aattcatgcctttgc

SEQ ID NO: 229871 - DNA, 15 bp, Homo sapiens
gaattcatgcctttg

SEQ ID NO: 229872 - DNA, 15 bp, Homo sapiens
agaattcatgccttt

SEQ ID NO: 229873 - DNA, 15 bp, Homo sapiens
gagaattcatgcctt

SEQ ID NO: 229874 - DNA, 15 bp, Homo sapiens
ggagaattcatgcct

SEQ ID NO: 229875 - DNA, 15 bp, Homo sapiens
aggagaattcatgcc

SEQ ID NO: 229876 - DNA, 15 bp, Homo sapiens
gaggagaattcatgc

SEQ ID NO: 229877 - DNA, 15 bp, Homo sapiens
agaggagaattcatg

SEQ ID NO: 229878 - DNA, 15 bp, Homo sapiens
aagaggagaattcat

SEQ ID NO: 229879 - DNA, 15 bp, Homo sapiens
gaagaggagaattca

SEQ ID NO: 229880 - DNA, 15 bp, Homo sapiens
tgaagaggagaattc

SEQ ID NO: 229881 - DNA, 15 bp, Homo sapiens
ttgaagaggagaatt

SEQ ID NO: 229882 - DNA, 15 bp, Homo sapiens
attgaagaggagaat

SEQ ID NO: 229883 - DNA, 15 bp, Homo sapiens
aattgaagaggagaa

SEQ ID NO: 229884 - DNA, 15 bp, Homo sapiens
taattgaagaggaga

SEQ ID NO: 229885 - DNA, 15 bp, Homo sapiens
ttaattgaagaggag

SEQ ID NO: 229886 - DNA, 15 bp, Homo sapiens
tttaattgaagagga

SEQ ID NO: 229887 - DNA, 15 bp, Homo sapiens
gtttaattgaagagg

SEQ ID NO: 229888 - DNA, 15 bp, Homo sapiens
agtttaattgaagag

SEQ ID NO: 229889 - DNA, 15 bp, Homo sapiens
gagtttaattgaaga

SEQ ID NO: 229890 - DNA, 15 bp, Homo sapiens
tgagtttaattgaag

SEQ ID NO: 229891 - DNA, 15 bp, Homo sapiens
atgagtttaattgaa

SEQ ID NO: 229892 - DNA, 15 bp, Homo sapiens
gatgagtttaattga

SEQ ID NO: 229893 - DNA, 15 bp, Homo sapiens
tgatgagtttaattg

SEQ ID NO: 229894 - DNA, 15 bp, Homo sapiens
gtgatgagtttaatt

SEQ ID NO: 229895 - DNA, 15 bp, Homo sapiens
agtgatgagtttaat

SEQ ID NO: 229896 - DNA, 15 bp, Homo sapiens
aagtgatgagtttaa

SEQ ID NO: 229897 - DNA, 15 bp, Homo sapiens
taagtgatgagttta

SEQ ID NO: 229898 - DNA, 15 bp, Homo sapiens
ataagtgatgagttt

SEQ ID NO: 229899 - DNA, 15 bp, Homo sapiens
aataagtgatgagtt

SEQ ID NO: 229900 - DNA, 15 bp, Homo sapiens
aaataagtgatgagt

SEQ ID NO: 229901 - DNA, 15 bp, Homo sapiens
aaaataagtgatgag

SEQ ID NO: 229902 - DNA, 15 bp, Homo sapiens
caaaataagtgatga

SEQ ID NO: 229903 - DNA, 15 bp, Homo sapiens
ccaaaataagtgatg

SEQ ID NO: 229904 - DNA, 15 bp, Homo sapiens
gccaaaataagtgat

SEQ ID NO: 229905 - DNA, 15 bp, Homo sapiens
tgccaaaataagtga

SEQ ID NO: 229906 - DNA, 15 bp, Homo sapiens
ctgccaaaataagtg

SEQ ID NO: 229907 - DNA, 15 bp, Homo sapiens
actgccaaaataagt

SEQ ID NO: 229908 - DNA, 15 bp, Homo sapiens
tactgccaaaataag

SEQ ID NO: 229909 - DNA, 15 bp, Homo sapiens
gtactgccaaaataa

SEQ ID NO: 229910 - DNA, 15 bp, Homo sapiens
tgtactgccaaaata

SEQ ID NO: 229911 - DNA, 15 bp, Homo sapiens
atgtactgccaaaat

SEQ ID NO: 229912 - DNA, 15 bp, Homo sapiens
tatgtactgccaaaa

SEQ ID NO: 229913 - DNA, 15 bp, Homo sapiens
ttatgtactgccaaa

SEQ ID NO: 229914 - DNA, 15 bp, Homo sapiens
tttatgtactgccaa

SEQ ID NO: 229915 - DNA, 15 bp, Homo sapiens
gtttatgtactgcca

SEQ ID NO: 229916 - DNA, 15 bp, Homo sapiens
tgtttatgtactgcc

SEQ ID NO: 229917 - DNA, 15 bp, Homo sapiens
atgtttatgtactgc

SEQ ID NO: 229918 - DNA, 15 bp, Homo sapiens
tatgtttatgtactg

SEQ ID NO: 229919 - DNA, 15 bp, Homo sapiens
ttatgtttatgtact

SEQ ID NO: 229920 - DNA, 15 bp, Homo sapiens
cttatgtttatgtac

SEQ ID NO: 229921 - DNA, 15 bp, Homo sapiens
gcttatgtttatgta

SEQ ID NO: 229922 - DNA, 15 bp, Homo sapiens
ggcttatgtttatgt

SEQ ID NO: 229923 - DNA, 15 bp, Homo sapiens
tggcttatgtttatg

SEQ ID NO: 229924 - DNA, 15 bp, Homo sapiens
atggcttatgtttat

SEQ ID NO: 229925 - DNA, 15 bp, Homo sapiens
tatggcttatgttta

SEQ ID NO: 229926 - DNA, 15 bp, Homo sapiens
atatggcttatgttt

SEQ ID NO: 229927 - DNA, 15 bp, Homo sapiens
aatatggcttatgtt

SEQ ID NO: 229928 - DNA, 15 bp, Homo sapiens
aaatatggcttatgt

SEQ ID NO: 229929 - DNA, 15 bp, Homo sapiens
taaatatggcttatg

SEQ ID NO: 229930 - DNA, 15 bp, Homo sapiens
ttaaatatggcttat

SEQ ID NO: 229931 - DNA, 15 bp, Homo sapiens
gttaaatatggctta

SEQ ID NO: 229932 - DNA, 15 bp, Homo sapiens
agttaaatatggctt

SEQ ID NO: 229933 - DNA, 15 bp, Homo sapiens
aagttaaatatggct

SEQ ID NO: 229934 - DNA, 15 bp, Homo sapiens
taagttaaatatggc

SEQ ID NO: 229935 - DNA, 15 bp, Homo sapiens
ataagttaaatatgg

SEQ ID NO: 229936 - DNA, 15 bp, Homo sapiens
tataagttaaatatg

SEQ ID NO: 229937 - DNA, 15 bp, Homo sapiens
ttataagttaaatat

SEQ ID NO: 229938 - DNA, 15 bp, Homo sapiens
cttataagttaaata

SEQ ID NO: 229939 - DNA, 15 bp, Homo sapiens
tcttataagttaaat

SEQ ID NO: 229940 - DNA, 15 bp, Homo sapiens
ttcttataagttaaa

SEQ ID NO: 229941 - DNA, 15 bp, Homo sapiens
attcttataagttaa

SEQ ID NO: 229942 - DNA, 15 bp, Homo sapiens
cattcttataagtta

SEQ ID NO: 229943 - DNA, 15 bp, Homo sapiens
ccattcttataagtt

SEQ ID NO: 229944 - DNA, 15 bp, Homo sapiens
gccattcttataagt

SEQ ID NO: 229945 - DNA, 15 bp, Homo sapiens
tgccattcttataag

SEQ ID NO: 229946 - DNA, 15 bp, Homo sapiens
ctgccattcttataa

SEQ ID NO: 229947 - DNA, 15 bp, Homo sapiens
tctgccattcttata

SEQ ID NO: 229948 - DNA, 15 bp, Homo sapiens
ctctgccattcttat

SEQ ID NO: 229949 - DNA, 15 bp, Homo sapiens
gctctgccattctta

SEQ ID NO: 229950 - DNA, 15 bp, Homo sapiens
tgctctgccattctt

SEQ ID NO: 229951 - DNA, 15 bp, Homo sapiens
atgctctgccattct

SEQ ID NO: 229952 - DNA, 15 bp, Homo sapiens
catgctctgccattc

SEQ ID NO: 229953 - DNA, 15 bp, Homo sapiens
ccatgctctgccatt

SEQ ID NO: 229954 - DNA, 15 bp, Homo sapiens
cccatgctctgccat

SEQ ID NO: 229955 - DNA, 15 bp, Homo sapiens
acccatgctctgcca

SEQ ID NO: 229956 - DNA, 15 bp, Homo sapiens
tacccatgctctgcc

SEQ ID NO: 229957 - DNA, 15 bp, Homo sapiens
ctacccatgctctgc

SEQ ID NO: 229958 - DNA, 15 bp, Homo sapiens
tctacccatgctctg

SEQ ID NO: 229959 - DNA, 15 bp, Homo sapiens
ttctacccatgctct

SEQ ID NO: 229960 - DNA, 15 bp, Homo sapiens
tttctacccatgctc

SEQ ID NO: 229961 - DNA, 15 bp, Homo sapiens
ctttctacccatgct

SEQ ID NO: 229962 - DNA, 15 bp, Homo sapiens
gctttctacccatgc

SEQ ID NO: 229963 - DNA, 15 bp, Homo sapiens
agctttctacccatg

SEQ ID NO: 229964 - DNA, 15 bp, Homo sapiens
gagctttctacccat

SEQ ID NO: 229965 - DNA, 15 bp, Homo sapiens
ggagctttctaccca

SEQ ID NO: 229966 - DNA, 15 bp, Homo sapiens
tggagctttctaccc

SEQ ID NO: 229967 - DNA, 15 bp, Homo sapiens
ctggagctttctacc

SEQ ID NO: 229968 - DNA, 15 bp, Homo sapiens
tctggagctttctac

SEQ ID NO: 229969 - DNA, 15 bp, Homo sapiens
gtctggagctttcta

SEQ ID NO: 229970 - DNA, 15 bp, Homo sapiens
agtctggagctttct

SEQ ID NO: 229971 - DNA, 15 bp, Homo sapiens
aagtctggagctttc

SEQ ID NO: 229972 - DNA, 15 bp, Homo sapiens
gaagtctggagcttt

SEQ ID NO: 229973 - DNA, 15 bp, Homo sapiens
agaagtctggagctt

SEQ ID NO: 229974 - DNA, 15 bp, Homo sapiens
gagaagtctggagct

SEQ ID NO: 229975 - DNA, 15 bp, Homo sapiens
agagaagtctggagc

SEQ ID NO: 229976 - DNA, 15 bp, Homo sapiens
cagagaagtctggag

SEQ ID NO: 229977 - DNA, 15 bp, Homo sapiens
acagagaagtctgga

SEQ ID NO: 229978 - DNA, 15 bp, Homo sapiens
tacagagaagtctgg

SEQ ID NO: 229979 - DNA, 15 bp, Homo sapiens
ctacagagaagtctg

SEQ ID NO: 229980 - DNA, 15 bp, Homo sapiens
gctacagagaagtct

SEQ ID NO: 229981 - DNA, 15 bp, Homo sapiens
agctacagagaagtc

SEQ ID NO: 229982 - DNA, 15 bp, Homo sapiens
gagctacagagaagt

SEQ ID NO: 229983 - DNA, 15 bp, Homo sapiens
cgagctacagagaag

SEQ ID NO: 229984 - DNA, 15 bp, Homo sapiens
tcgagctacagagaa

SEQ ID NO: 229985 - DNA, 15 bp, Homo sapiens
atcgagctacagaga

SEQ ID NO: 229986 - DNA, 15 bp, Homo sapiens
gatcgagctacagag

SEQ ID NO: 229987 - DNA, 15 bp, Homo sapiens
tgatcgagctacaga

SEQ ID NO: 229988 - DNA, 15 bp, Homo sapiens
ttgatcgagctacag

SEQ ID NO: 229989 - DNA, 15 bp, Homo sapiens
attgatcgagctaca

SEQ ID NO: 229990 - DNA, 15 bp, Homo sapiens
gattgatcgagctac

SEQ ID NO: 229991 - DNA, 15 bp, Homo sapiens
tgattgatcgagcta

SEQ ID NO: 229992 - DNA, 15 bp, Homo sapiens
gtgattgatcgagct

SEQ ID NO: 229993 - DNA, 15 bp, Homo sapiens
agtgattgatcgagc

SEQ ID NO: 229994 - DNA, 15 bp, Homo sapiens
tagtgattgatcgag

SEQ ID NO: 229995 - DNA, 15 bp, Homo sapiens
ctagtgattgatcga

SEQ ID NO: 229996 - DNA, 15 bp, Homo sapiens
cctagtgattgatcg

SEQ ID NO: 229997 - DNA, 15 bp, Homo sapiens
ccctagtgattgatc

SEQ ID NO: 229998 - DNA, 15 bp, Homo sapiens
cccctagtgattgat

SEQ ID NO: 229999 - DNA, 15 bp, Homo sapiens
gcccctagtgattga

SEQ ID NO: 230000 - DNA, 15 bp, Homo sapiens
agcccctagtgattg

SEQ ID NO: 230001 - DNA, 15 bp, Homo sapiens
cagcccctagtgatt

SEQ ID NO: 230002 - DNA, 15 bp, Homo sapiens
acagcccctagtgat

SEQ ID NO: 230003 - DNA, 15 bp, Homo sapiens
cacagcccctagtga

SEQ ID NO: 230004 - DNA, 15 bp, Homo sapiens
acacagcccctagtg

SEQ ID NO: 230005 - DNA, 15 bp, Homo sapiens
aacacagcccctagt

SEQ ID NO: 230006 - DNA, 15 bp, Homo sapiens
aaacacagcccctag

SEQ ID NO: 230007 - DNA, 15 bp, Homo sapiens
taaacacagccccta

SEQ ID NO: 230008 - DNA, 15 bp, Homo sapiens
ctaaacacagcccct

SEQ ID NO: 230009 - DNA, 15 bp, Homo sapiens
gctaaacacagcccc

SEQ ID NO: 230010 - DNA, 15 bp, Homo sapiens
agctaaacacagccc

SEQ ID NO: 230011 - DNA, 15 bp, Homo sapiens
cagctaaacacagcc

SEQ ID NO: 230012 - DNA, 15 bp, Homo sapiens
ccagctaaacacagc

SEQ ID NO: 230013 - DNA, 15 bp, Homo sapiens
cccagctaaacacag

SEQ ID NO: 230014 - DNA, 15 bp, Homo sapiens
tcccagctaaacaca

SEQ ID NO: 230015 - DNA, 15 bp, Homo sapiens
ttcccagctaaacac

SEQ ID NO: 230016 - DNA, 15 bp, Homo sapiens
cttcccagctaaaca

SEQ ID NO: 230017 - DNA, 15 bp, Homo sapiens
gcttcccagctaaac

SEQ ID NO: 230018 - DNA, 15 bp, Homo sapiens
tgcttcccagctaaa

SEQ ID NO: 230019 - DNA, 15 bp, Homo sapiens
ctgcttcccagctaa

SEQ ID NO: 230020 - DNA, 15 bp, Homo sapiens
gctgcttcccagcta

SEQ ID NO: 230021 - DNA, 15 bp, Homo sapiens
ggctgcttcccagct

SEQ ID NO: 230022 - DNA, 15 bp, Homo sapiens
aggctgcttcccagc

SEQ ID NO: 230023 - DNA, 15 bp, Homo sapiens
caggctgcttcccag

SEQ ID NO: 230024 - DNA, 15 bp, Homo sapiens
ccaggctgcttccca

SEQ ID NO: 230025 - DNA, 15 bp, Homo sapiens
cccaggctgcttccc

SEQ ID NO: 230026 - DNA, 15 bp, Homo sapiens
ccccaggctgcttcc

SEQ ID NO: 230027 - DNA, 15 bp, Homo sapiens
tccccaggctgcttc

SEQ ID NO: 230028 - DNA, 15 bp, Homo sapiens
ctccccaggctgctt

SEQ ID NO: 230029 - DNA, 15 bp, Homo sapiens
tctccccaggctgct

SEQ ID NO: 230030 - DNA, 15 bp, Homo sapiens
ctctccccaggctgc

SEQ ID NO: 230031 - DNA, 15 bp, Homo sapiens
tctctccccaggctg

SEQ ID NO: 230032 - DNA, 15 bp, Homo sapiens
atctctccccaggct

SEQ ID NO: 230033 - DNA, 15 bp, Homo sapiens
catctctccccaggc

SEQ ID NO: 230034 - DNA, 15 bp, Homo sapiens
ccatctctccccagg

SEQ ID NO: 230035 - DNA, 15 bp, Homo sapiens
cccatctctccccag

SEQ ID NO: 230036 - DNA, 15 bp, Homo sapiens
gcccatctctcccca

SEQ ID NO: 230037 - DNA, 15 bp, Homo sapiens
tgcccatctctcccc

SEQ ID NO: 230038 - DNA, 15 bp, Homo sapiens
ctgcccatctctccc

SEQ ID NO: 230039 - DNA, 15 bp, Homo sapiens
actgcccatctctcc

SEQ ID NO: 230040 - DNA, 15 bp, Homo sapiens
gactgcccatctctc

SEQ ID NO: 230041 - DNA, 15 bp, Homo sapiens
tgactgcccatctct

SEQ ID NO: 230042 - DNA, 15 bp, Homo sapiens
atgactgcccatctc

SEQ ID NO: 230043 - DNA, 15 bp, Homo sapiens
catgactgcccatct

SEQ ID NO: 230044 - DNA, 15 bp, Homo sapiens
acatgactgcccatc

SEQ ID NO: 230045 - DNA, 15 bp, Homo sapiens
cacatgactgcccat

SEQ ID NO: 230046 - DNA, 15 bp, Homo sapiens
ccacatgactgccca

SEQ ID NO: 230047 - DNA, 15 bp, Homo sapiens
gccacatgactgccc

SEQ ID NO: 230048 - DNA, 15 bp, Homo sapiens
tgccacatgactgcc

SEQ ID NO: 230049 - DNA, 15 bp, Homo sapiens
ttgccacatgactgc

SEQ ID NO: 230050 - DNA, 15 bp, Homo sapiens
cttgccacatgactg

SEQ ID NO: 230051 - DNA, 15 bp, Homo sapiens
tcttgccacatgact

SEQ ID NO: 230052 - DNA, 15 bp, Homo sapiens
ttcttgccacatgac

SEQ ID NO: 230053 - DNA, 15 bp, Homo sapiens
tttcttgccacatga

SEQ ID NO: 230054 - DNA, 15 bp, Homo sapiens
atttcttgccacatg

SEQ ID NO: 230055 - DNA, 15 bp, Homo sapiens
tatttcttgccacat

SEQ ID NO: 230056 - DNA, 15 bp, Homo sapiens
ttatttcttgccaca

SEQ ID NO: 230057 - DNA, 15 bp, Homo sapiens
tttatttcttgccac

SEQ ID NO: 230058 - DNA, 15 bp, Homo sapiens
ttttatttcttgcca

SEQ ID NO: 230059 - DNA, 15 bp, Homo sapiens
cttttatttcttgcc

SEQ ID NO: 230060 - DNA, 15 bp, Homo sapiens
tcttttatttcttgc

SEQ ID NO: 230061 - DNA, 15 bp, Homo sapiens
gtcttttatttcttg

SEQ ID NO: 230062 - DNA, 15 bp, Homo sapiens
agtcttttatttctt

SEQ ID NO: 230063 - DNA, 15 bp, Homo sapiens
aagtcttttatttct

SEQ ID NO: 230064 - DNA, 15 bp, Homo sapiens
aaagtcttttatttc

SEQ ID NO: 230065 - DNA, 15 bp, Homo sapiens
caaagtcttttattt

SEQ ID NO: 230066 - DNA, 15 bp, Homo sapiens
tcaaagtcttttatt

SEQ ID NO: 230067 - DNA, 15 bp, Homo sapiens
ttcaaagtcttttat

SEQ ID NO: 230068 - DNA, 15 bp, Homo sapiens
attcaaagtctttta

SEQ ID NO: 230069 - DNA, 15 bp, Homo sapiens
gattcaaagtctttt

SEQ ID NO: 230070 - DNA, 15 bp, Homo sapiens
agattcaaagtcttt

SEQ ID NO: 230071 - DNA, 15 bp, Homo sapiens
tagattcaaagtctt

SEQ ID NO: 230072 - DNA, 15 bp, Homo sapiens
ttagattcaaagtct

SEQ ID NO: 230073 - DNA, 15 bp, Homo sapiens
tttagattcaaagtc

SEQ ID NO: 230074 - DNA, 15 bp, Homo sapiens
ttttagattcaaagt

SEQ ID NO: 230075 - DNA, 15 bp, Homo sapiens
gttttagattcaaag

SEQ ID NO: 230076 - DNA, 15 bp, Homo sapiens
agttttagattcaaa

SEQ ID NO: 230077 - DNA, 15 bp, Homo sapiens
gagttttagattcaa

SEQ ID NO: 230078 - DNA, 15 bp, Homo sapiens
ggagttttagattca

SEQ ID NO: 230079 - DNA, 15 bp, Homo sapiens
aggagttttagattc

SEQ ID NO: 230080 - DNA, 15 bp, Homo sapiens
caggagttttagatt

SEQ ID NO: 230081 - DNA, 15 bp, Homo sapiens
acaggagttttagat

SEQ ID NO: 230082 - DNA, 15 bp, Homo sapiens
gacaggagttttaga

SEQ ID NO: 230083 - DNA, 15 bp, Homo sapiens
ggacaggagttttag

SEQ ID NO: 230084 - DNA, 15 bp, Homo sapiens
aggacaggagtttta

SEQ ID NO: 230085 - DNA, 15 bp, Homo sapiens
aaggacaggagtttt

SEQ ID NO: 230086 - DNA, 15 bp, Homo sapiens
aaaggacaggagttt

SEQ ID NO: 230087 - DNA, 15 bp, Homo sapiens
caaaggacaggagtt

SEQ ID NO: 230088 - DNA, 15 bp, Homo sapiens
tcaaaggacaggagt

SEQ ID NO: 230089 - DNA, 15 bp, Homo sapiens
atcaaaggacaggag

SEQ ID NO: 230090 - DNA, 15 bp, Homo sapiens
aatcaaaggacagga

SEQ ID NO: 230091 - DNA, 15 bp, Homo sapiens
gaatcaaaggacagg

SEQ ID NO: 230092 - DNA, 15 bp, Homo sapiens
agaatcaaaggacag

SEQ ID NO: 230093 - DNA, 15 bp, Homo sapiens
aagaatcaaaggaca

SEQ ID NO: 230094 - DNA, 15 bp, Homo sapiens
caagaatcaaaggac

SEQ ID NO: 230095 - DNA, 15 bp, Homo sapiens
tcaagaatcaaagga

SEQ ID NO: 230096 - DNA, 15 bp, Homo sapiens
ttcaagaatcaaagg

SEQ ID NO: 230097 - DNA, 15 bp, Homo sapiens
tttcaagaatcaaag

SEQ ID NO: 230098 - DNA, 15 bp, Homo sapiens
ctttcaagaatcaaa

SEQ ID NO: 230099 - DNA, 15 bp, Homo sapiens
tctttcaagaatcaa

SEQ ID NO: 230100 - DNA, 15 bp, Homo sapiens
ctctttcaagaatca

SEQ ID NO: 230101 - DNA, 15 bp, Homo sapiens
tctctttcaagaatc

SEQ ID NO: 230102 - DNA, 15 bp, Homo sapiens
ttctctttcaagaat

SEQ ID NO: 230103 - DNA, 15 bp, Homo sapiens
tttctctttcaagaa

SEQ ID NO: 230104 - DNA, 15 bp, Homo sapiens
ctttctctttcaaga

SEQ ID NO: 230105 - DNA, 15 bp, Homo sapiens
cctttctctttcaag

SEQ ID NO: 230106 - DNA, 15 bp, Homo sapiens
ccctttctctttcaa

SEQ ID NO: 230107 - DNA, 15 bp, Homo sapiens
cccctttctctttca

SEQ ID NO: 230108 - DNA, 15 bp, Homo sapiens
tcccctttctctttc

SEQ ID NO: 230109 - DNA, 15 bp, Homo sapiens
ctcccctttctcttt

SEQ ID NO: 230110 - DNA, 15 bp, Homo sapiens
tctcccctttctctt

SEQ ID NO: 230111 - DNA, 15 bp, Homo sapiens
ttctcccctttctct

SEQ ID NO: 230112 - DNA, 15 bp, Homo sapiens
aattctcccctttct

SEQ ID NO: 230113 - DNA, 15 bp, Homo sapiens
aaattctcccctttc

SEQ ID NO: 230114 - DNA, 15 bp, Homo sapiens
aaaattctccccttt

SEQ ID NO: 230115 - DNA, 15 bp, Homo sapiens
gaaaattctcccctt

SEQ ID NO: 230116 - DNA, 15 bp, Homo sapiens
agaaaattctcccct

SEQ ID NO: 230117 - DNA, 15 bp, Homo sapiens
aagaaaattctcccc

SEQ ID NO: 230118 - DNA, 15 bp, Homo sapiens
gaagaaaattctccc

SEQ ID NO: 230119 - DNA, 15 bp, Homo sapiens
agaagaaaattctcc

SEQ ID NO: 230120 - DNA, 15 bp, Homo sapiens
aagaagaaaattctc

SEQ ID NO: 230121 - DNA, 15 bp, Homo sapiens
aaagaagaaaattct

SEQ ID NO: 230122 - DNA, 15 bp, Homo sapiens
taaagaagaaaattc

SEQ ID NO: 230123 - DNA, 15 bp, Homo sapiens
ataaagaagaaaatt

SEQ ID NO: 230124 - DNA, 15 bp, Homo sapiens
aataaagaagaaaat

SEQ ID NO: 230125 - DNA, 15 bp, Homo sapiens
aaataaagaagaaaa

SEQ ID NO: 230126 - DNA, 15 bp, Homo sapiens
aaaataaagaagaaa

SEQ ID NO: 230127 - DNA, 15 bp, Homo sapiens
gaaaataaagaagaa

SEQ ID NO: 230128 - DNA, 15 bp, Homo sapiens
agaaaataaagaaga

SEQ ID NO: 230129 - DNA, 15 bp, Homo sapiens
aagaaaataaagaag

SEQ ID NO: 230130 - DNA, 15 bp, Homo sapiens
aaagaaaataaagaa

SEQ ID NO: 230131 - DNA, 15 bp, Homo sapiens
aaaagaaaataaaga

SEQ ID NO: 230132 - DNA, 15 bp, Homo sapiens
aaaaagaaaataaag

SEQ ID NO: 230133 - DNA, 15 bp, Homo sapiens
gaaaaagaaaataaa

SEQ ID NO: 230134 - DNA, 15 bp, Homo sapiens
agaaaaagaaaataa

SEQ ID NO: 230135 - DNA, 15 bp, Homo sapiens
tagaaaaagaaaata

SEQ ID NO: 230136 - DNA, 15 bp, Homo sapiens
ctagaaaaagaaaat

SEQ ID NO: 230137 - DNA, 15 bp, Homo sapiens
actagaaaaagaaaa

SEQ ID NO: 230138 - DNA, 15 bp, Homo sapiens
aactagaaaaagaaa

SEQ ID NO: 230139 - DNA, 15 bp, Homo sapiens
taactagaaaaagaa

SEQ ID NO: 230140 - DNA, 15 bp, Homo sapiens
ttaactagaaaaaga

SEQ ID NO: 230141 - DNA, 15 bp, Homo sapiens
tttaactagaaaaag

SEQ ID NO: 230142 - DNA, 15 bp, Homo sapiens
ctttaactagaaaaa

SEQ ID NO: 230143 - DNA, 15 bp, Homo sapiens
tctttaactagaaaa

SEQ ID NO: 230144 - DNA, 15 bp, Homo sapiens
atctttaactagaaa

SEQ ID NO: 230145 - DNA, 15 bp, Homo sapiens
tatctttaactagaa

SEQ ID NO: 230146 - DNA, 15 bp, Homo sapiens
atatctttaactaga

SEQ ID NO: 230147 - DNA, 15 bp, Homo sapiens
aatatctttaactag

SEQ ID NO: 230148 - DNA, 15 bp, Homo sapiens
caatatctttaacta

SEQ ID NO: 230149 - DNA, 15 bp, Homo sapiens
acaatatctttaact

SEQ ID NO: 230150 - DNA, 15 bp, Homo sapiens
tacaatatctttaac

SEQ ID NO: 230151 - DNA, 15 bp, Homo sapiens
gtacaatatctttaa

SEQ ID NO: 230152 - DNA, 15 bp, Homo sapiens
tgtacaatatcttta

SEQ ID NO: 230153 - DNA, 15 bp, Homo sapiens
ctgtacaatatcttt

SEQ ID NO: 230154 - DNA, 15 bp, Homo sapiens
tctgtacaatatctt

SEQ ID NO: 230155 - DNA, 15 bp, Homo sapiens
ctctgtacaatatct

SEQ ID NO: 230156 - DNA, 15 bp, Homo sapiens
tctctgtacaatatc

SEQ ID NO: 230157 - DNA, 15 bp, Homo sapiens
atctctgtacaatat

SEQ ID NO: 230158 - DNA, 15 bp, Homo sapiens
aatctctgtacaata

SEQ ID NO: 230159 - DNA, 15 bp, Homo sapiens
caatctctgtacaat

SEQ ID NO: 230160 - DNA, 15 bp, Homo sapiens
tcaatctctgtacaa

SEQ ID NO: 230161 - DNA, 15 bp, Homo sapiens
atcaatctctgtaca

SEQ ID NO: 230162 - DNA, 15 bp, Homo sapiens
aatcaatctctgtac

SEQ ID NO: 230163 - DNA, 15 bp, Homo sapiens
aaatcaatctctgta

SEQ ID NO: 230164 - DNA, 15 bp, Homo sapiens
taaatcaatctctgt

SEQ ID NO: 230165 - DNA, 15 bp, Homo sapiens
ataaatcaatctctg

SEQ ID NO: 230166 - DNA, 15 bp, Homo sapiens
cataaatcaatctct

SEQ ID NO: 230167 - DNA, 15 bp, Homo sapiens
gcataaatcaatctc

SEQ ID NO: 230168 - DNA, 15 bp, Homo sapiens
tgcataaatcaatct

SEQ ID NO: 230169 - DNA, 15 bp, Homo sapiens
atgcataaatcaatc

SEQ ID NO: 230170 - DNA, 15 bp, Homo sapiens
aatgcataaatcaat

SEQ ID NO: 230171 - DNA, 15 bp, Homo sapiens
taaatgcataaatca

SEQ ID NO: 230172 - DNA, 15 bp, Homo sapiens
ttaaatgcataaatc

SEQ ID NO: 230173 - DNA, 15 bp, Homo sapiens
gttaaatgcataaat

SEQ ID NO: 230174 - DNA, 15 bp, Homo sapiens
tgttaaatgcataaa

SEQ ID NO: 230175 - DNA, 15 bp, Homo sapiens
ttgttaaatgcataa

SEQ ID NO: 230176 - DNA, 15 bp, Homo sapiens
cttgttaaatgcata

SEQ ID NO: 230177 - DNA, 15 bp, Homo sapiens
acttgttaaatgcat

SEQ ID NO: 230178 - DNA, 15 bp, Homo sapiens
tacttgttaaatgca

SEQ ID NO: 230179 - DNA, 15 bp, Homo sapiens
gtacttgttaaatgc

SEQ ID NO: 230180 - DNA, 15 bp, Homo sapiens
cgtacttgttaaatg

SEQ ID NO: 230181 - DNA, 15 bp, Homo sapiens
acgtacttgttaaat

SEQ ID NO: 230182 - DNA, 15 bp, Homo sapiens
aacgtacttgttaaa

SEQ ID NO: 230183 - DNA, 15 bp, Homo sapiens
aaacgtacttgttaa

SEQ ID NO: 230184 - DNA, 15 bp, Homo sapiens
aaaacgtacttgtta

SEQ ID NO: 230185 - DNA, 15 bp, Homo sapiens
caaaacgtacttgtt

SEQ ID NO: 230186 - DNA, 15 bp, Homo sapiens
tcaaaacgtacttgt

SEQ ID NO: 230187 - DNA, 15 bp, Homo sapiens
ctcaaaacgtacttg

SEQ ID NO: 230188 - DNA, 15 bp, Homo sapiens
actcaaaacgtactt

SEQ ID NO: 230189 - DNA, 15 bp, Homo sapiens
cactcaaaacgtact

SEQ ID NO: 230190 - DNA, 15 bp, Homo sapiens
gcactcaaaacgtac

SEQ ID NO: 230191 - DNA, 15 bp, Homo sapiens
ggcactcaaaacgta

SEQ ID NO: 230192 - DNA, 15 bp, Homo sapiens
aggcactcaaaacgt

SEQ ID NO: 230193 - DNA, 15 bp, Homo sapiens
taggcactcaaaacg

SEQ ID NO: 230194 - DNA, 15 bp, Homo sapiens
gtaggcactcaaaac

SEQ ID NO: 230195 - DNA, 15 bp, Homo sapiens
ggtaggcactcaaaa

SEQ ID NO: 230196 - DNA, 15 bp, Homo sapiens
tggtaggcactcaaa

SEQ ID NO: 230197 - DNA, 15 bp, Homo sapiens
atggtaggcactcaa

SEQ ID NO: 230198 - DNA, 15 bp, Homo sapiens
aatggtaggcactca

SEQ ID NO: 230199 - DNA, 15 bp, Homo sapiens
aaatggtaggcactc

SEQ ID NO: 230200 - DNA, 15 bp, Homo sapiens
taaatggtaggcact

SEQ ID NO: 230201 - DNA, 15 bp, Homo sapiens
gtaaatggtaggcac

SEQ ID NO: 230202 - DNA, 15 bp, Homo sapiens
tgtaaatggtaggca

SEQ ID NO: 230203 - DNA, 15 bp, Homo sapiens
ttgtaaatggtaggc

SEQ ID NO: 230204 - DNA, 15 bp, Homo sapiens
cttgtaaatggtagg

SEQ ID NO: 230205 - DNA, 15 bp, Homo sapiens
ccttgtaaatggtag

SEQ ID NO: 230206 - DNA, 15 bp, Homo sapiens
cccttgtaaatggta

SEQ ID NO: 230207 - DNA, 15 bp, Homo sapiens
ccccttgtaaatggt

SEQ ID NO: 230208 - DNA, 15 bp, Homo sapiens
cccccttgtaaatgg

SEQ ID NO: 230209 - DNA, 15 bp, Homo sapiens
ccccccttgtaaatg

SEQ ID NO: 230210 - DNA, 15 bp, Homo sapiens
accccccttgtaaat

SEQ ID NO: 230211 - DNA, 15 bp, Homo sapiens
caccccccttgtaaa

SEQ ID NO: 230212 - DNA, 15 bp, Homo sapiens
acaccccccttgtaa

SEQ ID NO: 230213 - DNA, 15 bp, Homo sapiens
aacaccccccttgta

SEQ ID NO: 230214 - DNA, 15 bp, Homo sapiens
gaacaccccccttgt

SEQ ID NO: 230215 - DNA, 15 bp, Homo sapiens
agaacaccccccttg

SEQ ID NO: 230216 - DNA, 15 bp, Homo sapiens
tagaacacccccctt

SEQ ID NO: 230217 - DNA, 15 bp, Homo sapiens
ctagaacacccccct

SEQ ID NO: 230218 - DNA, 15 bp, Homo sapiens
tctagaacacccccc

SEQ ID NO: 230219 - DNA, 15 bp, Homo sapiens
atctagaacaccccc

SEQ ID NO: 230220 - DNA, 15 bp, Homo sapiens
tatctagaacacccc

SEQ ID NO: 230221 - DNA, 15 bp, Homo sapiens
gtatctagaacaccc

SEQ ID NO: 230222 - DNA, 15 bp, Homo sapiens
agtatctagaacacc

SEQ ID NO: 230223 - DNA, 15 bp, Homo sapiens
gagtatctagaacac

SEQ ID NO: 230224 - DNA, 15 bp, Homo sapiens
cgagtatctagaaca

SEQ ID NO: 230225 - DNA, 15 bp, Homo sapiens
ccgagtatctagaac

SEQ ID NO: 230226 - DNA, 15 bp, Homo sapiens
cccgagtatctagaa

SEQ ID NO: 230227 - DNA, 15 bp, Homo sapiens
tcccgagtatctaga

SEQ ID NO: 230228 - DNA, 15 bp, Homo sapiens
atcccgagtatctag

SEQ ID NO: 230229 - DNA, 15 bp, Homo sapiens
tatcccgagtatcta

SEQ ID NO: 230230 - DNA, 15 bp, Homo sapiens
gtatcccgagtatct

SEQ ID NO: 230231 - DNA, 15 bp, Homo sapiens
tgtatcccgagtatc

SEQ ID NO: 230232 - DNA, 15 bp, Homo sapiens
ctgtatcccgagtat

SEQ ID NO: 230233 - DNA, 15 bp, Homo sapiens
actgtatcccgagta

SEQ ID NO: 230234 - DNA, 15 bp, Homo sapiens
tactgtatcccgagt

SEQ ID NO: 230235 - DNA, 15 bp, Homo sapiens
ctactgtatcccgag

SEQ ID NO: 230236 - DNA, 15 bp, Homo sapiens
actactgtatcccga

SEQ ID NO: 230237 - DNA, 15 bp, Homo sapiens
tactactgtatcccg

SEQ ID NO: 230238 - DNA, 15 bp, Homo sapiens
ctactactgtatccc

SEQ ID NO: 230239 - DNA, 15 bp, Homo sapiens
cctactactgtatcc

SEQ ID NO: 230240 - DNA, 15 bp, Homo sapiens
gcctactactgtatc

SEQ ID NO: 230241 - DNA, 15 bp, Homo sapiens
tgcctactactgtat

SEQ ID NO: 230242 - DNA, 15 bp, Homo sapiens
ttgcctactactgta

SEQ ID NO: 230243 - DNA, 15 bp, Homo sapiens
tttgcctactactgt

SEQ ID NO: 230244 - DNA, 15 bp, Homo sapiens
ttttgcctactactg

SEQ ID NO: 230245 - DNA, 15 bp, Homo sapiens
gttttgcctactact

SEQ ID NO: 230246 - DNA, 15 bp, Homo sapiens
tgttttgcctactac

SEQ ID NO: 230247 - DNA, 15 bp, Homo sapiens
ctgttttgcctacta

SEQ ID NO: 230248 - DNA, 15 bp, Homo sapiens
tctgttttgcctact

SEQ ID NO: 230249 - DNA, 15 bp, Homo sapiens
atctgttttgcctac

SEQ ID NO: 230250 - DNA, 15 bp, Homo sapiens
catctgttttgccta

SEQ ID NO: 230251 - DNA, 15 bp, Homo sapiens
acatctgttttgcct

SEQ ID NO: 230252 - DNA, 15 bp, Homo sapiens
aacatctgttttgcc

SEQ ID NO: 230253 - DNA, 15 bp, Homo sapiens
aaacatctgttttgc

SEQ ID NO: 230254 - DNA, 15 bp, Homo sapiens
aaaacatctgttttg

SEQ ID NO: 230255 - DNA, 15 bp, Homo sapiens
aaaaacatctgtttt

SEQ ID NO: 230256 - DNA, 15 bp, Homo sapiens
aaaaaacatctgttt

SEQ ID NO: 230257 - DNA, 15 bp, Homo sapiens
aaaaaaacatctgtt

SEQ ID NO: 230258 - DNA, 15 bp, Homo sapiens
gaaaaaaacatctgt

SEQ ID NO: 230259 - DNA, 15 bp, Homo sapiens
ggaaaaaaacatctg

SEQ ID NO: 230260 - DNA, 15 bp, Homo sapiens
aggaaaaaaacatct

SEQ ID NO: 230261 - DNA, 15 bp, Homo sapiens
gaggaaaaaaacatc

SEQ ID NO: 230262 - DNA, 15 bp, Homo sapiens
ggaggaaaaaaacat

SEQ ID NO: 230263 - DNA, 15 bp, Homo sapiens
aggaggaaaaaaaca

SEQ ID NO: 230264 - DNA, 15 bp, Homo sapiens
caggaggaaaaaaac

SEQ ID NO: 230265 - DNA, 15 bp, Homo sapiens
tcaggaggaaaaaaa

SEQ ID NO: 230266 - DNA, 15 bp, Homo sapiens
ttcaggaggaaaaaa

SEQ ID NO: 230267 - DNA, 15 bp, Homo sapiens
tttcaggaggaaaaa

SEQ ID NO: 230268 - DNA, 15 bp, Homo sapiens
gtttcaggaggaaaa

SEQ ID NO: 230269 - DNA, 15 bp, Homo sapiens
tgtttcaggaggaaa

SEQ ID NO: 230270 - DNA, 15 bp, Homo sapiens
atgtttcaggaggaa

SEQ ID NO: 230271 - DNA, 15 bp, Homo sapiens
aatgtttcaggagga

SEQ ID NO: 230272 - DNA, 15 bp, Homo sapiens
gaatgtttcaggagg

SEQ ID NO: 230273 - DNA, 15 bp, Homo sapiens
agaatgtttcaggag

SEQ ID NO: 230274 - DNA, 15 bp, Homo sapiens
gagaatgtttcagga

SEQ ID NO: 230275 - DNA, 15 bp, Homo sapiens
tgagaatgtttcagg

SEQ ID NO: 230276 - DNA, 15 bp, Homo sapiens
ctgagaatgtttcag

SEQ ID NO: 230277 - DNA, 15 bp, Homo sapiens
gctgagaatgtttca

SEQ ID NO: 230278 - DNA, 15 bp, Homo sapiens
agctgagaatgtttc

SEQ ID NO: 230279 - DNA, 15 bp, Homo sapiens
aagctgagaatgttt

SEQ ID NO: 230280 - DNA, 15 bp, Homo sapiens
aaagctgagaatgtt

SEQ ID NO: 230281 - DNA, 15 bp, Homo sapiens
aaaagctgagaatgt

SEQ ID NO: 230282 - DNA, 15 bp, Homo sapiens
gaaaagctgagaatg

SEQ ID NO: 230283 - DNA, 15 bp, Homo sapiens
ggaaaagctgagaat

SEQ ID NO: 230284 - DNA, 15 bp, Homo sapiens
aggaaaagctgagaa

SEQ ID NO: 230285 - DNA, 15 bp, Homo sapiens
gaggaaaagctgaga

SEQ ID NO: 230286 - DNA, 15 bp, Homo sapiens
agaggaaaagctgag

SEQ ID NO: 230287 - DNA, 15 bp, Homo sapiens
aagaggaaaagctga

SEQ ID NO: 230288 - DNA, 15 bp, Homo sapiens
aaagaggaaaagctg

SEQ ID NO: 230289 - DNA, 15 bp, Homo sapiens
gaaagaggaaaagct

SEQ ID NO: 230290 - DNA, 15 bp, Homo sapiens
ggaaagaggaaaagc

SEQ ID NO: 230291 - DNA, 15 bp, Homo sapiens
aggaaagaggaaaag

SEQ ID NO: 230292 - DNA, 15 bp, Homo sapiens
aaggaaagaggaaaa

SEQ ID NO: 230293 - DNA, 15 bp, Homo sapiens
aaaggaaagaggaaa

SEQ ID NO: 230294 - DNA, 15 bp, Homo sapiens
aaaaggaaagaggaa

SEQ ID NO: 230295 - DNA, 15 bp, Homo sapiens
taaaaggaaagagga

SEQ ID NO: 230296 - DNA, 15 bp, Homo sapiens
ataaaaggaaagagg

SEQ ID NO: 230297 - DNA, 15 bp, Homo sapiens
aataaaaggaaagag

SEQ ID NO: 230298 - DNA, 15 bp, Homo sapiens
caataaaaggaaaga

SEQ ID NO: 230299 - DNA, 15 bp, Homo sapiens
gcaataaaaggaaag

SEQ ID NO: 230300 - DNA, 15 bp, Homo sapiens
ggcaataaaaggaaa

SEQ ID NO: 230301 - DNA, 15 bp, Homo sapiens
tggcaataaaaggaa

SEQ ID NO: 230302 - DNA, 15 bp, Homo sapiens
gtggcaataaaagga

SEQ ID NO: 230303 - DNA, 15 bp, Homo sapiens
ggtggcaataaaagg

SEQ ID NO: 230304 - DNA, 15 bp, Homo sapiens
aggtggcaataaaag

SEQ ID NO: 230305 - DNA, 15 bp, Homo sapiens
caggtggcaataaaa

SEQ ID NO: 230306 - DNA, 15 bp, Homo sapiens
gcaggtggcaataaa

SEQ ID NO: 230307 - DNA, 15 bp, Homo sapiens
ggcaggtggcaataa

SEQ ID NO: 230308 - DNA, 15 bp, Homo sapiens
aggcaggtggcaata

SEQ ID NO: 230309 - DNA, 15 bp, Homo sapiens
caggcaggtggcaat

SEQ ID NO: 230310 - DNA, 15 bp, Homo sapiens
gcaggcaggtggcaa

SEQ ID NO: 230311 - DNA, 15 bp, Homo sapiens
ggcaggcaggtggca

SEQ ID NO: 230312 - DNA, 15 bp, Homo sapiens
gggcaggcaggtggc

SEQ ID NO: 230313 - DNA, 15 bp, Homo sapiens
ggggcaggcaggtgg

SEQ ID NO: 230314 - DNA, 15 bp, Homo sapiens
gggggcaggcaggtg

SEQ ID NO: 230315 - DNA, 15 bp, Homo sapiens
tgggggcaggcaggt

SEQ ID NO: 230316 - DNA, 15 bp, Homo sapiens
ctgggggcaggcagg

SEQ ID NO: 230317 - DNA, 15 bp, Homo sapiens
actgggggcaggcag

SEQ ID NO: 230318 - DNA, 15 bp, Homo sapiens
cactgggggcaggca

SEQ ID NO: 230319 - DNA, 15 bp, Homo sapiens
tcactgggggcaggc

SEQ ID NO: 230320 - DNA, 15 bp, Homo sapiens
gtcactgggggcagg

SEQ ID NO: 230321 - DNA, 15 bp, Homo sapiens
ggtcactgggggcag

SEQ ID NO: 230322 - DNA, 15 bp, Homo sapiens
gggtcactgggggca

SEQ ID NO: 230323 - DNA, 15 bp, Homo sapiens
tgggtcactgggggc

SEQ ID NO: 230324 - DNA, 15 bp, Homo sapiens
atgggtcactggggg

SEQ ID NO: 230325 - DNA, 15 bp, Homo sapiens
gatgggtcactgggg

SEQ ID NO: 230326 - DNA, 15 bp, Homo sapiens
agatgggtcactggg

SEQ ID NO: 230327 - DNA, 15 bp, Homo sapiens
cagatgggtcactgg

SEQ ID NO: 230328 - DNA, 15 bp, Homo sapiens
acagatgggtcactg

SEQ ID NO: 230329 - DNA, 15 bp, Homo sapiens
aacagatgggtcact

SEQ ID NO: 230330 - DNA, 15 bp, Homo sapiens
caacagatgggtcac

SEQ ID NO: 230331 - DNA, 15 bp, Homo sapiens
tcaacagatgggtca

SEQ ID NO: 230332 - DNA, 15 bp, Homo sapiens
atcaacagatgggtc

SEQ ID NO: 230333 - DNA, 15 bp, Homo sapiens
catcaacagatgggt

SEQ ID NO: 230334 - DNA, 15 bp, Homo sapiens
acatcaacagatggg

SEQ ID NO: 230335 - DNA, 15 bp, Homo sapiens
gacatcaacagatgg

SEQ ID NO: 230336 - DNA, 15 bp, Homo sapiens
ggacatcaacagatg

SEQ ID NO: 230337 - DNA, 15 bp, Homo sapiens
tggacatcaacagat

SEQ ID NO: 230338 - DNA, 15 bp, Homo sapiens
ctggacatcaacaga

SEQ ID NO: 230339 - DNA, 15 bp, Homo sapiens
gctggacatcaacag

SEQ ID NO: 230340 - DNA, 15 bp, Homo sapiens
ggctggacatcaaca

SEQ ID NO: 230341 - DNA, 15 bp, Homo sapiens
gggctggacatcaac

SEQ ID NO: 230342 - DNA, 15 bp, Homo sapiens
tgggctggacatcaa

SEQ ID NO: 230343 - DNA, 15 bp, Homo sapiens
ttgggctggacatca

SEQ ID NO: 230344 - DNA, 15 bp, Homo sapiens
tttgggctggacatc

SEQ ID NO: 230345 - DNA, 15 bp, Homo sapiens
ctttgggctggacat

SEQ ID NO: 230346 - DNA, 15 bp, Homo sapiens
cctttgggctggaca

SEQ ID NO: 230347 - DNA, 15 bp, Homo sapiens
tcctttgggctggac

SEQ ID NO: 230348 - DNA, 15 bp, Homo sapiens
ttcctttgggctgga

SEQ ID NO: 230349 - DNA, 15 bp, Homo sapiens
attcctttgggctgg

SEQ ID NO: 230350 - DNA, 15 bp, Homo sapiens
aattcctttgggctg

SEQ ID NO: 230351 - DNA, 15 bp, Homo sapiens
gaattcctttgggct

SEQ ID NO: 230352 - DNA, 15 bp, Homo sapiens
tgaattcctttgggc

SEQ ID NO: 230353 - DNA, 15 bp, Homo sapiens
gtgaattcctttggg

SEQ ID NO: 230354 - DNA, 15 bp, Homo sapiens
agtgaattcctttgg

SEQ ID NO: 230355 - DNA, 15 bp, Homo sapiens
aagtgaattcctttg

SEQ ID NO: 230356 - DNA, 15 bp, Homo sapiens
caagtgaattccttt

SEQ ID NO: 230357 - DNA, 15 bp, Homo sapiens
tcaagtgaattcctt

SEQ ID NO: 230358 - DNA, 15 bp, Homo sapiens
ttcaagtgaattcct

SEQ ID NO: 230359 - DNA, 15 bp, Homo sapiens
attcaagtgaattcc

SEQ ID NO: 230360 - DNA, 15 bp, Homo sapiens
tattcaagtgaattc

SEQ ID NO: 230361 - DNA, 15 bp, Homo sapiens
ttattcaagtgaatt

SEQ ID NO: 230362 - DNA, 15 bp, Homo sapiens
tttattcaagtgaat

SEQ ID NO: 230363 - DNA, 15 bp, Homo sapiens
atttattcaagtgaa

SEQ ID NO: 230364 - DNA, 15 bp, Homo sapiens
gatttattcaagtga

SEQ ID NO: 230365 - DNA, 15 bp, Homo sapiens
cgatttattcaagtg

SEQ ID NO: 230366 - DNA, 15 bp, Homo sapiens
gcgatttattcaagt

SEQ ID NO: 230367 - DNA, 15 bp, Homo sapiens
tgcgatttattcaag

SEQ ID NO: 230368 - DNA, 15 bp, Homo sapiens
ttgcgatttattcaa

SEQ ID NO: 230369 - DNA, 15 bp, Homo sapiens
tttgcgatttattca

SEQ ID NO: 230370 - DNA, 15 bp, Homo sapiens
ttttgcgatttattc

SEQ ID NO: 230371 - DNA, 15 bp, Homo sapiens
gttttgcgatttatt

SEQ ID NO: 230372 - DNA, 15 bp, Homo sapiens
agttttgcgatttat

SEQ ID NO: 230373 - DNA, 15 bp, Homo sapiens
cagttttgcgattta

SEQ ID NO: 230374 - DNA, 15 bp, Homo sapiens
gcagttttgcgattt

SEQ ID NO: 230375 - DNA, 15 bp, Homo sapiens
ggcagttttgcgatt

SEQ ID NO: 230376 - DNA, 15 bp, Homo sapiens
tggcagttttgcgat

SEQ ID NO: 230377 - DNA, 15 bp, Homo sapiens
gtggcagttttgcga

SEQ ID NO: 230378 - DNA, 15 bp, Homo sapiens
agtggcagttttgcg

SEQ ID NO: 230379 - DNA, 15 bp, Homo sapiens
tagtggcagttttgc

SEQ ID NO: 230380 - DNA, 15 bp, Homo sapiens
gtagtggcagttttg

SEQ ID NO: 230381 - DNA, 15 bp, Homo sapiens
agtagtggcagtttt

SEQ ID NO: 230382 - DNA, 15 bp, Homo sapiens
aagtagtggcagttt

SEQ ID NO: 230383 - DNA, 15 bp, Homo sapiens
caagtagtggcagtt

SEQ ID NO: 230384 - DNA, 15 bp, Homo sapiens
ccaagtagtggcagt

SEQ ID NO: 230385 - DNA, 15 bp, Homo sapiens
tccaagtagtggcag

SEQ ID NO: 230386 - DNA, 15 bp, Homo sapiens
ctccaagtagtggca

SEQ ID NO: 230387 - DNA, 15 bp, Homo sapiens
cctccaagtagtggc

SEQ ID NO: 230388 - DNA, 15 bp, Homo sapiens
tcctccaagtagtgg

SEQ ID NO: 230389 - DNA, 15 bp, Homo sapiens
ttcctccaagtagtg

SEQ ID NO: 230390 - DNA, 15 bp, Homo sapiens
tttcctccaagtagt

SEQ ID NO: 230391 - DNA, 15 bp, Homo sapiens
atttcctccaagtag

SEQ ID NO: 230392 - DNA, 15 bp, Homo sapiens
aatttcctccaagta

SEQ ID NO: 230393 - DNA, 15 bp, Homo sapiens
gaatttcctccaagt

SEQ ID NO: 230394 - DNA, 15 bp, Homo sapiens
tgaatttcctccaag

SEQ ID NO: 230395 - DNA, 15 bp, Homo sapiens
ctgaatttcctccaa

SEQ ID NO: 230396 - DNA, 15 bp, Homo sapiens
cctgaatttcctcca

SEQ ID NO: 230397 - DNA, 15 bp, Homo sapiens
ccctgaatttcctcc

SEQ ID NO: 230398 - DNA, 15 bp, Homo sapiens
tccctgaatttcctc

SEQ ID NO: 230399 - DNA, 15 bp, Homo sapiens
atccctgaatttcct

SEQ ID NO: 230400 - DNA, 15 bp, Homo sapiens
aatccctgaatttcc

SEQ ID NO: 230401 - DNA, 15 bp, Homo sapiens
taatccctgaatttc

SEQ ID NO: 230402 - DNA, 15 bp, Homo sapiens
ataatccctgaattt

SEQ ID NO: 230403 - DNA, 15 bp, Homo sapiens
aataatccctgaatt

SEQ ID NO: 230404 - DNA, 15 bp, Homo sapiens
gaataatccctgaat

SEQ ID NO: 230405 - DNA, 15 bp, Homo sapiens
ggaataatccctgaa

SEQ ID NO: 230406 - DNA, 15 bp, Homo sapiens
aggaataatccctga

SEQ ID NO: 230407 - DNA, 15 bp, Homo sapiens
caggaataatccctg

SEQ ID NO: 230408 - DNA, 15 bp, Homo sapiens
tcaggaataatccct

SEQ ID NO: 230409 - DNA, 15 bp, Homo sapiens
ttcaggaataatccc

SEQ ID NO: 230410 - DNA, 15 bp, Homo sapiens
attcaggaataatcc

SEQ ID NO: 230411 - DNA, 15 bp, Homo sapiens
cattcaggaataatc

SEQ ID NO: 230412 - DNA, 15 bp, Homo sapiens
tcattcaggaataat

SEQ ID NO: 230413 - DNA, 15 bp, Homo sapiens
ttcattcaggaataa

SEQ ID NO: 230414 - DNA, 15 bp, Homo sapiens
cttcattcaggaata

SEQ ID NO: 230415 - DNA, 15 bp, Homo sapiens
tcttcattcaggaat

SEQ ID NO: 230416 - DNA, 15 bp, Homo sapiens
ttcttcattcaggaa

SEQ ID NO: 230417 - DNA, 15 bp, Homo sapiens
tttcttcattcagga

SEQ ID NO: 230418 - DNA, 15 bp, Homo sapiens
ttttcttcattcagg

SEQ ID NO: 230419 - DNA, 15 bp, Homo sapiens
attttcttcattcag

SEQ ID NO: 230420 - DNA, 15 bp, Homo sapiens
cattttcttcattca

SEQ ID NO: 230421 - DNA, 15 bp, Homo sapiens
ccattttcttcattc

SEQ ID NO: 230422 - DNA, 15 bp, Homo sapiens
tccattttcttcatt

SEQ ID NO: 230423 - DNA, 15 bp, Homo sapiens
ttccattttcttcat

SEQ ID NO: 230424 - DNA, 15 bp, Homo sapiens
tttccattttcttca

SEQ ID NO: 230425 - DNA, 15 bp, Homo sapiens
ctttccattttcttc

SEQ ID NO: 230426 - DNA, 15 bp, Homo sapiens
tctttccattttctt

SEQ ID NO: 230427 - DNA, 15 bp, Homo sapiens
atctttccattttct

SEQ ID NO: 230428 - DNA, 15 bp, Homo sapiens
gatctttccattttc

SEQ ID NO: 230429 - DNA, 15 bp, Homo sapiens
agatctttccatttt

SEQ ID NO: 230430 - DNA, 15 bp, Homo sapiens
gagatctttccattt

SEQ ID NO: 230431 - DNA, 15 bp, Homo sapiens
tgagatctttccatt

SEQ ID NO: 230432 - DNA, 15 bp, Homo sapiens
ctgagatctttccat

SEQ ID NO: 230433 - DNA, 15 bp, Homo sapiens
cctgagatctttcca

SEQ ID NO: 230434 - DNA, 15 bp, Homo sapiens
acctgagatctttcc

SEQ ID NO: 230435 - DNA, 15 bp, Homo sapiens
aacctgagatctttc

SEQ ID NO: 230436 - DNA, 15 bp, Homo sapiens
caacctgagatcttt

SEQ ID NO: 230437 - DNA, 15 bp, Homo sapiens
gcaacctgagatctt

SEQ ID NO: 230438 - DNA, 15 bp, Homo sapiens
agcaacctgagatct

SEQ ID NO: 230439 - DNA, 15 bp, Homo sapiens
aagcaacctgagatc

SEQ ID NO: 230440 - DNA, 15 bp, Homo sapiens
taagcaacctgagat

SEQ ID NO: 230441 - DNA, 15 bp, Homo sapiens
ctaagcaacctgaga

SEQ ID NO: 230442 - DNA, 15 bp, Homo sapiens
gctaagcaacctgag

SEQ ID NO: 230443 - DNA, 15 bp, Homo sapiens
cgctaagcaacctga

SEQ ID NO: 230444 - DNA, 15 bp, Homo sapiens
tcgctaagcaacctg

SEQ ID NO: 230445 - DNA, 15 bp, Homo sapiens
ctcgctaagcaacct

SEQ ID NO: 230446 - DNA, 15 bp, Homo sapiens
cctcgctaagcaacc

SEQ ID NO: 230447 - DNA, 15 bp, Homo sapiens
gcctcgctaagcaac

SEQ ID NO: 230448 - DNA, 15 bp, Homo sapiens
ggcctcgctaagcaa

SEQ ID NO: 230449 - DNA, 15 bp, Homo sapiens
gggcctcgctaagca

SEQ ID NO: 230450 - DNA, 15 bp, Homo sapiens
agggcctcgctaagc

SEQ ID NO: 230451 - DNA, 15 bp, Homo sapiens
cagggcctcgctaag

SEQ ID NO: 230452 - DNA, 15 bp, Homo sapiens
ccagggcctcgctaa

SEQ ID NO: 230453 - DNA, 15 bp, Homo sapiens
accagggcctcgcta

SEQ ID NO: 230454 - DNA, 15 bp, Homo sapiens
aaccagggcctcgct

SEQ ID NO: 230455 - DNA, 15 bp, Homo sapiens
caaccagggcctcgc

SEQ ID NO: 230456 - DNA, 15 bp, Homo sapiens
acaaccagggcctcg

SEQ ID NO: 230457 - DNA, 15 bp, Homo sapiens
gacaaccagggcctc

SEQ ID NO: 230458 - DNA, 15 bp, Homo sapiens
agacaaccagggcct

SEQ ID NO: 230459 - DNA, 15 bp, Homo sapiens
cagacaaccagggcc

SEQ ID NO: 230460 - DNA, 15 bp, Homo sapiens
acagacaaccagggc

SEQ ID NO: 230461 - DNA, 15 bp, Homo sapiens
aacagacaaccaggg

SEQ ID NO: 230462 - DNA, 15 bp, Homo sapiens
gaacagacaaccagg

SEQ ID NO: 230463 - DNA, 15 bp, Homo sapiens
ggaacagacaaccag

SEQ ID NO: 230464 - DNA, 15 bp, Homo sapiens
tggaacagacaacca

SEQ ID NO: 230465 - DNA, 15 bp, Homo sapiens
ctggaacagacaacc

SEQ ID NO: 230466 - DNA, 15 bp, Homo sapiens
cctggaacagacaac

SEQ ID NO: 230467 - DNA, 15 bp, Homo sapiens
ccctggaacagacaa

SEQ ID NO: 230468 - DNA, 15 bp, Homo sapiens
accctggaacagaca

SEQ ID NO: 230469 - DNA, 15 bp, Homo sapiens
gaccctggaacagac

SEQ ID NO: 230470 - DNA, 15 bp, Homo sapiens
agaccctggaacaga

SEQ ID NO: 230471 - DNA, 15 bp, Homo sapiens
gagaccctggaacag

SEQ ID NO: 230472 - DNA, 15 bp, Homo sapiens
agagaccctggaaca

SEQ ID NO: 230473 - DNA, 15 bp, Homo sapiens
aagagaccctggaac

SEQ ID NO: 230474 - DNA, 15 bp, Homo sapiens
aaagagaccctggaa

SEQ ID NO: 230475 - DNA, 15 bp, Homo sapiens
caaagagaccctgga

SEQ ID NO: 230476 - DNA, 15 bp, Homo sapiens
gcaaagagaccctgg

SEQ ID NO: 230477 - DNA, 15 bp, Homo sapiens
agcaaagagaccctg

SEQ ID NO: 230478 - DNA, 15 bp, Homo sapiens
gagcaaagagaccct

SEQ ID NO: 230479 - DNA, 15 bp, Homo sapiens
agagcaaagagaccc

SEQ ID NO: 230480 - DNA, 15 bp, Homo sapiens
aagagcaaagagacc

SEQ ID NO: 230481 - DNA, 15 bp, Homo sapiens
gaagagcaaagagac

SEQ ID NO: 230482 - DNA, 15 bp, Homo sapiens
ggaagagcaaagaga

SEQ ID NO: 230483 - DNA, 15 bp, Homo sapiens
aggaagagcaaagag

SEQ ID NO: 230484 - DNA, 15 bp, Homo sapiens
caggaagagcaaaga

SEQ ID NO: 230485 - DNA, 15 bp, Homo sapiens
gcaggaagagcaaag

SEQ ID NO: 230486 - DNA, 15 bp, Homo sapiens
agcaggaagagcaaa

SEQ ID NO: 230487 - DNA, 15 bp, Homo sapiens
aagcaggaagagcaa

SEQ ID NO: 230488 - DNA, 15 bp, Homo sapiens
gaagcaggaagagca

SEQ ID NO: 230489 - DNA, 15 bp, Homo sapiens
agaagcaggaagagc

SEQ ID NO: 230490 - DNA, 15 bp, Homo sapiens
aagaagcaggaagag

SEQ ID NO: 230491 - DNA, 15 bp, Homo sapiens
aaagaagcaggaaga

SEQ ID NO: 230492 - DNA, 15 bp, Homo sapiens
gaaagaagcaggaag

SEQ ID NO: 230493 - DNA, 15 bp, Homo sapiens
ggaaagaagcaggaa

SEQ ID NO: 230494 - DNA, 15 bp, Homo sapiens
aggaaagaagcagga

SEQ ID NO: 230495 - DNA, 15 bp, Homo sapiens
aaggaaagaagcagg

SEQ ID NO: 230496 - DNA, 15 bp, Homo sapiens
caaggaaagaagcag

SEQ ID NO: 230497 - DNA, 15 bp, Homo sapiens
ccaaggaaagaagca

SEQ ID NO: 230498 - DNA, 15 bp, Homo sapiens
tccaaggaaagaagc

SEQ ID NO: 230499 - DNA, 15 bp, Homo sapiens
ctccaaggaaagaag

SEQ ID NO: 230500 - DNA, 15 bp, Homo sapiens
actccaaggaaagaa

SEQ ID NO: 230501 - DNA, 15 bp, Homo sapiens
aactccaaggaaaga

SEQ ID NO: 230502 - DNA, 15 bp, Homo sapiens
caactccaaggaaag

SEQ ID NO: 230503 - DNA, 15 bp, Homo sapiens
gcaactccaaggaaa

SEQ ID NO: 230504 - DNA, 15 bp, Homo sapiens
cgcaactccaaggaa

SEQ ID NO: 230505 - DNA, 15 bp, Homo sapiens
acgcaactccaagga

SEQ ID NO: 230506 - DNA, 15 bp, Homo sapiens
gacgcaactccaagg

SEQ ID NO: 230507 - DNA, 15 bp, Homo sapiens
agacgcaactccaag

SEQ ID NO: 230508 - DNA, 15 bp, Homo sapiens
cagacgcaactccaa

SEQ ID NO: 230509 - DNA, 15 bp, Homo sapiens
acagacgcaactcca

SEQ ID NO: 230510 - DNA, 15 bp, Homo sapiens
gacagacgcaactcc

SEQ ID NO: 230511 - DNA, 15 bp, Homo sapiens
agacagacgcaactc

SEQ ID NO: 230512 - DNA, 15 bp, Homo sapiens
tagacagacgcaact

SEQ ID NO: 230513 - DNA, 15 bp, Homo sapiens
ctagacagacgcaac

SEQ ID NO: 230514 - DNA, 15 bp, Homo sapiens
actagacagacgcaa

SEQ ID NO: 230515 - DNA, 15 bp, Homo sapiens
cactagacagacgca

SEQ ID NO: 230516 - DNA, 15 bp, Homo sapiens
ccactagacagacgc

SEQ ID NO: 230517 - DNA, 15 bp, Homo sapiens
accactagacagacg

SEQ ID NO: 230518 - DNA, 15 bp, Homo sapiens
aaccactagacagac

SEQ ID NO: 230519 - DNA, 15 bp, Homo sapiens
caaccactagacaga

SEQ ID NO: 230520 - DNA, 15 bp, Homo sapiens
ccaaccactagacag

SEQ ID NO: 230521 - DNA, 15 bp, Homo sapiens
gccaaccactagaca

SEQ ID NO: 230522 - DNA, 15 bp, Homo sapiens
ggccaaccactagac

SEQ ID NO: 230523 - DNA, 15 bp, Homo sapiens
gggccaaccactaga

SEQ ID NO: 230524 - DNA, 15 bp, Homo sapiens
ggggccaaccactag

SEQ ID NO: 230525 - DNA, 15 bp, Homo sapiens
aggggccaaccacta

SEQ ID NO: 230526 - DNA, 15 bp, Homo sapiens
caggggccaaccact

SEQ ID NO: 230527 - DNA, 15 bp, Homo sapiens
gcaggggccaaccac

SEQ ID NO: 230528 - DNA, 15 bp, Homo sapiens
agcaggggccaacca

SEQ ID NO: 230529 - DNA, 15 bp, Homo sapiens
aagcaggggccaacc

SEQ ID NO: 230530 - DNA, 15 bp, Homo sapiens
gaagcaggggccaac

SEQ ID NO: 230531 - DNA, 15 bp, Homo sapiens
agaagcaggggccaa

SEQ ID NO: 230532 - DNA, 15 bp, Homo sapiens
aagaagcaggggcca

SEQ ID NO: 230533 - DNA, 15 bp, Homo sapiens
gaagaagcaggggcc

SEQ ID NO: 230534 - DNA, 15 bp, Homo sapiens
ggaagaagcaggggc

SEQ ID NO: 230535 - DNA, 15 bp, Homo sapiens
gaggaagaagcaggg

SEQ ID NO: 230536 - DNA, 15 bp, Homo sapiens
ggaggaagaagcagg

SEQ ID NO: 230537 - DNA, 15 bp, Homo sapiens
tggaggaagaagcag

SEQ ID NO: 230538 - DNA, 15 bp, Homo sapiens
gtggaggaagaagca

SEQ ID NO: 230539 - DNA, 15 bp, Homo sapiens
agtggaggaagaagc

SEQ ID NO: 230540 - DNA, 15 bp, Homo sapiens
gagtggaggaagaag

SEQ ID NO: 230541 - DNA, 15 bp, Homo sapiens
tgagtggaggaagaa

SEQ ID NO: 230542 - DNA, 15 bp, Homo sapiens
ttgagtggaggaaga

SEQ ID NO: 230543 - DNA, 15 bp, Homo sapiens
gttgagtggaggaag

SEQ ID NO: 230544 - DNA, 15 bp, Homo sapiens
agttgagtggaggaa

SEQ ID NO: 230545 - DNA, 15 bp, Homo sapiens
gagttgagtggagga

SEQ ID NO: 230546 - DNA, 15 bp, Homo sapiens
agagttgagtggagg

SEQ ID NO: 230547 - DNA, 15 bp, Homo sapiens
cagagttgagtggag

SEQ ID NO: 230548 - DNA, 15 bp, Homo sapiens
ccagagttgagtgga

SEQ ID NO: 230549 - DNA, 15 bp, Homo sapiens
cccagagttgagtgg

SEQ ID NO: 230550 - DNA, 15 bp, Homo sapiens
gcccagagttgagtg

SEQ ID NO: 230551 - DNA, 15 bp, Homo sapiens
agcccagagttgagt

SEQ ID NO: 230552 - DNA, 15 bp, Homo sapiens
aagcccagagttgag

SEQ ID NO: 230553 - DNA, 15 bp, Homo sapiens
taagcccagagttga

SEQ ID NO: 230554 - DNA, 15 bp, Homo sapiens
ataagcccagagttg

SEQ ID NO: 230555 - DNA, 15 bp, Homo sapiens
aataagcccagagtt

SEQ ID NO: 230556 - DNA, 15 bp, Homo sapiens
aaataagcccagagt

SEQ ID NO: 230557 - DNA, 15 bp, Homo sapiens
taaataagcccagag

SEQ ID NO: 230558 - DNA, 15 bp, Homo sapiens
gtaaataagcccaga

SEQ ID NO: 230559 - DNA, 15 bp, Homo sapiens
agtaaataagcccag

SEQ ID NO: 230560 - DNA, 15 bp, Homo sapiens
aagtaaataagccca

SEQ ID NO: 230561 - DNA, 15 bp, Homo sapiens
aaagtaaataagccc

SEQ ID NO: 230562 - DNA, 15 bp, Homo sapiens
caaagtaaataagcc

SEQ ID NO: 230563 - DNA, 15 bp, Homo sapiens
ccaaagtaaataagc

SEQ ID NO: 230564 - DNA, 15 bp, Homo sapiens
gccaaagtaaataag

SEQ ID NO: 230565 - DNA, 15 bp, Homo sapiens
ggccaaagtaaataa

SEQ ID NO: 230566 - DNA, 15 bp, Homo sapiens
tggccaaagtaaata

SEQ ID NO: 230567 - DNA, 15 bp, Homo sapiens
gtggccaaagtaaat

SEQ ID NO: 230568 - DNA, 15 bp, Homo sapiens
agtggccaaagtaaa

SEQ ID NO: 230569 - DNA, 15 bp, Homo sapiens
aagtggccaaagtaa

SEQ ID NO: 230570 - DNA, 15 bp, Homo sapiens
gaagtggccaaagta

SEQ ID NO: 230571 - DNA, 15 bp, Homo sapiens
tgaagtggccaaagt

SEQ ID NO: 230572 - DNA, 15 bp, Homo sapiens
gtgaagtggccaaag

SEQ ID NO: 230573 - DNA, 15 bp, Homo sapiens
tgtgaagtggccaaa

SEQ ID NO: 230574 - DNA, 15 bp, Homo sapiens
ttgtgaagtggccaa

SEQ ID NO: 230575 - DNA, 15 bp, Homo sapiens
cttgtgaagtggcca

SEQ ID NO: 230576 - DNA, 15 bp, Homo sapiens
tcttgtgaagtggcc

SEQ ID NO: 230577 - DNA, 15 bp, Homo sapiens
ttcttgtgaagtggc

SEQ ID NO: 230578 - DNA, 15 bp, Homo sapiens
cttcttgtgaagtgg

SEQ ID NO: 230579 - DNA, 15 bp, Homo sapiens
tcttcttgtgaagtg

SEQ ID NO: 230580 - DNA, 15 bp, Homo sapiens
ctcttcttgtgaagt

SEQ ID NO: 230581 - DNA, 15 bp, Homo sapiens
actcttcttgtgaag

SEQ ID NO: 230582 - DNA, 15 bp, Homo sapiens
tactcttcttgtgaa

SEQ ID NO: 230583 - DNA, 15 bp, Homo sapiens
ttactcttcttgtga

SEQ ID NO: 230584 - DNA, 15 bp, Homo sapiens
tttactcttcttgtg

SEQ ID NO: 230585 - DNA, 15 bp, Homo sapiens
gtttactcttcttgt

SEQ ID NO: 230586 - DNA, 15 bp, Homo sapiens
ggtttactcttcttg

SEQ ID NO: 230587 - DNA, 15 bp, Homo sapiens
aggtttactcttctt

SEQ ID NO: 230588 - DNA, 15 bp, Homo sapiens
aaggtttactcttct

SEQ ID NO: 230589 - DNA, 15 bp, Homo sapiens
caaggtttactcttc

SEQ ID NO: 230590 - DNA, 15 bp, Homo sapiens
tcaaggtttactctt

SEQ ID NO: 230591 - DNA, 15 bp, Homo sapiens
ttcaaggtttactct

SEQ ID NO: 230592 - DNA, 15 bp, Homo sapiens
attcaaggtttactc

SEQ ID NO: 230593 - DNA, 15 bp, Homo sapiens
cattcaaggtttact

SEQ ID NO: 230594 - DNA, 15 bp, Homo sapiens
acattcaaggtttac

SEQ ID NO: 230595 - DNA, 15 bp, Homo sapiens
tacattcaaggttta

SEQ ID NO: 230596 - DNA, 15 bp, Homo sapiens
atacattcaaggttt

SEQ ID NO: 230597 - DNA, 15 bp, Homo sapiens
aatacattcaaggtt

SEQ ID NO: 230598 - DNA, 15 bp, Homo sapiens
aaatacattcaaggt

SEQ ID NO: 230599 - DNA, 15 bp, Homo sapiens
taaatacattcaagg

SEQ ID NO: 230600 - DNA, 15 bp, Homo sapiens
ctaaatacattcaag

SEQ ID NO: 230601 - DNA, 15 bp, Homo sapiens
tctaaatacattcaa

SEQ ID NO: 230602 - DNA, 15 bp, Homo sapiens
gtctaaatacattca

SEQ ID NO: 230603 - DNA, 15 bp, Homo sapiens
agtctaaatacattc

SEQ ID NO: 230604 - DNA, 15 bp, Homo sapiens
gagtctaaatacatt

SEQ ID NO: 230605 - DNA, 15 bp, Homo sapiens
ggagtctaaatacat

SEQ ID NO: 230606 - DNA, 15 bp, Homo sapiens
tggagtctaaataca

SEQ ID NO: 230607 - DNA, 15 bp, Homo sapiens
ctggagtctaaatac

SEQ ID NO: 230608 - DNA, 15 bp, Homo sapiens
actggagtctaaata

SEQ ID NO: 230609 - DNA, 15 bp, Homo sapiens
aactggagtctaaat

SEQ ID NO: 230610 - DNA, 15 bp, Homo sapiens
gaactggagtctaaa

SEQ ID NO: 230611 - DNA, 15 bp, Homo sapiens
agaactggagtctaa

SEQ ID NO: 230612 - DNA, 15 bp, Homo sapiens
cagaactggagtcta

SEQ ID NO: 230613 - DNA, 15 bp, Homo sapiens
gcagaactggagtct

SEQ ID NO: 230614 - DNA, 15 bp, Homo sapiens
ggcagaactggagtc

SEQ ID NO: 230615 - DNA, 15 bp, Homo sapiens
aggcagaactggagt

SEQ ID NO: 230616 - DNA, 15 bp, Homo sapiens
gaggcagaactggag

SEQ ID NO: 230617 - DNA, 15 bp, Homo sapiens
agaggcagaactgga

SEQ ID NO: 230618 - DNA, 15 bp, Homo sapiens
tagaggcagaactgg

SEQ ID NO: 230619 - DNA, 15 bp, Homo sapiens
atagaggcagaactg

SEQ ID NO: 230620 - DNA, 15 bp, Homo sapiens
aatagaggcagaact

SEQ ID NO: 230621 - DNA, 15 bp, Homo sapiens
caatagaggcagaac

SEQ ID NO: 230622 - DNA, 15 bp, Homo sapiens
tcaatagaggcagaa

SEQ ID NO: 230623 - DNA, 15 bp, Homo sapiens
gtcaatagaggcaga

SEQ ID NO: 230624 - DNA, 15 bp, Homo sapiens
agtcaatagaggcag

SEQ ID NO: 230625 - DNA, 15 bp, Homo sapiens
aagtcaatagaggca

SEQ ID NO: 230626 - DNA, 15 bp, Homo sapiens
gaagtcaatagaggc

SEQ ID NO: 230627 - DNA, 15 bp, Homo sapiens
tgaagtcaatagagg

SEQ ID NO: 230628 - DNA, 15 bp, Homo sapiens
ctgaagtcaatagag

SEQ ID NO: 230629 - DNA, 15 bp, Homo sapiens
cctgaagtcaataga

SEQ ID NO: 230630 - DNA, 15 bp, Homo sapiens
acctgaagtcaatag

SEQ ID NO: 230631 - DNA, 15 bp, Homo sapiens
gacctgaagtcaata

SEQ ID NO: 230632 - DNA, 15 bp, Homo sapiens
tgacctgaagtcaat

SEQ ID NO: 230633 - DNA, 15 bp, Homo sapiens
ctgacctgaagtcaa

SEQ ID NO: 230634 - DNA, 15 bp, Homo sapiens
actgacctgaagtca

SEQ ID NO: 230635 - DNA, 15 bp, Homo sapiens
cactgacctgaagtc

SEQ ID NO: 230636 - DNA, 15 bp, Homo sapiens
ccactgacctgaagt

SEQ ID NO: 230637 - DNA, 15 bp, Homo sapiens
accactgacctgaag

SEQ ID NO: 230638 - DNA, 15 bp, Homo sapiens
caccactgacctgaa

SEQ ID NO: 230639 - DNA, 15 bp, Homo sapiens
gcaccactgacctga

SEQ ID NO: 230640 - DNA, 15 bp, Homo sapiens
ggcaccactgacctg

SEQ ID NO: 230641 - DNA, 15 bp, Homo sapiens
tggcaccactgacct

SEQ ID NO: 230642 - DNA, 15 bp, Homo sapiens
atggcaccactgacc

SEQ ID NO: 230643 - DNA, 15 bp, Homo sapiens
catggcaccactgac

SEQ ID NO: 230644 - DNA, 15 bp, Homo sapiens
acatggcaccactga

SEQ ID NO: 230645 - DNA, 15 bp, Homo sapiens
tacatggcaccactg

SEQ ID NO: 230646 - DNA, 15 bp, Homo sapiens
ctacatggcaccact

SEQ ID NO: 230647 - DNA, 15 bp, Homo sapiens
gctacatggcaccac

SEQ ID NO: 230648 - DNA, 15 bp, Homo sapiens
agctacatggcacca

SEQ ID NO: 230649 - DNA, 15 bp, Homo sapiens
gagctacatggcacc

SEQ ID NO: 230650 - DNA, 15 bp, Homo sapiens
ggagctacatggcac

SEQ ID NO: 230651 - DNA, 15 bp, Homo sapiens
gggagctacatggca

SEQ ID NO: 230652 - DNA, 15 bp, Homo sapiens
agggagctacatggc

SEQ ID NO: 230653 - DNA, 15 bp, Homo sapiens
gagggagctacatgg

SEQ ID NO: 230654 - DNA, 15 bp, Homo sapiens
ggagggagctacatg

SEQ ID NO: 230655 - DNA, 15 bp, Homo sapiens
tggagggagctacat

SEQ ID NO: 230656 - DNA, 15 bp, Homo sapiens
ttggagggagctaca

SEQ ID NO: 230657 - DNA, 15 bp, Homo sapiens
tttggagggagctac

SEQ ID NO: 230658 - DNA, 15 bp, Homo sapiens
ctttggagggagcta

SEQ ID NO: 230659 - DNA, 15 bp, Homo sapiens
gctttggagggagct

SEQ ID NO: 230660 - DNA, 15 bp, Homo sapiens
cgctttggagggagc

SEQ ID NO: 230661 - DNA, 15 bp, Homo sapiens
acgctttggagggag

SEQ ID NO: 230662 - DNA, 15 bp, Homo sapiens
cacgctttggaggga

SEQ ID NO: 230663 - DNA, 15 bp, Homo sapiens
acacgctttggaggg

SEQ ID NO: 230664 - DNA, 15 bp, Homo sapiens
aacacgctttggagg

SEQ ID NO: 230665 - DNA, 15 bp, Homo sapiens
aaacacgctttggag

SEQ ID NO: 230666 - DNA, 15 bp, Homo sapiens
aaaacacgctttgga

SEQ ID NO: 230667 - DNA, 15 bp, Homo sapiens
caaaacacgctttgg

SEQ ID NO: 230668 - DNA, 15 bp, Homo sapiens
acaaaacacgctttg

SEQ ID NO: 230669 - DNA, 15 bp, Homo sapiens
tacaaaacacgcttt

SEQ ID NO: 230670 - DNA, 15 bp, Homo sapiens
atacaaaacacgctt

SEQ ID NO: 230671 - DNA, 15 bp, Homo sapiens
aatacaaaacacgct

SEQ ID NO: 230672 - DNA, 15 bp, Homo sapiens
gaatacaaaacacgc

SEQ ID NO: 230673 - DNA, 15 bp, Homo sapiens
agaatacaaaacacg

SEQ ID NO: 230674 - DNA, 15 bp, Homo sapiens
cagaatacaaaacac

SEQ ID NO: 230675 - DNA, 15 bp, Homo sapiens
tcagaatacaaaaca

SEQ ID NO: 230676 - DNA, 15 bp, Homo sapiens
ctcagaatacaaaac

SEQ ID NO: 230677 - DNA, 15 bp, Homo sapiens
actcagaatacaaaa

SEQ ID NO: 230678 - DNA, 15 bp, Homo sapiens
aactcagaatacaaa

SEQ ID NO: 230679 - DNA, 15 bp, Homo sapiens
gaactcagaatacaa

SEQ ID NO: 230680 - DNA, 15 bp, Homo sapiens
ggaactcagaataca

SEQ ID NO: 230681 - DNA, 15 bp, Homo sapiens
gggaactcagaatac

SEQ ID NO: 230682 - DNA, 15 bp, Homo sapiens
ggggaactcagaata

SEQ ID NO: 230683 - DNA, 15 bp, Homo sapiens
aggggaactcagaat

SEQ ID NO: 230684 - DNA, 15 bp, Homo sapiens
aaggggaactcagaa

SEQ ID NO: 230685 - DNA, 15 bp, Homo sapiens
gaaggggaactcaga

SEQ ID NO: 230686 - DNA, 15 bp, Homo sapiens
tgaaggggaactcag

SEQ ID NO: 230687 - DNA, 15 bp, Homo sapiens
atgaaggggaactca

SEQ ID NO: 230688 - DNA, 15 bp, Homo sapiens
aatgaaggggaactc

SEQ ID NO: 230689 - DNA, 15 bp, Homo sapiens
aaatgaaggggaact

SEQ ID NO: 230690 - DNA, 15 bp, Homo sapiens
caaatgaaggggaac

SEQ ID NO: 230691 - DNA, 15 bp, Homo sapiens
acaaatgaaggggaa

SEQ ID NO: 230692 - DNA, 15 bp, Homo sapiens
cacaaatgaagggga

SEQ ID NO: 230693 - DNA, 15 bp, Homo sapiens
acacaaatgaagggg

SEQ ID NO: 230694 - DNA, 15 bp, Homo sapiens
gacacaaatgaaggg

SEQ ID NO: 230695 - DNA, 15 bp, Homo sapiens
ggacacaaatgaagg

SEQ ID NO: 230696 - DNA, 15 bp, Homo sapiens
gggacacaaatgaag

SEQ ID NO: 230697 - DNA, 15 bp, Homo sapiens
ggggacacaaatgaa

SEQ ID NO: 230698 - DNA, 15 bp, Homo sapiens
aggggacacaaatga

SEQ ID NO: 230699 - DNA, 15 bp, Homo sapiens
gaggggacacaaatg

SEQ ID NO: 230700 - DNA, 15 bp, Homo sapiens
agaggggacacaaat

SEQ ID NO: 230701 - DNA, 15 bp, Homo sapiens
gagaggggacacaaa

SEQ ID NO: 230702 - DNA, 15 bp, Homo sapiens
agagaggggacacaa

SEQ ID NO: 230703 - DNA, 15 bp, Homo sapiens
aagagaggggacaca

SEQ ID NO: 230704 - DNA, 15 bp, Homo sapiens
taagagaggggacac

SEQ ID NO: 230705 - DNA, 15 bp, Homo sapiens
ttaagagaggggaca

SEQ ID NO: 230706 - DNA, 15 bp, Homo sapiens
attaagagaggggac

SEQ ID NO: 230707 - DNA, 15 bp, Homo sapiens
tattaagagagggga

SEQ ID NO: 230708 - DNA, 15 bp, Homo sapiens
ttattaagagagggg

SEQ ID NO: 230709 - DNA, 15 bp, Homo sapiens
gttattaagagaggg

SEQ ID NO: 230710 - DNA, 15 bp, Homo sapiens
agttattaagagagg

SEQ ID NO: 230711 - DNA, 15 bp, Homo sapiens
aagttattaagagag

SEQ ID NO: 230712 - DNA, 15 bp, Homo sapiens
caagttattaagaga

SEQ ID NO: 230713 - DNA, 15 bp, Homo sapiens
gcaagttattaagag

SEQ ID NO: 230714 - DNA, 15 bp, Homo sapiens
tgcaagttattaaga

SEQ ID NO: 230715 - DNA, 15 bp, Homo sapiens
atgcaagttattaag

SEQ ID NO: 230716 - DNA, 15 bp, Homo sapiens
aatgcaagttattaa

SEQ ID NO: 230717 - DNA, 15 bp, Homo sapiens
aaatgcaagttatta

SEQ ID NO: 230718 - DNA, 15 bp, Homo sapiens
taaatgcaagttatt

SEQ ID NO: 230719 - DNA, 15 bp, Homo sapiens
gtaaatgcaagttat

SEQ ID NO: 230720 - DNA, 15 bp, Homo sapiens
agtaaatgcaagtta

SEQ ID NO: 230721 - DNA, 15 bp, Homo sapiens
tagtaaatgcaagtt

SEQ ID NO: 230722 - DNA, 15 bp, Homo sapiens
atagtaaatgcaagt

SEQ ID NO: 230723 - DNA, 15 bp, Homo sapiens
aatagtaaatgcaag

SEQ ID NO: 230724 - DNA, 15 bp, Homo sapiens
aaatagtaaatgcaa

SEQ ID NO: 230725 - DNA, 15 bp, Homo sapiens
caaatagtaaatgca

SEQ ID NO: 230726 - DNA, 15 bp, Homo sapiens
acaaatagtaaatgc

SEQ ID NO: 230727 - DNA, 15 bp, Homo sapiens
cacaaatagtaaatg

SEQ ID NO: 230728 - DNA, 15 bp, Homo sapiens
ccacaaatagtaaat

SEQ ID NO: 230729 - DNA, 15 bp, Homo sapiens
tccacaaatagtaaa

SEQ ID NO: 230730 - DNA, 15 bp, Homo sapiens
ttccacaaatagtaa

SEQ ID NO: 230731 - DNA, 15 bp, Homo sapiens
cttccacaaatagta

SEQ ID NO: 230732 - DNA, 15 bp, Homo sapiens
ccttccacaaatagt

SEQ ID NO: 230733 - DNA, 15 bp, Homo sapiens
accttccacaaatag

SEQ ID NO: 230734 - DNA, 15 bp, Homo sapiens
taccttccacaaata

SEQ ID NO: 230735 - DNA, 15 bp, Homo sapiens
ctaccttccacaaat

SEQ ID NO: 230736 - DNA, 15 bp, Homo sapiens
actaccttccacaaa

SEQ ID NO: 230737 - DNA, 15 bp, Homo sapiens
gactaccttccacaa

SEQ ID NO: 230738 - DNA, 15 bp, Homo sapiens
ggactaccttccaca

SEQ ID NO: 230739 - DNA, 15 bp, Homo sapiens
gggactaccttccac

SEQ ID NO: 230740 - DNA, 15 bp, Homo sapiens
agggactaccttcca

SEQ ID NO: 230741 - DNA, 15 bp, Homo sapiens
tagggactaccttcc

SEQ ID NO: 230742 - DNA, 15 bp, Homo sapiens
ttagggactaccttc

SEQ ID NO: 230743 - DNA, 15 bp, Homo sapiens
tttagggactacctt

SEQ ID NO: 230744 - DNA, 15 bp, Homo sapiens
atttagggactacct

SEQ ID NO: 230745 - DNA, 15 bp, Homo sapiens
gatttagggactacc

SEQ ID NO: 230746 - DNA, 15 bp, Homo sapiens
agatttagggactac

SEQ ID NO: 230747 - DNA, 15 bp, Homo sapiens
cagatttagggacta

SEQ ID NO: 230748 - DNA, 15 bp, Homo sapiens
acagatttagggact

SEQ ID NO: 230749 - DNA, 15 bp, Homo sapiens
aacagatttagggac

SEQ ID NO: 230750 - DNA, 15 bp, Homo sapiens
aaacagatttaggga

SEQ ID NO: 230751 - DNA, 15 bp, Homo sapiens
taaacagatttaggg

SEQ ID NO: 230752 - DNA, 15 bp, Homo sapiens
gtaaacagatttagg

SEQ ID NO: 230753 - DNA, 15 bp, Homo sapiens
agtaaacagatttag

SEQ ID NO: 230754 - DNA, 15 bp, Homo sapiens
aagtaaacagattta

SEQ ID NO: 230755 - DNA, 15 bp, Homo sapiens
aaagtaaacagattt

SEQ ID NO: 230756 - DNA, 15 bp, Homo sapiens
aaaagtaaacagatt

SEQ ID NO: 230757 - DNA, 15 bp, Homo sapiens
caaaagtaaacagat

SEQ ID NO: 230758 - DNA, 15 bp, Homo sapiens
tcaaaagtaaacaga

SEQ ID NO: 230759 - DNA, 15 bp, Homo sapiens
ctcaaaagtaaacag

SEQ ID NO: 230760 - DNA, 15 bp, Homo sapiens
cctcaaaagtaaaca

SEQ ID NO: 230761 - DNA, 15 bp, Homo sapiens
acctcaaaagtaaac

SEQ ID NO: 230762 - DNA, 15 bp, Homo sapiens
gacctcaaaagtaaa

SEQ ID NO: 230763 - DNA, 15 bp, Homo sapiens
agacctcaaaagtaa

SEQ ID NO: 230764 - DNA, 15 bp, Homo sapiens
aagacctcaaaagta

SEQ ID NO: 230765 - DNA, 15 bp, Homo sapiens
caagacctcaaaagt

SEQ ID NO: 230766 - DNA, 15 bp, Homo sapiens
tcaagacctcaaaag

SEQ ID NO: 230767 - DNA, 15 bp, Homo sapiens
atcaagacctcaaaa

SEQ ID NO: 230768 - DNA, 15 bp, Homo sapiens
catcaagacctcaaa

SEQ ID NO: 230769 - DNA, 15 bp, Homo sapiens
acatcaagacctcaa

SEQ ID NO: 230770 - DNA, 15 bp, Homo sapiens
aacatcaagacctca

SEQ ID NO: 230771 - DNA, 15 bp, Homo sapiens
gaacatcaagacctc

SEQ ID NO: 230772 - DNA, 15 bp, Homo sapiens
ggaacatcaagacct

SEQ ID NO: 230773 - DNA, 15 bp, Homo sapiens
gggaacatcaagacc

SEQ ID NO: 230774 - DNA, 15 bp, Homo sapiens
agggaacatcaagac

SEQ ID NO: 230775 - DNA, 15 bp, Homo sapiens
tagggaacatcaaga

SEQ ID NO: 230776 - DNA, 15 bp, Homo sapiens
ttagggaacatcaag

SEQ ID NO: 230777 - DNA, 15 bp, Homo sapiens
tttagggaacatcaa

SEQ ID NO: 230778 - DNA, 15 bp, Homo sapiens
atttagggaacatca

SEQ ID NO: 230779 - DNA, 15 bp, Homo sapiens
tatttagggaacatc

SEQ ID NO: 230780 - DNA, 15 bp, Homo sapiens
atatttagggaacat

SEQ ID NO: 230781 - DNA, 15 bp, Homo sapiens
tatatttagggaaca

SEQ ID NO: 230782 - DNA, 15 bp, Homo sapiens
atatatttagggaac

SEQ ID NO: 230783 - DNA, 15 bp, Homo sapiens
gatatatttagggaa

SEQ ID NO: 230784 - DNA, 15 bp, Homo sapiens
agatatatttaggga

SEQ ID NO: 230785 - DNA, 15 bp, Homo sapiens
tagatatatttaggg

SEQ ID NO: 230786 - DNA, 15 bp, Homo sapiens
ctagatatatttagg

SEQ ID NO: 230787 - DNA, 15 bp, Homo sapiens
cctagatatatttag

SEQ ID NO: 230788 - DNA, 15 bp, Homo sapiens
acctagatatattta

SEQ ID NO: 230789 - DNA, 15 bp, Homo sapiens
aacctagatatattt

SEQ ID NO: 230790 - DNA, 15 bp, Homo sapiens
gaacctagatatatt

SEQ ID NO: 230791 - DNA, 15 bp, Homo sapiens
agaacctagatatat

SEQ ID NO: 230792 - DNA, 15 bp, Homo sapiens
gagaacctagatata

SEQ ID NO: 230793 - DNA, 15 bp, Homo sapiens
agagaacctagatat

SEQ ID NO: 230794 - DNA, 15 bp, Homo sapiens
aagagaacctagata

SEQ ID NO: 230795 - DNA, 15 bp, Homo sapiens
aaagagaacctagat

SEQ ID NO: 230796 - DNA, 15 bp, Homo sapiens
aaaagagaacctaga

SEQ ID NO: 230797 - DNA, 15 bp, Homo sapiens
gaaaagagaacctag

SEQ ID NO: 230798 - DNA, 15 bp, Homo sapiens
agaaaagagaaccta

SEQ ID NO: 230799 - DNA, 15 bp, Homo sapiens
aagaaaagagaacct

SEQ ID NO: 230800 - DNA, 15 bp, Homo sapiens
taagaaaagagaacc

SEQ ID NO: 230801 - DNA, 15 bp, Homo sapiens
ttaagaaaagagaac

SEQ ID NO: 230802 - DNA, 15 bp, Homo sapiens
tttaagaaaagagaa

SEQ ID NO: 230803 - DNA, 15 bp, Homo sapiens
ttttaagaaaagaga

SEQ ID NO: 230804 - DNA, 15 bp, Homo sapiens
tttttaagaaaagag

SEQ ID NO: 230805 - DNA, 15 bp, Homo sapiens
tttttttaagaaaag

SEQ ID NO: 230806 - DNA, 15 bp, Homo sapiens
ctttttttaagaaaa

SEQ ID NO: 230807 - DNA, 15 bp, Homo sapiens
tctttttttaagaaa

SEQ ID NO: 230808 - DNA, 15 bp, Homo sapiens
ttctttttttaagaa

SEQ ID NO: 230809 - DNA, 15 bp, Homo sapiens
tttctttttttaaga

SEQ ID NO: 230810 - DNA, 15 bp, Homo sapiens
ttttctttttttaag

SEQ ID NO: 230811 - DNA, 15 bp, Homo sapiens
tttttctttttttaa

SEQ ID NO: 230812 - DNA, 15 bp, Homo sapiens
ttttttcttttttta

SEQ ID NO: 230813 - DNA, 15 bp, Homo sapiens
tctttttttttcttt

SEQ ID NO: 230814 - DNA, 15 bp, Homo sapiens
ttctttttttttctt

SEQ ID NO: 230815 - DNA, 15 bp, Homo sapiens
attctttttttttct

SEQ ID NO: 230816 - DNA, 15 bp, Homo sapiens
aattctttttttttc

SEQ ID NO: 230817 - DNA, 15 bp, Homo sapiens
aaattcttttttttt

SEQ ID NO: 230818 - DNA, 15 bp, Homo sapiens
caaattctttttttt

SEQ ID NO: 230819 - DNA, 15 bp, Homo sapiens
tcaaattcttttttt

SEQ ID NO: 230820 - DNA, 15 bp, Homo sapiens
ctcaaattctttttt

SEQ ID NO: 230821 - DNA, 15 bp, Homo sapiens
tctcaaattcttttt

SEQ ID NO: 230822 - DNA, 15 bp, Homo sapiens
ttctcaaattctttt

SEQ ID NO: 230823 - DNA, 15 bp, Homo sapiens
cttctcaaattcttt

SEQ ID NO: 230824 - DNA, 15 bp, Homo sapiens
acttctcaaattctt

SEQ ID NO: 230825 - DNA, 15 bp, Homo sapiens
gacttctcaaattct

SEQ ID NO: 230826 - DNA, 15 bp, Homo sapiens
ggacttctcaaattc

SEQ ID NO: 230827 - DNA, 15 bp, Homo sapiens
tggacttctcaaatt

SEQ ID NO: 230828 - DNA, 15 bp, Homo sapiens
gtggacttctcaaat

SEQ ID NO: 230829 - DNA, 15 bp, Homo sapiens
agtggacttctcaaa

SEQ ID NO: 230830 - DNA, 15 bp, Homo sapiens
cagtggacttctcaa

SEQ ID NO: 230831 - DNA, 15 bp, Homo sapiens
ccagtggacttctca

SEQ ID NO: 230832 - DNA, 15 bp, Homo sapiens
gccagtggacttctc

SEQ ID NO: 230833 - DNA, 15 bp, Homo sapiens
tgccagtggacttct

SEQ ID NO: 230834 - DNA, 15 bp, Homo sapiens
ctgccagtggacttc

SEQ ID NO: 230835 - DNA, 15 bp, Homo sapiens
gctgccagtggactt

SEQ ID NO: 230836 - DNA, 15 bp, Homo sapiens
tgctgccagtggact

SEQ ID NO: 230837 - DNA, 15 bp, Homo sapiens
atgctgccagtggac

SEQ ID NO: 230838 - DNA, 15 bp, Homo sapiens
catgctgccagtgga

SEQ ID NO: 230839 - DNA, 15 bp, Homo sapiens
ccatgctgccagtgg

SEQ ID NO: 230840 - DNA, 15 bp, Homo sapiens
tccatgctgccagtg

SEQ ID NO: 230841 - DNA, 15 bp, Homo sapiens
atccatgctgccagt

SEQ ID NO: 230842 - DNA, 15 bp, Homo sapiens
catccatgctgccag

SEQ ID NO: 230843 - DNA, 15 bp, Homo sapiens
tcatccatgctgcca

SEQ ID NO: 230844 - DNA, 15 bp, Homo sapiens
ttcatccatgctgcc

SEQ ID NO: 230845 - DNA, 15 bp, Homo sapiens
attcatccatgctgc

SEQ ID NO: 230846 - DNA, 15 bp, Homo sapiens
gattcatccatgctg

SEQ ID NO: 230847 - DNA, 15 bp, Homo sapiens
agattcatccatgct

SEQ ID NO: 230848 - DNA, 15 bp, Homo sapiens
tagattcatccatgc

SEQ ID NO: 230849 - DNA, 15 bp, Homo sapiens
atagattcatccatg

SEQ ID NO: 230850 - DNA, 15 bp, Homo sapiens
catagattcatccat

SEQ ID NO: 230851 - DNA, 15 bp, Homo sapiens
gcatagattcatcca

SEQ ID NO: 230852 - DNA, 15 bp, Homo sapiens
ggcatagattcatcc

SEQ ID NO: 230853 - DNA, 15 bp, Homo sapiens
tggcatagattcatc

SEQ ID NO: 230854 - DNA, 15 bp, Homo sapiens
atggcatagattcat

SEQ ID NO: 230855 - DNA, 15 bp, Homo sapiens
gatggcatagattca

SEQ ID NO: 230856 - DNA, 15 bp, Homo sapiens
agatggcatagattc

SEQ ID NO: 230857 - DNA, 15 bp, Homo sapiens
aagatggcatagatt

SEQ ID NO: 230858 - DNA, 15 bp, Homo sapiens
aaagatggcatagat

SEQ ID NO: 230859 - DNA, 15 bp, Homo sapiens
taaagatggcataga

SEQ ID NO: 230860 - DNA, 15 bp, Homo sapiens
ataaagatggcatag

SEQ ID NO: 230861 - DNA, 15 bp, Homo sapiens
gataaagatggcata

SEQ ID NO: 230862 - DNA, 15 bp, Homo sapiens
tgataaagatggcat

SEQ ID NO: 230863 - DNA, 15 bp, Homo sapiens
atgataaagatggca

SEQ ID NO: 230864 - DNA, 15 bp, Homo sapiens
tatgataaagatggc

SEQ ID NO: 230865 - DNA, 15 bp, Homo sapiens
atatgataaagatgg

SEQ ID NO: 230866 - DNA, 15 bp, Homo sapiens
gatatgataaagatg

SEQ ID NO: 230867 - DNA, 15 bp, Homo sapiens
agatatgataaagat

SEQ ID NO: 230868 - DNA, 15 bp, Homo sapiens
cagatatgataaaga

SEQ ID NO: 230869 - DNA, 15 bp, Homo sapiens
acagatatgataaag

SEQ ID NO: 230870 - DNA, 15 bp, Homo sapiens
tacagatatgataaa

SEQ ID NO: 230871 - DNA, 15 bp, Homo sapiens
atacagatatgataa

SEQ ID NO: 230872 - DNA, 15 bp, Homo sapiens
aatacagatatgata

SEQ ID NO: 230873 - DNA, 15 bp, Homo sapiens
caatacagatatgat

SEQ ID NO: 230874 - DNA, 15 bp, Homo sapiens
tcaatacagatatga

SEQ ID NO: 230875 - DNA, 15 bp, Homo sapiens
ttcaatacagatatg

SEQ ID NO: 230876 - DNA, 15 bp, Homo sapiens
tttcaatacagatat

SEQ ID NO: 230877 - DNA, 15 bp, Homo sapiens
ctttcaatacagata

SEQ ID NO: 230878 - DNA, 15 bp, Homo sapiens
tctttcaatacagat

SEQ ID NO: 230879 - DNA, 15 bp, Homo sapiens
atctttcaatacaga

SEQ ID NO: 230880 - DNA, 15 bp, Homo sapiens
aatctttcaatacag

SEQ ID NO: 230881 - DNA, 15 bp, Homo sapiens
aaatctttcaataca

SEQ ID NO: 230882 - DNA, 15 bp, Homo sapiens
taaatctttcaatac

SEQ ID NO: 230883 - DNA, 15 bp, Homo sapiens
ctaaatctttcaata

SEQ ID NO: 230884 - DNA, 15 bp, Homo sapiens
cctaaatctttcaat

SEQ ID NO: 230885 - DNA, 15 bp, Homo sapiens
gcctaaatctttcaa

SEQ ID NO: 230886 - DNA, 15 bp, Homo sapiens
agcctaaatctttca

SEQ ID NO: 230887 - DNA, 15 bp, Homo sapiens
tagcctaaatctttc

SEQ ID NO: 230888 - DNA, 15 bp, Homo sapiens
gtagcctaaatcttt

SEQ ID NO: 230889 - DNA, 15 bp, Homo sapiens
tgtagcctaaatctt

SEQ ID NO: 230890 - DNA, 15 bp, Homo sapiens
atgtagcctaaatct

SEQ ID NO: 230891 - DNA, 15 bp, Homo sapiens
tatgtagcctaaatc

SEQ ID NO: 230892 - DNA, 15 bp, Homo sapiens
atatgtagcctaaat

SEQ ID NO: 230893 - DNA, 15 bp, Homo sapiens
aatatgtagcctaaa

SEQ ID NO: 230894 - DNA, 15 bp, Homo sapiens
taatatgtagcctaa

SEQ ID NO: 230895 - DNA, 15 bp, Homo sapiens
ttaatatgtagccta

SEQ ID NO: 230896 - DNA, 15 bp, Homo sapiens
gttaatatgtagcct

SEQ ID NO: 230897 - DNA, 15 bp, Homo sapiens
tgttaatatgtagcc

SEQ ID NO: 230898 - DNA, 15 bp, Homo sapiens
ctgttaatatgtagc

SEQ ID NO: 230899 - DNA, 15 bp, Homo sapiens
cctgttaatatgtag

SEQ ID NO: 230900 - DNA, 15 bp, Homo sapiens
acctgttaatatgta

SEQ ID NO: 230901 - DNA, 15 bp, Homo sapiens
cacctgttaatatgt

SEQ ID NO: 230902 - DNA, 15 bp, Homo sapiens
tcacctgttaatatg

SEQ ID NO: 230903 - DNA, 15 bp, Homo sapiens
ttcacctgttaatat

SEQ ID NO: 230904 - DNA, 15 bp, Homo sapiens
attcacctgttaata

SEQ ID NO: 230905 - DNA, 15 bp, Homo sapiens
gattcacctgttaat

SEQ ID NO: 230906 - DNA, 15 bp, Homo sapiens
agattcacctgttaa

SEQ ID NO: 230907 - DNA, 15 bp, Homo sapiens
cagattcacctgtta

SEQ ID NO: 230908 - DNA, 15 bp, Homo sapiens
gcagattcacctgtt

SEQ ID NO: 230909 - DNA, 15 bp, Homo sapiens
agcagattcacctgt

SEQ ID NO: 230910 - DNA, 15 bp, Homo sapiens
gagcagattcacctg

SEQ ID NO: 230911 - DNA, 15 bp, Homo sapiens
agagcagattcacct

SEQ ID NO: 230912 - DNA, 15 bp, Homo sapiens
cagagcagattcacc

SEQ ID NO: 230913 - DNA, 15 bp, Homo sapiens
tcagagcagattcac

SEQ ID NO: 230914 - DNA, 15 bp, Homo sapiens
ctcagagcagattca

SEQ ID NO: 230915 - DNA, 15 bp, Homo sapiens
actcagagcagattc

SEQ ID NO: 230916 - DNA, 15 bp, Homo sapiens
tactcagagcagatt

SEQ ID NO: 230917 - DNA, 15 bp, Homo sapiens
ctactcagagcagat

SEQ ID NO: 230918 - DNA, 15 bp, Homo sapiens
gctactcagagcaga

SEQ ID NO: 230919 - DNA, 15 bp, Homo sapiens
ggctactcagagcag

SEQ ID NO: 230920 - DNA, 15 bp, Homo sapiens
aggctactcagagca

SEQ ID NO: 230921 - DNA, 15 bp, Homo sapiens
gaggctactcagagc

SEQ ID NO: 230922 - DNA, 15 bp, Homo sapiens
agaggctactcagag

SEQ ID NO: 230923 - DNA, 15 bp, Homo sapiens
aagaggctactcaga

SEQ ID NO: 230924 - DNA, 15 bp, Homo sapiens
caagaggctactcag

SEQ ID NO: 230925 - DNA, 15 bp, Homo sapiens
acaagaggctactca

SEQ ID NO: 230926 - DNA, 15 bp, Homo sapiens
aacaagaggctactc

SEQ ID NO: 230927 - DNA, 15 bp, Homo sapiens
taacaagaggctact

SEQ ID NO: 230928 - DNA, 15 bp, Homo sapiens
ataacaagaggctac

SEQ ID NO: 230929 - DNA, 15 bp, Homo sapiens
aataacaagaggcta

SEQ ID NO: 230930 - DNA, 15 bp, Homo sapiens
caataacaagaggct

SEQ ID NO: 230931 - DNA, 15 bp, Homo sapiens
acaataacaagaggc

SEQ ID NO: 230932 - DNA, 15 bp, Homo sapiens
gacaataacaagagg

SEQ ID NO: 230933 - DNA, 15 bp, Homo sapiens
tgacaataacaagag

SEQ ID NO: 230934 - DNA, 15 bp, Homo sapiens
atgacaataacaaga

SEQ ID NO: 230935 - DNA, 15 bp, Homo sapiens
gatgacaataacaag

SEQ ID NO: 230936 - DNA, 15 bp, Homo sapiens
ggatgacaataacaa

SEQ ID NO: 230937 - DNA, 15 bp, Homo sapiens
aggatgacaataaca

SEQ ID NO: 230938 - DNA, 15 bp, Homo sapiens
aaggatgacaataac

SEQ ID NO: 230939 - DNA, 15 bp, Homo sapiens
taaggatgacaataa

SEQ ID NO: 230940 - DNA, 15 bp, Homo sapiens
ataaggatgacaata

SEQ ID NO: 230941 - DNA, 15 bp, Homo sapiens
tataaggatgacaat

SEQ ID NO: 230942 - DNA, 15 bp, Homo sapiens
ttataaggatgacaa

SEQ ID NO: 230943 - DNA, 15 bp, Homo sapiens
attataaggatgaca

SEQ ID NO: 230944 - DNA, 15 bp, Homo sapiens
aattataaggatgac

SEQ ID NO: 230945 - DNA, 15 bp, Homo sapiens
aaattataaggatga

SEQ ID NO: 230946 - DNA, 15 bp, Homo sapiens
taaattataaggatg

SEQ ID NO: 230947 - DNA, 15 bp, Homo sapiens
ataaattataaggat

SEQ ID NO: 230948 - DNA, 15 bp, Homo sapiens
aataaattataagga

SEQ ID NO: 230949 - DNA, 15 bp, Homo sapiens
taataaattataagg

SEQ ID NO: 230950 - DNA, 15 bp, Homo sapiens
ttaataaattataag

SEQ ID NO: 230951 - DNA, 15 bp, Homo sapiens
tttaataaattataa

SEQ ID NO: 230952 - DNA, 15 bp, Homo sapiens
atttaataaattata

SEQ ID NO: 230953 - DNA, 15 bp, Homo sapiens
catttaataaattat

SEQ ID NO: 230954 - DNA, 15 bp, Homo sapiens
ccatttaataaatta

SEQ ID NO: 230955 - DNA, 15 bp, Homo sapiens
tccatttaataaatt

SEQ ID NO: 230956 - DNA, 15 bp, Homo sapiens
gtccatttaataaat

SEQ ID NO: 230957 - DNA, 15 bp, Homo sapiens
tgtccatttaataaa

SEQ ID NO: 230958 - DNA, 15 bp, Homo sapiens
atgtccatttaataa

SEQ ID NO: 230959 - DNA, 15 bp, Homo sapiens
tatgtccatttaata

SEQ ID NO: 230960 - DNA, 15 bp, Homo sapiens
ttatgtccatttaat

SEQ ID NO: 230961 - DNA, 15 bp, Homo sapiens
attatgtccatttaa

SEQ ID NO: 230962 - DNA, 15 bp, Homo sapiens
aattatgtccattta

SEQ ID NO: 230963 - DNA, 15 bp, Homo sapiens
taattatgtccattt

SEQ ID NO: 230964 - DNA, 15 bp, Homo sapiens
ctaattatgtccatt

SEQ ID NO: 230965 - DNA, 15 bp, Homo sapiens
tctaattatgtccat

SEQ ID NO: 230966 - DNA, 15 bp, Homo sapiens
ttctaattatgtcca

SEQ ID NO: 230967 - DNA, 15 bp, Homo sapiens
cttctaattatgtcc

SEQ ID NO: 230968 - DNA, 15 bp, Homo sapiens
gcttctaattatgtc

SEQ ID NO: 230969 - DNA, 15 bp, Homo sapiens
tgcttctaattatgt

SEQ ID NO: 230970 - DNA, 15 bp, Homo sapiens
gtgcttctaattatg

SEQ ID NO: 230971 - DNA, 15 bp, Homo sapiens
agtgcttctaattat

SEQ ID NO: 230972 - DNA, 15 bp, Homo sapiens
tagtgcttctaatta

SEQ ID NO: 230973 - DNA, 15 bp, Homo sapiens
ttagtgcttctaatt

SEQ ID NO: 230974 - DNA, 15 bp, Homo sapiens
attagtgcttctaat

SEQ ID NO: 230975 - DNA, 15 bp, Homo sapiens
gattagtgcttctaa

SEQ ID NO: 230976 - DNA, 15 bp, Homo sapiens
tgattagtgcttcta

SEQ ID NO: 230977 - DNA, 15 bp, Homo sapiens
ctgattagtgcttct

SEQ ID NO: 230978 - DNA, 15 bp, Homo sapiens
gctgattagtgcttc

SEQ ID NO: 230979 - DNA, 15 bp, Homo sapiens
ggctgattagtgctt

SEQ ID NO: 230980 - DNA, 15 bp, Homo sapiens
cggctgattagtgct

SEQ ID NO: 230981 - DNA, 15 bp, Homo sapiens
acggctgattagtgc

SEQ ID NO: 230982 - DNA, 15 bp, Homo sapiens
cacggctgattagtg

SEQ ID NO: 230983 - DNA, 15 bp, Homo sapiens
ccacggctgattagt

SEQ ID NO: 230984 - DNA, 15 bp, Homo sapiens
gccacggctgattag

SEQ ID NO: 230985 - DNA, 15 bp, Homo sapiens
tgccacggctgatta

SEQ ID NO: 230986 - DNA, 15 bp, Homo sapiens
gtgccacggctgatt

SEQ ID NO: 230987 - DNA, 15 bp, Homo sapiens
agtgccacggctgat

SEQ ID NO: 230988 - DNA, 15 bp, Homo sapiens
aagtgccacggctga

SEQ ID NO: 230989 - DNA, 15 bp, Homo sapiens
caagtgccacggctg

SEQ ID NO: 230990 - DNA, 15 bp, Homo sapiens
tcaagtgccacggct

SEQ ID NO: 230991 - DNA, 15 bp, Homo sapiens
atcaagtgccacggc

SEQ ID NO: 230992 - DNA, 15 bp, Homo sapiens
catcaagtgccacgg

SEQ ID NO: 230993 - DNA, 15 bp, Homo sapiens
tcatcaagtgccacg

SEQ ID NO: 230994 - DNA, 15 bp, Homo sapiens
atcatcaagtgccac

SEQ ID NO: 230995 - DNA, 15 bp, Homo sapiens
catcatcaagtgcca

SEQ ID NO: 230996 - DNA, 15 bp, Homo sapiens
acatcatcaagtgcc

SEQ ID NO: 230997 - DNA, 15 bp, Homo sapiens
tacatcatcaagtgc

SEQ ID NO: 230998 - DNA, 15 bp, Homo sapiens
gtacatcatcaagtg

SEQ ID NO: 230999 - DNA, 15 bp, Homo sapiens
agtacatcatcaagt

SEQ ID NO: 231000 - DNA, 15 bp, Homo sapiens
aagtacatcatcaag

SEQ ID NO: 231001 - DNA, 15 bp, Homo sapiens
caagtacatcatcaa

SEQ ID NO: 231002 - DNA, 15 bp, Homo sapiens
acaagtacatcatca

SEQ ID NO: 231003 - DNA, 15 bp, Homo sapiens
tacaagtacatcatc

SEQ ID NO: 231004 - DNA, 15 bp, Homo sapiens
ttacaagtacatcat

SEQ ID NO: 231005 - DNA, 15 bp, Homo sapiens
attacaagtacatca

SEQ ID NO: 231006 - DNA, 15 bp, Homo sapiens
gattacaagtacatc

SEQ ID NO: 231007 - DNA, 15 bp, Homo sapiens
agattacaagtacat

SEQ ID NO: 231008 - DNA, 15 bp, Homo sapiens
cagattacaagtaca

SEQ ID NO: 231009 - DNA, 15 bp, Homo sapiens
ccagattacaagtac

SEQ ID NO: 231010 - DNA, 15 bp, Homo sapiens
gccagattacaagta

SEQ ID NO: 231011 - DNA, 15 bp, Homo sapiens
agccagattacaagt

SEQ ID NO: 231012 - DNA, 15 bp, Homo sapiens
gagccagattacaag

SEQ ID NO: 231013 - DNA, 15 bp, Homo sapiens
tgagccagattacaa

SEQ ID NO: 231014 - DNA, 15 bp, Homo sapiens
atgagccagattaca

SEQ ID NO: 231015 - DNA, 15 bp, Homo sapiens
tatgagccagattac

SEQ ID NO: 231016 - DNA, 15 bp, Homo sapiens
ttatgagccagatta

SEQ ID NO: 231017 - DNA, 15 bp, Homo sapiens
attatgagccagatt

SEQ ID NO: 231018 - DNA, 15 bp, Homo sapiens
cattatgagccagat

SEQ ID NO: 231019 - DNA, 15 bp, Homo sapiens
tcattatgagccaga

SEQ ID NO: 231020 - DNA, 15 bp, Homo sapiens
ctcattatgagccag

SEQ ID NO: 231021 - DNA, 15 bp, Homo sapiens
actcattatgagcca

SEQ ID NO: 231022 - DNA, 15 bp, Homo sapiens
cactcattatgagcc

SEQ ID NO: 231023 - DNA, 15 bp, Homo sapiens
ccactcattatgagc

SEQ ID NO: 231024 - DNA, 15 bp, Homo sapiens
accactcattatgag

SEQ ID NO: 231025 - DNA, 15 bp, Homo sapiens
aaccactcattatga

SEQ ID NO: 231026 - DNA, 15 bp, Homo sapiens
caaccactcattatg

SEQ ID NO: 231027 - DNA, 15 bp, Homo sapiens
acaaccactcattat

SEQ ID NO: 231028 - DNA, 15 bp, Homo sapiens
gacaaccactcatta

SEQ ID NO: 231029 - DNA, 15 bp, Homo sapiens
tgacaaccactcatt

SEQ ID NO: 231030 - DNA, 15 bp, Homo sapiens
atgacaaccactcat

SEQ ID NO: 231031 - DNA, 15 bp, Homo sapiens
gatgacaaccactca

SEQ ID NO: 231032 - DNA, 15 bp, Homo sapiens
tgatgacaaccactc

SEQ ID NO: 231033 - DNA, 15 bp, Homo sapiens
ctgatgacaaccact

SEQ ID NO: 231034 - DNA, 15 bp, Homo sapiens
actgatgacaaccac

SEQ ID NO: 231035 - DNA, 15 bp, Homo sapiens
aactgatgacaacca

SEQ ID NO: 231036 - DNA, 15 bp, Homo sapiens
taactgatgacaacc

SEQ ID NO: 231037 - DNA, 15 bp, Homo sapiens
ataactgatgacaac

SEQ ID NO: 231038 - DNA, 15 bp, Homo sapiens
aataactgatgacaa

SEQ ID NO: 231039 - DNA, 15 bp, Homo sapiens
caataactgatgaca

SEQ ID NO: 231040 - DNA, 15 bp, Homo sapiens
acaataactgatgac

SEQ ID NO: 231041 - DNA, 15 bp, Homo sapiens
tacaataactgatga

SEQ ID NO: 231042 - DNA, 15 bp, Homo sapiens
gtacaataactgatg

SEQ ID NO: 231043 - DNA, 15 bp, Homo sapiens
tgtacaataactgat

SEQ ID NO: 231044 - DNA, 15 bp, Homo sapiens
ctgtacaataactga

SEQ ID NO: 231045 - DNA, 15 bp, Homo sapiens
tctgtacaataactg

SEQ ID NO: 231046 - DNA, 15 bp, Homo sapiens
ctctgtacaataact

SEQ ID NO: 231047 - DNA, 15 bp, Homo sapiens
actctgtacaataac

SEQ ID NO: 231048 - DNA, 15 bp, Homo sapiens
tactctgtacaataa

SEQ ID NO: 231049 - DNA, 15 bp, Homo sapiens
ctactctgtacaata

SEQ ID NO: 231050 - DNA, 15 bp, Homo sapiens
cctactctgtacaat

SEQ ID NO: 231051 - DNA, 15 bp, Homo sapiens
tcctactctgtacaa

SEQ ID NO: 231052 - DNA, 15 bp, Homo sapiens
ttcctactctgtaca

SEQ ID NO: 231053 - DNA, 15 bp, Homo sapiens
tttcctactctgtac

SEQ ID NO: 231054 - DNA, 15 bp, Homo sapiens
atttcctactctgta

SEQ ID NO: 231055 - DNA, 15 bp, Homo sapiens
catttcctactctgt

SEQ ID NO: 231056 - DNA, 15 bp, Homo sapiens
ccatttcctactctg

SEQ ID NO: 231057 - DNA, 15 bp, Homo sapiens
accatttcctactct

SEQ ID NO: 231058 - DNA, 15 bp, Homo sapiens
gaccatttcctactc

SEQ ID NO: 231059 - DNA, 15 bp, Homo sapiens
tgaccatttcctact

SEQ ID NO: 231060 - DNA, 15 bp, Homo sapiens
ctgaccatttcctac

SEQ ID NO: 231061 - DNA, 15 bp, Homo sapiens
cctgaccatttccta

SEQ ID NO: 231062 - DNA, 15 bp, Homo sapiens
ccctgaccatttcct

SEQ ID NO: 231063 - DNA, 15 bp, Homo sapiens
gccctgaccatttcc

SEQ ID NO: 231064 - DNA, 15 bp, Homo sapiens
ggccctgaccatttc

SEQ ID NO: 231065 - DNA, 15 bp, Homo sapiens
gggccctgaccattt

SEQ ID NO: 231066 - DNA, 15 bp, Homo sapiens
agggccctgaccatt

SEQ ID NO: 231067 - DNA, 15 bp, Homo sapiens
gagggccctgaccat

SEQ ID NO: 231068 - DNA, 15 bp, Homo sapiens
agagggccctgacca

SEQ ID NO: 231069 - DNA, 15 bp, Homo sapiens
gagagggccctgacc

SEQ ID NO: 231070 - DNA, 15 bp, Homo sapiens
tgagagggccctgac

SEQ ID NO: 231071 - DNA, 15 bp, Homo sapiens
ttgagagggccctga

SEQ ID NO: 231072 - DNA, 15 bp, Homo sapiens
tttgagagggccctg

SEQ ID NO: 231073 - DNA, 15 bp, Homo sapiens
gtttgagagggccct

SEQ ID NO: 231074 - DNA, 15 bp, Homo sapiens
tgtttgagagggccc

SEQ ID NO: 231075 - DNA, 15 bp, Homo sapiens
gtgtttgagagggcc

SEQ ID NO: 231076 - DNA, 15 bp, Homo sapiens
agtgtttgagagggc

SEQ ID NO: 231077 - DNA, 15 bp, Homo sapiens
cagtgtttgagaggg

SEQ ID NO: 231078 - DNA, 15 bp, Homo sapiens
tcagtgtttgagagg

SEQ ID NO: 231079 - DNA, 15 bp, Homo sapiens
atcagtgtttgagag

SEQ ID NO: 231080 - DNA, 15 bp, Homo sapiens
aatcagtgtttgaga

SEQ ID NO: 231081 - DNA, 15 bp, Homo sapiens
caatcagtgtttgag

SEQ ID NO: 231082 - DNA, 15 bp, Homo sapiens
tcaatcagtgtttga

SEQ ID NO: 231083 - DNA, 15 bp, Homo sapiens
ttcaatcagtgtttg

SEQ ID NO: 231084 - DNA, 15 bp, Homo sapiens
gttcaatcagtgttt

SEQ ID NO: 231085 - DNA, 15 bp, Homo sapiens
tgttcaatcagtgtt

SEQ ID NO: 231086 - DNA, 15 bp, Homo sapiens
atgttcaatcagtgt

SEQ ID NO: 231087 - DNA, 15 bp, Homo sapiens
aatgttcaatcagtg

SEQ ID NO: 231088 - DNA, 15 bp, Homo sapiens
aaatgttcaatcagt

SEQ ID NO: 231089 - DNA, 15 bp, Homo sapiens
gaaatgttcaatcag

SEQ ID NO: 231090 - DNA, 15 bp, Homo sapiens
tgaaatgttcaatca

SEQ ID NO: 231091 - DNA, 15 bp, Homo sapiens
ctgaaatgttcaatc

SEQ ID NO: 231092 - DNA, 15 bp, Homo sapiens
tctgaaatgttcaat

SEQ ID NO: 231093 - DNA, 15 bp, Homo sapiens
ctctgaaatgttcaa

SEQ ID NO: 231094 - DNA, 15 bp, Homo sapiens
actctgaaatgttca

SEQ ID NO: 231095 - DNA, 15 bp, Homo sapiens
aactctgaaatgttc

SEQ ID NO: 231096 - DNA, 15 bp, Homo sapiens
taactctgaaatgtt

SEQ ID NO: 231097 - DNA, 15 bp, Homo sapiens
ataactctgaaatgt

SEQ ID NO: 231098 - DNA, 15 bp, Homo sapiens
aataactctgaaatg

SEQ ID NO: 231099 - DNA, 15 bp, Homo sapiens
taataactctgaaat

SEQ ID NO: 231100 - DNA, 15 bp, Homo sapiens
ttaataactctgaaa

SEQ ID NO: 231101 - DNA, 15 bp, Homo sapiens
tttaataactctgaa

SEQ ID NO: 231102 - DNA, 15 bp, Homo sapiens
atttaataactctga

SEQ ID NO: 231103 - DNA, 15 bp, Homo sapiens
catttaataactctg

SEQ ID NO: 231104 - DNA, 15 bp, Homo sapiens
ccatttaataactct

SEQ ID NO: 231105 - DNA, 15 bp, Homo sapiens
tccatttaataactc

SEQ ID NO: 231106 - DNA, 15 bp, Homo sapiens
atccatttaataact

SEQ ID NO: 231107 - DNA, 15 bp, Homo sapiens
gatccatttaataac

SEQ ID NO: 231108 - DNA, 15 bp, Homo sapiens
agatccatttaataa

SEQ ID NO: 231109 - DNA, 15 bp, Homo sapiens
aagatccatttaata

SEQ ID NO: 231110 - DNA, 15 bp, Homo sapiens
taagatccatttaat

SEQ ID NO: 231111 - DNA, 15 bp, Homo sapiens
ttaagatccatttaa

SEQ ID NO: 231112 - DNA, 15 bp, Homo sapiens
attaagatccattta

SEQ ID NO: 231113 - DNA, 15 bp, Homo sapiens
gattaagatccattt

SEQ ID NO: 231114 - DNA, 15 bp, Homo sapiens
tgattaagatccatt

SEQ ID NO: 231115 - DNA, 15 bp, Homo sapiens
gtgattaagatccat

SEQ ID NO: 231116 - DNA, 15 bp, Homo sapiens
agtgattaagatcca

SEQ ID NO: 231117 - DNA, 15 bp, Homo sapiens
aagtgattaagatcc

SEQ ID NO: 231118 - DNA, 15 bp, Homo sapiens
aaagtgattaagatc

SEQ ID NO: 231119 - DNA, 15 bp, Homo sapiens
taaagtgattaagat

SEQ ID NO: 231120 - DNA, 15 bp, Homo sapiens
ataaagtgattaaga

SEQ ID NO: 231121 - DNA, 15 bp, Homo sapiens
gataaagtgattaag

SEQ ID NO: 231122 - DNA, 15 bp, Homo sapiens
tgataaagtgattaa

SEQ ID NO: 231123 - DNA, 15 bp, Homo sapiens
ctgataaagtgatta

SEQ ID NO: 231124 - DNA, 15 bp, Homo sapiens
tctgataaagtgatt

SEQ ID NO: 231125 - DNA, 15 bp, Homo sapiens
ttctgataaagtgat

SEQ ID NO: 231126 - DNA, 15 bp, Homo sapiens
tttctgataaagtga

SEQ ID NO: 231127 - DNA, 15 bp, Homo sapiens
ttttctgataaagtg

SEQ ID NO: 231128 - DNA, 15 bp, Homo sapiens
attttctgataaagt

SEQ ID NO: 231129 - DNA, 15 bp, Homo sapiens
aattttctgataaag

SEQ ID NO: 231130 - DNA, 15 bp, Homo sapiens
taattttctgataaa

SEQ ID NO: 231131 - DNA, 15 bp, Homo sapiens
ctaattttctgataa

SEQ ID NO: 231132 - DNA, 15 bp, Homo sapiens
cctaattttctgata

SEQ ID NO: 231133 - DNA, 15 bp, Homo sapiens
tcctaattttctgat

SEQ ID NO: 231134 - DNA, 15 bp, Homo sapiens
ttcctaattttctga

SEQ ID NO: 231135 - DNA, 15 bp, Homo sapiens
tttcctaattttctg

SEQ ID NO: 231136 - DNA, 15 bp, Homo sapiens
atttcctaattttct

SEQ ID NO: 231137 - DNA, 15 bp, Homo sapiens
tatttcctaattttc

SEQ ID NO: 231138 - DNA, 15 bp, Homo sapiens
ttatttcctaatttt

SEQ ID NO: 231139 - DNA, 15 bp, Homo sapiens
attatttcctaattt

SEQ ID NO: 231140 - DNA, 15 bp, Homo sapiens
cattatttcctaatt

SEQ ID NO: 231141 - DNA, 15 bp, Homo sapiens
acattatttcctaat

SEQ ID NO: 231142 - DNA, 15 bp, Homo sapiens
tacattatttcctaa

SEQ ID NO: 231143 - DNA, 15 bp, Homo sapiens
atacattatttccta

SEQ ID NO: 231144 - DNA, 15 bp, Homo sapiens
aatacattatttcct

SEQ ID NO: 231145 - DNA, 15 bp, Homo sapiens
aaatacattatttcc

SEQ ID NO: 231146 - DNA, 15 bp, Homo sapiens
gaaatacattatttc

SEQ ID NO: 231147 - DNA, 15 bp, Homo sapiens
ggaaatacattattt

SEQ ID NO: 231148 - DNA, 15 bp, Homo sapiens
gggaaatacattatt

SEQ ID NO: 231149 - DNA, 15 bp, Homo sapiens
tgggaaatacattat

SEQ ID NO: 231150 - DNA, 15 bp, Homo sapiens
ttgggaaatacatta

SEQ ID NO: 231151 - DNA, 15 bp, Homo sapiens
attgggaaatacatt

SEQ ID NO: 231152 - DNA, 15 bp, Homo sapiens
tattgggaaatacat

SEQ ID NO: 231153 - DNA, 15 bp, Homo sapiens
atattgggaaataca

SEQ ID NO: 231154 - DNA, 15 bp, Homo sapiens
aatattgggaaatac

SEQ ID NO: 231155 - DNA, 15 bp, Homo sapiens
aaatattgggaaata

SEQ ID NO: 231156 - DNA, 15 bp, Homo sapiens
aaaatattgggaaat

SEQ ID NO: 231157 - DNA, 15 bp, Homo sapiens
taaaatattgggaaa

SEQ ID NO: 231158 - DNA, 15 bp, Homo sapiens
ttaaaatattgggaa

SEQ ID NO: 231159 - DNA, 15 bp, Homo sapiens
attaaaatattggga

SEQ ID NO: 231160 - DNA, 15 bp, Homo sapiens
gattaaaatattggg

SEQ ID NO: 231161 - DNA, 15 bp, Homo sapiens
tgattaaaatattgg

SEQ ID NO: 231162 - DNA, 15 bp, Homo sapiens
ctgattaaaatattg

SEQ ID NO: 231163 - DNA, 15 bp, Homo sapiens
tctgattaaaatatt

SEQ ID NO: 231164 - DNA, 15 bp, Homo sapiens
ttctgattaaaatat

SEQ ID NO: 231165 - DNA, 15 bp, Homo sapiens
tttctgattaaaata

SEQ ID NO: 231166 - DNA, 15 bp, Homo sapiens
gtttctgattaaaat

SEQ ID NO: 231167 - DNA, 15 bp, Homo sapiens
tgtttctgattaaaa

SEQ ID NO: 231168 - DNA, 15 bp, Homo sapiens
atgtttctgattaaa

SEQ ID NO: 231169 - DNA, 15 bp, Homo sapiens
gatgtttctgattaa

SEQ ID NO: 231170 - DNA, 15 bp, Homo sapiens
agatgtttctgatta

SEQ ID NO: 231171 - DNA, 15 bp, Homo sapiens
aagatgtttctgatt

SEQ ID NO: 231172 - DNA, 15 bp, Homo sapiens
aaagatgtttctgat

SEQ ID NO: 231173 - DNA, 15 bp, Homo sapiens
aaaagatgtttctga

SEQ ID NO: 231174 - DNA, 15 bp, Homo sapiens
caaaagatgtttctg

SEQ ID NO: 231175 - DNA, 15 bp, Homo sapiens
ccaaaagatgtttct

SEQ ID NO: 231176 - DNA, 15 bp, Homo sapiens
accaaaagatgtttc

SEQ ID NO: 231177 - DNA, 15 bp, Homo sapiens
gaccaaaagatgttt

SEQ ID NO: 231178 - DNA, 15 bp, Homo sapiens
tgaccaaaagatgtt

SEQ ID NO: 231179 - DNA, 15 bp, Homo sapiens
atgaccaaaagatgt

SEQ ID NO: 231180 - DNA, 15 bp, Homo sapiens
catgaccaaaagatg

SEQ ID NO: 231181 - DNA, 15 bp, Homo sapiens
tcatgaccaaaagat

SEQ ID NO: 231182 - DNA, 15 bp, Homo sapiens
ctcatgaccaaaaga

SEQ ID NO: 231183 - DNA, 15 bp, Homo sapiens
cctcatgaccaaaag

SEQ ID NO: 231184 - DNA, 15 bp, Homo sapiens
tcctcatgaccaaaa

SEQ ID NO: 231185 - DNA, 15 bp, Homo sapiens
ttcctcatgaccaaa

SEQ ID NO: 231186 - DNA, 15 bp, Homo sapiens
tttcctcatgaccaa

SEQ ID NO: 231187 - DNA, 15 bp, Homo sapiens
ctttcctcatgacca

SEQ ID NO: 231188 - DNA, 15 bp, Homo sapiens
tctttcctcatgacc

SEQ ID NO: 231189 - DNA, 15 bp, Homo sapiens
ctctttcctcatgac

SEQ ID NO: 231190 - DNA, 15 bp, Homo sapiens
tctctttcctcatga

SEQ ID NO: 231191 - DNA, 15 bp, Homo sapiens
ctctctttcctcatg

SEQ ID NO: 231192 - DNA, 15 bp, Homo sapiens
tctctctttcctcat

SEQ ID NO: 231193 - DNA, 15 bp, Homo sapiens
ctctctctttcctca

SEQ ID NO: 231194 - DNA, 15 bp, Homo sapiens
tctctctctttcctc

SEQ ID NO: 231195 - DNA, 15 bp, Homo sapiens
ctctctctctttcct

SEQ ID NO: 231196 - DNA, 15 bp, Homo sapiens
tctctctctctttcc

SEQ ID NO: 231197 - DNA, 15 bp, Homo sapiens
ttctctctctctttc

SEQ ID NO: 231198 - DNA, 15 bp, Homo sapiens
tttctctctctcttt

SEQ ID NO: 231199 - DNA, 15 bp, Homo sapiens
atttctctctctctt

SEQ ID NO: 231200 - DNA, 15 bp, Homo sapiens
tatttctctctctct

SEQ ID NO: 231201 - DNA, 15 bp, Homo sapiens
ctatttctctctctc

SEQ ID NO: 231202 - DNA, 15 bp, Homo sapiens
cctatttctctctct

SEQ ID NO: 231203 - DNA, 15 bp, Homo sapiens
tcctatttctctctc

SEQ ID NO: 231204 - DNA, 15 bp, Homo sapiens
ctcctatttctctct

SEQ ID NO: 231205 - DNA, 15 bp, Homo sapiens
cctcctatttctctc

SEQ ID NO: 231206 - DNA, 15 bp, Homo sapiens
ccctcctatttctct

SEQ ID NO: 231207 - DNA, 15 bp, Homo sapiens
cccctcctatttctc

SEQ ID NO: 231208 - DNA, 15 bp, Homo sapiens
ccccctcctatttct

SEQ ID NO: 231209 - DNA, 15 bp, Homo sapiens
cccccctcctatttc

SEQ ID NO: 231210 - DNA, 15 bp, Homo sapiens
acccccctcctattt

SEQ ID NO: 231211 - DNA, 15 bp, Homo sapiens
tacccccctcctatt

SEQ ID NO: 231212 - DNA, 15 bp, Homo sapiens
ttacccccctcctat

SEQ ID NO: 231213 - DNA, 15 bp, Homo sapiens
tttacccccctccta

SEQ ID NO: 231214 - DNA, 15 bp, Homo sapiens
ctttacccccctcct

SEQ ID NO: 231215 - DNA, 15 bp, Homo sapiens
tctttacccccctcc

SEQ ID NO: 231216 - DNA, 15 bp, Homo sapiens
ctctttacccccctc

SEQ ID NO: 231217 - DNA, 15 bp, Homo sapiens
tctctttacccccct

SEQ ID NO: 231218 - DNA, 15 bp, Homo sapiens
ctctctttacccccc

SEQ ID NO: 231219 - DNA, 15 bp, Homo sapiens
tctctctttaccccc

SEQ ID NO: 231220 - DNA, 15 bp, Homo sapiens
ctctctctttacccc

SEQ ID NO: 231221 - DNA, 15 bp, Homo sapiens
tctctctctttaccc

SEQ ID NO: 231222 - DNA, 15 bp, Homo sapiens
ctctctctctttacc

SEQ ID NO: 231223 - DNA, 15 bp, Homo sapiens
tctctctctctttac

SEQ ID NO: 231224 - DNA, 15 bp, Homo sapiens
atctctctctcttta

SEQ ID NO: 231225 - DNA, 15 bp, Homo sapiens
tatctctctctcttt

SEQ ID NO: 231226 - DNA, 15 bp, Homo sapiens
atatctctctctctt

SEQ ID NO: 231227 - DNA, 15 bp, Homo sapiens
aatatctctctctct

SEQ ID NO: 231228 - DNA, 15 bp, Homo sapiens
caatatctctctctc

SEQ ID NO: 231229 - DNA, 15 bp, Homo sapiens
tcaatatctctctct

SEQ ID NO: 231230 - DNA, 15 bp, Homo sapiens
ctcaatatctctctc

SEQ ID NO: 231231 - DNA, 15 bp, Homo sapiens
tctcaatatctctct

SEQ ID NO: 231232 - DNA, 15 bp, Homo sapiens
ctctcaatatctctc

SEQ ID NO: 231233 - DNA, 15 bp, Homo sapiens
tctctcaatatctct

SEQ ID NO: 231234 - DNA, 15 bp, Homo sapiens
ctctctcaatatctc

SEQ ID NO: 231235 - DNA, 15 bp, Homo sapiens
tctctctcaatatct

SEQ ID NO: 231236 - DNA, 15 bp, Homo sapiens
ctctctctcaatatc

SEQ ID NO: 231237 - DNA, 15 bp, Homo sapiens
gctctctctcaatat

SEQ ID NO: 231238 - DNA, 15 bp, Homo sapiens
tgctctctctcaata

SEQ ID NO: 231239 - DNA, 15 bp, Homo sapiens
ttgctctctctcaat

SEQ ID NO: 231240 - DNA, 15 bp, Homo sapiens
cttgctctctctcaa

SEQ ID NO: 231241 - DNA, 15 bp, Homo sapiens
acttgctctctctca

SEQ ID NO: 231242 - DNA, 15 bp, Homo sapiens
gacttgctctctctc

SEQ ID NO: 231243 - DNA, 15 bp, Homo sapiens
tgacttgctctctct

SEQ ID NO: 231244 - DNA, 15 bp, Homo sapiens
ttgacttgctctctc

SEQ ID NO: 231245 - DNA, 15 bp, Homo sapiens
cttgacttgctctct

SEQ ID NO: 231246 - DNA, 15 bp, Homo sapiens
acttgacttgctctc

SEQ ID NO: 231247 - DNA, 15 bp, Homo sapiens
gacttgacttgctct

SEQ ID NO: 231248 - DNA, 15 bp, Homo sapiens
agacttgacttgctc

SEQ ID NO: 231249 - DNA, 15 bp, Homo sapiens
aagacttgacttgct

SEQ ID NO: 231250 - DNA, 15 bp, Homo sapiens
aaagacttgacttgc

SEQ ID NO: 231251 - DNA, 15 bp, Homo sapiens
aaaagacttgacttg

SEQ ID NO: 231252 - DNA, 15 bp, Homo sapiens
gaaaagacttgactt

SEQ ID NO: 231253 - DNA, 15 bp, Homo sapiens
ggaaaagacttgact

SEQ ID NO: 231254 - DNA, 15 bp, Homo sapiens
aggaaaagacttgac

SEQ ID NO: 231255 - DNA, 15 bp, Homo sapiens
aaggaaaagacttga

SEQ ID NO: 231256 - DNA, 15 bp, Homo sapiens
aaaggaaaagacttg

SEQ ID NO: 231257 - DNA, 15 bp, Homo sapiens
caaaggaaaagactt

SEQ ID NO: 231258 - DNA, 15 bp, Homo sapiens
tcaaaggaaaagact

SEQ ID NO: 231259 - DNA, 15 bp, Homo sapiens
ctcaaaggaaaagac

SEQ ID NO: 231260 - DNA, 15 bp, Homo sapiens
actcaaaggaaaaga

SEQ ID NO: 231261 - DNA, 15 bp, Homo sapiens
aactcaaaggaaaag

SEQ ID NO: 231262 - DNA, 15 bp, Homo sapiens
gaactcaaaggaaaa

SEQ ID NO: 231263 - DNA, 15 bp, Homo sapiens
agaactcaaaggaaa

SEQ ID NO: 231264 - DNA, 15 bp, Homo sapiens
aagaactcaaaggaa

SEQ ID NO: 231265 - DNA, 15 bp, Homo sapiens
taagaactcaaagga

SEQ ID NO: 231266 - DNA, 15 bp, Homo sapiens
ataagaactcaaagg

SEQ ID NO: 231267 - DNA, 15 bp, Homo sapiens
aataagaactcaaag

SEQ ID NO: 231268 - DNA, 15 bp, Homo sapiens
caataagaactcaaa

SEQ ID NO: 231269 - DNA, 15 bp, Homo sapiens
ccaataagaactcaa

SEQ ID NO: 231270 - DNA, 15 bp, Homo sapiens
gccaataagaactca

SEQ ID NO: 231271 - DNA, 15 bp, Homo sapiens
agccaataagaactc

SEQ ID NO: 231272 - DNA, 15 bp, Homo sapiens
tagccaataagaact

SEQ ID NO: 231273 - DNA, 15 bp, Homo sapiens
ttagccaataagaac

SEQ ID NO: 231274 - DNA, 15 bp, Homo sapiens
attagccaataagaa

SEQ ID NO: 231275 - DNA, 15 bp, Homo sapiens
gattagccaataaga

SEQ ID NO: 231276 - DNA, 15 bp, Homo sapiens
tgattagccaataag

SEQ ID NO: 231277 - DNA, 15 bp, Homo sapiens
ttgattagccaataa

SEQ ID NO: 231278 - DNA, 15 bp, Homo sapiens
gttgattagccaata

SEQ ID NO: 231279 - DNA, 15 bp, Homo sapiens
ggttgattagccaat

SEQ ID NO: 231280 - DNA, 15 bp, Homo sapiens
aggttgattagccaa

SEQ ID NO: 231281 - DNA, 15 bp, Homo sapiens
caggttgattagcca

SEQ ID NO: 231282 - DNA, 15 bp, Homo sapiens
ccaggttgattagcc

SEQ ID NO: 231283 - DNA, 15 bp, Homo sapiens
accaggttgattagc

SEQ ID NO: 231284 - DNA, 15 bp, Homo sapiens
aaccaggttgattag

SEQ ID NO: 231285 - DNA, 15 bp, Homo sapiens
aaaccaggttgatta

SEQ ID NO: 231286 - DNA, 15 bp, Homo sapiens
caaaccaggttgatt

SEQ ID NO: 231287 - DNA, 15 bp, Homo sapiens
gcaaaccaggttgat

SEQ ID NO: 231288 - DNA, 15 bp, Homo sapiens
agcaaaccaggttga

SEQ ID NO: 231289 - DNA, 15 bp, Homo sapiens
aagcaaaccaggttg

SEQ ID NO: 231290 - DNA, 15 bp, Homo sapiens
taagcaaaccaggtt

SEQ ID NO: 231291 - DNA, 15 bp, Homo sapiens
ataagcaaaccaggt

SEQ ID NO: 231292 - DNA, 15 bp, Homo sapiens
cataagcaaaccagg

SEQ ID NO: 231293 - DNA, 15 bp, Homo sapiens
acataagcaaaccag

SEQ ID NO: 231294 - DNA, 15 bp, Homo sapiens
cacataagcaaacca

SEQ ID NO: 231295 - DNA, 15 bp, Homo sapiens
tcacataagcaaacc

SEQ ID NO: 231296 - DNA, 15 bp, Homo sapiens
ttcacataagcaaac

SEQ ID NO: 231297 - DNA, 15 bp, Homo sapiens
tttcacataagcaaa

SEQ ID NO: 231298 - DNA, 15 bp, Homo sapiens
ttttcacataagcaa

SEQ ID NO: 231299 - DNA, 15 bp, Homo sapiens
attttcacataagca

SEQ ID NO: 231300 - DNA, 15 bp, Homo sapiens
gattttcacataagc

SEQ ID NO: 231301 - DNA, 15 bp, Homo sapiens
agattttcacataag

SEQ ID NO: 231302 - DNA, 15 bp, Homo sapiens
gagattttcacataa

SEQ ID NO: 231303 - DNA, 15 bp, Homo sapiens
agagattttcacata

SEQ ID NO: 231304 - DNA, 15 bp, Homo sapiens
tagagattttcacat

SEQ ID NO: 231305 - DNA, 15 bp, Homo sapiens
gtagagattttcaca

SEQ ID NO: 231306 - DNA, 15 bp, Homo sapiens
tgtagagattttcac

SEQ ID NO: 231307 - DNA, 15 bp, Homo sapiens
ctgtagagattttca

SEQ ID NO: 231308 - DNA, 15 bp, Homo sapiens
tctgtagagattttc

SEQ ID NO: 231309 - DNA, 15 bp, Homo sapiens
atctgtagagatttt

SEQ ID NO: 231310 - DNA, 15 bp, Homo sapiens
tatctgtagagattt

SEQ ID NO: 231311 - DNA, 15 bp, Homo sapiens
atatctgtagagatt

SEQ ID NO: 231312 - DNA, 15 bp, Homo sapiens
gatatctgtagagat

SEQ ID NO: 231313 - DNA, 15 bp, Homo sapiens
agatatctgtagaga

SEQ ID NO: 231314 - DNA, 15 bp, Homo sapiens
tagatatctgtagag

SEQ ID NO: 231315 - DNA, 15 bp, Homo sapiens
ttagatatctgtaga

SEQ ID NO: 231316 - DNA, 15 bp, Homo sapiens
cttagatatctgtag

SEQ ID NO: 231317 - DNA, 15 bp, Homo sapiens
gcttagatatctgta

SEQ ID NO: 231318 - DNA, 15 bp, Homo sapiens
ggcttagatatctgt

SEQ ID NO: 231319 - DNA, 15 bp, Homo sapiens
aggcttagatatctg

SEQ ID NO: 231320 - DNA, 15 bp, Homo sapiens
gaggcttagatatct

SEQ ID NO: 231321 - DNA, 15 bp, Homo sapiens
ggaggcttagatatc

SEQ ID NO: 231322 - DNA, 15 bp, Homo sapiens
gggaggcttagatat

SEQ ID NO: 231323 - DNA, 15 bp, Homo sapiens
tgggaggcttagata

SEQ ID NO: 231324 - DNA, 15 bp, Homo sapiens
ctgggaggcttagat

SEQ ID NO: 231325 - DNA, 15 bp, Homo sapiens
tctgggaggcttaga

SEQ ID NO: 231326 - DNA, 15 bp, Homo sapiens
ctctgggaggcttag

SEQ ID NO: 231327 - DNA, 15 bp, Homo sapiens
gctctgggaggctta

SEQ ID NO: 231328 - DNA, 15 bp, Homo sapiens
agctctgggaggctt

SEQ ID NO: 231329 - DNA, 15 bp, Homo sapiens
tagctctgggaggct

SEQ ID NO: 231330 - DNA, 15 bp, Homo sapiens
ctagctctgggaggc

SEQ ID NO: 231331 - DNA, 15 bp, Homo sapiens
actagctctgggagg

SEQ ID NO: 231332 - DNA, 15 bp, Homo sapiens
aactagctctgggag

SEQ ID NO: 231333 - DNA, 15 bp, Homo sapiens
taactagctctggga

SEQ ID NO: 231334 - DNA, 15 bp, Homo sapiens
ataactagctctggg

SEQ ID NO: 231335 - DNA, 15 bp, Homo sapiens
tataactagctctgg

SEQ ID NO: 231336 - DNA, 15 bp, Homo sapiens
ttataactagctctg

SEQ ID NO: 231337 - DNA, 15 bp, Homo sapiens
tttataactagctct

SEQ ID NO: 231338 - DNA, 15 bp, Homo sapiens
ttttataactagctc

SEQ ID NO: 231339 - DNA, 15 bp, Homo sapiens
attttataactagct

SEQ ID NO: 231340 - DNA, 15 bp, Homo sapiens
tattttataactagc

SEQ ID NO: 231341 - DNA, 15 bp, Homo sapiens
ctattttataactag

SEQ ID NO: 231342 - DNA, 15 bp, Homo sapiens
actattttataacta

SEQ ID NO: 231343 - DNA, 15 bp, Homo sapiens
tactattttataact

SEQ ID NO: 231344 - DNA, 15 bp, Homo sapiens
ttactattttataac

SEQ ID NO: 231345 - DNA, 15 bp, Homo sapiens
tttactattttataa

SEQ ID NO: 231346 - DNA, 15 bp, Homo sapiens
ttttactattttata

SEQ ID NO: 231347 - DNA, 15 bp, Homo sapiens
tttttactattttat

SEQ ID NO: 231348 - DNA, 15 bp, Homo sapiens
ctttttactatttta

SEQ ID NO: 231349 - DNA, 15 bp, Homo sapiens
cctttttactatttt

SEQ ID NO: 231350 - DNA, 15 bp, Homo sapiens
tcctttttactattt

SEQ ID NO: 231351 - DNA, 15 bp, Homo sapiens
ttcctttttactatt

SEQ ID NO: 231352 - DNA, 15 bp, Homo sapiens
attcctttttactat

SEQ ID NO: 231353 - DNA, 15 bp, Homo sapiens
cattcctttttacta

SEQ ID NO: 231354 - DNA, 15 bp, Homo sapiens
tcattcctttttact

SEQ ID NO: 231355 - DNA, 15 bp, Homo sapiens
ttcattcctttttac

SEQ ID NO: 231356 - DNA, 15 bp, Homo sapiens
tttcattccttttta

SEQ ID NO: 231357 - DNA, 15 bp, Homo sapiens
ctttcattccttttt

SEQ ID NO: 231358 - DNA, 15 bp, Homo sapiens
tctttcattcctttt

SEQ ID NO: 231359 - DNA, 15 bp, Homo sapiens
ctctttcattccttt

SEQ ID NO: 231360 - DNA, 15 bp, Homo sapiens
actctttcattcctt

SEQ ID NO: 231361 - DNA, 15 bp, Homo sapiens
tactctttcattcct

SEQ ID NO: 231362 - DNA, 15 bp, Homo sapiens
ttactctttcattcc

SEQ ID NO: 231363 - DNA, 15 bp, Homo sapiens
gttactctttcattc

SEQ ID NO: 231364 - DNA, 15 bp, Homo sapiens
ggttactctttcatt

SEQ ID NO: 231365 - DNA, 15 bp, Homo sapiens
aggttactctttcat

SEQ ID NO: 231366 - DNA, 15 bp, Homo sapiens
aaggttactctttca

SEQ ID NO: 231367 - DNA, 15 bp, Homo sapiens
gaaggttactctttc

SEQ ID NO: 231368 - DNA, 15 bp, Homo sapiens
ggaaggttactcttt

SEQ ID NO: 231369 - DNA, 15 bp, Homo sapiens
aggaaggttactctt

SEQ ID NO: 231370 - DNA, 15 bp, Homo sapiens
gaggaaggttactct

SEQ ID NO: 231371 - DNA, 15 bp, Homo sapiens
tgaggaaggttactc

SEQ ID NO: 231372 - DNA, 15 bp, Homo sapiens
ttgaggaaggttact

SEQ ID NO: 231373 - DNA, 15 bp, Homo sapiens
cttgaggaaggttac

SEQ ID NO: 231374 - DNA, 15 bp, Homo sapiens
tcttgaggaaggtta

SEQ ID NO: 231375 - DNA, 15 bp, Homo sapiens
ttcttgaggaaggtt

SEQ ID NO: 231376 - DNA, 15 bp, Homo sapiens
gttcttgaggaaggt

SEQ ID NO: 231377 - DNA, 15 bp, Homo sapiens
ggttcttgaggaagg

SEQ ID NO: 231378 - DNA, 15 bp, Homo sapiens
aggttcttgaggaag

SEQ ID NO: 231379 - DNA, 15 bp, Homo sapiens
taggttcttgaggaa

SEQ ID NO: 231380 - DNA, 15 bp, Homo sapiens
gtaggttcttgagga

SEQ ID NO: 231381 - DNA, 15 bp, Homo sapiens
agtaggttcttgagg

SEQ ID NO: 231382 - DNA, 15 bp, Homo sapiens
cagtaggttcttgag

SEQ ID NO: 231383 - DNA, 15 bp, Homo sapiens
acagtaggttcttga

SEQ ID NO: 231384 - DNA, 15 bp, Homo sapiens
cacagtaggttcttg

SEQ ID NO: 231385 - DNA, 15 bp, Homo sapiens
acacagtaggttctt

SEQ ID NO: 231386 - DNA, 15 bp, Homo sapiens
cacacagtaggttct

SEQ ID NO: 231387 - DNA, 15 bp, Homo sapiens
gcacacagtaggttc

SEQ ID NO: 231388 - DNA, 15 bp, Homo sapiens
ggcacacagtaggtt

SEQ ID NO: 231389 - DNA, 15 bp, Homo sapiens
gtggcacacagtagg

SEQ ID NO: 231390 - DNA, 15 bp, Homo sapiens
tgtggcacacagtag

SEQ ID NO: 231391 - DNA, 15 bp, Homo sapiens
gtgtggcacacagta

SEQ ID NO: 231392 - DNA, 15 bp, Homo sapiens
tgtgtggcacacagt

SEQ ID NO: 231393 - DNA, 15 bp, Homo sapiens
atgtgtggcacacag

SEQ ID NO: 231394 - DNA, 15 bp, Homo sapiens
catgtgtggcacaca

SEQ ID NO: 231395 - DNA, 15 bp, Homo sapiens
acatgtgtggcacac

SEQ ID NO: 231396 - DNA, 15 bp, Homo sapiens
cacatgtgtggcaca

SEQ ID NO: 231397 - DNA, 15 bp, Homo sapiens
gcacatgtgtggcac

SEQ ID NO: 231398 - DNA, 15 bp, Homo sapiens
ggcacatgtgtggca

SEQ ID NO: 231399 - DNA, 15 bp, Homo sapiens
tggcacatgtgtggc

SEQ ID NO: 231400 - DNA, 15 bp, Homo sapiens
ctggcacatgtgtgg

SEQ ID NO: 231401 - DNA, 15 bp, Homo sapiens
actggcacatgtgtg

SEQ ID NO: 231402 - DNA, 15 bp, Homo sapiens
tactggcacatgtgt

SEQ ID NO: 231403 - DNA, 15 bp, Homo sapiens
ctactggcacatgtg

SEQ ID NO: 231404 - DNA, 15 bp, Homo sapiens
gctactggcacatgt

SEQ ID NO: 231405 - DNA, 15 bp, Homo sapiens
agctactggcacatg

SEQ ID NO: 231406 - DNA, 15 bp, Homo sapiens
aagctactggcacat

SEQ ID NO: 231407 - DNA, 15 bp, Homo sapiens
aaagctactggcaca

SEQ ID NO: 231408 - DNA, 15 bp, Homo sapiens
gaaagctactggcac

SEQ ID NO: 231409 - DNA, 15 bp, Homo sapiens
agaaagctactggca

SEQ ID NO: 231410 - DNA, 15 bp, Homo sapiens
tagaaagctactggc

SEQ ID NO: 231411 - DNA, 15 bp, Homo sapiens
atagaaagctactgg

SEQ ID NO: 231412 - DNA, 15 bp, Homo sapiens
catagaaagctactg

SEQ ID NO: 231413 - DNA, 15 bp, Homo sapiens
acatagaaagctact

SEQ ID NO: 231414 - DNA, 15 bp, Homo sapiens
tacatagaaagctac

SEQ ID NO: 231415 - DNA, 15 bp, Homo sapiens
atacatagaaagcta

SEQ ID NO: 231416 - DNA, 15 bp, Homo sapiens
aatacatagaaagct

SEQ ID NO: 231417 - DNA, 15 bp, Homo sapiens
taatacatagaaagc

SEQ ID NO: 231418 - DNA, 15 bp, Homo sapiens
ttaatacatagaaag

SEQ ID NO: 231419 - DNA, 15 bp, Homo sapiens
gttaatacatagaaa

SEQ ID NO: 231420 - DNA, 15 bp, Homo sapiens
agttaatacatagaa

SEQ ID NO: 231421 - DNA, 15 bp, Homo sapiens
cagttaatacataga

SEQ ID NO: 231422 - DNA, 15 bp, Homo sapiens
tcagttaatacatag

SEQ ID NO: 231423 - DNA, 15 bp, Homo sapiens
ctcagttaatacata

SEQ ID NO: 231424 - DNA, 15 bp, Homo sapiens
cctcagttaatacat

SEQ ID NO: 231425 - DNA, 15 bp, Homo sapiens
acctcagttaataca

SEQ ID NO: 231426 - DNA, 15 bp, Homo sapiens
aacctcagttaatac

SEQ ID NO: 231427 - DNA, 15 bp, Homo sapiens
caacctcagttaata

SEQ ID NO: 231428 - DNA, 15 bp, Homo sapiens
tcaacctcagttaat

SEQ ID NO: 231429 - DNA, 15 bp, Homo sapiens
ttcaacctcagttaa

SEQ ID NO: 231430 - DNA, 15 bp, Homo sapiens
tttcaacctcagtta

SEQ ID NO: 231431 - DNA, 15 bp, Homo sapiens
ctttcaacctcagtt

SEQ ID NO: 231432 - DNA, 15 bp, Homo sapiens
tctttcaacctcagt

SEQ ID NO: 231433 - DNA, 15 bp, Homo sapiens
ctctttcaacctcag

SEQ ID NO: 231434 - DNA, 15 bp, Homo sapiens
tctctttcaacctca

SEQ ID NO: 231435 - DNA, 15 bp, Homo sapiens
atctctttcaacctc

SEQ ID NO: 231436 - DNA, 15 bp, Homo sapiens
tatctctttcaacct

SEQ ID NO: 231437 - DNA, 15 bp, Homo sapiens
ttatctctttcaacc

SEQ ID NO: 231438 - DNA, 15 bp, Homo sapiens
cttatctctttcaac

SEQ ID NO: 231439 - DNA, 15 bp, Homo sapiens
ccttatctctttcaa

SEQ ID NO: 231440 - DNA, 15 bp, Homo sapiens
tccttatctctttca

SEQ ID NO: 231441 - DNA, 15 bp, Homo sapiens
ttccttatctctttc

SEQ ID NO: 231442 - DNA, 15 bp, Homo sapiens
attccttatctcttt

SEQ ID NO: 231443 - DNA, 15 bp, Homo sapiens
tattccttatctctt

SEQ ID NO: 231444 - DNA, 15 bp, Homo sapiens
atattccttatctct

SEQ ID NO: 231445 - DNA, 15 bp, Homo sapiens
tatattccttatctc

SEQ ID NO: 231446 - DNA, 15 bp, Homo sapiens
atatattccttatct

SEQ ID NO: 231447 - DNA, 15 bp, Homo sapiens
gatatattccttatc

SEQ ID NO: 231448 - DNA, 15 bp, Homo sapiens
agatatattccttat

SEQ ID NO: 231449 - DNA, 15 bp, Homo sapiens
tagatatattcctta

SEQ ID NO: 231450 - DNA, 15 bp, Homo sapiens
ctagatatattcctt

SEQ ID NO: 231451 - DNA, 15 bp, Homo sapiens
cctagatatattcct

SEQ ID NO: 231452 - DNA, 15 bp, Homo sapiens
tcctagatatattcc

SEQ ID NO: 231453 - DNA, 15 bp, Homo sapiens
atcctagatatattc

SEQ ID NO: 231454 - DNA, 15 bp, Homo sapiens
aatcctagatatatt

SEQ ID NO: 231455 - DNA, 15 bp, Homo sapiens
taatcctagatatat

SEQ ID NO: 231456 - DNA, 15 bp, Homo sapiens
ataatcctagatata

SEQ ID NO: 231457 - DNA, 15 bp, Homo sapiens
cataatcctagatat

SEQ ID NO: 231458 - DNA, 15 bp, Homo sapiens
acataatcctagata

SEQ ID NO: 231459 - DNA, 15 bp, Homo sapiens
tacataatcctagat

SEQ ID NO: 231460 - DNA, 15 bp, Homo sapiens
ttacataatcctaga

SEQ ID NO: 231461 - DNA, 15 bp, Homo sapiens
gttacataatcctag

SEQ ID NO: 231462 - DNA, 15 bp, Homo sapiens
agttacataatccta

SEQ ID NO: 231463 - DNA, 15 bp, Homo sapiens
tagttacataatcct

SEQ ID NO: 231464 - DNA, 15 bp, Homo sapiens
ctagttacataatcc

SEQ ID NO: 231465 - DNA, 15 bp, Homo sapiens
actagttacataatc

SEQ ID NO: 231466 - DNA, 15 bp, Homo sapiens
aactagttacataat

SEQ ID NO: 231467 - DNA, 15 bp, Homo sapiens
taactagttacataa

SEQ ID NO: 231468 - DNA, 15 bp, Homo sapiens
ctaactagttacata

SEQ ID NO: 231469 - DNA, 15 bp, Homo sapiens
actaactagttacat

SEQ ID NO: 231470 - DNA, 15 bp, Homo sapiens
tactaactagttaca

SEQ ID NO: 231471 - DNA, 15 bp, Homo sapiens
atactaactagttac

SEQ ID NO: 231472 - DNA, 15 bp, Homo sapiens
aatactaactagtta

SEQ ID NO: 231473 - DNA, 15 bp, Homo sapiens
caatactaactagtt

SEQ ID NO: 231474 - DNA, 15 bp, Homo sapiens
ccaatactaactagt

SEQ ID NO: 231475 - DNA, 15 bp, Homo sapiens
tccaatactaactag

SEQ ID NO: 231476 - DNA, 15 bp, Homo sapiens
ttccaatactaacta

SEQ ID NO: 231477 - DNA, 15 bp, Homo sapiens
gttccaatactaact

SEQ ID NO: 231478 - DNA, 15 bp, Homo sapiens
agttccaatactaac

SEQ ID NO: 231479 - DNA, 15 bp, Homo sapiens
cagttccaatactaa

SEQ ID NO: 231480 - DNA, 15 bp, Homo sapiens
ccagttccaatacta

SEQ ID NO: 231481 - DNA, 15 bp, Homo sapiens
gccagttccaatact

SEQ ID NO: 231482 - DNA, 15 bp, Homo sapiens
tgccagttccaatac

SEQ ID NO: 231483 - DNA, 15 bp, Homo sapiens
atgccagttccaata

SEQ ID NO: 231484 - DNA, 15 bp, Homo sapiens
catgccagttccaat

SEQ ID NO: 231485 - DNA, 15 bp, Homo sapiens
gcatgccagttccaa

SEQ ID NO: 231486 - DNA, 15 bp, Homo sapiens
tgcatgccagttcca

SEQ ID NO: 231487 - DNA, 15 bp, Homo sapiens
ttgcatgccagttcc

SEQ ID NO: 231488 - DNA, 15 bp, Homo sapiens
attgcatgccagttc

SEQ ID NO: 231489 - DNA, 15 bp, Homo sapiens
gattgcatgccagtt

SEQ ID NO: 231490 - DNA, 15 bp, Homo sapiens
agattgcatgccagt

SEQ ID NO: 231491 - DNA, 15 bp, Homo sapiens
gagattgcatgccag

SEQ ID NO: 231492 - DNA, 15 bp, Homo sapiens
ggagattgcatgcca

SEQ ID NO: 231493 - DNA, 15 bp, Homo sapiens
aggagattgcatgcc

SEQ ID NO: 231494 - DNA, 15 bp, Homo sapiens
taggagattgcatgc

SEQ ID NO: 231495 - DNA, 15 bp, Homo sapiens
ttaggagattgcatg

SEQ ID NO: 231496 - DNA, 15 bp, Homo sapiens
attaggagattgcat

SEQ ID NO: 231497 - DNA, 15 bp, Homo sapiens
gattaggagattgca

SEQ ID NO: 231498 - DNA, 15 bp, Homo sapiens
agattaggagattgc

SEQ ID NO: 231499 - DNA, 15 bp, Homo sapiens
aagattaggagattg

SEQ ID NO: 231500 - DNA, 15 bp, Homo sapiens
aaagattaggagatt

SEQ ID NO: 231501 - DNA, 15 bp, Homo sapiens
aaaagattaggagat

SEQ ID NO: 231502 - DNA, 15 bp, Homo sapiens
gaaaagattaggaga

SEQ ID NO: 231503 - DNA, 15 bp, Homo sapiens
agaaaagattaggag

SEQ ID NO: 231504 - DNA, 15 bp, Homo sapiens
aagaaaagattagga

SEQ ID NO: 231505 - DNA, 15 bp, Homo sapiens
gaagaaaagattagg

SEQ ID NO: 231506 - DNA, 15 bp, Homo sapiens
agaagaaaagattag

SEQ ID NO: 231507 - DNA, 15 bp, Homo sapiens
tagaagaaaagatta

SEQ ID NO: 231508 - DNA, 15 bp, Homo sapiens
gtagaagaaaagatt

SEQ ID NO: 231509 - DNA, 15 bp, Homo sapiens
ggtagaagaaaagat

SEQ ID NO: 231510 - DNA, 15 bp, Homo sapiens
tggtagaagaaaaga

SEQ ID NO: 231511 - DNA, 15 bp, Homo sapiens
ttggtagaagaaaag

SEQ ID NO: 231512 - DNA, 15 bp, Homo sapiens
tttggtagaagaaaa

SEQ ID NO: 231513 - DNA, 15 bp, Homo sapiens
atttggtagaagaaa

SEQ ID NO: 231514 - DNA, 15 bp, Homo sapiens
aatttggtagaagaa

SEQ ID NO: 231515 - DNA, 15 bp, Homo sapiens
caatttggtagaaga

SEQ ID NO: 231516 - DNA, 15 bp, Homo sapiens
acaatttggtagaag

SEQ ID NO: 231517 - DNA, 15 bp, Homo sapiens
gacaatttggtagaa

SEQ ID NO: 231518 - DNA, 15 bp, Homo sapiens
ggacaatttggtaga

SEQ ID NO: 231519 - DNA, 15 bp, Homo sapiens
tggacaatttggtag

SEQ ID NO: 231520 - DNA, 15 bp, Homo sapiens
ttggacaatttggta

SEQ ID NO: 231521 - DNA, 15 bp, Homo sapiens
gttggacaatttggt

SEQ ID NO: 231522 - DNA, 15 bp, Homo sapiens
tgttggacaatttgg

SEQ ID NO: 231523 - DNA, 15 bp, Homo sapiens
ctgttggacaatttg

SEQ ID NO: 231524 - DNA, 15 bp, Homo sapiens
actgttggacaattt

SEQ ID NO: 231525 - DNA, 15 bp, Homo sapiens
tactgttggacaatt

SEQ ID NO: 231526 - DNA, 15 bp, Homo sapiens
ttactgttggacaat

SEQ ID NO: 231527 - DNA, 15 bp, Homo sapiens
tttactgttggacaa

SEQ ID NO: 231528 - DNA, 15 bp, Homo sapiens
ttttactgttggaca

SEQ ID NO: 231529 - DNA, 15 bp, Homo sapiens
tttttactgttggac

SEQ ID NO: 231530 - DNA, 15 bp, Homo sapiens
atttttactgttgga

SEQ ID NO: 231531 - DNA, 15 bp, Homo sapiens
catttttactgttgg

SEQ ID NO: 231532 - DNA, 15 bp, Homo sapiens
gcatttttactgttg

SEQ ID NO: 231533 - DNA, 15 bp, Homo sapiens
ggcatttttactgtt

SEQ ID NO: 231534 - DNA, 15 bp, Homo sapiens
tggcatttttactgt

SEQ ID NO: 231535 - DNA, 15 bp, Homo sapiens
ctggcatttttactg

SEQ ID NO: 231536 - DNA, 15 bp, Homo sapiens
actggcatttttact

SEQ ID NO: 231537 - DNA, 15 bp, Homo sapiens
aactggcatttttac

SEQ ID NO: 231538 - DNA, 15 bp, Homo sapiens
caactggcattttta

SEQ ID NO: 231539 - DNA, 15 bp, Homo sapiens
acaactggcattttt

SEQ ID NO: 231540 - DNA, 15 bp, Homo sapiens
cacaactggcatttt

SEQ ID NO: 231541 - DNA, 15 bp, Homo sapiens
tcacaactggcattt

SEQ ID NO: 231542 - DNA, 15 bp, Homo sapiens
ttcacaactggcatt

SEQ ID NO: 231543 - DNA, 15 bp, Homo sapiens
attcacaactggcat

SEQ ID NO: 231544 - DNA, 15 bp, Homo sapiens
aattcacaactggca

SEQ ID NO: 231545 - DNA, 15 bp, Homo sapiens
aaattcacaactggc

SEQ ID NO: 231546 - DNA, 15 bp, Homo sapiens
aaaattcacaactgg

SEQ ID NO: 231547 - DNA, 15 bp, Homo sapiens
aaaaattcacaactg

SEQ ID NO: 231548 - DNA, 15 bp, Homo sapiens
aaaaaattcacaact

SEQ ID NO: 231549 - DNA, 15 bp, Homo sapiens
aaaaaaattcacaac

SEQ ID NO: 231550 - DNA, 15 bp, Homo sapiens
gaaaaaaattcacaa

SEQ ID NO: 231551 - DNA, 15 bp, Homo sapiens
agaaaaaaattcaca

SEQ ID NO: 231552 - DNA, 15 bp, Homo sapiens
aagaaaaaaattcac

SEQ ID NO: 231553 - DNA, 15 bp, Homo sapiens
taaagaaaaaaattc

SEQ ID NO: 231554 - DNA, 15 bp, Homo sapiens
gtaaagaaaaaaatt

SEQ ID NO: 231555 - DNA, 15 bp, Homo sapiens
agtaaagaaaaaaat

SEQ ID NO: 231556 - DNA, 15 bp, Homo sapiens
aagtaaagaaaaaaa

SEQ ID NO: 231557 - DNA, 15 bp, Homo sapiens
caagtaaagaaaaaa

SEQ ID NO: 231558 - DNA, 15 bp, Homo sapiens
tcaagtaaagaaaaa

SEQ ID NO: 231559 - DNA, 15 bp, Homo sapiens
atcaagtaaagaaaa

SEQ ID NO: 231560 - DNA, 15 bp, Homo sapiens
aatcaagtaaagaaa

SEQ ID NO: 231561 - DNA, 15 bp, Homo sapiens
caatcaagtaaagaa

SEQ ID NO: 231562 - DNA, 15 bp, Homo sapiens
acaatcaagtaaaga

SEQ ID NO: 231563 - DNA, 15 bp, Homo sapiens
aacaatcaagtaaag

SEQ ID NO: 231564 - DNA, 15 bp, Homo sapiens
aaacaatcaagtaaa

SEQ ID NO: 231565 - DNA, 15 bp, Homo sapiens
aaaacaatcaagtaa

SEQ ID NO: 231566 - DNA, 15 bp, Homo sapiens
taaaacaatcaagta

SEQ ID NO: 231567 - DNA, 15 bp, Homo sapiens
ttaaaacaatcaagt

SEQ ID NO: 231568 - DNA, 15 bp, Homo sapiens
attaaaacaatcaag

SEQ ID NO: 231569 - DNA, 15 bp, Homo sapiens
tattaaaacaatcaa

SEQ ID NO: 231570 - DNA, 15 bp, Homo sapiens
atattaaaacaatca

SEQ ID NO: 231571 - DNA, 15 bp, Homo sapiens
aatattaaaacaatc

SEQ ID NO: 231572 - DNA, 15 bp, Homo sapiens
aaatattaaaacaat

SEQ ID NO: 231573 - DNA, 15 bp, Homo sapiens
ggaaatattaaaaca

SEQ ID NO: 231574 - DNA, 15 bp, Homo sapiens
aggaaatattaaaac

SEQ ID NO: 231575 - DNA, 15 bp, Homo sapiens
aaggaaatattaaaa

SEQ ID NO: 231576 - DNA, 15 bp, Homo sapiens
aaaggaaatattaaa

SEQ ID NO: 231577 - DNA, 15 bp, Homo sapiens
aaaaggaaatattaa

SEQ ID NO: 231578 - DNA, 15 bp, Homo sapiens
gaaaaggaaatatta

SEQ ID NO: 231579 - DNA, 15 bp, Homo sapiens
cgaaaaggaaatatt

SEQ ID NO: 231580 - DNA, 15 bp, Homo sapiens
acgaaaaggaaatat

SEQ ID NO: 231581 - DNA, 15 bp, Homo sapiens
gacgaaaaggaaata

SEQ ID NO: 231582 - DNA, 15 bp, Homo sapiens
agacgaaaaggaaat

SEQ ID NO: 231583 - DNA, 15 bp, Homo sapiens
aagacgaaaaggaaa

SEQ ID NO: 231584 - DNA, 15 bp, Homo sapiens
aaagacgaaaaggaa

SEQ ID NO: 231585 - DNA, 15 bp, Homo sapiens
aaaagacgaaaagga

SEQ ID NO: 231586 - DNA, 15 bp, Homo sapiens
caaaagacgaaaagg

SEQ ID NO: 231587 - DNA, 15 bp, Homo sapiens
ccaaaagacgaaaag

SEQ ID NO: 231588 - DNA, 15 bp, Homo sapiens
accaaaagacgaaaa

SEQ ID NO: 231589 - DNA, 15 bp, Homo sapiens
taccaaaagacgaaa

SEQ ID NO: 231590 - DNA, 15 bp, Homo sapiens
ctaccaaaagacgaa

SEQ ID NO: 231591 - DNA, 15 bp, Homo sapiens
tctaccaaaagacga

SEQ ID NO: 231592 - DNA, 15 bp, Homo sapiens
ttctaccaaaagacg

SEQ ID NO: 231593 - DNA, 15 bp, Homo sapiens
attctaccaaaagac

SEQ ID NO: 231594 - DNA, 15 bp, Homo sapiens
tattctaccaaaaga

SEQ ID NO: 231595 - DNA, 15 bp, Homo sapiens
ttattctaccaaaag

SEQ ID NO: 231596 - DNA, 15 bp, Homo sapiens
tttattctaccaaaa

SEQ ID NO: 231597 - DNA, 15 bp, Homo sapiens
ttttattctaccaaa

SEQ ID NO: 231598 - DNA, 15 bp, Homo sapiens
gttttattctaccaa

SEQ ID NO: 231599 - DNA, 15 bp, Homo sapiens
tgttttattctacca

SEQ ID NO: 231600 - DNA, 15 bp, Homo sapiens
ttgttttattctacc

SEQ ID NO: 231601 - DNA, 15 bp, Homo sapiens
attgttttattctac

SEQ ID NO: 231602 - DNA, 15 bp, Homo sapiens
tattgttttattcta

SEQ ID NO: 231603 - DNA, 15 bp, Homo sapiens
ttattgttttattct

SEQ ID NO: 231604 - DNA, 15 bp, Homo sapiens
cttattgttttattc

SEQ ID NO: 231605 - DNA, 15 bp, Homo sapiens
tcttattgttttatt

SEQ ID NO: 231606 - DNA, 15 bp, Homo sapiens
atcttattgttttat

SEQ ID NO: 231607 - DNA, 15 bp, Homo sapiens
aatcttattgtttta

SEQ ID NO: 231608 - DNA, 15 bp, Homo sapiens
taatcttattgtttt

SEQ ID NO: 231609 - DNA, 15 bp, Homo sapiens
ataatcttattgttt

SEQ ID NO: 231610 - DNA, 15 bp, Homo sapiens
tataatcttattgtt

SEQ ID NO: 231611 - DNA, 15 bp, Homo sapiens
ctataatcttattgt

SEQ ID NO: 231612 - DNA, 15 bp, Homo sapiens
tctataatcttattg

SEQ ID NO: 231613 - DNA, 15 bp, Homo sapiens
atctataatcttatt

SEQ ID NO: 231614 - DNA, 15 bp, Homo sapiens
tatctataatcttat

SEQ ID NO: 231615 - DNA, 15 bp, Homo sapiens
gtatctataatctta

SEQ ID NO: 231616 - DNA, 15 bp, Homo sapiens
tgtatctataatctt

SEQ ID NO: 231617 - DNA, 15 bp, Homo sapiens
atgtatctataatct

SEQ ID NO: 231618 - DNA, 15 bp, Homo sapiens
catgtatctataatc

SEQ ID NO: 231619 - DNA, 15 bp, Homo sapiens
gcatgtatctataat

SEQ ID NO: 231620 - DNA, 15 bp, Homo sapiens
tgcatgtatctataa

SEQ ID NO: 231621 - DNA, 15 bp, Homo sapiens
ttgcatgtatctata

SEQ ID NO: 231622 - DNA, 15 bp, Homo sapiens
tttgcatgtatctat

SEQ ID NO: 231623 - DNA, 15 bp, Homo sapiens
ttttgcatgtatcta

SEQ ID NO: 231624 - DNA, 15 bp, Homo sapiens
tttttgcatgtatct

SEQ ID NO: 231625 - DNA, 15 bp, Homo sapiens
ttttttgcatgtatc

SEQ ID NO: 231626 - DNA, 15 bp, Homo sapiens
cttttttgcatgtat

SEQ ID NO: 231627 - DNA, 15 bp, Homo sapiens
gcttttttgcatgta

SEQ ID NO: 231628 - DNA, 15 bp, Homo sapiens
tgcttttttgcatgt

SEQ ID NO: 231629 - DNA, 15 bp, Homo sapiens
ttgcttttttgcatg

SEQ ID NO: 231630 - DNA, 15 bp, Homo sapiens
tttgcttttttgcat

SEQ ID NO: 231631 - DNA, 15 bp, Homo sapiens
atttgcttttttgca

SEQ ID NO: 231632 - DNA, 15 bp, Homo sapiens
tatttgcttttttgc

SEQ ID NO: 231633 - DNA, 15 bp, Homo sapiens
ctatttgcttttttg

SEQ ID NO: 231634 - DNA, 15 bp, Homo sapiens
actatttgctttttt

SEQ ID NO: 231635 - DNA, 15 bp, Homo sapiens
tactatttgcttttt

SEQ ID NO: 231636 - DNA, 15 bp, Homo sapiens
atactatttgctttt

SEQ ID NO: 231637 - DNA, 15 bp, Homo sapiens
tatactatttgcttt

SEQ ID NO: 231638 - DNA, 15 bp, Homo sapiens
ttatactatttgctt

SEQ ID NO: 231639 - DNA, 15 bp, Homo sapiens
tttatactatttgct

SEQ ID NO: 231640 - DNA, 15 bp, Homo sapiens
atttatactatttgc

SEQ ID NO: 231641 - DNA, 15 bp, Homo sapiens
tatttatactatttg

SEQ ID NO: 231642 - DNA, 15 bp, Homo sapiens
ttatttatactattt

SEQ ID NO: 231643 - DNA, 15 bp, Homo sapiens
cttatttatactatt

SEQ ID NO: 231644 - DNA, 15 bp, Homo sapiens
ccttatttatactat

SEQ ID NO: 231645 - DNA, 15 bp, Homo sapiens
accttatttatacta

SEQ ID NO: 231646 - DNA, 15 bp, Homo sapiens
taccttatttatact

SEQ ID NO: 231647 - DNA, 15 bp, Homo sapiens
ataccttatttatac

SEQ ID NO: 231648 - DNA, 15 bp, Homo sapiens
aataccttatttata

SEQ ID NO: 231649 - DNA, 15 bp, Homo sapiens
aaataccttatttat

SEQ ID NO: 231650 - DNA, 15 bp, Homo sapiens
caaataccttattta

SEQ ID NO: 231651 - DNA, 15 bp, Homo sapiens
ccaaataccttattt

SEQ ID NO: 231652 - DNA, 15 bp, Homo sapiens
tccaaataccttatt

SEQ ID NO: 231653 - DNA, 15 bp, Homo sapiens
ttccaaataccttat

SEQ ID NO: 231654 - DNA, 15 bp, Homo sapiens
attccaaatacctta

SEQ ID NO: 231655 - DNA, 15 bp, Homo sapiens
aattccaaatacctt

SEQ ID NO: 231656 - DNA, 15 bp, Homo sapiens
taattccaaatacct

SEQ ID NO: 231657 - DNA, 15 bp, Homo sapiens
gtaattccaaatacc

SEQ ID NO: 231658 - DNA, 15 bp, Homo sapiens
ggtaattccaaatac

SEQ ID NO: 231659 - DNA, 15 bp, Homo sapiens
tggtaattccaaata

SEQ ID NO: 231660 - DNA, 15 bp, Homo sapiens
atggtaattccaaat

SEQ ID NO: 231661 - DNA, 15 bp, Homo sapiens
tatggtaattccaaa

SEQ ID NO: 231662 - DNA, 15 bp, Homo sapiens
gtatggtaattccaa

SEQ ID NO: 231663 - DNA, 15 bp, Homo sapiens
ggtatggtaattcca

SEQ ID NO: 231664 - DNA, 15 bp, Homo sapiens
aggtatggtaattcc

SEQ ID NO: 231665 - DNA, 15 bp, Homo sapiens
caggtatggtaattc

SEQ ID NO: 231666 - DNA, 15 bp, Homo sapiens
tcaggtatggtaatt

SEQ ID NO: 231667 - DNA, 15 bp, Homo sapiens
ttcaggtatggtaat

SEQ ID NO: 231668 - DNA, 15 bp, Homo sapiens
tttcaggtatggtaa

SEQ ID NO: 231669 - DNA, 15 bp, Homo sapiens
atttcaggtatggta

SEQ ID NO: 231670 - DNA, 15 bp, Homo sapiens
catttcaggtatggt

SEQ ID NO: 231671 - DNA, 15 bp, Homo sapiens
tcatttcaggtatgg

SEQ ID NO: 231672 - DNA, 15 bp, Homo sapiens
gtcatttcaggtatg

SEQ ID NO: 231673 - DNA, 15 bp, Homo sapiens
agtcatttcaggtat

SEQ ID NO: 231674 - DNA, 15 bp, Homo sapiens
aagtcatttcaggta

SEQ ID NO: 231675 - DNA, 15 bp, Homo sapiens
aaagtcatttcaggt

SEQ ID NO: 231676 - DNA, 15 bp, Homo sapiens
caaagtcatttcagg

SEQ ID NO: 231677 - DNA, 15 bp, Homo sapiens
acaaagtcatttcag

SEQ ID NO: 231678 - DNA, 15 bp, Homo sapiens
tacaaagtcatttca

SEQ ID NO: 231679 - DNA, 15 bp, Homo sapiens
ttacaaagtcatttc

SEQ ID NO: 231680 - DNA, 15 bp, Homo sapiens
cttacaaagtcattt

SEQ ID NO: 231681 - DNA, 15 bp, Homo sapiens
ccttacaaagtcatt

SEQ ID NO: 231682 - DNA, 15 bp, Homo sapiens
accttacaaagtcat

SEQ ID NO: 231683 - DNA, 15 bp, Homo sapiens
aaccttacaaagtca

SEQ ID NO: 231684 - DNA, 15 bp, Homo sapiens
caaccttacaaagtc

SEQ ID NO: 231685 - DNA, 15 bp, Homo sapiens
tcaaccttacaaagt

SEQ ID NO: 231686 - DNA, 15 bp, Homo sapiens
atcaaccttacaaag

SEQ ID NO: 231687 - DNA, 15 bp, Homo sapiens
gatcaaccttacaaa

SEQ ID NO: 231688 - DNA, 15 bp, Homo sapiens
ggatcaaccttacaa

SEQ ID NO: 231689 - DNA, 15 bp, Homo sapiens
aggatcaaccttaca

SEQ ID NO: 231690 - DNA, 15 bp, Homo sapiens
aaggatcaaccttac

SEQ ID NO: 231691 - DNA, 15 bp, Homo sapiens
gaaggatcaacctta

SEQ ID NO: 231692 - DNA, 15 bp, Homo sapiens
agaaggatcaacctt

SEQ ID NO: 231693 - DNA, 15 bp, Homo sapiens
tagaaggatcaacct

SEQ ID NO: 231694 - DNA, 15 bp, Homo sapiens
atagaaggatcaacc

SEQ ID NO: 231695 - DNA, 15 bp, Homo sapiens
aatagaaggatcaac

SEQ ID NO: 231696 - DNA, 15 bp, Homo sapiens
aaatagaaggatcaa

SEQ ID NO: 231697 - DNA, 15 bp, Homo sapiens
gaaatagaaggatca

SEQ ID NO: 231698 - DNA, 15 bp, Homo sapiens
tgaaatagaaggatc

SEQ ID NO: 231699 - DNA, 15 bp, Homo sapiens
gtgaaatagaaggat

SEQ ID NO: 231700 - DNA, 15 bp, Homo sapiens
tgtgaaatagaagga

SEQ ID NO: 231701 - DNA, 15 bp, Homo sapiens
ttgtgaaatagaagg

SEQ ID NO: 231702 - DNA, 15 bp, Homo sapiens
attgtgaaatagaag

SEQ ID NO: 231703 - DNA, 15 bp, Homo sapiens
tattgtgaaatagaa

SEQ ID NO: 231704 - DNA, 15 bp, Homo sapiens
ctattgtgaaataga

SEQ ID NO: 231705 - DNA, 15 bp, Homo sapiens
actattgtgaaatag

SEQ ID NO: 231706 - DNA, 15 bp, Homo sapiens
aactattgtgaaata

SEQ ID NO: 231707 - DNA, 15 bp, Homo sapiens
aaactattgtgaaat

SEQ ID NO: 231708 - DNA, 15 bp, Homo sapiens
aaaactattgtgaaa

SEQ ID NO: 231709 - DNA, 15 bp, Homo sapiens
aaaaactattgtgaa

SEQ ID NO: 231710 - DNA, 15 bp, Homo sapiens
aaaaaactattgtga

SEQ ID NO: 231711 - DNA, 15 bp, Homo sapiens
aaaaaaactattgtg

SEQ ID NO: 231712 - DNA, 15 bp, Homo sapiens
caaaaaaactattgt

SEQ ID NO: 231713 - DNA, 15 bp, Homo sapiens
acaaaaaaactattg

SEQ ID NO: 231714 - DNA, 15 bp, Homo sapiens
tacaaaaaaactatt

SEQ ID NO: 231715 - DNA, 15 bp, Homo sapiens
ttacaaaaaaactat

SEQ ID NO: 231716 - DNA, 15 bp, Homo sapiens
cttacaaaaaaacta

SEQ ID NO: 231717 - DNA, 15 bp, Homo sapiens
acttacaaaaaaact

SEQ ID NO: 231718 - DNA, 15 bp, Homo sapiens
cacttacaaaaaaac

SEQ ID NO: 231719 - DNA, 15 bp, Homo sapiens
gcacttacaaaaaaa

SEQ ID NO: 231720 - DNA, 15 bp, Homo sapiens
agcacttacaaaaaa

SEQ ID NO: 231721 - DNA, 15 bp, Homo sapiens
aagcacttacaaaaa

SEQ ID NO: 231722 - DNA, 15 bp, Homo sapiens
aaagcacttacaaaa

SEQ ID NO: 231723 - DNA, 15 bp, Homo sapiens
taaagcacttacaaa

SEQ ID NO: 231724 - DNA, 15 bp, Homo sapiens
gtaaagcacttacaa

SEQ ID NO: 231725 - DNA, 15 bp, Homo sapiens
tgtaaagcacttaca

SEQ ID NO: 231726 - DNA, 15 bp, Homo sapiens
gtgtaaagcacttac

SEQ ID NO: 231727 - DNA, 15 bp, Homo sapiens
tgtgtaaagcactta

SEQ ID NO: 231728 - DNA, 15 bp, Homo sapiens
ctgtgtaaagcactt

SEQ ID NO: 231729 - DNA, 15 bp, Homo sapiens
tctgtgtaaagcact

SEQ ID NO: 231730 - DNA, 15 bp, Homo sapiens
atctgtgtaaagcac

SEQ ID NO: 231731 - DNA, 15 bp, Homo sapiens
catctgtgtaaagca

SEQ ID NO: 231732 - DNA, 15 bp, Homo sapiens
acatctgtgtaaagc

SEQ ID NO: 231733 - DNA, 15 bp, Homo sapiens
cacatctgtgtaaag

SEQ ID NO: 231734 - DNA, 15 bp, Homo sapiens
tcacatctgtgtaaa

SEQ ID NO: 231735 - DNA, 15 bp, Homo sapiens
ctcacatctgtgtaa

SEQ ID NO: 231736 - DNA, 15 bp, Homo sapiens
tctcacatctgtgta

SEQ ID NO: 231737 - DNA, 15 bp, Homo sapiens
ttctcacatctgtgt

SEQ ID NO: 231738 - DNA, 15 bp, Homo sapiens
cttctcacatctgtg

SEQ ID NO: 231739 - DNA, 15 bp, Homo sapiens
ccttctcacatctgt

SEQ ID NO: 231740 - DNA, 15 bp, Homo sapiens
tccttctcacatctg

SEQ ID NO: 231741 - DNA, 15 bp, Homo sapiens
ctccttctcacatct

SEQ ID NO: 231742 - DNA, 15 bp, Homo sapiens
cctccttctcacatc

SEQ ID NO: 231743 - DNA, 15 bp, Homo sapiens
tcctccttctcacat

SEQ ID NO: 231744 - DNA, 15 bp, Homo sapiens
ttcctccttctcaca

SEQ ID NO: 231745 - DNA, 15 bp, Homo sapiens
cttcctccttctcac

SEQ ID NO: 231746 - DNA, 15 bp, Homo sapiens
tcttcctccttctca

SEQ ID NO: 231747 - DNA, 15 bp, Homo sapiens
ttcttcctccttctc

SEQ ID NO: 231748 - DNA, 15 bp, Homo sapiens
tttcttcctccttct

SEQ ID NO: 231749 - DNA, 15 bp, Homo sapiens
ttttcttcctccttc

SEQ ID NO: 231750 - DNA, 15 bp, Homo sapiens
tttttcttcctcctt

SEQ ID NO: 231751 - DNA, 15 bp, Homo sapiens
atttttcttcctcct

SEQ ID NO: 231752 - DNA, 15 bp, Homo sapiens
catttttcttcctcc

SEQ ID NO: 231753 - DNA, 15 bp, Homo sapiens
tcatttttcttcctc

SEQ ID NO: 231754 - DNA, 15 bp, Homo sapiens
ttcatttttcttcct

SEQ ID NO: 231755 - DNA, 15 bp, Homo sapiens
cttcatttttcttcc

SEQ ID NO: 231756 - DNA, 15 bp, Homo sapiens
acttcatttttcttc

SEQ ID NO: 231757 - DNA, 15 bp, Homo sapiens
cacttcatttttctt

SEQ ID NO: 231758 - DNA, 15 bp, Homo sapiens
tcacttcatttttct

SEQ ID NO: 231759 - DNA, 15 bp, Homo sapiens
ttcacttcatttttc

SEQ ID NO: 231760 - DNA, 15 bp, Homo sapiens
tttcacttcattttt

SEQ ID NO: 231761 - DNA, 15 bp, Homo sapiens
ttttcacttcatttt

SEQ ID NO: 231762 - DNA, 15 bp, Homo sapiens
attttcacttcattt

SEQ ID NO: 231763 - DNA, 15 bp, Homo sapiens
tattttcacttcatt

SEQ ID NO: 231764 - DNA, 15 bp, Homo sapiens
atattttcacttcat

SEQ ID NO: 231765 - DNA, 15 bp, Homo sapiens
catattttcacttca

SEQ ID NO: 231766 - DNA, 15 bp, Homo sapiens
acatattttcacttc

SEQ ID NO: 231767 - DNA, 15 bp, Homo sapiens
gacatattttcactt

SEQ ID NO: 231768 - DNA, 15 bp, Homo sapiens
ggacatattttcact

SEQ ID NO: 231769 - DNA, 15 bp, Homo sapiens
tggacatattttcac

SEQ ID NO: 231770 - DNA, 15 bp, Homo sapiens
gtggacatattttca

SEQ ID NO: 231771 - DNA, 15 bp, Homo sapiens
agtggacatattttc

SEQ ID NO: 231772 - DNA, 15 bp, Homo sapiens
aagtggacatatttt

SEQ ID NO: 231773 - DNA, 15 bp, Homo sapiens
taagtggacatattt

SEQ ID NO: 231774 - DNA, 15 bp, Homo sapiens
ttaagtggacatatt

SEQ ID NO: 231775 - DNA, 15 bp, Homo sapiens
tttaagtggacatat

SEQ ID NO: 231776 - DNA, 15 bp, Homo sapiens
ttttaagtggacata

SEQ ID NO: 231777 - DNA, 15 bp, Homo sapiens
cttttaagtggacat

SEQ ID NO: 231778 - DNA, 15 bp, Homo sapiens
acttttaagtggaca

SEQ ID NO: 231779 - DNA, 15 bp, Homo sapiens
cacttttaagtggac

SEQ ID NO: 231780 - DNA, 15 bp, Homo sapiens
acacttttaagtgga

SEQ ID NO: 231781 - DNA, 15 bp, Homo sapiens
tacacttttaagtgg

SEQ ID NO: 231782 - DNA, 15 bp, Homo sapiens
ttacacttttaagtg

SEQ ID NO: 231783 - DNA, 15 bp, Homo sapiens
tttacacttttaagt

SEQ ID NO: 231784 - DNA, 15 bp, Homo sapiens
ctttacacttttaag

SEQ ID NO: 231785 - DNA, 15 bp, Homo sapiens
actttacacttttaa

SEQ ID NO: 231786 - DNA, 15 bp, Homo sapiens
aactttacactttta

SEQ ID NO: 231787 - DNA, 15 bp, Homo sapiens
caactttacactttt

SEQ ID NO: 231788 - DNA, 15 bp, Homo sapiens
tcaactttacacttt

SEQ ID NO: 231789 - DNA, 15 bp, Homo sapiens
ttcaactttacactt

SEQ ID NO: 231790 - DNA, 15 bp, Homo sapiens
attcaactttacact

SEQ ID NO: 231791 - DNA, 15 bp, Homo sapiens
cattcaactttacac

SEQ ID NO: 231792 - DNA, 15 bp, Homo sapiens
acattcaactttaca

SEQ ID NO: 231793 - DNA, 15 bp, Homo sapiens
aacattcaactttac

SEQ ID NO: 231794 - DNA, 15 bp, Homo sapiens
gaacattcaacttta

SEQ ID NO: 231795 - DNA, 15 bp, Homo sapiens
agaacattcaacttt

SEQ ID NO: 231796 - DNA, 15 bp, Homo sapiens
gagaacattcaactt

SEQ ID NO: 231797 - DNA, 15 bp, Homo sapiens
tgagaacattcaact

SEQ ID NO: 231798 - DNA, 15 bp, Homo sapiens
ttgagaacattcaac

SEQ ID NO: 231799 - DNA, 15 bp, Homo sapiens
attgagaacattcaa

SEQ ID NO: 231800 - DNA, 15 bp, Homo sapiens
tattgagaacattca

SEQ ID NO: 231801 - DNA, 15 bp, Homo sapiens
ttattgagaacattc

SEQ ID NO: 231802 - DNA, 15 bp, Homo sapiens
tttattgagaacatt

SEQ ID NO: 231803 - DNA, 15 bp, Homo sapiens
ctttattgagaacat

SEQ ID NO: 231804 - DNA, 15 bp, Homo sapiens
tctttattgagaaca

SEQ ID NO: 231805 - DNA, 15 bp, Homo sapiens
ctctttattgagaac

SEQ ID NO: 231806 - DNA, 15 bp, Homo sapiens
cctctttattgagaa

SEQ ID NO: 231807 - DNA, 15 bp, Homo sapiens
tcctctttattgaga

SEQ ID NO: 231808 - DNA, 15 bp, Homo sapiens
ctcctctttattgag

SEQ ID NO: 231809 - DNA, 15 bp, Homo sapiens
gctcctctttattga

SEQ ID NO: 231810 - DNA, 15 bp, Homo sapiens
tgctcctctttattg

SEQ ID NO: 231811 - DNA, 15 bp, Homo sapiens
gtgctcctctttatt

SEQ ID NO: 231812 - DNA, 15 bp, Homo sapiens
agtgctcctctttat

SEQ ID NO: 231813 - DNA, 15 bp, Homo sapiens
tagtgctcctcttta

SEQ ID NO: 231814 - DNA, 15 bp, Homo sapiens
ttagtgctcctcttt

SEQ ID NO: 231815 - DNA, 15 bp, Homo sapiens
tttagtgctcctctt

SEQ ID NO: 231816 - DNA, 15 bp, Homo sapiens
ttttagtgctcctct

SEQ ID NO: 231817 - DNA, 15 bp, Homo sapiens
tttttagtgctcctc

SEQ ID NO: 231818 - DNA, 15 bp, Homo sapiens
atttttagtgctcct

SEQ ID NO: 231819 - DNA, 15 bp, Homo sapiens
aatttttagtgctcc

SEQ ID NO: 231820 - DNA, 15 bp, Homo sapiens
gaatttttagtgctc

SEQ ID NO: 231821 - DNA, 15 bp, Homo sapiens
tgaatttttagtgct

SEQ ID NO: 231822 - DNA, 15 bp, Homo sapiens
ttgaatttttagtgc

SEQ ID NO: 231823 - DNA, 15 bp, Homo sapiens
attgaatttttagtg

SEQ ID NO: 231824 - DNA, 15 bp, Homo sapiens
aattgaatttttagt

SEQ ID NO: 231825 - DNA, 15 bp, Homo sapiens
gaattgaatttttag

SEQ ID NO: 231826 - DNA, 15 bp, Homo sapiens
ggaattgaattttta

SEQ ID NO: 231827 - DNA, 15 bp, Homo sapiens
cggaattgaattttt

SEQ ID NO: 231828 - DNA, 15 bp, Homo sapiens
acggaattgaatttt

SEQ ID NO: 231829 - DNA, 15 bp, Homo sapiens
gacggaattgaattt

SEQ ID NO: 231830 - DNA, 15 bp, Homo sapiens
ggacggaattgaatt

SEQ ID NO: 231831 - DNA, 15 bp, Homo sapiens
tggacggaattgaat

SEQ ID NO: 231832 - DNA, 15 bp, Homo sapiens
ttggacggaattgaa

SEQ ID NO: 231833 - DNA, 15 bp, Homo sapiens
gttggacggaattga

SEQ ID NO: 231834 - DNA, 15 bp, Homo sapiens
agttggacggaattg

SEQ ID NO: 231835 - DNA, 15 bp, Homo sapiens
gagttggacggaatt

SEQ ID NO: 231836 - DNA, 15 bp, Homo sapiens
tgagttggacggaat

SEQ ID NO: 231837 - DNA, 15 bp, Homo sapiens
ttgagttggacggaa

SEQ ID NO: 231838 - DNA, 15 bp, Homo sapiens
attgagttggacgga

SEQ ID NO: 231839 - DNA, 15 bp, Homo sapiens
aattgagttggacgg

SEQ ID NO: 231840 - DNA, 15 bp, Homo sapiens
taattgagttggacg

SEQ ID NO: 231841 - DNA, 15 bp, Homo sapiens
ttaattgagttggac

SEQ ID NO: 231842 - DNA, 15 bp, Homo sapiens
cttaattgagttgga

SEQ ID NO: 231843 - DNA, 15 bp, Homo sapiens
acttaattgagttgg

SEQ ID NO: 231844 - DNA, 15 bp, Homo sapiens
tacttaattgagttg

SEQ ID NO: 231845 - DNA, 15 bp, Homo sapiens
ttacttaattgagtt

SEQ ID NO: 231846 - DNA, 15 bp, Homo sapiens
attacttaattgagt

SEQ ID NO: 231847 - DNA, 15 bp, Homo sapiens
aattacttaattgag

SEQ ID NO: 231848 - DNA, 15 bp, Homo sapiens
taattacttaattga

SEQ ID NO: 231849 - DNA, 15 bp, Homo sapiens
ataattacttaattg

SEQ ID NO: 231850 - DNA, 15 bp, Homo sapiens
tataattacttaatt

SEQ ID NO: 231851 - DNA, 15 bp, Homo sapiens
atataattacttaat

SEQ ID NO: 231852 - DNA, 15 bp, Homo sapiens
tatataattacttaa

SEQ ID NO: 231853 - DNA, 15 bp, Homo sapiens
gtatataattactta

SEQ ID NO: 231854 - DNA, 15 bp, Homo sapiens
agtatataattactt

SEQ ID NO: 231855 - DNA, 15 bp, Homo sapiens
cagtatataattact

SEQ ID NO: 231856 - DNA, 15 bp, Homo sapiens
tcagtatataattac

SEQ ID NO: 231857 - DNA, 15 bp, Homo sapiens
ctcagtatataatta

SEQ ID NO: 231858 - DNA, 15 bp, Homo sapiens
cctcagtatataatt

SEQ ID NO: 231859 - DNA, 15 bp, Homo sapiens
tcctcagtatataat

SEQ ID NO: 231860 - DNA, 15 bp, Homo sapiens
gtcctcagtatataa

SEQ ID NO: 231861 - DNA, 15 bp, Homo sapiens
tgtcctcagtatata

SEQ ID NO: 231862 - DNA, 15 bp, Homo sapiens
atgtcctcagtatat

SEQ ID NO: 231863 - DNA, 15 bp, Homo sapiens
tatgtcctcagtata

SEQ ID NO: 231864 - DNA, 15 bp, Homo sapiens
gtatgtcctcagtat

SEQ ID NO: 231865 - DNA, 15 bp, Homo sapiens
ggtatgtcctcagta

SEQ ID NO: 231866 - DNA, 15 bp, Homo sapiens
tggtatgtcctcagt

SEQ ID NO: 231867 - DNA, 15 bp, Homo sapiens
ttggtatgtcctcag

SEQ ID NO: 231868 - DNA, 15 bp, Homo sapiens
attggtatgtcctca

SEQ ID NO: 231869 - DNA, 15 bp, Homo sapiens
gattggtatgtcctc

SEQ ID NO: 231870 - DNA, 15 bp, Homo sapiens
agattggtatgtcct

SEQ ID NO: 231871 - DNA, 15 bp, Homo sapiens
gagattggtatgtcc

SEQ ID NO: 231872 - DNA, 15 bp, Homo sapiens
agagattggtatgtc

SEQ ID NO: 231873 - DNA, 15 bp, Homo sapiens
tagagattggtatgt

SEQ ID NO: 231874 - DNA, 15 bp, Homo sapiens
ctagagattggtatg

SEQ ID NO: 231875 - DNA, 15 bp, Homo sapiens
tctagagattggtat

SEQ ID NO: 231876 - DNA, 15 bp, Homo sapiens
gtctagagattggta

SEQ ID NO: 231877 - DNA, 15 bp, Homo sapiens
agtctagagattggt

SEQ ID NO: 231878 - DNA, 15 bp, Homo sapiens
cagtctagagattgg

SEQ ID NO: 231879 - DNA, 15 bp, Homo sapiens
ccagtctagagattg

SEQ ID NO: 231880 - DNA, 15 bp, Homo sapiens
gccagtctagagatt

SEQ ID NO: 231881 - DNA, 15 bp, Homo sapiens
agccagtctagagat

SEQ ID NO: 231882 - DNA, 15 bp, Homo sapiens
tagccagtctagaga

SEQ ID NO: 231883 - DNA, 15 bp, Homo sapiens
gtagccagtctagag

SEQ ID NO: 231884 - DNA, 15 bp, Homo sapiens
agtagccagtctaga

SEQ ID NO: 231885 - DNA, 15 bp, Homo sapiens
tagtagccagtctag

SEQ ID NO: 231886 - DNA, 15 bp, Homo sapiens
atagtagccagtcta

SEQ ID NO: 231887 - DNA, 15 bp, Homo sapiens
tatagtagccagtct

SEQ ID NO: 231888 - DNA, 15 bp, Homo sapiens
ttatagtagccagtc

SEQ ID NO: 231889 - DNA, 15 bp, Homo sapiens
tttatagtagccagt

SEQ ID NO: 231890 - DNA, 15 bp, Homo sapiens
ttttatagtagccag

SEQ ID NO: 231891 - DNA, 15 bp, Homo sapiens
attttatagtagcca

SEQ ID NO: 231892 - DNA, 15 bp, Homo sapiens
gattttatagtagcc

SEQ ID NO: 231893 - DNA, 15 bp, Homo sapiens
tgattttatagtagc

SEQ ID NO: 231894 - DNA, 15 bp, Homo sapiens
ttgattttatagtag

SEQ ID NO: 231895 - DNA, 15 bp, Homo sapiens
attgattttatagta

SEQ ID NO: 231896 - DNA, 15 bp, Homo sapiens
tattgattttatagt

SEQ ID NO: 231897 - DNA, 15 bp, Homo sapiens
atattgattttatag

SEQ ID NO: 231898 - DNA, 15 bp, Homo sapiens
catattgattttata

SEQ ID NO: 231899 - DNA, 15 bp, Homo sapiens
ccatattgattttat

SEQ ID NO: 231900 - DNA, 15 bp, Homo sapiens
tccatattgatttta

SEQ ID NO: 231901 - DNA, 15 bp, Homo sapiens
ttccatattgatttt

SEQ ID NO: 231902 - DNA, 15 bp, Homo sapiens
cttccatattgattt

SEQ ID NO: 231903 - DNA, 15 bp, Homo sapiens
ccttccatattgatt

SEQ ID NO: 231904 - DNA, 15 bp, Homo sapiens
tccttccatattgat

SEQ ID NO: 231905 - DNA, 15 bp, Homo sapiens
ttccttccatattga

SEQ ID NO: 231906 - DNA, 15 bp, Homo sapiens
tttccttccatattg

SEQ ID NO: 231907 - DNA, 15 bp, Homo sapiens
ctttccttccatatt

SEQ ID NO: 231908 - DNA, 15 bp, Homo sapiens
tctttccttccatat

SEQ ID NO: 231909 - DNA, 15 bp, Homo sapiens
ttctttccttccata

SEQ ID NO: 231910 - DNA, 15 bp, Homo sapiens
tttctttccttccat

SEQ ID NO: 231911 - DNA, 15 bp, Homo sapiens
ttttctttccttcca

SEQ ID NO: 231912 - DNA, 15 bp, Homo sapiens
gttttctttccttcc

SEQ ID NO: 231913 - DNA, 15 bp, Homo sapiens
tgttttctttccttc

SEQ ID NO: 231914 - DNA, 15 bp, Homo sapiens
atgttttctttcctt

SEQ ID NO: 231915 - DNA, 15 bp, Homo sapiens
aatgttttctttcct

SEQ ID NO: 231916 - DNA, 15 bp, Homo sapiens
gaatgttttctttcc

SEQ ID NO: 231917 - DNA, 15 bp, Homo sapiens
agaatgttttctttc

SEQ ID NO: 231918 - DNA, 15 bp, Homo sapiens
aagaatgttttcttt

SEQ ID NO: 231919 - DNA, 15 bp, Homo sapiens
caagaatgttttctt

SEQ ID NO: 231920 - DNA, 15 bp, Homo sapiens
tcaagaatgttttct

SEQ ID NO: 231921 - DNA, 15 bp, Homo sapiens
gtcaagaatgttttc

SEQ ID NO: 231922 - DNA, 15 bp, Homo sapiens
tgtcaagaatgtttt

SEQ ID NO: 231923 - DNA, 15 bp, Homo sapiens
atgtcaagaatgttt

SEQ ID NO: 231924 - DNA, 15 bp, Homo sapiens
aatgtcaagaatgtt

SEQ ID NO: 231925 - DNA, 15 bp, Homo sapiens
caatgtcaagaatgt

SEQ ID NO: 231926 - DNA, 15 bp, Homo sapiens
ccaatgtcaagaatg

SEQ ID NO: 231927 - DNA, 15 bp, Homo sapiens
cccaatgtcaagaat

SEQ ID NO: 231928 - DNA, 15 bp, Homo sapiens
gcccaatgtcaagaa

SEQ ID NO: 231929 - DNA, 15 bp, Homo sapiens
agcccaatgtcaaga

SEQ ID NO: 231930 - DNA, 15 bp, Homo sapiens
aagcccaatgtcaag

SEQ ID NO: 231931 - DNA, 15 bp, Homo sapiens
aaagcccaatgtcaa

SEQ ID NO: 231932 - DNA, 15 bp, Homo sapiens
taaagcccaatgtca

SEQ ID NO: 231933 - DNA, 15 bp, Homo sapiens
ttaaagcccaatgtc

SEQ ID NO: 231934 - DNA, 15 bp, Homo sapiens
tttaaagcccaatgt

SEQ ID NO: 231935 - DNA, 15 bp, Homo sapiens
ttttaaagcccaatg

SEQ ID NO: 231936 - DNA, 15 bp, Homo sapiens
gttttaaagcccaat

SEQ ID NO: 231937 - DNA, 15 bp, Homo sapiens
cgttttaaagcccaa

SEQ ID NO: 231938 - DNA, 15 bp, Homo sapiens
acgttttaaagccca

SEQ ID NO: 231939 - DNA, 15 bp, Homo sapiens
tacgttttaaagccc

SEQ ID NO: 231940 - DNA, 15 bp, Homo sapiens
ttacgttttaaagcc

SEQ ID NO: 231941 - DNA, 15 bp, Homo sapiens
cttacgttttaaagc

SEQ ID NO: 231942 - DNA, 15 bp, Homo sapiens
acttacgttttaaag

SEQ ID NO: 231943 - DNA, 15 bp, Homo sapiens
cacttacgttttaaa

SEQ ID NO: 231944 - DNA, 15 bp, Homo sapiens
acacttacgttttaa

SEQ ID NO: 231945 - DNA, 15 bp, Homo sapiens
tacacttacgtttta

SEQ ID NO: 231946 - DNA, 15 bp, Homo sapiens
ctacacttacgtttt

SEQ ID NO: 231947 - DNA, 15 bp, Homo sapiens
tctacacttacgttt

SEQ ID NO: 231948 - DNA, 15 bp, Homo sapiens
ttctacacttacgtt

SEQ ID NO: 231949 - DNA, 15 bp, Homo sapiens
tttctacacttacgt

SEQ ID NO: 231950 - DNA, 15 bp, Homo sapiens
ttttctacacttacg

SEQ ID NO: 231951 - DNA, 15 bp, Homo sapiens
cttttctacacttac

SEQ ID NO: 231952 - DNA, 15 bp, Homo sapiens
gcttttctacactta

SEQ ID NO: 231953 - DNA, 15 bp, Homo sapiens
ggcttttctacactt

SEQ ID NO: 231954 - DNA, 15 bp, Homo sapiens
tggcttttctacact

SEQ ID NO: 231955 - DNA, 15 bp, Homo sapiens
gtggcttttctacac

SEQ ID NO: 231956 - DNA, 15 bp, Homo sapiens
tgtggcttttctaca

SEQ ID NO: 231957 - DNA, 15 bp, Homo sapiens
ttgtggcttttctac

SEQ ID NO: 231958 - DNA, 15 bp, Homo sapiens
attgtggcttttcta

SEQ ID NO: 231959 - DNA, 15 bp, Homo sapiens
cattgtggcttttct

SEQ ID NO: 231960 - DNA, 15 bp, Homo sapiens
ccattgtggcttttc

SEQ ID NO: 231961 - DNA, 15 bp, Homo sapiens
tccattgtggctttt

SEQ ID NO: 231962 - DNA, 15 bp, Homo sapiens
ctccattgtggcttt

SEQ ID NO: 231963 - DNA, 15 bp, Homo sapiens
tctccattgtggctt

SEQ ID NO: 231964 - DNA, 15 bp, Homo sapiens
atctccattgtggct

SEQ ID NO: 231965 - DNA, 15 bp, Homo sapiens
aatctccattgtggc

SEQ ID NO: 231966 - DNA, 15 bp, Homo sapiens
taatctccattgtgg

SEQ ID NO: 231967 - DNA, 15 bp, Homo sapiens
gtaatctccattgtg

SEQ ID NO: 231968 - DNA, 15 bp, Homo sapiens
tgtaatctccattgt

SEQ ID NO: 231969 - DNA, 15 bp, Homo sapiens
ttgtaatctccattg

SEQ ID NO: 231970 - DNA, 15 bp, Homo sapiens
tttgtaatctccatt

SEQ ID NO: 231971 - DNA, 15 bp, Homo sapiens
atttgtaatctccat

SEQ ID NO: 231972 - DNA, 15 bp, Homo sapiens
catttgtaatctcca

SEQ ID NO: 231973 - DNA, 15 bp, Homo sapiens
acatttgtaatctcc

SEQ ID NO: 231974 - DNA, 15 bp, Homo sapiens
aacatttgtaatctc

SEQ ID NO: 231975 - DNA, 15 bp, Homo sapiens
caacatttgtaatct

SEQ ID NO: 231976 - DNA, 15 bp, Homo sapiens
tcaacatttgtaatc

SEQ ID NO: 231977 - DNA, 15 bp, Homo sapiens
atcaacatttgtaat

SEQ ID NO: 231978 - DNA, 15 bp, Homo sapiens
tatcaacatttgtaa

SEQ ID NO: 231979 - DNA, 15 bp, Homo sapiens
atatcaacatttgta

SEQ ID NO: 231980 - DNA, 15 bp, Homo sapiens
gatatcaacatttgt

SEQ ID NO: 231981 - DNA, 15 bp, Homo sapiens
tgatatcaacatttg

SEQ ID NO: 231982 - DNA, 15 bp, Homo sapiens
atgatatcaacattt

SEQ ID NO: 231983 - DNA, 15 bp, Homo sapiens
tatgatatcaacatt

SEQ ID NO: 231984 - DNA, 15 bp, Homo sapiens
ttatgatatcaacat

SEQ ID NO: 231985 - DNA, 15 bp, Homo sapiens
attatgatatcaaca

SEQ ID NO: 231986 - DNA, 15 bp, Homo sapiens
aattatgatatcaac

SEQ ID NO: 231987 - DNA, 15 bp, Homo sapiens
caattatgatatcaa

SEQ ID NO: 231988 - DNA, 15 bp, Homo sapiens
tcaattatgatatca

SEQ ID NO: 231989 - DNA, 15 bp, Homo sapiens
ctcaattatgatatc

SEQ ID NO: 231990 - DNA, 15 bp, Homo sapiens
tctcaattatgatat

SEQ ID NO: 231991 - DNA, 15 bp, Homo sapiens
ttctcaattatgata

SEQ ID NO: 231992 - DNA, 15 bp, Homo sapiens
tttctcaattatgat

SEQ ID NO: 231993 - DNA, 15 bp, Homo sapiens
ttttctcaattatga

SEQ ID NO: 231994 - DNA, 15 bp, Homo sapiens
tttttctcaattatg

SEQ ID NO: 231995 - DNA, 15 bp, Homo sapiens
ttttttctcaattat

SEQ ID NO: 231996 - DNA, 15 bp, Homo sapiens
tttttttctcaatta

SEQ ID NO: 231997 - DNA, 15 bp, Homo sapiens
gtttttttctcaatt

SEQ ID NO: 231998 - DNA, 15 bp, Homo sapiens
tgtttttttctcaat

SEQ ID NO: 231999 - DNA, 15 bp, Homo sapiens
gtgtttttttctcaa

SEQ ID NO: 232000 - DNA, 15 bp, Homo sapiens
ggtgtttttttctca

SEQ ID NO: 232001 - DNA, 15 bp, Homo sapiens
tggtgtttttttctc

SEQ ID NO: 232002 - DNA, 15 bp, Homo sapiens
atggtgtttttttct

SEQ ID NO: 232003 - DNA, 15 bp, Homo sapiens
tatggtgtttttttc

SEQ ID NO: 232004 - DNA, 15 bp, Homo sapiens
gtatggtgttttttt

SEQ ID NO: 232005 - DNA, 15 bp, Homo sapiens
tgtatggtgtttttt

SEQ ID NO: 232006 - DNA, 15 bp, Homo sapiens
atgtatggtgttttt

SEQ ID NO: 232007 - DNA, 15 bp, Homo sapiens
tatgtatggtgtttt

SEQ ID NO: 232008 - DNA, 15 bp, Homo sapiens
atatgtatggtgttt

SEQ ID NO: 232009 - DNA, 15 bp, Homo sapiens
catatgtatggtgtt

SEQ ID NO: 232010 - DNA, 15 bp, Homo sapiens
ccatatgtatggtgt

SEQ ID NO: 232011 - DNA, 15 bp, Homo sapiens
cccatatgtatggtg

SEQ ID NO: 232012 - DNA, 15 bp, Homo sapiens
tcccatatgtatggt

SEQ ID NO: 232013 - DNA, 15 bp, Homo sapiens
ttcccatatgtatgg

SEQ ID NO: 232014 - DNA, 15 bp, Homo sapiens
tttcccatatgtatg

SEQ ID NO: 232015 - DNA, 15 bp, Homo sapiens
atttcccatatgtat

SEQ ID NO: 232016 - DNA, 15 bp, Homo sapiens
catttcccatatgta

SEQ ID NO: 232017 - DNA, 15 bp, Homo sapiens
acatttcccatatgt

SEQ ID NO: 232018 - DNA, 15 bp, Homo sapiens
aacatttcccatatg

SEQ ID NO: 232019 - DNA, 15 bp, Homo sapiens
aaacatttcccatat

SEQ ID NO: 232020 - DNA, 15 bp, Homo sapiens
taaacatttcccata

SEQ ID NO: 232021 - DNA, 15 bp, Homo sapiens
ataaacatttcccat

SEQ ID NO: 232022 - DNA, 15 bp, Homo sapiens
aataaacatttccca

SEQ ID NO: 232023 - DNA, 15 bp, Homo sapiens
taataaacatttccc

SEQ ID NO: 232024 - DNA, 15 bp, Homo sapiens
ttaataaacatttcc

SEQ ID NO: 232025 - DNA, 15 bp, Homo sapiens
tttaataaacatttc

SEQ ID NO: 232026 - DNA, 15 bp, Homo sapiens
gtttaataaacattt

SEQ ID NO: 232027 - DNA, 15 bp, Homo sapiens
tgtttaataaacatt

SEQ ID NO: 232028 - DNA, 15 bp, Homo sapiens
ttgtttaataaacat

SEQ ID NO: 232029 - DNA, 15 bp, Homo sapiens
attgtttaataaaca

SEQ ID NO: 232030 - DNA, 15 bp, Homo sapiens
tattgtttaataaac

SEQ ID NO: 232031 - DNA, 15 bp, Homo sapiens
ttattgtttaataaa

SEQ ID NO: 232032 - DNA, 15 bp, Homo sapiens
gttattgtttaataa

SEQ ID NO: 232033 - DNA, 15 bp, Homo sapiens
tgttattgtttaata

SEQ ID NO: 232034 - DNA, 15 bp, Homo sapiens
gtgttattgtttaat

SEQ ID NO: 232035 - DNA, 15 bp, Homo sapiens
agtgttattgtttaa

SEQ ID NO: 232036 - DNA, 15 bp, Homo sapiens
cagtgttattgttta

SEQ ID NO: 232037 - DNA, 15 bp, Homo sapiens
ccagtgttattgttt

SEQ ID NO: 232038 - DNA, 15 bp, Homo sapiens
cccagtgttattgtt

SEQ ID NO: 232039 - DNA, 15 bp, Homo sapiens
gcccagtgttattgt

SEQ ID NO: 232040 - DNA, 15 bp, Homo sapiens
cgcccagtgttattg

SEQ ID NO: 232041 - DNA, 15 bp, Homo sapiens
tcgcccagtgttatt

SEQ ID NO: 232042 - DNA, 15 bp, Homo sapiens
ttcgcccagtgttat

SEQ ID NO: 232043 - DNA, 15 bp, Homo sapiens
attcgcccagtgtta

SEQ ID NO: 232044 - DNA, 15 bp, Homo sapiens
aattcgcccagtgtt

SEQ ID NO: 232045 - DNA, 15 bp, Homo sapiens
gaattcgcccagtgt

SEQ ID NO: 232046 - DNA, 15 bp, Homo sapiens
agaattcgcccagtg

SEQ ID NO: 232047 - DNA, 15 bp, Homo sapiens
tagaattcgcccagt

SEQ ID NO: 232048 - DNA, 15 bp, Homo sapiens
ttagaattcgcccag

SEQ ID NO: 232049 - DNA, 15 bp, Homo sapiens
attagaattcgccca

SEQ ID NO: 232050 - DNA, 15 bp, Homo sapiens
tattagaattcgccc

SEQ ID NO: 232051 - DNA, 15 bp, Homo sapiens
ttattagaattcgcc

SEQ ID NO: 232052 - DNA, 15 bp, Homo sapiens
tttattagaattcgc

SEQ ID NO: 232053 - DNA, 15 bp, Homo sapiens
atttattagaattcg

SEQ ID NO: 232054 - DNA, 15 bp, Homo sapiens
tatttattagaattc

SEQ ID NO: 232055 - DNA, 15 bp, Homo sapiens
atatttattagaatt

SEQ ID NO: 232056 - DNA, 15 bp, Homo sapiens
gatatttattagaat

SEQ ID NO: 232057 - DNA, 15 bp, Homo sapiens
agatatttattagaa

SEQ ID NO: 232058 - DNA, 15 bp, Homo sapiens
tagatatttattaga

SEQ ID NO: 232059 - DNA, 15 bp, Homo sapiens
atagatatttattag

SEQ ID NO: 232060 - DNA, 15 bp, Homo sapiens
gatagatatttatta

SEQ ID NO: 232061 - DNA, 15 bp, Homo sapiens
tgatagatatttatt

SEQ ID NO: 232062 - DNA, 15 bp, Homo sapiens
atgatagatatttat

SEQ ID NO: 232063 - DNA, 15 bp, Homo sapiens
aatgatagatattta

SEQ ID NO: 232064 - DNA, 15 bp, Homo sapiens
taatgatagatattt

SEQ ID NO: 232065 - DNA, 15 bp, Homo sapiens
ataatgatagatatt

SEQ ID NO: 232066 - DNA, 15 bp, Homo sapiens
aataatgatagatat

SEQ ID NO: 232067 - DNA, 15 bp, Homo sapiens
aaataatgatagata

SEQ ID NO: 232068 - DNA, 15 bp, Homo sapiens
gaaataatgatagat

SEQ ID NO: 232069 - DNA, 15 bp, Homo sapiens
tgaaataatgataga

SEQ ID NO: 232070 - DNA, 15 bp, Homo sapiens
atgaaataatgatag

SEQ ID NO: 232071 - DNA, 15 bp, Homo sapiens
catgaaataatgata

SEQ ID NO: 232072 - DNA, 15 bp, Homo sapiens
ccatgaaataatgat

SEQ ID NO: 232073 - DNA, 15 bp, Homo sapiens
cccatgaaataatga

SEQ ID NO: 232074 - DNA, 15 bp, Homo sapiens
tcccatgaaataatg

SEQ ID NO: 232075 - DNA, 15 bp, Homo sapiens
ctcccatgaaataat

SEQ ID NO: 232076 - DNA, 15 bp, Homo sapiens
tctcccatgaaataa

SEQ ID NO: 232077 - DNA, 15 bp, Homo sapiens
ttctcccatgaaata

SEQ ID NO: 232078 - DNA, 15 bp, Homo sapiens
tttctcccatgaaat

SEQ ID NO: 232079 - DNA, 15 bp, Homo sapiens
gtttctcccatgaaa

SEQ ID NO: 232080 - DNA, 15 bp, Homo sapiens
tgtttctcccatgaa

SEQ ID NO: 232081 - DNA, 15 bp, Homo sapiens
atgtttctcccatga

SEQ ID NO: 232082 - DNA, 15 bp, Homo sapiens
tatgtttctcccatg

SEQ ID NO: 232083 - DNA, 15 bp, Homo sapiens
ctatgtttctcccat

SEQ ID NO: 232084 - DNA, 15 bp, Homo sapiens
actatgtttctccca

SEQ ID NO: 232085 - DNA, 15 bp, Homo sapiens
aactatgtttctccc

SEQ ID NO: 232086 - DNA, 15 bp, Homo sapiens
aaactatgtttctcc

SEQ ID NO: 232087 - DNA, 15 bp, Homo sapiens
gaaactatgtttctc

SEQ ID NO: 232088 - DNA, 15 bp, Homo sapiens
tgaaactatgtttct

SEQ ID NO: 232089 - DNA, 15 bp, Homo sapiens
atgaaactatgtttc

SEQ ID NO: 232090 - DNA, 15 bp, Homo sapiens
aatgaaactatgttt

SEQ ID NO: 232091 - DNA, 15 bp, Homo sapiens
aaatgaaactatgtt

SEQ ID NO: 232092 - DNA, 15 bp, Homo sapiens
aaaatgaaactatgt

SEQ ID NO: 232093 - DNA, 15 bp, Homo sapiens
aaaaatgaaactatg

SEQ ID NO: 232094 - DNA, 15 bp, Homo sapiens
taaaaatgaaactat

SEQ ID NO: 232095 - DNA, 15 bp, Homo sapiens
ttaaaaatgaaacta

SEQ ID NO: 232096 - DNA, 15 bp, Homo sapiens
tttaaaaatgaaact

SEQ ID NO: 232097 - DNA, 15 bp, Homo sapiens
ttttaaaaatgaaac

SEQ ID NO: 232098 - DNA, 15 bp, Homo sapiens
attttaaaaatgaaa

SEQ ID NO: 232099 - DNA, 15 bp, Homo sapiens
aattttaaaaatgaa

SEQ ID NO: 232100 - DNA, 15 bp, Homo sapiens
aaattttaaaaatga

SEQ ID NO: 232101 - DNA, 15 bp, Homo sapiens
taaattttaaaaatg

SEQ ID NO: 232102 - DNA, 15 bp, Homo sapiens
tttaaattttaaaaa

SEQ ID NO: 232103 - DNA, 15 bp, Homo sapiens
tttttaaattttaaa

SEQ ID NO: 232104 - DNA, 15 bp, Homo sapiens
ttttttaaattttaa

SEQ ID NO: 232105 - DNA, 15 bp, Homo sapiens
attttttaaatttta

SEQ ID NO: 232106 - DNA, 15 bp, Homo sapiens
tattttttaaatttt

SEQ ID NO: 232107 - DNA, 15 bp, Homo sapiens
ctattttttaaattt

SEQ ID NO: 232108 - DNA, 15 bp, Homo sapiens
gctattttttaaatt

SEQ ID NO: 232109 - DNA, 15 bp, Homo sapiens
agctattttttaaat

SEQ ID NO: 232110 - DNA, 15 bp, Homo sapiens
aagctattttttaaa

SEQ ID NO: 232111 - DNA, 15 bp, Homo sapiens
aaagctattttttaa

SEQ ID NO: 232112 - DNA, 15 bp, Homo sapiens
caaagctatttttta

SEQ ID NO: 232113 - DNA, 15 bp, Homo sapiens
gcaaagctatttttt

SEQ ID NO: 232114 - DNA, 15 bp, Homo sapiens
tgcaaagctattttt

SEQ ID NO: 232115 - DNA, 15 bp, Homo sapiens
atgcaaagctatttt

SEQ ID NO: 232116 - DNA, 15 bp, Homo sapiens
tatgcaaagctattt

SEQ ID NO: 232117 - DNA, 15 bp, Homo sapiens
ttatgcaaagctatt

SEQ ID NO: 232118 - DNA, 15 bp, Homo sapiens
cttatgcaaagctat

SEQ ID NO: 232119 - DNA, 15 bp, Homo sapiens
gcttatgcaaagcta

SEQ ID NO: 232120 - DNA, 15 bp, Homo sapiens
tgcttatgcaaagct

SEQ ID NO: 232121 - DNA, 15 bp, Homo sapiens
gtgcttatgcaaagc

SEQ ID NO: 232122 - DNA, 15 bp, Homo sapiens
agtgcttatgcaaag

SEQ ID NO: 232123 - DNA, 15 bp, Homo sapiens
gagtgcttatgcaaa

SEQ ID NO: 232124 - DNA, 15 bp, Homo sapiens
tgagtgcttatgcaa

SEQ ID NO: 232125 - DNA, 15 bp, Homo sapiens
ttgagtgcttatgca

SEQ ID NO: 232126 - DNA, 15 bp, Homo sapiens
tttgagtgcttatgc

SEQ ID NO: 232127 - DNA, 15 bp, Homo sapiens
ctttgagtgcttatg

SEQ ID NO: 232128 - DNA, 15 bp, Homo sapiens
cctttgagtgcttat

SEQ ID NO: 232129 - DNA, 15 bp, Homo sapiens
tcctttgagtgctta

SEQ ID NO: 232130 - DNA, 15 bp, Homo sapiens
ttcctttgagtgctt

SEQ ID NO: 232131 - DNA, 15 bp, Homo sapiens
cttcctttgagtgct

SEQ ID NO: 232132 - DNA, 15 bp, Homo sapiens
tcttcctttgagtgc

SEQ ID NO: 232133 - DNA, 15 bp, Homo sapiens
ctcttcctttgagtg

SEQ ID NO: 232134 - DNA, 15 bp, Homo sapiens
actcttcctttgagt

SEQ ID NO: 232135 - DNA, 15 bp, Homo sapiens
aactcttcctttgag

SEQ ID NO: 232136 - DNA, 15 bp, Homo sapiens
aaactcttcctttga

SEQ ID NO: 232137 - DNA, 15 bp, Homo sapiens
aaaactcttcctttg

SEQ ID NO: 232138 - DNA, 15 bp, Homo sapiens
aaaaactcttccttt

SEQ ID NO: 232139 - DNA, 15 bp, Homo sapiens
aaaaaactcttcctt

SEQ ID NO: 232140 - DNA, 15 bp, Homo sapiens
aaaaaaactcttcct

SEQ ID NO: 232141 - DNA, 15 bp, Homo sapiens
aaaaaaaactcttcc

SEQ ID NO: 232142 - DNA, 15 bp, Homo sapiens
gaaaaaaaactcttc

SEQ ID NO: 232143 - DNA, 15 bp, Homo sapiens
ggaaaaaaaactctt

SEQ ID NO: 232144 - DNA, 15 bp, Homo sapiens
aggaaaaaaaactct

SEQ ID NO: 232145 - DNA, 15 bp, Homo sapiens
gaggaaaaaaaactc

SEQ ID NO: 232146 - DNA, 15 bp, Homo sapiens
agaggaaaaaaaact

SEQ ID NO: 232147 - DNA, 15 bp, Homo sapiens
tagaggaaaaaaaac

SEQ ID NO: 232148 - DNA, 15 bp, Homo sapiens
gtagaggaaaaaaaa

SEQ ID NO: 232149 - DNA, 15 bp, Homo sapiens
agtagaggaaaaaaa

SEQ ID NO: 232150 - DNA, 15 bp, Homo sapiens
tagtagaggaaaaaa

SEQ ID NO: 232151 - DNA, 15 bp, Homo sapiens
atagtagaggaaaaa

SEQ ID NO: 232152 - DNA, 15 bp, Homo sapiens
gatagtagaggaaaa

SEQ ID NO: 232153 - DNA, 15 bp, Homo sapiens
tgatagtagaggaaa

SEQ ID NO: 232154 - DNA, 15 bp, Homo sapiens
ttgatagtagaggaa

SEQ ID NO: 232155 - DNA, 15 bp, Homo sapiens
cttgatagtagagga

SEQ ID NO: 232156 - DNA, 15 bp, Homo sapiens
tcttgatagtagagg

SEQ ID NO: 232157 - DNA, 15 bp, Homo sapiens
atcttgatagtagag

SEQ ID NO: 232158 - DNA, 15 bp, Homo sapiens
aatcttgatagtaga

SEQ ID NO: 232159 - DNA, 15 bp, Homo sapiens
aaatcttgatagtag

SEQ ID NO: 232160 - DNA, 15 bp, Homo sapiens
gaaatcttgatagta

SEQ ID NO: 232161 - DNA, 15 bp, Homo sapiens
agaaatcttgatagt

SEQ ID NO: 232162 - DNA, 15 bp, Homo sapiens
aagaaatcttgatag

SEQ ID NO: 232163 - DNA, 15 bp, Homo sapiens
aaagaaatcttgata

SEQ ID NO: 232164 - DNA, 15 bp, Homo sapiens
caaagaaatcttgat

SEQ ID NO: 232165 - DNA, 15 bp, Homo sapiens
tcaaagaaatcttga

SEQ ID NO: 232166 - DNA, 15 bp, Homo sapiens
ctcaaagaaatcttg

SEQ ID NO: 232167 - DNA, 15 bp, Homo sapiens
tctcaaagaaatctt

SEQ ID NO: 232168 - DNA, 15 bp, Homo sapiens
atctcaaagaaatct

SEQ ID NO: 232169 - DNA, 15 bp, Homo sapiens
tatctcaaagaaatc

SEQ ID NO: 232170 - DNA, 15 bp, Homo sapiens
atatctcaaagaaat

SEQ ID NO: 232171 - DNA, 15 bp, Homo sapiens
tatatctcaaagaaa

SEQ ID NO: 232172 - DNA, 15 bp, Homo sapiens
gtatatctcaaagaa

SEQ ID NO: 232173 - DNA, 15 bp, Homo sapiens
tgtatatctcaaaga

SEQ ID NO: 232174 - DNA, 15 bp, Homo sapiens
ctgtatatctcaaag

SEQ ID NO: 232175 - DNA, 15 bp, Homo sapiens
tctgtatatctcaaa

SEQ ID NO: 232176 - DNA, 15 bp, Homo sapiens
ctctgtatatctcaa

SEQ ID NO: 232177 - DNA, 15 bp, Homo sapiens
cctctgtatatctca

SEQ ID NO: 232178 - DNA, 15 bp, Homo sapiens
gcctctgtatatctc

SEQ ID NO: 232179 - DNA, 15 bp, Homo sapiens
agcctctgtatatct

SEQ ID NO: 232180 - DNA, 15 bp, Homo sapiens
gagcctctgtatatc

SEQ ID NO: 232181 - DNA, 15 bp, Homo sapiens
tgagcctctgtatat

SEQ ID NO: 232182 - DNA, 15 bp, Homo sapiens
ttgagcctctgtata

SEQ ID NO: 232183 - DNA, 15 bp, Homo sapiens
gttgagcctctgtat

SEQ ID NO: 232184 - DNA, 15 bp, Homo sapiens
ggttgagcctctgta

SEQ ID NO: 232185 - DNA, 15 bp, Homo sapiens
aggttgagcctctgt

SEQ ID NO: 232186 - DNA, 15 bp, Homo sapiens
aaggttgagcctctg

SEQ ID NO: 232187 - DNA, 15 bp, Homo sapiens
gaaggttgagcctct

SEQ ID NO: 232188 - DNA, 15 bp, Homo sapiens
agaaggttgagcctc

SEQ ID NO: 232189 - DNA, 15 bp, Homo sapiens
aagaaggttgagcct

SEQ ID NO: 232190 - DNA, 15 bp, Homo sapiens
taagaaggttgagcc

SEQ ID NO: 232191 - DNA, 15 bp, Homo sapiens
gtaagaaggttgagc

SEQ ID NO: 232192 - DNA, 15 bp, Homo sapiens
tgtaagaaggttgag

SEQ ID NO: 232193 - DNA, 15 bp, Homo sapiens
atgtaagaaggttga

SEQ ID NO: 232194 - DNA, 15 bp, Homo sapiens
tatgtaagaaggttg

SEQ ID NO: 232195 - DNA, 15 bp, Homo sapiens
ttatgtaagaaggtt

SEQ ID NO: 232196 - DNA, 15 bp, Homo sapiens
attatgtaagaaggt

SEQ ID NO: 232197 - DNA, 15 bp, Homo sapiens
aattatgtaagaagg

SEQ ID NO: 232198 - DNA, 15 bp, Homo sapiens
caattatgtaagaag

SEQ ID NO: 232199 - DNA, 15 bp, Homo sapiens
tcaattatgtaagaa

SEQ ID NO: 232200 - DNA, 15 bp, Homo sapiens
ttcaattatgtaaga

SEQ ID NO: 232201 - DNA, 15 bp, Homo sapiens
attcaattatgtaag

SEQ ID NO: 232202 - DNA, 15 bp, Homo sapiens
aattcaattatgtaa

SEQ ID NO: 232203 - DNA, 15 bp, Homo sapiens
caattcaattatgta

SEQ ID NO: 232204 - DNA, 15 bp, Homo sapiens
tcaattcaattatgt

SEQ ID NO: 232205 - DNA, 15 bp, Homo sapiens
ctcaattcaattatg

SEQ ID NO: 232206 - DNA, 15 bp, Homo sapiens
cctcaattcaattat

SEQ ID NO: 232207 - DNA, 15 bp, Homo sapiens
acctcaattcaatta

SEQ ID NO: 232208 - DNA, 15 bp, Homo sapiens
tacctcaattcaatt

SEQ ID NO: 232209 - DNA, 15 bp, Homo sapiens
ttacctcaattcaat

SEQ ID NO: 232210 - DNA, 15 bp, Homo sapiens
tttacctcaattcaa

SEQ ID NO: 232211 - DNA, 15 bp, Homo sapiens
ttttacctcaattca

SEQ ID NO: 232212 - DNA, 15 bp, Homo sapiens
attttacctcaattc

SEQ ID NO: 232213 - DNA, 15 bp, Homo sapiens
tattttacctcaatt

SEQ ID NO: 232214 - DNA, 15 bp, Homo sapiens
ctattttacctcaat

SEQ ID NO: 232215 - DNA, 15 bp, Homo sapiens
tctattttacctcaa

SEQ ID NO: 232216 - DNA, 15 bp, Homo sapiens
gtctattttacctca

SEQ ID NO: 232217 - DNA, 15 bp, Homo sapiens
agtctattttacctc

SEQ ID NO: 232218 - DNA, 15 bp, Homo sapiens
gagtctattttacct

SEQ ID NO: 232219 - DNA, 15 bp, Homo sapiens
agagtctattttacc

SEQ ID NO: 232220 - DNA, 15 bp, Homo sapiens
aagagtctattttac

SEQ ID NO: 232221 - DNA, 15 bp, Homo sapiens
caagagtctatttta

SEQ ID NO: 232222 - DNA, 15 bp, Homo sapiens
tcaagagtctatttt

SEQ ID NO: 232223 - DNA, 15 bp, Homo sapiens
ttcaagagtctattt

SEQ ID NO: 232224 - DNA, 15 bp, Homo sapiens
tttcaagagtctatt

SEQ ID NO: 232225 - DNA, 15 bp, Homo sapiens
atttcaagagtctat

SEQ ID NO: 232226 - DNA, 15 bp, Homo sapiens
tatttcaagagtcta

SEQ ID NO: 232227 - DNA, 15 bp, Homo sapiens
ttatttcaagagtct

SEQ ID NO: 232228 - DNA, 15 bp, Homo sapiens
tttatttcaagagtc

SEQ ID NO: 232229 - DNA, 15 bp, Homo sapiens
ttttatttcaagagt

SEQ ID NO: 232230 - DNA, 15 bp, Homo sapiens
attttatttcaagag

SEQ ID NO: 232231 - DNA, 15 bp, Homo sapiens
tattttatttcaaga

SEQ ID NO: 232232 - DNA, 15 bp, Homo sapiens
atattttatttcaag

SEQ ID NO: 232233 - DNA, 15 bp, Homo sapiens
aatattttatttcaa

SEQ ID NO: 232234 - DNA, 15 bp, Homo sapiens
aaatattttatttca

SEQ ID NO: 232235 - DNA, 15 bp, Homo sapiens
aaaatattttatttc

SEQ ID NO: 232236 - DNA, 15 bp, Homo sapiens
gaaaaatattttatt

SEQ ID NO: 232237 - DNA, 15 bp, Homo sapiens
agaaaaatattttat

SEQ ID NO: 232238 - DNA, 15 bp, Homo sapiens
tagaaaaatatttta

SEQ ID NO: 232239 - DNA, 15 bp, Homo sapiens
ctagaaaaatatttt

SEQ ID NO: 232240 - DNA, 15 bp, Homo sapiens
gctagaaaaatattt

SEQ ID NO: 232241 - DNA, 15 bp, Homo sapiens
tgctagaaaaatatt

SEQ ID NO: 232242 - DNA, 15 bp, Homo sapiens
atgctagaaaaatat

SEQ ID NO: 232243 - DNA, 15 bp, Homo sapiens
catgctagaaaaata

SEQ ID NO: 232244 - DNA, 15 bp, Homo sapiens
tcatgctagaaaaat

SEQ ID NO: 232245 - DNA, 15 bp, Homo sapiens
ctcatgctagaaaaa

SEQ ID NO: 232246 - DNA, 15 bp, Homo sapiens
tctcatgctagaaaa

SEQ ID NO: 232247 - DNA, 15 bp, Homo sapiens
ttctcatgctagaaa

SEQ ID NO: 232248 - DNA, 15 bp, Homo sapiens
tttctcatgctagaa

SEQ ID NO: 232249 - DNA, 15 bp, Homo sapiens
ttttctcatgctaga

SEQ ID NO: 232250 - DNA, 15 bp, Homo sapiens
attttctcatgctag

SEQ ID NO: 232251 - DNA, 15 bp, Homo sapiens
tattttctcatgcta

SEQ ID NO: 232252 - DNA, 15 bp, Homo sapiens
ctattttctcatgct

SEQ ID NO: 232253 - DNA, 15 bp, Homo sapiens
cctattttctcatgc

SEQ ID NO: 232254 - DNA, 15 bp, Homo sapiens
ccctattttctcatg

SEQ ID NO: 232255 - DNA, 15 bp, Homo sapiens
accctattttctcat

SEQ ID NO: 232256 - DNA, 15 bp, Homo sapiens
aaccctattttctca

SEQ ID NO: 232257 - DNA, 15 bp, Homo sapiens
aaaccctattttctc

SEQ ID NO: 232258 - DNA, 15 bp, Homo sapiens
caaaccctattttct

SEQ ID NO: 232259 - DNA, 15 bp, Homo sapiens
gcaaaccctattttc

SEQ ID NO: 232260 - DNA, 15 bp, Homo sapiens
tgcaaaccctatttt

SEQ ID NO: 232261 - DNA, 15 bp, Homo sapiens
gtgcaaaccctattt

SEQ ID NO: 232262 - DNA, 15 bp, Homo sapiens
agtgcaaaccctatt

SEQ ID NO: 232263 - DNA, 15 bp, Homo sapiens
aagtgcaaaccctat

SEQ ID NO: 232264 - DNA, 15 bp, Homo sapiens
caagtgcaaacccta

SEQ ID NO: 232265 - DNA, 15 bp, Homo sapiens
tcaagtgcaaaccct

SEQ ID NO: 232266 - DNA, 15 bp, Homo sapiens
atcaagtgcaaaccc

SEQ ID NO: 232267 - DNA, 15 bp, Homo sapiens
tatcaagtgcaaacc

SEQ ID NO: 232268 - DNA, 15 bp, Homo sapiens
ttatcaagtgcaaac

SEQ ID NO: 232269 - DNA, 15 bp, Homo sapiens
tttatcaagtgcaaa

SEQ ID NO: 232270 - DNA, 15 bp, Homo sapiens
ttttatcaagtgcaa

SEQ ID NO: 232271 - DNA, 15 bp, Homo sapiens
attttatcaagtgca

SEQ ID NO: 232272 - DNA, 15 bp, Homo sapiens
aattttatcaagtgc

SEQ ID NO: 232273 - DNA, 15 bp, Homo sapiens
caattttatcaagtg

SEQ ID NO: 232274 - DNA, 15 bp, Homo sapiens
ccaattttatcaagt

SEQ ID NO: 232275 - DNA, 15 bp, Homo sapiens
cccaattttatcaag

SEQ ID NO: 232276 - DNA, 15 bp, Homo sapiens
gcccaattttatcaa

SEQ ID NO: 232277 - DNA, 15 bp, Homo sapiens
agcccaattttatca

SEQ ID NO: 232278 - DNA, 15 bp, Homo sapiens
cagcccaattttatc

SEQ ID NO: 232279 - DNA, 15 bp, Homo sapiens
ccagcccaattttat

SEQ ID NO: 232280 - DNA, 15 bp, Homo sapiens
cccagcccaatttta

SEQ ID NO: 232281 - DNA, 15 bp, Homo sapiens
gcccagcccaatttt

SEQ ID NO: 232282 - DNA, 15 bp, Homo sapiens
tgcccagcccaattt

SEQ ID NO: 232283 - DNA, 15 bp, Homo sapiens
ctgcccagcccaatt

SEQ ID NO: 232284 - DNA, 15 bp, Homo sapiens
cctgcccagcccaat

SEQ ID NO: 232285 - DNA, 15 bp, Homo sapiens
acctgcccagcccaa

SEQ ID NO: 232286 - DNA, 15 bp, Homo sapiens
gacctgcccagccca

SEQ ID NO: 232287 - DNA, 15 bp, Homo sapiens
tgacctgcccagccc

SEQ ID NO: 232288 - DNA, 15 bp, Homo sapiens
ttgacctgcccagcc

SEQ ID NO: 232289 - DNA, 15 bp, Homo sapiens
cttgacctgcccagc

SEQ ID NO: 232290 - DNA, 15 bp, Homo sapiens
acttgacctgcccag

SEQ ID NO: 232291 - DNA, 15 bp, Homo sapiens
tacttgacctgccca

SEQ ID NO: 232292 - DNA, 15 bp, Homo sapiens
ttacttgacctgccc

SEQ ID NO: 232293 - DNA, 15 bp, Homo sapiens
gttacttgacctgcc

SEQ ID NO: 232294 - DNA, 15 bp, Homo sapiens
agttacttgacctgc

SEQ ID NO: 232295 - DNA, 15 bp, Homo sapiens
cagttacttgacctg

SEQ ID NO: 232296 - DNA, 15 bp, Homo sapiens
ccagttacttgacct

SEQ ID NO: 232297 - DNA, 15 bp, Homo sapiens
gccagttacttgacc

SEQ ID NO: 232298 - DNA, 15 bp, Homo sapiens
ggccagttacttgac

SEQ ID NO: 232299 - DNA, 15 bp, Homo sapiens
aggccagttacttga

SEQ ID NO: 232300 - DNA, 15 bp, Homo sapiens
taggccagttacttg

SEQ ID NO: 232301 - DNA, 15 bp, Homo sapiens
ctaggccagttactt

SEQ ID NO: 232302 - DNA, 15 bp, Homo sapiens
cctaggccagttact

SEQ ID NO: 232303 - DNA, 15 bp, Homo sapiens
ccctaggccagttac

SEQ ID NO: 232304 - DNA, 15 bp, Homo sapiens
cccctaggccagtta

SEQ ID NO: 232305 - DNA, 15 bp, Homo sapiens
gcccctaggccagtt

SEQ ID NO: 232306 - DNA, 15 bp, Homo sapiens
tgcccctaggccagt

SEQ ID NO: 232307 - DNA, 15 bp, Homo sapiens
ttgcccctaggccag

SEQ ID NO: 232308 - DNA, 15 bp, Homo sapiens
attgcccctaggcca

SEQ ID NO: 232309 - DNA, 15 bp, Homo sapiens
cattgcccctaggcc

SEQ ID NO: 232310 - DNA, 15 bp, Homo sapiens
ccattgcccctaggc

SEQ ID NO: 232311 - DNA, 15 bp, Homo sapiens
cccattgcccctagg

SEQ ID NO: 232312 - DNA, 15 bp, Homo sapiens
gcccattgcccctag

SEQ ID NO: 232313 - DNA, 15 bp, Homo sapiens
tgcccattgccccta

SEQ ID NO: 232314 - DNA, 15 bp, Homo sapiens
ttgcccattgcccct

SEQ ID NO: 232315 - DNA, 15 bp, Homo sapiens
tttgcccattgcccc

SEQ ID NO: 232316 - DNA, 15 bp, Homo sapiens
ttttgcccattgccc

SEQ ID NO: 232317 - DNA, 15 bp, Homo sapiens
attttgcccattgcc

SEQ ID NO: 232318 - DNA, 15 bp, Homo sapiens
cattttgcccattgc

SEQ ID NO: 232319 - DNA, 15 bp, Homo sapiens
ccattttgcccattg

SEQ ID NO: 232320 - DNA, 15 bp, Homo sapiens
cccattttgcccatt

SEQ ID NO: 232321 - DNA, 15 bp, Homo sapiens
tcccattttgcccat

SEQ ID NO: 232322 - DNA, 15 bp, Homo sapiens
ctcccattttgccca

SEQ ID NO: 232323 - DNA, 15 bp, Homo sapiens
gctcccattttgccc

SEQ ID NO: 232324 - DNA, 15 bp, Homo sapiens
tgctcccattttgcc

SEQ ID NO: 232325 - DNA, 15 bp, Homo sapiens
ctgctcccattttgc

SEQ ID NO: 232326 - DNA, 15 bp, Homo sapiens
cctgctcccattttg

SEQ ID NO: 232327 - DNA, 15 bp, Homo sapiens
tcctgctcccatttt

SEQ ID NO: 232328 - DNA, 15 bp, Homo sapiens
gtcctgctcccattt

SEQ ID NO: 232329 - DNA, 15 bp, Homo sapiens
agtcctgctcccatt

SEQ ID NO: 232330 - DNA, 15 bp, Homo sapiens
cagtcctgctcccat

SEQ ID NO: 232331 - DNA, 15 bp, Homo sapiens
tcagtcctgctccca

SEQ ID NO: 232332 - DNA, 15 bp, Homo sapiens
atcagtcctgctccc

SEQ ID NO: 232333 - DNA, 15 bp, Homo sapiens
aatcagtcctgctcc

SEQ ID NO: 232334 - DNA, 15 bp, Homo sapiens
gaatcagtcctgctc

SEQ ID NO: 232335 - DNA, 15 bp, Homo sapiens
ggaatcagtcctgct

SEQ ID NO: 232336 - DNA, 15 bp, Homo sapiens
tggaatcagtcctgc

SEQ ID NO: 232337 - DNA, 15 bp, Homo sapiens
ttggaatcagtcctg

SEQ ID NO: 232338 - DNA, 15 bp, Homo sapiens
tttggaatcagtcct

SEQ ID NO: 232339 - DNA, 15 bp, Homo sapiens
atttggaatcagtcc

SEQ ID NO: 232340 - DNA, 15 bp, Homo sapiens
gatttggaatcagtc

SEQ ID NO: 232341 - DNA, 15 bp, Homo sapiens
ggatttggaatcagt

SEQ ID NO: 232342 - DNA, 15 bp, Homo sapiens
aggatttggaatcag

SEQ ID NO: 232343 - DNA, 15 bp, Homo sapiens
taggatttggaatca

SEQ ID NO: 232344 - DNA, 15 bp, Homo sapiens
ctaggatttggaatc

SEQ ID NO: 232345 - DNA, 15 bp, Homo sapiens
actaggatttggaat

SEQ ID NO: 232346 - DNA, 15 bp, Homo sapiens
gactaggatttggaa

SEQ ID NO: 232347 - DNA, 15 bp, Homo sapiens
agactaggatttgga

SEQ ID NO: 232348 - DNA, 15 bp, Homo sapiens
gagactaggatttgg

SEQ ID NO: 232349 - DNA, 15 bp, Homo sapiens
agagactaggatttg

SEQ ID NO: 232350 - DNA, 15 bp, Homo sapiens
cagagactaggattt

SEQ ID NO: 232351 - DNA, 15 bp, Homo sapiens
acagagactaggatt

SEQ ID NO: 232352 - DNA, 15 bp, Homo sapiens
aacagagactaggat

SEQ ID NO: 232353 - DNA, 15 bp, Homo sapiens
gaacagagactagga

SEQ ID NO: 232354 - DNA, 15 bp, Homo sapiens
ggaacagagactagg

SEQ ID NO: 232355 - DNA, 15 bp, Homo sapiens
aggaacagagactag

SEQ ID NO: 232356 - DNA, 15 bp, Homo sapiens
caggaacagagacta

SEQ ID NO: 232357 - DNA, 15 bp, Homo sapiens
ccaggaacagagact

SEQ ID NO: 232358 - DNA, 15 bp, Homo sapiens
accaggaacagagac

SEQ ID NO: 232359 - DNA, 15 bp, Homo sapiens
gaccaggaacagaga

SEQ ID NO: 232360 - DNA, 15 bp, Homo sapiens
ggaccaggaacagag

SEQ ID NO: 232361 - DNA, 15 bp, Homo sapiens
tggaccaggaacaga

SEQ ID NO: 232362 - DNA, 15 bp, Homo sapiens
ctggaccaggaacag

SEQ ID NO: 232363 - DNA, 15 bp, Homo sapiens
gctggaccaggaaca

SEQ ID NO: 232364 - DNA, 15 bp, Homo sapiens
agctggaccaggaac

SEQ ID NO: 232365 - DNA, 15 bp, Homo sapiens
aagctggaccaggaa

SEQ ID NO: 232366 - DNA, 15 bp, Homo sapiens
aaagctggaccagga

SEQ ID NO: 232367 - DNA, 15 bp, Homo sapiens
caaagctggaccagg

SEQ ID NO: 232368 - DNA, 15 bp, Homo sapiens
ccaaagctggaccag

SEQ ID NO: 232369 - DNA, 15 bp, Homo sapiens
accaaagctggacca

SEQ ID NO: 232370 - DNA, 15 bp, Homo sapiens
aaccaaagctggacc

SEQ ID NO: 232371 - DNA, 15 bp, Homo sapiens
aaaccaaagctggac

SEQ ID NO: 232372 - DNA, 15 bp, Homo sapiens
aaaaccaaagctgga

SEQ ID NO: 232373 - DNA, 15 bp, Homo sapiens
aaaaaccaaagctgg

SEQ ID NO: 232374 - DNA, 15 bp, Homo sapiens
gaaaaaccaaagctg

SEQ ID NO: 232375 - DNA, 15 bp, Homo sapiens
tgaaaaaccaaagct

SEQ ID NO: 232376 - DNA, 15 bp, Homo sapiens
gtgaaaaaccaaagc

SEQ ID NO: 232377 - DNA, 15 bp, Homo sapiens
ggtgaaaaaccaaag

SEQ ID NO: 232378 - DNA, 15 bp, Homo sapiens
aggtgaaaaaccaaa

SEQ ID NO: 232379 - DNA, 15 bp, Homo sapiens
caggtgaaaaaccaa

SEQ ID NO: 232380 - DNA, 15 bp, Homo sapiens
gcaggtgaaaaacca

SEQ ID NO: 232381 - DNA, 15 bp, Homo sapiens
tgcaggtgaaaaacc

SEQ ID NO: 232382 - DNA, 15 bp, Homo sapiens
atgcaggtgaaaaac

SEQ ID NO: 232383 - DNA, 15 bp, Homo sapiens
aatgcaggtgaaaaa

SEQ ID NO: 232384 - DNA, 15 bp, Homo sapiens
gaatgcaggtgaaaa

SEQ ID NO: 232385 - DNA, 15 bp, Homo sapiens
agaatgcaggtgaaa

SEQ ID NO: 232386 - DNA, 15 bp, Homo sapiens
tagaatgcaggtgaa

SEQ ID NO: 232387 - DNA, 15 bp, Homo sapiens
ctagaatgcaggtga

SEQ ID NO: 232388 - DNA, 15 bp, Homo sapiens
cctagaatgcaggtg

SEQ ID NO: 232389 - DNA, 15 bp, Homo sapiens
ccctagaatgcaggt

SEQ ID NO: 232390 - DNA, 15 bp, Homo sapiens
tccctagaatgcagg

SEQ ID NO: 232391 - DNA, 15 bp, Homo sapiens
ttccctagaatgcag

SEQ ID NO: 232392 - DNA, 15 bp, Homo sapiens
cttccctagaatgca

SEQ ID NO: 232393 - DNA, 15 bp, Homo sapiens
acttccctagaatgc

SEQ ID NO: 232394 - DNA, 15 bp, Homo sapiens
cacttccctagaatg

SEQ ID NO: 232395 - DNA, 15 bp, Homo sapiens
acacttccctagaat

SEQ ID NO: 232396 - DNA, 15 bp, Homo sapiens
tacacttccctagaa

SEQ ID NO: 232397 - DNA, 15 bp, Homo sapiens
atacacttccctaga

SEQ ID NO: 232398 - DNA, 15 bp, Homo sapiens
aatacacttccctag

SEQ ID NO: 232399 - DNA, 15 bp, Homo sapiens
taatacacttcccta

SEQ ID NO: 232400 - DNA, 15 bp, Homo sapiens
ataatacacttccct

SEQ ID NO: 232401 - DNA, 15 bp, Homo sapiens
tataatacacttccc

SEQ ID NO: 232402 - DNA, 15 bp, Homo sapiens
ctataatacacttcc

SEQ ID NO: 232403 - DNA, 15 bp, Homo sapiens
actataatacacttc

SEQ ID NO: 232404 - DNA, 15 bp, Homo sapiens
gactataatacactt

SEQ ID NO: 232405 - DNA, 15 bp, Homo sapiens
agactataatacact

SEQ ID NO: 232406 - DNA, 15 bp, Homo sapiens
aagactataatacac

SEQ ID NO: 232407 - DNA, 15 bp, Homo sapiens
gaagactataataca

SEQ ID NO: 232408 - DNA, 15 bp, Homo sapiens
agaagactataatac

SEQ ID NO: 232409 - DNA, 15 bp, Homo sapiens
aagaagactataata

SEQ ID NO: 232410 - DNA, 15 bp, Homo sapiens
gaagaagactataat

SEQ ID NO: 232411 - DNA, 15 bp, Homo sapiens
ggaagaagactataa

SEQ ID NO: 232412 - DNA, 15 bp, Homo sapiens
aggaagaagactata

SEQ ID NO: 232413 - DNA, 15 bp, Homo sapiens
gaggaagaagactat

SEQ ID NO: 232414 - DNA, 15 bp, Homo sapiens
tgaggaagaagacta

SEQ ID NO: 232415 - DNA, 15 bp, Homo sapiens
atgaggaagaagact

SEQ ID NO: 232416 - DNA, 15 bp, Homo sapiens
catgaggaagaagac

SEQ ID NO: 232417 - DNA, 15 bp, Homo sapiens
ccatgaggaagaaga

SEQ ID NO: 232418 - DNA, 15 bp, Homo sapiens
accatgaggaagaag

SEQ ID NO: 232419 - DNA, 15 bp, Homo sapiens
taccatgaggaagaa

SEQ ID NO: 232420 - DNA, 15 bp, Homo sapiens
ataccatgaggaaga

SEQ ID NO: 232421 - DNA, 15 bp, Homo sapiens
tataccatgaggaag

SEQ ID NO: 232422 - DNA, 15 bp, Homo sapiens
ttataccatgaggaa

SEQ ID NO: 232423 - DNA, 15 bp, Homo sapiens
tttataccatgagga

SEQ ID NO: 232424 - DNA, 15 bp, Homo sapiens
ctttataccatgagg

SEQ ID NO: 232425 - DNA, 15 bp, Homo sapiens
cctttataccatgag

SEQ ID NO: 232426 - DNA, 15 bp, Homo sapiens
tcctttataccatga

SEQ ID NO: 232427 - DNA, 15 bp, Homo sapiens
ctcctttataccatg

SEQ ID NO: 232428 - DNA, 15 bp, Homo sapiens
tctcctttataccat

SEQ ID NO: 232429 - DNA, 15 bp, Homo sapiens
ctctcctttatacca

SEQ ID NO: 232430 - DNA, 15 bp, Homo sapiens
gctctcctttatacc

SEQ ID NO: 232431 - DNA, 15 bp, Homo sapiens
cgctctcctttatac

SEQ ID NO: 232432 - DNA, 15 bp, Homo sapiens
acgctctcctttata

SEQ ID NO: 232433 - DNA, 15 bp, Homo sapiens
cacgctctcctttat

SEQ ID NO: 232434 - DNA, 15 bp, Homo sapiens
ccacgctctccttta

SEQ ID NO: 232435 - DNA, 15 bp, Homo sapiens
gccacgctctccttt

SEQ ID NO: 232436 - DNA, 15 bp, Homo sapiens
tgccacgctctcctt

SEQ ID NO: 232437 - DNA, 15 bp, Homo sapiens
atgccacgctctcct

SEQ ID NO: 232438 - DNA, 15 bp, Homo sapiens
tatgccacgctctcc

SEQ ID NO: 232439 - DNA, 15 bp, Homo sapiens
ttatgccacgctctc

SEQ ID NO: 232440 - DNA, 15 bp, Homo sapiens
tttatgccacgctct

SEQ ID NO: 232441 - DNA, 15 bp, Homo sapiens
atttatgccacgctc

SEQ ID NO: 232442 - DNA, 15 bp, Homo sapiens
catttatgccacgct

SEQ ID NO: 232443 - DNA, 15 bp, Homo sapiens
gcatttatgccacgc

SEQ ID NO: 232444 - DNA, 15 bp, Homo sapiens
agcatttatgccacg

SEQ ID NO: 232445 - DNA, 15 bp, Homo sapiens
cagcatttatgccac

SEQ ID NO: 232446 - DNA, 15 bp, Homo sapiens
acagcatttatgcca

SEQ ID NO: 232447 - DNA, 15 bp, Homo sapiens
cacagcatttatgcc

SEQ ID NO: 232448 - DNA, 15 bp, Homo sapiens
gcacagcatttatgc

SEQ ID NO: 232449 - DNA, 15 bp, Homo sapiens
ggcacagcatttatg

SEQ ID NO: 232450 - DNA, 15 bp, Homo sapiens
tggcacagcatttat

SEQ ID NO: 232451 - DNA, 15 bp, Homo sapiens
gtggcacagcattta

SEQ ID NO: 232452 - DNA, 15 bp, Homo sapiens
agtggcacagcattt

SEQ ID NO: 232453 - DNA, 15 bp, Homo sapiens
tagtggcacagcatt

SEQ ID NO: 232454 - DNA, 15 bp, Homo sapiens
ttagtggcacagcat

SEQ ID NO: 232455 - DNA, 15 bp, Homo sapiens
attagtggcacagca

SEQ ID NO: 232456 - DNA, 15 bp, Homo sapiens
aattagtggcacagc

SEQ ID NO: 232457 - DNA, 15 bp, Homo sapiens
aaattagtggcacag

SEQ ID NO: 232458 - DNA, 15 bp, Homo sapiens
caaattagtggcaca

SEQ ID NO: 232459 - DNA, 15 bp, Homo sapiens
gcaaattagtggcac

SEQ ID NO: 232460 - DNA, 15 bp, Homo sapiens
tgcaaattagtggca

SEQ ID NO: 232461 - DNA, 15 bp, Homo sapiens
atgcaaattagtggc

SEQ ID NO: 232462 - DNA, 15 bp, Homo sapiens
tatgcaaattagtgg

SEQ ID NO: 232463 - DNA, 15 bp, Homo sapiens
atatgcaaattagtg

SEQ ID NO: 232464 - DNA, 15 bp, Homo sapiens
aatatgcaaattagt

SEQ ID NO: 232465 - DNA, 15 bp, Homo sapiens
aaatatgcaaattag

SEQ ID NO: 232466 - DNA, 15 bp, Homo sapiens
caaatatgcaaatta

SEQ ID NO: 232467 - DNA, 15 bp, Homo sapiens
tcaaatatgcaaatt

SEQ ID NO: 232468 - DNA, 15 bp, Homo sapiens
ttcaaatatgcaaat

SEQ ID NO: 232469 - DNA, 15 bp, Homo sapiens
cttcaaatatgcaaa

SEQ ID NO: 232470 - DNA, 15 bp, Homo sapiens
tcttcaaatatgcaa

SEQ ID NO: 232471 - DNA, 15 bp, Homo sapiens
ttcttcaaatatgca

SEQ ID NO: 232472 - DNA, 15 bp, Homo sapiens
cttcttcaaatatgc

SEQ ID NO: 232473 - DNA, 15 bp, Homo sapiens
acttcttcaaatatg

SEQ ID NO: 232474 - DNA, 15 bp, Homo sapiens
tacttcttcaaatat

SEQ ID NO: 232475 - DNA, 15 bp, Homo sapiens
ttacttcttcaaata

SEQ ID NO: 232476 - DNA, 15 bp, Homo sapiens
tttacttcttcaaat

SEQ ID NO: 232477 - DNA, 15 bp, Homo sapiens
ctttacttcttcaaa

SEQ ID NO: 232478 - DNA, 15 bp, Homo sapiens
cctttacttcttcaa

SEQ ID NO: 232479 - DNA, 15 bp, Homo sapiens
acctttacttcttca

SEQ ID NO: 232480 - DNA, 15 bp, Homo sapiens
tacctttacttcttc

SEQ ID NO: 232481 - DNA, 15 bp, Homo sapiens
ttacctttacttctt

SEQ ID NO: 232482 - DNA, 15 bp, Homo sapiens
attacctttacttct

SEQ ID NO: 232483 - DNA, 15 bp, Homo sapiens
aattacctttacttc

SEQ ID NO: 232484 - DNA, 15 bp, Homo sapiens
caattacctttactt

SEQ ID NO: 232485 - DNA, 15 bp, Homo sapiens
ccaattacctttact

SEQ ID NO: 232486 - DNA, 15 bp, Homo sapiens
tccaattacctttac

SEQ ID NO: 232487 - DNA, 15 bp, Homo sapiens
atccaattaccttta

SEQ ID NO: 232488 - DNA, 15 bp, Homo sapiens
catccaattaccttt

SEQ ID NO: 232489 - DNA, 15 bp, Homo sapiens
tcatccaattacctt

SEQ ID NO: 232490 - DNA, 15 bp, Homo sapiens
gtcatccaattacct

SEQ ID NO: 232491 - DNA, 15 bp, Homo sapiens
tgtcatccaattacc

SEQ ID NO: 232492 - DNA, 15 bp, Homo sapiens
ctgtcatccaattac

SEQ ID NO: 232493 - DNA, 15 bp, Homo sapiens
tctgtcatccaatta

SEQ ID NO: 232494 - DNA, 15 bp, Homo sapiens
ttctgtcatccaatt

SEQ ID NO: 232495 - DNA, 15 bp, Homo sapiens
tttctgtcatccaat

SEQ ID NO: 232496 - DNA, 15 bp, Homo sapiens
ttttctgtcatccaa

SEQ ID NO: 232497 - DNA, 15 bp, Homo sapiens
gttttctgtcatcca

SEQ ID NO: 232498 - DNA, 15 bp, Homo sapiens
tgttttctgtcatcc

SEQ ID NO: 232499 - DNA, 15 bp, Homo sapiens
atgttttctgtcatc

SEQ ID NO: 232500 - DNA, 15 bp, Homo sapiens
gatgttttctgtcat

SEQ ID NO: 232501 - DNA, 15 bp, Homo sapiens
tgatgttttctgtca

SEQ ID NO: 232502 - DNA, 15 bp, Homo sapiens
ctgatgttttctgtc

SEQ ID NO: 232503 - DNA, 15 bp, Homo sapiens
cctgatgttttctgt

SEQ ID NO: 232504 - DNA, 15 bp, Homo sapiens
tcctgatgttttctg

SEQ ID NO: 232505 - DNA, 15 bp, Homo sapiens
atcctgatgttttct

SEQ ID NO: 232506 - DNA, 15 bp, Homo sapiens
aatcctgatgttttc

SEQ ID NO: 232507 - DNA, 15 bp, Homo sapiens
caatcctgatgtttt

SEQ ID NO: 232508 - DNA, 15 bp, Homo sapiens
tcaatcctgatgttt

SEQ ID NO: 232509 - DNA, 15 bp, Homo sapiens
atcaatcctgatgtt

SEQ ID NO: 232510 - DNA, 15 bp, Homo sapiens
gatcaatcctgatgt

SEQ ID NO: 232511 - DNA, 15 bp, Homo sapiens
agatcaatcctgatg

SEQ ID NO: 232512 - DNA, 15 bp, Homo sapiens
aagatcaatcctgat

SEQ ID NO: 232513 - DNA, 15 bp, Homo sapiens
aaagatcaatcctga

SEQ ID NO: 232514 - DNA, 15 bp, Homo sapiens
gaaagatcaatcctg

SEQ ID NO: 232515 - DNA, 15 bp, Homo sapiens
ggaaagatcaatcct

SEQ ID NO: 232516 - DNA, 15 bp, Homo sapiens
aggaaagatcaatcc

SEQ ID NO: 232517 - DNA, 15 bp, Homo sapiens
aaggaaagatcaatc

SEQ ID NO: 232518 - DNA, 15 bp, Homo sapiens
aaaggaaagatcaat

SEQ ID NO: 232519 - DNA, 15 bp, Homo sapiens
aaaaggaaagatcaa

SEQ ID NO: 232520 - DNA, 15 bp, Homo sapiens
aaaaaggaaagatca

SEQ ID NO: 232521 - DNA, 15 bp, Homo sapiens
gaaaaaggaaagatc

SEQ ID NO: 232522 - DNA, 15 bp, Homo sapiens
ggaaaaaggaaagat

SEQ ID NO: 232523 - DNA, 15 bp, Homo sapiens
aggaaaaaggaaaga

SEQ ID NO: 232524 - DNA, 15 bp, Homo sapiens
gaggaaaaaggaaag

SEQ ID NO: 232525 - DNA, 15 bp, Homo sapiens
agaggaaaaaggaaa

SEQ ID NO: 232526 - DNA, 15 bp, Homo sapiens
gagaggaaaaaggaa

SEQ ID NO: 232527 - DNA, 15 bp, Homo sapiens
agagaggaaaaagga

SEQ ID NO: 232528 - DNA, 15 bp, Homo sapiens
aagagaggaaaaagg

SEQ ID NO: 232529 - DNA, 15 bp, Homo sapiens
gaagagaggaaaaag

SEQ ID NO: 232530 - DNA, 15 bp, Homo sapiens
ggaagagaggaaaaa

SEQ ID NO: 232531 - DNA, 15 bp, Homo sapiens
aggaagagaggaaaa

SEQ ID NO: 232532 - DNA, 15 bp, Homo sapiens
aaggaagagaggaaa

SEQ ID NO: 232533 - DNA, 15 bp, Homo sapiens
aaaggaagagaggaa

SEQ ID NO: 232534 - DNA, 15 bp, Homo sapiens
caaaggaagagagga

SEQ ID NO: 232535 - DNA, 15 bp, Homo sapiens
acaaaggaagagagg

SEQ ID NO: 232536 - DNA, 15 bp, Homo sapiens
gacaaaggaagagag

SEQ ID NO: 232537 - DNA, 15 bp, Homo sapiens
agacaaaggaagaga

SEQ ID NO: 232538 - DNA, 15 bp, Homo sapiens
aagacaaaggaagag

SEQ ID NO: 232539 - DNA, 15 bp, Homo sapiens
gaagacaaaggaaga

SEQ ID NO: 232540 - DNA, 15 bp, Homo sapiens
agaagacaaaggaag

SEQ ID NO: 232541 - DNA, 15 bp, Homo sapiens
aagaagacaaaggaa

SEQ ID NO: 232542 - DNA, 15 bp, Homo sapiens
gaagaagacaaagga

SEQ ID NO: 232543 - DNA, 15 bp, Homo sapiens
ggaagaagacaaagg

SEQ ID NO: 232544 - DNA, 15 bp, Homo sapiens
aggaagaagacaaag

SEQ ID NO: 232545 - DNA, 15 bp, Homo sapiens
caggaagaagacaaa

SEQ ID NO: 232546 - DNA, 15 bp, Homo sapiens
acaggaagaagacaa

SEQ ID NO: 232547 - DNA, 15 bp, Homo sapiens
aacaggaagaagaca

SEQ ID NO: 232548 - DNA, 15 bp, Homo sapiens
aaacaggaagaagac

SEQ ID NO: 232549 - DNA, 15 bp, Homo sapiens
gaaacaggaagaaga

SEQ ID NO: 232550 - DNA, 15 bp, Homo sapiens
agaaacaggaagaag

SEQ ID NO: 232551 - DNA, 15 bp, Homo sapiens
aagaaacaggaagaa

SEQ ID NO: 232552 - DNA, 15 bp, Homo sapiens
gaagaaacaggaaga

SEQ ID NO: 232553 - DNA, 15 bp, Homo sapiens
agaagaaacaggaag

SEQ ID NO: 232554 - DNA, 15 bp, Homo sapiens
aagaagaaacaggaa

SEQ ID NO: 232555 - DNA, 15 bp, Homo sapiens
aaagaagaaacagga

SEQ ID NO: 232556 - DNA, 15 bp, Homo sapiens
gaaagaagaaacagg

SEQ ID NO: 232557 - DNA, 15 bp, Homo sapiens
tagaaagaagaaaca

SEQ ID NO: 232558 - DNA, 15 bp, Homo sapiens
ttagaaagaagaaac

SEQ ID NO: 232559 - DNA, 15 bp, Homo sapiens
tttagaaagaagaaa

SEQ ID NO: 232560 - DNA, 15 bp, Homo sapiens
ttttagaaagaagaa

SEQ ID NO: 232561 - DNA, 15 bp, Homo sapiens
cttttagaaagaaga

SEQ ID NO: 232562 - DNA, 15 bp, Homo sapiens
tcttttagaaagaag

SEQ ID NO: 232563 - DNA, 15 bp, Homo sapiens
atcttttagaaagaa

SEQ ID NO: 232564 - DNA, 15 bp, Homo sapiens
tatcttttagaaaga

SEQ ID NO: 232565 - DNA, 15 bp, Homo sapiens
ctatcttttagaaag

SEQ ID NO: 232566 - DNA, 15 bp, Homo sapiens
actatcttttagaaa

SEQ ID NO: 232567 - DNA, 15 bp, Homo sapiens
aactatcttttagaa

SEQ ID NO: 232568 - DNA, 15 bp, Homo sapiens
taactatcttttaga

SEQ ID NO: 232569 - DNA, 15 bp, Homo sapiens
ataactatcttttag

SEQ ID NO: 232570 - DNA, 15 bp, Homo sapiens
gataactatctttta

SEQ ID NO: 232571 - DNA, 15 bp, Homo sapiens
agataactatctttt

SEQ ID NO: 232572 - DNA, 15 bp, Homo sapiens
cagataactatcttt

SEQ ID NO: 232573 - DNA, 15 bp, Homo sapiens
acagataactatctt

SEQ ID NO: 232574 - DNA, 15 bp, Homo sapiens
cacagataactatct

SEQ ID NO: 232575 - DNA, 15 bp, Homo sapiens
ccacagataactatc

SEQ ID NO: 232576 - DNA, 15 bp, Homo sapiens
accacagataactat

SEQ ID NO: 232577 - DNA, 15 bp, Homo sapiens
gaccacagataacta

SEQ ID NO: 232578 - DNA, 15 bp, Homo sapiens
ggaccacagataact

SEQ ID NO: 232579 - DNA, 15 bp, Homo sapiens
gggaccacagataac

SEQ ID NO: 232580 - DNA, 15 bp, Homo sapiens
agggaccacagataa

SEQ ID NO: 232581 - DNA, 15 bp, Homo sapiens
aagggaccacagata

SEQ ID NO: 232582 - DNA, 15 bp, Homo sapiens
taagggaccacagat

SEQ ID NO: 232583 - DNA, 15 bp, Homo sapiens
ttaagggaccacaga

SEQ ID NO: 232584 - DNA, 15 bp, Homo sapiens
tttaagggaccacag

SEQ ID NO: 232585 - DNA, 15 bp, Homo sapiens
atttaagggaccaca

SEQ ID NO: 232586 - DNA, 15 bp, Homo sapiens
tatttaagggaccac

SEQ ID NO: 232587 - DNA, 15 bp, Homo sapiens
ctatttaagggacca

SEQ ID NO: 232588 - DNA, 15 bp, Homo sapiens
gctatttaagggacc

SEQ ID NO: 232589 - DNA, 15 bp, Homo sapiens
agctatttaagggac

SEQ ID NO: 232590 - DNA, 15 bp, Homo sapiens
aagctatttaaggga

SEQ ID NO: 232591 - DNA, 15 bp, Homo sapiens
aaagctatttaaggg

SEQ ID NO: 232592 - DNA, 15 bp, Homo sapiens
caaagctatttaagg

SEQ ID NO: 232593 - DNA, 15 bp, Homo sapiens
acaaagctatttaag

SEQ ID NO: 232594 - DNA, 15 bp, Homo sapiens
tacaaagctatttaa

SEQ ID NO: 232595 - DNA, 15 bp, Homo sapiens
ttacaaagctattta

SEQ ID NO: 232596 - DNA, 15 bp, Homo sapiens
attacaaagctattt

SEQ ID NO: 232597 - DNA, 15 bp, Homo sapiens
cattacaaagctatt

SEQ ID NO: 232598 - DNA, 15 bp, Homo sapiens
gcattacaaagctat

SEQ ID NO: 232599 - DNA, 15 bp, Homo sapiens
tgcattacaaagcta

SEQ ID NO: 232600 - DNA, 15 bp, Homo sapiens
ttgcattacaaagct

SEQ ID NO: 232601 - DNA, 15 bp, Homo sapiens
attgcattacaaagc

SEQ ID NO: 232602 - DNA, 15 bp, Homo sapiens
tattgcattacaaag

SEQ ID NO: 232603 - DNA, 15 bp, Homo sapiens
ttattgcattacaaa

SEQ ID NO: 232604 - DNA, 15 bp, Homo sapiens
tttattgcattacaa

SEQ ID NO: 232605 - DNA, 15 bp, Homo sapiens
atttattgcattaca

SEQ ID NO: 232606 - DNA, 15 bp, Homo sapiens
tatttattgcattac

SEQ ID NO: 232607 - DNA, 15 bp, Homo sapiens
ttatttattgcatta

SEQ ID NO: 232608 - DNA, 15 bp, Homo sapiens
tttatttattgcatt

SEQ ID NO: 232609 - DNA, 15 bp, Homo sapiens
atttatttattgcat

SEQ ID NO: 232610 - DNA, 15 bp, Homo sapiens
aatttatttattgca

SEQ ID NO: 232611 - DNA, 15 bp, Homo sapiens
caatttatttattgc

SEQ ID NO: 232612 - DNA, 15 bp, Homo sapiens
ccaatttatttattg

SEQ ID NO: 232613 - DNA, 15 bp, Homo sapiens
accaatttatttatt

SEQ ID NO: 232614 - DNA, 15 bp, Homo sapiens
caccaatttatttat

SEQ ID NO: 232615 - DNA, 15 bp, Homo sapiens
acaccaatttattta

SEQ ID NO: 232616 - DNA, 15 bp, Homo sapiens
aacaccaatttattt

SEQ ID NO: 232617 - DNA, 15 bp, Homo sapiens
aaacaccaatttatt

SEQ ID NO: 232618 - DNA, 15 bp, Homo sapiens
taaacaccaatttat

SEQ ID NO: 232619 - DNA, 15 bp, Homo sapiens
ttaaacaccaattta

SEQ ID NO: 232620 - DNA, 15 bp, Homo sapiens
tttaaacaccaattt

SEQ ID NO: 232621 - DNA, 15 bp, Homo sapiens
ttttaaacaccaatt

SEQ ID NO: 232622 - DNA, 15 bp, Homo sapiens
tttttaaacaccaat

SEQ ID NO: 232623 - DNA, 15 bp, Homo sapiens
atttttaaacaccaa

SEQ ID NO: 232624 - DNA, 15 bp, Homo sapiens
aatttttaaacacca

SEQ ID NO: 232625 - DNA, 15 bp, Homo sapiens
taatttttaaacacc

SEQ ID NO: 232626 - DNA, 15 bp, Homo sapiens
ataatttttaaacac

SEQ ID NO: 232627 - DNA, 15 bp, Homo sapiens
cataatttttaaaca

SEQ ID NO: 232628 - DNA, 15 bp, Homo sapiens
tcataatttttaaac

SEQ ID NO: 232629 - DNA, 15 bp, Homo sapiens
ttcataatttttaaa

SEQ ID NO: 232630 - DNA, 15 bp, Homo sapiens
tttcataatttttaa

SEQ ID NO: 232631 - DNA, 15 bp, Homo sapiens
atttcataattttta

SEQ ID NO: 232632 - DNA, 15 bp, Homo sapiens
tatttcataattttt

SEQ ID NO: 232633 - DNA, 15 bp, Homo sapiens
atatttcataatttt

SEQ ID NO: 232634 - DNA, 15 bp, Homo sapiens
catatttcataattt

SEQ ID NO: 232635 - DNA, 15 bp, Homo sapiens
tcatatttcataatt

SEQ ID NO: 232636 - DNA, 15 bp, Homo sapiens
ttcatatttcataat

SEQ ID NO: 232637 - DNA, 15 bp, Homo sapiens
attcatatttcataa

SEQ ID NO: 232638 - DNA, 15 bp, Homo sapiens
tattcatatttcata

SEQ ID NO: 232639 - DNA, 15 bp, Homo sapiens
atattcatatttcat

SEQ ID NO: 232640 - DNA, 15 bp, Homo sapiens
tatattcatatttca

SEQ ID NO: 232641 - DNA, 15 bp, Homo sapiens
ttatattcatatttc

SEQ ID NO: 232642 - DNA, 15 bp, Homo sapiens
tttatattcatattt

SEQ ID NO: 232643 - DNA, 15 bp, Homo sapiens
ttttatattcatatt

SEQ ID NO: 232644 - DNA, 15 bp, Homo sapiens
attttatattcatat

SEQ ID NO: 232645 - DNA, 15 bp, Homo sapiens
tattttatattcata

SEQ ID NO: 232646 - DNA, 15 bp, Homo sapiens
ttattttatattcat

SEQ ID NO: 232647 - DNA, 15 bp, Homo sapiens
attattttatattca

SEQ ID NO: 232648 - DNA, 15 bp, Homo sapiens
tattattttatattc

SEQ ID NO: 232649 - DNA, 15 bp, Homo sapiens
atattattttatatt

SEQ ID NO: 232650 - DNA, 15 bp, Homo sapiens
aatattattttatat

SEQ ID NO: 232651 - DNA, 15 bp, Homo sapiens
gaatattattttata

SEQ ID NO: 232652 - DNA, 15 bp, Homo sapiens
tgaatattattttat

SEQ ID NO: 232653 - DNA, 15 bp, Homo sapiens
atgaatattatttta

SEQ ID NO: 232654 - DNA, 15 bp, Homo sapiens
tatgaatattatttt

SEQ ID NO: 232655 - DNA, 15 bp, Homo sapiens
ttatgaatattattt

SEQ ID NO: 232656 - DNA, 15 bp, Homo sapiens
attatgaatattatt

SEQ ID NO: 232657 - DNA, 15 bp, Homo sapiens
tattatgaatattat

SEQ ID NO: 232658 - DNA, 15 bp, Homo sapiens
gtattatgaatatta

SEQ ID NO: 232659 - DNA, 15 bp, Homo sapiens
tgtattatgaatatt

SEQ ID NO: 232660 - DNA, 15 bp, Homo sapiens
atgtattatgaatat

SEQ ID NO: 232661 - DNA, 15 bp, Homo sapiens
catgtattatgaata

SEQ ID NO: 232662 - DNA, 15 bp, Homo sapiens
tcatgtattatgaat

SEQ ID NO: 232663 - DNA, 15 bp, Homo sapiens
atcatgtattatgaa

SEQ ID NO: 232664 - DNA, 15 bp, Homo sapiens
tatcatgtattatga

SEQ ID NO: 232665 - DNA, 15 bp, Homo sapiens
gtatcatgtattatg

SEQ ID NO: 232666 - DNA, 15 bp, Homo sapiens
tgtatcatgtattat

SEQ ID NO: 232667 - DNA, 15 bp, Homo sapiens
atgtatcatgtatta

SEQ ID NO: 232668 - DNA, 15 bp, Homo sapiens
tatgtatcatgtatt

SEQ ID NO: 232669 - DNA, 15 bp, Homo sapiens
ttatgtatcatgtat

SEQ ID NO: 232670 - DNA, 15 bp, Homo sapiens
tttatgtatcatgta

SEQ ID NO: 232671 - DNA, 15 bp, Homo sapiens
atttatgtatcatgt

SEQ ID NO: 232672 - DNA, 15 bp, Homo sapiens
tatttatgtatcatg

SEQ ID NO: 232673 - DNA, 15 bp, Homo sapiens
atatttatgtatcat

SEQ ID NO: 232674 - DNA, 15 bp, Homo sapiens
tatatttatgtatca

SEQ ID NO: 232675 - DNA, 15 bp, Homo sapiens
atatatttatgtatc

SEQ ID NO: 232676 - DNA, 15 bp, Homo sapiens
tatatatttatgtat

SEQ ID NO: 232677 - DNA, 15 bp, Homo sapiens
ttatatatttatgta

SEQ ID NO: 232678 - DNA, 15 bp, Homo sapiens
attatatatttatgt

SEQ ID NO: 232679 - DNA, 15 bp, Homo sapiens
tattatatatttatg

SEQ ID NO: 232680 - DNA, 15 bp, Homo sapiens
atattatatatttat

SEQ ID NO: 232681 - DNA, 15 bp, Homo sapiens
tatattatatattta

SEQ ID NO: 232682 - DNA, 15 bp, Homo sapiens
ttatattatatattt

SEQ ID NO: 232683 - DNA, 15 bp, Homo sapiens
tttatattatatatt

SEQ ID NO: 232684 - DNA, 15 bp, Homo sapiens
atttatattatatat

SEQ ID NO: 232685 - DNA, 15 bp, Homo sapiens
tatttatattatata

SEQ ID NO: 232686 - DNA, 15 bp, Homo sapiens
ttatttatattatat

SEQ ID NO: 232687 - DNA, 15 bp, Homo sapiens
tttatttatattata

SEQ ID NO: 232688 - DNA, 15 bp, Homo sapiens
atttatttatattat

SEQ ID NO: 232689 - DNA, 15 bp, Homo sapiens
tatttatttatatta

SEQ ID NO: 232690 - DNA, 15 bp, Homo sapiens
atatttatttatatt

SEQ ID NO: 232691 - DNA, 15 bp, Homo sapiens
ttatatttatttata

SEQ ID NO: 232692 - DNA, 15 bp, Homo sapiens
tttatatttatttat

SEQ ID NO: 232693 - DNA, 15 bp, Homo sapiens
cttttatatttattt

SEQ ID NO: 232694 - DNA, 15 bp, Homo sapiens
acttttatatttatt

SEQ ID NO: 232695 - DNA, 15 bp, Homo sapiens
tacttttatatttat

SEQ ID NO: 232696 - DNA, 15 bp, Homo sapiens
atacttttatattta

SEQ ID NO: 232697 - DNA, 15 bp, Homo sapiens
tatacttttatattt

SEQ ID NO: 232698 - DNA, 15 bp, Homo sapiens
ttatacttttatatt

SEQ ID NO: 232699 - DNA, 15 bp, Homo sapiens
cttatacttttatat

SEQ ID NO: 232700 - DNA, 15 bp, Homo sapiens
acttatacttttata

SEQ ID NO: 232701 - DNA, 15 bp, Homo sapiens
tacttatacttttat

SEQ ID NO: 232702 - DNA, 15 bp, Homo sapiens
ttacttatactttta

SEQ ID NO: 232703 - DNA, 15 bp, Homo sapiens
cttacttatactttt

SEQ ID NO: 232704 - DNA, 15 bp, Homo sapiens
tcttacttatacttt

SEQ ID NO: 232705 - DNA, 15 bp, Homo sapiens
ctcttacttatactt

SEQ ID NO: 232706 - DNA, 15 bp, Homo sapiens
cctcttacttatact

SEQ ID NO: 232707 - DNA, 15 bp, Homo sapiens
gcctcttacttatac

SEQ ID NO: 232708 - DNA, 15 bp, Homo sapiens
agcctcttacttata

SEQ ID NO: 232709 - DNA, 15 bp, Homo sapiens
tagcctcttacttat

SEQ ID NO: 232710 - DNA, 15 bp, Homo sapiens
ctagcctcttactta

SEQ ID NO: 232711 - DNA, 15 bp, Homo sapiens
cctagcctcttactt

SEQ ID NO: 232712 - DNA, 15 bp, Homo sapiens
acctagcctcttact

SEQ ID NO: 232713 - DNA, 15 bp, Homo sapiens
cacctagcctcttac

SEQ ID NO: 232714 - DNA, 15 bp, Homo sapiens
gcacctagcctctta

SEQ ID NO: 232715 - DNA, 15 bp, Homo sapiens
cgcacctagcctctt

SEQ ID NO: 232716 - DNA, 15 bp, Homo sapiens
ccgcacctagcctct

SEQ ID NO: 232717 - DNA, 15 bp, Homo sapiens
accgcacctagcctc

SEQ ID NO: 232718 - DNA, 15 bp, Homo sapiens
caccgcacctagcct

SEQ ID NO: 232719 - DNA, 15 bp, Homo sapiens
ccaccgcacctagcc

SEQ ID NO: 232720 - DNA, 15 bp, Homo sapiens
gccaccgcacctagc

SEQ ID NO: 232721 - DNA, 15 bp, Homo sapiens
agccaccgcacctag

SEQ ID NO: 232722 - DNA, 15 bp, Homo sapiens
aagccaccgcaccta

SEQ ID NO: 232723 - DNA, 15 bp, Homo sapiens
taagccaccgcacct

SEQ ID NO: 232724 - DNA, 15 bp, Homo sapiens
ataagccaccgcacc

SEQ ID NO: 232725 - DNA, 15 bp, Homo sapiens
cataagccaccgcac

SEQ ID NO: 232726 - DNA, 15 bp, Homo sapiens
gcataagccaccgca

SEQ ID NO: 232727 - DNA, 15 bp, Homo sapiens
ggcataagccaccgc

SEQ ID NO: 232728 - DNA, 15 bp, Homo sapiens
aggcataagccaccg

SEQ ID NO: 232729 - DNA, 15 bp, Homo sapiens
caggcataagccacc

SEQ ID NO: 232730 - DNA, 15 bp, Homo sapiens
acaggcataagccac

SEQ ID NO: 232731 - DNA, 15 bp, Homo sapiens
tacaggcataagcca

SEQ ID NO: 232732 - DNA, 15 bp, Homo sapiens
ttacaggcataagcc

SEQ ID NO: 232733 - DNA, 15 bp, Homo sapiens
ggctaagattacagg

SEQ ID NO: 232734 - DNA, 15 bp, Homo sapiens
gggctaagattacag

SEQ ID NO: 232735 - DNA, 15 bp, Homo sapiens
agggctaagattaca

SEQ ID NO: 232736 - DNA, 15 bp, Homo sapiens
aagggctaagattac

SEQ ID NO: 232737 - DNA, 15 bp, Homo sapiens
aaagggctaagatta

SEQ ID NO: 232738 - DNA, 15 bp, Homo sapiens
caaagggctaagatt

SEQ ID NO: 232739 - DNA, 15 bp, Homo sapiens
ccaaagggctaagat

SEQ ID NO: 232740 - DNA, 15 bp, Homo sapiens
cccaaagggctaaga

SEQ ID NO: 232741 - DNA, 15 bp, Homo sapiens
tcccaaagggctaag

SEQ ID NO: 232742 - DNA, 15 bp, Homo sapiens
ctcccaaagggctaa

SEQ ID NO: 232743 - DNA, 15 bp, Homo sapiens
tctcccaaagggcta

SEQ ID NO: 232744 - DNA, 15 bp, Homo sapiens
gtctcccaaagggct

SEQ ID NO: 232745 - DNA, 15 bp, Homo sapiens
agtctcccaaagggc

SEQ ID NO: 232746 - DNA, 15 bp, Homo sapiens
cagtctcccaaaggg

SEQ ID NO: 232747 - DNA, 15 bp, Homo sapiens
tcagtctcccaaagg

SEQ ID NO: 232748 - DNA, 15 bp, Homo sapiens
ctcagtctcccaaag

SEQ ID NO: 232749 - DNA, 15 bp, Homo sapiens
cctcagtctcccaaa

SEQ ID NO: 232750 - DNA, 15 bp, Homo sapiens
tgatcctcccacctc

SEQ ID NO: 232751 - DNA, 15 bp, Homo sapiens
gtgatcctcccacct

SEQ ID NO: 232752 - DNA, 15 bp, Homo sapiens
tgtgatcctcccacc

SEQ ID NO: 232753 - DNA, 15 bp, Homo sapiens
atgtgatcctcccac

SEQ ID NO: 232754 - DNA, 15 bp, Homo sapiens
catgtgatcctccca

SEQ ID NO: 232755 - DNA, 15 bp, Homo sapiens
tcatgtgatcctccc

SEQ ID NO: 232756 - DNA, 15 bp, Homo sapiens
ctcatgtgatcctcc

SEQ ID NO: 232757 - DNA, 15 bp, Homo sapiens
cctcatgtgatcctc

SEQ ID NO: 232758 - DNA, 15 bp, Homo sapiens
gcctcatgtgatcct

SEQ ID NO: 232759 - DNA, 15 bp, Homo sapiens
ggcctcatgtgatcc

SEQ ID NO: 232760 - DNA, 15 bp, Homo sapiens
tggcctcatgtgatc

SEQ ID NO: 232761 - DNA, 15 bp, Homo sapiens
ctggcctcatgtgat

SEQ ID NO: 232762 - DNA, 15 bp, Homo sapiens
tctggcctcatgtga

SEQ ID NO: 232763 - DNA, 15 bp, Homo sapiens
ttctggcctcatgtg

SEQ ID NO: 232764 - DNA, 15 bp, Homo sapiens
cttctggcctcatgt

SEQ ID NO: 232765 - DNA, 15 bp, Homo sapiens
acttctggcctcatg

SEQ ID NO: 232766 - DNA, 15 bp, Homo sapiens
aacttctggcctcat

SEQ ID NO: 232767 - DNA, 15 bp, Homo sapiens
aaacttctggcctca

SEQ ID NO: 232768 - DNA, 15 bp, Homo sapiens
caaacttctggcctc

SEQ ID NO: 232769 - DNA, 15 bp, Homo sapiens
tcaaacttctggcct

SEQ ID NO: 232770 - DNA, 15 bp, Homo sapiens
ctcaaacttctggcc

SEQ ID NO: 232771 - DNA, 15 bp, Homo sapiens
tctcaaacttctggc

SEQ ID NO: 232772 - DNA, 15 bp, Homo sapiens
gtctcaaacttctgg

SEQ ID NO: 232773 - DNA, 15 bp, Homo sapiens
ggtctcaaacttctg

SEQ ID NO: 232774 - DNA, 15 bp, Homo sapiens
tggtctcaaacttct

SEQ ID NO: 232775 - DNA, 15 bp, Homo sapiens
ctggtctcaaacttc

SEQ ID NO: 232776 - DNA, 15 bp, Homo sapiens
gctggtctcaaactt

SEQ ID NO: 232777 - DNA, 15 bp, Homo sapiens
actatgttacccagg

SEQ ID NO: 232778 - DNA, 15 bp, Homo sapiens
cactatgttacccag

SEQ ID NO: 232779 - DNA, 15 bp, Homo sapiens
tcactatgttaccca

SEQ ID NO: 232780 - DNA, 15 bp, Homo sapiens
ctcactatgttaccc

SEQ ID NO: 232781 - DNA, 15 bp, Homo sapiens
tctcactatgttacc

SEQ ID NO: 232782 - DNA, 15 bp, Homo sapiens
gtctcactatgttac

SEQ ID NO: 232783 - DNA, 15 bp, Homo sapiens
ggtctcactatgtta

SEQ ID NO: 232784 - DNA, 15 bp, Homo sapiens
aggtctcactatgtt

SEQ ID NO: 232785 - DNA, 15 bp, Homo sapiens
gaggtctcactatgt

SEQ ID NO: 232786 - DNA, 15 bp, Homo sapiens
tgaggtctcactatg

SEQ ID NO: 232787 - DNA, 15 bp, Homo sapiens
atgaggtctcactat

SEQ ID NO: 232788 - DNA, 15 bp, Homo sapiens
gatgaggtctcacta

SEQ ID NO: 232789 - DNA, 15 bp, Homo sapiens
ggatgaggtctcact

SEQ ID NO: 232790 - DNA, 15 bp, Homo sapiens
gggatgaggtctcac

SEQ ID NO: 232791 - DNA, 15 bp, Homo sapiens
agggatgaggtctca

SEQ ID NO: 232792 - DNA, 15 bp, Homo sapiens
tagggatgaggtctc

SEQ ID NO: 232793 - DNA, 15 bp, Homo sapiens
ttagggatgaggtct

SEQ ID NO: 232794 - DNA, 15 bp, Homo sapiens
tttagggatgaggtc

SEQ ID NO: 232795 - DNA, 15 bp, Homo sapiens
ttttagggatgaggt

SEQ ID NO: 232796 - DNA, 15 bp, Homo sapiens
tttttagggatgagg

SEQ ID NO: 232797 - DNA, 15 bp, Homo sapiens
ttttttagggatgag

SEQ ID NO: 232798 - DNA, 15 bp, Homo sapiens
tttttttagggatga

SEQ ID NO: 232799 - DNA, 15 bp, Homo sapiens
ttttttttagggatg

SEQ ID NO: 232800 - DNA, 15 bp, Homo sapiens
tttttttttagggat

SEQ ID NO: 232801 - DNA, 15 bp, Homo sapiens
ttttttttttaggga

SEQ ID NO: 232802 - DNA, 15 bp, Homo sapiens
tttttttttttaggg

SEQ ID NO: 232803 - DNA, 15 bp, Homo sapiens
tggccagctaatttt

SEQ ID NO: 232804 - DNA, 15 bp, Homo sapiens
gtggccagctaattt

SEQ ID NO: 232805 - DNA, 15 bp, Homo sapiens
agtggccagctaatt

SEQ ID NO: 232806 - DNA, 15 bp, Homo sapiens
cagtggccagctaat

SEQ ID NO: 232807 - DNA, 15 bp, Homo sapiens
acagtggccagctaa

SEQ ID NO: 232808 - DNA, 15 bp, Homo sapiens
cacagtggccagcta

SEQ ID NO: 232809 - DNA, 15 bp, Homo sapiens
ccacagtggccagct

SEQ ID NO: 232810 - DNA, 15 bp, Homo sapiens
gccacagtggccagc

SEQ ID NO: 232811 - DNA, 15 bp, Homo sapiens
tgccacagtggccag

SEQ ID NO: 232812 - DNA, 15 bp, Homo sapiens
gtgccacagtggcca

SEQ ID NO: 232813 - DNA, 15 bp, Homo sapiens
tgtgccacagtggcc

SEQ ID NO: 232814 - DNA, 15 bp, Homo sapiens
atgtgccacagtggc

SEQ ID NO: 232815 - DNA, 15 bp, Homo sapiens
tatgtgccacagtgg

SEQ ID NO: 232816 - DNA, 15 bp, Homo sapiens
ttatgtgccacagtg

SEQ ID NO: 232817 - DNA, 15 bp, Homo sapiens
gttatgtgccacagt

SEQ ID NO: 232818 - DNA, 15 bp, Homo sapiens
agttatgtgccacag

SEQ ID NO: 232819 - DNA, 15 bp, Homo sapiens
cagttatgtgccaca

SEQ ID NO: 232820 - DNA, 15 bp, Homo sapiens
acagttatgtgccac

SEQ ID NO: 232821 - DNA, 15 bp, Homo sapiens
cacagttatgtgcca

SEQ ID NO: 232822 - DNA, 15 bp, Homo sapiens
tcacagttatgtgcc

SEQ ID NO: 232823 - DNA, 15 bp, Homo sapiens
atcacagttatgtgc

SEQ ID NO: 232824 - DNA, 15 bp, Homo sapiens
gatcacagttatgtg

SEQ ID NO: 232825 - DNA, 15 bp, Homo sapiens
ggatcacagttatgt

SEQ ID NO: 232826 - DNA, 15 bp, Homo sapiens
gggatcacagttatg

SEQ ID NO: 232827 - DNA, 15 bp, Homo sapiens
tgggatcacagttat

SEQ ID NO: 232828 - DNA, 15 bp, Homo sapiens
ctgggatcacagtta

SEQ ID NO: 232829 - DNA, 15 bp, Homo sapiens
gctgggatcacagtt

SEQ ID NO: 232830 - DNA, 15 bp, Homo sapiens
agctgggatcacagt

SEQ ID NO: 232831 - DNA, 15 bp, Homo sapiens
tctgagtagctggga

SEQ ID NO: 232832 - DNA, 15 bp, Homo sapiens
ttctgagtagctggg

SEQ ID NO: 232833 - DNA, 15 bp, Homo sapiens
tttctgagtagctgg

SEQ ID NO: 232834 - DNA, 15 bp, Homo sapiens
ctttctgagtagctg

SEQ ID NO: 232835 - DNA, 15 bp, Homo sapiens
gctttctgagtagct

SEQ ID NO: 232836 - DNA, 15 bp, Homo sapiens
agctttctgagtagc

SEQ ID NO: 232837 - DNA, 15 bp, Homo sapiens
cagctttctgagtag

SEQ ID NO: 232838 - DNA, 15 bp, Homo sapiens
tcagctttctgagta

SEQ ID NO: 232839 - DNA, 15 bp, Homo sapiens
ctcagctttctgagt

SEQ ID NO: 232840 - DNA, 15 bp, Homo sapiens
cctcagctttctgag

SEQ ID NO: 232841 - DNA, 15 bp, Homo sapiens
acctcagctttctga

SEQ ID NO: 232842 - DNA, 15 bp, Homo sapiens
cacctcagctttctg

SEQ ID NO: 232843 - DNA, 15 bp, Homo sapiens
ccacctcagctttct

SEQ ID NO: 232844 - DNA, 15 bp, Homo sapiens
cccacctcagctttc

SEQ ID NO: 232845 - DNA, 15 bp, Homo sapiens
tcccacctcagcttt

SEQ ID NO: 232846 - DNA, 15 bp, Homo sapiens
ctcccacctcagctt

SEQ ID NO: 232847 - DNA, 15 bp, Homo sapiens
cctcccacctcagct

SEQ ID NO: 232848 - DNA, 15 bp, Homo sapiens
atcaaactcctgggc

SEQ ID NO: 232849 - DNA, 15 bp, Homo sapiens
catcaaactcctggg

SEQ ID NO: 232850 - DNA, 15 bp, Homo sapiens
gcatcaaactcctgg

SEQ ID NO: 232851 - DNA, 15 bp, Homo sapiens
agcatcaaactcctg

SEQ ID NO: 232852 - DNA, 15 bp, Homo sapiens
cagcatcaaactcct

SEQ ID NO: 232853 - DNA, 15 bp, Homo sapiens
acagcatcaaactcc

SEQ ID NO: 232854 - DNA, 15 bp, Homo sapiens
cacagcatcaaactc

SEQ ID NO: 232855 - DNA, 15 bp, Homo sapiens
tcacagcatcaaact

SEQ ID NO: 232856 - DNA, 15 bp, Homo sapiens
ctcacagcatcaaac

SEQ ID NO: 232857 - DNA, 15 bp, Homo sapiens
gctcacagcatcaaa

SEQ ID NO: 232858 - DNA, 15 bp, Homo sapiens
ggctcacagcatcaa

SEQ ID NO: 232859 - DNA, 15 bp, Homo sapiens
tggctcacagcatca

SEQ ID NO: 232860 - DNA, 15 bp, Homo sapiens
ctggctcacagcatc

SEQ ID NO: 232861 - DNA, 15 bp, Homo sapiens
cctggctcacagcat

SEQ ID NO: 232862 - DNA, 15 bp, Homo sapiens
gcctggctcacagca

SEQ ID NO: 232863 - DNA, 15 bp, Homo sapiens
agcctggctcacagc

SEQ ID NO: 232864 - DNA, 15 bp, Homo sapiens
aagcctggctcacag

SEQ ID NO: 232865 - DNA, 15 bp, Homo sapiens
taagcctggctcaca

SEQ ID NO: 232866 - DNA, 15 bp, Homo sapiens
ataagcctggctcac

SEQ ID NO: 232867 - DNA, 15 bp, Homo sapiens
cataagcctggctca

SEQ ID NO: 232868 - DNA, 15 bp, Homo sapiens
gcataagcctggctc

SEQ ID NO: 232869 - DNA, 15 bp, Homo sapiens
agcataagcctggct

SEQ ID NO: 232870 - DNA, 15 bp, Homo sapiens
tagcataagcctggc

SEQ ID NO: 232871 - DNA, 15 bp, Homo sapiens
gtagcataagcctgg

SEQ ID NO: 232872 - DNA, 15 bp, Homo sapiens
agtagcataagcctg

SEQ ID NO: 232873 - DNA, 15 bp, Homo sapiens
cagtagcataagcct

SEQ ID NO: 232874 - DNA, 15 bp, Homo sapiens
gcagtagcataagcc

SEQ ID NO: 232875 - DNA, 15 bp, Homo sapiens
tgcagtagcataagc

SEQ ID NO: 232876 - DNA, 15 bp, Homo sapiens
gtgcagtagcataag

SEQ ID NO: 232877 - DNA, 15 bp, Homo sapiens
agtgcagtagcataa

SEQ ID NO: 232878 - DNA, 15 bp, Homo sapiens
aagtgcagtagcata

SEQ ID NO: 232879 - DNA, 15 bp, Homo sapiens
gaagtgcagtagcat

SEQ ID NO: 232880 - DNA, 15 bp, Homo sapiens
tgaagtgcagtagca

SEQ ID NO: 232881 - DNA, 15 bp, Homo sapiens
ctgaagtgcagtagc

SEQ ID NO: 232882 - DNA, 15 bp, Homo sapiens
gctgaagtgcagtag

SEQ ID NO: 232883 - DNA, 15 bp, Homo sapiens
agctgaagtgcagta

SEQ ID NO: 232884 - DNA, 15 bp, Homo sapiens
cagctgaagtgcagt

SEQ ID NO: 232885 - DNA, 15 bp, Homo sapiens
ccagctgaagtgcag

SEQ ID NO: 232886 - DNA, 15 bp, Homo sapiens
cccagctgaagtgca

SEQ ID NO: 232887 - DNA, 15 bp, Homo sapiens
ccccagctgaagtgc

SEQ ID NO: 232888 - DNA, 15 bp, Homo sapiens
gccccagctgaagtg

SEQ ID NO: 232889 - DNA, 15 bp, Homo sapiens
tgccccagctgaagt

SEQ ID NO: 232890 - DNA, 15 bp, Homo sapiens
ttgccccagctgaag

SEQ ID NO: 232891 - DNA, 15 bp, Homo sapiens
gttgccccagctgaa

SEQ ID NO: 232892 - DNA, 15 bp, Homo sapiens
tgttgccccagctga

SEQ ID NO: 232893 - DNA, 15 bp, Homo sapiens
ctgttgccccagctg

SEQ ID NO: 232894 - DNA, 15 bp, Homo sapiens
tctgttgccccagct

SEQ ID NO: 232895 - DNA, 15 bp, Homo sapiens
ctctgttgccccagc

SEQ ID NO: 232896 - DNA, 15 bp, Homo sapiens
gctctgttgccccag

SEQ ID NO: 232897 - DNA, 15 bp, Homo sapiens
tgctctgttgcccca

SEQ ID NO: 232898 - DNA, 15 bp, Homo sapiens
ttgctctgttgcccc

SEQ ID NO: 232899 - DNA, 15 bp, Homo sapiens
cttgctctgttgccc

SEQ ID NO: 232900 - DNA, 15 bp, Homo sapiens
tcttgctctgttgcc

SEQ ID NO: 232901 - DNA, 15 bp, Homo sapiens
gtcttgctctgttgc

SEQ ID NO: 232902 - DNA, 15 bp, Homo sapiens
ggtcttgctctgttg

SEQ ID NO: 232903 - DNA, 15 bp, Homo sapiens
gggtcttgctctgtt

SEQ ID NO: 232904 - DNA, 15 bp, Homo sapiens
agggtcttgctctgt

SEQ ID NO: 232905 - DNA, 15 bp, Homo sapiens
cagggtcttgctctg

SEQ ID NO: 232906 - DNA, 15 bp, Homo sapiens
tcagggtcttgctct

SEQ ID NO: 232907 - DNA, 15 bp, Homo sapiens
gtcagggtcttgctc

SEQ ID NO: 232908 - DNA, 15 bp, Homo sapiens
agtcagggtcttgct

SEQ ID NO: 232909 - DNA, 15 bp, Homo sapiens
tagtcagggtcttgc

SEQ ID NO: 232910 - DNA, 15 bp, Homo sapiens
ttagtcagggtcttg

SEQ ID NO: 232911 - DNA, 15 bp, Homo sapiens
tttagtcagggtctt

SEQ ID NO: 232912 - DNA, 15 bp, Homo sapiens
ttttagtcagggtct

SEQ ID NO: 232913 - DNA, 15 bp, Homo sapiens
tttttagtcagggtc

SEQ ID NO: 232914 - DNA, 15 bp, Homo sapiens
ttttttagtcagggt

SEQ ID NO: 232915 - DNA, 15 bp, Homo sapiens
tttttttagtcaggg

SEQ ID NO: 232916 - DNA, 15 bp, Homo sapiens
ttttttttagtcagg

SEQ ID NO: 232917 - DNA, 15 bp, Homo sapiens
tttttttttagtcag

SEQ ID NO: 232918 - DNA, 15 bp, Homo sapiens
ttttttttttagtca

SEQ ID NO: 232919 - DNA, 15 bp, Homo sapiens
attttttttttagtc

SEQ ID NO: 232920 - DNA, 15 bp, Homo sapiens
cattttttttttagt

SEQ ID NO: 232921 - DNA, 15 bp, Homo sapiens
ccattttttttttag

SEQ ID NO: 232922 - DNA, 15 bp, Homo sapiens
accatttttttttta

SEQ ID NO: 232923 - DNA, 15 bp, Homo sapiens
caccatttttttttt

SEQ ID NO: 232924 - DNA, 15 bp, Homo sapiens
acaccattttttttt

SEQ ID NO: 232925 - DNA, 15 bp, Homo sapiens
tacaccatttttttt

SEQ ID NO: 232926 - DNA, 15 bp, Homo sapiens
atacaccattttttt

SEQ ID NO: 232927 - DNA, 15 bp, Homo sapiens
tatacaccatttttt

SEQ ID NO: 232928 - DNA, 15 bp, Homo sapiens
gtatacaccattttt

SEQ ID NO: 232929 - DNA, 15 bp, Homo sapiens
tgtatacaccatttt

SEQ ID NO: 232930 - DNA, 15 bp, Homo sapiens
atgtatacaccattt

SEQ ID NO: 232931 - DNA, 15 bp, Homo sapiens
tatgtatacaccatt

SEQ ID NO: 232932 - DNA, 15 bp, Homo sapiens
atatgtatacaccat

SEQ ID NO: 232933 - DNA, 15 bp, Homo sapiens
tatatgtatacacca

SEQ ID NO: 232934 - DNA, 15 bp, Homo sapiens
atatatgtatacacc

SEQ ID NO: 232935 - DNA, 15 bp, Homo sapiens
tatatatgtatacac

SEQ ID NO: 232936 - DNA, 15 bp, Homo sapiens
atatatatgtataca

SEQ ID NO: 232937 - DNA, 15 bp, Homo sapiens
tatatatatgtatac

SEQ ID NO: 232938 - DNA, 15 bp, Homo sapiens
catatatatatatat

SEQ ID NO: 232939 - DNA, 15 bp, Homo sapiens
acatatatatatata

SEQ ID NO: 232940 - DNA, 15 bp, Homo sapiens
cacatatatatatat

SEQ ID NO: 232941 - DNA, 15 bp, Homo sapiens
acacatatatatata

SEQ ID NO: 232942 - DNA, 15 bp, Homo sapiens
cacacatatatatat

SEQ ID NO: 232943 - DNA, 15 bp, Homo sapiens
acacacatatatata

SEQ ID NO: 232944 - DNA, 15 bp, Homo sapiens
cacacacatatatat

SEQ ID NO: 232945 - DNA, 15 bp, Homo sapiens
ttatacacacacaca

SEQ ID NO: 232946 - DNA, 15 bp, Homo sapiens
tttatacacacacac

SEQ ID NO: 232947 - DNA, 15 bp, Homo sapiens
ttttatacacacaca

SEQ ID NO: 232948 - DNA, 15 bp, Homo sapiens
attttatacacacac

SEQ ID NO: 232949 - DNA, 15 bp, Homo sapiens
aattttatacacaca

SEQ ID NO: 232950 - DNA, 15 bp, Homo sapiens
aaattttatacacac

SEQ ID NO: 232951 - DNA, 15 bp, Homo sapiens
aaaattttatacaca

SEQ ID NO: 232952 - DNA, 15 bp, Homo sapiens
aaaaattttatacac

SEQ ID NO: 232953 - DNA, 15 bp, Homo sapiens
taaaaattttataca

SEQ ID NO: 232954 - DNA, 15 bp, Homo sapiens
ttaaaaattttatac

SEQ ID NO: 232955 - DNA, 15 bp, Homo sapiens
tttaaaaattttata

SEQ ID NO: 232956 - DNA, 15 bp, Homo sapiens
atttaaaaattttat

SEQ ID NO: 232957 - DNA, 15 bp, Homo sapiens
tatttaaaaatttta

SEQ ID NO: 232958 - DNA, 15 bp, Homo sapiens
atatttaaaaatttt

SEQ ID NO: 232959 - DNA, 15 bp, Homo sapiens
atatatttaaaaatt

SEQ ID NO: 232960 - DNA, 15 bp, Homo sapiens
tatatatttaaaaat

SEQ ID NO: 232961 - DNA, 15 bp, Homo sapiens
ctatatatttaaaaa

SEQ ID NO: 232962 - DNA, 15 bp, Homo sapiens
tctatatatttaaaa

SEQ ID NO: 232963 - DNA, 15 bp, Homo sapiens
atctatatatttaaa

SEQ ID NO: 232964 - DNA, 15 bp, Homo sapiens
tatctatatatttaa

SEQ ID NO: 232965 - DNA, 15 bp, Homo sapiens
atatctatatattta

SEQ ID NO: 232966 - DNA, 15 bp, Homo sapiens
atatatctatatatt

SEQ ID NO: 232967 - DNA, 15 bp, Homo sapiens
ttatatatctatata

SEQ ID NO: 232968 - DNA, 15 bp, Homo sapiens
tttatatatctatat

SEQ ID NO: 232969 - DNA, 15 bp, Homo sapiens
ttttatatatctata

SEQ ID NO: 232970 - DNA, 15 bp, Homo sapiens
tttttatatatctat

SEQ ID NO: 232971 - DNA, 15 bp, Homo sapiens
atttttatatatcta

SEQ ID NO: 232972 - DNA, 15 bp, Homo sapiens
aatttttatatatct

SEQ ID NO: 232973 - DNA, 15 bp, Homo sapiens
taatttttatatatc

SEQ ID NO: 232974 - DNA, 15 bp, Homo sapiens
ataatttttatatat

SEQ ID NO: 232975 - DNA, 15 bp, Homo sapiens
cataatttttatata

SEQ ID NO: 232976 - DNA, 15 bp, Homo sapiens
acataatttttatat

SEQ ID NO: 232977 - DNA, 15 bp, Homo sapiens
tacataatttttata

SEQ ID NO: 232978 - DNA, 15 bp, Homo sapiens
atacataatttttat

SEQ ID NO: 232979 - DNA, 15 bp, Homo sapiens
tatacataattttta

SEQ ID NO: 232980 - DNA, 15 bp, Homo sapiens
ttatacataattttt

SEQ ID NO: 232981 - DNA, 15 bp, Homo sapiens
attatacataatttt

SEQ ID NO: 232982 - DNA, 15 bp, Homo sapiens
tattatacataattt

SEQ ID NO: 232983 - DNA, 15 bp, Homo sapiens
atattatacataatt

SEQ ID NO: 232984 - DNA, 15 bp, Homo sapiens
tatattatacataat

SEQ ID NO: 232985 - DNA, 15 bp, Homo sapiens
atatattatacataa

SEQ ID NO: 232986 - DNA, 15 bp, Homo sapiens
tatatattatacata

SEQ ID NO: 232987 - DNA, 15 bp, Homo sapiens
gtatatattatacat

SEQ ID NO: 232988 - DNA, 15 bp, Homo sapiens
tgtatatattataca

SEQ ID NO: 232989 - DNA, 15 bp, Homo sapiens
atgtatatattatac

SEQ ID NO: 232990 - DNA, 15 bp, Homo sapiens
tatgtatatattata

SEQ ID NO: 232991 - DNA, 15 bp, Homo sapiens
ttatgtatatattat

SEQ ID NO: 232992 - DNA, 15 bp, Homo sapiens
attatgtatatatta

SEQ ID NO: 232993 - DNA, 15 bp, Homo sapiens
aattatgtatatatt

SEQ ID NO: 232994 - DNA, 15 bp, Homo sapiens
aaattatgtatatat

SEQ ID NO: 232995 - DNA, 15 bp, Homo sapiens
aaaattatgtatata

SEQ ID NO: 232996 - DNA, 15 bp, Homo sapiens
taaaattatgtatat

SEQ ID NO: 232997 - DNA, 15 bp, Homo sapiens
gtaaaattatgtata

SEQ ID NO: 232998 - DNA, 15 bp, Homo sapiens
agtaaaattatgtat

SEQ ID NO: 232999 - DNA, 15 bp, Homo sapiens
aagtaaaattatgta

SEQ ID NO: 233000 - DNA, 15 bp, Homo sapiens
taagtaaaattatgt

SEQ ID NO: 233001 - DNA, 15 bp, Homo sapiens
ataagtaaaattatg

SEQ ID NO: 233002 - DNA, 15 bp, Homo sapiens
cataagtaaaattat

SEQ ID NO: 233003 - DNA, 15 bp, Homo sapiens
acataagtaaaatta

SEQ ID NO: 233004 - DNA, 15 bp, Homo sapiens
tacataagtaaaatt

SEQ ID NO: 233005 - DNA, 15 bp, Homo sapiens
atacataagtaaaat

SEQ ID NO: 233006 - DNA, 15 bp, Homo sapiens
tatacataagtaaaa

SEQ ID NO: 233007 - DNA, 15 bp, Homo sapiens
ttatacataagtaaa

SEQ ID NO: 233008 - DNA, 15 bp, Homo sapiens
attatacataagtaa

SEQ ID NO: 233009 - DNA, 15 bp, Homo sapiens
tattatacataagta

SEQ ID NO: 233010 - DNA, 15 bp, Homo sapiens
atattatacataagt

SEQ ID NO: 233011 - DNA, 15 bp, Homo sapiens
tatattatacataag

SEQ ID NO: 233012 - DNA, 15 bp, Homo sapiens
atatacataagtaaa

SEQ ID NO: 233013 - DNA, 15 bp, Homo sapiens
aatatacataagtaa

SEQ ID NO: 233014 - DNA, 15 bp, Homo sapiens
taatatacataagta

SEQ ID NO: 233015 - DNA, 15 bp, Homo sapiens
ataatatacataagt

SEQ ID NO: 233016 - DNA, 15 bp, Homo sapiens
tataatatacataag

SEQ ID NO: 233017 - DNA, 15 bp, Homo sapiens
gtataatatacataa

SEQ ID NO: 233018 - DNA, 15 bp, Homo sapiens
tgtataatatacata

SEQ ID NO: 233019 - DNA, 15 bp, Homo sapiens
atgtataatatacat

SEQ ID NO: 233020 - DNA, 15 bp, Homo sapiens
tatgtataatataca

SEQ ID NO: 233021 - DNA, 15 bp, Homo sapiens
ttatgtataatatac

SEQ ID NO: 233022 - DNA, 15 bp, Homo sapiens
tttatgtataatata

SEQ ID NO: 233023 - DNA, 15 bp, Homo sapiens
atttatgtataatat

SEQ ID NO: 233024 - DNA, 15 bp, Homo sapiens
tatttatgtataata

SEQ ID NO: 233025 - DNA, 15 bp, Homo sapiens
atatttatgtataat

SEQ ID NO: 233026 - DNA, 15 bp, Homo sapiens
tatatttatgtataa

SEQ ID NO: 233027 - DNA, 15 bp, Homo sapiens
atatatttatgtata

SEQ ID NO: 233028 - DNA, 15 bp, Homo sapiens
atatatatttatgta

SEQ ID NO: 233029 - DNA, 15 bp, Homo sapiens
atatctaggctgggt

SEQ ID NO: 233030 - DNA, 15 bp, Homo sapiens
gatatctaggctggg

SEQ ID NO: 233031 - DNA, 15 bp, Homo sapiens
agatatctaggctgg

SEQ ID NO: 233032 - DNA, 15 bp, Homo sapiens
aagatatctaggctg

SEQ ID NO: 233033 - DNA, 15 bp, Homo sapiens
taagatatctaggct

SEQ ID NO: 233034 - DNA, 15 bp, Homo sapiens
ttaagatatctaggc

SEQ ID NO: 233035 - DNA, 15 bp, Homo sapiens
tttaagatatctagg

SEQ ID NO: 233036 - DNA, 15 bp, Homo sapiens
ctttaagatatctag

SEQ ID NO: 233037 - DNA, 15 bp, Homo sapiens
cctttaagatatcta

SEQ ID NO: 233038 - DNA, 15 bp, Homo sapiens
acctttaagatatct

SEQ ID NO: 233039 - DNA, 15 bp, Homo sapiens
tacctttaagatatc

SEQ ID NO: 233040 - DNA, 15 bp, Homo sapiens
atacctttaagatat

SEQ ID NO: 233041 - DNA, 15 bp, Homo sapiens
tatacctttaagata

SEQ ID NO: 233042 - DNA, 15 bp, Homo sapiens
ttatacctttaagat

SEQ ID NO: 233043 - DNA, 15 bp, Homo sapiens
cttatacctttaaga

SEQ ID NO: 233044 - DNA, 15 bp, Homo sapiens
ccttatacctttaag

SEQ ID NO: 233045 - DNA, 15 bp, Homo sapiens
tccttatacctttaa

SEQ ID NO: 233046 - DNA, 15 bp, Homo sapiens
atccttataccttta

SEQ ID NO: 233047 - DNA, 15 bp, Homo sapiens
aatccttataccttt

SEQ ID NO: 233048 - DNA, 15 bp, Homo sapiens
aaatccttatacctt

SEQ ID NO: 233049 - DNA, 15 bp, Homo sapiens
taaatccttatacct

SEQ ID NO: 233050 - DNA, 15 bp, Homo sapiens
ttaaatccttatacc

SEQ ID NO: 233051 - DNA, 15 bp, Homo sapiens
tttaaatccttatac

SEQ ID NO: 233052 - DNA, 15 bp, Homo sapiens
atttaaatccttata

SEQ ID NO: 233053 - DNA, 15 bp, Homo sapiens
tatttaaatccttat

SEQ ID NO: 233054 - DNA, 15 bp, Homo sapiens
ttatttaaatcctta

SEQ ID NO: 233055 - DNA, 15 bp, Homo sapiens
tttatttaaatcctt

SEQ ID NO: 233056 - DNA, 15 bp, Homo sapiens
ctttatttaaatcct

SEQ ID NO: 233057 - DNA, 15 bp, Homo sapiens
actttatttaaatcc

SEQ ID NO: 233058 - DNA, 15 bp, Homo sapiens
aactttatttaaatc

SEQ ID NO: 233059 - DNA, 15 bp, Homo sapiens
aaactttatttaaat

SEQ ID NO: 233060 - DNA, 15 bp, Homo sapiens
caaactttatttaaa

SEQ ID NO: 233061 - DNA, 15 bp, Homo sapiens
acaaactttatttaa

SEQ ID NO: 233062 - DNA, 15 bp, Homo sapiens
gacaaactttattta

SEQ ID NO: 233063 - DNA, 15 bp, Homo sapiens
agacaaactttattt

SEQ ID NO: 233064 - DNA, 15 bp, Homo sapiens
aagacaaactttatt

SEQ ID NO: 233065 - DNA, 15 bp, Homo sapiens
aaagacaaactttat

SEQ ID NO: 233066 - DNA, 15 bp, Homo sapiens
gaaagacaaacttta

SEQ ID NO: 233067 - DNA, 15 bp, Homo sapiens
agaaagacaaacttt

SEQ ID NO: 233068 - DNA, 15 bp, Homo sapiens
tagaaagacaaactt

SEQ ID NO: 233069 - DNA, 15 bp, Homo sapiens
ttagaaagacaaact

SEQ ID NO: 233070 - DNA, 15 bp, Homo sapiens
attagaaagacaaac

SEQ ID NO: 233071 - DNA, 15 bp, Homo sapiens
cattagaaagacaaa

SEQ ID NO: 233072 - DNA, 15 bp, Homo sapiens
tcattagaaagacaa

SEQ ID NO: 233073 - DNA, 15 bp, Homo sapiens
atcattagaaagaca

SEQ ID NO: 233074 - DNA, 15 bp, Homo sapiens
tatcattagaaagac

SEQ ID NO: 233075 - DNA, 15 bp, Homo sapiens
gtatcattagaaaga

SEQ ID NO: 233076 - DNA, 15 bp, Homo sapiens
tgtatcattagaaag

SEQ ID NO: 233077 - DNA, 15 bp, Homo sapiens
gtgtatcattagaaa

SEQ ID NO: 233078 - DNA, 15 bp, Homo sapiens
agtgtatcattagaa

SEQ ID NO: 233079 - DNA, 15 bp, Homo sapiens
cagtgtatcattaga

SEQ ID NO: 233080 - DNA, 15 bp, Homo sapiens
ccagtgtatcattag

SEQ ID NO: 233081 - DNA, 15 bp, Homo sapiens
gccagtgtatcatta

SEQ ID NO: 233082 - DNA, 15 bp, Homo sapiens
ggccagtgtatcatt

SEQ ID NO: 233083 - DNA, 15 bp, Homo sapiens
aggccagtgtatcat

SEQ ID NO: 233084 - DNA, 15 bp, Homo sapiens
aaggccagtgtatca

SEQ ID NO: 233085 - DNA, 15 bp, Homo sapiens
gaaggccagtgtatc

SEQ ID NO: 233086 - DNA, 15 bp, Homo sapiens
tgaaggccagtgtat

SEQ ID NO: 233087 - DNA, 15 bp, Homo sapiens
ctgaaggccagtgta

SEQ ID NO: 233088 - DNA, 15 bp, Homo sapiens
tctgaaggccagtgt

SEQ ID NO: 233089 - DNA, 15 bp, Homo sapiens
ctctgaaggccagtg

SEQ ID NO: 233090 - DNA, 15 bp, Homo sapiens
tctctgaaggccagt

SEQ ID NO: 233091 - DNA, 15 bp, Homo sapiens
ctctctgaaggccag

SEQ ID NO: 233092 - DNA, 15 bp, Homo sapiens
gctctctgaaggcca

SEQ ID NO: 233093 - DNA, 15 bp, Homo sapiens
agctctctgaaggcc

SEQ ID NO: 233094 - DNA, 15 bp, Homo sapiens
cagctctctgaaggc

SEQ ID NO: 233095 - DNA, 15 bp, Homo sapiens
gcagctctctgaagg

SEQ ID NO: 233096 - DNA, 15 bp, Homo sapiens
agcagctctctgaag

SEQ ID NO: 233097 - DNA, 15 bp, Homo sapiens
aagcagctctctgaa

SEQ ID NO: 233098 - DNA, 15 bp, Homo sapiens
aaagcagctctctga

SEQ ID NO: 233099 - DNA, 15 bp, Homo sapiens
gaaagcagctctctg

SEQ ID NO: 233100 - DNA, 15 bp, Homo sapiens
agaaagcagctctct

SEQ ID NO: 233101 - DNA, 15 bp, Homo sapiens
gagaaagcagctctc

SEQ ID NO: 233102 - DNA, 15 bp, Homo sapiens
tgagaaagcagctct

SEQ ID NO: 233103 - DNA, 15 bp, Homo sapiens
ttgagaaagcagctc

SEQ ID NO: 233104 - DNA, 15 bp, Homo sapiens
cttgagaaagcagct

SEQ ID NO: 233105 - DNA, 15 bp, Homo sapiens
tcttgagaaagcagc

SEQ ID NO: 233106 - DNA, 15 bp, Homo sapiens
ttcttgagaaagcag

SEQ ID NO: 233107 - DNA, 15 bp, Homo sapiens
cttcttgagaaagca

SEQ ID NO: 233108 - DNA, 15 bp, Homo sapiens
gcttcttgagaaagc

SEQ ID NO: 233109 - DNA, 15 bp, Homo sapiens
ggcttcttgagaaag

SEQ ID NO: 233110 - DNA, 15 bp, Homo sapiens
aggcttcttgagaaa

SEQ ID NO: 233111 - DNA, 15 bp, Homo sapiens
aaggcttcttgagaa

SEQ ID NO: 233112 - DNA, 15 bp, Homo sapiens
aaaggcttcttgaga

SEQ ID NO: 233113 - DNA, 15 bp, Homo sapiens
caaaggcttcttgag

SEQ ID NO: 233114 - DNA, 15 bp, Homo sapiens
gcaaaggcttcttga

SEQ ID NO: 233115 - DNA, 15 bp, Homo sapiens
tgcaaaggcttcttg

SEQ ID NO: 233116 - DNA, 15 bp, Homo sapiens
ttgcaaaggcttctt

SEQ ID NO: 233117 - DNA, 15 bp, Homo sapiens
attgcaaaggcttct

SEQ ID NO: 233118 - DNA, 15 bp, Homo sapiens
gattgcaaaggcttc

SEQ ID NO: 233119 - DNA, 15 bp, Homo sapiens
ggattgcaaaggctt

SEQ ID NO: 233120 - DNA, 15 bp, Homo sapiens
aggattgcaaaggct

SEQ ID NO: 233121 - DNA, 15 bp, Homo sapiens
caggattgcaaaggc

SEQ ID NO: 233122 - DNA, 15 bp, Homo sapiens
tcaggattgcaaagg

SEQ ID NO: 233123 - DNA, 15 bp, Homo sapiens
gtcaggattgcaaag

SEQ ID NO: 233124 - DNA, 15 bp, Homo sapiens
tgtcaggattgcaaa

SEQ ID NO: 233125 - DNA, 15 bp, Homo sapiens
atgtcaggattgcaa

SEQ ID NO: 233126 - DNA, 15 bp, Homo sapiens
catgtcaggattgca

SEQ ID NO: 233127 - DNA, 15 bp, Homo sapiens
acatgtcaggattgc

SEQ ID NO: 233128 - DNA, 15 bp, Homo sapiens
aacatgtcaggattg

SEQ ID NO: 233129 - DNA, 15 bp, Homo sapiens
caacatgtcaggatt

SEQ ID NO: 233130 - DNA, 15 bp, Homo sapiens
gcaacatgtcaggat

SEQ ID NO: 233131 - DNA, 15 bp, Homo sapiens
tgcaacatgtcagga

SEQ ID NO: 233132 - DNA, 15 bp, Homo sapiens
atgcaacatgtcagg

SEQ ID NO: 233133 - DNA, 15 bp, Homo sapiens
catgcaacatgtcag

SEQ ID NO: 233134 - DNA, 15 bp, Homo sapiens
acatgcaacatgtca

SEQ ID NO: 233135 - DNA, 15 bp, Homo sapiens
aacatgcaacatgtc

SEQ ID NO: 233136 - DNA, 15 bp, Homo sapiens
aaacatgcaacatgt

SEQ ID NO: 233137 - DNA, 15 bp, Homo sapiens
aaaacatgcaacatg

SEQ ID NO: 233138 - DNA, 15 bp, Homo sapiens
taaaacatgcaacat

SEQ ID NO: 233139 - DNA, 15 bp, Homo sapiens
ctaaaacatgcaaca

SEQ ID NO: 233140 - DNA, 15 bp, Homo sapiens
cctaaaacatgcaac

SEQ ID NO: 233141 - DNA, 15 bp, Homo sapiens
ccctaaaacatgcaa

SEQ ID NO: 233142 - DNA, 15 bp, Homo sapiens
gccctaaaacatgca

SEQ ID NO: 233143 - DNA, 15 bp, Homo sapiens
agccctaaaacatgc

SEQ ID NO: 233144 - DNA, 15 bp, Homo sapiens
aagccctaaaacatg

SEQ ID NO: 233145 - DNA, 15 bp, Homo sapiens
aaagccctaaaacat

SEQ ID NO: 233146 - DNA, 15 bp, Homo sapiens
aaaagccctaaaaca

SEQ ID NO: 233147 - DNA, 15 bp, Homo sapiens
gaaaagccctaaaac

SEQ ID NO: 233148 - DNA, 15 bp, Homo sapiens
agaaaagccctaaaa

SEQ ID NO: 233149 - DNA, 15 bp, Homo sapiens
gagaaaagccctaaa

SEQ ID NO: 233150 - DNA, 15 bp, Homo sapiens
agagaaaagccctaa

SEQ ID NO: 233151 - DNA, 15 bp, Homo sapiens
cagagaaaagcccta

SEQ ID NO: 233152 - DNA, 15 bp, Homo sapiens
ccagagaaaagccct

SEQ ID NO: 233153 - DNA, 15 bp, Homo sapiens
cccagagaaaagccc

SEQ ID NO: 233154 - DNA, 15 bp, Homo sapiens
gcccagagaaaagcc

SEQ ID NO: 233155 - DNA, 15 bp, Homo sapiens
agcccagagaaaagc

SEQ ID NO: 233156 - DNA, 15 bp, Homo sapiens
gagcccagagaaaag

SEQ ID NO: 233157 - DNA, 15 bp, Homo sapiens
ggagcccagagaaaa

SEQ ID NO: 233158 - DNA, 15 bp, Homo sapiens
aggagcccagagaaa

SEQ ID NO: 233159 - DNA, 15 bp, Homo sapiens
taggagcccagagaa

SEQ ID NO: 233160 - DNA, 15 bp, Homo sapiens
ctaggagcccagaga

SEQ ID NO: 233161 - DNA, 15 bp, Homo sapiens
tctaggagcccagag

SEQ ID NO: 233162 - DNA, 15 bp, Homo sapiens
gtctaggagcccaga

SEQ ID NO: 233163 - DNA, 15 bp, Homo sapiens
tgtctaggagcccag

SEQ ID NO: 233164 - DNA, 15 bp, Homo sapiens
ctgtctaggagccca

SEQ ID NO: 233165 - DNA, 15 bp, Homo sapiens
actgtctaggagccc

SEQ ID NO: 233166 - DNA, 15 bp, Homo sapiens
aactgtctaggagcc

SEQ ID NO: 233167 - DNA, 15 bp, Homo sapiens
taactgtctaggagc

SEQ ID NO: 233168 - DNA, 15 bp, Homo sapiens
gtaactgtctaggag

SEQ ID NO: 233169 - DNA, 15 bp, Homo sapiens
agtaactgtctagga

SEQ ID NO: 233170 - DNA, 15 bp, Homo sapiens
aagtaactgtctagg

SEQ ID NO: 233171 - DNA, 15 bp, Homo sapiens
caagtaactgtctag

SEQ ID NO: 233172 - DNA, 15 bp, Homo sapiens
tcaagtaactgtcta

SEQ ID NO: 233173 - DNA, 15 bp, Homo sapiens
ttcaagtaactgtct

SEQ ID NO: 233174 - DNA, 15 bp, Homo sapiens
gttcaagtaactgtc

SEQ ID NO: 233175 - DNA, 15 bp, Homo sapiens
ggttcaagtaactgt

SEQ ID NO: 233176 - DNA, 15 bp, Homo sapiens
aggttcaagtaactg

SEQ ID NO: 233177 - DNA, 15 bp, Homo sapiens
caggttcaagtaact

SEQ ID NO: 233178 - DNA, 15 bp, Homo sapiens
acaggttcaagtaac

SEQ ID NO: 233179 - DNA, 15 bp, Homo sapiens
aacaggttcaagtaa

SEQ ID NO: 233180 - DNA, 15 bp, Homo sapiens
aaacaggttcaagta

SEQ ID NO: 233181 - DNA, 15 bp, Homo sapiens
gaaacaggttcaagt

SEQ ID NO: 233182 - DNA, 15 bp, Homo sapiens
agaaacaggttcaag

SEQ ID NO: 233183 - DNA, 15 bp, Homo sapiens
gagaaacaggttcaa

SEQ ID NO: 233184 - DNA, 15 bp, Homo sapiens
agagaaacaggttca

SEQ ID NO: 233185 - DNA, 15 bp, Homo sapiens
tagagaaacaggttc

SEQ ID NO: 233186 - DNA, 15 bp, Homo sapiens
ttagagaaacaggtt

SEQ ID NO: 233187 - DNA, 15 bp, Homo sapiens
attagagaaacaggt

SEQ ID NO: 233188 - DNA, 15 bp, Homo sapiens
aattagagaaacagg

SEQ ID NO: 233189 - DNA, 15 bp, Homo sapiens
gaattagagaaacag

SEQ ID NO: 233190 - DNA, 15 bp, Homo sapiens
tgaattagagaaaca

SEQ ID NO: 233191 - DNA, 15 bp, Homo sapiens
gtgaattagagaaac

SEQ ID NO: 233192 - DNA, 15 bp, Homo sapiens
agtgaattagagaaa

SEQ ID NO: 233193 - DNA, 15 bp, Homo sapiens
aagtgaattagagaa

SEQ ID NO: 233194 - DNA, 15 bp, Homo sapiens
taagtgaattagaga

SEQ ID NO: 233195 - DNA, 15 bp, Homo sapiens
ataagtgaattagag

SEQ ID NO: 233196 - DNA, 15 bp, Homo sapiens
aataagtgaattaga

SEQ ID NO: 233197 - DNA, 15 bp, Homo sapiens
aaataagtgaattag

SEQ ID NO: 233198 - DNA, 15 bp, Homo sapiens
aaaataagtgaatta

SEQ ID NO: 233199 - DNA, 15 bp, Homo sapiens
aaaaataagtgaatt

SEQ ID NO: 233200 - DNA, 15 bp, Homo sapiens
aaaaaataagtgaat

SEQ ID NO: 233201 - DNA, 15 bp, Homo sapiens
aaaaaaataagtgaa

SEQ ID NO: 233202 - DNA, 15 bp, Homo sapiens
taaaaaaataagtga

SEQ ID NO: 233203 - DNA, 15 bp, Homo sapiens
ataaaaaaataagtg

SEQ ID NO: 233204 - DNA, 15 bp, Homo sapiens
aataaaaaaataagt

SEQ ID NO: 233205 - DNA, 15 bp, Homo sapiens
aaataaaaaaataag

SEQ ID NO: 233206 - DNA, 15 bp, Homo sapiens
aaaaataaaaaaata

SEQ ID NO: 233207 - DNA, 15 bp, Homo sapiens
taaaaataaaaaaat

SEQ ID NO: 233208 - DNA, 15 bp, Homo sapiens
ataaaaataaaaaaa

SEQ ID NO: 233209 - DNA, 15 bp, Homo sapiens
aataaaaataaaaaa

SEQ ID NO: 233210 - DNA, 15 bp, Homo sapiens
aaataaaaataaaaa

SEQ ID NO: 233211 - DNA, 15 bp, Homo sapiens
ataaaaataaaaata

SEQ ID NO: 233212 - DNA, 15 bp, Homo sapiens
aataaaaataaaaat

SEQ ID NO: 233213 - DNA, 15 bp, Homo sapiens
caaaaaaataaaaat

SEQ ID NO: 233214 - DNA, 15 bp, Homo sapiens
ttgagactccatctc

SEQ ID NO: 233215 - DNA, 15 bp, Homo sapiens
gttgagactccatct

SEQ ID NO: 233216 - DNA, 15 bp, Homo sapiens
agttgagactccatc

SEQ ID NO: 233217 - DNA, 15 bp, Homo sapiens
gagttgagactccat

SEQ ID NO: 233218 - DNA, 15 bp, Homo sapiens
agagttgagactcca

SEQ ID NO: 233219 - DNA, 15 bp, Homo sapiens
cagagttgagactcc

SEQ ID NO: 233220 - DNA, 15 bp, Homo sapiens
ccagagttgagactc

SEQ ID NO: 233221 - DNA, 15 bp, Homo sapiens
gccagagttgagact

SEQ ID NO: 233222 - DNA, 15 bp, Homo sapiens
tgccagagttgagac

SEQ ID NO: 233223 - DNA, 15 bp, Homo sapiens
gtgccagagttgaga

SEQ ID NO: 233224 - DNA, 15 bp, Homo sapiens
ggtgccagagttgag

SEQ ID NO: 233225 - DNA, 15 bp, Homo sapiens
gggtgccagagttga

SEQ ID NO: 233226 - DNA, 15 bp, Homo sapiens
tgggtgccagagttg

SEQ ID NO: 233227 - DNA, 15 bp, Homo sapiens
ctgggtgccagagtt

SEQ ID NO: 233228 - DNA, 15 bp, Homo sapiens
cctgggtgccagagt

SEQ ID NO: 233229 - DNA, 15 bp, Homo sapiens
gcctgggtgccagag

SEQ ID NO: 233230 - DNA, 15 bp, Homo sapiens
tgcctgggtgccaga

SEQ ID NO: 233231 - DNA, 15 bp, Homo sapiens
ttgcctgggtgccag

SEQ ID NO: 233232 - DNA, 15 bp, Homo sapiens
attgcctgggtgcca

SEQ ID NO: 233233 - DNA, 15 bp, Homo sapiens
cattgcctgggtgcc

SEQ ID NO: 233234 - DNA, 15 bp, Homo sapiens
ccattgcctgggtgc

SEQ ID NO: 233235 - DNA, 15 bp, Homo sapiens
gccattgcctgggtg

SEQ ID NO: 233236 - DNA, 15 bp, Homo sapiens
tgccattgcctgggt

SEQ ID NO: 233237 - DNA, 15 bp, Homo sapiens
gtgccattgcctggg

SEQ ID NO: 233238 - DNA, 15 bp, Homo sapiens
agtgccattgcctgg

SEQ ID NO: 233239 - DNA, 15 bp, Homo sapiens
cagtgccattgcctg

SEQ ID NO: 233240 - DNA, 15 bp, Homo sapiens
acagtgccattgcct

SEQ ID NO: 233241 - DNA, 15 bp, Homo sapiens
cacagtgccattgcc

SEQ ID NO: 233242 - DNA, 15 bp, Homo sapiens
acacagtgccattgc

SEQ ID NO: 233243 - DNA, 15 bp, Homo sapiens
gacacagtgccattg

SEQ ID NO: 233244 - DNA, 15 bp, Homo sapiens
cgacacagtgccatt

SEQ ID NO: 233245 - DNA, 15 bp, Homo sapiens
ccgacacagtgccat

SEQ ID NO: 233246 - DNA, 15 bp, Homo sapiens
gccgacacagtgcca

SEQ ID NO: 233247 - DNA, 15 bp, Homo sapiens
agccgacacagtgcc

SEQ ID NO: 233248 - DNA, 15 bp, Homo sapiens
gagccgacacagtgc

SEQ ID NO: 233249 - DNA, 15 bp, Homo sapiens
tgagccgacacagtg

SEQ ID NO: 233250 - DNA, 15 bp, Homo sapiens
gtgagccgacacagt

SEQ ID NO: 233251 - DNA, 15 bp, Homo sapiens
agtgagccgacacag

SEQ ID NO: 233252 - DNA, 15 bp, Homo sapiens
cagtgagccgacaca

SEQ ID NO: 233253 - DNA, 15 bp, Homo sapiens
gcagtgagccgacac

SEQ ID NO: 233254 - DNA, 15 bp, Homo sapiens
tgcagtgagccgaca

SEQ ID NO: 233255 - DNA, 15 bp, Homo sapiens
ttgcagtgagccgac

SEQ ID NO: 233256 - DNA, 15 bp, Homo sapiens
aggagatggaggttg

SEQ ID NO: 233257 - DNA, 15 bp, Homo sapiens
caggagatggaggtt

SEQ ID NO: 233258 - DNA, 15 bp, Homo sapiens
ccaggagatggaggt

SEQ ID NO: 233259 - DNA, 15 bp, Homo sapiens
cccaggagatggagg

SEQ ID NO: 233260 - DNA, 15 bp, Homo sapiens
acccaggagatggag

SEQ ID NO: 233261 - DNA, 15 bp, Homo sapiens
aacccaggagatgga

SEQ ID NO: 233262 - DNA, 15 bp, Homo sapiens
gaacccaggagatgg

SEQ ID NO: 233263 - DNA, 15 bp, Homo sapiens
tgaacccaggagatg

SEQ ID NO: 233264 - DNA, 15 bp, Homo sapiens
ttgaacccaggagat

SEQ ID NO: 233265 - DNA, 15 bp, Homo sapiens
cttgaacccaggaga

SEQ ID NO: 233266 - DNA, 15 bp, Homo sapiens
ccaggagaattgctt

SEQ ID NO: 233267 - DNA, 15 bp, Homo sapiens
gccaggagaattgct

SEQ ID NO: 233268 - DNA, 15 bp, Homo sapiens
ggccaggagaattgc

SEQ ID NO: 233269 - DNA, 15 bp, Homo sapiens
gggccaggagaattg

SEQ ID NO: 233270 - DNA, 15 bp, Homo sapiens
tgggccaggagaatt

SEQ ID NO: 233271 - DNA, 15 bp, Homo sapiens
ctgggccaggagaat

SEQ ID NO: 233272 - DNA, 15 bp, Homo sapiens
actgggccaggagaa

SEQ ID NO: 233273 - DNA, 15 bp, Homo sapiens
gactgggccaggaga

SEQ ID NO: 233274 - DNA, 15 bp, Homo sapiens
agactgggccaggag

SEQ ID NO: 233275 - DNA, 15 bp, Homo sapiens
gagactgggccagga

SEQ ID NO: 233276 - DNA, 15 bp, Homo sapiens
ggagactgggccagg

SEQ ID NO: 233277 - DNA, 15 bp, Homo sapiens
aggagactgggccag

SEQ ID NO: 233278 - DNA, 15 bp, Homo sapiens
caggagactgggcca

SEQ ID NO: 233279 - DNA, 15 bp, Homo sapiens
tcaggagactgggcc

SEQ ID NO: 233280 - DNA, 15 bp, Homo sapiens
ctcaggagactgggc

SEQ ID NO: 233281 - DNA, 15 bp, Homo sapiens
actcaggagactggg

SEQ ID NO: 233282 - DNA, 15 bp, Homo sapiens
tactcaggagactgg

SEQ ID NO: 233283 - DNA, 15 bp, Homo sapiens
ctggtgggtgcctgt

SEQ ID NO: 233284 - DNA, 15 bp, Homo sapiens
gctggtgggtgcctg

SEQ ID NO: 233285 - DNA, 15 bp, Homo sapiens
tgctggtgggtgcct

SEQ ID NO: 233286 - DNA, 15 bp, Homo sapiens
gtgctggtgggtgcc

SEQ ID NO: 233287 - DNA, 15 bp, Homo sapiens
tgtgctggtgggtgc

SEQ ID NO: 233288 - DNA, 15 bp, Homo sapiens
gtgtgctggtgggtg

SEQ ID NO: 233289 - DNA, 15 bp, Homo sapiens
ggtgtgctggtgggt

SEQ ID NO: 233290 - DNA, 15 bp, Homo sapiens
aggtgtgctggtggg

SEQ ID NO: 233291 - DNA, 15 bp, Homo sapiens
caggtgtgctggtgg

SEQ ID NO: 233292 - DNA, 15 bp, Homo sapiens
ccaggtgtgctggtg

SEQ ID NO: 233293 - DNA, 15 bp, Homo sapiens
gccaggtgtgctggt

SEQ ID NO: 233294 - DNA, 15 bp, Homo sapiens
agccaggtgtgctgg

SEQ ID NO: 233295 - DNA, 15 bp, Homo sapiens
tagccaggtgtgctg

SEQ ID NO: 233296 - DNA, 15 bp, Homo sapiens
ctagccaggtgtgct

SEQ ID NO: 233297 - DNA, 15 bp, Homo sapiens
actagccaggtgtgc

SEQ ID NO: 233298 - DNA, 15 bp, Homo sapiens
aactagccaggtgtg

SEQ ID NO: 233299 - DNA, 15 bp, Homo sapiens
aaactagccaggtgt

SEQ ID NO: 233300 - DNA, 15 bp, Homo sapiens
aaaactagccaggtg

SEQ ID NO: 233301 - DNA, 15 bp, Homo sapiens
aaaaactagccaggt

SEQ ID NO: 233302 - DNA, 15 bp, Homo sapiens
taaaaactagccagg

SEQ ID NO: 233303 - DNA, 15 bp, Homo sapiens
ataaaaactagccag

SEQ ID NO: 233304 - DNA, 15 bp, Homo sapiens
tataaaaactagcca

SEQ ID NO: 233305 - DNA, 15 bp, Homo sapiens
atataaaaactagcc

SEQ ID NO: 233306 - DNA, 15 bp, Homo sapiens
aatataaaaactagc

SEQ ID NO: 233307 - DNA, 15 bp, Homo sapiens
aaatataaaaactag

SEQ ID NO: 233308 - DNA, 15 bp, Homo sapiens
aaaatataaaaacta

SEQ ID NO: 233309 - DNA, 15 bp, Homo sapiens
aaaaatataaaaact

SEQ ID NO: 233310 - DNA, 15 bp, Homo sapiens
taaaaatataaaaac

SEQ ID NO: 233311 - DNA, 15 bp, Homo sapiens
cgaaaccccatctct

SEQ ID NO: 233312 - DNA, 15 bp, Homo sapiens
gcgaaaccccatctc

SEQ ID NO: 233313 - DNA, 15 bp, Homo sapiens
ggcgaaaccccatct

SEQ ID NO: 233314 - DNA, 15 bp, Homo sapiens
tggcgaaaccccatc

SEQ ID NO: 233315 - DNA, 15 bp, Homo sapiens
atggcgaaaccccat

SEQ ID NO: 233316 - DNA, 15 bp, Homo sapiens
catggcgaaacccca

SEQ ID NO: 233317 - DNA, 15 bp, Homo sapiens
ggagaccagcctggc

SEQ ID NO: 233318 - DNA, 15 bp, Homo sapiens
tggagaccagcctgg

SEQ ID NO: 233319 - DNA, 15 bp, Homo sapiens
ttggagaccagcctg

SEQ ID NO: 233320 - DNA, 15 bp, Homo sapiens
gttggagaccagcct

SEQ ID NO: 233321 - DNA, 15 bp, Homo sapiens
agttggagaccagcc

SEQ ID NO: 233322 - DNA, 15 bp, Homo sapiens
gagttggagaccagc

SEQ ID NO: 233323 - DNA, 15 bp, Homo sapiens
ggagttggagaccag

SEQ ID NO: 233324 - DNA, 15 bp, Homo sapiens
aggagttggagacca

SEQ ID NO: 233325 - DNA, 15 bp, Homo sapiens
caggagttggagacc

SEQ ID NO: 233326 - DNA, 15 bp, Homo sapiens
tcaggagttggagac

SEQ ID NO: 233327 - DNA, 15 bp, Homo sapiens
gtcaggagttggaga

SEQ ID NO: 233328 - DNA, 15 bp, Homo sapiens
ggtcaggagttggag

SEQ ID NO: 233329 - DNA, 15 bp, Homo sapiens
aggtcaggagttgga

SEQ ID NO: 233330 - DNA, 15 bp, Homo sapiens
gaggtcaggagttgg

SEQ ID NO: 233331 - DNA, 15 bp, Homo sapiens
tgaggtcaggagttg

SEQ ID NO: 233332 - DNA, 15 bp, Homo sapiens
agctcatgcctgtaa

SEQ ID NO: 233333 - DNA, 15 bp, Homo sapiens
cagctcatgcctgta

SEQ ID NO: 233334 - DNA, 15 bp, Homo sapiens
gcagctcatgcctgt

SEQ ID NO: 233335 - DNA, 15 bp, Homo sapiens
ggcagctcatgcctg

SEQ ID NO: 233336 - DNA, 15 bp, Homo sapiens
tggcagctcatgcct

SEQ ID NO: 233337 - DNA, 15 bp, Homo sapiens
gtggcagctcatgcc

SEQ ID NO: 233338 - DNA, 15 bp, Homo sapiens
tgtggcagctcatgc

SEQ ID NO: 233339 - DNA, 15 bp, Homo sapiens
gtgtggcagctcatg

SEQ ID NO: 233340 - DNA, 15 bp, Homo sapiens
ggtgtggcagctcat

SEQ ID NO: 233341 - DNA, 15 bp, Homo sapiens
aggtgtggcagctca

SEQ ID NO: 233342 - DNA, 15 bp, Homo sapiens
caggtgtggcagctc

SEQ ID NO: 233343 - DNA, 15 bp, Homo sapiens
ccaggtgtggcagct

SEQ ID NO: 233344 - DNA, 15 bp, Homo sapiens
gccaggtgtggcagc

SEQ ID NO: 233345 - DNA, 15 bp, Homo sapiens
ggccaggtgtggcag

SEQ ID NO: 233346 - DNA, 15 bp, Homo sapiens
aggccaggtgtggca

SEQ ID NO: 233347 - DNA, 15 bp, Homo sapiens
gaggccaggtgtggc

SEQ ID NO: 233348 - DNA, 15 bp, Homo sapiens
agaggccaggtgtgg

SEQ ID NO: 233349 - DNA, 15 bp, Homo sapiens
tagaggccaggtgtg

SEQ ID NO: 233350 - DNA, 15 bp, Homo sapiens
ttagaggccaggtgt

SEQ ID NO: 233351 - DNA, 15 bp, Homo sapiens
attagaggccaggtg

SEQ ID NO: 233352 - DNA, 15 bp, Homo sapiens
aattagaggccaggt

SEQ ID NO: 233353 - DNA, 15 bp, Homo sapiens
gaattagaggccagg

SEQ ID NO: 233354 - DNA, 15 bp, Homo sapiens
tgaattagaggccag

SEQ ID NO: 233355 - DNA, 15 bp, Homo sapiens
gtgaattagaggcca

SEQ ID NO: 233356 - DNA, 15 bp, Homo sapiens
agtgaattagaggcc

SEQ ID NO: 233357 - DNA, 15 bp, Homo sapiens
aagtgaattagaggc

SEQ ID NO: 233358 - DNA, 15 bp, Homo sapiens
taagtgaattagagg

SEQ ID NO: 233359 - DNA, 15 bp, Homo sapiens
cataagtgaattaga

SEQ ID NO: 233360 - DNA, 15 bp, Homo sapiens
acataagtgaattag

SEQ ID NO: 233361 - DNA, 15 bp, Homo sapiens
aacataagtgaatta

SEQ ID NO: 233362 - DNA, 15 bp, Homo sapiens
gaacataagtgaatt

SEQ ID NO: 233363 - DNA, 15 bp, Homo sapiens
agaacataagtgaat

SEQ ID NO: 233364 - DNA, 15 bp, Homo sapiens
aagaacataagtgaa

SEQ ID NO: 233365 - DNA, 15 bp, Homo sapiens
aaagaacataagtga

SEQ ID NO: 233366 - DNA, 15 bp, Homo sapiens
taaagaacataagtg

SEQ ID NO: 233367 - DNA, 15 bp, Homo sapiens
ataaagaacataagt

SEQ ID NO: 233368 - DNA, 15 bp, Homo sapiens
aataaagaacataag

SEQ ID NO: 233369 - DNA, 15 bp, Homo sapiens
aaataaagaacataa

SEQ ID NO: 233370 - DNA, 15 bp, Homo sapiens
taaataaagaacata

SEQ ID NO: 233371 - DNA, 15 bp, Homo sapiens
ataaataaagaacat

SEQ ID NO: 233372 - DNA, 15 bp, Homo sapiens
gataaataaagaaca

SEQ ID NO: 233373 - DNA, 15 bp, Homo sapiens
agataaataaagaac

SEQ ID NO: 233374 - DNA, 15 bp, Homo sapiens
aagataaataaagaa

SEQ ID NO: 233375 - DNA, 15 bp, Homo sapiens
caagataaataaaga

SEQ ID NO: 233376 - DNA, 15 bp, Homo sapiens
acaagataaataaag

SEQ ID NO: 233377 - DNA, 15 bp, Homo sapiens
tacaagataaataaa

SEQ ID NO: 233378 - DNA, 15 bp, Homo sapiens
gtacaagataaataa

SEQ ID NO: 233379 - DNA, 15 bp, Homo sapiens
agtacaagataaata

SEQ ID NO: 233380 - DNA, 15 bp, Homo sapiens
cagtacaagataaat

SEQ ID NO: 233381 - DNA, 15 bp, Homo sapiens
ccagtacaagataaa

SEQ ID NO: 233382 - DNA, 15 bp, Homo sapiens
accagtacaagataa

SEQ ID NO: 233383 - DNA, 15 bp, Homo sapiens
taccagtacaagata

SEQ ID NO: 233384 - DNA, 15 bp, Homo sapiens
ataccagtacaagat

SEQ ID NO: 233385 - DNA, 15 bp, Homo sapiens
tataccagtacaaga

SEQ ID NO: 233386 - DNA, 15 bp, Homo sapiens
atataccagtacaag

SEQ ID NO: 233387 - DNA, 15 bp, Homo sapiens
aatataccagtacaa

SEQ ID NO: 233388 - DNA, 15 bp, Homo sapiens
gaatataccagtaca

SEQ ID NO: 233389 - DNA, 15 bp, Homo sapiens
tgaatataccagtac

SEQ ID NO: 233390 - DNA, 15 bp, Homo sapiens
ctgaatataccagta

SEQ ID NO: 233391 - DNA, 15 bp, Homo sapiens
gctgaatataccagt

SEQ ID NO: 233392 - DNA, 15 bp, Homo sapiens
ggctgaatataccag

SEQ ID NO: 233393 - DNA, 15 bp, Homo sapiens
aggctgaatatacca

SEQ ID NO: 233394 - DNA, 15 bp, Homo sapiens
taggctgaatatacc

SEQ ID NO: 233395 - DNA, 15 bp, Homo sapiens
ataggctgaatatac

SEQ ID NO: 233396 - DNA, 15 bp, Homo sapiens
gataggctgaatata

SEQ ID NO: 233397 - DNA, 15 bp, Homo sapiens
agataggctgaatat

SEQ ID NO: 233398 - DNA, 15 bp, Homo sapiens
tagataggctgaata

SEQ ID NO: 233399 - DNA, 15 bp, Homo sapiens
gtagataggctgaat

SEQ ID NO: 233400 - DNA, 15 bp, Homo sapiens
ggtagataggctgaa

SEQ ID NO: 233401 - DNA, 15 bp, Homo sapiens
tggtagataggctga

SEQ ID NO: 233402 - DNA, 15 bp, Homo sapiens
ctggtagataggctg

SEQ ID NO: 233403 - DNA, 15 bp, Homo sapiens
actggtagataggct

SEQ ID NO: 233404 - DNA, 15 bp, Homo sapiens
aactggtagataggc

SEQ ID NO: 233405 - DNA, 15 bp, Homo sapiens
caactggtagatagg

SEQ ID NO: 233406 - DNA, 15 bp, Homo sapiens
acaactggtagatag

SEQ ID NO: 233407 - DNA, 15 bp, Homo sapiens
cacaactggtagata

SEQ ID NO: 233408 - DNA, 15 bp, Homo sapiens
tcacaactggtagat

SEQ ID NO: 233409 - DNA, 15 bp, Homo sapiens
atcacaactggtaga

SEQ ID NO: 233410 - DNA, 15 bp, Homo sapiens
catcacaactggtag

SEQ ID NO: 233411 - DNA, 15 bp, Homo sapiens
acatcacaactggta

SEQ ID NO: 233412 - DNA, 15 bp, Homo sapiens
aacatcacaactggt

SEQ ID NO: 233413 - DNA, 15 bp, Homo sapiens
aaacatcacaactgg

SEQ ID NO: 233414 - DNA, 15 bp, Homo sapiens
aaaacatcacaactg

SEQ ID NO: 233415 - DNA, 15 bp, Homo sapiens
gaaaacatcacaact

SEQ ID NO: 233416 - DNA, 15 bp, Homo sapiens
agaaaacatcacaac

SEQ ID NO: 233417 - DNA, 15 bp, Homo sapiens
gagaaaacatcacaa

SEQ ID NO: 233418 - DNA, 15 bp, Homo sapiens
agagaaaacatcaca

SEQ ID NO: 233419 - DNA, 15 bp, Homo sapiens
aagagaaaacatcac

SEQ ID NO: 233420 - DNA, 15 bp, Homo sapiens
gaagagaaaacatca

SEQ ID NO: 233421 - DNA, 15 bp, Homo sapiens
agaagagaaaacatc

SEQ ID NO: 233422 - DNA, 15 bp, Homo sapiens
aagaagagaaaacat

SEQ ID NO: 233423 - DNA, 15 bp, Homo sapiens
gaagaagagaaaaca

SEQ ID NO: 233424 - DNA, 15 bp, Homo sapiens
ggaagaagagaaaac

SEQ ID NO: 233425 - DNA, 15 bp, Homo sapiens
aggaagaagagaaaa

SEQ ID NO: 233426 - DNA, 15 bp, Homo sapiens
aaggaagaagagaaa

SEQ ID NO: 233427 - DNA, 15 bp, Homo sapiens
gaaggaagaagagaa

SEQ ID NO: 233428 - DNA, 15 bp, Homo sapiens
tgaaggaagaagaga

SEQ ID NO: 233429 - DNA, 15 bp, Homo sapiens
ctgaaggaagaagag

SEQ ID NO: 233430 - DNA, 15 bp, Homo sapiens
actgaaggaagaaga

SEQ ID NO: 233431 - DNA, 15 bp, Homo sapiens
aactgaaggaagaag

SEQ ID NO: 233432 - DNA, 15 bp, Homo sapiens
gaactgaaggaagaa

SEQ ID NO: 233433 - DNA, 15 bp, Homo sapiens
tgaactgaaggaaga

SEQ ID NO: 233434 - DNA, 15 bp, Homo sapiens
ctgaactgaaggaag

SEQ ID NO: 233435 - DNA, 15 bp, Homo sapiens
gctgaactgaaggaa

SEQ ID NO: 233436 - DNA, 15 bp, Homo sapiens
agctgaactgaagga

SEQ ID NO: 233437 - DNA, 15 bp, Homo sapiens
cagctgaactgaagg

SEQ ID NO: 233438 - DNA, 15 bp, Homo sapiens
gcagctgaactgaag

SEQ ID NO: 233439 - DNA, 15 bp, Homo sapiens
ggcagctgaactgaa

SEQ ID NO: 233440 - DNA, 15 bp, Homo sapiens
tggcagctgaactga

SEQ ID NO: 233441 - DNA, 15 bp, Homo sapiens
ttggcagctgaactg

SEQ ID NO: 233442 - DNA, 15 bp, Homo sapiens
cttggcagctgaact

SEQ ID NO: 233443 - DNA, 15 bp, Homo sapiens
tcttggcagctgaac

SEQ ID NO: 233444 - DNA, 15 bp, Homo sapiens
ctcttggcagctgaa

SEQ ID NO: 233445 - DNA, 15 bp, Homo sapiens
tctcttggcagctga

SEQ ID NO: 233446 - DNA, 15 bp, Homo sapiens
atctcttggcagctg

SEQ ID NO: 233447 - DNA, 15 bp, Homo sapiens
aatctcttggcagct

SEQ ID NO: 233448 - DNA, 15 bp, Homo sapiens
aaatctcttggcagc

SEQ ID NO: 233449 - DNA, 15 bp, Homo sapiens
gaaatctcttggcag

SEQ ID NO: 233450 - DNA, 15 bp, Homo sapiens
agaaatctcttggca

SEQ ID NO: 233451 - DNA, 15 bp, Homo sapiens
cagaaatctcttggc

SEQ ID NO: 233452 - DNA, 15 bp, Homo sapiens
tcagaaatctcttgg

SEQ ID NO: 233453 - DNA, 15 bp, Homo sapiens
ttcagaaatctcttg

SEQ ID NO: 233454 - DNA, 15 bp, Homo sapiens
cttcagaaatctctt

SEQ ID NO: 233455 - DNA, 15 bp, Homo sapiens
acttcagaaatctct

SEQ ID NO: 233456 - DNA, 15 bp, Homo sapiens
aacttcagaaatctc

SEQ ID NO: 233457 - DNA, 15 bp, Homo sapiens
aaacttcagaaatct

SEQ ID NO: 233458 - DNA, 15 bp, Homo sapiens
gaaacttcagaaatc

SEQ ID NO: 233459 - DNA, 15 bp, Homo sapiens
ggaaacttcagaaat

SEQ ID NO: 233460 - DNA, 15 bp, Homo sapiens
aggaaacttcagaaa

SEQ ID NO: 233461 - DNA, 15 bp, Homo sapiens
caggaaacttcagaa

SEQ ID NO: 233462 - DNA, 15 bp, Homo sapiens
acaggaaacttcaga

SEQ ID NO: 233463 - DNA, 15 bp, Homo sapiens
tacaggaaacttcag

SEQ ID NO: 233464 - DNA, 15 bp, Homo sapiens
ctacaggaaacttca

SEQ ID NO: 233465 - DNA, 15 bp, Homo sapiens
tctacaggaaacttc

SEQ ID NO: 233466 - DNA, 15 bp, Homo sapiens
gtctacaggaaactt

SEQ ID NO: 233467 - DNA, 15 bp, Homo sapiens
agtctacaggaaact

SEQ ID NO: 233468 - DNA, 15 bp, Homo sapiens
aagtctacaggaaac

SEQ ID NO: 233469 - DNA, 15 bp, Homo sapiens
gaagtctacaggaaa

SEQ ID NO: 233470 - DNA, 15 bp, Homo sapiens
ggaagtctacaggaa

SEQ ID NO: 233471 - DNA, 15 bp, Homo sapiens
tggaagtctacagga

SEQ ID NO: 233472 - DNA, 15 bp, Homo sapiens
gtggaagtctacagg

SEQ ID NO: 233473 - DNA, 15 bp, Homo sapiens
ggtggaagtctacag

SEQ ID NO: 233474 - DNA, 15 bp, Homo sapiens
tggtggaagtctaca

SEQ ID NO: 233475 - DNA, 15 bp, Homo sapiens
gtggtggaagtctac

SEQ ID NO: 233476 - DNA, 15 bp, Homo sapiens
agtggtggaagtcta

SEQ ID NO: 233477 - DNA, 15 bp, Homo sapiens
aagtggtggaagtct

SEQ ID NO: 233478 - DNA, 15 bp, Homo sapiens
taagtggtggaagtc

SEQ ID NO: 233479 - DNA, 15 bp, Homo sapiens
ttaagtggtggaagt

SEQ ID NO: 233480 - DNA, 15 bp, Homo sapiens
cttaagtggtggaag

SEQ ID NO: 233481 - DNA, 15 bp, Homo sapiens
gcttaagtggtggaa

SEQ ID NO: 233482 - DNA, 15 bp, Homo sapiens
tgcttaagtggtgga

SEQ ID NO: 233483 - DNA, 15 bp, Homo sapiens
ctgcttaagtggtgg

SEQ ID NO: 233484 - DNA, 15 bp, Homo sapiens
gctgcttaagtggtg

SEQ ID NO: 233485 - DNA, 15 bp, Homo sapiens
tgctgcttaagtggt

SEQ ID NO: 233486 - DNA, 15 bp, Homo sapiens
gtgctgcttaagtgg

SEQ ID NO: 233487 - DNA, 15 bp, Homo sapiens
tgtgctgcttaagtg

SEQ ID NO: 233488 - DNA, 15 bp, Homo sapiens
ttgtgctgcttaagt

SEQ ID NO: 233489 - DNA, 15 bp, Homo sapiens
gttgtgctgcttaag

SEQ ID NO: 233490 - DNA, 15 bp, Homo sapiens
agttgtgctgcttaa

SEQ ID NO: 233491 - DNA, 15 bp, Homo sapiens
aagttgtgctgctta

SEQ ID NO: 233492 - DNA, 15 bp, Homo sapiens
caagttgtgctgctt

SEQ ID NO: 233493 - DNA, 15 bp, Homo sapiens
acaagttgtgctgct

SEQ ID NO: 233494 - DNA, 15 bp, Homo sapiens
tacaagttgtgctgc

SEQ ID NO: 233495 - DNA, 15 bp, Homo sapiens
ctacaagttgtgctg

SEQ ID NO: 233496 - DNA, 15 bp, Homo sapiens
actacaagttgtgct

SEQ ID NO: 233497 - DNA, 15 bp, Homo sapiens
aactacaagttgtgc

SEQ ID NO: 233498 - DNA, 15 bp, Homo sapiens
gaactacaagttgtg

SEQ ID NO: 233499 - DNA, 15 bp, Homo sapiens
agaactacaagttgt

SEQ ID NO: 233500 - DNA, 15 bp, Homo sapiens
cagaactacaagttg

SEQ ID NO: 233501 - DNA, 15 bp, Homo sapiens
gcagaactacaagtt

SEQ ID NO: 233502 - DNA, 15 bp, Homo sapiens
cgcagaactacaagt

SEQ ID NO: 233503 - DNA, 15 bp, Homo sapiens
ccgcagaactacaag

SEQ ID NO: 233504 - DNA, 15 bp, Homo sapiens
accgcagaactacaa

SEQ ID NO: 233505 - DNA, 15 bp, Homo sapiens
aaccgcagaactaca

SEQ ID NO: 233506 - DNA, 15 bp, Homo sapiens
caaccgcagaactac

SEQ ID NO: 233507 - DNA, 15 bp, Homo sapiens
gcaaccgcagaacta

SEQ ID NO: 233508 - DNA, 15 bp, Homo sapiens
agcaaccgcagaact

SEQ ID NO: 233509 - DNA, 15 bp, Homo sapiens
tagcaaccgcagaac

SEQ ID NO: 233510 - DNA, 15 bp, Homo sapiens
ttagcaaccgcagaa

SEQ ID NO: 233511 - DNA, 15 bp, Homo sapiens
tttagcaaccgcaga

SEQ ID NO: 233512 - DNA, 15 bp, Homo sapiens
atttagcaaccgcag

SEQ ID NO: 233513 - DNA, 15 bp, Homo sapiens
tatttagcaaccgca

SEQ ID NO: 233514 - DNA, 15 bp, Homo sapiens
atatttagcaaccgc

SEQ ID NO: 233515 - DNA, 15 bp, Homo sapiens
gatatttagcaaccg

SEQ ID NO: 233516 - DNA, 15 bp, Homo sapiens
tgatatttagcaacc

SEQ ID NO: 233517 - DNA, 15 bp, Homo sapiens
ttgatatttagcaac

SEQ ID NO: 233518 - DNA, 15 bp, Homo sapiens
attgatatttagcaa

SEQ ID NO: 233519 - DNA, 15 bp, Homo sapiens
cattgatatttagca

SEQ ID NO: 233520 - DNA, 15 bp, Homo sapiens
acattgatatttagc

SEQ ID NO: 233521 - DNA, 15 bp, Homo sapiens
gacattgatatttag

SEQ ID NO: 233522 - DNA, 15 bp, Homo sapiens
agacattgatattta

SEQ ID NO: 233523 - DNA, 15 bp, Homo sapiens
tagacattgatattt

SEQ ID NO: 233524 - DNA, 15 bp, Homo sapiens
ctagacattgatatt

SEQ ID NO: 233525 - DNA, 15 bp, Homo sapiens
tctagacattgatat

SEQ ID NO: 233526 - DNA, 15 bp, Homo sapiens
ttctagacattgata

SEQ ID NO: 233527 - DNA, 15 bp, Homo sapiens
attctagacattgat

SEQ ID NO: 233528 - DNA, 15 bp, Homo sapiens
aattctagacattga

SEQ ID NO: 233529 - DNA, 15 bp, Homo sapiens
aaattctagacattg

SEQ ID NO: 233530 - DNA, 15 bp, Homo sapiens
aaaattctagacatt

SEQ ID NO: 233531 - DNA, 15 bp, Homo sapiens
aaaaattctagacat

SEQ ID NO: 233532 - DNA, 15 bp, Homo sapiens
aaaaaattctagaca

SEQ ID NO: 233533 - DNA, 15 bp, Homo sapiens
aaaaaaattctagac

SEQ ID NO: 233534 - DNA, 15 bp, Homo sapiens
caaaaaaattctaga

SEQ ID NO: 233535 - DNA, 15 bp, Homo sapiens
tcaaaaaaattctag

SEQ ID NO: 233536 - DNA, 15 bp, Homo sapiens
ttcaaaaaaattcta

SEQ ID NO: 233537 - DNA, 15 bp, Homo sapiens
tttcaaaaaaattct

SEQ ID NO: 233538 - DNA, 15 bp, Homo sapiens
atttcaaaaaaattc

SEQ ID NO: 233539 - DNA, 15 bp, Homo sapiens
aatttcaaaaaaatt

SEQ ID NO: 233540 - DNA, 15 bp, Homo sapiens
aaatttcaaaaaaat

SEQ ID NO: 233541 - DNA, 15 bp, Homo sapiens
taaatttcaaaaaaa

SEQ ID NO: 233542 - DNA, 15 bp, Homo sapiens
ctaaatttcaaaaaa

SEQ ID NO: 233543 - DNA, 15 bp, Homo sapiens
tctaaatttcaaaaa

SEQ ID NO: 233544 - DNA, 15 bp, Homo sapiens
ctctaaatttcaaaa

SEQ ID NO: 233545 - DNA, 15 bp, Homo sapiens
tctctaaatttcaaa

SEQ ID NO: 233546 - DNA, 15 bp, Homo sapiens
ctctctaaatttcaa

SEQ ID NO: 233547 - DNA, 15 bp, Homo sapiens
tctctctaaatttca

SEQ ID NO: 233548 - DNA, 15 bp, Homo sapiens
gtctctctaaatttc

SEQ ID NO: 233549 - DNA, 15 bp, Homo sapiens
tgtctctctaaattt

SEQ ID NO: 233550 - DNA, 15 bp, Homo sapiens
ttgtctctctaaatt

SEQ ID NO: 233551 - DNA, 15 bp, Homo sapiens
tttgtctctctaaat

SEQ ID NO: 233552 - DNA, 15 bp, Homo sapiens
gtttgtctctctaaa

SEQ ID NO: 233553 - DNA, 15 bp, Homo sapiens
tgtttgtctctctaa

SEQ ID NO: 233554 - DNA, 15 bp, Homo sapiens
atgtttgtctctcta

SEQ ID NO: 233555 - DNA, 15 bp, Homo sapiens
tatgtttgtctctct

SEQ ID NO: 233556 - DNA, 15 bp, Homo sapiens
atatgtttgtctctc

SEQ ID NO: 233557 - DNA, 15 bp, Homo sapiens
catatgtttgtctct

SEQ ID NO: 233558 - DNA, 15 bp, Homo sapiens
acatatgtttgtctc

SEQ ID NO: 233559 - DNA, 15 bp, Homo sapiens
cacatatgtttgtct

SEQ ID NO: 233560 - DNA, 15 bp, Homo sapiens
acacatatgtttgtc

SEQ ID NO: 233561 - DNA, 15 bp, Homo sapiens
aacacatatgtttgt

SEQ ID NO: 233562 - DNA, 15 bp, Homo sapiens
gaacacatatgtttg

SEQ ID NO: 233563 - DNA, 15 bp, Homo sapiens
agaacacatatgttt

SEQ ID NO: 233564 - DNA, 15 bp, Homo sapiens
cagaacacatatgtt

SEQ ID NO: 233565 - DNA, 15 bp, Homo sapiens
acagaacacatatgt

SEQ ID NO: 233566 - DNA, 15 bp, Homo sapiens
gacagaacacatatg

SEQ ID NO: 233567 - DNA, 15 bp, Homo sapiens
tgacagaacacatat

SEQ ID NO: 233568 - DNA, 15 bp, Homo sapiens
gtgacagaacacata

SEQ ID NO: 233569 - DNA, 15 bp, Homo sapiens
ggtgacagaacacat

SEQ ID NO: 233570 - DNA, 15 bp, Homo sapiens
aggtgacagaacaca

SEQ ID NO: 233571 - DNA, 15 bp, Homo sapiens
aaggtgacagaacac

SEQ ID NO: 233572 - DNA, 15 bp, Homo sapiens
aaaggtgacagaaca

SEQ ID NO: 233573 - DNA, 15 bp, Homo sapiens
caaaggtgacagaac

SEQ ID NO: 233574 - DNA, 15 bp, Homo sapiens
tcaaaggtgacagaa

SEQ ID NO: 233575 - DNA, 15 bp, Homo sapiens
gtcaaaggtgacaga

SEQ ID NO: 233576 - DNA, 15 bp, Homo sapiens
agtcaaaggtgacag

SEQ ID NO: 233577 - DNA, 15 bp, Homo sapiens
aagtcaaaggtgaca

SEQ ID NO: 233578 - DNA, 15 bp, Homo sapiens
caagtcaaaggtgac

SEQ ID NO: 233579 - DNA, 15 bp, Homo sapiens
ccaagtcaaaggtga

SEQ ID NO: 233580 - DNA, 15 bp, Homo sapiens
gccaagtcaaaggtg

SEQ ID NO: 233581 - DNA, 15 bp, Homo sapiens
agccaagtcaaaggt

SEQ ID NO: 233582 - DNA, 15 bp, Homo sapiens
aagccaagtcaaagg

SEQ ID NO: 233583 - DNA, 15 bp, Homo sapiens
aaagccaagtcaaag

SEQ ID NO: 233584 - DNA, 15 bp, Homo sapiens
aaaagccaagtcaaa

SEQ ID NO: 233585 - DNA, 15 bp, Homo sapiens
taaaagccaagtcaa

SEQ ID NO: 233586 - DNA, 15 bp, Homo sapiens
ataaaagccaagtca

SEQ ID NO: 233587 - DNA, 15 bp, Homo sapiens
tataaaagccaagtc

SEQ ID NO: 233588 - DNA, 15 bp, Homo sapiens
atataaaagccaagt

SEQ ID NO: 233589 - DNA, 15 bp, Homo sapiens
tatataaaagccaag

SEQ ID NO: 233590 - DNA, 15 bp, Homo sapiens
ttatataaaagccaa

SEQ ID NO: 233591 - DNA, 15 bp, Homo sapiens
attatataaaagcca

SEQ ID NO: 233592 - DNA, 15 bp, Homo sapiens
tattatataaaagcc

SEQ ID NO: 233593 - DNA, 15 bp, Homo sapiens
atattatataaaagc

SEQ ID NO: 233594 - DNA, 15 bp, Homo sapiens
aatattatataaaag

SEQ ID NO: 233595 - DNA, 15 bp, Homo sapiens
aaatattatataaaa

SEQ ID NO: 233596 - DNA, 15 bp, Homo sapiens
taaatattatataaa

SEQ ID NO: 233597 - DNA, 15 bp, Homo sapiens
ttaaatattatataa

SEQ ID NO: 233598 - DNA, 15 bp, Homo sapiens
tttaaatattatata

SEQ ID NO: 233599 - DNA, 15 bp, Homo sapiens
atttaaatattatat

SEQ ID NO: 233600 - DNA, 15 bp, Homo sapiens
tatttaaatattata

SEQ ID NO: 233601 - DNA, 15 bp, Homo sapiens
ttatttaaatattat

SEQ ID NO: 233602 - DNA, 15 bp, Homo sapiens
tttatttaaatatta

SEQ ID NO: 233603 - DNA, 15 bp, Homo sapiens
ctttatttaaatatt

SEQ ID NO: 233604 - DNA, 15 bp, Homo sapiens
gctttatttaaatat

SEQ ID NO: 233605 - DNA, 15 bp, Homo sapiens
tgctttatttaaata

SEQ ID NO: 233606 - DNA, 15 bp, Homo sapiens
ctgctttatttaaat

SEQ ID NO: 233607 - DNA, 15 bp, Homo sapiens
cctgctttatttaaa

SEQ ID NO: 233608 - DNA, 15 bp, Homo sapiens
gcctgctttatttaa

SEQ ID NO: 233609 - DNA, 15 bp, Homo sapiens
tgcctgctttattta

SEQ ID NO: 233610 - DNA, 15 bp, Homo sapiens
ctgcctgctttattt

SEQ ID NO: 233611 - DNA, 15 bp, Homo sapiens
tctgcctgctttatt

SEQ ID NO: 233612 - DNA, 15 bp, Homo sapiens
gtctgcctgctttat

SEQ ID NO: 233613 - DNA, 15 bp, Homo sapiens
ggtctgcctgcttta

SEQ ID NO: 233614 - DNA, 15 bp, Homo sapiens
tggtctgcctgcttt

SEQ ID NO: 233615 - DNA, 15 bp, Homo sapiens
ttggtctgcctgctt

SEQ ID NO: 233616 - DNA, 15 bp, Homo sapiens
attggtctgcctgct

SEQ ID NO: 233617 - DNA, 15 bp, Homo sapiens
aattggtctgcctgc

SEQ ID NO: 233618 - DNA, 15 bp, Homo sapiens
aaattggtctgcctg

SEQ ID NO: 233619 - DNA, 15 bp, Homo sapiens
taaattggtctgcct

SEQ ID NO: 233620 - DNA, 15 bp, Homo sapiens
gtaaattggtctgcc

SEQ ID NO: 233621 - DNA, 15 bp, Homo sapiens
tgtaaattggtctgc

SEQ ID NO: 233622 - DNA, 15 bp, Homo sapiens
gtgtaaattggtctg

SEQ ID NO: 233623 - DNA, 15 bp, Homo sapiens
agtgtaaattggtct

SEQ ID NO: 233624 - DNA, 15 bp, Homo sapiens
cagtgtaaattggtc

SEQ ID NO: 233625 - DNA, 15 bp, Homo sapiens
tcagtgtaaattggt

SEQ ID NO: 233626 - DNA, 15 bp, Homo sapiens
ctcagtgtaaattgg

SEQ ID NO: 233627 - DNA, 15 bp, Homo sapiens
cctcagtgtaaattg

SEQ ID NO: 233628 - DNA, 15 bp, Homo sapiens
tcctcagtgtaaatt

SEQ ID NO: 233629 - DNA, 15 bp, Homo sapiens
atcctcagtgtaaat

SEQ ID NO: 233630 - DNA, 15 bp, Homo sapiens
catcctcagtgtaaa

SEQ ID NO: 233631 - DNA, 15 bp, Homo sapiens
tcatcctcagtgtaa

SEQ ID NO: 233632 - DNA, 15 bp, Homo sapiens
ttcatcctcagtgta

SEQ ID NO: 233633 - DNA, 15 bp, Homo sapiens
tttcatcctcagtgt

SEQ ID NO: 233634 - DNA, 15 bp, Homo sapiens
ctttcatcctcagtg

SEQ ID NO: 233635 - DNA, 15 bp, Homo sapiens
actttcatcctcagt

SEQ ID NO: 233636 - DNA, 15 bp, Homo sapiens
aactttcatcctcag

SEQ ID NO: 233637 - DNA, 15 bp, Homo sapiens
taactttcatcctca

SEQ ID NO: 233638 - DNA, 15 bp, Homo sapiens
gtaactttcatcctc

SEQ ID NO: 233639 - DNA, 15 bp, Homo sapiens
tgtaactttcatcct

SEQ ID NO: 233640 - DNA, 15 bp, Homo sapiens
ctgtaactttcatcc

SEQ ID NO: 233641 - DNA, 15 bp, Homo sapiens
actgtaactttcatc

SEQ ID NO: 233642 - DNA, 15 bp, Homo sapiens
aactgtaactttcat

SEQ ID NO: 233643 - DNA, 15 bp, Homo sapiens
aaactgtaactttca

SEQ ID NO: 233644 - DNA, 15 bp, Homo sapiens
taaactgtaactttc

SEQ ID NO: 233645 - DNA, 15 bp, Homo sapiens
ctaaactgtaacttt

SEQ ID NO: 233646 - DNA, 15 bp, Homo sapiens
cctaaactgtaactt

SEQ ID NO: 233647 - DNA, 15 bp, Homo sapiens
tcctaaactgtaact

SEQ ID NO: 233648 - DNA, 15 bp, Homo sapiens
ctcctaaactgtaac

SEQ ID NO: 233649 - DNA, 15 bp, Homo sapiens
tctcctaaactgtaa

SEQ ID NO: 233650 - DNA, 15 bp, Homo sapiens
ctctcctaaactgta

SEQ ID NO: 233651 - DNA, 15 bp, Homo sapiens
gctctcctaaactgt

SEQ ID NO: 233652 - DNA, 15 bp, Homo sapiens
agctctcctaaactg

SEQ ID NO: 233653 - DNA, 15 bp, Homo sapiens
aagctctcctaaact

SEQ ID NO: 233654 - DNA, 15 bp, Homo sapiens
caagctctcctaaac

SEQ ID NO: 233655 - DNA, 15 bp, Homo sapiens
gcaagctctcctaaa

SEQ ID NO: 233656 - DNA, 15 bp, Homo sapiens
agcaagctctcctaa

SEQ ID NO: 233657 - DNA, 15 bp, Homo sapiens
aagcaagctctccta

SEQ ID NO: 233658 - DNA, 15 bp, Homo sapiens
gaagcaagctctcct

SEQ ID NO: 233659 - DNA, 15 bp, Homo sapiens
agaagcaagctctcc

SEQ ID NO: 233660 - DNA, 15 bp, Homo sapiens
cagaagcaagctctc

SEQ ID NO: 233661 - DNA, 15 bp, Homo sapiens
acagaagcaagctct

SEQ ID NO: 233662 - DNA, 15 bp, Homo sapiens
cacagaagcaagctc

SEQ ID NO: 233663 - DNA, 15 bp, Homo sapiens
gcacagaagcaagct

SEQ ID NO: 233664 - DNA, 15 bp, Homo sapiens
tgcacagaagcaagc

SEQ ID NO: 233665 - DNA, 15 bp, Homo sapiens
atgcacagaagcaag

SEQ ID NO: 233666 - DNA, 15 bp, Homo sapiens
aatgcacagaagcaa

SEQ ID NO: 233667 - DNA, 15 bp, Homo sapiens
aaatgcacagaagca

SEQ ID NO: 233668 - DNA, 15 bp, Homo sapiens
aaaatgcacagaagc

SEQ ID NO: 233669 - DNA, 15 bp, Homo sapiens
taaaatgcacagaag

SEQ ID NO: 233670 - DNA, 15 bp, Homo sapiens
ataaaatgcacagaa

SEQ ID NO: 233671 - DNA, 15 bp, Homo sapiens
cataaaatgcacaga

SEQ ID NO: 233672 - DNA, 15 bp, Homo sapiens
ccataaaatgcacag

SEQ ID NO: 233673 - DNA, 15 bp, Homo sapiens
accataaaatgcaca

SEQ ID NO: 233674 - DNA, 15 bp, Homo sapiens
caccataaaatgcac

SEQ ID NO: 233675 - DNA, 15 bp, Homo sapiens
tcaccataaaatgca

SEQ ID NO: 233676 - DNA, 15 bp, Homo sapiens
ttcaccataaaatgc

SEQ ID NO: 233677 - DNA, 15 bp, Homo sapiens
cttcaccataaaatg

SEQ ID NO: 233678 - DNA, 15 bp, Homo sapiens
acttcaccataaaat

SEQ ID NO: 233679 - DNA, 15 bp, Homo sapiens
aacttcaccataaaa

SEQ ID NO: 233680 - DNA, 15 bp, Homo sapiens
gaacttcaccataaa

SEQ ID NO: 233681 - DNA, 15 bp, Homo sapiens
tgaacttcaccataa

SEQ ID NO: 233682 - DNA, 15 bp, Homo sapiens
atgaacttcaccata

SEQ ID NO: 233683 - DNA, 15 bp, Homo sapiens
gatgaacttcaccat

SEQ ID NO: 233684 - DNA, 15 bp, Homo sapiens
agatgaacttcacca

SEQ ID NO: 233685 - DNA, 15 bp, Homo sapiens
aagatgaacttcacc

SEQ ID NO: 233686 - DNA, 15 bp, Homo sapiens
taagatgaacttcac

SEQ ID NO: 233687 - DNA, 15 bp, Homo sapiens
ataagatgaacttca

SEQ ID NO: 233688 - DNA, 15 bp, Homo sapiens
cataagatgaacttc

SEQ ID NO: 233689 - DNA, 15 bp, Homo sapiens
tcataagatgaactt

SEQ ID NO: 233690 - DNA, 15 bp, Homo sapiens
atcataagatgaact

SEQ ID NO: 233691 - DNA, 15 bp, Homo sapiens
catcataagatgaac

SEQ ID NO: 233692 - DNA, 15 bp, Homo sapiens
tcatcataagatgaa

SEQ ID NO: 233693 - DNA, 15 bp, Homo sapiens
atcatcataagatga

SEQ ID NO: 233694 - DNA, 15 bp, Homo sapiens
gatcatcataagatg

SEQ ID NO: 233695 - DNA, 15 bp, Homo sapiens
tgatcatcataagat

SEQ ID NO: 233696 - DNA, 15 bp, Homo sapiens
atgatcatcataaga

SEQ ID NO: 233697 - DNA, 15 bp, Homo sapiens
aatgatcatcataag

SEQ ID NO: 233698 - DNA, 15 bp, Homo sapiens
aaatgatcatcataa

SEQ ID NO: 233699 - DNA, 15 bp, Homo sapiens
aaaatgatcatcata

SEQ ID NO: 233700 - DNA, 15 bp, Homo sapiens
gaaaatgatcatcat

SEQ ID NO: 233701 - DNA, 15 bp, Homo sapiens
ggaaaatgatcatca

SEQ ID NO: 233702 - DNA, 15 bp, Homo sapiens
tggaaaatgatcatc

SEQ ID NO: 233703 - DNA, 15 bp, Homo sapiens
ttggaaaatgatcat

SEQ ID NO: 233704 - DNA, 15 bp, Homo sapiens
cttggaaaatgatca

SEQ ID NO: 233705 - DNA, 15 bp, Homo sapiens
acttggaaaatgatc

SEQ ID NO: 233706 - DNA, 15 bp, Homo sapiens
cacttggaaaatgat

SEQ ID NO: 233707 - DNA, 15 bp, Homo sapiens
tcacttggaaaatga

SEQ ID NO: 233708 - DNA, 15 bp, Homo sapiens
atcacttggaaaatg

SEQ ID NO: 233709 - DNA, 15 bp, Homo sapiens
aatcacttggaaaat

SEQ ID NO: 233710 - DNA, 15 bp, Homo sapiens
aaatcacttggaaaa

SEQ ID NO: 233711 - DNA, 15 bp, Homo sapiens
caaatcacttggaaa

SEQ ID NO: 233712 - DNA, 15 bp, Homo sapiens
ccaaatcacttggaa

SEQ ID NO: 233713 - DNA, 15 bp, Homo sapiens
tccaaatcacttgga

SEQ ID NO: 233714 - DNA, 15 bp, Homo sapiens
ttccaaatcacttgg

SEQ ID NO: 233715 - DNA, 15 bp, Homo sapiens
gttccaaatcacttg

SEQ ID NO: 233716 - DNA, 15 bp, Homo sapiens
tgttccaaatcactt

SEQ ID NO: 233717 - DNA, 15 bp, Homo sapiens
atgttccaaatcact

SEQ ID NO: 233718 - DNA, 15 bp, Homo sapiens
aatgttccaaatcac

SEQ ID NO: 233719 - DNA, 15 bp, Homo sapiens
aaatgttccaaatca

SEQ ID NO: 233720 - DNA, 15 bp, Homo sapiens
aaaatgttccaaatc

SEQ ID NO: 233721 - DNA, 15 bp, Homo sapiens
caaaatgttccaaat

SEQ ID NO: 233722 - DNA, 15 bp, Homo sapiens
tcaaaatgttccaaa

SEQ ID NO: 233723 - DNA, 15 bp, Homo sapiens
ctcaaaatgttccaa

SEQ ID NO: 233724 - DNA, 15 bp, Homo sapiens
cctcaaaatgttcca

SEQ ID NO: 233725 - DNA, 15 bp, Homo sapiens
acctcaaaatgttcc

SEQ ID NO: 233726 - DNA, 15 bp, Homo sapiens
cacctcaaaatgttc

SEQ ID NO: 233727 - DNA, 15 bp, Homo sapiens
tcacctcaaaatgtt

SEQ ID NO: 233728 - DNA, 15 bp, Homo sapiens
ttcacctcaaaatgt

SEQ ID NO: 233729 - DNA, 15 bp, Homo sapiens
cttcacctcaaaatg

SEQ ID NO: 233730 - DNA, 15 bp, Homo sapiens
acttcacctcaaaat

SEQ ID NO: 233731 - DNA, 15 bp, Homo sapiens
cacttcacctcaaaa

SEQ ID NO: 233732 - DNA, 15 bp, Homo sapiens
ccacttcacctcaaa

SEQ ID NO: 233733 - DNA, 15 bp, Homo sapiens
tccacttcacctcaa

SEQ ID NO: 233734 - DNA, 15 bp, Homo sapiens
ttccacttcacctca

SEQ ID NO: 233735 - DNA, 15 bp, Homo sapiens
tttccacttcacctc

SEQ ID NO: 233736 - DNA, 15 bp, Homo sapiens
atttccacttcacct

SEQ ID NO: 233737 - DNA, 15 bp, Homo sapiens
aatttccacttcacc

SEQ ID NO: 233738 - DNA, 15 bp, Homo sapiens
caatttccacttcac

SEQ ID NO: 233739 - DNA, 15 bp, Homo sapiens
gcaatttccacttca

SEQ ID NO: 233740 - DNA, 15 bp, Homo sapiens
agcaatttccacttc

SEQ ID NO: 233741 - DNA, 15 bp, Homo sapiens
tagcaatttccactt

SEQ ID NO: 233742 - DNA, 15 bp, Homo sapiens
ttagcaatttccact

SEQ ID NO: 233743 - DNA, 15 bp, Homo sapiens
attagcaatttccac

SEQ ID NO: 233744 - DNA, 15 bp, Homo sapiens
cattagcaatttcca

SEQ ID NO: 233745 - DNA, 15 bp, Homo sapiens
acattagcaatttcc

SEQ ID NO: 233746 - DNA, 15 bp, Homo sapiens
cacattagcaatttc

SEQ ID NO: 233747 - DNA, 15 bp, Homo sapiens
tcacattagcaattt

SEQ ID NO: 233748 - DNA, 15 bp, Homo sapiens
atcacattagcaatt

SEQ ID NO: 233749 - DNA, 15 bp, Homo sapiens
catcacattagcaat

SEQ ID NO: 233750 - DNA, 15 bp, Homo sapiens
acatcacattagcaa

SEQ ID NO: 233751 - DNA, 15 bp, Homo sapiens
cacatcacattagca

SEQ ID NO: 233752 - DNA, 15 bp, Homo sapiens
acacatcacattagc

SEQ ID NO: 233753 - DNA, 15 bp, Homo sapiens
tacacatcacattag

SEQ ID NO: 233754 - DNA, 15 bp, Homo sapiens
gtacacatcacatta

SEQ ID NO: 233755 - DNA, 15 bp, Homo sapiens
agtacacatcacatt

SEQ ID NO: 233756 - DNA, 15 bp, Homo sapiens
cagtacacatcacat

SEQ ID NO: 233757 - DNA, 15 bp, Homo sapiens
tcagtacacatcaca

SEQ ID NO: 233758 - DNA, 15 bp, Homo sapiens
ttcagtacacatcac

SEQ ID NO: 233759 - DNA, 15 bp, Homo sapiens
tttcagtacacatca

SEQ ID NO: 233760 - DNA, 15 bp, Homo sapiens
ctttcagtacacatc

SEQ ID NO: 233761 - DNA, 15 bp, Homo sapiens
tctttcagtacacat

SEQ ID NO: 233762 - DNA, 15 bp, Homo sapiens
atctttcagtacaca

SEQ ID NO: 233763 - DNA, 15 bp, Homo sapiens
catctttcagtacac

SEQ ID NO: 233764 - DNA, 15 bp, Homo sapiens
tcatctttcagtaca

SEQ ID NO: 233765 - DNA, 15 bp, Homo sapiens
ctcatctttcagtac

SEQ ID NO: 233766 - DNA, 15 bp, Homo sapiens
tctcatctttcagta

SEQ ID NO: 233767 - DNA, 15 bp, Homo sapiens
atctcatctttcagt

SEQ ID NO: 233768 - DNA, 15 bp, Homo sapiens
catctcatctttcag

SEQ ID NO: 233769 - DNA, 15 bp, Homo sapiens
acatctcatctttca

SEQ ID NO: 233770 - DNA, 15 bp, Homo sapiens
aacatctcatctttc

SEQ ID NO: 233771 - DNA, 15 bp, Homo sapiens
taacatctcatcttt

SEQ ID NO: 233772 - DNA, 15 bp, Homo sapiens
ataacatctcatctt

SEQ ID NO: 233773 - DNA, 15 bp, Homo sapiens
gataacatctcatct

SEQ ID NO: 233774 - DNA, 15 bp, Homo sapiens
tgataacatctcatc

SEQ ID NO: 233775 - DNA, 15 bp, Homo sapiens
gtgataacatctcat

SEQ ID NO: 233776 - DNA, 15 bp, Homo sapiens
tgtgataacatctca

SEQ ID NO: 233777 - DNA, 15 bp, Homo sapiens
ttgtgataacatctc

SEQ ID NO: 233778 - DNA, 15 bp, Homo sapiens
tttgtgataacatct

SEQ ID NO: 233779 - DNA, 15 bp, Homo sapiens
ctttgtgataacatc

SEQ ID NO: 233780 - DNA, 15 bp, Homo sapiens
tctttgtgataacat

SEQ ID NO: 233781 - DNA, 15 bp, Homo sapiens
ttctttgtgataaca

SEQ ID NO: 233782 - DNA, 15 bp, Homo sapiens
cttctttgtgataac

SEQ ID NO: 233783 - DNA, 15 bp, Homo sapiens
tcttctttgtgataa

SEQ ID NO: 233784 - DNA, 15 bp, Homo sapiens
ttcttctttgtgata

SEQ ID NO: 233785 - DNA, 15 bp, Homo sapiens
attcttctttgtgat

SEQ ID NO: 233786 - DNA, 15 bp, Homo sapiens
cattcttctttgtga

SEQ ID NO: 233787 - DNA, 15 bp, Homo sapiens
acattcttctttgtg

SEQ ID NO: 233788 - DNA, 15 bp, Homo sapiens
cacattcttctttgt

SEQ ID NO: 233789 - DNA, 15 bp, Homo sapiens
acacattcttctttg

SEQ ID NO: 233790 - DNA, 15 bp, Homo sapiens
aacacattcttcttt

SEQ ID NO: 233791 - DNA, 15 bp, Homo sapiens
aaacacattcttctt

SEQ ID NO: 233792 - DNA, 15 bp, Homo sapiens
aaaacacattcttct

SEQ ID NO: 233793 - DNA, 15 bp, Homo sapiens
gaaaacacattcttc

SEQ ID NO: 233794 - DNA, 15 bp, Homo sapiens
agaaaacacattctt

SEQ ID NO: 233795 - DNA, 15 bp, Homo sapiens
cagaaaacacattct

SEQ ID NO: 233796 - DNA, 15 bp, Homo sapiens
acagaaaacacattc

SEQ ID NO: 233797 - DNA, 15 bp, Homo sapiens
gacagaaaacacatt

SEQ ID NO: 233798 - DNA, 15 bp, Homo sapiens
agacagaaaacacat

SEQ ID NO: 233799 - DNA, 15 bp, Homo sapiens
gagacagaaaacaca

SEQ ID NO: 233800 - DNA, 15 bp, Homo sapiens
tgagacagaaaacac

SEQ ID NO: 233801 - DNA, 15 bp, Homo sapiens
ttgagacagaaaaca

SEQ ID NO: 233802 - DNA, 15 bp, Homo sapiens
tttgagacagaaaac

SEQ ID NO: 233803 - DNA, 15 bp, Homo sapiens
atttgagacagaaaa

SEQ ID NO: 233804 - DNA, 15 bp, Homo sapiens
aatttgagacagaaa

SEQ ID NO: 233805 - DNA, 15 bp, Homo sapiens
taatttgagacagaa

SEQ ID NO: 233806 - DNA, 15 bp, Homo sapiens
ttaatttgagacaga

SEQ ID NO: 233807 - DNA, 15 bp, Homo sapiens
attaatttgagacag

SEQ ID NO: 233808 - DNA, 15 bp, Homo sapiens
cattaatttgagaca

SEQ ID NO: 233809 - DNA, 15 bp, Homo sapiens
acattaatttgagac

SEQ ID NO: 233810 - DNA, 15 bp, Homo sapiens
tacattaatttgaga

SEQ ID NO: 233811 - DNA, 15 bp, Homo sapiens
gtacattaatttgag

SEQ ID NO: 233812 - DNA, 15 bp, Homo sapiens
tgtacattaatttga

SEQ ID NO: 233813 - DNA, 15 bp, Homo sapiens
ctgtacattaatttg

SEQ ID NO: 233814 - DNA, 15 bp, Homo sapiens
actgtacattaattt

SEQ ID NO: 233815 - DNA, 15 bp, Homo sapiens
aactgtacattaatt

SEQ ID NO: 233816 - DNA, 15 bp, Homo sapiens
aaactgtacattaat

SEQ ID NO: 233817 - DNA, 15 bp, Homo sapiens
taaactgtacattaa

SEQ ID NO: 233818 - DNA, 15 bp, Homo sapiens
ataaactgtacatta

SEQ ID NO: 233819 - DNA, 15 bp, Homo sapiens
cataaactgtacatt

SEQ ID NO: 233820 - DNA, 15 bp, Homo sapiens
acataaactgtacat

SEQ ID NO: 233821 - DNA, 15 bp, Homo sapiens
gacataaactgtaca

SEQ ID NO: 233822 - DNA, 15 bp, Homo sapiens
tgacataaactgtac

SEQ ID NO: 233823 - DNA, 15 bp, Homo sapiens
ttgacataaactgta

SEQ ID NO: 233824 - DNA, 15 bp, Homo sapiens
attgacataaactgt

SEQ ID NO: 233825 - DNA, 15 bp, Homo sapiens
aattgacataaactg

SEQ ID NO: 233826 - DNA, 15 bp, Homo sapiens
caattgacataaact

SEQ ID NO: 233827 - DNA, 15 bp, Homo sapiens
gcaattgacataaac

SEQ ID NO: 233828 - DNA, 15 bp, Homo sapiens
tgcaattgacataaa

SEQ ID NO: 233829 - DNA, 15 bp, Homo sapiens
gtgcaattgacataa

SEQ ID NO: 233830 - DNA, 15 bp, Homo sapiens
agtgcaattgacata

SEQ ID NO: 233831 - DNA, 15 bp, Homo sapiens
cagtgcaattgacat

SEQ ID NO: 233832 - DNA, 15 bp, Homo sapiens
gcagtgcaattgaca

SEQ ID NO: 233833 - DNA, 15 bp, Homo sapiens
ggcagtgcaattgac

SEQ ID NO: 233834 - DNA, 15 bp, Homo sapiens
aggcagtgcaattga

SEQ ID NO: 233835 - DNA, 15 bp, Homo sapiens
gaggcagtgcaattg

SEQ ID NO: 233836 - DNA, 15 bp, Homo sapiens
agaggcagtgcaatt

SEQ ID NO: 233837 - DNA, 15 bp, Homo sapiens
aagaggcagtgcaat

SEQ ID NO: 233838 - DNA, 15 bp, Homo sapiens
aaagaggcagtgcaa

SEQ ID NO: 233839 - DNA, 15 bp, Homo sapiens
taaagaggcagtgca

SEQ ID NO: 233840 - DNA, 15 bp, Homo sapiens
ataaagaggcagtgc

SEQ ID NO: 233841 - DNA, 15 bp, Homo sapiens
aataaagaggcagtg

SEQ ID NO: 233842 - DNA, 15 bp, Homo sapiens
aaataaagaggcagt

SEQ ID NO: 233843 - DNA, 15 bp, Homo sapiens
caaataaagaggcag

SEQ ID NO: 233844 - DNA, 15 bp, Homo sapiens
gcaaataaagaggca

SEQ ID NO: 233845 - DNA, 15 bp, Homo sapiens
tgcaaataaagaggc

SEQ ID NO: 233846 - DNA, 15 bp, Homo sapiens
ctgcaaataaagagg

SEQ ID NO: 233847 - DNA, 15 bp, Homo sapiens
actgcaaataaagag

SEQ ID NO: 233848 - DNA, 15 bp, Homo sapiens
cactgcaaataaaga

SEQ ID NO: 233849 - DNA, 15 bp, Homo sapiens
ccactgcaaataaag

SEQ ID NO: 233850 - DNA, 15 bp, Homo sapiens
tccactgcaaataaa

SEQ ID NO: 233851 - DNA, 15 bp, Homo sapiens
gtccactgcaaataa

SEQ ID NO: 233852 - DNA, 15 bp, Homo sapiens
tgtccactgcaaata

SEQ ID NO: 233853 - DNA, 15 bp, Homo sapiens
ctgtccactgcaaat

SEQ ID NO: 233854 - DNA, 15 bp, Homo sapiens
actgtccactgcaaa

SEQ ID NO: 233855 - DNA, 15 bp, Homo sapiens
aactgtccactgcaa

SEQ ID NO: 233856 - DNA, 15 bp, Homo sapiens
caactgtccactgca

SEQ ID NO: 233857 - DNA, 15 bp, Homo sapiens
ccaactgtccactgc

SEQ ID NO: 233858 - DNA, 15 bp, Homo sapiens
tccaactgtccactg

SEQ ID NO: 233859 - DNA, 15 bp, Homo sapiens
atccaactgtccact

SEQ ID NO: 233860 - DNA, 15 bp, Homo sapiens
tatccaactgtccac

SEQ ID NO: 233861 - DNA, 15 bp, Homo sapiens
gtatccaactgtcca

SEQ ID NO: 233862 - DNA, 15 bp, Homo sapiens
ggtatccaactgtcc

SEQ ID NO: 233863 - DNA, 15 bp, Homo sapiens
tggtatccaactgtc

SEQ ID NO: 233864 - DNA, 15 bp, Homo sapiens
gtggtatccaactgt

SEQ ID NO: 233865 - DNA, 15 bp, Homo sapiens
ggtggtatccaactg

SEQ ID NO: 233866 - DNA, 15 bp, Homo sapiens
tggtggtatccaact

SEQ ID NO: 233867 - DNA, 15 bp, Homo sapiens
atggtggtatccaac

SEQ ID NO: 233868 - DNA, 15 bp, Homo sapiens
gatggtggtatccaa

SEQ ID NO: 233869 - DNA, 15 bp, Homo sapiens
tgatggtggtatcca

SEQ ID NO: 233870 - DNA, 15 bp, Homo sapiens
ttgatggtggtatcc

SEQ ID NO: 233871 - DNA, 15 bp, Homo sapiens
tttgatggtggtatc

SEQ ID NO: 233872 - DNA, 15 bp, Homo sapiens
gtttgatggtggtat

SEQ ID NO: 233873 - DNA, 15 bp, Homo sapiens
ggtttgatggtggta

SEQ ID NO: 233874 - DNA, 15 bp, Homo sapiens
tggtttgatggtggt

SEQ ID NO: 233875 - DNA, 15 bp, Homo sapiens
ctggtttgatggtgg

SEQ ID NO: 233876 - DNA, 15 bp, Homo sapiens
gctggtttgatggtg

SEQ ID NO: 233877 - DNA, 15 bp, Homo sapiens
agctggtttgatggt

SEQ ID NO: 233878 - DNA, 15 bp, Homo sapiens
tagctggtttgatgg

SEQ ID NO: 233879 - DNA, 15 bp, Homo sapiens
ctagctggtttgatg

SEQ ID NO: 233880 - DNA, 15 bp, Homo sapiens
tctagctggtttgat

SEQ ID NO: 233881 - DNA, 15 bp, Homo sapiens
atctagctggtttga

SEQ ID NO: 233882 - DNA, 15 bp, Homo sapiens
tatctagctggtttg

SEQ ID NO: 233883 - DNA, 15 bp, Homo sapiens
ctatctagctggttt

SEQ ID NO: 233884 - DNA, 15 bp, Homo sapiens
cctatctagctggtt

SEQ ID NO: 233885 - DNA, 15 bp, Homo sapiens
tcctatctagctggt

SEQ ID NO: 233886 - DNA, 15 bp, Homo sapiens
ttcctatctagctgg

SEQ ID NO: 233887 - DNA, 15 bp, Homo sapiens
tttcctatctagctg

SEQ ID NO: 233888 - DNA, 15 bp, Homo sapiens
ctttcctatctagct

SEQ ID NO: 233889 - DNA, 15 bp, Homo sapiens
cctttcctatctagc

SEQ ID NO: 233890 - DNA, 15 bp, Homo sapiens
tcctttcctatctag

SEQ ID NO: 233891 - DNA, 15 bp, Homo sapiens
ctcctttcctatcta

SEQ ID NO: 233892 - DNA, 15 bp, Homo sapiens
cctcctttcctatct

SEQ ID NO: 233893 - DNA, 15 bp, Homo sapiens
acctcctttcctatc

SEQ ID NO: 233894 - DNA, 15 bp, Homo sapiens
tacctcctttcctat

SEQ ID NO: 233895 - DNA, 15 bp, Homo sapiens
atacctcctttccta

SEQ ID NO: 233896 - DNA, 15 bp, Homo sapiens
aatacctcctttcct

SEQ ID NO: 233897 - DNA, 15 bp, Homo sapiens
aaatacctcctttcc

SEQ ID NO: 233898 - DNA, 15 bp, Homo sapiens
aaaatacctcctttc

SEQ ID NO: 233899 - DNA, 15 bp, Homo sapiens
taaaatacctccttt

SEQ ID NO: 233900 - DNA, 15 bp, Homo sapiens
ttaaaatacctcctt

SEQ ID NO: 233901 - DNA, 15 bp, Homo sapiens
cttaaaatacctcct

SEQ ID NO: 233902 - DNA, 15 bp, Homo sapiens
ccttaaaatacctcc

SEQ ID NO: 233903 - DNA, 15 bp, Homo sapiens
accttaaaatacctc

SEQ ID NO: 233904 - DNA, 15 bp, Homo sapiens
caccttaaaatacct

SEQ ID NO: 233905 - DNA, 15 bp, Homo sapiens
acaccttaaaatacc

SEQ ID NO: 233906 - DNA, 15 bp, Homo sapiens
tacaccttaaaatac

SEQ ID NO: 233907 - DNA, 15 bp, Homo sapiens
ctacaccttaaaata

SEQ ID NO: 233908 - DNA, 15 bp, Homo sapiens
tctacaccttaaaat

SEQ ID NO: 233909 - DNA, 15 bp, Homo sapiens
ttctacaccttaaaa

SEQ ID NO: 233910 - DNA, 15 bp, Homo sapiens
cttctacaccttaaa

SEQ ID NO: 233911 - DNA, 15 bp, Homo sapiens
tcttctacaccttaa

SEQ ID NO: 233912 - DNA, 15 bp, Homo sapiens
atcttctacacctta

SEQ ID NO: 233913 - DNA, 15 bp, Homo sapiens
tatcttctacacctt

SEQ ID NO: 233914 - DNA, 15 bp, Homo sapiens
ctatcttctacacct

SEQ ID NO: 233915 - DNA, 15 bp, Homo sapiens
actatcttctacacc

SEQ ID NO: 233916 - DNA, 15 bp, Homo sapiens
cactatcttctacac

SEQ ID NO: 233917 - DNA, 15 bp, Homo sapiens
tcactatcttctaca

SEQ ID NO: 233918 - DNA, 15 bp, Homo sapiens
ctcactatcttctac

SEQ ID NO: 233919 - DNA, 15 bp, Homo sapiens
cctcactatcttcta

SEQ ID NO: 233920 - DNA, 15 bp, Homo sapiens
gcctcactatcttct

SEQ ID NO: 233921 - DNA, 15 bp, Homo sapiens
ggcctcactatcttc

SEQ ID NO: 233922 - DNA, 15 bp, Homo sapiens
gggcctcactatctt

SEQ ID NO: 233923 - DNA, 15 bp, Homo sapiens
ggggcctcactatct

SEQ ID NO: 233924 - DNA, 15 bp, Homo sapiens
tggggcctcactatc

SEQ ID NO: 233925 - DNA, 15 bp, Homo sapiens
ctggggcctcactat

SEQ ID NO: 233926 - DNA, 15 bp, Homo sapiens
cctggggcctcacta

SEQ ID NO: 233927 - DNA, 15 bp, Homo sapiens
tcctggggcctcact

SEQ ID NO: 233928 - DNA, 15 bp, Homo sapiens
ctcctggggcctcac

SEQ ID NO: 233929 - DNA, 15 bp, Homo sapiens
actcctggggcctca

SEQ ID NO: 233930 - DNA, 15 bp, Homo sapiens
cactcctggggcctc

SEQ ID NO: 233931 - DNA, 15 bp, Homo sapiens
acactcctggggcct

SEQ ID NO: 233932 - DNA, 15 bp, Homo sapiens
cacactcctggggcc

SEQ ID NO: 233933 - DNA, 15 bp, Homo sapiens
ccacactcctggggc

SEQ ID NO: 233934 - DNA, 15 bp, Homo sapiens
tccacactcctgggg

SEQ ID NO: 233935 - DNA, 15 bp, Homo sapiens
ctccacactcctggg

SEQ ID NO: 233936 - DNA, 15 bp, Homo sapiens
gctccacactcctgg

SEQ ID NO: 233937 - DNA, 15 bp, Homo sapiens
ggctccacactcctg

SEQ ID NO: 233938 - DNA, 15 bp, Homo sapiens
tggctccacactcct

SEQ ID NO: 233939 - DNA, 15 bp, Homo sapiens
atggctccacactcc

SEQ ID NO: 233940 - DNA, 15 bp, Homo sapiens
catggctccacactc

SEQ ID NO: 233941 - DNA, 15 bp, Homo sapiens
gcatggctccacact

SEQ ID NO: 233942 - DNA, 15 bp, Homo sapiens
agcatggctccacac

SEQ ID NO: 233943 - DNA, 15 bp, Homo sapiens
cagcatggctccaca

SEQ ID NO: 233944 - DNA, 15 bp, Homo sapiens
ccagcatggctccac

SEQ ID NO: 233945 - DNA, 15 bp, Homo sapiens
tccagcatggctcca

SEQ ID NO: 233946 - DNA, 15 bp, Homo sapiens
ctccagcatggctcc

SEQ ID NO: 233947 - DNA, 15 bp, Homo sapiens
tctccagcatggctc

SEQ ID NO: 233948 - DNA, 15 bp, Homo sapiens
gtctccagcatggct

SEQ ID NO: 233949 - DNA, 15 bp, Homo sapiens
ggtctccagcatggc

SEQ ID NO: 233950 - DNA, 15 bp, Homo sapiens
aggtctccagcatgg

SEQ ID NO: 233951 - DNA, 15 bp, Homo sapiens
aaggtctccagcatg

SEQ ID NO: 233952 - DNA, 15 bp, Homo sapiens
aaaggtctccagcat

SEQ ID NO: 233953 - DNA, 15 bp, Homo sapiens
gaaaggtctccagca

SEQ ID NO: 233954 - DNA, 15 bp, Homo sapiens
agaaaggtctccagc

SEQ ID NO: 233955 - DNA, 15 bp, Homo sapiens
tagaaaggtctccag

SEQ ID NO: 233956 - DNA, 15 bp, Homo sapiens
ttagaaaggtctcca

SEQ ID NO: 233957 - DNA, 15 bp, Homo sapiens
cttagaaaggtctcc

SEQ ID NO: 233958 - DNA, 15 bp, Homo sapiens
gcttagaaaggtctc

SEQ ID NO: 233959 - DNA, 15 bp, Homo sapiens
agcttagaaaggtct

SEQ ID NO: 233960 - DNA, 15 bp, Homo sapiens
cagcttagaaaggtc

SEQ ID NO: 233961 - DNA, 15 bp, Homo sapiens
acagcttagaaaggt

SEQ ID NO: 233962 - DNA, 15 bp, Homo sapiens
gacagcttagaaagg

SEQ ID NO: 233963 - DNA, 15 bp, Homo sapiens
agacagcttagaaag

SEQ ID NO: 233964 - DNA, 15 bp, Homo sapiens
aagacagcttagaaa

SEQ ID NO: 233965 - DNA, 15 bp, Homo sapiens
caagacagcttagaa

SEQ ID NO: 233966 - DNA, 15 bp, Homo sapiens
tcaagacagcttaga

SEQ ID NO: 233967 - DNA, 15 bp, Homo sapiens
ctcaagacagcttag

SEQ ID NO: 233968 - DNA, 15 bp, Homo sapiens
tctcaagacagctta

SEQ ID NO: 233969 - DNA, 15 bp, Homo sapiens
ttctcaagacagctt

SEQ ID NO: 233970 - DNA, 15 bp, Homo sapiens
attctcaagacagct

SEQ ID NO: 233971 - DNA, 15 bp, Homo sapiens
aattctcaagacagc

SEQ ID NO: 233972 - DNA, 15 bp, Homo sapiens
aaattctcaagacag

SEQ ID NO: 233973 - DNA, 15 bp, Homo sapiens
gaaattctcaagaca

SEQ ID NO: 233974 - DNA, 15 bp, Homo sapiens
agaaattctcaagac

SEQ ID NO: 233975 - DNA, 15 bp, Homo sapiens
gagaaattctcaaga

SEQ ID NO: 233976 - DNA, 15 bp, Homo sapiens
ggagaaattctcaag

SEQ ID NO: 233977 - DNA, 15 bp, Homo sapiens
aggagaaattctcaa

SEQ ID NO: 233978 - DNA, 15 bp, Homo sapiens
gaggagaaattctca

SEQ ID NO: 233979 - DNA, 15 bp, Homo sapiens
tgaggagaaattctc

SEQ ID NO: 233980 - DNA, 15 bp, Homo sapiens
ctgaggagaaattct

SEQ ID NO: 233981 - DNA, 15 bp, Homo sapiens
actgaggagaaattc

SEQ ID NO: 233982 - DNA, 15 bp, Homo sapiens
cactgaggagaaatt

SEQ ID NO: 233983 - DNA, 15 bp, Homo sapiens
acactgaggagaaat

SEQ ID NO: 233984 - DNA, 15 bp, Homo sapiens
aacactgaggagaaa

SEQ ID NO: 233985 - DNA, 15 bp, Homo sapiens
caacactgaggagaa

SEQ ID NO: 233986 - DNA, 15 bp, Homo sapiens
tcaacactgaggaga

SEQ ID NO: 233987 - DNA, 15 bp, Homo sapiens
gtcaacactgaggag

SEQ ID NO: 233988 - DNA, 15 bp, Homo sapiens
agtcaacactgagga

SEQ ID NO: 233989 - DNA, 15 bp, Homo sapiens
cagtcaacactgagg

SEQ ID NO: 233990 - DNA, 15 bp, Homo sapiens
gcagtcaacactgag

SEQ ID NO: 233991 - DNA, 15 bp, Homo sapiens
tgcagtcaacactga

SEQ ID NO: 233992 - DNA, 15 bp, Homo sapiens
atgcagtcaacactg

SEQ ID NO: 233993 - DNA, 15 bp, Homo sapiens
aatgcagtcaacact

SEQ ID NO: 233994 - DNA, 15 bp, Homo sapiens
gaatgcagtcaacac

SEQ ID NO: 233995 - DNA, 15 bp, Homo sapiens
ggaatgcagtcaaca

SEQ ID NO: 233996 - DNA, 15 bp, Homo sapiens
aggaatgcagtcaac

SEQ ID NO: 233997 - DNA, 15 bp, Homo sapiens
gaggaatgcagtcaa

SEQ ID NO: 233998 - DNA, 15 bp, Homo sapiens
agaggaatgcagtca

SEQ ID NO: 233999 - DNA, 15 bp, Homo sapiens
cagaggaatgcagtc

SEQ ID NO: 234000 - DNA, 15 bp, Homo sapiens
gcagaggaatgcagt

SEQ ID NO: 234001 - DNA, 15 bp, Homo sapiens
ggcagaggaatgcag

SEQ ID NO: 234002 - DNA, 15 bp, Homo sapiens
gggcagaggaatgca

SEQ ID NO: 234003 - DNA, 15 bp, Homo sapiens
agggcagaggaatgc

SEQ ID NO: 234004 - DNA, 15 bp, Homo sapiens
aagggcagaggaatg

SEQ ID NO: 234005 - DNA, 15 bp, Homo sapiens
caagggcagaggaat

SEQ ID NO: 234006 - DNA, 15 bp, Homo sapiens
gcaagggcagaggaa

SEQ ID NO: 234007 - DNA, 15 bp, Homo sapiens
agcaagggcagagga

SEQ ID NO: 234008 - DNA, 15 bp, Homo sapiens
aagcaagggcagagg

SEQ ID NO: 234009 - DNA, 15 bp, Homo sapiens
aaagcaagggcagag

SEQ ID NO: 234010 - DNA, 15 bp, Homo sapiens
taaagcaagggcaga

SEQ ID NO: 234011 - DNA, 15 bp, Homo sapiens
gtaaagcaagggcag

SEQ ID NO: 234012 - DNA, 15 bp, Homo sapiens
ggtaaagcaagggca

SEQ ID NO: 234013 - DNA, 15 bp, Homo sapiens
tggtaaagcaagggc

SEQ ID NO: 234014 - DNA, 15 bp, Homo sapiens
ctggtaaagcaaggg

SEQ ID NO: 234015 - DNA, 15 bp, Homo sapiens
gctggtaaagcaagg

SEQ ID NO: 234016 - DNA, 15 bp, Homo sapiens
agctggtaaagcaag

SEQ ID NO: 234017 - DNA, 15 bp, Homo sapiens
gagctggtaaagcaa

SEQ ID NO: 234018 - DNA, 15 bp, Homo sapiens
ggagctggtaaagca

SEQ ID NO: 234019 - DNA, 15 bp, Homo sapiens
gggagctggtaaagc

SEQ ID NO: 234020 - DNA, 15 bp, Homo sapiens
ggggagctggtaaag

SEQ ID NO: 234021 - DNA, 15 bp, Homo sapiens
tggggagctggtaaa

SEQ ID NO: 234022 - DNA, 15 bp, Homo sapiens
atggggagctggtaa

SEQ ID NO: 234023 - DNA, 15 bp, Homo sapiens
gatggggagctggta

SEQ ID NO: 234024 - DNA, 15 bp, Homo sapiens
agatggggagctggt

SEQ ID NO: 234025 - DNA, 15 bp, Homo sapiens
gagatggggagctgg

SEQ ID NO: 234026 - DNA, 15 bp, Homo sapiens
agagatggggagctg

SEQ ID NO: 234027 - DNA, 15 bp, Homo sapiens
aagagatggggagct

SEQ ID NO: 234028 - DNA, 15 bp, Homo sapiens
taagagatggggagc

SEQ ID NO: 234029 - DNA, 15 bp, Homo sapiens
ataagagatggggag

SEQ ID NO: 234030 - DNA, 15 bp, Homo sapiens
tataagagatgggga

SEQ ID NO: 234031 - DNA, 15 bp, Homo sapiens
atataagagatgggg

SEQ ID NO: 234032 - DNA, 15 bp, Homo sapiens
aatataagagatggg

SEQ ID NO: 234033 - DNA, 15 bp, Homo sapiens
aaatataagagatgg

SEQ ID NO: 234034 - DNA, 15 bp, Homo sapiens
gaaatataagagatg

SEQ ID NO: 234035 - DNA, 15 bp, Homo sapiens
agaaatataagagat

SEQ ID NO: 234036 - DNA, 15 bp, Homo sapiens
cagaaatataagaga

SEQ ID NO: 234037 - DNA, 15 bp, Homo sapiens
tcagaaatataagag

SEQ ID NO: 234038 - DNA, 15 bp, Homo sapiens
gtcagaaatataaga

SEQ ID NO: 234039 - DNA, 15 bp, Homo sapiens
ggtcagaaatataag

SEQ ID NO: 234040 - DNA, 15 bp, Homo sapiens
gggtcagaaatataa

SEQ ID NO: 234041 - DNA, 15 bp, Homo sapiens
agggtcagaaatata

SEQ ID NO: 234042 - DNA, 15 bp, Homo sapiens
aagggtcagaaatat

SEQ ID NO: 234043 - DNA, 15 bp, Homo sapiens
caagggtcagaaata

SEQ ID NO: 234044 - DNA, 15 bp, Homo sapiens
ccaagggtcagaaat

SEQ ID NO: 234045 - DNA, 15 bp, Homo sapiens
gccaagggtcagaaa

SEQ ID NO: 234046 - DNA, 15 bp, Homo sapiens
agccaagggtcagaa

SEQ ID NO: 234047 - DNA, 15 bp, Homo sapiens
aagccaagggtcaga

SEQ ID NO: 234048 - DNA, 15 bp, Homo sapiens
aaagccaagggtcag

SEQ ID NO: 234049 - DNA, 15 bp, Homo sapiens
caaagccaagggtca

SEQ ID NO: 234050 - DNA, 15 bp, Homo sapiens
tcaaagccaagggtc

SEQ ID NO: 234051 - DNA, 15 bp, Homo sapiens
ttcaaagccaagggt

SEQ ID NO: 234052 - DNA, 15 bp, Homo sapiens
gttcaaagccaaggg

SEQ ID NO: 234053 - DNA, 15 bp, Homo sapiens
agttcaaagccaagg

SEQ ID NO: 234054 - DNA, 15 bp, Homo sapiens
aagttcaaagccaag

SEQ ID NO: 234055 - DNA, 15 bp, Homo sapiens
caagttcaaagccaa

SEQ ID NO: 234056 - DNA, 15 bp, Homo sapiens
tcaagttcaaagcca

SEQ ID NO: 234057 - DNA, 15 bp, Homo sapiens
gtcaagttcaaagcc

SEQ ID NO: 234058 - DNA, 15 bp, Homo sapiens
agtcaagttcaaagc

SEQ ID NO: 234059 - DNA, 15 bp, Homo sapiens
aagtcaagttcaaag

SEQ ID NO: 234060 - DNA, 15 bp, Homo sapiens
aaagtcaagttcaaa

SEQ ID NO: 234061 - DNA, 15 bp, Homo sapiens
caaagtcaagttcaa

SEQ ID NO: 234062 - DNA, 15 bp, Homo sapiens
tcaaagtcaagttca

SEQ ID NO: 234063 - DNA, 15 bp, Homo sapiens
atcaaagtcaagttc

SEQ ID NO: 234064 - DNA, 15 bp, Homo sapiens
aatcaaagtcaagtt

SEQ ID NO: 234065 - DNA, 15 bp, Homo sapiens
aaatcaaagtcaagt

SEQ ID NO: 234066 - DNA, 15 bp, Homo sapiens
gaaatcaaagtcaag

SEQ ID NO: 234067 - DNA, 15 bp, Homo sapiens
agaaatcaaagtcaa

SEQ ID NO: 234068 - DNA, 15 bp, Homo sapiens
cagaaatcaaagtca

SEQ ID NO: 234069 - DNA, 15 bp, Homo sapiens
acagaaatcaaagtc

SEQ ID NO: 234070 - DNA, 15 bp, Homo sapiens
gacagaaatcaaagt

SEQ ID NO: 234071 - DNA, 15 bp, Homo sapiens
agacagaaatcaaag

SEQ ID NO: 234072 - DNA, 15 bp, Homo sapiens
cagacagaaatcaaa

SEQ ID NO: 234073 - DNA, 15 bp, Homo sapiens
acagacagaaatcaa

SEQ ID NO: 234074 - DNA, 15 bp, Homo sapiens
tacagacagaaatca

SEQ ID NO: 234075 - DNA, 15 bp, Homo sapiens
atacagacagaaatc

SEQ ID NO: 234076 - DNA, 15 bp, Homo sapiens
gatacagacagaaat

SEQ ID NO: 234077 - DNA, 15 bp, Homo sapiens
ggatacagacagaaa

SEQ ID NO: 234078 - DNA, 15 bp, Homo sapiens
aggatacagacagaa

SEQ ID NO: 234079 - DNA, 15 bp, Homo sapiens
aaggatacagacaga

SEQ ID NO: 234080 - DNA, 15 bp, Homo sapiens
aaaggatacagacag

SEQ ID NO: 234081 - DNA, 15 bp, Homo sapiens
caaaggatacagaca

SEQ ID NO: 234082 - DNA, 15 bp, Homo sapiens
gcaaaggatacagac

SEQ ID NO: 234083 - DNA, 15 bp, Homo sapiens
agcaaaggatacaga

SEQ ID NO: 234084 - DNA, 15 bp, Homo sapiens
aagcaaaggatacag

SEQ ID NO: 234085 - DNA, 15 bp, Homo sapiens
gaagcaaaggataca

SEQ ID NO: 234086 - DNA, 15 bp, Homo sapiens
agaagcaaaggatac

SEQ ID NO: 234087 - DNA, 15 bp, Homo sapiens
gagaagcaaaggata

SEQ ID NO: 234088 - DNA, 15 bp, Homo sapiens
ggagaagcaaaggat

SEQ ID NO: 234089 - DNA, 15 bp, Homo sapiens
aggagaagcaaagga

SEQ ID NO: 234090 - DNA, 15 bp, Homo sapiens
gaggagaagcaaagg

SEQ ID NO: 234091 - DNA, 15 bp, Homo sapiens
agaggagaagcaaag

SEQ ID NO: 234092 - DNA, 15 bp, Homo sapiens
cagaggagaagcaaa

SEQ ID NO: 234093 - DNA, 15 bp, Homo sapiens
ccagaggagaagcaa

SEQ ID NO: 234094 - DNA, 15 bp, Homo sapiens
tccagaggagaagca

SEQ ID NO: 234095 - DNA, 15 bp, Homo sapiens
gtccagaggagaagc

SEQ ID NO: 234096 - DNA, 15 bp, Homo sapiens
agtccagaggagaag

SEQ ID NO: 234097 - DNA, 15 bp, Homo sapiens
cagtccagaggagaa

SEQ ID NO: 234098 - DNA, 15 bp, Homo sapiens
acagtccagaggaga

SEQ ID NO: 234099 - DNA, 15 bp, Homo sapiens
aacagtccagaggag

SEQ ID NO: 234100 - DNA, 15 bp, Homo sapiens
gaacagtccagagga

SEQ ID NO: 234101 - DNA, 15 bp, Homo sapiens
ggaacagtccagagg

SEQ ID NO: 234102 - DNA, 15 bp, Homo sapiens
tggaacagtccagag

SEQ ID NO: 234103 - DNA, 15 bp, Homo sapiens
ctggaacagtccaga

SEQ ID NO: 234104 - DNA, 15 bp, Homo sapiens
gctggaacagtccag

SEQ ID NO: 234105 - DNA, 15 bp, Homo sapiens
ggctggaacagtcca

SEQ ID NO: 234106 - DNA, 15 bp, Homo sapiens
gggctggaacagtcc

SEQ ID NO: 234107 - DNA, 15 bp, Homo sapiens
tgggctggaacagtc

SEQ ID NO: 234108 - DNA, 15 bp, Homo sapiens
gtgggctggaacagt

SEQ ID NO: 234109 - DNA, 15 bp, Homo sapiens
tgtgggctggaacag

SEQ ID NO: 234110 - DNA, 15 bp, Homo sapiens
atgtgggctggaaca

SEQ ID NO: 234111 - DNA, 15 bp, Homo sapiens
gatgtgggctggaac

SEQ ID NO: 234112 - DNA, 15 bp, Homo sapiens
ggatgtgggctggaa

SEQ ID NO: 234113 - DNA, 15 bp, Homo sapiens
aggatgtgggctgga

SEQ ID NO: 234114 - DNA, 15 bp, Homo sapiens
caggatgtgggctgg

SEQ ID NO: 234115 - DNA, 15 bp, Homo sapiens
acaggatgtgggctg

SEQ ID NO: 234116 - DNA, 15 bp, Homo sapiens
cacaggatgtgggct

SEQ ID NO: 234117 - DNA, 15 bp, Homo sapiens
ccacaggatgtgggc

SEQ ID NO: 234118 - DNA, 15 bp, Homo sapiens
gccacaggatgtggg

SEQ ID NO: 234119 - DNA, 15 bp, Homo sapiens
ggccacaggatgtgg

SEQ ID NO: 234120 - DNA, 15 bp, Homo sapiens
aggccacaggatgtg

SEQ ID NO: 234121 - DNA, 15 bp, Homo sapiens
caggccacaggatgt

SEQ ID NO: 234122 - DNA, 15 bp, Homo sapiens
acaggccacaggatg

SEQ ID NO: 234123 - DNA, 15 bp, Homo sapiens
gacaggccacaggat

SEQ ID NO: 234124 - DNA, 15 bp, Homo sapiens
ggacaggccacagga

SEQ ID NO: 234125 - DNA, 15 bp, Homo sapiens
tggacaggccacagg

SEQ ID NO: 234126 - DNA, 15 bp, Homo sapiens
atggacaggccacag

SEQ ID NO: 234127 - DNA, 15 bp, Homo sapiens
catggacaggccaca

SEQ ID NO: 234128 - DNA, 15 bp, Homo sapiens
acatggacaggccac

SEQ ID NO: 234129 - DNA, 15 bp, Homo sapiens
cacatggacaggcca

SEQ ID NO: 234130 - DNA, 15 bp, Homo sapiens
acacatggacaggcc

SEQ ID NO: 234131 - DNA, 15 bp, Homo sapiens
aacacatggacaggc

SEQ ID NO: 234132 - DNA, 15 bp, Homo sapiens
taacacatggacagg

SEQ ID NO: 234133 - DNA, 15 bp, Homo sapiens
ataacacatggacag

SEQ ID NO: 234134 - DNA, 15 bp, Homo sapiens
cataacacatggaca

SEQ ID NO: 234135 - DNA, 15 bp, Homo sapiens
gcataacacatggac

SEQ ID NO: 234136 - DNA, 15 bp, Homo sapiens
agcataacacatgga

SEQ ID NO: 234137 - DNA, 15 bp, Homo sapiens
aagcataacacatgg

SEQ ID NO: 234138 - DNA, 15 bp, Homo sapiens
caagcataacacatg

SEQ ID NO: 234139 - DNA, 15 bp, Homo sapiens
gcaagcataacacat

SEQ ID NO: 234140 - DNA, 15 bp, Homo sapiens
agcaagcataacaca

SEQ ID NO: 234141 - DNA, 15 bp, Homo sapiens
tagcaagcataacac

SEQ ID NO: 234142 - DNA, 15 bp, Homo sapiens
atagcaagcataaca

SEQ ID NO: 234143 - DNA, 15 bp, Homo sapiens
aatagcaagcataac

SEQ ID NO: 234144 - DNA, 15 bp, Homo sapiens
aaatagcaagcataa

SEQ ID NO: 234145 - DNA, 15 bp, Homo sapiens
aaaatagcaagcata

SEQ ID NO: 234146 - DNA, 15 bp, Homo sapiens
aaaaatagcaagcat

SEQ ID NO: 234147 - DNA, 15 bp, Homo sapiens
taaaaatagcaagca

SEQ ID NO: 234148 - DNA, 15 bp, Homo sapiens
ataaaaatagcaagc

SEQ ID NO: 234149 - DNA, 15 bp, Homo sapiens
gataaaaatagcaag

SEQ ID NO: 234150 - DNA, 15 bp, Homo sapiens
agataaaaatagcaa

SEQ ID NO: 234151 - DNA, 15 bp, Homo sapiens
cagataaaaatagca

SEQ ID NO: 234152 - DNA, 15 bp, Homo sapiens
tcagataaaaatagc

SEQ ID NO: 234153 - DNA, 15 bp, Homo sapiens
ttcagataaaaatag

SEQ ID NO: 234154 - DNA, 15 bp, Homo sapiens
tttcagataaaaata

SEQ ID NO: 234155 - DNA, 15 bp, Homo sapiens
gtttcagataaaaat

SEQ ID NO: 234156 - DNA, 15 bp, Homo sapiens
agtttcagataaaaa

SEQ ID NO: 234157 - DNA, 15 bp, Homo sapiens
gagtttcagataaaa

SEQ ID NO: 234158 - DNA, 15 bp, Homo sapiens
agagtttcagataaa

SEQ ID NO: 234159 - DNA, 15 bp, Homo sapiens
tagagtttcagataa

SEQ ID NO: 234160 - DNA, 15 bp, Homo sapiens
ttagagtttcagata

SEQ ID NO: 234161 - DNA, 15 bp, Homo sapiens
cttagagtttcagat

SEQ ID NO: 234162 - DNA, 15 bp, Homo sapiens
acttagagtttcaga

SEQ ID NO: 234163 - DNA, 15 bp, Homo sapiens
aacttagagtttcag

SEQ ID NO: 234164 - DNA, 15 bp, Homo sapiens
aaacttagagtttca

SEQ ID NO: 234165 - DNA, 15 bp, Homo sapiens
taaacttagagtttc

SEQ ID NO: 234166 - DNA, 15 bp, Homo sapiens
ataaacttagagttt

SEQ ID NO: 234167 - DNA, 15 bp, Homo sapiens
aataaacttagagtt

SEQ ID NO: 234168 - DNA, 15 bp, Homo sapiens
aaataaacttagagt

SEQ ID NO: 234169 - DNA, 15 bp, Homo sapiens
gaaataaacttagag

SEQ ID NO: 234170 - DNA, 15 bp, Homo sapiens
tgaaataaacttaga

SEQ ID NO: 234171 - DNA, 15 bp, Homo sapiens
ctgaaataaacttag

SEQ ID NO: 234172 - DNA, 15 bp, Homo sapiens
cctgaaataaactta

SEQ ID NO: 234173 - DNA, 15 bp, Homo sapiens
gcctgaaataaactt

SEQ ID NO: 234174 - DNA, 15 bp, Homo sapiens
tgcctgaaataaact

SEQ ID NO: 234175 - DNA, 15 bp, Homo sapiens
atgcctgaaataaac

SEQ ID NO: 234176 - DNA, 15 bp, Homo sapiens
aatgcctgaaataaa

SEQ ID NO: 234177 - DNA, 15 bp, Homo sapiens
caatgcctgaaataa

SEQ ID NO: 234178 - DNA, 15 bp, Homo sapiens
acaatgcctgaaata

SEQ ID NO: 234179 - DNA, 15 bp, Homo sapiens
cacaatgcctgaaat

SEQ ID NO: 234180 - DNA, 15 bp, Homo sapiens
ccacaatgcctgaaa

SEQ ID NO: 234181 - DNA, 15 bp, Homo sapiens
tccacaatgcctgaa

SEQ ID NO: 234182 - DNA, 15 bp, Homo sapiens
ttccacaatgcctga

SEQ ID NO: 234183 - DNA, 15 bp, Homo sapiens
cttccacaatgcctg

SEQ ID NO: 234184 - DNA, 15 bp, Homo sapiens
gcttccacaatgcct

SEQ ID NO: 234185 - DNA, 15 bp, Homo sapiens
ggcttccacaatgcc

SEQ ID NO: 234186 - DNA, 15 bp, Homo sapiens
gggcttccacaatgc

SEQ ID NO: 234187 - DNA, 15 bp, Homo sapiens
ggggcttccacaatg

SEQ ID NO: 234188 - DNA, 15 bp, Homo sapiens
gggggcttccacaat

SEQ ID NO: 234189 - DNA, 15 bp, Homo sapiens
agggggcttccacaa

SEQ ID NO: 234190 - DNA, 15 bp, Homo sapiens
aagggggcttccaca

SEQ ID NO: 234191 - DNA, 15 bp, Homo sapiens
caagggggcttccac

SEQ ID NO: 234192 - DNA, 15 bp, Homo sapiens
gcaagggggcttcca

SEQ ID NO: 234193 - DNA, 15 bp, Homo sapiens
agcaagggggcttcc

SEQ ID NO: 234194 - DNA, 15 bp, Homo sapiens
gagcaagggggcttc

SEQ ID NO: 234195 - DNA, 15 bp, Homo sapiens
agagcaagggggctt

SEQ ID NO: 234196 - DNA, 15 bp, Homo sapiens
tagagcaagggggct

SEQ ID NO: 234197 - DNA, 15 bp, Homo sapiens
atagagcaagggggc

SEQ ID NO: 234198 - DNA, 15 bp, Homo sapiens
aatagagcaaggggg

SEQ ID NO: 234199 - DNA, 15 bp, Homo sapiens
taatagagcaagggg

SEQ ID NO: 234200 - DNA, 15 bp, Homo sapiens
gtaatagagcaaggg

SEQ ID NO: 234201 - DNA, 15 bp, Homo sapiens
tgtaatagagcaagg

SEQ ID NO: 234202 - DNA, 15 bp, Homo sapiens
ttgtaatagagcaag

SEQ ID NO: 234203 - DNA, 15 bp, Homo sapiens
tttgtaatagagcaa

SEQ ID NO: 234204 - DNA, 15 bp, Homo sapiens
gtttgtaatagagca

SEQ ID NO: 234205 - DNA, 15 bp, Homo sapiens
agtttgtaatagagc

SEQ ID NO: 234206 - DNA, 15 bp, Homo sapiens
aagtttgtaatagag

SEQ ID NO: 234207 - DNA, 15 bp, Homo sapiens
taagtttgtaataga

SEQ ID NO: 234208 - DNA, 15 bp, Homo sapiens
ctaagtttgtaatag

SEQ ID NO: 234209 - DNA, 15 bp, Homo sapiens
cctaagtttgtaata

SEQ ID NO: 234210 - DNA, 15 bp, Homo sapiens
tcctaagtttgtaat

SEQ ID NO: 234211 - DNA, 15 bp, Homo sapiens
atcctaagtttgtaa

SEQ ID NO: 234212 - DNA, 15 bp, Homo sapiens
catcctaagtttgta

SEQ ID NO: 234213 - DNA, 15 bp, Homo sapiens
ccatcctaagtttgt

SEQ ID NO: 234214 - DNA, 15 bp, Homo sapiens
accatcctaagtttg

SEQ ID NO: 234215 - DNA, 15 bp, Homo sapiens
gaccatcctaagttt

SEQ ID NO: 234216 - DNA, 15 bp, Homo sapiens
ggaccatcctaagtt

SEQ ID NO: 234217 - DNA, 15 bp, Homo sapiens
aggaccatcctaagt

SEQ ID NO: 234218 - DNA, 15 bp, Homo sapiens
aaggaccatcctaag

SEQ ID NO: 234219 - DNA, 15 bp, Homo sapiens
caaggaccatcctaa

SEQ ID NO: 234220 - DNA, 15 bp, Homo sapiens
tcaaggaccatccta

SEQ ID NO: 234221 - DNA, 15 bp, Homo sapiens
ttcaaggaccatcct

SEQ ID NO: 234222 - DNA, 15 bp, Homo sapiens
tttcaaggaccatcc

SEQ ID NO: 234223 - DNA, 15 bp, Homo sapiens
atttcaaggaccatc

SEQ ID NO: 234224 - DNA, 15 bp, Homo sapiens
gatttcaaggaccat

SEQ ID NO: 234225 - DNA, 15 bp, Homo sapiens
agatttcaaggacca

SEQ ID NO: 234226 - DNA, 15 bp, Homo sapiens
aagatttcaaggacc

SEQ ID NO: 234227 - DNA, 15 bp, Homo sapiens
caagatttcaaggac

SEQ ID NO: 234228 - DNA, 15 bp, Homo sapiens
gcaagatttcaagga

SEQ ID NO: 234229 - DNA, 15 bp, Homo sapiens
agcaagatttcaagg

SEQ ID NO: 234230 - DNA, 15 bp, Homo sapiens
tagcaagatttcaag

SEQ ID NO: 234231 - DNA, 15 bp, Homo sapiens
atagcaagatttcaa

SEQ ID NO: 234232 - DNA, 15 bp, Homo sapiens
gatagcaagatttca

SEQ ID NO: 234233 - DNA, 15 bp, Homo sapiens
agatagcaagatttc

SEQ ID NO: 234234 - DNA, 15 bp, Homo sapiens
aagatagcaagattt

SEQ ID NO: 234235 - DNA, 15 bp, Homo sapiens
gaagatagcaagatt

SEQ ID NO: 234236 - DNA, 15 bp, Homo sapiens
ggaagatagcaagat

SEQ ID NO: 234237 - DNA, 15 bp, Homo sapiens
aggaagatagcaaga

SEQ ID NO: 234238 - DNA, 15 bp, Homo sapiens
caggaagatagcaag

SEQ ID NO: 234239 - DNA, 15 bp, Homo sapiens
gcaggaagatagcaa

SEQ ID NO: 234240 - DNA, 15 bp, Homo sapiens
agcaggaagatagca

SEQ ID NO: 234241 - DNA, 15 bp, Homo sapiens
tagcaggaagatagc

SEQ ID NO: 234242 - DNA, 15 bp, Homo sapiens
ttagcaggaagatag

SEQ ID NO: 234243 - DNA, 15 bp, Homo sapiens
tttagcaggaagata

SEQ ID NO: 234244 - DNA, 15 bp, Homo sapiens
ttttagcaggaagat

SEQ ID NO: 234245 - DNA, 15 bp, Homo sapiens
attttagcaggaaga

SEQ ID NO: 234246 - DNA, 15 bp, Homo sapiens
cattttagcaggaag

SEQ ID NO: 234247 - DNA, 15 bp, Homo sapiens
acattttagcaggaa

SEQ ID NO: 234248 - DNA, 15 bp, Homo sapiens
gacattttagcagga

SEQ ID NO: 234249 - DNA, 15 bp, Homo sapiens
agacattttagcagg

SEQ ID NO: 234250 - DNA, 15 bp, Homo sapiens
cagacattttagcag

SEQ ID NO: 234251 - DNA, 15 bp, Homo sapiens
acagacattttagca

SEQ ID NO: 234252 - DNA, 15 bp, Homo sapiens
cacagacattttagc

SEQ ID NO: 234253 - DNA, 15 bp, Homo sapiens
ccacagacattttag

SEQ ID NO: 234254 - DNA, 15 bp, Homo sapiens
cccacagacatttta

SEQ ID NO: 234255 - DNA, 15 bp, Homo sapiens
gcccacagacatttt

SEQ ID NO: 234256 - DNA, 15 bp, Homo sapiens
agcccacagacattt

SEQ ID NO: 234257 - DNA, 15 bp, Homo sapiens
cagcccacagacatt

SEQ ID NO: 234258 - DNA, 15 bp, Homo sapiens
gcagcccacagacat

SEQ ID NO: 234259 - DNA, 15 bp, Homo sapiens
tgcagcccacagaca

SEQ ID NO: 234260 - DNA, 15 bp, Homo sapiens
ctgcagcccacagac

SEQ ID NO: 234261 - DNA, 15 bp, Homo sapiens
tctgcagcccacaga

SEQ ID NO: 234262 - DNA, 15 bp, Homo sapiens
atctgcagcccacag

SEQ ID NO: 234263 - DNA, 15 bp, Homo sapiens
catctgcagcccaca

SEQ ID NO: 234264 - DNA, 15 bp, Homo sapiens
tcatctgcagcccac

SEQ ID NO: 234265 - DNA, 15 bp, Homo sapiens
atcatctgcagccca

SEQ ID NO: 234266 - DNA, 15 bp, Homo sapiens
catcatctgcagccc

SEQ ID NO: 234267 - DNA, 15 bp, Homo sapiens
gcatcatctgcagcc

SEQ ID NO: 234268 - DNA, 15 bp, Homo sapiens
ggcatcatctgcagc

SEQ ID NO: 234269 - DNA, 15 bp, Homo sapiens
gggcatcatctgcag

SEQ ID NO: 234270 - DNA, 15 bp, Homo sapiens
agggcatcatctgca

SEQ ID NO: 234271 - DNA, 15 bp, Homo sapiens
aagggcatcatctgc

SEQ ID NO: 234272 - DNA, 15 bp, Homo sapiens
aaagggcatcatctg

SEQ ID NO: 234273 - DNA, 15 bp, Homo sapiens
taaagggcatcatct

SEQ ID NO: 234274 - DNA, 15 bp, Homo sapiens
ataaagggcatcatc

SEQ ID NO: 234275 - DNA, 15 bp, Homo sapiens
aataaagggcatcat

SEQ ID NO: 234276 - DNA, 15 bp, Homo sapiens
taataaagggcatca

SEQ ID NO: 234277 - DNA, 15 bp, Homo sapiens
ttaataaagggcatc

SEQ ID NO: 234278 - DNA, 15 bp, Homo sapiens
tttaataaagggcat

SEQ ID NO: 234279 - DNA, 15 bp, Homo sapiens
ttttaataaagggca

SEQ ID NO: 234280 - DNA, 15 bp, Homo sapiens
gttttaataaagggc

SEQ ID NO: 234281 - DNA, 15 bp, Homo sapiens
agttttaataaaggg

SEQ ID NO: 234282 - DNA, 15 bp, Homo sapiens
tagttttaataaagg

SEQ ID NO: 234283 - DNA, 15 bp, Homo sapiens
ttagttttaataaag

SEQ ID NO: 234284 - DNA, 15 bp, Homo sapiens
tttagttttaataaa

SEQ ID NO: 234285 - DNA, 15 bp, Homo sapiens
gtttagttttaataa

SEQ ID NO: 234286 - DNA, 15 bp, Homo sapiens
agtttagttttaata

SEQ ID NO: 234287 - DNA, 15 bp, Homo sapiens
cagtttagttttaat

SEQ ID NO: 234288 - DNA, 15 bp, Homo sapiens
gcagtttagttttaa

SEQ ID NO: 234289 - DNA, 15 bp, Homo sapiens
agcagtttagtttta

SEQ ID NO: 234290 - DNA, 15 bp, Homo sapiens
tagcagtttagtttt

SEQ ID NO: 234291 - DNA, 15 bp, Homo sapiens
ttagcagtttagttt

SEQ ID NO: 234292 - DNA, 15 bp, Homo sapiens
tttagcagtttagtt

SEQ ID NO: 234293 - DNA, 15 bp, Homo sapiens
gtttagcagtttagt

SEQ ID NO: 234294 - DNA, 15 bp, Homo sapiens
tgtttagcagtttag

SEQ ID NO: 234295 - DNA, 15 bp, Homo sapiens
ctgtttagcagttta

SEQ ID NO: 234296 - DNA, 15 bp, Homo sapiens
gctgtttagcagttt

SEQ ID NO: 234297 - DNA, 15 bp, Homo sapiens
ggctgtttagcagtt

SEQ ID NO: 234298 - DNA, 15 bp, Homo sapiens
aggctgtttagcagt

SEQ ID NO: 234299 - DNA, 15 bp, Homo sapiens
aaggctgtttagcag

SEQ ID NO: 234300 - DNA, 15 bp, Homo sapiens
taaggctgtttagca

SEQ ID NO: 234301 - DNA, 15 bp, Homo sapiens
ctaaggctgtttagc

SEQ ID NO: 234302 - DNA, 15 bp, Homo sapiens
tctaaggctgtttag

SEQ ID NO: 234303 - DNA, 15 bp, Homo sapiens
ctctaaggctgttta

SEQ ID NO: 234304 - DNA, 15 bp, Homo sapiens
tctctaaggctgttt

SEQ ID NO: 234305 - DNA, 15 bp, Homo sapiens
ctctctaaggctgtt

SEQ ID NO: 234306 - DNA, 15 bp, Homo sapiens
tctctctaaggctgt

SEQ ID NO: 234307 - DNA, 15 bp, Homo sapiens
atctctctaaggctg

SEQ ID NO: 234308 - DNA, 15 bp, Homo sapiens
catctctctaaggct

SEQ ID NO: 234309 - DNA, 15 bp, Homo sapiens
tcatctctctaaggc

SEQ ID NO: 234310 - DNA, 15 bp, Homo sapiens
atcatctctctaagg

SEQ ID NO: 234311 - DNA, 15 bp, Homo sapiens
gatcatctctctaag

SEQ ID NO: 234312 - DNA, 15 bp, Homo sapiens
tgatcatctctctaa

SEQ ID NO: 234313 - DNA, 15 bp, Homo sapiens
gtgatcatctctcta

SEQ ID NO: 234314 - DNA, 15 bp, Homo sapiens
agtgatcatctctct

SEQ ID NO: 234315 - DNA, 15 bp, Homo sapiens
tagtgatcatctctc

SEQ ID NO: 234316 - DNA, 15 bp, Homo sapiens
atagtgatcatctct

SEQ ID NO: 234317 - DNA, 15 bp, Homo sapiens
gatagtgatcatctc

SEQ ID NO: 234318 - DNA, 15 bp, Homo sapiens
agatagtgatcatct

SEQ ID NO: 234319 - DNA, 15 bp, Homo sapiens
tagatagtgatcatc

SEQ ID NO: 234320 - DNA, 15 bp, Homo sapiens
ttagatagtgatcat

SEQ ID NO: 234321 - DNA, 15 bp, Homo sapiens
cttagatagtgatca

SEQ ID NO: 234322 - DNA, 15 bp, Homo sapiens
ccttagatagtgatc

SEQ ID NO: 234323 - DNA, 15 bp, Homo sapiens
accttagatagtgat

SEQ ID NO: 234324 - DNA, 15 bp, Homo sapiens
taccttagatagtga

SEQ ID NO: 234325 - DNA, 15 bp, Homo sapiens
ataccttagatagtg

SEQ ID NO: 234326 - DNA, 15 bp, Homo sapiens
cataccttagatagt

SEQ ID NO: 234327 - DNA, 15 bp, Homo sapiens
acataccttagatag

SEQ ID NO: 234328 - DNA, 15 bp, Homo sapiens
aacataccttagata

SEQ ID NO: 234329 - DNA, 15 bp, Homo sapiens
taacataccttagat

SEQ ID NO: 234330 - DNA, 15 bp, Homo sapiens
ataacataccttaga

SEQ ID NO: 234331 - DNA, 15 bp, Homo sapiens
aataacataccttag

SEQ ID NO: 234332 - DNA, 15 bp, Homo sapiens
aaataacatacctta

SEQ ID NO: 234333 - DNA, 15 bp, Homo sapiens
caaataacatacctt

SEQ ID NO: 234334 - DNA, 15 bp, Homo sapiens
acaaataacatacct

SEQ ID NO: 234335 - DNA, 15 bp, Homo sapiens
gacaaataacatacc

SEQ ID NO: 234336 - DNA, 15 bp, Homo sapiens
agacaaataacatac

SEQ ID NO: 234337 - DNA, 15 bp, Homo sapiens
aagacaaataacata

SEQ ID NO: 234338 - DNA, 15 bp, Homo sapiens
gaagacaaataacat

SEQ ID NO: 234339 - DNA, 15 bp, Homo sapiens
tgaagacaaataaca

SEQ ID NO: 234340 - DNA, 15 bp, Homo sapiens
ctgaagacaaataac

SEQ ID NO: 234341 - DNA, 15 bp, Homo sapiens
actgaagacaaataa

SEQ ID NO: 234342 - DNA, 15 bp, Homo sapiens
tactgaagacaaata

SEQ ID NO: 234343 - DNA, 15 bp, Homo sapiens
atactgaagacaaat

SEQ ID NO: 234344 - DNA, 15 bp, Homo sapiens
aatactgaagacaaa

SEQ ID NO: 234345 - DNA, 15 bp, Homo sapiens
aaatactgaagacaa

SEQ ID NO: 234346 - DNA, 15 bp, Homo sapiens
taaatactgaagaca

SEQ ID NO: 234347 - DNA, 15 bp, Homo sapiens
ataaatactgaagac

SEQ ID NO: 234348 - DNA, 15 bp, Homo sapiens
aataaatactgaaga

SEQ ID NO: 234349 - DNA, 15 bp, Homo sapiens
aaataaatactgaag

SEQ ID NO: 234350 - DNA, 15 bp, Homo sapiens
aaaataaatactgaa

SEQ ID NO: 234351 - DNA, 15 bp, Homo sapiens
aaaaataaatactga

SEQ ID NO: 234352 - DNA, 15 bp, Homo sapiens
taaaaataaatactg

SEQ ID NO: 234353 - DNA, 15 bp, Homo sapiens
ctaaaaataaatact

SEQ ID NO: 234354 - DNA, 15 bp, Homo sapiens
cctaaaaataaatac

SEQ ID NO: 234355 - DNA, 15 bp, Homo sapiens
tcctaaaaataaata

SEQ ID NO: 234356 - DNA, 15 bp, Homo sapiens
ttcctaaaaataaat

SEQ ID NO: 234357 - DNA, 15 bp, Homo sapiens
gttcctaaaaataaa

SEQ ID NO: 234358 - DNA, 15 bp, Homo sapiens
gtgttcctaaaaata

SEQ ID NO: 234359 - DNA, 15 bp, Homo sapiens
tgtgttcctaaaaat

SEQ ID NO: 234360 - DNA, 15 bp, Homo sapiens
ttgtgttcctaaaaa

SEQ ID NO: 234361 - DNA, 15 bp, Homo sapiens
attgtgttcctaaaa

SEQ ID NO: 234362 - DNA, 15 bp, Homo sapiens
tattgtgttcctaaa

SEQ ID NO: 234363 - DNA, 15 bp, Homo sapiens
gtattgtgttcctaa

SEQ ID NO: 234364 - DNA, 15 bp, Homo sapiens
tgtattgtgttccta

SEQ ID NO: 234365 - DNA, 15 bp, Homo sapiens
atgtattgtgttcct

SEQ ID NO: 234366 - DNA, 15 bp, Homo sapiens
aatgtattgtgttcc

SEQ ID NO: 234367 - DNA, 15 bp, Homo sapiens
taatgtattgtgttc

SEQ ID NO: 234368 - DNA, 15 bp, Homo sapiens
ttaatgtattgtgtt

SEQ ID NO: 234369 - DNA, 15 bp, Homo sapiens
attaatgtattgtgt

SEQ ID NO: 234370 - DNA, 15 bp, Homo sapiens
gattaatgtattgtg

SEQ ID NO: 234371 - DNA, 15 bp, Homo sapiens
agattaatgtattgt

SEQ ID NO: 234372 - DNA, 15 bp, Homo sapiens
aagattaatgtattg

SEQ ID NO: 234373 - DNA, 15 bp, Homo sapiens
taagattaatgtatt

SEQ ID NO: 234374 - DNA, 15 bp, Homo sapiens
ataagattaatgtat

SEQ ID NO: 234375 - DNA, 15 bp, Homo sapiens
aataagattaatgta

SEQ ID NO: 234376 - DNA, 15 bp, Homo sapiens
aaataagattaatgt

SEQ ID NO: 234377 - DNA, 15 bp, Homo sapiens
aaaataagattaatg

SEQ ID NO: 234378 - DNA, 15 bp, Homo sapiens
gaaaataagattaat

SEQ ID NO: 234379 - DNA, 15 bp, Homo sapiens
agaaaataagattaa

SEQ ID NO: 234380 - DNA, 15 bp, Homo sapiens
cagaaaataagatta

SEQ ID NO: 234381 - DNA, 15 bp, Homo sapiens
tcagaaaataagatt

SEQ ID NO: 234382 - DNA, 15 bp, Homo sapiens
ctcagaaaataagat

SEQ ID NO: 234383 - DNA, 15 bp, Homo sapiens
tctcagaaaataaga

SEQ ID NO: 234384 - DNA, 15 bp, Homo sapiens
ctctcagaaaataag

SEQ ID NO: 234385 - DNA, 15 bp, Homo sapiens
actctcagaaaataa

SEQ ID NO: 234386 - DNA, 15 bp, Homo sapiens
aactctcagaaaata

SEQ ID NO: 234387 - DNA, 15 bp, Homo sapiens
aaactctcagaaaat

SEQ ID NO: 234388 - DNA, 15 bp, Homo sapiens
aaaactctcagaaaa

SEQ ID NO: 234389 - DNA, 15 bp, Homo sapiens
aaaaactctcagaaa

SEQ ID NO: 234390 - DNA, 15 bp, Homo sapiens
caaaaactctcagaa

SEQ ID NO: 234391 - DNA, 15 bp, Homo sapiens
gcaaaaactctcaga

SEQ ID NO: 234392 - DNA, 15 bp, Homo sapiens
agcaaaaactctcag

SEQ ID NO: 234393 - DNA, 15 bp, Homo sapiens
aagcaaaaactctca

SEQ ID NO: 234394 - DNA, 15 bp, Homo sapiens
taagcaaaaactctc

SEQ ID NO: 234395 - DNA, 15 bp, Homo sapiens
ataagcaaaaactct

SEQ ID NO: 234396 - DNA, 15 bp, Homo sapiens
tataagcaaaaactc

SEQ ID NO: 234397 - DNA, 15 bp, Homo sapiens
ttataagcaaaaact

SEQ ID NO: 234398 - DNA, 15 bp, Homo sapiens
attataagcaaaaac

SEQ ID NO: 234399 - DNA, 15 bp, Homo sapiens
aattataagcaaaaa

SEQ ID NO: 234400 - DNA, 15 bp, Homo sapiens
aaattataagcaaaa

SEQ ID NO: 234401 - DNA, 15 bp, Homo sapiens
taaattataagcaaa

SEQ ID NO: 234402 - DNA, 15 bp, Homo sapiens
ataaattataagcaa

SEQ ID NO: 234403 - DNA, 15 bp, Homo sapiens
tataaattataagca

SEQ ID NO: 234404 - DNA, 15 bp, Homo sapiens
ctataaattataagc

SEQ ID NO: 234405 - DNA, 15 bp, Homo sapiens
actataaattataag

SEQ ID NO: 234406 - DNA, 15 bp, Homo sapiens
gactataaattataa

SEQ ID NO: 234407 - DNA, 15 bp, Homo sapiens
tgactataaattata

SEQ ID NO: 234408 - DNA, 15 bp, Homo sapiens
atgactataaattat

SEQ ID NO: 234409 - DNA, 15 bp, Homo sapiens
aatgactataaatta

SEQ ID NO: 234410 - DNA, 15 bp, Homo sapiens
gaatgactataaatt

SEQ ID NO: 234411 - DNA, 15 bp, Homo sapiens
agaatgactataaat

SEQ ID NO: 234412 - DNA, 15 bp, Homo sapiens
aagaatgactataaa

SEQ ID NO: 234413 - DNA, 15 bp, Homo sapiens
gaagaatgactataa

SEQ ID NO: 234414 - DNA, 15 bp, Homo sapiens
tgaagaatgactata

SEQ ID NO: 234415 - DNA, 15 bp, Homo sapiens
atgaagaatgactat

SEQ ID NO: 234416 - DNA, 15 bp, Homo sapiens
aatgaagaatgacta

SEQ ID NO: 234417 - DNA, 15 bp, Homo sapiens
taatgaagaatgact

SEQ ID NO: 234418 - DNA, 15 bp, Homo sapiens
ttaatgaagaatgac

SEQ ID NO: 234419 - DNA, 15 bp, Homo sapiens
attaatgaagaatga

SEQ ID NO: 234420 - DNA, 15 bp, Homo sapiens
aattaatgaagaatg

SEQ ID NO: 234421 - DNA, 15 bp, Homo sapiens
taattaatgaagaat

SEQ ID NO: 234422 - DNA, 15 bp, Homo sapiens
ataattaatgaagaa

SEQ ID NO: 234423 - DNA, 15 bp, Homo sapiens
tataattaatgaaga

SEQ ID NO: 234424 - DNA, 15 bp, Homo sapiens
gtataattaatgaag

SEQ ID NO: 234425 - DNA, 15 bp, Homo sapiens
agtataattaatgaa

SEQ ID NO: 234426 - DNA, 15 bp, Homo sapiens
aagtataattaatga

SEQ ID NO: 234427 - DNA, 15 bp, Homo sapiens
taagtataattaatg

SEQ ID NO: 234428 - DNA, 15 bp, Homo sapiens
gtaagtataattaat

SEQ ID NO: 234429 - DNA, 15 bp, Homo sapiens
ggtaagtataattaa

SEQ ID NO: 234430 - DNA, 15 bp, Homo sapiens
tggtaagtataatta

SEQ ID NO: 234431 - DNA, 15 bp, Homo sapiens
atggtaagtataatt

SEQ ID NO: 234432 - DNA, 15 bp, Homo sapiens
aatggtaagtataat

SEQ ID NO: 234433 - DNA, 15 bp, Homo sapiens
aaatggtaagtataa

SEQ ID NO: 234434 - DNA, 15 bp, Homo sapiens
gaaatggtaagtata

SEQ ID NO: 234435 - DNA, 15 bp, Homo sapiens
agaaatggtaagtat

SEQ ID NO: 234436 - DNA, 15 bp, Homo sapiens
gagaaatggtaagta

SEQ ID NO: 234437 - DNA, 15 bp, Homo sapiens
agagaaatggtaagt

SEQ ID NO: 234438 - DNA, 15 bp, Homo sapiens
aagagaaatggtaag

SEQ ID NO: 234439 - DNA, 15 bp, Homo sapiens
caagagaaatggtaa

SEQ ID NO: 234440 - DNA, 15 bp, Homo sapiens
tcaagagaaatggta

SEQ ID NO: 234441 - DNA, 15 bp, Homo sapiens
ctcaagagaaatggt

SEQ ID NO: 234442 - DNA, 15 bp, Homo sapiens
tctcaagagaaatgg

SEQ ID NO: 234443 - DNA, 15 bp, Homo sapiens
ttctcaagagaaatg

SEQ ID NO: 234444 - DNA, 15 bp, Homo sapiens
attctcaagagaaat

SEQ ID NO: 234445 - DNA, 15 bp, Homo sapiens
tattctcaagagaaa

SEQ ID NO: 234446 - DNA, 15 bp, Homo sapiens
gtattctcaagagaa

SEQ ID NO: 234447 - DNA, 15 bp, Homo sapiens
agtattctcaagaga

SEQ ID NO: 234448 - DNA, 15 bp, Homo sapiens
cagtattctcaagag

SEQ ID NO: 234449 - DNA, 15 bp, Homo sapiens
tcagtattctcaaga

SEQ ID NO: 234450 - DNA, 15 bp, Homo sapiens
ttcagtattctcaag

SEQ ID NO: 234451 - DNA, 15 bp, Homo sapiens
tttcagtattctcaa

SEQ ID NO: 234452 - DNA, 15 bp, Homo sapiens
atttcagtattctca

SEQ ID NO: 234453 - DNA, 15 bp, Homo sapiens
catttcagtattctc

SEQ ID NO: 234454 - DNA, 15 bp, Homo sapiens
tcatttcagtattct

SEQ ID NO: 234455 - DNA, 15 bp, Homo sapiens
ttcatttcagtattc

SEQ ID NO: 234456 - DNA, 15 bp, Homo sapiens
tttcatttcagtatt

SEQ ID NO: 234457 - DNA, 15 bp, Homo sapiens
ttttcatttcagtat

SEQ ID NO: 234458 - DNA, 15 bp, Homo sapiens
tttttcatttcagta

SEQ ID NO: 234459 - DNA, 15 bp, Homo sapiens
ctttttcatttcagt

SEQ ID NO: 234460 - DNA, 15 bp, Homo sapiens
actttttcatttcag

SEQ ID NO: 234461 - DNA, 15 bp, Homo sapiens
cactttttcatttca

SEQ ID NO: 234462 - DNA, 15 bp, Homo sapiens
acactttttcatttc

SEQ ID NO: 234463 - DNA, 15 bp, Homo sapiens
gacactttttcattt

SEQ ID NO: 234464 - DNA, 15 bp, Homo sapiens
agacactttttcatt

SEQ ID NO: 234465 - DNA, 15 bp, Homo sapiens
aagacactttttcat

SEQ ID NO: 234466 - DNA, 15 bp, Homo sapiens
aaagacactttttca

SEQ ID NO: 234467 - DNA, 15 bp, Homo sapiens
caaagacactttttc

SEQ ID NO: 234468 - DNA, 15 bp, Homo sapiens
ccaaagacacttttt

SEQ ID NO: 234469 - DNA, 15 bp, Homo sapiens
tccaaagacactttt

SEQ ID NO: 234470 - DNA, 15 bp, Homo sapiens
atccaaagacacttt

SEQ ID NO: 234471 - DNA, 15 bp, Homo sapiens
aatccaaagacactt

SEQ ID NO: 234472 - DNA, 15 bp, Homo sapiens
aaatccaaagacact

SEQ ID NO: 234473 - DNA, 15 bp, Homo sapiens
aaaatccaaagacac

SEQ ID NO: 234474 - DNA, 15 bp, Homo sapiens
caaaatccaaagaca

SEQ ID NO: 234475 - DNA, 15 bp, Homo sapiens
acaaaatccaaagac

SEQ ID NO: 234476 - DNA, 15 bp, Homo sapiens
cacaaaatccaaaga

SEQ ID NO: 234477 - DNA, 15 bp, Homo sapiens
acacaaaatccaaag

SEQ ID NO: 234478 - DNA, 15 bp, Homo sapiens
tacacaaaatccaaa

SEQ ID NO: 234479 - DNA, 15 bp, Homo sapiens
ttacacaaaatccaa

SEQ ID NO: 234480 - DNA, 15 bp, Homo sapiens
gttacacaaaatcca

SEQ ID NO: 234481 - DNA, 15 bp, Homo sapiens
agttacacaaaatcc

SEQ ID NO: 234482 - DNA, 15 bp, Homo sapiens
cagttacacaaaatc

SEQ ID NO: 234483 - DNA, 15 bp, Homo sapiens
tcagttacacaaaat

SEQ ID NO: 234484 - DNA, 15 bp, Homo sapiens
ttcagttacacaaaa

SEQ ID NO: 234485 - DNA, 15 bp, Homo sapiens
attcagttacacaaa

SEQ ID NO: 234486 - DNA, 15 bp, Homo sapiens
aattcagttacacaa

SEQ ID NO: 234487 - DNA, 15 bp, Homo sapiens
aaattcagttacaca

SEQ ID NO: 234488 - DNA, 15 bp, Homo sapiens
taaattcagttacac

SEQ ID NO: 234489 - DNA, 15 bp, Homo sapiens
ataaattcagttaca

SEQ ID NO: 234490 - DNA, 15 bp, Homo sapiens
cataaattcagttac

SEQ ID NO: 234491 - DNA, 15 bp, Homo sapiens
tcataaattcagtta

SEQ ID NO: 234492 - DNA, 15 bp, Homo sapiens
atcataaattcagtt

SEQ ID NO: 234493 - DNA, 15 bp, Homo sapiens
tatcataaattcagt

SEQ ID NO: 234494 - DNA, 15 bp, Homo sapiens
ttatcataaattcag

SEQ ID NO: 234495 - DNA, 15 bp, Homo sapiens
tttatcataaattca

SEQ ID NO: 234496 - DNA, 15 bp, Homo sapiens
ctttatcataaattc

SEQ ID NO: 234497 - DNA, 15 bp, Homo sapiens
tctttatcataaatt

SEQ ID NO: 234498 - DNA, 15 bp, Homo sapiens
ttctttatcataaat

SEQ ID NO: 234499 - DNA, 15 bp, Homo sapiens
tttctttatcataaa

SEQ ID NO: 234500 - DNA, 15 bp, Homo sapiens
ttttctttatcataa

SEQ ID NO: 234501 - DNA, 15 bp, Homo sapiens
tttttctttatcata

SEQ ID NO: 234502 - DNA, 15 bp, Homo sapiens
atttttctttatcat

SEQ ID NO: 234503 - DNA, 15 bp, Homo sapiens
aatttttctttatca

SEQ ID NO: 234504 - DNA, 15 bp, Homo sapiens
caatttttctttatc

SEQ ID NO: 234505 - DNA, 15 bp, Homo sapiens
ccaatttttctttat

SEQ ID NO: 234506 - DNA, 15 bp, Homo sapiens
accaatttttcttta

SEQ ID NO: 234507 - DNA, 15 bp, Homo sapiens
aaccaatttttcttt

SEQ ID NO: 234508 - DNA, 15 bp, Homo sapiens
aaaccaatttttctt

SEQ ID NO: 234509 - DNA, 15 bp, Homo sapiens
taaaccaatttttct

SEQ ID NO: 234510 - DNA, 15 bp, Homo sapiens
ataaaccaatttttc

SEQ ID NO: 234511 - DNA, 15 bp, Homo sapiens
aataaaccaattttt

SEQ ID NO: 234512 - DNA, 15 bp, Homo sapiens
aaataaaccaatttt

SEQ ID NO: 234513 - DNA, 15 bp, Homo sapiens
gaaataaaccaattt

SEQ ID NO: 234514 - DNA, 15 bp, Homo sapiens
agaaataaaccaatt

SEQ ID NO: 234515 - DNA, 15 bp, Homo sapiens
aagaaataaaccaat

SEQ ID NO: 234516 - DNA, 15 bp, Homo sapiens
caagaaataaaccaa

SEQ ID NO: 234517 - DNA, 15 bp, Homo sapiens
acaagaaataaacca

SEQ ID NO: 234518 - DNA, 15 bp, Homo sapiens
cacaagaaataaacc

SEQ ID NO: 234519 - DNA, 15 bp, Homo sapiens
acacaagaaataaac

SEQ ID NO: 234520 - DNA, 15 bp, Homo sapiens
aacacaagaaataaa

SEQ ID NO: 234521 - DNA, 15 bp, Homo sapiens
taacacaagaaataa

SEQ ID NO: 234522 - DNA, 15 bp, Homo sapiens
ataacacaagaaata

SEQ ID NO: 234523 - DNA, 15 bp, Homo sapiens
gataacacaagaaat

SEQ ID NO: 234524 - DNA, 15 bp, Homo sapiens
agataacacaagaaa

SEQ ID NO: 234525 - DNA, 15 bp, Homo sapiens
aagataacacaagaa

SEQ ID NO: 234526 - DNA, 15 bp, Homo sapiens
gaagataacacaaga

SEQ ID NO: 234527 - DNA, 15 bp, Homo sapiens
agaagataacacaag

SEQ ID NO: 234528 - DNA, 15 bp, Homo sapiens
aagaagataacacaa

SEQ ID NO: 234529 - DNA, 15 bp, Homo sapiens
taagaagataacaca

SEQ ID NO: 234530 - DNA, 15 bp, Homo sapiens
gtaagaagataacac

SEQ ID NO: 234531 - DNA, 15 bp, Homo sapiens
tgtaagaagataaca

SEQ ID NO: 234532 - DNA, 15 bp, Homo sapiens
atgtaagaagataac

SEQ ID NO: 234533 - DNA, 15 bp, Homo sapiens
aatgtaagaagataa

SEQ ID NO: 234534 - DNA, 15 bp, Homo sapiens
aaatgtaagaagata

SEQ ID NO: 234535 - DNA, 15 bp, Homo sapiens
gaaatgtaagaagat

SEQ ID NO: 234536 - DNA, 15 bp, Homo sapiens
tgaaatgtaagaaga

SEQ ID NO: 234537 - DNA, 15 bp, Homo sapiens
ctgaaatgtaagaag

SEQ ID NO: 234538 - DNA, 15 bp, Homo sapiens
actgaaatgtaagaa

SEQ ID NO: 234539 - DNA, 15 bp, Homo sapiens
cactgaaatgtaaga

SEQ ID NO: 234540 - DNA, 15 bp, Homo sapiens
ccactgaaatgtaag

SEQ ID NO: 234541 - DNA, 15 bp, Homo sapiens
gccactgaaatgtaa

SEQ ID NO: 234542 - DNA, 15 bp, Homo sapiens
agccactgaaatgta

SEQ ID NO: 234543 - DNA, 15 bp, Homo sapiens
aagccactgaaatgt

SEQ ID NO: 234544 - DNA, 15 bp, Homo sapiens
aaagccactgaaatg

SEQ ID NO: 234545 - DNA, 15 bp, Homo sapiens
taaagccactgaaat

SEQ ID NO: 234546 - DNA, 15 bp, Homo sapiens
ctaaagccactgaaa

SEQ ID NO: 234547 - DNA, 15 bp, Homo sapiens
tctaaagccactgaa

SEQ ID NO: 234548 - DNA, 15 bp, Homo sapiens
ttctaaagccactga

SEQ ID NO: 234549 - DNA, 15 bp, Homo sapiens
tttctaaagccactg

SEQ ID NO: 234550 - DNA, 15 bp, Homo sapiens
atttctaaagccact

SEQ ID NO: 234551 - DNA, 15 bp, Homo sapiens
tatttctaaagccac

SEQ ID NO: 234552 - DNA, 15 bp, Homo sapiens
atatttctaaagcca

SEQ ID NO: 234553 - DNA, 15 bp, Homo sapiens
tatatttctaaagcc

SEQ ID NO: 234554 - DNA, 15 bp, Homo sapiens
atatatttctaaagc

SEQ ID NO: 234555 - DNA, 15 bp, Homo sapiens
aatatatttctaaag

SEQ ID NO: 234556 - DNA, 15 bp, Homo sapiens
taatatatttctaaa

SEQ ID NO: 234557 - DNA, 15 bp, Homo sapiens
ttaatatatttctaa

SEQ ID NO: 234558 - DNA, 15 bp, Homo sapiens
tttaatatatttcta

SEQ ID NO: 234559 - DNA, 15 bp, Homo sapiens
ctttaatatatttct

SEQ ID NO: 234560 - DNA, 15 bp, Homo sapiens
actttaatatatttc

SEQ ID NO: 234561 - DNA, 15 bp, Homo sapiens
aactttaatatattt

SEQ ID NO: 234562 - DNA, 15 bp, Homo sapiens
gaactttaatatatt

SEQ ID NO: 234563 - DNA, 15 bp, Homo sapiens
tgaactttaatatat

SEQ ID NO: 234564 - DNA, 15 bp, Homo sapiens
ttgaactttaatata

SEQ ID NO: 234565 - DNA, 15 bp, Homo sapiens
tttgaactttaatat

SEQ ID NO: 234566 - DNA, 15 bp, Homo sapiens
ttttgaactttaata

SEQ ID NO: 234567 - DNA, 15 bp, Homo sapiens
tttttgaactttaat

SEQ ID NO: 234568 - DNA, 15 bp, Homo sapiens
gtttttgaactttaa

SEQ ID NO: 234569 - DNA, 15 bp, Homo sapiens
ggtttttgaacttta

SEQ ID NO: 234570 - DNA, 15 bp, Homo sapiens
cggtttttgaacttt

SEQ ID NO: 234571 - DNA, 15 bp, Homo sapiens
ccggtttttgaactt

SEQ ID NO: 234572 - DNA, 15 bp, Homo sapiens
cccggtttttgaact

SEQ ID NO: 234573 - DNA, 15 bp, Homo sapiens
acccggtttttgaac

SEQ ID NO: 234574 - DNA, 15 bp, Homo sapiens
gacccggtttttgaa

SEQ ID NO: 234575 - DNA, 15 bp, Homo sapiens
tgacccggtttttga

SEQ ID NO: 234576 - DNA, 15 bp, Homo sapiens
ttgacccggtttttg

SEQ ID NO: 234577 - DNA, 15 bp, Homo sapiens
attgacccggttttt

SEQ ID NO: 234578 - DNA, 15 bp, Homo sapiens
aattgacccggtttt

SEQ ID NO: 234579 - DNA, 15 bp, Homo sapiens
aaattgacccggttt

SEQ ID NO: 234580 - DNA, 15 bp, Homo sapiens
taaattgacccggtt

SEQ ID NO: 234581 - DNA, 15 bp, Homo sapiens
ataaattgacccggt

SEQ ID NO: 234582 - DNA, 15 bp, Homo sapiens
aataaattgacccgg

SEQ ID NO: 234583 - DNA, 15 bp, Homo sapiens
taataaattgacccg

SEQ ID NO: 234584 - DNA, 15 bp, Homo sapiens
ttaataaattgaccc

SEQ ID NO: 234585 - DNA, 15 bp, Homo sapiens
attaataaattgacc

SEQ ID NO: 234586 - DNA, 15 bp, Homo sapiens
gattaataaattgac

SEQ ID NO: 234587 - DNA, 15 bp, Homo sapiens
agattaataaattga

SEQ ID NO: 234588 - DNA, 15 bp, Homo sapiens
gagattaataaattg

SEQ ID NO: 234589 - DNA, 15 bp, Homo sapiens
tgagattaataaatt

SEQ ID NO: 234590 - DNA, 15 bp, Homo sapiens
ctgagattaataaat

SEQ ID NO: 234591 - DNA, 15 bp, Homo sapiens
actgagattaataaa

SEQ ID NO: 234592 - DNA, 15 bp, Homo sapiens
tactgagattaataa

SEQ ID NO: 234593 - DNA, 15 bp, Homo sapiens
ttactgagattaata

SEQ ID NO: 234594 - DNA, 15 bp, Homo sapiens
gttactgagattaat

SEQ ID NO: 234595 - DNA, 15 bp, Homo sapiens
agttactgagattaa

SEQ ID NO: 234596 - DNA, 15 bp, Homo sapiens
cagttactgagatta

SEQ ID NO: 234597 - DNA, 15 bp, Homo sapiens
acagttactgagatt

SEQ ID NO: 234598 - DNA, 15 bp, Homo sapiens
aacagttactgagat

SEQ ID NO: 234599 - DNA, 15 bp, Homo sapiens
aaacagttactgaga

SEQ ID NO: 234600 - DNA, 15 bp, Homo sapiens
aaaacagttactgag

SEQ ID NO: 234601 - DNA, 15 bp, Homo sapiens
taaaacagttactga

SEQ ID NO: 234602 - DNA, 15 bp, Homo sapiens
ataaaacagttactg

SEQ ID NO: 234603 - DNA, 15 bp, Homo sapiens
aataaaacagttact

SEQ ID NO: 234604 - DNA, 15 bp, Homo sapiens
taataaaacagttac

SEQ ID NO: 234605 - DNA, 15 bp, Homo sapiens
ataataaaacagtta

SEQ ID NO: 234606 - DNA, 15 bp, Homo sapiens
gataataaaacagtt

SEQ ID NO: 234607 - DNA, 15 bp, Homo sapiens
ggataataaaacagt

SEQ ID NO: 234608 - DNA, 15 bp, Homo sapiens
aggataataaaacag

SEQ ID NO: 234609 - DNA, 15 bp, Homo sapiens
aaggataataaaaca

SEQ ID NO: 234610 - DNA, 15 bp, Homo sapiens
aaaggataataaaac

SEQ ID NO: 234611 - DNA, 15 bp, Homo sapiens
aaaaggataataaaa

SEQ ID NO: 234612 - DNA, 15 bp, Homo sapiens
caaaaggataataaa

SEQ ID NO: 234613 - DNA, 15 bp, Homo sapiens
tcaaaaggataataa

SEQ ID NO: 234614 - DNA, 15 bp, Homo sapiens
ctcaaaaggataata

SEQ ID NO: 234615 - DNA, 15 bp, Homo sapiens
actcaaaaggataat

SEQ ID NO: 234616 - DNA, 15 bp, Homo sapiens
cactcaaaaggataa

SEQ ID NO: 234617 - DNA, 15 bp, Homo sapiens
acactcaaaaggata

SEQ ID NO: 234618 - DNA, 15 bp, Homo sapiens
cacactcaaaaggat

SEQ ID NO: 234619 - DNA, 15 bp, Homo sapiens
acacactcaaaagga

SEQ ID NO: 234620 - DNA, 15 bp, Homo sapiens
cacacactcaaaagg

SEQ ID NO: 234621 - DNA, 15 bp, Homo sapiens
tcacacactcaaaag

SEQ ID NO: 234622 - DNA, 15 bp, Homo sapiens
atcacacactcaaaa

SEQ ID NO: 234623 - DNA, 15 bp, Homo sapiens
aatcacacactcaaa

SEQ ID NO: 234624 - DNA, 15 bp, Homo sapiens
taatcacacactcaa

SEQ ID NO: 234625 - DNA, 15 bp, Homo sapiens
ttaatcacacactca

SEQ ID NO: 234626 - DNA, 15 bp, Homo sapiens
tttaatcacacactc

SEQ ID NO: 234627 - DNA, 15 bp, Homo sapiens
atttaatcacacact

SEQ ID NO: 234628 - DNA, 15 bp, Homo sapiens
catttaatcacacac

SEQ ID NO: 234629 - DNA, 15 bp, Homo sapiens
acatttaatcacaca

SEQ ID NO: 234630 - DNA, 15 bp, Homo sapiens
tacatttaatcacac

SEQ ID NO: 234631 - DNA, 15 bp, Homo sapiens
ctacatttaatcaca

SEQ ID NO: 234632 - DNA, 15 bp, Homo sapiens
gctacatttaatcac

SEQ ID NO: 234633 - DNA, 15 bp, Homo sapiens
tgctacatttaatca

SEQ ID NO: 234634 - DNA, 15 bp, Homo sapiens
ctgctacatttaatc

SEQ ID NO: 234635 - DNA, 15 bp, Homo sapiens
tctgctacatttaat

SEQ ID NO: 234636 - DNA, 15 bp, Homo sapiens
ctctgctacatttaa

SEQ ID NO: 234637 - DNA, 15 bp, Homo sapiens
tctctgctacattta

SEQ ID NO: 234638 - DNA, 15 bp, Homo sapiens
ttctctgctacattt

SEQ ID NO: 234639 - DNA, 15 bp, Homo sapiens
attctctgctacatt

SEQ ID NO: 234640 - DNA, 15 bp, Homo sapiens
aattctctgctacat

SEQ ID NO: 234641 - DNA, 15 bp, Homo sapiens
gaattctctgctaca

SEQ ID NO: 234642 - DNA, 15 bp, Homo sapiens
tgaattctctgctac

SEQ ID NO: 234643 - DNA, 15 bp, Homo sapiens
atgaattctctgcta

SEQ ID NO: 234644 - DNA, 15 bp, Homo sapiens
catgaattctctgct

SEQ ID NO: 234645 - DNA, 15 bp, Homo sapiens
ccatgaattctctgc

SEQ ID NO: 234646 - DNA, 15 bp, Homo sapiens
tccatgaattctctg

SEQ ID NO: 234647 - DNA, 15 bp, Homo sapiens
atccatgaattctct

SEQ ID NO: 234648 - DNA, 15 bp, Homo sapiens
catccatgaattctc

SEQ ID NO: 234649 - DNA, 15 bp, Homo sapiens
tcatccatgaattct

SEQ ID NO: 234650 - DNA, 15 bp, Homo sapiens
ttcatccatgaattc

SEQ ID NO: 234651 - DNA, 15 bp, Homo sapiens
cttcatccatgaatt

SEQ ID NO: 234652 - DNA, 15 bp, Homo sapiens
acttcatccatgaat

SEQ ID NO: 234653 - DNA, 15 bp, Homo sapiens
tacttcatccatgaa

SEQ ID NO: 234654 - DNA, 15 bp, Homo sapiens
atacttcatccatga

SEQ ID NO: 234655 - DNA, 15 bp, Homo sapiens
catacttcatccatg

SEQ ID NO: 234656 - DNA, 15 bp, Homo sapiens
ccatacttcatccat

SEQ ID NO: 234657 - DNA, 15 bp, Homo sapiens
tccatacttcatcca

SEQ ID NO: 234658 - DNA, 15 bp, Homo sapiens
ctccatacttcatcc

SEQ ID NO: 234659 - DNA, 15 bp, Homo sapiens
tctccatacttcatc

SEQ ID NO: 234660 - DNA, 15 bp, Homo sapiens
ttctccatacttcat

SEQ ID NO: 234661 - DNA, 15 bp, Homo sapiens
tttctccatacttca

SEQ ID NO: 234662 - DNA, 15 bp, Homo sapiens
atttctccatacttc

SEQ ID NO: 234663 - DNA, 15 bp, Homo sapiens
aatttctccatactt

SEQ ID NO: 234664 - DNA, 15 bp, Homo sapiens
gaatttctccatact

SEQ ID NO: 234665 - DNA, 15 bp, Homo sapiens
agaatttctccatac

SEQ ID NO: 234666 - DNA, 15 bp, Homo sapiens
aagaatttctccata

SEQ ID NO: 234667 - DNA, 15 bp, Homo sapiens
aaagaatttctccat

SEQ ID NO: 234668 - DNA, 15 bp, Homo sapiens
gaaagaatttctcca

SEQ ID NO: 234669 - DNA, 15 bp, Homo sapiens
agaaagaatttctcc

SEQ ID NO: 234670 - DNA, 15 bp, Homo sapiens
aagaaagaatttctc

SEQ ID NO: 234671 - DNA, 15 bp, Homo sapiens
taagaaagaatttct

SEQ ID NO: 234672 - DNA, 15 bp, Homo sapiens
gtaagaaagaatttc

SEQ ID NO: 234673 - DNA, 15 bp, Homo sapiens
ggtaagaaagaattt

SEQ ID NO: 234674 - DNA, 15 bp, Homo sapiens
gggtaagaaagaatt

SEQ ID NO: 234675 - DNA, 15 bp, Homo sapiens
agggtaagaaagaat

SEQ ID NO: 234676 - DNA, 15 bp, Homo sapiens
cagggtaagaaagaa

SEQ ID NO: 234677 - DNA, 15 bp, Homo sapiens
ccagggtaagaaaga

SEQ ID NO: 234678 - DNA, 15 bp, Homo sapiens
tccagggtaagaaag

SEQ ID NO: 234679 - DNA, 15 bp, Homo sapiens
gtccagggtaagaaa

SEQ ID NO: 234680 - DNA, 15 bp, Homo sapiens
tgtccagggtaagaa

SEQ ID NO: 234681 - DNA, 15 bp, Homo sapiens
ttgtccagggtaaga

SEQ ID NO: 234682 - DNA, 15 bp, Homo sapiens
attgtccagggtaag

SEQ ID NO: 234683 - DNA, 15 bp, Homo sapiens
aattgtccagggtaa

SEQ ID NO: 234684 - DNA, 15 bp, Homo sapiens
aaattgtccagggta

SEQ ID NO: 234685 - DNA, 15 bp, Homo sapiens
aaaattgtccagggt

SEQ ID NO: 234686 - DNA, 15 bp, Homo sapiens
aaaaattgtccaggg

SEQ ID NO: 234687 - DNA, 15 bp, Homo sapiens
taaaaattgtccagg

SEQ ID NO: 234688 - DNA, 15 bp, Homo sapiens
gtaaaaattgtccag

SEQ ID NO: 234689 - DNA, 15 bp, Homo sapiens
ggtaaaaattgtcca

SEQ ID NO: 234690 - DNA, 15 bp, Homo sapiens
gggtaaaaattgtcc

SEQ ID NO: 234691 - DNA, 15 bp, Homo sapiens
agggtaaaaattgtc

SEQ ID NO: 234692 - DNA, 15 bp, Homo sapiens
cagggtaaaaattgt

SEQ ID NO: 234693 - DNA, 15 bp, Homo sapiens
ccagggtaaaaattg

SEQ ID NO: 234694 - DNA, 15 bp, Homo sapiens
tccagggtaaaaatt

SEQ ID NO: 234695 - DNA, 15 bp, Homo sapiens
ctccagggtaaaaat

SEQ ID NO: 234696 - DNA, 15 bp, Homo sapiens
actccagggtaaaaa

SEQ ID NO: 234697 - DNA, 15 bp, Homo sapiens
tactccagggtaaaa

SEQ ID NO: 234698 - DNA, 15 bp, Homo sapiens
ttactccagggtaaa

SEQ ID NO: 234699 - DNA, 15 bp, Homo sapiens
attactccagggtaa

SEQ ID NO: 234700 - DNA, 15 bp, Homo sapiens
aattactccagggta

SEQ ID NO: 234701 - DNA, 15 bp, Homo sapiens
aaattactccagggt

SEQ ID NO: 234702 - DNA, 15 bp, Homo sapiens
aaaattactccaggg

SEQ ID NO: 234703 - DNA, 15 bp, Homo sapiens
aaaaattactccagg

SEQ ID NO: 234704 - DNA, 15 bp, Homo sapiens
aaaaaattactccag

SEQ ID NO: 234705 - DNA, 15 bp, Homo sapiens
gaaaaaattactcca

SEQ ID NO: 234706 - DNA, 15 bp, Homo sapiens
agaaaaaattactcc

SEQ ID NO: 234707 - DNA, 15 bp, Homo sapiens
aagaaaaaattactc

SEQ ID NO: 234708 - DNA, 15 bp, Homo sapiens
taagaaaaaattact

SEQ ID NO: 234709 - DNA, 15 bp, Homo sapiens
gtaagaaaaaattac

SEQ ID NO: 234710 - DNA, 15 bp, Homo sapiens
agtaagaaaaaatta

SEQ ID NO: 234711 - DNA, 15 bp, Homo sapiens
aagtaagaaaaaatt

SEQ ID NO: 234712 - DNA, 15 bp, Homo sapiens
aaagtaagaaaaaat

SEQ ID NO: 234713 - DNA, 15 bp, Homo sapiens
aaaagtaagaaaaaa

SEQ ID NO: 234714 - DNA, 15 bp, Homo sapiens
aaaaagtaagaaaaa

SEQ ID NO: 234715 - DNA, 15 bp, Homo sapiens
gaaaaagtaagaaaa

SEQ ID NO: 234716 - DNA, 15 bp, Homo sapiens
agaaaaagtaagaaa

SEQ ID NO: 234717 - DNA, 15 bp, Homo sapiens
gagaaaaagtaagaa

SEQ ID NO: 234718 - DNA, 15 bp, Homo sapiens
ggagaaaaagtaaga

SEQ ID NO: 234719 - DNA, 15 bp, Homo sapiens
cggagaaaaagtaag

SEQ ID NO: 234720 - DNA, 15 bp, Homo sapiens
acggagaaaaagtaa

SEQ ID NO: 234721 - DNA, 15 bp, Homo sapiens
tacggagaaaaagta

SEQ ID NO: 234722 - DNA, 15 bp, Homo sapiens
atacggagaaaaagt

SEQ ID NO: 234723 - DNA, 15 bp, Homo sapiens
aatacggagaaaaag

SEQ ID NO: 234724 - DNA, 15 bp, Homo sapiens
aaatacggagaaaaa

SEQ ID NO: 234725 - DNA, 15 bp, Homo sapiens
gaaatacggagaaaa

SEQ ID NO: 234726 - DNA, 15 bp, Homo sapiens
agaaatacggagaaa

SEQ ID NO: 234727 - DNA, 15 bp, Homo sapiens
gagaaatacggagaa

SEQ ID NO: 234728 - DNA, 15 bp, Homo sapiens
tgagaaatacggaga

SEQ ID NO: 234729 - DNA, 15 bp, Homo sapiens
ctgagaaatacggag

SEQ ID NO: 234730 - DNA, 15 bp, Homo sapiens
actgagaaatacgga

SEQ ID NO: 234731 - DNA, 15 bp, Homo sapiens
tactgagaaatacgg

SEQ ID NO: 234732 - DNA, 15 bp, Homo sapiens
ttactgagaaatacg

SEQ ID NO: 234733 - DNA, 15 bp, Homo sapiens
gttactgagaaatac

SEQ ID NO: 234734 - DNA, 15 bp, Homo sapiens
cgttactgagaaata

SEQ ID NO: 234735 - DNA, 15 bp, Homo sapiens
tcgttactgagaaat

SEQ ID NO: 234736 - DNA, 15 bp, Homo sapiens
atcgttactgagaaa

SEQ ID NO: 234737 - DNA, 15 bp, Homo sapiens
catcgttactgagaa

SEQ ID NO: 234738 - DNA, 15 bp, Homo sapiens
ccatcgttactgaga

SEQ ID NO: 234739 - DNA, 15 bp, Homo sapiens
accatcgttactgag

SEQ ID NO: 234740 - DNA, 15 bp, Homo sapiens
taccatcgttactga

SEQ ID NO: 234741 - DNA, 15 bp, Homo sapiens
ttaccatcgttactg

SEQ ID NO: 234742 - DNA, 15 bp, Homo sapiens
gttaccatcgttact

SEQ ID NO: 234743 - DNA, 15 bp, Homo sapiens
tgttaccatcgttac

SEQ ID NO: 234744 - DNA, 15 bp, Homo sapiens
gtgttaccatcgtta

SEQ ID NO: 234745 - DNA, 15 bp, Homo sapiens
agtgttaccatcgtt

SEQ ID NO: 234746 - DNA, 15 bp, Homo sapiens
gagtgttaccatcgt

SEQ ID NO: 234747 - DNA, 15 bp, Homo sapiens
tgagtgttaccatcg

SEQ ID NO: 234748 - DNA, 15 bp, Homo sapiens
gtgagtgttaccatc

SEQ ID NO: 234749 - DNA, 15 bp, Homo sapiens
tgtgagtgttaccat

SEQ ID NO: 234750 - DNA, 15 bp, Homo sapiens
gtgtgagtgttacca

SEQ ID NO: 234751 - DNA, 15 bp, Homo sapiens
agtgtgagtgttacc

SEQ ID NO: 234752 - DNA, 15 bp, Homo sapiens
aagtgtgagtgttac

SEQ ID NO: 234753 - DNA, 15 bp, Homo sapiens
caagtgtgagtgtta

SEQ ID NO: 234754 - DNA, 15 bp, Homo sapiens
ccaagtgtgagtgtt

SEQ ID NO: 234755 - DNA, 15 bp, Homo sapiens
gccaagtgtgagtgt

SEQ ID NO: 234756 - DNA, 15 bp, Homo sapiens
agccaagtgtgagtg

SEQ ID NO: 234757 - DNA, 15 bp, Homo sapiens
tagccaagtgtgagt

SEQ ID NO: 234758 - DNA, 15 bp, Homo sapiens
atagccaagtgtgag

SEQ ID NO: 234759 - DNA, 15 bp, Homo sapiens
aatagccaagtgtga

SEQ ID NO: 234760 - DNA, 15 bp, Homo sapiens
taatagccaagtgtg

SEQ ID NO: 234761 - DNA, 15 bp, Homo sapiens
ttaatagccaagtgt

SEQ ID NO: 234762 - DNA, 15 bp, Homo sapiens
cttaatagccaagtg

SEQ ID NO: 234763 - DNA, 15 bp, Homo sapiens
tcttaatagccaagt

SEQ ID NO: 234764 - DNA, 15 bp, Homo sapiens
ttcttaatagccaag

SEQ ID NO: 234765 - DNA, 15 bp, Homo sapiens
attcttaatagccaa

SEQ ID NO: 234766 - DNA, 15 bp, Homo sapiens
tattcttaatagcca

SEQ ID NO: 234767 - DNA, 15 bp, Homo sapiens
atattcttaatagcc

SEQ ID NO: 234768 - DNA, 15 bp, Homo sapiens
tatattcttaatagc

SEQ ID NO: 234769 - DNA, 15 bp, Homo sapiens
atatattcttaatag

SEQ ID NO: 234770 - DNA, 15 bp, Homo sapiens
tatatattcttaata

SEQ ID NO: 234771 - DNA, 15 bp, Homo sapiens
ttatatattcttaat

SEQ ID NO: 234772 - DNA, 15 bp, Homo sapiens
attatatattcttaa

SEQ ID NO: 234773 - DNA, 15 bp, Homo sapiens
gattatatattctta

SEQ ID NO: 234774 - DNA, 15 bp, Homo sapiens
tgattatatattctt

SEQ ID NO: 234775 - DNA, 15 bp, Homo sapiens
ctgattatatattct

SEQ ID NO: 234776 - DNA, 15 bp, Homo sapiens
tctgattatatattc

SEQ ID NO: 234777 - DNA, 15 bp, Homo sapiens
gtctgattatatatt

SEQ ID NO: 234778 - DNA, 15 bp, Homo sapiens
tgtctgattatatat

SEQ ID NO: 234779 - DNA, 15 bp, Homo sapiens
atgtctgattatata

SEQ ID NO: 234780 - DNA, 15 bp, Homo sapiens
gatgtctgattatat

SEQ ID NO: 234781 - DNA, 15 bp, Homo sapiens
ggatgtctgattata

SEQ ID NO: 234782 - DNA, 15 bp, Homo sapiens
tggatgtctgattat

SEQ ID NO: 234783 - DNA, 15 bp, Homo sapiens
ttggatgtctgatta

SEQ ID NO: 234784 - DNA, 15 bp, Homo sapiens
tttggatgtctgatt

SEQ ID NO: 234785 - DNA, 15 bp, Homo sapiens
atttggatgtctgat

SEQ ID NO: 234786 - DNA, 15 bp, Homo sapiens
aatttggatgtctga

SEQ ID NO: 234787 - DNA, 15 bp, Homo sapiens
taatttggatgtctg

SEQ ID NO: 234788 - DNA, 15 bp, Homo sapiens
ataatttggatgtct

SEQ ID NO: 234789 - DNA, 15 bp, Homo sapiens
aataatttggatgtc

SEQ ID NO: 234790 - DNA, 15 bp, Homo sapiens
gaataatttggatgt

SEQ ID NO: 234791 - DNA, 15 bp, Homo sapiens
agaataatttggatg

SEQ ID NO: 234792 - DNA, 15 bp, Homo sapiens
aagaataatttggat

SEQ ID NO: 234793 - DNA, 15 bp, Homo sapiens
aaagaataatttgga

SEQ ID NO: 234794 - DNA, 15 bp, Homo sapiens
aaaagaataatttgg

SEQ ID NO: 234795 - DNA, 15 bp, Homo sapiens
aaaaagaataatttg

SEQ ID NO: 234796 - DNA, 15 bp, Homo sapiens
gaaaaagaataattt

SEQ ID NO: 234797 - DNA, 15 bp, Homo sapiens
agaaaaagaataatt

SEQ ID NO: 234798 - DNA, 15 bp, Homo sapiens
aagaaaaagaataat

SEQ ID NO: 234799 - DNA, 15 bp, Homo sapiens
aaagaaaaagaataa

SEQ ID NO: 234800 - DNA, 15 bp, Homo sapiens
aaaagaaaaagaata

SEQ ID NO: 234801 - DNA, 15 bp, Homo sapiens
aaaaagaaaaagaat

SEQ ID NO: 234802 - DNA, 15 bp, Homo sapiens
taaaaaaaagaaaaa

SEQ ID NO: 234803 - DNA, 15 bp, Homo sapiens
gattaaaaaaaagaa

SEQ ID NO: 234804 - DNA, 15 bp, Homo sapiens
tgattaaaaaaaaga

SEQ ID NO: 234805 - DNA, 15 bp, Homo sapiens
gtgattaaaaaaaag

SEQ ID NO: 234806 - DNA, 15 bp, Homo sapiens
tgtgattaaaaaaaa

SEQ ID NO: 234807 - DNA, 15 bp, Homo sapiens
ctgtgattaaaaaaa

SEQ ID NO: 234808 - DNA, 15 bp, Homo sapiens
tctgtgattaaaaaa

SEQ ID NO: 234809 - DNA, 15 bp, Homo sapiens
ttctgtgattaaaaa

SEQ ID NO: 234810 - DNA, 15 bp, Homo sapiens
attctgtgattaaaa

SEQ ID NO: 234811 - DNA, 15 bp, Homo sapiens
aattctgtgattaaa

SEQ ID NO: 234812 - DNA, 15 bp, Homo sapiens
taattctgtgattaa

SEQ ID NO: 234813 - DNA, 15 bp, Homo sapiens
ttaattctgtgatta

SEQ ID NO: 234814 - DNA, 15 bp, Homo sapiens
gttaattctgtgatt

SEQ ID NO: 234815 - DNA, 15 bp, Homo sapiens
agttaattctgtgat

SEQ ID NO: 234816 - DNA, 15 bp, Homo sapiens
gagttaattctgtga

SEQ ID NO: 234817 - DNA, 15 bp, Homo sapiens
ggagttaattctgtg

SEQ ID NO: 234818 - DNA, 15 bp, Homo sapiens
aggagttaattctgt

SEQ ID NO: 234819 - DNA, 15 bp, Homo sapiens
caggagttaattctg

SEQ ID NO: 234820 - DNA, 15 bp, Homo sapiens
tcaggagttaattct

SEQ ID NO: 234821 - DNA, 15 bp, Homo sapiens
ctcaggagttaattc

SEQ ID NO: 234822 - DNA, 15 bp, Homo sapiens
cctcaggagttaatt

SEQ ID NO: 234823 - DNA, 15 bp, Homo sapiens
tcctcaggagttaat

SEQ ID NO: 234824 - DNA, 15 bp, Homo sapiens
ctcctcaggagttaa

SEQ ID NO: 234825 - DNA, 15 bp, Homo sapiens
tctcctcaggagtta

SEQ ID NO: 234826 - DNA, 15 bp, Homo sapiens
ctctcctcaggagtt

SEQ ID NO: 234827 - DNA, 15 bp, Homo sapiens
tctctcctcaggagt

SEQ ID NO: 234828 - DNA, 15 bp, Homo sapiens
ctctctcctcaggag

SEQ ID NO: 234829 - DNA, 15 bp, Homo sapiens
gctctctcctcagga

SEQ ID NO: 234830 - DNA, 15 bp, Homo sapiens
ggctctctcctcagg

SEQ ID NO: 234831 - DNA, 15 bp, Homo sapiens
gggctctctcctcag

SEQ ID NO: 234832 - DNA, 15 bp, Homo sapiens
tgggctctctcctca

SEQ ID NO: 234833 - DNA, 15 bp, Homo sapiens
ttgggctctctcctc

SEQ ID NO: 234834 - DNA, 15 bp, Homo sapiens
tttgggctctctcct

SEQ ID NO: 234835 - DNA, 15 bp, Homo sapiens
ttttgggctctctcc

SEQ ID NO: 234836 - DNA, 15 bp, Homo sapiens
cttttgggctctctc

SEQ ID NO: 234837 - DNA, 15 bp, Homo sapiens
tcttttgggctctct

SEQ ID NO: 234838 - DNA, 15 bp, Homo sapiens
atcttttgggctctc

SEQ ID NO: 234839 - DNA, 15 bp, Homo sapiens
aatcttttgggctct

SEQ ID NO: 234840 - DNA, 15 bp, Homo sapiens
caatcttttgggctc

SEQ ID NO: 234841 - DNA, 15 bp, Homo sapiens
gcaatcttttgggct

SEQ ID NO: 234842 - DNA, 15 bp, Homo sapiens
ggcaatcttttgggc

SEQ ID NO: 234843 - DNA, 15 bp, Homo sapiens
tggcaatcttttggg

SEQ ID NO: 234844 - DNA, 15 bp, Homo sapiens
ttggcaatcttttgg

SEQ ID NO: 234845 - DNA, 15 bp, Homo sapiens
tttggcaatcttttg

SEQ ID NO: 234846 - DNA, 15 bp, Homo sapiens
ctttggcaatctttt

SEQ ID NO: 234847 - DNA, 15 bp, Homo sapiens
gctttggcaatcttt

SEQ ID NO: 234848 - DNA, 15 bp, Homo sapiens
ggctttggcaatctt

SEQ ID NO: 234849 - DNA, 15 bp, Homo sapiens
tggctttggcaatct

SEQ ID NO: 234850 - DNA, 15 bp, Homo sapiens
atggctttggcaatc

SEQ ID NO: 234851 - DNA, 15 bp, Homo sapiens
catggctttggcaat

SEQ ID NO: 234852 - DNA, 15 bp, Homo sapiens
gcatggctttggcaa

SEQ ID NO: 234853 - DNA, 15 bp, Homo sapiens
cgcatggctttggca

SEQ ID NO: 234854 - DNA, 15 bp, Homo sapiens
gcgcatggctttggc

SEQ ID NO: 234855 - DNA, 15 bp, Homo sapiens
tgcgcatggctttgg

SEQ ID NO: 234856 - DNA, 15 bp, Homo sapiens
ttgcgcatggctttg

SEQ ID NO: 234857 - DNA, 15 bp, Homo sapiens
tttgcgcatggcttt

SEQ ID NO: 234858 - DNA, 15 bp, Homo sapiens
gtttgcgcatggctt

SEQ ID NO: 234859 - DNA, 15 bp, Homo sapiens
tgtttgcgcatggct

SEQ ID NO: 234860 - DNA, 15 bp, Homo sapiens
ctgtttgcgcatggc

SEQ ID NO: 234861 - DNA, 15 bp, Homo sapiens
actgtttgcgcatgg

SEQ ID NO: 234862 - DNA, 15 bp, Homo sapiens
gactgtttgcgcatg

SEQ ID NO: 234863 - DNA, 15 bp, Homo sapiens
agactgtttgcgcat

SEQ ID NO: 234864 - DNA, 15 bp, Homo sapiens
aagactgtttgcgca

SEQ ID NO: 234865 - DNA, 15 bp, Homo sapiens
gaagactgtttgcgc

SEQ ID NO: 234866 - DNA, 15 bp, Homo sapiens
agaagactgtttgcg

SEQ ID NO: 234867 - DNA, 15 bp, Homo sapiens
cagaagactgtttgc

SEQ ID NO: 234868 - DNA, 15 bp, Homo sapiens
tcagaagactgtttg

SEQ ID NO: 234869 - DNA, 15 bp, Homo sapiens
ttcagaagactgttt

SEQ ID NO: 234870 - DNA, 15 bp, Homo sapiens
cttcagaagactgtt

SEQ ID NO: 234871 - DNA, 15 bp, Homo sapiens
acttcagaagactgt

SEQ ID NO: 234872 - DNA, 15 bp, Homo sapiens
gacttcagaagactg

SEQ ID NO: 234873 - DNA, 15 bp, Homo sapiens
tgacttcagaagact

SEQ ID NO: 234874 - DNA, 15 bp, Homo sapiens
ttgacttcagaagac

SEQ ID NO: 234875 - DNA, 15 bp, Homo sapiens
tttgacttcagaaga

SEQ ID NO: 234876 - DNA, 15 bp, Homo sapiens
ctttgacttcagaag

SEQ ID NO: 234877 - DNA, 15 bp, Homo sapiens
tctttgacttcagaa

SEQ ID NO: 234878 - DNA, 15 bp, Homo sapiens
ttctttgacttcaga

SEQ ID NO: 234879 - DNA, 15 bp, Homo sapiens
tttctttgacttcag

SEQ ID NO: 234880 - DNA, 15 bp, Homo sapiens
ttttctttgacttca

SEQ ID NO: 234881 - DNA, 15 bp, Homo sapiens
tttttctttgacttc

SEQ ID NO: 234882 - DNA, 15 bp, Homo sapiens
atttttctttgactt

SEQ ID NO: 234883 - DNA, 15 bp, Homo sapiens
catttttctttgact

SEQ ID NO: 234884 - DNA, 15 bp, Homo sapiens
ccatttttctttgac

SEQ ID NO: 234885 - DNA, 15 bp, Homo sapiens
cccatttttctttga

SEQ ID NO: 234886 - DNA, 15 bp, Homo sapiens
tcccatttttctttg

SEQ ID NO: 234887 - DNA, 15 bp, Homo sapiens
ttcccatttttcttt

SEQ ID NO: 234888 - DNA, 15 bp, Homo sapiens
tttcccatttttctt

SEQ ID NO: 234889 - DNA, 15 bp, Homo sapiens
ctttcccatttttct

SEQ ID NO: 234890 - DNA, 15 bp, Homo sapiens
actttcccatttttc

SEQ ID NO: 234891 - DNA, 15 bp, Homo sapiens
gactttcccattttt

SEQ ID NO: 234892 - DNA, 15 bp, Homo sapiens
agactttcccatttt

SEQ ID NO: 234893 - DNA, 15 bp, Homo sapiens
tagactttcccattt

SEQ ID NO: 234894 - DNA, 15 bp, Homo sapiens
ttagactttcccatt

SEQ ID NO: 234895 - DNA, 15 bp, Homo sapiens
tttagactttcccat

SEQ ID NO: 234896 - DNA, 15 bp, Homo sapiens
atttagactttccca

SEQ ID NO: 234897 - DNA, 15 bp, Homo sapiens
catttagactttccc

SEQ ID NO: 234898 - DNA, 15 bp, Homo sapiens
gcatttagactttcc

SEQ ID NO: 234899 - DNA, 15 bp, Homo sapiens
agcatttagactttc

SEQ ID NO: 234900 - DNA, 15 bp, Homo sapiens
cagcatttagacttt

SEQ ID NO: 234901 - DNA, 15 bp, Homo sapiens
acagcatttagactt

SEQ ID NO: 234902 - DNA, 15 bp, Homo sapiens
tacagcatttagact

SEQ ID NO: 234903 - DNA, 15 bp, Homo sapiens
ttacagcatttagac

SEQ ID NO: 234904 - DNA, 15 bp, Homo sapiens
gttacagcatttaga

SEQ ID NO: 234905 - DNA, 15 bp, Homo sapiens
agttacagcatttag

SEQ ID NO: 234906 - DNA, 15 bp, Homo sapiens
tagttacagcattta

SEQ ID NO: 234907 - DNA, 15 bp, Homo sapiens
ctagttacagcattt

SEQ ID NO: 234908 - DNA, 15 bp, Homo sapiens
gctagttacagcatt

SEQ ID NO: 234909 - DNA, 15 bp, Homo sapiens
tgctagttacagcat

SEQ ID NO: 234910 - DNA, 15 bp, Homo sapiens
ttgctagttacagca

SEQ ID NO: 234911 - DNA, 15 bp, Homo sapiens
attgctagttacagc

SEQ ID NO: 234912 - DNA, 15 bp, Homo sapiens
aattgctagttacag

SEQ ID NO: 234913 - DNA, 15 bp, Homo sapiens
caattgctagttaca

SEQ ID NO: 234914 - DNA, 15 bp, Homo sapiens
ccaattgctagttac

SEQ ID NO: 234915 - DNA, 15 bp, Homo sapiens
gccaattgctagtta

SEQ ID NO: 234916 - DNA, 15 bp, Homo sapiens
tgccaattgctagtt

SEQ ID NO: 234917 - DNA, 15 bp, Homo sapiens
ttgccaattgctagt

SEQ ID NO: 234918 - DNA, 15 bp, Homo sapiens
tttgccaattgctag

SEQ ID NO: 234919 - DNA, 15 bp, Homo sapiens
ttttgccaattgcta

SEQ ID NO: 234920 - DNA, 15 bp, Homo sapiens
cttttgccaattgct

SEQ ID NO: 234921 - DNA, 15 bp, Homo sapiens
gcttttgccaattgc

SEQ ID NO: 234922 - DNA, 15 bp, Homo sapiens
tgcttttgccaattg

SEQ ID NO: 234923 - DNA, 15 bp, Homo sapiens
ttgcttttgccaatt

SEQ ID NO: 234924 - DNA, 15 bp, Homo sapiens
cttgcttttgccaat

SEQ ID NO: 234925 - DNA, 15 bp, Homo sapiens
acttgcttttgccaa

SEQ ID NO: 234926 - DNA, 15 bp, Homo sapiens
cacttgcttttgcca

SEQ ID NO: 234927 - DNA, 15 bp, Homo sapiens
ccacttgcttttgcc

SEQ ID NO: 234928 - DNA, 15 bp, Homo sapiens
tccacttgcttttgc

SEQ ID NO: 234929 - DNA, 15 bp, Homo sapiens
gtccacttgcttttg

SEQ ID NO: 234930 - DNA, 15 bp, Homo sapiens
tgtccacttgctttt

SEQ ID NO: 234931 - DNA, 15 bp, Homo sapiens
ttgtccacttgcttt

SEQ ID NO: 234932 - DNA, 15 bp, Homo sapiens
cttgtccacttgctt

SEQ ID NO: 234933 - DNA, 15 bp, Homo sapiens
ccttgtccacttgct

SEQ ID NO: 234934 - DNA, 15 bp, Homo sapiens
gccttgtccacttgc

SEQ ID NO: 234935 - DNA, 15 bp, Homo sapiens
tgccttgtccacttg

SEQ ID NO: 234936 - DNA, 15 bp, Homo sapiens
atgccttgtccactt

SEQ ID NO: 234937 - DNA, 15 bp, Homo sapiens
aatgccttgtccact

SEQ ID NO: 234938 - DNA, 15 bp, Homo sapiens
caatgccttgtccac

SEQ ID NO: 234939 - DNA, 15 bp, Homo sapiens
ccaatgccttgtcca

SEQ ID NO: 234940 - DNA, 15 bp, Homo sapiens
tccaatgccttgtcc

SEQ ID NO: 234941 - DNA, 15 bp, Homo sapiens
ctccaatgccttgtc

SEQ ID NO: 234942 - DNA, 15 bp, Homo sapiens
tctccaatgccttgt

SEQ ID NO: 234943 - DNA, 15 bp, Homo sapiens
ttctccaatgccttg

SEQ ID NO: 234944 - DNA, 15 bp, Homo sapiens
tttctccaatgcctt

SEQ ID NO: 234945 - DNA, 15 bp, Homo sapiens
gtttctccaatgcct

SEQ ID NO: 234946 - DNA, 15 bp, Homo sapiens
agtttctccaatgcc

SEQ ID NO: 234947 - DNA, 15 bp, Homo sapiens
gagtttctccaatgc

SEQ ID NO: 234948 - DNA, 15 bp, Homo sapiens
tgagtttctccaatg

SEQ ID NO: 234949 - DNA, 15 bp, Homo sapiens
ctgagtttctccaat

SEQ ID NO: 234950 - DNA, 15 bp, Homo sapiens
tctgagtttctccaa

SEQ ID NO: 234951 - DNA, 15 bp, Homo sapiens
ctctgagtttctcca

SEQ ID NO: 234952 - DNA, 15 bp, Homo sapiens
tctctgagtttctcc

SEQ ID NO: 234953 - DNA, 15 bp, Homo sapiens
gtctctgagtttctc

SEQ ID NO: 234954 - DNA, 15 bp, Homo sapiens
ggtctctgagtttct

SEQ ID NO: 234955 - DNA, 15 bp, Homo sapiens
aggtctctgagtttc

SEQ ID NO: 234956 - DNA, 15 bp, Homo sapiens
caggtctctgagttt

SEQ ID NO: 234957 - DNA, 15 bp, Homo sapiens
gcaggtctctgagtt

SEQ ID NO: 234958 - DNA, 15 bp, Homo sapiens
tgcaggtctctgagt

SEQ ID NO: 234959 - DNA, 15 bp, Homo sapiens
ctgcaggtctctgag

SEQ ID NO: 234960 - DNA, 15 bp, Homo sapiens
cctgcaggtctctga

SEQ ID NO: 234961 - DNA, 15 bp, Homo sapiens
ccctgcaggtctctg

SEQ ID NO: 234962 - DNA, 15 bp, Homo sapiens
tccctgcaggtctct

SEQ ID NO: 234963 - DNA, 15 bp, Homo sapiens
ctccctgcaggtctc

SEQ ID NO: 234964 - DNA, 15 bp, Homo sapiens
gctccctgcaggtct

SEQ ID NO: 234965 - DNA, 15 bp, Homo sapiens
agctccctgcaggtc

SEQ ID NO: 234966 - DNA, 15 bp, Homo sapiens
tagctccctgcaggt

SEQ ID NO: 234967 - DNA, 15 bp, Homo sapiens
atagctccctgcagg

SEQ ID NO: 234968 - DNA, 15 bp, Homo sapiens
catagctccctgcag

SEQ ID NO: 234969 - DNA, 15 bp, Homo sapiens
ccatagctccctgca

SEQ ID NO: 234970 - DNA, 15 bp, Homo sapiens
tccatagctccctgc

SEQ ID NO: 234971 - DNA, 15 bp, Homo sapiens
atccatagctccctg

SEQ ID NO: 234972 - DNA, 15 bp, Homo sapiens
catccatagctccct

SEQ ID NO: 234973 - DNA, 15 bp, Homo sapiens
tcatccatagctccc

SEQ ID NO: 234974 - DNA, 15 bp, Homo sapiens
gtcatccatagctcc

SEQ ID NO: 234975 - DNA, 15 bp, Homo sapiens
ggtcatccatagctc

SEQ ID NO: 234976 - DNA, 15 bp, Homo sapiens
aggtcatccatagct

SEQ ID NO: 234977 - DNA, 15 bp, Homo sapiens
caggtcatccatagc

SEQ ID NO: 234978 - DNA, 15 bp, Homo sapiens
ccaggtcatccatag

SEQ ID NO: 234979 - DNA, 15 bp, Homo sapiens
tccaggtcatccata

SEQ ID NO: 234980 - DNA, 15 bp, Homo sapiens
gtccaggtcatccat

SEQ ID NO: 234981 - DNA, 15 bp, Homo sapiens
cgtccaggtcatcca

SEQ ID NO: 234982 - DNA, 15 bp, Homo sapiens
gcgtccaggtcatcc

SEQ ID NO: 234983 - DNA, 15 bp, Homo sapiens
agcgtccaggtcatc

SEQ ID NO: 234984 - DNA, 15 bp, Homo sapiens
cagcgtccaggtcat

SEQ ID NO: 234985 - DNA, 15 bp, Homo sapiens
tcagcgtccaggtca

SEQ ID NO: 234986 - DNA, 15 bp, Homo sapiens
gtcagcgtccaggtc

SEQ ID NO: 234987 - DNA, 15 bp, Homo sapiens
tgtcagcgtccaggt

SEQ ID NO: 234988 - DNA, 15 bp, Homo sapiens
atgtcagcgtccagg

SEQ ID NO: 234989 - DNA, 15 bp, Homo sapiens
catgtcagcgtccag

SEQ ID NO: 234990 - DNA, 15 bp, Homo sapiens
tcatgtcagcgtcca

SEQ ID NO: 234991 - DNA, 15 bp, Homo sapiens
ttcatgtcagcgtcc

SEQ ID NO: 234992 - DNA, 15 bp, Homo sapiens
cttcatgtcagcgtc

SEQ ID NO: 234993 - DNA, 15 bp, Homo sapiens
ccttcatgtcagcgt

SEQ ID NO: 234994 - DNA, 15 bp, Homo sapiens
tccttcatgtcagcg

SEQ ID NO: 234995 - DNA, 15 bp, Homo sapiens
ctccttcatgtcagc

SEQ ID NO: 234996 - DNA, 15 bp, Homo sapiens
cctccttcatgtcag

SEQ ID NO: 234997 - DNA, 15 bp, Homo sapiens
gcctccttcatgtca

SEQ ID NO: 234998 - DNA, 15 bp, Homo sapiens
tgcctccttcatgtc

SEQ ID NO: 234999 - DNA, 15 bp, Homo sapiens
ctgcctccttcatgt

SEQ ID NO: 235000 - DNA, 15 bp, Homo sapiens
actctgcctccttca

SEQ ID NO: 235001 - DNA, 15 bp, Homo sapiens
gactctgcctccttc

SEQ ID NO: 235002 - DNA, 15 bp, Homo sapiens
ggactctgcctcctt

SEQ ID NO: 235003 - DNA, 15 bp, Homo sapiens
cggactctgcctcct

SEQ ID NO: 235004 - DNA, 15 bp, Homo sapiens
acggactctgcctcc

SEQ ID NO: 235005 - DNA, 15 bp, Homo sapiens
cacggactctgcctc

SEQ ID NO: 235006 - DNA, 15 bp, Homo sapiens
gcacggactctgcct

SEQ ID NO: 235007 - DNA, 15 bp, Homo sapiens
cgcacggactctgcc

SEQ ID NO: 235008 - DNA, 15 bp, Homo sapiens
ccgcacggactctgc

SEQ ID NO: 235009 - DNA, 15 bp, Homo sapiens
tccgcacggactctg

SEQ ID NO: 235010 - DNA, 15 bp, Homo sapiens
ttccgcacggactct

SEQ ID NO: 235011 - DNA, 15 bp, Homo sapiens
attccgcacggactc

SEQ ID NO: 235012 - DNA, 15 bp, Homo sapiens
cattccgcacggact

SEQ ID NO: 235013 - DNA, 15 bp, Homo sapiens
ccattccgcacggac

SEQ ID NO: 235014 - DNA, 15 bp, Homo sapiens
gccattccgcacgga

SEQ ID NO: 235015 - DNA, 15 bp, Homo sapiens
agccattccgcacgg

SEQ ID NO: 235016 - DNA, 15 bp, Homo sapiens
cagccattccgcacg

SEQ ID NO: 235017 - DNA, 15 bp, Homo sapiens
ccagccattccgcac

SEQ ID NO: 235018 - DNA, 15 bp, Homo sapiens
tccagccattccgca

SEQ ID NO: 235019 - DNA, 15 bp, Homo sapiens
ttccagccattccgc

SEQ ID NO: 235020 - DNA, 15 bp, Homo sapiens
cttccagccattccg

SEQ ID NO: 235021 - DNA, 15 bp, Homo sapiens
gcttccagccattcc

SEQ ID NO: 235022 - DNA, 15 bp, Homo sapiens
ggcttccagccattc

SEQ ID NO: 235023 - DNA, 15 bp, Homo sapiens
gggcttccagccatt

SEQ ID NO: 235024 - DNA, 15 bp, Homo sapiens
cgggcttccagccat

SEQ ID NO: 235025 - DNA, 15 bp, Homo sapiens
acgggcttccagcca

SEQ ID NO: 235026 - DNA, 15 bp, Homo sapiens
cacgggcttccagcc

SEQ ID NO: 235027 - DNA, 15 bp, Homo sapiens
ccacgggcttccagc

SEQ ID NO: 235028 - DNA, 15 bp, Homo sapiens
cccacgggcttccag

SEQ ID NO: 235029 - DNA, 15 bp, Homo sapiens
tcccacgggcttcca

SEQ ID NO: 235030 - DNA, 15 bp, Homo sapiens
ctcccacgggcttcc

SEQ ID NO: 235031 - DNA, 15 bp, Homo sapiens
tctcccacgggcttc

SEQ ID NO: 235032 - DNA, 15 bp, Homo sapiens
gtctcccacgggctt

SEQ ID NO: 235033 - DNA, 15 bp, Homo sapiens
agtctcccacgggct

SEQ ID NO: 235034 - DNA, 15 bp, Homo sapiens
aagtctcccacgggc

SEQ ID NO: 235035 - DNA, 15 bp, Homo sapiens
taagtctcccacggg

SEQ ID NO: 235036 - DNA, 15 bp, Homo sapiens
gtaagtctcccacgg

SEQ ID NO: 235037 - DNA, 15 bp, Homo sapiens
agtaagtctcccacg

SEQ ID NO: 235038 - DNA, 15 bp, Homo sapiens
gagtaagtctcccac

SEQ ID NO: 235039 - DNA, 15 bp, Homo sapiens
tgagtaagtctccca

SEQ ID NO: 235040 - DNA, 15 bp, Homo sapiens
atgagtaagtctccc

SEQ ID NO: 235041 - DNA, 15 bp, Homo sapiens
aatgagtaagtctcc

SEQ ID NO: 235042 - DNA, 15 bp, Homo sapiens
caatgagtaagtctc

SEQ ID NO: 235043 - DNA, 15 bp, Homo sapiens
tcaatgagtaagtct

SEQ ID NO: 235044 - DNA, 15 bp, Homo sapiens
gtcaatgagtaagtc

SEQ ID NO: 235045 - DNA, 15 bp, Homo sapiens
agtcaatgagtaagt

SEQ ID NO: 235046 - DNA, 15 bp, Homo sapiens
gagtcaatgagtaag

SEQ ID NO: 235047 - DNA, 15 bp, Homo sapiens
cgagtcaatgagtaa

SEQ ID NO: 235048 - DNA, 15 bp, Homo sapiens
gcgagtcaatgagta

SEQ ID NO: 235049 - DNA, 15 bp, Homo sapiens
agcgagtcaatgagt

SEQ ID NO: 235050 - DNA, 15 bp, Homo sapiens
cagcgagtcaatgag

SEQ ID NO: 235051 - DNA, 15 bp, Homo sapiens
gcagcgagtcaatga

SEQ ID NO: 235052 - DNA, 15 bp, Homo sapiens
tgcagcgagtcaatg

SEQ ID NO: 235053 - DNA, 15 bp, Homo sapiens
ctgcagcgagtcaat

SEQ ID NO: 235054 - DNA, 15 bp, Homo sapiens
cctgcagcgagtcaa

SEQ ID NO: 235055 - DNA, 15 bp, Homo sapiens
tcctgcagcgagtca

SEQ ID NO: 235056 - DNA, 15 bp, Homo sapiens
atcctgcagcgagtc

SEQ ID NO: 235057 - DNA, 15 bp, Homo sapiens
gatcctgcagcgagt

SEQ ID NO: 235058 - DNA, 15 bp, Homo sapiens
tgatcctgcagcgag

SEQ ID NO: 235059 - DNA, 15 bp, Homo sapiens
gtgatcctgcagcga

SEQ ID NO: 235060 - DNA, 15 bp, Homo sapiens
tgtgatcctgcagcg

SEQ ID NO: 235061 - DNA, 15 bp, Homo sapiens
atgtgatcctgcagc

SEQ ID NO: 235062 - DNA, 15 bp, Homo sapiens
aatgtgatcctgcag

SEQ ID NO: 235063 - DNA, 15 bp, Homo sapiens
caatgtgatcctgca

SEQ ID NO: 235064 - DNA, 15 bp, Homo sapiens
tcaatgtgatcctgc

SEQ ID NO: 235065 - DNA, 15 bp, Homo sapiens
ttcaatgtgatcctg

SEQ ID NO: 235066 - DNA, 15 bp, Homo sapiens
tttcaatgtgatcct

SEQ ID NO: 235067 - DNA, 15 bp, Homo sapiens
ttttcaatgtgatcc

SEQ ID NO: 235068 - DNA, 15 bp, Homo sapiens
tttttcaatgtgatc

SEQ ID NO: 235069 - DNA, 15 bp, Homo sapiens
ttttttcaatgtgat

SEQ ID NO: 235070 - DNA, 15 bp, Homo sapiens
attttttcaatgtga

SEQ ID NO: 235071 - DNA, 15 bp, Homo sapiens
gattttttcaatgtg

SEQ ID NO: 235072 - DNA, 15 bp, Homo sapiens
tgattttttcaatgt

SEQ ID NO: 235073 - DNA, 15 bp, Homo sapiens
atgattttttcaatg

SEQ ID NO: 235074 - DNA, 15 bp, Homo sapiens
catgattttttcaat

SEQ ID NO: 235075 - DNA, 15 bp, Homo sapiens
ccatgattttttcaa

SEQ ID NO: 235076 - DNA, 15 bp, Homo sapiens
accatgattttttca

SEQ ID NO: 235077 - DNA, 15 bp, Homo sapiens
gaccatgattttttc

SEQ ID NO: 235078 - DNA, 15 bp, Homo sapiens
tgaccatgatttttt

SEQ ID NO: 235079 - DNA, 15 bp, Homo sapiens
ctgaccatgattttt

SEQ ID NO: 235080 - DNA, 15 bp, Homo sapiens
gctgaccatgatttt

SEQ ID NO: 235081 - DNA, 15 bp, Homo sapiens
tgctgaccatgattt

SEQ ID NO: 235082 - DNA, 15 bp, Homo sapiens
atgctgaccatgatt

SEQ ID NO: 235083 - DNA, 15 bp, Homo sapiens
gatgctgaccatgat

SEQ ID NO: 235084 - DNA, 15 bp, Homo sapiens
tgatgctgaccatga

SEQ ID NO: 235085 - DNA, 15 bp, Homo sapiens
atgatgctgaccatg

SEQ ID NO: 235086 - DNA, 15 bp, Homo sapiens
aatgatgctgaccat

SEQ ID NO: 235087 - DNA, 15 bp, Homo sapiens
caatgatgctgacca

SEQ ID NO: 235088 - DNA, 15 bp, Homo sapiens
acaatgatgctgacc

SEQ ID NO: 235089 - DNA, 15 bp, Homo sapiens
gacaatgatgctgac

SEQ ID NO: 235090 - DNA, 15 bp, Homo sapiens
agacaatgatgctga

SEQ ID NO: 235091 - DNA, 15 bp, Homo sapiens
aagacaatgatgctg

SEQ ID NO: 235092 - DNA, 15 bp, Homo sapiens
aaagacaatgatgct

SEQ ID NO: 235093 - DNA, 15 bp, Homo sapiens
caaagacaatgatgc

SEQ ID NO: 235094 - DNA, 15 bp, Homo sapiens
tcaaagacaatgatg

SEQ ID NO: 235095 - DNA, 15 bp, Homo sapiens
ttcaaagacaatgat

SEQ ID NO: 235096 - DNA, 15 bp, Homo sapiens
cttcaaagacaatga

SEQ ID NO: 235097 - DNA, 15 bp, Homo sapiens
ccttcaaagacaatg

SEQ ID NO: 235098 - DNA, 15 bp, Homo sapiens
tccttcaaagacaat

SEQ ID NO: 235099 - DNA, 15 bp, Homo sapiens
atccttcaaagacaa

SEQ ID NO: 235100 - DNA, 15 bp, Homo sapiens
aatccttcaaagaca

SEQ ID NO: 235101 - DNA, 15 bp, Homo sapiens
aaatccttcaaagac

SEQ ID NO: 235102 - DNA, 15 bp, Homo sapiens
aaaatccttcaaaga

SEQ ID NO: 235103 - DNA, 15 bp, Homo sapiens
aaaaatccttcaaag

SEQ ID NO: 235104 - DNA, 15 bp, Homo sapiens
taaaaatccttcaaa

SEQ ID NO: 235105 - DNA, 15 bp, Homo sapiens
ttaaaaatccttcaa

SEQ ID NO: 235106 - DNA, 15 bp, Homo sapiens
cttaaaaatccttca

SEQ ID NO: 235107 - DNA, 15 bp, Homo sapiens
tcttaaaaatccttc

SEQ ID NO: 235108 - DNA, 15 bp, Homo sapiens
ttcttaaaaatcctt

SEQ ID NO: 235109 - DNA, 15 bp, Homo sapiens
tttcttaaaaatcct

SEQ ID NO: 235110 - DNA, 15 bp, Homo sapiens
atttcttaaaaatcc

SEQ ID NO: 235111 - DNA, 15 bp, Homo sapiens
catttcttaaaaatc

SEQ ID NO: 235112 - DNA, 15 bp, Homo sapiens
acatttcttaaaaat

SEQ ID NO: 235113 - DNA, 15 bp, Homo sapiens
aacatttcttaaaaa

SEQ ID NO: 235114 - DNA, 15 bp, Homo sapiens
aaacatttcttaaaa

SEQ ID NO: 235115 - DNA, 15 bp, Homo sapiens
aaaacatttcttaaa

SEQ ID NO: 235116 - DNA, 15 bp, Homo sapiens
gaaaacatttcttaa

SEQ ID NO: 235117 - DNA, 15 bp, Homo sapiens
agaaaacatttctta

SEQ ID NO: 235118 - DNA, 15 bp, Homo sapiens
aagaaaacatttctt

SEQ ID NO: 235119 - DNA, 15 bp, Homo sapiens
caagaaaacatttct

SEQ ID NO: 235120 - DNA, 15 bp, Homo sapiens
acaagaaaacatttc

SEQ ID NO: 235121 - DNA, 15 bp, Homo sapiens
aacaagaaaacattt

SEQ ID NO: 235122 - DNA, 15 bp, Homo sapiens
taacaagaaaacatt

SEQ ID NO: 235123 - DNA, 15 bp, Homo sapiens
ttaacaagaaaacat

SEQ ID NO: 235124 - DNA, 15 bp, Homo sapiens
tttaacaagaaaaca

SEQ ID NO: 235125 - DNA, 15 bp, Homo sapiens
atttaacaagaaaac

SEQ ID NO: 235126 - DNA, 15 bp, Homo sapiens
tatttaacaagaaaa

SEQ ID NO: 235127 - DNA, 15 bp, Homo sapiens
atatttaacaagaaa

SEQ ID NO: 235128 - DNA, 15 bp, Homo sapiens
tatatttaacaagaa

SEQ ID NO: 235129 - DNA, 15 bp, Homo sapiens
ttatatttaacaaga

SEQ ID NO: 235130 - DNA, 15 bp, Homo sapiens
gttatatttaacaag

SEQ ID NO: 235131 - DNA, 15 bp, Homo sapiens
tgttatatttaacaa

SEQ ID NO: 235132 - DNA, 15 bp, Homo sapiens
gtgttatatttaaca

SEQ ID NO: 235133 - DNA, 15 bp, Homo sapiens
tgtgttatatttaac

SEQ ID NO: 235134 - DNA, 15 bp, Homo sapiens
ttgtgttatatttaa

SEQ ID NO: 235135 - DNA, 15 bp, Homo sapiens
tttgtgttatattta

SEQ ID NO: 235136 - DNA, 15 bp, Homo sapiens
atttgtgttatattt

SEQ ID NO: 235137 - DNA, 15 bp, Homo sapiens
tatttgtgttatatt

SEQ ID NO: 235138 - DNA, 15 bp, Homo sapiens
ttatttgtgttatat

SEQ ID NO: 235139 - DNA, 15 bp, Homo sapiens
tttatttgtgttata

SEQ ID NO: 235140 - DNA, 15 bp, Homo sapiens
ctttatttgtgttat

SEQ ID NO: 235141 - DNA, 15 bp, Homo sapiens
tctttatttgtgtta

SEQ ID NO: 235142 - DNA, 15 bp, Homo sapiens
ctctttatttgtgtt

SEQ ID NO: 235143 - DNA, 15 bp, Homo sapiens
tctctttatttgtgt

SEQ ID NO: 235144 - DNA, 15 bp, Homo sapiens
ctctctttatttgtg

SEQ ID NO: 235145 - DNA, 15 bp, Homo sapiens
gctctctttatttgt

SEQ ID NO: 235146 - DNA, 15 bp, Homo sapiens
ggctctctttatttg

SEQ ID NO: 235147 - DNA, 15 bp, Homo sapiens
tggctctctttattt

SEQ ID NO: 235148 - DNA, 15 bp, Homo sapiens
gtggctctctttatt

SEQ ID NO: 235149 - DNA, 15 bp, Homo sapiens
cgtggctctctttat

SEQ ID NO: 235150 - DNA, 15 bp, Homo sapiens
acgtggctctcttta

SEQ ID NO: 235151 - DNA, 15 bp, Homo sapiens
tacgtggctctcttt

SEQ ID NO: 235152 - DNA, 15 bp, Homo sapiens
atacgtggctctctt

SEQ ID NO: 235153 - DNA, 15 bp, Homo sapiens
tatacgtggctctct

SEQ ID NO: 235154 - DNA, 15 bp, Homo sapiens
atatacgtggctctc

SEQ ID NO: 235155 - DNA, 15 bp, Homo sapiens
tatatacgtggctct

SEQ ID NO: 235156 - DNA, 15 bp, Homo sapiens
ttatatacgtggctc

SEQ ID NO: 235157 - DNA, 15 bp, Homo sapiens
tttatatacgtggct

SEQ ID NO: 235158 - DNA, 15 bp, Homo sapiens
atttatatacgtggc

SEQ ID NO: 235159 - DNA, 15 bp, Homo sapiens
aatttatatacgtgg

SEQ ID NO: 235160 - DNA, 15 bp, Homo sapiens
caatttatatacgtg

SEQ ID NO: 235161 - DNA, 15 bp, Homo sapiens
acaatttatatacgt

SEQ ID NO: 235162 - DNA, 15 bp, Homo sapiens
aacaatttatatacg

SEQ ID NO: 235163 - DNA, 15 bp, Homo sapiens
taacaatttatatac

SEQ ID NO: 235164 - DNA, 15 bp, Homo sapiens
ataacaatttatata

SEQ ID NO: 235165 - DNA, 15 bp, Homo sapiens
tataacaatttatat

SEQ ID NO: 235166 - DNA, 15 bp, Homo sapiens
ttataacaatttata

SEQ ID NO: 235167 - DNA, 15 bp, Homo sapiens
cttataacaatttat

SEQ ID NO: 235168 - DNA, 15 bp, Homo sapiens
ccttataacaattta

SEQ ID NO: 235169 - DNA, 15 bp, Homo sapiens
cccttataacaattt

SEQ ID NO: 235170 - DNA, 15 bp, Homo sapiens
tcccttataacaatt

SEQ ID NO: 235171 - DNA, 15 bp, Homo sapiens
atcccttataacaat

SEQ ID NO: 235172 - DNA, 15 bp, Homo sapiens
aatcccttataacaa

SEQ ID NO: 235173 - DNA, 15 bp, Homo sapiens
caatcccttataaca

SEQ ID NO: 235174 - DNA, 15 bp, Homo sapiens
acaatcccttataac

SEQ ID NO: 235175 - DNA, 15 bp, Homo sapiens
aacaatcccttataa

SEQ ID NO: 235176 - DNA, 15 bp, Homo sapiens
taacaatcccttata

SEQ ID NO: 235177 - DNA, 15 bp, Homo sapiens
gtaacaatcccttat

SEQ ID NO: 235178 - DNA, 15 bp, Homo sapiens
tgtaacaatccctta

SEQ ID NO: 235179 - DNA, 15 bp, Homo sapiens
ttgtaacaatccctt

SEQ ID NO: 235180 - DNA, 15 bp, Homo sapiens
tttgtaacaatccct

SEQ ID NO: 235181 - DNA, 15 bp, Homo sapiens
ctttgtaacaatccc

SEQ ID NO: 235182 - DNA, 15 bp, Homo sapiens
gctttgtaacaatcc

SEQ ID NO: 235183 - DNA, 15 bp, Homo sapiens
ggctttgtaacaatc

SEQ ID NO: 235184 - DNA, 15 bp, Homo sapiens
tggctttgtaacaat

SEQ ID NO: 235185 - DNA, 15 bp, Homo sapiens
ttggctttgtaacaa

SEQ ID NO: 235186 - DNA, 15 bp, Homo sapiens
gttggctttgtaaca

SEQ ID NO: 235187 - DNA, 15 bp, Homo sapiens
cgttggctttgtaac

SEQ ID NO: 235188 - DNA, 15 bp, Homo sapiens
gcgttggctttgtaa

SEQ ID NO: 235189 - DNA, 15 bp, Homo sapiens
ggcgttggctttgta

SEQ ID NO: 235190 - DNA, 15 bp, Homo sapiens
cggcgttggctttgt

SEQ ID NO: 235191 - DNA, 15 bp, Homo sapiens
gcggcgttggctttg

SEQ ID NO: 235192 - DNA, 15 bp, Homo sapiens
agcggcgttggcttt

SEQ ID NO: 235193 - DNA, 15 bp, Homo sapiens
cagcggcgttggctt

SEQ ID NO: 235194 - DNA, 15 bp, Homo sapiens
gcagcggcgttggct

SEQ ID NO: 235195 - DNA, 15 bp, Homo sapiens
tgcagcggcgttggc

SEQ ID NO: 235196 - DNA, 15 bp, Homo sapiens
ttgcagcggcgttgg

SEQ ID NO: 235197 - DNA, 15 bp, Homo sapiens
gttgcagcggcgttg

SEQ ID NO: 235198 - DNA, 15 bp, Homo sapiens
ggttgcagcggcgtt

SEQ ID NO: 235199 - DNA, 15 bp, Homo sapiens
gggttgcagcggcgt

SEQ ID NO: 235200 - DNA, 15 bp, Homo sapiens
ggggttgcagcggcg

SEQ ID NO: 235201 - DNA, 15 bp, Homo sapiens
tggggttgcagcggc

SEQ ID NO: 235202 - DNA, 15 bp, Homo sapiens
gtggggttgcagcgg

SEQ ID NO: 235203 - DNA, 15 bp, Homo sapiens
ggtggggttgcagcg

SEQ ID NO: 235204 - DNA, 15 bp, Homo sapiens
gggtggggttgcagc

SEQ ID NO: 235205 - DNA, 15 bp, Homo sapiens
tgggtggggttgcag

SEQ ID NO: 235206 - DNA, 15 bp, Homo sapiens
atgggtggggttgca

SEQ ID NO: 235207 - DNA, 15 bp, Homo sapiens
gatgggtggggttgc

SEQ ID NO: 235208 - DNA, 15 bp, Homo sapiens
tgatgggtggggttg

SEQ ID NO: 235209 - DNA, 15 bp, Homo sapiens
ctgatgggtggggtt

SEQ ID NO: 235210 - DNA, 15 bp, Homo sapiens
cctgatgggtggggt

SEQ ID NO: 235211 - DNA, 15 bp, Homo sapiens
tcctgatgggtgggg

SEQ ID NO: 235212 - DNA, 15 bp, Homo sapiens
ctcctgatgggtggg

SEQ ID NO: 235213 - DNA, 15 bp, Homo sapiens
actcctgatgggtgg

SEQ ID NO: 235214 - DNA, 15 bp, Homo sapiens
gactcctgatgggtg

SEQ ID NO: 235215 - DNA, 15 bp, Homo sapiens
tgactcctgatgggt

SEQ ID NO: 235216 - DNA, 15 bp, Homo sapiens
ctgactcctgatggg

SEQ ID NO: 235217 - DNA, 15 bp, Homo sapiens
cctgactcctgatgg

SEQ ID NO: 235218 - DNA, 15 bp, Homo sapiens
tcctgactcctgatg

SEQ ID NO: 235219 - DNA, 15 bp, Homo sapiens
gtcctgactcctgat

SEQ ID NO: 235220 - DNA, 15 bp, Homo sapiens
tgtcctgactcctga

SEQ ID NO: 235221 - DNA, 15 bp, Homo sapiens
ctgtcctgactcctg

SEQ ID NO: 235222 - DNA, 15 bp, Homo sapiens
cctgtcctgactcct

SEQ ID NO: 235223 - DNA, 15 bp, Homo sapiens
acctgtcctgactcc

SEQ ID NO: 235224 - DNA, 15 bp, Homo sapiens
cacctgtcctgactc

SEQ ID NO: 235225 - DNA, 15 bp, Homo sapiens
gcacctgtcctgact

SEQ ID NO: 235226 - DNA, 15 bp, Homo sapiens
agcacctgtcctgac

SEQ ID NO: 235227 - DNA, 15 bp, Homo sapiens
aagcacctgtcctga

SEQ ID NO: 235228 - DNA, 15 bp, Homo sapiens
aaagcacctgtcctg

SEQ ID NO: 235229 - DNA, 15 bp, Homo sapiens
gaaagcacctgtcct

SEQ ID NO: 235230 - DNA, 15 bp, Homo sapiens
ggaaagcacctgtcc

SEQ ID NO: 235231 - DNA, 15 bp, Homo sapiens
tggaaagcacctgtc

SEQ ID NO: 235232 - DNA, 15 bp, Homo sapiens
atggaaagcacctgt

SEQ ID NO: 235233 - DNA, 15 bp, Homo sapiens
tatggaaagcacctg

SEQ ID NO: 235234 - DNA, 15 bp, Homo sapiens
atatggaaagcacct

SEQ ID NO: 235235 - DNA, 15 bp, Homo sapiens
catatggaaagcacc

SEQ ID NO: 235236 - DNA, 15 bp, Homo sapiens
tcatatggaaagcac

SEQ ID NO: 235237 - DNA, 15 bp, Homo sapiens
gtcatatggaaagca

SEQ ID NO: 235238 - DNA, 15 bp, Homo sapiens
ggtcatatggaaagc

SEQ ID NO: 235239 - DNA, 15 bp, Homo sapiens
gggtcatatggaaag

SEQ ID NO: 235240 - DNA, 15 bp, Homo sapiens
agggtcatatggaaa

SEQ ID NO: 235241 - DNA, 15 bp, Homo sapiens
gagggtcatatggaa

SEQ ID NO: 235242 - DNA, 15 bp, Homo sapiens
tgagggtcatatgga

SEQ ID NO: 235243 - DNA, 15 bp, Homo sapiens
atgagggtcatatgg

SEQ ID NO: 235244 - DNA, 15 bp, Homo sapiens
aatgagggtcatatg

SEQ ID NO: 235245 - DNA, 15 bp, Homo sapiens
caatgagggtcatat

SEQ ID NO: 235246 - DNA, 15 bp, Homo sapiens
ccaatgagggtcata

SEQ ID NO: 235247 - DNA, 15 bp, Homo sapiens
cccaatgagggtcat

SEQ ID NO: 235248 - DNA, 15 bp, Homo sapiens
ccccaatgagggtca

SEQ ID NO: 235249 - DNA, 15 bp, Homo sapiens
accccaatgagggtc

SEQ ID NO: 235250 - DNA, 15 bp, Homo sapiens
aaccccaatgagggt

SEQ ID NO: 235251 - DNA, 15 bp, Homo sapiens
gaaccccaatgaggg

SEQ ID NO: 235252 - DNA, 15 bp, Homo sapiens
tgaaccccaatgagg

SEQ ID NO: 235253 - DNA, 15 bp, Homo sapiens
atgaaccccaatgag

SEQ ID NO: 235254 - DNA, 15 bp, Homo sapiens
aatgaaccccaatga

SEQ ID NO: 235255 - DNA, 15 bp, Homo sapiens
caatgaaccccaatg

SEQ ID NO: 235256 - DNA, 15 bp, Homo sapiens
ccaatgaaccccaat

SEQ ID NO: 235257 - DNA, 15 bp, Homo sapiens
tccaatgaaccccaa

SEQ ID NO: 235258 - DNA, 15 bp, Homo sapiens
ttccaatgaacccca

SEQ ID NO: 235259 - DNA, 15 bp, Homo sapiens
gttccaatgaacccc

SEQ ID NO: 235260 - DNA, 15 bp, Homo sapiens
ggttccaatgaaccc

SEQ ID NO: 235261 - DNA, 15 bp, Homo sapiens
gggttccaatgaacc

SEQ ID NO: 235262 - DNA, 15 bp, Homo sapiens
ggggttccaatgaac

SEQ ID NO: 235263 - DNA, 15 bp, Homo sapiens
gggggttccaatgaa

SEQ ID NO: 235264 - DNA, 15 bp, Homo sapiens
agggggttccaatga

SEQ ID NO: 235265 - DNA, 15 bp, Homo sapiens
cagggggttccaatg

SEQ ID NO: 235266 - DNA, 15 bp, Homo sapiens
gcagggggttccaat

SEQ ID NO: 235267 - DNA, 15 bp, Homo sapiens
ggcagggggttccaa

SEQ ID NO: 235268 - DNA, 15 bp, Homo sapiens
gggcagggggttcca

SEQ ID NO: 235269 - DNA, 15 bp, Homo sapiens
ggggcagggggttcc

SEQ ID NO: 235270 - DNA, 15 bp, Homo sapiens
gggggcagggggttc

SEQ ID NO: 235271 - DNA, 15 bp, Homo sapiens
tgggggcagggggtt

SEQ ID NO: 235272 - DNA, 15 bp, Homo sapiens
ttgggggcagggggt

SEQ ID NO: 235273 - DNA, 15 bp, Homo sapiens
tttgggggcaggggg

SEQ ID NO: 235274 - DNA, 15 bp, Homo sapiens
atttgggggcagggg

SEQ ID NO: 235275 - DNA, 15 bp, Homo sapiens
tatttgggggcaggg

SEQ ID NO: 235276 - DNA, 15 bp, Homo sapiens
ttatttgggggcagg

SEQ ID NO: 235277 - DNA, 15 bp, Homo sapiens
gttatttgggggcag

SEQ ID NO: 235278 - DNA, 15 bp, Homo sapiens
tgttatttgggggca

SEQ ID NO: 235279 - DNA, 15 bp, Homo sapiens
ttgttatttgggggc

SEQ ID NO: 235280 - DNA, 15 bp, Homo sapiens
gttgttatttggggg

SEQ ID NO: 235281 - DNA, 15 bp, Homo sapiens
agttgttatttgggg

SEQ ID NO: 235282 - DNA, 15 bp, Homo sapiens
tagttgttatttggg

SEQ ID NO: 235283 - DNA, 15 bp, Homo sapiens
ttagttgttatttgg

SEQ ID NO: 235284 - DNA, 15 bp, Homo sapiens
attagttgttatttg

SEQ ID NO: 235285 - DNA, 15 bp, Homo sapiens
cattagttgttattt

SEQ ID NO: 235286 - DNA, 15 bp, Homo sapiens
gcattagttgttatt

SEQ ID NO: 235287 - DNA, 15 bp, Homo sapiens
tgcattagttgttat

SEQ ID NO: 235288 - DNA, 15 bp, Homo sapiens
ttgcattagttgtta

SEQ ID NO: 235289 - DNA, 15 bp, Homo sapiens
gttgcattagttgtt

SEQ ID NO: 235290 - DNA, 15 bp, Homo sapiens
agttgcattagttgt

SEQ ID NO: 235291 - DNA, 15 bp, Homo sapiens
aagttgcattagttg

SEQ ID NO: 235292 - DNA, 15 bp, Homo sapiens
aaagttgcattagtt

SEQ ID NO: 235293 - DNA, 15 bp, Homo sapiens
aaaagttgcattagt

SEQ ID NO: 235294 - DNA, 15 bp, Homo sapiens
taaaagttgcattag

SEQ ID NO: 235295 - DNA, 15 bp, Homo sapiens
ataaaagttgcatta

SEQ ID NO: 235296 - DNA, 15 bp, Homo sapiens
cataaaagttgcatt

SEQ ID NO: 235297 - DNA, 15 bp, Homo sapiens
tcataaaagttgcat

SEQ ID NO: 235298 - DNA, 15 bp, Homo sapiens
atcataaaagttgca

SEQ ID NO: 235299 - DNA, 15 bp, Homo sapiens
tatcataaaagttgc

SEQ ID NO: 235300 - DNA, 15 bp, Homo sapiens
ttatcataaaagttg

SEQ ID NO: 235301 - DNA, 15 bp, Homo sapiens
attatcataaaagtt

SEQ ID NO: 235302 - DNA, 15 bp, Homo sapiens
aattatcataaaagt

SEQ ID NO: 235303 - DNA, 15 bp, Homo sapiens
aaattatcataaaag

SEQ ID NO: 235304 - DNA, 15 bp, Homo sapiens
taaattatcataaaa

SEQ ID NO: 235305 - DNA, 15 bp, Homo sapiens
gtaaattatcataaa

SEQ ID NO: 235306 - DNA, 15 bp, Homo sapiens
tgtaaattatcataa

SEQ ID NO: 235307 - DNA, 15 bp, Homo sapiens
atgtaaattatcata

SEQ ID NO: 235308 - DNA, 15 bp, Homo sapiens
aatgtaaattatcat

SEQ ID NO: 235309 - DNA, 15 bp, Homo sapiens
aaatgtaaattatca

SEQ ID NO: 235310 - DNA, 15 bp, Homo sapiens
taaatgtaaattatc

SEQ ID NO: 235311 - DNA, 15 bp, Homo sapiens
ataaatgtaaattat

SEQ ID NO: 235312 - DNA, 15 bp, Homo sapiens
aataaatgtaaatta

SEQ ID NO: 235313 - DNA, 15 bp, Homo sapiens
aaataaatgtaaatt

SEQ ID NO: 235314 - DNA, 15 bp, Homo sapiens
aaaataaatgtaaat

SEQ ID NO: 235315 - DNA, 15 bp, Homo sapiens
aaaaataaatgtaaa

SEQ ID NO: 235316 - DNA, 15 bp, Homo sapiens
taaaaataaatgtaa

SEQ ID NO: 235317 - DNA, 15 bp, Homo sapiens
ataaaaataaatgta

SEQ ID NO: 235318 - DNA, 15 bp, Homo sapiens
aataaaaataaatgt

SEQ ID NO: 235319 - DNA, 15 bp, Homo sapiens
aaataaaaataaatg

SEQ ID NO: 235320 - DNA, 15 bp, Homo sapiens
taaaaaataaaaata

SEQ ID NO: 235321 - DNA, 15 bp, Homo sapiens
ataaaaaataaaaat

SEQ ID NO: 235322 - DNA, 15 bp, Homo sapiens
gataaaaaataaaaa

SEQ ID NO: 235323 - DNA, 15 bp, Homo sapiens
ggataaaaaataaaa

SEQ ID NO: 235324 - DNA, 15 bp, Homo sapiens
tggataaaaaataaa

SEQ ID NO: 235325 - DNA, 15 bp, Homo sapiens
ttggataaaaaataa

SEQ ID NO: 235326 - DNA, 15 bp, Homo sapiens
gttggataaaaaata

SEQ ID NO: 235327 - DNA, 15 bp, Homo sapiens
agttggataaaaaat

SEQ ID NO: 235328 - DNA, 15 bp, Homo sapiens
cagttggataaaaaa

SEQ ID NO: 235329 - DNA, 15 bp, Homo sapiens
acagttggataaaaa

SEQ ID NO: 235330 - DNA, 15 bp, Homo sapiens
cacagttggataaaa

SEQ ID NO: 235331 - DNA, 15 bp, Homo sapiens
gcacagttggataaa

SEQ ID NO: 235332 - DNA, 15 bp, Homo sapiens
tgcacagttggataa

SEQ ID NO: 235333 - DNA, 15 bp, Homo sapiens
atgcacagttggata

SEQ ID NO: 235334 - DNA, 15 bp, Homo sapiens
gatgcacagttggat

SEQ ID NO: 235335 - DNA, 15 bp, Homo sapiens
agatgcacagttgga

SEQ ID NO: 235336 - DNA, 15 bp, Homo sapiens
gagatgcacagttgg

SEQ ID NO: 235337 - DNA, 15 bp, Homo sapiens
agagatgcacagttg

SEQ ID NO: 235338 - DNA, 15 bp, Homo sapiens
tagagatgcacagtt

SEQ ID NO: 235339 - DNA, 15 bp, Homo sapiens
ctagagatgcacagt

SEQ ID NO: 235340 - DNA, 15 bp, Homo sapiens
tctagagatgcacag

SEQ ID NO: 235341 - DNA, 15 bp, Homo sapiens
gtctagagatgcaca

SEQ ID NO: 235342 - DNA, 15 bp, Homo sapiens
tgtctagagatgcac

SEQ ID NO: 235343 - DNA, 15 bp, Homo sapiens
ttgtctagagatgca

SEQ ID NO: 235344 - DNA, 15 bp, Homo sapiens
attgtctagagatgc

SEQ ID NO: 235345 - DNA, 15 bp, Homo sapiens
cattgtctagagatg

SEQ ID NO: 235346 - DNA, 15 bp, Homo sapiens
acattgtctagagat

SEQ ID NO: 235347 - DNA, 15 bp, Homo sapiens
tacattgtctagaga

SEQ ID NO: 235348 - DNA, 15 bp, Homo sapiens
ctacattgtctagag

SEQ ID NO: 235349 - DNA, 15 bp, Homo sapiens
tctacattgtctaga

SEQ ID NO: 235350 - DNA, 15 bp, Homo sapiens
atctacattgtctag

SEQ ID NO: 235351 - DNA, 15 bp, Homo sapiens
aatctacattgtcta

SEQ ID NO: 235352 - DNA, 15 bp, Homo sapiens
taatctacattgtct

SEQ ID NO: 235353 - DNA, 15 bp, Homo sapiens
ctaatctacattgtc

SEQ ID NO: 235354 - DNA, 15 bp, Homo sapiens
cctaatctacattgt

SEQ ID NO: 235355 - DNA, 15 bp, Homo sapiens
acctaatctacattg

SEQ ID NO: 235356 - DNA, 15 bp, Homo sapiens
aacctaatctacatt

SEQ ID NO: 235357 - DNA, 15 bp, Homo sapiens
aaacctaatctacat

SEQ ID NO: 235358 - DNA, 15 bp, Homo sapiens
taaacctaatctaca

SEQ ID NO: 235359 - DNA, 15 bp, Homo sapiens
gtaaacctaatctac

SEQ ID NO: 235360 - DNA, 15 bp, Homo sapiens
ggtaaacctaatcta

SEQ ID NO: 235361 - DNA, 15 bp, Homo sapiens
aggtaaacctaatct

SEQ ID NO: 235362 - DNA, 15 bp, Homo sapiens
taggtaaacctaatc

SEQ ID NO: 235363 - DNA, 15 bp, Homo sapiens
ataggtaaacctaat

SEQ ID NO: 235364 - DNA, 15 bp, Homo sapiens
aataggtaaacctaa

SEQ ID NO: 235365 - DNA, 15 bp, Homo sapiens
aaataggtaaaccta

SEQ ID NO: 235366 - DNA, 15 bp, Homo sapiens
aaaataggtaaacct

SEQ ID NO: 235367 - DNA, 15 bp, Homo sapiens
aaaaataggtaaacc

SEQ ID NO: 235368 - DNA, 15 bp, Homo sapiens
taaaaataggtaaac

SEQ ID NO: 235369 - DNA, 15 bp, Homo sapiens
ttaaaaataggtaaa

SEQ ID NO: 235370 - DNA, 15 bp, Homo sapiens
tttaaaaataggtaa

SEQ ID NO: 235371 - DNA, 15 bp, Homo sapiens
ttttaaaaataggta

SEQ ID NO: 235372 - DNA, 15 bp, Homo sapiens
tttttaaaaataggt

SEQ ID NO: 235373 - DNA, 15 bp, Homo sapiens
ttttttaaaaatagg

SEQ ID NO: 235374 - DNA, 15 bp, Homo sapiens
attttttaaaaatag

SEQ ID NO: 235375 - DNA, 15 bp, Homo sapiens
tattttttaaaaata

SEQ ID NO: 235376 - DNA, 15 bp, Homo sapiens
atattttttaaaaat

SEQ ID NO: 235377 - DNA, 15 bp, Homo sapiens
aatattttttaaaaa

SEQ ID NO: 235378 - DNA, 15 bp, Homo sapiens
aaatattttttaaaa

SEQ ID NO: 235379 - DNA, 15 bp, Homo sapiens
aaaatattttttaaa

SEQ ID NO: 235380 - DNA, 15 bp, Homo sapiens
aaaaatattttttaa

SEQ ID NO: 235381 - DNA, 15 bp, Homo sapiens
taaaaatatttttta

SEQ ID NO: 235382 - DNA, 15 bp, Homo sapiens
gattaaaaatatttt

SEQ ID NO: 235383 - DNA, 15 bp, Homo sapiens
ggattaaaaatattt

SEQ ID NO: 235384 - DNA, 15 bp, Homo sapiens
gggattaaaaatatt

SEQ ID NO: 235385 - DNA, 15 bp, Homo sapiens
ggggattaaaaatat

SEQ ID NO: 235386 - DNA, 15 bp, Homo sapiens
tggggattaaaaata

SEQ ID NO: 235387 - DNA, 15 bp, Homo sapiens
ctggggattaaaaat

SEQ ID NO: 235388 - DNA, 15 bp, Homo sapiens
tctggggattaaaaa

SEQ ID NO: 235389 - DNA, 15 bp, Homo sapiens
atctggggattaaaa

SEQ ID NO: 235390 - DNA, 15 bp, Homo sapiens
aatctggggattaaa

SEQ ID NO: 235391 - DNA, 15 bp, Homo sapiens
aaatctggggattaa

SEQ ID NO: 235392 - DNA, 15 bp, Homo sapiens
gaaatctggggatta

SEQ ID NO: 235393 - DNA, 15 bp, Homo sapiens
ggaaatctggggatt

SEQ ID NO: 235394 - DNA, 15 bp, Homo sapiens
gggaaatctggggat

SEQ ID NO: 235395 - DNA, 15 bp, Homo sapiens
ggggaaatctgggga

SEQ ID NO: 235396 - DNA, 15 bp, Homo sapiens
aggggaaatctgggg

SEQ ID NO: 235397 - DNA, 15 bp, Homo sapiens
gaggggaaatctggg

SEQ ID NO: 235398 - DNA, 15 bp, Homo sapiens
agaggggaaatctgg

SEQ ID NO: 235399 - DNA, 15 bp, Homo sapiens
gagaggggaaatctg

SEQ ID NO: 235400 - DNA, 15 bp, Homo sapiens
agagaggggaaatct

SEQ ID NO: 235401 - DNA, 15 bp, Homo sapiens
aagagaggggaaatc

SEQ ID NO: 235402 - DNA, 15 bp, Homo sapiens
gaagagaggggaaat

SEQ ID NO: 235403 - DNA, 15 bp, Homo sapiens
ggaagagaggggaaa

SEQ ID NO: 235404 - DNA, 15 bp, Homo sapiens
aggaagagaggggaa

SEQ ID NO: 235405 - DNA, 15 bp, Homo sapiens
aaggaagagagggga

SEQ ID NO: 235406 - DNA, 15 bp, Homo sapiens
aaaggaagagagggg

SEQ ID NO: 235407 - DNA, 15 bp, Homo sapiens
aaaaggaagagaggg

SEQ ID NO: 235408 - DNA, 15 bp, Homo sapiens
aaaaaggaagagagg

SEQ ID NO: 235409 - DNA, 15 bp, Homo sapiens
gaaaaaggaagagag

SEQ ID NO: 235410 - DNA, 15 bp, Homo sapiens
ggaaaaaggaagaga

SEQ ID NO: 235411 - DNA, 15 bp, Homo sapiens
aggaaaaaggaagag

SEQ ID NO: 235412 - DNA, 15 bp, Homo sapiens
aaggaaaaaggaaga

SEQ ID NO: 235413 - DNA, 15 bp, Homo sapiens
aaaggaaaaaggaag

SEQ ID NO: 235414 - DNA, 15 bp, Homo sapiens
aaaaggaaaaaggaa

SEQ ID NO: 235415 - DNA, 15 bp, Homo sapiens
gaaaaggaaaaagga

SEQ ID NO: 235416 - DNA, 15 bp, Homo sapiens
tgaaaaggaaaaagg

SEQ ID NO: 235417 - DNA, 15 bp, Homo sapiens
ctgaaaaggaaaaag

SEQ ID NO: 235418 - DNA, 15 bp, Homo sapiens
actgaaaaggaaaaa

SEQ ID NO: 235419 - DNA, 15 bp, Homo sapiens
aactgaaaaggaaaa

SEQ ID NO: 235420 - DNA, 15 bp, Homo sapiens
aaactgaaaaggaaa

SEQ ID NO: 235421 - DNA, 15 bp, Homo sapiens
taaactgaaaaggaa

SEQ ID NO: 235422 - DNA, 15 bp, Homo sapiens
ataaactgaaaagga

SEQ ID NO: 235423 - DNA, 15 bp, Homo sapiens
aataaactgaaaagg

SEQ ID NO: 235424 - DNA, 15 bp, Homo sapiens
aaataaactgaaaag

SEQ ID NO: 235425 - DNA, 15 bp, Homo sapiens
caaataaactgaaaa

SEQ ID NO: 235426 - DNA, 15 bp, Homo sapiens
acaaataaactgaaa

SEQ ID NO: 235427 - DNA, 15 bp, Homo sapiens
aacaaataaactgaa

SEQ ID NO: 235428 - DNA, 15 bp, Homo sapiens
taacaaataaactga

SEQ ID NO: 235429 - DNA, 15 bp, Homo sapiens
ttaacaaataaactg

SEQ ID NO: 235430 - DNA, 15 bp, Homo sapiens
tttaacaaataaact

SEQ ID NO: 235431 - DNA, 15 bp, Homo sapiens
ctttaacaaataaac

SEQ ID NO: 235432 - DNA, 15 bp, Homo sapiens
tctttaacaaataaa

SEQ ID NO: 235433 - DNA, 15 bp, Homo sapiens
gtctttaacaaataa

SEQ ID NO: 235434 - DNA, 15 bp, Homo sapiens
tgtctttaacaaata

SEQ ID NO: 235435 - DNA, 15 bp, Homo sapiens
gtgtctttaacaaat

SEQ ID NO: 235436 - DNA, 15 bp, Homo sapiens
agtgtctttaacaaa

SEQ ID NO: 235437 - DNA, 15 bp, Homo sapiens
cagtgtctttaacaa

SEQ ID NO: 235438 - DNA, 15 bp, Homo sapiens
tcagtgtctttaaca

SEQ ID NO: 235439 - DNA, 15 bp, Homo sapiens
ttcagtgtctttaac

SEQ ID NO: 235440 - DNA, 15 bp, Homo sapiens
attcagtgtctttaa

SEQ ID NO: 235441 - DNA, 15 bp, Homo sapiens
aattcagtgtcttta

SEQ ID NO: 235442 - DNA, 15 bp, Homo sapiens
caattcagtgtcttt

SEQ ID NO: 235443 - DNA, 15 bp, Homo sapiens
acaattcagtgtctt

SEQ ID NO: 235444 - DNA, 15 bp, Homo sapiens
aacaattcagtgtct

SEQ ID NO: 235445 - DNA, 15 bp, Homo sapiens
aaacaattcagtgtc

SEQ ID NO: 235446 - DNA, 15 bp, Homo sapiens
caaacaattcagtgt

SEQ ID NO: 235447 - DNA, 15 bp, Homo sapiens
acaaacaattcagtg

SEQ ID NO: 235448 - DNA, 15 bp, Homo sapiens
aacaaacaattcagt

SEQ ID NO: 235449 - DNA, 15 bp, Homo sapiens
aaacaaacaattcag

SEQ ID NO: 235450 - DNA, 15 bp, Homo sapiens
aaaacaaacaattca

SEQ ID NO: 235451 - DNA, 15 bp, Homo sapiens
caaaacaaacaattc

SEQ ID NO: 235452 - DNA, 15 bp, Homo sapiens
acaaaacaaacaatt

SEQ ID NO: 235453 - DNA, 15 bp, Homo sapiens
tacaaaacaaacaat

SEQ ID NO: 235454 - DNA, 15 bp, Homo sapiens
atacaaaacaaacaa

SEQ ID NO: 235455 - DNA, 15 bp, Homo sapiens
aatacaaaacaaaca

SEQ ID NO: 235456 - DNA, 15 bp, Homo sapiens
caatacaaaacaaac

SEQ ID NO: 235457 - DNA, 15 bp, Homo sapiens
tcaatacaaaacaaa

SEQ ID NO: 235458 - DNA, 15 bp, Homo sapiens
atcaatacaaaacaa

SEQ ID NO: 235459 - DNA, 15 bp, Homo sapiens
aatcaatacaaaaca

SEQ ID NO: 235460 - DNA, 15 bp, Homo sapiens
gaatcaatacaaaac

SEQ ID NO: 235461 - DNA, 15 bp, Homo sapiens
ggaatcaatacaaaa

SEQ ID NO: 235462 - DNA, 15 bp, Homo sapiens
gggaatcaatacaaa

SEQ ID NO: 235463 - DNA, 15 bp, Homo sapiens
tgggaatcaatacaa

SEQ ID NO: 235464 - DNA, 15 bp, Homo sapiens
ctgggaatcaataca

SEQ ID NO: 235465 - DNA, 15 bp, Homo sapiens
tctgggaatcaatac

SEQ ID NO: 235466 - DNA, 15 bp, Homo sapiens
ctctgggaatcaata

SEQ ID NO: 235467 - DNA, 15 bp, Homo sapiens
gctctgggaatcaat

SEQ ID NO: 235468 - DNA, 15 bp, Homo sapiens
ggctctgggaatcaa

SEQ ID NO: 235469 - DNA, 15 bp, Homo sapiens
aggctctgggaatca

SEQ ID NO: 235470 - DNA, 15 bp, Homo sapiens
caggctctgggaatc

SEQ ID NO: 235471 - DNA, 15 bp, Homo sapiens
ccaggctctgggaat

SEQ ID NO: 235472 - DNA, 15 bp, Homo sapiens
tccaggctctgggaa

SEQ ID NO: 235473 - DNA, 15 bp, Homo sapiens
atccaggctctggga

SEQ ID NO: 235474 - DNA, 15 bp, Homo sapiens
aatccaggctctggg

SEQ ID NO: 235475 - DNA, 15 bp, Homo sapiens
aaatccaggctctgg

SEQ ID NO: 235476 - DNA, 15 bp, Homo sapiens
aaaatccaggctctg

SEQ ID NO: 235477 - DNA, 15 bp, Homo sapiens
caaaatccaggctct

SEQ ID NO: 235478 - DNA, 15 bp, Homo sapiens
gcaaaatccaggctc

SEQ ID NO: 235479 - DNA, 15 bp, Homo sapiens
tgcaaaatccaggct

SEQ ID NO: 235480 - DNA, 15 bp, Homo sapiens
ctgcaaaatccaggc

SEQ ID NO: 235481 - DNA, 15 bp, Homo sapiens
tctgcaaaatccagg

SEQ ID NO: 235482 - DNA, 15 bp, Homo sapiens
ttctgcaaaatccag

SEQ ID NO: 235483 - DNA, 15 bp, Homo sapiens
attctgcaaaatcca

SEQ ID NO: 235484 - DNA, 15 bp, Homo sapiens
aattctgcaaaatcc

SEQ ID NO: 235485 - DNA, 15 bp, Homo sapiens
caattctgcaaaatc

SEQ ID NO: 235486 - DNA, 15 bp, Homo sapiens
cacaattctgcaaaa

SEQ ID NO: 235487 - DNA, 15 bp, Homo sapiens
acacaattctgcaaa

SEQ ID NO: 235488 - DNA, 15 bp, Homo sapiens
gacacaattctgcaa

SEQ ID NO: 235489 - DNA, 15 bp, Homo sapiens
ggacacaattctgca

SEQ ID NO: 235490 - DNA, 15 bp, Homo sapiens
tggacacaattctgc

SEQ ID NO: 235491 - DNA, 15 bp, Homo sapiens
atggacacaattctg

SEQ ID NO: 235492 - DNA, 15 bp, Homo sapiens
tatggacacaattct

SEQ ID NO: 235493 - DNA, 15 bp, Homo sapiens
atatggacacaattc

SEQ ID NO: 235494 - DNA, 15 bp, Homo sapiens
catatggacacaatt

SEQ ID NO: 235495 - DNA, 15 bp, Homo sapiens
ccatatggacacaat

SEQ ID NO: 235496 - DNA, 15 bp, Homo sapiens
accatatggacacaa

SEQ ID NO: 235497 - DNA, 15 bp, Homo sapiens
taccatatggacaca

SEQ ID NO: 235498 - DNA, 15 bp, Homo sapiens
ataccatatggacac

SEQ ID NO: 235499 - DNA, 15 bp, Homo sapiens
tataccatatggaca

SEQ ID NO: 235500 - DNA, 15 bp, Homo sapiens
ctataccatatggac

SEQ ID NO: 235501 - DNA, 15 bp, Homo sapiens
actataccatatgga

SEQ ID NO: 235502 - DNA, 15 bp, Homo sapiens
gactataccatatgg

SEQ ID NO: 235503 - DNA, 15 bp, Homo sapiens
agactataccatatg

SEQ ID NO: 235504 - DNA, 15 bp, Homo sapiens
gagactataccatat

SEQ ID NO: 235505 - DNA, 15 bp, Homo sapiens
ggagactataccata

SEQ ID NO: 235506 - DNA, 15 bp, Homo sapiens
tggagactataccat

SEQ ID NO: 235507 - DNA, 15 bp, Homo sapiens
ctggagactatacca

SEQ ID NO: 235508 - DNA, 15 bp, Homo sapiens
cctggagactatacc

SEQ ID NO: 235509 - DNA, 15 bp, Homo sapiens
acctggagactatac

SEQ ID NO: 235510 - DNA, 15 bp, Homo sapiens
aacctggagactata

SEQ ID NO: 235511 - DNA, 15 bp, Homo sapiens
gaacctggagactat

SEQ ID NO: 235512 - DNA, 15 bp, Homo sapiens
ggaacctggagacta

SEQ ID NO: 235513 - DNA, 15 bp, Homo sapiens
aggaacctggagact

SEQ ID NO: 235514 - DNA, 15 bp, Homo sapiens
gaggaacctggagac

SEQ ID NO: 235515 - DNA, 15 bp, Homo sapiens
agaggaacctggaga

SEQ ID NO: 235516 - DNA, 15 bp, Homo sapiens
gagaggaacctggag

SEQ ID NO: 235517 - DNA, 15 bp, Homo sapiens
agagaggaacctgga

SEQ ID NO: 235518 - DNA, 15 bp, Homo sapiens
tagagaggaacctgg

SEQ ID NO: 235519 - DNA, 15 bp, Homo sapiens
gtagagaggaacctg

SEQ ID NO: 235520 - DNA, 15 bp, Homo sapiens
agtagagaggaacct

SEQ ID NO: 235521 - DNA, 15 bp, Homo sapiens
gagtagagaggaacc

SEQ ID NO: 235522 - DNA, 15 bp, Homo sapiens
cgagtagagaggaac

SEQ ID NO: 235523 - DNA, 15 bp, Homo sapiens
ccgagtagagaggaa

SEQ ID NO: 235524 - DNA, 15 bp, Homo sapiens
accgagtagagagga

SEQ ID NO: 235525 - DNA, 15 bp, Homo sapiens
taccgagtagagagg

SEQ ID NO: 235526 - DNA, 15 bp, Homo sapiens
ataccgagtagagag

SEQ ID NO: 235527 - DNA, 15 bp, Homo sapiens
gataccgagtagaga

SEQ ID NO: 235528 - DNA, 15 bp, Homo sapiens
agataccgagtagag

SEQ ID NO: 235529 - DNA, 15 bp, Homo sapiens
gagataccgagtaga

SEQ ID NO: 235530 - DNA, 15 bp, Homo sapiens
agagataccgagtag

SEQ ID NO: 235531 - DNA, 15 bp, Homo sapiens
aagagataccgagta

SEQ ID NO: 235532 - DNA, 15 bp, Homo sapiens
caagagataccgagt

SEQ ID NO: 235533 - DNA, 15 bp, Homo sapiens
acaagagataccgag

SEQ ID NO: 235534 - DNA, 15 bp, Homo sapiens
tacaagagataccga

SEQ ID NO: 235535 - DNA, 15 bp, Homo sapiens
ttacaagagataccg

SEQ ID NO: 235536 - DNA, 15 bp, Homo sapiens
tttacaagagatacc

SEQ ID NO: 235537 - DNA, 15 bp, Homo sapiens
atttacaagagatac

SEQ ID NO: 235538 - DNA, 15 bp, Homo sapiens
aatttacaagagata

SEQ ID NO: 235539 - DNA, 15 bp, Homo sapiens
caatttacaagagat

SEQ ID NO: 235540 - DNA, 15 bp, Homo sapiens
ccaatttacaagaga

SEQ ID NO: 235541 - DNA, 15 bp, Homo sapiens
accaatttacaagag

SEQ ID NO: 235542 - DNA, 15 bp, Homo sapiens
caccaatttacaaga

SEQ ID NO: 235543 - DNA, 15 bp, Homo sapiens
ccaccaatttacaag

SEQ ID NO: 235544 - DNA, 15 bp, Homo sapiens
tccaccaatttacaa

SEQ ID NO: 235545 - DNA, 15 bp, Homo sapiens
atccaccaatttaca

SEQ ID NO: 235546 - DNA, 15 bp, Homo sapiens
catccaccaatttac

SEQ ID NO: 235547 - DNA, 15 bp, Homo sapiens
ccatccaccaattta

SEQ ID NO: 235548 - DNA, 15 bp, Homo sapiens
tccatccaccaattt

SEQ ID NO: 235549 - DNA, 15 bp, Homo sapiens
ctccatccaccaatt

SEQ ID NO: 235550 - DNA, 15 bp, Homo sapiens
tctccatccaccaat

SEQ ID NO: 235551 - DNA, 15 bp, Homo sapiens
atctccatccaccaa

SEQ ID NO: 235552 - DNA, 15 bp, Homo sapiens
tatctccatccacca

SEQ ID NO: 235553 - DNA, 15 bp, Homo sapiens
ctatctccatccacc

SEQ ID NO: 235554 - DNA, 15 bp, Homo sapiens
tctatctccatccac

SEQ ID NO: 235555 - DNA, 15 bp, Homo sapiens
ctctatctccatcca

SEQ ID NO: 235556 - DNA, 15 bp, Homo sapiens
tctctatctccatcc

SEQ ID NO: 235557 - DNA, 15 bp, Homo sapiens
atctctatctccatc

SEQ ID NO: 235558 - DNA, 15 bp, Homo sapiens
aatctctatctccat

SEQ ID NO: 235559 - DNA, 15 bp, Homo sapiens
aaatctctatctcca

SEQ ID NO: 235560 - DNA, 15 bp, Homo sapiens
taaatctctatctcc

SEQ ID NO: 235561 - DNA, 15 bp, Homo sapiens
ttaaatctctatctc

SEQ ID NO: 235562 - DNA, 15 bp, Homo sapiens
attaaatctctatct

SEQ ID NO: 235563 - DNA, 15 bp, Homo sapiens
gattaaatctctatc

SEQ ID NO: 235564 - DNA, 15 bp, Homo sapiens
tgattaaatctctat

SEQ ID NO: 235565 - DNA, 15 bp, Homo sapiens
ttgattaaatctcta

SEQ ID NO: 235566 - DNA, 15 bp, Homo sapiens
tttgattaaatctct

SEQ ID NO: 235567 - DNA, 15 bp, Homo sapiens
ttttgattaaatctc

SEQ ID NO: 235568 - DNA, 15 bp, Homo sapiens
cttttgattaaatct

SEQ ID NO: 235569 - DNA, 15 bp, Homo sapiens
gcttttgattaaatc

SEQ ID NO: 235570 - DNA, 15 bp, Homo sapiens
tgcttttgattaaat

SEQ ID NO: 235571 - DNA, 15 bp, Homo sapiens
gtgcttttgattaaa

SEQ ID NO: 235572 - DNA, 15 bp, Homo sapiens
tgtgcttttgattaa

SEQ ID NO: 235573 - DNA, 15 bp, Homo sapiens
gtgtgcttttgatta

SEQ ID NO: 235574 - DNA, 15 bp, Homo sapiens
agtgtgcttttgatt

SEQ ID NO: 235575 - DNA, 15 bp, Homo sapiens
gagtgtgcttttgat

SEQ ID NO: 235576 - DNA, 15 bp, Homo sapiens
agagtgtgcttttga

SEQ ID NO: 235577 - DNA, 15 bp, Homo sapiens
aagagtgtgcttttg

SEQ ID NO: 235578 - DNA, 15 bp, Homo sapiens
aaagagtgtgctttt

SEQ ID NO: 235579 - DNA, 15 bp, Homo sapiens
aaaagagtgtgcttt

SEQ ID NO: 235580 - DNA, 15 bp, Homo sapiens
taaaagagtgtgctt

SEQ ID NO: 235581 - DNA, 15 bp, Homo sapiens
gtaaaagagtgtgct

SEQ ID NO: 235582 - DNA, 15 bp, Homo sapiens
agtaaaagagtgtgc

SEQ ID NO: 235583 - DNA, 15 bp, Homo sapiens
cagtaaaagagtgtg

SEQ ID NO: 235584 - DNA, 15 bp, Homo sapiens
ccagtaaaagagtgt

SEQ ID NO: 235585 - DNA, 15 bp, Homo sapiens
cccagtaaaagagtg

SEQ ID NO: 235586 - DNA, 15 bp, Homo sapiens
tcccagtaaaagagt

SEQ ID NO: 235587 - DNA, 15 bp, Homo sapiens
ttcccagtaaaagag

SEQ ID NO: 235588 - DNA, 15 bp, Homo sapiens
gttcccagtaaaaga

SEQ ID NO: 235589 - DNA, 15 bp, Homo sapiens
agttcccagtaaaag

SEQ ID NO: 235590 - DNA, 15 bp, Homo sapiens
gagttcccagtaaaa

SEQ ID NO: 235591 - DNA, 15 bp, Homo sapiens
agagttcccagtaaa

SEQ ID NO: 235592 - DNA, 15 bp, Homo sapiens
gagagttcccagtaa

SEQ ID NO: 235593 - DNA, 15 bp, Homo sapiens
tgagagttcccagta

SEQ ID NO: 235594 - DNA, 15 bp, Homo sapiens
atgagagttcccagt

SEQ ID NO: 235595 - DNA, 15 bp, Homo sapiens
gatgagagttcccag

SEQ ID NO: 235596 - DNA, 15 bp, Homo sapiens
agatgagagttccca

SEQ ID NO: 235597 - DNA, 15 bp, Homo sapiens
tagatgagagttccc

SEQ ID NO: 235598 - DNA, 15 bp, Homo sapiens
atagatgagagttcc

SEQ ID NO: 235599 - DNA, 15 bp, Homo sapiens
tatagatgagagttc

SEQ ID NO: 235600 - DNA, 15 bp, Homo sapiens
ttatagatgagagtt

SEQ ID NO: 235601 - DNA, 15 bp, Homo sapiens
tttatagatgagagt

SEQ ID NO: 235602 - DNA, 15 bp, Homo sapiens
atttatagatgagag

SEQ ID NO: 235603 - DNA, 15 bp, Homo sapiens
aatttatagatgaga

SEQ ID NO: 235604 - DNA, 15 bp, Homo sapiens
caatttatagatgag

SEQ ID NO: 235605 - DNA, 15 bp, Homo sapiens
acaatttatagatga

SEQ ID NO: 235606 - DNA, 15 bp, Homo sapiens
tacaatttatagatg

SEQ ID NO: 235607 - DNA, 15 bp, Homo sapiens
atacaatttatagat

SEQ ID NO: 235608 - DNA, 15 bp, Homo sapiens
gatacaatttataga

SEQ ID NO: 235609 - DNA, 15 bp, Homo sapiens
agatacaatttatag

SEQ ID NO: 235610 - DNA, 15 bp, Homo sapiens
aagatacaatttata

SEQ ID NO: 235611 - DNA, 15 bp, Homo sapiens
taagatacaatttat

SEQ ID NO: 235612 - DNA, 15 bp, Homo sapiens
ataagatacaattta

SEQ ID NO: 235613 - DNA, 15 bp, Homo sapiens
aataagatacaattt

SEQ ID NO: 235614 - DNA, 15 bp, Homo sapiens
caataagatacaatt

SEQ ID NO: 235615 - DNA, 15 bp, Homo sapiens
acaataagatacaat

SEQ ID NO: 235616 - DNA, 15 bp, Homo sapiens
tacaataagatacaa

SEQ ID NO: 235617 - DNA, 15 bp, Homo sapiens
atacaataagataca

SEQ ID NO: 235618 - DNA, 15 bp, Homo sapiens
tatacaataagatac

SEQ ID NO: 235619 - DNA, 15 bp, Homo sapiens
atatacaataagata

SEQ ID NO: 235620 - DNA, 15 bp, Homo sapiens
aatatacaataagat

SEQ ID NO: 235621 - DNA, 15 bp, Homo sapiens
taatatacaataaga

SEQ ID NO: 235622 - DNA, 15 bp, Homo sapiens
ttaatatacaataag

SEQ ID NO: 235623 - DNA, 15 bp, Homo sapiens
attaatatacaataa

SEQ ID NO: 235624 - DNA, 15 bp, Homo sapiens
cattaatatacaata

SEQ ID NO: 235625 - DNA, 15 bp, Homo sapiens
tcattaatatacaat

SEQ ID NO: 235626 - DNA, 15 bp, Homo sapiens
ttcattaatatacaa

SEQ ID NO: 235627 - DNA, 15 bp, Homo sapiens
cttcattaatataca

SEQ ID NO: 235628 - DNA, 15 bp, Homo sapiens
tcttcattaatatac

SEQ ID NO: 235629 - DNA, 15 bp, Homo sapiens
ttcttcattaatata

SEQ ID NO: 235630 - DNA, 15 bp, Homo sapiens
attcttcattaatat

SEQ ID NO: 235631 - DNA, 15 bp, Homo sapiens
aattcttcattaata

SEQ ID NO: 235632 - DNA, 15 bp, Homo sapiens
taattcttcattaat

SEQ ID NO: 235633 - DNA, 15 bp, Homo sapiens
ctaattcttcattaa

SEQ ID NO: 235634 - DNA, 15 bp, Homo sapiens
actaattcttcatta

SEQ ID NO: 235635 - DNA, 15 bp, Homo sapiens
aactaattcttcatt

SEQ ID NO: 235636 - DNA, 15 bp, Homo sapiens
aaactaattcttcat

SEQ ID NO: 235637 - DNA, 15 bp, Homo sapiens
taaactaattcttca

SEQ ID NO: 235638 - DNA, 15 bp, Homo sapiens
ctaaactaattcttc

SEQ ID NO: 235639 - DNA, 15 bp, Homo sapiens
gctaaactaattctt

SEQ ID NO: 235640 - DNA, 15 bp, Homo sapiens
agctaaactaattct

SEQ ID NO: 235641 - DNA, 15 bp, Homo sapiens
tagctaaactaattc

SEQ ID NO: 235642 - DNA, 15 bp, Homo sapiens
atagctaaactaatt

SEQ ID NO: 235643 - DNA, 15 bp, Homo sapiens
tatagctaaactaat

SEQ ID NO: 235644 - DNA, 15 bp, Homo sapiens
ttatagctaaactaa

SEQ ID NO: 235645 - DNA, 15 bp, Homo sapiens
tttatagctaaacta

SEQ ID NO: 235646 - DNA, 15 bp, Homo sapiens
atttatagctaaact

SEQ ID NO: 235647 - DNA, 15 bp, Homo sapiens
aatttatagctaaac

SEQ ID NO: 235648 - DNA, 15 bp, Homo sapiens
gaatttatagctaaa

SEQ ID NO: 235649 - DNA, 15 bp, Homo sapiens
agaatttatagctaa

SEQ ID NO: 235650 - DNA, 15 bp, Homo sapiens
cagaatttatagcta

SEQ ID NO: 235651 - DNA, 15 bp, Homo sapiens
acagaatttatagct

SEQ ID NO: 235652 - DNA, 15 bp, Homo sapiens
aacagaatttatagc

SEQ ID NO: 235653 - DNA, 15 bp, Homo sapiens
aaacagaatttatag

SEQ ID NO: 235654 - DNA, 15 bp, Homo sapiens
caaacagaatttata

SEQ ID NO: 235655 - DNA, 15 bp, Homo sapiens
acaaacagaatttat

SEQ ID NO: 235656 - DNA, 15 bp, Homo sapiens
tacaaacagaattta

SEQ ID NO: 235657 - DNA, 15 bp, Homo sapiens
ctacaaacagaattt

SEQ ID NO: 235658 - DNA, 15 bp, Homo sapiens
actacaaacagaatt

SEQ ID NO: 235659 - DNA, 15 bp, Homo sapiens
tactacaaacagaat

SEQ ID NO: 235660 - DNA, 15 bp, Homo sapiens
ttactacaaacagaa

SEQ ID NO: 235661 - DNA, 15 bp, Homo sapiens
cttactacaaacaga

SEQ ID NO: 235662 - DNA, 15 bp, Homo sapiens
ccttactacaaacag

SEQ ID NO: 235663 - DNA, 15 bp, Homo sapiens
tccttactacaaaca

SEQ ID NO: 235664 - DNA, 15 bp, Homo sapiens
ttccttactacaaac

SEQ ID NO: 235665 - DNA, 15 bp, Homo sapiens
attccttactacaaa

SEQ ID NO: 235666 - DNA, 15 bp, Homo sapiens
aattccttactacaa

SEQ ID NO: 235667 - DNA, 15 bp, Homo sapiens
caattccttactaca

SEQ ID NO: 235668 - DNA, 15 bp, Homo sapiens
gcaattccttactac

SEQ ID NO: 235669 - DNA, 15 bp, Homo sapiens
ggcaattccttacta

SEQ ID NO: 235670 - DNA, 15 bp, Homo sapiens
gggcaattccttact

SEQ ID NO: 235671 - DNA, 15 bp, Homo sapiens
tgggcaattccttac

SEQ ID NO: 235672 - DNA, 15 bp, Homo sapiens
ttgggcaattcctta

SEQ ID NO: 235673 - DNA, 15 bp, Homo sapiens
tttgggcaattcctt

SEQ ID NO: 235674 - DNA, 15 bp, Homo sapiens
ctttgggcaattcct

SEQ ID NO: 235675 - DNA, 15 bp, Homo sapiens
gctttgggcaattcc

SEQ ID NO: 235676 - DNA, 15 bp, Homo sapiens
agctttgggcaattc

SEQ ID NO: 235677 - DNA, 15 bp, Homo sapiens
tagctttgggcaatt

SEQ ID NO: 235678 - DNA, 15 bp, Homo sapiens
atagctttgggcaat

SEQ ID NO: 235679 - DNA, 15 bp, Homo sapiens
catagctttgggcaa

SEQ ID NO: 235680 - DNA, 15 bp, Homo sapiens
ccatagctttgggca

SEQ ID NO: 235681 - DNA, 15 bp, Homo sapiens
tccatagctttgggc

SEQ ID NO: 235682 - DNA, 15 bp, Homo sapiens
atccatagctttggg

SEQ ID NO: 235683 - DNA, 15 bp, Homo sapiens
catccatagctttgg

SEQ ID NO: 235684 - DNA, 15 bp, Homo sapiens
acatccatagctttg

SEQ ID NO: 235685 - DNA, 15 bp, Homo sapiens
aacatccatagcttt

SEQ ID NO: 235686 - DNA, 15 bp, Homo sapiens
taacatccatagctt

SEQ ID NO: 235687 - DNA, 15 bp, Homo sapiens
ctaacatccatagct

SEQ ID NO: 235688 - DNA, 15 bp, Homo sapiens
tctaacatccatagc

SEQ ID NO: 235689 - DNA, 15 bp, Homo sapiens
gtctaacatccatag

SEQ ID NO: 235690 - DNA, 15 bp, Homo sapiens
agtctaacatccata

SEQ ID NO: 235691 - DNA, 15 bp, Homo sapiens
aagtctaacatccat

SEQ ID NO: 235692 - DNA, 15 bp, Homo sapiens
taagtctaacatcca

SEQ ID NO: 235693 - DNA, 15 bp, Homo sapiens
ataagtctaacatcc

SEQ ID NO: 235694 - DNA, 15 bp, Homo sapiens
cataagtctaacatc

SEQ ID NO: 235695 - DNA, 15 bp, Homo sapiens
ccataagtctaacat

SEQ ID NO: 235696 - DNA, 15 bp, Homo sapiens
accataagtctaaca

SEQ ID NO: 235697 - DNA, 15 bp, Homo sapiens
aaccataagtctaac

SEQ ID NO: 235698 - DNA, 15 bp, Homo sapiens
taaccataagtctaa

SEQ ID NO: 235699 - DNA, 15 bp, Homo sapiens
gtaaccataagtcta

SEQ ID NO: 235700 - DNA, 15 bp, Homo sapiens
ggtaaccataagtct

SEQ ID NO: 235701 - DNA, 15 bp, Homo sapiens
aggtaaccataagtc

SEQ ID NO: 235702 - DNA, 15 bp, Homo sapiens
gaggtaaccataagt

SEQ ID NO: 235703 - DNA, 15 bp, Homo sapiens
ggaggtaaccataag

SEQ ID NO: 235704 - DNA, 15 bp, Homo sapiens
gggaggtaaccataa

SEQ ID NO: 235705 - DNA, 15 bp, Homo sapiens
ggggaggtaaccata

SEQ ID NO: 235706 - DNA, 15 bp, Homo sapiens
aggggaggtaaccat

SEQ ID NO: 235707 - DNA, 15 bp, Homo sapiens
aaggggaggtaacca

SEQ ID NO: 235708 - DNA, 15 bp, Homo sapiens
aaaggggaggtaacc

SEQ ID NO: 235709 - DNA, 15 bp, Homo sapiens
caaaggggaggtaac

SEQ ID NO: 235710 - DNA, 15 bp, Homo sapiens
ccaaaggggaggtaa

SEQ ID NO: 235711 - DNA, 15 bp, Homo sapiens
accaaaggggaggta

SEQ ID NO: 235712 - DNA, 15 bp, Homo sapiens
aaccaaaggggaggt

SEQ ID NO: 235713 - DNA, 15 bp, Homo sapiens
gaaccaaaggggagg

SEQ ID NO: 235714 - DNA, 15 bp, Homo sapiens
ggaaccaaaggggag

SEQ ID NO: 235715 - DNA, 15 bp, Homo sapiens
gggaaccaaagggga

SEQ ID NO: 235716 - DNA, 15 bp, Homo sapiens
tgggaaccaaagggg

SEQ ID NO: 235717 - DNA, 15 bp, Homo sapiens
atgggaaccaaaggg

SEQ ID NO: 235718 - DNA, 15 bp, Homo sapiens
tatgggaaccaaagg

SEQ ID NO: 235719 - DNA, 15 bp, Homo sapiens
atatgggaaccaaag

SEQ ID NO: 235720 - DNA, 15 bp, Homo sapiens
aatatgggaaccaaa

SEQ ID NO: 235721 - DNA, 15 bp, Homo sapiens
gaatatgggaaccaa

SEQ ID NO: 235722 - DNA, 15 bp, Homo sapiens
agaatatgggaacca

SEQ ID NO: 235723 - DNA, 15 bp, Homo sapiens
tagaatatgggaacc

SEQ ID NO: 235724 - DNA, 15 bp, Homo sapiens
ctagaatatgggaac

SEQ ID NO: 235725 - DNA, 15 bp, Homo sapiens
tctagaatatgggaa

SEQ ID NO: 235726 - DNA, 15 bp, Homo sapiens
ttctagaatatggga

SEQ ID NO: 235727 - DNA, 15 bp, Homo sapiens
gttctagaatatggg

SEQ ID NO: 235728 - DNA, 15 bp, Homo sapiens
tgttctagaatatgg

SEQ ID NO: 235729 - DNA, 15 bp, Homo sapiens
atgttctagaatatg

SEQ ID NO: 235730 - DNA, 15 bp, Homo sapiens
gatgttctagaatat

SEQ ID NO: 235731 - DNA, 15 bp, Homo sapiens
agatgttctagaata

SEQ ID NO: 235732 - DNA, 15 bp, Homo sapiens
gagatgttctagaat

SEQ ID NO: 235733 - DNA, 15 bp, Homo sapiens
ggagatgttctagaa

SEQ ID NO: 235734 - DNA, 15 bp, Homo sapiens
aggagatgttctaga

SEQ ID NO: 235735 - DNA, 15 bp, Homo sapiens
caggagatgttctag

SEQ ID NO: 235736 - DNA, 15 bp, Homo sapiens
tcaggagatgttcta

SEQ ID NO: 235737 - DNA, 15 bp, Homo sapiens
ttcaggagatgttct

SEQ ID NO: 235738 - DNA, 15 bp, Homo sapiens
tttcaggagatgttc

SEQ ID NO: 235739 - DNA, 15 bp, Homo sapiens
ttttcaggagatgtt

SEQ ID NO: 235740 - DNA, 15 bp, Homo sapiens
tttttcaggagatgt

SEQ ID NO: 235741 - DNA, 15 bp, Homo sapiens
ttttttcaggagatg

SEQ ID NO: 235742 - DNA, 15 bp, Homo sapiens
tttttttcaggagat

SEQ ID NO: 235743 - DNA, 15 bp, Homo sapiens
ttttttttcaggaga

SEQ ID NO: 235744 - DNA, 15 bp, Homo sapiens
cttttttttcaggag

SEQ ID NO: 235745 - DNA, 15 bp, Homo sapiens
acttttttttcagga

SEQ ID NO: 235746 - DNA, 15 bp, Homo sapiens
aacttttttttcagg

SEQ ID NO: 235747 - DNA, 15 bp, Homo sapiens
taacttttttttcag

SEQ ID NO: 235748 - DNA, 15 bp, Homo sapiens
ttaacttttttttca

SEQ ID NO: 235749 - DNA, 15 bp, Homo sapiens
attaacttttttttc

SEQ ID NO: 235750 - DNA, 15 bp, Homo sapiens
tattaactttttttt

SEQ ID NO: 235751 - DNA, 15 bp, Homo sapiens
ttattaacttttttt

SEQ ID NO: 235752 - DNA, 15 bp, Homo sapiens
tttattaactttttt

SEQ ID NO: 235753 - DNA, 15 bp, Homo sapiens
ttttattaacttttt

SEQ ID NO: 235754 - DNA, 15 bp, Homo sapiens
attttattaactttt

SEQ ID NO: 235755 - DNA, 15 bp, Homo sapiens
aattttattaacttt

SEQ ID NO: 235756 - DNA, 15 bp, Homo sapiens
aaattttattaactt

SEQ ID NO: 235757 - DNA, 15 bp, Homo sapiens
taaattttattaact

SEQ ID NO: 235758 - DNA, 15 bp, Homo sapiens
ctaaattttattaac

SEQ ID NO: 235759 - DNA, 15 bp, Homo sapiens
tctaaattttattaa

SEQ ID NO: 235760 - DNA, 15 bp, Homo sapiens
gtctaaattttatta

SEQ ID NO: 235761 - DNA, 15 bp, Homo sapiens
tgtctaaattttatt

SEQ ID NO: 235762 - DNA, 15 bp, Homo sapiens
ttgtctaaattttat

SEQ ID NO: 235763 - DNA, 15 bp, Homo sapiens
attgtctaaatttta

SEQ ID NO: 235764 - DNA, 15 bp, Homo sapiens
tattgtctaaatttt

SEQ ID NO: 235765 - DNA, 15 bp, Homo sapiens
ttattgtctaaattt

SEQ ID NO: 235766 - DNA, 15 bp, Homo sapiens
cttattgtctaaatt

SEQ ID NO: 235767 - DNA, 15 bp, Homo sapiens
tcttattgtctaaat

SEQ ID NO: 235768 - DNA, 15 bp, Homo sapiens
ctcttattgtctaaa

SEQ ID NO: 235769 - DNA, 15 bp, Homo sapiens
tctcttattgtctaa

SEQ ID NO: 235770 - DNA, 15 bp, Homo sapiens
atctcttattgtcta

SEQ ID NO: 235771 - DNA, 15 bp, Homo sapiens
tatctcttattgtct

SEQ ID NO: 235772 - DNA, 15 bp, Homo sapiens
atatctcttattgtc

SEQ ID NO: 235773 - DNA, 15 bp, Homo sapiens
tatatctcttattgt

SEQ ID NO: 235774 - DNA, 15 bp, Homo sapiens
ttatatctcttattg

SEQ ID NO: 235775 - DNA, 15 bp, Homo sapiens
cttatatctcttatt

SEQ ID NO: 235776 - DNA, 15 bp, Homo sapiens
tcttatatctcttat

SEQ ID NO: 235777 - DNA, 15 bp, Homo sapiens
ctcttatatctctta

SEQ ID NO: 235778 - DNA, 15 bp, Homo sapiens
tctcttatatctctt

SEQ ID NO: 235779 - DNA, 15 bp, Homo sapiens
atctcttatatctct

SEQ ID NO: 235780 - DNA, 15 bp, Homo sapiens
catctcttatatctc

SEQ ID NO: 235781 - DNA, 15 bp, Homo sapiens
ccatctcttatatct

SEQ ID NO: 235782 - DNA, 15 bp, Homo sapiens
accatctcttatatc

SEQ ID NO: 235783 - DNA, 15 bp, Homo sapiens
aaccatctcttatat

SEQ ID NO: 235784 - DNA, 15 bp, Homo sapiens
aaaccatctcttata

SEQ ID NO: 235785 - DNA, 15 bp, Homo sapiens
taaaccatctcttat

SEQ ID NO: 235786 - DNA, 15 bp, Homo sapiens
ttaaaccatctctta

SEQ ID NO: 235787 - DNA, 15 bp, Homo sapiens
tttaaaccatctctt

SEQ ID NO: 235788 - DNA, 15 bp, Homo sapiens
ctttaaaccatctct

SEQ ID NO: 235789 - DNA, 15 bp, Homo sapiens
actttaaaccatctc

SEQ ID NO: 235790 - DNA, 15 bp, Homo sapiens
tactttaaaccatct

SEQ ID NO: 235791 - DNA, 15 bp, Homo sapiens
atactttaaaccatc

SEQ ID NO: 235792 - DNA, 15 bp, Homo sapiens
tatactttaaaccat

SEQ ID NO: 235793 - DNA, 15 bp, Homo sapiens
gtatactttaaacca

SEQ ID NO: 235794 - DNA, 15 bp, Homo sapiens
ggtatactttaaacc

SEQ ID NO: 235795 - DNA, 15 bp, Homo sapiens
gggtatactttaaac

SEQ ID NO: 235796 - DNA, 15 bp, Homo sapiens
ggggtatactttaaa

SEQ ID NO: 235797 - DNA, 15 bp, Homo sapiens
tggggtatactttaa

SEQ ID NO: 235798 - DNA, 15 bp, Homo sapiens
ttggggtatacttta

SEQ ID NO: 235799 - DNA, 15 bp, Homo sapiens
tttggggtatacttt

SEQ ID NO: 235800 - DNA, 15 bp, Homo sapiens
atttggggtatactt

SEQ ID NO: 235801 - DNA, 15 bp, Homo sapiens
gatttggggtatact

SEQ ID NO: 235802 - DNA, 15 bp, Homo sapiens
agatttggggtatac

SEQ ID NO: 235803 - DNA, 15 bp, Homo sapiens
gagatttggggtata

SEQ ID NO: 235804 - DNA, 15 bp, Homo sapiens
tgagatttggggtat

SEQ ID NO: 235805 - DNA, 15 bp, Homo sapiens
atgagatttggggta

SEQ ID NO: 235806 - DNA, 15 bp, Homo sapiens
aatgagatttggggt

SEQ ID NO: 235807 - DNA, 15 bp, Homo sapiens
caatgagatttgggg

SEQ ID NO: 235808 - DNA, 15 bp, Homo sapiens
tcaatgagatttggg

SEQ ID NO: 235809 - DNA, 15 bp, Homo sapiens
gtcaatgagatttgg

SEQ ID NO: 235810 - DNA, 15 bp, Homo sapiens
tgtcaatgagatttg

SEQ ID NO: 235811 - DNA, 15 bp, Homo sapiens
ctgtcaatgagattt

SEQ ID NO: 235812 - DNA, 15 bp, Homo sapiens
actgtcaatgagatt

SEQ ID NO: 235813 - DNA, 15 bp, Homo sapiens
cactgtcaatgagat

SEQ ID NO: 235814 - DNA, 15 bp, Homo sapiens
acactgtcaatgaga

SEQ ID NO: 235815 - DNA, 15 bp, Homo sapiens
tacactgtcaatgag

SEQ ID NO: 235816 - DNA, 15 bp, Homo sapiens
ctacactgtcaatga

SEQ ID NO: 235817 - DNA, 15 bp, Homo sapiens
actacactgtcaatg

SEQ ID NO: 235818 - DNA, 15 bp, Homo sapiens
gactacactgtcaat

SEQ ID NO: 235819 - DNA, 15 bp, Homo sapiens
tgactacactgtcaa

SEQ ID NO: 235820 - DNA, 15 bp, Homo sapiens
ctgactacactgtca

SEQ ID NO: 235821 - DNA, 15 bp, Homo sapiens
tctgactacactgtc

SEQ ID NO: 235822 - DNA, 15 bp, Homo sapiens
atctgactacactgt

SEQ ID NO: 235823 - DNA, 15 bp, Homo sapiens
tatctgactacactg

SEQ ID NO: 235824 - DNA, 15 bp, Homo sapiens
ttatctgactacact

SEQ ID NO: 235825 - DNA, 15 bp, Homo sapiens
tttatctgactacac

SEQ ID NO: 235826 - DNA, 15 bp, Homo sapiens
ttttatctgactaca

SEQ ID NO: 235827 - DNA, 15 bp, Homo sapiens
tttttatctgactac

SEQ ID NO: 235828 - DNA, 15 bp, Homo sapiens
atttttatctgacta

SEQ ID NO: 235829 - DNA, 15 bp, Homo sapiens
tatttttatctgact

SEQ ID NO: 235830 - DNA, 15 bp, Homo sapiens
ttatttttatctgac

SEQ ID NO: 235831 - DNA, 15 bp, Homo sapiens
cttatttttatctga

SEQ ID NO: 235832 - DNA, 15 bp, Homo sapiens
acttatttttatctg

SEQ ID NO: 235833 - DNA, 15 bp, Homo sapiens
tacttatttttatct

SEQ ID NO: 235834 - DNA, 15 bp, Homo sapiens
gtacttatttttatc

SEQ ID NO: 235835 - DNA, 15 bp, Homo sapiens
agtacttatttttat

SEQ ID NO: 235836 - DNA, 15 bp, Homo sapiens
cagtacttattttta

SEQ ID NO: 235837 - DNA, 15 bp, Homo sapiens
tcagtacttattttt

SEQ ID NO: 235838 - DNA, 15 bp, Homo sapiens
ttcagtacttatttt

SEQ ID NO: 235839 - DNA, 15 bp, Homo sapiens
attcagtacttattt

SEQ ID NO: 235840 - DNA, 15 bp, Homo sapiens
aattcagtacttatt

SEQ ID NO: 235841 - DNA, 15 bp, Homo sapiens
aaattcagtacttat

SEQ ID NO: 235842 - DNA, 15 bp, Homo sapiens
aaaattcagtactta

SEQ ID NO: 235843 - DNA, 15 bp, Homo sapiens
caaaattcagtactt

SEQ ID NO: 235844 - DNA, 15 bp, Homo sapiens
gcaaaattcagtact

SEQ ID NO: 235845 - DNA, 15 bp, Homo sapiens
agcaaaattcagtac

SEQ ID NO: 235846 - DNA, 15 bp, Homo sapiens
tagcaaaattcagta

SEQ ID NO: 235847 - DNA, 15 bp, Homo sapiens
ttagcaaaattcagt

SEQ ID NO: 235848 - DNA, 15 bp, Homo sapiens
tttagcaaaattcag

SEQ ID NO: 235849 - DNA, 15 bp, Homo sapiens
atttagcaaaattca

SEQ ID NO: 235850 - DNA, 15 bp, Homo sapiens
tatttagcaaaattc

SEQ ID NO: 235851 - DNA, 15 bp, Homo sapiens
atatttagcaaaatt

SEQ ID NO: 235852 - DNA, 15 bp, Homo sapiens
aatatttagcaaaat

SEQ ID NO: 235853 - DNA, 15 bp, Homo sapiens
taatatttagcaaaa

SEQ ID NO: 235854 - DNA, 15 bp, Homo sapiens
ataatatttagcaaa

SEQ ID NO: 235855 - DNA, 15 bp, Homo sapiens
aataatatttagcaa

SEQ ID NO: 235856 - DNA, 15 bp, Homo sapiens
taataatatttagca

SEQ ID NO: 235857 - DNA, 15 bp, Homo sapiens
ttaataatatttagc

SEQ ID NO: 235858 - DNA, 15 bp, Homo sapiens
tttaataatatttag

SEQ ID NO: 235859 - DNA, 15 bp, Homo sapiens
atttaataatattta

SEQ ID NO: 235860 - DNA, 15 bp, Homo sapiens
tatttaataatattt

SEQ ID NO: 235861 - DNA, 15 bp, Homo sapiens
atatttaataatatt

SEQ ID NO: 235862 - DNA, 15 bp, Homo sapiens
catatttaataatat

SEQ ID NO: 235863 - DNA, 15 bp, Homo sapiens
acatatttaataata

SEQ ID NO: 235864 - DNA, 15 bp, Homo sapiens
gacatatttaataat

SEQ ID NO: 235865 - DNA, 15 bp, Homo sapiens
tgacatatttaataa

SEQ ID NO: 235866 - DNA, 15 bp, Homo sapiens
ttgacatatttaata

SEQ ID NO: 235867 - DNA, 15 bp, Homo sapiens
tttgacatatttaat

SEQ ID NO: 235868 - DNA, 15 bp, Homo sapiens
ttttgacatatttaa

SEQ ID NO: 235869 - DNA, 15 bp, Homo sapiens
gttttgacatattta

SEQ ID NO: 235870 - DNA, 15 bp, Homo sapiens
tgttttgacatattt

SEQ ID NO: 235871 - DNA, 15 bp, Homo sapiens
ttgttttgacatatt

SEQ ID NO: 235872 - DNA, 15 bp, Homo sapiens
gttgttttgacatat

SEQ ID NO: 235873 - DNA, 15 bp, Homo sapiens
agttgttttgacata

SEQ ID NO: 235874 - DNA, 15 bp, Homo sapiens
cagttgttttgacat

SEQ ID NO: 235875 - DNA, 15 bp, Homo sapiens
ccagttgttttgaca

SEQ ID NO: 235876 - DNA, 15 bp, Homo sapiens
tccagttgttttgac

SEQ ID NO: 235877 - DNA, 15 bp, Homo sapiens
ttccagttgttttga

SEQ ID NO: 235878 - DNA, 15 bp, Homo sapiens
tttccagttgttttg

SEQ ID NO: 235879 - DNA, 15 bp, Homo sapiens
ttttccagttgtttt

SEQ ID NO: 235880 - DNA, 15 bp, Homo sapiens
gttttccagttgttt

SEQ ID NO: 235881 - DNA, 15 bp, Homo sapiens
cgttttccagttgtt

SEQ ID NO: 235882 - DNA, 15 bp, Homo sapiens
tcgttttccagttgt

SEQ ID NO: 235883 - DNA, 15 bp, Homo sapiens
ttcgttttccagttg

SEQ ID NO: 235884 - DNA, 15 bp, Homo sapiens
tttcgttttccagtt

SEQ ID NO: 235885 - DNA, 15 bp, Homo sapiens
atttcgttttccagt

SEQ ID NO: 235886 - DNA, 15 bp, Homo sapiens
gatttcgttttccag

SEQ ID NO: 235887 - DNA, 15 bp, Homo sapiens
ggatttcgttttcca

SEQ ID NO: 235888 - DNA, 15 bp, Homo sapiens
aggatttcgttttcc

SEQ ID NO: 235889 - DNA, 15 bp, Homo sapiens
aaggatttcgttttc

SEQ ID NO: 235890 - DNA, 15 bp, Homo sapiens
caaggatttcgtttt

SEQ ID NO: 235891 - DNA, 15 bp, Homo sapiens
ccaaggatttcgttt

SEQ ID NO: 235892 - DNA, 15 bp, Homo sapiens
cccaaggatttcgtt

SEQ ID NO: 235893 - DNA, 15 bp, Homo sapiens
ccccaaggatttcgt

SEQ ID NO: 235894 - DNA, 15 bp, Homo sapiens
cccccaaggatttcg

SEQ ID NO: 235895 - DNA, 15 bp, Homo sapiens
acccccaaggatttc

SEQ ID NO: 235896 - DNA, 15 bp, Homo sapiens
tacccccaaggattt

SEQ ID NO: 235897 - DNA, 15 bp, Homo sapiens
ttacccccaaggatt

SEQ ID NO: 235898 - DNA, 15 bp, Homo sapiens
attacccccaaggat

SEQ ID NO: 235899 - DNA, 15 bp, Homo sapiens
gattacccccaagga

SEQ ID NO: 235900 - DNA, 15 bp, Homo sapiens
tgattacccccaagg

SEQ ID NO: 235901 - DNA, 15 bp, Homo sapiens
ttgattacccccaag

SEQ ID NO: 235902 - DNA, 15 bp, Homo sapiens
tttgattacccccaa

SEQ ID NO: 235903 - DNA, 15 bp, Homo sapiens
atttgattaccccca

SEQ ID NO: 235904 - DNA, 15 bp, Homo sapiens
tatttgattaccccc

SEQ ID NO: 235905 - DNA, 15 bp, Homo sapiens
ttatttgattacccc

SEQ ID NO: 235906 - DNA, 15 bp, Homo sapiens
attatttgattaccc

SEQ ID NO: 235907 - DNA, 15 bp, Homo sapiens
cattatttgattacc

SEQ ID NO: 235908 - DNA, 15 bp, Homo sapiens
acattatttgattac

SEQ ID NO: 235909 - DNA, 15 bp, Homo sapiens
aacattatttgatta

SEQ ID NO: 235910 - DNA, 15 bp, Homo sapiens
taacattatttgatt

SEQ ID NO: 235911 - DNA, 15 bp, Homo sapiens
ttaacattatttgat

SEQ ID NO: 235912 - DNA, 15 bp, Homo sapiens
gttaacattatttga

SEQ ID NO: 235913 - DNA, 15 bp, Homo sapiens
agttaacattatttg

SEQ ID NO: 235914 - DNA, 15 bp, Homo sapiens
cagttaacattattt

SEQ ID NO: 235915 - DNA, 15 bp, Homo sapiens
gcagttaacattatt

SEQ ID NO: 235916 - DNA, 15 bp, Homo sapiens
ggcagttaacattat

SEQ ID NO: 235917 - DNA, 15 bp, Homo sapiens
aggcagttaacatta

SEQ ID NO: 235918 - DNA, 15 bp, Homo sapiens
taggcagttaacatt

SEQ ID NO: 235919 - DNA, 15 bp, Homo sapiens
ttaggcagttaacat

SEQ ID NO: 235920 - DNA, 15 bp, Homo sapiens
tttaggcagttaaca

SEQ ID NO: 235921 - DNA, 15 bp, Homo sapiens
ttttaggcagttaac

SEQ ID NO: 235922 - DNA, 15 bp, Homo sapiens
attttaggcagttaa

SEQ ID NO: 235923 - DNA, 15 bp, Homo sapiens
aattttaggcagtta

SEQ ID NO: 235924 - DNA, 15 bp, Homo sapiens
taattttaggcagtt

SEQ ID NO: 235925 - DNA, 15 bp, Homo sapiens
ataattttaggcagt

SEQ ID NO: 235926 - DNA, 15 bp, Homo sapiens
gataattttaggcag

SEQ ID NO: 235927 - DNA, 15 bp, Homo sapiens
tgataattttaggca

SEQ ID NO: 235928 - DNA, 15 bp, Homo sapiens
atgataattttaggc

SEQ ID NO: 235929 - DNA, 15 bp, Homo sapiens
aatgataattttagg

SEQ ID NO: 235930 - DNA, 15 bp, Homo sapiens
taatgataattttag

SEQ ID NO: 235931 - DNA, 15 bp, Homo sapiens
ttaatgataatttta

SEQ ID NO: 235932 - DNA, 15 bp, Homo sapiens
attaatgataatttt

SEQ ID NO: 235933 - DNA, 15 bp, Homo sapiens
gattaatgataattt

SEQ ID NO: 235934 - DNA, 15 bp, Homo sapiens
cgattaatgataatt

SEQ ID NO: 235935 - DNA, 15 bp, Homo sapiens
acgattaatgataat

SEQ ID NO: 235936 - DNA, 15 bp, Homo sapiens
aacgattaatgataa

SEQ ID NO: 235937 - DNA, 15 bp, Homo sapiens
gaacgattaatgata

SEQ ID NO: 235938 - DNA, 15 bp, Homo sapiens
agaacgattaatgat

SEQ ID NO: 235939 - DNA, 15 bp, Homo sapiens
aagaacgattaatga

SEQ ID NO: 235940 - DNA, 15 bp, Homo sapiens
taagaacgattaatg

SEQ ID NO: 235941 - DNA, 15 bp, Homo sapiens
ataagaacgattaat

SEQ ID NO: 235942 - DNA, 15 bp, Homo sapiens
aataagaacgattaa

SEQ ID NO: 235943 - DNA, 15 bp, Homo sapiens
aaataagaacgatta

SEQ ID NO: 235944 - DNA, 15 bp, Homo sapiens
taaataagaacgatt

SEQ ID NO: 235945 - DNA, 15 bp, Homo sapiens
gtaaataagaacgat

SEQ ID NO: 235946 - DNA, 15 bp, Homo sapiens
tgtaaataagaacga

SEQ ID NO: 235947 - DNA, 15 bp, Homo sapiens
ctgtaaataagaacg

SEQ ID NO: 235948 - DNA, 15 bp, Homo sapiens
tctgtaaataagaac

SEQ ID NO: 235949 - DNA, 15 bp, Homo sapiens
ttctgtaaataagaa

SEQ ID NO: 235950 - DNA, 15 bp, Homo sapiens
attctgtaaataaga

SEQ ID NO: 235951 - DNA, 15 bp, Homo sapiens
tattctgtaaataag

SEQ ID NO: 235952 - DNA, 15 bp, Homo sapiens
gtattctgtaaataa

SEQ ID NO: 235953 - DNA, 15 bp, Homo sapiens
tgtattctgtaaata

SEQ ID NO: 235954 - DNA, 15 bp, Homo sapiens
gtgtattctgtaaat

SEQ ID NO: 235955 - DNA, 15 bp, Homo sapiens
tgtgtattctgtaaa

SEQ ID NO: 235956 - DNA, 15 bp, Homo sapiens
gtgtgtattctgtaa

SEQ ID NO: 235957 - DNA, 15 bp, Homo sapiens
ggtgtgtattctgta

SEQ ID NO: 235958 - DNA, 15 bp, Homo sapiens
aggtgtgtattctgt

SEQ ID NO: 235959 - DNA, 15 bp, Homo sapiens
aaggtgtgtattctg

SEQ ID NO: 235960 - DNA, 15 bp, Homo sapiens
gaaggtgtgtattct

SEQ ID NO: 235961 - DNA, 15 bp, Homo sapiens
agaaggtgtgtattc

SEQ ID NO: 235962 - DNA, 15 bp, Homo sapiens
cagaaggtgtgtatt

SEQ ID NO: 235963 - DNA, 15 bp, Homo sapiens
ccagaaggtgtgtat

SEQ ID NO: 235964 - DNA, 15 bp, Homo sapiens
gccagaaggtgtgta

SEQ ID NO: 235965 - DNA, 15 bp, Homo sapiens
tgccagaaggtgtgt

SEQ ID NO: 235966 - DNA, 15 bp, Homo sapiens
ctgccagaaggtgtg

SEQ ID NO: 235967 - DNA, 15 bp, Homo sapiens
cctgccagaaggtgt

SEQ ID NO: 235968 - DNA, 15 bp, Homo sapiens
tcctgccagaaggtg

SEQ ID NO: 235969 - DNA, 15 bp, Homo sapiens
ctcctgccagaaggt

SEQ ID NO: 235970 - DNA, 15 bp, Homo sapiens
tctcctgccagaagg

SEQ ID NO: 235971 - DNA, 15 bp, Homo sapiens
ttctcctgccagaag

SEQ ID NO: 235972 - DNA, 15 bp, Homo sapiens
cttctcctgccagaa

SEQ ID NO: 235973 - DNA, 15 bp, Homo sapiens
ccttctcctgccaga

SEQ ID NO: 235974 - DNA, 15 bp, Homo sapiens
cccttctcctgccag

SEQ ID NO: 235975 - DNA, 15 bp, Homo sapiens
gcccttctcctgcca

SEQ ID NO: 235976 - DNA, 15 bp, Homo sapiens
agcccttctcctgcc

SEQ ID NO: 235977 - DNA, 15 bp, Homo sapiens
aagcccttctcctgc

SEQ ID NO: 235978 - DNA, 15 bp, Homo sapiens
taagcccttctcctg

SEQ ID NO: 235979 - DNA, 15 bp, Homo sapiens
ctaagcccttctcct

SEQ ID NO: 235980 - DNA, 15 bp, Homo sapiens
cctaagcccttctcc

SEQ ID NO: 235981 - DNA, 15 bp, Homo sapiens
tcctaagcccttctc

SEQ ID NO: 235982 - DNA, 15 bp, Homo sapiens
ctcctaagcccttct

SEQ ID NO: 235983 - DNA, 15 bp, Homo sapiens
actcctaagcccttc

SEQ ID NO: 235984 - DNA, 15 bp, Homo sapiens
gactcctaagccctt

SEQ ID NO: 235985 - DNA, 15 bp, Homo sapiens
tgactcctaagccct

SEQ ID NO: 235986 - DNA, 15 bp, Homo sapiens
gtgactcctaagccc

SEQ ID NO: 235987 - DNA, 15 bp, Homo sapiens
tgtgactcctaagcc

SEQ ID NO: 235988 - DNA, 15 bp, Homo sapiens
gtgtgactcctaagc

SEQ ID NO: 235989 - DNA, 15 bp, Homo sapiens
ggtgtgactcctaag

SEQ ID NO: 235990 - DNA, 15 bp, Homo sapiens
aggtgtgactcctaa

SEQ ID NO: 235991 - DNA, 15 bp, Homo sapiens
caggtgtgactccta

SEQ ID NO: 235992 - DNA, 15 bp, Homo sapiens
gcaggtgtgactcct

SEQ ID NO: 235993 - DNA, 15 bp, Homo sapiens
ggcaggtgtgactcc

SEQ ID NO: 235994 - DNA, 15 bp, Homo sapiens
tggcaggtgtgactc

SEQ ID NO: 235995 - DNA, 15 bp, Homo sapiens
ttggcaggtgtgact

SEQ ID NO: 235996 - DNA, 15 bp, Homo sapiens
gttggcaggtgtgac

SEQ ID NO: 235997 - DNA, 15 bp, Homo sapiens
tgttggcaggtgtga

SEQ ID NO: 235998 - DNA, 15 bp, Homo sapiens
ctgttggcaggtgtg

SEQ ID NO: 235999 - DNA, 15 bp, Homo sapiens
tctgttggcaggtgt

SEQ ID NO: 236000 - DNA, 15 bp, Homo sapiens
gtctgttggcaggtg

SEQ ID NO: 236001 - DNA, 15 bp, Homo sapiens
agtctgttggcaggt

SEQ ID NO: 236002 - DNA, 15 bp, Homo sapiens
aagtctgttggcagg

SEQ ID NO: 236003 - DNA, 15 bp, Homo sapiens
gaagtctgttggcag

SEQ ID NO: 236004 - DNA, 15 bp, Homo sapiens
ggaagtctgttggca

SEQ ID NO: 236005 - DNA, 15 bp, Homo sapiens
tggaagtctgttggc

SEQ ID NO: 236006 - DNA, 15 bp, Homo sapiens
ctggaagtctgttgg

SEQ ID NO: 236007 - DNA, 15 bp, Homo sapiens
actggaagtctgttg

SEQ ID NO: 236008 - DNA, 15 bp, Homo sapiens
aactggaagtctgtt

SEQ ID NO: 236009 - DNA, 15 bp, Homo sapiens
taactggaagtctgt

SEQ ID NO: 236010 - DNA, 15 bp, Homo sapiens
ctaactggaagtctg

SEQ ID NO: 236011 - DNA, 15 bp, Homo sapiens
gctaactggaagtct

SEQ ID NO: 236012 - DNA, 15 bp, Homo sapiens
tgctaactggaagtc

SEQ ID NO: 236013 - DNA, 15 bp, Homo sapiens
gtgctaactggaagt

SEQ ID NO: 236014 - DNA, 15 bp, Homo sapiens
ggtgctaactggaag

SEQ ID NO: 236015 - DNA, 15 bp, Homo sapiens
aggtgctaactggaa

SEQ ID NO: 236016 - DNA, 15 bp, Homo sapiens
aaggtgctaactgga

SEQ ID NO: 236017 - DNA, 15 bp, Homo sapiens
aaaggtgctaactgg

SEQ ID NO: 236018 - DNA, 15 bp, Homo sapiens
caaaggtgctaactg

SEQ ID NO: 236019 - DNA, 15 bp, Homo sapiens
tcaaaggtgctaact

SEQ ID NO: 236020 - DNA, 15 bp, Homo sapiens
atcaaaggtgctaac

SEQ ID NO: 236021 - DNA, 15 bp, Homo sapiens
tatcaaaggtgctaa

SEQ ID NO: 236022 - DNA, 15 bp, Homo sapiens
gtatcaaaggtgcta

SEQ ID NO: 236023 - DNA, 15 bp, Homo sapiens
agtatcaaaggtgct

SEQ ID NO: 236024 - DNA, 15 bp, Homo sapiens
tagtatcaaaggtgc

SEQ ID NO: 236025 - DNA, 15 bp, Homo sapiens
ctagtatcaaaggtg

SEQ ID NO: 236026 - DNA, 15 bp, Homo sapiens
gctagtatcaaaggt

SEQ ID NO: 236027 - DNA, 15 bp, Homo sapiens
tgctagtatcaaagg

SEQ ID NO: 236028 - DNA, 15 bp, Homo sapiens
ctgctagtatcaaag

SEQ ID NO: 236029 - DNA, 15 bp, Homo sapiens
tctgctagtatcaaa

SEQ ID NO: 236030 - DNA, 15 bp, Homo sapiens
atctgctagtatcaa

SEQ ID NO: 236031 - DNA, 15 bp, Homo sapiens
catctgctagtatca

SEQ ID NO: 236032 - DNA, 15 bp, Homo sapiens
acatctgctagtatc

SEQ ID NO: 236033 - DNA, 15 bp, Homo sapiens
aacatctgctagtat

SEQ ID NO: 236034 - DNA, 15 bp, Homo sapiens
gaacatctgctagta

SEQ ID NO: 236035 - DNA, 15 bp, Homo sapiens
agaacatctgctagt

SEQ ID NO: 236036 - DNA, 15 bp, Homo sapiens
cagaacatctgctag

SEQ ID NO: 236037 - DNA, 15 bp, Homo sapiens
acagaacatctgcta

SEQ ID NO: 236038 - DNA, 15 bp, Homo sapiens
aacagaacatctgct

SEQ ID NO: 236039 - DNA, 15 bp, Homo sapiens
aaacagaacatctgc

SEQ ID NO: 236040 - DNA, 15 bp, Homo sapiens
aaaacagaacatctg

SEQ ID NO: 236041 - DNA, 15 bp, Homo sapiens
aaaaacagaacatct

SEQ ID NO: 236042 - DNA, 15 bp, Homo sapiens
taaaaacagaacatc

SEQ ID NO: 236043 - DNA, 15 bp, Homo sapiens
ataaaaacagaacat

SEQ ID NO: 236044 - DNA, 15 bp, Homo sapiens
cataaaaacagaaca

SEQ ID NO: 236045 - DNA, 15 bp, Homo sapiens
ccataaaaacagaac

SEQ ID NO: 236046 - DNA, 15 bp, Homo sapiens
gccataaaaacagaa

SEQ ID NO: 236047 - DNA, 15 bp, Homo sapiens
tgccataaaaacaga

SEQ ID NO: 236048 - DNA, 15 bp, Homo sapiens
ttgccataaaaacag

SEQ ID NO: 236049 - DNA, 15 bp, Homo sapiens
cttgccataaaaaca

SEQ ID NO: 236050 - DNA, 15 bp, Homo sapiens
ccttgccataaaaac

SEQ ID NO: 236051 - DNA, 15 bp, Homo sapiens
tccttgccataaaaa

SEQ ID NO: 236052 - DNA, 15 bp, Homo sapiens
ttccttgccataaaa

SEQ ID NO: 236053 - DNA, 15 bp, Homo sapiens
cttccttgccataaa

SEQ ID NO: 236054 - DNA, 15 bp, Homo sapiens
ccttccttgccataa

SEQ ID NO: 236055 - DNA, 15 bp, Homo sapiens
gccttccttgccata

SEQ ID NO: 236056 - DNA, 15 bp, Homo sapiens
ggccttccttgccat

SEQ ID NO: 236057 - DNA, 15 bp, Homo sapiens
tggccttccttgcca

SEQ ID NO: 236058 - DNA, 15 bp, Homo sapiens
gtggccttccttgcc

SEQ ID NO: 236059 - DNA, 15 bp, Homo sapiens
tgtggccttccttgc

SEQ ID NO: 236060 - DNA, 15 bp, Homo sapiens
atgtggccttccttg

SEQ ID NO: 236061 - DNA, 15 bp, Homo sapiens
tatgtggccttcctt

SEQ ID NO: 236062 - DNA, 15 bp, Homo sapiens
ctatgtggccttcct

SEQ ID NO: 236063 - DNA, 15 bp, Homo sapiens
actatgtggccttcc

SEQ ID NO: 236064 - DNA, 15 bp, Homo sapiens
gactatgtggccttc

SEQ ID NO: 236065 - DNA, 15 bp, Homo sapiens
agactatgtggcctt

SEQ ID NO: 236066 - DNA, 15 bp, Homo sapiens
aagactatgtggcct

SEQ ID NO: 236067 - DNA, 15 bp, Homo sapiens
aaagactatgtggcc

SEQ ID NO: 236068 - DNA, 15 bp, Homo sapiens
aaaagactatgtggc

SEQ ID NO: 236069 - DNA, 15 bp, Homo sapiens
taaaagactatgtgg

SEQ ID NO: 236070 - DNA, 15 bp, Homo sapiens
ataaaagactatgtg

SEQ ID NO: 236071 - DNA, 15 bp, Homo sapiens
aataaaagactatgt

SEQ ID NO: 236072 - DNA, 15 bp, Homo sapiens
gaataaaagactatg

SEQ ID NO: 236073 - DNA, 15 bp, Homo sapiens
agaataaaagactat

SEQ ID NO: 236074 - DNA, 15 bp, Homo sapiens
cagaataaaagacta

SEQ ID NO: 236075 - DNA, 15 bp, Homo sapiens
acagaataaaagact

SEQ ID NO: 236076 - DNA, 15 bp, Homo sapiens
aacagaataaaagac

SEQ ID NO: 236077 - DNA, 15 bp, Homo sapiens
taacagaataaaaga

SEQ ID NO: 236078 - DNA, 15 bp, Homo sapiens
ataacagaataaaag

SEQ ID NO: 236079 - DNA, 15 bp, Homo sapiens
tataacagaataaaa

SEQ ID NO: 236080 - DNA, 15 bp, Homo sapiens
ctataacagaataaa

SEQ ID NO: 236081 - DNA, 15 bp, Homo sapiens
cctataacagaataa

SEQ ID NO: 236082 - DNA, 15 bp, Homo sapiens
tcctataacagaata

SEQ ID NO: 236083 - DNA, 15 bp, Homo sapiens
ttcctataacagaat

SEQ ID NO: 236084 - DNA, 15 bp, Homo sapiens
tttcctataacagaa

SEQ ID NO: 236085 - DNA, 15 bp, Homo sapiens
ctttcctataacaga

SEQ ID NO: 236086 - DNA, 15 bp, Homo sapiens
actttcctataacag

SEQ ID NO: 236087 - DNA, 15 bp, Homo sapiens
cactttcctataaca

SEQ ID NO: 236088 - DNA, 15 bp, Homo sapiens
gcactttcctataac

SEQ ID NO: 236089 - DNA, 15 bp, Homo sapiens
tgcactttcctataa

SEQ ID NO: 236090 - DNA, 15 bp, Homo sapiens
ctgcactttcctata

SEQ ID NO: 236091 - DNA, 15 bp, Homo sapiens
actgcactttcctat

SEQ ID NO: 236092 - DNA, 15 bp, Homo sapiens
gactgcactttccta

SEQ ID NO: 236093 - DNA, 15 bp, Homo sapiens
tgactgcactttcct

SEQ ID NO: 236094 - DNA, 15 bp, Homo sapiens
atgactgcactttcc

SEQ ID NO: 236095 - DNA, 15 bp, Homo sapiens
tatgactgcactttc

SEQ ID NO: 236096 - DNA, 15 bp, Homo sapiens
ttatgactgcacttt

SEQ ID NO: 236097 - DNA, 15 bp, Homo sapiens
gttatgactgcactt

SEQ ID NO: 236098 - DNA, 15 bp, Homo sapiens
tgttatgactgcact

SEQ ID NO: 236099 - DNA, 15 bp, Homo sapiens
atgttatgactgcac

SEQ ID NO: 236100 - DNA, 15 bp, Homo sapiens
catgttatgactgca

SEQ ID NO: 236101 - DNA, 15 bp, Homo sapiens
tcatgttatgactgc

SEQ ID NO: 236102 - DNA, 15 bp, Homo sapiens
atcatgttatgactg

SEQ ID NO: 236103 - DNA, 15 bp, Homo sapiens
tatcatgttatgact

SEQ ID NO: 236104 - DNA, 15 bp, Homo sapiens
ttatcatgttatgac

SEQ ID NO: 236105 - DNA, 15 bp, Homo sapiens
tttatcatgttatga

SEQ ID NO: 236106 - DNA, 15 bp, Homo sapiens
atttatcatgttatg

SEQ ID NO: 236107 - DNA, 15 bp, Homo sapiens
tatttatcatgttat

SEQ ID NO: 236108 - DNA, 15 bp, Homo sapiens
ctatttatcatgtta

SEQ ID NO: 236109 - DNA, 15 bp, Homo sapiens
cctatttatcatgtt

SEQ ID NO: 236110 - DNA, 15 bp, Homo sapiens
acctatttatcatgt

SEQ ID NO: 236111 - DNA, 15 bp, Homo sapiens
aacctatttatcatg

SEQ ID NO: 236112 - DNA, 15 bp, Homo sapiens
gaacctatttatcat

SEQ ID NO: 236113 - DNA, 15 bp, Homo sapiens
agaacctatttatca

SEQ ID NO: 236114 - DNA, 15 bp, Homo sapiens
aagaacctatttatc

SEQ ID NO: 236115 - DNA, 15 bp, Homo sapiens
aaagaacctatttat

SEQ ID NO: 236116 - DNA, 15 bp, Homo sapiens
taaagaacctattta

SEQ ID NO: 236117 - DNA, 15 bp, Homo sapiens
ataaagaacctattt

SEQ ID NO: 236118 - DNA, 15 bp, Homo sapiens
cataaagaacctatt

SEQ ID NO: 236119 - DNA, 15 bp, Homo sapiens
gcataaagaacctat

SEQ ID NO: 236120 - DNA, 15 bp, Homo sapiens
agcataaagaaccta

SEQ ID NO: 236121 - DNA, 15 bp, Homo sapiens
tagcataaagaacct

SEQ ID NO: 236122 - DNA, 15 bp, Homo sapiens
ctagcataaagaacc

SEQ ID NO: 236123 - DNA, 15 bp, Homo sapiens
tctagcataaagaac

SEQ ID NO: 236124 - DNA, 15 bp, Homo sapiens
ttctagcataaagaa

SEQ ID NO: 236125 - DNA, 15 bp, Homo sapiens
gttctagcataaaga

SEQ ID NO: 236126 - DNA, 15 bp, Homo sapiens
tgttctagcataaag

SEQ ID NO: 236127 - DNA, 15 bp, Homo sapiens
gtgttctagcataaa

SEQ ID NO: 236128 - DNA, 15 bp, Homo sapiens
tgtgttctagcataa

SEQ ID NO: 236129 - DNA, 15 bp, Homo sapiens
gtgtgttctagcata

SEQ ID NO: 236130 - DNA, 15 bp, Homo sapiens
tgtgtgttctagcat

SEQ ID NO: 236131 - DNA, 15 bp, Homo sapiens
ctgtgtgttctagca

SEQ ID NO: 236132 - DNA, 15 bp, Homo sapiens
gctgtgtgttctagc

SEQ ID NO: 236133 - DNA, 15 bp, Homo sapiens
tgctgtgtgttctag

SEQ ID NO: 236134 - DNA, 15 bp, Homo sapiens
ctgctgtgtgttcta

SEQ ID NO: 236135 - DNA, 15 bp, Homo sapiens
actgctgtgtgttct

SEQ ID NO: 236136 - DNA, 15 bp, Homo sapiens
aactgctgtgtgttc

SEQ ID NO: 236137 - DNA, 15 bp, Homo sapiens
gaactgctgtgtgtt

SEQ ID NO: 236138 - DNA, 15 bp, Homo sapiens
agaactgctgtgtgt

SEQ ID NO: 236139 - DNA, 15 bp, Homo sapiens
cagaactgctgtgtg

SEQ ID NO: 236140 - DNA, 15 bp, Homo sapiens
tcagaactgctgtgt

SEQ ID NO: 236141 - DNA, 15 bp, Homo sapiens
ttcagaactgctgtg

SEQ ID NO: 236142 - DNA, 15 bp, Homo sapiens
tttcagaactgctgt

SEQ ID NO: 236143 - DNA, 15 bp, Homo sapiens
gtttcagaactgctg

SEQ ID NO: 236144 - DNA, 15 bp, Homo sapiens
ggtttcagaactgct

SEQ ID NO: 236145 - DNA, 15 bp, Homo sapiens
tggtttcagaactgc

SEQ ID NO: 236146 - DNA, 15 bp, Homo sapiens
atggtttcagaactg

SEQ ID NO: 236147 - DNA, 15 bp, Homo sapiens
aatggtttcagaact

SEQ ID NO: 236148 - DNA, 15 bp, Homo sapiens
aaatggtttcagaac

SEQ ID NO: 236149 - DNA, 15 bp, Homo sapiens
aaaatggtttcagaa

SEQ ID NO: 236150 - DNA, 15 bp, Homo sapiens
taaaatggtttcaga

SEQ ID NO: 236151 - DNA, 15 bp, Homo sapiens
ttaaaatggtttcag

SEQ ID NO: 236152 - DNA, 15 bp, Homo sapiens
tttaaaatggtttca

SEQ ID NO: 236153 - DNA, 15 bp, Homo sapiens
ttttaaaatggtttc

SEQ ID NO: 236154 - DNA, 15 bp, Homo sapiens
gttttaaaatggttt

SEQ ID NO: 236155 - DNA, 15 bp, Homo sapiens
agttttaaaatggtt

SEQ ID NO: 236156 - DNA, 15 bp, Homo sapiens
aagttttaaaatggt

SEQ ID NO: 236157 - DNA, 15 bp, Homo sapiens
caagttttaaaatgg

SEQ ID NO: 236158 - DNA, 15 bp, Homo sapiens
gcaagttttaaaatg

SEQ ID NO: 236159 - DNA, 15 bp, Homo sapiens
agcaagttttaaaat

SEQ ID NO: 236160 - DNA, 15 bp, Homo sapiens
aagcaagttttaaaa

SEQ ID NO: 236161 - DNA, 15 bp, Homo sapiens
aaagcaagttttaaa

SEQ ID NO: 236162 - DNA, 15 bp, Homo sapiens
taaagcaagttttaa

SEQ ID NO: 236163 - DNA, 15 bp, Homo sapiens
ataaagcaagtttta

SEQ ID NO: 236164 - DNA, 15 bp, Homo sapiens
gataaagcaagtttt

SEQ ID NO: 236165 - DNA, 15 bp, Homo sapiens
agataaagcaagttt

SEQ ID NO: 236166 - DNA, 15 bp, Homo sapiens
gagataaagcaagtt

SEQ ID NO: 236167 - DNA, 15 bp, Homo sapiens
cgagataaagcaagt

SEQ ID NO: 236168 - DNA, 15 bp, Homo sapiens
tcgagataaagcaag

SEQ ID NO: 236169 - DNA, 15 bp, Homo sapiens
ctcgagataaagcaa

SEQ ID NO: 236170 - DNA, 15 bp, Homo sapiens
gctcgagataaagca

SEQ ID NO: 236171 - DNA, 15 bp, Homo sapiens
ggctcgagataaagc

SEQ ID NO: 236172 - DNA, 15 bp, Homo sapiens
gggctcgagataaag

SEQ ID NO: 236173 - DNA, 15 bp, Homo sapiens
ggggctcgagataaa

SEQ ID NO: 236174 - DNA, 15 bp, Homo sapiens
aggggctcgagataa

SEQ ID NO: 236175 - DNA, 15 bp, Homo sapiens
aaggggctcgagata

SEQ ID NO: 236176 - DNA, 15 bp, Homo sapiens
taaggggctcgagat

SEQ ID NO: 236177 - DNA, 15 bp, Homo sapiens
ttaaggggctcgaga

SEQ ID NO: 236178 - DNA, 15 bp, Homo sapiens
attaaggggctcgag

SEQ ID NO: 236179 - DNA, 15 bp, Homo sapiens
aattaaggggctcga

SEQ ID NO: 236180 - DNA, 15 bp, Homo sapiens
aaattaaggggctcg

SEQ ID NO: 236181 - DNA, 15 bp, Homo sapiens
caaattaaggggctc

SEQ ID NO: 236182 - DNA, 15 bp, Homo sapiens
ccaaattaaggggct

SEQ ID NO: 236183 - DNA, 15 bp, Homo sapiens
tccaaattaaggggc

SEQ ID NO: 236184 - DNA, 15 bp, Homo sapiens
ttccaaattaagggg

SEQ ID NO: 236185 - DNA, 15 bp, Homo sapiens
cttccaaattaaggg

SEQ ID NO: 236186 - DNA, 15 bp, Homo sapiens
gcttccaaattaagg

SEQ ID NO: 236187 - DNA, 15 bp, Homo sapiens
agcttccaaattaag

SEQ ID NO: 236188 - DNA, 15 bp, Homo sapiens
gagcttccaaattaa

SEQ ID NO: 236189 - DNA, 15 bp, Homo sapiens
agagcttccaaatta

SEQ ID NO: 236190 - DNA, 15 bp, Homo sapiens
aagagcttccaaatt

SEQ ID NO: 236191 - DNA, 15 bp, Homo sapiens
gaagagcttccaaat

SEQ ID NO: 236192 - DNA, 15 bp, Homo sapiens
tgaagagcttccaaa

SEQ ID NO: 236193 - DNA, 15 bp, Homo sapiens
ttgaagagcttccaa

SEQ ID NO: 236194 - DNA, 15 bp, Homo sapiens
tttgaagagcttcca

SEQ ID NO: 236195 - DNA, 15 bp, Homo sapiens
ttttgaagagcttcc

SEQ ID NO: 236196 - DNA, 15 bp, Homo sapiens
tttttgaagagcttc

SEQ ID NO: 236197 - DNA, 15 bp, Homo sapiens
gtttttgaagagctt

SEQ ID NO: 236198 - DNA, 15 bp, Homo sapiens
tgtttttgaagagct

SEQ ID NO: 236199 - DNA, 15 bp, Homo sapiens
ttgtttttgaagagc

SEQ ID NO: 236200 - DNA, 15 bp, Homo sapiens
tttgtttttgaagag

SEQ ID NO: 236201 - DNA, 15 bp, Homo sapiens
ttttgtttttgaaga

SEQ ID NO: 236202 - DNA, 15 bp, Homo sapiens
cttttgtttttgaag

SEQ ID NO: 236203 - DNA, 15 bp, Homo sapiens
tcttttgtttttgaa

SEQ ID NO: 236204 - DNA, 15 bp, Homo sapiens
atcttttgtttttga

SEQ ID NO: 236205 - DNA, 15 bp, Homo sapiens
tatcttttgtttttg

SEQ ID NO: 236206 - DNA, 15 bp, Homo sapiens
ttatcttttgttttt

SEQ ID NO: 236207 - DNA, 15 bp, Homo sapiens
tttatcttttgtttt

SEQ ID NO: 236208 - DNA, 15 bp, Homo sapiens
gtttatcttttgttt

SEQ ID NO: 236209 - DNA, 15 bp, Homo sapiens
agtttatcttttgtt

SEQ ID NO: 236210 - DNA, 15 bp, Homo sapiens
aagtttatcttttgt

SEQ ID NO: 236211 - DNA, 15 bp, Homo sapiens
aaagtttatcttttg

SEQ ID NO: 236212 - DNA, 15 bp, Homo sapiens
gaaagtttatctttt

SEQ ID NO: 236213 - DNA, 15 bp, Homo sapiens
agaaagtttatcttt

SEQ ID NO: 236214 - DNA, 15 bp, Homo sapiens
aagaaagtttatctt

SEQ ID NO: 236215 - DNA, 15 bp, Homo sapiens
caagaaagtttatct

SEQ ID NO: 236216 - DNA, 15 bp, Homo sapiens
tcaagaaagtttatc

SEQ ID NO: 236217 - DNA, 15 bp, Homo sapiens
atcaagaaagtttat

SEQ ID NO: 236218 - DNA, 15 bp, Homo sapiens
tatcaagaaagttta

SEQ ID NO: 236219 - DNA, 15 bp, Homo sapiens
ctatcaagaaagttt

SEQ ID NO: 236220 - DNA, 15 bp, Homo sapiens
tctatcaagaaagtt

SEQ ID NO: 236221 - DNA, 15 bp, Homo sapiens
ttctatcaagaaagt

SEQ ID NO: 236222 - DNA, 15 bp, Homo sapiens
tttctatcaagaaag

SEQ ID NO: 236223 - DNA, 15 bp, Homo sapiens
ctttctatcaagaaa

SEQ ID NO: 236224 - DNA, 15 bp, Homo sapiens
tctttctatcaagaa

SEQ ID NO: 236225 - DNA, 15 bp, Homo sapiens
gtctttctatcaaga

SEQ ID NO: 236226 - DNA, 15 bp, Homo sapiens
agtctttctatcaag

SEQ ID NO: 236227 - DNA, 15 bp, Homo sapiens
gagtctttctatcaa

SEQ ID NO: 236228 - DNA, 15 bp, Homo sapiens
ggagtctttctatca

SEQ ID NO: 236229 - DNA, 15 bp, Homo sapiens
aggagtctttctatc

SEQ ID NO: 236230 - DNA, 15 bp, Homo sapiens
gaggagtctttctat

SEQ ID NO: 236231 - DNA, 15 bp, Homo sapiens
tgaggagtctttcta

SEQ ID NO: 236232 - DNA, 15 bp, Homo sapiens
atgaggagtctttct

SEQ ID NO: 236233 - DNA, 15 bp, Homo sapiens
aatgaggagtctttc

SEQ ID NO: 236234 - DNA, 15 bp, Homo sapiens
caatgaggagtcttt

SEQ ID NO: 236235 - DNA, 15 bp, Homo sapiens
gcaatgaggagtctt

SEQ ID NO: 236236 - DNA, 15 bp, Homo sapiens
ggcaatgaggagtct

SEQ ID NO: 236237 - DNA, 15 bp, Homo sapiens
tggcaatgaggagtc

SEQ ID NO: 236238 - DNA, 15 bp, Homo sapiens
atggcaatgaggagt

SEQ ID NO: 236239 - DNA, 15 bp, Homo sapiens
tatggcaatgaggag

SEQ ID NO: 236240 - DNA, 15 bp, Homo sapiens
atatggcaatgagga

SEQ ID NO: 236241 - DNA, 15 bp, Homo sapiens
tatatggcaatgagg

SEQ ID NO: 236242 - DNA, 15 bp, Homo sapiens
ttatatggcaatgag

SEQ ID NO: 236243 - DNA, 15 bp, Homo sapiens
gttatatggcaatga

SEQ ID NO: 236244 - DNA, 15 bp, Homo sapiens
tgttatatggcaatg

SEQ ID NO: 236245 - DNA, 15 bp, Homo sapiens
gtgttatatggcaat

SEQ ID NO: 236246 - DNA, 15 bp, Homo sapiens
ggtgttatatggcaa

SEQ ID NO: 236247 - DNA, 15 bp, Homo sapiens
aggtgttatatggca

SEQ ID NO: 236248 - DNA, 15 bp, Homo sapiens
caggtgttatatggc

SEQ ID NO: 236249 - DNA, 15 bp, Homo sapiens
tcaggtgttatatgg

SEQ ID NO: 236250 - DNA, 15 bp, Homo sapiens
gtcaggtgttatatg

SEQ ID NO: 236251 - DNA, 15 bp, Homo sapiens
ggtcaggtgttatat

SEQ ID NO: 236252 - DNA, 15 bp, Homo sapiens
tggtcaggtgttata

SEQ ID NO: 236253 - DNA, 15 bp, Homo sapiens
atggtcaggtgttat

SEQ ID NO: 236254 - DNA, 15 bp, Homo sapiens
tatggtcaggtgtta

SEQ ID NO: 236255 - DNA, 15 bp, Homo sapiens
ttatggtcaggtgtt

SEQ ID NO: 236256 - DNA, 15 bp, Homo sapiens
tttatggtcaggtgt

SEQ ID NO: 236257 - DNA, 15 bp, Homo sapiens
ttttatggtcaggtg

SEQ ID NO: 236258 - DNA, 15 bp, Homo sapiens
tttttatggtcaggt

SEQ ID NO: 236259 - DNA, 15 bp, Homo sapiens
ctttttatggtcagg

SEQ ID NO: 236260 - DNA, 15 bp, Homo sapiens
tctttttatggtcag

SEQ ID NO: 236261 - DNA, 15 bp, Homo sapiens
ttctttttatggtca

SEQ ID NO: 236262 - DNA, 15 bp, Homo sapiens
tttctttttatggtc

SEQ ID NO: 236263 - DNA, 15 bp, Homo sapiens
ttttctttttatggt

SEQ ID NO: 236264 - DNA, 15 bp, Homo sapiens
tttttctttttatgg

SEQ ID NO: 236265 - DNA, 15 bp, Homo sapiens
gtttttctttttatg

SEQ ID NO: 236266 - DNA, 15 bp, Homo sapiens
tgtttttctttttat

SEQ ID NO: 236267 - DNA, 15 bp, Homo sapiens
ttgtttttcttttta

SEQ ID NO: 236268 - DNA, 15 bp, Homo sapiens
tttgtttttcttttt

SEQ ID NO: 236269 - DNA, 15 bp, Homo sapiens
ttttgtttttctttt

SEQ ID NO: 236270 - DNA, 15 bp, Homo sapiens
tttttgtttttcttt

SEQ ID NO: 236271 - DNA, 15 bp, Homo sapiens
gtttttgtttttctt

SEQ ID NO: 236272 - DNA, 15 bp, Homo sapiens
ggtttttgtttttct

SEQ ID NO: 236273 - DNA, 15 bp, Homo sapiens
tggtttttgtttttc

SEQ ID NO: 236274 - DNA, 15 bp, Homo sapiens
ctttggtttttgttt

SEQ ID NO: 236275 - DNA, 15 bp, Homo sapiens
tctttggtttttgtt

SEQ ID NO: 236276 - DNA, 15 bp, Homo sapiens
gtctttggtttttgt

SEQ ID NO: 236277 - DNA, 15 bp, Homo sapiens
ggtctttggtttttg

SEQ ID NO: 236278 - DNA, 15 bp, Homo sapiens
aggtctttggttttt

SEQ ID NO: 236279 - DNA, 15 bp, Homo sapiens
aaggtctttggtttt

SEQ ID NO: 236280 - DNA, 15 bp, Homo sapiens
caaggtctttggttt

SEQ ID NO: 236281 - DNA, 15 bp, Homo sapiens
acaaggtctttggtt

SEQ ID NO: 236282 - DNA, 15 bp, Homo sapiens
aacaaggtctttggt

SEQ ID NO: 236283 - DNA, 15 bp, Homo sapiens
aaacaaggtctttgg

SEQ ID NO: 236284 - DNA, 15 bp, Homo sapiens
caaacaaggtctttg

SEQ ID NO: 236285 - DNA, 15 bp, Homo sapiens
acaaacaaggtcttt

SEQ ID NO: 236286 - DNA, 15 bp, Homo sapiens
gacaaacaaggtctt

SEQ ID NO: 236287 - DNA, 15 bp, Homo sapiens
tgacaaacaaggtct

SEQ ID NO: 236288 - DNA, 15 bp, Homo sapiens
ttgacaaacaaggtc

SEQ ID NO: 236289 - DNA, 15 bp, Homo sapiens
tttgacaaacaaggt

SEQ ID NO: 236290 - DNA, 15 bp, Homo sapiens
ctttgacaaacaagg

SEQ ID NO: 236291 - DNA, 15 bp, Homo sapiens
gctttgacaaacaag

SEQ ID NO: 236292 - DNA, 15 bp, Homo sapiens
agctttgacaaacaa

SEQ ID NO: 236293 - DNA, 15 bp, Homo sapiens
aagctttgacaaaca

SEQ ID NO: 236294 - DNA, 15 bp, Homo sapiens
aaagctttgacaaac

SEQ ID NO: 236295 - DNA, 15 bp, Homo sapiens
aaaagctttgacaaa

SEQ ID NO: 236296 - DNA, 15 bp, Homo sapiens
aaaaagctttgacaa

SEQ ID NO: 236297 - DNA, 15 bp, Homo sapiens
taaaaagctttgaca

SEQ ID NO: 236298 - DNA, 15 bp, Homo sapiens
ttaaaaagctttgac

SEQ ID NO: 236299 - DNA, 15 bp, Homo sapiens
tttaaaaagctttga

SEQ ID NO: 236300 - DNA, 15 bp, Homo sapiens
atttaaaaagctttg

SEQ ID NO: 236301 - DNA, 15 bp, Homo sapiens
catttaaaaagcttt

SEQ ID NO: 236302 - DNA, 15 bp, Homo sapiens
acatttaaaaagctt

SEQ ID NO: 236303 - DNA, 15 bp, Homo sapiens
aacatttaaaaagct

SEQ ID NO: 236304 - DNA, 15 bp, Homo sapiens
aaacatttaaaaagc

SEQ ID NO: 236305 - DNA, 15 bp, Homo sapiens
aaaacatttaaaaag

SEQ ID NO: 236306 - DNA, 15 bp, Homo sapiens
taaaacatttaaaaa

SEQ ID NO: 236307 - DNA, 15 bp, Homo sapiens
ttaaaacatttaaaa

SEQ ID NO: 236308 - DNA, 15 bp, Homo sapiens
gttaaaacatttaaa

SEQ ID NO: 236309 - DNA, 15 bp, Homo sapiens
ggttaaaacatttaa

SEQ ID NO: 236310 - DNA, 15 bp, Homo sapiens
aggttaaaacattta

SEQ ID NO: 236311 - DNA, 15 bp, Homo sapiens
caggttaaaacattt

SEQ ID NO: 236312 - DNA, 15 bp, Homo sapiens
acaggttaaaacatt

SEQ ID NO: 236313 - DNA, 15 bp, Homo sapiens
cacaggttaaaacat

SEQ ID NO: 236314 - DNA, 15 bp, Homo sapiens
ccacaggttaaaaca

SEQ ID NO: 236315 - DNA, 15 bp, Homo sapiens
gccacaggttaaaac

SEQ ID NO: 236316 - DNA, 15 bp, Homo sapiens
agccacaggttaaaa

SEQ ID NO: 236317 - DNA, 15 bp, Homo sapiens
aagccacaggttaaa

SEQ ID NO: 236318 - DNA, 15 bp, Homo sapiens
taagccacaggttaa

SEQ ID NO: 236319 - DNA, 15 bp, Homo sapiens
ataagccacaggtta

SEQ ID NO: 236320 - DNA, 15 bp, Homo sapiens
tataagccacaggtt

SEQ ID NO: 236321 - DNA, 15 bp, Homo sapiens
atataagccacaggt

SEQ ID NO: 236322 - DNA, 15 bp, Homo sapiens
tatataagccacagg

SEQ ID NO: 236323 - DNA, 15 bp, Homo sapiens
ctatataagccacag

SEQ ID NO: 236324 - DNA, 15 bp, Homo sapiens
cctatataagccaca

SEQ ID NO: 236325 - DNA, 15 bp, Homo sapiens
ccctatataagccac

SEQ ID NO: 236326 - DNA, 15 bp, Homo sapiens
tccctatataagcca

SEQ ID NO: 236327 - DNA, 15 bp, Homo sapiens
ttccctatataagcc

SEQ ID NO: 236328 - DNA, 15 bp, Homo sapiens
tttccctatataagc

SEQ ID NO: 236329 - DNA, 15 bp, Homo sapiens
gtttccctatataag

SEQ ID NO: 236330 - DNA, 15 bp, Homo sapiens
tgtttccctatataa

SEQ ID NO: 236331 - DNA, 15 bp, Homo sapiens
atgtttccctatata

SEQ ID NO: 236332 - DNA, 15 bp, Homo sapiens
aatgtttccctatat

SEQ ID NO: 236333 - DNA, 15 bp, Homo sapiens
taatgtttccctata

SEQ ID NO: 236334 - DNA, 15 bp, Homo sapiens
ataatgtttccctat

SEQ ID NO: 236335 - DNA, 15 bp, Homo sapiens
aataatgtttcccta

SEQ ID NO: 236336 - DNA, 15 bp, Homo sapiens
aaataatgtttccct

SEQ ID NO: 236337 - DNA, 15 bp, Homo sapiens
aaaataatgtttccc

SEQ ID NO: 236338 - DNA, 15 bp, Homo sapiens
aaaaataatgtttcc

SEQ ID NO: 236339 - DNA, 15 bp, Homo sapiens
caaaaataatgtttc

SEQ ID NO: 236340 - DNA, 15 bp, Homo sapiens
ccaaaaataatgttt

SEQ ID NO: 236341 - DNA, 15 bp, Homo sapiens
tccaaaaataatgtt

SEQ ID NO: 236342 - DNA, 15 bp, Homo sapiens
ctccaaaaataatgt

SEQ ID NO: 236343 - DNA, 15 bp, Homo sapiens
tctccaaaaataatg

SEQ ID NO: 236344 - DNA, 15 bp, Homo sapiens
ctctccaaaaataat

SEQ ID NO: 236345 - DNA, 15 bp, Homo sapiens
cctctccaaaaataa

SEQ ID NO: 236346 - DNA, 15 bp, Homo sapiens
tcctctccaaaaata

SEQ ID NO: 236347 - DNA, 15 bp, Homo sapiens
ttcctctccaaaaat

SEQ ID NO: 236348 - DNA, 15 bp, Homo sapiens
tttcctctccaaaaa

SEQ ID NO: 236349 - DNA, 15 bp, Homo sapiens
ttttcctctccaaaa

SEQ ID NO: 236350 - DNA, 15 bp, Homo sapiens
tttttcctctccaaa

SEQ ID NO: 236351 - DNA, 15 bp, Homo sapiens
atttttcctctccaa

SEQ ID NO: 236352 - DNA, 15 bp, Homo sapiens
aatttttcctctcca

SEQ ID NO: 236353 - DNA, 15 bp, Homo sapiens
aaatttttcctctcc

SEQ ID NO: 236354 - DNA, 15 bp, Homo sapiens
caaatttttcctctc

SEQ ID NO: 236355 - DNA, 15 bp, Homo sapiens
tcaaatttttcctct

SEQ ID NO: 236356 - DNA, 15 bp, Homo sapiens
ttcaaatttttcctc

SEQ ID NO: 236357 - DNA, 15 bp, Homo sapiens
attcaaatttttcct

SEQ ID NO: 236358 - DNA, 15 bp, Homo sapiens
aattcaaatttttcc

SEQ ID NO: 236359 - DNA, 15 bp, Homo sapiens
aaattcaaatttttc

SEQ ID NO: 236360 - DNA, 15 bp, Homo sapiens
gaaattcaaattttt

SEQ ID NO: 236361 - DNA, 15 bp, Homo sapiens
agaaattcaaatttt

SEQ ID NO: 236362 - DNA, 15 bp, Homo sapiens
aagaaattcaaattt

SEQ ID NO: 236363 - DNA, 15 bp, Homo sapiens
aaagaaattcaaatt

SEQ ID NO: 236364 - DNA, 15 bp, Homo sapiens
aaaaagaaattcaaa

SEQ ID NO: 236365 - DNA, 15 bp, Homo sapiens
aaaaaagaaattcaa

SEQ ID NO: 236366 - DNA, 15 bp, Homo sapiens
caaaaaagaaattca

SEQ ID NO: 236367 - DNA, 15 bp, Homo sapiens
acaaaaaagaaattc

SEQ ID NO: 236368 - DNA, 15 bp, Homo sapiens
aacaaaaaagaaatt

SEQ ID NO: 236369 - DNA, 15 bp, Homo sapiens
gaacaaaaaagaaat

SEQ ID NO: 236370 - DNA, 15 bp, Homo sapiens
ggaacaaaaaagaaa

SEQ ID NO: 236371 - DNA, 15 bp, Homo sapiens
tggaacaaaaaagaa

SEQ ID NO: 236372 - DNA, 15 bp, Homo sapiens
ttggaacaaaaaaga

SEQ ID NO: 236373 - DNA, 15 bp, Homo sapiens
tttggaacaaaaaag

SEQ ID NO: 236374 - DNA, 15 bp, Homo sapiens
ttttggaacaaaaaa

SEQ ID NO: 236375 - DNA, 15 bp, Homo sapiens
cttttggaacaaaaa

SEQ ID NO: 236376 - DNA, 15 bp, Homo sapiens
tcttttggaacaaaa

SEQ ID NO: 236377 - DNA, 15 bp, Homo sapiens
atcttttggaacaaa

SEQ ID NO: 236378 - DNA, 15 bp, Homo sapiens
aatcttttggaacaa

SEQ ID NO: 236379 - DNA, 15 bp, Homo sapiens
aaatcttttggaaca

SEQ ID NO: 236380 - DNA, 15 bp, Homo sapiens
aaaatcttttggaac

SEQ ID NO: 236381 - DNA, 15 bp, Homo sapiens
aaaaatcttttggaa

SEQ ID NO: 236382 - DNA, 15 bp, Homo sapiens
taaaaatcttttgga

SEQ ID NO: 236383 - DNA, 15 bp, Homo sapiens
ttaaaaatcttttgg

SEQ ID NO: 236384 - DNA, 15 bp, Homo sapiens
tttaaaaatcttttg

SEQ ID NO: 236385 - DNA, 15 bp, Homo sapiens
ctttaaaaatctttt

SEQ ID NO: 236386 - DNA, 15 bp, Homo sapiens
gctttaaaaatcttt

SEQ ID NO: 236387 - DNA, 15 bp, Homo sapiens
ggctttaaaaatctt

SEQ ID NO: 236388 - DNA, 15 bp, Homo sapiens
aggctttaaaaatct

SEQ ID NO: 236389 - DNA, 15 bp, Homo sapiens
caggctttaaaaatc

SEQ ID NO: 236390 - DNA, 15 bp, Homo sapiens
acaggctttaaaaat

SEQ ID NO: 236391 - DNA, 15 bp, Homo sapiens
gacaggctttaaaaa

SEQ ID NO: 236392 - DNA, 15 bp, Homo sapiens
agacaggctttaaaa

SEQ ID NO: 236393 - DNA, 15 bp, Homo sapiens
aagacaggctttaaa

SEQ ID NO: 236394 - DNA, 15 bp, Homo sapiens
caagacaggctttaa

SEQ ID NO: 236395 - DNA, 15 bp, Homo sapiens
tcaagacaggcttta

SEQ ID NO: 236396 - DNA, 15 bp, Homo sapiens
ttcaagacaggcttt

SEQ ID NO: 236397 - DNA, 15 bp, Homo sapiens
cttcaagacaggctt

SEQ ID NO: 236398 - DNA, 15 bp, Homo sapiens
acttcaagacaggct

SEQ ID NO: 236399 - DNA, 15 bp, Homo sapiens
aacttcaagacaggc

SEQ ID NO: 236400 - DNA, 15 bp, Homo sapiens
taacttcaagacagg

SEQ ID NO: 236401 - DNA, 15 bp, Homo sapiens
ataacttcaagacag

SEQ ID NO: 236402 - DNA, 15 bp, Homo sapiens
tataacttcaagaca

SEQ ID NO: 236403 - DNA, 15 bp, Homo sapiens
atataacttcaagac

SEQ ID NO: 236404 - DNA, 15 bp, Homo sapiens
aatataacttcaaga

SEQ ID NO: 236405 - DNA, 15 bp, Homo sapiens
gaatataacttcaag

SEQ ID NO: 236406 - DNA, 15 bp, Homo sapiens
agaatataacttcaa

SEQ ID NO: 236407 - DNA, 15 bp, Homo sapiens
tagaatataacttca

SEQ ID NO: 236408 - DNA, 15 bp, Homo sapiens
atagaatataacttc

SEQ ID NO: 236409 - DNA, 15 bp, Homo sapiens
aatagaatataactt

SEQ ID NO: 236410 - DNA, 15 bp, Homo sapiens
aaatagaatataact

SEQ ID NO: 236411 - DNA, 15 bp, Homo sapiens
caaatagaatataac

SEQ ID NO: 236412 - DNA, 15 bp, Homo sapiens
acaaatagaatataa

SEQ ID NO: 236413 - DNA, 15 bp, Homo sapiens
aacaaatagaatata

SEQ ID NO: 236414 - DNA, 15 bp, Homo sapiens
aaacaaatagaatat

SEQ ID NO: 236415 - DNA, 15 bp, Homo sapiens
taaacaaatagaata

SEQ ID NO: 236416 - DNA, 15 bp, Homo sapiens
ttaaacaaatagaat

SEQ ID NO: 236417 - DNA, 15 bp, Homo sapiens
tttaaacaaatagaa

SEQ ID NO: 236418 - DNA, 15 bp, Homo sapiens
ctttaaacaaataga

SEQ ID NO: 236419 - DNA, 15 bp, Homo sapiens
actttaaacaaatag

SEQ ID NO: 236420 - DNA, 15 bp, Homo sapiens
aactttaaacaaata

SEQ ID NO: 236421 - DNA, 15 bp, Homo sapiens
aaactttaaacaaat

SEQ ID NO: 236422 - DNA, 15 bp, Homo sapiens
taaactttaaacaaa

SEQ ID NO: 236423 - DNA, 15 bp, Homo sapiens
gtaaactttaaacaa

SEQ ID NO: 236424 - DNA, 15 bp, Homo sapiens
agtaaactttaaaca

SEQ ID NO: 236425 - DNA, 15 bp, Homo sapiens
tagtaaactttaaac

SEQ ID NO: 236426 - DNA, 15 bp, Homo sapiens
atagtaaactttaaa

SEQ ID NO: 236427 - DNA, 15 bp, Homo sapiens
gatagtaaactttaa

SEQ ID NO: 236428 - DNA, 15 bp, Homo sapiens
agatagtaaacttta

SEQ ID NO: 236429 - DNA, 15 bp, Homo sapiens
aagatagtaaacttt

SEQ ID NO: 236430 - DNA, 15 bp, Homo sapiens
aaagatagtaaactt

SEQ ID NO: 236431 - DNA, 15 bp, Homo sapiens
aaaagatagtaaact

SEQ ID NO: 236432 - DNA, 15 bp, Homo sapiens
caaaagatagtaaac

SEQ ID NO: 236433 - DNA, 15 bp, Homo sapiens
tcaaaagatagtaaa

SEQ ID NO: 236434 - DNA, 15 bp, Homo sapiens
ttcaaaagatagtaa

SEQ ID NO: 236435 - DNA, 15 bp, Homo sapiens
tttcaaaagatagta

SEQ ID NO: 236436 - DNA, 15 bp, Homo sapiens
atttcaaaagatagt

SEQ ID NO: 236437 - DNA, 15 bp, Homo sapiens
tatttcaaaagatag

SEQ ID NO: 236438 - DNA, 15 bp, Homo sapiens
ttatttcaaaagata

SEQ ID NO: 236439 - DNA, 15 bp, Homo sapiens
tttatttcaaaagat

SEQ ID NO: 236440 - DNA, 15 bp, Homo sapiens
ttttatttcaaaaga

SEQ ID NO: 236441 - DNA, 15 bp, Homo sapiens
attttatttcaaaag

SEQ ID NO: 236442 - DNA, 15 bp, Homo sapiens
tattttatttcaaaa

SEQ ID NO: 236443 - DNA, 15 bp, Homo sapiens
ctattttatttcaaa

SEQ ID NO: 236444 - DNA, 15 bp, Homo sapiens
cctattttatttcaa

SEQ ID NO: 236445 - DNA, 15 bp, Homo sapiens
gcctattttatttca

SEQ ID NO: 236446 - DNA, 15 bp, Homo sapiens
agcctattttatttc

SEQ ID NO: 236447 - DNA, 15 bp, Homo sapiens
tagcctattttattt

SEQ ID NO: 236448 - DNA, 15 bp, Homo sapiens
atagcctattttatt

SEQ ID NO: 236449 - DNA, 15 bp, Homo sapiens
aatagcctattttat

SEQ ID NO: 236450 - DNA, 15 bp, Homo sapiens
taatagcctatttta

SEQ ID NO: 236451 - DNA, 15 bp, Homo sapiens
ataatagcctatttt

SEQ ID NO: 236452 - DNA, 15 bp, Homo sapiens
aataatagcctattt

SEQ ID NO: 236453 - DNA, 15 bp, Homo sapiens
aaataatagcctatt

SEQ ID NO: 236454 - DNA, 15 bp, Homo sapiens
caaataatagcctat

SEQ ID NO: 236455 - DNA, 15 bp, Homo sapiens
tcaaataatagccta

SEQ ID NO: 236456 - DNA, 15 bp, Homo sapiens
ttcaaataatagcct

SEQ ID NO: 236457 - DNA, 15 bp, Homo sapiens
tttcaaataatagcc

SEQ ID NO: 236458 - DNA, 15 bp, Homo sapiens
atttcaaataatagc

SEQ ID NO: 236459 - DNA, 15 bp, Homo sapiens
aatttcaaataatag

SEQ ID NO: 236460 - DNA, 15 bp, Homo sapiens
taatttcaaataata

SEQ ID NO: 236461 - DNA, 15 bp, Homo sapiens
ataatttcaaataat

SEQ ID NO: 236462 - DNA, 15 bp, Homo sapiens
tataatttcaaataa

SEQ ID NO: 236463 - DNA, 15 bp, Homo sapiens
atataatttcaaata

SEQ ID NO: 236464 - DNA, 15 bp, Homo sapiens
catataatttcaaat

SEQ ID NO: 236465 - DNA, 15 bp, Homo sapiens
gcatataatttcaaa

SEQ ID NO: 236466 - DNA, 15 bp, Homo sapiens
tgcatataatttcaa

SEQ ID NO: 236467 - DNA, 15 bp, Homo sapiens
atgcatataatttca

SEQ ID NO: 236468 - DNA, 15 bp, Homo sapiens
gatgcatataatttc

SEQ ID NO: 236469 - DNA, 15 bp, Homo sapiens
agatgcatataattt

SEQ ID NO: 236470 - DNA, 15 bp, Homo sapiens
gagatgcatataatt

SEQ ID NO: 236471 - DNA, 15 bp, Homo sapiens
tgagatgcatataat

SEQ ID NO: 236472 - DNA, 15 bp, Homo sapiens
ttgagatgcatataa

SEQ ID NO: 236473 - DNA, 15 bp, Homo sapiens
tttgagatgcatata

SEQ ID NO: 236474 - DNA, 15 bp, Homo sapiens
ttttgagatgcatat

SEQ ID NO: 236475 - DNA, 15 bp, Homo sapiens
gttttgagatgcata

SEQ ID NO: 236476 - DNA, 15 bp, Homo sapiens
tgttttgagatgcat

SEQ ID NO: 236477 - DNA, 15 bp, Homo sapiens
atgttttgagatgca

SEQ ID NO: 236478 - DNA, 15 bp, Homo sapiens
aatgttttgagatgc

SEQ ID NO: 236479 - DNA, 15 bp, Homo sapiens
aaatgttttgagatg

SEQ ID NO: 236480 - DNA, 15 bp, Homo sapiens
aaaatgttttgagat

SEQ ID NO: 236481 - DNA, 15 bp, Homo sapiens
gaaaatgttttgaga

SEQ ID NO: 236482 - DNA, 15 bp, Homo sapiens
agaaaatgttttgag

SEQ ID NO: 236483 - DNA, 15 bp, Homo sapiens
cagaaaatgttttga

SEQ ID NO: 236484 - DNA, 15 bp, Homo sapiens
ccagaaaatgttttg

SEQ ID NO: 236485 - DNA, 15 bp, Homo sapiens
gccagaaaatgtttt

SEQ ID NO: 236486 - DNA, 15 bp, Homo sapiens
tgccagaaaatgttt

SEQ ID NO: 236487 - DNA, 15 bp, Homo sapiens
atgccagaaaatgtt

SEQ ID NO: 236488 - DNA, 15 bp, Homo sapiens
aatgccagaaaatgt

SEQ ID NO: 236489 - DNA, 15 bp, Homo sapiens
aaatgccagaaaatg

SEQ ID NO: 236490 - DNA, 15 bp, Homo sapiens
gaaatgccagaaaat

SEQ ID NO: 236491 - DNA, 15 bp, Homo sapiens
tgaaatgccagaaaa

SEQ ID NO: 236492 - DNA, 15 bp, Homo sapiens
atgaaatgccagaaa

SEQ ID NO: 236493 - DNA, 15 bp, Homo sapiens
aatgaaatgccagaa

SEQ ID NO: 236494 - DNA, 15 bp, Homo sapiens
aaatgaaatgccaga

SEQ ID NO: 236495 - DNA, 15 bp, Homo sapiens
aaaatgaaatgccag

SEQ ID NO: 236496 - DNA, 15 bp, Homo sapiens
aaaaatgaaatgcca

SEQ ID NO: 236497 - DNA, 15 bp, Homo sapiens
taaaaatgaaatgcc

SEQ ID NO: 236498 - DNA, 15 bp, Homo sapiens
ttaaaaatgaaatgc

SEQ ID NO: 236499 - DNA, 15 bp, Homo sapiens
attaaaaatgaaatg

SEQ ID NO: 236500 - DNA, 15 bp, Homo sapiens
gattaaaaatgaaat

SEQ ID NO: 236501 - DNA, 15 bp, Homo sapiens
agattaaaaatgaaa

SEQ ID NO: 236502 - DNA, 15 bp, Homo sapiens
aagattaaaaatgaa

SEQ ID NO: 236503 - DNA, 15 bp, Homo sapiens
aaagattaaaaatga

SEQ ID NO: 236504 - DNA, 15 bp, Homo sapiens
taaagattaaaaatg

SEQ ID NO: 236505 - DNA, 15 bp, Homo sapiens
ttaaagattaaaaat

SEQ ID NO: 236506 - DNA, 15 bp, Homo sapiens
attaaagattaaaaa

SEQ ID NO: 236507 - DNA, 15 bp, Homo sapiens
tattaaagattaaaa

SEQ ID NO: 236508 - DNA, 15 bp, Homo sapiens
ctattaaagattaaa

SEQ ID NO: 236509 - DNA, 15 bp, Homo sapiens
tctattaaagattaa

SEQ ID NO: 236510 - DNA, 15 bp, Homo sapiens
atctattaaagatta

SEQ ID NO: 236511 - DNA, 15 bp, Homo sapiens
tatctattaaagatt

SEQ ID NO: 236512 - DNA, 15 bp, Homo sapiens
ttatctattaaagat

SEQ ID NO: 236513 - DNA, 15 bp, Homo sapiens
tttatctattaaaga

SEQ ID NO: 236514 - DNA, 15 bp, Homo sapiens
ttttatctattaaag

SEQ ID NO: 236515 - DNA, 15 bp, Homo sapiens
tttttatctattaaa

SEQ ID NO: 236516 - DNA, 15 bp, Homo sapiens
atttttatctattaa

SEQ ID NO: 236517 - DNA, 15 bp, Homo sapiens
tatttttatctatta

SEQ ID NO: 236518 - DNA, 15 bp, Homo sapiens
ttatttttatctatt

SEQ ID NO: 236519 - DNA, 15 bp, Homo sapiens
tttatttttatctat

SEQ ID NO: 236520 - DNA, 15 bp, Homo sapiens
ttttatttttatcta

SEQ ID NO: 236521 - DNA, 15 bp, Homo sapiens
tttttatttttatct

SEQ ID NO: 236522 - DNA, 15 bp, Homo sapiens
ctttttatttttatc

SEQ ID NO: 236523 - DNA, 15 bp, Homo sapiens
tctttttatttttat

SEQ ID NO: 236524 - DNA, 15 bp, Homo sapiens
atctttttattttta

SEQ ID NO: 236525 - DNA, 15 bp, Homo sapiens
catctttttattttt

SEQ ID NO: 236526 - DNA, 15 bp, Homo sapiens
acatctttttatttt

SEQ ID NO: 236527 - DNA, 15 bp, Homo sapiens
aacatctttttattt

SEQ ID NO: 236528 - DNA, 15 bp, Homo sapiens
caacatctttttatt

SEQ ID NO: 236529 - DNA, 15 bp, Homo sapiens
tcaacatctttttat

SEQ ID NO: 236530 - DNA, 15 bp, Homo sapiens
atcaacatcttttta

SEQ ID NO: 236531 - DNA, 15 bp, Homo sapiens
aatcaacatcttttt

SEQ ID NO: 236532 - DNA, 15 bp, Homo sapiens
aaatcaacatctttt

SEQ ID NO: 236533 - DNA, 15 bp, Homo sapiens
aaaatcaacatcttt

SEQ ID NO: 236534 - DNA, 15 bp, Homo sapiens
taaaatcaacatctt

SEQ ID NO: 236535 - DNA, 15 bp, Homo sapiens
ttaaaatcaacatct

SEQ ID NO: 236536 - DNA, 15 bp, Homo sapiens
tttaaaatcaacatc

SEQ ID NO: 236537 - DNA, 15 bp, Homo sapiens
ttttaaaatcaacat

SEQ ID NO: 236538 - DNA, 15 bp, Homo sapiens
cttttaaaatcaaca

SEQ ID NO: 236539 - DNA, 15 bp, Homo sapiens
gcttttaaaatcaac

SEQ ID NO: 236540 - DNA, 15 bp, Homo sapiens
agcttttaaaatcaa

SEQ ID NO: 236541 - DNA, 15 bp, Homo sapiens
tagcttttaaaatca

SEQ ID NO: 236542 - DNA, 15 bp, Homo sapiens
ttagcttttaaaatc

SEQ ID NO: 236543 - DNA, 15 bp, Homo sapiens
attagcttttaaaat

SEQ ID NO: 236544 - DNA, 15 bp, Homo sapiens
aattagcttttaaaa

SEQ ID NO: 236545 - DNA, 15 bp, Homo sapiens
taattagcttttaaa

SEQ ID NO: 236546 - DNA, 15 bp, Homo sapiens
gtaattagcttttaa

SEQ ID NO: 236547 - DNA, 15 bp, Homo sapiens
tgtaattagctttta

SEQ ID NO: 236548 - DNA, 15 bp, Homo sapiens
ctgtaattagctttt

SEQ ID NO: 236549 - DNA, 15 bp, Homo sapiens
actgtaattagcttt

SEQ ID NO: 236550 - DNA, 15 bp, Homo sapiens
aactgtaattagctt

SEQ ID NO: 236551 - DNA, 15 bp, Homo sapiens
gaactgtaattagct

SEQ ID NO: 236552 - DNA, 15 bp, Homo sapiens
agaactgtaattagc

SEQ ID NO: 236553 - DNA, 15 bp, Homo sapiens
aagaactgtaattag

SEQ ID NO: 236554 - DNA, 15 bp, Homo sapiens
caagaactgtaatta

SEQ ID NO: 236555 - DNA, 15 bp, Homo sapiens
tcaagaactgtaatt

SEQ ID NO: 236556 - DNA, 15 bp, Homo sapiens
ctcaagaactgtaat

SEQ ID NO: 236557 - DNA, 15 bp, Homo sapiens
actcaagaactgtaa

SEQ ID NO: 236558 - DNA, 15 bp, Homo sapiens
gactcaagaactgta

SEQ ID NO: 236559 - DNA, 15 bp, Homo sapiens
ggactcaagaactgt

SEQ ID NO: 236560 - DNA, 15 bp, Homo sapiens
aggactcaagaactg

SEQ ID NO: 236561 - DNA, 15 bp, Homo sapiens
gaggactcaagaact

SEQ ID NO: 236562 - DNA, 15 bp, Homo sapiens
ggaggactcaagaac

SEQ ID NO: 236563 - DNA, 15 bp, Homo sapiens
tggaggactcaagaa

SEQ ID NO: 236564 - DNA, 15 bp, Homo sapiens
ttggaggactcaaga

SEQ ID NO: 236565 - DNA, 15 bp, Homo sapiens
cttggaggactcaag

SEQ ID NO: 236566 - DNA, 15 bp, Homo sapiens
ccttggaggactcaa

SEQ ID NO: 236567 - DNA, 15 bp, Homo sapiens
accttggaggactca

SEQ ID NO: 236568 - DNA, 15 bp, Homo sapiens
taccttggaggactc

SEQ ID NO: 236569 - DNA, 15 bp, Homo sapiens
gtaccttggaggact

SEQ ID NO: 236570 - DNA, 15 bp, Homo sapiens
ggtaccttggaggac

SEQ ID NO: 236571 - DNA, 15 bp, Homo sapiens
aggtaccttggagga

SEQ ID NO: 236572 - DNA, 15 bp, Homo sapiens
taggtaccttggagg

SEQ ID NO: 236573 - DNA, 15 bp, Homo sapiens
gtaggtaccttggag

SEQ ID NO: 236574 - DNA, 15 bp, Homo sapiens
ggtaggtaccttgga

SEQ ID NO: 236575 - DNA, 15 bp, Homo sapiens
gggtaggtaccttgg

SEQ ID NO: 236576 - DNA, 15 bp, Homo sapiens
tgggtaggtaccttg

SEQ ID NO: 236577 - DNA, 15 bp, Homo sapiens
atgggtaggtacctt

SEQ ID NO: 236578 - DNA, 15 bp, Homo sapiens
catgggtaggtacct

SEQ ID NO: 236579 - DNA, 15 bp, Homo sapiens
ccatgggtaggtacc

SEQ ID NO: 236580 - DNA, 15 bp, Homo sapiens
tccatgggtaggtac

SEQ ID NO: 236581 - DNA, 15 bp, Homo sapiens
ctccatgggtaggta

SEQ ID NO: 236582 - DNA, 15 bp, Homo sapiens
tctccatgggtaggt

SEQ ID NO: 236583 - DNA, 15 bp, Homo sapiens
ctctccatgggtagg

SEQ ID NO: 236584 - DNA, 15 bp, Homo sapiens
tctctccatgggtag

SEQ ID NO: 236585 - DNA, 15 bp, Homo sapiens
ttctctccatgggta

SEQ ID NO: 236586 - DNA, 15 bp, Homo sapiens
attctctccatgggt

SEQ ID NO: 236587 - DNA, 15 bp, Homo sapiens
tattctctccatggg

SEQ ID NO: 236588 - DNA, 15 bp, Homo sapiens
atattctctccatgg

SEQ ID NO: 236589 - DNA, 15 bp, Homo sapiens
aatattctctccatg

SEQ ID NO: 236590 - DNA, 15 bp, Homo sapiens
taatattctctccat

SEQ ID NO: 236591 - DNA, 15 bp, Homo sapiens
ttaatattctctcca

SEQ ID NO: 236592 - DNA, 15 bp, Homo sapiens
attaatattctctcc

SEQ ID NO: 236593 - DNA, 15 bp, Homo sapiens
cattaatattctctc

SEQ ID NO: 236594 - DNA, 15 bp, Homo sapiens
gcattaatattctct

SEQ ID NO: 236595 - DNA, 15 bp, Homo sapiens
tgcattaatattctc

SEQ ID NO: 236596 - DNA, 15 bp, Homo sapiens
atgcattaatattct

SEQ ID NO: 236597 - DNA, 15 bp, Homo sapiens
tatgcattaatattc

SEQ ID NO: 236598 - DNA, 15 bp, Homo sapiens
atatgcattaatatt

SEQ ID NO: 236599 - DNA, 15 bp, Homo sapiens
tatatgcattaatat

SEQ ID NO: 236600 - DNA, 15 bp, Homo sapiens
ctatatgcattaata

SEQ ID NO: 236601 - DNA, 15 bp, Homo sapiens
gctatatgcattaat

SEQ ID NO: 236602 - DNA, 15 bp, Homo sapiens
agctatatgcattaa

SEQ ID NO: 236603 - DNA, 15 bp, Homo sapiens
tagctatatgcatta

SEQ ID NO: 236604 - DNA, 15 bp, Homo sapiens
ttagctatatgcatt

SEQ ID NO: 236605 - DNA, 15 bp, Homo sapiens
tttagctatatgcat

SEQ ID NO: 236606 - DNA, 15 bp, Homo sapiens
ttttagctatatgca

SEQ ID NO: 236607 - DNA, 15 bp, Homo sapiens
attttagctatatgc

SEQ ID NO: 236608 - DNA, 15 bp, Homo sapiens
gattttagctatatg

SEQ ID NO: 236609 - DNA, 15 bp, Homo sapiens
ggattttagctatat

SEQ ID NO: 236610 - DNA, 15 bp, Homo sapiens
aggattttagctata

SEQ ID NO: 236611 - DNA, 15 bp, Homo sapiens
caggattttagctat

SEQ ID NO: 236612 - DNA, 15 bp, Homo sapiens
tcaggattttagcta

SEQ ID NO: 236613 - DNA, 15 bp, Homo sapiens
gtcaggattttagct

SEQ ID NO: 236614 - DNA, 15 bp, Homo sapiens
agtcaggattttagc

SEQ ID NO: 236615 - DNA, 15 bp, Homo sapiens
tagtcaggattttag

SEQ ID NO: 236616 - DNA, 15 bp, Homo sapiens
ttagtcaggatttta

SEQ ID NO: 236617 - DNA, 15 bp, Homo sapiens
tttagtcaggatttt

SEQ ID NO: 236618 - DNA, 15 bp, Homo sapiens
ctttagtcaggattt

SEQ ID NO: 236619 - DNA, 15 bp, Homo sapiens
tctttagtcaggatt

SEQ ID NO: 236620 - DNA, 15 bp, Homo sapiens
ttctttagtcaggat

SEQ ID NO: 236621 - DNA, 15 bp, Homo sapiens
tttctttagtcagga

SEQ ID NO: 236622 - DNA, 15 bp, Homo sapiens
gtttctttagtcagg

SEQ ID NO: 236623 - DNA, 15 bp, Homo sapiens
ggtttctttagtcag

SEQ ID NO: 236624 - DNA, 15 bp, Homo sapiens
aggtttctttagtca

SEQ ID NO: 236625 - DNA, 15 bp, Homo sapiens
aaggtttctttagtc

SEQ ID NO: 236626 - DNA, 15 bp, Homo sapiens
caaggtttctttagt

SEQ ID NO: 236627 - DNA, 15 bp, Homo sapiens
tcaaggtttctttag

SEQ ID NO: 236628 - DNA, 15 bp, Homo sapiens
ttcaaggtttcttta

SEQ ID NO: 236629 - DNA, 15 bp, Homo sapiens
cttcaaggtttcttt

SEQ ID NO: 236630 - DNA, 15 bp, Homo sapiens
ccttcaaggtttctt

SEQ ID NO: 236631 - DNA, 15 bp, Homo sapiens
tccttcaaggtttct

SEQ ID NO: 236632 - DNA, 15 bp, Homo sapiens
atccttcaaggtttc

SEQ ID NO: 236633 - DNA, 15 bp, Homo sapiens
aatccttcaaggttt

SEQ ID NO: 236634 - DNA, 15 bp, Homo sapiens
aaatccttcaaggtt

SEQ ID NO: 236635 - DNA, 15 bp, Homo sapiens
caaatccttcaaggt

SEQ ID NO: 236636 - DNA, 15 bp, Homo sapiens
tcaaatccttcaagg

SEQ ID NO: 236637 - DNA, 15 bp, Homo sapiens
ttcaaatccttcaag

SEQ ID NO: 236638 - DNA, 15 bp, Homo sapiens
attcaaatccttcaa

SEQ ID NO: 236639 - DNA, 15 bp, Homo sapiens
aattcaaatccttca

SEQ ID NO: 236640 - DNA, 15 bp, Homo sapiens
gaattcaaatccttc

SEQ ID NO: 236641 - DNA, 15 bp, Homo sapiens
agaattcaaatcctt

SEQ ID NO: 236642 - DNA, 15 bp, Homo sapiens
cagaattcaaatcct

SEQ ID NO: 236643 - DNA, 15 bp, Homo sapiens
acagaattcaaatcc

SEQ ID NO: 236644 - DNA, 15 bp, Homo sapiens
tacagaattcaaatc

SEQ ID NO: 236645 - DNA, 15 bp, Homo sapiens
ttacagaattcaaat

SEQ ID NO: 236646 - DNA, 15 bp, Homo sapiens
attacagaattcaaa

SEQ ID NO: 236647 - DNA, 15 bp, Homo sapiens
aattacagaattcaa

SEQ ID NO: 236648 - DNA, 15 bp, Homo sapiens
caattacagaattca

SEQ ID NO: 236649 - DNA, 15 bp, Homo sapiens
acaattacagaattc

SEQ ID NO: 236650 - DNA, 15 bp, Homo sapiens
aacaattacagaatt

SEQ ID NO: 236651 - DNA, 15 bp, Homo sapiens
gaacaattacagaat

SEQ ID NO: 236652 - DNA, 15 bp, Homo sapiens
agaacaattacagaa

SEQ ID NO: 236653 - DNA, 15 bp, Homo sapiens
gagaacaattacaga

SEQ ID NO: 236654 - DNA, 15 bp, Homo sapiens
tgagaacaattacag

SEQ ID NO: 236655 - DNA, 15 bp, Homo sapiens
ttgagaacaattaca

SEQ ID NO: 236656 - DNA, 15 bp, Homo sapiens
tttgagaacaattac

SEQ ID NO: 236657 - DNA, 15 bp, Homo sapiens
gtttgagaacaatta

SEQ ID NO: 236658 - DNA, 15 bp, Homo sapiens
agtttgagaacaatt

SEQ ID NO: 236659 - DNA, 15 bp, Homo sapiens
cagtttgagaacaat

SEQ ID NO: 236660 - DNA, 15 bp, Homo sapiens
tcagtttgagaacaa

SEQ ID NO: 236661 - DNA, 15 bp, Homo sapiens
ttcagtttgagaaca

SEQ ID NO: 236662 - DNA, 15 bp, Homo sapiens
attcagtttgagaac

SEQ ID NO: 236663 - DNA, 15 bp, Homo sapiens
gattcagtttgagaa

SEQ ID NO: 236664 - DNA, 15 bp, Homo sapiens
agattcagtttgaga

SEQ ID NO: 236665 - DNA, 15 bp, Homo sapiens
cagattcagtttgag

SEQ ID NO: 236666 - DNA, 15 bp, Homo sapiens
tcagattcagtttga

SEQ ID NO: 236667 - DNA, 15 bp, Homo sapiens
ctcagattcagtttg

SEQ ID NO: 236668 - DNA, 15 bp, Homo sapiens
tctcagattcagttt

SEQ ID NO: 236669 - DNA, 15 bp, Homo sapiens
ctctcagattcagtt

SEQ ID NO: 236670 - DNA, 15 bp, Homo sapiens
tctctcagattcagt

SEQ ID NO: 236671 - DNA, 15 bp, Homo sapiens
gtctctcagattcag

SEQ ID NO: 236672 - DNA, 15 bp, Homo sapiens
ggtctctcagattca

SEQ ID NO: 236673 - DNA, 15 bp, Homo sapiens
gggtctctcagattc

SEQ ID NO: 236674 - DNA, 15 bp, Homo sapiens
tgggtctctcagatt

SEQ ID NO: 236675 - DNA, 15 bp, Homo sapiens
ctgggtctctcagat

SEQ ID NO: 236676 - DNA, 15 bp, Homo sapiens
tctgggtctctcaga

SEQ ID NO: 236677 - DNA, 15 bp, Homo sapiens
gtctgggtctctcag

SEQ ID NO: 236678 - DNA, 15 bp, Homo sapiens
ggtctgggtctctca

SEQ ID NO: 236679 - DNA, 15 bp, Homo sapiens
aggtctgggtctctc

SEQ ID NO: 236680 - DNA, 15 bp, Homo sapiens
aaggtctgggtctct

SEQ ID NO: 236681 - DNA, 15 bp, Homo sapiens
aaaggtctgggtctc

SEQ ID NO: 236682 - DNA, 15 bp, Homo sapiens
aaaaggtctgggtct

SEQ ID NO: 236683 - DNA, 15 bp, Homo sapiens
gaaaaggtctgggtc

SEQ ID NO: 236684 - DNA, 15 bp, Homo sapiens
tgaaaaggtctgggt

SEQ ID NO: 236685 - DNA, 15 bp, Homo sapiens
ttgaaaaggtctggg

SEQ ID NO: 236686 - DNA, 15 bp, Homo sapiens
tttgaaaaggtctgg

SEQ ID NO: 236687 - DNA, 15 bp, Homo sapiens
ctttgaaaaggtctg

SEQ ID NO: 236688 - DNA, 15 bp, Homo sapiens
actttgaaaaggtct

SEQ ID NO: 236689 - DNA, 15 bp, Homo sapiens
aactttgaaaaggtc

SEQ ID NO: 236690 - DNA, 15 bp, Homo sapiens
gaactttgaaaaggt

SEQ ID NO: 236691 - DNA, 15 bp, Homo sapiens
tgaactttgaaaagg

SEQ ID NO: 236692 - DNA, 15 bp, Homo sapiens
ctgaactttgaaaag

SEQ ID NO: 236693 - DNA, 15 bp, Homo sapiens
tctgaactttgaaaa

SEQ ID NO: 236694 - DNA, 15 bp, Homo sapiens
gtctgaactttgaaa

SEQ ID NO: 236695 - DNA, 15 bp, Homo sapiens
agtctgaactttgaa

SEQ ID NO: 236696 - DNA, 15 bp, Homo sapiens
cagtctgaactttga

SEQ ID NO: 236697 - DNA, 15 bp, Homo sapiens
tcagtctgaactttg

SEQ ID NO: 236698 - DNA, 15 bp, Homo sapiens
ttcagtctgaacttt

SEQ ID NO: 236699 - DNA, 15 bp, Homo sapiens
tttcagtctgaactt

SEQ ID NO: 236700 - DNA, 15 bp, Homo sapiens
ttttcagtctgaact

SEQ ID NO: 236701 - DNA, 15 bp, Homo sapiens
tttttcagtctgaac

SEQ ID NO: 236702 - DNA, 15 bp, Homo sapiens
atttttcagtctgaa

SEQ ID NO: 236703 - DNA, 15 bp, Homo sapiens
gatttttcagtctga

SEQ ID NO: 236704 - DNA, 15 bp, Homo sapiens
ggatttttcagtctg

SEQ ID NO: 236705 - DNA, 15 bp, Homo sapiens
gggatttttcagtct

SEQ ID NO: 236706 - DNA, 15 bp, Homo sapiens
agggatttttcagtc

SEQ ID NO: 236707 - DNA, 15 bp, Homo sapiens
aagggatttttcagt

SEQ ID NO: 236708 - DNA, 15 bp, Homo sapiens
aaagggatttttcag

SEQ ID NO: 236709 - DNA, 15 bp, Homo sapiens
caaagggatttttca

SEQ ID NO: 236710 - DNA, 15 bp, Homo sapiens
gcaaagggatttttc

SEQ ID NO: 236711 - DNA, 15 bp, Homo sapiens
ggcaaagggattttt

SEQ ID NO: 236712 - DNA, 15 bp, Homo sapiens
gggcaaagggatttt

SEQ ID NO: 236713 - DNA, 15 bp, Homo sapiens
tgggcaaagggattt

SEQ ID NO: 236714 - DNA, 15 bp, Homo sapiens
gtgggcaaagggatt

SEQ ID NO: 236715 - DNA, 15 bp, Homo sapiens
ggtgggcaaagggat

SEQ ID NO: 236716 - DNA, 15 bp, Homo sapiens
gggtgggcaaaggga

SEQ ID NO: 236717 - DNA, 15 bp, Homo sapiens
agggtgggcaaaggg

SEQ ID NO: 236718 - DNA, 15 bp, Homo sapiens
tagggtgggcaaagg

SEQ ID NO: 236719 - DNA, 15 bp, Homo sapiens
ttagggtgggcaaag

SEQ ID NO: 236720 - DNA, 15 bp, Homo sapiens
gttagggtgggcaaa

SEQ ID NO: 236721 - DNA, 15 bp, Homo sapiens
ggttagggtgggcaa

SEQ ID NO: 236722 - DNA, 15 bp, Homo sapiens
gggttagggtgggca

SEQ ID NO: 236723 - DNA, 15 bp, Homo sapiens
tgggttagggtgggc

SEQ ID NO: 236724 - DNA, 15 bp, Homo sapiens
gtgggttagggtggg

SEQ ID NO: 236725 - DNA, 15 bp, Homo sapiens
ggtgggttagggtgg

SEQ ID NO: 236726 - DNA, 15 bp, Homo sapiens
gggtgggttagggtg

SEQ ID NO: 236727 - DNA, 15 bp, Homo sapiens
ggggtgggttagggt

SEQ ID NO: 236728 - DNA, 15 bp, Homo sapiens
aggggtgggttaggg

SEQ ID NO: 236729 - DNA, 15 bp, Homo sapiens
gaggggtgggttagg

SEQ ID NO: 236730 - DNA, 15 bp, Homo sapiens
ggaggggtgggttag

SEQ ID NO: 236731 - DNA, 15 bp, Homo sapiens
aggaggggtgggtta

SEQ ID NO: 236732 - DNA, 15 bp, Homo sapiens
gaggaggggtgggtt

SEQ ID NO: 236733 - DNA, 15 bp, Homo sapiens
ggaggaggggtgggt

SEQ ID NO: 236734 - DNA, 15 bp, Homo sapiens
aggaggaggggtggg

SEQ ID NO: 236735 - DNA, 15 bp, Homo sapiens
aaggaggaggggtgg

SEQ ID NO: 236736 - DNA, 15 bp, Homo sapiens
gaaggaggaggggtg

SEQ ID NO: 236737 - DNA, 15 bp, Homo sapiens
ggaaggaggaggggt

SEQ ID NO: 236738 - DNA, 15 bp, Homo sapiens
gggaaggaggagggg

SEQ ID NO: 236739 - DNA, 15 bp, Homo sapiens
agggaaggaggaggg

SEQ ID NO: 236740 - DNA, 15 bp, Homo sapiens
cagggaaggaggagg

SEQ ID NO: 236741 - DNA, 15 bp, Homo sapiens
acagggaaggaggag

SEQ ID NO: 236742 - DNA, 15 bp, Homo sapiens
cacagggaaggagga

SEQ ID NO: 236743 - DNA, 15 bp, Homo sapiens
gcacagggaaggagg

SEQ ID NO: 236744 - DNA, 15 bp, Homo sapiens
agcacagggaaggag

SEQ ID NO: 236745 - DNA, 15 bp, Homo sapiens
aagcacagggaagga

SEQ ID NO: 236746 - DNA, 15 bp, Homo sapiens
gaagcacagggaagg

SEQ ID NO: 236747 - DNA, 15 bp, Homo sapiens
agaagcacagggaag

SEQ ID NO: 236748 - DNA, 15 bp, Homo sapiens
tagaagcacagggaa

SEQ ID NO: 236749 - DNA, 15 bp, Homo sapiens
atagaagcacaggga

SEQ ID NO: 236750 - DNA, 15 bp, Homo sapiens
tatagaagcacaggg

SEQ ID NO: 236751 - DNA, 15 bp, Homo sapiens
atatagaagcacagg

SEQ ID NO: 236752 - DNA, 15 bp, Homo sapiens
aatatagaagcacag

SEQ ID NO: 236753 - DNA, 15 bp, Homo sapiens
taatatagaagcaca

SEQ ID NO: 236754 - DNA, 15 bp, Homo sapiens
ttaatatagaagcac

SEQ ID NO: 236755 - DNA, 15 bp, Homo sapiens
attaatatagaagca

SEQ ID NO: 236756 - DNA, 15 bp, Homo sapiens
aattaatatagaagc

SEQ ID NO: 236757 - DNA, 15 bp, Homo sapiens
caattaatatagaag

SEQ ID NO: 236758 - DNA, 15 bp, Homo sapiens
acaattaatatagaa

SEQ ID NO: 236759 - DNA, 15 bp, Homo sapiens
cacaattaatataga

SEQ ID NO: 236760 - DNA, 15 bp, Homo sapiens
tcacaattaatatag

SEQ ID NO: 236761 - DNA, 15 bp, Homo sapiens
ttcacaattaatata

SEQ ID NO: 236762 - DNA, 15 bp, Homo sapiens
attcacaattaatat

SEQ ID NO: 236763 - DNA, 15 bp, Homo sapiens
aattcacaattaata

SEQ ID NO: 236764 - DNA, 15 bp, Homo sapiens
aaattcacaattaat

SEQ ID NO: 236765 - DNA, 15 bp, Homo sapiens
aaaattcacaattaa

SEQ ID NO: 236766 - DNA, 15 bp, Homo sapiens
aaaaattcacaatta

SEQ ID NO: 236767 - DNA, 15 bp, Homo sapiens
aaaaaattcacaatt

SEQ ID NO: 236768 - DNA, 15 bp, Homo sapiens
taaaaaattcacaat

SEQ ID NO: 236769 - DNA, 15 bp, Homo sapiens
gtaaaaaattcacaa

SEQ ID NO: 236770 - DNA, 15 bp, Homo sapiens
tgtaaaaaattcaca

SEQ ID NO: 236771 - DNA, 15 bp, Homo sapiens
gtgtaaaaaattcac

SEQ ID NO: 236772 - DNA, 15 bp, Homo sapiens
agtgtaaaaaattca

SEQ ID NO: 236773 - DNA, 15 bp, Homo sapiens
aagtgtaaaaaattc

SEQ ID NO: 236774 - DNA, 15 bp, Homo sapiens
taagtgtaaaaaatt

SEQ ID NO: 236775 - DNA, 15 bp, Homo sapiens
ataagtgtaaaaaat

SEQ ID NO: 236776 - DNA, 15 bp, Homo sapiens
tataagtgtaaaaaa

SEQ ID NO: 236777 - DNA, 15 bp, Homo sapiens
ttataagtgtaaaaa

SEQ ID NO: 236778 - DNA, 15 bp, Homo sapiens
attataagtgtaaaa

SEQ ID NO: 236779 - DNA, 15 bp, Homo sapiens
cattataagtgtaaa

SEQ ID NO: 236780 - DNA, 15 bp, Homo sapiens
gcattataagtgtaa

SEQ ID NO: 236781 - DNA, 15 bp, Homo sapiens
ggcattataagtgta

SEQ ID NO: 236782 - DNA, 15 bp, Homo sapiens
aggcattataagtgt

SEQ ID NO: 236783 - DNA, 15 bp, Homo sapiens
gaggcattataagtg

SEQ ID NO: 236784 - DNA, 15 bp, Homo sapiens
agaggcattataagt

SEQ ID NO: 236785 - DNA, 15 bp, Homo sapiens
tagaggcattataag

SEQ ID NO: 236786 - DNA, 15 bp, Homo sapiens
atagaggcattataa

SEQ ID NO: 236787 - DNA, 15 bp, Homo sapiens
aatagaggcattata

SEQ ID NO: 236788 - DNA, 15 bp, Homo sapiens
taatagaggcattat

SEQ ID NO: 236789 - DNA, 15 bp, Homo sapiens
gtaatagaggcatta

SEQ ID NO: 236790 - DNA, 15 bp, Homo sapiens
ggtaatagaggcatt

SEQ ID NO: 236791 - DNA, 15 bp, Homo sapiens
tggtaatagaggcat

SEQ ID NO: 236792 - DNA, 15 bp, Homo sapiens
atggtaatagaggca

SEQ ID NO: 236793 - DNA, 15 bp, Homo sapiens
tatggtaatagaggc

SEQ ID NO: 236794 - DNA, 15 bp, Homo sapiens
gtatggtaatagagg

SEQ ID NO: 236795 - DNA, 15 bp, Homo sapiens
tgtatggtaatagag

SEQ ID NO: 236796 - DNA, 15 bp, Homo sapiens
ttgtatggtaataga

SEQ ID NO: 236797 - DNA, 15 bp, Homo sapiens
gttgtatggtaatag

SEQ ID NO: 236798 - DNA, 15 bp, Homo sapiens
agttgtatggtaata

SEQ ID NO: 236799 - DNA, 15 bp, Homo sapiens
cagttgtatggtaat

SEQ ID NO: 236800 - DNA, 15 bp, Homo sapiens
gcagttgtatggtaa

SEQ ID NO: 236801 - DNA, 15 bp, Homo sapiens
agcagttgtatggta

SEQ ID NO: 236802 - DNA, 15 bp, Homo sapiens
gagcagttgtatggt

SEQ ID NO: 236803 - DNA, 15 bp, Homo sapiens
agagcagttgtatgg

SEQ ID NO: 236804 - DNA, 15 bp, Homo sapiens
aagagcagttgtatg

SEQ ID NO: 236805 - DNA, 15 bp, Homo sapiens
gaagagcagttgtat

SEQ ID NO: 236806 - DNA, 15 bp, Homo sapiens
agaagagcagttgta

SEQ ID NO: 236807 - DNA, 15 bp, Homo sapiens
aagaagagcagttgt

SEQ ID NO: 236808 - DNA, 15 bp, Homo sapiens
taagaagagcagttg

SEQ ID NO: 236809 - DNA, 15 bp, Homo sapiens
ataagaagagcagtt

SEQ ID NO: 236810 - DNA, 15 bp, Homo sapiens
aataagaagagcagt

SEQ ID NO: 236811 - DNA, 15 bp, Homo sapiens
aaataagaagagcag

SEQ ID NO: 236812 - DNA, 15 bp, Homo sapiens
taaataagaagagca

SEQ ID NO: 236813 - DNA, 15 bp, Homo sapiens
ttaaataagaagagc

SEQ ID NO: 236814 - DNA, 15 bp, Homo sapiens
attaaataagaagag

SEQ ID NO: 236815 - DNA, 15 bp, Homo sapiens
aattaaataagaaga

SEQ ID NO: 236816 - DNA, 15 bp, Homo sapiens
caattaaataagaag

SEQ ID NO: 236817 - DNA, 15 bp, Homo sapiens
acaattaaataagaa

SEQ ID NO: 236818 - DNA, 15 bp, Homo sapiens
tacaattaaataaga

SEQ ID NO: 236819 - DNA, 15 bp, Homo sapiens
atacaattaaataag

SEQ ID NO: 236820 - DNA, 15 bp, Homo sapiens
aatacaattaaataa

SEQ ID NO: 236821 - DNA, 15 bp, Homo sapiens
aaatacaattaaata

SEQ ID NO: 236822 - DNA, 15 bp, Homo sapiens
caaatacaattaaat

SEQ ID NO: 236823 - DNA, 15 bp, Homo sapiens
acaaatacaattaaa

SEQ ID NO: 236824 - DNA, 15 bp, Homo sapiens
cacaaatacaattaa

SEQ ID NO: 236825 - DNA, 15 bp, Homo sapiens
acacaaatacaatta

SEQ ID NO: 236826 - DNA, 15 bp, Homo sapiens
cacacaaatacaatt

SEQ ID NO: 236827 - DNA, 15 bp, Homo sapiens
acacacaaatacaat

SEQ ID NO: 236828 - DNA, 15 bp, Homo sapiens
aacacacaaatacaa

SEQ ID NO: 236829 - DNA, 15 bp, Homo sapiens
aaacacacaaataca

SEQ ID NO: 236830 - DNA, 15 bp, Homo sapiens
aaaacacacaaatac

SEQ ID NO: 236831 - DNA, 15 bp, Homo sapiens
gaaaaacacacaaat

SEQ ID NO: 236832 - DNA, 15 bp, Homo sapiens
agaaaaacacacaaa

SEQ ID NO: 236833 - DNA, 15 bp, Homo sapiens
cagaaaaacacacaa

SEQ ID NO: 236834 - DNA, 15 bp, Homo sapiens
acagaaaaacacaca

SEQ ID NO: 236835 - DNA, 15 bp, Homo sapiens
cacagaaaaacacac

SEQ ID NO: 236836 - DNA, 15 bp, Homo sapiens
acacagaaaaacaca

SEQ ID NO: 236837 - DNA, 15 bp, Homo sapiens
cacacagaaaaacac

SEQ ID NO: 236838 - DNA, 15 bp, Homo sapiens
acacacagaaaaaca

SEQ ID NO: 236839 - DNA, 15 bp, Homo sapiens
cacacacagaaaaac

SEQ ID NO: 236840 - DNA, 15 bp, Homo sapiens
gcacacacagaaaaa

SEQ ID NO: 236841 - DNA, 15 bp, Homo sapiens
tgcacacacagaaaa

SEQ ID NO: 236842 - DNA, 15 bp, Homo sapiens
gtgcacacacagaaa

SEQ ID NO: 236843 - DNA, 15 bp, Homo sapiens
tgtgcacacacagaa

SEQ ID NO: 236844 - DNA, 15 bp, Homo sapiens
atgtgcacacacaga

SEQ ID NO: 236845 - DNA, 15 bp, Homo sapiens
aatgtgcacacacag

SEQ ID NO: 236846 - DNA, 15 bp, Homo sapiens
gaatgtgcacacaca

SEQ ID NO: 236847 - DNA, 15 bp, Homo sapiens
agaatgtgcacacac

SEQ ID NO: 236848 - DNA, 15 bp, Homo sapiens
cagaatgtgcacaca

SEQ ID NO: 236849 - DNA, 15 bp, Homo sapiens
acagaatgtgcacac

SEQ ID NO: 236850 - DNA, 15 bp, Homo sapiens
gacagaatgtgcaca

SEQ ID NO: 236851 - DNA, 15 bp, Homo sapiens
tgacagaatgtgcac

SEQ ID NO: 236852 - DNA, 15 bp, Homo sapiens
atgacagaatgtgca

SEQ ID NO: 236853 - DNA, 15 bp, Homo sapiens
gatgacagaatgtgc

SEQ ID NO: 236854 - DNA, 15 bp, Homo sapiens
ggatgacagaatgtg

SEQ ID NO: 236855 - DNA, 15 bp, Homo sapiens
tggatgacagaatgt

SEQ ID NO: 236856 - DNA, 15 bp, Homo sapiens
atggatgacagaatg

SEQ ID NO: 236857 - DNA, 15 bp, Homo sapiens
aatggatgacagaat

SEQ ID NO: 236858 - DNA, 15 bp, Homo sapiens
taatggatgacagaa

SEQ ID NO: 236859 - DNA, 15 bp, Homo sapiens
ttaatggatgacaga

SEQ ID NO: 236860 - DNA, 15 bp, Homo sapiens
tttaatggatgacag

SEQ ID NO: 236861 - DNA, 15 bp, Homo sapiens
ttttaatggatgaca

SEQ ID NO: 236862 - DNA, 15 bp, Homo sapiens
attttaatggatgac

SEQ ID NO: 236863 - DNA, 15 bp, Homo sapiens
cattttaatggatga

SEQ ID NO: 236864 - DNA, 15 bp, Homo sapiens
gcattttaatggatg

SEQ ID NO: 236865 - DNA, 15 bp, Homo sapiens
ggcattttaatggat

SEQ ID NO: 236866 - DNA, 15 bp, Homo sapiens
cggcattttaatgga

SEQ ID NO: 236867 - DNA, 15 bp, Homo sapiens
tcggcattttaatgg

SEQ ID NO: 236868 - DNA, 15 bp, Homo sapiens
ttcggcattttaatg

SEQ ID NO: 236869 - DNA, 15 bp, Homo sapiens
attcggcattttaat

SEQ ID NO: 236870 - DNA, 15 bp, Homo sapiens
gattcggcattttaa

SEQ ID NO: 236871 - DNA, 15 bp, Homo sapiens
agattcggcatttta

SEQ ID NO: 236872 - DNA, 15 bp, Homo sapiens
cagattcggcatttt

SEQ ID NO: 236873 - DNA, 15 bp, Homo sapiens
gcagattcggcattt

SEQ ID NO: 236874 - DNA, 15 bp, Homo sapiens
tgcagattcggcatt

SEQ ID NO: 236875 - DNA, 15 bp, Homo sapiens
ctgcagattcggcat

SEQ ID NO: 236876 - DNA, 15 bp, Homo sapiens
gctgcagattcggca

SEQ ID NO: 236877 - DNA, 15 bp, Homo sapiens
tgctgcagattcggc

SEQ ID NO: 236878 - DNA, 15 bp, Homo sapiens
ttgctgcagattcgg

SEQ ID NO: 236879 - DNA, 15 bp, Homo sapiens
attgctgcagattcg

SEQ ID NO: 236880 - DNA, 15 bp, Homo sapiens
cattgctgcagattc

SEQ ID NO: 236881 - DNA, 15 bp, Homo sapiens
ccattgctgcagatt

SEQ ID NO: 236882 - DNA, 15 bp, Homo sapiens
tccattgctgcagat

SEQ ID NO: 236883 - DNA, 15 bp, Homo sapiens
ttccattgctgcaga

SEQ ID NO: 236884 - DNA, 15 bp, Homo sapiens
tttccattgctgcag

SEQ ID NO: 236885 - DNA, 15 bp, Homo sapiens
ttttccattgctgca

SEQ ID NO: 236886 - DNA, 15 bp, Homo sapiens
tttttccattgctgc

SEQ ID NO: 236887 - DNA, 15 bp, Homo sapiens
ttttttccattgctg

SEQ ID NO: 236888 - DNA, 15 bp, Homo sapiens
tttttttccattgct

SEQ ID NO: 236889 - DNA, 15 bp, Homo sapiens
ttttttttccattgc

SEQ ID NO: 236890 - DNA, 15 bp, Homo sapiens
gttttttttccattg

SEQ ID NO: 236891 - DNA, 15 bp, Homo sapiens
agttttttttccatt

SEQ ID NO: 236892 - DNA, 15 bp, Homo sapiens
tagttttttttccat

SEQ ID NO: 236893 - DNA, 15 bp, Homo sapiens
atagttttttttcca

SEQ ID NO: 236894 - DNA, 15 bp, Homo sapiens
gatagttttttttcc

SEQ ID NO: 236895 - DNA, 15 bp, Homo sapiens
agatagttttttttc

SEQ ID NO: 236896 - DNA, 15 bp, Homo sapiens
gagatagtttttttt

SEQ ID NO: 236897 - DNA, 15 bp, Homo sapiens
tgagatagttttttt

SEQ ID NO: 236898 - DNA, 15 bp, Homo sapiens
ttgagatagtttttt

SEQ ID NO: 236899 - DNA, 15 bp, Homo sapiens
gttgagatagttttt

SEQ ID NO: 236900 - DNA, 15 bp, Homo sapiens
agttgagatagtttt

SEQ ID NO: 236901 - DNA, 15 bp, Homo sapiens
gagttgagatagttt

SEQ ID NO: 236902 - DNA, 15 bp, Homo sapiens
agagttgagatagtt

SEQ ID NO: 236903 - DNA, 15 bp, Homo sapiens
aagagttgagatagt

SEQ ID NO: 236904 - DNA, 15 bp, Homo sapiens
gaagagttgagatag

SEQ ID NO: 236905 - DNA, 15 bp, Homo sapiens
agaagagttgagata

SEQ ID NO: 236906 - DNA, 15 bp, Homo sapiens
aagaagagttgagat

SEQ ID NO: 236907 - DNA, 15 bp, Homo sapiens
gaagaagagttgaga

SEQ ID NO: 236908 - DNA, 15 bp, Homo sapiens
agaagaagagttgag

SEQ ID NO: 236909 - DNA, 15 bp, Homo sapiens
gagaagaagagttga

SEQ ID NO: 236910 - DNA, 15 bp, Homo sapiens
ggagaagaagagttg

SEQ ID NO: 236911 - DNA, 15 bp, Homo sapiens
aggagaagaagagtt

SEQ ID NO: 236912 - DNA, 15 bp, Homo sapiens
aaggagaagaagagt

SEQ ID NO: 236913 - DNA, 15 bp, Homo sapiens
gaaggagaagaagag

SEQ ID NO: 236914 - DNA, 15 bp, Homo sapiens
ggaaggagaagaaga

SEQ ID NO: 236915 - DNA, 15 bp, Homo sapiens
tggaaggagaagaag

SEQ ID NO: 236916 - DNA, 15 bp, Homo sapiens
atggaaggagaagaa

SEQ ID NO: 236917 - DNA, 15 bp, Homo sapiens
tatggaaggagaaga

SEQ ID NO: 236918 - DNA, 15 bp, Homo sapiens
gtatggaaggagaag

SEQ ID NO: 236919 - DNA, 15 bp, Homo sapiens
agtatggaaggagaa

SEQ ID NO: 236920 - DNA, 15 bp, Homo sapiens
cagtatggaaggaga

SEQ ID NO: 236921 - DNA, 15 bp, Homo sapiens
tcagtatggaaggag

SEQ ID NO: 236922 - DNA, 15 bp, Homo sapiens
ttcagtatggaagga

SEQ ID NO: 236923 - DNA, 15 bp, Homo sapiens
cttcagtatggaagg

SEQ ID NO: 236924 - DNA, 15 bp, Homo sapiens
gcttcagtatggaag

SEQ ID NO: 236925 - DNA, 15 bp, Homo sapiens
tgcttcagtatggaa

SEQ ID NO: 236926 - DNA, 15 bp, Homo sapiens
ttgcttcagtatgga

SEQ ID NO: 236927 - DNA, 15 bp, Homo sapiens
attgcttcagtatgg

SEQ ID NO: 236928 - DNA, 15 bp, Homo sapiens
aattgcttcagtatg

SEQ ID NO: 236929 - DNA, 15 bp, Homo sapiens
gaattgcttcagtat

SEQ ID NO: 236930 - DNA, 15 bp, Homo sapiens
ggaattgcttcagta

SEQ ID NO: 236931 - DNA, 15 bp, Homo sapiens
gggaattgcttcagt

SEQ ID NO: 236932 - DNA, 15 bp, Homo sapiens
tgggaattgcttcag

SEQ ID NO: 236933 - DNA, 15 bp, Homo sapiens
atgggaattgcttca

SEQ ID NO: 236934 - DNA, 15 bp, Homo sapiens
catgggaattgcttc

SEQ ID NO: 236935 - DNA, 15 bp, Homo sapiens
tcatgggaattgctt

SEQ ID NO: 236936 - DNA, 15 bp, Homo sapiens
ttcatgggaattgct

SEQ ID NO: 236937 - DNA, 15 bp, Homo sapiens
attcatgggaattgc

SEQ ID NO: 236938 - DNA, 15 bp, Homo sapiens
aattcatgggaattg

SEQ ID NO: 236939 - DNA, 15 bp, Homo sapiens
aaattcatgggaatt

SEQ ID NO: 236940 - DNA, 15 bp, Homo sapiens
caaattcatgggaat

SEQ ID NO: 236941 - DNA, 15 bp, Homo sapiens
acaaattcatgggaa

SEQ ID NO: 236942 - DNA, 15 bp, Homo sapiens
tacaaattcatggga

SEQ ID NO: 236943 - DNA, 15 bp, Homo sapiens
atacaaattcatggg

SEQ ID NO: 236944 - DNA, 15 bp, Homo sapiens
catacaaattcatgg

SEQ ID NO: 236945 - DNA, 15 bp, Homo sapiens
gcatacaaattcatg

SEQ ID NO: 236946 - DNA, 15 bp, Homo sapiens
tgcatacaaattcat

SEQ ID NO: 236947 - DNA, 15 bp, Homo sapiens
atgcatacaaattca

SEQ ID NO: 236948 - DNA, 15 bp, Homo sapiens
gatgcatacaaattc

SEQ ID NO: 236949 - DNA, 15 bp, Homo sapiens
ggatgcatacaaatt

SEQ ID NO: 236950 - DNA, 15 bp, Homo sapiens
gggatgcatacaaat

SEQ ID NO: 236951 - DNA, 15 bp, Homo sapiens
agggatgcatacaaa

SEQ ID NO: 236952 - DNA, 15 bp, Homo sapiens
aagggatgcatacaa

SEQ ID NO: 236953 - DNA, 15 bp, Homo sapiens
gaagggatgcataca

SEQ ID NO: 236954 - DNA, 15 bp, Homo sapiens
ggaagggatgcatac

SEQ ID NO: 236955 - DNA, 15 bp, Homo sapiens
aggaagggatgcata

SEQ ID NO: 236956 - DNA, 15 bp, Homo sapiens
gaggaagggatgcat

SEQ ID NO: 236957 - DNA, 15 bp, Homo sapiens
agaggaagggatgca

SEQ ID NO: 236958 - DNA, 15 bp, Homo sapiens
tagaggaagggatgc

SEQ ID NO: 236959 - DNA, 15 bp, Homo sapiens
gtagaggaagggatg

SEQ ID NO: 236960 - DNA, 15 bp, Homo sapiens
ggtagaggaagggat

SEQ ID NO: 236961 - DNA, 15 bp, Homo sapiens
gggtagaggaaggga

SEQ ID NO: 236962 - DNA, 15 bp, Homo sapiens
agggtagaggaaggg

SEQ ID NO: 236963 - DNA, 15 bp, Homo sapiens
cagggtagaggaagg

SEQ ID NO: 236964 - DNA, 15 bp, Homo sapiens
acagggtagaggaag

SEQ ID NO: 236965 - DNA, 15 bp, Homo sapiens
gacagggtagaggaa

SEQ ID NO: 236966 - DNA, 15 bp, Homo sapiens
agacagggtagagga

SEQ ID NO: 236967 - DNA, 15 bp, Homo sapiens
aagacagggtagagg

SEQ ID NO: 236968 - DNA, 15 bp, Homo sapiens
aaagacagggtagag

SEQ ID NO: 236969 - DNA, 15 bp, Homo sapiens
caaagacagggtaga

SEQ ID NO: 236970 - DNA, 15 bp, Homo sapiens
tcaaagacagggtag

SEQ ID NO: 236971 - DNA, 15 bp, Homo sapiens
ttcaaagacagggta

SEQ ID NO: 236972 - DNA, 15 bp, Homo sapiens
tttcaaagacagggt

SEQ ID NO: 236973 - DNA, 15 bp, Homo sapiens
atttcaaagacaggg

SEQ ID NO: 236974 - DNA, 15 bp, Homo sapiens
catttcaaagacagg

SEQ ID NO: 236975 - DNA, 15 bp, Homo sapiens
acatttcaaagacag

SEQ ID NO: 236976 - DNA, 15 bp, Homo sapiens
aacatttcaaagaca

SEQ ID NO: 236977 - DNA, 15 bp, Homo sapiens
caacatttcaaagac

SEQ ID NO: 236978 - DNA, 15 bp, Homo sapiens
ccaacatttcaaaga

SEQ ID NO: 236979 - DNA, 15 bp, Homo sapiens
accaacatttcaaag

SEQ ID NO: 236980 - DNA, 15 bp, Homo sapiens
taccaacatttcaaa

SEQ ID NO: 236981 - DNA, 15 bp, Homo sapiens
ctaccaacatttcaa

SEQ ID NO: 236982 - DNA, 15 bp, Homo sapiens
gctaccaacatttca

SEQ ID NO: 236983 - DNA, 15 bp, Homo sapiens
agctaccaacatttc

SEQ ID NO: 236984 - DNA, 15 bp, Homo sapiens
cagctaccaacattt

SEQ ID NO: 236985 - DNA, 15 bp, Homo sapiens
gcagctaccaacatt

SEQ ID NO: 236986 - DNA, 15 bp, Homo sapiens
tgcagctaccaacat

SEQ ID NO: 236987 - DNA, 15 bp, Homo sapiens
ctgcagctaccaaca

SEQ ID NO: 236988 - DNA, 15 bp, Homo sapiens
cctgcagctaccaac

SEQ ID NO: 236989 - DNA, 15 bp, Homo sapiens
ccctgcagctaccaa

SEQ ID NO: 236990 - DNA, 15 bp, Homo sapiens
accctgcagctacca

SEQ ID NO: 236991 - DNA, 15 bp, Homo sapiens
aaccctgcagctacc

SEQ ID NO: 236992 - DNA, 15 bp, Homo sapiens
gaaccctgcagctac

SEQ ID NO: 236993 - DNA, 15 bp, Homo sapiens
cgaaccctgcagcta

SEQ ID NO: 236994 - DNA, 15 bp, Homo sapiens
ccgaaccctgcagct

SEQ ID NO: 236995 - DNA, 15 bp, Homo sapiens
accgaaccctgcagc

SEQ ID NO: 236996 - DNA, 15 bp, Homo sapiens
taccgaaccctgcag

SEQ ID NO: 236997 - DNA, 15 bp, Homo sapiens
ttaccgaaccctgca

SEQ ID NO: 236998 - DNA, 15 bp, Homo sapiens
attaccgaaccctgc

SEQ ID NO: 236999 - DNA, 15 bp, Homo sapiens
tattaccgaaccctg

SEQ ID NO: 237000 - DNA, 15 bp, Homo sapiens
atattaccgaaccct

SEQ ID NO: 237001 - DNA, 15 bp, Homo sapiens
aatattaccgaaccc

SEQ ID NO: 237002 - DNA, 15 bp, Homo sapiens
aaatattaccgaacc

SEQ ID NO: 237003 - DNA, 15 bp, Homo sapiens
gaaatattaccgaac

SEQ ID NO: 237004 - DNA, 15 bp, Homo sapiens
agaaatattaccgaa

SEQ ID NO: 237005 - DNA, 15 bp, Homo sapiens
aagaaatattaccga

SEQ ID NO: 237006 - DNA, 15 bp, Homo sapiens
taagaaatattaccg

SEQ ID NO: 237007 - DNA, 15 bp, Homo sapiens
gtaagaaatattacc

SEQ ID NO: 237008 - DNA, 15 bp, Homo sapiens
agtaagaaatattac

SEQ ID NO: 237009 - DNA, 15 bp, Homo sapiens
aagtaagaaatatta

SEQ ID NO: 237010 - DNA, 15 bp, Homo sapiens
aaagtaagaaatatt

SEQ ID NO: 237011 - DNA, 15 bp, Homo sapiens
taaagtaagaaatat

SEQ ID NO: 237012 - DNA, 15 bp, Homo sapiens
gtaaagtaagaaata

SEQ ID NO: 237013 - DNA, 15 bp, Homo sapiens
tgtaaagtaagaaat

SEQ ID NO: 237014 - DNA, 15 bp, Homo sapiens
gtgtaaagtaagaaa

SEQ ID NO: 237015 - DNA, 15 bp, Homo sapiens
tgtgtaaagtaagaa

SEQ ID NO: 237016 - DNA, 15 bp, Homo sapiens
atgtgtaaagtaaga

SEQ ID NO: 237017 - DNA, 15 bp, Homo sapiens
catgtgtaaagtaag

SEQ ID NO: 237018 - DNA, 15 bp, Homo sapiens
acatgtgtaaagtaa

SEQ ID NO: 237019 - DNA, 15 bp, Homo sapiens
aacatgtgtaaagta

SEQ ID NO: 237020 - DNA, 15 bp, Homo sapiens
caacatgtgtaaagt

SEQ ID NO: 237021 - DNA, 15 bp, Homo sapiens
tcaacatgtgtaaag

SEQ ID NO: 237022 - DNA, 15 bp, Homo sapiens
gtcaacatgtgtaaa

SEQ ID NO: 237023 - DNA, 15 bp, Homo sapiens
agtcaacatgtgtaa

SEQ ID NO: 237024 - DNA, 15 bp, Homo sapiens
aagtcaacatgtgta

SEQ ID NO: 237025 - DNA, 15 bp, Homo sapiens
gaagtcaacatgtgt

SEQ ID NO: 237026 - DNA, 15 bp, Homo sapiens
tgaagtcaacatgtg

SEQ ID NO: 237027 - DNA, 15 bp, Homo sapiens
ttgaagtcaacatgt

SEQ ID NO: 237028 - DNA, 15 bp, Homo sapiens
tttgaagtcaacatg

SEQ ID NO: 237029 - DNA, 15 bp, Homo sapiens
gtttgaagtcaacat

SEQ ID NO: 237030 - DNA, 15 bp, Homo sapiens
agtttgaagtcaaca

SEQ ID NO: 237031 - DNA, 15 bp, Homo sapiens
aagtttgaagtcaac

SEQ ID NO: 237032 - DNA, 15 bp, Homo sapiens
gaagtttgaagtcaa

SEQ ID NO: 237033 - DNA, 15 bp, Homo sapiens
ggaagtttgaagtca

SEQ ID NO: 237034 - DNA, 15 bp, Homo sapiens
tggaagtttgaagtc

SEQ ID NO: 237035 - DNA, 15 bp, Homo sapiens
ttggaagtttgaagt

SEQ ID NO: 237036 - DNA, 15 bp, Homo sapiens
gttggaagtttgaag

SEQ ID NO: 237037 - DNA, 15 bp, Homo sapiens
tgttggaagtttgaa

SEQ ID NO: 237038 - DNA, 15 bp, Homo sapiens
atgttggaagtttga

SEQ ID NO: 237039 - DNA, 15 bp, Homo sapiens
aatgttggaagtttg

SEQ ID NO: 237040 - DNA, 15 bp, Homo sapiens
gaatgttggaagttt

SEQ ID NO: 237041 - DNA, 15 bp, Homo sapiens
tgaatgttggaagtt

SEQ ID NO: 237042 - DNA, 15 bp, Homo sapiens
atgaatgttggaagt

SEQ ID NO: 237043 - DNA, 15 bp, Homo sapiens
tatgaatgttggaag

SEQ ID NO: 237044 - DNA, 15 bp, Homo sapiens
ctatgaatgttggaa

SEQ ID NO: 237045 - DNA, 15 bp, Homo sapiens
actatgaatgttgga

SEQ ID NO: 237046 - DNA, 15 bp, Homo sapiens
aactatgaatgttgg

SEQ ID NO: 237047 - DNA, 15 bp, Homo sapiens
gaactatgaatgttg

SEQ ID NO: 237048 - DNA, 15 bp, Homo sapiens
agaactatgaatgtt

SEQ ID NO: 237049 - DNA, 15 bp, Homo sapiens
gagaactatgaatgt

SEQ ID NO: 237050 - DNA, 15 bp, Homo sapiens
tgagaactatgaatg

SEQ ID NO: 237051 - DNA, 15 bp, Homo sapiens
gtgagaactatgaat

SEQ ID NO: 237052 - DNA, 15 bp, Homo sapiens
ggtgagaactatgaa

SEQ ID NO: 237053 - DNA, 15 bp, Homo sapiens
gggtgagaactatga

SEQ ID NO: 237054 - DNA, 15 bp, Homo sapiens
agggtgagaactatg

SEQ ID NO: 237055 - DNA, 15 bp, Homo sapiens
cagggtgagaactat

SEQ ID NO: 237056 - DNA, 15 bp, Homo sapiens
tcagggtgagaacta

SEQ ID NO: 237057 - DNA, 15 bp, Homo sapiens
gtcagggtgagaact

SEQ ID NO: 237058 - DNA, 15 bp, Homo sapiens
agtcagggtgagaac

SEQ ID NO: 237059 - DNA, 15 bp, Homo sapiens
gagtcagggtgagaa

SEQ ID NO: 237060 - DNA, 15 bp, Homo sapiens
agagtcagggtgaga

SEQ ID NO: 237061 - DNA, 15 bp, Homo sapiens
tagagtcagggtgag

SEQ ID NO: 237062 - DNA, 15 bp, Homo sapiens
ctagagtcagggtga

SEQ ID NO: 237063 - DNA, 15 bp, Homo sapiens
actagagtcagggtg

SEQ ID NO: 237064 - DNA, 15 bp, Homo sapiens
gactagagtcagggt

SEQ ID NO: 237065 - DNA, 15 bp, Homo sapiens
agactagagtcaggg

SEQ ID NO: 237066 - DNA, 15 bp, Homo sapiens
gagactagagtcagg

SEQ ID NO: 237067 - DNA, 15 bp, Homo sapiens
agagactagagtcag

SEQ ID NO: 237068 - DNA, 15 bp, Homo sapiens
aagagactagagtca

SEQ ID NO: 237069 - DNA, 15 bp, Homo sapiens
taagagactagagtc

SEQ ID NO: 237070 - DNA, 15 bp, Homo sapiens
ttaagagactagagt

SEQ ID NO: 237071 - DNA, 15 bp, Homo sapiens
tttaagagactagag

SEQ ID NO: 237072 - DNA, 15 bp, Homo sapiens
ctttaagagactaga

SEQ ID NO: 237073 - DNA, 15 bp, Homo sapiens
tctttaagagactag

SEQ ID NO: 237074 - DNA, 15 bp, Homo sapiens
ctctttaagagacta

SEQ ID NO: 237075 - DNA, 15 bp, Homo sapiens
tctctttaagagact

SEQ ID NO: 237076 - DNA, 15 bp, Homo sapiens
gtctctttaagagac

SEQ ID NO: 237077 - DNA, 15 bp, Homo sapiens
agtctctttaagaga

SEQ ID NO: 237078 - DNA, 15 bp, Homo sapiens
aagtctctttaagag

SEQ ID NO: 237079 - DNA, 15 bp, Homo sapiens
taagtctctttaaga

SEQ ID NO: 237080 - DNA, 15 bp, Homo sapiens
ttaagtctctttaag

SEQ ID NO: 237081 - DNA, 15 bp, Homo sapiens
tttaagtctctttaa

SEQ ID NO: 237082 - DNA, 15 bp, Homo sapiens
ctttaagtctcttta

SEQ ID NO: 237083 - DNA, 15 bp, Homo sapiens
tctttaagtctcttt

SEQ ID NO: 237084 - DNA, 15 bp, Homo sapiens
ctctttaagtctctt

SEQ ID NO: 237085 - DNA, 15 bp, Homo sapiens
gctctttaagtctct

SEQ ID NO: 237086 - DNA, 15 bp, Homo sapiens
ggctctttaagtctc

SEQ ID NO: 237087 - DNA, 15 bp, Homo sapiens
aggctctttaagtct

SEQ ID NO: 237088 - DNA, 15 bp, Homo sapiens
gaggctctttaagtc

SEQ ID NO: 237089 - DNA, 15 bp, Homo sapiens
ggaggctctttaagt

SEQ ID NO: 237090 - DNA, 15 bp, Homo sapiens
gggaggctctttaag

SEQ ID NO: 237091 - DNA, 15 bp, Homo sapiens
ggggaggctctttaa

SEQ ID NO: 237092 - DNA, 15 bp, Homo sapiens
tggggaggctcttta

SEQ ID NO: 237093 - DNA, 15 bp, Homo sapiens
gtggggaggctcttt

SEQ ID NO: 237094 - DNA, 15 bp, Homo sapiens
agtggggaggctctt

SEQ ID NO: 237095 - DNA, 15 bp, Homo sapiens
aagtggggaggctct

SEQ ID NO: 237096 - DNA, 15 bp, Homo sapiens
taagtggggaggctc

SEQ ID NO: 237097 - DNA, 15 bp, Homo sapiens
ttaagtggggaggct

SEQ ID NO: 237098 - DNA, 15 bp, Homo sapiens
tttaagtggggaggc

SEQ ID NO: 237099 - DNA, 15 bp, Homo sapiens
ctttaagtggggagg

SEQ ID NO: 237100 - DNA, 15 bp, Homo sapiens
tctttaagtggggag

SEQ ID NO: 237101 - DNA, 15 bp, Homo sapiens
ctctttaagtgggga

SEQ ID NO: 237102 - DNA, 15 bp, Homo sapiens
actctttaagtgggg

SEQ ID NO: 237103 - DNA, 15 bp, Homo sapiens
cactctttaagtggg

SEQ ID NO: 237104 - DNA, 15 bp, Homo sapiens
ccactctttaagtgg

SEQ ID NO: 237105 - DNA, 15 bp, Homo sapiens
tccactctttaagtg

SEQ ID NO: 237106 - DNA, 15 bp, Homo sapiens
gtccactctttaagt

SEQ ID NO: 237107 - DNA, 15 bp, Homo sapiens
tgtccactctttaag

SEQ ID NO: 237108 - DNA, 15 bp, Homo sapiens
ttgtccactctttaa

SEQ ID NO: 237109 - DNA, 15 bp, Homo sapiens
attgtccactcttta

SEQ ID NO: 237110 - DNA, 15 bp, Homo sapiens
cattgtccactcttt

SEQ ID NO: 237111 - DNA, 15 bp, Homo sapiens
acattgtccactctt

SEQ ID NO: 237112 - DNA, 15 bp, Homo sapiens
tacattgtccactct

SEQ ID NO: 237113 - DNA, 15 bp, Homo sapiens
ctacattgtccactc

SEQ ID NO: 237114 - DNA, 15 bp, Homo sapiens
tctacattgtccact

SEQ ID NO: 237115 - DNA, 15 bp, Homo sapiens
ttctacattgtccac

SEQ ID NO: 237116 - DNA, 15 bp, Homo sapiens
tttctacattgtcca

SEQ ID NO: 237117 - DNA, 15 bp, Homo sapiens
atttctacattgtcc

SEQ ID NO: 237118 - DNA, 15 bp, Homo sapiens
catttctacattgtc

SEQ ID NO: 237119 - DNA, 15 bp, Homo sapiens
tcatttctacattgt

SEQ ID NO: 237120 - DNA, 15 bp, Homo sapiens
ctcatttctacattg

SEQ ID NO: 237121 - DNA, 15 bp, Homo sapiens
cctcatttctacatt

SEQ ID NO: 237122 - DNA, 15 bp, Homo sapiens
tcctcatttctacat

SEQ ID NO: 237123 - DNA, 15 bp, Homo sapiens
ttcctcatttctaca

SEQ ID NO: 237124 - DNA, 15 bp, Homo sapiens
tttcctcatttctac

SEQ ID NO: 237125 - DNA, 15 bp, Homo sapiens
gtttcctcatttcta

SEQ ID NO: 237126 - DNA, 15 bp, Homo sapiens
ggtttcctcatttct

SEQ ID NO: 237127 - DNA, 15 bp, Homo sapiens
aggtttcctcatttc

SEQ ID NO: 237128 - DNA, 15 bp, Homo sapiens
caggtttcctcattt

SEQ ID NO: 237129 - DNA, 15 bp, Homo sapiens
tcaggtttcctcatt

SEQ ID NO: 237130 - DNA, 15 bp, Homo sapiens
ctcaggtttcctcat

SEQ ID NO: 237131 - DNA, 15 bp, Homo sapiens
cctcaggtttcctca

SEQ ID NO: 237132 - DNA, 15 bp, Homo sapiens
ccctcaggtttcctc

SEQ ID NO: 237133 - DNA, 15 bp, Homo sapiens
gccctcaggtttcct

SEQ ID NO: 237134 - DNA, 15 bp, Homo sapiens
tgccctcaggtttcc

SEQ ID NO: 237135 - DNA, 15 bp, Homo sapiens
ttgccctcaggtttc

SEQ ID NO: 237136 - DNA, 15 bp, Homo sapiens
tttgccctcaggttt

SEQ ID NO: 237137 - DNA, 15 bp, Homo sapiens
ctttgccctcaggtt

SEQ ID NO: 237138 - DNA, 15 bp, Homo sapiens
gctttgccctcaggt

SEQ ID NO: 237139 - DNA, 15 bp, Homo sapiens
agctttgccctcagg

SEQ ID NO: 237140 - DNA, 15 bp, Homo sapiens
tagctttgccctcag

SEQ ID NO: 237141 - DNA, 15 bp, Homo sapiens
ttagctttgccctca

SEQ ID NO: 237142 - DNA, 15 bp, Homo sapiens
attagctttgccctc

SEQ ID NO: 237143 - DNA, 15 bp, Homo sapiens
cattagctttgccct

SEQ ID NO: 237144 - DNA, 15 bp, Homo sapiens
ccattagctttgccc

SEQ ID NO: 237145 - DNA, 15 bp, Homo sapiens
cccattagctttgcc

SEQ ID NO: 237146 - DNA, 15 bp, Homo sapiens
tcccattagctttgc

SEQ ID NO: 237147 - DNA, 15 bp, Homo sapiens
atcccattagctttg

SEQ ID NO: 237148 - DNA, 15 bp, Homo sapiens
catcccattagcttt

SEQ ID NO: 237149 - DNA, 15 bp, Homo sapiens
acatcccattagctt

SEQ ID NO: 237150 - DNA, 15 bp, Homo sapiens
aacatcccattagct

SEQ ID NO: 237151 - DNA, 15 bp, Homo sapiens
aaacatcccattagc

SEQ ID NO: 237152 - DNA, 15 bp, Homo sapiens
taaacatcccattag

SEQ ID NO: 237153 - DNA, 15 bp, Homo sapiens
gtaaacatcccatta

SEQ ID NO: 237154 - DNA, 15 bp, Homo sapiens
tgtaaacatcccatt

SEQ ID NO: 237155 - DNA, 15 bp, Homo sapiens
ttgtaaacatcccat

SEQ ID NO: 237156 - DNA, 15 bp, Homo sapiens
gttgtaaacatccca

SEQ ID NO: 237157 - DNA, 15 bp, Homo sapiens
tgttgtaaacatccc

SEQ ID NO: 237158 - DNA, 15 bp, Homo sapiens
gtgttgtaaacatcc

SEQ ID NO: 237159 - DNA, 15 bp, Homo sapiens
ggtgttgtaaacatc

SEQ ID NO: 237160 - DNA, 15 bp, Homo sapiens
aggtgttgtaaacat

SEQ ID NO: 237161 - DNA, 15 bp, Homo sapiens
taggtgttgtaaaca

SEQ ID NO: 237162 - DNA, 15 bp, Homo sapiens
gtaggtgttgtaaac

SEQ ID NO: 237163 - DNA, 15 bp, Homo sapiens
agtaggtgttgtaaa

SEQ ID NO: 237164 - DNA, 15 bp, Homo sapiens
tagtaggtgttgtaa

SEQ ID NO: 237165 - DNA, 15 bp, Homo sapiens
gtagtaggtgttgta

SEQ ID NO: 237166 - DNA, 15 bp, Homo sapiens
agtagtaggtgttgt

SEQ ID NO: 237167 - DNA, 15 bp, Homo sapiens
aagtagtaggtgttg

SEQ ID NO: 237168 - DNA, 15 bp, Homo sapiens
gaagtagtaggtgtt

SEQ ID NO: 237169 - DNA, 15 bp, Homo sapiens
agaagtagtaggtgt

SEQ ID NO: 237170 - DNA, 15 bp, Homo sapiens
tagaagtagtaggtg

SEQ ID NO: 237171 - DNA, 15 bp, Homo sapiens
ttagaagtagtaggt

SEQ ID NO: 237172 - DNA, 15 bp, Homo sapiens
tttagaagtagtagg

SEQ ID NO: 237173 - DNA, 15 bp, Homo sapiens
atttagaagtagtag

SEQ ID NO: 237174 - DNA, 15 bp, Homo sapiens
aatttagaagtagta

SEQ ID NO: 237175 - DNA, 15 bp, Homo sapiens
aaatttagaagtagt

SEQ ID NO: 237176 - DNA, 15 bp, Homo sapiens
taaatttagaagtag

SEQ ID NO: 237177 - DNA, 15 bp, Homo sapiens
ctaaatttagaagta

SEQ ID NO: 237178 - DNA, 15 bp, Homo sapiens
actaaatttagaagt

SEQ ID NO: 237179 - DNA, 15 bp, Homo sapiens
aactaaatttagaag

SEQ ID NO: 237180 - DNA, 15 bp, Homo sapiens
aaactaaatttagaa

SEQ ID NO: 237181 - DNA, 15 bp, Homo sapiens
caaactaaatttaga

SEQ ID NO: 237182 - DNA, 15 bp, Homo sapiens
ccaaactaaatttag

SEQ ID NO: 237183 - DNA, 15 bp, Homo sapiens
accaaactaaattta

SEQ ID NO: 237184 - DNA, 15 bp, Homo sapiens
taccaaactaaattt

SEQ ID NO: 237185 - DNA, 15 bp, Homo sapiens
gtaccaaactaaatt

SEQ ID NO: 237186 - DNA, 15 bp, Homo sapiens
tgtaccaaactaaat

SEQ ID NO: 237187 - DNA, 15 bp, Homo sapiens
atgtaccaaactaaa

SEQ ID NO: 237188 - DNA, 15 bp, Homo sapiens
aatgtaccaaactaa

SEQ ID NO: 237189 - DNA, 15 bp, Homo sapiens
taatgtaccaaacta

SEQ ID NO: 237190 - DNA, 15 bp, Homo sapiens
ataatgtaccaaact

SEQ ID NO: 237191 - DNA, 15 bp, Homo sapiens
aataatgtaccaaac

SEQ ID NO: 237192 - DNA, 15 bp, Homo sapiens
taataatgtaccaaa

SEQ ID NO: 237193 - DNA, 15 bp, Homo sapiens
ttaataatgtaccaa

SEQ ID NO: 237194 - DNA, 15 bp, Homo sapiens
gttaataatgtacca

SEQ ID NO: 237195 - DNA, 15 bp, Homo sapiens
agttaataatgtacc

SEQ ID NO: 237196 - DNA, 15 bp, Homo sapiens
tagttaataatgtac

SEQ ID NO: 237197 - DNA, 15 bp, Homo sapiens
atagttaataatgta

SEQ ID NO: 237198 - DNA, 15 bp, Homo sapiens
tatagttaataatgt

SEQ ID NO: 237199 - DNA, 15 bp, Homo sapiens
ttatagttaataatg

SEQ ID NO: 237200 - DNA, 15 bp, Homo sapiens
attatagttaataat

SEQ ID NO: 237201 - DNA, 15 bp, Homo sapiens
aattatagttaataa

SEQ ID NO: 237202 - DNA, 15 bp, Homo sapiens
aaattatagttaata

SEQ ID NO: 237203 - DNA, 15 bp, Homo sapiens
aaaattatagttaat

SEQ ID NO: 237204 - DNA, 15 bp, Homo sapiens
caaaattatagttaa

SEQ ID NO: 237205 - DNA, 15 bp, Homo sapiens
acaaaattatagtta

SEQ ID NO: 237206 - DNA, 15 bp, Homo sapiens
cacaaaattatagtt

SEQ ID NO: 237207 - DNA, 15 bp, Homo sapiens
ccacaaaattatagt

SEQ ID NO: 237208 - DNA, 15 bp, Homo sapiens
gccacaaaattatag

SEQ ID NO: 237209 - DNA, 15 bp, Homo sapiens
ggccacaaaattata

SEQ ID NO: 237210 - DNA, 15 bp, Homo sapiens
tggccacaaaattat

SEQ ID NO: 237211 - DNA, 15 bp, Homo sapiens
ttggccacaaaatta

SEQ ID NO: 237212 - DNA, 15 bp, Homo sapiens
attggccacaaaatt

SEQ ID NO: 237213 - DNA, 15 bp, Homo sapiens
aattggccacaaaat

SEQ ID NO: 237214 - DNA, 15 bp, Homo sapiens
aaattggccacaaaa

SEQ ID NO: 237215 - DNA, 15 bp, Homo sapiens
taaattggccacaaa

SEQ ID NO: 237216 - DNA, 15 bp, Homo sapiens
ttaaattggccacaa

SEQ ID NO: 237217 - DNA, 15 bp, Homo sapiens
tttaaattggccaca

SEQ ID NO: 237218 - DNA, 15 bp, Homo sapiens
atttaaattggccac

SEQ ID NO: 237219 - DNA, 15 bp, Homo sapiens
aatttaaattggcca

SEQ ID NO: 237220 - DNA, 15 bp, Homo sapiens
aaatttaaattggcc

SEQ ID NO: 237221 - DNA, 15 bp, Homo sapiens
taaatttaaattggc

SEQ ID NO: 237222 - DNA, 15 bp, Homo sapiens
ttaaatttaaattgg

SEQ ID NO: 237223 - DNA, 15 bp, Homo sapiens
tttaaatttaaattg

SEQ ID NO: 237224 - DNA, 15 bp, Homo sapiens
gtttaaatttaaatt

SEQ ID NO: 237225 - DNA, 15 bp, Homo sapiens
agtttaaatttaaat

SEQ ID NO: 237226 - DNA, 15 bp, Homo sapiens
cagtttaaatttaaa

SEQ ID NO: 237227 - DNA, 15 bp, Homo sapiens
acagtttaaatttaa

SEQ ID NO: 237228 - DNA, 15 bp, Homo sapiens
aacagtttaaattta

SEQ ID NO: 237229 - DNA, 15 bp, Homo sapiens
aaacagtttaaattt

SEQ ID NO: 237230 - DNA, 15 bp, Homo sapiens
aaaacagtttaaatt

SEQ ID NO: 237231 - DNA, 15 bp, Homo sapiens
gaaaacagtttaaat

SEQ ID NO: 237232 - DNA, 15 bp, Homo sapiens
agaaaacagtttaaa

SEQ ID NO: 237233 - DNA, 15 bp, Homo sapiens
aagaaaacagtttaa

SEQ ID NO: 237234 - DNA, 15 bp, Homo sapiens
aaagaaaacagttta

SEQ ID NO: 237235 - DNA, 15 bp, Homo sapiens
aaaagaaaacagttt

SEQ ID NO: 237236 - DNA, 15 bp, Homo sapiens
taaaagaaaacagtt

SEQ ID NO: 237237 - DNA, 15 bp, Homo sapiens
ttaaaagaaaacagt

SEQ ID NO: 237238 - DNA, 15 bp, Homo sapiens
attaaaagaaaacag

SEQ ID NO: 237239 - DNA, 15 bp, Homo sapiens
tattaaaagaaaaca

SEQ ID NO: 237240 - DNA, 15 bp, Homo sapiens
atattaaaagaaaac

SEQ ID NO: 237241 - DNA, 15 bp, Homo sapiens
gatattaaaagaaaa

SEQ ID NO: 237242 - DNA, 15 bp, Homo sapiens
ggatattaaaagaaa

SEQ ID NO: 237243 - DNA, 15 bp, Homo sapiens
gggatattaaaagaa

SEQ ID NO: 237244 - DNA, 15 bp, Homo sapiens
tgggatattaaaaga

SEQ ID NO: 237245 - DNA, 15 bp, Homo sapiens
ctgggatattaaaag

SEQ ID NO: 237246 - DNA, 15 bp, Homo sapiens
actgggatattaaaa

SEQ ID NO: 237247 - DNA, 15 bp, Homo sapiens
aactgggatattaaa

SEQ ID NO: 237248 - DNA, 15 bp, Homo sapiens
gaactgggatattaa

SEQ ID NO: 237249 - DNA, 15 bp, Homo sapiens
ggaactgggatatta

SEQ ID NO: 237250 - DNA, 15 bp, Homo sapiens
tggaactgggatatt

SEQ ID NO: 237251 - DNA, 15 bp, Homo sapiens
atggaactgggatat

SEQ ID NO: 237252 - DNA, 15 bp, Homo sapiens
aatggaactgggata

SEQ ID NO: 237253 - DNA, 15 bp, Homo sapiens
taatggaactgggat

SEQ ID NO: 237254 - DNA, 15 bp, Homo sapiens
ataatggaactggga

SEQ ID NO: 237255 - DNA, 15 bp, Homo sapiens
gataatggaactggg

SEQ ID NO: 237256 - DNA, 15 bp, Homo sapiens
ggataatggaactgg

SEQ ID NO: 237257 - DNA, 15 bp, Homo sapiens
tggataatggaactg

SEQ ID NO: 237258 - DNA, 15 bp, Homo sapiens
atggataatggaact

SEQ ID NO: 237259 - DNA, 15 bp, Homo sapiens
aatggataatggaac

SEQ ID NO: 237260 - DNA, 15 bp, Homo sapiens
gaatggataatggaa

SEQ ID NO: 237261 - DNA, 15 bp, Homo sapiens
agaatggataatgga

SEQ ID NO: 237262 - DNA, 15 bp, Homo sapiens
cagaatggataatgg

SEQ ID NO: 237263 - DNA, 15 bp, Homo sapiens
acagaatggataatg

SEQ ID NO: 237264 - DNA, 15 bp, Homo sapiens
cacagaatggataat

SEQ ID NO: 237265 - DNA, 15 bp, Homo sapiens
acacagaatggataa

SEQ ID NO: 237266 - DNA, 15 bp, Homo sapiens
aacacagaatggata

SEQ ID NO: 237267 - DNA, 15 bp, Homo sapiens
taacacagaatggat

SEQ ID NO: 237268 - DNA, 15 bp, Homo sapiens
ctaacacagaatgga

SEQ ID NO: 237269 - DNA, 15 bp, Homo sapiens
gctaacacagaatgg

SEQ ID NO: 237270 - DNA, 15 bp, Homo sapiens
agctaacacagaatg

SEQ ID NO: 237271 - DNA, 15 bp, Homo sapiens
aagctaacacagaat

SEQ ID NO: 237272 - DNA, 15 bp, Homo sapiens
taagctaacacagaa

SEQ ID NO: 237273 - DNA, 15 bp, Homo sapiens
ttaagctaacacaga

SEQ ID NO: 237274 - DNA, 15 bp, Homo sapiens
attaagctaacacag

SEQ ID NO: 237275 - DNA, 15 bp, Homo sapiens
tattaagctaacaca

SEQ ID NO: 237276 - DNA, 15 bp, Homo sapiens
atattaagctaacac

SEQ ID NO: 237277 - DNA, 15 bp, Homo sapiens
aatattaagctaaca

SEQ ID NO: 237278 - DNA, 15 bp, Homo sapiens
caatattaagctaac

SEQ ID NO: 237279 - DNA, 15 bp, Homo sapiens
gcaatattaagctaa

SEQ ID NO: 237280 - DNA, 15 bp, Homo sapiens
agcaatattaagcta

SEQ ID NO: 237281 - DNA, 15 bp, Homo sapiens
gagcaatattaagct

SEQ ID NO: 237282 - DNA, 15 bp, Homo sapiens
tgagcaatattaagc

SEQ ID NO: 237283 - DNA, 15 bp, Homo sapiens
ttgagcaatattaag

SEQ ID NO: 237284 - DNA, 15 bp, Homo sapiens
tttgagcaatattaa

SEQ ID NO: 237285 - DNA, 15 bp, Homo sapiens
atttgagcaatatta

SEQ ID NO: 237286 - DNA, 15 bp, Homo sapiens
tatttgagcaatatt

SEQ ID NO: 237287 - DNA, 15 bp, Homo sapiens
atatttgagcaatat

SEQ ID NO: 237288 - DNA, 15 bp, Homo sapiens
gatatttgagcaata

SEQ ID NO: 237289 - DNA, 15 bp, Homo sapiens
tgatatttgagcaat

SEQ ID NO: 237290 - DNA, 15 bp, Homo sapiens
atgatatttgagcaa

SEQ ID NO: 237291 - DNA, 15 bp, Homo sapiens
aatgatatttgagca

SEQ ID NO: 237292 - DNA, 15 bp, Homo sapiens
aaatgatatttgagc

SEQ ID NO: 237293 - DNA, 15 bp, Homo sapiens
aaaatgatatttgag

SEQ ID NO: 237294 - DNA, 15 bp, Homo sapiens
aaaaatgatatttga

SEQ ID NO: 237295 - DNA, 15 bp, Homo sapiens
caaaaatgatatttg

SEQ ID NO: 237296 - DNA, 15 bp, Homo sapiens
acaaaaatgatattt

SEQ ID NO: 237297 - DNA, 15 bp, Homo sapiens
cacaaaaatgatatt

SEQ ID NO: 237298 - DNA, 15 bp, Homo sapiens
ccacaaaaatgatat

SEQ ID NO: 237299 - DNA, 15 bp, Homo sapiens
cccacaaaaatgata

SEQ ID NO: 237300 - DNA, 15 bp, Homo sapiens
gcccacaaaaatgat

SEQ ID NO: 237301 - DNA, 15 bp, Homo sapiens
ggcccacaaaaatga

SEQ ID NO: 237302 - DNA, 15 bp, Homo sapiens
aggcccacaaaaatg

SEQ ID NO: 237303 - DNA, 15 bp, Homo sapiens
aaggcccacaaaaat

SEQ ID NO: 237304 - DNA, 15 bp, Homo sapiens
aaaggcccacaaaaa

SEQ ID NO: 237305 - DNA, 15 bp, Homo sapiens
caaaggcccacaaaa

SEQ ID NO: 237306 - DNA, 15 bp, Homo sapiens
acaaaggcccacaaa

SEQ ID NO: 237307 - DNA, 15 bp, Homo sapiens
gacaaaggcccacaa

SEQ ID NO: 237308 - DNA, 15 bp, Homo sapiens
tgacaaaggcccaca

SEQ ID NO: 237309 - DNA, 15 bp, Homo sapiens
ttgacaaaggcccac

SEQ ID NO: 237310 - DNA, 15 bp, Homo sapiens
attgacaaaggccca

SEQ ID NO: 237311 - DNA, 15 bp, Homo sapiens
tattgacaaaggccc

SEQ ID NO: 237312 - DNA, 15 bp, Homo sapiens
ctattgacaaaggcc

SEQ ID NO: 237313 - DNA, 15 bp, Homo sapiens
tctattgacaaaggc

SEQ ID NO: 237314 - DNA, 15 bp, Homo sapiens
ttctattgacaaagg

SEQ ID NO: 237315 - DNA, 15 bp, Homo sapiens
tttctattgacaaag

SEQ ID NO: 237316 - DNA, 15 bp, Homo sapiens
atttctattgacaaa

SEQ ID NO: 237317 - DNA, 15 bp, Homo sapiens
aatttctattgacaa

SEQ ID NO: 237318 - DNA, 15 bp, Homo sapiens
taatttctattgaca

SEQ ID NO: 237319 - DNA, 15 bp, Homo sapiens
ttaatttctattgac

SEQ ID NO: 237320 - DNA, 15 bp, Homo sapiens
attaatttctattga

SEQ ID NO: 237321 - DNA, 15 bp, Homo sapiens
aattaatttctattg

SEQ ID NO: 237322 - DNA, 15 bp, Homo sapiens
gaattaatttctatt

SEQ ID NO: 237323 - DNA, 15 bp, Homo sapiens
agaattaatttctat

SEQ ID NO: 237324 - DNA, 15 bp, Homo sapiens
cagaattaatttcta

SEQ ID NO: 237325 - DNA, 15 bp, Homo sapiens
acagaattaatttct

SEQ ID NO: 237326 - DNA, 15 bp, Homo sapiens
gacagaattaatttc

SEQ ID NO: 237327 - DNA, 15 bp, Homo sapiens
agacagaattaattt

SEQ ID NO: 237328 - DNA, 15 bp, Homo sapiens
gagacagaattaatt

SEQ ID NO: 237329 - DNA, 15 bp, Homo sapiens
agagacagaattaat

SEQ ID NO: 237330 - DNA, 15 bp, Homo sapiens
gagagacagaattaa

SEQ ID NO: 237331 - DNA, 15 bp, Homo sapiens
agagagacagaatta

SEQ ID NO: 237332 - DNA, 15 bp, Homo sapiens
aagagagacagaatt

SEQ ID NO: 237333 - DNA, 15 bp, Homo sapiens
caagagagacagaat

SEQ ID NO: 237334 - DNA, 15 bp, Homo sapiens
ccaagagagacagaa

SEQ ID NO: 237335 - DNA, 15 bp, Homo sapiens
tccaagagagacaga

SEQ ID NO: 237336 - DNA, 15 bp, Homo sapiens
atccaagagagacag

SEQ ID NO: 237337 - DNA, 15 bp, Homo sapiens
aatccaagagagaca

SEQ ID NO: 237338 - DNA, 15 bp, Homo sapiens
caatccaagagagac

SEQ ID NO: 237339 - DNA, 15 bp, Homo sapiens
gcaatccaagagaga

SEQ ID NO: 237340 - DNA, 15 bp, Homo sapiens
tgcaatccaagagag

SEQ ID NO: 237341 - DNA, 15 bp, Homo sapiens
ttgcaatccaagaga

SEQ ID NO: 237342 - DNA, 15 bp, Homo sapiens
cttgcaatccaagag

SEQ ID NO: 237343 - DNA, 15 bp, Homo sapiens
acttgcaatccaaga

SEQ ID NO: 237344 - DNA, 15 bp, Homo sapiens
aacttgcaatccaag

SEQ ID NO: 237345 - DNA, 15 bp, Homo sapiens
gaacttgcaatccaa

SEQ ID NO: 237346 - DNA, 15 bp, Homo sapiens
agaacttgcaatcca

SEQ ID NO: 237347 - DNA, 15 bp, Homo sapiens
cagaacttgcaatcc

SEQ ID NO: 237348 - DNA, 15 bp, Homo sapiens
acagaacttgcaatc

SEQ ID NO: 237349 - DNA, 15 bp, Homo sapiens
cacagaacttgcaat

SEQ ID NO: 237350 - DNA, 15 bp, Homo sapiens
gcacagaacttgcaa

SEQ ID NO: 237351 - DNA, 15 bp, Homo sapiens
agcacagaacttgca

SEQ ID NO: 237352 - DNA, 15 bp, Homo sapiens
cagcacagaacttgc

SEQ ID NO: 237353 - DNA, 15 bp, Homo sapiens
tcagcacagaacttg

SEQ ID NO: 237354 - DNA, 15 bp, Homo sapiens
ttcagcacagaactt

SEQ ID NO: 237355 - DNA, 15 bp, Homo sapiens
attcagcacagaact

SEQ ID NO: 237356 - DNA, 15 bp, Homo sapiens
tattcagcacagaac

SEQ ID NO: 237357 - DNA, 15 bp, Homo sapiens
ctattcagcacagaa

SEQ ID NO: 237358 - DNA, 15 bp, Homo sapiens
actattcagcacaga

SEQ ID NO: 237359 - DNA, 15 bp, Homo sapiens
cactattcagcacag

SEQ ID NO: 237360 - DNA, 15 bp, Homo sapiens
tcactattcagcaca

SEQ ID NO: 237361 - DNA, 15 bp, Homo sapiens
ctcactattcagcac

SEQ ID NO: 237362 - DNA, 15 bp, Homo sapiens
cctcactattcagca

SEQ ID NO: 237363 - DNA, 15 bp, Homo sapiens
ccctcactattcagc

SEQ ID NO: 237364 - DNA, 15 bp, Homo sapiens
accctcactattcag

SEQ ID NO: 237365 - DNA, 15 bp, Homo sapiens
gaccctcactattca

SEQ ID NO: 237366 - DNA, 15 bp, Homo sapiens
agaccctcactattc

SEQ ID NO: 237367 - DNA, 15 bp, Homo sapiens
tagaccctcactatt

SEQ ID NO: 237368 - DNA, 15 bp, Homo sapiens
atagaccctcactat

SEQ ID NO: 237369 - DNA, 15 bp, Homo sapiens
aatagaccctcacta

SEQ ID NO: 237370 - DNA, 15 bp, Homo sapiens
gaatagaccctcact

SEQ ID NO: 237371 - DNA, 15 bp, Homo sapiens
ggaatagaccctcac

SEQ ID NO: 237372 - DNA, 15 bp, Homo sapiens
gggaatagaccctca

SEQ ID NO: 237373 - DNA, 15 bp, Homo sapiens
tgggaatagaccctc

SEQ ID NO: 237374 - DNA, 15 bp, Homo sapiens
ttgggaatagaccct

SEQ ID NO: 237375 - DNA, 15 bp, Homo sapiens
cttgggaatagaccc

SEQ ID NO: 237376 - DNA, 15 bp, Homo sapiens
gcttgggaatagacc

SEQ ID NO: 237377 - DNA, 15 bp, Homo sapiens
tgcttgggaatagac

SEQ ID NO: 237378 - DNA, 15 bp, Homo sapiens
ctgcttgggaataga

SEQ ID NO: 237379 - DNA, 15 bp, Homo sapiens
gctgcttgggaatag

SEQ ID NO: 237380 - DNA, 15 bp, Homo sapiens
agctgcttgggaata

SEQ ID NO: 237381 - DNA, 15 bp, Homo sapiens
aagctgcttgggaat

SEQ ID NO: 237382 - DNA, 15 bp, Homo sapiens
gaagctgcttgggaa

SEQ ID NO: 237383 - DNA, 15 bp, Homo sapiens
ggaagctgcttggga

SEQ ID NO: 237384 - DNA, 15 bp, Homo sapiens
tggaagctgcttggg

SEQ ID NO: 237385 - DNA, 15 bp, Homo sapiens
atggaagctgcttgg

SEQ ID NO: 237386 - DNA, 15 bp, Homo sapiens
aatggaagctgcttg

SEQ ID NO: 237387 - DNA, 15 bp, Homo sapiens
gaatggaagctgctt

SEQ ID NO: 237388 - DNA, 15 bp, Homo sapiens
agaatggaagctgct

SEQ ID NO: 237389 - DNA, 15 bp, Homo sapiens
aagaatggaagctgc

SEQ ID NO: 237390 - DNA, 15 bp, Homo sapiens
aaagaatggaagctg

SEQ ID NO: 237391 - DNA, 15 bp, Homo sapiens
taaagaatggaagct

SEQ ID NO: 237392 - DNA, 15 bp, Homo sapiens
gtaaagaatggaagc

SEQ ID NO: 237393 - DNA, 15 bp, Homo sapiens
agtaaagaatggaag

SEQ ID NO: 237394 - DNA, 15 bp, Homo sapiens
cagtaaagaatggaa

SEQ ID NO: 237395 - DNA, 15 bp, Homo sapiens
ccagtaaagaatgga

SEQ ID NO: 237396 - DNA, 15 bp, Homo sapiens
cccagtaaagaatgg

SEQ ID NO: 237397 - DNA, 15 bp, Homo sapiens
tcccagtaaagaatg

SEQ ID NO: 237398 - DNA, 15 bp, Homo sapiens
ttcccagtaaagaat

SEQ ID NO: 237399 - DNA, 15 bp, Homo sapiens
gttcccagtaaagaa

SEQ ID NO: 237400 - DNA, 15 bp, Homo sapiens
cgttcccagtaaaga

SEQ ID NO: 237401 - DNA, 15 bp, Homo sapiens
acgttcccagtaaag

SEQ ID NO: 237402 - DNA, 15 bp, Homo sapiens
gacgttcccagtaaa

SEQ ID NO: 237403 - DNA, 15 bp, Homo sapiens
tgacgttcccagtaa

SEQ ID NO: 237404 - DNA, 15 bp, Homo sapiens
ttgacgttcccagta

SEQ ID NO: 237405 - DNA, 15 bp, Homo sapiens
cttgacgttcccagt

SEQ ID NO: 237406 - DNA, 15 bp, Homo sapiens
tcttgacgttcccag

SEQ ID NO: 237407 - DNA, 15 bp, Homo sapiens
ttcttgacgttccca

SEQ ID NO: 237408 - DNA, 15 bp, Homo sapiens
attcttgacgttccc

SEQ ID NO: 237409 - DNA, 15 bp, Homo sapiens
cattcttgacgttcc

SEQ ID NO: 237410 - DNA, 15 bp, Homo sapiens
acattcttgacgttc

SEQ ID NO: 237411 - DNA, 15 bp, Homo sapiens
cacattcttgacgtt

SEQ ID NO: 237412 - DNA, 15 bp, Homo sapiens
ccacattcttgacgt

SEQ ID NO: 237413 - DNA, 15 bp, Homo sapiens
tccacattcttgacg

SEQ ID NO: 237414 - DNA, 15 bp, Homo sapiens
atccacattcttgac

SEQ ID NO: 237415 - DNA, 15 bp, Homo sapiens
catccacattcttga

SEQ ID NO: 237416 - DNA, 15 bp, Homo sapiens
gcatccacattcttg

SEQ ID NO: 237417 - DNA, 15 bp, Homo sapiens
agcatccacattctt

SEQ ID NO: 237418 - DNA, 15 bp, Homo sapiens
gagcatccacattct

SEQ ID NO: 237419 - DNA, 15 bp, Homo sapiens
tgagcatccacattc

SEQ ID NO: 237420 - DNA, 15 bp, Homo sapiens
atgagcatccacatt

SEQ ID NO: 237421 - DNA, 15 bp, Homo sapiens
tatgagcatccacat

SEQ ID NO: 237422 - DNA, 15 bp, Homo sapiens
ttatgagcatccaca

SEQ ID NO: 237423 - DNA, 15 bp, Homo sapiens
attatgagcatccac

SEQ ID NO: 237424 - DNA, 15 bp, Homo sapiens
aattatgagcatcca

SEQ ID NO: 237425 - DNA, 15 bp, Homo sapiens
taattatgagcatcc

SEQ ID NO: 237426 - DNA, 15 bp, Homo sapiens
gtaattatgagcatc

SEQ ID NO: 237427 - DNA, 15 bp, Homo sapiens
tgtaattatgagcat

SEQ ID NO: 237428 - DNA, 15 bp, Homo sapiens
ttgtaattatgagca

SEQ ID NO: 237429 - DNA, 15 bp, Homo sapiens
attgtaattatgagc

SEQ ID NO: 237430 - DNA, 15 bp, Homo sapiens
aattgtaattatgag

SEQ ID NO: 237431 - DNA, 15 bp, Homo sapiens
aaattgtaattatga

SEQ ID NO: 237432 - DNA, 15 bp, Homo sapiens
gaaattgtaattatg

SEQ ID NO: 237433 - DNA, 15 bp, Homo sapiens
agaaattgtaattat

SEQ ID NO: 237434 - DNA, 15 bp, Homo sapiens
tagaaattgtaatta

SEQ ID NO: 237435 - DNA, 15 bp, Homo sapiens
ttagaaattgtaatt

SEQ ID NO: 237436 - DNA, 15 bp, Homo sapiens
cttagaaattgtaat

SEQ ID NO: 237437 - DNA, 15 bp, Homo sapiens
acttagaaattgtaa

SEQ ID NO: 237438 - DNA, 15 bp, Homo sapiens
cacttagaaattgta

SEQ ID NO: 237439 - DNA, 15 bp, Homo sapiens
gcacttagaaattgt

SEQ ID NO: 237440 - DNA, 15 bp, Homo sapiens
agcacttagaaattg

SEQ ID NO: 237441 - DNA, 15 bp, Homo sapiens
gagcacttagaaatt

SEQ ID NO: 237442 - DNA, 15 bp, Homo sapiens
agagcacttagaaat

SEQ ID NO: 237443 - DNA, 15 bp, Homo sapiens
aagagcacttagaaa

SEQ ID NO: 237444 - DNA, 15 bp, Homo sapiens
taagagcacttagaa

SEQ ID NO: 237445 - DNA, 15 bp, Homo sapiens
ctaagagcacttaga

SEQ ID NO: 237446 - DNA, 15 bp, Homo sapiens
actaagagcacttag

SEQ ID NO: 237447 - DNA, 15 bp, Homo sapiens
tactaagagcactta

SEQ ID NO: 237448 - DNA, 15 bp, Homo sapiens
ttactaagagcactt

SEQ ID NO: 237449 - DNA, 15 bp, Homo sapiens
cttactaagagcact

SEQ ID NO: 237450 - DNA, 15 bp, Homo sapiens
acttactaagagcac

SEQ ID NO: 237451 - DNA, 15 bp, Homo sapiens
aacttactaagagca

SEQ ID NO: 237452 - DNA, 15 bp, Homo sapiens
caacttactaagagc

SEQ ID NO: 237453 - DNA, 15 bp, Homo sapiens
acaacttactaagag

SEQ ID NO: 237454 - DNA, 15 bp, Homo sapiens
aacaacttactaaga

SEQ ID NO: 237455 - DNA, 15 bp, Homo sapiens
aaacaacttactaag

SEQ ID NO: 237456 - DNA, 15 bp, Homo sapiens
aaaacaacttactaa

SEQ ID NO: 237457 - DNA, 15 bp, Homo sapiens
taaaacaacttacta

SEQ ID NO: 237458 - DNA, 15 bp, Homo sapiens
ttaaaacaacttact

SEQ ID NO: 237459 - DNA, 15 bp, Homo sapiens
attaaaacaacttac

SEQ ID NO: 237460 - DNA, 15 bp, Homo sapiens
cattaaaacaactta

SEQ ID NO: 237461 - DNA, 15 bp, Homo sapiens
tcattaaaacaactt

SEQ ID NO: 237462 - DNA, 15 bp, Homo sapiens
atcattaaaacaact

SEQ ID NO: 237463 - DNA, 15 bp, Homo sapiens
aatcattaaaacaac

SEQ ID NO: 237464 - DNA, 15 bp, Homo sapiens
gaatcattaaaacaa

SEQ ID NO: 237465 - DNA, 15 bp, Homo sapiens
agaatcattaaaaca

SEQ ID NO: 237466 - DNA, 15 bp, Homo sapiens
tagaatcattaaaac

SEQ ID NO: 237467 - DNA, 15 bp, Homo sapiens
ctagaatcattaaaa

SEQ ID NO: 237468 - DNA, 15 bp, Homo sapiens
tctagaatcattaaa

SEQ ID NO: 237469 - DNA, 15 bp, Homo sapiens
gtctagaatcattaa

SEQ ID NO: 237470 - DNA, 15 bp, Homo sapiens
ggtctagaatcatta

SEQ ID NO: 237471 - DNA, 15 bp, Homo sapiens
aggtctagaatcatt

SEQ ID NO: 237472 - DNA, 15 bp, Homo sapiens
aaggtctagaatcat

SEQ ID NO: 237473 - DNA, 15 bp, Homo sapiens
caaggtctagaatca

SEQ ID NO: 237474 - DNA, 15 bp, Homo sapiens
gcaaggtctagaatc

SEQ ID NO: 237475 - DNA, 15 bp, Homo sapiens
agcaaggtctagaat

SEQ ID NO: 237476 - DNA, 15 bp, Homo sapiens
gagcaaggtctagaa

SEQ ID NO: 237477 - DNA, 15 bp, Homo sapiens
tgagcaaggtctaga

SEQ ID NO: 237478 - DNA, 15 bp, Homo sapiens
ctgagcaaggtctag

SEQ ID NO: 237479 - DNA, 15 bp, Homo sapiens
tctgagcaaggtcta

SEQ ID NO: 237480 - DNA, 15 bp, Homo sapiens
ctctgagcaaggtct

SEQ ID NO: 237481 - DNA, 15 bp, Homo sapiens
cctctgagcaaggtc

SEQ ID NO: 237482 - DNA, 15 bp, Homo sapiens
acctctgagcaaggt

SEQ ID NO: 237483 - DNA, 15 bp, Homo sapiens
cacctctgagcaagg

SEQ ID NO: 237484 - DNA, 15 bp, Homo sapiens
ccacctctgagcaag

SEQ ID NO: 237485 - DNA, 15 bp, Homo sapiens
gccacctctgagcaa

SEQ ID NO: 237486 - DNA, 15 bp, Homo sapiens
tgccacctctgagca

SEQ ID NO: 237487 - DNA, 15 bp, Homo sapiens
atgccacctctgagc

SEQ ID NO: 237488 - DNA, 15 bp, Homo sapiens
aatgccacctctgag

SEQ ID NO: 237489 - DNA, 15 bp, Homo sapiens
aaatgccacctctga

SEQ ID NO: 237490 - DNA, 15 bp, Homo sapiens
caaatgccacctctg

SEQ ID NO: 237491 - DNA, 15 bp, Homo sapiens
acaaatgccacctct

SEQ ID NO: 237492 - DNA, 15 bp, Homo sapiens
gacaaatgccacctc

SEQ ID NO: 237493 - DNA, 15 bp, Homo sapiens
tgacaaatgccacct

SEQ ID NO: 237494 - DNA, 15 bp, Homo sapiens
ttgacaaatgccacc

SEQ ID NO: 237495 - DNA, 15 bp, Homo sapiens
attgacaaatgccac

SEQ ID NO: 237496 - DNA, 15 bp, Homo sapiens
aattgacaaatgcca

SEQ ID NO: 237497 - DNA, 15 bp, Homo sapiens
gaattgacaaatgcc

SEQ ID NO: 237498 - DNA, 15 bp, Homo sapiens
agaattgacaaatgc

SEQ ID NO: 237499 - DNA, 15 bp, Homo sapiens
tagaattgacaaatg

SEQ ID NO: 237500 - DNA, 15 bp, Homo sapiens
ttagaattgacaaat

SEQ ID NO: 237501 - DNA, 15 bp, Homo sapiens
cttagaattgacaaa

SEQ ID NO: 237502 - DNA, 15 bp, Homo sapiens
tcttagaattgacaa

SEQ ID NO: 237503 - DNA, 15 bp, Homo sapiens
gtcttagaattgaca

SEQ ID NO: 237504 - DNA, 15 bp, Homo sapiens
agtcttagaattgac

SEQ ID NO: 237505 - DNA, 15 bp, Homo sapiens
gagtcttagaattga

SEQ ID NO: 237506 - DNA, 15 bp, Homo sapiens
tgagtcttagaattg

SEQ ID NO: 237507 - DNA, 15 bp, Homo sapiens
atgagtcttagaatt

SEQ ID NO: 237508 - DNA, 15 bp, Homo sapiens
aatgagtcttagaat

SEQ ID NO: 237509 - DNA, 15 bp, Homo sapiens
aaatgagtcttagaa

SEQ ID NO: 237510 - DNA, 15 bp, Homo sapiens
taaatgagtcttaga

SEQ ID NO: 237511 - DNA, 15 bp, Homo sapiens
gtaaatgagtcttag

SEQ ID NO: 237512 - DNA, 15 bp, Homo sapiens
ggtaaatgagtctta

SEQ ID NO: 237513 - DNA, 15 bp, Homo sapiens
aggtaaatgagtctt

SEQ ID NO: 237514 - DNA, 15 bp, Homo sapiens
aaggtaaatgagtct

SEQ ID NO: 237515 - DNA, 15 bp, Homo sapiens
aaaggtaaatgagtc

SEQ ID NO: 237516 - DNA, 15 bp, Homo sapiens
aaaaggtaaatgagt

SEQ ID NO: 237517 - DNA, 15 bp, Homo sapiens
aaaaaggtaaatgag

SEQ ID NO: 237518 - DNA, 15 bp, Homo sapiens
aaaaaaggtaaatga

SEQ ID NO: 237519 - DNA, 15 bp, Homo sapiens
gaaaaaaggtaaatg

SEQ ID NO: 237520 - DNA, 15 bp, Homo sapiens
agaaaaaaggtaaat

SEQ ID NO: 237521 - DNA, 15 bp, Homo sapiens
cagaaaaaaggtaaa

SEQ ID NO: 237522 - DNA, 15 bp, Homo sapiens
acagaaaaaaggtaa

SEQ ID NO: 237523 - DNA, 15 bp, Homo sapiens
tacagaaaaaaggta

SEQ ID NO: 237524 - DNA, 15 bp, Homo sapiens
ctacagaaaaaaggt

SEQ ID NO: 237525 - DNA, 15 bp, Homo sapiens
tctacagaaaaaagg

SEQ ID NO: 237526 - DNA, 15 bp, Homo sapiens
gtctacagaaaaaag

SEQ ID NO: 237527 - DNA, 15 bp, Homo sapiens
agtctacagaaaaaa

SEQ ID NO: 237528 - DNA, 15 bp, Homo sapiens
gagtctacagaaaaa

SEQ ID NO: 237529 - DNA, 15 bp, Homo sapiens
ggagtctacagaaaa

SEQ ID NO: 237530 - DNA, 15 bp, Homo sapiens
tggagtctacagaaa

SEQ ID NO: 237531 - DNA, 15 bp, Homo sapiens
gtggagtctacagaa

SEQ ID NO: 237532 - DNA, 15 bp, Homo sapiens
agtggagtctacaga

SEQ ID NO: 237533 - DNA, 15 bp, Homo sapiens
gagtggagtctacag

SEQ ID NO: 237534 - DNA, 15 bp, Homo sapiens
agagtggagtctaca

SEQ ID NO: 237535 - DNA, 15 bp, Homo sapiens
aagagtggagtctac

SEQ ID NO: 237536 - DNA, 15 bp, Homo sapiens
gaagagtggagtcta

SEQ ID NO: 237537 - DNA, 15 bp, Homo sapiens
ggaagagtggagtct

SEQ ID NO: 237538 - DNA, 15 bp, Homo sapiens
aggaagagtggagtc

SEQ ID NO: 237539 - DNA, 15 bp, Homo sapiens
caggaagagtggagt

SEQ ID NO: 237540 - DNA, 15 bp, Homo sapiens
gcaggaagagtggag

SEQ ID NO: 237541 - DNA, 15 bp, Homo sapiens
ggcaggaagagtgga

SEQ ID NO: 237542 - DNA, 15 bp, Homo sapiens
gggcaggaagagtgg

SEQ ID NO: 237543 - DNA, 15 bp, Homo sapiens
tgggcaggaagagtg

SEQ ID NO: 237544 - DNA, 15 bp, Homo sapiens
ttgggcaggaagagt

SEQ ID NO: 237545 - DNA, 15 bp, Homo sapiens
cttgggcaggaagag

SEQ ID NO: 237546 - DNA, 15 bp, Homo sapiens
gcttgggcaggaaga

SEQ ID NO: 237547 - DNA, 15 bp, Homo sapiens
ggcttgggcaggaag

SEQ ID NO: 237548 - DNA, 15 bp, Homo sapiens
gggcttgggcaggaa

SEQ ID NO: 237549 - DNA, 15 bp, Homo sapiens
agggcttgggcagga

SEQ ID NO: 237550 - DNA, 15 bp, Homo sapiens
tagggcttgggcagg

SEQ ID NO: 237551 - DNA, 15 bp, Homo sapiens
ttagggcttgggcag

SEQ ID NO: 237552 - DNA, 15 bp, Homo sapiens
gttagggcttgggca

SEQ ID NO: 237553 - DNA, 15 bp, Homo sapiens
ggttagggcttgggc

SEQ ID NO: 237554 - DNA, 15 bp, Homo sapiens
tggttagggcttggg

SEQ ID NO: 237555 - DNA, 15 bp, Homo sapiens
gtggttagggcttgg

SEQ ID NO: 237556 - DNA, 15 bp, Homo sapiens
tgtggttagggcttg

SEQ ID NO: 237557 - DNA, 15 bp, Homo sapiens
ctgtggttagggctt

SEQ ID NO: 237558 - DNA, 15 bp, Homo sapiens
tctgtggttagggct

SEQ ID NO: 237559 - DNA, 15 bp, Homo sapiens
gtctgtggttagggc

SEQ ID NO: 237560 - DNA, 15 bp, Homo sapiens
tgtctgtggttaggg

SEQ ID NO: 237561 - DNA, 15 bp, Homo sapiens
ctgtctgtggttagg

SEQ ID NO: 237562 - DNA, 15 bp, Homo sapiens
actgtctgtggttag

SEQ ID NO: 237563 - DNA, 15 bp, Homo sapiens
cactgtctgtggtta

SEQ ID NO: 237564 - DNA, 15 bp, Homo sapiens
tcactgtctgtggtt

SEQ ID NO: 237565 - DNA, 15 bp, Homo sapiens
atcactgtctgtggt

SEQ ID NO: 237566 - DNA, 15 bp, Homo sapiens
aatcactgtctgtgg

SEQ ID NO: 237567 - DNA, 15 bp, Homo sapiens
taatcactgtctgtg

SEQ ID NO: 237568 - DNA, 15 bp, Homo sapiens
ataatcactgtctgt

SEQ ID NO: 237569 - DNA, 15 bp, Homo sapiens
tataatcactgtctg

SEQ ID NO: 237570 - DNA, 15 bp, Homo sapiens
ttataatcactgtct

SEQ ID NO: 237571 - DNA, 15 bp, Homo sapiens
tttataatcactgtc

SEQ ID NO: 237572 - DNA, 15 bp, Homo sapiens
atttataatcactgt

SEQ ID NO: 237573 - DNA, 15 bp, Homo sapiens
catttataatcactg

SEQ ID NO: 237574 - DNA, 15 bp, Homo sapiens
tcatttataatcact

SEQ ID NO: 237575 - DNA, 15 bp, Homo sapiens
atcatttataatcac

SEQ ID NO: 237576 - DNA, 15 bp, Homo sapiens
aatcatttataatca

SEQ ID NO: 237577 - DNA, 15 bp, Homo sapiens
aaatcatttataatc

SEQ ID NO: 237578 - DNA, 15 bp, Homo sapiens
aaaatcatttataat

SEQ ID NO: 237579 - DNA, 15 bp, Homo sapiens
caaaatcatttataa

SEQ ID NO: 237580 - DNA, 15 bp, Homo sapiens
tcaaaatcatttata

SEQ ID NO: 237581 - DNA, 15 bp, Homo sapiens
gtcaaaatcatttat

SEQ ID NO: 237582 - DNA, 15 bp, Homo sapiens
tgtcaaaatcattta

SEQ ID NO: 237583 - DNA, 15 bp, Homo sapiens
ctgtcaaaatcattt

SEQ ID NO: 237584 - DNA, 15 bp, Homo sapiens
cctgtcaaaatcatt

SEQ ID NO: 237585 - DNA, 15 bp, Homo sapiens
ccctgtcaaaatcat

SEQ ID NO: 237586 - DNA, 15 bp, Homo sapiens
tccctgtcaaaatca

SEQ ID NO: 237587 - DNA, 15 bp, Homo sapiens
atccctgtcaaaatc

SEQ ID NO: 237588 - DNA, 15 bp, Homo sapiens
tatccctgtcaaaat

SEQ ID NO: 237589 - DNA, 15 bp, Homo sapiens
ctatccctgtcaaaa

SEQ ID NO: 237590 - DNA, 15 bp, Homo sapiens
tctatccctgtcaaa

SEQ ID NO: 237591 - DNA, 15 bp, Homo sapiens
atctatccctgtcaa

SEQ ID NO: 237592 - DNA, 15 bp, Homo sapiens
gatctatccctgtca

SEQ ID NO: 237593 - DNA, 15 bp, Homo sapiens
agatctatccctgtc

SEQ ID NO: 237594 - DNA, 15 bp, Homo sapiens
aagatctatccctgt

SEQ ID NO: 237595 - DNA, 15 bp, Homo sapiens
taagatctatccctg

SEQ ID NO: 237596 - DNA, 15 bp, Homo sapiens
gtaagatctatccct

SEQ ID NO: 237597 - DNA, 15 bp, Homo sapiens
ggtaagatctatccc

SEQ ID NO: 237598 - DNA, 15 bp, Homo sapiens
aggtaagatctatcc

SEQ ID NO: 237599 - DNA, 15 bp, Homo sapiens
gaggtaagatctatc

SEQ ID NO: 237600 - DNA, 15 bp, Homo sapiens
agaggtaagatctat

SEQ ID NO: 237601 - DNA, 15 bp, Homo sapiens
aagaggtaagatcta

SEQ ID NO: 237602 - DNA, 15 bp, Homo sapiens
caagaggtaagatct

SEQ ID NO: 237603 - DNA, 15 bp, Homo sapiens
tcaagaggtaagatc

SEQ ID NO: 237604 - DNA, 15 bp, Homo sapiens
ctcaagaggtaagat

SEQ ID NO: 237605 - DNA, 15 bp, Homo sapiens
actcaagaggtaaga

SEQ ID NO: 237606 - DNA, 15 bp, Homo sapiens
gactcaagaggtaag

SEQ ID NO: 237607 - DNA, 15 bp, Homo sapiens
agactcaagaggtaa

SEQ ID NO: 237608 - DNA, 15 bp, Homo sapiens
cagactcaagaggta

SEQ ID NO: 237609 - DNA, 15 bp, Homo sapiens
acagactcaagaggt

SEQ ID NO: 237610 - DNA, 15 bp, Homo sapiens
tacagactcaagagg

SEQ ID NO: 237611 - DNA, 15 bp, Homo sapiens
ttacagactcaagag

SEQ ID NO: 237612 - DNA, 15 bp, Homo sapiens
attacagactcaaga

SEQ ID NO: 237613 - DNA, 15 bp, Homo sapiens
tattacagactcaag

SEQ ID NO: 237614 - DNA, 15 bp, Homo sapiens
ctattacagactcaa

SEQ ID NO: 237615 - DNA, 15 bp, Homo sapiens
cctattacagactca

SEQ ID NO: 237616 - DNA, 15 bp, Homo sapiens
gcctattacagactc

SEQ ID NO: 237617 - DNA, 15 bp, Homo sapiens
tgcctattacagact

SEQ ID NO: 237618 - DNA, 15 bp, Homo sapiens
atgcctattacagac

SEQ ID NO: 237619 - DNA, 15 bp, Homo sapiens
aatgcctattacaga

SEQ ID NO: 237620 - DNA, 15 bp, Homo sapiens
caatgcctattacag

SEQ ID NO: 237621 - DNA, 15 bp, Homo sapiens
ccaatgcctattaca

SEQ ID NO: 237622 - DNA, 15 bp, Homo sapiens
accaatgcctattac

SEQ ID NO: 237623 - DNA, 15 bp, Homo sapiens
aaccaatgcctatta

SEQ ID NO: 237624 - DNA, 15 bp, Homo sapiens
aaaccaatgcctatt

SEQ ID NO: 237625 - DNA, 15 bp, Homo sapiens
gaaaccaatgcctat

SEQ ID NO: 237626 - DNA, 15 bp, Homo sapiens
tgaaaccaatgccta

SEQ ID NO: 237627 - DNA, 15 bp, Homo sapiens
atgaaaccaatgcct

SEQ ID NO: 237628 - DNA, 15 bp, Homo sapiens
catgaaaccaatgcc

SEQ ID NO: 237629 - DNA, 15 bp, Homo sapiens
ccatgaaaccaatgc

SEQ ID NO: 237630 - DNA, 15 bp, Homo sapiens
accatgaaaccaatg

SEQ ID NO: 237631 - DNA, 15 bp, Homo sapiens
aaccatgaaaccaat

SEQ ID NO: 237632 - DNA, 15 bp, Homo sapiens
taaccatgaaaccaa

SEQ ID NO: 237633 - DNA, 15 bp, Homo sapiens
ctaaccatgaaacca

SEQ ID NO: 237634 - DNA, 15 bp, Homo sapiens
cctaaccatgaaacc

SEQ ID NO: 237635 - DNA, 15 bp, Homo sapiens
tcctaaccatgaaac

SEQ ID NO: 237636 - DNA, 15 bp, Homo sapiens
ttcctaaccatgaaa

SEQ ID NO: 237637 - DNA, 15 bp, Homo sapiens
attcctaaccatgaa

SEQ ID NO: 237638 - DNA, 15 bp, Homo sapiens
cattcctaaccatga

SEQ ID NO: 237639 - DNA, 15 bp, Homo sapiens
acattcctaaccatg

SEQ ID NO: 237640 - DNA, 15 bp, Homo sapiens
aacattcctaaccat

SEQ ID NO: 237641 - DNA, 15 bp, Homo sapiens
caacattcctaacca

SEQ ID NO: 237642 - DNA, 15 bp, Homo sapiens
acaacattcctaacc

SEQ ID NO: 237643 - DNA, 15 bp, Homo sapiens
aacaacattcctaac

SEQ ID NO: 237644 - DNA, 15 bp, Homo sapiens
aaacaacattcctaa

SEQ ID NO: 237645 - DNA, 15 bp, Homo sapiens
gaaacaacattccta

SEQ ID NO: 237646 - DNA, 15 bp, Homo sapiens
agaaacaacattcct

SEQ ID NO: 237647 - DNA, 15 bp, Homo sapiens
tagaaacaacattcc

SEQ ID NO: 237648 - DNA, 15 bp, Homo sapiens
gtagaaacaacattc

SEQ ID NO: 237649 - DNA, 15 bp, Homo sapiens
agtagaaacaacatt

SEQ ID NO: 237650 - DNA, 15 bp, Homo sapiens
cagtagaaacaacat

SEQ ID NO: 237651 - DNA, 15 bp, Homo sapiens
ccagtagaaacaaca

SEQ ID NO: 237652 - DNA, 15 bp, Homo sapiens
gccagtagaaacaac

SEQ ID NO: 237653 - DNA, 15 bp, Homo sapiens
ggccagtagaaacaa

SEQ ID NO: 237654 - DNA, 15 bp, Homo sapiens
tggccagtagaaaca

SEQ ID NO: 237655 - DNA, 15 bp, Homo sapiens
gtggccagtagaaac

SEQ ID NO: 237656 - DNA, 15 bp, Homo sapiens
agtggccagtagaaa

SEQ ID NO: 237657 - DNA, 15 bp, Homo sapiens
aagtggccagtagaa

SEQ ID NO: 237658 - DNA, 15 bp, Homo sapiens
aaagtggccagtaga

SEQ ID NO: 237659 - DNA, 15 bp, Homo sapiens
gaaagtggccagtag

SEQ ID NO: 237660 - DNA, 15 bp, Homo sapiens
agaaagtggccagta

SEQ ID NO: 237661 - DNA, 15 bp, Homo sapiens
tagaaagtggccagt

SEQ ID NO: 237662 - DNA, 15 bp, Homo sapiens
ttagaaagtggccag

SEQ ID NO: 237663 - DNA, 15 bp, Homo sapiens
attagaaagtggcca

SEQ ID NO: 237664 - DNA, 15 bp, Homo sapiens
aattagaaagtggcc

SEQ ID NO: 237665 - DNA, 15 bp, Homo sapiens
aaattagaaagtggc

SEQ ID NO: 237666 - DNA, 15 bp, Homo sapiens
taaattagaaagtgg

SEQ ID NO: 237667 - DNA, 15 bp, Homo sapiens
ttaaattagaaagtg

SEQ ID NO: 237668 - DNA, 15 bp, Homo sapiens
attaaattagaaagt

SEQ ID NO: 237669 - DNA, 15 bp, Homo sapiens
aattaaattagaaag

SEQ ID NO: 237670 - DNA, 15 bp, Homo sapiens
aaattaaattagaaa

SEQ ID NO: 237671 - DNA, 15 bp, Homo sapiens
aaaattaaattagaa

SEQ ID NO: 237672 - DNA, 15 bp, Homo sapiens
taaaattaaattaga

SEQ ID NO: 237673 - DNA, 15 bp, Homo sapiens
ttaaaattaaattag

SEQ ID NO: 237674 - DNA, 15 bp, Homo sapiens
cttaaaattaaatta

SEQ ID NO: 237675 - DNA, 15 bp, Homo sapiens
acttaaaattaaatt

SEQ ID NO: 237676 - DNA, 15 bp, Homo sapiens
cacttaaaattaaat

SEQ ID NO: 237677 - DNA, 15 bp, Homo sapiens
ccacttaaaattaaa

SEQ ID NO: 237678 - DNA, 15 bp, Homo sapiens
tccacttaaaattaa

SEQ ID NO: 237679 - DNA, 15 bp, Homo sapiens
ttccacttaaaatta

SEQ ID NO: 237680 - DNA, 15 bp, Homo sapiens
tttccacttaaaatt

SEQ ID NO: 237681 - DNA, 15 bp, Homo sapiens
gtttccacttaaaat

SEQ ID NO: 237682 - DNA, 15 bp, Homo sapiens
tgtttccacttaaaa

SEQ ID NO: 237683 - DNA, 15 bp, Homo sapiens
atgtttccacttaaa

SEQ ID NO: 237684 - DNA, 15 bp, Homo sapiens
catgtttccacttaa

SEQ ID NO: 237685 - DNA, 15 bp, Homo sapiens
acatgtttccactta

SEQ ID NO: 237686 - DNA, 15 bp, Homo sapiens
aacatgtttccactt

SEQ ID NO: 237687 - DNA, 15 bp, Homo sapiens
taacatgtttccact

SEQ ID NO: 237688 - DNA, 15 bp, Homo sapiens
ttaacatgtttccac

SEQ ID NO: 237689 - DNA, 15 bp, Homo sapiens
tttaacatgtttcca

SEQ ID NO: 237690 - DNA, 15 bp, Homo sapiens
ttttaacatgtttcc

SEQ ID NO: 237691 - DNA, 15 bp, Homo sapiens
attttaacatgtttc

SEQ ID NO: 237692 - DNA, 15 bp, Homo sapiens
gattttaacatgttt

SEQ ID NO: 237693 - DNA, 15 bp, Homo sapiens
tgattttaacatgtt

SEQ ID NO: 237694 - DNA, 15 bp, Homo sapiens
ttgattttaacatgt

SEQ ID NO: 237695 - DNA, 15 bp, Homo sapiens
cttgattttaacatg

SEQ ID NO: 237696 - DNA, 15 bp, Homo sapiens
acttgattttaacat

SEQ ID NO: 237697 - DNA, 15 bp, Homo sapiens
aacttgattttaaca

SEQ ID NO: 237698 - DNA, 15 bp, Homo sapiens
caacttgattttaac

SEQ ID NO: 237699 - DNA, 15 bp, Homo sapiens
acaacttgattttaa

SEQ ID NO: 237700 - DNA, 15 bp, Homo sapiens
aacaacttgatttta

SEQ ID NO: 237701 - DNA, 15 bp, Homo sapiens
caacaacttgatttt

SEQ ID NO: 237702 - DNA, 15 bp, Homo sapiens
gcaacaacttgattt

SEQ ID NO: 237703 - DNA, 15 bp, Homo sapiens
tgcaacaacttgatt

SEQ ID NO: 237704 - DNA, 15 bp, Homo sapiens
atgcaacaacttgat

SEQ ID NO: 237705 - DNA, 15 bp, Homo sapiens
aatgcaacaacttga

SEQ ID NO: 237706 - DNA, 15 bp, Homo sapiens
aaatgcaacaacttg

SEQ ID NO: 237707 - DNA, 15 bp, Homo sapiens
caaatgcaacaactt

SEQ ID NO: 237708 - DNA, 15 bp, Homo sapiens
ccaaatgcaacaact

SEQ ID NO: 237709 - DNA, 15 bp, Homo sapiens
accaaatgcaacaac

SEQ ID NO: 237710 - DNA, 15 bp, Homo sapiens
caccaaatgcaacaa

SEQ ID NO: 237711 - DNA, 15 bp, Homo sapiens
tcaccaaatgcaaca

SEQ ID NO: 237712 - DNA, 15 bp, Homo sapiens
ttcaccaaatgcaac

SEQ ID NO: 237713 - DNA, 15 bp, Homo sapiens
tttcaccaaatgcaa

SEQ ID NO: 237714 - DNA, 15 bp, Homo sapiens
ttttcaccaaatgca

SEQ ID NO: 237715 - DNA, 15 bp, Homo sapiens
tttttcaccaaatgc

SEQ ID NO: 237716 - DNA, 15 bp, Homo sapiens
ttttttcaccaaatg

SEQ ID NO: 237717 - DNA, 15 bp, Homo sapiens
attttttcaccaaat

SEQ ID NO: 237718 - DNA, 15 bp, Homo sapiens
tattttttcaccaaa

SEQ ID NO: 237719 - DNA, 15 bp, Homo sapiens
atattttttcaccaa

SEQ ID NO: 237720 - DNA, 15 bp, Homo sapiens
aatattttttcacca

SEQ ID NO: 237721 - DNA, 15 bp, Homo sapiens
taatattttttcacc

SEQ ID NO: 237722 - DNA, 15 bp, Homo sapiens
ttaatattttttcac

SEQ ID NO: 237723 - DNA, 15 bp, Homo sapiens
cttaatattttttca

SEQ ID NO: 237724 - DNA, 15 bp, Homo sapiens
ccttaatattttttc

SEQ ID NO: 237725 - DNA, 15 bp, Homo sapiens
accttaatatttttt

SEQ ID NO: 237726 - DNA, 15 bp, Homo sapiens
taccttaatattttt

SEQ ID NO: 237727 - DNA, 15 bp, Homo sapiens
ctaccttaatatttt

SEQ ID NO: 237728 - DNA, 15 bp, Homo sapiens
gctaccttaatattt

SEQ ID NO: 237729 - DNA, 15 bp, Homo sapiens
agctaccttaatatt

SEQ ID NO: 237730 - DNA, 15 bp, Homo sapiens
tagctaccttaatat

SEQ ID NO: 237731 - DNA, 15 bp, Homo sapiens
atagctaccttaata

SEQ ID NO: 237732 - DNA, 15 bp, Homo sapiens
catagctaccttaat

SEQ ID NO: 237733 - DNA, 15 bp, Homo sapiens
acatagctaccttaa

SEQ ID NO: 237734 - DNA, 15 bp, Homo sapiens
aacatagctacctta

SEQ ID NO: 237735 - DNA, 15 bp, Homo sapiens
taacatagctacctt

SEQ ID NO: 237736 - DNA, 15 bp, Homo sapiens
ttaacatagctacct

SEQ ID NO: 237737 - DNA, 15 bp, Homo sapiens
tttaacatagctacc

SEQ ID NO: 237738 - DNA, 15 bp, Homo sapiens
ttttaacatagctac

SEQ ID NO: 237739 - DNA, 15 bp, Homo sapiens
gttttaacatagcta

SEQ ID NO: 237740 - DNA, 15 bp, Homo sapiens
tgttttaacatagct

SEQ ID NO: 237741 - DNA, 15 bp, Homo sapiens
ctgttttaacatagc

SEQ ID NO: 237742 - DNA, 15 bp, Homo sapiens
tctgttttaacatag

SEQ ID NO: 237743 - DNA, 15 bp, Homo sapiens
ttctgttttaacata

SEQ ID NO: 237744 - DNA, 15 bp, Homo sapiens
attctgttttaacat

SEQ ID NO: 237745 - DNA, 15 bp, Homo sapiens
tattctgttttaaca

SEQ ID NO: 237746 - DNA, 15 bp, Homo sapiens
ttattctgttttaac

SEQ ID NO: 237747 - DNA, 15 bp, Homo sapiens
tttattctgttttaa

SEQ ID NO: 237748 - DNA, 15 bp, Homo sapiens
ttttattctgtttta

SEQ ID NO: 237749 - DNA, 15 bp, Homo sapiens
tttttattctgtttt

SEQ ID NO: 237750 - DNA, 15 bp, Homo sapiens
ctttttattctgttt

SEQ ID NO: 237751 - DNA, 15 bp, Homo sapiens
tctttttattctgtt

SEQ ID NO: 237752 - DNA, 15 bp, Homo sapiens
ttctttttattctgt

SEQ ID NO: 237753 - DNA, 15 bp, Homo sapiens
tttctttttattctg

SEQ ID NO: 237754 - DNA, 15 bp, Homo sapiens
ttttctttttattct

SEQ ID NO: 237755 - DNA, 15 bp, Homo sapiens
gttttctttttattc

SEQ ID NO: 237756 - DNA, 15 bp, Homo sapiens
tgttttctttttatt

SEQ ID NO: 237757 - DNA, 15 bp, Homo sapiens
gtgttttctttttat

SEQ ID NO: 237758 - DNA, 15 bp, Homo sapiens
cgtgttttcttttta

SEQ ID NO: 237759 - DNA, 15 bp, Homo sapiens
tcgtgttttcttttt

SEQ ID NO: 237760 - DNA, 15 bp, Homo sapiens
ttcgtgttttctttt

SEQ ID NO: 237761 - DNA, 15 bp, Homo sapiens
attcgtgttttcttt

SEQ ID NO: 237762 - DNA, 15 bp, Homo sapiens
tattcgtgttttctt

SEQ ID NO: 237763 - DNA, 15 bp, Homo sapiens
gtattcgtgttttct

SEQ ID NO: 237764 - DNA, 15 bp, Homo sapiens
tgtattcgtgttttc

SEQ ID NO: 237765 - DNA, 15 bp, Homo sapiens
ttgtattcgtgtttt

SEQ ID NO: 237766 - DNA, 15 bp, Homo sapiens
tttgtattcgtgttt

SEQ ID NO: 237767 - DNA, 15 bp, Homo sapiens
gtttgtattcgtgtt

SEQ ID NO: 237768 - DNA, 15 bp, Homo sapiens
agtttgtattcgtgt

SEQ ID NO: 237769 - DNA, 15 bp, Homo sapiens
tagtttgtattcgtg

SEQ ID NO: 237770 - DNA, 15 bp, Homo sapiens
ttagtttgtattcgt

SEQ ID NO: 237771 - DNA, 15 bp, Homo sapiens
tttagtttgtattcg

SEQ ID NO: 237772 - DNA, 15 bp, Homo sapiens
ctttagtttgtattc

SEQ ID NO: 237773 - DNA, 15 bp, Homo sapiens
tctttagtttgtatt

SEQ ID NO: 237774 - DNA, 15 bp, Homo sapiens
atctttagtttgtat

SEQ ID NO: 237775 - DNA, 15 bp, Homo sapiens
tatctttagtttgta

SEQ ID NO: 237776 - DNA, 15 bp, Homo sapiens
ctatctttagtttgt

SEQ ID NO: 237777 - DNA, 15 bp, Homo sapiens
tctatctttagtttg

SEQ ID NO: 237778 - DNA, 15 bp, Homo sapiens
ttctatctttagttt

SEQ ID NO: 237779 - DNA, 15 bp, Homo sapiens
attctatctttagtt

SEQ ID NO: 237780 - DNA, 15 bp, Homo sapiens
gattctatctttagt

SEQ ID NO: 237781 - DNA, 15 bp, Homo sapiens
tgattctatctttag

SEQ ID NO: 237782 - DNA, 15 bp, Homo sapiens
ttgattctatcttta

SEQ ID NO: 237783 - DNA, 15 bp, Homo sapiens
gttgattctatcttt

SEQ ID NO: 237784 - DNA, 15 bp, Homo sapiens
tgttgattctatctt

SEQ ID NO: 237785 - DNA, 15 bp, Homo sapiens
atgttgattctatct

SEQ ID NO: 237786 - DNA, 15 bp, Homo sapiens
aatgttgattctatc

SEQ ID NO: 237787 - DNA, 15 bp, Homo sapiens
taatgttgattctat

SEQ ID NO: 237788 - DNA, 15 bp, Homo sapiens
ctaatgttgattcta

SEQ ID NO: 237789 - DNA, 15 bp, Homo sapiens
tctaatgttgattct

SEQ ID NO: 237790 - DNA, 15 bp, Homo sapiens
atctaatgttgattc

SEQ ID NO: 237791 - DNA, 15 bp, Homo sapiens
tatctaatgttgatt

SEQ ID NO: 237792 - DNA, 15 bp, Homo sapiens
atatctaatgttgat

SEQ ID NO: 237793 - DNA, 15 bp, Homo sapiens
gatatctaatgttga

SEQ ID NO: 237794 - DNA, 15 bp, Homo sapiens
tgatatctaatgttg

SEQ ID NO: 237795 - DNA, 15 bp, Homo sapiens
ctgatatctaatgtt

SEQ ID NO: 237796 - DNA, 15 bp, Homo sapiens
actgatatctaatgt

SEQ ID NO: 237797 - DNA, 15 bp, Homo sapiens
tactgatatctaatg

SEQ ID NO: 237798 - DNA, 15 bp, Homo sapiens
ttactgatatctaat

SEQ ID NO: 237799 - DNA, 15 bp, Homo sapiens
tttactgatatctaa

SEQ ID NO: 237800 - DNA, 15 bp, Homo sapiens
ctttactgatatcta

SEQ ID NO: 237801 - DNA, 15 bp, Homo sapiens
actttactgatatct

SEQ ID NO: 237802 - DNA, 15 bp, Homo sapiens
cactttactgatatc

SEQ ID NO: 237803 - DNA, 15 bp, Homo sapiens
ccactttactgatat

SEQ ID NO: 237804 - DNA, 15 bp, Homo sapiens
tccactttactgata

SEQ ID NO: 237805 - DNA, 15 bp, Homo sapiens
ttccactttactgat

SEQ ID NO: 237806 - DNA, 15 bp, Homo sapiens
tttccactttactga

SEQ ID NO: 237807 - DNA, 15 bp, Homo sapiens
ttttccactttactg

SEQ ID NO: 237808 - DNA, 15 bp, Homo sapiens
attttccactttact

SEQ ID NO: 237809 - DNA, 15 bp, Homo sapiens
tattttccactttac

SEQ ID NO: 237810 - DNA, 15 bp, Homo sapiens
ttattttccacttta

SEQ ID NO: 237811 - DNA, 15 bp, Homo sapiens
attattttccacttt

SEQ ID NO: 237812 - DNA, 15 bp, Homo sapiens
cattattttccactt

SEQ ID NO: 237813 - DNA, 15 bp, Homo sapiens
ccattattttccact

SEQ ID NO: 237814 - DNA, 15 bp, Homo sapiens
gccattattttccac

SEQ ID NO: 237815 - DNA, 15 bp, Homo sapiens
tgccattattttcca

SEQ ID NO: 237816 - DNA, 15 bp, Homo sapiens
atgccattattttcc

SEQ ID NO: 237817 - DNA, 15 bp, Homo sapiens
tatgccattattttc

SEQ ID NO: 237818 - DNA, 15 bp, Homo sapiens
gtatgccattatttt

SEQ ID NO: 237819 - DNA, 15 bp, Homo sapiens
tgtatgccattattt

SEQ ID NO: 237820 - DNA, 15 bp, Homo sapiens
atgtatgccattatt

SEQ ID NO: 237821 - DNA, 15 bp, Homo sapiens
aatgtatgccattat

SEQ ID NO: 237822 - DNA, 15 bp, Homo sapiens
aaatgtatgccatta

SEQ ID NO: 237823 - DNA, 15 bp, Homo sapiens
aaaatgtatgccatt

SEQ ID NO: 237824 - DNA, 15 bp, Homo sapiens
gaaaatgtatgccat

SEQ ID NO: 237825 - DNA, 15 bp, Homo sapiens
ggaaaatgtatgcca

SEQ ID NO: 237826 - DNA, 15 bp, Homo sapiens
tggaaaatgtatgcc

SEQ ID NO: 237827 - DNA, 15 bp, Homo sapiens
ctggaaaatgtatgc

SEQ ID NO: 237828 - DNA, 15 bp, Homo sapiens
tctggaaaatgtatg

SEQ ID NO: 237829 - DNA, 15 bp, Homo sapiens
ctctggaaaatgtat

SEQ ID NO: 237830 - DNA, 15 bp, Homo sapiens
actctggaaaatgta

SEQ ID NO: 237831 - DNA, 15 bp, Homo sapiens
tactctggaaaatgt

SEQ ID NO: 237832 - DNA, 15 bp, Homo sapiens
ttactctggaaaatg

SEQ ID NO: 237833 - DNA, 15 bp, Homo sapiens
tttactctggaaaat

SEQ ID NO: 237834 - DNA, 15 bp, Homo sapiens
gtttactctggaaaa

SEQ ID NO: 237835 - DNA, 15 bp, Homo sapiens
agtttactctggaaa

SEQ ID NO: 237836 - DNA, 15 bp, Homo sapiens
cagtttactctggaa

SEQ ID NO: 237837 - DNA, 15 bp, Homo sapiens
gcagtttactctgga

SEQ ID NO: 237838 - DNA, 15 bp, Homo sapiens
tgcagtttactctgg

SEQ ID NO: 237839 - DNA, 15 bp, Homo sapiens
atgcagtttactctg

SEQ ID NO: 237840 - DNA, 15 bp, Homo sapiens
tatgcagtttactct

SEQ ID NO: 237841 - DNA, 15 bp, Homo sapiens
atatgcagtttactc

SEQ ID NO: 237842 - DNA, 15 bp, Homo sapiens
tatatgcagtttact

SEQ ID NO: 237843 - DNA, 15 bp, Homo sapiens
ttatatgcagtttac

SEQ ID NO: 237844 - DNA, 15 bp, Homo sapiens
attatatgcagttta

SEQ ID NO: 237845 - DNA, 15 bp, Homo sapiens
tattatatgcagttt

SEQ ID NO: 237846 - DNA, 15 bp, Homo sapiens
ctattatatgcagtt

SEQ ID NO: 237847 - DNA, 15 bp, Homo sapiens
tctattatatgcagt

SEQ ID NO: 237848 - DNA, 15 bp, Homo sapiens
ttctattatatgcag

SEQ ID NO: 237849 - DNA, 15 bp, Homo sapiens
tttctattatatgca

SEQ ID NO: 237850 - DNA, 15 bp, Homo sapiens
ctttctattatatgc

SEQ ID NO: 237851 - DNA, 15 bp, Homo sapiens
gctttctattatatg

SEQ ID NO: 237852 - DNA, 15 bp, Homo sapiens
tgctttctattatat

SEQ ID NO: 237853 - DNA, 15 bp, Homo sapiens
atgctttctattata

SEQ ID NO: 237854 - DNA, 15 bp, Homo sapiens
catgctttctattat

SEQ ID NO: 237855 - DNA, 15 bp, Homo sapiens
tcatgctttctatta

SEQ ID NO: 237856 - DNA, 15 bp, Homo sapiens
ttcatgctttctatt

SEQ ID NO: 237857 - DNA, 15 bp, Homo sapiens
tttcatgctttctat

SEQ ID NO: 237858 - DNA, 15 bp, Homo sapiens
ctttcatgctttcta

SEQ ID NO: 237859 - DNA, 15 bp, Homo sapiens
cctttcatgctttct

SEQ ID NO: 237860 - DNA, 15 bp, Homo sapiens
tcctttcatgctttc

SEQ ID NO: 237861 - DNA, 15 bp, Homo sapiens
ttcctttcatgcttt

SEQ ID NO: 237862 - DNA, 15 bp, Homo sapiens
tttcctttcatgctt

SEQ ID NO: 237863 - DNA, 15 bp, Homo sapiens
atttcctttcatgct

SEQ ID NO: 237864 - DNA, 15 bp, Homo sapiens
tatttcctttcatgc

SEQ ID NO: 237865 - DNA, 15 bp, Homo sapiens
gtatttcctttcatg

SEQ ID NO: 237866 - DNA, 15 bp, Homo sapiens
tgtatttcctttcat

SEQ ID NO: 237867 - DNA, 15 bp, Homo sapiens
atgtatttcctttca

SEQ ID NO: 237868 - DNA, 15 bp, Homo sapiens
tatgtatttcctttc

SEQ ID NO: 237869 - DNA, 15 bp, Homo sapiens
ttatgtatttccttt

SEQ ID NO: 237870 - DNA, 15 bp, Homo sapiens
attatgtatttcctt

SEQ ID NO: 237871 - DNA, 15 bp, Homo sapiens
gattatgtatttcct

SEQ ID NO: 237872 - DNA, 15 bp, Homo sapiens
tgattatgtatttcc

SEQ ID NO: 237873 - DNA, 15 bp, Homo sapiens
atgattatgtatttc

SEQ ID NO: 237874 - DNA, 15 bp, Homo sapiens
aatgattatgtattt

SEQ ID NO: 237875 - DNA, 15 bp, Homo sapiens
aaatgattatgtatt

SEQ ID NO: 237876 - DNA, 15 bp, Homo sapiens
aaaatgattatgtat

SEQ ID NO: 237877 - DNA, 15 bp, Homo sapiens
taaaatgattatgta

SEQ ID NO: 237878 - DNA, 15 bp, Homo sapiens
ttaaaatgattatgt

SEQ ID NO: 237879 - DNA, 15 bp, Homo sapiens
tttaaaatgattatg

SEQ ID NO: 237880 - DNA, 15 bp, Homo sapiens
ttttaaaatgattat

SEQ ID NO: 237881 - DNA, 15 bp, Homo sapiens
cttttaaaatgatta

SEQ ID NO: 237882 - DNA, 15 bp, Homo sapiens
acttttaaaatgatt

SEQ ID NO: 237883 - DNA, 15 bp, Homo sapiens
aacttttaaaatgat

SEQ ID NO: 237884 - DNA, 15 bp, Homo sapiens
aaacttttaaaatga

SEQ ID NO: 237885 - DNA, 15 bp, Homo sapiens
caaacttttaaaatg

SEQ ID NO: 237886 - DNA, 15 bp, Homo sapiens
tcaaacttttaaaat

SEQ ID NO: 237887 - DNA, 15 bp, Homo sapiens
ttcaaacttttaaaa

SEQ ID NO: 237888 - DNA, 15 bp, Homo sapiens
attcaaacttttaaa

SEQ ID NO: 237889 - DNA, 15 bp, Homo sapiens
aattcaaacttttaa

SEQ ID NO: 237890 - DNA, 15 bp, Homo sapiens
taattcaaactttta

SEQ ID NO: 237891 - DNA, 15 bp, Homo sapiens
ataattcaaactttt

SEQ ID NO: 237892 - DNA, 15 bp, Homo sapiens
tataattcaaacttt

SEQ ID NO: 237893 - DNA, 15 bp, Homo sapiens
ttataattcaaactt

SEQ ID NO: 237894 - DNA, 15 bp, Homo sapiens
attataattcaaact

SEQ ID NO: 237895 - DNA, 15 bp, Homo sapiens
aattataattcaaac

SEQ ID NO: 237896 - DNA, 15 bp, Homo sapiens
aaattataattcaaa

SEQ ID NO: 237897 - DNA, 15 bp, Homo sapiens
aaaattataattcaa

SEQ ID NO: 237898 - DNA, 15 bp, Homo sapiens
aaaaattataattca

SEQ ID NO: 237899 - DNA, 15 bp, Homo sapiens
gaaaaattataattc

SEQ ID NO: 237900 - DNA, 15 bp, Homo sapiens
agaaaaattataatt

SEQ ID NO: 237901 - DNA, 15 bp, Homo sapiens
gagaaaaattataat

SEQ ID NO: 237902 - DNA, 15 bp, Homo sapiens
agagaaaaattataa

SEQ ID NO: 237903 - DNA, 15 bp, Homo sapiens
aagagaaaaattata

SEQ ID NO: 237904 - DNA, 15 bp, Homo sapiens
gaagagaaaaattat

SEQ ID NO: 237905 - DNA, 15 bp, Homo sapiens
tgaagagaaaaatta

SEQ ID NO: 237906 - DNA, 15 bp, Homo sapiens
gtgaagagaaaaatt

SEQ ID NO: 237907 - DNA, 15 bp, Homo sapiens
tgtgaagagaaaaat

SEQ ID NO: 237908 - DNA, 15 bp, Homo sapiens
gtgtgaagagaaaaa

SEQ ID NO: 237909 - DNA, 15 bp, Homo sapiens
tgtgtgaagagaaaa

SEQ ID NO: 237910 - DNA, 15 bp, Homo sapiens
atgtgtgaagagaaa

SEQ ID NO: 237911 - DNA, 15 bp, Homo sapiens
aatgtgtgaagagaa

SEQ ID NO: 237912 - DNA, 15 bp, Homo sapiens
aaatgtgtgaagaga

SEQ ID NO: 237913 - DNA, 15 bp, Homo sapiens
taaatgtgtgaagag

SEQ ID NO: 237914 - DNA, 15 bp, Homo sapiens
ataaatgtgtgaaga

SEQ ID NO: 237915 - DNA, 15 bp, Homo sapiens
aataaatgtgtgaag

SEQ ID NO: 237916 - DNA, 15 bp, Homo sapiens
aaataaatgtgtgaa

SEQ ID NO: 237917 - DNA, 15 bp, Homo sapiens
taaataaatgtgtga

SEQ ID NO: 237918 - DNA, 15 bp, Homo sapiens
ataaataaatgtgtg

SEQ ID NO: 237919 - DNA, 15 bp, Homo sapiens
tataaataaatgtgt

SEQ ID NO: 237920 - DNA, 15 bp, Homo sapiens
atataaataaatgtg

SEQ ID NO: 237921 - DNA, 15 bp, Homo sapiens
aatataaataaatgt

SEQ ID NO: 237922 - DNA, 15 bp, Homo sapiens
aaatataaataaatg

SEQ ID NO: 237923 - DNA, 15 bp, Homo sapiens
aaaatataaataaat

SEQ ID NO: 237924 - DNA, 15 bp, Homo sapiens
aaaaatataaataaa

SEQ ID NO: 237925 - DNA, 15 bp, Homo sapiens
ccaaaaatataaata

SEQ ID NO: 237926 - DNA, 15 bp, Homo sapiens
cccaaaaatataaat

SEQ ID NO: 237927 - DNA, 15 bp, Homo sapiens
acccaaaaatataaa

SEQ ID NO: 237928 - DNA, 15 bp, Homo sapiens
tacccaaaaatataa

SEQ ID NO: 237929 - DNA, 15 bp, Homo sapiens
ttacccaaaaatata

SEQ ID NO: 237930 - DNA, 15 bp, Homo sapiens
attacccaaaaatat

SEQ ID NO: 237931 - DNA, 15 bp, Homo sapiens
tattacccaaaaata

SEQ ID NO: 237932 - DNA, 15 bp, Homo sapiens
ttattacccaaaaat

SEQ ID NO: 237933 - DNA, 15 bp, Homo sapiens
tttattacccaaaaa

SEQ ID NO: 237934 - DNA, 15 bp, Homo sapiens
gtttattacccaaaa

SEQ ID NO: 237935 - DNA, 15 bp, Homo sapiens
tgtttattacccaaa

SEQ ID NO: 237936 - DNA, 15 bp, Homo sapiens
ttgtttattacccaa

SEQ ID NO: 237937 - DNA, 15 bp, Homo sapiens
attgtttattaccca

SEQ ID NO: 237938 - DNA, 15 bp, Homo sapiens
cattgtttattaccc

SEQ ID NO: 237939 - DNA, 15 bp, Homo sapiens
tcattgtttattacc

SEQ ID NO: 237940 - DNA, 15 bp, Homo sapiens
gtcattgtttattac

SEQ ID NO: 237941 - DNA, 15 bp, Homo sapiens
agtcattgtttatta

SEQ ID NO: 237942 - DNA, 15 bp, Homo sapiens
aagtcattgtttatt

SEQ ID NO: 237943 - DNA, 15 bp, Homo sapiens
aaagtcattgtttat

SEQ ID NO: 237944 - DNA, 15 bp, Homo sapiens
aaaagtcattgttta

SEQ ID NO: 237945 - DNA, 15 bp, Homo sapiens
aaaaagtcattgttt

SEQ ID NO: 237946 - DNA, 15 bp, Homo sapiens
caaaaagtcattgtt

SEQ ID NO: 237947 - DNA, 15 bp, Homo sapiens
ccaaaaagtcattgt

SEQ ID NO: 237948 - DNA, 15 bp, Homo sapiens
accaaaaagtcattg

SEQ ID NO: 237949 - DNA, 15 bp, Homo sapiens
aaccaaaaagtcatt

SEQ ID NO: 237950 - DNA, 15 bp, Homo sapiens
gaaccaaaaagtcat

SEQ ID NO: 237951 - DNA, 15 bp, Homo sapiens
agaaccaaaaagtca

SEQ ID NO: 237952 - DNA, 15 bp, Homo sapiens
aagaaccaaaaagtc

SEQ ID NO: 237953 - DNA, 15 bp, Homo sapiens
gaagaaccaaaaagt

SEQ ID NO: 237954 - DNA, 15 bp, Homo sapiens
tgaagaaccaaaaag

SEQ ID NO: 237955 - DNA, 15 bp, Homo sapiens
atgaagaaccaaaaa

SEQ ID NO: 237956 - DNA, 15 bp, Homo sapiens
gatgaagaaccaaaa

SEQ ID NO: 237957 - DNA, 15 bp, Homo sapiens
ggatgaagaaccaaa

SEQ ID NO: 237958 - DNA, 15 bp, Homo sapiens
tggatgaagaaccaa

SEQ ID NO: 237959 - DNA, 15 bp, Homo sapiens
ttggatgaagaacca

SEQ ID NO: 237960 - DNA, 15 bp, Homo sapiens
cttggatgaagaacc

SEQ ID NO: 237961 - DNA, 15 bp, Homo sapiens
acttggatgaagaac

SEQ ID NO: 237962 - DNA, 15 bp, Homo sapiens
aacttggatgaagaa

SEQ ID NO: 237963 - DNA, 15 bp, Homo sapiens
taacttggatgaaga

SEQ ID NO: 237964 - DNA, 15 bp, Homo sapiens
gtaacttggatgaag

SEQ ID NO: 237965 - DNA, 15 bp, Homo sapiens
agtaacttggatgaa

SEQ ID NO: 237966 - DNA, 15 bp, Homo sapiens
cagtaacttggatga

SEQ ID NO: 237967 - DNA, 15 bp, Homo sapiens
tcagtaacttggatg

SEQ ID NO: 237968 - DNA, 15 bp, Homo sapiens
ttcagtaacttggat

SEQ ID NO: 237969 - DNA, 15 bp, Homo sapiens
cttcagtaacttgga

SEQ ID NO: 237970 - DNA, 15 bp, Homo sapiens
tcttcagtaacttgg

SEQ ID NO: 237971 - DNA, 15 bp, Homo sapiens
gtcttcagtaacttg

SEQ ID NO: 237972 - DNA, 15 bp, Homo sapiens
ggtcttcagtaactt

SEQ ID NO: 237973 - DNA, 15 bp, Homo sapiens
aggtcttcagtaact

SEQ ID NO: 237974 - DNA, 15 bp, Homo sapiens
caggtcttcagtaac

SEQ ID NO: 237975 - DNA, 15 bp, Homo sapiens
tcaggtcttcagtaa

SEQ ID NO: 237976 - DNA, 15 bp, Homo sapiens
ttcaggtcttcagta

SEQ ID NO: 237977 - DNA, 15 bp, Homo sapiens
attcaggtcttcagt

SEQ ID NO: 237978 - DNA, 15 bp, Homo sapiens
aattcaggtcttcag

SEQ ID NO: 237979 - DNA, 15 bp, Homo sapiens
taattcaggtcttca

SEQ ID NO: 237980 - DNA, 15 bp, Homo sapiens
ttaattcaggtcttc

SEQ ID NO: 237981 - DNA, 15 bp, Homo sapiens
cttaattcaggtctt

SEQ ID NO: 237982 - DNA, 15 bp, Homo sapiens
acttaattcaggtct

SEQ ID NO: 237983 - DNA, 15 bp, Homo sapiens
gacttaattcaggtc

SEQ ID NO: 237984 - DNA, 15 bp, Homo sapiens
tgacttaattcaggt

SEQ ID NO: 237985 - DNA, 15 bp, Homo sapiens
ctgacttaattcagg

SEQ ID NO: 237986 - DNA, 15 bp, Homo sapiens
gctgacttaattcag

SEQ ID NO: 237987 - DNA, 15 bp, Homo sapiens
agctgacttaattca

SEQ ID NO: 237988 - DNA, 15 bp, Homo sapiens
cagctgacttaattc

SEQ ID NO: 237989 - DNA, 15 bp, Homo sapiens
acagctgacttaatt

SEQ ID NO: 237990 - DNA, 15 bp, Homo sapiens
aacagctgacttaat

SEQ ID NO: 237991 - DNA, 15 bp, Homo sapiens
caacagctgacttaa

SEQ ID NO: 237992 - DNA, 15 bp, Homo sapiens
acaacagctgactta

SEQ ID NO: 237993 - DNA, 15 bp, Homo sapiens
aacaacagctgactt

SEQ ID NO: 237994 - DNA, 15 bp, Homo sapiens
caacaacagctgact

SEQ ID NO: 237995 - DNA, 15 bp, Homo sapiens
tcaacaacagctgac

SEQ ID NO: 237996 - DNA, 15 bp, Homo sapiens
ctcaacaacagctga

SEQ ID NO: 237997 - DNA, 15 bp, Homo sapiens
actcaacaacagctg

SEQ ID NO: 237998 - DNA, 15 bp, Homo sapiens
cactcaacaacagct

SEQ ID NO: 237999 - DNA, 15 bp, Homo sapiens
ccactcaacaacagc

SEQ ID NO: 238000 - DNA, 15 bp, Homo sapiens
cccactcaacaacag

SEQ ID NO: 238001 - DNA, 15 bp, Homo sapiens
gcccactcaacaaca

SEQ ID NO: 238002 - DNA, 15 bp, Homo sapiens
tgcccactcaacaac

SEQ ID NO: 238003 - DNA, 15 bp, Homo sapiens
ttgcccactcaacaa

SEQ ID NO: 238004 - DNA, 15 bp, Homo sapiens
gttgcccactcaaca

SEQ ID NO: 238005 - DNA, 15 bp, Homo sapiens
agttgcccactcaac

SEQ ID NO: 238006 - DNA, 15 bp, Homo sapiens
cagttgcccactcaa

SEQ ID NO: 238007 - DNA, 15 bp, Homo sapiens
acagttgcccactca

SEQ ID NO: 238008 - DNA, 15 bp, Homo sapiens
tacagttgcccactc

SEQ ID NO: 238009 - DNA, 15 bp, Homo sapiens
ctacagttgcccact

SEQ ID NO: 238010 - DNA, 15 bp, Homo sapiens
actacagttgcccac

SEQ ID NO: 238011 - DNA, 15 bp, Homo sapiens
aactacagttgccca

SEQ ID NO: 238012 - DNA, 15 bp, Homo sapiens
caactacagttgccc

SEQ ID NO: 238013 - DNA, 15 bp, Homo sapiens
tcaactacagttgcc

SEQ ID NO: 238014 - DNA, 15 bp, Homo sapiens
atcaactacagttgc

SEQ ID NO: 238015 - DNA, 15 bp, Homo sapiens
aatcaactacagttg

SEQ ID NO: 238016 - DNA, 15 bp, Homo sapiens
aaatcaactacagtt

SEQ ID NO: 238017 - DNA, 15 bp, Homo sapiens
gaaatcaactacagt

SEQ ID NO: 238018 - DNA, 15 bp, Homo sapiens
ggaaatcaactacag

SEQ ID NO: 238019 - DNA, 15 bp, Homo sapiens
aggaaatcaactaca

SEQ ID NO: 238020 - DNA, 15 bp, Homo sapiens
gaggaaatcaactac

SEQ ID NO: 238021 - DNA, 15 bp, Homo sapiens
agaggaaatcaacta

SEQ ID NO: 238022 - DNA, 15 bp, Homo sapiens
cagaggaaatcaact

SEQ ID NO: 238023 - DNA, 15 bp, Homo sapiens
tcagaggaaatcaac

SEQ ID NO: 238024 - DNA, 15 bp, Homo sapiens
ctcagaggaaatcaa

SEQ ID NO: 238025 - DNA, 15 bp, Homo sapiens
gctcagaggaaatca

SEQ ID NO: 238026 - DNA, 15 bp, Homo sapiens
agctcagaggaaatc

SEQ ID NO: 238027 - DNA, 15 bp, Homo sapiens
cagctcagaggaaat

SEQ ID NO: 238028 - DNA, 15 bp, Homo sapiens
ccagctcagaggaaa

SEQ ID NO: 238029 - DNA, 15 bp, Homo sapiens
gccagctcagaggaa

SEQ ID NO: 238030 - DNA, 15 bp, Homo sapiens
ggccagctcagagga

SEQ ID NO: 238031 - DNA, 15 bp, Homo sapiens
aggccagctcagagg

SEQ ID NO: 238032 - DNA, 15 bp, Homo sapiens
aaggccagctcagag

SEQ ID NO: 238033 - DNA, 15 bp, Homo sapiens
caaggccagctcaga

SEQ ID NO: 238034 - DNA, 15 bp, Homo sapiens
gcaaggccagctcag

SEQ ID NO: 238035 - DNA, 15 bp, Homo sapiens
ggcaaggccagctca

SEQ ID NO: 238036 - DNA, 15 bp, Homo sapiens
tggcaaggccagctc

SEQ ID NO: 238037 - DNA, 15 bp, Homo sapiens
atggcaaggccagct

SEQ ID NO: 238038 - DNA, 15 bp, Homo sapiens
aatggcaaggccagc

SEQ ID NO: 238039 - DNA, 15 bp, Homo sapiens
aaatggcaaggccag

SEQ ID NO: 238040 - DNA, 15 bp, Homo sapiens
taaatggcaaggcca

SEQ ID NO: 238041 - DNA, 15 bp, Homo sapiens
ataaatggcaaggcc

SEQ ID NO: 238042 - DNA, 15 bp, Homo sapiens
aataaatggcaaggc

SEQ ID NO: 238043 - DNA, 15 bp, Homo sapiens
aaataaatggcaagg

SEQ ID NO: 238044 - DNA, 15 bp, Homo sapiens
caaataaatggcaag

SEQ ID NO: 238045 - DNA, 15 bp, Homo sapiens
ccaaataaatggcaa

SEQ ID NO: 238046 - DNA, 15 bp, Homo sapiens
tccaaataaatggca

SEQ ID NO: 238047 - DNA, 15 bp, Homo sapiens
ttccaaataaatggc

SEQ ID NO: 238048 - DNA, 15 bp, Homo sapiens
cttccaaataaatgg

SEQ ID NO: 238049 - DNA, 15 bp, Homo sapiens
acttccaaataaatg

SEQ ID NO: 238050 - DNA, 15 bp, Homo sapiens
tacttccaaataaat

SEQ ID NO: 238051 - DNA, 15 bp, Homo sapiens
gtacttccaaataaa

SEQ ID NO: 238052 - DNA, 15 bp, Homo sapiens
tgtacttccaaataa

SEQ ID NO: 238053 - DNA, 15 bp, Homo sapiens
ttgtacttccaaata

SEQ ID NO: 238054 - DNA, 15 bp, Homo sapiens
attgtacttccaaat

SEQ ID NO: 238055 - DNA, 15 bp, Homo sapiens
aattgtacttccaaa

SEQ ID NO: 238056 - DNA, 15 bp, Homo sapiens
gaattgtacttccaa

SEQ ID NO: 238057 - DNA, 15 bp, Homo sapiens
ggaattgtacttcca

SEQ ID NO: 238058 - DNA, 15 bp, Homo sapiens
tggaattgtacttcc

SEQ ID NO: 238059 - DNA, 15 bp, Homo sapiens
ctggaattgtacttc

SEQ ID NO: 238060 - DNA, 15 bp, Homo sapiens
cctggaattgtactt

SEQ ID NO: 238061 - DNA, 15 bp, Homo sapiens
tcctggaattgtact

SEQ ID NO: 238062 - DNA, 15 bp, Homo sapiens
gtcctggaattgtac

SEQ ID NO: 238063 - DNA, 15 bp, Homo sapiens
ggtcctggaattgta

SEQ ID NO: 238064 - DNA, 15 bp, Homo sapiens
gggtcctggaattgt

SEQ ID NO: 238065 - DNA, 15 bp, Homo sapiens
ggggtcctggaattg

SEQ ID NO: 238066 - DNA, 15 bp, Homo sapiens
cggggtcctggaatt

SEQ ID NO: 238067 - DNA, 15 bp, Homo sapiens
gcggggtcctggaat

SEQ ID NO: 238068 - DNA, 15 bp, Homo sapiens
tgcggggtcctggaa

SEQ ID NO: 238069 - DNA, 15 bp, Homo sapiens
atgcggggtcctgga

SEQ ID NO: 238070 - DNA, 15 bp, Homo sapiens
catgcggggtcctgg

SEQ ID NO: 238071 - DNA, 15 bp, Homo sapiens
acatgcggggtcctg

SEQ ID NO: 238072 - DNA, 15 bp, Homo sapiens
tacatgcggggtcct

SEQ ID NO: 238073 - DNA, 15 bp, Homo sapiens
gtacatgcggggtcc

SEQ ID NO: 238074 - DNA, 15 bp, Homo sapiens
ggtacatgcggggtc

SEQ ID NO: 238075 - DNA, 15 bp, Homo sapiens
tggtacatgcggggt

SEQ ID NO: 238076 - DNA, 15 bp, Homo sapiens
ttggtacatgcgggg

SEQ ID NO: 238077 - DNA, 15 bp, Homo sapiens
tttggtacatgcggg

SEQ ID NO: 238078 - DNA, 15 bp, Homo sapiens
ttttggtacatgcgg

SEQ ID NO: 238079 - DNA, 15 bp, Homo sapiens
gttttggtacatgcg

SEQ ID NO: 238080 - DNA, 15 bp, Homo sapiens
agttttggtacatgc

SEQ ID NO: 238081 - DNA, 15 bp, Homo sapiens
gagttttggtacatg

SEQ ID NO: 238082 - DNA, 15 bp, Homo sapiens
tgagttttggtacat

SEQ ID NO: 238083 - DNA, 15 bp, Homo sapiens
atgagttttggtaca

SEQ ID NO: 238084 - DNA, 15 bp, Homo sapiens
catgagttttggtac

SEQ ID NO: 238085 - DNA, 15 bp, Homo sapiens
acatgagttttggta

SEQ ID NO: 238086 - DNA, 15 bp, Homo sapiens
tacatgagttttggt

SEQ ID NO: 238087 - DNA, 15 bp, Homo sapiens
atacatgagttttgg

SEQ ID NO: 238088 - DNA, 15 bp, Homo sapiens
tatacatgagttttg

SEQ ID NO: 238089 - DNA, 15 bp, Homo sapiens
gtatacatgagtttt

SEQ ID NO: 238090 - DNA, 15 bp, Homo sapiens
agtatacatgagttt

SEQ ID NO: 238091 - DNA, 15 bp, Homo sapiens
gagtatacatgagtt

SEQ ID NO: 238092 - DNA, 15 bp, Homo sapiens
tgagtatacatgagt

SEQ ID NO: 238093 - DNA, 15 bp, Homo sapiens
ttgagtatacatgag

SEQ ID NO: 238094 - DNA, 15 bp, Homo sapiens
cttgagtatacatga

SEQ ID NO: 238095 - DNA, 15 bp, Homo sapiens
acttgagtatacatg

SEQ ID NO: 238096 - DNA, 15 bp, Homo sapiens
gacttgagtatacat

SEQ ID NO: 238097 - DNA, 15 bp, Homo sapiens
ggacttgagtataca

SEQ ID NO: 238098 - DNA, 15 bp, Homo sapiens
gggacttgagtatac

SEQ ID NO: 238099 - DNA, 15 bp, Homo sapiens
tgggacttgagtata

SEQ ID NO: 238100 - DNA, 15 bp, Homo sapiens
gtgggacttgagtat

SEQ ID NO: 238101 - DNA, 15 bp, Homo sapiens
tgtgggacttgagta

SEQ ID NO: 238102 - DNA, 15 bp, Homo sapiens
atgtgggacttgagt

SEQ ID NO: 238103 - DNA, 15 bp, Homo sapiens
aatgtgggacttgag

SEQ ID NO: 238104 - DNA, 15 bp, Homo sapiens
aaatgtgggacttga

SEQ ID NO: 238105 - DNA, 15 bp, Homo sapiens
gaaatgtgggacttg

SEQ ID NO: 238106 - DNA, 15 bp, Homo sapiens
ggaaatgtgggactt

SEQ ID NO: 238107 - DNA, 15 bp, Homo sapiens
gggaaatgtgggact

SEQ ID NO: 238108 - DNA, 15 bp, Homo sapiens
ggggaaatgtgggac

SEQ ID NO: 238109 - DNA, 15 bp, Homo sapiens
tggggaaatgtggga

SEQ ID NO: 238110 - DNA, 15 bp, Homo sapiens
atggggaaatgtggg

SEQ ID NO: 238111 - DNA, 15 bp, Homo sapiens
catggggaaatgtgg

SEQ ID NO: 238112 - DNA, 15 bp, Homo sapiens
ccatggggaaatgtg

SEQ ID NO: 238113 - DNA, 15 bp, Homo sapiens
tccatggggaaatgt

SEQ ID NO: 238114 - DNA, 15 bp, Homo sapiens
ttccatggggaaatg

SEQ ID NO: 238115 - DNA, 15 bp, Homo sapiens
gttccatggggaaat

SEQ ID NO: 238116 - DNA, 15 bp, Homo sapiens
ggttccatggggaaa

SEQ ID NO: 238117 - DNA, 15 bp, Homo sapiens
aggttccatggggaa

SEQ ID NO: 238118 - DNA, 15 bp, Homo sapiens
caggttccatgggga

SEQ ID NO: 238119 - DNA, 15 bp, Homo sapiens
gcaggttccatgggg

SEQ ID NO: 238120 - DNA, 15 bp, Homo sapiens
tgcaggttccatggg

SEQ ID NO: 238121 - DNA, 15 bp, Homo sapiens
atgcaggttccatgg

SEQ ID NO: 238122 - DNA, 15 bp, Homo sapiens
catgcaggttccatg

SEQ ID NO: 238123 - DNA, 15 bp, Homo sapiens
acatgcaggttccat

SEQ ID NO: 238124 - DNA, 15 bp, Homo sapiens
tacatgcaggttcca

SEQ ID NO: 238125 - DNA, 15 bp, Homo sapiens
ctacatgcaggttcc

SEQ ID NO: 238126 - DNA, 15 bp, Homo sapiens
cctacatgcaggttc

SEQ ID NO: 238127 - DNA, 15 bp, Homo sapiens
tcctacatgcaggtt

SEQ ID NO: 238128 - DNA, 15 bp, Homo sapiens
ttcctacatgcaggt

SEQ ID NO: 238129 - DNA, 15 bp, Homo sapiens
tttcctacatgcagg

SEQ ID NO: 238130 - DNA, 15 bp, Homo sapiens
ttttcctacatgcag

SEQ ID NO: 238131 - DNA, 15 bp, Homo sapiens
cttttcctacatgca

SEQ ID NO: 238132 - DNA, 15 bp, Homo sapiens
acttttcctacatgc

SEQ ID NO: 238133 - DNA, 15 bp, Homo sapiens
gacttttcctacatg

SEQ ID NO: 238134 - DNA, 15 bp, Homo sapiens
tgacttttcctacat

SEQ ID NO: 238135 - DNA, 15 bp, Homo sapiens
ctgacttttcctaca

SEQ ID NO: 238136 - DNA, 15 bp, Homo sapiens
gctgacttttcctac

SEQ ID NO: 238137 - DNA, 15 bp, Homo sapiens
agctgacttttccta

SEQ ID NO: 238138 - DNA, 15 bp, Homo sapiens
gagctgacttttcct

SEQ ID NO: 238139 - DNA, 15 bp, Homo sapiens
agagctgacttttcc

SEQ ID NO: 238140 - DNA, 15 bp, Homo sapiens
gagagctgacttttc

SEQ ID NO: 238141 - DNA, 15 bp, Homo sapiens
ggagagctgactttt

SEQ ID NO: 238142 - DNA, 15 bp, Homo sapiens
tggagagctgacttt

SEQ ID NO: 238143 - DNA, 15 bp, Homo sapiens
atggagagctgactt

SEQ ID NO: 238144 - DNA, 15 bp, Homo sapiens
tatggagagctgact

SEQ ID NO: 238145 - DNA, 15 bp, Homo sapiens
atatggagagctgac

SEQ ID NO: 238146 - DNA, 15 bp, Homo sapiens
tatatggagagctga

SEQ ID NO: 238147 - DNA, 15 bp, Homo sapiens
atatatggagagctg

SEQ ID NO: 238148 - DNA, 15 bp, Homo sapiens
tatatatggagagct

SEQ ID NO: 238149 - DNA, 15 bp, Homo sapiens
atatatatggagagc

SEQ ID NO: 238150 - DNA, 15 bp, Homo sapiens
tatatatatggagag

SEQ ID NO: 238151 - DNA, 15 bp, Homo sapiens
atatatatatggaga

SEQ ID NO: 238152 - DNA, 15 bp, Homo sapiens
catatatatatggag

SEQ ID NO: 238153 - DNA, 15 bp, Homo sapiens
ccatatatatatgga

SEQ ID NO: 238154 - DNA, 15 bp, Homo sapiens
cccatatatatatgg

SEQ ID NO: 238155 - DNA, 15 bp, Homo sapiens
acccatatatatatg

SEQ ID NO: 238156 - DNA, 15 bp, Homo sapiens
aacccatatatatat

SEQ ID NO: 238157 - DNA, 15 bp, Homo sapiens
aaacccatatatata

SEQ ID NO: 238158 - DNA, 15 bp, Homo sapiens
gaaacccatatatat

SEQ ID NO: 238159 - DNA, 15 bp, Homo sapiens
cgaaacccatatata

SEQ ID NO: 238160 - DNA, 15 bp, Homo sapiens
gcgaaacccatatat

SEQ ID NO: 238161 - DNA, 15 bp, Homo sapiens
tgcgaaacccatata

SEQ ID NO: 238162 - DNA, 15 bp, Homo sapiens
atgcgaaacccatat

SEQ ID NO: 238163 - DNA, 15 bp, Homo sapiens
gatgcgaaacccata

SEQ ID NO: 238164 - DNA, 15 bp, Homo sapiens
ggatgcgaaacccat

SEQ ID NO: 238165 - DNA, 15 bp, Homo sapiens
aggatgcgaaaccca

SEQ ID NO: 238166 - DNA, 15 bp, Homo sapiens
caggatgcgaaaccc

SEQ ID NO: 238167 - DNA, 15 bp, Homo sapiens
gcaggatgcgaaacc

SEQ ID NO: 238168 - DNA, 15 bp, Homo sapiens
tgcaggatgcgaaac

SEQ ID NO: 238169 - DNA, 15 bp, Homo sapiens
ttgcaggatgcgaaa

SEQ ID NO: 238170 - DNA, 15 bp, Homo sapiens
tttgcaggatgcgaa

SEQ ID NO: 238171 - DNA, 15 bp, Homo sapiens
atttgcaggatgcga

SEQ ID NO: 238172 - DNA, 15 bp, Homo sapiens
tatttgcaggatgcg

SEQ ID NO: 238173 - DNA, 15 bp, Homo sapiens
gtatttgcaggatgc

SEQ ID NO: 238174 - DNA, 15 bp, Homo sapiens
agtatttgcaggatg

SEQ ID NO: 238175 - DNA, 15 bp, Homo sapiens
cagtatttgcaggat

SEQ ID NO: 238176 - DNA, 15 bp, Homo sapiens
acagtatttgcagga

SEQ ID NO: 238177 - DNA, 15 bp, Homo sapiens
atacagtatttgcag

SEQ ID NO: 238178 - DNA, 15 bp, Homo sapiens
aatacagtatttgca

SEQ ID NO: 238179 - DNA, 15 bp, Homo sapiens
aaatacagtatttgc

SEQ ID NO: 238180 - DNA, 15 bp, Homo sapiens
aaaatacagtatttg

SEQ ID NO: 238181 - DNA, 15 bp, Homo sapiens
gaaaatacagtattt

SEQ ID NO: 238182 - DNA, 15 bp, Homo sapiens
ggaaaatacagtatt

SEQ ID NO: 238183 - DNA, 15 bp, Homo sapiens
tggaaaatacagtat

SEQ ID NO: 238184 - DNA, 15 bp, Homo sapiens
atggaaaatacagta

SEQ ID NO: 238185 - DNA, 15 bp, Homo sapiens
tatggaaaatacagt

SEQ ID NO: 238186 - DNA, 15 bp, Homo sapiens
atatggaaaatacag

SEQ ID NO: 238187 - DNA, 15 bp, Homo sapiens
catatggaaaataca

SEQ ID NO: 238188 - DNA, 15 bp, Homo sapiens
acatatggaaaatac

SEQ ID NO: 238189 - DNA, 15 bp, Homo sapiens
aacatatggaaaata

SEQ ID NO: 238190 - DNA, 15 bp, Homo sapiens
aaacatatggaaaat

SEQ ID NO: 238191 - DNA, 15 bp, Homo sapiens
caaacatatggaaaa

SEQ ID NO: 238192 - DNA, 15 bp, Homo sapiens
ccaaacatatggaaa

SEQ ID NO: 238193 - DNA, 15 bp, Homo sapiens
accaaacatatggaa

SEQ ID NO: 238194 - DNA, 15 bp, Homo sapiens
aaccaaacatatgga

SEQ ID NO: 238195 - DNA, 15 bp, Homo sapiens
caaccaaacatatgg

SEQ ID NO: 238196 - DNA, 15 bp, Homo sapiens
tcaaccaaacatatg

SEQ ID NO: 238197 - DNA, 15 bp, Homo sapiens
ttcaaccaaacatat

SEQ ID NO: 238198 - DNA, 15 bp, Homo sapiens
tttcaaccaaacata

SEQ ID NO: 238199 - DNA, 15 bp, Homo sapiens
ttttcaaccaaacat

SEQ ID NO: 238200 - DNA, 15 bp, Homo sapiens
tttttcaaccaaaca

SEQ ID NO: 238201 - DNA, 15 bp, Homo sapiens
ttttttcaaccaaac

SEQ ID NO: 238202 - DNA, 15 bp, Homo sapiens
tttttttcaaccaaa

SEQ ID NO: 238203 - DNA, 15 bp, Homo sapiens
atttttttcaaccaa

SEQ ID NO: 238204 - DNA, 15 bp, Homo sapiens
gatttttttcaacca

SEQ ID NO: 238205 - DNA, 15 bp, Homo sapiens
agatttttttcaacc

SEQ ID NO: 238206 - DNA, 15 bp, Homo sapiens
cagatttttttcaac

SEQ ID NO: 238207 - DNA, 15 bp, Homo sapiens
acagatttttttcaa

SEQ ID NO: 238208 - DNA, 15 bp, Homo sapiens
cacagatttttttca

SEQ ID NO: 238209 - DNA, 15 bp, Homo sapiens
gcacagatttttttc

SEQ ID NO: 238210 - DNA, 15 bp, Homo sapiens
tgcacagattttttt

SEQ ID NO: 238211 - DNA, 15 bp, Homo sapiens
atgcacagatttttt

SEQ ID NO: 238212 - DNA, 15 bp, Homo sapiens
tatgcacagattttt

SEQ ID NO: 238213 - DNA, 15 bp, Homo sapiens
ttatgcacagatttt

SEQ ID NO: 238214 - DNA, 15 bp, Homo sapiens
tttatgcacagattt

SEQ ID NO: 238215 - DNA, 15 bp, Homo sapiens
atttatgcacagatt

SEQ ID NO: 238216 - DNA, 15 bp, Homo sapiens
catttatgcacagat

SEQ ID NO: 238217 - DNA, 15 bp, Homo sapiens
ccatttatgcacaga

SEQ ID NO: 238218 - DNA, 15 bp, Homo sapiens
tccatttatgcacag

SEQ ID NO: 238219 - DNA, 15 bp, Homo sapiens
gtccatttatgcaca

SEQ ID NO: 238220 - DNA, 15 bp, Homo sapiens
ggtccatttatgcac

SEQ ID NO: 238221 - DNA, 15 bp, Homo sapiens
gggtccatttatgca

SEQ ID NO: 238222 - DNA, 15 bp, Homo sapiens
tgggtccatttatgc

SEQ ID NO: 238223 - DNA, 15 bp, Homo sapiens
ctgggtccatttatg

SEQ ID NO: 238224 - DNA, 15 bp, Homo sapiens
cctgggtccatttat

SEQ ID NO: 238225 - DNA, 15 bp, Homo sapiens
tcctgggtccattta

SEQ ID NO: 238226 - DNA, 15 bp, Homo sapiens
ttcctgggtccattt

SEQ ID NO: 238227 - DNA, 15 bp, Homo sapiens
cttcctgggtccatt

SEQ ID NO: 238228 - DNA, 15 bp, Homo sapiens
acttcctgggtccat

SEQ ID NO: 238229 - DNA, 15 bp, Homo sapiens
aacttcctgggtcca

SEQ ID NO: 238230 - DNA, 15 bp, Homo sapiens
aaacttcctgggtcc

SEQ ID NO: 238231 - DNA, 15 bp, Homo sapiens
caaacttcctgggtc

SEQ ID NO: 238232 - DNA, 15 bp, Homo sapiens
ccaaacttcctgggt

SEQ ID NO: 238233 - DNA, 15 bp, Homo sapiens
aaccaaacttcctgg

SEQ ID NO: 238234 - DNA, 15 bp, Homo sapiens
caaccaaacttcctg

SEQ ID NO: 238235 - DNA, 15 bp, Homo sapiens
tcaaccaaacttcct

SEQ ID NO: 238236 - DNA, 15 bp, Homo sapiens
ctcaaccaaacttcc

SEQ ID NO: 238237 - DNA, 15 bp, Homo sapiens
tctcaaccaaacttc

SEQ ID NO: 238238 - DNA, 15 bp, Homo sapiens
ttctcaaccaaactt

SEQ ID NO: 238239 - DNA, 15 bp, Homo sapiens
tttctcaaccaaact

SEQ ID NO: 238240 - DNA, 15 bp, Homo sapiens
ttttctcaaccaaac

SEQ ID NO: 238241 - DNA, 15 bp, Homo sapiens
tttttctcaaccaaa

SEQ ID NO: 238242 - DNA, 15 bp, Homo sapiens
atttttctcaaccaa

SEQ ID NO: 238243 - DNA, 15 bp, Homo sapiens
gatttttctcaacca

SEQ ID NO: 238244 - DNA, 15 bp, Homo sapiens
agatttttctcaacc

SEQ ID NO: 238245 - DNA, 15 bp, Homo sapiens
cagatttttctcaac

SEQ ID NO: 238246 - DNA, 15 bp, Homo sapiens
acagatttttctcaa

SEQ ID NO: 238247 - DNA, 15 bp, Homo sapiens
cacagatttttctca

SEQ ID NO: 238248 - DNA, 15 bp, Homo sapiens
gcacagatttttctc

SEQ ID NO: 238249 - DNA, 15 bp, Homo sapiens
tgcacagatttttct

SEQ ID NO: 238250 - DNA, 15 bp, Homo sapiens
atgcacagatttttc

SEQ ID NO: 238251 - DNA, 15 bp, Homo sapiens
atatgcacagatttt

SEQ ID NO: 238252 - DNA, 15 bp, Homo sapiens
catatgcacagattt

SEQ ID NO: 238253 - DNA, 15 bp, Homo sapiens
acatatgcacagatt

SEQ ID NO: 238254 - DNA, 15 bp, Homo sapiens
cacatatgcacagat

SEQ ID NO: 238255 - DNA, 15 bp, Homo sapiens
tcacatatgcacaga

SEQ ID NO: 238256 - DNA, 15 bp, Homo sapiens
ttcacatatgcacag

SEQ ID NO: 238257 - DNA, 15 bp, Homo sapiens
gttcacatatgcaca

SEQ ID NO: 238258 - DNA, 15 bp, Homo sapiens
ggttcacatatgcac

SEQ ID NO: 238259 - DNA, 15 bp, Homo sapiens
gggttcacatatgca

SEQ ID NO: 238260 - DNA, 15 bp, Homo sapiens
tgggttcacatatgc

SEQ ID NO: 238261 - DNA, 15 bp, Homo sapiens
atgggttcacatatg

SEQ ID NO: 238262 - DNA, 15 bp, Homo sapiens
catgggttcacatat

SEQ ID NO: 238263 - DNA, 15 bp, Homo sapiens
gcatgggttcacata

SEQ ID NO: 238264 - DNA, 15 bp, Homo sapiens
tgcatgggttcacat

SEQ ID NO: 238265 - DNA, 15 bp, Homo sapiens
ctgcatgggttcaca

SEQ ID NO: 238266 - DNA, 15 bp, Homo sapiens
actgcatgggttcac

SEQ ID NO: 238267 - DNA, 15 bp, Homo sapiens
aactgcatgggttca

SEQ ID NO: 238268 - DNA, 15 bp, Homo sapiens
gaactgcatgggttc

SEQ ID NO: 238269 - DNA, 15 bp, Homo sapiens
tgaactgcatgggtt

SEQ ID NO: 238270 - DNA, 15 bp, Homo sapiens
ctgaactgcatgggt

SEQ ID NO: 238271 - DNA, 15 bp, Homo sapiens
tctgaactgcatggg

SEQ ID NO: 238272 - DNA, 15 bp, Homo sapiens
gtctgaactgcatgg

SEQ ID NO: 238273 - DNA, 15 bp, Homo sapiens
ggtctgaactgcatg

SEQ ID NO: 238274 - DNA, 15 bp, Homo sapiens
aggtctgaactgcat

SEQ ID NO: 238275 - DNA, 15 bp, Homo sapiens
taggtctgaactgca

SEQ ID NO: 238276 - DNA, 15 bp, Homo sapiens
ttaggtctgaactgc

SEQ ID NO: 238277 - DNA, 15 bp, Homo sapiens
cttaggtctgaactg

SEQ ID NO: 238278 - DNA, 15 bp, Homo sapiens
acttaggtctgaact

SEQ ID NO: 238279 - DNA, 15 bp, Homo sapiens
aacttaggtctgaac

SEQ ID NO: 238280 - DNA, 15 bp, Homo sapiens
taacttaggtctgaa

SEQ ID NO: 238281 - DNA, 15 bp, Homo sapiens
ataacttaggtctga

SEQ ID NO: 238282 - DNA, 15 bp, Homo sapiens
aataacttaggtctg

SEQ ID NO: 238283 - DNA, 15 bp, Homo sapiens
aaataacttaggtct

SEQ ID NO: 238284 - DNA, 15 bp, Homo sapiens
taaataacttaggtc

SEQ ID NO: 238285 - DNA, 15 bp, Homo sapiens
ttaaataacttaggt

SEQ ID NO: 238286 - DNA, 15 bp, Homo sapiens
cttaaataacttagg

SEQ ID NO: 238287 - DNA, 15 bp, Homo sapiens
ccttaaataacttag

SEQ ID NO: 238288 - DNA, 15 bp, Homo sapiens
tccttaaataactta

SEQ ID NO: 238289 - DNA, 15 bp, Homo sapiens
atccttaaataactt

SEQ ID NO: 238290 - DNA, 15 bp, Homo sapiens
gatccttaaataact

SEQ ID NO: 238291 - DNA, 15 bp, Homo sapiens
tgatccttaaataac

SEQ ID NO: 238292 - DNA, 15 bp, Homo sapiens
ttgatccttaaataa

SEQ ID NO: 238293 - DNA, 15 bp, Homo sapiens
gttgatccttaaata

SEQ ID NO: 238294 - DNA, 15 bp, Homo sapiens
agttgatccttaaat

SEQ ID NO: 238295 - DNA, 15 bp, Homo sapiens
cagttgatccttaaa

SEQ ID NO: 238296 - DNA, 15 bp, Homo sapiens
acagttgatccttaa

SEQ ID NO: 238297 - DNA, 15 bp, Homo sapiens
tacagttgatcctta

SEQ ID NO: 238298 - DNA, 15 bp, Homo sapiens
atacagttgatcctt

SEQ ID NO: 238299 - DNA, 15 bp, Homo sapiens
aatacagttgatcct

SEQ ID NO: 238300 - DNA, 15 bp, Homo sapiens
taatacagttgatcc

SEQ ID NO: 238301 - DNA, 15 bp, Homo sapiens
ctaatacagttgatc

SEQ ID NO: 238302 - DNA, 15 bp, Homo sapiens
gctaatacagttgat

SEQ ID NO: 238303 - DNA, 15 bp, Homo sapiens
agctaatacagttga

SEQ ID NO: 238304 - DNA, 15 bp, Homo sapiens
aagctaatacagttg

SEQ ID NO: 238305 - DNA, 15 bp, Homo sapiens
aaagctaatacagtt

SEQ ID NO: 238306 - DNA, 15 bp, Homo sapiens
aaaagctaatacagt

SEQ ID NO: 238307 - DNA, 15 bp, Homo sapiens
caaaagctaatacag

SEQ ID NO: 238308 - DNA, 15 bp, Homo sapiens
acaaaagctaataca

SEQ ID NO: 238309 - DNA, 15 bp, Homo sapiens
aacaaaagctaatac

SEQ ID NO: 238310 - DNA, 15 bp, Homo sapiens
taacaaaagctaata

SEQ ID NO: 238311 - DNA, 15 bp, Homo sapiens
ataacaaaagctaat

SEQ ID NO: 238312 - DNA, 15 bp, Homo sapiens
tataacaaaagctaa

SEQ ID NO: 238313 - DNA, 15 bp, Homo sapiens
atataacaaaagcta

SEQ ID NO: 238314 - DNA, 15 bp, Homo sapiens
aatataacaaaagct

SEQ ID NO: 238315 - DNA, 15 bp, Homo sapiens
gaatataacaaaagc

SEQ ID NO: 238316 - DNA, 15 bp, Homo sapiens
cgaatataacaaaag

SEQ ID NO: 238317 - DNA, 15 bp, Homo sapiens
acgaatataacaaaa

SEQ ID NO: 238318 - DNA, 15 bp, Homo sapiens
aacgaatataacaaa

SEQ ID NO: 238319 - DNA, 15 bp, Homo sapiens
aaacgaatataacaa

SEQ ID NO: 238320 - DNA, 15 bp, Homo sapiens
gaaacgaatataaca

SEQ ID NO: 238321 - DNA, 15 bp, Homo sapiens
ggaaacgaatataac

SEQ ID NO: 238322 - DNA, 15 bp, Homo sapiens
tggaaacgaatataa

SEQ ID NO: 238323 - DNA, 15 bp, Homo sapiens
ttggaaacgaatata

SEQ ID NO: 238324 - DNA, 15 bp, Homo sapiens
attggaaacgaatat

SEQ ID NO: 238325 - DNA, 15 bp, Homo sapiens
tattggaaacgaata

SEQ ID NO: 238326 - DNA, 15 bp, Homo sapiens
ttattggaaacgaat

SEQ ID NO: 238327 - DNA, 15 bp, Homo sapiens
attattggaaacgaa

SEQ ID NO: 238328 - DNA, 15 bp, Homo sapiens
tattattggaaacga

SEQ ID NO: 238329 - DNA, 15 bp, Homo sapiens
atattattggaaacg

SEQ ID NO: 238330 - DNA, 15 bp, Homo sapiens
tatattattggaaac

SEQ ID NO: 238331 - DNA, 15 bp, Homo sapiens
atatattattggaaa

SEQ ID NO: 238332 - DNA, 15 bp, Homo sapiens
aatatattattggaa

SEQ ID NO: 238333 - DNA, 15 bp, Homo sapiens
aaaaatatattattg

SEQ ID NO: 238334 - DNA, 15 bp, Homo sapiens
aaaaaatatattatt

SEQ ID NO: 238335 - DNA, 15 bp, Homo sapiens
caaaaaatatattat

SEQ ID NO: 238336 - DNA, 15 bp, Homo sapiens
acaaaaaatatatta

SEQ ID NO: 238337 - DNA, 15 bp, Homo sapiens
aacaaaaaatatatt

SEQ ID NO: 238338 - DNA, 15 bp, Homo sapiens
gaacaaaaaatatat

SEQ ID NO: 238339 - DNA, 15 bp, Homo sapiens
agaacaaaaaatata

SEQ ID NO: 238340 - DNA, 15 bp, Homo sapiens
aagaacaaaaaatat

SEQ ID NO: 238341 - DNA, 15 bp, Homo sapiens
aaagaacaaaaaata

SEQ ID NO: 238342 - DNA, 15 bp, Homo sapiens
aaaagaacaaaaaat

SEQ ID NO: 238343 - DNA, 15 bp, Homo sapiens
gaaaagaacaaaaaa

SEQ ID NO: 238344 - DNA, 15 bp, Homo sapiens
agaaaagaacaaaaa

SEQ ID NO: 238345 - DNA, 15 bp, Homo sapiens
aagaaaagaacaaaa

SEQ ID NO: 238346 - DNA, 15 bp, Homo sapiens
gaagaaaagaacaaa

SEQ ID NO: 238347 - DNA, 15 bp, Homo sapiens
agaagaaaagaacaa

SEQ ID NO: 238348 - DNA, 15 bp, Homo sapiens
tagaagaaaagaaca

SEQ ID NO: 238349 - DNA, 15 bp, Homo sapiens
ctagaagaaaagaac

SEQ ID NO: 238350 - DNA, 15 bp, Homo sapiens
cctagaagaaaagaa

SEQ ID NO: 238351 - DNA, 15 bp, Homo sapiens
gcctagaagaaaaga

SEQ ID NO: 238352 - DNA, 15 bp, Homo sapiens
tgcctagaagaaaag

SEQ ID NO: 238353 - DNA, 15 bp, Homo sapiens
atgcctagaagaaaa

SEQ ID NO: 238354 - DNA, 15 bp, Homo sapiens
aatgcctagaagaaa

SEQ ID NO: 238355 - DNA, 15 bp, Homo sapiens
aaatgcctagaagaa

SEQ ID NO: 238356 - DNA, 15 bp, Homo sapiens
taaatgcctagaaga

SEQ ID NO: 238357 - DNA, 15 bp, Homo sapiens
ctaaatgcctagaag

SEQ ID NO: 238358 - DNA, 15 bp, Homo sapiens
tctaaatgcctagaa

SEQ ID NO: 238359 - DNA, 15 bp, Homo sapiens
ctctaaatgcctaga

SEQ ID NO: 238360 - DNA, 15 bp, Homo sapiens
tctctaaatgcctag

SEQ ID NO: 238361 - DNA, 15 bp, Homo sapiens
ttctctaaatgccta

SEQ ID NO: 238362 - DNA, 15 bp, Homo sapiens
cttctctaaatgcct

SEQ ID NO: 238363 - DNA, 15 bp, Homo sapiens
tcttctctaaatgcc

SEQ ID NO: 238364 - DNA, 15 bp, Homo sapiens
ttcttctctaaatgc

SEQ ID NO: 238365 - DNA, 15 bp, Homo sapiens
tttcttctctaaatg

SEQ ID NO: 238366 - DNA, 15 bp, Homo sapiens
atttcttctctaaat

SEQ ID NO: 238367 - DNA, 15 bp, Homo sapiens
aatttcttctctaaa

SEQ ID NO: 238368 - DNA, 15 bp, Homo sapiens
caatttcttctctaa

SEQ ID NO: 238369 - DNA, 15 bp, Homo sapiens
gcaatttcttctcta

SEQ ID NO: 238370 - DNA, 15 bp, Homo sapiens
tgcaatttcttctct

SEQ ID NO: 238371 - DNA, 15 bp, Homo sapiens
gtgcaatttcttctc

SEQ ID NO: 238372 - DNA, 15 bp, Homo sapiens
ggtgcaatttcttct

SEQ ID NO: 238373 - DNA, 15 bp, Homo sapiens
tggtgcaatttcttc

SEQ ID NO: 238374 - DNA, 15 bp, Homo sapiens
ttggtgcaatttctt

SEQ ID NO: 238375 - DNA, 15 bp, Homo sapiens
attggtgcaatttct

SEQ ID NO: 238376 - DNA, 15 bp, Homo sapiens
gattggtgcaatttc

SEQ ID NO: 238377 - DNA, 15 bp, Homo sapiens
tgattggtgcaattt

SEQ ID NO: 238378 - DNA, 15 bp, Homo sapiens
ttgattggtgcaatt

SEQ ID NO: 238379 - DNA, 15 bp, Homo sapiens
gttgattggtgcaat

SEQ ID NO: 238380 - DNA, 15 bp, Homo sapiens
agttgattggtgcaa

SEQ ID NO: 238381 - DNA, 15 bp, Homo sapiens
aagttgattggtgca

SEQ ID NO: 238382 - DNA, 15 bp, Homo sapiens
aaagttgattggtgc

SEQ ID NO: 238383 - DNA, 15 bp, Homo sapiens
taaagttgattggtg

SEQ ID NO: 238384 - DNA, 15 bp, Homo sapiens
ttaaagttgattggt

SEQ ID NO: 238385 - DNA, 15 bp, Homo sapiens
tttaaagttgattgg

SEQ ID NO: 238386 - DNA, 15 bp, Homo sapiens
ctttaaagttgattg

SEQ ID NO: 238387 - DNA, 15 bp, Homo sapiens
actttaaagttgatt

SEQ ID NO: 238388 - DNA, 15 bp, Homo sapiens
aactttaaagttgat

SEQ ID NO: 238389 - DNA, 15 bp, Homo sapiens
taactttaaagttga

SEQ ID NO: 238390 - DNA, 15 bp, Homo sapiens
ttaactttaaagttg

SEQ ID NO: 238391 - DNA, 15 bp, Homo sapiens
tttaactttaaagtt

SEQ ID NO: 238392 - DNA, 15 bp, Homo sapiens
ttttaactttaaagt

SEQ ID NO: 238393 - DNA, 15 bp, Homo sapiens
gttttaactttaaag

SEQ ID NO: 238394 - DNA, 15 bp, Homo sapiens
cgttttaactttaaa

SEQ ID NO: 238395 - DNA, 15 bp, Homo sapiens
ccgttttaactttaa

SEQ ID NO: 238396 - DNA, 15 bp, Homo sapiens
accgttttaacttta

SEQ ID NO: 238397 - DNA, 15 bp, Homo sapiens
caccgttttaacttt

SEQ ID NO: 238398 - DNA, 15 bp, Homo sapiens
tcaccgttttaactt

SEQ ID NO: 238399 - DNA, 15 bp, Homo sapiens
ttcaccgttttaact

SEQ ID NO: 238400 - DNA, 15 bp, Homo sapiens
attcaccgttttaac

SEQ ID NO: 238401 - DNA, 15 bp, Homo sapiens
cattcaccgttttaa

SEQ ID NO: 238402 - DNA, 15 bp, Homo sapiens
tcattcaccgtttta

SEQ ID NO: 238403 - DNA, 15 bp, Homo sapiens
atcattcaccgtttt

SEQ ID NO: 238404 - DNA, 15 bp, Homo sapiens
aatcattcaccgttt

SEQ ID NO: 238405 - DNA, 15 bp, Homo sapiens
aaatcattcaccgtt

SEQ ID NO: 238406 - DNA, 15 bp, Homo sapiens
taaatcattcaccgt

SEQ ID NO: 238407 - DNA, 15 bp, Homo sapiens
ataaatcattcaccg

SEQ ID NO: 238408 - DNA, 15 bp, Homo sapiens
gataaatcattcacc

SEQ ID NO: 238409 - DNA, 15 bp, Homo sapiens
ggataaatcattcac

SEQ ID NO: 238410 - DNA, 15 bp, Homo sapiens
tggataaatcattca

SEQ ID NO: 238411 - DNA, 15 bp, Homo sapiens
ctggataaatcattc

SEQ ID NO: 238412 - DNA, 15 bp, Homo sapiens
actggataaatcatt

SEQ ID NO: 238413 - DNA, 15 bp, Homo sapiens
gactggataaatcat

SEQ ID NO: 238414 - DNA, 15 bp, Homo sapiens
tgactggataaatca

SEQ ID NO: 238415 - DNA, 15 bp, Homo sapiens
ctgactggataaatc

SEQ ID NO: 238416 - DNA, 15 bp, Homo sapiens
gctgactggataaat

SEQ ID NO: 238417 - DNA, 15 bp, Homo sapiens
agctgactggataaa

SEQ ID NO: 238418 - DNA, 15 bp, Homo sapiens
cagctgactggataa

SEQ ID NO: 238419 - DNA, 15 bp, Homo sapiens
acagctgactggata

SEQ ID NO: 238420 - DNA, 15 bp, Homo sapiens
gacagctgactggat

SEQ ID NO: 238421 - DNA, 15 bp, Homo sapiens
agacagctgactgga

SEQ ID NO: 238422 - DNA, 15 bp, Homo sapiens
gagacagctgactgg

SEQ ID NO: 238423 - DNA, 15 bp, Homo sapiens
ggagacagctgactg

SEQ ID NO: 238424 - DNA, 15 bp, Homo sapiens
tggagacagctgact

SEQ ID NO: 238425 - DNA, 15 bp, Homo sapiens
gtggagacagctgac

SEQ ID NO: 238426 - DNA, 15 bp, Homo sapiens
agtggagacagctga

SEQ ID NO: 238427 - DNA, 15 bp, Homo sapiens
aagtggagacagctg

SEQ ID NO: 238428 - DNA, 15 bp, Homo sapiens
caagtggagacagct

SEQ ID NO: 238429 - DNA, 15 bp, Homo sapiens
tcaagtggagacagc

SEQ ID NO: 238430 - DNA, 15 bp, Homo sapiens
gtcaagtggagacag

SEQ ID NO: 238431 - DNA, 15 bp, Homo sapiens
ggtcaagtggagaca

SEQ ID NO: 238432 - DNA, 15 bp, Homo sapiens
aggtcaagtggagac

SEQ ID NO: 238433 - DNA, 15 bp, Homo sapiens
caggtcaagtggaga

SEQ ID NO: 238434 - DNA, 15 bp, Homo sapiens
gcaggtcaagtggag

SEQ ID NO: 238435 - DNA, 15 bp, Homo sapiens
tgcaggtcaagtgga

SEQ ID NO: 238436 - DNA, 15 bp, Homo sapiens
atgcaggtcaagtgg

SEQ ID NO: 238437 - DNA, 15 bp, Homo sapiens
gatgcaggtcaagtg

SEQ ID NO: 238438 - DNA, 15 bp, Homo sapiens
ggatgcaggtcaagt

SEQ ID NO: 238439 - DNA, 15 bp, Homo sapiens
gggatgcaggtcaag

SEQ ID NO: 238440 - DNA, 15 bp, Homo sapiens
agggatgcaggtcaa

SEQ ID NO: 238441 - DNA, 15 bp, Homo sapiens
gagggatgcaggtca

SEQ ID NO: 238442 - DNA, 15 bp, Homo sapiens
agagggatgcaggtc

SEQ ID NO: 238443 - DNA, 15 bp, Homo sapiens
gagagggatgcaggt

SEQ ID NO: 238444 - DNA, 15 bp, Homo sapiens
agagagggatgcagg

SEQ ID NO: 238445 - DNA, 15 bp, Homo sapiens
tagagagggatgcag

SEQ ID NO: 238446 - DNA, 15 bp, Homo sapiens
ttagagagggatgca

SEQ ID NO: 238447 - DNA, 15 bp, Homo sapiens
tttagagagggatgc

SEQ ID NO: 238448 - DNA, 15 bp, Homo sapiens
ctttagagagggatg

SEQ ID NO: 238449 - DNA, 15 bp, Homo sapiens
tctttagagagggat

SEQ ID NO: 238450 - DNA, 15 bp, Homo sapiens
atctttagagaggga

SEQ ID NO: 238451 - DNA, 15 bp, Homo sapiens
catctttagagaggg

SEQ ID NO: 238452 - DNA, 15 bp, Homo sapiens
acatctttagagagg

SEQ ID NO: 238453 - DNA, 15 bp, Homo sapiens
gacatctttagagag

SEQ ID NO: 238454 - DNA, 15 bp, Homo sapiens
agacatctttagaga

SEQ ID NO: 238455 - DNA, 15 bp, Homo sapiens
gagacatctttagag

SEQ ID NO: 238456 - DNA, 15 bp, Homo sapiens
cgagacatctttaga

SEQ ID NO: 238457 - DNA, 15 bp, Homo sapiens
gcgagacatctttag

SEQ ID NO: 238458 - DNA, 15 bp, Homo sapiens
ggcgagacatcttta

SEQ ID NO: 238459 - DNA, 15 bp, Homo sapiens
tggcgagacatcttt

SEQ ID NO: 238460 - DNA, 15 bp, Homo sapiens
ctggcgagacatctt

SEQ ID NO: 238461 - DNA, 15 bp, Homo sapiens
gctggcgagacatct

SEQ ID NO: 238462 - DNA, 15 bp, Homo sapiens
agctggcgagacatc

SEQ ID NO: 238463 - DNA, 15 bp, Homo sapiens
tagctggcgagacat

SEQ ID NO: 238464 - DNA, 15 bp, Homo sapiens
ctagctggcgagaca

SEQ ID NO: 238465 - DNA, 15 bp, Homo sapiens
tctagctggcgagac

SEQ ID NO: 238466 - DNA, 15 bp, Homo sapiens
atctagctggcgaga

SEQ ID NO: 238467 - DNA, 15 bp, Homo sapiens
catctagctggcgag

SEQ ID NO: 238468 - DNA, 15 bp, Homo sapiens
tcatctagctggcga

SEQ ID NO: 238469 - DNA, 15 bp, Homo sapiens
gtcatctagctggcg

SEQ ID NO: 238470 - DNA, 15 bp, Homo sapiens
ggtcatctagctggc

SEQ ID NO: 238471 - DNA, 15 bp, Homo sapiens
aggtcatctagctgg

SEQ ID NO: 238472 - DNA, 15 bp, Homo sapiens
aaggtcatctagctg

SEQ ID NO: 238473 - DNA, 15 bp, Homo sapiens
taaggtcatctagct

SEQ ID NO: 238474 - DNA, 15 bp, Homo sapiens
ttaaggtcatctagc

SEQ ID NO: 238475 - DNA, 15 bp, Homo sapiens
attaaggtcatctag

SEQ ID NO: 238476 - DNA, 15 bp, Homo sapiens
tattaaggtcatcta

SEQ ID NO: 238477 - DNA, 15 bp, Homo sapiens
atattaaggtcatct

SEQ ID NO: 238478 - DNA, 15 bp, Homo sapiens
catattaaggtcatc

SEQ ID NO: 238479 - DNA, 15 bp, Homo sapiens
gcatattaaggtcat

SEQ ID NO: 238480 - DNA, 15 bp, Homo sapiens
cgcatattaaggtca

SEQ ID NO: 238481 - DNA, 15 bp, Homo sapiens
tcgcatattaaggtc

SEQ ID NO: 238482 - DNA, 15 bp, Homo sapiens
atcgcatattaaggt

SEQ ID NO: 238483 - DNA, 15 bp, Homo sapiens
catcgcatattaagg

SEQ ID NO: 238484 - DNA, 15 bp, Homo sapiens
ccatcgcatattaag

SEQ ID NO: 238485 - DNA, 15 bp, Homo sapiens
tccatcgcatattaa

SEQ ID NO: 238486 - DNA, 15 bp, Homo sapiens
ttccatcgcatatta

SEQ ID NO: 238487 - DNA, 15 bp, Homo sapiens
tttccatcgcatatt

SEQ ID NO: 238488 - DNA, 15 bp, Homo sapiens
gtttccatcgcatat

SEQ ID NO: 238489 - DNA, 15 bp, Homo sapiens
agtttccatcgcata

SEQ ID NO: 238490 - DNA, 15 bp, Homo sapiens
aagtttccatcgcat

SEQ ID NO: 238491 - DNA, 15 bp, Homo sapiens
aaagtttccatcgca

SEQ ID NO: 238492 - DNA, 15 bp, Homo sapiens
aaaagtttccatcgc

SEQ ID NO: 238493 - DNA, 15 bp, Homo sapiens
taaaagtttccatcg

SEQ ID NO: 238494 - DNA, 15 bp, Homo sapiens
gtaaaagtttccatc

SEQ ID NO: 238495 - DNA, 15 bp, Homo sapiens
tgtaaaagtttccat

SEQ ID NO: 238496 - DNA, 15 bp, Homo sapiens
ctgtaaaagtttcca

SEQ ID NO: 238497 - DNA, 15 bp, Homo sapiens
cctgtaaaagtttcc

SEQ ID NO: 238498 - DNA, 15 bp, Homo sapiens
acctgtaaaagtttc

SEQ ID NO: 238499 - DNA, 15 bp, Homo sapiens
tacctgtaaaagttt

SEQ ID NO: 238500 - DNA, 15 bp, Homo sapiens
atacctgtaaaagtt

SEQ ID NO: 238501 - DNA, 15 bp, Homo sapiens
gatacctgtaaaagt

SEQ ID NO: 238502 - DNA, 15 bp, Homo sapiens
tgatacctgtaaaag

SEQ ID NO: 238503 - DNA, 15 bp, Homo sapiens
ctgatacctgtaaaa

SEQ ID NO: 238504 - DNA, 15 bp, Homo sapiens
gctgatacctgtaaa

SEQ ID NO: 238505 - DNA, 15 bp, Homo sapiens
agctgatacctgtaa

SEQ ID NO: 238506 - DNA, 15 bp, Homo sapiens
aagctgatacctgta

SEQ ID NO: 238507 - DNA, 15 bp, Homo sapiens
taagctgatacctgt

SEQ ID NO: 238508 - DNA, 15 bp, Homo sapiens
ataagctgatacctg

SEQ ID NO: 238509 - DNA, 15 bp, Homo sapiens
aataagctgatacct

SEQ ID NO: 238510 - DNA, 15 bp, Homo sapiens
gaataagctgatacc

SEQ ID NO: 238511 - DNA, 15 bp, Homo sapiens
ggaataagctgatac

SEQ ID NO: 238512 - DNA, 15 bp, Homo sapiens
gggaataagctgata

SEQ ID NO: 238513 - DNA, 15 bp, Homo sapiens
ggggaataagctgat

SEQ ID NO: 238514 - DNA, 15 bp, Homo sapiens
aggggaataagctga

SEQ ID NO: 238515 - DNA, 15 bp, Homo sapiens
aaggggaataagctg

SEQ ID NO: 238516 - DNA, 15 bp, Homo sapiens
gaaggggaataagct

SEQ ID NO: 238517 - DNA, 15 bp, Homo sapiens
tgaaggggaataagc

SEQ ID NO: 238518 - DNA, 15 bp, Homo sapiens
atgaaggggaataag

SEQ ID NO: 238519 - DNA, 15 bp, Homo sapiens
tatgaaggggaataa

SEQ ID NO: 238520 - DNA, 15 bp, Homo sapiens
ttatgaaggggaata

SEQ ID NO: 238521 - DNA, 15 bp, Homo sapiens
attatgaaggggaat

SEQ ID NO: 238522 - DNA, 15 bp, Homo sapiens
cattatgaaggggaa

SEQ ID NO: 238523 - DNA, 15 bp, Homo sapiens
gcattatgaagggga

SEQ ID NO: 238524 - DNA, 15 bp, Homo sapiens
tgcattatgaagggg

SEQ ID NO: 238525 - DNA, 15 bp, Homo sapiens
ctgcattatgaaggg

SEQ ID NO: 238526 - DNA, 15 bp, Homo sapiens
cctgcattatgaagg

SEQ ID NO: 238527 - DNA, 15 bp, Homo sapiens
gcctgcattatgaag

SEQ ID NO: 238528 - DNA, 15 bp, Homo sapiens
agcctgcattatgaa

SEQ ID NO: 238529 - DNA, 15 bp, Homo sapiens
aagcctgcattatga

SEQ ID NO: 238530 - DNA, 15 bp, Homo sapiens
taagcctgcattatg

SEQ ID NO: 238531 - DNA, 15 bp, Homo sapiens
gtaagcctgcattat

SEQ ID NO: 238532 - DNA, 15 bp, Homo sapiens
tgtaagcctgcatta

SEQ ID NO: 238533 - DNA, 15 bp, Homo sapiens
gtgtaagcctgcatt

SEQ ID NO: 238534 - DNA, 15 bp, Homo sapiens
ggtgtaagcctgcat

SEQ ID NO: 238535 - DNA, 15 bp, Homo sapiens
aggtgtaagcctgca

SEQ ID NO: 238536 - DNA, 15 bp, Homo sapiens
aaggtgtaagcctgc

SEQ ID NO: 238537 - DNA, 15 bp, Homo sapiens
caaggtgtaagcctg

SEQ ID NO: 238538 - DNA, 15 bp, Homo sapiens
ccaaggtgtaagcct

SEQ ID NO: 238539 - DNA, 15 bp, Homo sapiens
cccaaggtgtaagcc

SEQ ID NO: 238540 - DNA, 15 bp, Homo sapiens
acccaaggtgtaagc

SEQ ID NO: 238541 - DNA, 15 bp, Homo sapiens
cacccaaggtgtaag

SEQ ID NO: 238542 - DNA, 15 bp, Homo sapiens
ccacccaaggtgtaa

SEQ ID NO: 238543 - DNA, 15 bp, Homo sapiens
accacccaaggtgta

SEQ ID NO: 238544 - DNA, 15 bp, Homo sapiens
gaccacccaaggtgt

SEQ ID NO: 238545 - DNA, 15 bp, Homo sapiens
agaccacccaaggtg

SEQ ID NO: 238546 - DNA, 15 bp, Homo sapiens
aagaccacccaaggt

SEQ ID NO: 238547 - DNA, 15 bp, Homo sapiens
aaagaccacccaagg

SEQ ID NO: 238548 - DNA, 15 bp, Homo sapiens
taaagaccacccaag

SEQ ID NO: 238549 - DNA, 15 bp, Homo sapiens
ttaaagaccacccaa

SEQ ID NO: 238550 - DNA, 15 bp, Homo sapiens
tttaaagaccaccca

SEQ ID NO: 238551 - DNA, 15 bp, Homo sapiens
gtttaaagaccaccc

SEQ ID NO: 238552 - DNA, 15 bp, Homo sapiens
ggtttaaagaccacc

SEQ ID NO: 238553 - DNA, 15 bp, Homo sapiens
gggtttaaagaccac

SEQ ID NO: 238554 - DNA, 15 bp, Homo sapiens
agggtttaaagacca

SEQ ID NO: 238555 - DNA, 15 bp, Homo sapiens
tagggtttaaagacc

SEQ ID NO: 238556 - DNA, 15 bp, Homo sapiens
gtagggtttaaagac

SEQ ID NO: 238557 - DNA, 15 bp, Homo sapiens
ggtagggtttaaaga

SEQ ID NO: 238558 - DNA, 15 bp, Homo sapiens
aggtagggtttaaag

SEQ ID NO: 238559 - DNA, 15 bp, Homo sapiens
gaggtagggtttaaa

SEQ ID NO: 238560 - DNA, 15 bp, Homo sapiens
tgaggtagggtttaa

SEQ ID NO: 238561 - DNA, 15 bp, Homo sapiens
gtgaggtagggttta

SEQ ID NO: 238562 - DNA, 15 bp, Homo sapiens
agtgaggtagggttt

SEQ ID NO: 238563 - DNA, 15 bp, Homo sapiens
tagtgaggtagggtt

SEQ ID NO: 238564 - DNA, 15 bp, Homo sapiens
atagtgaggtagggt

SEQ ID NO: 238565 - DNA, 15 bp, Homo sapiens
tatagtgaggtaggg

SEQ ID NO: 238566 - DNA, 15 bp, Homo sapiens
atatagtgaggtagg

SEQ ID NO: 238567 - DNA, 15 bp, Homo sapiens
aatatagtgaggtag

SEQ ID NO: 238568 - DNA, 15 bp, Homo sapiens
taatatagtgaggta

SEQ ID NO: 238569 - DNA, 15 bp, Homo sapiens
gtaatatagtgaggt

SEQ ID NO: 238570 - DNA, 15 bp, Homo sapiens
ggtaatatagtgagg

SEQ ID NO: 238571 - DNA, 15 bp, Homo sapiens
tggtaatatagtgag

SEQ ID NO: 238572 - DNA, 15 bp, Homo sapiens
gtggtaatatagtga

SEQ ID NO: 238573 - DNA, 15 bp, Homo sapiens
agtggtaatatagtg

SEQ ID NO: 238574 - DNA, 15 bp, Homo sapiens
gagtggtaatatagt

SEQ ID NO: 238575 - DNA, 15 bp, Homo sapiens
tgagtggtaatatag

SEQ ID NO: 238576 - DNA, 15 bp, Homo sapiens
gtgagtggtaatata

SEQ ID NO: 238577 - DNA, 15 bp, Homo sapiens
ggtgagtggtaatat

SEQ ID NO: 238578 - DNA, 15 bp, Homo sapiens
cggtgagtggtaata

SEQ ID NO: 238579 - DNA, 15 bp, Homo sapiens
acggtgagtggtaat

SEQ ID NO: 238580 - DNA, 15 bp, Homo sapiens
aacggtgagtggtaa

SEQ ID NO: 238581 - DNA, 15 bp, Homo sapiens
aaacggtgagtggta

SEQ ID NO: 238582 - DNA, 15 bp, Homo sapiens
aaaacggtgagtggt

SEQ ID NO: 238583 - DNA, 15 bp, Homo sapiens
gaaaacggtgagtgg

SEQ ID NO: 238584 - DNA, 15 bp, Homo sapiens
gagaaaacggtgagt

SEQ ID NO: 238585 - DNA, 15 bp, Homo sapiens
agagaaaacggtgag

SEQ ID NO: 238586 - DNA, 15 bp, Homo sapiens
aagagaaaacggtga

SEQ ID NO: 238587 - DNA, 15 bp, Homo sapiens
aaagagaaaacggtg

SEQ ID NO: 238588 - DNA, 15 bp, Homo sapiens
gaaagagaaaacggt

SEQ ID NO: 238589 - DNA, 15 bp, Homo sapiens
agaaagagaaaacgg

SEQ ID NO: 238590 - DNA, 15 bp, Homo sapiens
aagaaagagaaaacg

SEQ ID NO: 238591 - DNA, 15 bp, Homo sapiens
aaagaaagagaaaac

SEQ ID NO: 238592 - DNA, 15 bp, Homo sapiens
caaagaaagagaaaa

SEQ ID NO: 238593 - DNA, 15 bp, Homo sapiens
gcaaagaaagagaaa

SEQ ID NO: 238594 - DNA, 15 bp, Homo sapiens
agcaaagaaagagaa

SEQ ID NO: 238595 - DNA, 15 bp, Homo sapiens
cagcaaagaaagaga

SEQ ID NO: 238596 - DNA, 15 bp, Homo sapiens
tcagcaaagaaagag

SEQ ID NO: 238597 - DNA, 15 bp, Homo sapiens
atcagcaaagaaaga

SEQ ID NO: 238598 - DNA, 15 bp, Homo sapiens
catcagcaaagaaag

SEQ ID NO: 238599 - DNA, 15 bp, Homo sapiens
ccatcagcaaagaaa

SEQ ID NO: 238600 - DNA, 15 bp, Homo sapiens
accatcagcaaagaa

SEQ ID NO: 238601 - DNA, 15 bp, Homo sapiens
taccatcagcaaaga

SEQ ID NO: 238602 - DNA, 15 bp, Homo sapiens
ataccatcagcaaag

SEQ ID NO: 238603 - DNA, 15 bp, Homo sapiens
aataccatcagcaaa

SEQ ID NO: 238604 - DNA, 15 bp, Homo sapiens
aaataccatcagcaa

SEQ ID NO: 238605 - DNA, 15 bp, Homo sapiens
caaataccatcagca

SEQ ID NO: 238606 - DNA, 15 bp, Homo sapiens
tcaaataccatcagc

SEQ ID NO: 238607 - DNA, 15 bp, Homo sapiens
atcaaataccatcag

SEQ ID NO: 238608 - DNA, 15 bp, Homo sapiens
tatcaaataccatca

SEQ ID NO: 238609 - DNA, 15 bp, Homo sapiens
ttatcaaataccatc

SEQ ID NO: 238610 - DNA, 15 bp, Homo sapiens
attatcaaataccat

SEQ ID NO: 238611 - DNA, 15 bp, Homo sapiens
cattatcaaatacca

SEQ ID NO: 238612 - DNA, 15 bp, Homo sapiens
tcattatcaaatacc

SEQ ID NO: 238613 - DNA, 15 bp, Homo sapiens
ttcattatcaaatac

SEQ ID NO: 238614 - DNA, 15 bp, Homo sapiens
attcattatcaaata

SEQ ID NO: 238615 - DNA, 15 bp, Homo sapiens
aattcattatcaaat

SEQ ID NO: 238616 - DNA, 15 bp, Homo sapiens
aaattcattatcaaa

SEQ ID NO: 238617 - DNA, 15 bp, Homo sapiens
taaattcattatcaa

SEQ ID NO: 238618 - DNA, 15 bp, Homo sapiens
ctaaattcattatca

SEQ ID NO: 238619 - DNA, 15 bp, Homo sapiens
gctaaattcattatc

SEQ ID NO: 238620 - DNA, 15 bp, Homo sapiens
tgctaaattcattat

SEQ ID NO: 238621 - DNA, 15 bp, Homo sapiens
atgctaaattcatta

SEQ ID NO: 238622 - DNA, 15 bp, Homo sapiens
catgctaaattcatt

SEQ ID NO: 238623 - DNA, 15 bp, Homo sapiens
acatgctaaattcat

SEQ ID NO: 238624 - DNA, 15 bp, Homo sapiens
cacatgctaaattca

SEQ ID NO: 238625 - DNA, 15 bp, Homo sapiens
tcacatgctaaattc

SEQ ID NO: 238626 - DNA, 15 bp, Homo sapiens
atcacatgctaaatt

SEQ ID NO: 238627 - DNA, 15 bp, Homo sapiens
catcacatgctaaat

SEQ ID NO: 238628 - DNA, 15 bp, Homo sapiens
tcatcacatgctaaa

SEQ ID NO: 238629 - DNA, 15 bp, Homo sapiens
gtcatcacatgctaa

SEQ ID NO: 238630 - DNA, 15 bp, Homo sapiens
tgtcatcacatgcta

SEQ ID NO: 238631 - DNA, 15 bp, Homo sapiens
atgtcatcacatgct

SEQ ID NO: 238632 - DNA, 15 bp, Homo sapiens
gatgtcatcacatgc

SEQ ID NO: 238633 - DNA, 15 bp, Homo sapiens
tgatgtcatcacatg

SEQ ID NO: 238634 - DNA, 15 bp, Homo sapiens
ctgatgtcatcacat

SEQ ID NO: 238635 - DNA, 15 bp, Homo sapiens
cctgatgtcatcaca

SEQ ID NO: 238636 - DNA, 15 bp, Homo sapiens
acctgatgtcatcac

SEQ ID NO: 238637 - DNA, 15 bp, Homo sapiens
tacctgatgtcatca

SEQ ID NO: 238638 - DNA, 15 bp, Homo sapiens
atacctgatgtcatc

SEQ ID NO: 238639 - DNA, 15 bp, Homo sapiens
aatacctgatgtcat

SEQ ID NO: 238640 - DNA, 15 bp, Homo sapiens
aaatacctgatgtca

SEQ ID NO: 238641 - DNA, 15 bp, Homo sapiens
caaatacctgatgtc

SEQ ID NO: 238642 - DNA, 15 bp, Homo sapiens
acaaatacctgatgt

SEQ ID NO: 238643 - DNA, 15 bp, Homo sapiens
gacaaatacctgatg

SEQ ID NO: 238644 - DNA, 15 bp, Homo sapiens
agacaaatacctgat

SEQ ID NO: 238645 - DNA, 15 bp, Homo sapiens
aagacaaatacctga

SEQ ID NO: 238646 - DNA, 15 bp, Homo sapiens
aaagacaaatacctg

SEQ ID NO: 238647 - DNA, 15 bp, Homo sapiens
gaaagacaaatacct

SEQ ID NO: 238648 - DNA, 15 bp, Homo sapiens
tgaaagacaaatacc

SEQ ID NO: 238649 - DNA, 15 bp, Homo sapiens
ctgaaagacaaatac

SEQ ID NO: 238650 - DNA, 15 bp, Homo sapiens
actgaaagacaaata

SEQ ID NO: 238651 - DNA, 15 bp, Homo sapiens
tactgaaagacaaat

SEQ ID NO: 238652 - DNA, 15 bp, Homo sapiens
atactgaaagacaaa

SEQ ID NO: 238653 - DNA, 15 bp, Homo sapiens
gatactgaaagacaa

SEQ ID NO: 238654 - DNA, 15 bp, Homo sapiens
agatactgaaagaca

SEQ ID NO: 238655 - DNA, 15 bp, Homo sapiens
aagatactgaaagac

SEQ ID NO: 238656 - DNA, 15 bp, Homo sapiens
caagatactgaaaga

SEQ ID NO: 238657 - DNA, 15 bp, Homo sapiens
tcaagatactgaaag

SEQ ID NO: 238658 - DNA, 15 bp, Homo sapiens
ttcaagatactgaaa

SEQ ID NO: 238659 - DNA, 15 bp, Homo sapiens
gttcaagatactgaa

SEQ ID NO: 238660 - DNA, 15 bp, Homo sapiens
ggttcaagatactga

SEQ ID NO: 238661 - DNA, 15 bp, Homo sapiens
aggttcaagatactg

SEQ ID NO: 238662 - DNA, 15 bp, Homo sapiens
taggttcaagatact

SEQ ID NO: 238663 - DNA, 15 bp, Homo sapiens
ttaggttcaagatac

SEQ ID NO: 238664 - DNA, 15 bp, Homo sapiens
tttaggttcaagata

SEQ ID NO: 238665 - DNA, 15 bp, Homo sapiens
ctttaggttcaagat

SEQ ID NO: 238666 - DNA, 15 bp, Homo sapiens
cctttaggttcaaga

SEQ ID NO: 238667 - DNA, 15 bp, Homo sapiens
gcctttaggttcaag

SEQ ID NO: 238668 - DNA, 15 bp, Homo sapiens
ggcctttaggttcaa

SEQ ID NO: 238669 - DNA, 15 bp, Homo sapiens
aggcctttaggttca

SEQ ID NO: 238670 - DNA, 15 bp, Homo sapiens
gaggcctttaggttc

SEQ ID NO: 238671 - DNA, 15 bp, Homo sapiens
tgaggcctttaggtt

SEQ ID NO: 238672 - DNA, 15 bp, Homo sapiens
atgaggcctttaggt

SEQ ID NO: 238673 - DNA, 15 bp, Homo sapiens
aatgaggcctttagg

SEQ ID NO: 238674 - DNA, 15 bp, Homo sapiens
aaatgaggcctttag

SEQ ID NO: 238675 - DNA, 15 bp, Homo sapiens
taaatgaggccttta

SEQ ID NO: 238676 - DNA, 15 bp, Homo sapiens
ataaatgaggccttt

SEQ ID NO: 238677 - DNA, 15 bp, Homo sapiens
aataaatgaggcctt

SEQ ID NO: 238678 - DNA, 15 bp, Homo sapiens
aaataaatgaggcct

SEQ ID NO: 238679 - DNA, 15 bp, Homo sapiens
taaataaatgaggcc

SEQ ID NO: 238680 - DNA, 15 bp, Homo sapiens
ataaataaatgaggc

SEQ ID NO: 238681 - DNA, 15 bp, Homo sapiens
tataaataaatgagg

SEQ ID NO: 238682 - DNA, 15 bp, Homo sapiens
ctataaataaatgag

SEQ ID NO: 238683 - DNA, 15 bp, Homo sapiens
tctataaataaatga

SEQ ID NO: 238684 - DNA, 15 bp, Homo sapiens
ctctataaataaatg

SEQ ID NO: 238685 - DNA, 15 bp, Homo sapiens
actctataaataaat

SEQ ID NO: 238686 - DNA, 15 bp, Homo sapiens
aactctataaataaa

SEQ ID NO: 238687 - DNA, 15 bp, Homo sapiens
aaactctataaataa

SEQ ID NO: 238688 - DNA, 15 bp, Homo sapiens
taaactctataaata

SEQ ID NO: 238689 - DNA, 15 bp, Homo sapiens
ttaaactctataaat

SEQ ID NO: 238690 - DNA, 15 bp, Homo sapiens
attaaactctataaa

SEQ ID NO: 238691 - DNA, 15 bp, Homo sapiens
aattaaactctataa

SEQ ID NO: 238692 - DNA, 15 bp, Homo sapiens
aaattaaactctata

SEQ ID NO: 238693 - DNA, 15 bp, Homo sapiens
taaattaaactctat

SEQ ID NO: 238694 - DNA, 15 bp, Homo sapiens
ttaaattaaactcta

SEQ ID NO: 238695 - DNA, 15 bp, Homo sapiens
attaaattaaactct

SEQ ID NO: 238696 - DNA, 15 bp, Homo sapiens
aattaaattaaactc

SEQ ID NO: 238697 - DNA, 15 bp, Homo sapiens
aaattaaattaaact

SEQ ID NO: 238698 - DNA, 15 bp, Homo sapiens
aaaattaaattaaac

SEQ ID NO: 238699 - DNA, 15 bp, Homo sapiens
aaaaattaaattaaa

SEQ ID NO: 238700 - DNA, 15 bp, Homo sapiens
aaaaaattaaattaa

SEQ ID NO: 238701 - DNA, 15 bp, Homo sapiens
caaaaaattaaatta

SEQ ID NO: 238702 - DNA, 15 bp, Homo sapiens
tcaaaaaattaaatt

SEQ ID NO: 238703 - DNA, 15 bp, Homo sapiens
atcaaaaaattaaat

SEQ ID NO: 238704 - DNA, 15 bp, Homo sapiens
catcaaaaaattaaa

SEQ ID NO: 238705 - DNA, 15 bp, Homo sapiens
acatcaaaaaattaa

SEQ ID NO: 238706 - DNA, 15 bp, Homo sapiens
tacatcaaaaaatta

SEQ ID NO: 238707 - DNA, 15 bp, Homo sapiens
gtacatcaaaaaatt

SEQ ID NO: 238708 - DNA, 15 bp, Homo sapiens
agtacatcaaaaaat

SEQ ID NO: 238709 - DNA, 15 bp, Homo sapiens
tagtacatcaaaaaa

SEQ ID NO: 238710 - DNA, 15 bp, Homo sapiens
atagtacatcaaaaa

SEQ ID NO: 238711 - DNA, 15 bp, Homo sapiens
aatagtacatcaaaa

SEQ ID NO: 238712 - DNA, 15 bp, Homo sapiens
gaatagtacatcaaa

SEQ ID NO: 238713 - DNA, 15 bp, Homo sapiens
tgaatagtacatcaa

SEQ ID NO: 238714 - DNA, 15 bp, Homo sapiens
atgaatagtacatca

SEQ ID NO: 238715 - DNA, 15 bp, Homo sapiens
tatgaatagtacatc

SEQ ID NO: 238716 - DNA, 15 bp, Homo sapiens
atatgaatagtacat

SEQ ID NO: 238717 - DNA, 15 bp, Homo sapiens
catatgaatagtaca

SEQ ID NO: 238718 - DNA, 15 bp, Homo sapiens
tcatatgaatagtac

SEQ ID NO: 238719 - DNA, 15 bp, Homo sapiens
atcatatgaatagta

SEQ ID NO: 238720 - DNA, 15 bp, Homo sapiens
tatcatatgaatagt

SEQ ID NO: 238721 - DNA, 15 bp, Homo sapiens
atatcatatgaatag

SEQ ID NO: 238722 - DNA, 15 bp, Homo sapiens
aatatcatatgaata

SEQ ID NO: 238723 - DNA, 15 bp, Homo sapiens
aaatatcatatgaat

SEQ ID NO: 238724 - DNA, 15 bp, Homo sapiens
caaatatcatatgaa

SEQ ID NO: 238725 - DNA, 15 bp, Homo sapiens
acaaatatcatatga

SEQ ID NO: 238726 - DNA, 15 bp, Homo sapiens
tacaaatatcatatg

SEQ ID NO: 238727 - DNA, 15 bp, Homo sapiens
ctacaaatatcatat

SEQ ID NO: 238728 - DNA, 15 bp, Homo sapiens
tctacaaatatcata

SEQ ID NO: 238729 - DNA, 15 bp, Homo sapiens
ttctacaaatatcat

SEQ ID NO: 238730 - DNA, 15 bp, Homo sapiens
tttctacaaatatca

SEQ ID NO: 238731 - DNA, 15 bp, Homo sapiens
ttttctacaaatatc

SEQ ID NO: 238732 - DNA, 15 bp, Homo sapiens
attttctacaaatat

SEQ ID NO: 238733 - DNA, 15 bp, Homo sapiens
aattttctacaaata

SEQ ID NO: 238734 - DNA, 15 bp, Homo sapiens
caattttctacaaat

SEQ ID NO: 238735 - DNA, 15 bp, Homo sapiens
gcaattttctacaaa

SEQ ID NO: 238736 - DNA, 15 bp, Homo sapiens
tgcaattttctacaa

SEQ ID NO: 238737 - DNA, 15 bp, Homo sapiens
ttgcaattttctaca

SEQ ID NO: 238738 - DNA, 15 bp, Homo sapiens
tttgcaattttctac

SEQ ID NO: 238739 - DNA, 15 bp, Homo sapiens
ttttgcaattttcta

SEQ ID NO: 238740 - DNA, 15 bp, Homo sapiens
cttttgcaattttct

SEQ ID NO: 238741 - DNA, 15 bp, Homo sapiens
ccttttgcaattttc

SEQ ID NO: 238742 - DNA, 15 bp, Homo sapiens
accttttgcaatttt

SEQ ID NO: 238743 - DNA, 15 bp, Homo sapiens
aaccttttgcaattt

SEQ ID NO: 238744 - DNA, 15 bp, Homo sapiens
taaccttttgcaatt

SEQ ID NO: 238745 - DNA, 15 bp, Homo sapiens
ttaaccttttgcaat

SEQ ID NO: 238746 - DNA, 15 bp, Homo sapiens
tttaaccttttgcaa

SEQ ID NO: 238747 - DNA, 15 bp, Homo sapiens
atttaaccttttgca

SEQ ID NO: 238748 - DNA, 15 bp, Homo sapiens
tatttaaccttttgc

SEQ ID NO: 238749 - DNA, 15 bp, Homo sapiens
ttatttaaccttttg

SEQ ID NO: 238750 - DNA, 15 bp, Homo sapiens
tttatttaacctttt

SEQ ID NO: 238751 - DNA, 15 bp, Homo sapiens
atttatttaaccttt

SEQ ID NO: 238752 - DNA, 15 bp, Homo sapiens
gatttatttaacctt

SEQ ID NO: 238753 - DNA, 15 bp, Homo sapiens
tgatttatttaacct

SEQ ID NO: 238754 - DNA, 15 bp, Homo sapiens
gtgatttatttaacc

SEQ ID NO: 238755 - DNA, 15 bp, Homo sapiens
tgtgatttatttaac

SEQ ID NO: 238756 - DNA, 15 bp, Homo sapiens
ctgtgatttatttaa

SEQ ID NO: 238757 - DNA, 15 bp, Homo sapiens
actgtgatttattta

SEQ ID NO: 238758 - DNA, 15 bp, Homo sapiens
tactgtgatttattt

SEQ ID NO: 238759 - DNA, 15 bp, Homo sapiens
ttactgtgatttatt

SEQ ID NO: 238760 - DNA, 15 bp, Homo sapiens
attactgtgatttat

SEQ ID NO: 238761 - DNA, 15 bp, Homo sapiens
aattactgtgattta

SEQ ID NO: 238762 - DNA, 15 bp, Homo sapiens
caattactgtgattt

SEQ ID NO: 238763 - DNA, 15 bp, Homo sapiens
tcaattactgtgatt

SEQ ID NO: 238764 - DNA, 15 bp, Homo sapiens
ttcaattactgtgat

SEQ ID NO: 238765 - DNA, 15 bp, Homo sapiens
tttcaattactgtga

SEQ ID NO: 238766 - DNA, 15 bp, Homo sapiens
gtttcaattactgtg

SEQ ID NO: 238767 - DNA, 15 bp, Homo sapiens
ggtttcaattactgt

SEQ ID NO: 238768 - DNA, 15 bp, Homo sapiens
aggtttcaattactg

SEQ ID NO: 238769 - DNA, 15 bp, Homo sapiens
caggtttcaattact

SEQ ID NO: 238770 - DNA, 15 bp, Homo sapiens
acaggtttcaattac

SEQ ID NO: 238771 - DNA, 15 bp, Homo sapiens
cacaggtttcaatta

SEQ ID NO: 238772 - DNA, 15 bp, Homo sapiens
ccacaggtttcaatt

SEQ ID NO: 238773 - DNA, 15 bp, Homo sapiens
accacaggtttcaat

SEQ ID NO: 238774 - DNA, 15 bp, Homo sapiens
taccacaggtttcaa

SEQ ID NO: 238775 - DNA, 15 bp, Homo sapiens
ctaccacaggtttca

SEQ ID NO: 238776 - DNA, 15 bp, Homo sapiens
cctaccacaggtttc

SEQ ID NO: 238777 - DNA, 15 bp, Homo sapiens
acctaccacaggttt

SEQ ID NO: 238778 - DNA, 15 bp, Homo sapiens
gacctaccacaggtt

SEQ ID NO: 238779 - DNA, 15 bp, Homo sapiens
tgacctaccacaggt

SEQ ID NO: 238780 - DNA, 15 bp, Homo sapiens
gtgacctaccacagg

SEQ ID NO: 238781 - DNA, 15 bp, Homo sapiens
tgtgacctaccacag

SEQ ID NO: 238782 - DNA, 15 bp, Homo sapiens
ctgtgacctaccaca

SEQ ID NO: 238783 - DNA, 15 bp, Homo sapiens
tctgtgacctaccac

SEQ ID NO: 238784 - DNA, 15 bp, Homo sapiens
ttctgtgacctacca

SEQ ID NO: 238785 - DNA, 15 bp, Homo sapiens
tttctgtgacctacc

SEQ ID NO: 238786 - DNA, 15 bp, Homo sapiens
gtttctgtgacctac

SEQ ID NO: 238787 - DNA, 15 bp, Homo sapiens
tgtttctgtgaccta

SEQ ID NO: 238788 - DNA, 15 bp, Homo sapiens
atgtttctgtgacct

SEQ ID NO: 238789 - DNA, 15 bp, Homo sapiens
aatgtttctgtgacc

SEQ ID NO: 238790 - DNA, 15 bp, Homo sapiens
aaatgtttctgtgac

SEQ ID NO: 238791 - DNA, 15 bp, Homo sapiens
aaaatgtttctgtga

SEQ ID NO: 238792 - DNA, 15 bp, Homo sapiens
aaaaatgtttctgtg

SEQ ID NO: 238793 - DNA, 15 bp, Homo sapiens
gaaaaatgtttctgt

SEQ ID NO: 238794 - DNA, 15 bp, Homo sapiens
tgaaaaatgtttctg

SEQ ID NO: 238795 - DNA, 15 bp, Homo sapiens
gtgaaaaatgtttct

SEQ ID NO: 238796 - DNA, 15 bp, Homo sapiens
tgtgaaaaatgtttc

SEQ ID NO: 238797 - DNA, 15 bp, Homo sapiens
atgtgaaaaatgttt

SEQ ID NO: 238798 - DNA, 15 bp, Homo sapiens
tatgtgaaaaatgtt

SEQ ID NO: 238799 - DNA, 15 bp, Homo sapiens
ttatgtgaaaaatgt

SEQ ID NO: 238800 - DNA, 15 bp, Homo sapiens
attatgtgaaaaatg

SEQ ID NO: 238801 - DNA, 15 bp, Homo sapiens
cattatgtgaaaaat

SEQ ID NO: 238802 - DNA, 15 bp, Homo sapiens
ccattatgtgaaaaa

SEQ ID NO: 238803 - DNA, 15 bp, Homo sapiens
gccattatgtgaaaa

SEQ ID NO: 238804 - DNA, 15 bp, Homo sapiens
agccattatgtgaaa

SEQ ID NO: 238805 - DNA, 15 bp, Homo sapiens
tagccattatgtgaa

SEQ ID NO: 238806 - DNA, 15 bp, Homo sapiens
ttagccattatgtga

SEQ ID NO: 238807 - DNA, 15 bp, Homo sapiens
attagccattatgtg

SEQ ID NO: 238808 - DNA, 15 bp, Homo sapiens
tattagccattatgt

SEQ ID NO: 238809 - DNA, 15 bp, Homo sapiens
ttattagccattatg

SEQ ID NO: 238810 - DNA, 15 bp, Homo sapiens
tttattagccattat

SEQ ID NO: 238811 - DNA, 15 bp, Homo sapiens
ctttattagccatta

SEQ ID NO: 238812 - DNA, 15 bp, Homo sapiens
cctttattagccatt

SEQ ID NO: 238813 - DNA, 15 bp, Homo sapiens
tcctttattagccat

SEQ ID NO: 238814 - DNA, 15 bp, Homo sapiens
ctcctttattagcca

SEQ ID NO: 238815 - DNA, 15 bp, Homo sapiens
actcctttattagcc

SEQ ID NO: 238816 - DNA, 15 bp, Homo sapiens
gactcctttattagc

SEQ ID NO: 238817 - DNA, 15 bp, Homo sapiens
tgactcctttattag

SEQ ID NO: 238818 - DNA, 15 bp, Homo sapiens
atgactcctttatta

SEQ ID NO: 238819 - DNA, 15 bp, Homo sapiens
aatgactcctttatt

SEQ ID NO: 238820 - DNA, 15 bp, Homo sapiens
aaatgactcctttat

SEQ ID NO: 238821 - DNA, 15 bp, Homo sapiens
aaaatgactccttta

SEQ ID NO: 238822 - DNA, 15 bp, Homo sapiens
aaaaatgactccttt

SEQ ID NO: 238823 - DNA, 15 bp, Homo sapiens
gaaaaatgactcctt

SEQ ID NO: 238824 - DNA, 15 bp, Homo sapiens
agaaaaatgactcct

SEQ ID NO: 238825 - DNA, 15 bp, Homo sapiens
aagaaaaatgactcc

SEQ ID NO: 238826 - DNA, 15 bp, Homo sapiens
taagaaaaatgactc

SEQ ID NO: 238827 - DNA, 15 bp, Homo sapiens
gtaagaaaaatgact

SEQ ID NO: 238828 - DNA, 15 bp, Homo sapiens
agtaagaaaaatgac

SEQ ID NO: 238829 - DNA, 15 bp, Homo sapiens
aagtaagaaaaatga

SEQ ID NO: 238830 - DNA, 15 bp, Homo sapiens
aaagtaagaaaaatg

SEQ ID NO: 238831 - DNA, 15 bp, Homo sapiens
gaaagtaagaaaaat

SEQ ID NO: 238832 - DNA, 15 bp, Homo sapiens
tgaaagtaagaaaaa

SEQ ID NO: 238833 - DNA, 15 bp, Homo sapiens
atgaaagtaagaaaa

SEQ ID NO: 238834 - DNA, 15 bp, Homo sapiens
tgatgaaagtaagaa

SEQ ID NO: 238835 - DNA, 15 bp, Homo sapiens
atgatgaaagtaaga

SEQ ID NO: 238836 - DNA, 15 bp, Homo sapiens
catgatgaaagtaag

SEQ ID NO: 238837 - DNA, 15 bp, Homo sapiens
acatgatgaaagtaa

SEQ ID NO: 238838 - DNA, 15 bp, Homo sapiens
tacatgatgaaagta

SEQ ID NO: 238839 - DNA, 15 bp, Homo sapiens
atacatgatgaaagt

SEQ ID NO: 238840 - DNA, 15 bp, Homo sapiens
aatacatgatgaaag

SEQ ID NO: 238841 - DNA, 15 bp, Homo sapiens
aaatacatgatgaaa

SEQ ID NO: 238842 - DNA, 15 bp, Homo sapiens
aaaatacatgatgaa

SEQ ID NO: 238843 - DNA, 15 bp, Homo sapiens
aaaaatacatgatga

SEQ ID NO: 238844 - DNA, 15 bp, Homo sapiens
aaaaaatacatgatg

SEQ ID NO: 238845 - DNA, 15 bp, Homo sapiens
aaaaaaatacatgat

SEQ ID NO: 238846 - DNA, 15 bp, Homo sapiens
aaaaaaaatacatga

SEQ ID NO: 238847 - DNA, 15 bp, Homo sapiens
aaaaaaaaatacatg

SEQ ID NO: 238848 - DNA, 15 bp, Homo sapiens
aaaaaaaaaatacat

SEQ ID NO: 238849 - DNA, 15 bp, Homo sapiens
gaaaaaaaaaataca

SEQ ID NO: 238850 - DNA, 15 bp, Homo sapiens
tgaaaaaaaaaatac

SEQ ID NO: 238851 - DNA, 15 bp, Homo sapiens
atgaaaaaaaaaata

SEQ ID NO: 238852 - DNA, 15 bp, Homo sapiens
tcaaaatgaaaaaaa

SEQ ID NO: 238853 - DNA, 15 bp, Homo sapiens
ttcaaaatgaaaaaa

SEQ ID NO: 238854 - DNA, 15 bp, Homo sapiens
tttcaaaatgaaaaa

SEQ ID NO: 238855 - DNA, 15 bp, Homo sapiens
ttttcaaaatgaaaa

SEQ ID NO: 238856 - DNA, 15 bp, Homo sapiens
tttttcaaaatgaaa

SEQ ID NO: 238857 - DNA, 15 bp, Homo sapiens
atttttcaaaatgaa

SEQ ID NO: 238858 - DNA, 15 bp, Homo sapiens
gatttttcaaaatga

SEQ ID NO: 238859 - DNA, 15 bp, Homo sapiens
tgatttttcaaaatg

SEQ ID NO: 238860 - DNA, 15 bp, Homo sapiens
ctgatttttcaaaat

SEQ ID NO: 238861 - DNA, 15 bp, Homo sapiens
cctgatttttcaaaa

SEQ ID NO: 238862 - DNA, 15 bp, Homo sapiens
tcctgatttttcaaa

SEQ ID NO: 238863 - DNA, 15 bp, Homo sapiens
ttcctgatttttcaa

SEQ ID NO: 238864 - DNA, 15 bp, Homo sapiens
tttcctgatttttca

SEQ ID NO: 238865 - DNA, 15 bp, Homo sapiens
ctttcctgatttttc

SEQ ID NO: 238866 - DNA, 15 bp, Homo sapiens
actttcctgattttt

SEQ ID NO: 238867 - DNA, 15 bp, Homo sapiens
gactttcctgatttt

SEQ ID NO: 238868 - DNA, 15 bp, Homo sapiens
agactttcctgattt

SEQ ID NO: 238869 - DNA, 15 bp, Homo sapiens
gagactttcctgatt

SEQ ID NO: 238870 - DNA, 15 bp, Homo sapiens
agagactttcctgat

SEQ ID NO: 238871 - DNA, 15 bp, Homo sapiens
tagagactttcctga

SEQ ID NO: 238872 - DNA, 15 bp, Homo sapiens
atagagactttcctg

SEQ ID NO: 238873 - DNA, 15 bp, Homo sapiens
aatagagactttcct

SEQ ID NO: 238874 - DNA, 15 bp, Homo sapiens
caatagagactttcc

SEQ ID NO: 238875 - DNA, 15 bp, Homo sapiens
acaatagagactttc

SEQ ID NO: 238876 - DNA, 15 bp, Homo sapiens
aacaatagagacttt

SEQ ID NO: 238877 - DNA, 15 bp, Homo sapiens
aaacaatagagactt

SEQ ID NO: 238878 - DNA, 15 bp, Homo sapiens
aaaacaatagagact

SEQ ID NO: 238879 - DNA, 15 bp, Homo sapiens
aaaaacaatagagac

SEQ ID NO: 238880 - DNA, 15 bp, Homo sapiens
gaaaaacaatagaga

SEQ ID NO: 238881 - DNA, 15 bp, Homo sapiens
agaaaaacaatagag

SEQ ID NO: 238882 - DNA, 15 bp, Homo sapiens
aagaaaaacaataga

SEQ ID NO: 238883 - DNA, 15 bp, Homo sapiens
ttagaagaaaaacaa

SEQ ID NO: 238884 - DNA, 15 bp, Homo sapiens
gttagaagaaaaaca

SEQ ID NO: 238885 - DNA, 15 bp, Homo sapiens
agttagaagaaaaac

SEQ ID NO: 238886 - DNA, 15 bp, Homo sapiens
cagttagaagaaaaa

SEQ ID NO: 238887 - DNA, 15 bp, Homo sapiens
ccagttagaagaaaa

SEQ ID NO: 238888 - DNA, 15 bp, Homo sapiens
accagttagaagaaa

SEQ ID NO: 238889 - DNA, 15 bp, Homo sapiens
aaccagttagaagaa

SEQ ID NO: 238890 - DNA, 15 bp, Homo sapiens
caaccagttagaaga

SEQ ID NO: 238891 - DNA, 15 bp, Homo sapiens
gcaaccagttagaag

SEQ ID NO: 238892 - DNA, 15 bp, Homo sapiens
agcaaccagttagaa

SEQ ID NO: 238893 - DNA, 15 bp, Homo sapiens
tagcaaccagttaga

SEQ ID NO: 238894 - DNA, 15 bp, Homo sapiens
atagcaaccagttag

SEQ ID NO: 238895 - DNA, 15 bp, Homo sapiens
aatagcaaccagtta

SEQ ID NO: 238896 - DNA, 15 bp, Homo sapiens
aaatagcaaccagtt

SEQ ID NO: 238897 - DNA, 15 bp, Homo sapiens
taaatagcaaccagt

SEQ ID NO: 238898 - DNA, 15 bp, Homo sapiens
ttaaatagcaaccag

SEQ ID NO: 238899 - DNA, 15 bp, Homo sapiens
tttaaatagcaacca

SEQ ID NO: 238900 - DNA, 15 bp, Homo sapiens
atttaaatagcaacc

SEQ ID NO: 238901 - DNA, 15 bp, Homo sapiens
tatttaaatagcaac

SEQ ID NO: 238902 - DNA, 15 bp, Homo sapiens
atatttaaatagcaa

SEQ ID NO: 238903 - DNA, 15 bp, Homo sapiens
gatatttaaatagca

SEQ ID NO: 238904 - DNA, 15 bp, Homo sapiens
agatatttaaatagc

SEQ ID NO: 238905 - DNA, 15 bp, Homo sapiens
aagatatttaaatag

SEQ ID NO: 238906 - DNA, 15 bp, Homo sapiens
gaagatatttaaata

SEQ ID NO: 238907 - DNA, 15 bp, Homo sapiens
ggaagatatttaaat

SEQ ID NO: 238908 - DNA, 15 bp, Homo sapiens
aggaagatatttaaa

SEQ ID NO: 238909 - DNA, 15 bp, Homo sapiens
aaggaagatatttaa

SEQ ID NO: 238910 - DNA, 15 bp, Homo sapiens
taaggaagatattta

SEQ ID NO: 238911 - DNA, 15 bp, Homo sapiens
ataaggaagatattt

SEQ ID NO: 238912 - DNA, 15 bp, Homo sapiens
aataaggaagatatt

SEQ ID NO: 238913 - DNA, 15 bp, Homo sapiens
aaataaggaagatat

SEQ ID NO: 238914 - DNA, 15 bp, Homo sapiens
aaaataaggaagata

SEQ ID NO: 238915 - DNA, 15 bp, Homo sapiens
aaaaataaggaagat

SEQ ID NO: 238916 - DNA, 15 bp, Homo sapiens
aaaaaataaggaaga

SEQ ID NO: 238917 - DNA, 15 bp, Homo sapiens
gaaaaaataaggaag

SEQ ID NO: 238918 - DNA, 15 bp, Homo sapiens
ggaaaaaataaggaa

SEQ ID NO: 238919 - DNA, 15 bp, Homo sapiens
tggaaaaaataagga

SEQ ID NO: 238920 - DNA, 15 bp, Homo sapiens
ctggaaaaaataagg

SEQ ID NO: 238921 - DNA, 15 bp, Homo sapiens
tctggaaaaaataag

SEQ ID NO: 238922 - DNA, 15 bp, Homo sapiens
atctggaaaaaataa

SEQ ID NO: 238923 - DNA, 15 bp, Homo sapiens
tatctggaaaaaata

SEQ ID NO: 238924 - DNA, 15 bp, Homo sapiens
ctatctggaaaaaat

SEQ ID NO: 238925 - DNA, 15 bp, Homo sapiens
gctatctggaaaaaa

SEQ ID NO: 238926 - DNA, 15 bp, Homo sapiens
tgctatctggaaaaa

SEQ ID NO: 238927 - DNA, 15 bp, Homo sapiens
gtgctatctggaaaa

SEQ ID NO: 238928 - DNA, 15 bp, Homo sapiens
tgtgctatctggaaa

SEQ ID NO: 238929 - DNA, 15 bp, Homo sapiens
atgtgctatctggaa

SEQ ID NO: 238930 - DNA, 15 bp, Homo sapiens
aatgtgctatctgga

SEQ ID NO: 238931 - DNA, 15 bp, Homo sapiens
aaatgtgctatctgg

SEQ ID NO: 238932 - DNA, 15 bp, Homo sapiens
taaatgtgctatctg

SEQ ID NO: 238933 - DNA, 15 bp, Homo sapiens
ataaatgtgctatct

SEQ ID NO: 238934 - DNA, 15 bp, Homo sapiens
tataaatgtgctatc

SEQ ID NO: 238935 - DNA, 15 bp, Homo sapiens
gtataaatgtgctat

SEQ ID NO: 238936 - DNA, 15 bp, Homo sapiens
ggtataaatgtgcta

SEQ ID NO: 238937 - DNA, 15 bp, Homo sapiens
tggtataaatgtgct

SEQ ID NO: 238938 - DNA, 15 bp, Homo sapiens
ctggtataaatgtgc

SEQ ID NO: 238939 - DNA, 15 bp, Homo sapiens
actggtataaatgtg

SEQ ID NO: 238940 - DNA, 15 bp, Homo sapiens
cactggtataaatgt

SEQ ID NO: 238941 - DNA, 15 bp, Homo sapiens
ccactggtataaatg

SEQ ID NO: 238942 - DNA, 15 bp, Homo sapiens
accactggtataaat

SEQ ID NO: 238943 - DNA, 15 bp, Homo sapiens
caccactggtataaa

SEQ ID NO: 238944 - DNA, 15 bp, Homo sapiens
acaccactggtataa

SEQ ID NO: 238945 - DNA, 15 bp, Homo sapiens
aacaccactggtata

SEQ ID NO: 238946 - DNA, 15 bp, Homo sapiens
aaacaccactggtat

SEQ ID NO: 238947 - DNA, 15 bp, Homo sapiens
taaacaccactggta

SEQ ID NO: 238948 - DNA, 15 bp, Homo sapiens
gtaaacaccactggt

SEQ ID NO: 238949 - DNA, 15 bp, Homo sapiens
ggtaaacaccactgg

SEQ ID NO: 238950 - DNA, 15 bp, Homo sapiens
aggtaaacaccactg

SEQ ID NO: 238951 - DNA, 15 bp, Homo sapiens
aaggtaaacaccact

SEQ ID NO: 238952 - DNA, 15 bp, Homo sapiens
aaaggtaaacaccac

SEQ ID NO: 238953 - DNA, 15 bp, Homo sapiens
taaaggtaaacacca

SEQ ID NO: 238954 - DNA, 15 bp, Homo sapiens
ctaaaggtaaacacc

SEQ ID NO: 238955 - DNA, 15 bp, Homo sapiens
actaaaggtaaacac

SEQ ID NO: 238956 - DNA, 15 bp, Homo sapiens
aactaaaggtaaaca

SEQ ID NO: 238957 - DNA, 15 bp, Homo sapiens
gaactaaaggtaaac

SEQ ID NO: 238958 - DNA, 15 bp, Homo sapiens
agaactaaaggtaaa

SEQ ID NO: 238959 - DNA, 15 bp, Homo sapiens
aagaactaaaggtaa

SEQ ID NO: 238960 - DNA, 15 bp, Homo sapiens
taagaactaaaggta

SEQ ID NO: 238961 - DNA, 15 bp, Homo sapiens
ctaagaactaaaggt

SEQ ID NO: 238962 - DNA, 15 bp, Homo sapiens
tctaagaactaaagg

SEQ ID NO: 238963 - DNA, 15 bp, Homo sapiens
atctaagaactaaag

SEQ ID NO: 238964 - DNA, 15 bp, Homo sapiens
aatctaagaactaaa

SEQ ID NO: 238965 - DNA, 15 bp, Homo sapiens
aaatctaagaactaa

SEQ ID NO: 238966 - DNA, 15 bp, Homo sapiens
aaaatctaagaacta

SEQ ID NO: 238967 - DNA, 15 bp, Homo sapiens
taaaatctaagaact

SEQ ID NO: 238968 - DNA, 15 bp, Homo sapiens
ctaaaatctaagaac

SEQ ID NO: 238969 - DNA, 15 bp, Homo sapiens
gctaaaatctaagaa

SEQ ID NO: 238970 - DNA, 15 bp, Homo sapiens
agctaaaatctaaga

SEQ ID NO: 238971 - DNA, 15 bp, Homo sapiens
tagctaaaatctaag

SEQ ID NO: 238972 - DNA, 15 bp, Homo sapiens
ttagctaaaatctaa

SEQ ID NO: 238973 - DNA, 15 bp, Homo sapiens
attagctaaaatcta

SEQ ID NO: 238974 - DNA, 15 bp, Homo sapiens
cattagctaaaatct

SEQ ID NO: 238975 - DNA, 15 bp, Homo sapiens
gcattagctaaaatc

SEQ ID NO: 238976 - DNA, 15 bp, Homo sapiens
tgcattagctaaaat

SEQ ID NO: 238977 - DNA, 15 bp, Homo sapiens
ctgcattagctaaaa

SEQ ID NO: 238978 - DNA, 15 bp, Homo sapiens
actgcattagctaaa

SEQ ID NO: 238979 - DNA, 15 bp, Homo sapiens
aactgcattagctaa

SEQ ID NO: 238980 - DNA, 15 bp, Homo sapiens
caactgcattagcta

SEQ ID NO: 238981 - DNA, 15 bp, Homo sapiens
ccaactgcattagct

SEQ ID NO: 238982 - DNA, 15 bp, Homo sapiens
accaactgcattagc

SEQ ID NO: 238983 - DNA, 15 bp, Homo sapiens
aaccaactgcattag

SEQ ID NO: 238984 - DNA, 15 bp, Homo sapiens
aaaccaactgcatta

SEQ ID NO: 238985 - DNA, 15 bp, Homo sapiens
taaaccaactgcatt

SEQ ID NO: 238986 - DNA, 15 bp, Homo sapiens
ttaaaccaactgcat

SEQ ID NO: 238987 - DNA, 15 bp, Homo sapiens
attaaaccaactgca

SEQ ID NO: 238988 - DNA, 15 bp, Homo sapiens
cattaaaccaactgc

SEQ ID NO: 238989 - DNA, 15 bp, Homo sapiens
tcattaaaccaactg

SEQ ID NO: 238990 - DNA, 15 bp, Homo sapiens
gtcattaaaccaact

SEQ ID NO: 238991 - DNA, 15 bp, Homo sapiens
agtcattaaaccaac

SEQ ID NO: 238992 - DNA, 15 bp, Homo sapiens
gagtcattaaaccaa

SEQ ID NO: 238993 - DNA, 15 bp, Homo sapiens
agagtcattaaacca

SEQ ID NO: 238994 - DNA, 15 bp, Homo sapiens
tagagtcattaaacc

SEQ ID NO: 238995 - DNA, 15 bp, Homo sapiens
ctagagtcattaaac

SEQ ID NO: 238996 - DNA, 15 bp, Homo sapiens
tctagagtcattaaa

SEQ ID NO: 238997 - DNA, 15 bp, Homo sapiens
gtctagagtcattaa

SEQ ID NO: 238998 - DNA, 15 bp, Homo sapiens
ggtctagagtcatta

SEQ ID NO: 238999 - DNA, 15 bp, Homo sapiens
aggtctagagtcatt

SEQ ID NO: 239000 - DNA, 15 bp, Homo sapiens
aaggtctagagtcat

SEQ ID NO: 239001 - DNA, 15 bp, Homo sapiens
taaggtctagagtca

SEQ ID NO: 239002 - DNA, 15 bp, Homo sapiens
ataaggtctagagtc

SEQ ID NO: 239003 - DNA, 15 bp, Homo sapiens
aataaggtctagagt

SEQ ID NO: 239004 - DNA, 15 bp, Homo sapiens
aaataaggtctagag

SEQ ID NO: 239005 - DNA, 15 bp, Homo sapiens
taaataaggtctaga

SEQ ID NO: 239006 - DNA, 15 bp, Homo sapiens
ttaaataaggtctag

SEQ ID NO: 239007 - DNA, 15 bp, Homo sapiens
tttaaataaggtcta

SEQ ID NO: 239008 - DNA, 15 bp, Homo sapiens
atttaaataaggtct

SEQ ID NO: 239009 - DNA, 15 bp, Homo sapiens
tatttaaataaggtc

SEQ ID NO: 239010 - DNA, 15 bp, Homo sapiens
atatttaaataaggt

SEQ ID NO: 239011 - DNA, 15 bp, Homo sapiens
catatttaaataagg

SEQ ID NO: 239012 - DNA, 15 bp, Homo sapiens
gcatatttaaataag

SEQ ID NO: 239013 - DNA, 15 bp, Homo sapiens
tgcatatttaaataa

SEQ ID NO: 239014 - DNA, 15 bp, Homo sapiens
ttgcatatttaaata

SEQ ID NO: 239015 - DNA, 15 bp, Homo sapiens
attgcatatttaaat

SEQ ID NO: 239016 - DNA, 15 bp, Homo sapiens
aattgcatatttaaa

SEQ ID NO: 239017 - DNA, 15 bp, Homo sapiens
aaattgcatatttaa

SEQ ID NO: 239018 - DNA, 15 bp, Homo sapiens
aaaattgcatattta

SEQ ID NO: 239019 - DNA, 15 bp, Homo sapiens
caaaattgcatattt

SEQ ID NO: 239020 - DNA, 15 bp, Homo sapiens
tcaaaattgcatatt

SEQ ID NO: 239021 - DNA, 15 bp, Homo sapiens
atcaaaattgcatat

SEQ ID NO: 239022 - DNA, 15 bp, Homo sapiens
catcaaaattgcata

SEQ ID NO: 239023 - DNA, 15 bp, Homo sapiens
acatcaaaattgcat

SEQ ID NO: 239024 - DNA, 15 bp, Homo sapiens
tacatcaaaattgca

SEQ ID NO: 239025 - DNA, 15 bp, Homo sapiens
ctacatcaaaattgc

SEQ ID NO: 239026 - DNA, 15 bp, Homo sapiens
gctacatcaaaattg

SEQ ID NO: 239027 - DNA, 15 bp, Homo sapiens
tgctacatcaaaatt

SEQ ID NO: 239028 - DNA, 15 bp, Homo sapiens
gtgctacatcaaaat

SEQ ID NO: 239029 - DNA, 15 bp, Homo sapiens
tgtgctacatcaaaa

SEQ ID NO: 239030 - DNA, 15 bp, Homo sapiens
atgtgctacatcaaa

SEQ ID NO: 239031 - DNA, 15 bp, Homo sapiens
tatgtgctacatcaa

SEQ ID NO: 239032 - DNA, 15 bp, Homo sapiens
ttatgtgctacatca

SEQ ID NO: 239033 - DNA, 15 bp, Homo sapiens
tttatgtgctacatc

SEQ ID NO: 239034 - DNA, 15 bp, Homo sapiens
ttttatgtgctacat

SEQ ID NO: 239035 - DNA, 15 bp, Homo sapiens
tttttatgtgctaca

SEQ ID NO: 239036 - DNA, 15 bp, Homo sapiens
gtttttatgtgctac

SEQ ID NO: 239037 - DNA, 15 bp, Homo sapiens
tgtttttatgtgcta

SEQ ID NO: 239038 - DNA, 15 bp, Homo sapiens
atgtttttatgtgct

SEQ ID NO: 239039 - DNA, 15 bp, Homo sapiens
aatgtttttatgtgc

SEQ ID NO: 239040 - DNA, 15 bp, Homo sapiens
aaatgtttttatgtg

SEQ ID NO: 239041 - DNA, 15 bp, Homo sapiens
caaatgtttttatgt

SEQ ID NO: 239042 - DNA, 15 bp, Homo sapiens
tcaaatgtttttatg

SEQ ID NO: 239043 - DNA, 15 bp, Homo sapiens
ctcaaatgtttttat

SEQ ID NO: 239044 - DNA, 15 bp, Homo sapiens
tctcaaatgttttta

SEQ ID NO: 239045 - DNA, 15 bp, Homo sapiens
ctctcaaatgttttt

SEQ ID NO: 239046 - DNA, 15 bp, Homo sapiens
tctctcaaatgtttt

SEQ ID NO: 239047 - DNA, 15 bp, Homo sapiens
atctctcaaatgttt

SEQ ID NO: 239048 - DNA, 15 bp, Homo sapiens
tatctctcaaatgtt

SEQ ID NO: 239049 - DNA, 15 bp, Homo sapiens
atatctctcaaatgt

SEQ ID NO: 239050 - DNA, 15 bp, Homo sapiens
tatatctctcaaatg

SEQ ID NO: 239051 - DNA, 15 bp, Homo sapiens
atatatctctcaaat

SEQ ID NO: 239052 - DNA, 15 bp, Homo sapiens
aatatatctctcaaa

SEQ ID NO: 239053 - DNA, 15 bp, Homo sapiens
aaatatatctctcaa

SEQ ID NO: 239054 - DNA, 15 bp, Homo sapiens
aaaatatatctctca

SEQ ID NO: 239055 - DNA, 15 bp, Homo sapiens
taaaatatatctctc

SEQ ID NO: 239056 - DNA, 15 bp, Homo sapiens
ataaaatatatctct

SEQ ID NO: 239057 - DNA, 15 bp, Homo sapiens
gataaaatatatctc

SEQ ID NO: 239058 - DNA, 15 bp, Homo sapiens
agataaaatatatct

SEQ ID NO: 239059 - DNA, 15 bp, Homo sapiens
tagataaaatatatc

SEQ ID NO: 239060 - DNA, 15 bp, Homo sapiens
atagataaaatatat

SEQ ID NO: 239061 - DNA, 15 bp, Homo sapiens
tatagataaaatata

SEQ ID NO: 239062 - DNA, 15 bp, Homo sapiens
ttatagataaaatat

SEQ ID NO: 239063 - DNA, 15 bp, Homo sapiens
attatagataaaata

SEQ ID NO: 239064 - DNA, 15 bp, Homo sapiens
tattatagataaaat

SEQ ID NO: 239065 - DNA, 15 bp, Homo sapiens
ctattatagataaaa

SEQ ID NO: 239066 - DNA, 15 bp, Homo sapiens
cctattatagataaa

SEQ ID NO: 239067 - DNA, 15 bp, Homo sapiens
acctattatagataa

SEQ ID NO: 239068 - DNA, 15 bp, Homo sapiens
aacctattatagata

SEQ ID NO: 239069 - DNA, 15 bp, Homo sapiens
aaacctattatagat

SEQ ID NO: 239070 - DNA, 15 bp, Homo sapiens
caaacctattataga

SEQ ID NO: 239071 - DNA, 15 bp, Homo sapiens
gcaaacctattatag

SEQ ID NO: 239072 - DNA, 15 bp, Homo sapiens
agcaaacctattata

SEQ ID NO: 239073 - DNA, 15 bp, Homo sapiens
cagcaaacctattat

SEQ ID NO: 239074 - DNA, 15 bp, Homo sapiens
tcagcaaacctatta

SEQ ID NO: 239075 - DNA, 15 bp, Homo sapiens
ttcagcaaacctatt

SEQ ID NO: 239076 - DNA, 15 bp, Homo sapiens
attcagcaaacctat

SEQ ID NO: 239077 - DNA, 15 bp, Homo sapiens
aattcagcaaaccta

SEQ ID NO: 239078 - DNA, 15 bp, Homo sapiens
taattcagcaaacct

SEQ ID NO: 239079 - DNA, 15 bp, Homo sapiens
ttaattcagcaaacc

SEQ ID NO: 239080 - DNA, 15 bp, Homo sapiens
attaattcagcaaac

SEQ ID NO: 239081 - DNA, 15 bp, Homo sapiens
aattaattcagcaaa

SEQ ID NO: 239082 - DNA, 15 bp, Homo sapiens
gaattaattcagcaa

SEQ ID NO: 239083 - DNA, 15 bp, Homo sapiens
tgaattaattcagca

SEQ ID NO: 239084 - DNA, 15 bp, Homo sapiens
ttgaattaattcagc

SEQ ID NO: 239085 - DNA, 15 bp, Homo sapiens
tttgaattaattcag

SEQ ID NO: 239086 - DNA, 15 bp, Homo sapiens
atttgaattaattca

SEQ ID NO: 239087 - DNA, 15 bp, Homo sapiens
tatttgaattaattc

SEQ ID NO: 239088 - DNA, 15 bp, Homo sapiens
atatttgaattaatt

SEQ ID NO: 239089 - DNA, 15 bp, Homo sapiens
gatatttgaattaat

SEQ ID NO: 239090 - DNA, 15 bp, Homo sapiens
tgatatttgaattaa

SEQ ID NO: 239091 - DNA, 15 bp, Homo sapiens
ttgatatttgaatta

SEQ ID NO: 239092 - DNA, 15 bp, Homo sapiens
tttgatatttgaatt

SEQ ID NO: 239093 - DNA, 15 bp, Homo sapiens
ctttgatatttgaat

SEQ ID NO: 239094 - DNA, 15 bp, Homo sapiens
gctttgatatttgaa

SEQ ID NO: 239095 - DNA, 15 bp, Homo sapiens
tgctttgatatttga

SEQ ID NO: 239096 - DNA, 15 bp, Homo sapiens
gtgctttgatatttg

SEQ ID NO: 239097 - DNA, 15 bp, Homo sapiens
agtgctttgatattt

SEQ ID NO: 239098 - DNA, 15 bp, Homo sapiens
gagtgctttgatatt

SEQ ID NO: 239099 - DNA, 15 bp, Homo sapiens
tgagtgctttgatat

SEQ ID NO: 239100 - DNA, 15 bp, Homo sapiens
ttgagtgctttgata

SEQ ID NO: 239101 - DNA, 15 bp, Homo sapiens
attgagtgctttgat

SEQ ID NO: 239102 - DNA, 15 bp, Homo sapiens
cattgagtgctttga

SEQ ID NO: 239103 - DNA, 15 bp, Homo sapiens
ccattgagtgctttg

SEQ ID NO: 239104 - DNA, 15 bp, Homo sapiens
accattgagtgcttt

SEQ ID NO: 239105 - DNA, 15 bp, Homo sapiens
aaccattgagtgctt

SEQ ID NO: 239106 - DNA, 15 bp, Homo sapiens
gaaccattgagtgct

SEQ ID NO: 239107 - DNA, 15 bp, Homo sapiens
tgaaccattgagtgc

SEQ ID NO: 239108 - DNA, 15 bp, Homo sapiens
atgaaccattgagtg

SEQ ID NO: 239109 - DNA, 15 bp, Homo sapiens
tatgaaccattgagt

SEQ ID NO: 239110 - DNA, 15 bp, Homo sapiens
atatgaaccattgag

SEQ ID NO: 239111 - DNA, 15 bp, Homo sapiens
aatatgaaccattga

SEQ ID NO: 239112 - DNA, 15 bp, Homo sapiens
aaatatgaaccattg

SEQ ID NO: 239113 - DNA, 15 bp, Homo sapiens
aaaatatgaaccatt

SEQ ID NO: 239114 - DNA, 15 bp, Homo sapiens
gaaaatatgaaccat

SEQ ID NO: 239115 - DNA, 15 bp, Homo sapiens
agaaaatatgaacca

SEQ ID NO: 239116 - DNA, 15 bp, Homo sapiens
aagaaaatatgaacc

SEQ ID NO: 239117 - DNA, 15 bp, Homo sapiens
taagaaaatatgaac

SEQ ID NO: 239118 - DNA, 15 bp, Homo sapiens
ttaagaaaatatgaa

SEQ ID NO: 239119 - DNA, 15 bp, Homo sapiens
attaagaaaatatga

SEQ ID NO: 239120 - DNA, 15 bp, Homo sapiens
cattaagaaaatatg

SEQ ID NO: 239121 - DNA, 15 bp, Homo sapiens
tcattaagaaaatat

SEQ ID NO: 239122 - DNA, 15 bp, Homo sapiens
ttcattaagaaaata

SEQ ID NO: 239123 - DNA, 15 bp, Homo sapiens
tttcattaagaaaat

SEQ ID NO: 239124 - DNA, 15 bp, Homo sapiens
atttcattaagaaaa

SEQ ID NO: 239125 - DNA, 15 bp, Homo sapiens
aatttcattaagaaa

SEQ ID NO: 239126 - DNA, 15 bp, Homo sapiens
caatttcattaagaa

SEQ ID NO: 239127 - DNA, 15 bp, Homo sapiens
tcaatttcattaaga

SEQ ID NO: 239128 - DNA, 15 bp, Homo sapiens
ttcaatttcattaag

SEQ ID NO: 239129 - DNA, 15 bp, Homo sapiens
cttcaatttcattaa

SEQ ID NO: 239130 - DNA, 15 bp, Homo sapiens
tcttcaatttcatta

SEQ ID NO: 239131 - DNA, 15 bp, Homo sapiens
ttcttcaatttcatt

SEQ ID NO: 239132 - DNA, 15 bp, Homo sapiens
cttcttcaatttcat

SEQ ID NO: 239133 - DNA, 15 bp, Homo sapiens
acttcttcaatttca

SEQ ID NO: 239134 - DNA, 15 bp, Homo sapiens
tacttcttcaatttc

SEQ ID NO: 239135 - DNA, 15 bp, Homo sapiens
ttacttcttcaattt

SEQ ID NO: 239136 - DNA, 15 bp, Homo sapiens
cttacttcttcaatt

SEQ ID NO: 239137 - DNA, 15 bp, Homo sapiens
tcttacttcttcaat

SEQ ID NO: 239138 - DNA, 15 bp, Homo sapiens
ttcttacttcttcaa

SEQ ID NO: 239139 - DNA, 15 bp, Homo sapiens
tttcttacttcttca

SEQ ID NO: 239140 - DNA, 15 bp, Homo sapiens
atttcttacttcttc

SEQ ID NO: 239141 - DNA, 15 bp, Homo sapiens
aatttcttacttctt

SEQ ID NO: 239142 - DNA, 15 bp, Homo sapiens
taatttcttacttct

SEQ ID NO: 239143 - DNA, 15 bp, Homo sapiens
ctaatttcttacttc

SEQ ID NO: 239144 - DNA, 15 bp, Homo sapiens
actaatttcttactt

SEQ ID NO: 239145 - DNA, 15 bp, Homo sapiens
cactaatttcttact

SEQ ID NO: 239146 - DNA, 15 bp, Homo sapiens
acactaatttcttac

SEQ ID NO: 239147 - DNA, 15 bp, Homo sapiens
tacactaatttctta

SEQ ID NO: 239148 - DNA, 15 bp, Homo sapiens
gtacactaatttctt

SEQ ID NO: 239149 - DNA, 15 bp, Homo sapiens
tgtacactaatttct

SEQ ID NO: 239150 - DNA, 15 bp, Homo sapiens
ttgtacactaatttc

SEQ ID NO: 239151 - DNA, 15 bp, Homo sapiens
attgtacactaattt

SEQ ID NO: 239152 - DNA, 15 bp, Homo sapiens
tattgtacactaatt

SEQ ID NO: 239153 - DNA, 15 bp, Homo sapiens
atattgtacactaat

SEQ ID NO: 239154 - DNA, 15 bp, Homo sapiens
aatattgtacactaa

SEQ ID NO: 239155 - DNA, 15 bp, Homo sapiens
aaatattgtacacta

SEQ ID NO: 239156 - DNA, 15 bp, Homo sapiens
aaaatattgtacact

SEQ ID NO: 239157 - DNA, 15 bp, Homo sapiens
taaaatattgtacac

SEQ ID NO: 239158 - DNA, 15 bp, Homo sapiens
gtaaaatattgtaca

SEQ ID NO: 239159 - DNA, 15 bp, Homo sapiens
tgtaaaatattgtac

SEQ ID NO: 239160 - DNA, 15 bp, Homo sapiens
ttgtaaaatattgta

SEQ ID NO: 239161 - DNA, 15 bp, Homo sapiens
attgtaaaatattgt

SEQ ID NO: 239162 - DNA, 15 bp, Homo sapiens
gattgtaaaatattg

SEQ ID NO: 239163 - DNA, 15 bp, Homo sapiens
agattgtaaaatatt

SEQ ID NO: 239164 - DNA, 15 bp, Homo sapiens
aagattgtaaaatat

SEQ ID NO: 239165 - DNA, 15 bp, Homo sapiens
taagattgtaaaata

SEQ ID NO: 239166 - DNA, 15 bp, Homo sapiens
ctaagattgtaaaat

SEQ ID NO: 239167 - DNA, 15 bp, Homo sapiens
actaagattgtaaaa

SEQ ID NO: 239168 - DNA, 15 bp, Homo sapiens
gactaagattgtaaa

SEQ ID NO: 239169 - DNA, 15 bp, Homo sapiens
agactaagattgtaa

SEQ ID NO: 239170 - DNA, 15 bp, Homo sapiens
aagactaagattgta

SEQ ID NO: 239171 - DNA, 15 bp, Homo sapiens
aaagactaagattgt

SEQ ID NO: 239172 - DNA, 15 bp, Homo sapiens
caaagactaagattg

SEQ ID NO: 239173 - DNA, 15 bp, Homo sapiens
gcaaagactaagatt

SEQ ID NO: 239174 - DNA, 15 bp, Homo sapiens
tgcaaagactaagat

SEQ ID NO: 239175 - DNA, 15 bp, Homo sapiens
ttgcaaagactaaga

SEQ ID NO: 239176 - DNA, 15 bp, Homo sapiens
tttgcaaagactaag

SEQ ID NO: 239177 - DNA, 15 bp, Homo sapiens
ctttgcaaagactaa

SEQ ID NO: 239178 - DNA, 15 bp, Homo sapiens
tctttgcaaagacta

SEQ ID NO: 239179 - DNA, 15 bp, Homo sapiens
ctctttgcaaagact

SEQ ID NO: 239180 - DNA, 15 bp, Homo sapiens
actctttgcaaagac

SEQ ID NO: 239181 - DNA, 15 bp, Homo sapiens
cactctttgcaaaga

SEQ ID NO: 239182 - DNA, 15 bp, Homo sapiens
acactctttgcaaag

SEQ ID NO: 239183 - DNA, 15 bp, Homo sapiens
aacactctttgcaaa

SEQ ID NO: 239184 - DNA, 15 bp, Homo sapiens
taacactctttgcaa

SEQ ID NO: 239185 - DNA, 15 bp, Homo sapiens
ttaacactctttgca

SEQ ID NO: 239186 - DNA, 15 bp, Homo sapiens
attaacactctttgc

SEQ ID NO: 239187 - DNA, 15 bp, Homo sapiens
tattaacactctttg

SEQ ID NO: 239188 - DNA, 15 bp, Homo sapiens
ttattaacactcttt

SEQ ID NO: 239189 - DNA, 15 bp, Homo sapiens
gttattaacactctt

SEQ ID NO: 239190 - DNA, 15 bp, Homo sapiens
ggttattaacactct

SEQ ID NO: 239191 - DNA, 15 bp, Homo sapiens
aggttattaacactc

SEQ ID NO: 239192 - DNA, 15 bp, Homo sapiens
taggttattaacact

SEQ ID NO: 239193 - DNA, 15 bp, Homo sapiens
ctaggttattaacac

SEQ ID NO: 239194 - DNA, 15 bp, Homo sapiens
cctaggttattaaca

SEQ ID NO: 239195 - DNA, 15 bp, Homo sapiens
tcctaggttattaac

SEQ ID NO: 239196 - DNA, 15 bp, Homo sapiens
atcctaggttattaa

SEQ ID NO: 239197 - DNA, 15 bp, Homo sapiens
aatcctaggttatta

SEQ ID NO: 239198 - DNA, 15 bp, Homo sapiens
taatcctaggttatt

SEQ ID NO: 239199 - DNA, 15 bp, Homo sapiens
ctaatcctaggttat

SEQ ID NO: 239200 - DNA, 15 bp, Homo sapiens
actaatcctaggtta

SEQ ID NO: 239201 - DNA, 15 bp, Homo sapiens
tactaatcctaggtt

SEQ ID NO: 239202 - DNA, 15 bp, Homo sapiens
ttactaatcctaggt

SEQ ID NO: 239203 - DNA, 15 bp, Homo sapiens
tttactaatcctagg

SEQ ID NO: 239204 - DNA, 15 bp, Homo sapiens
ctttactaatcctag

SEQ ID NO: 239205 - DNA, 15 bp, Homo sapiens
gctttactaatccta

SEQ ID NO: 239206 - DNA, 15 bp, Homo sapiens
tgctttactaatcct

SEQ ID NO: 239207 - DNA, 15 bp, Homo sapiens
ttgctttactaatcc

SEQ ID NO: 239208 - DNA, 15 bp, Homo sapiens
tttgctttactaatc

SEQ ID NO: 239209 - DNA, 15 bp, Homo sapiens
ttttgctttactaat

SEQ ID NO: 239210 - DNA, 15 bp, Homo sapiens
attttgctttactaa

SEQ ID NO: 239211 - DNA, 15 bp, Homo sapiens
gattttgctttacta

SEQ ID NO: 239212 - DNA, 15 bp, Homo sapiens
agattttgctttact

SEQ ID NO: 239213 - DNA, 15 bp, Homo sapiens
cagattttgctttac

SEQ ID NO: 239214 - DNA, 15 bp, Homo sapiens
acagattttgcttta

SEQ ID NO: 239215 - DNA, 15 bp, Homo sapiens
aacagattttgcttt

SEQ ID NO: 239216 - DNA, 15 bp, Homo sapiens
taacagattttgctt

SEQ ID NO: 239217 - DNA, 15 bp, Homo sapiens
ttaacagattttgct

SEQ ID NO: 239218 - DNA, 15 bp, Homo sapiens
tttaacagattttgc

SEQ ID NO: 239219 - DNA, 15 bp, Homo sapiens
atttaacagattttg

SEQ ID NO: 239220 - DNA, 15 bp, Homo sapiens
aatttaacagatttt

SEQ ID NO: 239221 - DNA, 15 bp, Homo sapiens
aaatttaacagattt

SEQ ID NO: 239222 - DNA, 15 bp, Homo sapiens
taaatttaacagatt

SEQ ID NO: 239223 - DNA, 15 bp, Homo sapiens
ataaatttaacagat

SEQ ID NO: 239224 - DNA, 15 bp, Homo sapiens
cataaatttaacaga

SEQ ID NO: 239225 - DNA, 15 bp, Homo sapiens
acataaatttaacag

SEQ ID NO: 239226 - DNA, 15 bp, Homo sapiens
cacataaatttaaca

SEQ ID NO: 239227 - DNA, 15 bp, Homo sapiens
acacataaatttaac

SEQ ID NO: 239228 - DNA, 15 bp, Homo sapiens
aacacataaatttaa

SEQ ID NO: 239229 - DNA, 15 bp, Homo sapiens
aaacacataaattta

SEQ ID NO: 239230 - DNA, 15 bp, Homo sapiens
aaaacacataaattt

SEQ ID NO: 239231 - DNA, 15 bp, Homo sapiens
aaaaacacataaatt

SEQ ID NO: 239232 - DNA, 15 bp, Homo sapiens
gaaaaacacataaat

SEQ ID NO: 239233 - DNA, 15 bp, Homo sapiens
agaaaaacacataaa

SEQ ID NO: 239234 - DNA, 15 bp, Homo sapiens
tagaaaaacacataa

SEQ ID NO: 239235 - DNA, 15 bp, Homo sapiens
ctagaaaaacacata

SEQ ID NO: 239236 - DNA, 15 bp, Homo sapiens
actagaaaaacacat

SEQ ID NO: 239237 - DNA, 15 bp, Homo sapiens
cactagaaaaacaca

SEQ ID NO: 239238 - DNA, 15 bp, Homo sapiens
ccactagaaaaacac

SEQ ID NO: 239239 - DNA, 15 bp, Homo sapiens
tccactagaaaaaca

SEQ ID NO: 239240 - DNA, 15 bp, Homo sapiens
atccactagaaaaac

SEQ ID NO: 239241 - DNA, 15 bp, Homo sapiens
catccactagaaaaa

SEQ ID NO: 239242 - DNA, 15 bp, Homo sapiens
ccatccactagaaaa

SEQ ID NO: 239243 - DNA, 15 bp, Homo sapiens
tccatccactagaaa

SEQ ID NO: 239244 - DNA, 15 bp, Homo sapiens
ttccatccactagaa

SEQ ID NO: 239245 - DNA, 15 bp, Homo sapiens
gttccatccactaga

SEQ ID NO: 239246 - DNA, 15 bp, Homo sapiens
tgttccatccactag

SEQ ID NO: 239247 - DNA, 15 bp, Homo sapiens
atgttccatccacta

SEQ ID NO: 239248 - DNA, 15 bp, Homo sapiens
tatgttccatccact

SEQ ID NO: 239249 - DNA, 15 bp, Homo sapiens
ctatgttccatccac

SEQ ID NO: 239250 - DNA, 15 bp, Homo sapiens
tctatgttccatcca

SEQ ID NO: 239251 - DNA, 15 bp, Homo sapiens
ttctatgttccatcc

SEQ ID NO: 239252 - DNA, 15 bp, Homo sapiens
tttctatgttccatc

SEQ ID NO: 239253 - DNA, 15 bp, Homo sapiens
atttctatgttccat

SEQ ID NO: 239254 - DNA, 15 bp, Homo sapiens
tatttctatgttcca

SEQ ID NO: 239255 - DNA, 15 bp, Homo sapiens
atatttctatgttcc

SEQ ID NO: 239256 - DNA, 15 bp, Homo sapiens
aatatttctatgttc

SEQ ID NO: 239257 - DNA, 15 bp, Homo sapiens
aaatatttctatgtt

SEQ ID NO: 239258 - DNA, 15 bp, Homo sapiens
caaatatttctatgt

SEQ ID NO: 239259 - DNA, 15 bp, Homo sapiens
acaaatatttctatg

SEQ ID NO: 239260 - DNA, 15 bp, Homo sapiens
aacaaatatttctat

SEQ ID NO: 239261 - DNA, 15 bp, Homo sapiens
gaacaaatatttcta

SEQ ID NO: 239262 - DNA, 15 bp, Homo sapiens
agaacaaatatttct

SEQ ID NO: 239263 - DNA, 15 bp, Homo sapiens
aagaacaaatatttc

SEQ ID NO: 239264 - DNA, 15 bp, Homo sapiens
aaagaacaaatattt

SEQ ID NO: 239265 - DNA, 15 bp, Homo sapiens
taaagaacaaatatt

SEQ ID NO: 239266 - DNA, 15 bp, Homo sapiens
ataaagaacaaatat

SEQ ID NO: 239267 - DNA, 15 bp, Homo sapiens
aataaagaacaaata

SEQ ID NO: 239268 - DNA, 15 bp, Homo sapiens
gaataaagaacaaat

SEQ ID NO: 239269 - DNA, 15 bp, Homo sapiens
agaataaagaacaaa

SEQ ID NO: 239270 - DNA, 15 bp, Homo sapiens
aagaataaagaacaa

SEQ ID NO: 239271 - DNA, 15 bp, Homo sapiens
aaagaataaagaaca

SEQ ID NO: 239272 - DNA, 15 bp, Homo sapiens
aaaagaataaagaac

SEQ ID NO: 239273 - DNA, 15 bp, Homo sapiens
aaaaagaataaagaa

SEQ ID NO: 239274 - DNA, 15 bp, Homo sapiens
aaaaaagaataaaga

SEQ ID NO: 239275 - DNA, 15 bp, Homo sapiens
aaaaaaagaataaag

SEQ ID NO: 239276 - DNA, 15 bp, Homo sapiens
aaaaaaaagaataaa

SEQ ID NO: 239277 - DNA, 15 bp, Homo sapiens
aaaaaaaaagaataa

SEQ ID NO: 239278 - DNA, 15 bp, Homo sapiens
gaaaaaaaaagaata

SEQ ID NO: 239279 - DNA, 15 bp, Homo sapiens
gaagaaaaaaaaaga

SEQ ID NO: 239280 - DNA, 15 bp, Homo sapiens
agaagaaaaaaaaag

SEQ ID NO: 239281 - DNA, 15 bp, Homo sapiens
gagcagaagaaaaaa

SEQ ID NO: 239282 - DNA, 15 bp, Homo sapiens
agagcagaagaaaaa

SEQ ID NO: 239283 - DNA, 15 bp, Homo sapiens
cagagcagaagaaaa

SEQ ID NO: 239284 - DNA, 15 bp, Homo sapiens
acagagcagaagaaa

SEQ ID NO: 239285 - DNA, 15 bp, Homo sapiens
aacagagcagaagaa

SEQ ID NO: 239286 - DNA, 15 bp, Homo sapiens
aaacagagcagaaga

SEQ ID NO: 239287 - DNA, 15 bp, Homo sapiens
gaaacagagcagaag

SEQ ID NO: 239288 - DNA, 15 bp, Homo sapiens
agaaacagagcagaa

SEQ ID NO: 239289 - DNA, 15 bp, Homo sapiens
gagaaacagagcaga

SEQ ID NO: 239290 - DNA, 15 bp, Homo sapiens
agagaaacagagcag

SEQ ID NO: 239291 - DNA, 15 bp, Homo sapiens
tagagaaacagagca

SEQ ID NO: 239292 - DNA, 15 bp, Homo sapiens
ttagagaaacagagc

SEQ ID NO: 239293 - DNA, 15 bp, Homo sapiens
attagagaaacagag

SEQ ID NO: 239294 - DNA, 15 bp, Homo sapiens
aattagagaaacaga

SEQ ID NO: 239295 - DNA, 15 bp, Homo sapiens
atgaattagagaaac

SEQ ID NO: 239296 - DNA, 15 bp, Homo sapiens
aatgaattagagaaa

SEQ ID NO: 239297 - DNA, 15 bp, Homo sapiens
taatgaattagagaa

SEQ ID NO: 239298 - DNA, 15 bp, Homo sapiens
ataatgaattagaga

SEQ ID NO: 239299 - DNA, 15 bp, Homo sapiens
gataatgaattagag

SEQ ID NO: 239300 - DNA, 15 bp, Homo sapiens
agataatgaattaga

SEQ ID NO: 239301 - DNA, 15 bp, Homo sapiens
aagataatgaattag

SEQ ID NO: 239302 - DNA, 15 bp, Homo sapiens
gaagataatgaatta

SEQ ID NO: 239303 - DNA, 15 bp, Homo sapiens
tgaagataatgaatt

SEQ ID NO: 239304 - DNA, 15 bp, Homo sapiens
atgaagataatgaat

SEQ ID NO: 239305 - DNA, 15 bp, Homo sapiens
catgaagataatgaa

SEQ ID NO: 239306 - DNA, 15 bp, Homo sapiens
acatgaagataatga

SEQ ID NO: 239307 - DNA, 15 bp, Homo sapiens
cacatgaagataatg

SEQ ID NO: 239308 - DNA, 15 bp, Homo sapiens
tcacatgaagataat

SEQ ID NO: 239309 - DNA, 15 bp, Homo sapiens
atcacatgaagataa

SEQ ID NO: 239310 - DNA, 15 bp, Homo sapiens
catcacatgaagata

SEQ ID NO: 239311 - DNA, 15 bp, Homo sapiens
tcatcacatgaagat

SEQ ID NO: 239312 - DNA, 15 bp, Homo sapiens
atcatcacatgaaga

SEQ ID NO: 239313 - DNA, 15 bp, Homo sapiens
aatcatcacatgaag

SEQ ID NO: 239314 - DNA, 15 bp, Homo sapiens
gaatcatcacatgaa

SEQ ID NO: 239315 - DNA, 15 bp, Homo sapiens
agaatcatcacatga

SEQ ID NO: 239316 - DNA, 15 bp, Homo sapiens
aagaatcatcacatg

SEQ ID NO: 239317 - DNA, 15 bp, Homo sapiens
taagaatcatcacat

SEQ ID NO: 239318 - DNA, 15 bp, Homo sapiens
ataagaatcatcaca

SEQ ID NO: 239319 - DNA, 15 bp, Homo sapiens
cataagaatcatcac

SEQ ID NO: 239320 - DNA, 15 bp, Homo sapiens
ccataagaatcatca

SEQ ID NO: 239321 - DNA, 15 bp, Homo sapiens
accataagaatcatc

SEQ ID NO: 239322 - DNA, 15 bp, Homo sapiens
gaccataagaatcat

SEQ ID NO: 239323 - DNA, 15 bp, Homo sapiens
ggaccataagaatca

SEQ ID NO: 239324 - DNA, 15 bp, Homo sapiens
tggaccataagaatc

SEQ ID NO: 239325 - DNA, 15 bp, Homo sapiens
atggaccataagaat

SEQ ID NO: 239326 - DNA, 15 bp, Homo sapiens
gatggaccataagaa

SEQ ID NO: 239327 - DNA, 15 bp, Homo sapiens
agatggaccataaga

SEQ ID NO: 239328 - DNA, 15 bp, Homo sapiens
aagatggaccataag

SEQ ID NO: 239329 - DNA, 15 bp, Homo sapiens
caagatggaccataa

SEQ ID NO: 239330 - DNA, 15 bp, Homo sapiens
tcaagatggaccata

SEQ ID NO: 239331 - DNA, 15 bp, Homo sapiens
atcaagatggaccat

SEQ ID NO: 239332 - DNA, 15 bp, Homo sapiens
aatcaagatggacca

SEQ ID NO: 239333 - DNA, 15 bp, Homo sapiens
aaatcaagatggacc

SEQ ID NO: 239334 - DNA, 15 bp, Homo sapiens
taaatcaagatggac

SEQ ID NO: 239335 - DNA, 15 bp, Homo sapiens
gtaaatcaagatgga

SEQ ID NO: 239336 - DNA, 15 bp, Homo sapiens
agtaaatcaagatgg

SEQ ID NO: 239337 - DNA, 15 bp, Homo sapiens
aagtaaatcaagatg

SEQ ID NO: 239338 - DNA, 15 bp, Homo sapiens
gaagtaaatcaagat

SEQ ID NO: 239339 - DNA, 15 bp, Homo sapiens
ggaagtaaatcaaga

SEQ ID NO: 239340 - DNA, 15 bp, Homo sapiens
gggaagtaaatcaag

SEQ ID NO: 239341 - DNA, 15 bp, Homo sapiens
tgggaagtaaatcaa

SEQ ID NO: 239342 - DNA, 15 bp, Homo sapiens
atgggaagtaaatca

SEQ ID NO: 239343 - DNA, 15 bp, Homo sapiens
aatgggaagtaaatc

SEQ ID NO: 239344 - DNA, 15 bp, Homo sapiens
gaatgggaagtaaat

SEQ ID NO: 239345 - DNA, 15 bp, Homo sapiens
agaatgggaagtaaa

SEQ ID NO: 239346 - DNA, 15 bp, Homo sapiens
tagaatgggaagtaa

SEQ ID NO: 239347 - DNA, 15 bp, Homo sapiens
atagaatgggaagta

SEQ ID NO: 239348 - DNA, 15 bp, Homo sapiens
aatagaatgggaagt

SEQ ID NO: 239349 - DNA, 15 bp, Homo sapiens
aaatagaatgggaag

SEQ ID NO: 239350 - DNA, 15 bp, Homo sapiens
gaaatagaatgggaa

SEQ ID NO: 239351 - DNA, 15 bp, Homo sapiens
agaaatagaatggga

SEQ ID NO: 239352 - DNA, 15 bp, Homo sapiens
cagaaatagaatggg

SEQ ID NO: 239353 - DNA, 15 bp, Homo sapiens
acagaaatagaatgg

SEQ ID NO: 239354 - DNA, 15 bp, Homo sapiens
aacagaaatagaatg

SEQ ID NO: 239355 - DNA, 15 bp, Homo sapiens
taacagaaatagaat

SEQ ID NO: 239356 - DNA, 15 bp, Homo sapiens
ataacagaaatagaa

SEQ ID NO: 239357 - DNA, 15 bp, Homo sapiens
gataacagaaataga

SEQ ID NO: 239358 - DNA, 15 bp, Homo sapiens
tgataacagaaatag

SEQ ID NO: 239359 - DNA, 15 bp, Homo sapiens
gtgataacagaaata

SEQ ID NO: 239360 - DNA, 15 bp, Homo sapiens
ggtgataacagaaat

SEQ ID NO: 239361 - DNA, 15 bp, Homo sapiens
tggtgataacagaaa

SEQ ID NO: 239362 - DNA, 15 bp, Homo sapiens
atggtgataacagaa

SEQ ID NO: 239363 - DNA, 15 bp, Homo sapiens
aatggtgataacaga

SEQ ID NO: 239364 - DNA, 15 bp, Homo sapiens
aaatggtgataacag

SEQ ID NO: 239365 - DNA, 15 bp, Homo sapiens
gaaatggtgataaca

SEQ ID NO: 239366 - DNA, 15 bp, Homo sapiens
ggaaatggtgataac

SEQ ID NO: 239367 - DNA, 15 bp, Homo sapiens
cggaaatggtgataa

SEQ ID NO: 239368 - DNA, 15 bp, Homo sapiens
tcggaaatggtgata

SEQ ID NO: 239369 - DNA, 15 bp, Homo sapiens
ttcggaaatggtgat

SEQ ID NO: 239370 - DNA, 15 bp, Homo sapiens
cttcggaaatggtga

SEQ ID NO: 239371 - DNA, 15 bp, Homo sapiens
tcttcggaaatggtg

SEQ ID NO: 239372 - DNA, 15 bp, Homo sapiens
atcttcggaaatggt

SEQ ID NO: 239373 - DNA, 15 bp, Homo sapiens
aatcttcggaaatgg

SEQ ID NO: 239374 - DNA, 15 bp, Homo sapiens
taatcttcggaaatg

SEQ ID NO: 239375 - DNA, 15 bp, Homo sapiens
ctaatcttcggaaat

SEQ ID NO: 239376 - DNA, 15 bp, Homo sapiens
tctaatcttcggaaa

SEQ ID NO: 239377 - DNA, 15 bp, Homo sapiens
ttctaatcttcggaa

SEQ ID NO: 239378 - DNA, 15 bp, Homo sapiens
cttctaatcttcgga

SEQ ID NO: 239379 - DNA, 15 bp, Homo sapiens
acttctaatcttcgg

SEQ ID NO: 239380 - DNA, 15 bp, Homo sapiens
gacttctaatcttcg

SEQ ID NO: 239381 - DNA, 15 bp, Homo sapiens
cgacttctaatcttc

SEQ ID NO: 239382 - DNA, 15 bp, Homo sapiens
ccgacttctaatctt

SEQ ID NO: 239383 - DNA, 15 bp, Homo sapiens
cccgacttctaatct

SEQ ID NO: 239384 - DNA, 15 bp, Homo sapiens
ccccgacttctaatc

SEQ ID NO: 239385 - DNA, 15 bp, Homo sapiens
tccccgacttctaat

SEQ ID NO: 239386 - DNA, 15 bp, Homo sapiens
ttccccgacttctaa

SEQ ID NO: 239387 - DNA, 15 bp, Homo sapiens
attccccgacttcta

SEQ ID NO: 239388 - DNA, 15 bp, Homo sapiens
tattccccgacttct

SEQ ID NO: 239389 - DNA, 15 bp, Homo sapiens
atattccccgacttc

SEQ ID NO: 239390 - DNA, 15 bp, Homo sapiens
catattccccgactt

SEQ ID NO: 239391 - DNA, 15 bp, Homo sapiens
acatattccccgact

SEQ ID NO: 239392 - DNA, 15 bp, Homo sapiens
aacatattccccgac

SEQ ID NO: 239393 - DNA, 15 bp, Homo sapiens
taacatattccccga

SEQ ID NO: 239394 - DNA, 15 bp, Homo sapiens
ataacatattccccg

SEQ ID NO: 239395 - DNA, 15 bp, Homo sapiens
tataacatattcccc

SEQ ID NO: 239396 - DNA, 15 bp, Homo sapiens
gtataacatattccc

SEQ ID NO: 239397 - DNA, 15 bp, Homo sapiens
agtataacatattcc

SEQ ID NO: 239398 - DNA, 15 bp, Homo sapiens
aagtataacatattc

SEQ ID NO: 239399 - DNA, 15 bp, Homo sapiens
caagtataacatatt

SEQ ID NO: 239400 - DNA, 15 bp, Homo sapiens
tcaagtataacatat

SEQ ID NO: 239401 - DNA, 15 bp, Homo sapiens
ttcaagtataacata

SEQ ID NO: 239402 - DNA, 15 bp, Homo sapiens
tttcaagtataacat

SEQ ID NO: 239403 - DNA, 15 bp, Homo sapiens
ctttcaagtataaca

SEQ ID NO: 239404 - DNA, 15 bp, Homo sapiens
tctttcaagtataac

SEQ ID NO: 239405 - DNA, 15 bp, Homo sapiens
ttctttcaagtataa

SEQ ID NO: 239406 - DNA, 15 bp, Homo sapiens
cttctttcaagtata

SEQ ID NO: 239407 - DNA, 15 bp, Homo sapiens
tcttctttcaagtat

SEQ ID NO: 239408 - DNA, 15 bp, Homo sapiens
atcttctttcaagta

SEQ ID NO: 239409 - DNA, 15 bp, Homo sapiens
tatcttctttcaagt

SEQ ID NO: 239410 - DNA, 15 bp, Homo sapiens
atatcttctttcaag

SEQ ID NO: 239411 - DNA, 15 bp, Homo sapiens
catatcttctttcaa

SEQ ID NO: 239412 - DNA, 15 bp, Homo sapiens
acatatcttctttca

SEQ ID NO: 239413 - DNA, 15 bp, Homo sapiens
tacatatcttctttc

SEQ ID NO: 239414 - DNA, 15 bp, Homo sapiens
atacatatcttcttt

SEQ ID NO: 239415 - DNA, 15 bp, Homo sapiens
aatacatatcttctt

SEQ ID NO: 239416 - DNA, 15 bp, Homo sapiens
gaatacatatcttct

SEQ ID NO: 239417 - DNA, 15 bp, Homo sapiens
agaatacatatcttc

SEQ ID NO: 239418 - DNA, 15 bp, Homo sapiens
cagaatacatatctt

SEQ ID NO: 239419 - DNA, 15 bp, Homo sapiens
acagaatacatatct

SEQ ID NO: 239420 - DNA, 15 bp, Homo sapiens
gacagaatacatatc

SEQ ID NO: 239421 - DNA, 15 bp, Homo sapiens
tgacagaatacatat

SEQ ID NO: 239422 - DNA, 15 bp, Homo sapiens
atgacagaatacata

SEQ ID NO: 239423 - DNA, 15 bp, Homo sapiens
gatgacagaatacat

SEQ ID NO: 239424 - DNA, 15 bp, Homo sapiens
ggatgacagaataca

SEQ ID NO: 239425 - DNA, 15 bp, Homo sapiens
aggatgacagaatac

SEQ ID NO: 239426 - DNA, 15 bp, Homo sapiens
aaggatgacagaata

SEQ ID NO: 239427 - DNA, 15 bp, Homo sapiens
taaggatgacagaat

SEQ ID NO: 239428 - DNA, 15 bp, Homo sapiens
ataaggatgacagaa

SEQ ID NO: 239429 - DNA, 15 bp, Homo sapiens
gataaggatgacaga

SEQ ID NO: 239430 - DNA, 15 bp, Homo sapiens
agataaggatgacag

SEQ ID NO: 239431 - DNA, 15 bp, Homo sapiens
tagataaggatgaca

SEQ ID NO: 239432 - DNA, 15 bp, Homo sapiens
atagataaggatgac

SEQ ID NO: 239433 - DNA, 15 bp, Homo sapiens
catagataaggatga

SEQ ID NO: 239434 - DNA, 15 bp, Homo sapiens
tcatagataaggatg

SEQ ID NO: 239435 - DNA, 15 bp, Homo sapiens
atcatagataaggat

SEQ ID NO: 239436 - DNA, 15 bp, Homo sapiens
gatcatagataagga

SEQ ID NO: 239437 - DNA, 15 bp, Homo sapiens
ggatcatagataagg

SEQ ID NO: 239438 - DNA, 15 bp, Homo sapiens
aggatcatagataag

SEQ ID NO: 239439 - DNA, 15 bp, Homo sapiens
caggatcatagataa

SEQ ID NO: 239440 - DNA, 15 bp, Homo sapiens
ccaggatcatagata

SEQ ID NO: 239441 - DNA, 15 bp, Homo sapiens
accaggatcatagat

SEQ ID NO: 239442 - DNA, 15 bp, Homo sapiens
taccaggatcataga

SEQ ID NO: 239443 - DNA, 15 bp, Homo sapiens
ttaccaggatcatag

SEQ ID NO: 239444 - DNA, 15 bp, Homo sapiens
gttaccaggatcata

SEQ ID NO: 239445 - DNA, 15 bp, Homo sapiens
ggttaccaggatcat

SEQ ID NO: 239446 - DNA, 15 bp, Homo sapiens
aggttaccaggatca

SEQ ID NO: 239447 - DNA, 15 bp, Homo sapiens
gaggttaccaggatc

SEQ ID NO: 239448 - DNA, 15 bp, Homo sapiens
agaggttaccaggat

SEQ ID NO: 239449 - DNA, 15 bp, Homo sapiens
tagaggttaccagga

SEQ ID NO: 239450 - DNA, 15 bp, Homo sapiens
ctagaggttaccagg

SEQ ID NO: 239451 - DNA, 15 bp, Homo sapiens
tctagaggttaccag

SEQ ID NO: 239452 - DNA, 15 bp, Homo sapiens
ctctagaggttacca

SEQ ID NO: 239453 - DNA, 15 bp, Homo sapiens
gctctagaggttacc

SEQ ID NO: 239454 - DNA, 15 bp, Homo sapiens
agctctagaggttac

SEQ ID NO: 239455 - DNA, 15 bp, Homo sapiens
gagctctagaggtta

SEQ ID NO: 239456 - DNA, 15 bp, Homo sapiens
tgagctctagaggtt

SEQ ID NO: 239457 - DNA, 15 bp, Homo sapiens
ctgagctctagaggt

SEQ ID NO: 239458 - DNA, 15 bp, Homo sapiens
tctgagctctagagg

SEQ ID NO: 239459 - DNA, 15 bp, Homo sapiens
atctgagctctagag

SEQ ID NO: 239460 - DNA, 15 bp, Homo sapiens
catctgagctctaga

SEQ ID NO: 239461 - DNA, 15 bp, Homo sapiens
acatctgagctctag

SEQ ID NO: 239462 - DNA, 15 bp, Homo sapiens
aacatctgagctcta

SEQ ID NO: 239463 - DNA, 15 bp, Homo sapiens
taacatctgagctct

SEQ ID NO: 239464 - DNA, 15 bp, Homo sapiens
ctaacatctgagctc

SEQ ID NO: 239465 - DNA, 15 bp, Homo sapiens
actaacatctgagct

SEQ ID NO: 239466 - DNA, 15 bp, Homo sapiens
aactaacatctgagc

SEQ ID NO: 239467 - DNA, 15 bp, Homo sapiens
caactaacatctgag

SEQ ID NO: 239468 - DNA, 15 bp, Homo sapiens
gcaactaacatctga

SEQ ID NO: 239469 - DNA, 15 bp, Homo sapiens
agcaactaacatctg

SEQ ID NO: 239470 - DNA, 15 bp, Homo sapiens
cagcaactaacatct

SEQ ID NO: 239471 - DNA, 15 bp, Homo sapiens
ccagcaactaacatc

SEQ ID NO: 239472 - DNA, 15 bp, Homo sapiens
accagcaactaacat

SEQ ID NO: 239473 - DNA, 15 bp, Homo sapiens
aaccagcaactaaca

SEQ ID NO: 239474 - DNA, 15 bp, Homo sapiens
caaccagcaactaac

SEQ ID NO: 239475 - DNA, 15 bp, Homo sapiens
ccaaccagcaactaa

SEQ ID NO: 239476 - DNA, 15 bp, Homo sapiens
tccaaccagcaacta

SEQ ID NO: 239477 - DNA, 15 bp, Homo sapiens
ttccaaccagcaact

SEQ ID NO: 239478 - DNA, 15 bp, Homo sapiens
tttccaaccagcaac

SEQ ID NO: 239479 - DNA, 15 bp, Homo sapiens
ttttccaaccagcaa

SEQ ID NO: 239480 - DNA, 15 bp, Homo sapiens
cttttccaaccagca

SEQ ID NO: 239481 - DNA, 15 bp, Homo sapiens
tcttttccaaccagc

SEQ ID NO: 239482 - DNA, 15 bp, Homo sapiens
ttcttttccaaccag

SEQ ID NO: 239483 - DNA, 15 bp, Homo sapiens
cttcttttccaacca

SEQ ID NO: 239484 - DNA, 15 bp, Homo sapiens
tcttcttttccaacc

SEQ ID NO: 239485 - DNA, 15 bp, Homo sapiens
tctcttcttttccaa

SEQ ID NO: 239486 - DNA, 15 bp, Homo sapiens
ttctcttcttttcca

SEQ ID NO: 239487 - DNA, 15 bp, Homo sapiens
tttctcttcttttcc

SEQ ID NO: 239488 - DNA, 15 bp, Homo sapiens
ttttctcttcttttc

SEQ ID NO: 239489 - DNA, 15 bp, Homo sapiens
tttttctcttctttt

SEQ ID NO: 239490 - DNA, 15 bp, Homo sapiens
atttttctcttcttt

SEQ ID NO: 239491 - DNA, 15 bp, Homo sapiens
gatttttctcttctt

SEQ ID NO: 239492 - DNA, 15 bp, Homo sapiens
agatttttctcttct

SEQ ID NO: 239493 - DNA, 15 bp, Homo sapiens
tagatttttctcttc

SEQ ID NO: 239494 - DNA, 15 bp, Homo sapiens
atagatttttctctt

SEQ ID NO: 239495 - DNA, 15 bp, Homo sapiens
catagatttttctct

SEQ ID NO: 239496 - DNA, 15 bp, Homo sapiens
gcatagatttttctc

SEQ ID NO: 239497 - DNA, 15 bp, Homo sapiens
agcatagatttttct

SEQ ID NO: 239498 - DNA, 15 bp, Homo sapiens
cagcatagatttttc

SEQ ID NO: 239499 - DNA, 15 bp, Homo sapiens
ccagcatagattttt

SEQ ID NO: 239500 - DNA, 15 bp, Homo sapiens
accagcatagatttt

SEQ ID NO: 239501 - DNA, 15 bp, Homo sapiens
caccagcatagattt

SEQ ID NO: 239502 - DNA, 15 bp, Homo sapiens
ccaccagcatagatt

SEQ ID NO: 239503 - DNA, 15 bp, Homo sapiens
cccaccagcatagat

SEQ ID NO: 239504 - DNA, 15 bp, Homo sapiens
gcccaccagcataga

SEQ ID NO: 239505 - DNA, 15 bp, Homo sapiens
tgcccaccagcatag

SEQ ID NO: 239506 - DNA, 15 bp, Homo sapiens
ttgcccaccagcata

SEQ ID NO: 239507 - DNA, 15 bp, Homo sapiens
gttgcccaccagcat

SEQ ID NO: 239508 - DNA, 15 bp, Homo sapiens
tgttgcccaccagca

SEQ ID NO: 239509 - DNA, 15 bp, Homo sapiens
gtgttgcccaccagc

SEQ ID NO: 239510 - DNA, 15 bp, Homo sapiens
agtgttgcccaccag

SEQ ID NO: 239511 - DNA, 15 bp, Homo sapiens
cagtgttgcccacca

SEQ ID NO: 239512 - DNA, 15 bp, Homo sapiens
acagtgttgcccacc

SEQ ID NO: 239513 - DNA, 15 bp, Homo sapiens
aacagtgttgcccac

SEQ ID NO: 239514 - DNA, 15 bp, Homo sapiens
caacagtgttgccca

SEQ ID NO: 239515 - DNA, 15 bp, Homo sapiens
tcaacagtgttgccc

SEQ ID NO: 239516 - DNA, 15 bp, Homo sapiens
ttcaacagtgttgcc

SEQ ID NO: 239517 - DNA, 15 bp, Homo sapiens
attcaacagtgttgc

SEQ ID NO: 239518 - DNA, 15 bp, Homo sapiens
aattcaacagtgttg

SEQ ID NO: 239519 - DNA, 15 bp, Homo sapiens
caattcaacagtgtt

SEQ ID NO: 239520 - DNA, 15 bp, Homo sapiens
gcaattcaacagtgt

SEQ ID NO: 239521 - DNA, 15 bp, Homo sapiens
tgcaattcaacagtg

SEQ ID NO: 239522 - DNA, 15 bp, Homo sapiens
ctgcaattcaacagt

SEQ ID NO: 239523 - DNA, 15 bp, Homo sapiens
cctgcaattcaacag

SEQ ID NO: 239524 - DNA, 15 bp, Homo sapiens
tcctgcaattcaaca

SEQ ID NO: 239525 - DNA, 15 bp, Homo sapiens
ctcctgcaattcaac

SEQ ID NO: 239526 - DNA, 15 bp, Homo sapiens
actcctgcaattcaa

SEQ ID NO: 239527 - DNA, 15 bp, Homo sapiens
tactcctgcaattca

SEQ ID NO: 239528 - DNA, 15 bp, Homo sapiens
ttactcctgcaattc

SEQ ID NO: 239529 - DNA, 15 bp, Homo sapiens
attactcctgcaatt

SEQ ID NO: 239530 - DNA, 15 bp, Homo sapiens
tattactcctgcaat

SEQ ID NO: 239531 - DNA, 15 bp, Homo sapiens
atattactcctgcaa

SEQ ID NO: 239532 - DNA, 15 bp, Homo sapiens
aatattactcctgca

SEQ ID NO: 239533 - DNA, 15 bp, Homo sapiens
aaatattactcctgc

SEQ ID NO: 239534 - DNA, 15 bp, Homo sapiens
aaaatattactcctg

SEQ ID NO: 239535 - DNA, 15 bp, Homo sapiens
gaaaatattactcct

SEQ ID NO: 239536 - DNA, 15 bp, Homo sapiens
agaaaatattactcc

SEQ ID NO: 239537 - DNA, 15 bp, Homo sapiens
aagaaaatattactc

SEQ ID NO: 239538 - DNA, 15 bp, Homo sapiens
aaagaaaatattact

SEQ ID NO: 239539 - DNA, 15 bp, Homo sapiens
taaagaaaatattac

SEQ ID NO: 239540 - DNA, 15 bp, Homo sapiens
gtaaagaaaatatta

SEQ ID NO: 239541 - DNA, 15 bp, Homo sapiens
agtaaagaaaatatt

SEQ ID NO: 239542 - DNA, 15 bp, Homo sapiens
gagtaaagaaaatat

SEQ ID NO: 239543 - DNA, 15 bp, Homo sapiens
tgagtaaagaaaata

SEQ ID NO: 239544 - DNA, 15 bp, Homo sapiens
atgagtaaagaaaat

SEQ ID NO: 239545 - DNA, 15 bp, Homo sapiens
tatgagtaaagaaaa

SEQ ID NO: 239546 - DNA, 15 bp, Homo sapiens
ttatgagtaaagaaa

SEQ ID NO: 239547 - DNA, 15 bp, Homo sapiens
tttatgagtaaagaa

SEQ ID NO: 239548 - DNA, 15 bp, Homo sapiens
ctttatgagtaaaga

SEQ ID NO: 239549 - DNA, 15 bp, Homo sapiens
actttatgagtaaag

SEQ ID NO: 239550 - DNA, 15 bp, Homo sapiens
cactttatgagtaaa

SEQ ID NO: 239551 - DNA, 15 bp, Homo sapiens
acactttatgagtaa

SEQ ID NO: 239552 - DNA, 15 bp, Homo sapiens
cacactttatgagta

SEQ ID NO: 239553 - DNA, 15 bp, Homo sapiens
ccacactttatgagt

SEQ ID NO: 239554 - DNA, 15 bp, Homo sapiens
gccacactttatgag

SEQ ID NO: 239555 - DNA, 15 bp, Homo sapiens
tgccacactttatga

SEQ ID NO: 239556 - DNA, 15 bp, Homo sapiens
atgccacactttatg

SEQ ID NO: 239557 - DNA, 15 bp, Homo sapiens
aatgccacactttat

SEQ ID NO: 239558 - DNA, 15 bp, Homo sapiens
aaatgccacacttta

SEQ ID NO: 239559 - DNA, 15 bp, Homo sapiens
caaatgccacacttt

SEQ ID NO: 239560 - DNA, 15 bp, Homo sapiens
tcaaatgccacactt

SEQ ID NO: 239561 - DNA, 15 bp, Homo sapiens
ttcaaatgccacact

SEQ ID NO: 239562 - DNA, 15 bp, Homo sapiens
cttcaaatgccacac

SEQ ID NO: 239563 - DNA, 15 bp, Homo sapiens
ccttcaaatgccaca

SEQ ID NO: 239564 - DNA, 15 bp, Homo sapiens
gccttcaaatgccac

SEQ ID NO: 239565 - DNA, 15 bp, Homo sapiens
agccttcaaatgcca

SEQ ID NO: 239566 - DNA, 15 bp, Homo sapiens
aagccttcaaatgcc

SEQ ID NO: 239567 - DNA, 15 bp, Homo sapiens
aaagccttcaaatgc

SEQ ID NO: 239568 - DNA, 15 bp, Homo sapiens
aaaagccttcaaatg

SEQ ID NO: 239569 - DNA, 15 bp, Homo sapiens
taaaagccttcaaat

SEQ ID NO: 239570 - DNA, 15 bp, Homo sapiens
ctaaaagccttcaaa

SEQ ID NO: 239571 - DNA, 15 bp, Homo sapiens
cctaaaagccttcaa

SEQ ID NO: 239572 - DNA, 15 bp, Homo sapiens
gcctaaaagccttca

SEQ ID NO: 239573 - DNA, 15 bp, Homo sapiens
ggcctaaaagccttc

SEQ ID NO: 239574 - DNA, 15 bp, Homo sapiens
aggcctaaaagcctt

SEQ ID NO: 239575 - DNA, 15 bp, Homo sapiens
aaggcctaaaagcct

SEQ ID NO: 239576 - DNA, 15 bp, Homo sapiens
taaggcctaaaagcc

SEQ ID NO: 239577 - DNA, 15 bp, Homo sapiens
ttaaggcctaaaagc

SEQ ID NO: 239578 - DNA, 15 bp, Homo sapiens
attaaggcctaaaag

SEQ ID NO: 239579 - DNA, 15 bp, Homo sapiens
cattaaggcctaaaa

SEQ ID NO: 239580 - DNA, 15 bp, Homo sapiens
tcattaaggcctaaa

SEQ ID NO: 239581 - DNA, 15 bp, Homo sapiens
ttcattaaggcctaa

SEQ ID NO: 239582 - DNA, 15 bp, Homo sapiens
gttcattaaggccta

SEQ ID NO: 239583 - DNA, 15 bp, Homo sapiens
tgttcattaaggcct

SEQ ID NO: 239584 - DNA, 15 bp, Homo sapiens
ttgttcattaaggcc

SEQ ID NO: 239585 - DNA, 15 bp, Homo sapiens
tttgttcattaaggc

SEQ ID NO: 239586 - DNA, 15 bp, Homo sapiens
ctttgttcattaagg

SEQ ID NO: 239587 - DNA, 15 bp, Homo sapiens
actttgttcattaag

SEQ ID NO: 239588 - DNA, 15 bp, Homo sapiens
cactttgttcattaa

SEQ ID NO: 239589 - DNA, 15 bp, Homo sapiens
gcactttgttcatta

SEQ ID NO: 239590 - DNA, 15 bp, Homo sapiens
tgcactttgttcatt

SEQ ID NO: 239591 - DNA, 15 bp, Homo sapiens
atgcactttgttcat

SEQ ID NO: 239592 - DNA, 15 bp, Homo sapiens
tatgcactttgttca

SEQ ID NO: 239593 - DNA, 15 bp, Homo sapiens
gtatgcactttgttc

SEQ ID NO: 239594 - DNA, 15 bp, Homo sapiens
agtatgcactttgtt

SEQ ID NO: 239595 - DNA, 15 bp, Homo sapiens
tagtatgcactttgt

SEQ ID NO: 239596 - DNA, 15 bp, Homo sapiens
ttagtatgcactttg

SEQ ID NO: 239597 - DNA, 15 bp, Homo sapiens
attagtatgcacttt

SEQ ID NO: 239598 - DNA, 15 bp, Homo sapiens
cattagtatgcactt

SEQ ID NO: 239599 - DNA, 15 bp, Homo sapiens
gcattagtatgcact

SEQ ID NO: 239600 - DNA, 15 bp, Homo sapiens
tgcattagtatgcac

SEQ ID NO: 239601 - DNA, 15 bp, Homo sapiens
ttgcattagtatgca

SEQ ID NO: 239602 - DNA, 15 bp, Homo sapiens
attgcattagtatgc

SEQ ID NO: 239603 - DNA, 15 bp, Homo sapiens
aattgcattagtatg

SEQ ID NO: 239604 - DNA, 15 bp, Homo sapiens
aaattgcattagtat

SEQ ID NO: 239605 - DNA, 15 bp, Homo sapiens
taaattgcattagta

SEQ ID NO: 239606 - DNA, 15 bp, Homo sapiens
ttaaattgcattagt

SEQ ID NO: 239607 - DNA, 15 bp, Homo sapiens
tttaaattgcattag

SEQ ID NO: 239608 - DNA, 15 bp, Homo sapiens
atttaaattgcatta

SEQ ID NO: 239609 - DNA, 15 bp, Homo sapiens
tatttaaattgcatt

SEQ ID NO: 239610 - DNA, 15 bp, Homo sapiens
ctatttaaattgcat

SEQ ID NO: 239611 - DNA, 15 bp, Homo sapiens
gctatttaaattgca

SEQ ID NO: 239612 - DNA, 15 bp, Homo sapiens
agctatttaaattgc

SEQ ID NO: 239613 - DNA, 15 bp, Homo sapiens
tagctatttaaattg

SEQ ID NO: 239614 - DNA, 15 bp, Homo sapiens
ctagctatttaaatt

SEQ ID NO: 239615 - DNA, 15 bp, Homo sapiens
gctagctatttaaat

SEQ ID NO: 239616 - DNA, 15 bp, Homo sapiens
ggctagctatttaaa

SEQ ID NO: 239617 - DNA, 15 bp, Homo sapiens
tggctagctatttaa

SEQ ID NO: 239618 - DNA, 15 bp, Homo sapiens
ctggctagctattta

SEQ ID NO: 239619 - DNA, 15 bp, Homo sapiens
cctggctagctattt

SEQ ID NO: 239620 - DNA, 15 bp, Homo sapiens
tcctggctagctatt

SEQ ID NO: 239621 - DNA, 15 bp, Homo sapiens
ctcctggctagctat

SEQ ID NO: 239622 - DNA, 15 bp, Homo sapiens
cctcctggctagcta

SEQ ID NO: 239623 - DNA, 15 bp, Homo sapiens
tcctcctggctagct

SEQ ID NO: 239624 - DNA, 15 bp, Homo sapiens
ttcctcctggctagc

SEQ ID NO: 239625 - DNA, 15 bp, Homo sapiens
gttcctcctggctag

SEQ ID NO: 239626 - DNA, 15 bp, Homo sapiens
agttcctcctggcta

SEQ ID NO: 239627 - DNA, 15 bp, Homo sapiens
tagttcctcctggct

SEQ ID NO: 239628 - DNA, 15 bp, Homo sapiens
ctagttcctcctggc

SEQ ID NO: 239629 - DNA, 15 bp, Homo sapiens
actagttcctcctgg

SEQ ID NO: 239630 - DNA, 15 bp, Homo sapiens
cactagttcctcctg

SEQ ID NO: 239631 - DNA, 15 bp, Homo sapiens
gcactagttcctcct

SEQ ID NO: 239632 - DNA, 15 bp, Homo sapiens
agcactagttcctcc

SEQ ID NO: 239633 - DNA, 15 bp, Homo sapiens
cagcactagttcctc

SEQ ID NO: 239634 - DNA, 15 bp, Homo sapiens
acagcactagttcct

SEQ ID NO: 239635 - DNA, 15 bp, Homo sapiens
gacagcactagttcc

SEQ ID NO: 239636 - DNA, 15 bp, Homo sapiens
ggacagcactagttc

SEQ ID NO: 239637 - DNA, 15 bp, Homo sapiens
tggacagcactagtt

SEQ ID NO: 239638 - DNA, 15 bp, Homo sapiens
ctggacagcactagt

SEQ ID NO: 239639 - DNA, 15 bp, Homo sapiens
cctggacagcactag

SEQ ID NO: 239640 - DNA, 15 bp, Homo sapiens
ccctggacagcacta

SEQ ID NO: 239641 - DNA, 15 bp, Homo sapiens
tccctggacagcact

SEQ ID NO: 239642 - DNA, 15 bp, Homo sapiens
ttccctggacagcac

SEQ ID NO: 239643 - DNA, 15 bp, Homo sapiens
attccctggacagca

SEQ ID NO: 239644 - DNA, 15 bp, Homo sapiens
gattccctggacagc

SEQ ID NO: 239645 - DNA, 15 bp, Homo sapiens
tgattccctggacag

SEQ ID NO: 239646 - DNA, 15 bp, Homo sapiens
ctgattccctggaca

SEQ ID NO: 239647 - DNA, 15 bp, Homo sapiens
tctgattccctggac

SEQ ID NO: 239648 - DNA, 15 bp, Homo sapiens
gtctgattccctgga

SEQ ID NO: 239649 - DNA, 15 bp, Homo sapiens
tgtctgattccctgg

SEQ ID NO: 239650 - DNA, 15 bp, Homo sapiens
atgtctgattccctg

SEQ ID NO: 239651 - DNA, 15 bp, Homo sapiens
tatgtctgattccct

SEQ ID NO: 239652 - DNA, 15 bp, Homo sapiens
gtatgtctgattccc

SEQ ID NO: 239653 - DNA, 15 bp, Homo sapiens
tgtatgtctgattcc

SEQ ID NO: 239654 - DNA, 15 bp, Homo sapiens
gtgtatgtctgattc

SEQ ID NO: 239655 - DNA, 15 bp, Homo sapiens
tgtgtatgtctgatt

SEQ ID NO: 239656 - DNA, 15 bp, Homo sapiens
ctgtgtatgtctgat

SEQ ID NO: 239657 - DNA, 15 bp, Homo sapiens
actgtgtatgtctga

SEQ ID NO: 239658 - DNA, 15 bp, Homo sapiens
aactgtgtatgtctg

SEQ ID NO: 239659 - DNA, 15 bp, Homo sapiens
aaactgtgtatgtct

SEQ ID NO: 239660 - DNA, 15 bp, Homo sapiens
gaaactgtgtatgtc

SEQ ID NO: 239661 - DNA, 15 bp, Homo sapiens
tgaaactgtgtatgt

SEQ ID NO: 239662 - DNA, 15 bp, Homo sapiens
atgaaactgtgtatg

SEQ ID NO: 239663 - DNA, 15 bp, Homo sapiens
aatgaaactgtgtat

SEQ ID NO: 239664 - DNA, 15 bp, Homo sapiens
aaatgaaactgtgta

SEQ ID NO: 239665 - DNA, 15 bp, Homo sapiens
taaatgaaactgtgt

SEQ ID NO: 239666 - DNA, 15 bp, Homo sapiens
ttaaatgaaactgtg

SEQ ID NO: 239667 - DNA, 15 bp, Homo sapiens
cttaaatgaaactgt

SEQ ID NO: 239668 - DNA, 15 bp, Homo sapiens
ccttaaatgaaactg

SEQ ID NO: 239669 - DNA, 15 bp, Homo sapiens
tccttaaatgaaact

SEQ ID NO: 239670 - DNA, 15 bp, Homo sapiens
gtccttaaatgaaac

SEQ ID NO: 239671 - DNA, 15 bp, Homo sapiens
tgtccttaaatgaaa

SEQ ID NO: 239672 - DNA, 15 bp, Homo sapiens
ctgtccttaaatgaa

SEQ ID NO: 239673 - DNA, 15 bp, Homo sapiens
gctgtccttaaatga

SEQ ID NO: 239674 - DNA, 15 bp, Homo sapiens
agctgtccttaaatg

SEQ ID NO: 239675 - DNA, 15 bp, Homo sapiens
cagctgtccttaaat

SEQ ID NO: 239676 - DNA, 15 bp, Homo sapiens
gcagctgtccttaaa

SEQ ID NO: 239677 - DNA, 15 bp, Homo sapiens
tgcagctgtccttaa

SEQ ID NO: 239678 - DNA, 15 bp, Homo sapiens
ttgcagctgtcctta

SEQ ID NO: 239679 - DNA, 15 bp, Homo sapiens
tttgcagctgtcctt

SEQ ID NO: 239680 - DNA, 15 bp, Homo sapiens
atttgcagctgtcct

SEQ ID NO: 239681 - DNA, 15 bp, Homo sapiens
catttgcagctgtcc

SEQ ID NO: 239682 - DNA, 15 bp, Homo sapiens
tcatttgcagctgtc

SEQ ID NO: 239683 - DNA, 15 bp, Homo sapiens
ctcatttgcagctgt

SEQ ID NO: 239684 - DNA, 15 bp, Homo sapiens
tctcatttgcagctg

SEQ ID NO: 239685 - DNA, 15 bp, Homo sapiens
atctcatttgcagct

SEQ ID NO: 239686 - DNA, 15 bp, Homo sapiens
aatctcatttgcagc

SEQ ID NO: 239687 - DNA, 15 bp, Homo sapiens
caatctcatttgcag

SEQ ID NO: 239688 - DNA, 15 bp, Homo sapiens
acaatctcatttgca

SEQ ID NO: 239689 - DNA, 15 bp, Homo sapiens
gacaatctcatttgc

SEQ ID NO: 239690 - DNA, 15 bp, Homo sapiens
ggacaatctcatttg

SEQ ID NO: 239691 - DNA, 15 bp, Homo sapiens
gggacaatctcattt

SEQ ID NO: 239692 - DNA, 15 bp, Homo sapiens
agggacaatctcatt

SEQ ID NO: 239693 - DNA, 15 bp, Homo sapiens
gagggacaatctcat

SEQ ID NO: 239694 - DNA, 15 bp, Homo sapiens
agagggacaatctca

SEQ ID NO: 239695 - DNA, 15 bp, Homo sapiens
tagagggacaatctc

SEQ ID NO: 239696 - DNA, 15 bp, Homo sapiens
ttagagggacaatct

SEQ ID NO: 239697 - DNA, 15 bp, Homo sapiens
cttagagggacaatc

SEQ ID NO: 239698 - DNA, 15 bp, Homo sapiens
acttagagggacaat

SEQ ID NO: 239699 - DNA, 15 bp, Homo sapiens
cacttagagggacaa

SEQ ID NO: 239700 - DNA, 15 bp, Homo sapiens
ccacttagagggaca

SEQ ID NO: 239701 - DNA, 15 bp, Homo sapiens
tccacttagagggac

SEQ ID NO: 239702 - DNA, 15 bp, Homo sapiens
ttccacttagaggga

SEQ ID NO: 239703 - DNA, 15 bp, Homo sapiens
gttccacttagaggg

SEQ ID NO: 239704 - DNA, 15 bp, Homo sapiens
tgttccacttagagg

SEQ ID NO: 239705 - DNA, 15 bp, Homo sapiens
ctgttccacttagag

SEQ ID NO: 239706 - DNA, 15 bp, Homo sapiens
actgttccacttaga

SEQ ID NO: 239707 - DNA, 15 bp, Homo sapiens
tactgttccacttag

SEQ ID NO: 239708 - DNA, 15 bp, Homo sapiens
ttactgttccactta

SEQ ID NO: 239709 - DNA, 15 bp, Homo sapiens
gttactgttccactt

SEQ ID NO: 239710 - DNA, 15 bp, Homo sapiens
agttactgttccact

SEQ ID NO: 239711 - DNA, 15 bp, Homo sapiens
tagttactgttccac

SEQ ID NO: 239712 - DNA, 15 bp, Homo sapiens
ctagttactgttcca

SEQ ID NO: 239713 - DNA, 15 bp, Homo sapiens
gctagttactgttcc

SEQ ID NO: 239714 - DNA, 15 bp, Homo sapiens
tgctagttactgttc

SEQ ID NO: 239715 - DNA, 15 bp, Homo sapiens
atgctagttactgtt

SEQ ID NO: 239716 - DNA, 15 bp, Homo sapiens
aatgctagttactgt

SEQ ID NO: 239717 - DNA, 15 bp, Homo sapiens
taatgctagttactg

SEQ ID NO: 239718 - DNA, 15 bp, Homo sapiens
gtaatgctagttact

SEQ ID NO: 239719 - DNA, 15 bp, Homo sapiens
tgtaatgctagttac

SEQ ID NO: 239720 - DNA, 15 bp, Homo sapiens
atgtaatgctagtta

SEQ ID NO: 239721 - DNA, 15 bp, Homo sapiens
catgtaatgctagtt

SEQ ID NO: 239722 - DNA, 15 bp, Homo sapiens
tcatgtaatgctagt

SEQ ID NO: 239723 - DNA, 15 bp, Homo sapiens
gtcatgtaatgctag

SEQ ID NO: 239724 - DNA, 15 bp, Homo sapiens
ggtcatgtaatgcta

SEQ ID NO: 239725 - DNA, 15 bp, Homo sapiens
tggtcatgtaatgct

SEQ ID NO: 239726 - DNA, 15 bp, Homo sapiens
ttggtcatgtaatgc

SEQ ID NO: 239727 - DNA, 15 bp, Homo sapiens
cttggtcatgtaatg

SEQ ID NO: 239728 - DNA, 15 bp, Homo sapiens
ccttggtcatgtaat

SEQ ID NO: 239729 - DNA, 15 bp, Homo sapiens
gccttggtcatgtaa

SEQ ID NO: 239730 - DNA, 15 bp, Homo sapiens
agccttggtcatgta

SEQ ID NO: 239731 - DNA, 15 bp, Homo sapiens
tagccttggtcatgt

SEQ ID NO: 239732 - DNA, 15 bp, Homo sapiens
ctagccttggtcatg

SEQ ID NO: 239733 - DNA, 15 bp, Homo sapiens
tctagccttggtcat

SEQ ID NO: 239734 - DNA, 15 bp, Homo sapiens
ttctagccttggtca

SEQ ID NO: 239735 - DNA, 15 bp, Homo sapiens
tttctagccttggtc

SEQ ID NO: 239736 - DNA, 15 bp, Homo sapiens
ttttctagccttggt

SEQ ID NO: 239737 - DNA, 15 bp, Homo sapiens
tttttctagccttgg

SEQ ID NO: 239738 - DNA, 15 bp, Homo sapiens
ctttttctagccttg

SEQ ID NO: 239739 - DNA, 15 bp, Homo sapiens
cctttttctagcctt

SEQ ID NO: 239740 - DNA, 15 bp, Homo sapiens
tcctttttctagcct

SEQ ID NO: 239741 - DNA, 15 bp, Homo sapiens
ttcctttttctagcc

SEQ ID NO: 239742 - DNA, 15 bp, Homo sapiens
tttcctttttctagc

SEQ ID NO: 239743 - DNA, 15 bp, Homo sapiens
atttcctttttctag

SEQ ID NO: 239744 - DNA, 15 bp, Homo sapiens
catttcctttttcta

SEQ ID NO: 239745 - DNA, 15 bp, Homo sapiens
ccatttcctttttct

SEQ ID NO: 239746 - DNA, 15 bp, Homo sapiens
tccatttcctttttc

SEQ ID NO: 239747 - DNA, 15 bp, Homo sapiens
ttccatttccttttt

SEQ ID NO: 239748 - DNA, 15 bp, Homo sapiens
tttccatttcctttt

SEQ ID NO: 239749 - DNA, 15 bp, Homo sapiens
atttccatttccttt

SEQ ID NO: 239750 - DNA, 15 bp, Homo sapiens
catttccatttcctt

SEQ ID NO: 239751 - DNA, 15 bp, Homo sapiens
acatttccatttcct

SEQ ID NO: 239752 - DNA, 15 bp, Homo sapiens
gacatttccatttcc

SEQ ID NO: 239753 - DNA, 15 bp, Homo sapiens
tgacatttccatttc

SEQ ID NO: 239754 - DNA, 15 bp, Homo sapiens
ctgacatttccattt

SEQ ID NO: 239755 - DNA, 15 bp, Homo sapiens
actgacatttccatt

SEQ ID NO: 239756 - DNA, 15 bp, Homo sapiens
tactgacatttccat

SEQ ID NO: 239757 - DNA, 15 bp, Homo sapiens
ctactgacatttcca

SEQ ID NO: 239758 - DNA, 15 bp, Homo sapiens
cctactgacatttcc

SEQ ID NO: 239759 - DNA, 15 bp, Homo sapiens
gcctactgacatttc

SEQ ID NO: 239760 - DNA, 15 bp, Homo sapiens
agcctactgacattt

SEQ ID NO: 239761 - DNA, 15 bp, Homo sapiens
cagcctactgacatt

SEQ ID NO: 239762 - DNA, 15 bp, Homo sapiens
acagcctactgacat

SEQ ID NO: 239763 - DNA, 15 bp, Homo sapiens
cacagcctactgaca

SEQ ID NO: 239764 - DNA, 15 bp, Homo sapiens
acacagcctactgac

SEQ ID NO: 239765 - DNA, 15 bp, Homo sapiens
cacacagcctactga

SEQ ID NO: 239766 - DNA, 15 bp, Homo sapiens
gcacacagcctactg

SEQ ID NO: 239767 - DNA, 15 bp, Homo sapiens
tgcacacagcctact

SEQ ID NO: 239768 - DNA, 15 bp, Homo sapiens
ctgcacacagcctac

SEQ ID NO: 239769 - DNA, 15 bp, Homo sapiens
actgcacacagccta

SEQ ID NO: 239770 - DNA, 15 bp, Homo sapiens
aactgcacacagcct

SEQ ID NO: 239771 - DNA, 15 bp, Homo sapiens
caactgcacacagcc

SEQ ID NO: 239772 - DNA, 15 bp, Homo sapiens
acaactgcacacagc

SEQ ID NO: 239773 - DNA, 15 bp, Homo sapiens
aacaactgcacacag

SEQ ID NO: 239774 - DNA, 15 bp, Homo sapiens
taacaactgcacaca

SEQ ID NO: 239775 - DNA, 15 bp, Homo sapiens
ataacaactgcacac

SEQ ID NO: 239776 - DNA, 15 bp, Homo sapiens
aataacaactgcaca

SEQ ID NO: 239777 - DNA, 15 bp, Homo sapiens
caataacaactgcac

SEQ ID NO: 239778 - DNA, 15 bp, Homo sapiens
tcaataacaactgca

SEQ ID NO: 239779 - DNA, 15 bp, Homo sapiens
atcaataacaactgc

SEQ ID NO: 239780 - DNA, 15 bp, Homo sapiens
aatcaataacaactg

SEQ ID NO: 239781 - DNA, 15 bp, Homo sapiens
aaatcaataacaact

SEQ ID NO: 239782 - DNA, 15 bp, Homo sapiens
caaatcaataacaac

SEQ ID NO: 239783 - DNA, 15 bp, Homo sapiens
gcaaatcaataacaa

SEQ ID NO: 239784 - DNA, 15 bp, Homo sapiens
tgcaaatcaataaca

SEQ ID NO: 239785 - DNA, 15 bp, Homo sapiens
atgcaaatcaataac

SEQ ID NO: 239786 - DNA, 15 bp, Homo sapiens
aaatgcaaatcaata

SEQ ID NO: 239787 - DNA, 15 bp, Homo sapiens
taaatgcaaatcaat

SEQ ID NO: 239788 - DNA, 15 bp, Homo sapiens
ctaaatgcaaatcaa

SEQ ID NO: 239789 - DNA, 15 bp, Homo sapiens
actaaatgcaaatca

SEQ ID NO: 239790 - DNA, 15 bp, Homo sapiens
aactaaatgcaaatc

SEQ ID NO: 239791 - DNA, 15 bp, Homo sapiens
aaactaaatgcaaat

SEQ ID NO: 239792 - DNA, 15 bp, Homo sapiens
gaaactaaatgcaaa

SEQ ID NO: 239793 - DNA, 15 bp, Homo sapiens
agaaactaaatgcaa

SEQ ID NO: 239794 - DNA, 15 bp, Homo sapiens
gagaaactaaatgca

SEQ ID NO: 239795 - DNA, 15 bp, Homo sapiens
tgagaaactaaatgc

SEQ ID NO: 239796 - DNA, 15 bp, Homo sapiens
ctgagaaactaaatg

SEQ ID NO: 239797 - DNA, 15 bp, Homo sapiens
actgagaaactaaat

SEQ ID NO: 239798 - DNA, 15 bp, Homo sapiens
aactgagaaactaaa

SEQ ID NO: 239799 - DNA, 15 bp, Homo sapiens
aaactgagaaactaa

SEQ ID NO: 239800 - DNA, 15 bp, Homo sapiens
taaactgagaaacta

SEQ ID NO: 239801 - DNA, 15 bp, Homo sapiens
ctaaactgagaaact

SEQ ID NO: 239802 - DNA, 15 bp, Homo sapiens
actaaactgagaaac

SEQ ID NO: 239803 - DNA, 15 bp, Homo sapiens
tactaaactgagaaa

SEQ ID NO: 239804 - DNA, 15 bp, Homo sapiens
ttactaaactgagaa

SEQ ID NO: 239805 - DNA, 15 bp, Homo sapiens
gttactaaactgaga

SEQ ID NO: 239806 - DNA, 15 bp, Homo sapiens
ggttactaaactgag

SEQ ID NO: 239807 - DNA, 15 bp, Homo sapiens
gggttactaaactga

SEQ ID NO: 239808 - DNA, 15 bp, Homo sapiens
agggttactaaactg

SEQ ID NO: 239809 - DNA, 15 bp, Homo sapiens
aagggttactaaact

SEQ ID NO: 239810 - DNA, 15 bp, Homo sapiens
aaagggttactaaac

SEQ ID NO: 239811 - DNA, 15 bp, Homo sapiens
taaagggttactaaa

SEQ ID NO: 239812 - DNA, 15 bp, Homo sapiens
gtaaagggttactaa

SEQ ID NO: 239813 - DNA, 15 bp, Homo sapiens
tgtaaagggttacta

SEQ ID NO: 239814 - DNA, 15 bp, Homo sapiens
atgtaaagggttact

SEQ ID NO: 239815 - DNA, 15 bp, Homo sapiens
aatgtaaagggttac

SEQ ID NO: 239816 - DNA, 15 bp, Homo sapiens
aaatgtaaagggtta

SEQ ID NO: 239817 - DNA, 15 bp, Homo sapiens
aaaatgtaaagggtt

SEQ ID NO: 239818 - DNA, 15 bp, Homo sapiens
gaaaatgtaaagggt

SEQ ID NO: 239819 - DNA, 15 bp, Homo sapiens
tgaaaatgtaaaggg

SEQ ID NO: 239820 - DNA, 15 bp, Homo sapiens
atgaaaatgtaaagg

SEQ ID NO: 239821 - DNA, 15 bp, Homo sapiens
tatgaaaatgtaaag

SEQ ID NO: 239822 - DNA, 15 bp, Homo sapiens
ttatgaaaatgtaaa

SEQ ID NO: 239823 - DNA, 15 bp, Homo sapiens
attatgaaaatgtaa

SEQ ID NO: 239824 - DNA, 15 bp, Homo sapiens
cattatgaaaatgta

SEQ ID NO: 239825 - DNA, 15 bp, Homo sapiens
gcattatgaaaatgt

SEQ ID NO: 239826 - DNA, 15 bp, Homo sapiens
tgcattatgaaaatg

SEQ ID NO: 239827 - DNA, 15 bp, Homo sapiens
ctgcattatgaaaat

SEQ ID NO: 239828 - DNA, 15 bp, Homo sapiens
tctgcattatgaaaa

SEQ ID NO: 239829 - DNA, 15 bp, Homo sapiens
ctctgcattatgaaa

SEQ ID NO: 239830 - DNA, 15 bp, Homo sapiens
tctctgcattatgaa

SEQ ID NO: 239831 - DNA, 15 bp, Homo sapiens
ttctctgcattatga

SEQ ID NO: 239832 - DNA, 15 bp, Homo sapiens
gttctctgcattatg

SEQ ID NO: 239833 - DNA, 15 bp, Homo sapiens
agttctctgcattat

SEQ ID NO: 239834 - DNA, 15 bp, Homo sapiens
tagttctctgcatta

SEQ ID NO: 239835 - DNA, 15 bp, Homo sapiens
ttagttctctgcatt

SEQ ID NO: 239836 - DNA, 15 bp, Homo sapiens
gttagttctctgcat

SEQ ID NO: 239837 - DNA, 15 bp, Homo sapiens
agttagttctctgca

SEQ ID NO: 239838 - DNA, 15 bp, Homo sapiens
tagttagttctctgc

SEQ ID NO: 239839 - DNA, 15 bp, Homo sapiens
atagttagttctctg

SEQ ID NO: 239840 - DNA, 15 bp, Homo sapiens
tatagttagttctct

SEQ ID NO: 239841 - DNA, 15 bp, Homo sapiens
ctatagttagttctc

SEQ ID NO: 239842 - DNA, 15 bp, Homo sapiens
tctatagttagttct

SEQ ID NO: 239843 - DNA, 15 bp, Homo sapiens
ttctatagttagttc

SEQ ID NO: 239844 - DNA, 15 bp, Homo sapiens
attctatagttagtt

SEQ ID NO: 239845 - DNA, 15 bp, Homo sapiens
cattctatagttagt

SEQ ID NO: 239846 - DNA, 15 bp, Homo sapiens
acattctatagttag

SEQ ID NO: 239847 - DNA, 15 bp, Homo sapiens
cacattctatagtta

SEQ ID NO: 239848 - DNA, 15 bp, Homo sapiens
acacattctatagtt

SEQ ID NO: 239849 - DNA, 15 bp, Homo sapiens
tacacattctatagt

SEQ ID NO: 239850 - DNA, 15 bp, Homo sapiens
atacacattctatag

SEQ ID NO: 239851 - DNA, 15 bp, Homo sapiens
aatacacattctata

SEQ ID NO: 239852 - DNA, 15 bp, Homo sapiens
aaatacacattctat

SEQ ID NO: 239853 - DNA, 15 bp, Homo sapiens
aaaatacacattcta

SEQ ID NO: 239854 - DNA, 15 bp, Homo sapiens
aaaaatacacattct

SEQ ID NO: 239855 - DNA, 15 bp, Homo sapiens
taaaaatacacattc

SEQ ID NO: 239856 - DNA, 15 bp, Homo sapiens
ttaaaaatacacatt

SEQ ID NO: 239857 - DNA, 15 bp, Homo sapiens
tttaaaaatacacat

SEQ ID NO: 239858 - DNA, 15 bp, Homo sapiens
ttttaaaaatacaca

SEQ ID NO: 239859 - DNA, 15 bp, Homo sapiens
cttttaaaaatacac

SEQ ID NO: 239860 - DNA, 15 bp, Homo sapiens
ccttttaaaaataca

SEQ ID NO: 239861 - DNA, 15 bp, Homo sapiens
gccttttaaaaatac

SEQ ID NO: 239862 - DNA, 15 bp, Homo sapiens
agccttttaaaaata

SEQ ID NO: 239863 - DNA, 15 bp, Homo sapiens
tagccttttaaaaat

SEQ ID NO: 239864 - DNA, 15 bp, Homo sapiens
ctagccttttaaaaa

SEQ ID NO: 239865 - DNA, 15 bp, Homo sapiens
cctagccttttaaaa

SEQ ID NO: 239866 - DNA, 15 bp, Homo sapiens
gcctagccttttaaa

SEQ ID NO: 239867 - DNA, 15 bp, Homo sapiens
tgcctagccttttaa

SEQ ID NO: 239868 - DNA, 15 bp, Homo sapiens
atgcctagcctttta

SEQ ID NO: 239869 - DNA, 15 bp, Homo sapiens
catgcctagcctttt

SEQ ID NO: 239870 - DNA, 15 bp, Homo sapiens
ccatgcctagccttt

SEQ ID NO: 239871 - DNA, 15 bp, Homo sapiens
cccatgcctagcctt

SEQ ID NO: 239872 - DNA, 15 bp, Homo sapiens
ccccatgcctagcct

SEQ ID NO: 239873 - DNA, 15 bp, Homo sapiens
cccccatgcctagcc

SEQ ID NO: 239874 - DNA, 15 bp, Homo sapiens
gcccccatgcctagc

SEQ ID NO: 239875 - DNA, 15 bp, Homo sapiens
agcccccatgcctag

SEQ ID NO: 239876 - DNA, 15 bp, Homo sapiens
gagcccccatgccta

SEQ ID NO: 239877 - DNA, 15 bp, Homo sapiens
agagcccccatgcct

SEQ ID NO: 239878 - DNA, 15 bp, Homo sapiens
aagagcccccatgcc

SEQ ID NO: 239879 - DNA, 15 bp, Homo sapiens
caagagcccccatgc

SEQ ID NO: 239880 - DNA, 15 bp, Homo sapiens
gcaagagcccccatg

SEQ ID NO: 239881 - DNA, 15 bp, Homo sapiens
ggcaagagcccccat

SEQ ID NO: 239882 - DNA, 15 bp, Homo sapiens
aggcaagagccccca

SEQ ID NO: 239883 - DNA, 15 bp, Homo sapiens
caggcaagagccccc

SEQ ID NO: 239884 - DNA, 15 bp, Homo sapiens
acaggcaagagcccc

SEQ ID NO: 239885 - DNA, 15 bp, Homo sapiens
tacaggcaagagccc

SEQ ID NO: 239886 - DNA, 15 bp, Homo sapiens
ttacaggcaagagcc

SEQ ID NO: 239887 - DNA, 15 bp, Homo sapiens
attacaggcaagagc

SEQ ID NO: 239888 - DNA, 15 bp, Homo sapiens
gattacaggcaagag

SEQ ID NO: 239889 - DNA, 15 bp, Homo sapiens
ggattacaggcaaga

SEQ ID NO: 239890 - DNA, 15 bp, Homo sapiens
gggattacaggcaag

SEQ ID NO: 239891 - DNA, 15 bp, Homo sapiens
tgggattacaggcaa

SEQ ID NO: 239892 - DNA, 15 bp, Homo sapiens
atgttgggattacag

SEQ ID NO: 239893 - DNA, 15 bp, Homo sapiens
aatgttgggattaca

SEQ ID NO: 239894 - DNA, 15 bp, Homo sapiens
aaatgttgggattac

SEQ ID NO: 239895 - DNA, 15 bp, Homo sapiens
aaaatgttgggatta

SEQ ID NO: 239896 - DNA, 15 bp, Homo sapiens
caaaatgttgggatt

SEQ ID NO: 239897 - DNA, 15 bp, Homo sapiens
acaaaatgttgggat

SEQ ID NO: 239898 - DNA, 15 bp, Homo sapiens
cacaaaatgttggga

SEQ ID NO: 239899 - DNA, 15 bp, Homo sapiens
tcacaaaatgttggg

SEQ ID NO: 239900 - DNA, 15 bp, Homo sapiens
ctcacaaaatgttgg

SEQ ID NO: 239901 - DNA, 15 bp, Homo sapiens
cctcacaaaatgttg

SEQ ID NO: 239902 - DNA, 15 bp, Homo sapiens
gcctcacaaaatgtt

SEQ ID NO: 239903 - DNA, 15 bp, Homo sapiens
agcctcacaaaatgt

SEQ ID NO: 239904 - DNA, 15 bp, Homo sapiens
cagcctcacaaaatg

SEQ ID NO: 239905 - DNA, 15 bp, Homo sapiens
tcagcctcacaaaat

SEQ ID NO: 239906 - DNA, 15 bp, Homo sapiens
ctcagcctcacaaaa

SEQ ID NO: 239907 - DNA, 15 bp, Homo sapiens
cctcagcctcacaaa

SEQ ID NO: 239908 - DNA, 15 bp, Homo sapiens
acctcagcctcacaa

SEQ ID NO: 239909 - DNA, 15 bp, Homo sapiens
cacctcagcctcaca

SEQ ID NO: 239910 - DNA, 15 bp, Homo sapiens
tcacctcagcctcac

SEQ ID NO: 239911 - DNA, 15 bp, Homo sapiens
ctcacctcagcctca

SEQ ID NO: 239912 - DNA, 15 bp, Homo sapiens
tctcacctcagcctc

SEQ ID NO: 239913 - DNA, 15 bp, Homo sapiens
ctctcacctcagcct

SEQ ID NO: 239914 - DNA, 15 bp, Homo sapiens
cctctcacctcagcc

SEQ ID NO: 239915 - DNA, 15 bp, Homo sapiens
ccctctcacctcagc

SEQ ID NO: 239916 - DNA, 15 bp, Homo sapiens
accctctcacctcag

SEQ ID NO: 239917 - DNA, 15 bp, Homo sapiens
aaccctctcacctca

SEQ ID NO: 239918 - DNA, 15 bp, Homo sapiens
caaccctctcacctc

SEQ ID NO: 239919 - DNA, 15 bp, Homo sapiens
gcaaccctctcacct

SEQ ID NO: 239920 - DNA, 15 bp, Homo sapiens
agcaaccctctcacc

SEQ ID NO: 239921 - DNA, 15 bp, Homo sapiens
aagcaaccctctcac

SEQ ID NO: 239922 - DNA, 15 bp, Homo sapiens
caagcaaccctctca

SEQ ID NO: 239923 - DNA, 15 bp, Homo sapiens
tcaagcaaccctctc

SEQ ID NO: 239924 - DNA, 15 bp, Homo sapiens
ctcaagcaaccctct

SEQ ID NO: 239925 - DNA, 15 bp, Homo sapiens
cctcaagcaaccctc

SEQ ID NO: 239926 - DNA, 15 bp, Homo sapiens
acctcaagcaaccct

SEQ ID NO: 239927 - DNA, 15 bp, Homo sapiens
gacctcaagcaaccc

SEQ ID NO: 239928 - DNA, 15 bp, Homo sapiens
tgacctcaagcaacc

SEQ ID NO: 239929 - DNA, 15 bp, Homo sapiens
ctgacctcaagcaac

SEQ ID NO: 239930 - DNA, 15 bp, Homo sapiens
tctgacctcaagcaa

SEQ ID NO: 239931 - DNA, 15 bp, Homo sapiens
ttctgacctcaagca

SEQ ID NO: 239932 - DNA, 15 bp, Homo sapiens
cttctgacctcaagc

SEQ ID NO: 239933 - DNA, 15 bp, Homo sapiens
acttctgacctcaag

SEQ ID NO: 239934 - DNA, 15 bp, Homo sapiens
aacttctgacctcaa

SEQ ID NO: 239935 - DNA, 15 bp, Homo sapiens
aaacttctgacctca

SEQ ID NO: 239936 - DNA, 15 bp, Homo sapiens
caaacttctgacctc

SEQ ID NO: 239937 - DNA, 15 bp, Homo sapiens
tcaaacttctgacct

SEQ ID NO: 239938 - DNA, 15 bp, Homo sapiens
ctcaaacttctgacc

SEQ ID NO: 239939 - DNA, 15 bp, Homo sapiens
tctcaaacttctgac

SEQ ID NO: 239940 - DNA, 15 bp, Homo sapiens
gtctcaaacttctga

SEQ ID NO: 239941 - DNA, 15 bp, Homo sapiens
tatgttgcccaggct

SEQ ID NO: 239942 - DNA, 15 bp, Homo sapiens
ctatgttgcccaggc

SEQ ID NO: 239943 - DNA, 15 bp, Homo sapiens
cctatgttgcccagg

SEQ ID NO: 239944 - DNA, 15 bp, Homo sapiens
tcctatgttgcccag

SEQ ID NO: 239945 - DNA, 15 bp, Homo sapiens
ttcctatgttgccca

SEQ ID NO: 239946 - DNA, 15 bp, Homo sapiens
cttcctatgttgccc

SEQ ID NO: 239947 - DNA, 15 bp, Homo sapiens
tcttcctatgttgcc

SEQ ID NO: 239948 - DNA, 15 bp, Homo sapiens
ctcttcctatgttgc

SEQ ID NO: 239949 - DNA, 15 bp, Homo sapiens
gctcttcctatgttg

SEQ ID NO: 239950 - DNA, 15 bp, Homo sapiens
ggctcttcctatgtt

SEQ ID NO: 239951 - DNA, 15 bp, Homo sapiens
aggctcttcctatgt

SEQ ID NO: 239952 - DNA, 15 bp, Homo sapiens
caggctcttcctatg

SEQ ID NO: 239953 - DNA, 15 bp, Homo sapiens
acaggctcttcctat

SEQ ID NO: 239954 - DNA, 15 bp, Homo sapiens
gacaggctcttccta

SEQ ID NO: 239955 - DNA, 15 bp, Homo sapiens
agacaggctcttcct

SEQ ID NO: 239956 - DNA, 15 bp, Homo sapiens
gagacaggctcttcc

SEQ ID NO: 239957 - DNA, 15 bp, Homo sapiens
agagacaggctcttc

SEQ ID NO: 239958 - DNA, 15 bp, Homo sapiens
tagagacaggctctt

SEQ ID NO: 239959 - DNA, 15 bp, Homo sapiens
gtagagacaggctct

SEQ ID NO: 239960 - DNA, 15 bp, Homo sapiens
tgtagagacaggctc

SEQ ID NO: 239961 - DNA, 15 bp, Homo sapiens
ttgtagagacaggct

SEQ ID NO: 239962 - DNA, 15 bp, Homo sapiens
tttgtagagacaggc

SEQ ID NO: 239963 - DNA, 15 bp, Homo sapiens
attttgtagagacag

SEQ ID NO: 239964 - DNA, 15 bp, Homo sapiens
tattttgtagagaca

SEQ ID NO: 239965 - DNA, 15 bp, Homo sapiens
ttattttgtagagac

SEQ ID NO: 239966 - DNA, 15 bp, Homo sapiens
tttattttgtagaga

SEQ ID NO: 239967 - DNA, 15 bp, Homo sapiens
ttttattttgtagag

SEQ ID NO: 239968 - DNA, 15 bp, Homo sapiens
tttttattttgtaga

SEQ ID NO: 239969 - DNA, 15 bp, Homo sapiens
atttttattttgtag

SEQ ID NO: 239970 - DNA, 15 bp, Homo sapiens
ttaatttttattttg

SEQ ID NO: 239971 - DNA, 15 bp, Homo sapiens
tttaatttttatttt

SEQ ID NO: 239972 - DNA, 15 bp, Homo sapiens
ttttaatttttattt

SEQ ID NO: 239973 - DNA, 15 bp, Homo sapiens
tttttaatttttatt

SEQ ID NO: 239974 - DNA, 15 bp, Homo sapiens
ttttttaatttttat

SEQ ID NO: 239975 - DNA, 15 bp, Homo sapiens
attttttaattttta

SEQ ID NO: 239976 - DNA, 15 bp, Homo sapiens
aattttttaattttt

SEQ ID NO: 239977 - DNA, 15 bp, Homo sapiens
taattttttaatttt

SEQ ID NO: 239978 - DNA, 15 bp, Homo sapiens
gtaattttttaattt

SEQ ID NO: 239979 - DNA, 15 bp, Homo sapiens
tgtaattttttaatt

SEQ ID NO: 239980 - DNA, 15 bp, Homo sapiens
atgtaattttttaat

SEQ ID NO: 239981 - DNA, 15 bp, Homo sapiens
tatgtaattttttaa

SEQ ID NO: 239982 - DNA, 15 bp, Homo sapiens
atatgtaatttttta

SEQ ID NO: 239983 - DNA, 15 bp, Homo sapiens
catatgtaatttttt

SEQ ID NO: 239984 - DNA, 15 bp, Homo sapiens
acatatgtaattttt

SEQ ID NO: 239985 - DNA, 15 bp, Homo sapiens
cacatatgtaatttt

SEQ ID NO: 239986 - DNA, 15 bp, Homo sapiens
ccacatatgtaattt

SEQ ID NO: 239987 - DNA, 15 bp, Homo sapiens
accacatatgtaatt

SEQ ID NO: 239988 - DNA, 15 bp, Homo sapiens
caccacatatgtaat

SEQ ID NO: 239989 - DNA, 15 bp, Homo sapiens
acaccacatatgtaa

SEQ ID NO: 239990 - DNA, 15 bp, Homo sapiens
cacaccacatatgta

SEQ ID NO: 239991 - DNA, 15 bp, Homo sapiens
ccacaccacatatgt

SEQ ID NO: 239992 - DNA, 15 bp, Homo sapiens
accacaccacatatg

SEQ ID NO: 239993 - DNA, 15 bp, Homo sapiens
caccacaccacatat

SEQ ID NO: 239994 - DNA, 15 bp, Homo sapiens
acaccacaccacata

SEQ ID NO: 239995 - DNA, 15 bp, Homo sapiens
cacaccacaccacat

SEQ ID NO: 239996 - DNA, 15 bp, Homo sapiens
gcacaccacaccaca

SEQ ID NO: 239997 - DNA, 15 bp, Homo sapiens
cgcacaccacaccac

SEQ ID NO: 239998 - DNA, 15 bp, Homo sapiens
acgcacaccacacca

SEQ ID NO: 239999 - DNA, 15 bp, Homo sapiens
gacgcacaccacacc

SEQ ID NO: 240000 - DNA, 15 bp, Homo sapiens
agacgcacaccacac

SEQ ID NO: 240001 - DNA, 15 bp, Homo sapiens
cagacgcacaccaca

SEQ ID NO: 240002 - DNA, 15 bp, Homo sapiens
acagacgcacaccac

SEQ ID NO: 240003 - DNA, 15 bp, Homo sapiens
tacagacgcacacca

SEQ ID NO: 240004 - DNA, 15 bp, Homo sapiens
ctacagacgcacacc

SEQ ID NO: 240005 - DNA, 15 bp, Homo sapiens
actacagacgcacac

SEQ ID NO: 240006 - DNA, 15 bp, Homo sapiens
gactacagacgcaca

SEQ ID NO: 240007 - DNA, 15 bp, Homo sapiens
agactacagacgcac

SEQ ID NO: 240008 - DNA, 15 bp, Homo sapiens
aagactacagacgca

SEQ ID NO: 240009 - DNA, 15 bp, Homo sapiens
taagactacagacgc

SEQ ID NO: 240010 - DNA, 15 bp, Homo sapiens
ctaagactacagacg

SEQ ID NO: 240011 - DNA, 15 bp, Homo sapiens
gctaagactacagac

SEQ ID NO: 240012 - DNA, 15 bp, Homo sapiens
agctaagactacaga

SEQ ID NO: 240013 - DNA, 15 bp, Homo sapiens
tagctaagactacag

SEQ ID NO: 240014 - DNA, 15 bp, Homo sapiens
gtagctaagactaca

SEQ ID NO: 240015 - DNA, 15 bp, Homo sapiens
agtagctaagactac

SEQ ID NO: 240016 - DNA, 15 bp, Homo sapiens
aagtagctaagacta

SEQ ID NO: 240017 - DNA, 15 bp, Homo sapiens
caagtagctaagact

SEQ ID NO: 240018 - DNA, 15 bp, Homo sapiens
tcaagtagctaagac

SEQ ID NO: 240019 - DNA, 15 bp, Homo sapiens
ctcaagtagctaaga

SEQ ID NO: 240020 - DNA, 15 bp, Homo sapiens
tctcaagtagctaag

SEQ ID NO: 240021 - DNA, 15 bp, Homo sapiens
ctctcaagtagctaa

SEQ ID NO: 240022 - DNA, 15 bp, Homo sapiens
tctctcaagtagcta

SEQ ID NO: 240023 - DNA, 15 bp, Homo sapiens
gtctctcaagtagct

SEQ ID NO: 240024 - DNA, 15 bp, Homo sapiens
agtctctcaagtagc

SEQ ID NO: 240025 - DNA, 15 bp, Homo sapiens
cagtctctcaagtag

SEQ ID NO: 240026 - DNA, 15 bp, Homo sapiens
tcagtctctcaagta

SEQ ID NO: 240027 - DNA, 15 bp, Homo sapiens
ctcagtctctcaagt

SEQ ID NO: 240028 - DNA, 15 bp, Homo sapiens
cctcagtctctcaag

SEQ ID NO: 240029 - DNA, 15 bp, Homo sapiens
acctcagtctctcaa

SEQ ID NO: 240030 - DNA, 15 bp, Homo sapiens
cacctcagtctctca

SEQ ID NO: 240031 - DNA, 15 bp, Homo sapiens
ccacctcagtctctc

SEQ ID NO: 240032 - DNA, 15 bp, Homo sapiens
cccacctcagtctct

SEQ ID NO: 240033 - DNA, 15 bp, Homo sapiens
agcctcaagtgatcc

SEQ ID NO: 240034 - DNA, 15 bp, Homo sapiens
tagcctcaagtgatc

SEQ ID NO: 240035 - DNA, 15 bp, Homo sapiens
ctagcctcaagtgat

SEQ ID NO: 240036 - DNA, 15 bp, Homo sapiens
cctagcctcaagtga

SEQ ID NO: 240037 - DNA, 15 bp, Homo sapiens
tcctagcctcaagtg

SEQ ID NO: 240038 - DNA, 15 bp, Homo sapiens
ctcctagcctcaagt

SEQ ID NO: 240039 - DNA, 15 bp, Homo sapiens
actcctagcctcaag

SEQ ID NO: 240040 - DNA, 15 bp, Homo sapiens
aactcctagcctcaa

SEQ ID NO: 240041 - DNA, 15 bp, Homo sapiens
gaactcctagcctca

SEQ ID NO: 240042 - DNA, 15 bp, Homo sapiens
tgaactcctagcctc

SEQ ID NO: 240043 - DNA, 15 bp, Homo sapiens
ttgaactcctagcct

SEQ ID NO: 240044 - DNA, 15 bp, Homo sapiens
cttgaactcctagcc

SEQ ID NO: 240045 - DNA, 15 bp, Homo sapiens
ccttgaactcctagc

SEQ ID NO: 240046 - DNA, 15 bp, Homo sapiens
accttgaactcctag

SEQ ID NO: 240047 - DNA, 15 bp, Homo sapiens
aaccttgaactccta

SEQ ID NO: 240048 - DNA, 15 bp, Homo sapiens
taaccttgaactcct

SEQ ID NO: 240049 - DNA, 15 bp, Homo sapiens
gtaaccttgaactcc

SEQ ID NO: 240050 - DNA, 15 bp, Homo sapiens
tgtaaccttgaactc

SEQ ID NO: 240051 - DNA, 15 bp, Homo sapiens
ctgtaaccttgaact

SEQ ID NO: 240052 - DNA, 15 bp, Homo sapiens
actgtaaccttgaac

SEQ ID NO: 240053 - DNA, 15 bp, Homo sapiens
cactgtaaccttgaa

SEQ ID NO: 240054 - DNA, 15 bp, Homo sapiens
tcactgtaaccttga

SEQ ID NO: 240055 - DNA, 15 bp, Homo sapiens
ctcactgtaaccttg

SEQ ID NO: 240056 - DNA, 15 bp, Homo sapiens
gctcactgtaacctt

SEQ ID NO: 240057 - DNA, 15 bp, Homo sapiens
tagctcactgtaacc

SEQ ID NO: 240058 - DNA, 15 bp, Homo sapiens
atagctcactgtaac

SEQ ID NO: 240059 - DNA, 15 bp, Homo sapiens
catagctcactgtaa

SEQ ID NO: 240060 - DNA, 15 bp, Homo sapiens
acatagctcactgta

SEQ ID NO: 240061 - DNA, 15 bp, Homo sapiens
aacatagctcactgt

SEQ ID NO: 240062 - DNA, 15 bp, Homo sapiens
aaacatagctcactg

SEQ ID NO: 240063 - DNA, 15 bp, Homo sapiens
caaacatagctcact

SEQ ID NO: 240064 - DNA, 15 bp, Homo sapiens
acaaacatagctcac

SEQ ID NO: 240065 - DNA, 15 bp, Homo sapiens
cacaaacatagctca

SEQ ID NO: 240066 - DNA, 15 bp, Homo sapiens
gcacaaacatagctc

SEQ ID NO: 240067 - DNA, 15 bp, Homo sapiens
ggcacaaacatagct

SEQ ID NO: 240068 - DNA, 15 bp, Homo sapiens
tggcacaaacatagc

SEQ ID NO: 240069 - DNA, 15 bp, Homo sapiens
gtggcacaaacatag

SEQ ID NO: 240070 - DNA, 15 bp, Homo sapiens
ggtggcacaaacata

SEQ ID NO: 240071 - DNA, 15 bp, Homo sapiens
cggtggcacaaacat

SEQ ID NO: 240072 - DNA, 15 bp, Homo sapiens
gcggtggcacaaaca

SEQ ID NO: 240073 - DNA, 15 bp, Homo sapiens
tgcggtggcacaaac

SEQ ID NO: 240074 - DNA, 15 bp, Homo sapiens
gtgcggtggcacaaa

SEQ ID NO: 240075 - DNA, 15 bp, Homo sapiens
agtgcggtggcacaa

SEQ ID NO: 240076 - DNA, 15 bp, Homo sapiens
gagtgcggtggcaca

SEQ ID NO: 240077 - DNA, 15 bp, Homo sapiens
ggagtgcggtggcac

SEQ ID NO: 240078 - DNA, 15 bp, Homo sapiens
tggagtgcggtggca

SEQ ID NO: 240079 - DNA, 15 bp, Homo sapiens
ctggagtgcggtggc

SEQ ID NO: 240080 - DNA, 15 bp, Homo sapiens
gctggagtgcggtgg

SEQ ID NO: 240081 - DNA, 15 bp, Homo sapiens
ggctggagtgcggtg

SEQ ID NO: 240082 - DNA, 15 bp, Homo sapiens
aggctggagtgcggt

SEQ ID NO: 240083 - DNA, 15 bp, Homo sapiens
caggctggagtgcgg

SEQ ID NO: 240084 - DNA, 15 bp, Homo sapiens
ccaggctggagtgcg

SEQ ID NO: 240085 - DNA, 15 bp, Homo sapiens
aagacagggtctcac

SEQ ID NO: 240086 - DNA, 15 bp, Homo sapiens
aaagacagggtctca

SEQ ID NO: 240087 - DNA, 15 bp, Homo sapiens
taaagacagggtctc

SEQ ID NO: 240088 - DNA, 15 bp, Homo sapiens
ttaaagacagggtct

SEQ ID NO: 240089 - DNA, 15 bp, Homo sapiens
tttaaagacagggtc

SEQ ID NO: 240090 - DNA, 15 bp, Homo sapiens
ttttaaagacagggt

SEQ ID NO: 240091 - DNA, 15 bp, Homo sapiens
tttttaaagacaggg

SEQ ID NO: 240092 - DNA, 15 bp, Homo sapiens
atttttaaagacagg

SEQ ID NO: 240093 - DNA, 15 bp, Homo sapiens
tatttttaaagacag

SEQ ID NO: 240094 - DNA, 15 bp, Homo sapiens
ttatttttaaagaca

SEQ ID NO: 240095 - DNA, 15 bp, Homo sapiens
tttatttttaaagac

SEQ ID NO: 240096 - DNA, 15 bp, Homo sapiens
gttttatttttaaag

SEQ ID NO: 240097 - DNA, 15 bp, Homo sapiens
tgttttatttttaaa

SEQ ID NO: 240098 - DNA, 15 bp, Homo sapiens
ttgttttatttttaa

SEQ ID NO: 240099 - DNA, 15 bp, Homo sapiens
ttttgttttattttt

SEQ ID NO: 240100 - DNA, 15 bp, Homo sapiens
tttttgttttatttt

SEQ ID NO: 240101 - DNA, 15 bp, Homo sapiens
gtttttgttttattt

SEQ ID NO: 240102 - DNA, 15 bp, Homo sapiens
tgtttttgttttatt

SEQ ID NO: 240103 - DNA, 15 bp, Homo sapiens
ttgtttttgttttat

SEQ ID NO: 240104 - DNA, 15 bp, Homo sapiens
tttgtttttgtttta

SEQ ID NO: 240105 - DNA, 15 bp, Homo sapiens
ctttgtttttgtttt

SEQ ID NO: 240106 - DNA, 15 bp, Homo sapiens
tctttgtttttgttt

SEQ ID NO: 240107 - DNA, 15 bp, Homo sapiens
atctttgtttttgtt

SEQ ID NO: 240108 - DNA, 15 bp, Homo sapiens
catctttgtttttgt

SEQ ID NO: 240109 - DNA, 15 bp, Homo sapiens
acatctttgtttttg

SEQ ID NO: 240110 - DNA, 15 bp, Homo sapiens
cacatctttgttttt

SEQ ID NO: 240111 - DNA, 15 bp, Homo sapiens
ccacatctttgtttt

SEQ ID NO: 240112 - DNA, 15 bp, Homo sapiens
tccacatctttgttt

SEQ ID NO: 240113 - DNA, 15 bp, Homo sapiens
atccacatctttgtt

SEQ ID NO: 240114 - DNA, 15 bp, Homo sapiens
tatccacatctttgt

SEQ ID NO: 240115 - DNA, 15 bp, Homo sapiens
ttatccacatctttg

SEQ ID NO: 240116 - DNA, 15 bp, Homo sapiens
tttatccacatcttt

SEQ ID NO: 240117 - DNA, 15 bp, Homo sapiens
ttttatccacatctt

SEQ ID NO: 240118 - DNA, 15 bp, Homo sapiens
cttttatccacatct

SEQ ID NO: 240119 - DNA, 15 bp, Homo sapiens
tcttttatccacatc

SEQ ID NO: 240120 - DNA, 15 bp, Homo sapiens
atcttttatccacat

SEQ ID NO: 240121 - DNA, 15 bp, Homo sapiens
catcttttatccaca

SEQ ID NO: 240122 - DNA, 15 bp, Homo sapiens
acatcttttatccac

SEQ ID NO: 240123 - DNA, 15 bp, Homo sapiens
tacatcttttatcca

SEQ ID NO: 240124 - DNA, 15 bp, Homo sapiens
ctacatcttttatcc

SEQ ID NO: 240125 - DNA, 15 bp, Homo sapiens
tctacatcttttatc

SEQ ID NO: 240126 - DNA, 15 bp, Homo sapiens
ctctacatcttttat

SEQ ID NO: 240127 - DNA, 15 bp, Homo sapiens
actctacatctttta

SEQ ID NO: 240128 - DNA, 15 bp, Homo sapiens
cactctacatctttt

SEQ ID NO: 240129 - DNA, 15 bp, Homo sapiens
acactctacatcttt

SEQ ID NO: 240130 - DNA, 15 bp, Homo sapiens
gacactctacatctt

SEQ ID NO: 240131 - DNA, 15 bp, Homo sapiens
ggacactctacatct

SEQ ID NO: 240132 - DNA, 15 bp, Homo sapiens
tggacactctacatc

SEQ ID NO: 240133 - DNA, 15 bp, Homo sapiens
ttggacactctacat

SEQ ID NO: 240134 - DNA, 15 bp, Homo sapiens
gttggacactctaca

SEQ ID NO: 240135 - DNA, 15 bp, Homo sapiens
ggttggacactctac

SEQ ID NO: 240136 - DNA, 15 bp, Homo sapiens
aggttggacactcta

SEQ ID NO: 240137 - DNA, 15 bp, Homo sapiens
caggttggacactct

SEQ ID NO: 240138 - DNA, 15 bp, Homo sapiens
ccaggttggacactc

SEQ ID NO: 240139 - DNA, 15 bp, Homo sapiens
cccaggttggacact

SEQ ID NO: 240140 - DNA, 15 bp, Homo sapiens
gcccaggttggacac

SEQ ID NO: 240141 - DNA, 15 bp, Homo sapiens
tgcccaggttggaca

SEQ ID NO: 240142 - DNA, 15 bp, Homo sapiens
ctgcccaggttggac

SEQ ID NO: 240143 - DNA, 15 bp, Homo sapiens
gctgcccaggttgga

SEQ ID NO: 240144 - DNA, 15 bp, Homo sapiens
tgctgcccaggttgg

SEQ ID NO: 240145 - DNA, 15 bp, Homo sapiens
atgctgcccaggttg

SEQ ID NO: 240146 - DNA, 15 bp, Homo sapiens
tatgctgcccaggtt

SEQ ID NO: 240147 - DNA, 15 bp, Homo sapiens
ctatgctgcccaggt

SEQ ID NO: 240148 - DNA, 15 bp, Homo sapiens
actatgctgcccagg

SEQ ID NO: 240149 - DNA, 15 bp, Homo sapiens
cactatgctgcccag

SEQ ID NO: 240150 - DNA, 15 bp, Homo sapiens
tcactatgctgccca

SEQ ID NO: 240151 - DNA, 15 bp, Homo sapiens
ctcactatgctgccc

SEQ ID NO: 240152 - DNA, 15 bp, Homo sapiens
tctcactatgctgcc

SEQ ID NO: 240153 - DNA, 15 bp, Homo sapiens
gtctcactatgctgc

SEQ ID NO: 240154 - DNA, 15 bp, Homo sapiens
ggtctcactatgctg

SEQ ID NO: 240155 - DNA, 15 bp, Homo sapiens
aggtctcactatgct

SEQ ID NO: 240156 - DNA, 15 bp, Homo sapiens
aaggtctcactatgc

SEQ ID NO: 240157 - DNA, 15 bp, Homo sapiens
caaggtctcactatg

SEQ ID NO: 240158 - DNA, 15 bp, Homo sapiens
acaaggtctcactat

SEQ ID NO: 240159 - DNA, 15 bp, Homo sapiens
gacaaggtctcacta

SEQ ID NO: 240160 - DNA, 15 bp, Homo sapiens
agacaaggtctcact

SEQ ID NO: 240161 - DNA, 15 bp, Homo sapiens
gagacaaggtctcac

SEQ ID NO: 240162 - DNA, 15 bp, Homo sapiens
agagacaaggtctca

SEQ ID NO: 240163 - DNA, 15 bp, Homo sapiens
tagagacaaggtctc

SEQ ID NO: 240164 - DNA, 15 bp, Homo sapiens
gtagagacaaggtct

SEQ ID NO: 240165 - DNA, 15 bp, Homo sapiens
ggtagagacaaggtc

SEQ ID NO: 240166 - DNA, 15 bp, Homo sapiens
tggtagagacaaggt

SEQ ID NO: 240167 - DNA, 15 bp, Homo sapiens
ttggtagagacaagg

SEQ ID NO: 240168 - DNA, 15 bp, Homo sapiens
tttggtagagacaag

SEQ ID NO: 240169 - DNA, 15 bp, Homo sapiens
ttttggtagagacaa

SEQ ID NO: 240170 - DNA, 15 bp, Homo sapiens
ttttttggtagagac

SEQ ID NO: 240171 - DNA, 15 bp, Homo sapiens
tttttttggtagaga

SEQ ID NO: 240172 - DNA, 15 bp, Homo sapiens
ttttttttggtagag

SEQ ID NO: 240173 - DNA, 15 bp, Homo sapiens
tttttttttggtaga

SEQ ID NO: 240174 - DNA, 15 bp, Homo sapiens
ttttttttttggtag

SEQ ID NO: 240175 - DNA, 15 bp, Homo sapiens
tttttttttttggta

SEQ ID NO: 240176 - DNA, 15 bp, Homo sapiens
ttaattttttttttt

SEQ ID NO: 240177 - DNA, 15 bp, Homo sapiens
gttaatttttttttt

SEQ ID NO: 240178 - DNA, 15 bp, Homo sapiens
ggttaattttttttt

SEQ ID NO: 240179 - DNA, 15 bp, Homo sapiens
gggttaatttttttt

SEQ ID NO: 240180 - DNA, 15 bp, Homo sapiens
cgggttaattttttt

SEQ ID NO: 240181 - DNA, 15 bp, Homo sapiens
ccgggttaatttttt

SEQ ID NO: 240182 - DNA, 15 bp, Homo sapiens
gccgggttaattttt

SEQ ID NO: 240183 - DNA, 15 bp, Homo sapiens
tgccgggttaatttt

SEQ ID NO: 240184 - DNA, 15 bp, Homo sapiens
atgccgggttaattt

SEQ ID NO: 240185 - DNA, 15 bp, Homo sapiens
catgccgggttaatt

SEQ ID NO: 240186 - DNA, 15 bp, Homo sapiens
tcatgccgggttaat

SEQ ID NO: 240187 - DNA, 15 bp, Homo sapiens
atcatgccgggttaa

SEQ ID NO: 240188 - DNA, 15 bp, Homo sapiens
aatcatgccgggtta

SEQ ID NO: 240189 - DNA, 15 bp, Homo sapiens
caatcatgccgggtt

SEQ ID NO: 240190 - DNA, 15 bp, Homo sapiens
gcaatcatgccgggt

SEQ ID NO: 240191 - DNA, 15 bp, Homo sapiens
tgcaatcatgccggg

SEQ ID NO: 240192 - DNA, 15 bp, Homo sapiens
gtgcaatcatgccgg

SEQ ID NO: 240193 - DNA, 15 bp, Homo sapiens
tgtgcaatcatgccg

SEQ ID NO: 240194 - DNA, 15 bp, Homo sapiens
atgtgcaatcatgcc

SEQ ID NO: 240195 - DNA, 15 bp, Homo sapiens
catgtgcaatcatgc

SEQ ID NO: 240196 - DNA, 15 bp, Homo sapiens
gcatgtgcaatcatg

SEQ ID NO: 240197 - DNA, 15 bp, Homo sapiens
cgcatgtgcaatcat

SEQ ID NO: 240198 - DNA, 15 bp, Homo sapiens
acgcatgtgcaatca

SEQ ID NO: 240199 - DNA, 15 bp, Homo sapiens
cacgcatgtgcaatc

SEQ ID NO: 240200 - DNA, 15 bp, Homo sapiens
acacgcatgtgcaat

SEQ ID NO: 240201 - DNA, 15 bp, Homo sapiens
tacacgcatgtgcaa

SEQ ID NO: 240202 - DNA, 15 bp, Homo sapiens
ctacacgcatgtgca

SEQ ID NO: 240203 - DNA, 15 bp, Homo sapiens
actacacgcatgtgc

SEQ ID NO: 240204 - DNA, 15 bp, Homo sapiens
gactacacgcatgtg

SEQ ID NO: 240205 - DNA, 15 bp, Homo sapiens
ggactacacgcatgt

SEQ ID NO: 240206 - DNA, 15 bp, Homo sapiens
gggactacacgcatg

SEQ ID NO: 240207 - DNA, 15 bp, Homo sapiens
tgggactacacgcat

SEQ ID NO: 240208 - DNA, 15 bp, Homo sapiens
ctgggactacacgca

SEQ ID NO: 240209 - DNA, 15 bp, Homo sapiens
gctgggactacacgc

SEQ ID NO: 240210 - DNA, 15 bp, Homo sapiens
agctgggactacacg

SEQ ID NO: 240211 - DNA, 15 bp, Homo sapiens
tagctgggactacac

SEQ ID NO: 240212 - DNA, 15 bp, Homo sapiens
ggtagctgggactac

SEQ ID NO: 240213 - DNA, 15 bp, Homo sapiens
aggtagctgggacta

SEQ ID NO: 240214 - DNA, 15 bp, Homo sapiens
caggtagctgggact

SEQ ID NO: 240215 - DNA, 15 bp, Homo sapiens
tagcctcccaggtag

SEQ ID NO: 240216 - DNA, 15 bp, Homo sapiens
ttagcctcccaggta

SEQ ID NO: 240217 - DNA, 15 bp, Homo sapiens
cttagcctcccaggt

SEQ ID NO: 240218 - DNA, 15 bp, Homo sapiens
ccttagcctcccagg

SEQ ID NO: 240219 - DNA, 15 bp, Homo sapiens
accttagcctcccag

SEQ ID NO: 240220 - DNA, 15 bp, Homo sapiens
tcccaccttagcctc

SEQ ID NO: 240221 - DNA, 15 bp, Homo sapiens
ctcccaccttagcct

SEQ ID NO: 240222 - DNA, 15 bp, Homo sapiens
cctcccaccttagcc

SEQ ID NO: 240223 - DNA, 15 bp, Homo sapiens
tcctcccaccttagc

SEQ ID NO: 240224 - DNA, 15 bp, Homo sapiens
atcctcccaccttag

SEQ ID NO: 240225 - DNA, 15 bp, Homo sapiens
aatcctcccacctta

SEQ ID NO: 240226 - DNA, 15 bp, Homo sapiens
caatcctcccacctt

SEQ ID NO: 240227 - DNA, 15 bp, Homo sapiens
tgcaatcctcccacc

SEQ ID NO: 240228 - DNA, 15 bp, Homo sapiens
atgcaatcctcccac

SEQ ID NO: 240229 - DNA, 15 bp, Homo sapiens
catgcaatcctccca

SEQ ID NO: 240230 - DNA, 15 bp, Homo sapiens
tcatgcaatcctccc

SEQ ID NO: 240231 - DNA, 15 bp, Homo sapiens
ctcatgcaatcctcc

SEQ ID NO: 240232 - DNA, 15 bp, Homo sapiens
gctcatgcaatcctc

SEQ ID NO: 240233 - DNA, 15 bp, Homo sapiens
ggctcatgcaatcct

SEQ ID NO: 240234 - DNA, 15 bp, Homo sapiens
gggctcatgcaatcc

SEQ ID NO: 240235 - DNA, 15 bp, Homo sapiens
tgggctcatgcaatc

SEQ ID NO: 240236 - DNA, 15 bp, Homo sapiens
ctgggctcatgcaat

SEQ ID NO: 240237 - DNA, 15 bp, Homo sapiens
cctgggctcatgcaa

SEQ ID NO: 240238 - DNA, 15 bp, Homo sapiens
tcctgggctcatgca

SEQ ID NO: 240239 - DNA, 15 bp, Homo sapiens
ctcctgggctcatgc

SEQ ID NO: 240240 - DNA, 15 bp, Homo sapiens
cctcctgggctcatg

SEQ ID NO: 240241 - DNA, 15 bp, Homo sapiens
acctcctgggctcat

SEQ ID NO: 240242 - DNA, 15 bp, Homo sapiens
gacctcctgggctca

SEQ ID NO: 240243 - DNA, 15 bp, Homo sapiens
cgacctcctgggctc

SEQ ID NO: 240244 - DNA, 15 bp, Homo sapiens
tcgacctcctgggct

SEQ ID NO: 240245 - DNA, 15 bp, Homo sapiens
ctcgacctcctgggc

SEQ ID NO: 240246 - DNA, 15 bp, Homo sapiens
cctcgacctcctggg

SEQ ID NO: 240247 - DNA, 15 bp, Homo sapiens
gcctcgacctcctgg

SEQ ID NO: 240248 - DNA, 15 bp, Homo sapiens
agcctcgacctcctg

SEQ ID NO: 240249 - DNA, 15 bp, Homo sapiens
cagcctcgacctcct

SEQ ID NO: 240250 - DNA, 15 bp, Homo sapiens
tactgcagcctcgac

SEQ ID NO: 240251 - DNA, 15 bp, Homo sapiens
ttactgcagcctcga

SEQ ID NO: 240252 - DNA, 15 bp, Homo sapiens
cttactgcagcctcg

SEQ ID NO: 240253 - DNA, 15 bp, Homo sapiens
gcttactgcagcctc

SEQ ID NO: 240254 - DNA, 15 bp, Homo sapiens
ggcttactgcagcct

SEQ ID NO: 240255 - DNA, 15 bp, Homo sapiens
tggcttactgcagcc

SEQ ID NO: 240256 - DNA, 15 bp, Homo sapiens
atggcttactgcagc

SEQ ID NO: 240257 - DNA, 15 bp, Homo sapiens
tatggcttactgcag

SEQ ID NO: 240258 - DNA, 15 bp, Homo sapiens
ttatggcttactgca

SEQ ID NO: 240259 - DNA, 15 bp, Homo sapiens
attatggcttactgc

SEQ ID NO: 240260 - DNA, 15 bp, Homo sapiens
gattatggcttactg

SEQ ID NO: 240261 - DNA, 15 bp, Homo sapiens
cgattatggcttact

SEQ ID NO: 240262 - DNA, 15 bp, Homo sapiens
acgattatggcttac

SEQ ID NO: 240263 - DNA, 15 bp, Homo sapiens
cacgattatggctta

SEQ ID NO: 240264 - DNA, 15 bp, Homo sapiens
gcacgattatggctt

SEQ ID NO: 240265 - DNA, 15 bp, Homo sapiens
ggcacgattatggct

SEQ ID NO: 240266 - DNA, 15 bp, Homo sapiens
tggcacgattatggc

SEQ ID NO: 240267 - DNA, 15 bp, Homo sapiens
gtggcacgattatgg

SEQ ID NO: 240268 - DNA, 15 bp, Homo sapiens
agtggcacgattatg

SEQ ID NO: 240269 - DNA, 15 bp, Homo sapiens
cagtggcacgattat

SEQ ID NO: 240270 - DNA, 15 bp, Homo sapiens
tcagtggcacgatta

SEQ ID NO: 240271 - DNA, 15 bp, Homo sapiens
ttcagtggcacgatt

SEQ ID NO: 240272 - DNA, 15 bp, Homo sapiens
gttcagtggcacgat

SEQ ID NO: 240273 - DNA, 15 bp, Homo sapiens
agttcagtggcacga

SEQ ID NO: 240274 - DNA, 15 bp, Homo sapiens
gagttcagtggcacg

SEQ ID NO: 240275 - DNA, 15 bp, Homo sapiens
ggagttcagtggcac

SEQ ID NO: 240276 - DNA, 15 bp, Homo sapiens
tggagttcagtggca

SEQ ID NO: 240277 - DNA, 15 bp, Homo sapiens
ctggagttcagtggc

SEQ ID NO: 240278 - DNA, 15 bp, Homo sapiens
gctggagttcagtgg

SEQ ID NO: 240279 - DNA, 15 bp, Homo sapiens
ggctggagttcagtg

SEQ ID NO: 240280 - DNA, 15 bp, Homo sapiens
aggctggagttcagt

SEQ ID NO: 240281 - DNA, 15 bp, Homo sapiens
caggctggagttcag

SEQ ID NO: 240282 - DNA, 15 bp, Homo sapiens
aagacagagtctcac

SEQ ID NO: 240283 - DNA, 15 bp, Homo sapiens
aaagacagagtctca

SEQ ID NO: 240284 - DNA, 15 bp, Homo sapiens
taaagacagagtctc

SEQ ID NO: 240285 - DNA, 15 bp, Homo sapiens
gtaaagacagagtct

SEQ ID NO: 240286 - DNA, 15 bp, Homo sapiens
tgtaaagacagagtc

SEQ ID NO: 240287 - DNA, 15 bp, Homo sapiens
ttgtaaagacagagt

SEQ ID NO: 240288 - DNA, 15 bp, Homo sapiens
tttgtaaagacagag

SEQ ID NO: 240289 - DNA, 15 bp, Homo sapiens
gtttgtaaagacaga

SEQ ID NO: 240290 - DNA, 15 bp, Homo sapiens
tgtttgtaaagacag

SEQ ID NO: 240291 - DNA, 15 bp, Homo sapiens
ttgtttgtaaagaca

SEQ ID NO: 240292 - DNA, 15 bp, Homo sapiens
tttgtttgtaaagac

SEQ ID NO: 240293 - DNA, 15 bp, Homo sapiens
ttttgtttgtaaaga

SEQ ID NO: 240294 - DNA, 15 bp, Homo sapiens
gttttgtttgtaaag

SEQ ID NO: 240295 - DNA, 15 bp, Homo sapiens
tgttttgtttgtaaa

SEQ ID NO: 240296 - DNA, 15 bp, Homo sapiens
ttgttttgtttgtaa

SEQ ID NO: 240297 - DNA, 15 bp, Homo sapiens
tttgttttgtttgta

SEQ ID NO: 240298 - DNA, 15 bp, Homo sapiens
ttttgttttgtttgt

SEQ ID NO: 240299 - DNA, 15 bp, Homo sapiens
ggcagtgaggagggt

SEQ ID NO: 240300 - DNA, 15 bp, Homo sapiens
gggcagtgaggaggg

SEQ ID NO: 240301 - DNA, 15 bp, Homo sapiens
ggggcagtgaggagg

SEQ ID NO: 240302 - DNA, 15 bp, Homo sapiens
gggggcagtgaggag

SEQ ID NO: 240303 - DNA, 15 bp, Homo sapiens
tgggggcagtgagga

SEQ ID NO: 240304 - DNA, 15 bp, Homo sapiens
gtgggggcagtgagg

SEQ ID NO: 240305 - DNA, 15 bp, Homo sapiens
ggtgggggcagtgag

SEQ ID NO: 240306 - DNA, 15 bp, Homo sapiens
gggtgggggcagtga

SEQ ID NO: 240307 - DNA, 15 bp, Homo sapiens
ggggtgggggcagtg

SEQ ID NO: 240308 - DNA, 15 bp, Homo sapiens
aggggtgggggcagt

SEQ ID NO: 240309 - DNA, 15 bp, Homo sapiens
taggggtgggggcag

SEQ ID NO: 240310 - DNA, 15 bp, Homo sapiens
gtaggggtgggggca

SEQ ID NO: 240311 - DNA, 15 bp, Homo sapiens
ggtaggggtgggggc

SEQ ID NO: 240312 - DNA, 15 bp, Homo sapiens
aggtaggggtggggg

SEQ ID NO: 240313 - DNA, 15 bp, Homo sapiens
gaggtaggggtgggg

SEQ ID NO: 240314 - DNA, 15 bp, Homo sapiens
tgaggtaggggtggg

SEQ ID NO: 240315 - DNA, 15 bp, Homo sapiens
ttgaggtaggggtgg

SEQ ID NO: 240316 - DNA, 15 bp, Homo sapiens
gttgaggtaggggtg

SEQ ID NO: 240317 - DNA, 15 bp, Homo sapiens
agttgaggtaggggt

SEQ ID NO: 240318 - DNA, 15 bp, Homo sapiens
gagttgaggtagggg

SEQ ID NO: 240319 - DNA, 15 bp, Homo sapiens
ggagttgaggtaggg

SEQ ID NO: 240320 - DNA, 15 bp, Homo sapiens
tggagttgaggtagg

SEQ ID NO: 240321 - DNA, 15 bp, Homo sapiens
atggagttgaggtag

SEQ ID NO: 240322 - DNA, 15 bp, Homo sapiens
tatggagttgaggta

SEQ ID NO: 240323 - DNA, 15 bp, Homo sapiens
gtatggagttgaggt

SEQ ID NO: 240324 - DNA, 15 bp, Homo sapiens
tgtatggagttgagg

SEQ ID NO: 240325 - DNA, 15 bp, Homo sapiens
ctgtatggagttgag

SEQ ID NO: 240326 - DNA, 15 bp, Homo sapiens
actgtatggagttga

SEQ ID NO: 240327 - DNA, 15 bp, Homo sapiens
aactgtatggagttg

SEQ ID NO: 240328 - DNA, 15 bp, Homo sapiens
aaactgtatggagtt

SEQ ID NO: 240329 - DNA, 15 bp, Homo sapiens
aaaactgtatggagt

SEQ ID NO: 240330 - DNA, 15 bp, Homo sapiens
aaaaactgtatggag

SEQ ID NO: 240331 - DNA, 15 bp, Homo sapiens
gaaaaactgtatgga

SEQ ID NO: 240332 - DNA, 15 bp, Homo sapiens
agaaaaactgtatgg

SEQ ID NO: 240333 - DNA, 15 bp, Homo sapiens
cagaaaaactgtatg

SEQ ID NO: 240334 - DNA, 15 bp, Homo sapiens
acagaaaaactgtat

SEQ ID NO: 240335 - DNA, 15 bp, Homo sapiens
aacagaaaaactgta

SEQ ID NO: 240336 - DNA, 15 bp, Homo sapiens
aaacagaaaaactgt

SEQ ID NO: 240337 - DNA, 15 bp, Homo sapiens
gaaacagaaaaactg

SEQ ID NO: 240338 - DNA, 15 bp, Homo sapiens
tgaaacagaaaaact

SEQ ID NO: 240339 - DNA, 15 bp, Homo sapiens
gtgaaacagaaaaac

SEQ ID NO: 240340 - DNA, 15 bp, Homo sapiens
tgtgaaacagaaaaa

SEQ ID NO: 240341 - DNA, 15 bp, Homo sapiens
ttgtgaaacagaaaa

SEQ ID NO: 240342 - DNA, 15 bp, Homo sapiens
tttgtgaaacagaaa

SEQ ID NO: 240343 - DNA, 15 bp, Homo sapiens
gtttgtgaaacagaa

SEQ ID NO: 240344 - DNA, 15 bp, Homo sapiens
ggtttgtgaaacaga

SEQ ID NO: 240345 - DNA, 15 bp, Homo sapiens
aggtttgtgaaacag

SEQ ID NO: 240346 - DNA, 15 bp, Homo sapiens
aaggtttgtgaaaca

SEQ ID NO: 240347 - DNA, 15 bp, Homo sapiens
taaggtttgtgaaac

SEQ ID NO: 240348 - DNA, 15 bp, Homo sapiens
ctaaggtttgtgaaa

SEQ ID NO: 240349 - DNA, 15 bp, Homo sapiens
tctaaggtttgtgaa

SEQ ID NO: 240350 - DNA, 15 bp, Homo sapiens
gtctaaggtttgtga

SEQ ID NO: 240351 - DNA, 15 bp, Homo sapiens
ggtctaaggtttgtg

SEQ ID NO: 240352 - DNA, 15 bp, Homo sapiens
aggtctaaggtttgt

SEQ ID NO: 240353 - DNA, 15 bp, Homo sapiens
aaggtctaaggtttg

SEQ ID NO: 240354 - DNA, 15 bp, Homo sapiens
taaggtctaaggttt

SEQ ID NO: 240355 - DNA, 15 bp, Homo sapiens
ctaaggtctaaggtt

SEQ ID NO: 240356 - DNA, 15 bp, Homo sapiens
cctaaggtctaaggt

SEQ ID NO: 240357 - DNA, 15 bp, Homo sapiens
acctaaggtctaagg

SEQ ID NO: 240358 - DNA, 15 bp, Homo sapiens
tacctaaggtctaag

SEQ ID NO: 240359 - DNA, 15 bp, Homo sapiens
ctacctaaggtctaa

SEQ ID NO: 240360 - DNA, 15 bp, Homo sapiens
actacctaaggtcta

SEQ ID NO: 240361 - DNA, 15 bp, Homo sapiens
aactacctaaggtct

SEQ ID NO: 240362 - DNA, 15 bp, Homo sapiens
taactacctaaggtc

SEQ ID NO: 240363 - DNA, 15 bp, Homo sapiens
ttaactacctaaggt

SEQ ID NO: 240364 - DNA, 15 bp, Homo sapiens
attaactacctaagg

SEQ ID NO: 240365 - DNA, 15 bp, Homo sapiens
gattaactacctaag

SEQ ID NO: 240366 - DNA, 15 bp, Homo sapiens
agattaactacctaa

SEQ ID NO: 240367 - DNA, 15 bp, Homo sapiens
aagattaactaccta

SEQ ID NO: 240368 - DNA, 15 bp, Homo sapiens
aaagattaactacct

SEQ ID NO: 240369 - DNA, 15 bp, Homo sapiens
caaagattaactacc

SEQ ID NO: 240370 - DNA, 15 bp, Homo sapiens
ccaaagattaactac

SEQ ID NO: 240371 - DNA, 15 bp, Homo sapiens
accaaagattaacta

SEQ ID NO: 240372 - DNA, 15 bp, Homo sapiens
taccaaagattaact

SEQ ID NO: 240373 - DNA, 15 bp, Homo sapiens
ataccaaagattaac

SEQ ID NO: 240374 - DNA, 15 bp, Homo sapiens
tataccaaagattaa

SEQ ID NO: 240375 - DNA, 15 bp, Homo sapiens
gtataccaaagatta

SEQ ID NO: 240376 - DNA, 15 bp, Homo sapiens
cgtataccaaagatt

SEQ ID NO: 240377 - DNA, 15 bp, Homo sapiens
gcgtataccaaagat

SEQ ID NO: 240378 - DNA, 15 bp, Homo sapiens
ggcgtataccaaaga

SEQ ID NO: 240379 - DNA, 15 bp, Homo sapiens
aggcgtataccaaag

SEQ ID NO: 240380 - DNA, 15 bp, Homo sapiens
aaggcgtataccaaa

SEQ ID NO: 240381 - DNA, 15 bp, Homo sapiens
gaaggcgtataccaa

SEQ ID NO: 240382 - DNA, 15 bp, Homo sapiens
ggaaggcgtatacca

SEQ ID NO: 240383 - DNA, 15 bp, Homo sapiens
aggaaggcgtatacc

SEQ ID NO: 240384 - DNA, 15 bp, Homo sapiens
caggaaggcgtatac

SEQ ID NO: 240385 - DNA, 15 bp, Homo sapiens
ccaggaaggcgtata

SEQ ID NO: 240386 - DNA, 15 bp, Homo sapiens
tccaggaaggcgtat

SEQ ID NO: 240387 - DNA, 15 bp, Homo sapiens
ttccaggaaggcgta

SEQ ID NO: 240388 - DNA, 15 bp, Homo sapiens
attccaggaaggcgt

SEQ ID NO: 240389 - DNA, 15 bp, Homo sapiens
tattccaggaaggcg

SEQ ID NO: 240390 - DNA, 15 bp, Homo sapiens
atattccaggaaggc

SEQ ID NO: 240391 - DNA, 15 bp, Homo sapiens
tatattccaggaagg

SEQ ID NO: 240392 - DNA, 15 bp, Homo sapiens
gtatattccaggaag

SEQ ID NO: 240393 - DNA, 15 bp, Homo sapiens
agtatattccaggaa

SEQ ID NO: 240394 - DNA, 15 bp, Homo sapiens
cagtatattccagga

SEQ ID NO: 240395 - DNA, 15 bp, Homo sapiens
acagtatattccagg

SEQ ID NO: 240396 - DNA, 15 bp, Homo sapiens
cacagtatattccag

SEQ ID NO: 240397 - DNA, 15 bp, Homo sapiens
acacagtatattcca

SEQ ID NO: 240398 - DNA, 15 bp, Homo sapiens
tacacagtatattcc

SEQ ID NO: 240399 - DNA, 15 bp, Homo sapiens
gtacacagtatattc

SEQ ID NO: 240400 - DNA, 15 bp, Homo sapiens
ggtacacagtatatt

SEQ ID NO: 240401 - DNA, 15 bp, Homo sapiens
aggtacacagtatat

SEQ ID NO: 240402 - DNA, 15 bp, Homo sapiens
taggtacacagtata

SEQ ID NO: 240403 - DNA, 15 bp, Homo sapiens
ctaggtacacagtat

SEQ ID NO: 240404 - DNA, 15 bp, Homo sapiens
tctaggtacacagta

SEQ ID NO: 240405 - DNA, 15 bp, Homo sapiens
atctaggtacacagt

SEQ ID NO: 240406 - DNA, 15 bp, Homo sapiens
catctaggtacacag

SEQ ID NO: 240407 - DNA, 15 bp, Homo sapiens
gcatctaggtacaca

SEQ ID NO: 240408 - DNA, 15 bp, Homo sapiens
ggcatctaggtacac

SEQ ID NO: 240409 - DNA, 15 bp, Homo sapiens
tggcatctaggtaca

SEQ ID NO: 240410 - DNA, 15 bp, Homo sapiens
ctggcatctaggtac

SEQ ID NO: 240411 - DNA, 15 bp, Homo sapiens
cctggcatctaggta

SEQ ID NO: 240412 - DNA, 15 bp, Homo sapiens
tcctggcatctaggt

SEQ ID NO: 240413 - DNA, 15 bp, Homo sapiens
gtcctggcatctagg

SEQ ID NO: 240414 - DNA, 15 bp, Homo sapiens
tgtcctggcatctag

SEQ ID NO: 240415 - DNA, 15 bp, Homo sapiens
gtgtcctggcatcta

SEQ ID NO: 240416 - DNA, 15 bp, Homo sapiens
tgtgtcctggcatct

SEQ ID NO: 240417 - DNA, 15 bp, Homo sapiens
atgtgtcctggcatc

SEQ ID NO: 240418 - DNA, 15 bp, Homo sapiens
aatgtgtcctggcat

SEQ ID NO: 240419 - DNA, 15 bp, Homo sapiens
aaatgtgtcctggca

SEQ ID NO: 240420 - DNA, 15 bp, Homo sapiens
aaaatgtgtcctggc

SEQ ID NO: 240421 - DNA, 15 bp, Homo sapiens
aaaaatgtgtcctgg

SEQ ID NO: 240422 - DNA, 15 bp, Homo sapiens
taaaaatgtgtcctg

SEQ ID NO: 240423 - DNA, 15 bp, Homo sapiens
ttaaaaatgtgtcct

SEQ ID NO: 240424 - DNA, 15 bp, Homo sapiens
tttaaaaatgtgtcc

SEQ ID NO: 240425 - DNA, 15 bp, Homo sapiens
ctttaaaaatgtgtc

SEQ ID NO: 240426 - DNA, 15 bp, Homo sapiens
actttaaaaatgtgt

SEQ ID NO: 240427 - DNA, 15 bp, Homo sapiens
gactttaaaaatgtg

SEQ ID NO: 240428 - DNA, 15 bp, Homo sapiens
ggactttaaaaatgt

SEQ ID NO: 240429 - DNA, 15 bp, Homo sapiens
tggactttaaaaatg

SEQ ID NO: 240430 - DNA, 15 bp, Homo sapiens
ctggactttaaaaat

SEQ ID NO: 240431 - DNA, 15 bp, Homo sapiens
tctggactttaaaaa

SEQ ID NO: 240432 - DNA, 15 bp, Homo sapiens
atctggactttaaaa

SEQ ID NO: 240433 - DNA, 15 bp, Homo sapiens
tatctggactttaaa

SEQ ID NO: 240434 - DNA, 15 bp, Homo sapiens
gtatctggactttaa

SEQ ID NO: 240435 - DNA, 15 bp, Homo sapiens
ggtatctggacttta

SEQ ID NO: 240436 - DNA, 15 bp, Homo sapiens
tggtatctggacttt

SEQ ID NO: 240437 - DNA, 15 bp, Homo sapiens
atggtatctggactt

SEQ ID NO: 240438 - DNA, 15 bp, Homo sapiens
gatggtatctggact

SEQ ID NO: 240439 - DNA, 15 bp, Homo sapiens
tgatggtatctggac

SEQ ID NO: 240440 - DNA, 15 bp, Homo sapiens
ttgatggtatctgga

SEQ ID NO: 240441 - DNA, 15 bp, Homo sapiens
attgatggtatctgg

SEQ ID NO: 240442 - DNA, 15 bp, Homo sapiens
cattgatggtatctg

SEQ ID NO: 240443 - DNA, 15 bp, Homo sapiens
acattgatggtatct

SEQ ID NO: 240444 - DNA, 15 bp, Homo sapiens
aacattgatggtatc

SEQ ID NO: 240445 - DNA, 15 bp, Homo sapiens
caacattgatggtat

SEQ ID NO: 240446 - DNA, 15 bp, Homo sapiens
tcaacattgatggta

SEQ ID NO: 240447 - DNA, 15 bp, Homo sapiens
atcaacattgatggt

SEQ ID NO: 240448 - DNA, 15 bp, Homo sapiens
catcaacattgatgg

SEQ ID NO: 240449 - DNA, 15 bp, Homo sapiens
tcatcaacattgatg

SEQ ID NO: 240450 - DNA, 15 bp, Homo sapiens
ttcatcaacattgat

SEQ ID NO: 240451 - DNA, 15 bp, Homo sapiens
cttcatcaacattga

SEQ ID NO: 240452 - DNA, 15 bp, Homo sapiens
acttcatcaacattg

SEQ ID NO: 240453 - DNA, 15 bp, Homo sapiens
tacttcatcaacatt

SEQ ID NO: 240454 - DNA, 15 bp, Homo sapiens
ttacttcatcaacat

SEQ ID NO: 240455 - DNA, 15 bp, Homo sapiens
tttacttcatcaaca

SEQ ID NO: 240456 - DNA, 15 bp, Homo sapiens
atttacttcatcaac

SEQ ID NO: 240457 - DNA, 15 bp, Homo sapiens
tatttacttcatcaa

SEQ ID NO: 240458 - DNA, 15 bp, Homo sapiens
ctatttacttcatca

SEQ ID NO: 240459 - DNA, 15 bp, Homo sapiens
cctatttacttcatc

SEQ ID NO: 240460 - DNA, 15 bp, Homo sapiens
acctatttacttcat

SEQ ID NO: 240461 - DNA, 15 bp, Homo sapiens
aacctatttacttca

SEQ ID NO: 240462 - DNA, 15 bp, Homo sapiens
aaacctatttacttc

SEQ ID NO: 240463 - DNA, 15 bp, Homo sapiens
caaacctatttactt

SEQ ID NO: 240464 - DNA, 15 bp, Homo sapiens
gcaaacctatttact

SEQ ID NO: 240465 - DNA, 15 bp, Homo sapiens
agcaaacctatttac

SEQ ID NO: 240466 - DNA, 15 bp, Homo sapiens
cagcaaacctattta

SEQ ID NO: 240467 - DNA, 15 bp, Homo sapiens
acagcaaacctattt

SEQ ID NO: 240468 - DNA, 15 bp, Homo sapiens
tacagcaaacctatt

SEQ ID NO: 240469 - DNA, 15 bp, Homo sapiens
atacagcaaacctat

SEQ ID NO: 240470 - DNA, 15 bp, Homo sapiens
tatacagcaaaccta

SEQ ID NO: 240471 - DNA, 15 bp, Homo sapiens
gtatacagcaaacct

SEQ ID NO: 240472 - DNA, 15 bp, Homo sapiens
agtatacagcaaacc

SEQ ID NO: 240473 - DNA, 15 bp, Homo sapiens
aagtatacagcaaac

SEQ ID NO: 240474 - DNA, 15 bp, Homo sapiens
taagtatacagcaaa

SEQ ID NO: 240475 - DNA, 15 bp, Homo sapiens
ataagtatacagcaa

SEQ ID NO: 240476 - DNA, 15 bp, Homo sapiens
aataagtatacagca

SEQ ID NO: 240477 - DNA, 15 bp, Homo sapiens
taataagtatacagc

SEQ ID NO: 240478 - DNA, 15 bp, Homo sapiens
ctaataagtatacag

SEQ ID NO: 240479 - DNA, 15 bp, Homo sapiens
tctaataagtataca

SEQ ID NO: 240480 - DNA, 15 bp, Homo sapiens
atctaataagtatac

SEQ ID NO: 240481 - DNA, 15 bp, Homo sapiens
aatctaataagtata

SEQ ID NO: 240482 - DNA, 15 bp, Homo sapiens
taatctaataagtat

SEQ ID NO: 240483 - DNA, 15 bp, Homo sapiens
ataatctaataagta

SEQ ID NO: 240484 - DNA, 15 bp, Homo sapiens
aataatctaataagt

SEQ ID NO: 240485 - DNA, 15 bp, Homo sapiens
taataatctaataag

SEQ ID NO: 240486 - DNA, 15 bp, Homo sapiens
ttaataatctaataa

SEQ ID NO: 240487 - DNA, 15 bp, Homo sapiens
cttaataatctaata

SEQ ID NO: 240488 - DNA, 15 bp, Homo sapiens
acttaataatctaat

SEQ ID NO: 240489 - DNA, 15 bp, Homo sapiens
tacttaataatctaa

SEQ ID NO: 240490 - DNA, 15 bp, Homo sapiens
atacttaataatcta

SEQ ID NO: 240491 - DNA, 15 bp, Homo sapiens
aatacttaataatct

SEQ ID NO: 240492 - DNA, 15 bp, Homo sapiens
gaatacttaataatc

SEQ ID NO: 240493 - DNA, 15 bp, Homo sapiens
ggaatacttaataat

SEQ ID NO: 240494 - DNA, 15 bp, Homo sapiens
tggaatacttaataa

SEQ ID NO: 240495 - DNA, 15 bp, Homo sapiens
ctggaatacttaata

SEQ ID NO: 240496 - DNA, 15 bp, Homo sapiens
tctggaatacttaat

SEQ ID NO: 240497 - DNA, 15 bp, Homo sapiens
atctggaatacttaa

SEQ ID NO: 240498 - DNA, 15 bp, Homo sapiens
aatctggaatactta

SEQ ID NO: 240499 - DNA, 15 bp, Homo sapiens
aaatctggaatactt

SEQ ID NO: 240500 - DNA, 15 bp, Homo sapiens
gaaatctggaatact

SEQ ID NO: 240501 - DNA, 15 bp, Homo sapiens
agaaatctggaatac

SEQ ID NO: 240502 - DNA, 15 bp, Homo sapiens
tagaaatctggaata

SEQ ID NO: 240503 - DNA, 15 bp, Homo sapiens
ttagaaatctggaat

SEQ ID NO: 240504 - DNA, 15 bp, Homo sapiens
tttagaaatctggaa

SEQ ID NO: 240505 - DNA, 15 bp, Homo sapiens
ctttagaaatctgga

SEQ ID NO: 240506 - DNA, 15 bp, Homo sapiens
gctttagaaatctgg

SEQ ID NO: 240507 - DNA, 15 bp, Homo sapiens
agctttagaaatctg

SEQ ID NO: 240508 - DNA, 15 bp, Homo sapiens
gagctttagaaatct

SEQ ID NO: 240509 - DNA, 15 bp, Homo sapiens
tgagctttagaaatc

SEQ ID NO: 240510 - DNA, 15 bp, Homo sapiens
ctgagctttagaaat

SEQ ID NO: 240511 - DNA, 15 bp, Homo sapiens
actgagctttagaaa

SEQ ID NO: 240512 - DNA, 15 bp, Homo sapiens
aactgagctttagaa

SEQ ID NO: 240513 - DNA, 15 bp, Homo sapiens
aaactgagctttaga

SEQ ID NO: 240514 - DNA, 15 bp, Homo sapiens
aaaactgagctttag

SEQ ID NO: 240515 - DNA, 15 bp, Homo sapiens
aaaaactgagcttta

SEQ ID NO: 240516 - DNA, 15 bp, Homo sapiens
gaaaaactgagcttt

SEQ ID NO: 240517 - DNA, 15 bp, Homo sapiens
tgaaaaactgagctt

SEQ ID NO: 240518 - DNA, 15 bp, Homo sapiens
ttgaaaaactgagct

SEQ ID NO: 240519 - DNA, 15 bp, Homo sapiens
tttgaaaaactgagc

SEQ ID NO: 240520 - DNA, 15 bp, Homo sapiens
ttttgaaaaactgag

SEQ ID NO: 240521 - DNA, 15 bp, Homo sapiens
attttgaaaaactga

SEQ ID NO: 240522 - DNA, 15 bp, Homo sapiens
cattttgaaaaactg

SEQ ID NO: 240523 - DNA, 15 bp, Homo sapiens
acattttgaaaaact

SEQ ID NO: 240524 - DNA, 15 bp, Homo sapiens
tacattttgaaaaac

SEQ ID NO: 240525 - DNA, 15 bp, Homo sapiens
ttacattttgaaaaa

SEQ ID NO: 240526 - DNA, 15 bp, Homo sapiens
tttacattttgaaaa

SEQ ID NO: 240527 - DNA, 15 bp, Homo sapiens
ctttacattttgaaa

SEQ ID NO: 240528 - DNA, 15 bp, Homo sapiens
gctttacattttgaa

SEQ ID NO: 240529 - DNA, 15 bp, Homo sapiens
agctttacattttga

SEQ ID NO: 240530 - DNA, 15 bp, Homo sapiens
tagctttacattttg

SEQ ID NO: 240531 - DNA, 15 bp, Homo sapiens
atagctttacatttt

SEQ ID NO: 240532 - DNA, 15 bp, Homo sapiens
catagctttacattt

SEQ ID NO: 240533 - DNA, 15 bp, Homo sapiens
acatagctttacatt

SEQ ID NO: 240534 - DNA, 15 bp, Homo sapiens
tacatagctttacat

SEQ ID NO: 240535 - DNA, 15 bp, Homo sapiens
gtacatagctttaca

SEQ ID NO: 240536 - DNA, 15 bp, Homo sapiens
ggtacatagctttac

SEQ ID NO: 240537 - DNA, 15 bp, Homo sapiens
tggtacatagcttta

SEQ ID NO: 240538 - DNA, 15 bp, Homo sapiens
ttggtacatagcttt

SEQ ID NO: 240539 - DNA, 15 bp, Homo sapiens
cttggtacatagctt

SEQ ID NO: 240540 - DNA, 15 bp, Homo sapiens
tcttggtacatagct

SEQ ID NO: 240541 - DNA, 15 bp, Homo sapiens
gtcttggtacatagc

SEQ ID NO: 240542 - DNA, 15 bp, Homo sapiens
ggtcttggtacatag

SEQ ID NO: 240543 - DNA, 15 bp, Homo sapiens
tggtcttggtacata

SEQ ID NO: 240544 - DNA, 15 bp, Homo sapiens
ttggtcttggtacat

SEQ ID NO: 240545 - DNA, 15 bp, Homo sapiens
tttggtcttggtaca

SEQ ID NO: 240546 - DNA, 15 bp, Homo sapiens
atttggtcttggtac

SEQ ID NO: 240547 - DNA, 15 bp, Homo sapiens
catttggtcttggta

SEQ ID NO: 240548 - DNA, 15 bp, Homo sapiens
tcatttggtcttggt

SEQ ID NO: 240549 - DNA, 15 bp, Homo sapiens
ttcatttggtcttgg

SEQ ID NO: 240550 - DNA, 15 bp, Homo sapiens
tttcatttggtcttg

SEQ ID NO: 240551 - DNA, 15 bp, Homo sapiens
ctttcatttggtctt

SEQ ID NO: 240552 - DNA, 15 bp, Homo sapiens
tctttcatttggtct

SEQ ID NO: 240553 - DNA, 15 bp, Homo sapiens
ctctttcatttggtc

SEQ ID NO: 240554 - DNA, 15 bp, Homo sapiens
cctctttcatttggt

SEQ ID NO: 240555 - DNA, 15 bp, Homo sapiens
tcctctttcatttgg

SEQ ID NO: 240556 - DNA, 15 bp, Homo sapiens
ttcctctttcatttg

SEQ ID NO: 240557 - DNA, 15 bp, Homo sapiens
attcctctttcattt

SEQ ID NO: 240558 - DNA, 15 bp, Homo sapiens
aattcctctttcatt

SEQ ID NO: 240559 - DNA, 15 bp, Homo sapiens
aaattcctctttcat

SEQ ID NO: 240560 - DNA, 15 bp, Homo sapiens
taaattcctctttca

SEQ ID NO: 240561 - DNA, 15 bp, Homo sapiens
gtaaattcctctttc

SEQ ID NO: 240562 - DNA, 15 bp, Homo sapiens
tgtaaattcctcttt

SEQ ID NO: 240563 - DNA, 15 bp, Homo sapiens
ttgtaaattcctctt

SEQ ID NO: 240564 - DNA, 15 bp, Homo sapiens
tttgtaaattcctct

SEQ ID NO: 240565 - DNA, 15 bp, Homo sapiens
ttttgtaaattcctc

SEQ ID NO: 240566 - DNA, 15 bp, Homo sapiens
attttgtaaattcct

SEQ ID NO: 240567 - DNA, 15 bp, Homo sapiens
tattttgtaaattcc

SEQ ID NO: 240568 - DNA, 15 bp, Homo sapiens
ttattttgtaaattc

SEQ ID NO: 240569 - DNA, 15 bp, Homo sapiens
attattttgtaaatt

SEQ ID NO: 240570 - DNA, 15 bp, Homo sapiens
aattattttgtaaat

SEQ ID NO: 240571 - DNA, 15 bp, Homo sapiens
caattattttgtaaa

SEQ ID NO: 240572 - DNA, 15 bp, Homo sapiens
tcaattattttgtaa

SEQ ID NO: 240573 - DNA, 15 bp, Homo sapiens
ctcaattattttgta

SEQ ID NO: 240574 - DNA, 15 bp, Homo sapiens
tctcaattattttgt

SEQ ID NO: 240575 - DNA, 15 bp, Homo sapiens
gtctcaattattttg

SEQ ID NO: 240576 - DNA, 15 bp, Homo sapiens
agtctcaattatttt

SEQ ID NO: 240577 - DNA, 15 bp, Homo sapiens
cagtctcaattattt

SEQ ID NO: 240578 - DNA, 15 bp, Homo sapiens
acagtctcaattatt

SEQ ID NO: 240579 - DNA, 15 bp, Homo sapiens
gacagtctcaattat

SEQ ID NO: 240580 - DNA, 15 bp, Homo sapiens
agacagtctcaatta

SEQ ID NO: 240581 - DNA, 15 bp, Homo sapiens
aagacagtctcaatt

SEQ ID NO: 240582 - DNA, 15 bp, Homo sapiens
aaagacagtctcaat

SEQ ID NO: 240583 - DNA, 15 bp, Homo sapiens
taaagacagtctcaa

SEQ ID NO: 240584 - DNA, 15 bp, Homo sapiens
gtaaagacagtctca

SEQ ID NO: 240585 - DNA, 15 bp, Homo sapiens
tgtaaagacagtctc

SEQ ID NO: 240586 - DNA, 15 bp, Homo sapiens
ctgtaaagacagtct

SEQ ID NO: 240587 - DNA, 15 bp, Homo sapiens
actgtaaagacagtc

SEQ ID NO: 240588 - DNA, 15 bp, Homo sapiens
aactgtaaagacagt

SEQ ID NO: 240589 - DNA, 15 bp, Homo sapiens
gaactgtaaagacag

SEQ ID NO: 240590 - DNA, 15 bp, Homo sapiens
agaactgtaaagaca

SEQ ID NO: 240591 - DNA, 15 bp, Homo sapiens
tagaactgtaaagac

SEQ ID NO: 240592 - DNA, 15 bp, Homo sapiens
ttagaactgtaaaga

SEQ ID NO: 240593 - DNA, 15 bp, Homo sapiens
gttagaactgtaaag

SEQ ID NO: 240594 - DNA, 15 bp, Homo sapiens
agttagaactgtaaa

SEQ ID NO: 240595 - DNA, 15 bp, Homo sapiens
tagttagaactgtaa

SEQ ID NO: 240596 - DNA, 15 bp, Homo sapiens
atagttagaactgta

SEQ ID NO: 240597 - DNA, 15 bp, Homo sapiens
gatagttagaactgt

SEQ ID NO: 240598 - DNA, 15 bp, Homo sapiens
tgatagttagaactg

SEQ ID NO: 240599 - DNA, 15 bp, Homo sapiens
ctgatagttagaact

SEQ ID NO: 240600 - DNA, 15 bp, Homo sapiens
actgatagttagaac

SEQ ID NO: 240601 - DNA, 15 bp, Homo sapiens
aactgatagttagaa

SEQ ID NO: 240602 - DNA, 15 bp, Homo sapiens
taactgatagttaga

SEQ ID NO: 240603 - DNA, 15 bp, Homo sapiens
ataactgatagttag

SEQ ID NO: 240604 - DNA, 15 bp, Homo sapiens
gataactgatagtta

SEQ ID NO: 240605 - DNA, 15 bp, Homo sapiens
agataactgatagtt

SEQ ID NO: 240606 - DNA, 15 bp, Homo sapiens
aagataactgatagt

SEQ ID NO: 240607 - DNA, 15 bp, Homo sapiens
aaagataactgatag

SEQ ID NO: 240608 - DNA, 15 bp, Homo sapiens
taaagataactgata

SEQ ID NO: 240609 - DNA, 15 bp, Homo sapiens
ttaaagataactgat

SEQ ID NO: 240610 - DNA, 15 bp, Homo sapiens
attaaagataactga

SEQ ID NO: 240611 - DNA, 15 bp, Homo sapiens
tattaaagataactg

SEQ ID NO: 240612 - DNA, 15 bp, Homo sapiens
atattaaagataact

SEQ ID NO: 240613 - DNA, 15 bp, Homo sapiens
aatattaaagataac

SEQ ID NO: 240614 - DNA, 15 bp, Homo sapiens
caatattaaagataa

SEQ ID NO: 240615 - DNA, 15 bp, Homo sapiens
tcaatattaaagata

SEQ ID NO: 240616 - DNA, 15 bp, Homo sapiens
atcaatattaaagat

SEQ ID NO: 240617 - DNA, 15 bp, Homo sapiens
catcaatattaaaga

SEQ ID NO: 240618 - DNA, 15 bp, Homo sapiens
tcatcaatattaaag

SEQ ID NO: 240619 - DNA, 15 bp, Homo sapiens
ttcatcaatattaaa

SEQ ID NO: 240620 - DNA, 15 bp, Homo sapiens
tttcatcaatattaa

SEQ ID NO: 240621 - DNA, 15 bp, Homo sapiens
atttcatcaatatta

SEQ ID NO: 240622 - DNA, 15 bp, Homo sapiens
catttcatcaatatt

SEQ ID NO: 240623 - DNA, 15 bp, Homo sapiens
gcatttcatcaatat

SEQ ID NO: 240624 - DNA, 15 bp, Homo sapiens
agcatttcatcaata

SEQ ID NO: 240625 - DNA, 15 bp, Homo sapiens
tagcatttcatcaat

SEQ ID NO: 240626 - DNA, 15 bp, Homo sapiens
atagcatttcatcaa

SEQ ID NO: 240627 - DNA, 15 bp, Homo sapiens
tatagcatttcatca

SEQ ID NO: 240628 - DNA, 15 bp, Homo sapiens
gtatagcatttcatc

SEQ ID NO: 240629 - DNA, 15 bp, Homo sapiens
agtatagcatttcat

SEQ ID NO: 240630 - DNA, 15 bp, Homo sapiens
aagtatagcatttca

SEQ ID NO: 240631 - DNA, 15 bp, Homo sapiens
aaagtatagcatttc

SEQ ID NO: 240632 - DNA, 15 bp, Homo sapiens
gaaagtatagcattt

SEQ ID NO: 240633 - DNA, 15 bp, Homo sapiens
tgaaagtatagcatt

SEQ ID NO: 240634 - DNA, 15 bp, Homo sapiens
gtgaaagtatagcat

SEQ ID NO: 240635 - DNA, 15 bp, Homo sapiens
ggtgaaagtatagca

SEQ ID NO: 240636 - DNA, 15 bp, Homo sapiens
aggtgaaagtatagc

SEQ ID NO: 240637 - DNA, 15 bp, Homo sapiens
taggtgaaagtatag

SEQ ID NO: 240638 - DNA, 15 bp, Homo sapiens
ctaggtgaaagtata

SEQ ID NO: 240639 - DNA, 15 bp, Homo sapiens
gctaggtgaaagtat

SEQ ID NO: 240640 - DNA, 15 bp, Homo sapiens
tgctaggtgaaagta

SEQ ID NO: 240641 - DNA, 15 bp, Homo sapiens
ttgctaggtgaaagt

SEQ ID NO: 240642 - DNA, 15 bp, Homo sapiens
attgctaggtgaaag

SEQ ID NO: 240643 - DNA, 15 bp, Homo sapiens
gattgctaggtgaaa

SEQ ID NO: 240644 - DNA, 15 bp, Homo sapiens
tgattgctaggtgaa

SEQ ID NO: 240645 - DNA, 15 bp, Homo sapiens
gtgattgctaggtga

SEQ ID NO: 240646 - DNA, 15 bp, Homo sapiens
agtgattgctaggtg

SEQ ID NO: 240647 - DNA, 15 bp, Homo sapiens
gagtgattgctaggt

SEQ ID NO: 240648 - DNA, 15 bp, Homo sapiens
agagtgattgctagg

SEQ ID NO: 240649 - DNA, 15 bp, Homo sapiens
gagagtgattgctag

SEQ ID NO: 240650 - DNA, 15 bp, Homo sapiens
tgagagtgattgcta

SEQ ID NO: 240651 - DNA, 15 bp, Homo sapiens
atgagagtgattgct

SEQ ID NO: 240652 - DNA, 15 bp, Homo sapiens
tatgagagtgattgc

SEQ ID NO: 240653 - DNA, 15 bp, Homo sapiens
ctatgagagtgattg

SEQ ID NO: 240654 - DNA, 15 bp, Homo sapiens
actatgagagtgatt

SEQ ID NO: 240655 - DNA, 15 bp, Homo sapiens
cactatgagagtgat

SEQ ID NO: 240656 - DNA, 15 bp, Homo sapiens
ccactatgagagtga

SEQ ID NO: 240657 - DNA, 15 bp, Homo sapiens
tccactatgagagtg

SEQ ID NO: 240658 - DNA, 15 bp, Homo sapiens
ttccactatgagagt

SEQ ID NO: 240659 - DNA, 15 bp, Homo sapiens
tttccactatgagag

SEQ ID NO: 240660 - DNA, 15 bp, Homo sapiens
atttccactatgaga

SEQ ID NO: 240661 - DNA, 15 bp, Homo sapiens
gatttccactatgag

SEQ ID NO: 240662 - DNA, 15 bp, Homo sapiens
tgatttccactatga

SEQ ID NO: 240663 - DNA, 15 bp, Homo sapiens
ttgatttccactatg

SEQ ID NO: 240664 - DNA, 15 bp, Homo sapiens
cttgatttccactat

SEQ ID NO: 240665 - DNA, 15 bp, Homo sapiens
gcttgatttccacta

SEQ ID NO: 240666 - DNA, 15 bp, Homo sapiens
tgcttgatttccact

SEQ ID NO: 240667 - DNA, 15 bp, Homo sapiens
gtgcttgatttccac

SEQ ID NO: 240668 - DNA, 15 bp, Homo sapiens
tgtgcttgatttcca

SEQ ID NO: 240669 - DNA, 15 bp, Homo sapiens
atgtgcttgatttcc

SEQ ID NO: 240670 - DNA, 15 bp, Homo sapiens
tatgtgcttgatttc

SEQ ID NO: 240671 - DNA, 15 bp, Homo sapiens
atatgtgcttgattt

SEQ ID NO: 240672 - DNA, 15 bp, Homo sapiens
aatatgtgcttgatt

SEQ ID NO: 240673 - DNA, 15 bp, Homo sapiens
gaatatgtgcttgat

SEQ ID NO: 240674 - DNA, 15 bp, Homo sapiens
agaatatgtgcttga

SEQ ID NO: 240675 - DNA, 15 bp, Homo sapiens
aagaatatgtgcttg

SEQ ID NO: 240676 - DNA, 15 bp, Homo sapiens
aaagaatatgtgctt

SEQ ID NO: 240677 - DNA, 15 bp, Homo sapiens
aaaagaatatgtgct

SEQ ID NO: 240678 - DNA, 15 bp, Homo sapiens
caaaagaatatgtgc

SEQ ID NO: 240679 - DNA, 15 bp, Homo sapiens
ccaaaagaatatgtg

SEQ ID NO: 240680 - DNA, 15 bp, Homo sapiens
tccaaaagaatatgt

SEQ ID NO: 240681 - DNA, 15 bp, Homo sapiens
ttccaaaagaatatg

SEQ ID NO: 240682 - DNA, 15 bp, Homo sapiens
cttccaaaagaatat

SEQ ID NO: 240683 - DNA, 15 bp, Homo sapiens
acttccaaaagaata

SEQ ID NO: 240684 - DNA, 15 bp, Homo sapiens
cacttccaaaagaat

SEQ ID NO: 240685 - DNA, 15 bp, Homo sapiens
tcacttccaaaagaa

SEQ ID NO: 240686 - DNA, 15 bp, Homo sapiens
ttcacttccaaaaga

SEQ ID NO: 240687 - DNA, 15 bp, Homo sapiens
tttcacttccaaaag

SEQ ID NO: 240688 - DNA, 15 bp, Homo sapiens
atttcacttccaaaa

SEQ ID NO: 240689 - DNA, 15 bp, Homo sapiens
tatttcacttccaaa

SEQ ID NO: 240690 - DNA, 15 bp, Homo sapiens
atatttcacttccaa

SEQ ID NO: 240691 - DNA, 15 bp, Homo sapiens
aatatttcacttcca

SEQ ID NO: 240692 - DNA, 15 bp, Homo sapiens
caatatttcacttcc

SEQ ID NO: 240693 - DNA, 15 bp, Homo sapiens
acaatatttcacttc

SEQ ID NO: 240694 - DNA, 15 bp, Homo sapiens
cacaatatttcactt

SEQ ID NO: 240695 - DNA, 15 bp, Homo sapiens
tcacaatatttcact

SEQ ID NO: 240696 - DNA, 15 bp, Homo sapiens
ttcacaatatttcac

SEQ ID NO: 240697 - DNA, 15 bp, Homo sapiens
tttcacaatatttca

SEQ ID NO: 240698 - DNA, 15 bp, Homo sapiens
atttcacaatatttc

SEQ ID NO: 240699 - DNA, 15 bp, Homo sapiens
aatttcacaatattt

SEQ ID NO: 240700 - DNA, 15 bp, Homo sapiens
aaatttcacaatatt

SEQ ID NO: 240701 - DNA, 15 bp, Homo sapiens
taaatttcacaatat

SEQ ID NO: 240702 - DNA, 15 bp, Homo sapiens
ataaatttcacaata

SEQ ID NO: 240703 - DNA, 15 bp, Homo sapiens
tataaatttcacaat

SEQ ID NO: 240704 - DNA, 15 bp, Homo sapiens
gtataaatttcacaa

SEQ ID NO: 240705 - DNA, 15 bp, Homo sapiens
tgtataaatttcaca

SEQ ID NO: 240706 - DNA, 15 bp, Homo sapiens
gtgtataaatttcac

SEQ ID NO: 240707 - DNA, 15 bp, Homo sapiens
tgtgtataaatttca

SEQ ID NO: 240708 - DNA, 15 bp, Homo sapiens
atgtgtataaatttc

SEQ ID NO: 240709 - DNA, 15 bp, Homo sapiens
aatgtgtataaattt

SEQ ID NO: 240710 - DNA, 15 bp, Homo sapiens
aaatgtgtataaatt

SEQ ID NO: 240711 - DNA, 15 bp, Homo sapiens
aaaatgtgtataaat

SEQ ID NO: 240712 - DNA, 15 bp, Homo sapiens
aaaaatgtgtataaa

SEQ ID NO: 240713 - DNA, 15 bp, Homo sapiens
caaaaatgtgtataa

SEQ ID NO: 240714 - DNA, 15 bp, Homo sapiens
acaaaaatgtgtata

SEQ ID NO: 240715 - DNA, 15 bp, Homo sapiens
tacaaaaatgtgtat

SEQ ID NO: 240716 - DNA, 15 bp, Homo sapiens
ttacaaaaatgtgta

SEQ ID NO: 240717 - DNA, 15 bp, Homo sapiens
tttacaaaaatgtgt

SEQ ID NO: 240718 - DNA, 15 bp, Homo sapiens
ttttacaaaaatgtg

SEQ ID NO: 240719 - DNA, 15 bp, Homo sapiens
cttttacaaaaatgt

SEQ ID NO: 240720 - DNA, 15 bp, Homo sapiens
acttttacaaaaatg

SEQ ID NO: 240721 - DNA, 15 bp, Homo sapiens
gacttttacaaaaat

SEQ ID NO: 240722 - DNA, 15 bp, Homo sapiens
tgacttttacaaaaa

SEQ ID NO: 240723 - DNA, 15 bp, Homo sapiens
ttgacttttacaaaa

SEQ ID NO: 240724 - DNA, 15 bp, Homo sapiens
tttgacttttacaaa

SEQ ID NO: 240725 - DNA, 15 bp, Homo sapiens
atttgacttttacaa

SEQ ID NO: 240726 - DNA, 15 bp, Homo sapiens
tatttgacttttaca

SEQ ID NO: 240727 - DNA, 15 bp, Homo sapiens
gtatttgacttttac

SEQ ID NO: 240728 - DNA, 15 bp, Homo sapiens
tgtatttgactttta

SEQ ID NO: 240729 - DNA, 15 bp, Homo sapiens
atgtatttgactttt

SEQ ID NO: 240730 - DNA, 15 bp, Homo sapiens
catgtatttgacttt

SEQ ID NO: 240731 - DNA, 15 bp, Homo sapiens
ccatgtatttgactt

SEQ ID NO: 240732 - DNA, 15 bp, Homo sapiens
gccatgtatttgact

SEQ ID NO: 240733 - DNA, 15 bp, Homo sapiens
ggccatgtatttgac

SEQ ID NO: 240734 - DNA, 15 bp, Homo sapiens
aggccatgtatttga

SEQ ID NO: 240735 - DNA, 15 bp, Homo sapiens
aaggccatgtatttg

SEQ ID NO: 240736 - DNA, 15 bp, Homo sapiens
caaggccatgtattt

SEQ ID NO: 240737 - DNA, 15 bp, Homo sapiens
acaaggccatgtatt

SEQ ID NO: 240738 - DNA, 15 bp, Homo sapiens
tacaaggccatgtat

SEQ ID NO: 240739 - DNA, 15 bp, Homo sapiens
atacaaggccatgta

SEQ ID NO: 240740 - DNA, 15 bp, Homo sapiens
aatacaaggccatgt

SEQ ID NO: 240741 - DNA, 15 bp, Homo sapiens
taatacaaggccatg

SEQ ID NO: 240742 - DNA, 15 bp, Homo sapiens
ataatacaaggccat

SEQ ID NO: 240743 - DNA, 15 bp, Homo sapiens
gataatacaaggcca

SEQ ID NO: 240744 - DNA, 15 bp, Homo sapiens
agataatacaaggcc

SEQ ID NO: 240745 - DNA, 15 bp, Homo sapiens
tagataatacaaggc

SEQ ID NO: 240746 - DNA, 15 bp, Homo sapiens
ttagataatacaagg

SEQ ID NO: 240747 - DNA, 15 bp, Homo sapiens
gttagataatacaag

SEQ ID NO: 240748 - DNA, 15 bp, Homo sapiens
tgttagataatacaa

SEQ ID NO: 240749 - DNA, 15 bp, Homo sapiens
gtgttagataataca

SEQ ID NO: 240750 - DNA, 15 bp, Homo sapiens
agtgttagataatac

SEQ ID NO: 240751 - DNA, 15 bp, Homo sapiens
cagtgttagataata

SEQ ID NO: 240752 - DNA, 15 bp, Homo sapiens
tcagtgttagataat

SEQ ID NO: 240753 - DNA, 15 bp, Homo sapiens
ctcagtgttagataa

SEQ ID NO: 240754 - DNA, 15 bp, Homo sapiens
tctcagtgttagata

SEQ ID NO: 240755 - DNA, 15 bp, Homo sapiens
ttctcagtgttagat

SEQ ID NO: 240756 - DNA, 15 bp, Homo sapiens
attctcagtgttaga

SEQ ID NO: 240757 - DNA, 15 bp, Homo sapiens
gattctcagtgttag

SEQ ID NO: 240758 - DNA, 15 bp, Homo sapiens
ggattctcagtgtta

SEQ ID NO: 240759 - DNA, 15 bp, Homo sapiens
tggattctcagtgtt

SEQ ID NO: 240760 - DNA, 15 bp, Homo sapiens
ttggattctcagtgt

SEQ ID NO: 240761 - DNA, 15 bp, Homo sapiens
cttggattctcagtg

SEQ ID NO: 240762 - DNA, 15 bp, Homo sapiens
ccttggattctcagt

SEQ ID NO: 240763 - DNA, 15 bp, Homo sapiens
tccttggattctcag

SEQ ID NO: 240764 - DNA, 15 bp, Homo sapiens
ctccttggattctca

SEQ ID NO: 240765 - DNA, 15 bp, Homo sapiens
cctccttggattctc

SEQ ID NO: 240766 - DNA, 15 bp, Homo sapiens
acctccttggattct

SEQ ID NO: 240767 - DNA, 15 bp, Homo sapiens
tacctccttggattc

SEQ ID NO: 240768 - DNA, 15 bp, Homo sapiens
ctacctccttggatt

SEQ ID NO: 240769 - DNA, 15 bp, Homo sapiens
tctacctccttggat

SEQ ID NO: 240770 - DNA, 15 bp, Homo sapiens
ttctacctccttgga

SEQ ID NO: 240771 - DNA, 15 bp, Homo sapiens
cttctacctccttgg

SEQ ID NO: 240772 - DNA, 15 bp, Homo sapiens
acttctacctccttg

SEQ ID NO: 240773 - DNA, 15 bp, Homo sapiens
aacttctacctcctt

SEQ ID NO: 240774 - DNA, 15 bp, Homo sapiens
taacttctacctcct

SEQ ID NO: 240775 - DNA, 15 bp, Homo sapiens
ataacttctacctcc

SEQ ID NO: 240776 - DNA, 15 bp, Homo sapiens
aataacttctacctc

SEQ ID NO: 240777 - DNA, 15 bp, Homo sapiens
gaataacttctacct

SEQ ID NO: 240778 - DNA, 15 bp, Homo sapiens
tgaataacttctacc

SEQ ID NO: 240779 - DNA, 15 bp, Homo sapiens
ttgaataacttctac

SEQ ID NO: 240780 - DNA, 15 bp, Homo sapiens
tttgaataacttcta

SEQ ID NO: 240781 - DNA, 15 bp, Homo sapiens
atttgaataacttct

SEQ ID NO: 240782 - DNA, 15 bp, Homo sapiens
gatttgaataacttc

SEQ ID NO: 240783 - DNA, 15 bp, Homo sapiens
tgatttgaataactt

SEQ ID NO: 240784 - DNA, 15 bp, Homo sapiens
ttgatttgaataact

SEQ ID NO: 240785 - DNA, 15 bp, Homo sapiens
tttgatttgaataac

SEQ ID NO: 240786 - DNA, 15 bp, Homo sapiens
ttttgatttgaataa

SEQ ID NO: 240787 - DNA, 15 bp, Homo sapiens
gttttgatttgaata

SEQ ID NO: 240788 - DNA, 15 bp, Homo sapiens
tgttttgatttgaat

SEQ ID NO: 240789 - DNA, 15 bp, Homo sapiens
ttgttttgatttgaa

SEQ ID NO: 240790 - DNA, 15 bp, Homo sapiens
attgttttgatttga

SEQ ID NO: 240791 - DNA, 15 bp, Homo sapiens
aattgttttgatttg

SEQ ID NO: 240792 - DNA, 15 bp, Homo sapiens
taattgttttgattt

SEQ ID NO: 240793 - DNA, 15 bp, Homo sapiens
ataattgttttgatt

SEQ ID NO: 240794 - DNA, 15 bp, Homo sapiens
aataattgttttgat

SEQ ID NO: 240795 - DNA, 15 bp, Homo sapiens
taataattgttttga

SEQ ID NO: 240796 - DNA, 15 bp, Homo sapiens
ttaataattgttttg

SEQ ID NO: 240797 - DNA, 15 bp, Homo sapiens
tttaataattgtttt

SEQ ID NO: 240798 - DNA, 15 bp, Homo sapiens
ttttaataattgttt

SEQ ID NO: 240799 - DNA, 15 bp, Homo sapiens
attttaataattgtt

SEQ ID NO: 240800 - DNA, 15 bp, Homo sapiens
cattttaataattgt

SEQ ID NO: 240801 - DNA, 15 bp, Homo sapiens
tcattttaataattg

SEQ ID NO: 240802 - DNA, 15 bp, Homo sapiens
ctcattttaataatt

SEQ ID NO: 240803 - DNA, 15 bp, Homo sapiens
actcattttaataat

SEQ ID NO: 240804 - DNA, 15 bp, Homo sapiens
cactcattttaataa

SEQ ID NO: 240805 - DNA, 15 bp, Homo sapiens
ccactcattttaata

SEQ ID NO: 240806 - DNA, 15 bp, Homo sapiens
cccactcattttaat

SEQ ID NO: 240807 - DNA, 15 bp, Homo sapiens
ccccactcattttaa

SEQ ID NO: 240808 - DNA, 15 bp, Homo sapiens
tccccactcatttta

SEQ ID NO: 240809 - DNA, 15 bp, Homo sapiens
ttccccactcatttt

SEQ ID NO: 240810 - DNA, 15 bp, Homo sapiens
cttccccactcattt

SEQ ID NO: 240811 - DNA, 15 bp, Homo sapiens
acttccccactcatt

SEQ ID NO: 240812 - DNA, 15 bp, Homo sapiens
cacttccccactcat

SEQ ID NO: 240813 - DNA, 15 bp, Homo sapiens
acacttccccactca

SEQ ID NO: 240814 - DNA, 15 bp, Homo sapiens
tacacttccccactc

SEQ ID NO: 240815 - DNA, 15 bp, Homo sapiens
ttacacttccccact

SEQ ID NO: 240816 - DNA, 15 bp, Homo sapiens
tttacacttccccac

SEQ ID NO: 240817 - DNA, 15 bp, Homo sapiens
gtttacacttcccca

SEQ ID NO: 240818 - DNA, 15 bp, Homo sapiens
tgtttacacttcccc

SEQ ID NO: 240819 - DNA, 15 bp, Homo sapiens
ttgtttacacttccc

SEQ ID NO: 240820 - DNA, 15 bp, Homo sapiens
tttgtttacacttcc

SEQ ID NO: 240821 - DNA, 15 bp, Homo sapiens
ctttgtttacacttc

SEQ ID NO: 240822 - DNA, 15 bp, Homo sapiens
actttgtttacactt

SEQ ID NO: 240823 - DNA, 15 bp, Homo sapiens
gactttgtttacact

SEQ ID NO: 240824 - DNA, 15 bp, Homo sapiens
ggactttgtttacac

SEQ ID NO: 240825 - DNA, 15 bp, Homo sapiens
gggactttgtttaca

SEQ ID NO: 240826 - DNA, 15 bp, Homo sapiens
tgggactttgtttac

SEQ ID NO: 240827 - DNA, 15 bp, Homo sapiens
ttgggactttgttta

SEQ ID NO: 240828 - DNA, 15 bp, Homo sapiens
attgggactttgttt

SEQ ID NO: 240829 - DNA, 15 bp, Homo sapiens
aattgggactttgtt

SEQ ID NO: 240830 - DNA, 15 bp, Homo sapiens
taattgggactttgt

SEQ ID NO: 240831 - DNA, 15 bp, Homo sapiens
ttaattgggactttg

SEQ ID NO: 240832 - DNA, 15 bp, Homo sapiens
attaattgggacttt

SEQ ID NO: 240833 - DNA, 15 bp, Homo sapiens
tattaattgggactt

SEQ ID NO: 240834 - DNA, 15 bp, Homo sapiens
gtattaattgggact

SEQ ID NO: 240835 - DNA, 15 bp, Homo sapiens
tgtattaattgggac

SEQ ID NO: 240836 - DNA, 15 bp, Homo sapiens
atgtattaattggga

SEQ ID NO: 240837 - DNA, 15 bp, Homo sapiens
aatgtattaattggg

SEQ ID NO: 240838 - DNA, 15 bp, Homo sapiens
aaatgtattaattgg

SEQ ID NO: 240839 - DNA, 15 bp, Homo sapiens
taaatgtattaattg

SEQ ID NO: 240840 - DNA, 15 bp, Homo sapiens
ttaaatgtattaatt

SEQ ID NO: 240841 - DNA, 15 bp, Homo sapiens
attaaatgtattaat

SEQ ID NO: 240842 - DNA, 15 bp, Homo sapiens
tattaaatgtattaa

SEQ ID NO: 240843 - DNA, 15 bp, Homo sapiens
ttattaaatgtatta

SEQ ID NO: 240844 - DNA, 15 bp, Homo sapiens
attattaaatgtatt

SEQ ID NO: 240845 - DNA, 15 bp, Homo sapiens
aattattaaatgtat

SEQ ID NO: 240846 - DNA, 15 bp, Homo sapiens
caattattaaatgta

SEQ ID NO: 240847 - DNA, 15 bp, Homo sapiens
acaattattaaatgt

SEQ ID NO: 240848 - DNA, 15 bp, Homo sapiens
aacaattattaaatg

SEQ ID NO: 240849 - DNA, 15 bp, Homo sapiens
taacaattattaaat

SEQ ID NO: 240850 - DNA, 15 bp, Homo sapiens
ataacaattattaaa

SEQ ID NO: 240851 - DNA, 15 bp, Homo sapiens
gataacaattattaa

SEQ ID NO: 240852 - DNA, 15 bp, Homo sapiens
ggataacaattatta

SEQ ID NO: 240853 - DNA, 15 bp, Homo sapiens
aggataacaattatt

SEQ ID NO: 240854 - DNA, 15 bp, Homo sapiens
aaggataacaattat

SEQ ID NO: 240855 - DNA, 15 bp, Homo sapiens
aaaggataacaatta

SEQ ID NO: 240856 - DNA, 15 bp, Homo sapiens
caaaggataacaatt

SEQ ID NO: 240857 - DNA, 15 bp, Homo sapiens
gcaaaggataacaat

SEQ ID NO: 240858 - DNA, 15 bp, Homo sapiens
agcaaaggataacaa

SEQ ID NO: 240859 - DNA, 15 bp, Homo sapiens
cagcaaaggataaca

SEQ ID NO: 240860 - DNA, 15 bp, Homo sapiens
gcagcaaaggataac

SEQ ID NO: 240861 - DNA, 15 bp, Homo sapiens
agcagcaaaggataa

SEQ ID NO: 240862 - DNA, 15 bp, Homo sapiens
aagcagcaaaggata

SEQ ID NO: 240863 - DNA, 15 bp, Homo sapiens
caagcagcaaaggat

SEQ ID NO: 240864 - DNA, 15 bp, Homo sapiens
ccaagcagcaaagga

SEQ ID NO: 240865 - DNA, 15 bp, Homo sapiens
tccaagcagcaaagg

SEQ ID NO: 240866 - DNA, 15 bp, Homo sapiens
ttccaagcagcaaag

SEQ ID NO: 240867 - DNA, 15 bp, Homo sapiens
attccaagcagcaaa

SEQ ID NO: 240868 - DNA, 15 bp, Homo sapiens
gattccaagcagcaa

SEQ ID NO: 240869 - DNA, 15 bp, Homo sapiens
agattccaagcagca

SEQ ID NO: 240870 - DNA, 15 bp, Homo sapiens
aagattccaagcagc

SEQ ID NO: 240871 - DNA, 15 bp, Homo sapiens
aaagattccaagcag

SEQ ID NO: 240872 - DNA, 15 bp, Homo sapiens
caaagattccaagca

SEQ ID NO: 240873 - DNA, 15 bp, Homo sapiens
ccaaagattccaagc

SEQ ID NO: 240874 - DNA, 15 bp, Homo sapiens
gccaaagattccaag

SEQ ID NO: 240875 - DNA, 15 bp, Homo sapiens
agccaaagattccaa

SEQ ID NO: 240876 - DNA, 15 bp, Homo sapiens
aagccaaagattcca

SEQ ID NO: 240877 - DNA, 15 bp, Homo sapiens
aaagccaaagattcc

SEQ ID NO: 240878 - DNA, 15 bp, Homo sapiens
taaagccaaagattc

SEQ ID NO: 240879 - DNA, 15 bp, Homo sapiens
ataaagccaaagatt

SEQ ID NO: 240880 - DNA, 15 bp, Homo sapiens
aataaagccaaagat

SEQ ID NO: 240881 - DNA, 15 bp, Homo sapiens
taataaagccaaaga

SEQ ID NO: 240882 - DNA, 15 bp, Homo sapiens
ataataaagccaaag

SEQ ID NO: 240883 - DNA, 15 bp, Homo sapiens
tataataaagccaaa

SEQ ID NO: 240884 - DNA, 15 bp, Homo sapiens
atataataaagccaa

SEQ ID NO: 240885 - DNA, 15 bp, Homo sapiens
aatataataaagcca

SEQ ID NO: 240886 - DNA, 15 bp, Homo sapiens
aaatataataaagcc

SEQ ID NO: 240887 - DNA, 15 bp, Homo sapiens
gaaatataataaagc

SEQ ID NO: 240888 - DNA, 15 bp, Homo sapiens
agaaatataataaag

SEQ ID NO: 240889 - DNA, 15 bp, Homo sapiens
aagaaatataataaa

SEQ ID NO: 240890 - DNA, 15 bp, Homo sapiens
caagaaatataataa

SEQ ID NO: 240891 - DNA, 15 bp, Homo sapiens
ccaagaaatataata

SEQ ID NO: 240892 - DNA, 15 bp, Homo sapiens
tccaagaaatataat

SEQ ID NO: 240893 - DNA, 15 bp, Homo sapiens
gtccaagaaatataa

SEQ ID NO: 240894 - DNA, 15 bp, Homo sapiens
agtccaagaaatata

SEQ ID NO: 240895 - DNA, 15 bp, Homo sapiens
aagtccaagaaatat

SEQ ID NO: 240896 - DNA, 15 bp, Homo sapiens
gaagtccaagaaata

SEQ ID NO: 240897 - DNA, 15 bp, Homo sapiens
tgaagtccaagaaat

SEQ ID NO: 240898 - DNA, 15 bp, Homo sapiens
ctgaagtccaagaaa

SEQ ID NO: 240899 - DNA, 15 bp, Homo sapiens
gctgaagtccaagaa

SEQ ID NO: 240900 - DNA, 15 bp, Homo sapiens
ggctgaagtccaaga

SEQ ID NO: 240901 - DNA, 15 bp, Homo sapiens
tggctgaagtccaag

SEQ ID NO: 240902 - DNA, 15 bp, Homo sapiens
atggctgaagtccaa

SEQ ID NO: 240903 - DNA, 15 bp, Homo sapiens
catggctgaagtcca

SEQ ID NO: 240904 - DNA, 15 bp, Homo sapiens
ccatggctgaagtcc

SEQ ID NO: 240905 - DNA, 15 bp, Homo sapiens
accatggctgaagtc

SEQ ID NO: 240906 - DNA, 15 bp, Homo sapiens
aaccatggctgaagt

SEQ ID NO: 240907 - DNA, 15 bp, Homo sapiens
taaccatggctgaag

SEQ ID NO: 240908 - DNA, 15 bp, Homo sapiens
ataaccatggctgaa

SEQ ID NO: 240909 - DNA, 15 bp, Homo sapiens
tataaccatggctga

SEQ ID NO: 240910 - DNA, 15 bp, Homo sapiens
ttataaccatggctg

SEQ ID NO: 240911 - DNA, 15 bp, Homo sapiens
tttataaccatggct

SEQ ID NO: 240912 - DNA, 15 bp, Homo sapiens
ttttataaccatggc

SEQ ID NO: 240913 - DNA, 15 bp, Homo sapiens
cttttataaccatgg

SEQ ID NO: 240914 - DNA, 15 bp, Homo sapiens
tcttttataaccatg

SEQ ID NO: 240915 - DNA, 15 bp, Homo sapiens
ttcttttataaccat

SEQ ID NO: 240916 - DNA, 15 bp, Homo sapiens
cttcttttataacca

SEQ ID NO: 240917 - DNA, 15 bp, Homo sapiens
gcttcttttataacc

SEQ ID NO: 240918 - DNA, 15 bp, Homo sapiens
ggcttcttttataac

SEQ ID NO: 240919 - DNA, 15 bp, Homo sapiens
aggcttcttttataa

SEQ ID NO: 240920 - DNA, 15 bp, Homo sapiens
caggcttcttttata

SEQ ID NO: 240921 - DNA, 15 bp, Homo sapiens
acaggcttcttttat

SEQ ID NO: 240922 - DNA, 15 bp, Homo sapiens
aacaggcttctttta

SEQ ID NO: 240923 - DNA, 15 bp, Homo sapiens
aaacaggcttctttt

SEQ ID NO: 240924 - DNA, 15 bp, Homo sapiens
taaacaggcttcttt

SEQ ID NO: 240925 - DNA, 15 bp, Homo sapiens
ctaaacaggcttctt

SEQ ID NO: 240926 - DNA, 15 bp, Homo sapiens
actaaacaggcttct

SEQ ID NO: 240927 - DNA, 15 bp, Homo sapiens
aactaaacaggcttc

SEQ ID NO: 240928 - DNA, 15 bp, Homo sapiens
taactaaacaggctt

SEQ ID NO: 240929 - DNA, 15 bp, Homo sapiens
ctaactaaacaggct

SEQ ID NO: 240930 - DNA, 15 bp, Homo sapiens
cctaactaaacaggc

SEQ ID NO: 240931 - DNA, 15 bp, Homo sapiens
gcctaactaaacagg

SEQ ID NO: 240932 - DNA, 15 bp, Homo sapiens
tgcctaactaaacag

SEQ ID NO: 240933 - DNA, 15 bp, Homo sapiens
gtgcctaactaaaca

SEQ ID NO: 240934 - DNA, 15 bp, Homo sapiens
tgtgcctaactaaac

SEQ ID NO: 240935 - DNA, 15 bp, Homo sapiens
ttgtgcctaactaaa

SEQ ID NO: 240936 - DNA, 15 bp, Homo sapiens
tttgtgcctaactaa

SEQ ID NO: 240937 - DNA, 15 bp, Homo sapiens
ttttgtgcctaacta

SEQ ID NO: 240938 - DNA, 15 bp, Homo sapiens
attttgtgcctaact

SEQ ID NO: 240939 - DNA, 15 bp, Homo sapiens
tattttgtgcctaac

SEQ ID NO: 240940 - DNA, 15 bp, Homo sapiens
ttattttgtgcctaa

SEQ ID NO: 240941 - DNA, 15 bp, Homo sapiens
tttattttgtgccta

SEQ ID NO: 240942 - DNA, 15 bp, Homo sapiens
ttttattttgtgcct

SEQ ID NO: 240943 - DNA, 15 bp, Homo sapiens
tttttattttgtgcc

SEQ ID NO: 240944 - DNA, 15 bp, Homo sapiens
gtttttattttgtgc

SEQ ID NO: 240945 - DNA, 15 bp, Homo sapiens
agtttttattttgtg

SEQ ID NO: 240946 - DNA, 15 bp, Homo sapiens
cagtttttattttgt

SEQ ID NO: 240947 - DNA, 15 bp, Homo sapiens
tcagtttttattttg

SEQ ID NO: 240948 - DNA, 15 bp, Homo sapiens
gtcagtttttatttt

SEQ ID NO: 240949 - DNA, 15 bp, Homo sapiens
ggtcagtttttattt

SEQ ID NO: 240950 - DNA, 15 bp, Homo sapiens
aggtcagtttttatt

SEQ ID NO: 240951 - DNA, 15 bp, Homo sapiens
taggtcagtttttat

SEQ ID NO: 240952 - DNA, 15 bp, Homo sapiens
ataggtcagttttta

SEQ ID NO: 240953 - DNA, 15 bp, Homo sapiens
aataggtcagttttt

SEQ ID NO: 240954 - DNA, 15 bp, Homo sapiens
taataggtcagtttt

SEQ ID NO: 240955 - DNA, 15 bp, Homo sapiens
ctaataggtcagttt

SEQ ID NO: 240956 - DNA, 15 bp, Homo sapiens
gctaataggtcagtt

SEQ ID NO: 240957 - DNA, 15 bp, Homo sapiens
ggctaataggtcagt

SEQ ID NO: 240958 - DNA, 15 bp, Homo sapiens
aggctaataggtcag

SEQ ID NO: 240959 - DNA, 15 bp, Homo sapiens
caggctaataggtca

SEQ ID NO: 240960 - DNA, 15 bp, Homo sapiens
ccaggctaataggtc

SEQ ID NO: 240961 - DNA, 15 bp, Homo sapiens
accaggctaataggt

SEQ ID NO: 240962 - DNA, 15 bp, Homo sapiens
caccaggctaatagg

SEQ ID NO: 240963 - DNA, 15 bp, Homo sapiens
gcaccaggctaatag

SEQ ID NO: 240964 - DNA, 15 bp, Homo sapiens
ggcaccaggctaata

SEQ ID NO: 240965 - DNA, 15 bp, Homo sapiens
tggcaccaggctaat

SEQ ID NO: 240966 - DNA, 15 bp, Homo sapiens
ttggcaccaggctaa

SEQ ID NO: 240967 - DNA, 15 bp, Homo sapiens
gttggcaccaggcta

SEQ ID NO: 240968 - DNA, 15 bp, Homo sapiens
tgttggcaccaggct

SEQ ID NO: 240969 - DNA, 15 bp, Homo sapiens
gtgttggcaccaggc

SEQ ID NO: 240970 - DNA, 15 bp, Homo sapiens
agtgttggcaccagg

SEQ ID NO: 240971 - DNA, 15 bp, Homo sapiens
cagtgttggcaccag

SEQ ID NO: 240972 - DNA, 15 bp, Homo sapiens
tcagtgttggcacca

SEQ ID NO: 240973 - DNA, 15 bp, Homo sapiens
ttcagtgttggcacc

SEQ ID NO: 240974 - DNA, 15 bp, Homo sapiens
tttcagtgttggcac

SEQ ID NO: 240975 - DNA, 15 bp, Homo sapiens
atttcagtgttggca

SEQ ID NO: 240976 - DNA, 15 bp, Homo sapiens
catttcagtgttggc

SEQ ID NO: 240977 - DNA, 15 bp, Homo sapiens
tcatttcagtgttgg

SEQ ID NO: 240978 - DNA, 15 bp, Homo sapiens
ctcatttcagtgttg

SEQ ID NO: 240979 - DNA, 15 bp, Homo sapiens
cctcatttcagtgtt

SEQ ID NO: 240980 - DNA, 15 bp, Homo sapiens
acctcatttcagtgt

SEQ ID NO: 240981 - DNA, 15 bp, Homo sapiens
aacctcatttcagtg

SEQ ID NO: 240982 - DNA, 15 bp, Homo sapiens
caacctcatttcagt

SEQ ID NO: 240983 - DNA, 15 bp, Homo sapiens
ccaacctcatttcag

SEQ ID NO: 240984 - DNA, 15 bp, Homo sapiens
gccaacctcatttca

SEQ ID NO: 240985 - DNA, 15 bp, Homo sapiens
agccaacctcatttc

SEQ ID NO: 240986 - DNA, 15 bp, Homo sapiens
gagccaacctcattt

SEQ ID NO: 240987 - DNA, 15 bp, Homo sapiens
agagccaacctcatt

SEQ ID NO: 240988 - DNA, 15 bp, Homo sapiens
tagagccaacctcat

SEQ ID NO: 240989 - DNA, 15 bp, Homo sapiens
ttagagccaacctca

SEQ ID NO: 240990 - DNA, 15 bp, Homo sapiens
attagagccaacctc

SEQ ID NO: 240991 - DNA, 15 bp, Homo sapiens
cattagagccaacct

SEQ ID NO: 240992 - DNA, 15 bp, Homo sapiens
tcattagagccaacc

SEQ ID NO: 240993 - DNA, 15 bp, Homo sapiens
ctcattagagccaac

SEQ ID NO: 240994 - DNA, 15 bp, Homo sapiens
tctcattagagccaa

SEQ ID NO: 240995 - DNA, 15 bp, Homo sapiens
ttctcattagagcca

SEQ ID NO: 240996 - DNA, 15 bp, Homo sapiens
tttctcattagagcc

SEQ ID NO: 240997 - DNA, 15 bp, Homo sapiens
atttctcattagagc

SEQ ID NO: 240998 - DNA, 15 bp, Homo sapiens
catttctcattagag

SEQ ID NO: 240999 - DNA, 15 bp, Homo sapiens
acatttctcattaga

SEQ ID NO: 241000 - DNA, 15 bp, Homo sapiens
tacatttctcattag

SEQ ID NO: 241001 - DNA, 15 bp, Homo sapiens
ttacatttctcatta

SEQ ID NO: 241002 - DNA, 15 bp, Homo sapiens
gttacatttctcatt

SEQ ID NO: 241003 - DNA, 15 bp, Homo sapiens
tgttacatttctcat

SEQ ID NO: 241004 - DNA, 15 bp, Homo sapiens
atgttacatttctca

SEQ ID NO: 241005 - DNA, 15 bp, Homo sapiens
tatgttacatttctc

SEQ ID NO: 241006 - DNA, 15 bp, Homo sapiens
gtatgttacatttct

SEQ ID NO: 241007 - DNA, 15 bp, Homo sapiens
ggtatgttacatttc

SEQ ID NO: 241008 - DNA, 15 bp, Homo sapiens
aggtatgttacattt

SEQ ID NO: 241009 - DNA, 15 bp, Homo sapiens
taggtatgttacatt

SEQ ID NO: 241010 - DNA, 15 bp, Homo sapiens
gtaggtatgttacat

SEQ ID NO: 241011 - DNA, 15 bp, Homo sapiens
agtaggtatgttaca

SEQ ID NO: 241012 - DNA, 15 bp, Homo sapiens
aagtaggtatgttac

SEQ ID NO: 241013 - DNA, 15 bp, Homo sapiens
gaagtaggtatgtta

SEQ ID NO: 241014 - DNA, 15 bp, Homo sapiens
ggaagtaggtatgtt

SEQ ID NO: 241015 - DNA, 15 bp, Homo sapiens
aggaagtaggtatgt

SEQ ID NO: 241016 - DNA, 15 bp, Homo sapiens
gaggaagtaggtatg

SEQ ID NO: 241017 - DNA, 15 bp, Homo sapiens
tgaggaagtaggtat

SEQ ID NO: 241018 - DNA, 15 bp, Homo sapiens
atgaggaagtaggta

SEQ ID NO: 241019 - DNA, 15 bp, Homo sapiens
aatgaggaagtaggt

SEQ ID NO: 241020 - DNA, 15 bp, Homo sapiens
aaatgaggaagtagg

SEQ ID NO: 241021 - DNA, 15 bp, Homo sapiens
aaaatgaggaagtag

SEQ ID NO: 241022 - DNA, 15 bp, Homo sapiens
gaaaatgaggaagta

SEQ ID NO: 241023 - DNA, 15 bp, Homo sapiens
tgaaaatgaggaagt

SEQ ID NO: 241024 - DNA, 15 bp, Homo sapiens
atgaaaatgaggaag

SEQ ID NO: 241025 - DNA, 15 bp, Homo sapiens
gatgaaaatgaggaa

SEQ ID NO: 241026 - DNA, 15 bp, Homo sapiens
ggatgaaaatgagga

SEQ ID NO: 241027 - DNA, 15 bp, Homo sapiens
gggatgaaaatgagg

SEQ ID NO: 241028 - DNA, 15 bp, Homo sapiens
agggatgaaaatgag

SEQ ID NO: 241029 - DNA, 15 bp, Homo sapiens
cagggatgaaaatga

SEQ ID NO: 241030 - DNA, 15 bp, Homo sapiens
acagggatgaaaatg

SEQ ID NO: 241031 - DNA, 15 bp, Homo sapiens
aacagggatgaaaat

SEQ ID NO: 241032 - DNA, 15 bp, Homo sapiens
aaacagggatgaaaa

SEQ ID NO: 241033 - DNA, 15 bp, Homo sapiens
taaacagggatgaaa

SEQ ID NO: 241034 - DNA, 15 bp, Homo sapiens
ataaacagggatgaa

SEQ ID NO: 241035 - DNA, 15 bp, Homo sapiens
tataaacagggatga

SEQ ID NO: 241036 - DNA, 15 bp, Homo sapiens
gtataaacagggatg

SEQ ID NO: 241037 - DNA, 15 bp, Homo sapiens
agtataaacagggat

SEQ ID NO: 241038 - DNA, 15 bp, Homo sapiens
aagtataaacaggga

SEQ ID NO: 241039 - DNA, 15 bp, Homo sapiens
aaagtataaacaggg

SEQ ID NO: 241040 - DNA, 15 bp, Homo sapiens
caaagtataaacagg

SEQ ID NO: 241041 - DNA, 15 bp, Homo sapiens
ccaaagtataaacag

SEQ ID NO: 241042 - DNA, 15 bp, Homo sapiens
accaaagtataaaca

SEQ ID NO: 241043 - DNA, 15 bp, Homo sapiens
caccaaagtataaac

SEQ ID NO: 241044 - DNA, 15 bp, Homo sapiens
ccaccaaagtataaa

SEQ ID NO: 241045 - DNA, 15 bp, Homo sapiens
cccaccaaagtataa

SEQ ID NO: 241046 - DNA, 15 bp, Homo sapiens
gcccaccaaagtata

SEQ ID NO: 241047 - DNA, 15 bp, Homo sapiens
tgcccaccaaagtat

SEQ ID NO: 241048 - DNA, 15 bp, Homo sapiens
atgcccaccaaagta

SEQ ID NO: 241049 - DNA, 15 bp, Homo sapiens
tatgcccaccaaagt

SEQ ID NO: 241050 - DNA, 15 bp, Homo sapiens
ctatgcccaccaaag

SEQ ID NO: 241051 - DNA, 15 bp, Homo sapiens
tctatgcccaccaaa

SEQ ID NO: 241052 - DNA, 15 bp, Homo sapiens
atctatgcccaccaa

SEQ ID NO: 241053 - DNA, 15 bp, Homo sapiens
aatctatgcccacca

SEQ ID NO: 241054 - DNA, 15 bp, Homo sapiens
caatctatgcccacc

SEQ ID NO: 241055 - DNA, 15 bp, Homo sapiens
tcaatctatgcccac

SEQ ID NO: 241056 - DNA, 15 bp, Homo sapiens
ctcaatctatgccca

SEQ ID NO: 241057 - DNA, 15 bp, Homo sapiens
tctcaatctatgccc

SEQ ID NO: 241058 - DNA, 15 bp, Homo sapiens
ttctcaatctatgcc

SEQ ID NO: 241059 - DNA, 15 bp, Homo sapiens
gttctcaatctatgc

SEQ ID NO: 241060 - DNA, 15 bp, Homo sapiens
tgttctcaatctatg

SEQ ID NO: 241061 - DNA, 15 bp, Homo sapiens
ctgttctcaatctat

SEQ ID NO: 241062 - DNA, 15 bp, Homo sapiens
tctgttctcaatcta

SEQ ID NO: 241063 - DNA, 15 bp, Homo sapiens
ctctgttctcaatct

SEQ ID NO: 241064 - DNA, 15 bp, Homo sapiens
actctgttctcaatc

SEQ ID NO: 241065 - DNA, 15 bp, Homo sapiens
cactctgttctcaat

SEQ ID NO: 241066 - DNA, 15 bp, Homo sapiens
gcactctgttctcaa

SEQ ID NO: 241067 - DNA, 15 bp, Homo sapiens
agcactctgttctca

SEQ ID NO: 241068 - DNA, 15 bp, Homo sapiens
aagcactctgttctc

SEQ ID NO: 241069 - DNA, 15 bp, Homo sapiens
caagcactctgttct

SEQ ID NO: 241070 - DNA, 15 bp, Homo sapiens
gcaagcactctgttc

SEQ ID NO: 241071 - DNA, 15 bp, Homo sapiens
ggcaagcactctgtt

SEQ ID NO: 241072 - DNA, 15 bp, Homo sapiens
aggcaagcactctgt

SEQ ID NO: 241073 - DNA, 15 bp, Homo sapiens
aaggcaagcactctg

SEQ ID NO: 241074 - DNA, 15 bp, Homo sapiens
aaaggcaagcactct

SEQ ID NO: 241075 - DNA, 15 bp, Homo sapiens
aaaaggcaagcactc

SEQ ID NO: 241076 - DNA, 15 bp, Homo sapiens
taaaaggcaagcact

SEQ ID NO: 241077 - DNA, 15 bp, Homo sapiens
ataaaaggcaagcac

SEQ ID NO: 241078 - DNA, 15 bp, Homo sapiens
tataaaaggcaagca

SEQ ID NO: 241079 - DNA, 15 bp, Homo sapiens
ttataaaaggcaagc

SEQ ID NO: 241080 - DNA, 15 bp, Homo sapiens
tttataaaaggcaag

SEQ ID NO: 241081 - DNA, 15 bp, Homo sapiens
ctttataaaaggcaa

SEQ ID NO: 241082 - DNA, 15 bp, Homo sapiens
tctttataaaaggca

SEQ ID NO: 241083 - DNA, 15 bp, Homo sapiens
ctctttataaaaggc

SEQ ID NO: 241084 - DNA, 15 bp, Homo sapiens
tctctttataaaagg

SEQ ID NO: 241085 - DNA, 15 bp, Homo sapiens
ctctctttataaaag

SEQ ID NO: 241086 - DNA, 15 bp, Homo sapiens
cctctctttataaaa

SEQ ID NO: 241087 - DNA, 15 bp, Homo sapiens
tcctctctttataaa

SEQ ID NO: 241088 - DNA, 15 bp, Homo sapiens
ctcctctctttataa

SEQ ID NO: 241089 - DNA, 15 bp, Homo sapiens
cctcctctctttata

SEQ ID NO: 241090 - DNA, 15 bp, Homo sapiens
tcctcctctctttat

SEQ ID NO: 241091 - DNA, 15 bp, Homo sapiens
ttcctcctctcttta

SEQ ID NO: 241092 - DNA, 15 bp, Homo sapiens
attcctcctctcttt

SEQ ID NO: 241093 - DNA, 15 bp, Homo sapiens
aattcctcctctctt

SEQ ID NO: 241094 - DNA, 15 bp, Homo sapiens
caattcctcctctct

SEQ ID NO: 241095 - DNA, 15 bp, Homo sapiens
acaattcctcctctc

SEQ ID NO: 241096 - DNA, 15 bp, Homo sapiens
aacaattcctcctct

SEQ ID NO: 241097 - DNA, 15 bp, Homo sapiens
caacaattcctcctc

SEQ ID NO: 241098 - DNA, 15 bp, Homo sapiens
tcaacaattcctcct

SEQ ID NO: 241099 - DNA, 15 bp, Homo sapiens
ctcaacaattcctcc

SEQ ID NO: 241100 - DNA, 15 bp, Homo sapiens
actcaacaattcctc

SEQ ID NO: 241101 - DNA, 15 bp, Homo sapiens
tactcaacaattcct

SEQ ID NO: 241102 - DNA, 15 bp, Homo sapiens
ctactcaacaattcc

SEQ ID NO: 241103 - DNA, 15 bp, Homo sapiens
tctactcaacaattc

SEQ ID NO: 241104 - DNA, 15 bp, Homo sapiens
ttctactcaacaatt

SEQ ID NO: 241105 - DNA, 15 bp, Homo sapiens
cttctactcaacaat

SEQ ID NO: 241106 - DNA, 15 bp, Homo sapiens
tcttctactcaacaa

SEQ ID NO: 241107 - DNA, 15 bp, Homo sapiens
ttcttctactcaaca

SEQ ID NO: 241108 - DNA, 15 bp, Homo sapiens
attcttctactcaac

SEQ ID NO: 241109 - DNA, 15 bp, Homo sapiens
aattcttctactcaa

SEQ ID NO: 241110 - DNA, 15 bp, Homo sapiens
caattcttctactca

SEQ ID NO: 241111 - DNA, 15 bp, Homo sapiens
gcaattcttctactc

SEQ ID NO: 241112 - DNA, 15 bp, Homo sapiens
agcaattcttctact

SEQ ID NO: 241113 - DNA, 15 bp, Homo sapiens
gagcaattcttctac

SEQ ID NO: 241114 - DNA, 15 bp, Homo sapiens
tgagcaattcttcta

SEQ ID NO: 241115 - DNA, 15 bp, Homo sapiens
ctgagcaattcttct

SEQ ID NO: 241116 - DNA, 15 bp, Homo sapiens
gctgagcaattcttc

SEQ ID NO: 241117 - DNA, 15 bp, Homo sapiens
agctgagcaattctt

SEQ ID NO: 241118 - DNA, 15 bp, Homo sapiens
tagctgagcaattct

SEQ ID NO: 241119 - DNA, 15 bp, Homo sapiens
ctagctgagcaattc

SEQ ID NO: 241120 - DNA, 15 bp, Homo sapiens
actagctgagcaatt

SEQ ID NO: 241121 - DNA, 15 bp, Homo sapiens
cactagctgagcaat

SEQ ID NO: 241122 - DNA, 15 bp, Homo sapiens
acactagctgagcaa

SEQ ID NO: 241123 - DNA, 15 bp, Homo sapiens
aacactagctgagca

SEQ ID NO: 241124 - DNA, 15 bp, Homo sapiens
gaacactagctgagc

SEQ ID NO: 241125 - DNA, 15 bp, Homo sapiens
tgaacactagctgag

SEQ ID NO: 241126 - DNA, 15 bp, Homo sapiens
ctgaacactagctga

SEQ ID NO: 241127 - DNA, 15 bp, Homo sapiens
tctgaacactagctg

SEQ ID NO: 241128 - DNA, 15 bp, Homo sapiens
ttctgaacactagct

SEQ ID NO: 241129 - DNA, 15 bp, Homo sapiens
tttctgaacactagc

SEQ ID NO: 241130 - DNA, 15 bp, Homo sapiens
atttctgaacactag

SEQ ID NO: 241131 - DNA, 15 bp, Homo sapiens
aatttctgaacacta

SEQ ID NO: 241132 - DNA, 15 bp, Homo sapiens
caatttctgaacact

SEQ ID NO: 241133 - DNA, 15 bp, Homo sapiens
tcaatttctgaacac

SEQ ID NO: 241134 - DNA, 15 bp, Homo sapiens
ctcaatttctgaaca

SEQ ID NO: 241135 - DNA, 15 bp, Homo sapiens
tctcaatttctgaac

SEQ ID NO: 241136 - DNA, 15 bp, Homo sapiens
atctcaatttctgaa

SEQ ID NO: 241137 - DNA, 15 bp, Homo sapiens
gatctcaatttctga

SEQ ID NO: 241138 - DNA, 15 bp, Homo sapiens
tgatctcaatttctg

SEQ ID NO: 241139 - DNA, 15 bp, Homo sapiens
gtgatctcaatttct

SEQ ID NO: 241140 - DNA, 15 bp, Homo sapiens
tgtgatctcaatttc

SEQ ID NO: 241141 - DNA, 15 bp, Homo sapiens
atgtgatctcaattt

SEQ ID NO: 241142 - DNA, 15 bp, Homo sapiens
gatgtgatctcaatt

SEQ ID NO: 241143 - DNA, 15 bp, Homo sapiens
agatgtgatctcaat

SEQ ID NO: 241144 - DNA, 15 bp, Homo sapiens
cagatgtgatctcaa

SEQ ID NO: 241145 - DNA, 15 bp, Homo sapiens
tcagatgtgatctca

SEQ ID NO: 241146 - DNA, 15 bp, Homo sapiens
ctcagatgtgatctc

SEQ ID NO: 241147 - DNA, 15 bp, Homo sapiens
gctcagatgtgatct

SEQ ID NO: 241148 - DNA, 15 bp, Homo sapiens
agctcagatgtgatc

SEQ ID NO: 241149 - DNA, 15 bp, Homo sapiens
gagctcagatgtgat

SEQ ID NO: 241150 - DNA, 15 bp, Homo sapiens
cgagctcagatgtga

SEQ ID NO: 241151 - DNA, 15 bp, Homo sapiens
tcgagctcagatgtg

SEQ ID NO: 241152 - DNA, 15 bp, Homo sapiens
gtcgagctcagatgt

SEQ ID NO: 241153 - DNA, 15 bp, Homo sapiens
ggtcgagctcagatg

SEQ ID NO: 241154 - DNA, 15 bp, Homo sapiens
cggtcgagctcagat

SEQ ID NO: 241155 - DNA, 15 bp, Homo sapiens
acggtcgagctcaga

SEQ ID NO: 241156 - DNA, 15 bp, Homo sapiens
aacggtcgagctcag

SEQ ID NO: 241157 - DNA, 15 bp, Homo sapiens
aaacggtcgagctca

SEQ ID NO: 241158 - DNA, 15 bp, Homo sapiens
taaacggtcgagctc

SEQ ID NO: 241159 - DNA, 15 bp, Homo sapiens
ataaacggtcgagct

SEQ ID NO: 241160 - DNA, 15 bp, Homo sapiens
aataaacggtcgagc

SEQ ID NO: 241161 - DNA, 15 bp, Homo sapiens
aaataaacggtcgag

SEQ ID NO: 241162 - DNA, 15 bp, Homo sapiens
taaataaacggtcga

SEQ ID NO: 241163 - DNA, 15 bp, Homo sapiens
gtaaataaacggtcg

SEQ ID NO: 241164 - DNA, 15 bp, Homo sapiens
agtaaataaacggtc

SEQ ID NO: 241165 - DNA, 15 bp, Homo sapiens
cagtaaataaacggt

SEQ ID NO: 241166 - DNA, 15 bp, Homo sapiens
ccagtaaataaacgg

SEQ ID NO: 241167 - DNA, 15 bp, Homo sapiens
gccagtaaataaacg

SEQ ID NO: 241168 - DNA, 15 bp, Homo sapiens
agccagtaaataaac

SEQ ID NO: 241169 - DNA, 15 bp, Homo sapiens
cagccagtaaataaa

SEQ ID NO: 241170 - DNA, 15 bp, Homo sapiens
acagccagtaaataa

SEQ ID NO: 241171 - DNA, 15 bp, Homo sapiens
gacagccagtaaata

SEQ ID NO: 241172 - DNA, 15 bp, Homo sapiens
tgacagccagtaaat

SEQ ID NO: 241173 - DNA, 15 bp, Homo sapiens
gtgacagccagtaaa

SEQ ID NO: 241174 - DNA, 15 bp, Homo sapiens
agtgacagccagtaa

SEQ ID NO: 241175 - DNA, 15 bp, Homo sapiens
gagtgacagccagta

SEQ ID NO: 241176 - DNA, 15 bp, Homo sapiens
agagtgacagccagt

SEQ ID NO: 241177 - DNA, 15 bp, Homo sapiens
aagagtgacagccag

SEQ ID NO: 241178 - DNA, 15 bp, Homo sapiens
aaagagtgacagcca

SEQ ID NO: 241179 - DNA, 15 bp, Homo sapiens
caaagagtgacagcc

SEQ ID NO: 241180 - DNA, 15 bp, Homo sapiens
ccaaagagtgacagc

SEQ ID NO: 241181 - DNA, 15 bp, Homo sapiens
cccaaagagtgacag

SEQ ID NO: 241182 - DNA, 15 bp, Homo sapiens
gcccaaagagtgaca

SEQ ID NO: 241183 - DNA, 15 bp, Homo sapiens
tgcccaaagagtgac

SEQ ID NO: 241184 - DNA, 15 bp, Homo sapiens
ttgcccaaagagtga

SEQ ID NO: 241185 - DNA, 15 bp, Homo sapiens
cttgcccaaagagtg

SEQ ID NO: 241186 - DNA, 15 bp, Homo sapiens
acttgcccaaagagt

SEQ ID NO: 241187 - DNA, 15 bp, Homo sapiens
aacttgcccaaagag

SEQ ID NO: 241188 - DNA, 15 bp, Homo sapiens
taacttgcccaaaga

SEQ ID NO: 241189 - DNA, 15 bp, Homo sapiens
ataacttgcccaaag

SEQ ID NO: 241190 - DNA, 15 bp, Homo sapiens
aataacttgcccaaa

SEQ ID NO: 241191 - DNA, 15 bp, Homo sapiens
aaataacttgcccaa

SEQ ID NO: 241192 - DNA, 15 bp, Homo sapiens
aaaataacttgccca

SEQ ID NO: 241193 - DNA, 15 bp, Homo sapiens
taaaataacttgccc

SEQ ID NO: 241194 - DNA, 15 bp, Homo sapiens
ataaaataacttgcc

SEQ ID NO: 241195 - DNA, 15 bp, Homo sapiens
gataaaataacttgc

SEQ ID NO: 241196 - DNA, 15 bp, Homo sapiens
agataaaataacttg

SEQ ID NO: 241197 - DNA, 15 bp, Homo sapiens
gagataaaataactt

SEQ ID NO: 241198 - DNA, 15 bp, Homo sapiens
agagataaaataact

SEQ ID NO: 241199 - DNA, 15 bp, Homo sapiens
tagagataaaataac

SEQ ID NO: 241200 - DNA, 15 bp, Homo sapiens
gtagagataaaataa

SEQ ID NO: 241201 - DNA, 15 bp, Homo sapiens
tgtagagataaaata

SEQ ID NO: 241202 - DNA, 15 bp, Homo sapiens
gtgtagagataaaat

SEQ ID NO: 241203 - DNA, 15 bp, Homo sapiens
tgtgtagagataaaa

SEQ ID NO: 241204 - DNA, 15 bp, Homo sapiens
atgtgtagagataaa

SEQ ID NO: 241205 - DNA, 15 bp, Homo sapiens
aatgtgtagagataa

SEQ ID NO: 241206 - DNA, 15 bp, Homo sapiens
aaatgtgtagagata

SEQ ID NO: 241207 - DNA, 15 bp, Homo sapiens
taaatgtgtagagat

SEQ ID NO: 241208 - DNA, 15 bp, Homo sapiens
ctaaatgtgtagaga

SEQ ID NO: 241209 - DNA, 15 bp, Homo sapiens
actaaatgtgtagag

SEQ ID NO: 241210 - DNA, 15 bp, Homo sapiens
aactaaatgtgtaga

SEQ ID NO: 241211 - DNA, 15 bp, Homo sapiens
gaactaaatgtgtag

SEQ ID NO: 241212 - DNA, 15 bp, Homo sapiens
ggaactaaatgtgta

SEQ ID NO: 241213 - DNA, 15 bp, Homo sapiens
aggaactaaatgtgt

SEQ ID NO: 241214 - DNA, 15 bp, Homo sapiens
gaggaactaaatgtg

SEQ ID NO: 241215 - DNA, 15 bp, Homo sapiens
tgaggaactaaatgt

SEQ ID NO: 241216 - DNA, 15 bp, Homo sapiens
atgaggaactaaatg

SEQ ID NO: 241217 - DNA, 15 bp, Homo sapiens
gatgaggaactaaat

SEQ ID NO: 241218 - DNA, 15 bp, Homo sapiens
agatgaggaactaaa

SEQ ID NO: 241219 - DNA, 15 bp, Homo sapiens
tagatgaggaactaa

SEQ ID NO: 241220 - DNA, 15 bp, Homo sapiens
atagatgaggaacta

SEQ ID NO: 241221 - DNA, 15 bp, Homo sapiens
gatagatgaggaact

SEQ ID NO: 241222 - DNA, 15 bp, Homo sapiens
tgatagatgaggaac

SEQ ID NO: 241223 - DNA, 15 bp, Homo sapiens
ttgatagatgaggaa

SEQ ID NO: 241224 - DNA, 15 bp, Homo sapiens
tttgatagatgagga

SEQ ID NO: 241225 - DNA, 15 bp, Homo sapiens
atttgatagatgagg

SEQ ID NO: 241226 - DNA, 15 bp, Homo sapiens
catttgatagatgag

SEQ ID NO: 241227 - DNA, 15 bp, Homo sapiens
ccatttgatagatga

SEQ ID NO: 241228 - DNA, 15 bp, Homo sapiens
tccatttgatagatg

SEQ ID NO: 241229 - DNA, 15 bp, Homo sapiens
ttccatttgatagat

SEQ ID NO: 241230 - DNA, 15 bp, Homo sapiens
gttccatttgataga

SEQ ID NO: 241231 - DNA, 15 bp, Homo sapiens
agttccatttgatag

SEQ ID NO: 241232 - DNA, 15 bp, Homo sapiens
aagttccatttgata

SEQ ID NO: 241233 - DNA, 15 bp, Homo sapiens
aaagttccatttgat

SEQ ID NO: 241234 - DNA, 15 bp, Homo sapiens
taaagttccatttga

SEQ ID NO: 241235 - DNA, 15 bp, Homo sapiens
ttaaagttccatttg

SEQ ID NO: 241236 - DNA, 15 bp, Homo sapiens
gttaaagttccattt

SEQ ID NO: 241237 - DNA, 15 bp, Homo sapiens
cgttaaagttccatt

SEQ ID NO: 241238 - DNA, 15 bp, Homo sapiens
acgttaaagttccat

SEQ ID NO: 241239 - DNA, 15 bp, Homo sapiens
cacgttaaagttcca

SEQ ID NO: 241240 - DNA, 15 bp, Homo sapiens
acacgttaaagttcc

SEQ ID NO: 241241 - DNA, 15 bp, Homo sapiens
tacacgttaaagttc

SEQ ID NO: 241242 - DNA, 15 bp, Homo sapiens
atacacgttaaagtt

SEQ ID NO: 241243 - DNA, 15 bp, Homo sapiens
gatacacgttaaagt

SEQ ID NO: 241244 - DNA, 15 bp, Homo sapiens
agatacacgttaaag

SEQ ID NO: 241245 - DNA, 15 bp, Homo sapiens
aagatacacgttaaa

SEQ ID NO: 241246 - DNA, 15 bp, Homo sapiens
caagatacacgttaa

SEQ ID NO: 241247 - DNA, 15 bp, Homo sapiens
gcaagatacacgtta

SEQ ID NO: 241248 - DNA, 15 bp, Homo sapiens
agcaagatacacgtt

SEQ ID NO: 241249 - DNA, 15 bp, Homo sapiens
cagcaagatacacgt

SEQ ID NO: 241250 - DNA, 15 bp, Homo sapiens
ccagcaagatacacg

SEQ ID NO: 241251 - DNA, 15 bp, Homo sapiens
gccagcaagatacac

SEQ ID NO: 241252 - DNA, 15 bp, Homo sapiens
agccagcaagataca

SEQ ID NO: 241253 - DNA, 15 bp, Homo sapiens
aagccagcaagatac

SEQ ID NO: 241254 - DNA, 15 bp, Homo sapiens
gaagccagcaagata

SEQ ID NO: 241255 - DNA, 15 bp, Homo sapiens
ggaagccagcaagat

SEQ ID NO: 241256 - DNA, 15 bp, Homo sapiens
aggaagccagcaaga

SEQ ID NO: 241257 - DNA, 15 bp, Homo sapiens
aaggaagccagcaag

SEQ ID NO: 241258 - DNA, 15 bp, Homo sapiens
taaggaagccagcaa

SEQ ID NO: 241259 - DNA, 15 bp, Homo sapiens
gtaaggaagccagca

SEQ ID NO: 241260 - DNA, 15 bp, Homo sapiens
ggtaaggaagccagc

SEQ ID NO: 241261 - DNA, 15 bp, Homo sapiens
cggtaaggaagccag

SEQ ID NO: 241262 - DNA, 15 bp, Homo sapiens
tcggtaaggaagcca

SEQ ID NO: 241263 - DNA, 15 bp, Homo sapiens
ttcggtaaggaagcc

SEQ ID NO: 241264 - DNA, 15 bp, Homo sapiens
tttcggtaaggaagc

SEQ ID NO: 241265 - DNA, 15 bp, Homo sapiens
ttttcggtaaggaag

SEQ ID NO: 241266 - DNA, 15 bp, Homo sapiens
gttttcggtaaggaa

SEQ ID NO: 241267 - DNA, 15 bp, Homo sapiens
tgttttcggtaagga

SEQ ID NO: 241268 - DNA, 15 bp, Homo sapiens
atgttttcggtaagg

SEQ ID NO: 241269 - DNA, 15 bp, Homo sapiens
tatgttttcggtaag

SEQ ID NO: 241270 - DNA, 15 bp, Homo sapiens
atatgttttcggtaa

SEQ ID NO: 241271 - DNA, 15 bp, Homo sapiens
tatatgttttcggta

SEQ ID NO: 241272 - DNA, 15 bp, Homo sapiens
atatatgttttcggt

SEQ ID NO: 241273 - DNA, 15 bp, Homo sapiens
aatatatgttttcgg

SEQ ID NO: 241274 - DNA, 15 bp, Homo sapiens
aaatatatgttttcg

SEQ ID NO: 241275 - DNA, 15 bp, Homo sapiens
caaatatatgttttc

SEQ ID NO: 241276 - DNA, 15 bp, Homo sapiens
tcaaatatatgtttt

SEQ ID NO: 241277 - DNA, 15 bp, Homo sapiens
ttcaaatatatgttt

SEQ ID NO: 241278 - DNA, 15 bp, Homo sapiens
tttcaaatatatgtt

SEQ ID NO: 241279 - DNA, 15 bp, Homo sapiens
ttttcaaatatatgt

SEQ ID NO: 241280 - DNA, 15 bp, Homo sapiens
attttcaaatatatg

SEQ ID NO: 241281 - DNA, 15 bp, Homo sapiens
cattttcaaatatat

SEQ ID NO: 241282 - DNA, 15 bp, Homo sapiens
gcattttcaaatata

SEQ ID NO: 241283 - DNA, 15 bp, Homo sapiens
agcattttcaaatat

SEQ ID NO: 241284 - DNA, 15 bp, Homo sapiens
aagcattttcaaata

SEQ ID NO: 241285 - DNA, 15 bp, Homo sapiens
caagcattttcaaat

SEQ ID NO: 241286 - DNA, 15 bp, Homo sapiens
ccaagcattttcaaa

SEQ ID NO: 241287 - DNA, 15 bp, Homo sapiens
gccaagcattttcaa

SEQ ID NO: 241288 - DNA, 15 bp, Homo sapiens
tgccaagcattttca

SEQ ID NO: 241289 - DNA, 15 bp, Homo sapiens
ttgccaagcattttc

SEQ ID NO: 241290 - DNA, 15 bp, Homo sapiens
tttgccaagcatttt

SEQ ID NO: 241291 - DNA, 15 bp, Homo sapiens
ctttgccaagcattt

SEQ ID NO: 241292 - DNA, 15 bp, Homo sapiens
actttgccaagcatt

SEQ ID NO: 241293 - DNA, 15 bp, Homo sapiens
aactttgccaagcat

SEQ ID NO: 241294 - DNA, 15 bp, Homo sapiens
aaactttgccaagca

SEQ ID NO: 241295 - DNA, 15 bp, Homo sapiens
taaactttgccaagc

SEQ ID NO: 241296 - DNA, 15 bp, Homo sapiens
ctaaactttgccaag

SEQ ID NO: 241297 - DNA, 15 bp, Homo sapiens
tctaaactttgccaa

SEQ ID NO: 241298 - DNA, 15 bp, Homo sapiens
ttctaaactttgcca

SEQ ID NO: 241299 - DNA, 15 bp, Homo sapiens
attctaaactttgcc

SEQ ID NO: 241300 - DNA, 15 bp, Homo sapiens
cattctaaactttgc

SEQ ID NO: 241301 - DNA, 15 bp, Homo sapiens
gcattctaaactttg

SEQ ID NO: 241302 - DNA, 15 bp, Homo sapiens
agcattctaaacttt

SEQ ID NO: 241303 - DNA, 15 bp, Homo sapiens
cagcattctaaactt

SEQ ID NO: 241304 - DNA, 15 bp, Homo sapiens
tcagcattctaaact

SEQ ID NO: 241305 - DNA, 15 bp, Homo sapiens
ttcagcattctaaac

SEQ ID NO: 241306 - DNA, 15 bp, Homo sapiens
attcagcattctaaa

SEQ ID NO: 241307 - DNA, 15 bp, Homo sapiens
tattcagcattctaa

SEQ ID NO: 241308 - DNA, 15 bp, Homo sapiens
ctattcagcattcta

SEQ ID NO: 241309 - DNA, 15 bp, Homo sapiens
actattcagcattct

SEQ ID NO: 241310 - DNA, 15 bp, Homo sapiens
aactattcagcattc

SEQ ID NO: 241311 - DNA, 15 bp, Homo sapiens
caactattcagcatt

SEQ ID NO: 241312 - DNA, 15 bp, Homo sapiens
acaactattcagcat

SEQ ID NO: 241313 - DNA, 15 bp, Homo sapiens
tacaactattcagca

SEQ ID NO: 241314 - DNA, 15 bp, Homo sapiens
ttacaactattcagc

SEQ ID NO: 241315 - DNA, 15 bp, Homo sapiens
cttacaactattcag

SEQ ID NO: 241316 - DNA, 15 bp, Homo sapiens
tcttacaactattca

SEQ ID NO: 241317 - DNA, 15 bp, Homo sapiens
atcttacaactattc

SEQ ID NO: 241318 - DNA, 15 bp, Homo sapiens
tatcttacaactatt

SEQ ID NO: 241319 - DNA, 15 bp, Homo sapiens
atatcttacaactat

SEQ ID NO: 241320 - DNA, 15 bp, Homo sapiens
aatatcttacaacta

SEQ ID NO: 241321 - DNA, 15 bp, Homo sapiens
taatatcttacaact

SEQ ID NO: 241322 - DNA, 15 bp, Homo sapiens
ttaatatcttacaac

SEQ ID NO: 241323 - DNA, 15 bp, Homo sapiens
attaatatcttacaa

SEQ ID NO: 241324 - DNA, 15 bp, Homo sapiens
cattaatatcttaca

SEQ ID NO: 241325 - DNA, 15 bp, Homo sapiens
acattaatatcttac

SEQ ID NO: 241326 - DNA, 15 bp, Homo sapiens
cacattaatatctta

SEQ ID NO: 241327 - DNA, 15 bp, Homo sapiens
tcacattaatatctt

SEQ ID NO: 241328 - DNA, 15 bp, Homo sapiens
gtcacattaatatct

SEQ ID NO: 241329 - DNA, 15 bp, Homo sapiens
tgtcacattaatatc

SEQ ID NO: 241330 - DNA, 15 bp, Homo sapiens
atgtcacattaatat

SEQ ID NO: 241331 - DNA, 15 bp, Homo sapiens
catgtcacattaata

SEQ ID NO: 241332 - DNA, 15 bp, Homo sapiens
tcatgtcacattaat

SEQ ID NO: 241333 - DNA, 15 bp, Homo sapiens
ttcatgtcacattaa

SEQ ID NO: 241334 - DNA, 15 bp, Homo sapiens
tttcatgtcacatta

SEQ ID NO: 241335 - DNA, 15 bp, Homo sapiens
atttcatgtcacatt

SEQ ID NO: 241336 - DNA, 15 bp, Homo sapiens
aatttcatgtcacat

SEQ ID NO: 241337 - DNA, 15 bp, Homo sapiens
caatttcatgtcaca

SEQ ID NO: 241338 - DNA, 15 bp, Homo sapiens
tcaatttcatgtcac

SEQ ID NO: 241339 - DNA, 15 bp, Homo sapiens
ctcaatttcatgtca

SEQ ID NO: 241340 - DNA, 15 bp, Homo sapiens
tctcaatttcatgtc

SEQ ID NO: 241341 - DNA, 15 bp, Homo sapiens
ttctcaatttcatgt

SEQ ID NO: 241342 - DNA, 15 bp, Homo sapiens
tttctcaatttcatg

SEQ ID NO: 241343 - DNA, 15 bp, Homo sapiens
ttttctcaatttcat

SEQ ID NO: 241344 - DNA, 15 bp, Homo sapiens
tttttctcaatttca

SEQ ID NO: 241345 - DNA, 15 bp, Homo sapiens
ttttttctcaatttc

SEQ ID NO: 241346 - DNA, 15 bp, Homo sapiens
tttttttctcaattt

SEQ ID NO: 241347 - DNA, 15 bp, Homo sapiens
ctttttttctcaatt

SEQ ID NO: 241348 - DNA, 15 bp, Homo sapiens
actttttttctcaat

SEQ ID NO: 241349 - DNA, 15 bp, Homo sapiens
tactttttttctcaa

SEQ ID NO: 241350 - DNA, 15 bp, Homo sapiens
atactttttttctca

SEQ ID NO: 241351 - DNA, 15 bp, Homo sapiens
aatactttttttctc

SEQ ID NO: 241352 - DNA, 15 bp, Homo sapiens
caatactttttttct

SEQ ID NO: 241353 - DNA, 15 bp, Homo sapiens
ccaatactttttttc

SEQ ID NO: 241354 - DNA, 15 bp, Homo sapiens
accaatacttttttt

SEQ ID NO: 241355 - DNA, 15 bp, Homo sapiens
caccaatactttttt

SEQ ID NO: 241356 - DNA, 15 bp, Homo sapiens
tcaccaatacttttt

SEQ ID NO: 241357 - DNA, 15 bp, Homo sapiens
gtcaccaatactttt

SEQ ID NO: 241358 - DNA, 15 bp, Homo sapiens
tgtcaccaatacttt

SEQ ID NO: 241359 - DNA, 15 bp, Homo sapiens
ttgtcaccaatactt

SEQ ID NO: 241360 - DNA, 15 bp, Homo sapiens
gttgtcaccaatact

SEQ ID NO: 241361 - DNA, 15 bp, Homo sapiens
agttgtcaccaatac

SEQ ID NO: 241362 - DNA, 15 bp, Homo sapiens
cagttgtcaccaata

SEQ ID NO: 241363 - DNA, 15 bp, Homo sapiens
ccagttgtcaccaat

SEQ ID NO: 241364 - DNA, 15 bp, Homo sapiens
gccagttgtcaccaa

SEQ ID NO: 241365 - DNA, 15 bp, Homo sapiens
agccagttgtcacca

SEQ ID NO: 241366 - DNA, 15 bp, Homo sapiens
tagccagttgtcacc

SEQ ID NO: 241367 - DNA, 15 bp, Homo sapiens
gtagccagttgtcac

SEQ ID NO: 241368 - DNA, 15 bp, Homo sapiens
cgtagccagttgtca

SEQ ID NO: 241369 - DNA, 15 bp, Homo sapiens
acgtagccagttgtc

SEQ ID NO: 241370 - DNA, 15 bp, Homo sapiens
cacgtagccagttgt

SEQ ID NO: 241371 - DNA, 15 bp, Homo sapiens
tcacgtagccagttg

SEQ ID NO: 241372 - DNA, 15 bp, Homo sapiens
ctcacgtagccagtt

SEQ ID NO: 241373 - DNA, 15 bp, Homo sapiens
cctcacgtagccagt

SEQ ID NO: 241374 - DNA, 15 bp, Homo sapiens
tcctcacgtagccag

SEQ ID NO: 241375 - DNA, 15 bp, Homo sapiens
atcctcacgtagcca

SEQ ID NO: 241376 - DNA, 15 bp, Homo sapiens
gatcctcacgtagcc

SEQ ID NO: 241377 - DNA, 15 bp, Homo sapiens
agatcctcacgtagc

SEQ ID NO: 241378 - DNA, 15 bp, Homo sapiens
cagatcctcacgtag

SEQ ID NO: 241379 - DNA, 15 bp, Homo sapiens
tcagatcctcacgta

SEQ ID NO: 241380 - DNA, 15 bp, Homo sapiens
atcagatcctcacgt

SEQ ID NO: 241381 - DNA, 15 bp, Homo sapiens
catcagatcctcacg

SEQ ID NO: 241382 - DNA, 15 bp, Homo sapiens
tcatcagatcctcac

SEQ ID NO: 241383 - DNA, 15 bp, Homo sapiens
atcatcagatcctca

SEQ ID NO: 241384 - DNA, 15 bp, Homo sapiens
tatcatcagatcctc

SEQ ID NO: 241385 - DNA, 15 bp, Homo sapiens
atatcatcagatcct

SEQ ID NO: 241386 - DNA, 15 bp, Homo sapiens
aatatcatcagatcc

SEQ ID NO: 241387 - DNA, 15 bp, Homo sapiens
aaatatcatcagatc

SEQ ID NO: 241388 - DNA, 15 bp, Homo sapiens
caaatatcatcagat

SEQ ID NO: 241389 - DNA, 15 bp, Homo sapiens
gcaaatatcatcaga

SEQ ID NO: 241390 - DNA, 15 bp, Homo sapiens
tgcaaatatcatcag

SEQ ID NO: 241391 - DNA, 15 bp, Homo sapiens
ttgcaaatatcatca

SEQ ID NO: 241392 - DNA, 15 bp, Homo sapiens
tttgcaaatatcatc

SEQ ID NO: 241393 - DNA, 15 bp, Homo sapiens
ctttgcaaatatcat

SEQ ID NO: 241394 - DNA, 15 bp, Homo sapiens
actttgcaaatatca

SEQ ID NO: 241395 - DNA, 15 bp, Homo sapiens
tactttgcaaatatc

SEQ ID NO: 241396 - DNA, 15 bp, Homo sapiens
atactttgcaaatat

SEQ ID NO: 241397 - DNA, 15 bp, Homo sapiens
catactttgcaaata

SEQ ID NO: 241398 - DNA, 15 bp, Homo sapiens
tcatactttgcaaat

SEQ ID NO: 241399 - DNA, 15 bp, Homo sapiens
ttcatactttgcaaa

SEQ ID NO: 241400 - DNA, 15 bp, Homo sapiens
tttcatactttgcaa

SEQ ID NO: 241401 - DNA, 15 bp, Homo sapiens
ttttcatactttgca

SEQ ID NO: 241402 - DNA, 15 bp, Homo sapiens
attttcatactttgc

SEQ ID NO: 241403 - DNA, 15 bp, Homo sapiens
aattttcatactttg

SEQ ID NO: 241404 - DNA, 15 bp, Homo sapiens
gaattttcatacttt

SEQ ID NO: 241405 - DNA, 15 bp, Homo sapiens
ggaattttcatactt

SEQ ID NO: 241406 - DNA, 15 bp, Homo sapiens
tggaattttcatact

SEQ ID NO: 241407 - DNA, 15 bp, Homo sapiens
ttggaattttcatac

SEQ ID NO: 241408 - DNA, 15 bp, Homo sapiens
cttggaattttcata

SEQ ID NO: 241409 - DNA, 15 bp, Homo sapiens
acttggaattttcat

SEQ ID NO: 241410 - DNA, 15 bp, Homo sapiens
tacttggaattttca

SEQ ID NO: 241411 - DNA, 15 bp, Homo sapiens
atacttggaattttc

SEQ ID NO: 241412 - DNA, 15 bp, Homo sapiens
aatacttggaatttt

SEQ ID NO: 241413 - DNA, 15 bp, Homo sapiens
taatacttggaattt

SEQ ID NO: 241414 - DNA, 15 bp, Homo sapiens
ataatacttggaatt

SEQ ID NO: 241415 - DNA, 15 bp, Homo sapiens
aataatacttggaat

SEQ ID NO: 241416 - DNA, 15 bp, Homo sapiens
aaataatacttggaa

SEQ ID NO: 241417 - DNA, 15 bp, Homo sapiens
caaataatacttgga

SEQ ID NO: 241418 - DNA, 15 bp, Homo sapiens
tcaaataatacttgg

SEQ ID NO: 241419 - DNA, 15 bp, Homo sapiens
ttcaaataatacttg

SEQ ID NO: 241420 - DNA, 15 bp, Homo sapiens
attcaaataatactt

SEQ ID NO: 241421 - DNA, 15 bp, Homo sapiens
aattcaaataatact

SEQ ID NO: 241422 - DNA, 15 bp, Homo sapiens
aaattcaaataatac

SEQ ID NO: 241423 - DNA, 15 bp, Homo sapiens
aaaattcaaataata

SEQ ID NO: 241424 - DNA, 15 bp, Homo sapiens
aaaaattcaaataat

SEQ ID NO: 241425 - DNA, 15 bp, Homo sapiens
taaaaattcaaataa

SEQ ID NO: 241426 - DNA, 15 bp, Homo sapiens
ataaaaattcaaata

SEQ ID NO: 241427 - DNA, 15 bp, Homo sapiens
tataaaaattcaaat

SEQ ID NO: 241428 - DNA, 15 bp, Homo sapiens
atataaaaattcaaa

SEQ ID NO: 241429 - DNA, 15 bp, Homo sapiens
aatataaaaattcaa

SEQ ID NO: 241430 - DNA, 15 bp, Homo sapiens
aaatataaaaattca

SEQ ID NO: 241431 - DNA, 15 bp, Homo sapiens
caaatataaaaattc

SEQ ID NO: 241432 - DNA, 15 bp, Homo sapiens
acaaatataaaaatt

SEQ ID NO: 241433 - DNA, 15 bp, Homo sapiens
aacaaatataaaaat

SEQ ID NO: 241434 - DNA, 15 bp, Homo sapiens
gaacaaatataaaaa

SEQ ID NO: 241435 - DNA, 15 bp, Homo sapiens
tgaacaaatataaaa

SEQ ID NO: 241436 - DNA, 15 bp, Homo sapiens
atgaacaaatataaa

SEQ ID NO: 241437 - DNA, 15 bp, Homo sapiens
aatgaacaaatataa

SEQ ID NO: 241438 - DNA, 15 bp, Homo sapiens
aaatgaacaaatata

SEQ ID NO: 241439 - DNA, 15 bp, Homo sapiens
taaatgaacaaatat

SEQ ID NO: 241440 - DNA, 15 bp, Homo sapiens
ctaaatgaacaaata

SEQ ID NO: 241441 - DNA, 15 bp, Homo sapiens
gctaaatgaacaaat

SEQ ID NO: 241442 - DNA, 15 bp, Homo sapiens
tgctaaatgaacaaa

SEQ ID NO: 241443 - DNA, 15 bp, Homo sapiens
ttgctaaatgaacaa

SEQ ID NO: 241444 - DNA, 15 bp, Homo sapiens
tttgctaaatgaaca

SEQ ID NO: 241445 - DNA, 15 bp, Homo sapiens
ttttgctaaatgaac

SEQ ID NO: 241446 - DNA, 15 bp, Homo sapiens
attttgctaaatgaa

SEQ ID NO: 241447 - DNA, 15 bp, Homo sapiens
aattttgctaaatga

SEQ ID NO: 241448 - DNA, 15 bp, Homo sapiens
gaattttgctaaatg

SEQ ID NO: 241449 - DNA, 15 bp, Homo sapiens
agaattttgctaaat

SEQ ID NO: 241450 - DNA, 15 bp, Homo sapiens
aagaattttgctaaa

SEQ ID NO: 241451 - DNA, 15 bp, Homo sapiens
aaagaattttgctaa

SEQ ID NO: 241452 - DNA, 15 bp, Homo sapiens
aaaagaattttgcta

SEQ ID NO: 241453 - DNA, 15 bp, Homo sapiens
taaaagaattttgct

SEQ ID NO: 241454 - DNA, 15 bp, Homo sapiens
ataaaagaattttgc

SEQ ID NO: 241455 - DNA, 15 bp, Homo sapiens
cataaaagaattttg

SEQ ID NO: 241456 - DNA, 15 bp, Homo sapiens
ccataaaagaatttt

SEQ ID NO: 241457 - DNA, 15 bp, Homo sapiens
gccataaaagaattt

SEQ ID NO: 241458 - DNA, 15 bp, Homo sapiens
tgccataaaagaatt

SEQ ID NO: 241459 - DNA, 15 bp, Homo sapiens
gtgccataaaagaat

SEQ ID NO: 241460 - DNA, 15 bp, Homo sapiens
agtgccataaaagaa

SEQ ID NO: 241461 - DNA, 15 bp, Homo sapiens
tagtgccataaaaga

SEQ ID NO: 241462 - DNA, 15 bp, Homo sapiens
ttagtgccataaaag

SEQ ID NO: 241463 - DNA, 15 bp, Homo sapiens
tttagtgccataaaa

SEQ ID NO: 241464 - DNA, 15 bp, Homo sapiens
atttagtgccataaa

SEQ ID NO: 241465 - DNA, 15 bp, Homo sapiens
aatttagtgccataa

SEQ ID NO: 241466 - DNA, 15 bp, Homo sapiens
gaatttagtgccata

SEQ ID NO: 241467 - DNA, 15 bp, Homo sapiens
tgaatttagtgccat

SEQ ID NO: 241468 - DNA, 15 bp, Homo sapiens
gtgaatttagtgcca

SEQ ID NO: 241469 - DNA, 15 bp, Homo sapiens
tgtgaatttagtgcc

SEQ ID NO: 241470 - DNA, 15 bp, Homo sapiens
atgtgaatttagtgc

SEQ ID NO: 241471 - DNA, 15 bp, Homo sapiens
catgtgaatttagtg

SEQ ID NO: 241472 - DNA, 15 bp, Homo sapiens
acatgtgaatttagt

SEQ ID NO: 241473 - DNA, 15 bp, Homo sapiens
tacatgtgaatttag

SEQ ID NO: 241474 - DNA, 15 bp, Homo sapiens
gtacatgtgaattta

SEQ ID NO: 241475 - DNA, 15 bp, Homo sapiens
agtacatgtgaattt

SEQ ID NO: 241476 - DNA, 15 bp, Homo sapiens
tagtacatgtgaatt

SEQ ID NO: 241477 - DNA, 15 bp, Homo sapiens
atagtacatgtgaat

SEQ ID NO: 241478 - DNA, 15 bp, Homo sapiens
aatagtacatgtgaa

SEQ ID NO: 241479 - DNA, 15 bp, Homo sapiens
gaatagtacatgtga

SEQ ID NO: 241480 - DNA, 15 bp, Homo sapiens
agaatagtacatgtg

SEQ ID NO: 241481 - DNA, 15 bp, Homo sapiens
aagaatagtacatgt

SEQ ID NO: 241482 - DNA, 15 bp, Homo sapiens
gaagaatagtacatg

SEQ ID NO: 241483 - DNA, 15 bp, Homo sapiens
agaagaatagtacat

SEQ ID NO: 241484 - DNA, 15 bp, Homo sapiens
aagaagaatagtaca

SEQ ID NO: 241485 - DNA, 15 bp, Homo sapiens
taagaagaatagtac

SEQ ID NO: 241486 - DNA, 15 bp, Homo sapiens
ttaagaagaatagta

SEQ ID NO: 241487 - DNA, 15 bp, Homo sapiens
tttaagaagaatagt

SEQ ID NO: 241488 - DNA, 15 bp, Homo sapiens
atttaagaagaatag

SEQ ID NO: 241489 - DNA, 15 bp, Homo sapiens
tatttaagaagaata

SEQ ID NO: 241490 - DNA, 15 bp, Homo sapiens
ttatttaagaagaat

SEQ ID NO: 241491 - DNA, 15 bp, Homo sapiens
cttatttaagaagaa

SEQ ID NO: 241492 - DNA, 15 bp, Homo sapiens
acttatttaagaaga

SEQ ID NO: 241493 - DNA, 15 bp, Homo sapiens
gacttatttaagaag

SEQ ID NO: 241494 - DNA, 15 bp, Homo sapiens
agacttatttaagaa

SEQ ID NO: 241495 - DNA, 15 bp, Homo sapiens
aagacttatttaaga

SEQ ID NO: 241496 - DNA, 15 bp, Homo sapiens
taagacttatttaag

SEQ ID NO: 241497 - DNA, 15 bp, Homo sapiens
ttaagacttatttaa

SEQ ID NO: 241498 - DNA, 15 bp, Homo sapiens
tttaagacttattta

SEQ ID NO: 241499 - DNA, 15 bp, Homo sapiens
ttttaagacttattt

SEQ ID NO: 241500 - DNA, 15 bp, Homo sapiens
attttaagacttatt

SEQ ID NO: 241501 - DNA, 15 bp, Homo sapiens
tattttaagacttat

SEQ ID NO: 241502 - DNA, 15 bp, Homo sapiens
ttattttaagactta

SEQ ID NO: 241503 - DNA, 15 bp, Homo sapiens
attattttaagactt

SEQ ID NO: 241504 - DNA, 15 bp, Homo sapiens
aattattttaagact

SEQ ID NO: 241505 - DNA, 15 bp, Homo sapiens
caattattttaagac

SEQ ID NO: 241506 - DNA, 15 bp, Homo sapiens
ccaattattttaaga

SEQ ID NO: 241507 - DNA, 15 bp, Homo sapiens
accaattattttaag

SEQ ID NO: 241508 - DNA, 15 bp, Homo sapiens
aaccaattattttaa

SEQ ID NO: 241509 - DNA, 15 bp, Homo sapiens
taaccaattatttta

SEQ ID NO: 241510 - DNA, 15 bp, Homo sapiens
ttaaccaattatttt

SEQ ID NO: 241511 - DNA, 15 bp, Homo sapiens
attaaccaattattt

SEQ ID NO: 241512 - DNA, 15 bp, Homo sapiens
cattaaccaattatt

SEQ ID NO: 241513 - DNA, 15 bp, Homo sapiens
acattaaccaattat

SEQ ID NO: 241514 - DNA, 15 bp, Homo sapiens
tacattaaccaatta

SEQ ID NO: 241515 - DNA, 15 bp, Homo sapiens
ctacattaaccaatt

SEQ ID NO: 241516 - DNA, 15 bp, Homo sapiens
cctacattaaccaat

SEQ ID NO: 241517 - DNA, 15 bp, Homo sapiens
tcctacattaaccaa

SEQ ID NO: 241518 - DNA, 15 bp, Homo sapiens
ttcctacattaacca

SEQ ID NO: 241519 - DNA, 15 bp, Homo sapiens
attcctacattaacc

SEQ ID NO: 241520 - DNA, 15 bp, Homo sapiens
tattcctacattaac

SEQ ID NO: 241521 - DNA, 15 bp, Homo sapiens
ttattcctacattaa

SEQ ID NO: 241522 - DNA, 15 bp, Homo sapiens
attattcctacatta

SEQ ID NO: 241523 - DNA, 15 bp, Homo sapiens
tattattcctacatt

SEQ ID NO: 241524 - DNA, 15 bp, Homo sapiens
atattattcctacat

SEQ ID NO: 241525 - DNA, 15 bp, Homo sapiens
tatattattcctaca

SEQ ID NO: 241526 - DNA, 15 bp, Homo sapiens
atatattattcctac

SEQ ID NO: 241527 - DNA, 15 bp, Homo sapiens
aatatattattccta

SEQ ID NO: 241528 - DNA, 15 bp, Homo sapiens
aaatatattattcct

SEQ ID NO: 241529 - DNA, 15 bp, Homo sapiens
aaaatatattattcc

SEQ ID NO: 241530 - DNA, 15 bp, Homo sapiens
aaaaatatattattc

SEQ ID NO: 241531 - DNA, 15 bp, Homo sapiens
taaaaaatatattat

SEQ ID NO: 241532 - DNA, 15 bp, Homo sapiens
ataaaaaatatatta

SEQ ID NO: 241533 - DNA, 15 bp, Homo sapiens
tataaaaaatatatt

SEQ ID NO: 241534 - DNA, 15 bp, Homo sapiens
ttataaaaaatatat

SEQ ID NO: 241535 - DNA, 15 bp, Homo sapiens
cttataaaaaatata

SEQ ID NO: 241536 - DNA, 15 bp, Homo sapiens
acttataaaaaatat

SEQ ID NO: 241537 - DNA, 15 bp, Homo sapiens
tacttataaaaaata

SEQ ID NO: 241538 - DNA, 15 bp, Homo sapiens
ttacttataaaaaat

SEQ ID NO: 241539 - DNA, 15 bp, Homo sapiens
cttacttataaaaaa

SEQ ID NO: 241540 - DNA, 15 bp, Homo sapiens
tcttacttataaaaa

SEQ ID NO: 241541 - DNA, 15 bp, Homo sapiens
ttcttacttataaaa

SEQ ID NO: 241542 - DNA, 15 bp, Homo sapiens
cttcttacttataaa

SEQ ID NO: 241543 - DNA, 15 bp, Homo sapiens
acttcttacttataa

SEQ ID NO: 241544 - DNA, 15 bp, Homo sapiens
tacttcttacttata

SEQ ID NO: 241545 - DNA, 15 bp, Homo sapiens
ttacttcttacttat

SEQ ID NO: 241546 - DNA, 15 bp, Homo sapiens
gttacttcttactta

SEQ ID NO: 241547 - DNA, 15 bp, Homo sapiens
agttacttcttactt

SEQ ID NO: 241548 - DNA, 15 bp, Homo sapiens
tagttacttcttact

SEQ ID NO: 241549 - DNA, 15 bp, Homo sapiens
ctagttacttcttac

SEQ ID NO: 241550 - DNA, 15 bp, Homo sapiens
tctagttacttctta

SEQ ID NO: 241551 - DNA, 15 bp, Homo sapiens
ttctagttacttctt

SEQ ID NO: 241552 - DNA, 15 bp, Homo sapiens
attctagttacttct

SEQ ID NO: 241553 - DNA, 15 bp, Homo sapiens
aattctagttacttc

SEQ ID NO: 241554 - DNA, 15 bp, Homo sapiens
caattctagttactt

SEQ ID NO: 241555 - DNA, 15 bp, Homo sapiens
acaattctagttact

SEQ ID NO: 241556 - DNA, 15 bp, Homo sapiens
tacaattctagttac

SEQ ID NO: 241557 - DNA, 15 bp, Homo sapiens
ttacaattctagtta

SEQ ID NO: 241558 - DNA, 15 bp, Homo sapiens
tttacaattctagtt

SEQ ID NO: 241559 - DNA, 15 bp, Homo sapiens
ttttacaattctagt

SEQ ID NO: 241560 - DNA, 15 bp, Homo sapiens
tttttacaattctag

SEQ ID NO: 241561 - DNA, 15 bp, Homo sapiens
ttttttacaattcta

SEQ ID NO: 241562 - DNA, 15 bp, Homo sapiens
tttttttacaattct

SEQ ID NO: 241563 - DNA, 15 bp, Homo sapiens
ttttttttacaattc

SEQ ID NO: 241564 - DNA, 15 bp, Homo sapiens
tttttttttacaatt

SEQ ID NO: 241565 - DNA, 15 bp, Homo sapiens
ttttttttttacaat

SEQ ID NO: 241566 - DNA, 15 bp, Homo sapiens
tttttttttttacaa

SEQ ID NO: 241567 - DNA, 15 bp, Homo sapiens
ttttttttttttaca

SEQ ID NO: 241568 - DNA, 15 bp, Homo sapiens
ggtactttttttttt

SEQ ID NO: 241569 - DNA, 15 bp, Homo sapiens
aggtacttttttttt

SEQ ID NO: 241570 - DNA, 15 bp, Homo sapiens
gaggtactttttttt

SEQ ID NO: 241571 - DNA, 15 bp, Homo sapiens
tgaggtacttttttt

SEQ ID NO: 241572 - DNA, 15 bp, Homo sapiens
ttgaggtactttttt

SEQ ID NO: 241573 - DNA, 15 bp, Homo sapiens
attgaggtacttttt

SEQ ID NO: 241574 - DNA, 15 bp, Homo sapiens
aattgaggtactttt

SEQ ID NO: 241575 - DNA, 15 bp, Homo sapiens
aaattgaggtacttt

SEQ ID NO: 241576 - DNA, 15 bp, Homo sapiens
taaattgaggtactt

SEQ ID NO: 241577 - DNA, 15 bp, Homo sapiens
ttaaattgaggtact

SEQ ID NO: 241578 - DNA, 15 bp, Homo sapiens
tttaaattgaggtac

SEQ ID NO: 241579 - DNA, 15 bp, Homo sapiens
ttttaaattgaggta

SEQ ID NO: 241580 - DNA, 15 bp, Homo sapiens
tttttaaattgaggt

SEQ ID NO: 241581 - DNA, 15 bp, Homo sapiens
gtttttaaattgagg

SEQ ID NO: 241582 - DNA, 15 bp, Homo sapiens
ggtttttaaattgag

SEQ ID NO: 241583 - DNA, 15 bp, Homo sapiens
gggtttttaaattga

SEQ ID NO: 241584 - DNA, 15 bp, Homo sapiens
ggggtttttaaattg

SEQ ID NO: 241585 - DNA, 15 bp, Homo sapiens
tggggtttttaaatt

SEQ ID NO: 241586 - DNA, 15 bp, Homo sapiens
atggggtttttaaat

SEQ ID NO: 241587 - DNA, 15 bp, Homo sapiens
tatggggtttttaaa

SEQ ID NO: 241588 - DNA, 15 bp, Homo sapiens
ttatggggtttttaa

SEQ ID NO: 241589 - DNA, 15 bp, Homo sapiens
tttatggggttttta

SEQ ID NO: 241590 - DNA, 15 bp, Homo sapiens
ttttatggggttttt

SEQ ID NO: 241591 - DNA, 15 bp, Homo sapiens
attttatggggtttt

SEQ ID NO: 241592 - DNA, 15 bp, Homo sapiens
gattttatggggttt

SEQ ID NO: 241593 - DNA, 15 bp, Homo sapiens
agattttatggggtt

SEQ ID NO: 241594 - DNA, 15 bp, Homo sapiens
gagattttatggggt

SEQ ID NO: 241595 - DNA, 15 bp, Homo sapiens
tgagattttatgggg

SEQ ID NO: 241596 - DNA, 15 bp, Homo sapiens
ctgagattttatggg

SEQ ID NO: 241597 - DNA, 15 bp, Homo sapiens
actgagattttatgg

SEQ ID NO: 241598 - DNA, 15 bp, Homo sapiens
gactgagattttatg

SEQ ID NO: 241599 - DNA, 15 bp, Homo sapiens
tgactgagattttat

SEQ ID NO: 241600 - DNA, 15 bp, Homo sapiens
atgactgagatttta

SEQ ID NO: 241601 - DNA, 15 bp, Homo sapiens
tatgactgagatttt

SEQ ID NO: 241602 - DNA, 15 bp, Homo sapiens
ctatgactgagattt

SEQ ID NO: 241603 - DNA, 15 bp, Homo sapiens
actatgactgagatt

SEQ ID NO: 241604 - DNA, 15 bp, Homo sapiens
tactatgactgagat

SEQ ID NO: 241605 - DNA, 15 bp, Homo sapiens
ttactatgactgaga

SEQ ID NO: 241606 - DNA, 15 bp, Homo sapiens
cttactatgactgag

SEQ ID NO: 241607 - DNA, 15 bp, Homo sapiens
ccttactatgactga

SEQ ID NO: 241608 - DNA, 15 bp, Homo sapiens
accttactatgactg

SEQ ID NO: 241609 - DNA, 15 bp, Homo sapiens
gaccttactatgact

SEQ ID NO: 241610 - DNA, 15 bp, Homo sapiens
agaccttactatgac

SEQ ID NO: 241611 - DNA, 15 bp, Homo sapiens
tagaccttactatga

SEQ ID NO: 241612 - DNA, 15 bp, Homo sapiens
ctagaccttactatg

SEQ ID NO: 241613 - DNA, 15 bp, Homo sapiens
actagaccttactat

SEQ ID NO: 241614 - DNA, 15 bp, Homo sapiens
cactagaccttacta

SEQ ID NO: 241615 - DNA, 15 bp, Homo sapiens
gcactagaccttact

SEQ ID NO: 241616 - DNA, 15 bp, Homo sapiens
tgcactagaccttac

SEQ ID NO: 241617 - DNA, 15 bp, Homo sapiens
ttgcactagacctta

SEQ ID NO: 241618 - DNA, 15 bp, Homo sapiens
tttgcactagacctt

SEQ ID NO: 241619 - DNA, 15 bp, Homo sapiens
ttttgcactagacct

SEQ ID NO: 241620 - DNA, 15 bp, Homo sapiens
cttttgcactagacc

SEQ ID NO: 241621 - DNA, 15 bp, Homo sapiens
acttttgcactagac

SEQ ID NO: 241622 - DNA, 15 bp, Homo sapiens
tacttttgcactaga

SEQ ID NO: 241623 - DNA, 15 bp, Homo sapiens
ctacttttgcactag

SEQ ID NO: 241624 - DNA, 15 bp, Homo sapiens
cctacttttgcacta

SEQ ID NO: 241625 - DNA, 15 bp, Homo sapiens
tcctacttttgcact

SEQ ID NO: 241626 - DNA, 15 bp, Homo sapiens
ctcctacttttgcac

SEQ ID NO: 241627 - DNA, 15 bp, Homo sapiens
tctcctacttttgca

SEQ ID NO: 241628 - DNA, 15 bp, Homo sapiens
gtctcctacttttgc

SEQ ID NO: 241629 - DNA, 15 bp, Homo sapiens
agtctcctacttttg

SEQ ID NO: 241630 - DNA, 15 bp, Homo sapiens
cagtctcctactttt

SEQ ID NO: 241631 - DNA, 15 bp, Homo sapiens
ccagtctcctacttt

SEQ ID NO: 241632 - DNA, 15 bp, Homo sapiens
cccagtctcctactt

SEQ ID NO: 241633 - DNA, 15 bp, Homo sapiens
gcccagtctcctact

SEQ ID NO: 241634 - DNA, 15 bp, Homo sapiens
agcccagtctcctac

SEQ ID NO: 241635 - DNA, 15 bp, Homo sapiens
gagcccagtctccta

SEQ ID NO: 241636 - DNA, 15 bp, Homo sapiens
agagcccagtctcct

SEQ ID NO: 241637 - DNA, 15 bp, Homo sapiens
gagagcccagtctcc

SEQ ID NO: 241638 - DNA, 15 bp, Homo sapiens
agagagcccagtctc

SEQ ID NO: 241639 - DNA, 15 bp, Homo sapiens
cagagagcccagtct

SEQ ID NO: 241640 - DNA, 15 bp, Homo sapiens
acagagagcccagtc

SEQ ID NO: 241641 - DNA, 15 bp, Homo sapiens
tacagagagcccagt

SEQ ID NO: 241642 - DNA, 15 bp, Homo sapiens
atacagagagcccag

SEQ ID NO: 241643 - DNA, 15 bp, Homo sapiens
catacagagagccca

SEQ ID NO: 241644 - DNA, 15 bp, Homo sapiens
acatacagagagccc

SEQ ID NO: 241645 - DNA, 15 bp, Homo sapiens
aacatacagagagcc

SEQ ID NO: 241646 - DNA, 15 bp, Homo sapiens
aaacatacagagagc

SEQ ID NO: 241647 - DNA, 15 bp, Homo sapiens
gaaacatacagagag

SEQ ID NO: 241648 - DNA, 15 bp, Homo sapiens
tgaaacatacagaga

SEQ ID NO: 241649 - DNA, 15 bp, Homo sapiens
ctgaaacatacagag

SEQ ID NO: 241650 - DNA, 15 bp, Homo sapiens
tctgaaacatacaga

SEQ ID NO: 241651 - DNA, 15 bp, Homo sapiens
atctgaaacatacag

SEQ ID NO: 241652 - DNA, 15 bp, Homo sapiens
catctgaaacataca

SEQ ID NO: 241653 - DNA, 15 bp, Homo sapiens
tcatctgaaacatac

SEQ ID NO: 241654 - DNA, 15 bp, Homo sapiens
ttcatctgaaacata

SEQ ID NO: 241655 - DNA, 15 bp, Homo sapiens
tttcatctgaaacat

SEQ ID NO: 241656 - DNA, 15 bp, Homo sapiens
ctttcatctgaaaca

SEQ ID NO: 241657 - DNA, 15 bp, Homo sapiens
actttcatctgaaac

SEQ ID NO: 241658 - DNA, 15 bp, Homo sapiens
tactttcatctgaaa

SEQ ID NO: 241659 - DNA, 15 bp, Homo sapiens
ttactttcatctgaa

SEQ ID NO: 241660 - DNA, 15 bp, Homo sapiens
cttactttcatctga

SEQ ID NO: 241661 - DNA, 15 bp, Homo sapiens
tcttactttcatctg

SEQ ID NO: 241662 - DNA, 15 bp, Homo sapiens
ttcttactttcatct

SEQ ID NO: 241663 - DNA, 15 bp, Homo sapiens
tttcttactttcatc

SEQ ID NO: 241664 - DNA, 15 bp, Homo sapiens
atttcttactttcat

SEQ ID NO: 241665 - DNA, 15 bp, Homo sapiens
aatttcttactttca

SEQ ID NO: 241666 - DNA, 15 bp, Homo sapiens
caatttcttactttc

SEQ ID NO: 241667 - DNA, 15 bp, Homo sapiens
ccaatttcttacttt

SEQ ID NO: 241668 - DNA, 15 bp, Homo sapiens
cccaatttcttactt

SEQ ID NO: 241669 - DNA, 15 bp, Homo sapiens
tcccaatttcttact

SEQ ID NO: 241670 - DNA, 15 bp, Homo sapiens
atcccaatttcttac

SEQ ID NO: 241671 - DNA, 15 bp, Homo sapiens
aatcccaatttctta

SEQ ID NO: 241672 - DNA, 15 bp, Homo sapiens
aaatcccaatttctt

SEQ ID NO: 241673 - DNA, 15 bp, Homo sapiens
aaaatcccaatttct

SEQ ID NO: 241674 - DNA, 15 bp, Homo sapiens
aaaaatcccaatttc

SEQ ID NO: 241675 - DNA, 15 bp, Homo sapiens
gaaaaatcccaattt

SEQ ID NO: 241676 - DNA, 15 bp, Homo sapiens
agaaaaatcccaatt

SEQ ID NO: 241677 - DNA, 15 bp, Homo sapiens
cagaaaaatcccaat

SEQ ID NO: 241678 - DNA, 15 bp, Homo sapiens
gcagaaaaatcccaa

SEQ ID NO: 241679 - DNA, 15 bp, Homo sapiens
ggcagaaaaatccca

SEQ ID NO: 241680 - DNA, 15 bp, Homo sapiens
aggcagaaaaatccc

SEQ ID NO: 241681 - DNA, 15 bp, Homo sapiens
taggcagaaaaatcc

SEQ ID NO: 241682 - DNA, 15 bp, Homo sapiens
ctaggcagaaaaatc

SEQ ID NO: 241683 - DNA, 15 bp, Homo sapiens
tctaggcagaaaaat

SEQ ID NO: 241684 - DNA, 15 bp, Homo sapiens
gtctaggcagaaaaa

SEQ ID NO: 241685 - DNA, 15 bp, Homo sapiens
cgtctaggcagaaaa

SEQ ID NO: 241686 - DNA, 15 bp, Homo sapiens
tcgtctaggcagaaa

SEQ ID NO: 241687 - DNA, 15 bp, Homo sapiens
atcgtctaggcagaa

SEQ ID NO: 241688 - DNA, 15 bp, Homo sapiens
aatcgtctaggcaga

SEQ ID NO: 241689 - DNA, 15 bp, Homo sapiens
caatcgtctaggcag

SEQ ID NO: 241690 - DNA, 15 bp, Homo sapiens
gcaatcgtctaggca

SEQ ID NO: 241691 - DNA, 15 bp, Homo sapiens
ggcaatcgtctaggc

SEQ ID NO: 241692 - DNA, 15 bp, Homo sapiens
aggcaatcgtctagg

SEQ ID NO: 241693 - DNA, 15 bp, Homo sapiens
aaggcaatcgtctag

SEQ ID NO: 241694 - DNA, 15 bp, Homo sapiens
caaggcaatcgtcta

SEQ ID NO: 241695 - DNA, 15 bp, Homo sapiens
ccaaggcaatcgtct

SEQ ID NO: 241696 - DNA, 15 bp, Homo sapiens
accaaggcaatcgtc

SEQ ID NO: 241697 - DNA, 15 bp, Homo sapiens
aaccaaggcaatcgt

SEQ ID NO: 241698 - DNA, 15 bp, Homo sapiens
gaaccaaggcaatcg

SEQ ID NO: 241699 - DNA, 15 bp, Homo sapiens
agaaccaaggcaatc

SEQ ID NO: 241700 - DNA, 15 bp, Homo sapiens
aagaaccaaggcaat

SEQ ID NO: 241701 - DNA, 15 bp, Homo sapiens
gaagaaccaaggcaa

SEQ ID NO: 241702 - DNA, 15 bp, Homo sapiens
tgaagaaccaaggca

SEQ ID NO: 241703 - DNA, 15 bp, Homo sapiens
gtgaagaaccaaggc

SEQ ID NO: 241704 - DNA, 15 bp, Homo sapiens
tgtgaagaaccaagg

SEQ ID NO: 241705 - DNA, 15 bp, Homo sapiens
ttgtgaagaaccaag

SEQ ID NO: 241706 - DNA, 15 bp, Homo sapiens
gttgtgaagaaccaa

SEQ ID NO: 241707 - DNA, 15 bp, Homo sapiens
agttgtgaagaacca

SEQ ID NO: 241708 - DNA, 15 bp, Homo sapiens
aagttgtgaagaacc

SEQ ID NO: 241709 - DNA, 15 bp, Homo sapiens
aaagttgtgaagaac

SEQ ID NO: 241710 - DNA, 15 bp, Homo sapiens
aaaagttgtgaagaa

SEQ ID NO: 241711 - DNA, 15 bp, Homo sapiens
aaaaagttgtgaaga

SEQ ID NO: 241712 - DNA, 15 bp, Homo sapiens
caaaaagttgtgaag

SEQ ID NO: 241713 - DNA, 15 bp, Homo sapiens
gcaaaaagttgtgaa

SEQ ID NO: 241714 - DNA, 15 bp, Homo sapiens
ggcaaaaagttgtga

SEQ ID NO: 241715 - DNA, 15 bp, Homo sapiens
aggcaaaaagttgtg

SEQ ID NO: 241716 - DNA, 15 bp, Homo sapiens
taggcaaaaagttgt

SEQ ID NO: 241717 - DNA, 15 bp, Homo sapiens
ataggcaaaaagttg

SEQ ID NO: 241718 - DNA, 15 bp, Homo sapiens
aataggcaaaaagtt

SEQ ID NO: 241719 - DNA, 15 bp, Homo sapiens
aaataggcaaaaagt

SEQ ID NO: 241720 - DNA, 15 bp, Homo sapiens
aaaataggcaaaaag

SEQ ID NO: 241721 - DNA, 15 bp, Homo sapiens
aaaaataggcaaaaa

SEQ ID NO: 241722 - DNA, 15 bp, Homo sapiens
taaaaataggcaaaa

SEQ ID NO: 241723 - DNA, 15 bp, Homo sapiens
ttaaaaataggcaaa

SEQ ID NO: 241724 - DNA, 15 bp, Homo sapiens
tttaaaaataggcaa

SEQ ID NO: 241725 - DNA, 15 bp, Homo sapiens
atttaaaaataggca

SEQ ID NO: 241726 - DNA, 15 bp, Homo sapiens
aatttaaaaataggc

SEQ ID NO: 241727 - DNA, 15 bp, Homo sapiens
gaatttaaaaatagg

SEQ ID NO: 241728 - DNA, 15 bp, Homo sapiens
ggaatttaaaaatag

SEQ ID NO: 241729 - DNA, 15 bp, Homo sapiens
aggaatttaaaaata

SEQ ID NO: 241730 - DNA, 15 bp, Homo sapiens
aaggaatttaaaaat

SEQ ID NO: 241731 - DNA, 15 bp, Homo sapiens
gaaggaatttaaaaa

SEQ ID NO: 241732 - DNA, 15 bp, Homo sapiens
agaaggaatttaaaa

SEQ ID NO: 241733 - DNA, 15 bp, Homo sapiens
aagaaggaatttaaa

SEQ ID NO: 241734 - DNA, 15 bp, Homo sapiens
aaagaaggaatttaa

SEQ ID NO: 241735 - DNA, 15 bp, Homo sapiens
aaaagaaggaattta

SEQ ID NO: 241736 - DNA, 15 bp, Homo sapiens
aaaaagaaggaattt

SEQ ID NO: 241737 - DNA, 15 bp, Homo sapiens
taaaaagaaggaatt

SEQ ID NO: 241738 - DNA, 15 bp, Homo sapiens
ttaaaaagaaggaat

SEQ ID NO: 241739 - DNA, 15 bp, Homo sapiens
tttaaaaagaaggaa

SEQ ID NO: 241740 - DNA, 15 bp, Homo sapiens
atttaaaaagaagga

SEQ ID NO: 241741 - DNA, 15 bp, Homo sapiens
catttaaaaagaagg

SEQ ID NO: 241742 - DNA, 15 bp, Homo sapiens
acatttaaaaagaag

SEQ ID NO: 241743 - DNA, 15 bp, Homo sapiens
aacatttaaaaagaa

SEQ ID NO: 241744 - DNA, 15 bp, Homo sapiens
taacatttaaaaaga

SEQ ID NO: 241745 - DNA, 15 bp, Homo sapiens
ataacatttaaaaag

SEQ ID NO: 241746 - DNA, 15 bp, Homo sapiens
tataacatttaaaaa

SEQ ID NO: 241747 - DNA, 15 bp, Homo sapiens
ctataacatttaaaa

SEQ ID NO: 241748 - DNA, 15 bp, Homo sapiens
tctataacatttaaa

SEQ ID NO: 241749 - DNA, 15 bp, Homo sapiens
ttctataacatttaa

SEQ ID NO: 241750 - DNA, 15 bp, Homo sapiens
attctataacattta

SEQ ID NO: 241751 - DNA, 15 bp, Homo sapiens
aattctataacattt

SEQ ID NO: 241752 - DNA, 15 bp, Homo sapiens
caattctataacatt

SEQ ID NO: 241753 - DNA, 15 bp, Homo sapiens
tcaattctataacat

SEQ ID NO: 241754 - DNA, 15 bp, Homo sapiens
ttcaattctataaca

SEQ ID NO: 241755 - DNA, 15 bp, Homo sapiens
attcaattctataac

SEQ ID NO: 241756 - DNA, 15 bp, Homo sapiens
aattcaattctataa

SEQ ID NO: 241757 - DNA, 15 bp, Homo sapiens
aaattcaattctata

SEQ ID NO: 241758 - DNA, 15 bp, Homo sapiens
taaattcaattctat

SEQ ID NO: 241759 - DNA, 15 bp, Homo sapiens
gtaaattcaattcta

SEQ ID NO: 241760 - DNA, 15 bp, Homo sapiens
agtaaattcaattct

SEQ ID NO: 241761 - DNA, 15 bp, Homo sapiens
aagtaaattcaattc

SEQ ID NO: 241762 - DNA, 15 bp, Homo sapiens
taagtaaattcaatt

SEQ ID NO: 241763 - DNA, 15 bp, Homo sapiens
ttaagtaaattcaat

SEQ ID NO: 241764 - DNA, 15 bp, Homo sapiens
tttaagtaaattcaa

SEQ ID NO: 241765 - DNA, 15 bp, Homo sapiens
atttaagtaaattca

SEQ ID NO: 241766 - DNA, 15 bp, Homo sapiens
catttaagtaaattc

SEQ ID NO: 241767 - DNA, 15 bp, Homo sapiens
gcatttaagtaaatt

SEQ ID NO: 241768 - DNA, 15 bp, Homo sapiens
ggcatttaagtaaat

SEQ ID NO: 241769 - DNA, 15 bp, Homo sapiens
tggcatttaagtaaa

SEQ ID NO: 241770 - DNA, 15 bp, Homo sapiens
atggcatttaagtaa

SEQ ID NO: 241771 - DNA, 15 bp, Homo sapiens
gatggcatttaagta

SEQ ID NO: 241772 - DNA, 15 bp, Homo sapiens
agatggcatttaagt

SEQ ID NO: 241773 - DNA, 15 bp, Homo sapiens
cagatggcatttaag

SEQ ID NO: 241774 - DNA, 15 bp, Homo sapiens
acagatggcatttaa

SEQ ID NO: 241775 - DNA, 15 bp, Homo sapiens
tacagatggcattta

SEQ ID NO: 241776 - DNA, 15 bp, Homo sapiens
gtacagatggcattt

SEQ ID NO: 241777 - DNA, 15 bp, Homo sapiens
agtacagatggcatt

SEQ ID NO: 241778 - DNA, 15 bp, Homo sapiens
gagtacagatggcat

SEQ ID NO: 241779 - DNA, 15 bp, Homo sapiens
tgagtacagatggca

SEQ ID NO: 241780 - DNA, 15 bp, Homo sapiens
ttgagtacagatggc

SEQ ID NO: 241781 - DNA, 15 bp, Homo sapiens
attgagtacagatgg

SEQ ID NO: 241782 - DNA, 15 bp, Homo sapiens
tattgagtacagatg

SEQ ID NO: 241783 - DNA, 15 bp, Homo sapiens
ctattgagtacagat

SEQ ID NO: 241784 - DNA, 15 bp, Homo sapiens
gctattgagtacaga

SEQ ID NO: 241785 - DNA, 15 bp, Homo sapiens
agctattgagtacag

SEQ ID NO: 241786 - DNA, 15 bp, Homo sapiens
tagctattgagtaca

SEQ ID NO: 241787 - DNA, 15 bp, Homo sapiens
gtagctattgagtac

SEQ ID NO: 241788 - DNA, 15 bp, Homo sapiens
agtagctattgagta

SEQ ID NO: 241789 - DNA, 15 bp, Homo sapiens
gagtagctattgagt

SEQ ID NO: 241790 - DNA, 15 bp, Homo sapiens
ggagtagctattgag

SEQ ID NO: 241791 - DNA, 15 bp, Homo sapiens
aggagtagctattga

SEQ ID NO: 241792 - DNA, 15 bp, Homo sapiens
caggagtagctattg

SEQ ID NO: 241793 - DNA, 15 bp, Homo sapiens
acaggagtagctatt

SEQ ID NO: 241794 - DNA, 15 bp, Homo sapiens
cacaggagtagctat

SEQ ID NO: 241795 - DNA, 15 bp, Homo sapiens
tcacaggagtagcta

SEQ ID NO: 241796 - DNA, 15 bp, Homo sapiens
gtcacaggagtagct

SEQ ID NO: 241797 - DNA, 15 bp, Homo sapiens
agtcacaggagtagc

SEQ ID NO: 241798 - DNA, 15 bp, Homo sapiens
tagtcacaggagtag

SEQ ID NO: 241799 - DNA, 15 bp, Homo sapiens
gtagtcacaggagta

SEQ ID NO: 241800 - DNA, 15 bp, Homo sapiens
cgtagtcacaggagt

SEQ ID NO: 241801 - DNA, 15 bp, Homo sapiens
tcgtagtcacaggag

SEQ ID NO: 241802 - DNA, 15 bp, Homo sapiens
atcgtagtcacagga

SEQ ID NO: 241803 - DNA, 15 bp, Homo sapiens
catcgtagtcacagg

SEQ ID NO: 241804 - DNA, 15 bp, Homo sapiens
gcatcgtagtcacag

SEQ ID NO: 241805 - DNA, 15 bp, Homo sapiens
tgcatcgtagtcaca

SEQ ID NO: 241806 - DNA, 15 bp, Homo sapiens
ttgcatcgtagtcac

SEQ ID NO: 241807 - DNA, 15 bp, Homo sapiens
tttgcatcgtagtca

SEQ ID NO: 241808 - DNA, 15 bp, Homo sapiens
ctttgcatcgtagtc

SEQ ID NO: 241809 - DNA, 15 bp, Homo sapiens
actttgcatcgtagt

SEQ ID NO: 241810 - DNA, 15 bp, Homo sapiens
tactttgcatcgtag

SEQ ID NO: 241811 - DNA, 15 bp, Homo sapiens
ttactttgcatcgta

SEQ ID NO: 241812 - DNA, 15 bp, Homo sapiens
tttactttgcatcgt

SEQ ID NO: 241813 - DNA, 15 bp, Homo sapiens
gtttactttgcatcg

SEQ ID NO: 241814 - DNA, 15 bp, Homo sapiens
tgtttactttgcatc

SEQ ID NO: 241815 - DNA, 15 bp, Homo sapiens
ttgtttactttgcat

SEQ ID NO: 241816 - DNA, 15 bp, Homo sapiens
attgtttactttgca

SEQ ID NO: 241817 - DNA, 15 bp, Homo sapiens
cattgtttactttgc

SEQ ID NO: 241818 - DNA, 15 bp, Homo sapiens
acattgtttactttg

SEQ ID NO: 241819 - DNA, 15 bp, Homo sapiens
aacattgtttacttt

SEQ ID NO: 241820 - DNA, 15 bp, Homo sapiens
taacattgtttactt

SEQ ID NO: 241821 - DNA, 15 bp, Homo sapiens
ataacattgtttact

SEQ ID NO: 241822 - DNA, 15 bp, Homo sapiens
aataacattgtttac

SEQ ID NO: 241823 - DNA, 15 bp, Homo sapiens
taataacattgttta

SEQ ID NO: 241824 - DNA, 15 bp, Homo sapiens
ctaataacattgttt

SEQ ID NO: 241825 - DNA, 15 bp, Homo sapiens
actaataacattgtt

SEQ ID NO: 241826 - DNA, 15 bp, Homo sapiens
gactaataacattgt

SEQ ID NO: 241827 - DNA, 15 bp, Homo sapiens
tgactaataacattg

SEQ ID NO: 241828 - DNA, 15 bp, Homo sapiens
atgactaataacatt

SEQ ID NO: 241829 - DNA, 15 bp, Homo sapiens
gatgactaataacat

SEQ ID NO: 241830 - DNA, 15 bp, Homo sapiens
agatgactaataaca

SEQ ID NO: 241831 - DNA, 15 bp, Homo sapiens
cagatgactaataac

SEQ ID NO: 241832 - DNA, 15 bp, Homo sapiens
ccagatgactaataa

SEQ ID NO: 241833 - DNA, 15 bp, Homo sapiens
tccagatgactaata

SEQ ID NO: 241834 - DNA, 15 bp, Homo sapiens
ttccagatgactaat

SEQ ID NO: 241835 - DNA, 15 bp, Homo sapiens
tttccagatgactaa

SEQ ID NO: 241836 - DNA, 15 bp, Homo sapiens
ttttccagatgacta

SEQ ID NO: 241837 - DNA, 15 bp, Homo sapiens
attttccagatgact

SEQ ID NO: 241838 - DNA, 15 bp, Homo sapiens
aattttccagatgac

SEQ ID NO: 241839 - DNA, 15 bp, Homo sapiens
gaattttccagatga

SEQ ID NO: 241840 - DNA, 15 bp, Homo sapiens
cgaattttccagatg

SEQ ID NO: 241841 - DNA, 15 bp, Homo sapiens
ccgaattttccagat

SEQ ID NO: 241842 - DNA, 15 bp, Homo sapiens
accgaattttccaga

SEQ ID NO: 241843 - DNA, 15 bp, Homo sapiens
gaccgaattttccag

SEQ ID NO: 241844 - DNA, 15 bp, Homo sapiens
agaccgaattttcca

SEQ ID NO: 241845 - DNA, 15 bp, Homo sapiens
aagaccgaattttcc

SEQ ID NO: 241846 - DNA, 15 bp, Homo sapiens
caagaccgaattttc

SEQ ID NO: 241847 - DNA, 15 bp, Homo sapiens
tcaagaccgaatttt

SEQ ID NO: 241848 - DNA, 15 bp, Homo sapiens
ttcaagaccgaattt

SEQ ID NO: 241849 - DNA, 15 bp, Homo sapiens
tttcaagaccgaatt

SEQ ID NO: 241850 - DNA, 15 bp, Homo sapiens
ttttcaagaccgaat

SEQ ID NO: 241851 - DNA, 15 bp, Homo sapiens
tttttcaagaccgaa

SEQ ID NO: 241852 - DNA, 15 bp, Homo sapiens
atttttcaagaccga

SEQ ID NO: 241853 - DNA, 15 bp, Homo sapiens
gatttttcaagaccg

SEQ ID NO: 241854 - DNA, 15 bp, Homo sapiens
agatttttcaagacc

SEQ ID NO: 241855 - DNA, 15 bp, Homo sapiens
tagatttttcaagac

SEQ ID NO: 241856 - DNA, 15 bp, Homo sapiens
ttagatttttcaaga

SEQ ID NO: 241857 - DNA, 15 bp, Homo sapiens
attagatttttcaag

SEQ ID NO: 241858 - DNA, 15 bp, Homo sapiens
aattagatttttcaa

SEQ ID NO: 241859 - DNA, 15 bp, Homo sapiens
aaattagatttttca

SEQ ID NO: 241860 - DNA, 15 bp, Homo sapiens
aaaattagatttttc

SEQ ID NO: 241861 - DNA, 15 bp, Homo sapiens
aaaaattagattttt

SEQ ID NO: 241862 - DNA, 15 bp, Homo sapiens
taaaaattagatttt

SEQ ID NO: 241863 - DNA, 15 bp, Homo sapiens
ttaaaaattagattt

SEQ ID NO: 241864 - DNA, 15 bp, Homo sapiens
attaaaaattagatt

SEQ ID NO: 241865 - DNA, 15 bp, Homo sapiens
gattaaaaattagat

SEQ ID NO: 241866 - DNA, 15 bp, Homo sapiens
agattaaaaattaga

SEQ ID NO: 241867 - DNA, 15 bp, Homo sapiens
cagattaaaaattag

SEQ ID NO: 241868 - DNA, 15 bp, Homo sapiens
ccagattaaaaatta

SEQ ID NO: 241869 - DNA, 15 bp, Homo sapiens
tccagattaaaaatt

SEQ ID NO: 241870 - DNA, 15 bp, Homo sapiens
atccagattaaaaat

SEQ ID NO: 241871 - DNA, 15 bp, Homo sapiens
tatccagattaaaaa

SEQ ID NO: 241872 - DNA, 15 bp, Homo sapiens
atatccagattaaaa

SEQ ID NO: 241873 - DNA, 15 bp, Homo sapiens
tatatccagattaaa

SEQ ID NO: 241874 - DNA, 15 bp, Homo sapiens
gtatatccagattaa

SEQ ID NO: 241875 - DNA, 15 bp, Homo sapiens
ggtatatccagatta

SEQ ID NO: 241876 - DNA, 15 bp, Homo sapiens
tggtatatccagatt

SEQ ID NO: 241877 - DNA, 15 bp, Homo sapiens
ctggtatatccagat

SEQ ID NO: 241878 - DNA, 15 bp, Homo sapiens
cctggtatatccaga

SEQ ID NO: 241879 - DNA, 15 bp, Homo sapiens
acctggtatatccag

SEQ ID NO: 241880 - DNA, 15 bp, Homo sapiens
tacctggtatatcca

SEQ ID NO: 241881 - DNA, 15 bp, Homo sapiens
ttacctggtatatcc

SEQ ID NO: 241882 - DNA, 15 bp, Homo sapiens
tttacctggtatatc

SEQ ID NO: 241883 - DNA, 15 bp, Homo sapiens
ttttacctggtatat

SEQ ID NO: 241884 - DNA, 15 bp, Homo sapiens
attttacctggtata

SEQ ID NO: 241885 - DNA, 15 bp, Homo sapiens
aattttacctggtat

SEQ ID NO: 241886 - DNA, 15 bp, Homo sapiens
taattttacctggta

SEQ ID NO: 241887 - DNA, 15 bp, Homo sapiens
ttaattttacctggt

SEQ ID NO: 241888 - DNA, 15 bp, Homo sapiens
attaattttacctgg

SEQ ID NO: 241889 - DNA, 15 bp, Homo sapiens
aattaattttacctg

SEQ ID NO: 241890 - DNA, 15 bp, Homo sapiens
aaattaattttacct

SEQ ID NO: 241891 - DNA, 15 bp, Homo sapiens
aaaattaattttacc

SEQ ID NO: 241892 - DNA, 15 bp, Homo sapiens
caaaattaattttac

SEQ ID NO: 241893 - DNA, 15 bp, Homo sapiens
accaaaattaatttt

SEQ ID NO: 241894 - DNA, 15 bp, Homo sapiens
aaccaaaattaattt

SEQ ID NO: 241895 - DNA, 15 bp, Homo sapiens
aaaccaaaattaatt

SEQ ID NO: 241896 - DNA, 15 bp, Homo sapiens
aaaaccaaaattaat

SEQ ID NO: 241897 - DNA, 15 bp, Homo sapiens
taaaaccaaaattaa

SEQ ID NO: 241898 - DNA, 15 bp, Homo sapiens
ctaaaaccaaaatta

SEQ ID NO: 241899 - DNA, 15 bp, Homo sapiens
gctaaaaccaaaatt

SEQ ID NO: 241900 - DNA, 15 bp, Homo sapiens
agctaaaaccaaaat

SEQ ID NO: 241901 - DNA, 15 bp, Homo sapiens
aagctaaaaccaaaa

SEQ ID NO: 241902 - DNA, 15 bp, Homo sapiens
aaagctaaaaccaaa

SEQ ID NO: 241903 - DNA, 15 bp, Homo sapiens
taaagctaaaaccaa

SEQ ID NO: 241904 - DNA, 15 bp, Homo sapiens
ataaagctaaaacca

SEQ ID NO: 241905 - DNA, 15 bp, Homo sapiens
gataaagctaaaacc

SEQ ID NO: 241906 - DNA, 15 bp, Homo sapiens
tgataaagctaaaac

SEQ ID NO: 241907 - DNA, 15 bp, Homo sapiens
ttgataaagctaaaa

SEQ ID NO: 241908 - DNA, 15 bp, Homo sapiens
tttgataaagctaaa

SEQ ID NO: 241909 - DNA, 15 bp, Homo sapiens
ttttgataaagctaa

SEQ ID NO: 241910 - DNA, 15 bp, Homo sapiens
tttttgataaagcta

SEQ ID NO: 241911 - DNA, 15 bp, Homo sapiens
atttttgataaagct

SEQ ID NO: 241912 - DNA, 15 bp, Homo sapiens
tatttttgataaagc

SEQ ID NO: 241913 - DNA, 15 bp, Homo sapiens
atatttttgataaag

SEQ ID NO: 241914 - DNA, 15 bp, Homo sapiens
tatatttttgataaa

SEQ ID NO: 241915 - DNA, 15 bp, Homo sapiens
atatatttttgataa

SEQ ID NO: 241916 - DNA, 15 bp, Homo sapiens
tatatatttttgata

SEQ ID NO: 241917 - DNA, 15 bp, Homo sapiens
atatatatttttgat

SEQ ID NO: 241918 - DNA, 15 bp, Homo sapiens
catatatatttttga

SEQ ID NO: 241919 - DNA, 15 bp, Homo sapiens
ccatatatatttttg

SEQ ID NO: 241920 - DNA, 15 bp, Homo sapiens
tccatatatattttt

SEQ ID NO: 241921 - DNA, 15 bp, Homo sapiens
ctccatatatatttt

SEQ ID NO: 241922 - DNA, 15 bp, Homo sapiens
actccatatatattt

SEQ ID NO: 241923 - DNA, 15 bp, Homo sapiens
tactccatatatatt

SEQ ID NO: 241924 - DNA, 15 bp, Homo sapiens
gtactccatatatat

SEQ ID NO: 241925 - DNA, 15 bp, Homo sapiens
tgtactccatatata

SEQ ID NO: 241926 - DNA, 15 bp, Homo sapiens
ctgtactccatatat

SEQ ID NO: 241927 - DNA, 15 bp, Homo sapiens
actgtactccatata

SEQ ID NO: 241928 - DNA, 15 bp, Homo sapiens
aactgtactccatat

SEQ ID NO: 241929 - DNA, 15 bp, Homo sapiens
aaactgtactccata

SEQ ID NO: 241930 - DNA, 15 bp, Homo sapiens
gaaactgtactccat

SEQ ID NO: 241931 - DNA, 15 bp, Homo sapiens
ggaaactgtactcca

SEQ ID NO: 241932 - DNA, 15 bp, Homo sapiens
tggaaactgtactcc

SEQ ID NO: 241933 - DNA, 15 bp, Homo sapiens
ctggaaactgtactc

SEQ ID NO: 241934 - DNA, 15 bp, Homo sapiens
tctggaaactgtact

SEQ ID NO: 241935 - DNA, 15 bp, Homo sapiens
atctggaaactgtac

SEQ ID NO: 241936 - DNA, 15 bp, Homo sapiens
catctggaaactgta

SEQ ID NO: 241937 - DNA, 15 bp, Homo sapiens
ccatctggaaactgt

SEQ ID NO: 241938 - DNA, 15 bp, Homo sapiens
gccatctggaaactg

SEQ ID NO: 241939 - DNA, 15 bp, Homo sapiens
tgccatctggaaact

SEQ ID NO: 241940 - DNA, 15 bp, Homo sapiens
gtgccatctggaaac

SEQ ID NO: 241941 - DNA, 15 bp, Homo sapiens
agtgccatctggaaa

SEQ ID NO: 241942 - DNA, 15 bp, Homo sapiens
tagtgccatctggaa

SEQ ID NO: 241943 - DNA, 15 bp, Homo sapiens
ttagtgccatctgga

SEQ ID NO: 241944 - DNA, 15 bp, Homo sapiens
cttagtgccatctgg

SEQ ID NO: 241945 - DNA, 15 bp, Homo sapiens
ccttagtgccatctg

SEQ ID NO: 241946 - DNA, 15 bp, Homo sapiens
accttagtgccatct

SEQ ID NO: 241947 - DNA, 15 bp, Homo sapiens
aaccttagtgccatc

SEQ ID NO: 241948 - DNA, 15 bp, Homo sapiens
aaaccttagtgccat

SEQ ID NO: 241949 - DNA, 15 bp, Homo sapiens
taaaccttagtgcca

SEQ ID NO: 241950 - DNA, 15 bp, Homo sapiens
ttaaaccttagtgcc

SEQ ID NO: 241951 - DNA, 15 bp, Homo sapiens
tttaaaccttagtgc

SEQ ID NO: 241952 - DNA, 15 bp, Homo sapiens
gtttaaaccttagtg

SEQ ID NO: 241953 - DNA, 15 bp, Homo sapiens
agtttaaaccttagt

SEQ ID NO: 241954 - DNA, 15 bp, Homo sapiens
cagtttaaaccttag

SEQ ID NO: 241955 - DNA, 15 bp, Homo sapiens
acagtttaaacctta

SEQ ID NO: 241956 - DNA, 15 bp, Homo sapiens
tacagtttaaacctt

SEQ ID NO: 241957 - DNA, 15 bp, Homo sapiens
ctacagtttaaacct

SEQ ID NO: 241958 - DNA, 15 bp, Homo sapiens
actacagtttaaacc

SEQ ID NO: 241959 - DNA, 15 bp, Homo sapiens
tactacagtttaaac

SEQ ID NO: 241960 - DNA, 15 bp, Homo sapiens
atactacagtttaaa

SEQ ID NO: 241961 - DNA, 15 bp, Homo sapiens
aatactacagtttaa

SEQ ID NO: 241962 - DNA, 15 bp, Homo sapiens
aaatactacagttta

SEQ ID NO: 241963 - DNA, 15 bp, Homo sapiens
taaatactacagttt

SEQ ID NO: 241964 - DNA, 15 bp, Homo sapiens
ataaatactacagtt

SEQ ID NO: 241965 - DNA, 15 bp, Homo sapiens
tataaatactacagt

SEQ ID NO: 241966 - DNA, 15 bp, Homo sapiens
ttataaatactacag

SEQ ID NO: 241967 - DNA, 15 bp, Homo sapiens
cttataaatactaca

SEQ ID NO: 241968 - DNA, 15 bp, Homo sapiens
gcttataaatactac

SEQ ID NO: 241969 - DNA, 15 bp, Homo sapiens
tgcttataaatacta

SEQ ID NO: 241970 - DNA, 15 bp, Homo sapiens
ttgcttataaatact

SEQ ID NO: 241971 - DNA, 15 bp, Homo sapiens
gttgcttataaatac

SEQ ID NO: 241972 - DNA, 15 bp, Homo sapiens
tgttgcttataaata

SEQ ID NO: 241973 - DNA, 15 bp, Homo sapiens
gtgttgcttataaat

SEQ ID NO: 241974 - DNA, 15 bp, Homo sapiens
ggtgttgcttataaa

SEQ ID NO: 241975 - DNA, 15 bp, Homo sapiens
tggtgttgcttataa

SEQ ID NO: 241976 - DNA, 15 bp, Homo sapiens
atggtgttgcttata

SEQ ID NO: 241977 - DNA, 15 bp, Homo sapiens
aatggtgttgcttat

SEQ ID NO: 241978 - DNA, 15 bp, Homo sapiens
aaatggtgttgctta

SEQ ID NO: 241979 - DNA, 15 bp, Homo sapiens
caaatggtgttgctt

SEQ ID NO: 241980 - DNA, 15 bp, Homo sapiens
tcaaatggtgttgct

SEQ ID NO: 241981 - DNA, 15 bp, Homo sapiens
ttcaaatggtgttgc

SEQ ID NO: 241982 - DNA, 15 bp, Homo sapiens
tttcaaatggtgttg

SEQ ID NO: 241983 - DNA, 15 bp, Homo sapiens
ctttcaaatggtgtt

SEQ ID NO: 241984 - DNA, 15 bp, Homo sapiens
actttcaaatggtgt

SEQ ID NO: 241985 - DNA, 15 bp, Homo sapiens
aactttcaaatggtg

SEQ ID NO: 241986 - DNA, 15 bp, Homo sapiens
aaactttcaaatggt

SEQ ID NO: 241987 - DNA, 15 bp, Homo sapiens
taaactttcaaatgg

SEQ ID NO: 241988 - DNA, 15 bp, Homo sapiens
ttaaactttcaaatg

SEQ ID NO: 241989 - DNA, 15 bp, Homo sapiens
tttaaactttcaaat

SEQ ID NO: 241990 - DNA, 15 bp, Homo sapiens
ttttaaactttcaaa

SEQ ID NO: 241991 - DNA, 15 bp, Homo sapiens
cttttaaactttcaa

SEQ ID NO: 241992 - DNA, 15 bp, Homo sapiens
acttttaaactttca

SEQ ID NO: 241993 - DNA, 15 bp, Homo sapiens
tacttttaaactttc

SEQ ID NO: 241994 - DNA, 15 bp, Homo sapiens
atacttttaaacttt

SEQ ID NO: 241995 - DNA, 15 bp, Homo sapiens
aatacttttaaactt

SEQ ID NO: 241996 - DNA, 15 bp, Homo sapiens
aaatacttttaaact

SEQ ID NO: 241997 - DNA, 15 bp, Homo sapiens
aaaatacttttaaac

SEQ ID NO: 241998 - DNA, 15 bp, Homo sapiens
aaaaatacttttaaa

SEQ ID NO: 241999 - DNA, 15 bp, Homo sapiens
taaaaatacttttaa

SEQ ID NO: 242000 - DNA, 15 bp, Homo sapiens
ataaaaatactttta

SEQ ID NO: 242001 - DNA, 15 bp, Homo sapiens
gataaaaatactttt

SEQ ID NO: 242002 - DNA, 15 bp, Homo sapiens
tgataaaaatacttt

SEQ ID NO: 242003 - DNA, 15 bp, Homo sapiens
ttgataaaaatactt

SEQ ID NO: 242004 - DNA, 15 bp, Homo sapiens
gttgataaaaatact

SEQ ID NO: 242005 - DNA, 15 bp, Homo sapiens
tgttgataaaaatac

SEQ ID NO: 242006 - DNA, 15 bp, Homo sapiens
ctgttgataaaaata

SEQ ID NO: 242007 - DNA, 15 bp, Homo sapiens
cctgttgataaaaat

SEQ ID NO: 242008 - DNA, 15 bp, Homo sapiens
acctgttgataaaaa

SEQ ID NO: 242009 - DNA, 15 bp, Homo sapiens
aacctgttgataaaa

SEQ ID NO: 242010 - DNA, 15 bp, Homo sapiens
taacctgttgataaa

SEQ ID NO: 242011 - DNA, 15 bp, Homo sapiens
ctaacctgttgataa

SEQ ID NO: 242012 - DNA, 15 bp, Homo sapiens
tctaacctgttgata

SEQ ID NO: 242013 - DNA, 15 bp, Homo sapiens
atctaacctgttgat

SEQ ID NO: 242014 - DNA, 15 bp, Homo sapiens
aatctaacctgttga

SEQ ID NO: 242015 - DNA, 15 bp, Homo sapiens
taatctaacctgttg

SEQ ID NO: 242016 - DNA, 15 bp, Homo sapiens
ctaatctaacctgtt

SEQ ID NO: 242017 - DNA, 15 bp, Homo sapiens
actaatctaacctgt

SEQ ID NO: 242018 - DNA, 15 bp, Homo sapiens
aactaatctaacctg

SEQ ID NO: 242019 - DNA, 15 bp, Homo sapiens
caactaatctaacct

SEQ ID NO: 242020 - DNA, 15 bp, Homo sapiens
ccaactaatctaacc

SEQ ID NO: 242021 - DNA, 15 bp, Homo sapiens
gccaactaatctaac

SEQ ID NO: 242022 - DNA, 15 bp, Homo sapiens
tgccaactaatctaa

SEQ ID NO: 242023 - DNA, 15 bp, Homo sapiens
atgccaactaatcta

SEQ ID NO: 242024 - DNA, 15 bp, Homo sapiens
aatgccaactaatct

SEQ ID NO: 242025 - DNA, 15 bp, Homo sapiens
taatgccaactaatc

SEQ ID NO: 242026 - DNA, 15 bp, Homo sapiens
ctaatgccaactaat

SEQ ID NO: 242027 - DNA, 15 bp, Homo sapiens
tctaatgccaactaa

SEQ ID NO: 242028 - DNA, 15 bp, Homo sapiens
gtctaatgccaacta

SEQ ID NO: 242029 - DNA, 15 bp, Homo sapiens
ggtctaatgccaact

SEQ ID NO: 242030 - DNA, 15 bp, Homo sapiens
aggtctaatgccaac

SEQ ID NO: 242031 - DNA, 15 bp, Homo sapiens
aaggtctaatgccaa

SEQ ID NO: 242032 - DNA, 15 bp, Homo sapiens
caaggtctaatgcca

SEQ ID NO: 242033 - DNA, 15 bp, Homo sapiens
tcaaggtctaatgcc

SEQ ID NO: 242034 - DNA, 15 bp, Homo sapiens
ttcaaggtctaatgc

SEQ ID NO: 242035 - DNA, 15 bp, Homo sapiens
gttcaaggtctaatg

SEQ ID NO: 242036 - DNA, 15 bp, Homo sapiens
ggttcaaggtctaat

SEQ ID NO: 242037 - DNA, 15 bp, Homo sapiens
aggttcaaggtctaa

SEQ ID NO: 242038 - DNA, 15 bp, Homo sapiens
caggttcaaggtcta

SEQ ID NO: 242039 - DNA, 15 bp, Homo sapiens
acaggttcaaggtct

SEQ ID NO: 242040 - DNA, 15 bp, Homo sapiens
tacaggttcaaggtc

SEQ ID NO: 242041 - DNA, 15 bp, Homo sapiens
atacaggttcaaggt

SEQ ID NO: 242042 - DNA, 15 bp, Homo sapiens
aatacaggttcaagg

SEQ ID NO: 242043 - DNA, 15 bp, Homo sapiens
caatacaggttcaag

SEQ ID NO: 242044 - DNA, 15 bp, Homo sapiens
acaatacaggttcaa

SEQ ID NO: 242045 - DNA, 15 bp, Homo sapiens
aacaatacaggttca

SEQ ID NO: 242046 - DNA, 15 bp, Homo sapiens
aaacaatacaggttc

SEQ ID NO: 242047 - DNA, 15 bp, Homo sapiens
gaaacaatacaggtt

SEQ ID NO: 242048 - DNA, 15 bp, Homo sapiens
agaaacaatacaggt

SEQ ID NO: 242049 - DNA, 15 bp, Homo sapiens
aagaaacaatacagg

SEQ ID NO: 242050 - DNA, 15 bp, Homo sapiens
caagaaacaatacag

SEQ ID NO: 242051 - DNA, 15 bp, Homo sapiens
acaagaaacaataca

SEQ ID NO: 242052 - DNA, 15 bp, Homo sapiens
aacaagaaacaatac

SEQ ID NO: 242053 - DNA, 15 bp, Homo sapiens
aaacaagaaacaata

SEQ ID NO: 242054 - DNA, 15 bp, Homo sapiens
aaaacaagaaacaat

SEQ ID NO: 242055 - DNA, 15 bp, Homo sapiens
taaaacaagaaacaa

SEQ ID NO: 242056 - DNA, 15 bp, Homo sapiens
gtaaaacaagaaaca

SEQ ID NO: 242057 - DNA, 15 bp, Homo sapiens
agtaaaacaagaaac

SEQ ID NO: 242058 - DNA, 15 bp, Homo sapiens
aagtaaaacaagaaa

SEQ ID NO: 242059 - DNA, 15 bp, Homo sapiens
gaagtaaaacaagaa

SEQ ID NO: 242060 - DNA, 15 bp, Homo sapiens
tgaagtaaaacaaga

SEQ ID NO: 242061 - DNA, 15 bp, Homo sapiens
ttgaagtaaaacaag

SEQ ID NO: 242062 - DNA, 15 bp, Homo sapiens
tttgaagtaaaacaa

SEQ ID NO: 242063 - DNA, 15 bp, Homo sapiens
atttgaagtaaaaca

SEQ ID NO: 242064 - DNA, 15 bp, Homo sapiens
catttgaagtaaaac

SEQ ID NO: 242065 - DNA, 15 bp, Homo sapiens
tcatttgaagtaaaa

SEQ ID NO: 242066 - DNA, 15 bp, Homo sapiens
ttcatttgaagtaaa

SEQ ID NO: 242067 - DNA, 15 bp, Homo sapiens
attcatttgaagtaa

SEQ ID NO: 242068 - DNA, 15 bp, Homo sapiens
gattcatttgaagta

SEQ ID NO: 242069 - DNA, 15 bp, Homo sapiens
ggattcatttgaagt

SEQ ID NO: 242070 - DNA, 15 bp, Homo sapiens
aggattcatttgaag

SEQ ID NO: 242071 - DNA, 15 bp, Homo sapiens
aaggattcatttgaa

SEQ ID NO: 242072 - DNA, 15 bp, Homo sapiens
taaggattcatttga

SEQ ID NO: 242073 - DNA, 15 bp, Homo sapiens
ttaaggattcatttg

SEQ ID NO: 242074 - DNA, 15 bp, Homo sapiens
tttaaggattcattt

SEQ ID NO: 242075 - DNA, 15 bp, Homo sapiens
ctttaaggattcatt

SEQ ID NO: 242076 - DNA, 15 bp, Homo sapiens
gctttaaggattcat

SEQ ID NO: 242077 - DNA, 15 bp, Homo sapiens
ggctttaaggattca

SEQ ID NO: 242078 - DNA, 15 bp, Homo sapiens
tggctttaaggattc

SEQ ID NO: 242079 - DNA, 15 bp, Homo sapiens
atggctttaaggatt

SEQ ID NO: 242080 - DNA, 15 bp, Homo sapiens
aatggctttaaggat

SEQ ID NO: 242081 - DNA, 15 bp, Homo sapiens
aaatggctttaagga

SEQ ID NO: 242082 - DNA, 15 bp, Homo sapiens
aaaatggctttaagg

SEQ ID NO: 242083 - DNA, 15 bp, Homo sapiens
aaaaatggctttaag

SEQ ID NO: 242084 - DNA, 15 bp, Homo sapiens
aaaaaatggctttaa

SEQ ID NO: 242085 - DNA, 15 bp, Homo sapiens
caaaaaatggcttta

SEQ ID NO: 242086 - DNA, 15 bp, Homo sapiens
acaaaaaatggcttt

SEQ ID NO: 242087 - DNA, 15 bp, Homo sapiens
aacaaaaaatggctt

SEQ ID NO: 242088 - DNA, 15 bp, Homo sapiens
aaacaaaaaatggct

SEQ ID NO: 242089 - DNA, 15 bp, Homo sapiens
caaacaaaaaatggc

SEQ ID NO: 242090 - DNA, 15 bp, Homo sapiens
ccaaacaaaaaatgg

SEQ ID NO: 242091 - DNA, 15 bp, Homo sapiens
gccaaacaaaaaatg

SEQ ID NO: 242092 - DNA, 15 bp, Homo sapiens
ggccaaacaaaaaat

SEQ ID NO: 242093 - DNA, 15 bp, Homo sapiens
gggccaaacaaaaaa

SEQ ID NO: 242094 - DNA, 15 bp, Homo sapiens
tgggccaaacaaaaa

SEQ ID NO: 242095 - DNA, 15 bp, Homo sapiens
ctgggccaaacaaaa

SEQ ID NO: 242096 - DNA, 15 bp, Homo sapiens
actgggccaaacaaa

SEQ ID NO: 242097 - DNA, 15 bp, Homo sapiens
cactgggccaaacaa

SEQ ID NO: 242098 - DNA, 15 bp, Homo sapiens
ccactgggccaaaca

SEQ ID NO: 242099 - DNA, 15 bp, Homo sapiens
tccactgggccaaac

SEQ ID NO: 242100 - DNA, 15 bp, Homo sapiens
atccactgggccaaa

SEQ ID NO: 242101 - DNA, 15 bp, Homo sapiens
gatccactgggccaa

SEQ ID NO: 242102 - DNA, 15 bp, Homo sapiens
agatccactgggcca

SEQ ID NO: 242103 - DNA, 15 bp, Homo sapiens
gagatccactgggcc

SEQ ID NO: 242104 - DNA, 15 bp, Homo sapiens
tgagatccactgggc

SEQ ID NO: 242105 - DNA, 15 bp, Homo sapiens
atgagatccactggg

SEQ ID NO: 242106 - DNA, 15 bp, Homo sapiens
tatgagatccactgg

SEQ ID NO: 242107 - DNA, 15 bp, Homo sapiens
ttatgagatccactg

SEQ ID NO: 242108 - DNA, 15 bp, Homo sapiens
attatgagatccact

SEQ ID NO: 242109 - DNA, 15 bp, Homo sapiens
aattatgagatccac

SEQ ID NO: 242110 - DNA, 15 bp, Homo sapiens
taattatgagatcca

SEQ ID NO: 242111 - DNA, 15 bp, Homo sapiens
ataattatgagatcc

SEQ ID NO: 242112 - DNA, 15 bp, Homo sapiens
tataattatgagatc

SEQ ID NO: 242113 - DNA, 15 bp, Homo sapiens
ctataattatgagat

SEQ ID NO: 242114 - DNA, 15 bp, Homo sapiens
cctataattatgaga

SEQ ID NO: 242115 - DNA, 15 bp, Homo sapiens
tcctataattatgag

SEQ ID NO: 242116 - DNA, 15 bp, Homo sapiens
ttcctataattatga

SEQ ID NO: 242117 - DNA, 15 bp, Homo sapiens
attcctataattatg

SEQ ID NO: 242118 - DNA, 15 bp, Homo sapiens
gattcctataattat

SEQ ID NO: 242119 - DNA, 15 bp, Homo sapiens
ggattcctataatta

SEQ ID NO: 242120 - DNA, 15 bp, Homo sapiens
tggattcctataatt

SEQ ID NO: 242121 - DNA, 15 bp, Homo sapiens
ctggattcctataat

SEQ ID NO: 242122 - DNA, 15 bp, Homo sapiens
gctggattcctataa

SEQ ID NO: 242123 - DNA, 15 bp, Homo sapiens
agctggattcctata

SEQ ID NO: 242124 - DNA, 15 bp, Homo sapiens
gagctggattcctat

SEQ ID NO: 242125 - DNA, 15 bp, Homo sapiens
tgagctggattccta

SEQ ID NO: 242126 - DNA, 15 bp, Homo sapiens
ctgagctggattcct

SEQ ID NO: 242127 - DNA, 15 bp, Homo sapiens
tctgagctggattcc

SEQ ID NO: 242128 - DNA, 15 bp, Homo sapiens
ttctgagctggattc

SEQ ID NO: 242129 - DNA, 15 bp, Homo sapiens
tttctgagctggatt

SEQ ID NO: 242130 - DNA, 15 bp, Homo sapiens
gtttctgagctggat

SEQ ID NO: 242131 - DNA, 15 bp, Homo sapiens
ggtttctgagctgga

SEQ ID NO: 242132 - DNA, 15 bp, Homo sapiens
tggtttctgagctgg

SEQ ID NO: 242133 - DNA, 15 bp, Homo sapiens
ctggtttctgagctg

SEQ ID NO: 242134 - DNA, 15 bp, Homo sapiens
tctggtttctgagct

SEQ ID NO: 242135 - DNA, 15 bp, Homo sapiens
ctctggtttctgagc

SEQ ID NO: 242136 - DNA, 15 bp, Homo sapiens
gctctggtttctgag

SEQ ID NO: 242137 - DNA, 15 bp, Homo sapiens
tgctctggtttctga

SEQ ID NO: 242138 - DNA, 15 bp, Homo sapiens
ctgctctggtttctg

SEQ ID NO: 242139 - DNA, 15 bp, Homo sapiens
actgctctggtttct

SEQ ID NO: 242140 - DNA, 15 bp, Homo sapiens
aactgctctggtttc

SEQ ID NO: 242141 - DNA, 15 bp, Homo sapiens
gaactgctctggttt

SEQ ID NO: 242142 - DNA, 15 bp, Homo sapiens
tgaactgctctggtt

SEQ ID NO: 242143 - DNA, 15 bp, Homo sapiens
atgaactgctctggt

SEQ ID NO: 242144 - DNA, 15 bp, Homo sapiens
aatgaactgctctgg

SEQ ID NO: 242145 - DNA, 15 bp, Homo sapiens
caatgaactgctctg

SEQ ID NO: 242146 - DNA, 15 bp, Homo sapiens
tcaatgaactgctct

SEQ ID NO: 242147 - DNA, 15 bp, Homo sapiens
ttcaatgaactgctc

SEQ ID NO: 242148 - DNA, 15 bp, Homo sapiens
attcaatgaactgct

SEQ ID NO: 242149 - DNA, 15 bp, Homo sapiens
aattcaatgaactgc

SEQ ID NO: 242150 - DNA, 15 bp, Homo sapiens
aaattcaatgaactg

SEQ ID NO: 242151 - DNA, 15 bp, Homo sapiens
caaattcaatgaact

SEQ ID NO: 242152 - DNA, 15 bp, Homo sapiens
gcaaattcaatgaac

SEQ ID NO: 242153 - DNA, 15 bp, Homo sapiens
agcaaattcaatgaa

SEQ ID NO: 242154 - DNA, 15 bp, Homo sapiens
tagcaaattcaatga

SEQ ID NO: 242155 - DNA, 15 bp, Homo sapiens
atagcaaattcaatg

SEQ ID NO: 242156 - DNA, 15 bp, Homo sapiens
tatagcaaattcaat

SEQ ID NO: 242157 - DNA, 15 bp, Homo sapiens
ttatagcaaattcaa

SEQ ID NO: 242158 - DNA, 15 bp, Homo sapiens
tttatagcaaattca

SEQ ID NO: 242159 - DNA, 15 bp, Homo sapiens
ttttatagcaaattc

SEQ ID NO: 242160 - DNA, 15 bp, Homo sapiens
attttatagcaaatt

SEQ ID NO: 242161 - DNA, 15 bp, Homo sapiens
cattttatagcaaat

SEQ ID NO: 242162 - DNA, 15 bp, Homo sapiens
acattttatagcaaa

SEQ ID NO: 242163 - DNA, 15 bp, Homo sapiens
aacattttatagcaa

SEQ ID NO: 242164 - DNA, 15 bp, Homo sapiens
gaacattttatagca

SEQ ID NO: 242165 - DNA, 15 bp, Homo sapiens
tgaacattttatagc

SEQ ID NO: 242166 - DNA, 15 bp, Homo sapiens
ctgaacattttatag

SEQ ID NO: 242167 - DNA, 15 bp, Homo sapiens
actgaacattttata

SEQ ID NO: 242168 - DNA, 15 bp, Homo sapiens
aactgaacattttat

SEQ ID NO: 242169 - DNA, 15 bp, Homo sapiens
caactgaacatttta

SEQ ID NO: 242170 - DNA, 15 bp, Homo sapiens
acaactgaacatttt

SEQ ID NO: 242171 - DNA, 15 bp, Homo sapiens
aacaactgaacattt

SEQ ID NO: 242172 - DNA, 15 bp, Homo sapiens
aaacaactgaacatt

SEQ ID NO: 242173 - DNA, 15 bp, Homo sapiens
aaaacaactgaacat

SEQ ID NO: 242174 - DNA, 15 bp, Homo sapiens
caaaacaactgaaca

SEQ ID NO: 242175 - DNA, 15 bp, Homo sapiens
gcaaaacaactgaac

SEQ ID NO: 242176 - DNA, 15 bp, Homo sapiens
tgcaaaacaactgaa

SEQ ID NO: 242177 - DNA, 15 bp, Homo sapiens
atgcaaaacaactga

SEQ ID NO: 242178 - DNA, 15 bp, Homo sapiens
aatgcaaaacaactg

SEQ ID NO: 242179 - DNA, 15 bp, Homo sapiens
taatgcaaaacaact

SEQ ID NO: 242180 - DNA, 15 bp, Homo sapiens
ttaatgcaaaacaac

SEQ ID NO: 242181 - DNA, 15 bp, Homo sapiens
cttaatgcaaaacaa

SEQ ID NO: 242182 - DNA, 15 bp, Homo sapiens
ccttaatgcaaaaca

SEQ ID NO: 242183 - DNA, 15 bp, Homo sapiens
accttaatgcaaaac

SEQ ID NO: 242184 - DNA, 15 bp, Homo sapiens
caccttaatgcaaaa

SEQ ID NO: 242185 - DNA, 15 bp, Homo sapiens
acaccttaatgcaaa

SEQ ID NO: 242186 - DNA, 15 bp, Homo sapiens
tacaccttaatgcaa

SEQ ID NO: 242187 - DNA, 15 bp, Homo sapiens
ttacaccttaatgca

SEQ ID NO: 242188 - DNA, 15 bp, Homo sapiens
cttacaccttaatgc

SEQ ID NO: 242189 - DNA, 15 bp, Homo sapiens
ccttacaccttaatg

SEQ ID NO: 242190 - DNA, 15 bp, Homo sapiens
gccttacaccttaat

SEQ ID NO: 242191 - DNA, 15 bp, Homo sapiens
agccttacaccttaa

SEQ ID NO: 242192 - DNA, 15 bp, Homo sapiens
aagccttacacctta

SEQ ID NO: 242193 - DNA, 15 bp, Homo sapiens
aaagccttacacctt

SEQ ID NO: 242194 - DNA, 15 bp, Homo sapiens
aaaagccttacacct

SEQ ID NO: 242195 - DNA, 15 bp, Homo sapiens
aaaaagccttacacc

SEQ ID NO: 242196 - DNA, 15 bp, Homo sapiens
caaaaagccttacac

SEQ ID NO: 242197 - DNA, 15 bp, Homo sapiens
ccaaaaagccttaca

SEQ ID NO: 242198 - DNA, 15 bp, Homo sapiens
accaaaaagccttac

SEQ ID NO: 242199 - DNA, 15 bp, Homo sapiens
aaccaaaaagcctta

SEQ ID NO: 242200 - DNA, 15 bp, Homo sapiens
aaaccaaaaagcctt

SEQ ID NO: 242201 - DNA, 15 bp, Homo sapiens
gaaaccaaaaagcct

SEQ ID NO: 242202 - DNA, 15 bp, Homo sapiens
ggaaaccaaaaagcc

SEQ ID NO: 242203 - DNA, 15 bp, Homo sapiens
tggaaaccaaaaagc

SEQ ID NO: 242204 - DNA, 15 bp, Homo sapiens
ttggaaaccaaaaag

SEQ ID NO: 242205 - DNA, 15 bp, Homo sapiens
gttggaaaccaaaaa

SEQ ID NO: 242206 - DNA, 15 bp, Homo sapiens
cgttggaaaccaaaa

SEQ ID NO: 242207 - DNA, 15 bp, Homo sapiens
acgttggaaaccaaa

SEQ ID NO: 242208 - DNA, 15 bp, Homo sapiens
aacgttggaaaccaa

SEQ ID NO: 242209 - DNA, 15 bp, Homo sapiens
aaacgttggaaacca

SEQ ID NO: 242210 - DNA, 15 bp, Homo sapiens
gaaacgttggaaacc

SEQ ID NO: 242211 - DNA, 15 bp, Homo sapiens
ggaaacgttggaaac

SEQ ID NO: 242212 - DNA, 15 bp, Homo sapiens
tggaaacgttggaaa

SEQ ID NO: 242213 - DNA, 15 bp, Homo sapiens
ttggaaacgttggaa

SEQ ID NO: 242214 - DNA, 15 bp, Homo sapiens
attggaaacgttgga

SEQ ID NO: 242215 - DNA, 15 bp, Homo sapiens
tattggaaacgttgg

SEQ ID NO: 242216 - DNA, 15 bp, Homo sapiens
ttattggaaacgttg

SEQ ID NO: 242217 - DNA, 15 bp, Homo sapiens
attattggaaacgtt

SEQ ID NO: 242218 - DNA, 15 bp, Homo sapiens
gattattggaaacgt

SEQ ID NO: 242219 - DNA, 15 bp, Homo sapiens
agattattggaaacg

SEQ ID NO: 242220 - DNA, 15 bp, Homo sapiens
gagattattggaaac

SEQ ID NO: 242221 - DNA, 15 bp, Homo sapiens
ggagattattggaaa

SEQ ID NO: 242222 - DNA, 15 bp, Homo sapiens
gggagattattggaa

SEQ ID NO: 242223 - DNA, 15 bp, Homo sapiens
agggagattattgga

SEQ ID NO: 242224 - DNA, 15 bp, Homo sapiens
aagggagattattgg

SEQ ID NO: 242225 - DNA, 15 bp, Homo sapiens
aaagggagattattg

SEQ ID NO: 242226 - DNA, 15 bp, Homo sapiens
caaagggagattatt

SEQ ID NO: 242227 - DNA, 15 bp, Homo sapiens
acaaagggagattat

SEQ ID NO: 242228 - DNA, 15 bp, Homo sapiens
aacaaagggagatta

SEQ ID NO: 242229 - DNA, 15 bp, Homo sapiens
aaacaaagggagatt

SEQ ID NO: 242230 - DNA, 15 bp, Homo sapiens
gaaacaaagggagat

SEQ ID NO: 242231 - DNA, 15 bp, Homo sapiens
ggaaacaaagggaga

SEQ ID NO: 242232 - DNA, 15 bp, Homo sapiens
aggaaacaaagggag

SEQ ID NO: 242233 - DNA, 15 bp, Homo sapiens
gaggaaacaaaggga

SEQ ID NO: 242234 - DNA, 15 bp, Homo sapiens
tgaggaaacaaaggg

SEQ ID NO: 242235 - DNA, 15 bp, Homo sapiens
ctgaggaaacaaagg

SEQ ID NO: 242236 - DNA, 15 bp, Homo sapiens
gctgaggaaacaaag

SEQ ID NO: 242237 - DNA, 15 bp, Homo sapiens
cgctgaggaaacaaa

SEQ ID NO: 242238 - DNA, 15 bp, Homo sapiens
acgctgaggaaacaa

SEQ ID NO: 242239 - DNA, 15 bp, Homo sapiens
gacgctgaggaaaca

SEQ ID NO: 242240 - DNA, 15 bp, Homo sapiens
tgacgctgaggaaac

SEQ ID NO: 242241 - DNA, 15 bp, Homo sapiens
ctgacgctgaggaaa

SEQ ID NO: 242242 - DNA, 15 bp, Homo sapiens
actgacgctgaggaa

SEQ ID NO: 242243 - DNA, 15 bp, Homo sapiens
gactgacgctgagga

SEQ ID NO: 242244 - DNA, 15 bp, Homo sapiens
ggactgacgctgagg

SEQ ID NO: 242245 - DNA, 15 bp, Homo sapiens
tggactgacgctgag

SEQ ID NO: 242246 - DNA, 15 bp, Homo sapiens
ctggactgacgctga

SEQ ID NO: 242247 - DNA, 15 bp, Homo sapiens
gctggactgacgctg

SEQ ID NO: 242248 - DNA, 15 bp, Homo sapiens
agctggactgacgct

SEQ ID NO: 242249 - DNA, 15 bp, Homo sapiens
cagctggactgacgc

SEQ ID NO: 242250 - DNA, 15 bp, Homo sapiens
gcagctggactgacg

SEQ ID NO: 242251 - DNA, 15 bp, Homo sapiens
ggcagctggactgac

SEQ ID NO: 242252 - DNA, 15 bp, Homo sapiens
cggcagctggactga

SEQ ID NO: 242253 - DNA, 15 bp, Homo sapiens
acggcagctggactg

SEQ ID NO: 242254 - DNA, 15 bp, Homo sapiens
cacggcagctggact

SEQ ID NO: 242255 - DNA, 15 bp, Homo sapiens
ccacggcagctggac

SEQ ID NO: 242256 - DNA, 15 bp, Homo sapiens
gccacggcagctgga

SEQ ID NO: 242257 - DNA, 15 bp, Homo sapiens
tgccacggcagctgg

SEQ ID NO: 242258 - DNA, 15 bp, Homo sapiens
ttgccacggcagctg

SEQ ID NO: 242259 - DNA, 15 bp, Homo sapiens
tttgccacggcagct

SEQ ID NO: 242260 - DNA, 15 bp, Homo sapiens
ctttgccacggcagc

SEQ ID NO: 242261 - DNA, 15 bp, Homo sapiens
tctttgccacggcag

SEQ ID NO: 242262 - DNA, 15 bp, Homo sapiens
atctttgccacggca

SEQ ID NO: 242263 - DNA, 15 bp, Homo sapiens
gatctttgccacggc

SEQ ID NO: 242264 - DNA, 15 bp, Homo sapiens
ggatctttgccacgg

SEQ ID NO: 242265 - DNA, 15 bp, Homo sapiens
tggatctttgccacg

SEQ ID NO: 242266 - DNA, 15 bp, Homo sapiens
atggatctttgccac

SEQ ID NO: 242267 - DNA, 15 bp, Homo sapiens
aatggatctttgcca

SEQ ID NO: 242268 - DNA, 15 bp, Homo sapiens
aaatggatctttgcc

SEQ ID NO: 242269 - DNA, 15 bp, Homo sapiens
gaaatggatctttgc

SEQ ID NO: 242270 - DNA, 15 bp, Homo sapiens
tgaaatggatctttg

SEQ ID NO: 242271 - DNA, 15 bp, Homo sapiens
gtgaaatggatcttt

SEQ ID NO: 242272 - DNA, 15 bp, Homo sapiens
tgtgaaatggatctt

SEQ ID NO: 242273 - DNA, 15 bp, Homo sapiens
atgtgaaatggatct

SEQ ID NO: 242274 - DNA, 15 bp, Homo sapiens
tatgtgaaatggatc

SEQ ID NO: 242275 - DNA, 15 bp, Homo sapiens
ttatgtgaaatggat

SEQ ID NO: 242276 - DNA, 15 bp, Homo sapiens
attatgtgaaatgga

SEQ ID NO: 242277 - DNA, 15 bp, Homo sapiens
tattatgtgaaatgg

SEQ ID NO: 242278 - DNA, 15 bp, Homo sapiens
ttattatgtgaaatg

SEQ ID NO: 242279 - DNA, 15 bp, Homo sapiens
tttattatgtgaaat

SEQ ID NO: 242280 - DNA, 15 bp, Homo sapiens
ctttattatgtgaaa

SEQ ID NO: 242281 - DNA, 15 bp, Homo sapiens
actttattatgtgaa

SEQ ID NO: 242282 - DNA, 15 bp, Homo sapiens
cactttattatgtga

SEQ ID NO: 242283 - DNA, 15 bp, Homo sapiens
gcactttattatgtg

SEQ ID NO: 242284 - DNA, 15 bp, Homo sapiens
ggcactttattatgt

SEQ ID NO: 242285 - DNA, 15 bp, Homo sapiens
gggcactttattatg

SEQ ID NO: 242286 - DNA, 15 bp, Homo sapiens
agggcactttattat

SEQ ID NO: 242287 - DNA, 15 bp, Homo sapiens
tagggcactttatta

SEQ ID NO: 242288 - DNA, 15 bp, Homo sapiens
atagggcactttatt

SEQ ID NO: 242289 - DNA, 15 bp, Homo sapiens
aatagggcactttat

SEQ ID NO: 242290 - DNA, 15 bp, Homo sapiens
taatagggcacttta

SEQ ID NO: 242291 - DNA, 15 bp, Homo sapiens
gtaatagggcacttt

SEQ ID NO: 242292 - DNA, 15 bp, Homo sapiens
tgtaatagggcactt

SEQ ID NO: 242293 - DNA, 15 bp, Homo sapiens
atgtaatagggcact

SEQ ID NO: 242294 - DNA, 15 bp, Homo sapiens
gatgtaatagggcac

SEQ ID NO: 242295 - DNA, 15 bp, Homo sapiens
tgatgtaatagggca

SEQ ID NO: 242296 - DNA, 15 bp, Homo sapiens
ttgatgtaatagggc

SEQ ID NO: 242297 - DNA, 15 bp, Homo sapiens
cttgatgtaataggg

SEQ ID NO: 242298 - DNA, 15 bp, Homo sapiens
acttgatgtaatagg

SEQ ID NO: 242299 - DNA, 15 bp, Homo sapiens
tacttgatgtaatag

SEQ ID NO: 242300 - DNA, 15 bp, Homo sapiens
ttacttgatgtaata

SEQ ID NO: 242301 - DNA, 15 bp, Homo sapiens
cttacttgatgtaat

SEQ ID NO: 242302 - DNA, 15 bp, Homo sapiens
acttacttgatgtaa

SEQ ID NO: 242303 - DNA, 15 bp, Homo sapiens
aacttacttgatgta

SEQ ID NO: 242304 - DNA, 15 bp, Homo sapiens
caacttacttgatgt

SEQ ID NO: 242305 - DNA, 15 bp, Homo sapiens
tcaacttacttgatg

SEQ ID NO: 242306 - DNA, 15 bp, Homo sapiens
atcaacttacttgat

SEQ ID NO: 242307 - DNA, 15 bp, Homo sapiens
aatcaacttacttga

SEQ ID NO: 242308 - DNA, 15 bp, Homo sapiens
aaatcaacttacttg

SEQ ID NO: 242309 - DNA, 15 bp, Homo sapiens
aaaatcaacttactt

SEQ ID NO: 242310 - DNA, 15 bp, Homo sapiens
taaaatcaacttact

SEQ ID NO: 242311 - DNA, 15 bp, Homo sapiens
ttaaaatcaacttac

SEQ ID NO: 242312 - DNA, 15 bp, Homo sapiens
attaaaatcaactta

SEQ ID NO: 242313 - DNA, 15 bp, Homo sapiens
aattaaaatcaactt

SEQ ID NO: 242314 - DNA, 15 bp, Homo sapiens
gaattaaaatcaact

SEQ ID NO: 242315 - DNA, 15 bp, Homo sapiens
agaattaaaatcaac

SEQ ID NO: 242316 - DNA, 15 bp, Homo sapiens
gagaattaaaatcaa

SEQ ID NO: 242317 - DNA, 15 bp, Homo sapiens
ggagaattaaaatca

SEQ ID NO: 242318 - DNA, 15 bp, Homo sapiens
aggagaattaaaatc

SEQ ID NO: 242319 - DNA, 15 bp, Homo sapiens
aaggagaattaaaat

SEQ ID NO: 242320 - DNA, 15 bp, Homo sapiens
aaaggagaattaaaa

SEQ ID NO: 242321 - DNA, 15 bp, Homo sapiens
taaaggagaattaaa

SEQ ID NO: 242322 - DNA, 15 bp, Homo sapiens
ataaaggagaattaa

SEQ ID NO: 242323 - DNA, 15 bp, Homo sapiens
cataaaggagaatta

SEQ ID NO: 242324 - DNA, 15 bp, Homo sapiens
tcataaaggagaatt

SEQ ID NO: 242325 - DNA, 15 bp, Homo sapiens
atcataaaggagaat

SEQ ID NO: 242326 - DNA, 15 bp, Homo sapiens
tatcataaaggagaa

SEQ ID NO: 242327 - DNA, 15 bp, Homo sapiens
gtatcataaaggaga

SEQ ID NO: 242328 - DNA, 15 bp, Homo sapiens
ggtatcataaaggag

SEQ ID NO: 242329 - DNA, 15 bp, Homo sapiens
tggtatcataaagga

SEQ ID NO: 242330 - DNA, 15 bp, Homo sapiens
ttggtatcataaagg

SEQ ID NO: 242331 - DNA, 15 bp, Homo sapiens
cttggtatcataaag

SEQ ID NO: 242332 - DNA, 15 bp, Homo sapiens
tcttggtatcataaa

SEQ ID NO: 242333 - DNA, 15 bp, Homo sapiens
ttcttggtatcataa

SEQ ID NO: 242334 - DNA, 15 bp, Homo sapiens
tttcttggtatcata

SEQ ID NO: 242335 - DNA, 15 bp, Homo sapiens
ttttcttggtatcat

SEQ ID NO: 242336 - DNA, 15 bp, Homo sapiens
attttcttggtatca

SEQ ID NO: 242337 - DNA, 15 bp, Homo sapiens
gattttcttggtatc

SEQ ID NO: 242338 - DNA, 15 bp, Homo sapiens
tgattttcttggtat

SEQ ID NO: 242339 - DNA, 15 bp, Homo sapiens
atgattttcttggta

SEQ ID NO: 242340 - DNA, 15 bp, Homo sapiens
catgattttcttggt

SEQ ID NO: 242341 - DNA, 15 bp, Homo sapiens
acatgattttcttgg

SEQ ID NO: 242342 - DNA, 15 bp, Homo sapiens
aacatgattttcttg

SEQ ID NO: 242343 - DNA, 15 bp, Homo sapiens
aaacatgattttctt

SEQ ID NO: 242344 - DNA, 15 bp, Homo sapiens
aaaacatgattttct

SEQ ID NO: 242345 - DNA, 15 bp, Homo sapiens
taaaacatgattttc

SEQ ID NO: 242346 - DNA, 15 bp, Homo sapiens
ataaaacatgatttt

SEQ ID NO: 242347 - DNA, 15 bp, Homo sapiens
aataaaacatgattt

SEQ ID NO: 242348 - DNA, 15 bp, Homo sapiens
caataaaacatgatt

SEQ ID NO: 242349 - DNA, 15 bp, Homo sapiens
tcaataaaacatgat

SEQ ID NO: 242350 - DNA, 15 bp, Homo sapiens
atcaataaaacatga

SEQ ID NO: 242351 - DNA, 15 bp, Homo sapiens
tatcaataaaacatg

SEQ ID NO: 242352 - DNA, 15 bp, Homo sapiens
ttatcaataaaacat

SEQ ID NO: 242353 - DNA, 15 bp, Homo sapiens
gttatcaataaaaca

SEQ ID NO: 242354 - DNA, 15 bp, Homo sapiens
agttatcaataaaac

SEQ ID NO: 242355 - DNA, 15 bp, Homo sapiens
aagttatcaataaaa

SEQ ID NO: 242356 - DNA, 15 bp, Homo sapiens
taagttatcaataaa

SEQ ID NO: 242357 - DNA, 15 bp, Homo sapiens
ttaagttatcaataa

SEQ ID NO: 242358 - DNA, 15 bp, Homo sapiens
cttaagttatcaata

SEQ ID NO: 242359 - DNA, 15 bp, Homo sapiens
tcttaagttatcaat

SEQ ID NO: 242360 - DNA, 15 bp, Homo sapiens
ctcttaagttatcaa

SEQ ID NO: 242361 - DNA, 15 bp, Homo sapiens
cctcttaagttatca

SEQ ID NO: 242362 - DNA, 15 bp, Homo sapiens
gcctcttaagttatc

SEQ ID NO: 242363 - DNA, 15 bp, Homo sapiens
agcctcttaagttat

SEQ ID NO: 242364 - DNA, 15 bp, Homo sapiens
aagcctcttaagtta

SEQ ID NO: 242365 - DNA, 15 bp, Homo sapiens
gaagcctcttaagtt

SEQ ID NO: 242366 - DNA, 15 bp, Homo sapiens
agaagcctcttaagt

SEQ ID NO: 242367 - DNA, 15 bp, Homo sapiens
gagaagcctcttaag

SEQ ID NO: 242368 - DNA, 15 bp, Homo sapiens
agagaagcctcttaa

SEQ ID NO: 242369 - DNA, 15 bp, Homo sapiens
gagagaagcctctta

SEQ ID NO: 242370 - DNA, 15 bp, Homo sapiens
ggagagaagcctctt

SEQ ID NO: 242371 - DNA, 15 bp, Homo sapiens
gggagagaagcctct

SEQ ID NO: 242372 - DNA, 15 bp, Homo sapiens
ggggagagaagcctc

SEQ ID NO: 242373 - DNA, 15 bp, Homo sapiens
tggggagagaagcct

SEQ ID NO: 242374 - DNA, 15 bp, Homo sapiens
atggggagagaagcc

SEQ ID NO: 242375 - DNA, 15 bp, Homo sapiens
tatggggagagaagc

SEQ ID NO: 242376 - DNA, 15 bp, Homo sapiens
ttatggggagagaag

SEQ ID NO: 242377 - DNA, 15 bp, Homo sapiens
gttatggggagagaa

SEQ ID NO: 242378 - DNA, 15 bp, Homo sapiens
agttatggggagaga

SEQ ID NO: 242379 - DNA, 15 bp, Homo sapiens
aagttatggggagag

SEQ ID NO: 242380 - DNA, 15 bp, Homo sapiens
aaagttatggggaga

SEQ ID NO: 242381 - DNA, 15 bp, Homo sapiens
aaaagttatggggag

SEQ ID NO: 242382 - DNA, 15 bp, Homo sapiens
taaaagttatgggga

SEQ ID NO: 242383 - DNA, 15 bp, Homo sapiens
ttaaaagttatgggg

SEQ ID NO: 242384 - DNA, 15 bp, Homo sapiens
tttaaaagttatggg

SEQ ID NO: 242385 - DNA, 15 bp, Homo sapiens
ttttaaaagttatgg

SEQ ID NO: 242386 - DNA, 15 bp, Homo sapiens
tttttaaaagttatg

SEQ ID NO: 242387 - DNA, 15 bp, Homo sapiens
atttttaaaagttat

SEQ ID NO: 242388 - DNA, 15 bp, Homo sapiens
tatttttaaaagtta

SEQ ID NO: 242389 - DNA, 15 bp, Homo sapiens
ctatttttaaaagtt

SEQ ID NO: 242390 - DNA, 15 bp, Homo sapiens
tctatttttaaaagt

SEQ ID NO: 242391 - DNA, 15 bp, Homo sapiens
ttctatttttaaaag

SEQ ID NO: 242392 - DNA, 15 bp, Homo sapiens
aattctatttttaaa

SEQ ID NO: 242393 - DNA, 15 bp, Homo sapiens
gaattctatttttaa

SEQ ID NO: 242394 - DNA, 15 bp, Homo sapiens
tgaattctattttta

SEQ ID NO: 242395 - DNA, 15 bp, Homo sapiens
ctgaattctattttt

SEQ ID NO: 242396 - DNA, 15 bp, Homo sapiens
actgaattctatttt

SEQ ID NO: 242397 - DNA, 15 bp, Homo sapiens
gactgaattctattt

SEQ ID NO: 242398 - DNA, 15 bp, Homo sapiens
ggactgaattctatt

SEQ ID NO: 242399 - DNA, 15 bp, Homo sapiens
aggactgaattctat

SEQ ID NO: 242400 - DNA, 15 bp, Homo sapiens
taggactgaattcta

SEQ ID NO: 242401 - DNA, 15 bp, Homo sapiens
ataggactgaattct

SEQ ID NO: 242402 - DNA, 15 bp, Homo sapiens
aataggactgaattc

SEQ ID NO: 242403 - DNA, 15 bp, Homo sapiens
taataggactgaatt

SEQ ID NO: 242404 - DNA, 15 bp, Homo sapiens
ataataggactgaat

SEQ ID NO: 242405 - DNA, 15 bp, Homo sapiens
gataataggactgaa

SEQ ID NO: 242406 - DNA, 15 bp, Homo sapiens
agataataggactga

SEQ ID NO: 242407 - DNA, 15 bp, Homo sapiens
cagataataggactg

SEQ ID NO: 242408 - DNA, 15 bp, Homo sapiens
tcagataataggact

SEQ ID NO: 242409 - DNA, 15 bp, Homo sapiens
ttcagataataggac

SEQ ID NO: 242410 - DNA, 15 bp, Homo sapiens
tttcagataatagga

SEQ ID NO: 242411 - DNA, 15 bp, Homo sapiens
ctttcagataatagg

SEQ ID NO: 242412 - DNA, 15 bp, Homo sapiens
tctttcagataatag

SEQ ID NO: 242413 - DNA, 15 bp, Homo sapiens
ttctttcagataata

SEQ ID NO: 242414 - DNA, 15 bp, Homo sapiens
tttctttcagataat

SEQ ID NO: 242415 - DNA, 15 bp, Homo sapiens
gtttctttcagataa

SEQ ID NO: 242416 - DNA, 15 bp, Homo sapiens
agtttctttcagata

SEQ ID NO: 242417 - DNA, 15 bp, Homo sapiens
cagtttctttcagat

SEQ ID NO: 242418 - DNA, 15 bp, Homo sapiens
acagtttctttcaga

SEQ ID NO: 242419 - DNA, 15 bp, Homo sapiens
cacagtttctttcag

SEQ ID NO: 242420 - DNA, 15 bp, Homo sapiens
tcacagtttctttca

SEQ ID NO: 242421 - DNA, 15 bp, Homo sapiens
atcacagtttctttc

SEQ ID NO: 242422 - DNA, 15 bp, Homo sapiens
tatcacagtttcttt

SEQ ID NO: 242423 - DNA, 15 bp, Homo sapiens
atatcacagtttctt

SEQ ID NO: 242424 - DNA, 15 bp, Homo sapiens
tatatcacagtttct

SEQ ID NO: 242425 - DNA, 15 bp, Homo sapiens
ctatatcacagtttc

SEQ ID NO: 242426 - DNA, 15 bp, Homo sapiens
actatatcacagttt

SEQ ID NO: 242427 - DNA, 15 bp, Homo sapiens
aactatatcacagtt

SEQ ID NO: 242428 - DNA, 15 bp, Homo sapiens
taactatatcacagt

SEQ ID NO: 242429 - DNA, 15 bp, Homo sapiens
ttaactatatcacag

SEQ ID NO: 242430 - DNA, 15 bp, Homo sapiens
attaactatatcaca

SEQ ID NO: 242431 - DNA, 15 bp, Homo sapiens
tattaactatatcac

SEQ ID NO: 242432 - DNA, 15 bp, Homo sapiens
atattaactatatca

SEQ ID NO: 242433 - DNA, 15 bp, Homo sapiens
aatattaactatatc

SEQ ID NO: 242434 - DNA, 15 bp, Homo sapiens
taatattaactatat

SEQ ID NO: 242435 - DNA, 15 bp, Homo sapiens
ttaatattaactata

SEQ ID NO: 242436 - DNA, 15 bp, Homo sapiens
tttaatattaactat

SEQ ID NO: 242437 - DNA, 15 bp, Homo sapiens
ttttaatattaacta

SEQ ID NO: 242438 - DNA, 15 bp, Homo sapiens
tttttaatattaact

SEQ ID NO: 242439 - DNA, 15 bp, Homo sapiens
ctttttaatattaac

SEQ ID NO: 242440 - DNA, 15 bp, Homo sapiens
tctttttaatattaa

SEQ ID NO: 242441 - DNA, 15 bp, Homo sapiens
ttctttttaatatta

SEQ ID NO: 242442 - DNA, 15 bp, Homo sapiens
tttctttttaatatt

SEQ ID NO: 242443 - DNA, 15 bp, Homo sapiens
gtttctttttaatat

SEQ ID NO: 242444 - DNA, 15 bp, Homo sapiens
agtttctttttaata

SEQ ID NO: 242445 - DNA, 15 bp, Homo sapiens
tagtttctttttaat

SEQ ID NO: 242446 - DNA, 15 bp, Homo sapiens
gtagtttctttttaa

SEQ ID NO: 242447 - DNA, 15 bp, Homo sapiens
agtagtttcttttta

SEQ ID NO: 242448 - DNA, 15 bp, Homo sapiens
aagtagtttcttttt

SEQ ID NO: 242449 - DNA, 15 bp, Homo sapiens
aaagtagtttctttt

SEQ ID NO: 242450 - DNA, 15 bp, Homo sapiens
aaaagtagtttcttt

SEQ ID NO: 242451 - DNA, 15 bp, Homo sapiens
taaaagtagtttctt

SEQ ID NO: 242452 - DNA, 15 bp, Homo sapiens
ttaaaagtagtttct

SEQ ID NO: 242453 - DNA, 15 bp, Homo sapiens
gttaaaagtagtttc

SEQ ID NO: 242454 - DNA, 15 bp, Homo sapiens
tgttaaaagtagttt

SEQ ID NO: 242455 - DNA, 15 bp, Homo sapiens
atgttaaaagtagtt

SEQ ID NO: 242456 - DNA, 15 bp, Homo sapiens
catgttaaaagtagt

SEQ ID NO: 242457 - DNA, 15 bp, Homo sapiens
tcatgttaaaagtag

SEQ ID NO: 242458 - DNA, 15 bp, Homo sapiens
ctcatgttaaaagta

SEQ ID NO: 242459 - DNA, 15 bp, Homo sapiens
tctcatgttaaaagt

SEQ ID NO: 242460 - DNA, 15 bp, Homo sapiens
ttctcatgttaaaag

SEQ ID NO: 242461 - DNA, 15 bp, Homo sapiens
attctcatgttaaaa

SEQ ID NO: 242462 - DNA, 15 bp, Homo sapiens
aattctcatgttaaa

SEQ ID NO: 242463 - DNA, 15 bp, Homo sapiens
taattctcatgttaa

SEQ ID NO: 242464 - DNA, 15 bp, Homo sapiens
ataattctcatgtta

SEQ ID NO: 242465 - DNA, 15 bp, Homo sapiens
tataattctcatgtt

SEQ ID NO: 242466 - DNA, 15 bp, Homo sapiens
atataattctcatgt

SEQ ID NO: 242467 - DNA, 15 bp, Homo sapiens
aatataattctcatg

SEQ ID NO: 242468 - DNA, 15 bp, Homo sapiens
aaatataattctcat

SEQ ID NO: 242469 - DNA, 15 bp, Homo sapiens
aaaatataattctca

SEQ ID NO: 242470 - DNA, 15 bp, Homo sapiens
aaaaatataattctc

SEQ ID NO: 242471 - DNA, 15 bp, Homo sapiens
gaaaaatataattct

SEQ ID NO: 242472 - DNA, 15 bp, Homo sapiens
tgaaaaatataattc

SEQ ID NO: 242473 - DNA, 15 bp, Homo sapiens
atgaaaaatataatt

SEQ ID NO: 242474 - DNA, 15 bp, Homo sapiens
catgaaaaatataat

SEQ ID NO: 242475 - DNA, 15 bp, Homo sapiens
acatgaaaaatataa

SEQ ID NO: 242476 - DNA, 15 bp, Homo sapiens
tacatgaaaaatata

SEQ ID NO: 242477 - DNA, 15 bp, Homo sapiens
atacatgaaaaatat

SEQ ID NO: 242478 - DNA, 15 bp, Homo sapiens
gatacatgaaaaata

SEQ ID NO: 242479 - DNA, 15 bp, Homo sapiens
tgatacatgaaaaat

SEQ ID NO: 242480 - DNA, 15 bp, Homo sapiens
ctgatacatgaaaaa

SEQ ID NO: 242481 - DNA, 15 bp, Homo sapiens
tctgatacatgaaaa

SEQ ID NO: 242482 - DNA, 15 bp, Homo sapiens
atctgatacatgaaa

SEQ ID NO: 242483 - DNA, 15 bp, Homo sapiens
aatctgatacatgaa

SEQ ID NO: 242484 - DNA, 15 bp, Homo sapiens
taatctgatacatga

SEQ ID NO: 242485 - DNA, 15 bp, Homo sapiens
ctaatctgatacatg

SEQ ID NO: 242486 - DNA, 15 bp, Homo sapiens
cctaatctgatacat

SEQ ID NO: 242487 - DNA, 15 bp, Homo sapiens
ccctaatctgataca

SEQ ID NO: 242488 - DNA, 15 bp, Homo sapiens
tccctaatctgatac

SEQ ID NO: 242489 - DNA, 15 bp, Homo sapiens
atccctaatctgata

SEQ ID NO: 242490 - DNA, 15 bp, Homo sapiens
tatccctaatctgat

SEQ ID NO: 242491 - DNA, 15 bp, Homo sapiens
atatccctaatctga

SEQ ID NO: 242492 - DNA, 15 bp, Homo sapiens
tatatccctaatctg

SEQ ID NO: 242493 - DNA, 15 bp, Homo sapiens
ctatatccctaatct

SEQ ID NO: 242494 - DNA, 15 bp, Homo sapiens
cctatatccctaatc

SEQ ID NO: 242495 - DNA, 15 bp, Homo sapiens
acctatatccctaat

SEQ ID NO: 242496 - DNA, 15 bp, Homo sapiens
cacctatatccctaa

SEQ ID NO: 242497 - DNA, 15 bp, Homo sapiens
acacctatatcccta

SEQ ID NO: 242498 - DNA, 15 bp, Homo sapiens
cacacctatatccct

SEQ ID NO: 242499 - DNA, 15 bp, Homo sapiens
acacacctatatccc

SEQ ID NO: 242500 - DNA, 15 bp, Homo sapiens
aacacacctatatcc

SEQ ID NO: 242501 - DNA, 15 bp, Homo sapiens
aaacacacctatatc

SEQ ID NO: 242502 - DNA, 15 bp, Homo sapiens
taaacacacctatat

SEQ ID NO: 242503 - DNA, 15 bp, Homo sapiens
ctaaacacacctata

SEQ ID NO: 242504 - DNA, 15 bp, Homo sapiens
gctaaacacacctat

SEQ ID NO: 242505 - DNA, 15 bp, Homo sapiens
agctaaacacaccta

SEQ ID NO: 242506 - DNA, 15 bp, Homo sapiens
cagctaaacacacct

SEQ ID NO: 242507 - DNA, 15 bp, Homo sapiens
tcagctaaacacacc

SEQ ID NO: 242508 - DNA, 15 bp, Homo sapiens
atcagctaaacacac

SEQ ID NO: 242509 - DNA, 15 bp, Homo sapiens
tatcagctaaacaca

SEQ ID NO: 242510 - DNA, 15 bp, Homo sapiens
atatcagctaaacac

SEQ ID NO: 242511 - DNA, 15 bp, Homo sapiens
tatatcagctaaaca

SEQ ID NO: 242512 - DNA, 15 bp, Homo sapiens
atatatcagctaaac

SEQ ID NO: 242513 - DNA, 15 bp, Homo sapiens
aatatatcagctaaa

SEQ ID NO: 242514 - DNA, 15 bp, Homo sapiens
aaatatatcagctaa

SEQ ID NO: 242515 - DNA, 15 bp, Homo sapiens
aaaatatatcagcta

SEQ ID NO: 242516 - DNA, 15 bp, Homo sapiens
taaaatatatcagct

SEQ ID NO: 242517 - DNA, 15 bp, Homo sapiens
ttaaaatatatcagc

SEQ ID NO: 242518 - DNA, 15 bp, Homo sapiens
tttaaaatatatcag

SEQ ID NO: 242519 - DNA, 15 bp, Homo sapiens
ctttaaaatatatca

SEQ ID NO: 242520 - DNA, 15 bp, Homo sapiens
actttaaaatatatc

SEQ ID NO: 242521 - DNA, 15 bp, Homo sapiens
tactttaaaatatat

SEQ ID NO: 242522 - DNA, 15 bp, Homo sapiens
ctactttaaaatata

SEQ ID NO: 242523 - DNA, 15 bp, Homo sapiens
tctactttaaaatat

SEQ ID NO: 242524 - DNA, 15 bp, Homo sapiens
ctctactttaaaata

SEQ ID NO: 242525 - DNA, 15 bp, Homo sapiens
tctctactttaaaat

SEQ ID NO: 242526 - DNA, 15 bp, Homo sapiens
atctctactttaaaa

SEQ ID NO: 242527 - DNA, 15 bp, Homo sapiens
aatctctactttaaa

SEQ ID NO: 242528 - DNA, 15 bp, Homo sapiens
aaatctctactttaa

SEQ ID NO: 242529 - DNA, 15 bp, Homo sapiens
taaatctctacttta

SEQ ID NO: 242530 - DNA, 15 bp, Homo sapiens
ttaaatctctacttt

SEQ ID NO: 242531 - DNA, 15 bp, Homo sapiens
tttaaatctctactt

SEQ ID NO: 242532 - DNA, 15 bp, Homo sapiens
atttaaatctctact

SEQ ID NO: 242533 - DNA, 15 bp, Homo sapiens
tatttaaatctctac

SEQ ID NO: 242534 - DNA, 15 bp, Homo sapiens
atatttaaatctcta

SEQ ID NO: 242535 - DNA, 15 bp, Homo sapiens
aatatttaaatctct

SEQ ID NO: 242536 - DNA, 15 bp, Homo sapiens
aaatatttaaatctc

SEQ ID NO: 242537 - DNA, 15 bp, Homo sapiens
caaatatttaaatct

SEQ ID NO: 242538 - DNA, 15 bp, Homo sapiens
ccaaatatttaaatc

SEQ ID NO: 242539 - DNA, 15 bp, Homo sapiens
tccaaatatttaaat

SEQ ID NO: 242540 - DNA, 15 bp, Homo sapiens
ctccaaatatttaaa

SEQ ID NO: 242541 - DNA, 15 bp, Homo sapiens
tctccaaatatttaa

SEQ ID NO: 242542 - DNA, 15 bp, Homo sapiens
gtctccaaatattta

SEQ ID NO: 242543 - DNA, 15 bp, Homo sapiens
tgtctccaaatattt

SEQ ID NO: 242544 - DNA, 15 bp, Homo sapiens
ctgtctccaaatatt

SEQ ID NO: 242545 - DNA, 15 bp, Homo sapiens
tctgtctccaaatat

SEQ ID NO: 242546 - DNA, 15 bp, Homo sapiens
gtctgtctccaaata

SEQ ID NO: 242547 - DNA, 15 bp, Homo sapiens
tgtctgtctccaaat

SEQ ID NO: 242548 - DNA, 15 bp, Homo sapiens
ttgtctgtctccaaa

SEQ ID NO: 242549 - DNA, 15 bp, Homo sapiens
attgtctgtctccaa

SEQ ID NO: 242550 - DNA, 15 bp, Homo sapiens
tattgtctgtctcca

SEQ ID NO: 242551 - DNA, 15 bp, Homo sapiens
ttattgtctgtctcc

SEQ ID NO: 242552 - DNA, 15 bp, Homo sapiens
cttattgtctgtctc

SEQ ID NO: 242553 - DNA, 15 bp, Homo sapiens
gcttattgtctgtct

SEQ ID NO: 242554 - DNA, 15 bp, Homo sapiens
agcttattgtctgtc

SEQ ID NO: 242555 - DNA, 15 bp, Homo sapiens
tagcttattgtctgt

SEQ ID NO: 242556 - DNA, 15 bp, Homo sapiens
atagcttattgtctg

SEQ ID NO: 242557 - DNA, 15 bp, Homo sapiens
catagcttattgtct

SEQ ID NO: 242558 - DNA, 15 bp, Homo sapiens
tcatagcttattgtc

SEQ ID NO: 242559 - DNA, 15 bp, Homo sapiens
atcatagcttattgt

SEQ ID NO: 242560 - DNA, 15 bp, Homo sapiens
catcatagcttattg

SEQ ID NO: 242561 - DNA, 15 bp, Homo sapiens
ccatcatagcttatt

SEQ ID NO: 242562 - DNA, 15 bp, Homo sapiens
gccatcatagcttat

SEQ ID NO: 242563 - DNA, 15 bp, Homo sapiens
ggccatcatagctta

SEQ ID NO: 242564 - DNA, 15 bp, Homo sapiens
tggccatcatagctt

SEQ ID NO: 242565 - DNA, 15 bp, Homo sapiens
atggccatcatagct

SEQ ID NO: 242566 - DNA, 15 bp, Homo sapiens
tatggccatcatagc

SEQ ID NO: 242567 - DNA, 15 bp, Homo sapiens
gtatggccatcatag

SEQ ID NO: 242568 - DNA, 15 bp, Homo sapiens
agtatggccatcata

SEQ ID NO: 242569 - DNA, 15 bp, Homo sapiens
cagtatggccatcat

SEQ ID NO: 242570 - DNA, 15 bp, Homo sapiens
acagtatggccatca

SEQ ID NO: 242571 - DNA, 15 bp, Homo sapiens
tacagtatggccatc

SEQ ID NO: 242572 - DNA, 15 bp, Homo sapiens
atacagtatggccat

SEQ ID NO: 242573 - DNA, 15 bp, Homo sapiens
aatacagtatggcca

SEQ ID NO: 242574 - DNA, 15 bp, Homo sapiens
gaatacagtatggcc

SEQ ID NO: 242575 - DNA, 15 bp, Homo sapiens
ggaatacagtatggc

SEQ ID NO: 242576 - DNA, 15 bp, Homo sapiens
tggaatacagtatgg

SEQ ID NO: 242577 - DNA, 15 bp, Homo sapiens
ctggaatacagtatg

SEQ ID NO: 242578 - DNA, 15 bp, Homo sapiens
gctggaatacagtat

SEQ ID NO: 242579 - DNA, 15 bp, Homo sapiens
ggctggaatacagta

SEQ ID NO: 242580 - DNA, 15 bp, Homo sapiens
aggctggaatacagt

SEQ ID NO: 242581 - DNA, 15 bp, Homo sapiens
caggctggaatacag

SEQ ID NO: 242582 - DNA, 15 bp, Homo sapiens
ccaggctggaataca

SEQ ID NO: 242583 - DNA, 15 bp, Homo sapiens
tccaggctggaatac

SEQ ID NO: 242584 - DNA, 15 bp, Homo sapiens
gtccaggctggaata

SEQ ID NO: 242585 - DNA, 15 bp, Homo sapiens
tgtccaggctggaat

SEQ ID NO: 242586 - DNA, 15 bp, Homo sapiens
ttgtccaggctggaa

SEQ ID NO: 242587 - DNA, 15 bp, Homo sapiens
gttgtccaggctgga

SEQ ID NO: 242588 - DNA, 15 bp, Homo sapiens
tttgttgtccaggct

SEQ ID NO: 242589 - DNA, 15 bp, Homo sapiens
ctttgttgtccaggc

SEQ ID NO: 242590 - DNA, 15 bp, Homo sapiens
gctttgttgtccagg

SEQ ID NO: 242591 - DNA, 15 bp, Homo sapiens
tgctttgttgtccag

SEQ ID NO: 242592 - DNA, 15 bp, Homo sapiens
ttgctttgttgtcca

SEQ ID NO: 242593 - DNA, 15 bp, Homo sapiens
cttgctttgttgtcc

SEQ ID NO: 242594 - DNA, 15 bp, Homo sapiens
tcttgctttgttgtc

SEQ ID NO: 242595 - DNA, 15 bp, Homo sapiens
atcttgctttgttgt

SEQ ID NO: 242596 - DNA, 15 bp, Homo sapiens
gatcttgctttgttg

SEQ ID NO: 242597 - DNA, 15 bp, Homo sapiens
ggatcttgctttgtt

SEQ ID NO: 242598 - DNA, 15 bp, Homo sapiens
tggatcttgctttgt

SEQ ID NO: 242599 - DNA, 15 bp, Homo sapiens
ctggatcttgctttg

SEQ ID NO: 242600 - DNA, 15 bp, Homo sapiens
actggatcttgcttt

SEQ ID NO: 242601 - DNA, 15 bp, Homo sapiens
gactggatcttgctt

SEQ ID NO: 242602 - DNA, 15 bp, Homo sapiens
agactggatcttgct

SEQ ID NO: 242603 - DNA, 15 bp, Homo sapiens
gagactggatcttgc

SEQ ID NO: 242604 - DNA, 15 bp, Homo sapiens
agagactggatcttg

SEQ ID NO: 242605 - DNA, 15 bp, Homo sapiens
tagagactggatctt

SEQ ID NO: 242606 - DNA, 15 bp, Homo sapiens
ttagagactggatct

SEQ ID NO: 242607 - DNA, 15 bp, Homo sapiens
tttagagactggatc

SEQ ID NO: 242608 - DNA, 15 bp, Homo sapiens
ttttagagactggat

SEQ ID NO: 242609 - DNA, 15 bp, Homo sapiens
tttttagagactgga

SEQ ID NO: 242610 - DNA, 15 bp, Homo sapiens
ctttttagagactgg

SEQ ID NO: 242611 - DNA, 15 bp, Homo sapiens
actttttagagactg

SEQ ID NO: 242612 - DNA, 15 bp, Homo sapiens
tactttttagagact

SEQ ID NO: 242613 - DNA, 15 bp, Homo sapiens
ttactttttagagac

SEQ ID NO: 242614 - DNA, 15 bp, Homo sapiens
tttactttttagaga

SEQ ID NO: 242615 - DNA, 15 bp, Homo sapiens
ttttactttttagag

SEQ ID NO: 242616 - DNA, 15 bp, Homo sapiens
tttttactttttaga

SEQ ID NO: 242617 - DNA, 15 bp, Homo sapiens
ttttttactttttag

SEQ ID NO: 242618 - DNA, 15 bp, Homo sapiens
tttttttacttttta

SEQ ID NO: 242619 - DNA, 15 bp, Homo sapiens
ccaattttttttttt

SEQ ID NO: 242620 - DNA, 15 bp, Homo sapiens
tccaatttttttttt

SEQ ID NO: 242621 - DNA, 15 bp, Homo sapiens
ctccaattttttttt

SEQ ID NO: 242622 - DNA, 15 bp, Homo sapiens
tctccaatttttttt

SEQ ID NO: 242623 - DNA, 15 bp, Homo sapiens
ttctccaattttttt

SEQ ID NO: 242624 - DNA, 15 bp, Homo sapiens
tttctccaatttttt

SEQ ID NO: 242625 - DNA, 15 bp, Homo sapiens
ttttctccaattttt

SEQ ID NO: 242626 - DNA, 15 bp, Homo sapiens
tttttctccaatttt

SEQ ID NO: 242627 - DNA, 15 bp, Homo sapiens
atttttctccaattt

SEQ ID NO: 242628 - DNA, 15 bp, Homo sapiens
catttttctccaatt

SEQ ID NO: 242629 - DNA, 15 bp, Homo sapiens
tcatttttctccaat

SEQ ID NO: 242630 - DNA, 15 bp, Homo sapiens
gtcatttttctccaa

SEQ ID NO: 242631 - DNA, 15 bp, Homo sapiens
tgtcatttttctcca

SEQ ID NO: 242632 - DNA, 15 bp, Homo sapiens
ctgtcatttttctcc

SEQ ID NO: 242633 - DNA, 15 bp, Homo sapiens
tctgtcatttttctc

SEQ ID NO: 242634 - DNA, 15 bp, Homo sapiens
ttctgtcatttttct

SEQ ID NO: 242635 - DNA, 15 bp, Homo sapiens
attctgtcatttttc

SEQ ID NO: 242636 - DNA, 15 bp, Homo sapiens
aattctgtcattttt

SEQ ID NO: 242637 - DNA, 15 bp, Homo sapiens
aaattctgtcatttt

SEQ ID NO: 242638 - DNA, 15 bp, Homo sapiens
gaaattctgtcattt

SEQ ID NO: 242639 - DNA, 15 bp, Homo sapiens
tgaaattctgtcatt

SEQ ID NO: 242640 - DNA, 15 bp, Homo sapiens
ttgaaattctgtcat

SEQ ID NO: 242641 - DNA, 15 bp, Homo sapiens
tttgaaattctgtca

SEQ ID NO: 242642 - DNA, 15 bp, Homo sapiens
ttttgaaattctgtc

SEQ ID NO: 242643 - DNA, 15 bp, Homo sapiens
attttgaaattctgt

SEQ ID NO: 242644 - DNA, 15 bp, Homo sapiens
tattttgaaattctg

SEQ ID NO: 242645 - DNA, 15 bp, Homo sapiens
gtattttgaaattct

SEQ ID NO: 242646 - DNA, 15 bp, Homo sapiens
agtattttgaaattc

SEQ ID NO: 242647 - DNA, 15 bp, Homo sapiens
gagtattttgaaatt

SEQ ID NO: 242648 - DNA, 15 bp, Homo sapiens
agagtattttgaaat

SEQ ID NO: 242649 - DNA, 15 bp, Homo sapiens
aagagtattttgaaa

SEQ ID NO: 242650 - DNA, 15 bp, Homo sapiens
caagagtattttgaa

SEQ ID NO: 242651 - DNA, 15 bp, Homo sapiens
tcaagagtattttga

SEQ ID NO: 242652 - DNA, 15 bp, Homo sapiens
gtcaagagtattttg

SEQ ID NO: 242653 - DNA, 15 bp, Homo sapiens
tgtcaagagtatttt

SEQ ID NO: 242654 - DNA, 15 bp, Homo sapiens
atgtcaagagtattt

SEQ ID NO: 242655 - DNA, 15 bp, Homo sapiens
tatgtcaagagtatt

SEQ ID NO: 242656 - DNA, 15 bp, Homo sapiens
ttatgtcaagagtat

SEQ ID NO: 242657 - DNA, 15 bp, Homo sapiens
attatgtcaagagta

SEQ ID NO: 242658 - DNA, 15 bp, Homo sapiens
cattatgtcaagagt

SEQ ID NO: 242659 - DNA, 15 bp, Homo sapiens
tcattatgtcaagag

SEQ ID NO: 242660 - DNA, 15 bp, Homo sapiens
atcattatgtcaaga

SEQ ID NO: 242661 - DNA, 15 bp, Homo sapiens
tatcattatgtcaag

SEQ ID NO: 242662 - DNA, 15 bp, Homo sapiens
atatcattatgtcaa

SEQ ID NO: 242663 - DNA, 15 bp, Homo sapiens
aatatcattatgtca

SEQ ID NO: 242664 - DNA, 15 bp, Homo sapiens
aaatatcattatgtc

SEQ ID NO: 242665 - DNA, 15 bp, Homo sapiens
caaatatcattatgt

SEQ ID NO: 242666 - DNA, 15 bp, Homo sapiens
acaaatatcattatg

SEQ ID NO: 242667 - DNA, 15 bp, Homo sapiens
gacaaatatcattat

SEQ ID NO: 242668 - DNA, 15 bp, Homo sapiens
tgacaaatatcatta

SEQ ID NO: 242669 - DNA, 15 bp, Homo sapiens
ttgacaaatatcatt

SEQ ID NO: 242670 - DNA, 15 bp, Homo sapiens
tttgacaaatatcat

SEQ ID NO: 242671 - DNA, 15 bp, Homo sapiens
atttgacaaatatca

SEQ ID NO: 242672 - DNA, 15 bp, Homo sapiens
aatttgacaaatatc

SEQ ID NO: 242673 - DNA, 15 bp, Homo sapiens
caatttgacaaatat

SEQ ID NO: 242674 - DNA, 15 bp, Homo sapiens
acaatttgacaaata

SEQ ID NO: 242675 - DNA, 15 bp, Homo sapiens
tacaatttgacaaat

SEQ ID NO: 242676 - DNA, 15 bp, Homo sapiens
gtacaatttgacaaa

SEQ ID NO: 242677 - DNA, 15 bp, Homo sapiens
tgtacaatttgacaa

SEQ ID NO: 242678 - DNA, 15 bp, Homo sapiens
ttgtacaatttgaca

SEQ ID NO: 242679 - DNA, 15 bp, Homo sapiens
tttgtacaatttgac

SEQ ID NO: 242680 - DNA, 15 bp, Homo sapiens
atttgtacaatttga

SEQ ID NO: 242681 - DNA, 15 bp, Homo sapiens
aatttgtacaatttg

SEQ ID NO: 242682 - DNA, 15 bp, Homo sapiens
gaatttgtacaattt

SEQ ID NO: 242683 - DNA, 15 bp, Homo sapiens
agaatttgtacaatt

SEQ ID NO: 242684 - DNA, 15 bp, Homo sapiens
tagaatttgtacaat

SEQ ID NO: 242685 - DNA, 15 bp, Homo sapiens
ttagaatttgtacaa

SEQ ID NO: 242686 - DNA, 15 bp, Homo sapiens
tttagaatttgtaca

SEQ ID NO: 242687 - DNA, 15 bp, Homo sapiens
gtttagaatttgtac

SEQ ID NO: 242688 - DNA, 15 bp, Homo sapiens
ggtttagaatttgta

SEQ ID NO: 242689 - DNA, 15 bp, Homo sapiens
tggtttagaatttgt

SEQ ID NO: 242690 - DNA, 15 bp, Homo sapiens
atggtttagaatttg

SEQ ID NO: 242691 - DNA, 15 bp, Homo sapiens
aatggtttagaattt

SEQ ID NO: 242692 - DNA, 15 bp, Homo sapiens
aaatggtttagaatt

SEQ ID NO: 242693 - DNA, 15 bp, Homo sapiens
aaaatggtttagaat

SEQ ID NO: 242694 - DNA, 15 bp, Homo sapiens
aaaaatggtttagaa

SEQ ID NO: 242695 - DNA, 15 bp, Homo sapiens
gaaaaatggtttaga

SEQ ID NO: 242696 - DNA, 15 bp, Homo sapiens
agaaaaatggtttag

SEQ ID NO: 242697 - DNA, 15 bp, Homo sapiens
aagaaaaatggttta

SEQ ID NO: 242698 - DNA, 15 bp, Homo sapiens
gaagaaaaatggttt

SEQ ID NO: 242699 - DNA, 15 bp, Homo sapiens
ggaagaaaaatggtt

SEQ ID NO: 242700 - DNA, 15 bp, Homo sapiens
aggaagaaaaatggt

SEQ ID NO: 242701 - DNA, 15 bp, Homo sapiens
gaggaagaaaaatgg

SEQ ID NO: 242702 - DNA, 15 bp, Homo sapiens
agaggaagaaaaatg

SEQ ID NO: 242703 - DNA, 15 bp, Homo sapiens
tagaggaagaaaaat

SEQ ID NO: 242704 - DNA, 15 bp, Homo sapiens
ttagaggaagaaaaa

SEQ ID NO: 242705 - DNA, 15 bp, Homo sapiens
cttagaggaagaaaa

SEQ ID NO: 242706 - DNA, 15 bp, Homo sapiens
tcttagaggaagaaa

SEQ ID NO: 242707 - DNA, 15 bp, Homo sapiens
ttcttagaggaagaa

SEQ ID NO: 242708 - DNA, 15 bp, Homo sapiens
tttcttagaggaaga

SEQ ID NO: 242709 - DNA, 15 bp, Homo sapiens
ttttcttagaggaag

SEQ ID NO: 242710 - DNA, 15 bp, Homo sapiens
attttcttagaggaa

SEQ ID NO: 242711 - DNA, 15 bp, Homo sapiens
gattttcttagagga

SEQ ID NO: 242712 - DNA, 15 bp, Homo sapiens
ggattttcttagagg

SEQ ID NO: 242713 - DNA, 15 bp, Homo sapiens
tggattttcttagag

SEQ ID NO: 242714 - DNA, 15 bp, Homo sapiens
atggattttcttaga

SEQ ID NO: 242715 - DNA, 15 bp, Homo sapiens
tatggattttcttag

SEQ ID NO: 242716 - DNA, 15 bp, Homo sapiens
atatggattttctta

SEQ ID NO: 242717 - DNA, 15 bp, Homo sapiens
tatatggattttctt

SEQ ID NO: 242718 - DNA, 15 bp, Homo sapiens
ttatatggattttct

SEQ ID NO: 242719 - DNA, 15 bp, Homo sapiens
tttatatggattttc

SEQ ID NO: 242720 - DNA, 15 bp, Homo sapiens
ttttatatggatttt

SEQ ID NO: 242721 - DNA, 15 bp, Homo sapiens
tttttatatggattt

SEQ ID NO: 242722 - DNA, 15 bp, Homo sapiens
atttttatatggatt

SEQ ID NO: 242723 - DNA, 15 bp, Homo sapiens
catttttatatggat

SEQ ID NO: 242724 - DNA, 15 bp, Homo sapiens
acatttttatatgga

SEQ ID NO: 242725 - DNA, 15 bp, Homo sapiens
gacatttttatatgg

SEQ ID NO: 242726 - DNA, 15 bp, Homo sapiens
agacatttttatatg

SEQ ID NO: 242727 - DNA, 15 bp, Homo sapiens
aagacatttttatat

SEQ ID NO: 242728 - DNA, 15 bp, Homo sapiens
taagacatttttata

SEQ ID NO: 242729 - DNA, 15 bp, Homo sapiens
ataagacatttttat

SEQ ID NO: 242730 - DNA, 15 bp, Homo sapiens
tataagacattttta

SEQ ID NO: 242731 - DNA, 15 bp, Homo sapiens
gtataagacattttt

SEQ ID NO: 242732 - DNA, 15 bp, Homo sapiens
agtataagacatttt

SEQ ID NO: 242733 - DNA, 15 bp, Homo sapiens
gagtataagacattt

SEQ ID NO: 242734 - DNA, 15 bp, Homo sapiens
agagtataagacatt

SEQ ID NO: 242735 - DNA, 15 bp, Homo sapiens
aagagtataagacat

SEQ ID NO: 242736 - DNA, 15 bp, Homo sapiens
caagagtataagaca

SEQ ID NO: 242737 - DNA, 15 bp, Homo sapiens
acaagagtataagac

SEQ ID NO: 242738 - DNA, 15 bp, Homo sapiens
gacaagagtataaga

SEQ ID NO: 242739 - DNA, 15 bp, Homo sapiens
tgacaagagtataag

SEQ ID NO: 242740 - DNA, 15 bp, Homo sapiens
atgacaagagtataa

SEQ ID NO: 242741 - DNA, 15 bp, Homo sapiens
aatgacaagagtata

SEQ ID NO: 242742 - DNA, 15 bp, Homo sapiens
aaatgacaagagtat

SEQ ID NO: 242743 - DNA, 15 bp, Homo sapiens
aaaatgacaagagta

SEQ ID NO: 242744 - DNA, 15 bp, Homo sapiens
taaaatgacaagagt

SEQ ID NO: 242745 - DNA, 15 bp, Homo sapiens
ataaaatgacaagag

SEQ ID NO: 242746 - DNA, 15 bp, Homo sapiens
aataaaatgacaaga

SEQ ID NO: 242747 - DNA, 15 bp, Homo sapiens
gaataaaatgacaag

SEQ ID NO: 242748 - DNA, 15 bp, Homo sapiens
ggaataaaatgacaa

SEQ ID NO: 242749 - DNA, 15 bp, Homo sapiens
tggaataaaatgaca

SEQ ID NO: 242750 - DNA, 15 bp, Homo sapiens
gtggaataaaatgac

SEQ ID NO: 242751 - DNA, 15 bp, Homo sapiens
ggtggaataaaatga

SEQ ID NO: 242752 - DNA, 15 bp, Homo sapiens
tggtggaataaaatg

SEQ ID NO: 242753 - DNA, 15 bp, Homo sapiens
ttggtggaataaaat

SEQ ID NO: 242754 - DNA, 15 bp, Homo sapiens
attggtggaataaaa

SEQ ID NO: 242755 - DNA, 15 bp, Homo sapiens
tattggtggaataaa

SEQ ID NO: 242756 - DNA, 15 bp, Homo sapiens
ttattggtggaataa

SEQ ID NO: 242757 - DNA, 15 bp, Homo sapiens
cttattggtggaata

SEQ ID NO: 242758 - DNA, 15 bp, Homo sapiens
tcttattggtggaat

SEQ ID NO: 242759 - DNA, 15 bp, Homo sapiens
ttcttattggtggaa

SEQ ID NO: 242760 - DNA, 15 bp, Homo sapiens
tttcttattggtgga

SEQ ID NO: 242761 - DNA, 15 bp, Homo sapiens
tatttcttattggtg

SEQ ID NO: 242762 - DNA, 15 bp, Homo sapiens
ttatttcttattggt

SEQ ID NO: 242763 - DNA, 15 bp, Homo sapiens
attatttcttattgg

SEQ ID NO: 242764 - DNA, 15 bp, Homo sapiens
cattatttcttattg

SEQ ID NO: 242765 - DNA, 15 bp, Homo sapiens
tcattatttcttatt

SEQ ID NO: 242766 - DNA, 15 bp, Homo sapiens
atcattatttcttat

SEQ ID NO: 242767 - DNA, 15 bp, Homo sapiens
aatcattatttctta

SEQ ID NO: 242768 - DNA, 15 bp, Homo sapiens
aaatcattatttctt

SEQ ID NO: 242769 - DNA, 15 bp, Homo sapiens
taaatcattatttct

SEQ ID NO: 242770 - DNA, 15 bp, Homo sapiens
ataaatcattatttc

SEQ ID NO: 242771 - DNA, 15 bp, Homo sapiens
gataaatcattattt

SEQ ID NO: 242772 - DNA, 15 bp, Homo sapiens
tgataaatcattatt

SEQ ID NO: 242773 - DNA, 15 bp, Homo sapiens
atgataaatcattat

SEQ ID NO: 242774 - DNA, 15 bp, Homo sapiens
catgataaatcatta

SEQ ID NO: 242775 - DNA, 15 bp, Homo sapiens
tcatgataaatcatt

SEQ ID NO: 242776 - DNA, 15 bp, Homo sapiens
ttcatgataaatcat

SEQ ID NO: 242777 - DNA, 15 bp, Homo sapiens
tttcatgataaatca

SEQ ID NO: 242778 - DNA, 15 bp, Homo sapiens
ttttcatgataaatc

SEQ ID NO: 242779 - DNA, 15 bp, Homo sapiens
tttttcatgataaat

SEQ ID NO: 242780 - DNA, 15 bp, Homo sapiens
ctttttcatgataaa

SEQ ID NO: 242781 - DNA, 15 bp, Homo sapiens
actttttcatgataa

SEQ ID NO: 242782 - DNA, 15 bp, Homo sapiens
cactttttcatgata

SEQ ID NO: 242783 - DNA, 15 bp, Homo sapiens
tcactttttcatgat

SEQ ID NO: 242784 - DNA, 15 bp, Homo sapiens
ttcactttttcatga

SEQ ID NO: 242785 - DNA, 15 bp, Homo sapiens
tttcactttttcatg

SEQ ID NO: 242786 - DNA, 15 bp, Homo sapiens
atttcactttttcat

SEQ ID NO: 242787 - DNA, 15 bp, Homo sapiens
tatttcactttttca

SEQ ID NO: 242788 - DNA, 15 bp, Homo sapiens
atatttcactttttc

SEQ ID NO: 242789 - DNA, 15 bp, Homo sapiens
aatatttcacttttt

SEQ ID NO: 242790 - DNA, 15 bp, Homo sapiens
caatatttcactttt

SEQ ID NO: 242791 - DNA, 15 bp, Homo sapiens
acaatatttcacttt

SEQ ID NO: 242792 - DNA, 15 bp, Homo sapiens
gacaatatttcactt

SEQ ID NO: 242793 - DNA, 15 bp, Homo sapiens
tgacaatatttcact

SEQ ID NO: 242794 - DNA, 15 bp, Homo sapiens
ttgacaatatttcac

SEQ ID NO: 242795 - DNA, 15 bp, Homo sapiens
cttgacaatatttca

SEQ ID NO: 242796 - DNA, 15 bp, Homo sapiens
acttgacaatatttc

SEQ ID NO: 242797 - DNA, 15 bp, Homo sapiens
aacttgacaatattt

SEQ ID NO: 242798 - DNA, 15 bp, Homo sapiens
aaacttgacaatatt

SEQ ID NO: 242799 - DNA, 15 bp, Homo sapiens
aaaacttgacaatat

SEQ ID NO: 242800 - DNA, 15 bp, Homo sapiens
aaaaacttgacaata

SEQ ID NO: 242801 - DNA, 15 bp, Homo sapiens
gaaaaacttgacaat

SEQ ID NO: 242802 - DNA, 15 bp, Homo sapiens
agaaaaacttgacaa

SEQ ID NO: 242803 - DNA, 15 bp, Homo sapiens
aagaaaaacttgaca

SEQ ID NO: 242804 - DNA, 15 bp, Homo sapiens
aaagaaaaacttgac

SEQ ID NO: 242805 - DNA, 15 bp, Homo sapiens
caaagaaaaacttga

SEQ ID NO: 242806 - DNA, 15 bp, Homo sapiens
acaaagaaaaacttg

SEQ ID NO: 242807 - DNA, 15 bp, Homo sapiens
gacaaagaaaaactt

SEQ ID NO: 242808 - DNA, 15 bp, Homo sapiens
agacaaagaaaaact

SEQ ID NO: 242809 - DNA, 15 bp, Homo sapiens
aagacaaagaaaaac

SEQ ID NO: 242810 - DNA, 15 bp, Homo sapiens
taagacaaagaaaaa

SEQ ID NO: 242811 - DNA, 15 bp, Homo sapiens
ataagacaaagaaaa

SEQ ID NO: 242812 - DNA, 15 bp, Homo sapiens
tataagacaaagaaa

SEQ ID NO: 242813 - DNA, 15 bp, Homo sapiens
ctataagacaaagaa

SEQ ID NO: 242814 - DNA, 15 bp, Homo sapiens
tctataagacaaaga

SEQ ID NO: 242815 - DNA, 15 bp, Homo sapiens
ttctataagacaaag

SEQ ID NO: 242816 - DNA, 15 bp, Homo sapiens
cttctataagacaaa

SEQ ID NO: 242817 - DNA, 15 bp, Homo sapiens
acttctataagacaa

SEQ ID NO: 242818 - DNA, 15 bp, Homo sapiens
aacttctataagaca

SEQ ID NO: 242819 - DNA, 15 bp, Homo sapiens
taacttctataagac

SEQ ID NO: 242820 - DNA, 15 bp, Homo sapiens
ataacttctataaga

SEQ ID NO: 242821 - DNA, 15 bp, Homo sapiens
gataacttctataag

SEQ ID NO: 242822 - DNA, 15 bp, Homo sapiens
agataacttctataa

SEQ ID NO: 242823 - DNA, 15 bp, Homo sapiens
cagataacttctata

SEQ ID NO: 242824 - DNA, 15 bp, Homo sapiens
gcagataacttctat

SEQ ID NO: 242825 - DNA, 15 bp, Homo sapiens
tgcagataacttcta

SEQ ID NO: 242826 - DNA, 15 bp, Homo sapiens
atgcagataacttct

SEQ ID NO: 242827 - DNA, 15 bp, Homo sapiens
aatgcagataacttc

SEQ ID NO: 242828 - DNA, 15 bp, Homo sapiens
taatgcagataactt

SEQ ID NO: 242829 - DNA, 15 bp, Homo sapiens
ataatgcagataact

SEQ ID NO: 242830 - DNA, 15 bp, Homo sapiens
aataatgcagataac

SEQ ID NO: 242831 - DNA, 15 bp, Homo sapiens
taataatgcagataa

SEQ ID NO: 242832 - DNA, 15 bp, Homo sapiens
ctaataatgcagata

SEQ ID NO: 242833 - DNA, 15 bp, Homo sapiens
gctaataatgcagat

SEQ ID NO: 242834 - DNA, 15 bp, Homo sapiens
tgctaataatgcaga

SEQ ID NO: 242835 - DNA, 15 bp, Homo sapiens
atgctaataatgcag

SEQ ID NO: 242836 - DNA, 15 bp, Homo sapiens
tatgctaataatgca

SEQ ID NO: 242837 - DNA, 15 bp, Homo sapiens
ctatgctaataatgc

SEQ ID NO: 242838 - DNA, 15 bp, Homo sapiens
cctatgctaataatg

SEQ ID NO: 242839 - DNA, 15 bp, Homo sapiens
gcctatgctaataat

SEQ ID NO: 242840 - DNA, 15 bp, Homo sapiens
agcctatgctaataa

SEQ ID NO: 242841 - DNA, 15 bp, Homo sapiens
gagcctatgctaata

SEQ ID NO: 242842 - DNA, 15 bp, Homo sapiens
tgagcctatgctaat

SEQ ID NO: 242843 - DNA, 15 bp, Homo sapiens
atgagcctatgctaa

SEQ ID NO: 242844 - DNA, 15 bp, Homo sapiens
gatgagcctatgcta

SEQ ID NO: 242845 - DNA, 15 bp, Homo sapiens
tgatgagcctatgct

SEQ ID NO: 242846 - DNA, 15 bp, Homo sapiens
atgatgagcctatgc

SEQ ID NO: 242847 - DNA, 15 bp, Homo sapiens
aatgatgagcctatg

SEQ ID NO: 242848 - DNA, 15 bp, Homo sapiens
gaatgatgagcctat

SEQ ID NO: 242849 - DNA, 15 bp, Homo sapiens
agaatgatgagccta

SEQ ID NO: 242850 - DNA, 15 bp, Homo sapiens
aagaatgatgagcct

SEQ ID NO: 242851 - DNA, 15 bp, Homo sapiens
caaagaatgatgagc

SEQ ID NO: 242852 - DNA, 15 bp, Homo sapiens
tcaaagaatgatgag

SEQ ID NO: 242853 - DNA, 15 bp, Homo sapiens
atcaaagaatgatga

SEQ ID NO: 242854 - DNA, 15 bp, Homo sapiens
aatcaaagaatgatg

SEQ ID NO: 242855 - DNA, 15 bp, Homo sapiens
gaatcaaagaatgat

SEQ ID NO: 242856 - DNA, 15 bp, Homo sapiens
agaatcaaagaatga

SEQ ID NO: 242857 - DNA, 15 bp, Homo sapiens
cagaatcaaagaatg

SEQ ID NO: 242858 - DNA, 15 bp, Homo sapiens
acagaatcaaagaat

SEQ ID NO: 242859 - DNA, 15 bp, Homo sapiens
aacagaatcaaagaa

SEQ ID NO: 242860 - DNA, 15 bp, Homo sapiens
caacagaatcaaaga

SEQ ID NO: 242861 - DNA, 15 bp, Homo sapiens
acaacagaatcaaag

SEQ ID NO: 242862 - DNA, 15 bp, Homo sapiens
gacaacagaatcaaa

SEQ ID NO: 242863 - DNA, 15 bp, Homo sapiens
ggacaacagaatcaa

SEQ ID NO: 242864 - DNA, 15 bp, Homo sapiens
tggacaacagaatca

SEQ ID NO: 242865 - DNA, 15 bp, Homo sapiens
ctggacaacagaatc

SEQ ID NO: 242866 - DNA, 15 bp, Homo sapiens
actggacaacagaat

SEQ ID NO: 242867 - DNA, 15 bp, Homo sapiens
aactggacaacagaa

SEQ ID NO: 242868 - DNA, 15 bp, Homo sapiens
taactggacaacaga

SEQ ID NO: 242869 - DNA, 15 bp, Homo sapiens
ctaactggacaacag

SEQ ID NO: 242870 - DNA, 15 bp, Homo sapiens
actaactggacaaca

SEQ ID NO: 242871 - DNA, 15 bp, Homo sapiens
aactaactggacaac

SEQ ID NO: 242872 - DNA, 15 bp, Homo sapiens
aaactaactggacaa

SEQ ID NO: 242873 - DNA, 15 bp, Homo sapiens
gaaactaactggaca

SEQ ID NO: 242874 - DNA, 15 bp, Homo sapiens
agaaactaactggac

SEQ ID NO: 242875 - DNA, 15 bp, Homo sapiens
gagaaactaactgga

SEQ ID NO: 242876 - DNA, 15 bp, Homo sapiens
ggagaaactaactgg

SEQ ID NO: 242877 - DNA, 15 bp, Homo sapiens
aggagaaactaactg

SEQ ID NO: 242878 - DNA, 15 bp, Homo sapiens
aaggagaaactaact

SEQ ID NO: 242879 - DNA, 15 bp, Homo sapiens
gaaggagaaactaac

SEQ ID NO: 242880 - DNA, 15 bp, Homo sapiens
agaaggagaaactaa

SEQ ID NO: 242881 - DNA, 15 bp, Homo sapiens
aagaaggagaaacta

SEQ ID NO: 242882 - DNA, 15 bp, Homo sapiens
caagaaggagaaact

SEQ ID NO: 242883 - DNA, 15 bp, Homo sapiens
gcaagaaggagaaac

SEQ ID NO: 242884 - DNA, 15 bp, Homo sapiens
tgcaagaaggagaaa

SEQ ID NO: 242885 - DNA, 15 bp, Homo sapiens
atgcaagaaggagaa

SEQ ID NO: 242886 - DNA, 15 bp, Homo sapiens
tatgcaagaaggaga

SEQ ID NO: 242887 - DNA, 15 bp, Homo sapiens
gtatgcaagaaggag

SEQ ID NO: 242888 - DNA, 15 bp, Homo sapiens
agtatgcaagaagga

SEQ ID NO: 242889 - DNA, 15 bp, Homo sapiens
cagtatgcaagaagg

SEQ ID NO: 242890 - DNA, 15 bp, Homo sapiens
acagtatgcaagaag

SEQ ID NO: 242891 - DNA, 15 bp, Homo sapiens
aacagtatgcaagaa

SEQ ID NO: 242892 - DNA, 15 bp, Homo sapiens
aaacagtatgcaaga

SEQ ID NO: 242893 - DNA, 15 bp, Homo sapiens
gaaacagtatgcaag

SEQ ID NO: 242894 - DNA, 15 bp, Homo sapiens
agaaacagtatgcaa

SEQ ID NO: 242895 - DNA, 15 bp, Homo sapiens
aagaaacagtatgca

SEQ ID NO: 242896 - DNA, 15 bp, Homo sapiens
gaagaaacagtatgc

SEQ ID NO: 242897 - DNA, 15 bp, Homo sapiens
agaagaaacagtatg

SEQ ID NO: 242898 - DNA, 15 bp, Homo sapiens
aagaagaaacagtat

SEQ ID NO: 242899 - DNA, 15 bp, Homo sapiens
gaagaagaaacagta

SEQ ID NO: 242900 - DNA, 15 bp, Homo sapiens
agaagaagaaacagt

SEQ ID NO: 242901 - DNA, 15 bp, Homo sapiens
aagaagaagaaacag

SEQ ID NO: 242902 - DNA, 15 bp, Homo sapiens
taagaagaagaaaca

SEQ ID NO: 242903 - DNA, 15 bp, Homo sapiens
ataagaagaagaaac

SEQ ID NO: 242904 - DNA, 15 bp, Homo sapiens
tataagaagaagaaa

SEQ ID NO: 242905 - DNA, 15 bp, Homo sapiens
atataagaagaagaa

SEQ ID NO: 242906 - DNA, 15 bp, Homo sapiens
catataagaagaaga

SEQ ID NO: 242907 - DNA, 15 bp, Homo sapiens
tcatataagaagaag

SEQ ID NO: 242908 - DNA, 15 bp, Homo sapiens
gtcatataagaagaa

SEQ ID NO: 242909 - DNA, 15 bp, Homo sapiens
tgtcatataagaaga

SEQ ID NO: 242910 - DNA, 15 bp, Homo sapiens
atgtcatataagaag

SEQ ID NO: 242911 - DNA, 15 bp, Homo sapiens
aatgtcatataagaa

SEQ ID NO: 242912 - DNA, 15 bp, Homo sapiens
aaatgtcatataaga

SEQ ID NO: 242913 - DNA, 15 bp, Homo sapiens
aaaatgtcatataag

SEQ ID NO: 242914 - DNA, 15 bp, Homo sapiens
taaaatgtcatataa

SEQ ID NO: 242915 - DNA, 15 bp, Homo sapiens
ataaaatgtcatata

SEQ ID NO: 242916 - DNA, 15 bp, Homo sapiens
tataaaatgtcatat

SEQ ID NO: 242917 - DNA, 15 bp, Homo sapiens
ttataaaatgtcata

SEQ ID NO: 242918 - DNA, 15 bp, Homo sapiens
cttataaaatgtcat

SEQ ID NO: 242919 - DNA, 15 bp, Homo sapiens
acttataaaatgtca

SEQ ID NO: 242920 - DNA, 15 bp, Homo sapiens
aacttataaaatgtc

SEQ ID NO: 242921 - DNA, 15 bp, Homo sapiens
aaacttataaaatgt

SEQ ID NO: 242922 - DNA, 15 bp, Homo sapiens
aaaacttataaaatg

SEQ ID NO: 242923 - DNA, 15 bp, Homo sapiens
caaaacttataaaat

SEQ ID NO: 242924 - DNA, 15 bp, Homo sapiens
acaaaacttataaaa

SEQ ID NO: 242925 - DNA, 15 bp, Homo sapiens
tacaaaacttataaa

SEQ ID NO: 242926 - DNA, 15 bp, Homo sapiens
atacaaaacttataa

SEQ ID NO: 242927 - DNA, 15 bp, Homo sapiens
tatacaaaacttata

SEQ ID NO: 242928 - DNA, 15 bp, Homo sapiens
ttatacaaaacttat

SEQ ID NO: 242929 - DNA, 15 bp, Homo sapiens
attatacaaaactta

SEQ ID NO: 242930 - DNA, 15 bp, Homo sapiens
aattatacaaaactt

SEQ ID NO: 242931 - DNA, 15 bp, Homo sapiens
aaattatacaaaact

SEQ ID NO: 242932 - DNA, 15 bp, Homo sapiens
taaattatacaaaac

SEQ ID NO: 242933 - DNA, 15 bp, Homo sapiens
gtaaattatacaaaa

SEQ ID NO: 242934 - DNA, 15 bp, Homo sapiens
tgtaaattatacaaa

SEQ ID NO: 242935 - DNA, 15 bp, Homo sapiens
gtgtaaattatacaa

SEQ ID NO: 242936 - DNA, 15 bp, Homo sapiens
tgtgtaaattataca

SEQ ID NO: 242937 - DNA, 15 bp, Homo sapiens
ctgtgtaaattatac

SEQ ID NO: 242938 - DNA, 15 bp, Homo sapiens
cctgtgtaaattata

SEQ ID NO: 242939 - DNA, 15 bp, Homo sapiens
gcctgtgtaaattat

SEQ ID NO: 242940 - DNA, 15 bp, Homo sapiens
agcctgtgtaaatta

SEQ ID NO: 242941 - DNA, 15 bp, Homo sapiens
gagcctgtgtaaatt

SEQ ID NO: 242942 - DNA, 15 bp, Homo sapiens
agagcctgtgtaaat

SEQ ID NO: 242943 - DNA, 15 bp, Homo sapiens
aagagcctgtgtaaa

SEQ ID NO: 242944 - DNA, 15 bp, Homo sapiens
taagagcctgtgtaa

SEQ ID NO: 242945 - DNA, 15 bp, Homo sapiens
ctaagagcctgtgta

SEQ ID NO: 242946 - DNA, 15 bp, Homo sapiens
actaagagcctgtgt

SEQ ID NO: 242947 - DNA, 15 bp, Homo sapiens
tactaagagcctgtg

SEQ ID NO: 242948 - DNA, 15 bp, Homo sapiens
ctactaagagcctgt

SEQ ID NO: 242949 - DNA, 15 bp, Homo sapiens
cctactaagagcctg

SEQ ID NO: 242950 - DNA, 15 bp, Homo sapiens
gcctactaagagcct

SEQ ID NO: 242951 - DNA, 15 bp, Homo sapiens
cgcctactaagagcc

SEQ ID NO: 242952 - DNA, 15 bp, Homo sapiens
acgcctactaagagc

SEQ ID NO: 242953 - DNA, 15 bp, Homo sapiens
aacgcctactaagag

SEQ ID NO: 242954 - DNA, 15 bp, Homo sapiens
caacgcctactaaga

SEQ ID NO: 242955 - DNA, 15 bp, Homo sapiens
tcaacgcctactaag

SEQ ID NO: 242956 - DNA, 15 bp, Homo sapiens
atcaacgcctactaa

SEQ ID NO: 242957 - DNA, 15 bp, Homo sapiens
gatcaacgcctacta

SEQ ID NO: 242958 - DNA, 15 bp, Homo sapiens
ggatcaacgcctact

SEQ ID NO: 242959 - DNA, 15 bp, Homo sapiens
aggatcaacgcctac

SEQ ID NO: 242960 - DNA, 15 bp, Homo sapiens
aaggatcaacgccta

SEQ ID NO: 242961 - DNA, 15 bp, Homo sapiens
caaggatcaacgcct

SEQ ID NO: 242962 - DNA, 15 bp, Homo sapiens
ccaaggatcaacgcc

SEQ ID NO: 242963 - DNA, 15 bp, Homo sapiens
gccaaggatcaacgc

SEQ ID NO: 242964 - DNA, 15 bp, Homo sapiens
agccaaggatcaacg

SEQ ID NO: 242965 - DNA, 15 bp, Homo sapiens
aagccaaggatcaac

SEQ ID NO: 242966 - DNA, 15 bp, Homo sapiens
taagccaaggatcaa

SEQ ID NO: 242967 - DNA, 15 bp, Homo sapiens
ctaagccaaggatca

SEQ ID NO: 242968 - DNA, 15 bp, Homo sapiens
cctaagccaaggatc

SEQ ID NO: 242969 - DNA, 15 bp, Homo sapiens
ccctaagccaaggat

SEQ ID NO: 242970 - DNA, 15 bp, Homo sapiens
gccctaagccaagga

SEQ ID NO: 242971 - DNA, 15 bp, Homo sapiens
agccctaagccaagg

SEQ ID NO: 242972 - DNA, 15 bp, Homo sapiens
tagccctaagccaag

SEQ ID NO: 242973 - DNA, 15 bp, Homo sapiens
atagccctaagccaa

SEQ ID NO: 242974 - DNA, 15 bp, Homo sapiens
tatagccctaagcca

SEQ ID NO: 242975 - DNA, 15 bp, Homo sapiens
atatagccctaagcc

SEQ ID NO: 242976 - DNA, 15 bp, Homo sapiens
tatatagccctaagc

SEQ ID NO: 242977 - DNA, 15 bp, Homo sapiens
atatatagccctaag

SEQ ID NO: 242978 - DNA, 15 bp, Homo sapiens
aatatatagccctaa

SEQ ID NO: 242979 - DNA, 15 bp, Homo sapiens
caatatatagcccta

SEQ ID NO: 242980 - DNA, 15 bp, Homo sapiens
acaatatatagccct

SEQ ID NO: 242981 - DNA, 15 bp, Homo sapiens
gacaatatatagccc

SEQ ID NO: 242982 - DNA, 15 bp, Homo sapiens
tgacaatatatagcc

SEQ ID NO: 242983 - DNA, 15 bp, Homo sapiens
atgacaatatatagc

SEQ ID NO: 242984 - DNA, 15 bp, Homo sapiens
catgacaatatatag

SEQ ID NO: 242985 - DNA, 15 bp, Homo sapiens
ccatgacaatatata

SEQ ID NO: 242986 - DNA, 15 bp, Homo sapiens
tccatgacaatatat

SEQ ID NO: 242987 - DNA, 15 bp, Homo sapiens
ttccatgacaatata

SEQ ID NO: 242988 - DNA, 15 bp, Homo sapiens
gttccatgacaatat

SEQ ID NO: 242989 - DNA, 15 bp, Homo sapiens
tgttccatgacaata

SEQ ID NO: 242990 - DNA, 15 bp, Homo sapiens
ctgttccatgacaat

SEQ ID NO: 242991 - DNA, 15 bp, Homo sapiens
tctgttccatgacaa

SEQ ID NO: 242992 - DNA, 15 bp, Homo sapiens
ttctgttccatgaca

SEQ ID NO: 242993 - DNA, 15 bp, Homo sapiens
attctgttccatgac

SEQ ID NO: 242994 - DNA, 15 bp, Homo sapiens
cattctgttccatga

SEQ ID NO: 242995 - DNA, 15 bp, Homo sapiens
tcattctgttccatg

SEQ ID NO: 242996 - DNA, 15 bp, Homo sapiens
atcattctgttccat

SEQ ID NO: 242997 - DNA, 15 bp, Homo sapiens
tatcattctgttcca

SEQ ID NO: 242998 - DNA, 15 bp, Homo sapiens
ttatcattctgttcc

SEQ ID NO: 242999 - DNA, 15 bp, Homo sapiens
tttatcattctgttc

SEQ ID NO: 243000 - DNA, 15 bp, Homo sapiens
ttttatcattctgtt

SEQ ID NO: 243001 - DNA, 15 bp, Homo sapiens
attttatcattctgt

SEQ ID NO: 243002 - DNA, 15 bp, Homo sapiens
aattttatcattctg

SEQ ID NO: 243003 - DNA, 15 bp, Homo sapiens
gaattttatcattct

SEQ ID NO: 243004 - DNA, 15 bp, Homo sapiens
agaattttatcattc

SEQ ID NO: 243005 - DNA, 15 bp, Homo sapiens
tagaattttatcatt

SEQ ID NO: 243006 - DNA, 15 bp, Homo sapiens
gtagaattttatcat

SEQ ID NO: 243007 - DNA, 15 bp, Homo sapiens
agtagaattttatca

SEQ ID NO: 243008 - DNA, 15 bp, Homo sapiens
aagtagaattttatc

SEQ ID NO: 243009 - DNA, 15 bp, Homo sapiens
gaagtagaattttat

SEQ ID NO: 243010 - DNA, 15 bp, Homo sapiens
agaagtagaatttta

SEQ ID NO: 243011 - DNA, 15 bp, Homo sapiens
tagaagtagaatttt

SEQ ID NO: 243012 - DNA, 15 bp, Homo sapiens
atagaagtagaattt

SEQ ID NO: 243013 - DNA, 15 bp, Homo sapiens
tatagaagtagaatt

SEQ ID NO: 243014 - DNA, 15 bp, Homo sapiens
ctatagaagtagaat

SEQ ID NO: 243015 - DNA, 15 bp, Homo sapiens
actatagaagtagaa

SEQ ID NO: 243016 - DNA, 15 bp, Homo sapiens
gactatagaagtaga

SEQ ID NO: 243017 - DNA, 15 bp, Homo sapiens
ggactatagaagtag

SEQ ID NO: 243018 - DNA, 15 bp, Homo sapiens
gggactatagaagta

SEQ ID NO: 243019 - DNA, 15 bp, Homo sapiens
agggactatagaagt

SEQ ID NO: 243020 - DNA, 15 bp, Homo sapiens
aagggactatagaag

SEQ ID NO: 243021 - DNA, 15 bp, Homo sapiens
caagggactatagaa

SEQ ID NO: 243022 - DNA, 15 bp, Homo sapiens
ccaagggactataga

SEQ ID NO: 243023 - DNA, 15 bp, Homo sapiens
tccaagggactatag

SEQ ID NO: 243024 - DNA, 15 bp, Homo sapiens
ctccaagggactata

SEQ ID NO: 243025 - DNA, 15 bp, Homo sapiens
actccaagggactat

SEQ ID NO: 243026 - DNA, 15 bp, Homo sapiens
cactccaagggacta

SEQ ID NO: 243027 - DNA, 15 bp, Homo sapiens
acactccaagggact

SEQ ID NO: 243028 - DNA, 15 bp, Homo sapiens
tacactccaagggac

SEQ ID NO: 243029 - DNA, 15 bp, Homo sapiens
ttacactccaaggga

SEQ ID NO: 243030 - DNA, 15 bp, Homo sapiens
gttacactccaaggg

SEQ ID NO: 243031 - DNA, 15 bp, Homo sapiens
agttacactccaagg

SEQ ID NO: 243032 - DNA, 15 bp, Homo sapiens
aagttacactccaag

SEQ ID NO: 243033 - DNA, 15 bp, Homo sapiens
taagttacactccaa

SEQ ID NO: 243034 - DNA, 15 bp, Homo sapiens
ctaagttacactcca

SEQ ID NO: 243035 - DNA, 15 bp, Homo sapiens
actaagttacactcc

SEQ ID NO: 243036 - DNA, 15 bp, Homo sapiens
tactaagttacactc

SEQ ID NO: 243037 - DNA, 15 bp, Homo sapiens
ttactaagttacact

SEQ ID NO: 243038 - DNA, 15 bp, Homo sapiens
tttactaagttacac

SEQ ID NO: 243039 - DNA, 15 bp, Homo sapiens
ctttactaagttaca

SEQ ID NO: 243040 - DNA, 15 bp, Homo sapiens
tctttactaagttac

SEQ ID NO: 243041 - DNA, 15 bp, Homo sapiens
atctttactaagtta

SEQ ID NO: 243042 - DNA, 15 bp, Homo sapiens
tatctttactaagtt

SEQ ID NO: 243043 - DNA, 15 bp, Homo sapiens
atatctttactaagt

SEQ ID NO: 243044 - DNA, 15 bp, Homo sapiens
aatatctttactaag

SEQ ID NO: 243045 - DNA, 15 bp, Homo sapiens
taatatctttactaa

SEQ ID NO: 243046 - DNA, 15 bp, Homo sapiens
ttaatatctttacta

SEQ ID NO: 243047 - DNA, 15 bp, Homo sapiens
attaatatctttact

SEQ ID NO: 243048 - DNA, 15 bp, Homo sapiens
aattaatatctttac

SEQ ID NO: 243049 - DNA, 15 bp, Homo sapiens
aaattaatatcttta

SEQ ID NO: 243050 - DNA, 15 bp, Homo sapiens
taaattaatatcttt

SEQ ID NO: 243051 - DNA, 15 bp, Homo sapiens
gtaaattaatatctt

SEQ ID NO: 243052 - DNA, 15 bp, Homo sapiens
tgtaaattaatatct

SEQ ID NO: 243053 - DNA, 15 bp, Homo sapiens
ttgtaaattaatatc

SEQ ID NO: 243054 - DNA, 15 bp, Homo sapiens
gttgtaaattaatat

SEQ ID NO: 243055 - DNA, 15 bp, Homo sapiens
cgttgtaaattaata

SEQ ID NO: 243056 - DNA, 15 bp, Homo sapiens
acgttgtaaattaat

SEQ ID NO: 243057 - DNA, 15 bp, Homo sapiens
cacgttgtaaattaa

SEQ ID NO: 243058 - DNA, 15 bp, Homo sapiens
gcacgttgtaaatta

SEQ ID NO: 243059 - DNA, 15 bp, Homo sapiens
agcacgttgtaaatt

SEQ ID NO: 243060 - DNA, 15 bp, Homo sapiens
gagcacgttgtaaat

SEQ ID NO: 243061 - DNA, 15 bp, Homo sapiens
agagcacgttgtaaa

SEQ ID NO: 243062 - DNA, 15 bp, Homo sapiens
tagagcacgttgtaa

SEQ ID NO: 243063 - DNA, 15 bp, Homo sapiens
ctagagcacgttgta

SEQ ID NO: 243064 - DNA, 15 bp, Homo sapiens
actagagcacgttgt

SEQ ID NO: 243065 - DNA, 15 bp, Homo sapiens
cactagagcacgttg

SEQ ID NO: 243066 - DNA, 15 bp, Homo sapiens
tcactagagcacgtt

SEQ ID NO: 243067 - DNA, 15 bp, Homo sapiens
atcactagagcacgt

SEQ ID NO: 243068 - DNA, 15 bp, Homo sapiens
catcactagagcacg

SEQ ID NO: 243069 - DNA, 15 bp, Homo sapiens
tcatcactagagcac

SEQ ID NO: 243070 - DNA, 15 bp, Homo sapiens
ctcatcactagagca

SEQ ID NO: 243071 - DNA, 15 bp, Homo sapiens
actcatcactagagc

SEQ ID NO: 243072 - DNA, 15 bp, Homo sapiens
gactcatcactagag

SEQ ID NO: 243073 - DNA, 15 bp, Homo sapiens
tgactcatcactaga

SEQ ID NO: 243074 - DNA, 15 bp, Homo sapiens
atgactcatcactag

SEQ ID NO: 243075 - DNA, 15 bp, Homo sapiens
tatgactcatcacta

SEQ ID NO: 243076 - DNA, 15 bp, Homo sapiens
ctatgactcatcact

SEQ ID NO: 243077 - DNA, 15 bp, Homo sapiens
actatgactcatcac

SEQ ID NO: 243078 - DNA, 15 bp, Homo sapiens
aactatgactcatca

SEQ ID NO: 243079 - DNA, 15 bp, Homo sapiens
caactatgactcatc

SEQ ID NO: 243080 - DNA, 15 bp, Homo sapiens
tcaactatgactcat

SEQ ID NO: 243081 - DNA, 15 bp, Homo sapiens
gtcaactatgactca

SEQ ID NO: 243082 - DNA, 15 bp, Homo sapiens
ggtcaactatgactc

SEQ ID NO: 243083 - DNA, 15 bp, Homo sapiens
gggtcaactatgact

SEQ ID NO: 243084 - DNA, 15 bp, Homo sapiens
agggtcaactatgac

SEQ ID NO: 243085 - DNA, 15 bp, Homo sapiens
tagggtcaactatga

SEQ ID NO: 243086 - DNA, 15 bp, Homo sapiens
atagggtcaactatg

SEQ ID NO: 243087 - DNA, 15 bp, Homo sapiens
aatagggtcaactat

SEQ ID NO: 243088 - DNA, 15 bp, Homo sapiens
aaatagggtcaacta

SEQ ID NO: 243089 - DNA, 15 bp, Homo sapiens
aaaatagggtcaact

SEQ ID NO: 243090 - DNA, 15 bp, Homo sapiens
taaaatagggtcaac

SEQ ID NO: 243091 - DNA, 15 bp, Homo sapiens
ataaaatagggtcaa

SEQ ID NO: 243092 - DNA, 15 bp, Homo sapiens
cataaaatagggtca

SEQ ID NO: 243093 - DNA, 15 bp, Homo sapiens
acataaaatagggtc

SEQ ID NO: 243094 - DNA, 15 bp, Homo sapiens
cacataaaatagggt

SEQ ID NO: 243095 - DNA, 15 bp, Homo sapiens
acacataaaataggg

SEQ ID NO: 243096 - DNA, 15 bp, Homo sapiens
gacacataaaatagg

SEQ ID NO: 243097 - DNA, 15 bp, Homo sapiens
tgacacataaaatag

SEQ ID NO: 243098 - DNA, 15 bp, Homo sapiens
ctgacacataaaata

SEQ ID NO: 243099 - DNA, 15 bp, Homo sapiens
tctgacacataaaat

SEQ ID NO: 243100 - DNA, 15 bp, Homo sapiens
gtctgacacataaaa

SEQ ID NO: 243101 - DNA, 15 bp, Homo sapiens
cgtctgacacataaa

SEQ ID NO: 243102 - DNA, 15 bp, Homo sapiens
tcgtctgacacataa

SEQ ID NO: 243103 - DNA, 15 bp, Homo sapiens
ttcgtctgacacata

SEQ ID NO: 243104 - DNA, 15 bp, Homo sapiens
gttcgtctgacacat

SEQ ID NO: 243105 - DNA, 15 bp, Homo sapiens
tgttcgtctgacaca

SEQ ID NO: 243106 - DNA, 15 bp, Homo sapiens
ctgttcgtctgacac

SEQ ID NO: 243107 - DNA, 15 bp, Homo sapiens
gctgttcgtctgaca

SEQ ID NO: 243108 - DNA, 15 bp, Homo sapiens
tgctgttcgtctgac

SEQ ID NO: 243109 - DNA, 15 bp, Homo sapiens
atgctgttcgtctga

SEQ ID NO: 243110 - DNA, 15 bp, Homo sapiens
gatgctgttcgtctg

SEQ ID NO: 243111 - DNA, 15 bp, Homo sapiens
tgatgctgttcgtct

SEQ ID NO: 243112 - DNA, 15 bp, Homo sapiens
atgatgctgttcgtc

SEQ ID NO: 243113 - DNA, 15 bp, Homo sapiens
tatgatgctgttcgt

SEQ ID NO: 243114 - DNA, 15 bp, Homo sapiens
ttatgatgctgttcg

SEQ ID NO: 243115 - DNA, 15 bp, Homo sapiens
attatgatgctgttc

SEQ ID NO: 243116 - DNA, 15 bp, Homo sapiens
gattatgatgctgtt

SEQ ID NO: 243117 - DNA, 15 bp, Homo sapiens
tgattatgatgctgt

SEQ ID NO: 243118 - DNA, 15 bp, Homo sapiens
atgattatgatgctg

SEQ ID NO: 243119 - DNA, 15 bp, Homo sapiens
catgattatgatgct

SEQ ID NO: 243120 - DNA, 15 bp, Homo sapiens
tcatgattatgatgc

SEQ ID NO: 243121 - DNA, 15 bp, Homo sapiens
gtcatgattatgatg

SEQ ID NO: 243122 - DNA, 15 bp, Homo sapiens
tgtcatgattatgat

SEQ ID NO: 243123 - DNA, 15 bp, Homo sapiens
ttgtcatgattatga

SEQ ID NO: 243124 - DNA, 15 bp, Homo sapiens
gttgtcatgattatg

SEQ ID NO: 243125 - DNA, 15 bp, Homo sapiens
tgttgtcatgattat

SEQ ID NO: 243126 - DNA, 15 bp, Homo sapiens
gtgttgtcatgatta

SEQ ID NO: 243127 - DNA, 15 bp, Homo sapiens
agtgttgtcatgatt

SEQ ID NO: 243128 - DNA, 15 bp, Homo sapiens
aagtgttgtcatgat

SEQ ID NO: 243129 - DNA, 15 bp, Homo sapiens
taagtgttgtcatga

SEQ ID NO: 243130 - DNA, 15 bp, Homo sapiens
gtaagtgttgtcatg

SEQ ID NO: 243131 - DNA, 15 bp, Homo sapiens
agtaagtgttgtcat

SEQ ID NO: 243132 - DNA, 15 bp, Homo sapiens
aagtaagtgttgtca

SEQ ID NO: 243133 - DNA, 15 bp, Homo sapiens
taagtaagtgttgtc

SEQ ID NO: 243134 - DNA, 15 bp, Homo sapiens
ataagtaagtgttgt

SEQ ID NO: 243135 - DNA, 15 bp, Homo sapiens
aataagtaagtgttg

SEQ ID NO: 243136 - DNA, 15 bp, Homo sapiens
caataagtaagtgtt

SEQ ID NO: 243137 - DNA, 15 bp, Homo sapiens
acaataagtaagtgt

SEQ ID NO: 243138 - DNA, 15 bp, Homo sapiens
gacaataagtaagtg

SEQ ID NO: 243139 - DNA, 15 bp, Homo sapiens
tgacaataagtaagt

SEQ ID NO: 243140 - DNA, 15 bp, Homo sapiens
ctgacaataagtaag

SEQ ID NO: 243141 - DNA, 15 bp, Homo sapiens
cctgacaataagtaa

SEQ ID NO: 243142 - DNA, 15 bp, Homo sapiens
tcctgacaataagta

SEQ ID NO: 243143 - DNA, 15 bp, Homo sapiens
ctcctgacaataagt

SEQ ID NO: 243144 - DNA, 15 bp, Homo sapiens
tctcctgacaataag

SEQ ID NO: 243145 - DNA, 15 bp, Homo sapiens
gtctcctgacaataa

SEQ ID NO: 243146 - DNA, 15 bp, Homo sapiens
tgtctcctgacaata

SEQ ID NO: 243147 - DNA, 15 bp, Homo sapiens
ctgtctcctgacaat

SEQ ID NO: 243148 - DNA, 15 bp, Homo sapiens
gctgtctcctgacaa

SEQ ID NO: 243149 - DNA, 15 bp, Homo sapiens
agctgtctcctgaca

SEQ ID NO: 243150 - DNA, 15 bp, Homo sapiens
gagctgtctcctgac

SEQ ID NO: 243151 - DNA, 15 bp, Homo sapiens
agagctgtctcctga

SEQ ID NO: 243152 - DNA, 15 bp, Homo sapiens
cagagctgtctcctg

SEQ ID NO: 243153 - DNA, 15 bp, Homo sapiens
acagagctgtctcct

SEQ ID NO: 243154 - DNA, 15 bp, Homo sapiens
gacagagctgtctcc

SEQ ID NO: 243155 - DNA, 15 bp, Homo sapiens
agacagagctgtctc

SEQ ID NO: 243156 - DNA, 15 bp, Homo sapiens
gagacagagctgtct

SEQ ID NO: 243157 - DNA, 15 bp, Homo sapiens
tgagacagagctgtc

SEQ ID NO: 243158 - DNA, 15 bp, Homo sapiens
ctgagacagagctgt

SEQ ID NO: 243159 - DNA, 15 bp, Homo sapiens
cctgagacagagctg

SEQ ID NO: 243160 - DNA, 15 bp, Homo sapiens
acctgagacagagct

SEQ ID NO: 243161 - DNA, 15 bp, Homo sapiens
aacctgagacagagc

SEQ ID NO: 243162 - DNA, 15 bp, Homo sapiens
taacctgagacagag

SEQ ID NO: 243163 - DNA, 15 bp, Homo sapiens
ctaacctgagacaga

SEQ ID NO: 243164 - DNA, 15 bp, Homo sapiens
gctaacctgagacag

SEQ ID NO: 243165 - DNA, 15 bp, Homo sapiens
agctaacctgagaca

SEQ ID NO: 243166 - DNA, 15 bp, Homo sapiens
cagctaacctgagac

SEQ ID NO: 243167 - DNA, 15 bp, Homo sapiens
acagctaacctgaga

SEQ ID NO: 243168 - DNA, 15 bp, Homo sapiens
cacagctaacctgag

SEQ ID NO: 243169 - DNA, 15 bp, Homo sapiens
acacagctaacctga

SEQ ID NO: 243170 - DNA, 15 bp, Homo sapiens
cacacagctaacctg

SEQ ID NO: 243171 - DNA, 15 bp, Homo sapiens
tcacacagctaacct

SEQ ID NO: 243172 - DNA, 15 bp, Homo sapiens
gtcacacagctaacc

SEQ ID NO: 243173 - DNA, 15 bp, Homo sapiens
ggtcacacagctaac

SEQ ID NO: 243174 - DNA, 15 bp, Homo sapiens
aggtcacacagctaa

SEQ ID NO: 243175 - DNA, 15 bp, Homo sapiens
gaggtcacacagcta

SEQ ID NO: 243176 - DNA, 15 bp, Homo sapiens
tgaggtcacacagct

SEQ ID NO: 243177 - DNA, 15 bp, Homo sapiens
ctgaggtcacacagc

SEQ ID NO: 243178 - DNA, 15 bp, Homo sapiens
cctgaggtcacacag

SEQ ID NO: 243179 - DNA, 15 bp, Homo sapiens
acctgaggtcacaca

SEQ ID NO: 243180 - DNA, 15 bp, Homo sapiens
tacctgaggtcacac

SEQ ID NO: 243181 - DNA, 15 bp, Homo sapiens
ttacctgaggtcaca

SEQ ID NO: 243182 - DNA, 15 bp, Homo sapiens
cttacctgaggtcac

SEQ ID NO: 243183 - DNA, 15 bp, Homo sapiens
acttacctgaggtca

SEQ ID NO: 243184 - DNA, 15 bp, Homo sapiens
gacttacctgaggtc

SEQ ID NO: 243185 - DNA, 15 bp, Homo sapiens
tgacttacctgaggt

SEQ ID NO: 243186 - DNA, 15 bp, Homo sapiens
ctgacttacctgagg

SEQ ID NO: 243187 - DNA, 15 bp, Homo sapiens
tctgacttacctgag

SEQ ID NO: 243188 - DNA, 15 bp, Homo sapiens
atctgacttacctga

SEQ ID NO: 243189 - DNA, 15 bp, Homo sapiens
catctgacttacctg

SEQ ID NO: 243190 - DNA, 15 bp, Homo sapiens
tcatctgacttacct

SEQ ID NO: 243191 - DNA, 15 bp, Homo sapiens
ttcatctgacttacc

SEQ ID NO: 243192 - DNA, 15 bp, Homo sapiens
cttcatctgacttac

SEQ ID NO: 243193 - DNA, 15 bp, Homo sapiens
tcttcatctgactta

SEQ ID NO: 243194 - DNA, 15 bp, Homo sapiens
atcttcatctgactt

SEQ ID NO: 243195 - DNA, 15 bp, Homo sapiens
gatcttcatctgact

SEQ ID NO: 243196 - DNA, 15 bp, Homo sapiens
agatcttcatctgac

SEQ ID NO: 243197 - DNA, 15 bp, Homo sapiens
gagatcttcatctga

SEQ ID NO: 243198 - DNA, 15 bp, Homo sapiens
agagatcttcatctg

SEQ ID NO: 243199 - DNA, 15 bp, Homo sapiens
cagagatcttcatct

SEQ ID NO: 243200 - DNA, 15 bp, Homo sapiens
ccagagatcttcatc

SEQ ID NO: 243201 - DNA, 15 bp, Homo sapiens
cccagagatcttcat

SEQ ID NO: 243202 - DNA, 15 bp, Homo sapiens
gcccagagatcttca

SEQ ID NO: 243203 - DNA, 15 bp, Homo sapiens
ggcccagagatcttc

SEQ ID NO: 243204 - DNA, 15 bp, Homo sapiens
tggcccagagatctt

SEQ ID NO: 243205 - DNA, 15 bp, Homo sapiens
ttggcccagagatct

SEQ ID NO: 243206 - DNA, 15 bp, Homo sapiens
cttggcccagagatc

SEQ ID NO: 243207 - DNA, 15 bp, Homo sapiens
acttggcccagagat

SEQ ID NO: 243208 - DNA, 15 bp, Homo sapiens
aacttggcccagaga

SEQ ID NO: 243209 - DNA, 15 bp, Homo sapiens
aaacttggcccagag

SEQ ID NO: 243210 - DNA, 15 bp, Homo sapiens
gaaacttggcccaga

SEQ ID NO: 243211 - DNA, 15 bp, Homo sapiens
ggaaacttggcccag

SEQ ID NO: 243212 - DNA, 15 bp, Homo sapiens
aggaaacttggccca

SEQ ID NO: 243213 - DNA, 15 bp, Homo sapiens
aaggaaacttggccc

SEQ ID NO: 243214 - DNA, 15 bp, Homo sapiens
aaaggaaacttggcc

SEQ ID NO: 243215 - DNA, 15 bp, Homo sapiens
aaaaggaaacttggc

SEQ ID NO: 243216 - DNA, 15 bp, Homo sapiens
aaaaaggaaacttgg

SEQ ID NO: 243217 - DNA, 15 bp, Homo sapiens
taaaaaggaaacttg

SEQ ID NO: 243218 - DNA, 15 bp, Homo sapiens
ataaaaaggaaactt

SEQ ID NO: 243219 - DNA, 15 bp, Homo sapiens
gataaaaaggaaact

SEQ ID NO: 243220 - DNA, 15 bp, Homo sapiens
tgataaaaaggaaac

SEQ ID NO: 243221 - DNA, 15 bp, Homo sapiens
atgataaaaaggaaa

SEQ ID NO: 243222 - DNA, 15 bp, Homo sapiens
aatgataaaaaggaa

SEQ ID NO: 243223 - DNA, 15 bp, Homo sapiens
aaatgataaaaagga

SEQ ID NO: 243224 - DNA, 15 bp, Homo sapiens
gaaatgataaaaagg

SEQ ID NO: 243225 - DNA, 15 bp, Homo sapiens
tagaaatgataaaaa

SEQ ID NO: 243226 - DNA, 15 bp, Homo sapiens
ttagaaatgataaaa

SEQ ID NO: 243227 - DNA, 15 bp, Homo sapiens
gttagaaatgataaa

SEQ ID NO: 243228 - DNA, 15 bp, Homo sapiens
tgttagaaatgataa

SEQ ID NO: 243229 - DNA, 15 bp, Homo sapiens
atgttagaaatgata

SEQ ID NO: 243230 - DNA, 15 bp, Homo sapiens
catgttagaaatgat

SEQ ID NO: 243231 - DNA, 15 bp, Homo sapiens
ccatgttagaaatga

SEQ ID NO: 243232 - DNA, 15 bp, Homo sapiens
cccatgttagaaatg

SEQ ID NO: 243233 - DNA, 15 bp, Homo sapiens
ccccatgttagaaat

SEQ ID NO: 243234 - DNA, 15 bp, Homo sapiens
accccatgttagaaa

SEQ ID NO: 243235 - DNA, 15 bp, Homo sapiens
caccccatgttagaa

SEQ ID NO: 243236 - DNA, 15 bp, Homo sapiens
acaccccatgttaga

SEQ ID NO: 243237 - DNA, 15 bp, Homo sapiens
cacaccccatgttag

SEQ ID NO: 243238 - DNA, 15 bp, Homo sapiens
ccacaccccatgtta

SEQ ID NO: 243239 - DNA, 15 bp, Homo sapiens
accacaccccatgtt

SEQ ID NO: 243240 - DNA, 15 bp, Homo sapiens
taccacaccccatgt

SEQ ID NO: 243241 - DNA, 15 bp, Homo sapiens
ataccacaccccatg

SEQ ID NO: 243242 - DNA, 15 bp, Homo sapiens
gataccacaccccat

SEQ ID NO: 243243 - DNA, 15 bp, Homo sapiens
agataccacacccca

SEQ ID NO: 243244 - DNA, 15 bp, Homo sapiens
gagataccacacccc

SEQ ID NO: 243245 - DNA, 15 bp, Homo sapiens
ggagataccacaccc

SEQ ID NO: 243246 - DNA, 15 bp, Homo sapiens
tggagataccacacc

SEQ ID NO: 243247 - DNA, 15 bp, Homo sapiens
ttggagataccacac

SEQ ID NO: 243248 - DNA, 15 bp, Homo sapiens
tttggagataccaca

SEQ ID NO: 243249 - DNA, 15 bp, Homo sapiens
ttttggagataccac

SEQ ID NO: 243250 - DNA, 15 bp, Homo sapiens
attttggagatacca

SEQ ID NO: 243251 - DNA, 15 bp, Homo sapiens
gattttggagatacc

SEQ ID NO: 243252 - DNA, 15 bp, Homo sapiens
agattttggagatac

SEQ ID NO: 243253 - DNA, 15 bp, Homo sapiens
tagattttggagata

SEQ ID NO: 243254 - DNA, 15 bp, Homo sapiens
atagattttggagat

SEQ ID NO: 243255 - DNA, 15 bp, Homo sapiens
tatagattttggaga

SEQ ID NO: 243256 - DNA, 15 bp, Homo sapiens
gtatagattttggag

SEQ ID NO: 243257 - DNA, 15 bp, Homo sapiens
tgtatagattttgga

SEQ ID NO: 243258 - DNA, 15 bp, Homo sapiens
ttgtatagattttgg

SEQ ID NO: 243259 - DNA, 15 bp, Homo sapiens
tttgtatagattttg

SEQ ID NO: 243260 - DNA, 15 bp, Homo sapiens
atttgtatagatttt

SEQ ID NO: 243261 - DNA, 15 bp, Homo sapiens
catttgtatagattt

SEQ ID NO: 243262 - DNA, 15 bp, Homo sapiens
gcatttgtatagatt

SEQ ID NO: 243263 - DNA, 15 bp, Homo sapiens
agcatttgtatagat

SEQ ID NO: 243264 - DNA, 15 bp, Homo sapiens
tagcatttgtataga

SEQ ID NO: 243265 - DNA, 15 bp, Homo sapiens
ttagcatttgtatag

SEQ ID NO: 243266 - DNA, 15 bp, Homo sapiens
attagcatttgtata

SEQ ID NO: 243267 - DNA, 15 bp, Homo sapiens
tattagcatttgtat

SEQ ID NO: 243268 - DNA, 15 bp, Homo sapiens
ttattagcatttgta

SEQ ID NO: 243269 - DNA, 15 bp, Homo sapiens
attattagcatttgt

SEQ ID NO: 243270 - DNA, 15 bp, Homo sapiens
gattattagcatttg

SEQ ID NO: 243271 - DNA, 15 bp, Homo sapiens
agattattagcattt

SEQ ID NO: 243272 - DNA, 15 bp, Homo sapiens
cagattattagcatt

SEQ ID NO: 243273 - DNA, 15 bp, Homo sapiens
gcagattattagcat

SEQ ID NO: 243274 - DNA, 15 bp, Homo sapiens
agcagattattagca

SEQ ID NO: 243275 - DNA, 15 bp, Homo sapiens
gagcagattattagc

SEQ ID NO: 243276 - DNA, 15 bp, Homo sapiens
agagcagattattag

SEQ ID NO: 243277 - DNA, 15 bp, Homo sapiens
aagagcagattatta

SEQ ID NO: 243278 - DNA, 15 bp, Homo sapiens
gaagagcagattatt

SEQ ID NO: 243279 - DNA, 15 bp, Homo sapiens
ggaagagcagattat

SEQ ID NO: 243280 - DNA, 15 bp, Homo sapiens
tggaagagcagatta

SEQ ID NO: 243281 - DNA, 15 bp, Homo sapiens
ctggaagagcagatt

SEQ ID NO: 243282 - DNA, 15 bp, Homo sapiens
actggaagagcagat

SEQ ID NO: 243283 - DNA, 15 bp, Homo sapiens
tactggaagagcaga

SEQ ID NO: 243284 - DNA, 15 bp, Homo sapiens
atactggaagagcag

SEQ ID NO: 243285 - DNA, 15 bp, Homo sapiens
tatactggaagagca

SEQ ID NO: 243286 - DNA, 15 bp, Homo sapiens
gtatactggaagagc

SEQ ID NO: 243287 - DNA, 15 bp, Homo sapiens
agtatactggaagag

SEQ ID NO: 243288 - DNA, 15 bp, Homo sapiens
aagtatactggaaga

SEQ ID NO: 243289 - DNA, 15 bp, Homo sapiens
gaagtatactggaag

SEQ ID NO: 243290 - DNA, 15 bp, Homo sapiens
ggaagtatactggaa

SEQ ID NO: 243291 - DNA, 15 bp, Homo sapiens
aggaagtatactgga

SEQ ID NO: 243292 - DNA, 15 bp, Homo sapiens
caggaagtatactgg

SEQ ID NO: 243293 - DNA, 15 bp, Homo sapiens
tcaggaagtatactg

SEQ ID NO: 243294 - DNA, 15 bp, Homo sapiens
ttcaggaagtatact

SEQ ID NO: 243295 - DNA, 15 bp, Homo sapiens
tttcaggaagtatac

SEQ ID NO: 243296 - DNA, 15 bp, Homo sapiens
ttttcaggaagtata

SEQ ID NO: 243297 - DNA, 15 bp, Homo sapiens
gttttcaggaagtat

SEQ ID NO: 243298 - DNA, 15 bp, Homo sapiens
cgttttcaggaagta

SEQ ID NO: 243299 - DNA, 15 bp, Homo sapiens
acgttttcaggaagt

SEQ ID NO: 243300 - DNA, 15 bp, Homo sapiens
aacgttttcaggaag

SEQ ID NO: 243301 - DNA, 15 bp, Homo sapiens
caacgttttcaggaa

SEQ ID NO: 243302 - DNA, 15 bp, Homo sapiens
acaacgttttcagga

SEQ ID NO: 243303 - DNA, 15 bp, Homo sapiens
cacaacgttttcagg

SEQ ID NO: 243304 - DNA, 15 bp, Homo sapiens
acacaacgttttcag

SEQ ID NO: 243305 - DNA, 15 bp, Homo sapiens
cacacaacgttttca

SEQ ID NO: 243306 - DNA, 15 bp, Homo sapiens
tcacacaacgttttc

SEQ ID NO: 243307 - DNA, 15 bp, Homo sapiens
ttcacacaacgtttt

SEQ ID NO: 243308 - DNA, 15 bp, Homo sapiens
cttcacacaacgttt

SEQ ID NO: 243309 - DNA, 15 bp, Homo sapiens
acttcacacaacgtt

SEQ ID NO: 243310 - DNA, 15 bp, Homo sapiens
gacttcacacaacgt

SEQ ID NO: 243311 - DNA, 15 bp, Homo sapiens
ggacttcacacaacg

SEQ ID NO: 243312 - DNA, 15 bp, Homo sapiens
tggacttcacacaac

SEQ ID NO: 243313 - DNA, 15 bp, Homo sapiens
atggacttcacacaa

SEQ ID NO: 243314 - DNA, 15 bp, Homo sapiens
catggacttcacaca

SEQ ID NO: 243315 - DNA, 15 bp, Homo sapiens
acatggacttcacac

SEQ ID NO: 243316 - DNA, 15 bp, Homo sapiens
aacatggacttcaca

SEQ ID NO: 243317 - DNA, 15 bp, Homo sapiens
caacatggacttcac

SEQ ID NO: 243318 - DNA, 15 bp, Homo sapiens
ccaacatggacttca

SEQ ID NO: 243319 - DNA, 15 bp, Homo sapiens
accaacatggacttc

SEQ ID NO: 243320 - DNA, 15 bp, Homo sapiens
caccaacatggactt

SEQ ID NO: 243321 - DNA, 15 bp, Homo sapiens
tcaccaacatggact

SEQ ID NO: 243322 - DNA, 15 bp, Homo sapiens
ttcaccaacatggac

SEQ ID NO: 243323 - DNA, 15 bp, Homo sapiens
tttcaccaacatgga

SEQ ID NO: 243324 - DNA, 15 bp, Homo sapiens
atttcaccaacatgg

SEQ ID NO: 243325 - DNA, 15 bp, Homo sapiens
tatttcaccaacatg

SEQ ID NO: 243326 - DNA, 15 bp, Homo sapiens
ctatttcaccaacat

SEQ ID NO: 243327 - DNA, 15 bp, Homo sapiens
actatttcaccaaca

SEQ ID NO: 243328 - DNA, 15 bp, Homo sapiens
gactatttcaccaac

SEQ ID NO: 243329 - DNA, 15 bp, Homo sapiens
agactatttcaccaa

SEQ ID NO: 243330 - DNA, 15 bp, Homo sapiens
aagactatttcacca

SEQ ID NO: 243331 - DNA, 15 bp, Homo sapiens
aaagactatttcacc

SEQ ID NO: 243332 - DNA, 15 bp, Homo sapiens
aaaagactatttcac

SEQ ID NO: 243333 - DNA, 15 bp, Homo sapiens
gaaaagactatttca

SEQ ID NO: 243334 - DNA, 15 bp, Homo sapiens
agaaaagactatttc

SEQ ID NO: 243335 - DNA, 15 bp, Homo sapiens
aagaaaagactattt

SEQ ID NO: 243336 - DNA, 15 bp, Homo sapiens
taagaaaagactatt

SEQ ID NO: 243337 - DNA, 15 bp, Homo sapiens
ataagaaaagactat

SEQ ID NO: 243338 - DNA, 15 bp, Homo sapiens
tataagaaaagacta

SEQ ID NO: 243339 - DNA, 15 bp, Homo sapiens
ttataagaaaagact

SEQ ID NO: 243340 - DNA, 15 bp, Homo sapiens
attataagaaaagac

SEQ ID NO: 243341 - DNA, 15 bp, Homo sapiens
aattataagaaaaga

SEQ ID NO: 243342 - DNA, 15 bp, Homo sapiens
aaattataagaaaag

SEQ ID NO: 243343 - DNA, 15 bp, Homo sapiens
aaaattataagaaaa

SEQ ID NO: 243344 - DNA, 15 bp, Homo sapiens
aaaaattataagaaa

SEQ ID NO: 243345 - DNA, 15 bp, Homo sapiens
aaaaaattataagaa

SEQ ID NO: 243346 - DNA, 15 bp, Homo sapiens
taaaaaattataaga

SEQ ID NO: 243347 - DNA, 15 bp, Homo sapiens
ataaaaaattataag

SEQ ID NO: 243348 - DNA, 15 bp, Homo sapiens
aataaaaaattataa

SEQ ID NO: 243349 - DNA, 15 bp, Homo sapiens
taataaaaaattata

SEQ ID NO: 243350 - DNA, 15 bp, Homo sapiens
gtaataaaaaattat

SEQ ID NO: 243351 - DNA, 15 bp, Homo sapiens
tgtaataaaaaatta

SEQ ID NO: 243352 - DNA, 15 bp, Homo sapiens
ctgtaataaaaaatt

SEQ ID NO: 243353 - DNA, 15 bp, Homo sapiens
actgtaataaaaaat

SEQ ID NO: 243354 - DNA, 15 bp, Homo sapiens
gactgtaataaaaaa

SEQ ID NO: 243355 - DNA, 15 bp, Homo sapiens
agactgtaataaaaa

SEQ ID NO: 243356 - DNA, 15 bp, Homo sapiens
cagactgtaataaaa

SEQ ID NO: 243357 - DNA, 15 bp, Homo sapiens
tcagactgtaataaa

SEQ ID NO: 243358 - DNA, 15 bp, Homo sapiens
ctcagactgtaataa

SEQ ID NO: 243359 - DNA, 15 bp, Homo sapiens
tctcagactgtaata

SEQ ID NO: 243360 - DNA, 15 bp, Homo sapiens
atctcagactgtaat

SEQ ID NO: 243361 - DNA, 15 bp, Homo sapiens
catctcagactgtaa

SEQ ID NO: 243362 - DNA, 15 bp, Homo sapiens
acatctcagactgta

SEQ ID NO: 243363 - DNA, 15 bp, Homo sapiens
tacatctcagactgt

SEQ ID NO: 243364 - DNA, 15 bp, Homo sapiens
ttacatctcagactg

SEQ ID NO: 243365 - DNA, 15 bp, Homo sapiens
cttacatctcagact

SEQ ID NO: 243366 - DNA, 15 bp, Homo sapiens
gcttacatctcagac

SEQ ID NO: 243367 - DNA, 15 bp, Homo sapiens
agcttacatctcaga

SEQ ID NO: 243368 - DNA, 15 bp, Homo sapiens
gagcttacatctcag

SEQ ID NO: 243369 - DNA, 15 bp, Homo sapiens
tgagcttacatctca

SEQ ID NO: 243370 - DNA, 15 bp, Homo sapiens
ctgagcttacatctc

SEQ ID NO: 243371 - DNA, 15 bp, Homo sapiens
cctgagcttacatct

SEQ ID NO: 243372 - DNA, 15 bp, Homo sapiens
ccctgagcttacatc

SEQ ID NO: 243373 - DNA, 15 bp, Homo sapiens
accctgagcttacat

SEQ ID NO: 243374 - DNA, 15 bp, Homo sapiens
taccctgagcttaca

SEQ ID NO: 243375 - DNA, 15 bp, Homo sapiens
ttaccctgagcttac

SEQ ID NO: 243376 - DNA, 15 bp, Homo sapiens
tttaccctgagctta

SEQ ID NO: 243377 - DNA, 15 bp, Homo sapiens
ttttaccctgagctt

SEQ ID NO: 243378 - DNA, 15 bp, Homo sapiens
tttttaccctgagct

SEQ ID NO: 243379 - DNA, 15 bp, Homo sapiens
ttttttaccctgagc

SEQ ID NO: 243380 - DNA, 15 bp, Homo sapiens
gttttttaccctgag

SEQ ID NO: 243381 - DNA, 15 bp, Homo sapiens
tgttttttaccctga

SEQ ID NO: 243382 - DNA, 15 bp, Homo sapiens
ctgttttttaccctg

SEQ ID NO: 243383 - DNA, 15 bp, Homo sapiens
cctgttttttaccct

SEQ ID NO: 243384 - DNA, 15 bp, Homo sapiens
acctgttttttaccc

SEQ ID NO: 243385 - DNA, 15 bp, Homo sapiens
aacctgttttttacc

SEQ ID NO: 243386 - DNA, 15 bp, Homo sapiens
aaacctgttttttac

SEQ ID NO: 243387 - DNA, 15 bp, Homo sapiens
caaacctgtttttta

SEQ ID NO: 243388 - DNA, 15 bp, Homo sapiens
gcaaacctgtttttt

SEQ ID NO: 243389 - DNA, 15 bp, Homo sapiens
tgcaaacctgttttt

SEQ ID NO: 243390 - DNA, 15 bp, Homo sapiens
atgcaaacctgtttt

SEQ ID NO: 243391 - DNA, 15 bp, Homo sapiens
tatgcaaacctgttt

SEQ ID NO: 243392 - DNA, 15 bp, Homo sapiens
ttatgcaaacctgtt

SEQ ID NO: 243393 - DNA, 15 bp, Homo sapiens
attatgcaaacctgt

SEQ ID NO: 243394 - DNA, 15 bp, Homo sapiens
tattatgcaaacctg

SEQ ID NO: 243395 - DNA, 15 bp, Homo sapiens
atattatgcaaacct

SEQ ID NO: 243396 - DNA, 15 bp, Homo sapiens
tatattatgcaaacc

SEQ ID NO: 243397 - DNA, 15 bp, Homo sapiens
atatattatgcaaac

SEQ ID NO: 243398 - DNA, 15 bp, Homo sapiens
tatatattatgcaaa

SEQ ID NO: 243399 - DNA, 15 bp, Homo sapiens
ttatatattatgcaa

SEQ ID NO: 243400 - DNA, 15 bp, Homo sapiens
attatatattatgca

SEQ ID NO: 243401 - DNA, 15 bp, Homo sapiens
tattatatattatgc

SEQ ID NO: 243402 - DNA, 15 bp, Homo sapiens
ttattatatattatg

SEQ ID NO: 243403 - DNA, 15 bp, Homo sapiens
tttattatatattat

SEQ ID NO: 243404 - DNA, 15 bp, Homo sapiens
atttattatatatta

SEQ ID NO: 243405 - DNA, 15 bp, Homo sapiens
tatttattatatatt

SEQ ID NO: 243406 - DNA, 15 bp, Homo sapiens
atatttattatatat

SEQ ID NO: 243407 - DNA, 15 bp, Homo sapiens
tatatttattatata

SEQ ID NO: 243408 - DNA, 15 bp, Homo sapiens
ttatatttattatat

SEQ ID NO: 243409 - DNA, 15 bp, Homo sapiens
attatatttattata

SEQ ID NO: 243410 - DNA, 15 bp, Homo sapiens
tattatatttattat

SEQ ID NO: 243411 - DNA, 15 bp, Homo sapiens
ttattatatttatta

SEQ ID NO: 243412 - DNA, 15 bp, Homo sapiens
cttattatatttatt

SEQ ID NO: 243413 - DNA, 15 bp, Homo sapiens
gcttattatatttat

SEQ ID NO: 243414 - DNA, 15 bp, Homo sapiens
tgcttattatattta

SEQ ID NO: 243415 - DNA, 15 bp, Homo sapiens
ttgcttattatattt

SEQ ID NO: 243416 - DNA, 15 bp, Homo sapiens
attgcttattatatt

SEQ ID NO: 243417 - DNA, 15 bp, Homo sapiens
tattgcttattatat

SEQ ID NO: 243418 - DNA, 15 bp, Homo sapiens
atattgcttattata

SEQ ID NO: 243419 - DNA, 15 bp, Homo sapiens
tatattgcttattat

SEQ ID NO: 243420 - DNA, 15 bp, Homo sapiens
gtatattgcttatta

SEQ ID NO: 243421 - DNA, 15 bp, Homo sapiens
cgtatattgcttatt

SEQ ID NO: 243422 - DNA, 15 bp, Homo sapiens
acgtatattgcttat

SEQ ID NO: 243423 - DNA, 15 bp, Homo sapiens
aacgtatattgctta

SEQ ID NO: 243424 - DNA, 15 bp, Homo sapiens
taacgtatattgctt

SEQ ID NO: 243425 - DNA, 15 bp, Homo sapiens
gtaacgtatattgct

SEQ ID NO: 243426 - DNA, 15 bp, Homo sapiens
tgtaacgtatattgc

SEQ ID NO: 243427 - DNA, 15 bp, Homo sapiens
atgtaacgtatattg

SEQ ID NO: 243428 - DNA, 15 bp, Homo sapiens
aatgtaacgtatatt

SEQ ID NO: 243429 - DNA, 15 bp, Homo sapiens
taatgtaacgtatat

SEQ ID NO: 243430 - DNA, 15 bp, Homo sapiens
ctaatgtaacgtata

SEQ ID NO: 243431 - DNA, 15 bp, Homo sapiens
gctaatgtaacgtat

SEQ ID NO: 243432 - DNA, 15 bp, Homo sapiens
agctaatgtaacgta

SEQ ID NO: 243433 - DNA, 15 bp, Homo sapiens
aagctaatgtaacgt

SEQ ID NO: 243434 - DNA, 15 bp, Homo sapiens
taagctaatgtaacg

SEQ ID NO: 243435 - DNA, 15 bp, Homo sapiens
ataagctaatgtaac

SEQ ID NO: 243436 - DNA, 15 bp, Homo sapiens
cataagctaatgtaa

SEQ ID NO: 243437 - DNA, 15 bp, Homo sapiens
ccataagctaatgta

SEQ ID NO: 243438 - DNA, 15 bp, Homo sapiens
cccataagctaatgt

SEQ ID NO: 243439 - DNA, 15 bp, Homo sapiens
tcccataagctaatg

SEQ ID NO: 243440 - DNA, 15 bp, Homo sapiens
ctcccataagctaat

SEQ ID NO: 243441 - DNA, 15 bp, Homo sapiens
actcccataagctaa

SEQ ID NO: 243442 - DNA, 15 bp, Homo sapiens
aactcccataagcta

SEQ ID NO: 243443 - DNA, 15 bp, Homo sapiens
aaactcccataagct

SEQ ID NO: 243444 - DNA, 15 bp, Homo sapiens
taaactcccataagc

SEQ ID NO: 243445 - DNA, 15 bp, Homo sapiens
ttaaactcccataag

SEQ ID NO: 243446 - DNA, 15 bp, Homo sapiens
attaaactcccataa

SEQ ID NO: 243447 - DNA, 15 bp, Homo sapiens
tattaaactcccata

SEQ ID NO: 243448 - DNA, 15 bp, Homo sapiens
atattaaactcccat

SEQ ID NO: 243449 - DNA, 15 bp, Homo sapiens
aatattaaactccca

SEQ ID NO: 243450 - DNA, 15 bp, Homo sapiens
aaatattaaactccc

SEQ ID NO: 243451 - DNA, 15 bp, Homo sapiens
aaaatattaaactcc

SEQ ID NO: 243452 - DNA, 15 bp, Homo sapiens
aaaaatattaaactc

SEQ ID NO: 243453 - DNA, 15 bp, Homo sapiens
taaaaatattaaact

SEQ ID NO: 243454 - DNA, 15 bp, Homo sapiens
ataaaaatattaaac

SEQ ID NO: 243455 - DNA, 15 bp, Homo sapiens
gataaaaatattaaa

SEQ ID NO: 243456 - DNA, 15 bp, Homo sapiens
tgataaaaatattaa

SEQ ID NO: 243457 - DNA, 15 bp, Homo sapiens
ctgataaaaatatta

SEQ ID NO: 243458 - DNA, 15 bp, Homo sapiens
actgataaaaatatt

SEQ ID NO: 243459 - DNA, 15 bp, Homo sapiens
cactgataaaaatat

SEQ ID NO: 243460 - DNA, 15 bp, Homo sapiens
acactgataaaaata

SEQ ID NO: 243461 - DNA, 15 bp, Homo sapiens
tacactgataaaaat

SEQ ID NO: 243462 - DNA, 15 bp, Homo sapiens
atacactgataaaaa

SEQ ID NO: 243463 - DNA, 15 bp, Homo sapiens
tatacactgataaaa

SEQ ID NO: 243464 - DNA, 15 bp, Homo sapiens
ttatacactgataaa

SEQ ID NO: 243465 - DNA, 15 bp, Homo sapiens
gttatacactgataa

SEQ ID NO: 243466 - DNA, 15 bp, Homo sapiens
ggttatacactgata

SEQ ID NO: 243467 - DNA, 15 bp, Homo sapiens
aggttatacactgat

SEQ ID NO: 243468 - DNA, 15 bp, Homo sapiens
taggttatacactga

SEQ ID NO: 243469 - DNA, 15 bp, Homo sapiens
gtaggttatacactg

SEQ ID NO: 243470 - DNA, 15 bp, Homo sapiens
tgtaggttatacact

SEQ ID NO: 243471 - DNA, 15 bp, Homo sapiens
ttgtaggttatacac

SEQ ID NO: 243472 - DNA, 15 bp, Homo sapiens
attgtaggttataca

SEQ ID NO: 243473 - DNA, 15 bp, Homo sapiens
cattgtaggttatac

SEQ ID NO: 243474 - DNA, 15 bp, Homo sapiens
gcattgtaggttata

SEQ ID NO: 243475 - DNA, 15 bp, Homo sapiens
tgcattgtaggttat

SEQ ID NO: 243476 - DNA, 15 bp, Homo sapiens
gtgcattgtaggtta

SEQ ID NO: 243477 - DNA, 15 bp, Homo sapiens
agtgcattgtaggtt

SEQ ID NO: 243478 - DNA, 15 bp, Homo sapiens
cagtgcattgtaggt

SEQ ID NO: 243479 - DNA, 15 bp, Homo sapiens
tcagtgcattgtagg

SEQ ID NO: 243480 - DNA, 15 bp, Homo sapiens
ctcagtgcattgtag

SEQ ID NO: 243481 - DNA, 15 bp, Homo sapiens
actcagtgcattgta

SEQ ID NO: 243482 - DNA, 15 bp, Homo sapiens
aactcagtgcattgt

SEQ ID NO: 243483 - DNA, 15 bp, Homo sapiens
caactcagtgcattg

SEQ ID NO: 243484 - DNA, 15 bp, Homo sapiens
acaactcagtgcatt

SEQ ID NO: 243485 - DNA, 15 bp, Homo sapiens
cacaactcagtgcat

SEQ ID NO: 243486 - DNA, 15 bp, Homo sapiens
tcacaactcagtgca

SEQ ID NO: 243487 - DNA, 15 bp, Homo sapiens
ttcacaactcagtgc

SEQ ID NO: 243488 - DNA, 15 bp, Homo sapiens
gttcacaactcagtg

SEQ ID NO: 243489 - DNA, 15 bp, Homo sapiens
agttcacaactcagt

SEQ ID NO: 243490 - DNA, 15 bp, Homo sapiens
cagttcacaactcag

SEQ ID NO: 243491 - DNA, 15 bp, Homo sapiens
tcagttcacaactca

SEQ ID NO: 243492 - DNA, 15 bp, Homo sapiens
ctcagttcacaactc

SEQ ID NO: 243493 - DNA, 15 bp, Homo sapiens
actcagttcacaact

SEQ ID NO: 243494 - DNA, 15 bp, Homo sapiens
aactcagttcacaac

SEQ ID NO: 243495 - DNA, 15 bp, Homo sapiens
caactcagttcacaa

SEQ ID NO: 243496 - DNA, 15 bp, Homo sapiens
tcaactcagttcaca

SEQ ID NO: 243497 - DNA, 15 bp, Homo sapiens
ctcaactcagttcac

SEQ ID NO: 243498 - DNA, 15 bp, Homo sapiens
tctcaactcagttca

SEQ ID NO: 243499 - DNA, 15 bp, Homo sapiens
ttctcaactcagttc

SEQ ID NO: 243500 - DNA, 15 bp, Homo sapiens
gttctcaactcagtt

SEQ ID NO: 243501 - DNA, 15 bp, Homo sapiens
tgttctcaactcagt

SEQ ID NO: 243502 - DNA, 15 bp, Homo sapiens
ttgttctcaactcag

SEQ ID NO: 243503 - DNA, 15 bp, Homo sapiens
cttgttctcaactca

SEQ ID NO: 243504 - DNA, 15 bp, Homo sapiens
ccttgttctcaactc

SEQ ID NO: 243505 - DNA, 15 bp, Homo sapiens
accttgttctcaact

SEQ ID NO: 243506 - DNA, 15 bp, Homo sapiens
taccttgttctcaac

SEQ ID NO: 243507 - DNA, 15 bp, Homo sapiens
ataccttgttctcaa

SEQ ID NO: 243508 - DNA, 15 bp, Homo sapiens
aataccttgttctca

SEQ ID NO: 243509 - DNA, 15 bp, Homo sapiens
taataccttgttctc

SEQ ID NO: 243510 - DNA, 15 bp, Homo sapiens
ttaataccttgttct

SEQ ID NO: 243511 - DNA, 15 bp, Homo sapiens
tttaataccttgttc

SEQ ID NO: 243512 - DNA, 15 bp, Homo sapiens
ctttaataccttgtt

SEQ ID NO: 243513 - DNA, 15 bp, Homo sapiens
gctttaataccttgt

SEQ ID NO: 243514 - DNA, 15 bp, Homo sapiens
tgctttaataccttg

SEQ ID NO: 243515 - DNA, 15 bp, Homo sapiens
ttgctttaatacctt

SEQ ID NO: 243516 - DNA, 15 bp, Homo sapiens
attgctttaatacct

SEQ ID NO: 243517 - DNA, 15 bp, Homo sapiens
aattgctttaatacc

SEQ ID NO: 243518 - DNA, 15 bp, Homo sapiens
caattgctttaatac

SEQ ID NO: 243519 - DNA, 15 bp, Homo sapiens
tcaattgctttaata

SEQ ID NO: 243520 - DNA, 15 bp, Homo sapiens
atcaattgctttaat

SEQ ID NO: 243521 - DNA, 15 bp, Homo sapiens
aatcaattgctttaa

SEQ ID NO: 243522 - DNA, 15 bp, Homo sapiens
caatcaattgcttta

SEQ ID NO: 243523 - DNA, 15 bp, Homo sapiens
ccaatcaattgcttt

SEQ ID NO: 243524 - DNA, 15 bp, Homo sapiens
accaatcaattgctt

SEQ ID NO: 243525 - DNA, 15 bp, Homo sapiens
caccaatcaattgct

SEQ ID NO: 243526 - DNA, 15 bp, Homo sapiens
acaccaatcaattgc

SEQ ID NO: 243527 - DNA, 15 bp, Homo sapiens
gacaccaatcaattg

SEQ ID NO: 243528 - DNA, 15 bp, Homo sapiens
tgacaccaatcaatt

SEQ ID NO: 243529 - DNA, 15 bp, Homo sapiens
ttgacaccaatcaat

SEQ ID NO: 243530 - DNA, 15 bp, Homo sapiens
tttgacaccaatcaa

SEQ ID NO: 243531 - DNA, 15 bp, Homo sapiens
atttgacaccaatca

SEQ ID NO: 243532 - DNA, 15 bp, Homo sapiens
aatttgacaccaatc

SEQ ID NO: 243533 - DNA, 15 bp, Homo sapiens
aaatttgacaccaat

SEQ ID NO: 243534 - DNA, 15 bp, Homo sapiens
caaatttgacaccaa

SEQ ID NO: 243535 - DNA, 15 bp, Homo sapiens
gcaaatttgacacca

SEQ ID NO: 243536 - DNA, 15 bp, Homo sapiens
ggcaaatttgacacc

SEQ ID NO: 243537 - DNA, 15 bp, Homo sapiens
gggcaaatttgacac

SEQ ID NO: 243538 - DNA, 15 bp, Homo sapiens
tgggcaaatttgaca

SEQ ID NO: 243539 - DNA, 15 bp, Homo sapiens
ttgggcaaatttgac

SEQ ID NO: 243540 - DNA, 15 bp, Homo sapiens
cttgggcaaatttga

SEQ ID NO: 243541 - DNA, 15 bp, Homo sapiens
acttgggcaaatttg

SEQ ID NO: 243542 - DNA, 15 bp, Homo sapiens
tacttgggcaaattt

SEQ ID NO: 243543 - DNA, 15 bp, Homo sapiens
ttacttgggcaaatt

SEQ ID NO: 243544 - DNA, 15 bp, Homo sapiens
cttacttgggcaaat

SEQ ID NO: 243545 - DNA, 15 bp, Homo sapiens
tcttacttgggcaaa

SEQ ID NO: 243546 - DNA, 15 bp, Homo sapiens
ttcttacttgggcaa

SEQ ID NO: 243547 - DNA, 15 bp, Homo sapiens
attcttacttgggca

SEQ ID NO: 243548 - DNA, 15 bp, Homo sapiens
cattcttacttgggc

SEQ ID NO: 243549 - DNA, 15 bp, Homo sapiens
ccattcttacttggg

SEQ ID NO: 243550 - DNA, 15 bp, Homo sapiens
tccattcttacttgg

SEQ ID NO: 243551 - DNA, 15 bp, Homo sapiens
ttccattcttacttg

SEQ ID NO: 243552 - DNA, 15 bp, Homo sapiens
tttccattcttactt

SEQ ID NO: 243553 - DNA, 15 bp, Homo sapiens
ctttccattcttact

SEQ ID NO: 243554 - DNA, 15 bp, Homo sapiens
tctttccattcttac

SEQ ID NO: 243555 - DNA, 15 bp, Homo sapiens
ctctttccattctta

SEQ ID NO: 243556 - DNA, 15 bp, Homo sapiens
cctctttccattctt

SEQ ID NO: 243557 - DNA, 15 bp, Homo sapiens
acctctttccattct

SEQ ID NO: 243558 - DNA, 15 bp, Homo sapiens
gacctctttccattc

SEQ ID NO: 243559 - DNA, 15 bp, Homo sapiens
tgacctctttccatt

SEQ ID NO: 243560 - DNA, 15 bp, Homo sapiens
ctgacctctttccat

SEQ ID NO: 243561 - DNA, 15 bp, Homo sapiens
tctgacctctttcca

SEQ ID NO: 243562 - DNA, 15 bp, Homo sapiens
gtctgacctctttcc

SEQ ID NO: 243563 - DNA, 15 bp, Homo sapiens
cgtctgacctctttc

SEQ ID NO: 243564 - DNA, 15 bp, Homo sapiens
gcgtctgacctcttt

SEQ ID NO: 243565 - DNA, 15 bp, Homo sapiens
agcgtctgacctctt

SEQ ID NO: 243566 - DNA, 15 bp, Homo sapiens
cagcgtctgacctct

SEQ ID NO: 243567 - DNA, 15 bp, Homo sapiens
ccagcgtctgacctc

SEQ ID NO: 243568 - DNA, 15 bp, Homo sapiens
accagcgtctgacct

SEQ ID NO: 243569 - DNA, 15 bp, Homo sapiens
aaccagcgtctgacc

SEQ ID NO: 243570 - DNA, 15 bp, Homo sapiens
taaccagcgtctgac

SEQ ID NO: 243571 - DNA, 15 bp, Homo sapiens
ttaaccagcgtctga

SEQ ID NO: 243572 - DNA, 15 bp, Homo sapiens
cttaaccagcgtctg

SEQ ID NO: 243573 - DNA, 15 bp, Homo sapiens
acttaaccagcgtct

SEQ ID NO: 243574 - DNA, 15 bp, Homo sapiens
aacttaaccagcgtc

SEQ ID NO: 243575 - DNA, 15 bp, Homo sapiens
caacttaaccagcgt

SEQ ID NO: 243576 - DNA, 15 bp, Homo sapiens
ccaacttaaccagcg

SEQ ID NO: 243577 - DNA, 15 bp, Homo sapiens
gccaacttaaccagc

SEQ ID NO: 243578 - DNA, 15 bp, Homo sapiens
tgccaacttaaccag

SEQ ID NO: 243579 - DNA, 15 bp, Homo sapiens
atgccaacttaacca

SEQ ID NO: 243580 - DNA, 15 bp, Homo sapiens
catgccaacttaacc

SEQ ID NO: 243581 - DNA, 15 bp, Homo sapiens
acatgccaacttaac

SEQ ID NO: 243582 - DNA, 15 bp, Homo sapiens
gacatgccaacttaa

SEQ ID NO: 243583 - DNA, 15 bp, Homo sapiens
agacatgccaactta

SEQ ID NO: 243584 - DNA, 15 bp, Homo sapiens
gagacatgccaactt

SEQ ID NO: 243585 - DNA, 15 bp, Homo sapiens
agagacatgccaact

SEQ ID NO: 243586 - DNA, 15 bp, Homo sapiens
tagagacatgccaac

SEQ ID NO: 243587 - DNA, 15 bp, Homo sapiens
ctagagacatgccaa

SEQ ID NO: 243588 - DNA, 15 bp, Homo sapiens
actagagacatgcca

SEQ ID NO: 243589 - DNA, 15 bp, Homo sapiens
cactagagacatgcc

SEQ ID NO: 243590 - DNA, 15 bp, Homo sapiens
tcactagagacatgc

SEQ ID NO: 243591 - DNA, 15 bp, Homo sapiens
ttcactagagacatg

SEQ ID NO: 243592 - DNA, 15 bp, Homo sapiens
tttcactagagacat

SEQ ID NO: 243593 - DNA, 15 bp, Homo sapiens
ctttcactagagaca

SEQ ID NO: 243594 - DNA, 15 bp, Homo sapiens
tctttcactagagac

SEQ ID NO: 243595 - DNA, 15 bp, Homo sapiens
ttctttcactagaga

SEQ ID NO: 243596 - DNA, 15 bp, Homo sapiens
cttctttcactagag

SEQ ID NO: 243597 - DNA, 15 bp, Homo sapiens
tcttctttcactaga

SEQ ID NO: 243598 - DNA, 15 bp, Homo sapiens
atcttctttcactag

SEQ ID NO: 243599 - DNA, 15 bp, Homo sapiens
catcttctttcacta

SEQ ID NO: 243600 - DNA, 15 bp, Homo sapiens
acatcttctttcact

SEQ ID NO: 243601 - DNA, 15 bp, Homo sapiens
cacatcttctttcac

SEQ ID NO: 243602 - DNA, 15 bp, Homo sapiens
tcacatcttctttca

SEQ ID NO: 243603 - DNA, 15 bp, Homo sapiens
atcacatcttctttc

SEQ ID NO: 243604 - DNA, 15 bp, Homo sapiens
aatcacatcttcttt

SEQ ID NO: 243605 - DNA, 15 bp, Homo sapiens
taatcacatcttctt

SEQ ID NO: 243606 - DNA, 15 bp, Homo sapiens
ataatcacatcttct

SEQ ID NO: 243607 - DNA, 15 bp, Homo sapiens
gataatcacatcttc

SEQ ID NO: 243608 - DNA, 15 bp, Homo sapiens
agataatcacatctt

SEQ ID NO: 243609 - DNA, 15 bp, Homo sapiens
tagataatcacatct

SEQ ID NO: 243610 - DNA, 15 bp, Homo sapiens
ttagataatcacatc

SEQ ID NO: 243611 - DNA, 15 bp, Homo sapiens
gttagataatcacat

SEQ ID NO: 243612 - DNA, 15 bp, Homo sapiens
agttagataatcaca

SEQ ID NO: 243613 - DNA, 15 bp, Homo sapiens
cagttagataatcac

SEQ ID NO: 243614 - DNA, 15 bp, Homo sapiens
tcagttagataatca

SEQ ID NO: 243615 - DNA, 15 bp, Homo sapiens
ttcagttagataatc

SEQ ID NO: 243616 - DNA, 15 bp, Homo sapiens
tttcagttagataat

SEQ ID NO: 243617 - DNA, 15 bp, Homo sapiens
ttttcagttagataa

SEQ ID NO: 243618 - DNA, 15 bp, Homo sapiens
attttcagttagata

SEQ ID NO: 243619 - DNA, 15 bp, Homo sapiens
cattttcagttagat

SEQ ID NO: 243620 - DNA, 15 bp, Homo sapiens
acattttcagttaga

SEQ ID NO: 243621 - DNA, 15 bp, Homo sapiens
aacattttcagttag

SEQ ID NO: 243622 - DNA, 15 bp, Homo sapiens
aaacattttcagtta

SEQ ID NO: 243623 - DNA, 15 bp, Homo sapiens
taaacattttcagtt

SEQ ID NO: 243624 - DNA, 15 bp, Homo sapiens
ttaaacattttcagt

SEQ ID NO: 243625 - DNA, 15 bp, Homo sapiens
tttaaacattttcag

SEQ ID NO: 243626 - DNA, 15 bp, Homo sapiens
ttttaaacattttca

SEQ ID NO: 243627 - DNA, 15 bp, Homo sapiens
gttttaaacattttc

SEQ ID NO: 243628 - DNA, 15 bp, Homo sapiens
agttttaaacatttt

SEQ ID NO: 243629 - DNA, 15 bp, Homo sapiens
cagttttaaacattt

SEQ ID NO: 243630 - DNA, 15 bp, Homo sapiens
acagttttaaacatt

SEQ ID NO: 243631 - DNA, 15 bp, Homo sapiens
aacagttttaaacat

SEQ ID NO: 243632 - DNA, 15 bp, Homo sapiens
aaacagttttaaaca

SEQ ID NO: 243633 - DNA, 15 bp, Homo sapiens
taaacagttttaaac

SEQ ID NO: 243634 - DNA, 15 bp, Homo sapiens
gtaaacagttttaaa

SEQ ID NO: 243635 - DNA, 15 bp, Homo sapiens
tgtaaacagttttaa

SEQ ID NO: 243636 - DNA, 15 bp, Homo sapiens
atgtaaacagtttta

SEQ ID NO: 243637 - DNA, 15 bp, Homo sapiens
aatgtaaacagtttt

SEQ ID NO: 243638 - DNA, 15 bp, Homo sapiens
aaatgtaaacagttt

SEQ ID NO: 243639 - DNA, 15 bp, Homo sapiens
aaaatgtaaacagtt

SEQ ID NO: 243640 - DNA, 15 bp, Homo sapiens
aaaaatgtaaacagt

SEQ ID NO: 243641 - DNA, 15 bp, Homo sapiens
taaaaatgtaaacag

SEQ ID NO: 243642 - DNA, 15 bp, Homo sapiens
ataaaaatgtaaaca

SEQ ID NO: 243643 - DNA, 15 bp, Homo sapiens
aataaaaatgtaaac

SEQ ID NO: 243644 - DNA, 15 bp, Homo sapiens
caataaaaatgtaaa

SEQ ID NO: 243645 - DNA, 15 bp, Homo sapiens
acaataaaaatgtaa

SEQ ID NO: 243646 - DNA, 15 bp, Homo sapiens
tacaataaaaatgta

SEQ ID NO: 243647 - DNA, 15 bp, Homo sapiens
gtacaataaaaatgt

SEQ ID NO: 243648 - DNA, 15 bp, Homo sapiens
tgtacaataaaaatg

SEQ ID NO: 243649 - DNA, 15 bp, Homo sapiens
gtgtacaataaaaat

SEQ ID NO: 243650 - DNA, 15 bp, Homo sapiens
agtgtacaataaaaa

SEQ ID NO: 243651 - DNA, 15 bp, Homo sapiens
tagtgtacaataaaa

SEQ ID NO: 243652 - DNA, 15 bp, Homo sapiens
atagtgtacaataaa

SEQ ID NO: 243653 - DNA, 15 bp, Homo sapiens
tatagtgtacaataa

SEQ ID NO: 243654 - DNA, 15 bp, Homo sapiens
ttatagtgtacaata

SEQ ID NO: 243655 - DNA, 15 bp, Homo sapiens
gttatagtgtacaat

SEQ ID NO: 243656 - DNA, 15 bp, Homo sapiens
tgttatagtgtacaa

SEQ ID NO: 243657 - DNA, 15 bp, Homo sapiens
ttgttatagtgtaca

SEQ ID NO: 243658 - DNA, 15 bp, Homo sapiens
attgttatagtgtac

SEQ ID NO: 243659 - DNA, 15 bp, Homo sapiens
tattgttatagtgta

SEQ ID NO: 243660 - DNA, 15 bp, Homo sapiens
ttattgttatagtgt

SEQ ID NO: 243661 - DNA, 15 bp, Homo sapiens
attattgttatagtg

SEQ ID NO: 243662 - DNA, 15 bp, Homo sapiens
tattattgttatagt

SEQ ID NO: 243663 - DNA, 15 bp, Homo sapiens
ttattattgttatag

SEQ ID NO: 243664 - DNA, 15 bp, Homo sapiens
attattattgttata

SEQ ID NO: 243665 - DNA, 15 bp, Homo sapiens
tattattattgttat

SEQ ID NO: 243666 - DNA, 15 bp, Homo sapiens
ctattattattgtta

SEQ ID NO: 243667 - DNA, 15 bp, Homo sapiens
actattattattgtt

SEQ ID NO: 243668 - DNA, 15 bp, Homo sapiens
tactattattattgt

SEQ ID NO: 243669 - DNA, 15 bp, Homo sapiens
ttactattattattg

SEQ ID NO: 243670 - DNA, 15 bp, Homo sapiens
attactattattatt

SEQ ID NO: 243671 - DNA, 15 bp, Homo sapiens
tattactattattat

SEQ ID NO: 243672 - DNA, 15 bp, Homo sapiens
ctattactattatta

SEQ ID NO: 243673 - DNA, 15 bp, Homo sapiens
atactattactatta

SEQ ID NO: 243674 - DNA, 15 bp, Homo sapiens
aatactattactatt

SEQ ID NO: 243675 - DNA, 15 bp, Homo sapiens
taatactattactat

SEQ ID NO: 243676 - DNA, 15 bp, Homo sapiens
ctaatactattacta

SEQ ID NO: 243677 - DNA, 15 bp, Homo sapiens
tctaatactattact

SEQ ID NO: 243678 - DNA, 15 bp, Homo sapiens
ctctaatactattac

SEQ ID NO: 243679 - DNA, 15 bp, Homo sapiens
tctctaatactatta

SEQ ID NO: 243680 - DNA, 15 bp, Homo sapiens
ttctctaatactatt

SEQ ID NO: 243681 - DNA, 15 bp, Homo sapiens
gttctctaatactat

SEQ ID NO: 243682 - DNA, 15 bp, Homo sapiens
agttctctaatacta

SEQ ID NO: 243683 - DNA, 15 bp, Homo sapiens
aagttctctaatact

SEQ ID NO: 243684 - DNA, 15 bp, Homo sapiens
aaagttctctaatac

SEQ ID NO: 243685 - DNA, 15 bp, Homo sapiens
taaagttctctaata

SEQ ID NO: 243686 - DNA, 15 bp, Homo sapiens
ttaaagttctctaat

SEQ ID NO: 243687 - DNA, 15 bp, Homo sapiens
attaaagttctctaa

SEQ ID NO: 243688 - DNA, 15 bp, Homo sapiens
aattaaagttctcta

SEQ ID NO: 243689 - DNA, 15 bp, Homo sapiens
aaattaaagttctct

SEQ ID NO: 243690 - DNA, 15 bp, Homo sapiens
caaattaaagttctc

SEQ ID NO: 243691 - DNA, 15 bp, Homo sapiens
gcaaattaaagttct

SEQ ID NO: 243692 - DNA, 15 bp, Homo sapiens
agcaaattaaagttc

SEQ ID NO: 243693 - DNA, 15 bp, Homo sapiens
aagcaaattaaagtt

SEQ ID NO: 243694 - DNA, 15 bp, Homo sapiens
caagcaaattaaagt

SEQ ID NO: 243695 - DNA, 15 bp, Homo sapiens
ccaagcaaattaaag

SEQ ID NO: 243696 - DNA, 15 bp, Homo sapiens
accaagcaaattaaa

SEQ ID NO: 243697 - DNA, 15 bp, Homo sapiens
aaccaagcaaattaa

SEQ ID NO: 243698 - DNA, 15 bp, Homo sapiens
caaccaagcaaatta

SEQ ID NO: 243699 - DNA, 15 bp, Homo sapiens
tcaaccaagcaaatt

SEQ ID NO: 243700 - DNA, 15 bp, Homo sapiens
ttcaaccaagcaaat

SEQ ID NO: 243701 - DNA, 15 bp, Homo sapiens
attcaaccaagcaaa

SEQ ID NO: 243702 - DNA, 15 bp, Homo sapiens
tattcaaccaagcaa

SEQ ID NO: 243703 - DNA, 15 bp, Homo sapiens
atattcaaccaagca

SEQ ID NO: 243704 - DNA, 15 bp, Homo sapiens
aatattcaaccaagc

SEQ ID NO: 243705 - DNA, 15 bp, Homo sapiens
caatattcaaccaag

SEQ ID NO: 243706 - DNA, 15 bp, Homo sapiens
tcaatattcaaccaa

SEQ ID NO: 243707 - DNA, 15 bp, Homo sapiens
gtcaatattcaacca

SEQ ID NO: 243708 - DNA, 15 bp, Homo sapiens
agtcaatattcaacc

SEQ ID NO: 243709 - DNA, 15 bp, Homo sapiens
aagtcaatattcaac

SEQ ID NO: 243710 - DNA, 15 bp, Homo sapiens
caagtcaatattcaa

SEQ ID NO: 243711 - DNA, 15 bp, Homo sapiens
tcaagtcaatattca

SEQ ID NO: 243712 - DNA, 15 bp, Homo sapiens
ttcaagtcaatattc

SEQ ID NO: 243713 - DNA, 15 bp, Homo sapiens
attcaagtcaatatt

SEQ ID NO: 243714 - DNA, 15 bp, Homo sapiens
aattcaagtcaatat

SEQ ID NO: 243715 - DNA, 15 bp, Homo sapiens
aaattcaagtcaata

SEQ ID NO: 243716 - DNA, 15 bp, Homo sapiens
taaattcaagtcaat

SEQ ID NO: 243717 - DNA, 15 bp, Homo sapiens
ttaaattcaagtcaa

SEQ ID NO: 243718 - DNA, 15 bp, Homo sapiens
attaaattcaagtca

SEQ ID NO: 243719 - DNA, 15 bp, Homo sapiens
gattaaattcaagtc

SEQ ID NO: 243720 - DNA, 15 bp, Homo sapiens
agattaaattcaagt

SEQ ID NO: 243721 - DNA, 15 bp, Homo sapiens
aagattaaattcaag

SEQ ID NO: 243722 - DNA, 15 bp, Homo sapiens
taagattaaattcaa

SEQ ID NO: 243723 - DNA, 15 bp, Homo sapiens
gtaagattaaattca

SEQ ID NO: 243724 - DNA, 15 bp, Homo sapiens
tgtaagattaaattc

SEQ ID NO: 243725 - DNA, 15 bp, Homo sapiens
ttgtaagattaaatt

SEQ ID NO: 243726 - DNA, 15 bp, Homo sapiens
tttgtaagattaaat

SEQ ID NO: 243727 - DNA, 15 bp, Homo sapiens
atttgtaagattaaa

SEQ ID NO: 243728 - DNA, 15 bp, Homo sapiens
aatttgtaagattaa

SEQ ID NO: 243729 - DNA, 15 bp, Homo sapiens
aaatttgtaagatta

SEQ ID NO: 243730 - DNA, 15 bp, Homo sapiens
taaatttgtaagatt

SEQ ID NO: 243731 - DNA, 15 bp, Homo sapiens
ctaaatttgtaagat

SEQ ID NO: 243732 - DNA, 15 bp, Homo sapiens
tctaaatttgtaaga

SEQ ID NO: 243733 - DNA, 15 bp, Homo sapiens
atctaaatttgtaag

SEQ ID NO: 243734 - DNA, 15 bp, Homo sapiens
tatctaaatttgtaa

SEQ ID NO: 243735 - DNA, 15 bp, Homo sapiens
atatctaaatttgta

SEQ ID NO: 243736 - DNA, 15 bp, Homo sapiens
tatatctaaatttgt

SEQ ID NO: 243737 - DNA, 15 bp, Homo sapiens
ttatatctaaatttg

SEQ ID NO: 243738 - DNA, 15 bp, Homo sapiens
tttatatctaaattt

SEQ ID NO: 243739 - DNA, 15 bp, Homo sapiens
atttatatctaaatt

SEQ ID NO: 243740 - DNA, 15 bp, Homo sapiens
gatttatatctaaat

SEQ ID NO: 243741 - DNA, 15 bp, Homo sapiens
agatttatatctaaa

SEQ ID NO: 243742 - DNA, 15 bp, Homo sapiens
cagatttatatctaa

SEQ ID NO: 243743 - DNA, 15 bp, Homo sapiens
tcagatttatatcta

SEQ ID NO: 243744 - DNA, 15 bp, Homo sapiens
atcagatttatatct

SEQ ID NO: 243745 - DNA, 15 bp, Homo sapiens
catcagatttatatc

SEQ ID NO: 243746 - DNA, 15 bp, Homo sapiens
acatcagatttatat

SEQ ID NO: 243747 - DNA, 15 bp, Homo sapiens
tacatcagatttata

SEQ ID NO: 243748 - DNA, 15 bp, Homo sapiens
gtacatcagatttat

SEQ ID NO: 243749 - DNA, 15 bp, Homo sapiens
agtacatcagattta

SEQ ID NO: 243750 - DNA, 15 bp, Homo sapiens
cagtacatcagattt

SEQ ID NO: 243751 - DNA, 15 bp, Homo sapiens
acagtacatcagatt

SEQ ID NO: 243752 - DNA, 15 bp, Homo sapiens
cacagtacatcagat

SEQ ID NO: 243753 - DNA, 15 bp, Homo sapiens
ccacagtacatcaga

SEQ ID NO: 243754 - DNA, 15 bp, Homo sapiens
accacagtacatcag

SEQ ID NO: 243755 - DNA, 15 bp, Homo sapiens
taccacagtacatca

SEQ ID NO: 243756 - DNA, 15 bp, Homo sapiens
ctaccacagtacatc

SEQ ID NO: 243757 - DNA, 15 bp, Homo sapiens
cctaccacagtacat

SEQ ID NO: 243758 - DNA, 15 bp, Homo sapiens
gcctaccacagtaca

SEQ ID NO: 243759 - DNA, 15 bp, Homo sapiens
tgcctaccacagtac

SEQ ID NO: 243760 - DNA, 15 bp, Homo sapiens
ttgcctaccacagta

SEQ ID NO: 243761 - DNA, 15 bp, Homo sapiens
tttgcctaccacagt

SEQ ID NO: 243762 - DNA, 15 bp, Homo sapiens
ttttgcctaccacag

SEQ ID NO: 243763 - DNA, 15 bp, Homo sapiens
attttgcctaccaca

SEQ ID NO: 243764 - DNA, 15 bp, Homo sapiens
tattttgcctaccac

SEQ ID NO: 243765 - DNA, 15 bp, Homo sapiens
ttattttgcctacca

SEQ ID NO: 243766 - DNA, 15 bp, Homo sapiens
attattttgcctacc

SEQ ID NO: 243767 - DNA, 15 bp, Homo sapiens
tattattttgcctac

SEQ ID NO: 243768 - DNA, 15 bp, Homo sapiens
ttattattttgccta

SEQ ID NO: 243769 - DNA, 15 bp, Homo sapiens
gttattattttgcct

SEQ ID NO: 243770 - DNA, 15 bp, Homo sapiens
agttattattttgcc

SEQ ID NO: 243771 - DNA, 15 bp, Homo sapiens
cagttattattttgc

SEQ ID NO: 243772 - DNA, 15 bp, Homo sapiens
gcagttattattttg

SEQ ID NO: 243773 - DNA, 15 bp, Homo sapiens
agcagttattatttt

SEQ ID NO: 243774 - DNA, 15 bp, Homo sapiens
gagcagttattattt

SEQ ID NO: 243775 - DNA, 15 bp, Homo sapiens
ggagcagttattatt

SEQ ID NO: 243776 - DNA, 15 bp, Homo sapiens
gggagcagttattat

SEQ ID NO: 243777 - DNA, 15 bp, Homo sapiens
tgggagcagttatta

SEQ ID NO: 243778 - DNA, 15 bp, Homo sapiens
ttgggagcagttatt

SEQ ID NO: 243779 - DNA, 15 bp, Homo sapiens
gttgggagcagttat

SEQ ID NO: 243780 - DNA, 15 bp, Homo sapiens
ggttgggagcagtta

SEQ ID NO: 243781 - DNA, 15 bp, Homo sapiens
gggttgggagcagtt

SEQ ID NO: 243782 - DNA, 15 bp, Homo sapiens
ggggttgggagcagt

SEQ ID NO: 243783 - DNA, 15 bp, Homo sapiens
aggggttgggagcag

SEQ ID NO: 243784 - DNA, 15 bp, Homo sapiens
caggggttgggagca

SEQ ID NO: 243785 - DNA, 15 bp, Homo sapiens
tcaggggttgggagc

SEQ ID NO: 243786 - DNA, 15 bp, Homo sapiens
ttcaggggttgggag

SEQ ID NO: 243787 - DNA, 15 bp, Homo sapiens
tttcaggggttggga

SEQ ID NO: 243788 - DNA, 15 bp, Homo sapiens
ctttcaggggttggg

SEQ ID NO: 243789 - DNA, 15 bp, Homo sapiens
tctttcaggggttgg

SEQ ID NO: 243790 - DNA, 15 bp, Homo sapiens
atctttcaggggttg

SEQ ID NO: 243791 - DNA, 15 bp, Homo sapiens
catctttcaggggtt

SEQ ID NO: 243792 - DNA, 15 bp, Homo sapiens
gcatctttcaggggt

SEQ ID NO: 243793 - DNA, 15 bp, Homo sapiens
agcatctttcagggg

SEQ ID NO: 243794 - DNA, 15 bp, Homo sapiens
gagcatctttcaggg

SEQ ID NO: 243795 - DNA, 15 bp, Homo sapiens
tgagcatctttcagg

SEQ ID NO: 243796 - DNA, 15 bp, Homo sapiens
gtgagcatctttcag

SEQ ID NO: 243797 - DNA, 15 bp, Homo sapiens
tgtgagcatctttca

SEQ ID NO: 243798 - DNA, 15 bp, Homo sapiens
atgtgagcatctttc

SEQ ID NO: 243799 - DNA, 15 bp, Homo sapiens
gatgtgagcatcttt

SEQ ID NO: 243800 - DNA, 15 bp, Homo sapiens
tgatgtgagcatctt

SEQ ID NO: 243801 - DNA, 15 bp, Homo sapiens
atgatgtgagcatct

SEQ ID NO: 243802 - DNA, 15 bp, Homo sapiens
tatgatgtgagcatc

SEQ ID NO: 243803 - DNA, 15 bp, Homo sapiens
ttatgatgtgagcat

SEQ ID NO: 243804 - DNA, 15 bp, Homo sapiens
attatgatgtgagca

SEQ ID NO: 243805 - DNA, 15 bp, Homo sapiens
gattatgatgtgagc

SEQ ID NO: 243806 - DNA, 15 bp, Homo sapiens
ggattatgatgtgag

SEQ ID NO: 243807 - DNA, 15 bp, Homo sapiens
gggattatgatgtga

SEQ ID NO: 243808 - DNA, 15 bp, Homo sapiens
agggattatgatgtg

SEQ ID NO: 243809 - DNA, 15 bp, Homo sapiens
cagggattatgatgt

SEQ ID NO: 243810 - DNA, 15 bp, Homo sapiens
ccagggattatgatg

SEQ ID NO: 243811 - DNA, 15 bp, Homo sapiens
tccagggattatgat

SEQ ID NO: 243812 - DNA, 15 bp, Homo sapiens
ttccagggattatga

SEQ ID NO: 243813 - DNA, 15 bp, Homo sapiens
gttccagggattatg

SEQ ID NO: 243814 - DNA, 15 bp, Homo sapiens
ggttccagggattat

SEQ ID NO: 243815 - DNA, 15 bp, Homo sapiens
aggttccagggatta

SEQ ID NO: 243816 - DNA, 15 bp, Homo sapiens
caggttccagggatt

SEQ ID NO: 243817 - DNA, 15 bp, Homo sapiens
acaggttccagggat

SEQ ID NO: 243818 - DNA, 15 bp, Homo sapiens
cacaggttccaggga

SEQ ID NO: 243819 - DNA, 15 bp, Homo sapiens
tcacaggttccaggg

SEQ ID NO: 243820 - DNA, 15 bp, Homo sapiens
ttcacaggttccagg

SEQ ID NO: 243821 - DNA, 15 bp, Homo sapiens
tttcacaggttccag

SEQ ID NO: 243822 - DNA, 15 bp, Homo sapiens
ttttcacaggttcca

SEQ ID NO: 243823 - DNA, 15 bp, Homo sapiens
attttcacaggttcc

SEQ ID NO: 243824 - DNA, 15 bp, Homo sapiens
cattttcacaggttc

SEQ ID NO: 243825 - DNA, 15 bp, Homo sapiens
acattttcacaggtt

SEQ ID NO: 243826 - DNA, 15 bp, Homo sapiens
aacattttcacaggt

SEQ ID NO: 243827 - DNA, 15 bp, Homo sapiens
taacattttcacagg

SEQ ID NO: 243828 - DNA, 15 bp, Homo sapiens
ctaacattttcacag

SEQ ID NO: 243829 - DNA, 15 bp, Homo sapiens
cctaacattttcaca

SEQ ID NO: 243830 - DNA, 15 bp, Homo sapiens
acctaacattttcac

SEQ ID NO: 243831 - DNA, 15 bp, Homo sapiens
aacctaacattttca

SEQ ID NO: 243832 - DNA, 15 bp, Homo sapiens
taacctaacattttc

SEQ ID NO: 243833 - DNA, 15 bp, Homo sapiens
gtaacctaacatttt

SEQ ID NO: 243834 - DNA, 15 bp, Homo sapiens
tgtaacctaacattt

SEQ ID NO: 243835 - DNA, 15 bp, Homo sapiens
ttgtaacctaacatt

SEQ ID NO: 243836 - DNA, 15 bp, Homo sapiens
tttgtaacctaacat

SEQ ID NO: 243837 - DNA, 15 bp, Homo sapiens
ctttgtaacctaaca

SEQ ID NO: 243838 - DNA, 15 bp, Homo sapiens
gctttgtaacctaac

SEQ ID NO: 243839 - DNA, 15 bp, Homo sapiens
tgctttgtaacctaa

SEQ ID NO: 243840 - DNA, 15 bp, Homo sapiens
ttgctttgtaaccta

SEQ ID NO: 243841 - DNA, 15 bp, Homo sapiens
cttgctttgtaacct

SEQ ID NO: 243842 - DNA, 15 bp, Homo sapiens
ccttgctttgtaacc

SEQ ID NO: 243843 - DNA, 15 bp, Homo sapiens
cccttgctttgtaac

SEQ ID NO: 243844 - DNA, 15 bp, Homo sapiens
tcccttgctttgtaa

SEQ ID NO: 243845 - DNA, 15 bp, Homo sapiens
ctcccttgctttgta

SEQ ID NO: 243846 - DNA, 15 bp, Homo sapiens
tctcccttgctttgt

SEQ ID NO: 243847 - DNA, 15 bp, Homo sapiens
ttctcccttgctttg

SEQ ID NO: 243848 - DNA, 15 bp, Homo sapiens
attctcccttgcttt

SEQ ID NO: 243849 - DNA, 15 bp, Homo sapiens
aattctcccttgctt

SEQ ID NO: 243850 - DNA, 15 bp, Homo sapiens
taattctcccttgct

SEQ ID NO: 243851 - DNA, 15 bp, Homo sapiens
ttaattctcccttgc

SEQ ID NO: 243852 - DNA, 15 bp, Homo sapiens
cttaattctcccttg

SEQ ID NO: 243853 - DNA, 15 bp, Homo sapiens
ccttaattctccctt

SEQ ID NO: 243854 - DNA, 15 bp, Homo sapiens
accttaattctccct

SEQ ID NO: 243855 - DNA, 15 bp, Homo sapiens
gaccttaattctccc

SEQ ID NO: 243856 - DNA, 15 bp, Homo sapiens
cgaccttaattctcc

SEQ ID NO: 243857 - DNA, 15 bp, Homo sapiens
acgaccttaattctc

SEQ ID NO: 243858 - DNA, 15 bp, Homo sapiens
tacgaccttaattct

SEQ ID NO: 243859 - DNA, 15 bp, Homo sapiens
ttacgaccttaattc

SEQ ID NO: 243860 - DNA, 15 bp, Homo sapiens
tttacgaccttaatt

SEQ ID NO: 243861 - DNA, 15 bp, Homo sapiens
atttacgaccttaat

SEQ ID NO: 243862 - DNA, 15 bp, Homo sapiens
catttacgaccttaa

SEQ ID NO: 243863 - DNA, 15 bp, Homo sapiens
ccatttacgacctta

SEQ ID NO: 243864 - DNA, 15 bp, Homo sapiens
tccatttacgacctt

SEQ ID NO: 243865 - DNA, 15 bp, Homo sapiens
ttccatttacgacct

SEQ ID NO: 243866 - DNA, 15 bp, Homo sapiens
attccatttacgacc

SEQ ID NO: 243867 - DNA, 15 bp, Homo sapiens
aattccatttacgac

SEQ ID NO: 243868 - DNA, 15 bp, Homo sapiens
taattccatttacga

SEQ ID NO: 243869 - DNA, 15 bp, Homo sapiens
ttaattccatttacg

SEQ ID NO: 243870 - DNA, 15 bp, Homo sapiens
cttaattccatttac

SEQ ID NO: 243871 - DNA, 15 bp, Homo sapiens
ccttaattccattta

SEQ ID NO: 243872 - DNA, 15 bp, Homo sapiens
accttaattccattt

SEQ ID NO: 243873 - DNA, 15 bp, Homo sapiens
aaccttaattccatt

SEQ ID NO: 243874 - DNA, 15 bp, Homo sapiens
caaccttaattccat

SEQ ID NO: 243875 - DNA, 15 bp, Homo sapiens
gcaaccttaattcca

SEQ ID NO: 243876 - DNA, 15 bp, Homo sapiens
tgcaaccttaattcc

SEQ ID NO: 243877 - DNA, 15 bp, Homo sapiens
ttgcaaccttaattc

SEQ ID NO: 243878 - DNA, 15 bp, Homo sapiens
tttgcaaccttaatt

SEQ ID NO: 243879 - DNA, 15 bp, Homo sapiens
atttgcaaccttaat

SEQ ID NO: 243880 - DNA, 15 bp, Homo sapiens
gatttgcaaccttaa

SEQ ID NO: 243881 - DNA, 15 bp, Homo sapiens
tgatttgcaacctta

SEQ ID NO: 243882 - DNA, 15 bp, Homo sapiens
ttgatttgcaacctt

SEQ ID NO: 243883 - DNA, 15 bp, Homo sapiens
gttgatttgcaacct

SEQ ID NO: 243884 - DNA, 15 bp, Homo sapiens
agttgatttgcaacc

SEQ ID NO: 243885 - DNA, 15 bp, Homo sapiens
cagttgatttgcaac

SEQ ID NO: 243886 - DNA, 15 bp, Homo sapiens
tcagttgatttgcaa

SEQ ID NO: 243887 - DNA, 15 bp, Homo sapiens
gtcagttgatttgca

SEQ ID NO: 243888 - DNA, 15 bp, Homo sapiens
ggtcagttgatttgc

SEQ ID NO: 243889 - DNA, 15 bp, Homo sapiens
aggtcagttgatttg

SEQ ID NO: 243890 - DNA, 15 bp, Homo sapiens
aaggtcagttgattt

SEQ ID NO: 243891 - DNA, 15 bp, Homo sapiens
aaaggtcagttgatt

SEQ ID NO: 243892 - DNA, 15 bp, Homo sapiens
taaaggtcagttgat

SEQ ID NO: 243893 - DNA, 15 bp, Homo sapiens
ttaaaggtcagttga

SEQ ID NO: 243894 - DNA, 15 bp, Homo sapiens
attaaaggtcagttg

SEQ ID NO: 243895 - DNA, 15 bp, Homo sapiens
aattaaaggtcagtt

SEQ ID NO: 243896 - DNA, 15 bp, Homo sapiens
taattaaaggtcagt

SEQ ID NO: 243897 - DNA, 15 bp, Homo sapiens
ctaattaaaggtcag

SEQ ID NO: 243898 - DNA, 15 bp, Homo sapiens
cctaattaaaggtca

SEQ ID NO: 243899 - DNA, 15 bp, Homo sapiens
ccctaattaaaggtc

SEQ ID NO: 243900 - DNA, 15 bp, Homo sapiens
tccctaattaaaggt

SEQ ID NO: 243901 - DNA, 15 bp, Homo sapiens
ctccctaattaaagg

SEQ ID NO: 243902 - DNA, 15 bp, Homo sapiens
tctccctaattaaag

SEQ ID NO: 243903 - DNA, 15 bp, Homo sapiens
atctccctaattaaa

SEQ ID NO: 243904 - DNA, 15 bp, Homo sapiens
aatctccctaattaa

SEQ ID NO: 243905 - DNA, 15 bp, Homo sapiens
taatctccctaatta

SEQ ID NO: 243906 - DNA, 15 bp, Homo sapiens
ataatctccctaatt

SEQ ID NO: 243907 - DNA, 15 bp, Homo sapiens
aataatctccctaat

SEQ ID NO: 243908 - DNA, 15 bp, Homo sapiens
gaataatctccctaa

SEQ ID NO: 243909 - DNA, 15 bp, Homo sapiens
agaataatctcccta

SEQ ID NO: 243910 - DNA, 15 bp, Homo sapiens
cagaataatctccct

SEQ ID NO: 243911 - DNA, 15 bp, Homo sapiens
ccagaataatctccc

SEQ ID NO: 243912 - DNA, 15 bp, Homo sapiens
tccagaataatctcc

SEQ ID NO: 243913 - DNA, 15 bp, Homo sapiens
atccagaataatctc

SEQ ID NO: 243914 - DNA, 15 bp, Homo sapiens
aatccagaataatct

SEQ ID NO: 243915 - DNA, 15 bp, Homo sapiens
taatccagaataatc

SEQ ID NO: 243916 - DNA, 15 bp, Homo sapiens
ataatccagaataat

SEQ ID NO: 243917 - DNA, 15 bp, Homo sapiens
gataatccagaataa

SEQ ID NO: 243918 - DNA, 15 bp, Homo sapiens
ggataatccagaata

SEQ ID NO: 243919 - DNA, 15 bp, Homo sapiens
aggataatccagaat

SEQ ID NO: 243920 - DNA, 15 bp, Homo sapiens
caggataatccagaa

SEQ ID NO: 243921 - DNA, 15 bp, Homo sapiens
tcaggataatccaga

SEQ ID NO: 243922 - DNA, 15 bp, Homo sapiens
atcaggataatccag

SEQ ID NO: 243923 - DNA, 15 bp, Homo sapiens
catcaggataatcca

SEQ ID NO: 243924 - DNA, 15 bp, Homo sapiens
ccatcaggataatcc

SEQ ID NO: 243925 - DNA, 15 bp, Homo sapiens
cccatcaggataatc

SEQ ID NO: 243926 - DNA, 15 bp, Homo sapiens
gcccatcaggataat

SEQ ID NO: 243927 - DNA, 15 bp, Homo sapiens
agcccatcaggataa

SEQ ID NO: 243928 - DNA, 15 bp, Homo sapiens
aagcccatcaggata

SEQ ID NO: 243929 - DNA, 15 bp, Homo sapiens
taagcccatcaggat

SEQ ID NO: 243930 - DNA, 15 bp, Homo sapiens
ttaagcccatcagga

SEQ ID NO: 243931 - DNA, 15 bp, Homo sapiens
attaagcccatcagg

SEQ ID NO: 243932 - DNA, 15 bp, Homo sapiens
cattaagcccatcag

SEQ ID NO: 243933 - DNA, 15 bp, Homo sapiens
acattaagcccatca

SEQ ID NO: 243934 - DNA, 15 bp, Homo sapiens
tacattaagcccatc

SEQ ID NO: 243935 - DNA, 15 bp, Homo sapiens
ttacattaagcccat

SEQ ID NO: 243936 - DNA, 15 bp, Homo sapiens
attacattaagccca

SEQ ID NO: 243937 - DNA, 15 bp, Homo sapiens
gattacattaagccc

SEQ ID NO: 243938 - DNA, 15 bp, Homo sapiens
ggattacattaagcc

SEQ ID NO: 243939 - DNA, 15 bp, Homo sapiens
gggattacattaagc

SEQ ID NO: 243940 - DNA, 15 bp, Homo sapiens
tgggattacattaag

SEQ ID NO: 243941 - DNA, 15 bp, Homo sapiens
ctgggattacattaa

SEQ ID NO: 243942 - DNA, 15 bp, Homo sapiens
cctgggattacatta

SEQ ID NO: 243943 - DNA, 15 bp, Homo sapiens
ccctgggattacatt

SEQ ID NO: 243944 - DNA, 15 bp, Homo sapiens
cccctgggattacat

SEQ ID NO: 243945 - DNA, 15 bp, Homo sapiens
gcccctgggattaca

SEQ ID NO: 243946 - DNA, 15 bp, Homo sapiens
ggcccctgggattac

SEQ ID NO: 243947 - DNA, 15 bp, Homo sapiens
aggcccctgggatta

SEQ ID NO: 243948 - DNA, 15 bp, Homo sapiens
aaggcccctgggatt

SEQ ID NO: 243949 - DNA, 15 bp, Homo sapiens
aaaggcccctgggat

SEQ ID NO: 243950 - DNA, 15 bp, Homo sapiens
taaaggcccctggga

SEQ ID NO: 243951 - DNA, 15 bp, Homo sapiens
ttaaaggcccctggg

SEQ ID NO: 243952 - DNA, 15 bp, Homo sapiens
tttaaaggcccctgg

SEQ ID NO: 243953 - DNA, 15 bp, Homo sapiens
ttttaaaggcccctg

SEQ ID NO: 243954 - DNA, 15 bp, Homo sapiens
cttttaaaggcccct

SEQ ID NO: 243955 - DNA, 15 bp, Homo sapiens
acttttaaaggcccc

SEQ ID NO: 243956 - DNA, 15 bp, Homo sapiens
cacttttaaaggccc

SEQ ID NO: 243957 - DNA, 15 bp, Homo sapiens
ccacttttaaaggcc

SEQ ID NO: 243958 - DNA, 15 bp, Homo sapiens
gccacttttaaaggc

SEQ ID NO: 243959 - DNA, 15 bp, Homo sapiens
tgccacttttaaagg

SEQ ID NO: 243960 - DNA, 15 bp, Homo sapiens
ctgccacttttaaag

SEQ ID NO: 243961 - DNA, 15 bp, Homo sapiens
ccctgccacttttaa

SEQ ID NO: 243962 - DNA, 15 bp, Homo sapiens
cccctgccactttta

SEQ ID NO: 243963 - DNA, 15 bp, Homo sapiens
tcccctgccactttt

SEQ ID NO: 243964 - DNA, 15 bp, Homo sapiens
ctcccctgccacttt

SEQ ID NO: 243965 - DNA, 15 bp, Homo sapiens
cctcccctgccactt

SEQ ID NO: 243966 - DNA, 15 bp, Homo sapiens
gcctcccctgccact

SEQ ID NO: 243967 - DNA, 15 bp, Homo sapiens
tgcctcccctgccac

SEQ ID NO: 243968 - DNA, 15 bp, Homo sapiens
ctgcctcccctgcca

SEQ ID NO: 243969 - DNA, 15 bp, Homo sapiens
tctgcctcccctgcc

SEQ ID NO: 243970 - DNA, 15 bp, Homo sapiens
ctctgcctcccctgc

SEQ ID NO: 243971 - DNA, 15 bp, Homo sapiens
tctctgcctcccctg

SEQ ID NO: 243972 - DNA, 15 bp, Homo sapiens
atctctgcctcccct

SEQ ID NO: 243973 - DNA, 15 bp, Homo sapiens
aatctctgcctcccc

SEQ ID NO: 243974 - DNA, 15 bp, Homo sapiens
aaatctctgcctccc

SEQ ID NO: 243975 - DNA, 15 bp, Homo sapiens
caaatctctgcctcc

SEQ ID NO: 243976 - DNA, 15 bp, Homo sapiens
tcaaatctctgcctc

SEQ ID NO: 243977 - DNA, 15 bp, Homo sapiens
ctcaaatctctgcct

SEQ ID NO: 243978 - DNA, 15 bp, Homo sapiens
tctcaaatctctgcc

SEQ ID NO: 243979 - DNA, 15 bp, Homo sapiens
ttctcaaatctctgc

SEQ ID NO: 243980 - DNA, 15 bp, Homo sapiens
attctcaaatctctg

SEQ ID NO: 243981 - DNA, 15 bp, Homo sapiens
cattctcaaatctct

SEQ ID NO: 243982 - DNA, 15 bp, Homo sapiens
gcattctcaaatctc

SEQ ID NO: 243983 - DNA, 15 bp, Homo sapiens
agcattctcaaatct

SEQ ID NO: 243984 - DNA, 15 bp, Homo sapiens
tagcattctcaaatc

SEQ ID NO: 243985 - DNA, 15 bp, Homo sapiens
ctagcattctcaaat

SEQ ID NO: 243986 - DNA, 15 bp, Homo sapiens
gctagcattctcaaa

SEQ ID NO: 243987 - DNA, 15 bp, Homo sapiens
agctagcattctcaa

SEQ ID NO: 243988 - DNA, 15 bp, Homo sapiens
tagctagcattctca

SEQ ID NO: 243989 - DNA, 15 bp, Homo sapiens
gtagctagcattctc

SEQ ID NO: 243990 - DNA, 15 bp, Homo sapiens
agtagctagcattct

SEQ ID NO: 243991 - DNA, 15 bp, Homo sapiens
tagtagctagcattc

SEQ ID NO: 243992 - DNA, 15 bp, Homo sapiens
ctagtagctagcatt

SEQ ID NO: 243993 - DNA, 15 bp, Homo sapiens
gctagtagctagcat

SEQ ID NO: 243994 - DNA, 15 bp, Homo sapiens
agctagtagctagca

SEQ ID NO: 243995 - DNA, 15 bp, Homo sapiens
aagctagtagctagc

SEQ ID NO: 243996 - DNA, 15 bp, Homo sapiens
caagctagtagctag

SEQ ID NO: 243997 - DNA, 15 bp, Homo sapiens
ccaagctagtagcta

SEQ ID NO: 243998 - DNA, 15 bp, Homo sapiens
tccaagctagtagct

SEQ ID NO: 243999 - DNA, 15 bp, Homo sapiens
ttccaagctagtagc

SEQ ID NO: 244000 - DNA, 15 bp, Homo sapiens
cttccaagctagtag

SEQ ID NO: 244001 - DNA, 15 bp, Homo sapiens
ccttccaagctagta

SEQ ID NO: 244002 - DNA, 15 bp, Homo sapiens
accttccaagctagt

SEQ ID NO: 244003 - DNA, 15 bp, Homo sapiens
taccttccaagctag

SEQ ID NO: 244004 - DNA, 15 bp, Homo sapiens
ttaccttccaagcta

SEQ ID NO: 244005 - DNA, 15 bp, Homo sapiens
tttaccttccaagct

SEQ ID NO: 244006 - DNA, 15 bp, Homo sapiens
ctttaccttccaagc

SEQ ID NO: 244007 - DNA, 15 bp, Homo sapiens
cctttaccttccaag

SEQ ID NO: 244008 - DNA, 15 bp, Homo sapiens
tcctttaccttccaa

SEQ ID NO: 244009 - DNA, 15 bp, Homo sapiens
ttcctttaccttcca

SEQ ID NO: 244010 - DNA, 15 bp, Homo sapiens
cttcctttaccttcc

SEQ ID NO: 244011 - DNA, 15 bp, Homo sapiens
gcttcctttaccttc

SEQ ID NO: 244012 - DNA, 15 bp, Homo sapiens
tgcttcctttacctt

SEQ ID NO: 244013 - DNA, 15 bp, Homo sapiens
ctgcttcctttacct

SEQ ID NO: 244014 - DNA, 15 bp, Homo sapiens
tctgcttcctttacc

SEQ ID NO: 244015 - DNA, 15 bp, Homo sapiens
gtctgcttcctttac

SEQ ID NO: 244016 - DNA, 15 bp, Homo sapiens
tgtctgcttccttta

SEQ ID NO: 244017 - DNA, 15 bp, Homo sapiens
atgtctgcttccttt

SEQ ID NO: 244018 - DNA, 15 bp, Homo sapiens
catgtctgcttcctt

SEQ ID NO: 244019 - DNA, 15 bp, Homo sapiens
tcatgtctgcttcct

SEQ ID NO: 244020 - DNA, 15 bp, Homo sapiens
atcatgtctgcttcc

SEQ ID NO: 244021 - DNA, 15 bp, Homo sapiens
gatcatgtctgcttc

SEQ ID NO: 244022 - DNA, 15 bp, Homo sapiens
ggatcatgtctgctt

SEQ ID NO: 244023 - DNA, 15 bp, Homo sapiens
aggatcatgtctgct

SEQ ID NO: 244024 - DNA, 15 bp, Homo sapiens
aaggatcatgtctgc

SEQ ID NO: 244025 - DNA, 15 bp, Homo sapiens
taaggatcatgtctg

SEQ ID NO: 244026 - DNA, 15 bp, Homo sapiens
ttaaggatcatgtct

SEQ ID NO: 244027 - DNA, 15 bp, Homo sapiens
tttaaggatcatgtc

SEQ ID NO: 244028 - DNA, 15 bp, Homo sapiens
atttaaggatcatgt

SEQ ID NO: 244029 - DNA, 15 bp, Homo sapiens
catttaaggatcatg

SEQ ID NO: 244030 - DNA, 15 bp, Homo sapiens
gcatttaaggatcat

SEQ ID NO: 244031 - DNA, 15 bp, Homo sapiens
tgcatttaaggatca

SEQ ID NO: 244032 - DNA, 15 bp, Homo sapiens
ctgcatttaaggatc

SEQ ID NO: 244033 - DNA, 15 bp, Homo sapiens
cctgcatttaaggat

SEQ ID NO: 244034 - DNA, 15 bp, Homo sapiens
gcctgcatttaagga

SEQ ID NO: 244035 - DNA, 15 bp, Homo sapiens
tgcctgcatttaagg

SEQ ID NO: 244036 - DNA, 15 bp, Homo sapiens
ctgcctgcatttaag

SEQ ID NO: 244037 - DNA, 15 bp, Homo sapiens
gctgcctgcatttaa

SEQ ID NO: 244038 - DNA, 15 bp, Homo sapiens
agctgcctgcattta

SEQ ID NO: 244039 - DNA, 15 bp, Homo sapiens
aagctgcctgcattt

SEQ ID NO: 244040 - DNA, 15 bp, Homo sapiens
gaagctgcctgcatt

SEQ ID NO: 244041 - DNA, 15 bp, Homo sapiens
agaagctgcctgcat

SEQ ID NO: 244042 - DNA, 15 bp, Homo sapiens
tagaagctgcctgca

SEQ ID NO: 244043 - DNA, 15 bp, Homo sapiens
ctagaagctgcctgc

SEQ ID NO: 244044 - DNA, 15 bp, Homo sapiens
tctagaagctgcctg

SEQ ID NO: 244045 - DNA, 15 bp, Homo sapiens
ttctagaagctgcct

SEQ ID NO: 244046 - DNA, 15 bp, Homo sapiens
cttctagaagctgcc

SEQ ID NO: 244047 - DNA, 15 bp, Homo sapiens
gcttctagaagctgc

SEQ ID NO: 244048 - DNA, 15 bp, Homo sapiens
ccagcttctagaagc

SEQ ID NO: 244049 - DNA, 15 bp, Homo sapiens
tccagcttctagaag

SEQ ID NO: 244050 - DNA, 15 bp, Homo sapiens
ttccagcttctagaa

SEQ ID NO: 244051 - DNA, 15 bp, Homo sapiens
tttccagcttctaga

SEQ ID NO: 244052 - DNA, 15 bp, Homo sapiens
ttttccagcttctag

SEQ ID NO: 244053 - DNA, 15 bp, Homo sapiens
cttttccagcttcta

SEQ ID NO: 244054 - DNA, 15 bp, Homo sapiens
ccttttccagcttct

SEQ ID NO: 244055 - DNA, 15 bp, Homo sapiens
gccttttccagcttc

SEQ ID NO: 244056 - DNA, 15 bp, Homo sapiens
tgccttttccagctt

SEQ ID NO: 244057 - DNA, 15 bp, Homo sapiens
ttgccttttccagct

SEQ ID NO: 244058 - DNA, 15 bp, Homo sapiens
tttgccttttccagc

SEQ ID NO: 244059 - DNA, 15 bp, Homo sapiens
ctttgccttttccag

SEQ ID NO: 244060 - DNA, 15 bp, Homo sapiens
tctttgccttttcca

SEQ ID NO: 244061 - DNA, 15 bp, Homo sapiens
ttctttgccttttcc

SEQ ID NO: 244062 - DNA, 15 bp, Homo sapiens
tttctttgccttttc

SEQ ID NO: 244063 - DNA, 15 bp, Homo sapiens
atttctttgcctttt

SEQ ID NO: 244064 - DNA, 15 bp, Homo sapiens
catttctttgccttt

SEQ ID NO: 244065 - DNA, 15 bp, Homo sapiens
ccatttctttgcctt

SEQ ID NO: 244066 - DNA, 15 bp, Homo sapiens
cccatttctttgcct

SEQ ID NO: 244067 - DNA, 15 bp, Homo sapiens
tcccatttctttgcc

SEQ ID NO: 244068 - DNA, 15 bp, Homo sapiens
atcccatttctttgc

SEQ ID NO: 244069 - DNA, 15 bp, Homo sapiens
aatcccatttctttg

SEQ ID NO: 244070 - DNA, 15 bp, Homo sapiens
gaatcccatttcttt

SEQ ID NO: 244071 - DNA, 15 bp, Homo sapiens
agaatcccatttctt

SEQ ID NO: 244072 - DNA, 15 bp, Homo sapiens
gagaatcccatttct

SEQ ID NO: 244073 - DNA, 15 bp, Homo sapiens
agagaatcccatttc

SEQ ID NO: 244074 - DNA, 15 bp, Homo sapiens
gagagaatcccattt

SEQ ID NO: 244075 - DNA, 15 bp, Homo sapiens
agagagaatcccatt

SEQ ID NO: 244076 - DNA, 15 bp, Homo sapiens
aagagagaatcccat

SEQ ID NO: 244077 - DNA, 15 bp, Homo sapiens
taagagagaatccca

SEQ ID NO: 244078 - DNA, 15 bp, Homo sapiens
ctaagagagaatccc

SEQ ID NO: 244079 - DNA, 15 bp, Homo sapiens
tctaagagagaatcc

SEQ ID NO: 244080 - DNA, 15 bp, Homo sapiens
ttctaagagagaatc

SEQ ID NO: 244081 - DNA, 15 bp, Homo sapiens
gttctaagagagaat

SEQ ID NO: 244082 - DNA, 15 bp, Homo sapiens
ggttctaagagagaa

SEQ ID NO: 244083 - DNA, 15 bp, Homo sapiens
aggttctaagagaga

SEQ ID NO: 244084 - DNA, 15 bp, Homo sapiens
gaggttctaagagag

SEQ ID NO: 244085 - DNA, 15 bp, Homo sapiens
ggaggttctaagaga

SEQ ID NO: 244086 - DNA, 15 bp, Homo sapiens
tggaggttctaagag

SEQ ID NO: 244087 - DNA, 15 bp, Homo sapiens
ctggaggttctaaga

SEQ ID NO: 244088 - DNA, 15 bp, Homo sapiens
tctggaggttctaag

SEQ ID NO: 244089 - DNA, 15 bp, Homo sapiens
ctctggaggttctaa

SEQ ID NO: 244090 - DNA, 15 bp, Homo sapiens
tctctggaggttcta

SEQ ID NO: 244091 - DNA, 15 bp, Homo sapiens
ttctctggaggttct

SEQ ID NO: 244092 - DNA, 15 bp, Homo sapiens
cttctctggaggttc

SEQ ID NO: 244093 - DNA, 15 bp, Homo sapiens
ccttctctggaggtt

SEQ ID NO: 244094 - DNA, 15 bp, Homo sapiens
tccttctctggaggt

SEQ ID NO: 244095 - DNA, 15 bp, Homo sapiens
ttccttctctggagg

SEQ ID NO: 244096 - DNA, 15 bp, Homo sapiens
attccttctctggag

SEQ ID NO: 244097 - DNA, 15 bp, Homo sapiens
aattccttctctgga

SEQ ID NO: 244098 - DNA, 15 bp, Homo sapiens
gaattccttctctgg

SEQ ID NO: 244099 - DNA, 15 bp, Homo sapiens
tgaattccttctctg

SEQ ID NO: 244100 - DNA, 15 bp, Homo sapiens
ctgaattccttctct

SEQ ID NO: 244101 - DNA, 15 bp, Homo sapiens
gctgaattccttctc

SEQ ID NO: 244102 - DNA, 15 bp, Homo sapiens
ggctgaattccttct

SEQ ID NO: 244103 - DNA, 15 bp, Homo sapiens
gggctgaattccttc

SEQ ID NO: 244104 - DNA, 15 bp, Homo sapiens
agggctgaattcctt

SEQ ID NO: 244105 - DNA, 15 bp, Homo sapiens
cagggctgaattcct

SEQ ID NO: 244106 - DNA, 15 bp, Homo sapiens
gcagggctgaattcc

SEQ ID NO: 244107 - DNA, 15 bp, Homo sapiens
ggcagggctgaattc

SEQ ID NO: 244108 - DNA, 15 bp, Homo sapiens
tggcagggctgaatt

SEQ ID NO: 244109 - DNA, 15 bp, Homo sapiens
ttggcagggctgaat

SEQ ID NO: 244110 - DNA, 15 bp, Homo sapiens
gttggcagggctgaa

SEQ ID NO: 244111 - DNA, 15 bp, Homo sapiens
agttggcagggctga

SEQ ID NO: 244112 - DNA, 15 bp, Homo sapiens
aagttggcagggctg

SEQ ID NO: 244113 - DNA, 15 bp, Homo sapiens
aaagttggcagggct

SEQ ID NO: 244114 - DNA, 15 bp, Homo sapiens
caaagttggcagggc

SEQ ID NO: 244115 - DNA, 15 bp, Homo sapiens
tcaaagttggcaggg

SEQ ID NO: 244116 - DNA, 15 bp, Homo sapiens
atcaaagttggcagg

SEQ ID NO: 244117 - DNA, 15 bp, Homo sapiens
aatcaaagttggcag

SEQ ID NO: 244118 - DNA, 15 bp, Homo sapiens
aaatcaaagttggca

SEQ ID NO: 244119 - DNA, 15 bp, Homo sapiens
aaaatcaaagttggc

SEQ ID NO: 244120 - DNA, 15 bp, Homo sapiens
taaaatcaaagttgg

SEQ ID NO: 244121 - DNA, 15 bp, Homo sapiens
ataaaatcaaagttg

SEQ ID NO: 244122 - DNA, 15 bp, Homo sapiens
gataaaatcaaagtt

SEQ ID NO: 244123 - DNA, 15 bp, Homo sapiens
ggataaaatcaaagt

SEQ ID NO: 244124 - DNA, 15 bp, Homo sapiens
gggataaaatcaaag

SEQ ID NO: 244125 - DNA, 15 bp, Homo sapiens
tgggataaaatcaaa

SEQ ID NO: 244126 - DNA, 15 bp, Homo sapiens
ctgggataaaatcaa

SEQ ID NO: 244127 - DNA, 15 bp, Homo sapiens
cctgggataaaatca

SEQ ID NO: 244128 - DNA, 15 bp, Homo sapiens
ccctgggataaaatc

SEQ ID NO: 244129 - DNA, 15 bp, Homo sapiens
tccctgggataaaat

SEQ ID NO: 244130 - DNA, 15 bp, Homo sapiens
ctccctgggataaaa

SEQ ID NO: 244131 - DNA, 15 bp, Homo sapiens
tctccctgggataaa

SEQ ID NO: 244132 - DNA, 15 bp, Homo sapiens
gtctccctgggataa

SEQ ID NO: 244133 - DNA, 15 bp, Homo sapiens
tgtctccctgggata

SEQ ID NO: 244134 - DNA, 15 bp, Homo sapiens
atgtctccctgggat

SEQ ID NO: 244135 - DNA, 15 bp, Homo sapiens
aatgtctccctggga

SEQ ID NO: 244136 - DNA, 15 bp, Homo sapiens
aaatgtctccctggg

SEQ ID NO: 244137 - DNA, 15 bp, Homo sapiens
aaaatgtctccctgg

SEQ ID NO: 244138 - DNA, 15 bp, Homo sapiens
aaaaatgtctccctg

SEQ ID NO: 244139 - DNA, 15 bp, Homo sapiens
caaaaatgtctccct

SEQ ID NO: 244140 - DNA, 15 bp, Homo sapiens
acaaaaatgtctccc

SEQ ID NO: 244141 - DNA, 15 bp, Homo sapiens
tacaaaaatgtctcc

SEQ ID NO: 244142 - DNA, 15 bp, Homo sapiens
ttacaaaaatgtctc

SEQ ID NO: 244143 - DNA, 15 bp, Homo sapiens
gttacaaaaatgtct

SEQ ID NO: 244144 - DNA, 15 bp, Homo sapiens
tgttacaaaaatgtc

SEQ ID NO: 244145 - DNA, 15 bp, Homo sapiens
ctgttacaaaaatgt

SEQ ID NO: 244146 - DNA, 15 bp, Homo sapiens
gctgttacaaaaatg

SEQ ID NO: 244147 - DNA, 15 bp, Homo sapiens
tgctgttacaaaaat

SEQ ID NO: 244148 - DNA, 15 bp, Homo sapiens
ttgctgttacaaaaa

SEQ ID NO: 244149 - DNA, 15 bp, Homo sapiens
attgctgttacaaaa

SEQ ID NO: 244150 - DNA, 15 bp, Homo sapiens
tattgctgttacaaa

SEQ ID NO: 244151 - DNA, 15 bp, Homo sapiens
ctattgctgttacaa

SEQ ID NO: 244152 - DNA, 15 bp, Homo sapiens
tctattgctgttaca

SEQ ID NO: 244153 - DNA, 15 bp, Homo sapiens
ttctattgctgttac

SEQ ID NO: 244154 - DNA, 15 bp, Homo sapiens
tttctattgctgtta

SEQ ID NO: 244155 - DNA, 15 bp, Homo sapiens
ttttctattgctgtt

SEQ ID NO: 244156 - DNA, 15 bp, Homo sapiens
attttctattgctgt

SEQ ID NO: 244157 - DNA, 15 bp, Homo sapiens
aattttctattgctg

SEQ ID NO: 244158 - DNA, 15 bp, Homo sapiens
taattttctattgct

SEQ ID NO: 244159 - DNA, 15 bp, Homo sapiens
ttaattttctattgc

SEQ ID NO: 244160 - DNA, 15 bp, Homo sapiens
attaattttctattg

SEQ ID NO: 244161 - DNA, 15 bp, Homo sapiens
cattaattttctatt

SEQ ID NO: 244162 - DNA, 15 bp, Homo sapiens
gcattaattttctat

SEQ ID NO: 244163 - DNA, 15 bp, Homo sapiens
tgcattaattttcta

SEQ ID NO: 244164 - DNA, 15 bp, Homo sapiens
atgcattaattttct

SEQ ID NO: 244165 - DNA, 15 bp, Homo sapiens
catgcattaattttc

SEQ ID NO: 244166 - DNA, 15 bp, Homo sapiens
acatgcattaatttt

SEQ ID NO: 244167 - DNA, 15 bp, Homo sapiens
tacatgcattaattt

SEQ ID NO: 244168 - DNA, 15 bp, Homo sapiens
gtacatgcattaatt

SEQ ID NO: 244169 - DNA, 15 bp, Homo sapiens
agtacatgcattaat

SEQ ID NO: 244170 - DNA, 15 bp, Homo sapiens
tagtacatgcattaa

SEQ ID NO: 244171 - DNA, 15 bp, Homo sapiens
atagtacatgcatta

SEQ ID NO: 244172 - DNA, 15 bp, Homo sapiens
tatagtacatgcatt

SEQ ID NO: 244173 - DNA, 15 bp, Homo sapiens
ttatagtacatgcat

SEQ ID NO: 244174 - DNA, 15 bp, Homo sapiens
tttatagtacatgca

SEQ ID NO: 244175 - DNA, 15 bp, Homo sapiens
ttttatagtacatgc

SEQ ID NO: 244176 - DNA, 15 bp, Homo sapiens
tttttatagtacatg

SEQ ID NO: 244177 - DNA, 15 bp, Homo sapiens
ttttttatagtacat

SEQ ID NO: 244178 - DNA, 15 bp, Homo sapiens
tttttttatagtaca

SEQ ID NO: 244179 - DNA, 15 bp, Homo sapiens
atttttttatagtac

SEQ ID NO: 244180 - DNA, 15 bp, Homo sapiens
gatttttttatagta

SEQ ID NO: 244181 - DNA, 15 bp, Homo sapiens
tgatttttttatagt

SEQ ID NO: 244182 - DNA, 15 bp, Homo sapiens
ttgatttttttatag

SEQ ID NO: 244183 - DNA, 15 bp, Homo sapiens
cttgatttttttata

SEQ ID NO: 244184 - DNA, 15 bp, Homo sapiens
tcttgatttttttat

SEQ ID NO: 244185 - DNA, 15 bp, Homo sapiens
ttcttgattttttta

SEQ ID NO: 244186 - DNA, 15 bp, Homo sapiens
cttcttgattttttt

SEQ ID NO: 244187 - DNA, 15 bp, Homo sapiens
acttcttgatttttt

SEQ ID NO: 244188 - DNA, 15 bp, Homo sapiens
aacttcttgattttt

SEQ ID NO: 244189 - DNA, 15 bp, Homo sapiens
gaacttcttgatttt

SEQ ID NO: 244190 - DNA, 15 bp, Homo sapiens
tgaacttcttgattt

SEQ ID NO: 244191 - DNA, 15 bp, Homo sapiens
gtgaacttcttgatt

SEQ ID NO: 244192 - DNA, 15 bp, Homo sapiens
cgtgaacttcttgat

SEQ ID NO: 244193 - DNA, 15 bp, Homo sapiens
gcgtgaacttcttga

SEQ ID NO: 244194 - DNA, 15 bp, Homo sapiens
tgcgtgaacttcttg

SEQ ID NO: 244195 - DNA, 15 bp, Homo sapiens
ttgcgtgaacttctt

SEQ ID NO: 244196 - DNA, 15 bp, Homo sapiens
tttgcgtgaacttct

SEQ ID NO: 244197 - DNA, 15 bp, Homo sapiens
atttgcgtgaacttc

SEQ ID NO: 244198 - DNA, 15 bp, Homo sapiens
aatttgcgtgaactt

SEQ ID NO: 244199 - DNA, 15 bp, Homo sapiens
taatttgcgtgaact

SEQ ID NO: 244200 - DNA, 15 bp, Homo sapiens
ttaatttgcgtgaac

SEQ ID NO: 244201 - DNA, 15 bp, Homo sapiens
attaatttgcgtgaa

SEQ ID NO: 244202 - DNA, 15 bp, Homo sapiens
aattaatttgcgtga

SEQ ID NO: 244203 - DNA, 15 bp, Homo sapiens
caattaatttgcgtg

SEQ ID NO: 244204 - DNA, 15 bp, Homo sapiens
tcaattaatttgcgt

SEQ ID NO: 244205 - DNA, 15 bp, Homo sapiens
ttcaattaatttgcg

SEQ ID NO: 244206 - DNA, 15 bp, Homo sapiens
tttcaattaatttgc

SEQ ID NO: 244207 - DNA, 15 bp, Homo sapiens
atttcaattaatttg

SEQ ID NO: 244208 - DNA, 15 bp, Homo sapiens
aatttcaattaattt

SEQ ID NO: 244209 - DNA, 15 bp, Homo sapiens
taatttcaattaatt

SEQ ID NO: 244210 - DNA, 15 bp, Homo sapiens
ttaatttcaattaat

SEQ ID NO: 244211 - DNA, 15 bp, Homo sapiens
attaatttcaattaa

SEQ ID NO: 244212 - DNA, 15 bp, Homo sapiens
aattaatttcaatta

SEQ ID NO: 244213 - DNA, 15 bp, Homo sapiens
taattaatttcaatt

SEQ ID NO: 244214 - DNA, 15 bp, Homo sapiens
ttaattaatttcaat

SEQ ID NO: 244215 - DNA, 15 bp, Homo sapiens
attaattaatttcaa

SEQ ID NO: 244216 - DNA, 15 bp, Homo sapiens
aattaattaatttca

SEQ ID NO: 244217 - DNA, 15 bp, Homo sapiens
aaattaattaatttc

SEQ ID NO: 244218 - DNA, 15 bp, Homo sapiens
taaattaattaattt

SEQ ID NO: 244219 - DNA, 15 bp, Homo sapiens
ataaattaattaatt

SEQ ID NO: 244220 - DNA, 15 bp, Homo sapiens
aataaattaattaat

SEQ ID NO: 244221 - DNA, 15 bp, Homo sapiens
caataaattaattaa

SEQ ID NO: 244222 - DNA, 15 bp, Homo sapiens
tcaataaattaatta

SEQ ID NO: 244223 - DNA, 15 bp, Homo sapiens
ttcaataaattaatt

SEQ ID NO: 244224 - DNA, 15 bp, Homo sapiens
attcaataaattaat

SEQ ID NO: 244225 - DNA, 15 bp, Homo sapiens
aattcaataaattaa

SEQ ID NO: 244226 - DNA, 15 bp, Homo sapiens
caattcaataaatta

SEQ ID NO: 244227 - DNA, 15 bp, Homo sapiens
tcaattcaataaatt

SEQ ID NO: 244228 - DNA, 15 bp, Homo sapiens
gtcaattcaataaat

SEQ ID NO: 244229 - DNA, 15 bp, Homo sapiens
agtcaattcaataaa

SEQ ID NO: 244230 - DNA, 15 bp, Homo sapiens
aagtcaattcaataa

SEQ ID NO: 244231 - DNA, 15 bp, Homo sapiens
taagtcaattcaata

SEQ ID NO: 244232 - DNA, 15 bp, Homo sapiens
ctaagtcaattcaat

SEQ ID NO: 244233 - DNA, 15 bp, Homo sapiens
tctaagtcaattcaa

SEQ ID NO: 244234 - DNA, 15 bp, Homo sapiens
ctctaagtcaattca

SEQ ID NO: 244235 - DNA, 15 bp, Homo sapiens
actctaagtcaattc

SEQ ID NO: 244236 - DNA, 15 bp, Homo sapiens
gactctaagtcaatt

SEQ ID NO: 244237 - DNA, 15 bp, Homo sapiens
agactctaagtcaat

SEQ ID NO: 244238 - DNA, 15 bp, Homo sapiens
aagactctaagtcaa

SEQ ID NO: 244239 - DNA, 15 bp, Homo sapiens
aaagactctaagtca

SEQ ID NO: 244240 - DNA, 15 bp, Homo sapiens
aaaagactctaagtc

SEQ ID NO: 244241 - DNA, 15 bp, Homo sapiens
taaaagactctaagt

SEQ ID NO: 244242 - DNA, 15 bp, Homo sapiens
ataaaagactctaag

SEQ ID NO: 244243 - DNA, 15 bp, Homo sapiens
gataaaagactctaa

SEQ ID NO: 244244 - DNA, 15 bp, Homo sapiens
tgataaaagactcta

SEQ ID NO: 244245 - DNA, 15 bp, Homo sapiens
atgataaaagactct

SEQ ID NO: 244246 - DNA, 15 bp, Homo sapiens
gatgataaaagactc

SEQ ID NO: 244247 - DNA, 15 bp, Homo sapiens
agatgataaaagact

SEQ ID NO: 244248 - DNA, 15 bp, Homo sapiens
cagatgataaaagac

SEQ ID NO: 244249 - DNA, 15 bp, Homo sapiens
tcagatgataaaaga

SEQ ID NO: 244250 - DNA, 15 bp, Homo sapiens
atcagatgataaaag

SEQ ID NO: 244251 - DNA, 15 bp, Homo sapiens
aatcagatgataaaa

SEQ ID NO: 244252 - DNA, 15 bp, Homo sapiens
aaatcagatgataaa

SEQ ID NO: 244253 - DNA, 15 bp, Homo sapiens
aaaatcagatgataa

SEQ ID NO: 244254 - DNA, 15 bp, Homo sapiens
aaaaatcagatgata

SEQ ID NO: 244255 - DNA, 15 bp, Homo sapiens
aaaaaatcagatgat

SEQ ID NO: 244256 - DNA, 15 bp, Homo sapiens
aaaaaaatcagatga

SEQ ID NO: 244257 - DNA, 15 bp, Homo sapiens
taaaaaaatcagatg

SEQ ID NO: 244258 - DNA, 15 bp, Homo sapiens
ttaaaaaaatcagat

SEQ ID NO: 244259 - DNA, 15 bp, Homo sapiens
tttaaaaaaatcaga

SEQ ID NO: 244260 - DNA, 15 bp, Homo sapiens
ttttaaaaaaatcag

SEQ ID NO: 244261 - DNA, 15 bp, Homo sapiens
tttttaaaaaaatca

SEQ ID NO: 244262 - DNA, 15 bp, Homo sapiens
catttttaaaaaaat

SEQ ID NO: 244263 - DNA, 15 bp, Homo sapiens
gcatttttaaaaaaa

SEQ ID NO: 244264 - DNA, 15 bp, Homo sapiens
tgcatttttaaaaaa

SEQ ID NO: 244265 - DNA, 15 bp, Homo sapiens
ttgcatttttaaaaa

SEQ ID NO: 244266 - DNA, 15 bp, Homo sapiens
tttgcatttttaaaa

SEQ ID NO: 244267 - DNA, 15 bp, Homo sapiens
gtttgcatttttaaa

SEQ ID NO: 244268 - DNA, 15 bp, Homo sapiens
agtttgcatttttaa

SEQ ID NO: 244269 - DNA, 15 bp, Homo sapiens
cagtttgcattttta

SEQ ID NO: 244270 - DNA, 15 bp, Homo sapiens
ccagtttgcattttt

SEQ ID NO: 244271 - DNA, 15 bp, Homo sapiens
tccagtttgcatttt

SEQ ID NO: 244272 - DNA, 15 bp, Homo sapiens
atccagtttgcattt

SEQ ID NO: 244273 - DNA, 15 bp, Homo sapiens
gatccagtttgcatt

SEQ ID NO: 244274 - DNA, 15 bp, Homo sapiens
agatccagtttgcat

SEQ ID NO: 244275 - DNA, 15 bp, Homo sapiens
tagatccagtttgca

SEQ ID NO: 244276 - DNA, 15 bp, Homo sapiens
ctagatccagtttgc

SEQ ID NO: 244277 - DNA, 15 bp, Homo sapiens
actagatccagtttg

SEQ ID NO: 244278 - DNA, 15 bp, Homo sapiens
aactagatccagttt

SEQ ID NO: 244279 - DNA, 15 bp, Homo sapiens
aaactagatccagtt

SEQ ID NO: 244280 - DNA, 15 bp, Homo sapiens
aaaactagatccagt

SEQ ID NO: 244281 - DNA, 15 bp, Homo sapiens
aaaaactagatccag

SEQ ID NO: 244282 - DNA, 15 bp, Homo sapiens
caaaaactagatcca

SEQ ID NO: 244283 - DNA, 15 bp, Homo sapiens
ccaaaaactagatcc

SEQ ID NO: 244284 - DNA, 15 bp, Homo sapiens
cccaaaaactagatc

SEQ ID NO: 244285 - DNA, 15 bp, Homo sapiens
acccaaaaactagat

SEQ ID NO: 244286 - DNA, 15 bp, Homo sapiens
aacccaaaaactaga

SEQ ID NO: 244287 - DNA, 15 bp, Homo sapiens
aaacccaaaaactag

SEQ ID NO: 244288 - DNA, 15 bp, Homo sapiens
aaaacccaaaaacta

SEQ ID NO: 244289 - DNA, 15 bp, Homo sapiens
taaaacccaaaaact

SEQ ID NO: 244290 - DNA, 15 bp, Homo sapiens
gtaaaacccaaaaac

SEQ ID NO: 244291 - DNA, 15 bp, Homo sapiens
agtaaaacccaaaaa

SEQ ID NO: 244292 - DNA, 15 bp, Homo sapiens
tagtaaaacccaaaa

SEQ ID NO: 244293 - DNA, 15 bp, Homo sapiens
ttagtaaaacccaaa

SEQ ID NO: 244294 - DNA, 15 bp, Homo sapiens
tttagtaaaacccaa

SEQ ID NO: 244295 - DNA, 15 bp, Homo sapiens
atttagtaaaaccca

SEQ ID NO: 244296 - DNA, 15 bp, Homo sapiens
tatttagtaaaaccc

SEQ ID NO: 244297 - DNA, 15 bp, Homo sapiens
ttatttagtaaaacc

SEQ ID NO: 244298 - DNA, 15 bp, Homo sapiens
tttatttagtaaaac

SEQ ID NO: 244299 - DNA, 15 bp, Homo sapiens
ttttatttagtaaaa

SEQ ID NO: 244300 - DNA, 15 bp, Homo sapiens
tttttatttagtaaa

SEQ ID NO: 244301 - DNA, 15 bp, Homo sapiens
ttttttatttagtaa

SEQ ID NO: 244302 - DNA, 15 bp, Homo sapiens
tttttttatttagta

SEQ ID NO: 244303 - DNA, 15 bp, Homo sapiens
ttttttttatttagt

SEQ ID NO: 244304 - DNA, 15 bp, Homo sapiens
attttttttatttag

SEQ ID NO: 244305 - DNA, 15 bp, Homo sapiens
aattttttttattta

SEQ ID NO: 244306 - DNA, 15 bp, Homo sapiens
ttaattttttttatt

SEQ ID NO: 244307 - DNA, 15 bp, Homo sapiens
tttaattttttttat

SEQ ID NO: 244308 - DNA, 15 bp, Homo sapiens
atttaatttttttta

SEQ ID NO: 244309 - DNA, 15 bp, Homo sapiens
tatttaatttttttt

SEQ ID NO: 244310 - DNA, 15 bp, Homo sapiens
atatttaattttttt

SEQ ID NO: 244311 - DNA, 15 bp, Homo sapiens
gatatttaatttttt

SEQ ID NO: 244312 - DNA, 15 bp, Homo sapiens
agatatttaattttt

SEQ ID NO: 244313 - DNA, 15 bp, Homo sapiens
aagatatttaatttt

SEQ ID NO: 244314 - DNA, 15 bp, Homo sapiens
caagatatttaattt

SEQ ID NO: 244315 - DNA, 15 bp, Homo sapiens
gcaagatatttaatt

SEQ ID NO: 244316 - DNA, 15 bp, Homo sapiens
agcaagatatttaat

SEQ ID NO: 244317 - DNA, 15 bp, Homo sapiens
aagcaagatatttaa

SEQ ID NO: 244318 - DNA, 15 bp, Homo sapiens
aaagcaagatattta

SEQ ID NO: 244319 - DNA, 15 bp, Homo sapiens
taaagcaagatattt

SEQ ID NO: 244320 - DNA, 15 bp, Homo sapiens
ataaagcaagatatt

SEQ ID NO: 244321 - DNA, 15 bp, Homo sapiens
cataaagcaagatat

SEQ ID NO: 244322 - DNA, 15 bp, Homo sapiens
acataaagcaagata

SEQ ID NO: 244323 - DNA, 15 bp, Homo sapiens
aacataaagcaagat

SEQ ID NO: 244324 - DNA, 15 bp, Homo sapiens
aaacataaagcaaga

SEQ ID NO: 244325 - DNA, 15 bp, Homo sapiens
taaacataaagcaag

SEQ ID NO: 244326 - DNA, 15 bp, Homo sapiens
ataaacataaagcaa

SEQ ID NO: 244327 - DNA, 15 bp, Homo sapiens
tataaacataaagca

SEQ ID NO: 244328 - DNA, 15 bp, Homo sapiens
atataaacataaagc

SEQ ID NO: 244329 - DNA, 15 bp, Homo sapiens
gatataaacataaag

SEQ ID NO: 244330 - DNA, 15 bp, Homo sapiens
tgatataaacataaa

SEQ ID NO: 244331 - DNA, 15 bp, Homo sapiens
atgatataaacataa

SEQ ID NO: 244332 - DNA, 15 bp, Homo sapiens
catgatataaacata

SEQ ID NO: 244333 - DNA, 15 bp, Homo sapiens
tcatgatataaacat

SEQ ID NO: 244334 - DNA, 15 bp, Homo sapiens
atcatgatataaaca

SEQ ID NO: 244335 - DNA, 15 bp, Homo sapiens
aatcatgatataaac

SEQ ID NO: 244336 - DNA, 15 bp, Homo sapiens
taatcatgatataaa

SEQ ID NO: 244337 - DNA, 15 bp, Homo sapiens
ataatcatgatataa

SEQ ID NO: 244338 - DNA, 15 bp, Homo sapiens
gataatcatgatata

SEQ ID NO: 244339 - DNA, 15 bp, Homo sapiens
agataatcatgatat

SEQ ID NO: 244340 - DNA, 15 bp, Homo sapiens
cagataatcatgata

SEQ ID NO: 244341 - DNA, 15 bp, Homo sapiens
acagataatcatgat

SEQ ID NO: 244342 - DNA, 15 bp, Homo sapiens
cacagataatcatga

SEQ ID NO: 244343 - DNA, 15 bp, Homo sapiens
acacagataatcatg

SEQ ID NO: 244344 - DNA, 15 bp, Homo sapiens
cacacagataatcat

SEQ ID NO: 244345 - DNA, 15 bp, Homo sapiens
ccacacagataatca

SEQ ID NO: 244346 - DNA, 15 bp, Homo sapiens
accacacagataatc

SEQ ID NO: 244347 - DNA, 15 bp, Homo sapiens
aaccacacagataat

SEQ ID NO: 244348 - DNA, 15 bp, Homo sapiens
aaaccacacagataa

SEQ ID NO: 244349 - DNA, 15 bp, Homo sapiens
caaaccacacagata

SEQ ID NO: 244350 - DNA, 15 bp, Homo sapiens
ccaaaccacacagat

SEQ ID NO: 244351 - DNA, 15 bp, Homo sapiens
cccaaaccacacaga

SEQ ID NO: 244352 - DNA, 15 bp, Homo sapiens
tcccaaaccacacag

SEQ ID NO: 244353 - DNA, 15 bp, Homo sapiens
gtcccaaaccacaca

SEQ ID NO: 244354 - DNA, 15 bp, Homo sapiens
agtcccaaaccacac

SEQ ID NO: 244355 - DNA, 15 bp, Homo sapiens
aagtcccaaaccaca

SEQ ID NO: 244356 - DNA, 15 bp, Homo sapiens
aaagtcccaaaccac

SEQ ID NO: 244357 - DNA, 15 bp, Homo sapiens
aaaagtcccaaacca

SEQ ID NO: 244358 - DNA, 15 bp, Homo sapiens
taaaagtcccaaacc

SEQ ID NO: 244359 - DNA, 15 bp, Homo sapiens
ttaaaagtcccaaac

SEQ ID NO: 244360 - DNA, 15 bp, Homo sapiens
tttaaaagtcccaaa

SEQ ID NO: 244361 - DNA, 15 bp, Homo sapiens
ctttaaaagtcccaa

SEQ ID NO: 244362 - DNA, 15 bp, Homo sapiens
actttaaaagtccca

SEQ ID NO: 244363 - DNA, 15 bp, Homo sapiens
gactttaaaagtccc

SEQ ID NO: 244364 - DNA, 15 bp, Homo sapiens
ggactttaaaagtcc

SEQ ID NO: 244365 - DNA, 15 bp, Homo sapiens
tggactttaaaagtc

SEQ ID NO: 244366 - DNA, 15 bp, Homo sapiens
atggactttaaaagt

SEQ ID NO: 244367 - DNA, 15 bp, Homo sapiens
gatggactttaaaag

SEQ ID NO: 244368 - DNA, 15 bp, Homo sapiens
ggatggactttaaaa

SEQ ID NO: 244369 - DNA, 15 bp, Homo sapiens
aggatggactttaaa

SEQ ID NO: 244370 - DNA, 15 bp, Homo sapiens
aaggatggactttaa

SEQ ID NO: 244371 - DNA, 15 bp, Homo sapiens
taaggatggacttta

SEQ ID NO: 244372 - DNA, 15 bp, Homo sapiens
ttaaggatggacttt

SEQ ID NO: 244373 - DNA, 15 bp, Homo sapiens
attaaggatggactt

SEQ ID NO: 244374 - DNA, 15 bp, Homo sapiens
aattaaggatggact

SEQ ID NO: 244375 - DNA, 15 bp, Homo sapiens
aaattaaggatggac

SEQ ID NO: 244376 - DNA, 15 bp, Homo sapiens
aaaattaaggatgga

SEQ ID NO: 244377 - DNA, 15 bp, Homo sapiens
taaaattaaggatgg

SEQ ID NO: 244378 - DNA, 15 bp, Homo sapiens
ctaaaattaaggatg

SEQ ID NO: 244379 - DNA, 15 bp, Homo sapiens
gctaaaattaaggat

SEQ ID NO: 244380 - DNA, 15 bp, Homo sapiens
agctaaaattaagga

SEQ ID NO: 244381 - DNA, 15 bp, Homo sapiens
gagctaaaattaagg

SEQ ID NO: 244382 - DNA, 15 bp, Homo sapiens
agagctaaaattaag

SEQ ID NO: 244383 - DNA, 15 bp, Homo sapiens
aagagctaaaattaa

SEQ ID NO: 244384 - DNA, 15 bp, Homo sapiens
aaagagctaaaatta

SEQ ID NO: 244385 - DNA, 15 bp, Homo sapiens
aaaagagctaaaatt

SEQ ID NO: 244386 - DNA, 15 bp, Homo sapiens
aaaaagagctaaaat

SEQ ID NO: 244387 - DNA, 15 bp, Homo sapiens
aaaaaagagctaaaa

SEQ ID NO: 244388 - DNA, 15 bp, Homo sapiens
taaaaaagagctaaa

SEQ ID NO: 244389 - DNA, 15 bp, Homo sapiens
ttaaaaaagagctaa

SEQ ID NO: 244390 - DNA, 15 bp, Homo sapiens
tttaaaaaagagcta

SEQ ID NO: 244391 - DNA, 15 bp, Homo sapiens
ttttaaaaaagagct

SEQ ID NO: 244392 - DNA, 15 bp, Homo sapiens
tttttaaaaaagagc

SEQ ID NO: 244393 - DNA, 15 bp, Homo sapiens
atttttaaaaaagag

SEQ ID NO: 244394 - DNA, 15 bp, Homo sapiens
catttttaaaaaaga

SEQ ID NO: 244395 - DNA, 15 bp, Homo sapiens
tcatttttaaaaaag

SEQ ID NO: 244396 - DNA, 15 bp, Homo sapiens
ttcatttttaaaaaa

SEQ ID NO: 244397 - DNA, 15 bp, Homo sapiens
attcatttttaaaaa

SEQ ID NO: 244398 - DNA, 15 bp, Homo sapiens
aaattcatttttaaa

SEQ ID NO: 244399 - DNA, 15 bp, Homo sapiens
gaaattcatttttaa

SEQ ID NO: 244400 - DNA, 15 bp, Homo sapiens
agaaattcattttta

SEQ ID NO: 244401 - DNA, 15 bp, Homo sapiens
tagaaattcattttt

SEQ ID NO: 244402 - DNA, 15 bp, Homo sapiens
atagaaattcatttt

SEQ ID NO: 244403 - DNA, 15 bp, Homo sapiens
tatagaaattcattt

SEQ ID NO: 244404 - DNA, 15 bp, Homo sapiens
atatagaaattcatt

SEQ ID NO: 244405 - DNA, 15 bp, Homo sapiens
catatagaaattcat

SEQ ID NO: 244406 - DNA, 15 bp, Homo sapiens
acatatagaaattca

SEQ ID NO: 244407 - DNA, 15 bp, Homo sapiens
aacatatagaaattc

SEQ ID NO: 244408 - DNA, 15 bp, Homo sapiens
aaacatatagaaatt

SEQ ID NO: 244409 - DNA, 15 bp, Homo sapiens
taaacatatagaaat

SEQ ID NO: 244410 - DNA, 15 bp, Homo sapiens
ctaaacatatagaaa

SEQ ID NO: 244411 - DNA, 15 bp, Homo sapiens
cctaaacatatagaa

SEQ ID NO: 244412 - DNA, 15 bp, Homo sapiens
acctaaacatataga

SEQ ID NO: 244413 - DNA, 15 bp, Homo sapiens
aacctaaacatatag

SEQ ID NO: 244414 - DNA, 15 bp, Homo sapiens
taacctaaacatata

SEQ ID NO: 244415 - DNA, 15 bp, Homo sapiens
ttaacctaaacatat

SEQ ID NO: 244416 - DNA, 15 bp, Homo sapiens
attaacctaaacata

SEQ ID NO: 244417 - DNA, 15 bp, Homo sapiens
aattaacctaaacat

SEQ ID NO: 244418 - DNA, 15 bp, Homo sapiens
taattaacctaaaca

SEQ ID NO: 244419 - DNA, 15 bp, Homo sapiens
ataattaacctaaac

SEQ ID NO: 244420 - DNA, 15 bp, Homo sapiens
tataattaacctaaa

SEQ ID NO: 244421 - DNA, 15 bp, Homo sapiens
atataattaacctaa

SEQ ID NO: 244422 - DNA, 15 bp, Homo sapiens
tatataattaaccta

SEQ ID NO: 244423 - DNA, 15 bp, Homo sapiens
atatataattaacct

SEQ ID NO: 244424 - DNA, 15 bp, Homo sapiens
catatataattaacc

SEQ ID NO: 244425 - DNA, 15 bp, Homo sapiens
tcatatataattaac

SEQ ID NO: 244426 - DNA, 15 bp, Homo sapiens
gtcatatataattaa

SEQ ID NO: 244427 - DNA, 15 bp, Homo sapiens
agtcatatataatta

SEQ ID NO: 244428 - DNA, 15 bp, Homo sapiens
cagtcatatataatt

SEQ ID NO: 244429 - DNA, 15 bp, Homo sapiens
tcagtcatatataat

SEQ ID NO: 244430 - DNA, 15 bp, Homo sapiens
ctcagtcatatataa

SEQ ID NO: 244431 - DNA, 15 bp, Homo sapiens
tctcagtcatatata

SEQ ID NO: 244432 - DNA, 15 bp, Homo sapiens
ttctcagtcatatat

SEQ ID NO: 244433 - DNA, 15 bp, Homo sapiens
attctcagtcatata

SEQ ID NO: 244434 - DNA, 15 bp, Homo sapiens
aattctcagtcatat

SEQ ID NO: 244435 - DNA, 15 bp, Homo sapiens
caattctcagtcata

SEQ ID NO: 244436 - DNA, 15 bp, Homo sapiens
acaattctcagtcat

SEQ ID NO: 244437 - DNA, 15 bp, Homo sapiens
gacaattctcagtca

SEQ ID NO: 244438 - DNA, 15 bp, Homo sapiens
agacaattctcagtc

SEQ ID NO: 244439 - DNA, 15 bp, Homo sapiens
tagacaattctcagt

SEQ ID NO: 244440 - DNA, 15 bp, Homo sapiens
ttagacaattctcag

SEQ ID NO: 244441 - DNA, 15 bp, Homo sapiens
tttagacaattctca

SEQ ID NO: 244442 - DNA, 15 bp, Homo sapiens
atttagacaattctc

SEQ ID NO: 244443 - DNA, 15 bp, Homo sapiens
gatttagacaattct

SEQ ID NO: 244444 - DNA, 15 bp, Homo sapiens
tgatttagacaattc

SEQ ID NO: 244445 - DNA, 15 bp, Homo sapiens
ctgatttagacaatt

SEQ ID NO: 244446 - DNA, 15 bp, Homo sapiens
tctgatttagacaat

SEQ ID NO: 244447 - DNA, 15 bp, Homo sapiens
ttctgatttagacaa

SEQ ID NO: 244448 - DNA, 15 bp, Homo sapiens
attctgatttagaca

SEQ ID NO: 244449 - DNA, 15 bp, Homo sapiens
aattctgatttagac

SEQ ID NO: 244450 - DNA, 15 bp, Homo sapiens
aaattctgatttaga

SEQ ID NO: 244451 - DNA, 15 bp, Homo sapiens
gaaattctgatttag

SEQ ID NO: 244452 - DNA, 15 bp, Homo sapiens
agaaattctgattta

SEQ ID NO: 244453 - DNA, 15 bp, Homo sapiens
gagaaattctgattt

SEQ ID NO: 244454 - DNA, 15 bp, Homo sapiens
agagaaattctgatt

SEQ ID NO: 244455 - DNA, 15 bp, Homo sapiens
tagagaaattctgat

SEQ ID NO: 244456 - DNA, 15 bp, Homo sapiens
ttagagaaattctga

SEQ ID NO: 244457 - DNA, 15 bp, Homo sapiens
attagagaaattctg

SEQ ID NO: 244458 - DNA, 15 bp, Homo sapiens
aattagagaaattct

SEQ ID NO: 244459 - DNA, 15 bp, Homo sapiens
gaattagagaaattc

SEQ ID NO: 244460 - DNA, 15 bp, Homo sapiens
tgaattagagaaatt

SEQ ID NO: 244461 - DNA, 15 bp, Homo sapiens
ttgaattagagaaat

SEQ ID NO: 244462 - DNA, 15 bp, Homo sapiens
tttgaattagagaaa

SEQ ID NO: 244463 - DNA, 15 bp, Homo sapiens
ttttgaattagagaa

SEQ ID NO: 244464 - DNA, 15 bp, Homo sapiens
attttgaattagaga

SEQ ID NO: 244465 - DNA, 15 bp, Homo sapiens
cattttgaattagag

SEQ ID NO: 244466 - DNA, 15 bp, Homo sapiens
acattttgaattaga

SEQ ID NO: 244467 - DNA, 15 bp, Homo sapiens
aacattttgaattag

SEQ ID NO: 244468 - DNA, 15 bp, Homo sapiens
aaacattttgaatta

SEQ ID NO: 244469 - DNA, 15 bp, Homo sapiens
taaacattttgaatt

SEQ ID NO: 244470 - DNA, 15 bp, Homo sapiens
ataaacattttgaat

SEQ ID NO: 244471 - DNA, 15 bp, Homo sapiens
tataaacattttgaa

SEQ ID NO: 244472 - DNA, 15 bp, Homo sapiens
ttataaacattttga

SEQ ID NO: 244473 - DNA, 15 bp, Homo sapiens
attataaacattttg

SEQ ID NO: 244474 - DNA, 15 bp, Homo sapiens
aattataaacatttt

SEQ ID NO: 244475 - DNA, 15 bp, Homo sapiens
aaattataaacattt

SEQ ID NO: 244476 - DNA, 15 bp, Homo sapiens
aaaattataaacatt

SEQ ID NO: 244477 - DNA, 15 bp, Homo sapiens
caaaattataaacat

SEQ ID NO: 244478 - DNA, 15 bp, Homo sapiens
ccaaaattataaaca

SEQ ID NO: 244479 - DNA, 15 bp, Homo sapiens
tccaaaattataaac

SEQ ID NO: 244480 - DNA, 15 bp, Homo sapiens
ttccaaaattataaa

SEQ ID NO: 244481 - DNA, 15 bp, Homo sapiens
cttccaaaattataa

SEQ ID NO: 244482 - DNA, 15 bp, Homo sapiens
ccttccaaaattata

SEQ ID NO: 244483 - DNA, 15 bp, Homo sapiens
tccttccaaaattat

SEQ ID NO: 244484 - DNA, 15 bp, Homo sapiens
atccttccaaaatta

SEQ ID NO: 244485 - DNA, 15 bp, Homo sapiens
gatccttccaaaatt

SEQ ID NO: 244486 - DNA, 15 bp, Homo sapiens
agatccttccaaaat

SEQ ID NO: 244487 - DNA, 15 bp, Homo sapiens
cagatccttccaaaa

SEQ ID NO: 244488 - DNA, 15 bp, Homo sapiens
ccagatccttccaaa

SEQ ID NO: 244489 - DNA, 15 bp, Homo sapiens
accagatccttccaa

SEQ ID NO: 244490 - DNA, 15 bp, Homo sapiens
taccagatccttcca

SEQ ID NO: 244491 - DNA, 15 bp, Homo sapiens
ctaccagatccttcc

SEQ ID NO: 244492 - DNA, 15 bp, Homo sapiens
cctaccagatccttc

SEQ ID NO: 244493 - DNA, 15 bp, Homo sapiens
tcctaccagatcctt

SEQ ID NO: 244494 - DNA, 15 bp, Homo sapiens
atcctaccagatcct

SEQ ID NO: 244495 - DNA, 15 bp, Homo sapiens
aatcctaccagatcc

SEQ ID NO: 244496 - DNA, 15 bp, Homo sapiens
caatcctaccagatc

SEQ ID NO: 244497 - DNA, 15 bp, Homo sapiens
acaatcctaccagat

SEQ ID NO: 244498 - DNA, 15 bp, Homo sapiens
tacaatcctaccaga

SEQ ID NO: 244499 - DNA, 15 bp, Homo sapiens
atacaatcctaccag

SEQ ID NO: 244500 - DNA, 15 bp, Homo sapiens
aatacaatcctacca

SEQ ID NO: 244501 - DNA, 15 bp, Homo sapiens
gaatacaatcctacc

SEQ ID NO: 244502 - DNA, 15 bp, Homo sapiens
agaatacaatcctac

SEQ ID NO: 244503 - DNA, 15 bp, Homo sapiens
aagaatacaatccta

SEQ ID NO: 244504 - DNA, 15 bp, Homo sapiens
caagaatacaatcct

SEQ ID NO: 244505 - DNA, 15 bp, Homo sapiens
acaagaatacaatcc

SEQ ID NO: 244506 - DNA, 15 bp, Homo sapiens
aacaagaatacaatc

SEQ ID NO: 244507 - DNA, 15 bp, Homo sapiens
gaacaagaatacaat

SEQ ID NO: 244508 - DNA, 15 bp, Homo sapiens
agaacaagaatacaa

SEQ ID NO: 244509 - DNA, 15 bp, Homo sapiens
aagaacaagaataca

SEQ ID NO: 244510 - DNA, 15 bp, Homo sapiens
caagaacaagaatac

SEQ ID NO: 244511 - DNA, 15 bp, Homo sapiens
acaagaacaagaata

SEQ ID NO: 244512 - DNA, 15 bp, Homo sapiens
cacaagaacaagaat

SEQ ID NO: 244513 - DNA, 15 bp, Homo sapiens
ccacaagaacaagaa

SEQ ID NO: 244514 - DNA, 15 bp, Homo sapiens
cccacaagaacaaga

SEQ ID NO: 244515 - DNA, 15 bp, Homo sapiens
ccccacaagaacaag

SEQ ID NO: 244516 - DNA, 15 bp, Homo sapiens
gccccacaagaacaa

SEQ ID NO: 244517 - DNA, 15 bp, Homo sapiens
tgccccacaagaaca

SEQ ID NO: 244518 - DNA, 15 bp, Homo sapiens
ctgccccacaagaac

SEQ ID NO: 244519 - DNA, 15 bp, Homo sapiens
tctgccccacaagaa

SEQ ID NO: 244520 - DNA, 15 bp, Homo sapiens
ctctgccccacaaga

SEQ ID NO: 244521 - DNA, 15 bp, Homo sapiens
actctgccccacaag

SEQ ID NO: 244522 - DNA, 15 bp, Homo sapiens
aactctgccccacaa

SEQ ID NO: 244523 - DNA, 15 bp, Homo sapiens
gaactctgccccaca

SEQ ID NO: 244524 - DNA, 15 bp, Homo sapiens
agaactctgccccac

SEQ ID NO: 244525 - DNA, 15 bp, Homo sapiens
aagaactctgcccca

SEQ ID NO: 244526 - DNA, 15 bp, Homo sapiens
taagaactctgcccc

SEQ ID NO: 244527 - DNA, 15 bp, Homo sapiens
ataagaactctgccc

SEQ ID NO: 244528 - DNA, 15 bp, Homo sapiens
cataagaactctgcc

SEQ ID NO: 244529 - DNA, 15 bp, Homo sapiens
ccataagaactctgc

SEQ ID NO: 244530 - DNA, 15 bp, Homo sapiens
cccataagaactctg

SEQ ID NO: 244531 - DNA, 15 bp, Homo sapiens
ccccataagaactct

SEQ ID NO: 244532 - DNA, 15 bp, Homo sapiens
gccccataagaactc

SEQ ID NO: 244533 - DNA, 15 bp, Homo sapiens
tgccccataagaact

SEQ ID NO: 244534 - DNA, 15 bp, Homo sapiens
ctgccccataagaac

SEQ ID NO: 244535 - DNA, 15 bp, Homo sapiens
tctgccccataagaa

SEQ ID NO: 244536 - DNA, 15 bp, Homo sapiens
atctgccccataaga

SEQ ID NO: 244537 - DNA, 15 bp, Homo sapiens
aatctgccccataag

SEQ ID NO: 244538 - DNA, 15 bp, Homo sapiens
caatctgccccataa

SEQ ID NO: 244539 - DNA, 15 bp, Homo sapiens
ccaatctgccccata

SEQ ID NO: 244540 - DNA, 15 bp, Homo sapiens
accaatctgccccat

SEQ ID NO: 244541 - DNA, 15 bp, Homo sapiens
taccaatctgcccca

SEQ ID NO: 244542 - DNA, 15 bp, Homo sapiens
ctaccaatctgcccc

SEQ ID NO: 244543 - DNA, 15 bp, Homo sapiens
tctaccaatctgccc

SEQ ID NO: 244544 - DNA, 15 bp, Homo sapiens
ttctaccaatctgcc

SEQ ID NO: 244545 - DNA, 15 bp, Homo sapiens
attctaccaatctgc

SEQ ID NO: 244546 - DNA, 15 bp, Homo sapiens
tattctaccaatctg

SEQ ID NO: 244547 - DNA, 15 bp, Homo sapiens
ttattctaccaatct

SEQ ID NO: 244548 - DNA, 15 bp, Homo sapiens
tttattctaccaatc

SEQ ID NO: 244549 - DNA, 15 bp, Homo sapiens
ttttattctaccaat

SEQ ID NO: 244550 - DNA, 15 bp, Homo sapiens
cttttattctaccaa

SEQ ID NO: 244551 - DNA, 15 bp, Homo sapiens
acttttattctacca

SEQ ID NO: 244552 - DNA, 15 bp, Homo sapiens
aacttttattctacc

SEQ ID NO: 244553 - DNA, 15 bp, Homo sapiens
taacttttattctac

SEQ ID NO: 244554 - DNA, 15 bp, Homo sapiens
ctaacttttattcta

SEQ ID NO: 244555 - DNA, 15 bp, Homo sapiens
actaacttttattct

SEQ ID NO: 244556 - DNA, 15 bp, Homo sapiens
aactaacttttattc

SEQ ID NO: 244557 - DNA, 15 bp, Homo sapiens
aaactaacttttatt

SEQ ID NO: 244558 - DNA, 15 bp, Homo sapiens
aaaactaacttttat

SEQ ID NO: 244559 - DNA, 15 bp, Homo sapiens
taaaactaactttta

SEQ ID NO: 244560 - DNA, 15 bp, Homo sapiens
gtaaaactaactttt

SEQ ID NO: 244561 - DNA, 15 bp, Homo sapiens
ggtaaaactaacttt

SEQ ID NO: 244562 - DNA, 15 bp, Homo sapiens
aggtaaaactaactt

SEQ ID NO: 244563 - DNA, 15 bp, Homo sapiens
caggtaaaactaact

SEQ ID NO: 244564 - DNA, 15 bp, Homo sapiens
ccaggtaaaactaac

SEQ ID NO: 244565 - DNA, 15 bp, Homo sapiens
gccaggtaaaactaa

SEQ ID NO: 244566 - DNA, 15 bp, Homo sapiens
agccaggtaaaacta

SEQ ID NO: 244567 - DNA, 15 bp, Homo sapiens
aagccaggtaaaact

SEQ ID NO: 244568 - DNA, 15 bp, Homo sapiens
gaagccaggtaaaac

SEQ ID NO: 244569 - DNA, 15 bp, Homo sapiens
ggaagccaggtaaaa

SEQ ID NO: 244570 - DNA, 15 bp, Homo sapiens
gggaagccaggtaaa

SEQ ID NO: 244571 - DNA, 15 bp, Homo sapiens
tgggaagccaggtaa

SEQ ID NO: 244572 - DNA, 15 bp, Homo sapiens
atgggaagccaggta

SEQ ID NO: 244573 - DNA, 15 bp, Homo sapiens
aatgggaagccaggt

SEQ ID NO: 244574 - DNA, 15 bp, Homo sapiens
caatgggaagccagg

SEQ ID NO: 244575 - DNA, 15 bp, Homo sapiens
ccaatgggaagccag

SEQ ID NO: 244576 - DNA, 15 bp, Homo sapiens
gccaatgggaagcca

SEQ ID NO: 244577 - DNA, 15 bp, Homo sapiens
agccaatgggaagcc

SEQ ID NO: 244578 - DNA, 15 bp, Homo sapiens
tagccaatgggaagc

SEQ ID NO: 244579 - DNA, 15 bp, Homo sapiens
ctagccaatgggaag

SEQ ID NO: 244580 - DNA, 15 bp, Homo sapiens
tctagccaatgggaa

SEQ ID NO: 244581 - DNA, 15 bp, Homo sapiens
ctctagccaatggga

SEQ ID NO: 244582 - DNA, 15 bp, Homo sapiens
gctctagccaatggg

SEQ ID NO: 244583 - DNA, 15 bp, Homo sapiens
tgctctagccaatgg

SEQ ID NO: 244584 - DNA, 15 bp, Homo sapiens
gtgctctagccaatg

SEQ ID NO: 244585 - DNA, 15 bp, Homo sapiens
agtgctctagccaat

SEQ ID NO: 244586 - DNA, 15 bp, Homo sapiens
tagtgctctagccaa

SEQ ID NO: 244587 - DNA, 15 bp, Homo sapiens
atagtgctctagcca

SEQ ID NO: 244588 - DNA, 15 bp, Homo sapiens
aatagtgctctagcc

SEQ ID NO: 244589 - DNA, 15 bp, Homo sapiens
taatagtgctctagc

SEQ ID NO: 244590 - DNA, 15 bp, Homo sapiens
gtaatagtgctctag

SEQ ID NO: 244591 - DNA, 15 bp, Homo sapiens
ggtaatagtgctcta

SEQ ID NO: 244592 - DNA, 15 bp, Homo sapiens
tggtaatagtgctct

SEQ ID NO: 244593 - DNA, 15 bp, Homo sapiens
ctggtaatagtgctc

SEQ ID NO: 244594 - DNA, 15 bp, Homo sapiens
gctggtaatagtgct

SEQ ID NO: 244595 - DNA, 15 bp, Homo sapiens
tgctggtaatagtgc

SEQ ID NO: 244596 - DNA, 15 bp, Homo sapiens
gtgctggtaatagtg

SEQ ID NO: 244597 - DNA, 15 bp, Homo sapiens
agtgctggtaatagt

SEQ ID NO: 244598 - DNA, 15 bp, Homo sapiens
cagtgctggtaatag

SEQ ID NO: 244599 - DNA, 15 bp, Homo sapiens
ccagtgctggtaata

SEQ ID NO: 244600 - DNA, 15 bp, Homo sapiens
tccagtgctggtaat

SEQ ID NO: 244601 - DNA, 15 bp, Homo sapiens
ttccagtgctggtaa

SEQ ID NO: 244602 - DNA, 15 bp, Homo sapiens
tttccagtgctggta

SEQ ID NO: 244603 - DNA, 15 bp, Homo sapiens
ttttccagtgctggt

SEQ ID NO: 244604 - DNA, 15 bp, Homo sapiens
attttccagtgctgg

SEQ ID NO: 244605 - DNA, 15 bp, Homo sapiens
tattttccagtgctg

SEQ ID NO: 244606 - DNA, 15 bp, Homo sapiens
ctattttccagtgct

SEQ ID NO: 244607 - DNA, 15 bp, Homo sapiens
tctattttccagtgc

SEQ ID NO: 244608 - DNA, 15 bp, Homo sapiens
atctattttccagtg

SEQ ID NO: 244609 - DNA, 15 bp, Homo sapiens
tatctattttccagt

SEQ ID NO: 244610 - DNA, 15 bp, Homo sapiens
atatctattttccag

SEQ ID NO: 244611 - DNA, 15 bp, Homo sapiens
tatatctattttcca

SEQ ID NO: 244612 - DNA, 15 bp, Homo sapiens
ttatatctattttcc

SEQ ID NO: 244613 - DNA, 15 bp, Homo sapiens
attatatctattttc

SEQ ID NO: 244614 - DNA, 15 bp, Homo sapiens
tattatatctatttt

SEQ ID NO: 244615 - DNA, 15 bp, Homo sapiens
atattatatctattt

SEQ ID NO: 244616 - DNA, 15 bp, Homo sapiens
tatattatatctatt

SEQ ID NO: 244617 - DNA, 15 bp, Homo sapiens
ttatattatatctat

SEQ ID NO: 244618 - DNA, 15 bp, Homo sapiens
attatattatatcta

SEQ ID NO: 244619 - DNA, 15 bp, Homo sapiens
cattatattatatct

SEQ ID NO: 244620 - DNA, 15 bp, Homo sapiens
tcattatattatatc

SEQ ID NO: 244621 - DNA, 15 bp, Homo sapiens
atcattatattatat

SEQ ID NO: 244622 - DNA, 15 bp, Homo sapiens
catcattatattata

SEQ ID NO: 244623 - DNA, 15 bp, Homo sapiens
ccatcattatattat

SEQ ID NO: 244624 - DNA, 15 bp, Homo sapiens
gccatcattatatta

SEQ ID NO: 244625 - DNA, 15 bp, Homo sapiens
ggccatcattatatt

SEQ ID NO: 244626 - DNA, 15 bp, Homo sapiens
tggccatcattatat

SEQ ID NO: 244627 - DNA, 15 bp, Homo sapiens
gtggccatcattata

SEQ ID NO: 244628 - DNA, 15 bp, Homo sapiens
agtggccatcattat

SEQ ID NO: 244629 - DNA, 15 bp, Homo sapiens
tagtggccatcatta

SEQ ID NO: 244630 - DNA, 15 bp, Homo sapiens
atagtggccatcatt

SEQ ID NO: 244631 - DNA, 15 bp, Homo sapiens
aatagtggccatcat

SEQ ID NO: 244632 - DNA, 15 bp, Homo sapiens
aaatagtggccatca

SEQ ID NO: 244633 - DNA, 15 bp, Homo sapiens
aaaatagtggccatc

SEQ ID NO: 244634 - DNA, 15 bp, Homo sapiens
taaaatagtggccat

SEQ ID NO: 244635 - DNA, 15 bp, Homo sapiens
ttaaaatagtggcca

SEQ ID NO: 244636 - DNA, 15 bp, Homo sapiens
tttaaaatagtggcc

SEQ ID NO: 244637 - DNA, 15 bp, Homo sapiens
atttaaaatagtggc

SEQ ID NO: 244638 - DNA, 15 bp, Homo sapiens
tatttaaaatagtgg

SEQ ID NO: 244639 - DNA, 15 bp, Homo sapiens
ttatttaaaatagtg

SEQ ID NO: 244640 - DNA, 15 bp, Homo sapiens
attatttaaaatagt

SEQ ID NO: 244641 - DNA, 15 bp, Homo sapiens
tattatttaaaatag

SEQ ID NO: 244642 - DNA, 15 bp, Homo sapiens
ttattatttaaaata

SEQ ID NO: 244643 - DNA, 15 bp, Homo sapiens
gttattatttaaaat

SEQ ID NO: 244644 - DNA, 15 bp, Homo sapiens
cgttattatttaaaa

SEQ ID NO: 244645 - DNA, 15 bp, Homo sapiens
acgttattatttaaa

SEQ ID NO: 244646 - DNA, 15 bp, Homo sapiens
aacgttattatttaa

SEQ ID NO: 244647 - DNA, 15 bp, Homo sapiens
aaacgttattattta

SEQ ID NO: 244648 - DNA, 15 bp, Homo sapiens
taaacgttattattt

SEQ ID NO: 244649 - DNA, 15 bp, Homo sapiens
ctaaacgttattatt

SEQ ID NO: 244650 - DNA, 15 bp, Homo sapiens
cctaaacgttattat

SEQ ID NO: 244651 - DNA, 15 bp, Homo sapiens
tcctaaacgttatta

SEQ ID NO: 244652 - DNA, 15 bp, Homo sapiens
gtcctaaacgttatt

SEQ ID NO: 244653 - DNA, 15 bp, Homo sapiens
agtcctaaacgttat

SEQ ID NO: 244654 - DNA, 15 bp, Homo sapiens
cagtcctaaacgtta

SEQ ID NO: 244655 - DNA, 15 bp, Homo sapiens
acagtcctaaacgtt

SEQ ID NO: 244656 - DNA, 15 bp, Homo sapiens
tacagtcctaaacgt

SEQ ID NO: 244657 - DNA, 15 bp, Homo sapiens
ctacagtcctaaacg

SEQ ID NO: 244658 - DNA, 15 bp, Homo sapiens
gctacagtcctaaac

SEQ ID NO: 244659 - DNA, 15 bp, Homo sapiens
tgctacagtcctaaa

SEQ ID NO: 244660 - DNA, 15 bp, Homo sapiens
atgctacagtcctaa

SEQ ID NO: 244661 - DNA, 15 bp, Homo sapiens
aatgctacagtccta

SEQ ID NO: 244662 - DNA, 15 bp, Homo sapiens
aaatgctacagtcct

SEQ ID NO: 244663 - DNA, 15 bp, Homo sapiens
taaatgctacagtcc

SEQ ID NO: 244664 - DNA, 15 bp, Homo sapiens
ttaaatgctacagtc

SEQ ID NO: 244665 - DNA, 15 bp, Homo sapiens
tttaaatgctacagt

SEQ ID NO: 244666 - DNA, 15 bp, Homo sapiens
ttttaaatgctacag

SEQ ID NO: 244667 - DNA, 15 bp, Homo sapiens
tttttaaatgctaca

SEQ ID NO: 244668 - DNA, 15 bp, Homo sapiens
ttttttaaatgctac

SEQ ID NO: 244669 - DNA, 15 bp, Homo sapiens
tttttttaaatgcta

SEQ ID NO: 244670 - DNA, 15 bp, Homo sapiens
atttttttaaatgct

SEQ ID NO: 244671 - DNA, 15 bp, Homo sapiens
gatttttttaaatgc

SEQ ID NO: 244672 - DNA, 15 bp, Homo sapiens
agatttttttaaatg

SEQ ID NO: 244673 - DNA, 15 bp, Homo sapiens
aagatttttttaaat

SEQ ID NO: 244674 - DNA, 15 bp, Homo sapiens
gaagatttttttaaa

SEQ ID NO: 244675 - DNA, 15 bp, Homo sapiens
agaagatttttttaa

SEQ ID NO: 244676 - DNA, 15 bp, Homo sapiens
gagaagattttttta

SEQ ID NO: 244677 - DNA, 15 bp, Homo sapiens
ggagaagattttttt

SEQ ID NO: 244678 - DNA, 15 bp, Homo sapiens
tggagaagatttttt

SEQ ID NO: 244679 - DNA, 15 bp, Homo sapiens
atggagaagattttt

SEQ ID NO: 244680 - DNA, 15 bp, Homo sapiens
gatggagaagatttt

SEQ ID NO: 244681 - DNA, 15 bp, Homo sapiens
tgatggagaagattt

SEQ ID NO: 244682 - DNA, 15 bp, Homo sapiens
gtgatggagaagatt

SEQ ID NO: 244683 - DNA, 15 bp, Homo sapiens
ggtgatggagaagat

SEQ ID NO: 244684 - DNA, 15 bp, Homo sapiens
tggtgatggagaaga

SEQ ID NO: 244685 - DNA, 15 bp, Homo sapiens
ctggtgatggagaag

SEQ ID NO: 244686 - DNA, 15 bp, Homo sapiens
actggtgatggagaa

SEQ ID NO: 244687 - DNA, 15 bp, Homo sapiens
tactggtgatggaga

SEQ ID NO: 244688 - DNA, 15 bp, Homo sapiens
ttactggtgatggag

SEQ ID NO: 244689 - DNA, 15 bp, Homo sapiens
tttactggtgatgga

SEQ ID NO: 244690 - DNA, 15 bp, Homo sapiens
ttttactggtgatgg

SEQ ID NO: 244691 - DNA, 15 bp, Homo sapiens
cttttactggtgatg

SEQ ID NO: 244692 - DNA, 15 bp, Homo sapiens
tcttttactggtgat

SEQ ID NO: 244693 - DNA, 15 bp, Homo sapiens
atcttttactggtga

SEQ ID NO: 244694 - DNA, 15 bp, Homo sapiens
gatcttttactggtg

SEQ ID NO: 244695 - DNA, 15 bp, Homo sapiens
tgatcttttactggt

SEQ ID NO: 244696 - DNA, 15 bp, Homo sapiens
ctgatcttttactgg

SEQ ID NO: 244697 - DNA, 15 bp, Homo sapiens
tctgatcttttactg

SEQ ID NO: 244698 - DNA, 15 bp, Homo sapiens
atctgatcttttact

SEQ ID NO: 244699 - DNA, 15 bp, Homo sapiens
aatctgatcttttac

SEQ ID NO: 244700 - DNA, 15 bp, Homo sapiens
caatctgatctttta

SEQ ID NO: 244701 - DNA, 15 bp, Homo sapiens
acaatctgatctttt

SEQ ID NO: 244702 - DNA, 15 bp, Homo sapiens
aacaatctgatcttt

SEQ ID NO: 244703 - DNA, 15 bp, Homo sapiens
aaacaatctgatctt

SEQ ID NO: 244704 - DNA, 15 bp, Homo sapiens
taaacaatctgatct

SEQ ID NO: 244705 - DNA, 15 bp, Homo sapiens
ttaaacaatctgatc

SEQ ID NO: 244706 - DNA, 15 bp, Homo sapiens
tttaaacaatctgat

SEQ ID NO: 244707 - DNA, 15 bp, Homo sapiens
ttttaaacaatctga

SEQ ID NO: 244708 - DNA, 15 bp, Homo sapiens
attttaaacaatctg

SEQ ID NO: 244709 - DNA, 15 bp, Homo sapiens
tattttaaacaatct

SEQ ID NO: 244710 - DNA, 15 bp, Homo sapiens
atattttaaacaatc

SEQ ID NO: 244711 - DNA, 15 bp, Homo sapiens
catatattttaaaca

SEQ ID NO: 244712 - DNA, 15 bp, Homo sapiens
acatatattttaaac

SEQ ID NO: 244713 - DNA, 15 bp, Homo sapiens
tacatatattttaaa

SEQ ID NO: 244714 - DNA, 15 bp, Homo sapiens
ctacatatattttaa

SEQ ID NO: 244715 - DNA, 15 bp, Homo sapiens
actacatatatttta

SEQ ID NO: 244716 - DNA, 15 bp, Homo sapiens
aactacatatatttt

SEQ ID NO: 244717 - DNA, 15 bp, Homo sapiens
aaactacatatattt

SEQ ID NO: 244718 - DNA, 15 bp, Homo sapiens
aaaactacatatatt

SEQ ID NO: 244719 - DNA, 15 bp, Homo sapiens
taaaactacatatat

SEQ ID NO: 244720 - DNA, 15 bp, Homo sapiens
ctaaaactacatata

SEQ ID NO: 244721 - DNA, 15 bp, Homo sapiens
actaaaactacatat

SEQ ID NO: 244722 - DNA, 15 bp, Homo sapiens
cactaaaactacata

SEQ ID NO: 244723 - DNA, 15 bp, Homo sapiens
acactaaaactacat

SEQ ID NO: 244724 - DNA, 15 bp, Homo sapiens
aacactaaaactaca

SEQ ID NO: 244725 - DNA, 15 bp, Homo sapiens
taacactaaaactac

SEQ ID NO: 244726 - DNA, 15 bp, Homo sapiens
ttaacactaaaacta

SEQ ID NO: 244727 - DNA, 15 bp, Homo sapiens
tttaacactaaaact

SEQ ID NO: 244728 - DNA, 15 bp, Homo sapiens
atttaacactaaaac

SEQ ID NO: 244729 - DNA, 15 bp, Homo sapiens
catttaacactaaaa

SEQ ID NO: 244730 - DNA, 15 bp, Homo sapiens
acatttaacactaaa

SEQ ID NO: 244731 - DNA, 15 bp, Homo sapiens
gacatttaacactaa

SEQ ID NO: 244732 - DNA, 15 bp, Homo sapiens
agacatttaacacta

SEQ ID NO: 244733 - DNA, 15 bp, Homo sapiens
aagacatttaacact

SEQ ID NO: 244734 - DNA, 15 bp, Homo sapiens
aaagacatttaacac

SEQ ID NO: 244735 - DNA, 15 bp, Homo sapiens
aaaagacatttaaca

SEQ ID NO: 244736 - DNA, 15 bp, Homo sapiens
taaaagacatttaac

SEQ ID NO: 244737 - DNA, 15 bp, Homo sapiens
ttaaaagacatttaa

SEQ ID NO: 244738 - DNA, 15 bp, Homo sapiens
cttaaaagacattta

SEQ ID NO: 244739 - DNA, 15 bp, Homo sapiens
acttaaaagacattt

SEQ ID NO: 244740 - DNA, 15 bp, Homo sapiens
gacttaaaagacatt

SEQ ID NO: 244741 - DNA, 15 bp, Homo sapiens
agacttaaaagacat

SEQ ID NO: 244742 - DNA, 15 bp, Homo sapiens
aagacttaaaagaca

SEQ ID NO: 244743 - DNA, 15 bp, Homo sapiens
gaagacttaaaagac

SEQ ID NO: 244744 - DNA, 15 bp, Homo sapiens
ggaagacttaaaaga

SEQ ID NO: 244745 - DNA, 15 bp, Homo sapiens
tggaagacttaaaag

SEQ ID NO: 244746 - DNA, 15 bp, Homo sapiens
ttggaagacttaaaa

SEQ ID NO: 244747 - DNA, 15 bp, Homo sapiens
tttggaagacttaaa

SEQ ID NO: 244748 - DNA, 15 bp, Homo sapiens
atttggaagacttaa

SEQ ID NO: 244749 - DNA, 15 bp, Homo sapiens
aatttggaagactta

SEQ ID NO: 244750 - DNA, 15 bp, Homo sapiens
aaatttggaagactt

SEQ ID NO: 244751 - DNA, 15 bp, Homo sapiens
aaaatttggaagact

SEQ ID NO: 244752 - DNA, 15 bp, Homo sapiens
aaaaatttggaagac

SEQ ID NO: 244753 - DNA, 15 bp, Homo sapiens
taaaaatttggaaga

SEQ ID NO: 244754 - DNA, 15 bp, Homo sapiens
ctaaaaatttggaag

SEQ ID NO: 244755 - DNA, 15 bp, Homo sapiens
tctaaaaatttggaa

SEQ ID NO: 244756 - DNA, 15 bp, Homo sapiens
ttctaaaaatttgga

SEQ ID NO: 244757 - DNA, 15 bp, Homo sapiens
tttctaaaaatttgg

SEQ ID NO: 244758 - DNA, 15 bp, Homo sapiens
atttctaaaaatttg

SEQ ID NO: 244759 - DNA, 15 bp, Homo sapiens
catttctaaaaattt

SEQ ID NO: 244760 - DNA, 15 bp, Homo sapiens
acatttctaaaaatt

SEQ ID NO: 244761 - DNA, 15 bp, Homo sapiens
cacatttctaaaaat

SEQ ID NO: 244762 - DNA, 15 bp, Homo sapiens
gcacatttctaaaaa

SEQ ID NO: 244763 - DNA, 15 bp, Homo sapiens
agcacatttctaaaa

SEQ ID NO: 244764 - DNA, 15 bp, Homo sapiens
gagcacatttctaaa

SEQ ID NO: 244765 - DNA, 15 bp, Homo sapiens
tgagcacatttctaa

SEQ ID NO: 244766 - DNA, 15 bp, Homo sapiens
atgagcacatttcta

SEQ ID NO: 244767 - DNA, 15 bp, Homo sapiens
aatgagcacatttct

SEQ ID NO: 244768 - DNA, 15 bp, Homo sapiens
aaatgagcacatttc

SEQ ID NO: 244769 - DNA, 15 bp, Homo sapiens
caaatgagcacattt

SEQ ID NO: 244770 - DNA, 15 bp, Homo sapiens
acaaatgagcacatt

SEQ ID NO: 244771 - DNA, 15 bp, Homo sapiens
tacaaatgagcacat

SEQ ID NO: 244772 - DNA, 15 bp, Homo sapiens
atacaaatgagcaca

SEQ ID NO: 244773 - DNA, 15 bp, Homo sapiens
tatacaaatgagcac

SEQ ID NO: 244774 - DNA, 15 bp, Homo sapiens
atatacaaatgagca

SEQ ID NO: 244775 - DNA, 15 bp, Homo sapiens
tatatacaaatgagc

SEQ ID NO: 244776 - DNA, 15 bp, Homo sapiens
ctatatacaaatgag

SEQ ID NO: 244777 - DNA, 15 bp, Homo sapiens
gctatatacaaatga

SEQ ID NO: 244778 - DNA, 15 bp, Homo sapiens
tgctatatacaaatg

SEQ ID NO: 244779 - DNA, 15 bp, Homo sapiens
ttgctatatacaaat

SEQ ID NO: 244780 - DNA, 15 bp, Homo sapiens
tttgctatatacaaa

SEQ ID NO: 244781 - DNA, 15 bp, Homo sapiens
atttgctatatacaa

SEQ ID NO: 244782 - DNA, 15 bp, Homo sapiens
aatttgctatataca

SEQ ID NO: 244783 - DNA, 15 bp, Homo sapiens
gaatttgctatatac

SEQ ID NO: 244784 - DNA, 15 bp, Homo sapiens
ggaatttgctatata

SEQ ID NO: 244785 - DNA, 15 bp, Homo sapiens
gggaatttgctatat

SEQ ID NO: 244786 - DNA, 15 bp, Homo sapiens
tgggaatttgctata

SEQ ID NO: 244787 - DNA, 15 bp, Homo sapiens
atgggaatttgctat

SEQ ID NO: 244788 - DNA, 15 bp, Homo sapiens
aatgggaatttgcta

SEQ ID NO: 244789 - DNA, 15 bp, Homo sapiens
aaatgggaatttgct

SEQ ID NO: 244790 - DNA, 15 bp, Homo sapiens
aaaatgggaatttgc

SEQ ID NO: 244791 - DNA, 15 bp, Homo sapiens
gaaaatgggaatttg

SEQ ID NO: 244792 - DNA, 15 bp, Homo sapiens
tgaaaatgggaattt

SEQ ID NO: 244793 - DNA, 15 bp, Homo sapiens
gtgaaaatgggaatt

SEQ ID NO: 244794 - DNA, 15 bp, Homo sapiens
tgtgaaaatgggaat

SEQ ID NO: 244795 - DNA, 15 bp, Homo sapiens
ttgtgaaaatgggaa

SEQ ID NO: 244796 - DNA, 15 bp, Homo sapiens
tttgtgaaaatggga

SEQ ID NO: 244797 - DNA, 15 bp, Homo sapiens
ttttgtgaaaatggg

SEQ ID NO: 244798 - DNA, 15 bp, Homo sapiens
gttttgtgaaaatgg

SEQ ID NO: 244799 - DNA, 15 bp, Homo sapiens
agttttgtgaaaatg

SEQ ID NO: 244800 - DNA, 15 bp, Homo sapiens
aagttttgtgaaaat

SEQ ID NO: 244801 - DNA, 15 bp, Homo sapiens
caagttttgtgaaaa

SEQ ID NO: 244802 - DNA, 15 bp, Homo sapiens
acaagttttgtgaaa

SEQ ID NO: 244803 - DNA, 15 bp, Homo sapiens
aacaagttttgtgaa

SEQ ID NO: 244804 - DNA, 15 bp, Homo sapiens
aaacaagttttgtga

SEQ ID NO: 244805 - DNA, 15 bp, Homo sapiens
taaacaagttttgtg

SEQ ID NO: 244806 - DNA, 15 bp, Homo sapiens
ttaaacaagttttgt

SEQ ID NO: 244807 - DNA, 15 bp, Homo sapiens
gttaaacaagttttg

SEQ ID NO: 244808 - DNA, 15 bp, Homo sapiens
ggttaaacaagtttt

SEQ ID NO: 244809 - DNA, 15 bp, Homo sapiens
tggttaaacaagttt

SEQ ID NO: 244810 - DNA, 15 bp, Homo sapiens
ctggttaaacaagtt

SEQ ID NO: 244811 - DNA, 15 bp, Homo sapiens
cctggttaaacaagt

SEQ ID NO: 244812 - DNA, 15 bp, Homo sapiens
tcctggttaaacaag

SEQ ID NO: 244813 - DNA, 15 bp, Homo sapiens
atcctggttaaacaa

SEQ ID NO: 244814 - DNA, 15 bp, Homo sapiens
gatcctggttaaaca

SEQ ID NO: 244815 - DNA, 15 bp, Homo sapiens
agatcctggttaaac

SEQ ID NO: 244816 - DNA, 15 bp, Homo sapiens
aagatcctggttaaa

SEQ ID NO: 244817 - DNA, 15 bp, Homo sapiens
aaagatcctggttaa

SEQ ID NO: 244818 - DNA, 15 bp, Homo sapiens
gaaagatcctggtta

SEQ ID NO: 244819 - DNA, 15 bp, Homo sapiens
tgaaagatcctggtt

SEQ ID NO: 244820 - DNA, 15 bp, Homo sapiens
atgaaagatcctggt

SEQ ID NO: 244821 - DNA, 15 bp, Homo sapiens
aatgaaagatcctgg

SEQ ID NO: 244822 - DNA, 15 bp, Homo sapiens
caatgaaagatcctg

SEQ ID NO: 244823 - DNA, 15 bp, Homo sapiens
acaatgaaagatcct

SEQ ID NO: 244824 - DNA, 15 bp, Homo sapiens
cacaatgaaagatcc

SEQ ID NO: 244825 - DNA, 15 bp, Homo sapiens
acacaatgaaagatc

SEQ ID NO: 244826 - DNA, 15 bp, Homo sapiens
tacacaatgaaagat

SEQ ID NO: 244827 - DNA, 15 bp, Homo sapiens
ttacacaatgaaaga

SEQ ID NO: 244828 - DNA, 15 bp, Homo sapiens
attacacaatgaaag

SEQ ID NO: 244829 - DNA, 15 bp, Homo sapiens
aattacacaatgaaa

SEQ ID NO: 244830 - DNA, 15 bp, Homo sapiens
aaattacacaatgaa

SEQ ID NO: 244831 - DNA, 15 bp, Homo sapiens
taaattacacaatga

SEQ ID NO: 244832 - DNA, 15 bp, Homo sapiens
ttaaattacacaatg

SEQ ID NO: 244833 - DNA, 15 bp, Homo sapiens
gttaaattacacaat

SEQ ID NO: 244834 - DNA, 15 bp, Homo sapiens
tgttaaattacacaa

SEQ ID NO: 244835 - DNA, 15 bp, Homo sapiens
ctgttaaattacaca

SEQ ID NO: 244836 - DNA, 15 bp, Homo sapiens
actgttaaattacac

SEQ ID NO: 244837 - DNA, 15 bp, Homo sapiens
aactgttaaattaca

SEQ ID NO: 244838 - DNA, 15 bp, Homo sapiens
aaactgttaaattac

SEQ ID NO: 244839 - DNA, 15 bp, Homo sapiens
taaactgttaaatta

SEQ ID NO: 244840 - DNA, 15 bp, Homo sapiens
ataaactgttaaatt

SEQ ID NO: 244841 - DNA, 15 bp, Homo sapiens
aataaactgttaaat

SEQ ID NO: 244842 - DNA, 15 bp, Homo sapiens
aaataaactgttaaa

SEQ ID NO: 244843 - DNA, 15 bp, Homo sapiens
gaaataaactgttaa

SEQ ID NO: 244844 - DNA, 15 bp, Homo sapiens
ggaaataaactgtta

SEQ ID NO: 244845 - DNA, 15 bp, Homo sapiens
aggaaataaactgtt

SEQ ID NO: 244846 - DNA, 15 bp, Homo sapiens
gaggaaataaactgt

SEQ ID NO: 244847 - DNA, 15 bp, Homo sapiens
tgaggaaataaactg

SEQ ID NO: 244848 - DNA, 15 bp, Homo sapiens
atgaggaaataaact

SEQ ID NO: 244849 - DNA, 15 bp, Homo sapiens
catgaggaaataaac

SEQ ID NO: 244850 - DNA, 15 bp, Homo sapiens
tcatgaggaaataaa

SEQ ID NO: 244851 - DNA, 15 bp, Homo sapiens
ttcatgaggaaataa

SEQ ID NO: 244852 - DNA, 15 bp, Homo sapiens
cttcatgaggaaata

SEQ ID NO: 244853 - DNA, 15 bp, Homo sapiens
tcttcatgaggaaat

SEQ ID NO: 244854 - DNA, 15 bp, Homo sapiens
ttcttcatgaggaaa

SEQ ID NO: 244855 - DNA, 15 bp, Homo sapiens
cttcttcatgaggaa

SEQ ID NO: 244856 - DNA, 15 bp, Homo sapiens
ccttcttcatgagga

SEQ ID NO: 244857 - DNA, 15 bp, Homo sapiens
tccttcttcatgagg

SEQ ID NO: 244858 - DNA, 15 bp, Homo sapiens
ttccttcttcatgag

SEQ ID NO: 244859 - DNA, 15 bp, Homo sapiens
gttccttcttcatga

SEQ ID NO: 244860 - DNA, 15 bp, Homo sapiens
tgttccttcttcatg

SEQ ID NO: 244861 - DNA, 15 bp, Homo sapiens
atgttccttcttcat

SEQ ID NO: 244862 - DNA, 15 bp, Homo sapiens
gatgttccttcttca

SEQ ID NO: 244863 - DNA, 15 bp, Homo sapiens
tgatgttccttcttc

SEQ ID NO: 244864 - DNA, 15 bp, Homo sapiens
ttgatgttccttctt

SEQ ID NO: 244865 - DNA, 15 bp, Homo sapiens
tttgatgttccttct

SEQ ID NO: 244866 - DNA, 15 bp, Homo sapiens
atttgatgttccttc

SEQ ID NO: 244867 - DNA, 15 bp, Homo sapiens
aatttgatgttcctt

SEQ ID NO: 244868 - DNA, 15 bp, Homo sapiens
gaatttgatgttcct

SEQ ID NO: 244869 - DNA, 15 bp, Homo sapiens
agaatttgatgttcc

SEQ ID NO: 244870 - DNA, 15 bp, Homo sapiens
cagaatttgatgttc

SEQ ID NO: 244871 - DNA, 15 bp, Homo sapiens
tcagaatttgatgtt

SEQ ID NO: 244872 - DNA, 15 bp, Homo sapiens
ttcagaatttgatgt

SEQ ID NO: 244873 - DNA, 15 bp, Homo sapiens
cttcagaatttgatg

SEQ ID NO: 244874 - DNA, 15 bp, Homo sapiens
ccttcagaatttgat

SEQ ID NO: 244875 - DNA, 15 bp, Homo sapiens
accttcagaatttga

SEQ ID NO: 244876 - DNA, 15 bp, Homo sapiens
taccttcagaatttg

SEQ ID NO: 244877 - DNA, 15 bp, Homo sapiens
ctaccttcagaattt

SEQ ID NO: 244878 - DNA, 15 bp, Homo sapiens
tctaccttcagaatt

SEQ ID NO: 244879 - DNA, 15 bp, Homo sapiens
ctctaccttcagaat

SEQ ID NO: 244880 - DNA, 15 bp, Homo sapiens
actctaccttcagaa

SEQ ID NO: 244881 - DNA, 15 bp, Homo sapiens
aactctaccttcaga

SEQ ID NO: 244882 - DNA, 15 bp, Homo sapiens
taactctaccttcag

SEQ ID NO: 244883 - DNA, 15 bp, Homo sapiens
ataactctaccttca

SEQ ID NO: 244884 - DNA, 15 bp, Homo sapiens
tataactctaccttc

SEQ ID NO: 244885 - DNA, 15 bp, Homo sapiens
ttataactctacctt

SEQ ID NO: 244886 - DNA, 15 bp, Homo sapiens
tttataactctacct

SEQ ID NO: 244887 - DNA, 15 bp, Homo sapiens
ttttataactctacc

SEQ ID NO: 244888 - DNA, 15 bp, Homo sapiens
cttttataactctac

SEQ ID NO: 244889 - DNA, 15 bp, Homo sapiens
gcttttataactcta

SEQ ID NO: 244890 - DNA, 15 bp, Homo sapiens
ggcttttataactct

SEQ ID NO: 244891 - DNA, 15 bp, Homo sapiens
tggcttttataactc

SEQ ID NO: 244892 - DNA, 15 bp, Homo sapiens
ctggcttttataact

SEQ ID NO: 244893 - DNA, 15 bp, Homo sapiens
actggcttttataac

SEQ ID NO: 244894 - DNA, 15 bp, Homo sapiens
tactggcttttataa

SEQ ID NO: 244895 - DNA, 15 bp, Homo sapiens
atactggcttttata

SEQ ID NO: 244896 - DNA, 15 bp, Homo sapiens
aatactggcttttat

SEQ ID NO: 244897 - DNA, 15 bp, Homo sapiens
aaatactggctttta

SEQ ID NO: 244898 - DNA, 15 bp, Homo sapiens
taaatactggctttt

SEQ ID NO: 244899 - DNA, 15 bp, Homo sapiens
ataaatactggcttt

SEQ ID NO: 244900 - DNA, 15 bp, Homo sapiens
cataaatactggctt

SEQ ID NO: 244901 - DNA, 15 bp, Homo sapiens
acataaatactggct

SEQ ID NO: 244902 - DNA, 15 bp, Homo sapiens
cacataaatactggc

SEQ ID NO: 244903 - DNA, 15 bp, Homo sapiens
acacataaatactgg

SEQ ID NO: 244904 - DNA, 15 bp, Homo sapiens
cacacataaatactg

SEQ ID NO: 244905 - DNA, 15 bp, Homo sapiens
tcacacataaatact

SEQ ID NO: 244906 - DNA, 15 bp, Homo sapiens
ttcacacataaatac

SEQ ID NO: 244907 - DNA, 15 bp, Homo sapiens
cttcacacataaata

SEQ ID NO: 244908 - DNA, 15 bp, Homo sapiens
tcttcacacataaat

SEQ ID NO: 244909 - DNA, 15 bp, Homo sapiens
ttcttcacacataaa

SEQ ID NO: 244910 - DNA, 15 bp, Homo sapiens
attcttcacacataa

SEQ ID NO: 244911 - DNA, 15 bp, Homo sapiens
aattcttcacacata

SEQ ID NO: 244912 - DNA, 15 bp, Homo sapiens
caattcttcacacat

SEQ ID NO: 244913 - DNA, 15 bp, Homo sapiens
acaattcttcacaca

SEQ ID NO: 244914 - DNA, 15 bp, Homo sapiens
aacaattcttcacac

SEQ ID NO: 244915 - DNA, 15 bp, Homo sapiens
taacaattcttcaca

SEQ ID NO: 244916 - DNA, 15 bp, Homo sapiens
ataacaattcttcac

SEQ ID NO: 244917 - DNA, 15 bp, Homo sapiens
cataacaattcttca

SEQ ID NO: 244918 - DNA, 15 bp, Homo sapiens
tcataacaattcttc

SEQ ID NO: 244919 - DNA, 15 bp, Homo sapiens
ttcataacaattctt

SEQ ID NO: 244920 - DNA, 15 bp, Homo sapiens
tttcataacaattct

SEQ ID NO: 244921 - DNA, 15 bp, Homo sapiens
ttttcataacaattc

SEQ ID NO: 244922 - DNA, 15 bp, Homo sapiens
gttttcataacaatt

SEQ ID NO: 244923 - DNA, 15 bp, Homo sapiens
tgttttcataacaat

SEQ ID NO: 244924 - DNA, 15 bp, Homo sapiens
ttgttttcataacaa

SEQ ID NO: 244925 - DNA, 15 bp, Homo sapiens
tttgttttcataaca

SEQ ID NO: 244926 - DNA, 15 bp, Homo sapiens
ttttgttttcataac

SEQ ID NO: 244927 - DNA, 15 bp, Homo sapiens
attttgttttcataa

SEQ ID NO: 244928 - DNA, 15 bp, Homo sapiens
aattttgttttcata

SEQ ID NO: 244929 - DNA, 15 bp, Homo sapiens
aaattttgttttcat

SEQ ID NO: 244930 - DNA, 15 bp, Homo sapiens
taaattttgttttca

SEQ ID NO: 244931 - DNA, 15 bp, Homo sapiens
ttaaattttgttttc

SEQ ID NO: 244932 - DNA, 15 bp, Homo sapiens
attaaattttgtttt

SEQ ID NO: 244933 - DNA, 15 bp, Homo sapiens
aattaaattttgttt

SEQ ID NO: 244934 - DNA, 15 bp, Homo sapiens
gaattaaattttgtt

SEQ ID NO: 244935 - DNA, 15 bp, Homo sapiens
ggaattaaattttgt

SEQ ID NO: 244936 - DNA, 15 bp, Homo sapiens
gggaattaaattttg

SEQ ID NO: 244937 - DNA, 15 bp, Homo sapiens
tgggaattaaatttt

SEQ ID NO: 244938 - DNA, 15 bp, Homo sapiens
ttgggaattaaattt

SEQ ID NO: 244939 - DNA, 15 bp, Homo sapiens
tttgggaattaaatt

SEQ ID NO: 244940 - DNA, 15 bp, Homo sapiens
atttgggaattaaat

SEQ ID NO: 244941 - DNA, 15 bp, Homo sapiens
aatttgggaattaaa

SEQ ID NO: 244942 - DNA, 15 bp, Homo sapiens
taatttgggaattaa

SEQ ID NO: 244943 - DNA, 15 bp, Homo sapiens
ttaatttgggaatta

SEQ ID NO: 244944 - DNA, 15 bp, Homo sapiens
attaatttgggaatt

SEQ ID NO: 244945 - DNA, 15 bp, Homo sapiens
tattaatttgggaat

SEQ ID NO: 244946 - DNA, 15 bp, Homo sapiens
ttattaatttgggaa

SEQ ID NO: 244947 - DNA, 15 bp, Homo sapiens
gttattaatttggga

SEQ ID NO: 244948 - DNA, 15 bp, Homo sapiens
ggttattaatttggg

SEQ ID NO: 244949 - DNA, 15 bp, Homo sapiens
tggttattaatttgg

SEQ ID NO: 244950 - DNA, 15 bp, Homo sapiens
ttggttattaatttg

SEQ ID NO: 244951 - DNA, 15 bp, Homo sapiens
cttggttattaattt

SEQ ID NO: 244952 - DNA, 15 bp, Homo sapiens
gcttggttattaatt

SEQ ID NO: 244953 - DNA, 15 bp, Homo sapiens
tgcttggttattaat

SEQ ID NO: 244954 - DNA, 15 bp, Homo sapiens
ttgcttggttattaa

SEQ ID NO: 244955 - DNA, 15 bp, Homo sapiens
tttgcttggttatta

SEQ ID NO: 244956 - DNA, 15 bp, Homo sapiens
atttgcttggttatt

SEQ ID NO: 244957 - DNA, 15 bp, Homo sapiens
catttgcttggttat

SEQ ID NO: 244958 - DNA, 15 bp, Homo sapiens
ccatttgcttggtta

SEQ ID NO: 244959 - DNA, 15 bp, Homo sapiens
tccatttgcttggtt

SEQ ID NO: 244960 - DNA, 15 bp, Homo sapiens
ctccatttgcttggt

SEQ ID NO: 244961 - DNA, 15 bp, Homo sapiens
tctccatttgcttgg

SEQ ID NO: 244962 - DNA, 15 bp, Homo sapiens
ttctccatttgcttg

SEQ ID NO: 244963 - DNA, 15 bp, Homo sapiens
attctccatttgctt

SEQ ID NO: 244964 - DNA, 15 bp, Homo sapiens
cattctccatttgct

SEQ ID NO: 244965 - DNA, 15 bp, Homo sapiens
tcattctccatttgc

SEQ ID NO: 244966 - DNA, 15 bp, Homo sapiens
ttcattctccatttg

SEQ ID NO: 244967 - DNA, 15 bp, Homo sapiens
tttcattctccattt

SEQ ID NO: 244968 - DNA, 15 bp, Homo sapiens
ttttcattctccatt

SEQ ID NO: 244969 - DNA, 15 bp, Homo sapiens
tttttcattctccat

SEQ ID NO: 244970 - DNA, 15 bp, Homo sapiens
ctttttcattctcca

SEQ ID NO: 244971 - DNA, 15 bp, Homo sapiens
gctttttcattctcc

SEQ ID NO: 244972 - DNA, 15 bp, Homo sapiens
agctttttcattctc

SEQ ID NO: 244973 - DNA, 15 bp, Homo sapiens
aagctttttcattct

SEQ ID NO: 244974 - DNA, 15 bp, Homo sapiens
aaagctttttcattc

SEQ ID NO: 244975 - DNA, 15 bp, Homo sapiens
aaaagctttttcatt

SEQ ID NO: 244976 - DNA, 15 bp, Homo sapiens
taaaagctttttcat

SEQ ID NO: 244977 - DNA, 15 bp, Homo sapiens
ttaaaagctttttca

SEQ ID NO: 244978 - DNA, 15 bp, Homo sapiens
attaaaagctttttc

SEQ ID NO: 244979 - DNA, 15 bp, Homo sapiens
tattaaaagcttttt

SEQ ID NO: 244980 - DNA, 15 bp, Homo sapiens
atattaaaagctttt

SEQ ID NO: 244981 - DNA, 15 bp, Homo sapiens
tatattaaaagcttt

SEQ ID NO: 244982 - DNA, 15 bp, Homo sapiens
gtatattaaaagctt

SEQ ID NO: 244983 - DNA, 15 bp, Homo sapiens
tgtatattaaaagct

SEQ ID NO: 244984 - DNA, 15 bp, Homo sapiens
gtgtatattaaaagc

SEQ ID NO: 244985 - DNA, 15 bp, Homo sapiens
agtgtatattaaaag

SEQ ID NO: 244986 - DNA, 15 bp, Homo sapiens
aagtgtatattaaaa

SEQ ID NO: 244987 - DNA, 15 bp, Homo sapiens
gaagtgtatattaaa

SEQ ID NO: 244988 - DNA, 15 bp, Homo sapiens
ggaagtgtatattaa

SEQ ID NO: 244989 - DNA, 15 bp, Homo sapiens
gggaagtgtatatta

SEQ ID NO: 244990 - DNA, 15 bp, Homo sapiens
agggaagtgtatatt

SEQ ID NO: 244991 - DNA, 15 bp, Homo sapiens
aagggaagtgtatat

SEQ ID NO: 244992 - DNA, 15 bp, Homo sapiens
aaagggaagtgtata

SEQ ID NO: 244993 - DNA, 15 bp, Homo sapiens
caaagggaagtgtat

SEQ ID NO: 244994 - DNA, 15 bp, Homo sapiens
gcaaagggaagtgta

SEQ ID NO: 244995 - DNA, 15 bp, Homo sapiens
cgcaaagggaagtgt

SEQ ID NO: 244996 - DNA, 15 bp, Homo sapiens
acgcaaagggaagtg

SEQ ID NO: 244997 - DNA, 15 bp, Homo sapiens
cacgcaaagggaagt

SEQ ID NO: 244998 - DNA, 15 bp, Homo sapiens
ccacgcaaagggaag

SEQ ID NO: 244999 - DNA, 15 bp, Homo sapiens
gccacgcaaagggaa

SEQ ID NO: 245000 - DNA, 15 bp, Homo sapiens
agccacgcaaaggga

SEQ ID NO: 245001 - DNA, 15 bp, Homo sapiens
aagccacgcaaaggg

SEQ ID NO: 245002 - DNA, 15 bp, Homo sapiens
gaagccacgcaaagg

SEQ ID NO: 245003 - DNA, 15 bp, Homo sapiens
tgaagccacgcaaag

SEQ ID NO: 245004 - DNA, 15 bp, Homo sapiens
ttgaagccacgcaaa

SEQ ID NO: 245005 - DNA, 15 bp, Homo sapiens
tttgaagccacgcaa

SEQ ID NO: 245006 - DNA, 15 bp, Homo sapiens
ttttgaagccacgca

SEQ ID NO: 245007 - DNA, 15 bp, Homo sapiens
cttttgaagccacgc

SEQ ID NO: 245008 - DNA, 15 bp, Homo sapiens
acttttgaagccacg

SEQ ID NO: 245009 - DNA, 15 bp, Homo sapiens
tacttttgaagccac

SEQ ID NO: 245010 - DNA, 15 bp, Homo sapiens
ctacttttgaagcca

SEQ ID NO: 245011 - DNA, 15 bp, Homo sapiens
tctacttttgaagcc

SEQ ID NO: 245012 - DNA, 15 bp, Homo sapiens
ttctacttttgaagc

SEQ ID NO: 245013 - DNA, 15 bp, Homo sapiens
cttctacttttgaag

SEQ ID NO: 245014 - DNA, 15 bp, Homo sapiens
tcttctacttttgaa

SEQ ID NO: 245015 - DNA, 15 bp, Homo sapiens
ttcttctacttttga

SEQ ID NO: 245016 - DNA, 15 bp, Homo sapiens
tttcttctacttttg

SEQ ID NO: 245017 - DNA, 15 bp, Homo sapiens
ttttcttctactttt

SEQ ID NO: 245018 - DNA, 15 bp, Homo sapiens
tttttcttctacttt

SEQ ID NO: 245019 - DNA, 15 bp, Homo sapiens
atttttcttctactt

SEQ ID NO: 245020 - DNA, 15 bp, Homo sapiens
catttttcttctact

SEQ ID NO: 245021 - DNA, 15 bp, Homo sapiens
acatttttcttctac

SEQ ID NO: 245022 - DNA, 15 bp, Homo sapiens
aacatttttcttcta

SEQ ID NO: 245023 - DNA, 15 bp, Homo sapiens
aaacatttttcttct

SEQ ID NO: 245024 - DNA, 15 bp, Homo sapiens
taaacatttttcttc

SEQ ID NO: 245025 - DNA, 15 bp, Homo sapiens
ttaaacatttttctt

SEQ ID NO: 245026 - DNA, 15 bp, Homo sapiens
tttaaacatttttct

SEQ ID NO: 245027 - DNA, 15 bp, Homo sapiens
ttttaaacatttttc

SEQ ID NO: 245028 - DNA, 15 bp, Homo sapiens
gttttaaacattttt

SEQ ID NO: 245029 - DNA, 15 bp, Homo sapiens
tgttttaaacatttt

SEQ ID NO: 245030 - DNA, 15 bp, Homo sapiens
ttgttttaaacattt

SEQ ID NO: 245031 - DNA, 15 bp, Homo sapiens
tttgttttaaacatt

SEQ ID NO: 245032 - DNA, 15 bp, Homo sapiens
atttgttttaaacat

SEQ ID NO: 245033 - DNA, 15 bp, Homo sapiens
aatttgttttaaaca

SEQ ID NO: 245034 - DNA, 15 bp, Homo sapiens
aaatttgttttaaac

SEQ ID NO: 245035 - DNA, 15 bp, Homo sapiens
aaaatttgttttaaa

SEQ ID NO: 245036 - DNA, 15 bp, Homo sapiens
caaaatttgttttaa

SEQ ID NO: 245037 - DNA, 15 bp, Homo sapiens
gcaaaatttgtttta

SEQ ID NO: 245038 - DNA, 15 bp, Homo sapiens
tgcaaaatttgtttt

SEQ ID NO: 245039 - DNA, 15 bp, Homo sapiens
atgcaaaatttgttt

SEQ ID NO: 245040 - DNA, 15 bp, Homo sapiens
catgcaaaatttgtt

SEQ ID NO: 245041 - DNA, 15 bp, Homo sapiens
tcatgcaaaatttgt

SEQ ID NO: 245042 - DNA, 15 bp, Homo sapiens
atcatgcaaaatttg

SEQ ID NO: 245043 - DNA, 15 bp, Homo sapiens
aatcatgcaaaattt

SEQ ID NO: 245044 - DNA, 15 bp, Homo sapiens
caatcatgcaaaatt

SEQ ID NO: 245045 - DNA, 15 bp, Homo sapiens
gcaatcatgcaaaat

SEQ ID NO: 245046 - DNA, 15 bp, Homo sapiens
ggcaatcatgcaaaa

SEQ ID NO: 245047 - DNA, 15 bp, Homo sapiens
tggcaatcatgcaaa

SEQ ID NO: 245048 - DNA, 15 bp, Homo sapiens
atggcaatcatgcaa

SEQ ID NO: 245049 - DNA, 15 bp, Homo sapiens
catggcaatcatgca

SEQ ID NO: 245050 - DNA, 15 bp, Homo sapiens
gcatggcaatcatgc

SEQ ID NO: 245051 - DNA, 15 bp, Homo sapiens
tgcatggcaatcatg

SEQ ID NO: 245052 - DNA, 15 bp, Homo sapiens
ttgcatggcaatcat

SEQ ID NO: 245053 - DNA, 15 bp, Homo sapiens
attgcatggcaatca

SEQ ID NO: 245054 - DNA, 15 bp, Homo sapiens
cattgcatggcaatc

SEQ ID NO: 245055 - DNA, 15 bp, Homo sapiens
tcattgcatggcaat

SEQ ID NO: 245056 - DNA, 15 bp, Homo sapiens
ctcattgcatggcaa

SEQ ID NO: 245057 - DNA, 15 bp, Homo sapiens
tctcattgcatggca

SEQ ID NO: 245058 - DNA, 15 bp, Homo sapiens
ttctcattgcatggc

SEQ ID NO: 245059 - DNA, 15 bp, Homo sapiens
attctcattgcatgg

SEQ ID NO: 245060 - DNA, 15 bp, Homo sapiens
aattctcattgcatg

SEQ ID NO: 245061 - DNA, 15 bp, Homo sapiens
aaattctcattgcat

SEQ ID NO: 245062 - DNA, 15 bp, Homo sapiens
gaaattctcattgca

SEQ ID NO: 245063 - DNA, 15 bp, Homo sapiens
ggaaattctcattgc

SEQ ID NO: 245064 - DNA, 15 bp, Homo sapiens
aggaaattctcattg

SEQ ID NO: 245065 - DNA, 15 bp, Homo sapiens
caggaaattctcatt

SEQ ID NO: 245066 - DNA, 15 bp, Homo sapiens
ccaggaaattctcat

SEQ ID NO: 245067 - DNA, 15 bp, Homo sapiens
tccaggaaattctca

SEQ ID NO: 245068 - DNA, 15 bp, Homo sapiens
ctccaggaaattctc

SEQ ID NO: 245069 - DNA, 15 bp, Homo sapiens
gctccaggaaattct

SEQ ID NO: 245070 - DNA, 15 bp, Homo sapiens
tgctccaggaaattc

SEQ ID NO: 245071 - DNA, 15 bp, Homo sapiens
ttgctccaggaaatt

SEQ ID NO: 245072 - DNA, 15 bp, Homo sapiens
tttgctccaggaaat

SEQ ID NO: 245073 - DNA, 15 bp, Homo sapiens
atttgctccaggaaa

SEQ ID NO: 245074 - DNA, 15 bp, Homo sapiens
aatttgctccaggaa

SEQ ID NO: 245075 - DNA, 15 bp, Homo sapiens
taatttgctccagga

SEQ ID NO: 245076 - DNA, 15 bp, Homo sapiens
ctaatttgctccagg

SEQ ID NO: 245077 - DNA, 15 bp, Homo sapiens
tctaatttgctccag

SEQ ID NO: 245078 - DNA, 15 bp, Homo sapiens
ttctaatttgctcca

SEQ ID NO: 245079 - DNA, 15 bp, Homo sapiens
attctaatttgctcc

SEQ ID NO: 245080 - DNA, 15 bp, Homo sapiens
cattctaatttgctc

SEQ ID NO: 245081 - DNA, 15 bp, Homo sapiens
acattctaatttgct

SEQ ID NO: 245082 - DNA, 15 bp, Homo sapiens
tacattctaatttgc

SEQ ID NO: 245083 - DNA, 15 bp, Homo sapiens
atacattctaatttg

SEQ ID NO: 245084 - DNA, 15 bp, Homo sapiens
tatacattctaattt

SEQ ID NO: 245085 - DNA, 15 bp, Homo sapiens
atatacattctaatt

SEQ ID NO: 245086 - DNA, 15 bp, Homo sapiens
catatacattctaat

SEQ ID NO: 245087 - DNA, 15 bp, Homo sapiens
ccatatacattctaa

SEQ ID NO: 245088 - DNA, 15 bp, Homo sapiens
gccatatacattcta

SEQ ID NO: 245089 - DNA, 15 bp, Homo sapiens
agccatatacattct

SEQ ID NO: 245090 - DNA, 15 bp, Homo sapiens
tagccatatacattc

SEQ ID NO: 245091 - DNA, 15 bp, Homo sapiens
ttagccatatacatt

SEQ ID NO: 245092 - DNA, 15 bp, Homo sapiens
gttagccatatacat

SEQ ID NO: 245093 - DNA, 15 bp, Homo sapiens
tgttagccatataca

SEQ ID NO: 245094 - DNA, 15 bp, Homo sapiens
ttgttagccatatac

SEQ ID NO: 245095 - DNA, 15 bp, Homo sapiens
tttgttagccatata

SEQ ID NO: 245096 - DNA, 15 bp, Homo sapiens
ttttgttagccatat

SEQ ID NO: 245097 - DNA, 15 bp, Homo sapiens
ttttttgttagccat

SEQ ID NO: 245098 - DNA, 15 bp, Homo sapiens
attttttgttagcca

SEQ ID NO: 245099 - DNA, 15 bp, Homo sapiens
tattttttgttagcc

SEQ ID NO: 245100 - DNA, 15 bp, Homo sapiens
ttattttttgttagc

SEQ ID NO: 245101 - DNA, 15 bp, Homo sapiens
attattttttgttag

SEQ ID NO: 245102 - DNA, 15 bp, Homo sapiens
tattattttttgtta

SEQ ID NO: 245103 - DNA, 15 bp, Homo sapiens
atattattttttgtt

SEQ ID NO: 245104 - DNA, 15 bp, Homo sapiens
aatattattttttgt

SEQ ID NO: 245105 - DNA, 15 bp, Homo sapiens
gaatattattttttg

SEQ ID NO: 245106 - DNA, 15 bp, Homo sapiens
tgaatattatttttt

SEQ ID NO: 245107 - DNA, 15 bp, Homo sapiens
ctgaatattattttt

SEQ ID NO: 245108 - DNA, 15 bp, Homo sapiens
cctgaatattatttt

SEQ ID NO: 245109 - DNA, 15 bp, Homo sapiens
acctgaatattattt

SEQ ID NO: 245110 - DNA, 15 bp, Homo sapiens
tacctgaatattatt

SEQ ID NO: 245111 - DNA, 15 bp, Homo sapiens
ctacctgaatattat

SEQ ID NO: 245112 - DNA, 15 bp, Homo sapiens
tctacctgaatatta

SEQ ID NO: 245113 - DNA, 15 bp, Homo sapiens
ttctacctgaatatt

SEQ ID NO: 245114 - DNA, 15 bp, Homo sapiens
tttctacctgaatat

SEQ ID NO: 245115 - DNA, 15 bp, Homo sapiens
atttctacctgaata

SEQ ID NO: 245116 - DNA, 15 bp, Homo sapiens
tatttctacctgaat

SEQ ID NO: 245117 - DNA, 15 bp, Homo sapiens
atatttctacctgaa

SEQ ID NO: 245118 - DNA, 15 bp, Homo sapiens
aatatttctacctga

SEQ ID NO: 245119 - DNA, 15 bp, Homo sapiens
gaatatttctacctg

SEQ ID NO: 245120 - DNA, 15 bp, Homo sapiens
tgaatatttctacct

SEQ ID NO: 245121 - DNA, 15 bp, Homo sapiens
ttgaatatttctacc

SEQ ID NO: 245122 - DNA, 15 bp, Homo sapiens
gttgaatatttctac

SEQ ID NO: 245123 - DNA, 15 bp, Homo sapiens
cgttgaatatttcta

SEQ ID NO: 245124 - DNA, 15 bp, Homo sapiens
acgttgaatatttct

SEQ ID NO: 245125 - DNA, 15 bp, Homo sapiens
aacgttgaatatttc

SEQ ID NO: 245126 - DNA, 15 bp, Homo sapiens
aaacgttgaatattt

SEQ ID NO: 245127 - DNA, 15 bp, Homo sapiens
aaaacgttgaatatt

SEQ ID NO: 245128 - DNA, 15 bp, Homo sapiens
aaaaacgttgaatat

SEQ ID NO: 245129 - DNA, 15 bp, Homo sapiens
caaaaacgttgaata

SEQ ID NO: 245130 - DNA, 15 bp, Homo sapiens
ccaaaaacgttgaat

SEQ ID NO: 245131 - DNA, 15 bp, Homo sapiens
accaaaaacgttgaa

SEQ ID NO: 245132 - DNA, 15 bp, Homo sapiens
caccaaaaacgttga

SEQ ID NO: 245133 - DNA, 15 bp, Homo sapiens
acaccaaaaacgttg

SEQ ID NO: 245134 - DNA, 15 bp, Homo sapiens
aacaccaaaaacgtt

SEQ ID NO: 245135 - DNA, 15 bp, Homo sapiens
aaacaccaaaaacgt

SEQ ID NO: 245136 - DNA, 15 bp, Homo sapiens
taaacaccaaaaacg

SEQ ID NO: 245137 - DNA, 15 bp, Homo sapiens
ttaaacaccaaaaac

SEQ ID NO: 245138 - DNA, 15 bp, Homo sapiens
cttaaacaccaaaaa

SEQ ID NO: 245139 - DNA, 15 bp, Homo sapiens
acttaaacaccaaaa

SEQ ID NO: 245140 - DNA, 15 bp, Homo sapiens
tacttaaacaccaaa

SEQ ID NO: 245141 - DNA, 15 bp, Homo sapiens
atacttaaacaccaa

SEQ ID NO: 245142 - DNA, 15 bp, Homo sapiens
tatacttaaacacca

SEQ ID NO: 245143 - DNA, 15 bp, Homo sapiens
atatacttaaacacc

SEQ ID NO: 245144 - DNA, 15 bp, Homo sapiens
gatatacttaaacac

SEQ ID NO: 245145 - DNA, 15 bp, Homo sapiens
tgatatacttaaaca

SEQ ID NO: 245146 - DNA, 15 bp, Homo sapiens
atgatatacttaaac

SEQ ID NO: 245147 - DNA, 15 bp, Homo sapiens
gatgatatacttaaa

SEQ ID NO: 245148 - DNA, 15 bp, Homo sapiens
agatgatatacttaa

SEQ ID NO: 245149 - DNA, 15 bp, Homo sapiens
aagatgatatactta

SEQ ID NO: 245150 - DNA, 15 bp, Homo sapiens
aaagatgatatactt

SEQ ID NO: 245151 - DNA, 15 bp, Homo sapiens
caaagatgatatact

SEQ ID NO: 245152 - DNA, 15 bp, Homo sapiens
acaaagatgatatac

SEQ ID NO: 245153 - DNA, 15 bp, Homo sapiens
tacaaagatgatata

SEQ ID NO: 245154 - DNA, 15 bp, Homo sapiens
atacaaagatgatat

SEQ ID NO: 245155 - DNA, 15 bp, Homo sapiens
aatacaaagatgata

SEQ ID NO: 245156 - DNA, 15 bp, Homo sapiens
gaatacaaagatgat

SEQ ID NO: 245157 - DNA, 15 bp, Homo sapiens
tgaatacaaagatga

SEQ ID NO: 245158 - DNA, 15 bp, Homo sapiens
gtgaatacaaagatg

SEQ ID NO: 245159 - DNA, 15 bp, Homo sapiens
agtgaatacaaagat

SEQ ID NO: 245160 - DNA, 15 bp, Homo sapiens
cagtgaatacaaaga

SEQ ID NO: 245161 - DNA, 15 bp, Homo sapiens
acagtgaatacaaag

SEQ ID NO: 245162 - DNA, 15 bp, Homo sapiens
aacagtgaatacaaa

SEQ ID NO: 245163 - DNA, 15 bp, Homo sapiens
taacagtgaatacaa

SEQ ID NO: 245164 - DNA, 15 bp, Homo sapiens
ctaacagtgaataca

SEQ ID NO: 245165 - DNA, 15 bp, Homo sapiens
tctaacagtgaatac

SEQ ID NO: 245166 - DNA, 15 bp, Homo sapiens
ttctaacagtgaata

SEQ ID NO: 245167 - DNA, 15 bp, Homo sapiens
attctaacagtgaat

SEQ ID NO: 245168 - DNA, 15 bp, Homo sapiens
tattctaacagtgaa

SEQ ID NO: 245169 - DNA, 15 bp, Homo sapiens
atattctaacagtga

SEQ ID NO: 245170 - DNA, 15 bp, Homo sapiens
catattctaacagtg

SEQ ID NO: 245171 - DNA, 15 bp, Homo sapiens
ccatattctaacagt

SEQ ID NO: 245172 - DNA, 15 bp, Homo sapiens
gccatattctaacag

SEQ ID NO: 245173 - DNA, 15 bp, Homo sapiens
ggccatattctaaca

SEQ ID NO: 245174 - DNA, 15 bp, Homo sapiens
tggccatattctaac

SEQ ID NO: 245175 - DNA, 15 bp, Homo sapiens
ctggccatattctaa

SEQ ID NO: 245176 - DNA, 15 bp, Homo sapiens
tctggccatattcta

SEQ ID NO: 245177 - DNA, 15 bp, Homo sapiens
ttctggccatattct

SEQ ID NO: 245178 - DNA, 15 bp, Homo sapiens
tttctggccatattc

SEQ ID NO: 245179 - DNA, 15 bp, Homo sapiens
ctttctggccatatt

SEQ ID NO: 245180 - DNA, 15 bp, Homo sapiens
actttctggccatat

SEQ ID NO: 245181 - DNA, 15 bp, Homo sapiens
aactttctggccata

SEQ ID NO: 245182 - DNA, 15 bp, Homo sapiens
caactttctggccat

SEQ ID NO: 245183 - DNA, 15 bp, Homo sapiens
tcaactttctggcca

SEQ ID NO: 245184 - DNA, 15 bp, Homo sapiens
ttcaactttctggcc

SEQ ID NO: 245185 - DNA, 15 bp, Homo sapiens
tttcaactttctggc

SEQ ID NO: 245186 - DNA, 15 bp, Homo sapiens
ctttcaactttctgg

SEQ ID NO: 245187 - DNA, 15 bp, Homo sapiens
cctttcaactttctg

SEQ ID NO: 245188 - DNA, 15 bp, Homo sapiens
tcctttcaactttct

SEQ ID NO: 245189 - DNA, 15 bp, Homo sapiens
ctcctttcaactttc

SEQ ID NO: 245190 - DNA, 15 bp, Homo sapiens
tctcctttcaacttt

SEQ ID NO: 245191 - DNA, 15 bp, Homo sapiens
gtctcctttcaactt

SEQ ID NO: 245192 - DNA, 15 bp, Homo sapiens
agtctcctttcaact

SEQ ID NO: 245193 - DNA, 15 bp, Homo sapiens
tagtctcctttcaac

SEQ ID NO: 245194 - DNA, 15 bp, Homo sapiens
ctagtctcctttcaa

SEQ ID NO: 245195 - DNA, 15 bp, Homo sapiens
cctagtctcctttca

SEQ ID NO: 245196 - DNA, 15 bp, Homo sapiens
tcctagtctcctttc

SEQ ID NO: 245197 - DNA, 15 bp, Homo sapiens
ttcctagtctccttt

SEQ ID NO: 245198 - DNA, 15 bp, Homo sapiens
cttcctagtctcctt

SEQ ID NO: 245199 - DNA, 15 bp, Homo sapiens
ccttcctagtctcct

SEQ ID NO: 245200 - DNA, 15 bp, Homo sapiens
cccttcctagtctcc

SEQ ID NO: 245201 - DNA, 15 bp, Homo sapiens
gcccttcctagtctc

SEQ ID NO: 245202 - DNA, 15 bp, Homo sapiens
tgcccttcctagtct

SEQ ID NO: 245203 - DNA, 15 bp, Homo sapiens
ttgcccttcctagtc

SEQ ID NO: 245204 - DNA, 15 bp, Homo sapiens
tttgcccttcctagt

SEQ ID NO: 245205 - DNA, 15 bp, Homo sapiens
atttgcccttcctag

SEQ ID NO: 245206 - DNA, 15 bp, Homo sapiens
aatttgcccttccta

SEQ ID NO: 245207 - DNA, 15 bp, Homo sapiens
taatttgcccttcct

SEQ ID NO: 245208 - DNA, 15 bp, Homo sapiens
ataatttgcccttcc

SEQ ID NO: 245209 - DNA, 15 bp, Homo sapiens
aataatttgcccttc

SEQ ID NO: 245210 - DNA, 15 bp, Homo sapiens
aaataatttgccctt

SEQ ID NO: 245211 - DNA, 15 bp, Homo sapiens
aaaataatttgccct

SEQ ID NO: 245212 - DNA, 15 bp, Homo sapiens
aaaaataatttgccc

SEQ ID NO: 245213 - DNA, 15 bp, Homo sapiens
taaaaataatttgcc

SEQ ID NO: 245214 - DNA, 15 bp, Homo sapiens
ataaaaataatttgc

SEQ ID NO: 245215 - DNA, 15 bp, Homo sapiens
cataaaaataatttg

SEQ ID NO: 245216 - DNA, 15 bp, Homo sapiens
acataaaaataattt

SEQ ID NO: 245217 - DNA, 15 bp, Homo sapiens
gacataaaaataatt

SEQ ID NO: 245218 - DNA, 15 bp, Homo sapiens
tgacataaaaataat

SEQ ID NO: 245219 - DNA, 15 bp, Homo sapiens
atgacataaaaataa

SEQ ID NO: 245220 - DNA, 15 bp, Homo sapiens
tatgacataaaaata

SEQ ID NO: 245221 - DNA, 15 bp, Homo sapiens
atatgacataaaaat

SEQ ID NO: 245222 - DNA, 15 bp, Homo sapiens
aatatgacataaaaa

SEQ ID NO: 245223 - DNA, 15 bp, Homo sapiens
taaaatatgacataa

SEQ ID NO: 245224 - DNA, 15 bp, Homo sapiens
ttaaaatatgacata

SEQ ID NO: 245225 - DNA, 15 bp, Homo sapiens
attaaaatatgacat

SEQ ID NO: 245226 - DNA, 15 bp, Homo sapiens
aattaaaatatgaca

SEQ ID NO: 245227 - DNA, 15 bp, Homo sapiens
aaattaaaatatgac

SEQ ID NO: 245228 - DNA, 15 bp, Homo sapiens
aaaattaaaatatga

SEQ ID NO: 245229 - DNA, 15 bp, Homo sapiens
taaaattaaaatatg

SEQ ID NO: 245230 - DNA, 15 bp, Homo sapiens
ataaaattaaaatat

SEQ ID NO: 245231 - DNA, 15 bp, Homo sapiens
tataaaattaaaata

SEQ ID NO: 245232 - DNA, 15 bp, Homo sapiens
ctataaaattaaaat

SEQ ID NO: 245233 - DNA, 15 bp, Homo sapiens
tctataaaattaaaa

SEQ ID NO: 245234 - DNA, 15 bp, Homo sapiens
atctataaaattaaa

SEQ ID NO: 245235 - DNA, 15 bp, Homo sapiens
gatctataaaattaa

SEQ ID NO: 245236 - DNA, 15 bp, Homo sapiens
tgatctataaaatta

SEQ ID NO: 245237 - DNA, 15 bp, Homo sapiens
gtgatctataaaatt

SEQ ID NO: 245238 - DNA, 15 bp, Homo sapiens
agtgatctataaaat

SEQ ID NO: 245239 - DNA, 15 bp, Homo sapiens
aagtgatctataaaa

SEQ ID NO: 245240 - DNA, 15 bp, Homo sapiens
taagtgatctataaa

SEQ ID NO: 245241 - DNA, 15 bp, Homo sapiens
ttaagtgatctataa

SEQ ID NO: 245242 - DNA, 15 bp, Homo sapiens
tttaagtgatctata

SEQ ID NO: 245243 - DNA, 15 bp, Homo sapiens
ctttaagtgatctat

SEQ ID NO: 245244 - DNA, 15 bp, Homo sapiens
gctttaagtgatcta

SEQ ID NO: 245245 - DNA, 15 bp, Homo sapiens
ggctttaagtgatct

SEQ ID NO: 245246 - DNA, 15 bp, Homo sapiens
gggctttaagtgatc

SEQ ID NO: 245247 - DNA, 15 bp, Homo sapiens
tgggctttaagtgat

SEQ ID NO: 245248 - DNA, 15 bp, Homo sapiens
gtgggctttaagtga

SEQ ID NO: 245249 - DNA, 15 bp, Homo sapiens
agtgggctttaagtg

SEQ ID NO: 245250 - DNA, 15 bp, Homo sapiens
aagtgggctttaagt

SEQ ID NO: 245251 - DNA, 15 bp, Homo sapiens
aaagtgggctttaag

SEQ ID NO: 245252 - DNA, 15 bp, Homo sapiens
caaagtgggctttaa

SEQ ID NO: 245253 - DNA, 15 bp, Homo sapiens
tcaaagtgggcttta

SEQ ID NO: 245254 - DNA, 15 bp, Homo sapiens
atcaaagtgggcttt

SEQ ID NO: 245255 - DNA, 15 bp, Homo sapiens
catcaaagtgggctt

SEQ ID NO: 245256 - DNA, 15 bp, Homo sapiens
ccatcaaagtgggct

SEQ ID NO: 245257 - DNA, 15 bp, Homo sapiens
gccatcaaagtgggc

SEQ ID NO: 245258 - DNA, 15 bp, Homo sapiens
agccatcaaagtggg

SEQ ID NO: 245259 - DNA, 15 bp, Homo sapiens
aagccatcaaagtgg

SEQ ID NO: 245260 - DNA, 15 bp, Homo sapiens
gaagccatcaaagtg

SEQ ID NO: 245261 - DNA, 15 bp, Homo sapiens
ggaagccatcaaagt

SEQ ID NO: 245262 - DNA, 15 bp, Homo sapiens
gggaagccatcaaag

SEQ ID NO: 245263 - DNA, 15 bp, Homo sapiens
tgggaagccatcaaa

SEQ ID NO: 245264 - DNA, 15 bp, Homo sapiens
gtgggaagccatcaa

SEQ ID NO: 245265 - DNA, 15 bp, Homo sapiens
agtgggaagccatca

SEQ ID NO: 245266 - DNA, 15 bp, Homo sapiens
cagtgggaagccatc

SEQ ID NO: 245267 - DNA, 15 bp, Homo sapiens
gcagtgggaagccat

SEQ ID NO: 245268 - DNA, 15 bp, Homo sapiens
tgcagtgggaagcca

SEQ ID NO: 245269 - DNA, 15 bp, Homo sapiens
atgcagtgggaagcc

SEQ ID NO: 245270 - DNA, 15 bp, Homo sapiens
aatgcagtgggaagc

SEQ ID NO: 245271 - DNA, 15 bp, Homo sapiens
aaatgcagtgggaag

SEQ ID NO: 245272 - DNA, 15 bp, Homo sapiens
gaaatgcagtgggaa

SEQ ID NO: 245273 - DNA, 15 bp, Homo sapiens
agaaatgcagtggga

SEQ ID NO: 245274 - DNA, 15 bp, Homo sapiens
cagaaatgcagtggg

SEQ ID NO: 245275 - DNA, 15 bp, Homo sapiens
acagaaatgcagtgg

SEQ ID NO: 245276 - DNA, 15 bp, Homo sapiens
gacagaaatgcagtg

SEQ ID NO: 245277 - DNA, 15 bp, Homo sapiens
agacagaaatgcagt

SEQ ID NO: 245278 - DNA, 15 bp, Homo sapiens
gagacagaaatgcag

SEQ ID NO: 245279 - DNA, 15 bp, Homo sapiens
agagacagaaatgca

SEQ ID NO: 245280 - DNA, 15 bp, Homo sapiens
gagagacagaaatgc

SEQ ID NO: 245281 - DNA, 15 bp, Homo sapiens
agagagacagaaatg

SEQ ID NO: 245282 - DNA, 15 bp, Homo sapiens
tagagagacagaaat

SEQ ID NO: 245283 - DNA, 15 bp, Homo sapiens
ctagagagacagaaa

SEQ ID NO: 245284 - DNA, 15 bp, Homo sapiens
cctagagagacagaa

SEQ ID NO: 245285 - DNA, 15 bp, Homo sapiens
acctagagagacaga

SEQ ID NO: 245286 - DNA, 15 bp, Homo sapiens
tacctagagagacag

SEQ ID NO: 245287 - DNA, 15 bp, Homo sapiens
ttacctagagagaca

SEQ ID NO: 245288 - DNA, 15 bp, Homo sapiens
attacctagagagac

SEQ ID NO: 245289 - DNA, 15 bp, Homo sapiens
aattacctagagaga

SEQ ID NO: 245290 - DNA, 15 bp, Homo sapiens
gaattacctagagag

SEQ ID NO: 245291 - DNA, 15 bp, Homo sapiens
ggaattacctagaga

SEQ ID NO: 245292 - DNA, 15 bp, Homo sapiens
aggaattacctagag

SEQ ID NO: 245293 - DNA, 15 bp, Homo sapiens
aaggaattacctaga

SEQ ID NO: 245294 - DNA, 15 bp, Homo sapiens
taaggaattacctag

SEQ ID NO: 245295 - DNA, 15 bp, Homo sapiens
ataaggaattaccta

SEQ ID NO: 245296 - DNA, 15 bp, Homo sapiens
aataaggaattacct

SEQ ID NO: 245297 - DNA, 15 bp, Homo sapiens
taataaggaattacc

SEQ ID NO: 245298 - DNA, 15 bp, Homo sapiens
ttaataaggaattac

SEQ ID NO: 245299 - DNA, 15 bp, Homo sapiens
attaataaggaatta

SEQ ID NO: 245300 - DNA, 15 bp, Homo sapiens
tattaataaggaatt

SEQ ID NO: 245301 - DNA, 15 bp, Homo sapiens
atattaataaggaat

SEQ ID NO: 245302 - DNA, 15 bp, Homo sapiens
aatattaataaggaa

SEQ ID NO: 245303 - DNA, 15 bp, Homo sapiens
aaatattaataagga

SEQ ID NO: 245304 - DNA, 15 bp, Homo sapiens
aaaatattaataagg

SEQ ID NO: 245305 - DNA, 15 bp, Homo sapiens
caaaatattaataag

SEQ ID NO: 245306 - DNA, 15 bp, Homo sapiens
tcaaaatattaataa

SEQ ID NO: 245307 - DNA, 15 bp, Homo sapiens
ttcaaaatattaata

SEQ ID NO: 245308 - DNA, 15 bp, Homo sapiens
cttcaaaatattaat

SEQ ID NO: 245309 - DNA, 15 bp, Homo sapiens
acttcaaaatattaa

SEQ ID NO: 245310 - DNA, 15 bp, Homo sapiens
cacttcaaaatatta

SEQ ID NO: 245311 - DNA, 15 bp, Homo sapiens
gcacttcaaaatatt

SEQ ID NO: 245312 - DNA, 15 bp, Homo sapiens
tgcacttcaaaatat

SEQ ID NO: 245313 - DNA, 15 bp, Homo sapiens
gtgcacttcaaaata

SEQ ID NO: 245314 - DNA, 15 bp, Homo sapiens
agtgcacttcaaaat

SEQ ID NO: 245315 - DNA, 15 bp, Homo sapiens
cagtgcacttcaaaa

SEQ ID NO: 245316 - DNA, 15 bp, Homo sapiens
gcagtgcacttcaaa

SEQ ID NO: 245317 - DNA, 15 bp, Homo sapiens
cgcagtgcacttcaa

SEQ ID NO: 245318 - DNA, 15 bp, Homo sapiens
ccgcagtgcacttca

SEQ ID NO: 245319 - DNA, 15 bp, Homo sapiens
accgcagtgcacttc

SEQ ID NO: 245320 - DNA, 15 bp, Homo sapiens
caccgcagtgcactt

SEQ ID NO: 245321 - DNA, 15 bp, Homo sapiens
ccaccgcagtgcact

SEQ ID NO: 245322 - DNA, 15 bp, Homo sapiens
gccaccgcagtgcac

SEQ ID NO: 245323 - DNA, 15 bp, Homo sapiens
agccaccgcagtgca

SEQ ID NO: 245324 - DNA, 15 bp, Homo sapiens
gagccaccgcagtgc

SEQ ID NO: 245325 - DNA, 15 bp, Homo sapiens
ggagccaccgcagtg

SEQ ID NO: 245326 - DNA, 15 bp, Homo sapiens
tggagccaccgcagt

SEQ ID NO: 245327 - DNA, 15 bp, Homo sapiens
atggagccaccgcag

SEQ ID NO: 245328 - DNA, 15 bp, Homo sapiens
catggagccaccgca

SEQ ID NO: 245329 - DNA, 15 bp, Homo sapiens
ccatggagccaccgc

SEQ ID NO: 245330 - DNA, 15 bp, Homo sapiens
gccatggagccaccg

SEQ ID NO: 245331 - DNA, 15 bp, Homo sapiens
agccatggagccacc

SEQ ID NO: 245332 - DNA, 15 bp, Homo sapiens
gagccatggagccac

SEQ ID NO: 245333 - DNA, 15 bp, Homo sapiens
tgagccatggagcca

SEQ ID NO: 245334 - DNA, 15 bp, Homo sapiens
atgagccatggagcc

SEQ ID NO: 245335 - DNA, 15 bp, Homo sapiens
catgagccatggagc

SEQ ID NO: 245336 - DNA, 15 bp, Homo sapiens
acatgagccatggag

SEQ ID NO: 245337 - DNA, 15 bp, Homo sapiens
cacatgagccatgga

SEQ ID NO: 245338 - DNA, 15 bp, Homo sapiens
acacatgagccatgg

SEQ ID NO: 245339 - DNA, 15 bp, Homo sapiens
aacacatgagccatg

SEQ ID NO: 245340 - DNA, 15 bp, Homo sapiens
aaacacatgagccat

SEQ ID NO: 245341 - DNA, 15 bp, Homo sapiens
caaacacatgagcca

SEQ ID NO: 245342 - DNA, 15 bp, Homo sapiens
acaaacacatgagcc

SEQ ID NO: 245343 - DNA, 15 bp, Homo sapiens
tacaaacacatgagc

SEQ ID NO: 245344 - DNA, 15 bp, Homo sapiens
ctacaaacacatgag

SEQ ID NO: 245345 - DNA, 15 bp, Homo sapiens
tctacaaacacatga

SEQ ID NO: 245346 - DNA, 15 bp, Homo sapiens
ttctacaaacacatg

SEQ ID NO: 245347 - DNA, 15 bp, Homo sapiens
tttctacaaacacat

SEQ ID NO: 245348 - DNA, 15 bp, Homo sapiens
ttttctacaaacaca

SEQ ID NO: 245349 - DNA, 15 bp, Homo sapiens
attttctacaaacac

SEQ ID NO: 245350 - DNA, 15 bp, Homo sapiens
cattttctacaaaca

SEQ ID NO: 245351 - DNA, 15 bp, Homo sapiens
tcattttctacaaac

SEQ ID NO: 245352 - DNA, 15 bp, Homo sapiens
ttcattttctacaaa

SEQ ID NO: 245353 - DNA, 15 bp, Homo sapiens
tttcattttctacaa

SEQ ID NO: 245354 - DNA, 15 bp, Homo sapiens
ctttcattttctaca

SEQ ID NO: 245355 - DNA, 15 bp, Homo sapiens
tctttcattttctac

SEQ ID NO: 245356 - DNA, 15 bp, Homo sapiens
ttctttcattttcta

SEQ ID NO: 245357 - DNA, 15 bp, Homo sapiens
attctttcattttct

SEQ ID NO: 245358 - DNA, 15 bp, Homo sapiens
tattctttcattttc

SEQ ID NO: 245359 - DNA, 15 bp, Homo sapiens
atattctttcatttt

SEQ ID NO: 245360 - DNA, 15 bp, Homo sapiens
tatattctttcattt

SEQ ID NO: 245361 - DNA, 15 bp, Homo sapiens
ttatattctttcatt

SEQ ID NO: 245362 - DNA, 15 bp, Homo sapiens
tttatattctttcat

SEQ ID NO: 245363 - DNA, 15 bp, Homo sapiens
atttatattctttca

SEQ ID NO: 245364 - DNA, 15 bp, Homo sapiens
gatttatattctttc

SEQ ID NO: 245365 - DNA, 15 bp, Homo sapiens
agatttatattcttt

SEQ ID NO: 245366 - DNA, 15 bp, Homo sapiens
cagatttatattctt

SEQ ID NO: 245367 - DNA, 15 bp, Homo sapiens
tcagatttatattct

SEQ ID NO: 245368 - DNA, 15 bp, Homo sapiens
ttcagatttatattc

SEQ ID NO: 245369 - DNA, 15 bp, Homo sapiens
gttcagatttatatt

SEQ ID NO: 245370 - DNA, 15 bp, Homo sapiens
agttcagatttatat

SEQ ID NO: 245371 - DNA, 15 bp, Homo sapiens
cagttcagatttata

SEQ ID NO: 245372 - DNA, 15 bp, Homo sapiens
tcagttcagatttat

SEQ ID NO: 245373 - DNA, 15 bp, Homo sapiens
ttcagttcagattta

SEQ ID NO: 245374 - DNA, 15 bp, Homo sapiens
tttcagttcagattt

SEQ ID NO: 245375 - DNA, 15 bp, Homo sapiens
ctttcagttcagatt

SEQ ID NO: 245376 - DNA, 15 bp, Homo sapiens
tctttcagttcagat

SEQ ID NO: 245377 - DNA, 15 bp, Homo sapiens
ctctttcagttcaga

SEQ ID NO: 245378 - DNA, 15 bp, Homo sapiens
actctttcagttcag

SEQ ID NO: 245379 - DNA, 15 bp, Homo sapiens
gactctttcagttca

SEQ ID NO: 245380 - DNA, 15 bp, Homo sapiens
agactctttcagttc

SEQ ID NO: 245381 - DNA, 15 bp, Homo sapiens
tagactctttcagtt

SEQ ID NO: 245382 - DNA, 15 bp, Homo sapiens
atagactctttcagt

SEQ ID NO: 245383 - DNA, 15 bp, Homo sapiens
tatagactctttcag

SEQ ID NO: 245384 - DNA, 15 bp, Homo sapiens
atatagactctttca

SEQ ID NO: 245385 - DNA, 15 bp, Homo sapiens
tatatagactctttc

SEQ ID NO: 245386 - DNA, 15 bp, Homo sapiens
ctatatagactcttt

SEQ ID NO: 245387 - DNA, 15 bp, Homo sapiens
actatatagactctt

SEQ ID NO: 245388 - DNA, 15 bp, Homo sapiens
tactatatagactct

SEQ ID NO: 245389 - DNA, 15 bp, Homo sapiens
atactatatagactc

SEQ ID NO: 245390 - DNA, 15 bp, Homo sapiens
tatactatatagact

SEQ ID NO: 245391 - DNA, 15 bp, Homo sapiens
ttatactatatagac

SEQ ID NO: 245392 - DNA, 15 bp, Homo sapiens
tttatactatataga

SEQ ID NO: 245393 - DNA, 15 bp, Homo sapiens
gtttatactatatag

SEQ ID NO: 245394 - DNA, 15 bp, Homo sapiens
ggtttatactatata

SEQ ID NO: 245395 - DNA, 15 bp, Homo sapiens
gggtttatactatat

SEQ ID NO: 245396 - DNA, 15 bp, Homo sapiens
ggggtttatactata

SEQ ID NO: 245397 - DNA, 15 bp, Homo sapiens
aggggtttatactat

SEQ ID NO: 245398 - DNA, 15 bp, Homo sapiens
gaggggtttatacta

SEQ ID NO: 245399 - DNA, 15 bp, Homo sapiens
agaggggtttatact

SEQ ID NO: 245400 - DNA, 15 bp, Homo sapiens
tagaggggtttatac

SEQ ID NO: 245401 - DNA, 15 bp, Homo sapiens
atagaggggtttata

SEQ ID NO: 245402 - DNA, 15 bp, Homo sapiens
aatagaggggtttat

SEQ ID NO: 245403 - DNA, 15 bp, Homo sapiens
aaatagaggggttta

SEQ ID NO: 245404 - DNA, 15 bp, Homo sapiens
caaatagaggggttt

SEQ ID NO: 245405 - DNA, 15 bp, Homo sapiens
acaaatagaggggtt

SEQ ID NO: 245406 - DNA, 15 bp, Homo sapiens
aacaaatagaggggt

SEQ ID NO: 245407 - DNA, 15 bp, Homo sapiens
caacaaatagagggg

SEQ ID NO: 245408 - DNA, 15 bp, Homo sapiens
tcaacaaatagaggg

SEQ ID NO: 245409 - DNA, 15 bp, Homo sapiens
atcaacaaatagagg

SEQ ID NO: 245410 - DNA, 15 bp, Homo sapiens
tatcaacaaatagag

SEQ ID NO: 245411 - DNA, 15 bp, Homo sapiens
atatcaacaaataga

SEQ ID NO: 245412 - DNA, 15 bp, Homo sapiens
gatatcaacaaatag

SEQ ID NO: 245413 - DNA, 15 bp, Homo sapiens
agatatcaacaaata

SEQ ID NO: 245414 - DNA, 15 bp, Homo sapiens
aagatatcaacaaat

SEQ ID NO: 245415 - DNA, 15 bp, Homo sapiens
taagatatcaacaaa

SEQ ID NO: 245416 - DNA, 15 bp, Homo sapiens
ttaagatatcaacaa

SEQ ID NO: 245417 - DNA, 15 bp, Homo sapiens
cttaagatatcaaca

SEQ ID NO: 245418 - DNA, 15 bp, Homo sapiens
acttaagatatcaac

SEQ ID NO: 245419 - DNA, 15 bp, Homo sapiens
aacttaagatatcaa

SEQ ID NO: 245420 - DNA, 15 bp, Homo sapiens
taacttaagatatca

SEQ ID NO: 245421 - DNA, 15 bp, Homo sapiens
ttaacttaagatatc

SEQ ID NO: 245422 - DNA, 15 bp, Homo sapiens
tttaacttaagatat

SEQ ID NO: 245423 - DNA, 15 bp, Homo sapiens
ttttaacttaagata

SEQ ID NO: 245424 - DNA, 15 bp, Homo sapiens
gttttaacttaagat

SEQ ID NO: 245425 - DNA, 15 bp, Homo sapiens
agttttaacttaaga

SEQ ID NO: 245426 - DNA, 15 bp, Homo sapiens
tagttttaacttaag

SEQ ID NO: 245427 - DNA, 15 bp, Homo sapiens
ctagttttaacttaa

SEQ ID NO: 245428 - DNA, 15 bp, Homo sapiens
actagttttaactta

SEQ ID NO: 245429 - DNA, 15 bp, Homo sapiens
gactagttttaactt

SEQ ID NO: 245430 - DNA, 15 bp, Homo sapiens
agactagttttaact

SEQ ID NO: 245431 - DNA, 15 bp, Homo sapiens
tagactagttttaac

SEQ ID NO: 245432 - DNA, 15 bp, Homo sapiens
atagactagttttaa

SEQ ID NO: 245433 - DNA, 15 bp, Homo sapiens
tatagactagtttta

SEQ ID NO: 245434 - DNA, 15 bp, Homo sapiens
atatagactagtttt

SEQ ID NO: 245435 - DNA, 15 bp, Homo sapiens
tatatagactagttt

SEQ ID NO: 245436 - DNA, 15 bp, Homo sapiens
ctatatagactagtt

SEQ ID NO: 245437 - DNA, 15 bp, Homo sapiens
actatatagactagt

SEQ ID NO: 245438 - DNA, 15 bp, Homo sapiens
tactatatagactag

SEQ ID NO: 245439 - DNA, 15 bp, Homo sapiens
atactatatagacta

SEQ ID NO: 245440 - DNA, 15 bp, Homo sapiens
atttatactatatag

SEQ ID NO: 245441 - DNA, 15 bp, Homo sapiens
gatttatactatata

SEQ ID NO: 245442 - DNA, 15 bp, Homo sapiens
ggatttatactatat

SEQ ID NO: 245443 - DNA, 15 bp, Homo sapiens
gggatttatactata

SEQ ID NO: 245444 - DNA, 15 bp, Homo sapiens
agggatttatactat

SEQ ID NO: 245445 - DNA, 15 bp, Homo sapiens
gagggatttatacta

SEQ ID NO: 245446 - DNA, 15 bp, Homo sapiens
agagggatttatact

SEQ ID NO: 245447 - DNA, 15 bp, Homo sapiens
tagagggatttatac

SEQ ID NO: 245448 - DNA, 15 bp, Homo sapiens
atagagggatttata

SEQ ID NO: 245449 - DNA, 15 bp, Homo sapiens
aatagagggatttat

SEQ ID NO: 245450 - DNA, 15 bp, Homo sapiens
aaatagagggattta

SEQ ID NO: 245451 - DNA, 15 bp, Homo sapiens
caaatagagggattt

SEQ ID NO: 245452 - DNA, 15 bp, Homo sapiens
acaaatagagggatt

SEQ ID NO: 245453 - DNA, 15 bp, Homo sapiens
aacaaatagagggat

SEQ ID NO: 245454 - DNA, 15 bp, Homo sapiens
taacaaatagaggga

SEQ ID NO: 245455 - DNA, 15 bp, Homo sapiens
ttaacaaatagaggg

SEQ ID NO: 245456 - DNA, 15 bp, Homo sapiens
attaacaaatagagg

SEQ ID NO: 245457 - DNA, 15 bp, Homo sapiens
tattaacaaatagag

SEQ ID NO: 245458 - DNA, 15 bp, Homo sapiens
atattaacaaataga

SEQ ID NO: 245459 - DNA, 15 bp, Homo sapiens
gatattaacaaatag

SEQ ID NO: 245460 - DNA, 15 bp, Homo sapiens
agatattaacaaata

SEQ ID NO: 245461 - DNA, 15 bp, Homo sapiens
aagatattaacaaat

SEQ ID NO: 245462 - DNA, 15 bp, Homo sapiens
taagatattaacaaa

SEQ ID NO: 245463 - DNA, 15 bp, Homo sapiens
ttaagatattaacaa

SEQ ID NO: 245464 - DNA, 15 bp, Homo sapiens
cttaagatattaaca

SEQ ID NO: 245465 - DNA, 15 bp, Homo sapiens
acttaagatattaac

SEQ ID NO: 245466 - DNA, 15 bp, Homo sapiens
aacttaagatattaa

SEQ ID NO: 245467 - DNA, 15 bp, Homo sapiens
taacttaagatatta

SEQ ID NO: 245468 - DNA, 15 bp, Homo sapiens
ttaacttaagatatt

SEQ ID NO: 245469 - DNA, 15 bp, Homo sapiens
gctatatagactagt

SEQ ID NO: 245470 - DNA, 15 bp, Homo sapiens
tgctatatagactag

SEQ ID NO: 245471 - DNA, 15 bp, Homo sapiens
atgctatatagacta

SEQ ID NO: 245472 - DNA, 15 bp, Homo sapiens
tatgctatatagact

SEQ ID NO: 245473 - DNA, 15 bp, Homo sapiens
ttatgctatatagac

SEQ ID NO: 245474 - DNA, 15 bp, Homo sapiens
tttatgctatataga

SEQ ID NO: 245475 - DNA, 15 bp, Homo sapiens
gtttatgctatatag

SEQ ID NO: 245476 - DNA, 15 bp, Homo sapiens
ggtttatgctatata

SEQ ID NO: 245477 - DNA, 15 bp, Homo sapiens
aggtttatgctatat

SEQ ID NO: 245478 - DNA, 15 bp, Homo sapiens
gaggtttatgctata

SEQ ID NO: 245479 - DNA, 15 bp, Homo sapiens
agaggtttatgctat

SEQ ID NO: 245480 - DNA, 15 bp, Homo sapiens
gagaggtttatgcta

SEQ ID NO: 245481 - DNA, 15 bp, Homo sapiens
agagaggtttatgct

SEQ ID NO: 245482 - DNA, 15 bp, Homo sapiens
tagagaggtttatgc

SEQ ID NO: 245483 - DNA, 15 bp, Homo sapiens
atagagaggtttatg

SEQ ID NO: 245484 - DNA, 15 bp, Homo sapiens
aatagagaggtttat

SEQ ID NO: 245485 - DNA, 15 bp, Homo sapiens
aaatagagaggttta

SEQ ID NO: 245486 - DNA, 15 bp, Homo sapiens
caaatagagaggttt

SEQ ID NO: 245487 - DNA, 15 bp, Homo sapiens
acaaatagagaggtt

SEQ ID NO: 245488 - DNA, 15 bp, Homo sapiens
aacaaatagagaggt

SEQ ID NO: 245489 - DNA, 15 bp, Homo sapiens
taacaaatagagagg

SEQ ID NO: 245490 - DNA, 15 bp, Homo sapiens
ttaacaaatagagag

SEQ ID NO: 245491 - DNA, 15 bp, Homo sapiens
attaacaaatagaga

SEQ ID NO: 245492 - DNA, 15 bp, Homo sapiens
attttaacttaagat

SEQ ID NO: 245493 - DNA, 15 bp, Homo sapiens
aattttaacttaaga

SEQ ID NO: 245494 - DNA, 15 bp, Homo sapiens
taattttaacttaag

SEQ ID NO: 245495 - DNA, 15 bp, Homo sapiens
ttaattttaacttaa

SEQ ID NO: 245496 - DNA, 15 bp, Homo sapiens
gttaattttaactta

SEQ ID NO: 245497 - DNA, 15 bp, Homo sapiens
tgttaattttaactt

SEQ ID NO: 245498 - DNA, 15 bp, Homo sapiens
atgttaattttaact

SEQ ID NO: 245499 - DNA, 15 bp, Homo sapiens
aatgttaattttaac

SEQ ID NO: 245500 - DNA, 15 bp, Homo sapiens
aaatgttaattttaa

SEQ ID NO: 245501 - DNA, 15 bp, Homo sapiens
caaatgttaatttta

SEQ ID NO: 245502 - DNA, 15 bp, Homo sapiens
tcaaatgttaatttt

SEQ ID NO: 245503 - DNA, 15 bp, Homo sapiens
ttcaaatgttaattt

SEQ ID NO: 245504 - DNA, 15 bp, Homo sapiens
tttcaaatgttaatt

SEQ ID NO: 245505 - DNA, 15 bp, Homo sapiens
ttttcaaatgttaat

SEQ ID NO: 245506 - DNA, 15 bp, Homo sapiens
attttcaaatgttaa

SEQ ID NO: 245507 - DNA, 15 bp, Homo sapiens
aattttcaaatgtta

SEQ ID NO: 245508 - DNA, 15 bp, Homo sapiens
aaattttcaaatgtt

SEQ ID NO: 245509 - DNA, 15 bp, Homo sapiens
aaaattttcaaatgt

SEQ ID NO: 245510 - DNA, 15 bp, Homo sapiens
taaaattttcaaatg

SEQ ID NO: 245511 - DNA, 15 bp, Homo sapiens
ataaaattttcaaat

SEQ ID NO: 245512 - DNA, 15 bp, Homo sapiens
aataaaattttcaaa

SEQ ID NO: 245513 - DNA, 15 bp, Homo sapiens
aaataaaattttcaa

SEQ ID NO: 245514 - DNA, 15 bp, Homo sapiens
caaataaaattttca

SEQ ID NO: 245515 - DNA, 15 bp, Homo sapiens
gcaaataaaattttc

SEQ ID NO: 245516 - DNA, 15 bp, Homo sapiens
agcaaataaaatttt

SEQ ID NO: 245517 - DNA, 15 bp, Homo sapiens
aagcaaataaaattt

SEQ ID NO: 245518 - DNA, 15 bp, Homo sapiens
gaagcaaataaaatt

SEQ ID NO: 245519 - DNA, 15 bp, Homo sapiens
ggaagcaaataaaat

SEQ ID NO: 245520 - DNA, 15 bp, Homo sapiens
aggaagcaaataaaa

SEQ ID NO: 245521 - DNA, 15 bp, Homo sapiens
gaggaagcaaataaa

SEQ ID NO: 245522 - DNA, 15 bp, Homo sapiens
agaggaagcaaataa

SEQ ID NO: 245523 - DNA, 15 bp, Homo sapiens
tagaggaagcaaata

SEQ ID NO: 245524 - DNA, 15 bp, Homo sapiens
ttagaggaagcaaat

SEQ ID NO: 245525 - DNA, 15 bp, Homo sapiens
cttagaggaagcaaa

SEQ ID NO: 245526 - DNA, 15 bp, Homo sapiens
ccttagaggaagcaa

SEQ ID NO: 245527 - DNA, 15 bp, Homo sapiens
accttagaggaagca

SEQ ID NO: 245528 - DNA, 15 bp, Homo sapiens
taccttagaggaagc

SEQ ID NO: 245529 - DNA, 15 bp, Homo sapiens
ctaccttagaggaag

SEQ ID NO: 245530 - DNA, 15 bp, Homo sapiens
tctaccttagaggaa

SEQ ID NO: 245531 - DNA, 15 bp, Homo sapiens
gtctaccttagagga

SEQ ID NO: 245532 - DNA, 15 bp, Homo sapiens
agtctaccttagagg

SEQ ID NO: 245533 - DNA, 15 bp, Homo sapiens
aagtctaccttagag

SEQ ID NO: 245534 - DNA, 15 bp, Homo sapiens
aaagtctaccttaga

SEQ ID NO: 245535 - DNA, 15 bp, Homo sapiens
gaaagtctaccttag

SEQ ID NO: 245536 - DNA, 15 bp, Homo sapiens
agaaagtctacctta

SEQ ID NO: 245537 - DNA, 15 bp, Homo sapiens
cagaaagtctacctt

SEQ ID NO: 245538 - DNA, 15 bp, Homo sapiens
tcagaaagtctacct

SEQ ID NO: 245539 - DNA, 15 bp, Homo sapiens
ttcagaaagtctacc

SEQ ID NO: 245540 - DNA, 15 bp, Homo sapiens
tttcagaaagtctac

SEQ ID NO: 245541 - DNA, 15 bp, Homo sapiens
gtttcagaaagtcta

SEQ ID NO: 245542 - DNA, 15 bp, Homo sapiens
agtttcagaaagtct

SEQ ID NO: 245543 - DNA, 15 bp, Homo sapiens
cagtttcagaaagtc

SEQ ID NO: 245544 - DNA, 15 bp, Homo sapiens
tcagtttcagaaagt

SEQ ID NO: 245545 - DNA, 15 bp, Homo sapiens
atcagtttcagaaag

SEQ ID NO: 245546 - DNA, 15 bp, Homo sapiens
gatcagtttcagaaa

SEQ ID NO: 245547 - DNA, 15 bp, Homo sapiens
agatcagtttcagaa

SEQ ID NO: 245548 - DNA, 15 bp, Homo sapiens
tagatcagtttcaga

SEQ ID NO: 245549 - DNA, 15 bp, Homo sapiens
ctagatcagtttcag

SEQ ID NO: 245550 - DNA, 15 bp, Homo sapiens
actagatcagtttca

SEQ ID NO: 245551 - DNA, 15 bp, Homo sapiens
aactagatcagtttc

SEQ ID NO: 245552 - DNA, 15 bp, Homo sapiens
taactagatcagttt

SEQ ID NO: 245553 - DNA, 15 bp, Homo sapiens
ataactagatcagtt

SEQ ID NO: 245554 - DNA, 15 bp, Homo sapiens
aataactagatcagt

SEQ ID NO: 245555 - DNA, 15 bp, Homo sapiens
aaataactagatcag

SEQ ID NO: 245556 - DNA, 15 bp, Homo sapiens
gaaataactagatca

SEQ ID NO: 245557 - DNA, 15 bp, Homo sapiens
agaaataactagatc

SEQ ID NO: 245558 - DNA, 15 bp, Homo sapiens
aagaaataactagat

SEQ ID NO: 245559 - DNA, 15 bp, Homo sapiens
aaagaaataactaga

SEQ ID NO: 245560 - DNA, 15 bp, Homo sapiens
aaaagaaataactag

SEQ ID NO: 245561 - DNA, 15 bp, Homo sapiens
aaaaagaaataacta

SEQ ID NO: 245562 - DNA, 15 bp, Homo sapiens
aaaaaagaaataact

SEQ ID NO: 245563 - DNA, 15 bp, Homo sapiens
gaaaaaagaaataac

SEQ ID NO: 245564 - DNA, 15 bp, Homo sapiens
ggaaaaaagaaataa

SEQ ID NO: 245565 - DNA, 15 bp, Homo sapiens
aggaaaaaagaaata

SEQ ID NO: 245566 - DNA, 15 bp, Homo sapiens
taggaaaaaagaaat

SEQ ID NO: 245567 - DNA, 15 bp, Homo sapiens
ctaggaaaaaagaaa

SEQ ID NO: 245568 - DNA, 15 bp, Homo sapiens
actaggaaaaaagaa

SEQ ID NO: 245569 - DNA, 15 bp, Homo sapiens
tactaggaaaaaaga

SEQ ID NO: 245570 - DNA, 15 bp, Homo sapiens
atactaggaaaaaag

SEQ ID NO: 245571 - DNA, 15 bp, Homo sapiens
tatactaggaaaaaa

SEQ ID NO: 245572 - DNA, 15 bp, Homo sapiens
ctatactaggaaaaa

SEQ ID NO: 245573 - DNA, 15 bp, Homo sapiens
actatactaggaaaa

SEQ ID NO: 245574 - DNA, 15 bp, Homo sapiens
cactatactaggaaa

SEQ ID NO: 245575 - DNA, 15 bp, Homo sapiens
gcactatactaggaa

SEQ ID NO: 245576 - DNA, 15 bp, Homo sapiens
tgcactatactagga

SEQ ID NO: 245577 - DNA, 15 bp, Homo sapiens
ttgcactatactagg

SEQ ID NO: 245578 - DNA, 15 bp, Homo sapiens
attgcactatactag

SEQ ID NO: 245579 - DNA, 15 bp, Homo sapiens
cattgcactatacta

SEQ ID NO: 245580 - DNA, 15 bp, Homo sapiens
tcattgcactatact

SEQ ID NO: 245581 - DNA, 15 bp, Homo sapiens
ctcattgcactatac

SEQ ID NO: 245582 - DNA, 15 bp, Homo sapiens
tctcattgcactata

SEQ ID NO: 245583 - DNA, 15 bp, Homo sapiens
ctctcattgcactat

SEQ ID NO: 245584 - DNA, 15 bp, Homo sapiens
gctctcattgcacta

SEQ ID NO: 245585 - DNA, 15 bp, Homo sapiens
agctctcattgcact

SEQ ID NO: 245586 - DNA, 15 bp, Homo sapiens
gagctctcattgcac

SEQ ID NO: 245587 - DNA, 15 bp, Homo sapiens
tgagctctcattgca

SEQ ID NO: 245588 - DNA, 15 bp, Homo sapiens
atgagctctcattgc

SEQ ID NO: 245589 - DNA, 15 bp, Homo sapiens
aatgagctctcattg

SEQ ID NO: 245590 - DNA, 15 bp, Homo sapiens
caatgagctctcatt

SEQ ID NO: 245591 - DNA, 15 bp, Homo sapiens
acaatgagctctcat

SEQ ID NO: 245592 - DNA, 15 bp, Homo sapiens
tacaatgagctctca

SEQ ID NO: 245593 - DNA, 15 bp, Homo sapiens
atacaatgagctctc

SEQ ID NO: 245594 - DNA, 15 bp, Homo sapiens
aatacaatgagctct

SEQ ID NO: 245595 - DNA, 15 bp, Homo sapiens
gaatacaatgagctc

SEQ ID NO: 245596 - DNA, 15 bp, Homo sapiens
tgaatacaatgagct

SEQ ID NO: 245597 - DNA, 15 bp, Homo sapiens
ctgaatacaatgagc

SEQ ID NO: 245598 - DNA, 15 bp, Homo sapiens
cctgaatacaatgag

SEQ ID NO: 245599 - DNA, 15 bp, Homo sapiens
ccctgaatacaatga

SEQ ID NO: 245600 - DNA, 15 bp, Homo sapiens
accctgaatacaatg

SEQ ID NO: 245601 - DNA, 15 bp, Homo sapiens
aaccctgaatacaat

SEQ ID NO: 245602 - DNA, 15 bp, Homo sapiens
aaaccctgaatacaa

SEQ ID NO: 245603 - DNA, 15 bp, Homo sapiens
taaaccctgaataca

SEQ ID NO: 245604 - DNA, 15 bp, Homo sapiens
ttaaaccctgaatac

SEQ ID NO: 245605 - DNA, 15 bp, Homo sapiens
cttaaaccctgaata

SEQ ID NO: 245606 - DNA, 15 bp, Homo sapiens
tcttaaaccctgaat

SEQ ID NO: 245607 - DNA, 15 bp, Homo sapiens
ttcttaaaccctgaa

SEQ ID NO: 245608 - DNA, 15 bp, Homo sapiens
gttcttaaaccctga

SEQ ID NO: 245609 - DNA, 15 bp, Homo sapiens
tgttcttaaaccctg

SEQ ID NO: 245610 - DNA, 15 bp, Homo sapiens
atgttcttaaaccct

SEQ ID NO: 245611 - DNA, 15 bp, Homo sapiens
aatgttcttaaaccc

SEQ ID NO: 245612 - DNA, 15 bp, Homo sapiens
aaatgttcttaaacc

SEQ ID NO: 245613 - DNA, 15 bp, Homo sapiens
taaatgttcttaaac

SEQ ID NO: 245614 - DNA, 15 bp, Homo sapiens
ttaaatgttcttaaa

SEQ ID NO: 245615 - DNA, 15 bp, Homo sapiens
tttaaatgttcttaa

SEQ ID NO: 245616 - DNA, 15 bp, Homo sapiens
ttttaaatgttctta

SEQ ID NO: 245617 - DNA, 15 bp, Homo sapiens
attttaaatgttctt

SEQ ID NO: 245618 - DNA, 15 bp, Homo sapiens
cattttaaatgttct

SEQ ID NO: 245619 - DNA, 15 bp, Homo sapiens
ccattttaaatgttc

SEQ ID NO: 245620 - DNA, 15 bp, Homo sapiens
cccattttaaatgtt

SEQ ID NO: 245621 - DNA, 15 bp, Homo sapiens
ccccattttaaatgt

SEQ ID NO: 245622 - DNA, 15 bp, Homo sapiens
gccccattttaaatg

SEQ ID NO: 245623 - DNA, 15 bp, Homo sapiens
ggccccattttaaat

SEQ ID NO: 245624 - DNA, 15 bp, Homo sapiens
cggccccattttaaa

SEQ ID NO: 245625 - DNA, 15 bp, Homo sapiens
ccggccccattttaa

SEQ ID NO: 245626 - DNA, 15 bp, Homo sapiens
cccggccccatttta

SEQ ID NO: 245627 - DNA, 15 bp, Homo sapiens
acccggccccatttt

SEQ ID NO: 245628 - DNA, 15 bp, Homo sapiens
cacccggccccattt

SEQ ID NO: 245629 - DNA, 15 bp, Homo sapiens
gcacccggccccatt

SEQ ID NO: 245630 - DNA, 15 bp, Homo sapiens
tgcacccggccccat

SEQ ID NO: 245631 - DNA, 15 bp, Homo sapiens
ctgcacccggcccca

SEQ ID NO: 245632 - DNA, 15 bp, Homo sapiens
agcatgagccactgc

SEQ ID NO: 245633 - DNA, 15 bp, Homo sapiens
aagcatgagccactg

SEQ ID NO: 245634 - DNA, 15 bp, Homo sapiens
taagcatgagccact

SEQ ID NO: 245635 - DNA, 15 bp, Homo sapiens
ataagcatgagccac

SEQ ID NO: 245636 - DNA, 15 bp, Homo sapiens
tataagcatgagcca

SEQ ID NO: 245637 - DNA, 15 bp, Homo sapiens
ttataagcatgagcc

SEQ ID NO: 245638 - DNA, 15 bp, Homo sapiens
attataagcatgagc

SEQ ID NO: 245639 - DNA, 15 bp, Homo sapiens
gattataagcatgag

SEQ ID NO: 245640 - DNA, 15 bp, Homo sapiens
ggattataagcatga

SEQ ID NO: 245641 - DNA, 15 bp, Homo sapiens
aggattataagcatg

SEQ ID NO: 245642 - DNA, 15 bp, Homo sapiens
taggattataagcat

SEQ ID NO: 245643 - DNA, 15 bp, Homo sapiens
ttaggattataagca

SEQ ID NO: 245644 - DNA, 15 bp, Homo sapiens
attaggattataagc

SEQ ID NO: 245645 - DNA, 15 bp, Homo sapiens
cattaggattataag

SEQ ID NO: 245646 - DNA, 15 bp, Homo sapiens
gcattaggattataa

SEQ ID NO: 245647 - DNA, 15 bp, Homo sapiens
agcattaggattata

SEQ ID NO: 245648 - DNA, 15 bp, Homo sapiens
aagcattaggattat

SEQ ID NO: 245649 - DNA, 15 bp, Homo sapiens
caagcattaggatta

SEQ ID NO: 245650 - DNA, 15 bp, Homo sapiens
ccaagcattaggatt

SEQ ID NO: 245651 - DNA, 15 bp, Homo sapiens
cccaagcattaggat

SEQ ID NO: 245652 - DNA, 15 bp, Homo sapiens
tcccaagcattagga

SEQ ID NO: 245653 - DNA, 15 bp, Homo sapiens
ctcccaagcattagg

SEQ ID NO: 245654 - DNA, 15 bp, Homo sapiens
cctcccaagcattag

SEQ ID NO: 245655 - DNA, 15 bp, Homo sapiens
gcctcccaagcatta

SEQ ID NO: 245656 - DNA, 15 bp, Homo sapiens
agcctcccaagcatt

SEQ ID NO: 245657 - DNA, 15 bp, Homo sapiens
cagcctcccaagcat

SEQ ID NO: 245658 - DNA, 15 bp, Homo sapiens
tcagcctcccaagca

SEQ ID NO: 245659 - DNA, 15 bp, Homo sapiens
ctcagcctcccaagc

SEQ ID NO: 245660 - DNA, 15 bp, Homo sapiens
acccgcctcagcctc

SEQ ID NO: 245661 - DNA, 15 bp, Homo sapiens
cacccgcctcagcct

SEQ ID NO: 245662 - DNA, 15 bp, Homo sapiens
aatccacccgcctca

SEQ ID NO: 245663 - DNA, 15 bp, Homo sapiens
agcaatccacccgcc

SEQ ID NO: 245664 - DNA, 15 bp, Homo sapiens
aagcaatccacccgc

SEQ ID NO: 245665 - DNA, 15 bp, Homo sapiens
caagcaatccacccg

SEQ ID NO: 245666 - DNA, 15 bp, Homo sapiens
gcaagcaatccaccc

SEQ ID NO: 245667 - DNA, 15 bp, Homo sapiens
ggcaagcaatccacc

SEQ ID NO: 245668 - DNA, 15 bp, Homo sapiens
gggcaagcaatccac

SEQ ID NO: 245669 - DNA, 15 bp, Homo sapiens
ggggcaagcaatcca

SEQ ID NO: 245670 - DNA, 15 bp, Homo sapiens
gggggcaagcaatcc

SEQ ID NO: 245671 - DNA, 15 bp, Homo sapiens
tgggggcaagcaatc

SEQ ID NO: 245672 - DNA, 15 bp, Homo sapiens
ctgggggcaagcaat

SEQ ID NO: 245673 - DNA, 15 bp, Homo sapiens
cctgggggcaagcaa

SEQ ID NO: 245674 - DNA, 15 bp, Homo sapiens
tcctgggggcaagca

SEQ ID NO: 245675 - DNA, 15 bp, Homo sapiens
ctcctgggggcaagc

SEQ ID NO: 245676 - DNA, 15 bp, Homo sapiens
actcctgggggcaag

SEQ ID NO: 245677 - DNA, 15 bp, Homo sapiens
aactcctgggggcaa

SEQ ID NO: 245678 - DNA, 15 bp, Homo sapiens
gaactcctgggggca

SEQ ID NO: 245679 - DNA, 15 bp, Homo sapiens
tgaactcctgggggc

SEQ ID NO: 245680 - DNA, 15 bp, Homo sapiens
ttgaactcctggggg

SEQ ID NO: 245681 - DNA, 15 bp, Homo sapiens
cttgaactcctgggg

SEQ ID NO: 245682 - DNA, 15 bp, Homo sapiens
tcttgaactcctggg

SEQ ID NO: 245683 - DNA, 15 bp, Homo sapiens
ctcaggctggtcttg

SEQ ID NO: 245684 - DNA, 15 bp, Homo sapiens
gctcaggctggtctt

SEQ ID NO: 245685 - DNA, 15 bp, Homo sapiens
tcatgttgctcaggc

SEQ ID NO: 245686 - DNA, 15 bp, Homo sapiens
gtcatgttgctcagg

SEQ ID NO: 245687 - DNA, 15 bp, Homo sapiens
tgtcatgttgctcag

SEQ ID NO: 245688 - DNA, 15 bp, Homo sapiens
ttgtcatgttgctca

SEQ ID NO: 245689 - DNA, 15 bp, Homo sapiens
tttgtcatgttgctc

SEQ ID NO: 245690 - DNA, 15 bp, Homo sapiens
ttttgtcatgttgct

SEQ ID NO: 245691 - DNA, 15 bp, Homo sapiens
gttttgtcatgttgc

SEQ ID NO: 245692 - DNA, 15 bp, Homo sapiens
ggttttgtcatgttg

SEQ ID NO: 245693 - DNA, 15 bp, Homo sapiens
gggttttgtcatgtt

SEQ ID NO: 245694 - DNA, 15 bp, Homo sapiens
ggggttttgtcatgt

SEQ ID NO: 245695 - DNA, 15 bp, Homo sapiens
tggggttttgtcatg

SEQ ID NO: 245696 - DNA, 15 bp, Homo sapiens
atggggttttgtcat

SEQ ID NO: 245697 - DNA, 15 bp, Homo sapiens
gatggggttttgtca

SEQ ID NO: 245698 - DNA, 15 bp, Homo sapiens
agatggggttttgtc

SEQ ID NO: 245699 - DNA, 15 bp, Homo sapiens
gagatggggttttgt

SEQ ID NO: 245700 - DNA, 15 bp, Homo sapiens
agagatggggttttg

SEQ ID NO: 245701 - DNA, 15 bp, Homo sapiens
tagagatggggtttt

SEQ ID NO: 245702 - DNA, 15 bp, Homo sapiens
ctaattttttgtaga

SEQ ID NO: 245703 - DNA, 15 bp, Homo sapiens
gctaattttttgtag

SEQ ID NO: 245704 - DNA, 15 bp, Homo sapiens
taccatgcccagcta

SEQ ID NO: 245705 - DNA, 15 bp, Homo sapiens
ttaccatgcccagct

SEQ ID NO: 245706 - DNA, 15 bp, Homo sapiens
gttaccatgcccagc

SEQ ID NO: 245707 - DNA, 15 bp, Homo sapiens
tgttaccatgcccag

SEQ ID NO: 245708 - DNA, 15 bp, Homo sapiens
atgttaccatgccca

SEQ ID NO: 245709 - DNA, 15 bp, Homo sapiens
catgttaccatgccc

SEQ ID NO: 245710 - DNA, 15 bp, Homo sapiens
gcatgttaccatgcc

SEQ ID NO: 245711 - DNA, 15 bp, Homo sapiens
cgcatgttaccatgc

SEQ ID NO: 245712 - DNA, 15 bp, Homo sapiens
gcgcatgttaccatg

SEQ ID NO: 245713 - DNA, 15 bp, Homo sapiens
ggcgcatgttaccat

SEQ ID NO: 245714 - DNA, 15 bp, Homo sapiens
aggcgcatgttacca

SEQ ID NO: 245715 - DNA, 15 bp, Homo sapiens
taggcgcatgttacc

SEQ ID NO: 245716 - DNA, 15 bp, Homo sapiens
ataggcgcatgttac

SEQ ID NO: 245717 - DNA, 15 bp, Homo sapiens
tataggcgcatgtta

SEQ ID NO: 245718 - DNA, 15 bp, Homo sapiens
ctataggcgcatgtt

SEQ ID NO: 245719 - DNA, 15 bp, Homo sapiens
actataggcgcatgt

SEQ ID NO: 245720 - DNA, 15 bp, Homo sapiens
gactataggcgcatg

SEQ ID NO: 245721 - DNA, 15 bp, Homo sapiens
ggactataggcgcat

SEQ ID NO: 245722 - DNA, 15 bp, Homo sapiens
tgctgggactatagg

SEQ ID NO: 245723 - DNA, 15 bp, Homo sapiens
ctgctgggactatag

SEQ ID NO: 245724 - DNA, 15 bp, Homo sapiens
actgctgggactata

SEQ ID NO: 245725 - DNA, 15 bp, Homo sapiens
gactgctgggactat

SEQ ID NO: 245726 - DNA, 15 bp, Homo sapiens
tgactgctgggacta

SEQ ID NO: 245727 - DNA, 15 bp, Homo sapiens
ctgactgctgggact

SEQ ID NO: 245728 - DNA, 15 bp, Homo sapiens
cctgactgctgggac

SEQ ID NO: 245729 - DNA, 15 bp, Homo sapiens
tcctgactgctggga

SEQ ID NO: 245730 - DNA, 15 bp, Homo sapiens
ctcctgactgctggg

SEQ ID NO: 245731 - DNA, 15 bp, Homo sapiens
cctcctgactgctgg

SEQ ID NO: 245732 - DNA, 15 bp, Homo sapiens
gcctcctgactgctg

SEQ ID NO: 245733 - DNA, 15 bp, Homo sapiens
agcctcctgactgct

SEQ ID NO: 245734 - DNA, 15 bp, Homo sapiens
cagcctcctgactgc

SEQ ID NO: 245735 - DNA, 15 bp, Homo sapiens
tcagcctcctgactg

SEQ ID NO: 245736 - DNA, 15 bp, Homo sapiens
ctcagcctcctgact

SEQ ID NO: 245737 - DNA, 15 bp, Homo sapiens
cctcagcctcctgac

SEQ ID NO: 245738 - DNA, 15 bp, Homo sapiens
acctcccgggctcaa

SEQ ID NO: 245739 - DNA, 15 bp, Homo sapiens
gacctcccgggctca

SEQ ID NO: 245740 - DNA, 15 bp, Homo sapiens
tgacctcccgggctc

SEQ ID NO: 245741 - DNA, 15 bp, Homo sapiens
ttgacctcccgggct

SEQ ID NO: 245742 - DNA, 15 bp, Homo sapiens
cttgacctcccgggc

SEQ ID NO: 245743 - DNA, 15 bp, Homo sapiens
tcttgacctcccggg

SEQ ID NO: 245744 - DNA, 15 bp, Homo sapiens
gtcttgacctcccgg

SEQ ID NO: 245745 - DNA, 15 bp, Homo sapiens
agtcttgacctcccg

SEQ ID NO: 245746 - DNA, 15 bp, Homo sapiens
cagtcttgacctccc

SEQ ID NO: 245747 - DNA, 15 bp, Homo sapiens
actgcagtcttgacc

SEQ ID NO: 245748 - DNA, 15 bp, Homo sapiens
cactgcagtcttgac

SEQ ID NO: 245749 - DNA, 15 bp, Homo sapiens
tcactgcagtcttga

SEQ ID NO: 245750 - DNA, 15 bp, Homo sapiens
ctcactgcagtcttg

SEQ ID NO: 245751 - DNA, 15 bp, Homo sapiens
gctcactgcagtctt

SEQ ID NO: 245752 - DNA, 15 bp, Homo sapiens
ggctcactgcagtct

SEQ ID NO: 245753 - DNA, 15 bp, Homo sapiens
tggctcactgcagtc

SEQ ID NO: 245754 - DNA, 15 bp, Homo sapiens
atggctcactgcagt

SEQ ID NO: 245755 - DNA, 15 bp, Homo sapiens
gatcatggctcactg

SEQ ID NO: 245756 - DNA, 15 bp, Homo sapiens
tgatcatggctcact

SEQ ID NO: 245757 - DNA, 15 bp, Homo sapiens
gtgatcatggctcac

SEQ ID NO: 245758 - DNA, 15 bp, Homo sapiens
tgtgatcatggctca

SEQ ID NO: 245759 - DNA, 15 bp, Homo sapiens
gtgtgatcatggctc

SEQ ID NO: 245760 - DNA, 15 bp, Homo sapiens
ggtgtgatcatggct

SEQ ID NO: 245761 - DNA, 15 bp, Homo sapiens
tggtgtgatcatggc

SEQ ID NO: 245762 - DNA, 15 bp, Homo sapiens
gtggtgtgatcatgg

SEQ ID NO: 245763 - DNA, 15 bp, Homo sapiens
agtggtgtgatcatg

SEQ ID NO: 245764 - DNA, 15 bp, Homo sapiens
cagtggtgtgatcat

SEQ ID NO: 245765 - DNA, 15 bp, Homo sapiens
tagtgcagtggtgtg

SEQ ID NO: 245766 - DNA, 15 bp, Homo sapiens
gtagtgcagtggtgt

SEQ ID NO: 245767 - DNA, 15 bp, Homo sapiens
tgtagtgcagtggtg

SEQ ID NO: 245768 - DNA, 15 bp, Homo sapiens
ctgtagtgcagtggt

SEQ ID NO: 245769 - DNA, 15 bp, Homo sapiens
actgtagtgcagtgg

SEQ ID NO: 245770 - DNA, 15 bp, Homo sapiens
gactgtagtgcagtg

SEQ ID NO: 245771 - DNA, 15 bp, Homo sapiens
agactgtagtgcagt

SEQ ID NO: 245772 - DNA, 15 bp, Homo sapiens
cagactgtagtgcag

SEQ ID NO: 245773 - DNA, 15 bp, Homo sapiens
ccagactgtagtgca

SEQ ID NO: 245774 - DNA, 15 bp, Homo sapiens
cccagactgtagtgc

SEQ ID NO: 245775 - DNA, 15 bp, Homo sapiens
gcccagactgtagtg

SEQ ID NO: 245776 - DNA, 15 bp, Homo sapiens
tgcccagactgtagt

SEQ ID NO: 245777 - DNA, 15 bp, Homo sapiens
ttgcccagactgtag

SEQ ID NO: 245778 - DNA, 15 bp, Homo sapiens
gttgcccagactgta

SEQ ID NO: 245779 - DNA, 15 bp, Homo sapiens
tgttgcccagactgt

SEQ ID NO: 245780 - DNA, 15 bp, Homo sapiens
ctgttgcccagactg

SEQ ID NO: 245781 - DNA, 15 bp, Homo sapiens
tctgttgcccagact

SEQ ID NO: 245782 - DNA, 15 bp, Homo sapiens
ctctgttgcccagac

SEQ ID NO: 245783 - DNA, 15 bp, Homo sapiens
actctgttgcccaga

SEQ ID NO: 245784 - DNA, 15 bp, Homo sapiens
ttcactctgttgccc

SEQ ID NO: 245785 - DNA, 15 bp, Homo sapiens
tttcactctgttgcc

SEQ ID NO: 245786 - DNA, 15 bp, Homo sapiens
gtttcactctgttgc

SEQ ID NO: 245787 - DNA, 15 bp, Homo sapiens
agtttcactctgttg

SEQ ID NO: 245788 - DNA, 15 bp, Homo sapiens
gagtttcactctgtt

SEQ ID NO: 245789 - DNA, 15 bp, Homo sapiens
agagtttcactctgt

SEQ ID NO: 245790 - DNA, 15 bp, Homo sapiens
cagagtttcactctg

SEQ ID NO: 245791 - DNA, 15 bp, Homo sapiens
ggagacagagtttca

SEQ ID NO: 245792 - DNA, 15 bp, Homo sapiens
aggagacagagtttc

SEQ ID NO: 245793 - DNA, 15 bp, Homo sapiens
aaggagacagagttt

SEQ ID NO: 245794 - DNA, 15 bp, Homo sapiens
taaggagacagagtt

SEQ ID NO: 245795 - DNA, 15 bp, Homo sapiens
ttaaggagacagagt

SEQ ID NO: 245796 - DNA, 15 bp, Homo sapiens
tttaaggagacagag

SEQ ID NO: 245797 - DNA, 15 bp, Homo sapiens
ttttaaggagacaga

SEQ ID NO: 245798 - DNA, 15 bp, Homo sapiens
tttttaaggagacag

SEQ ID NO: 245799 - DNA, 15 bp, Homo sapiens
ttttttaaggagaca

SEQ ID NO: 245800 - DNA, 15 bp, Homo sapiens
attttttaaggagac

SEQ ID NO: 245801 - DNA, 15 bp, Homo sapiens
tattttttaaggaga

SEQ ID NO: 245802 - DNA, 15 bp, Homo sapiens
ttattttttaaggag

SEQ ID NO: 245803 - DNA, 15 bp, Homo sapiens
attattttttaagga

SEQ ID NO: 245804 - DNA, 15 bp, Homo sapiens
tattattttttaagg

SEQ ID NO: 245805 - DNA, 15 bp, Homo sapiens
ttattattttttaag

SEQ ID NO: 245806 - DNA, 15 bp, Homo sapiens
attattattttttaa

SEQ ID NO: 245807 - DNA, 15 bp, Homo sapiens
tattattatttttta

SEQ ID NO: 245808 - DNA, 15 bp, Homo sapiens
ctttatttattatta

SEQ ID NO: 245809 - DNA, 15 bp, Homo sapiens
tctttatttattatt

SEQ ID NO: 245810 - DNA, 15 bp, Homo sapiens
ctctttatttattat

SEQ ID NO: 245811 - DNA, 15 bp, Homo sapiens
tctctttatttatta

SEQ ID NO: 245812 - DNA, 15 bp, Homo sapiens
ctctctttatttatt

SEQ ID NO: 245813 - DNA, 15 bp, Homo sapiens
tctctctttatttat

SEQ ID NO: 245814 - DNA, 15 bp, Homo sapiens
ctctctctttattta

SEQ ID NO: 245815 - DNA, 15 bp, Homo sapiens
tctctctctttattt

SEQ ID NO: 245816 - DNA, 15 bp, Homo sapiens
ctctctctctttatt

SEQ ID NO: 245817 - DNA, 15 bp, Homo sapiens
tctctctctctttat

SEQ ID NO: 245818 - DNA, 15 bp, Homo sapiens
ttctctctctcttta

SEQ ID NO: 245819 - DNA, 15 bp, Homo sapiens
ttttctctctctctt

SEQ ID NO: 245820 - DNA, 15 bp, Homo sapiens
tttttctctctctct

SEQ ID NO: 245821 - DNA, 15 bp, Homo sapiens
ctttttctctctctc

SEQ ID NO: 245822 - DNA, 15 bp, Homo sapiens
tctttttctctctct

SEQ ID NO: 245823 - DNA, 15 bp, Homo sapiens
ttctttttctctctc

SEQ ID NO: 245824 - DNA, 15 bp, Homo sapiens
tttctttttctctct

SEQ ID NO: 245825 - DNA, 15 bp, Homo sapiens
ttttctttttctctc

SEQ ID NO: 245826 - DNA, 15 bp, Homo sapiens
attttctttttctct

SEQ ID NO: 245827 - DNA, 15 bp, Homo sapiens
aattttctttttctc

SEQ ID NO: 245828 - DNA, 15 bp, Homo sapiens
aaattttctttttct

SEQ ID NO: 245829 - DNA, 15 bp, Homo sapiens
taaattttctttttc

SEQ ID NO: 245830 - DNA, 15 bp, Homo sapiens
ttaaattttcttttt

SEQ ID NO: 245831 - DNA, 15 bp, Homo sapiens
tttaaattttctttt

SEQ ID NO: 245832 - DNA, 15 bp, Homo sapiens
ttttaaattttcttt

SEQ ID NO: 245833 - DNA, 15 bp, Homo sapiens
attttaaattttctt

SEQ ID NO: 245834 - DNA, 15 bp, Homo sapiens
cattttaaattttct

SEQ ID NO: 245835 - DNA, 15 bp, Homo sapiens
ccattttaaattttc

SEQ ID NO: 245836 - DNA, 15 bp, Homo sapiens
accattttaaatttt

SEQ ID NO: 245837 - DNA, 15 bp, Homo sapiens
aaccattttaaattt

SEQ ID NO: 245838 - DNA, 15 bp, Homo sapiens
gaaccattttaaatt

SEQ ID NO: 245839 - DNA, 15 bp, Homo sapiens
agaaccattttaaat

SEQ ID NO: 245840 - DNA, 15 bp, Homo sapiens
aagaaccattttaaa

SEQ ID NO: 245841 - DNA, 15 bp, Homo sapiens
caagaaccattttaa

SEQ ID NO: 245842 - DNA, 15 bp, Homo sapiens
gcaagaaccatttta

SEQ ID NO: 245843 - DNA, 15 bp, Homo sapiens
agcaagaaccatttt

SEQ ID NO: 245844 - DNA, 15 bp, Homo sapiens
cagcaagaaccattt

SEQ ID NO: 245845 - DNA, 15 bp, Homo sapiens
gcagcaagaaccatt

SEQ ID NO: 245846 - DNA, 15 bp, Homo sapiens
ggcagcaagaaccat

SEQ ID NO: 245847 - DNA, 15 bp, Homo sapiens
aggcagcaagaacca

SEQ ID NO: 245848 - DNA, 15 bp, Homo sapiens
aaggcagcaagaacc

SEQ ID NO: 245849 - DNA, 15 bp, Homo sapiens
gaaggcagcaagaac

SEQ ID NO: 245850 - DNA, 15 bp, Homo sapiens
tgaaggcagcaagaa

SEQ ID NO: 245851 - DNA, 15 bp, Homo sapiens
gtgaaggcagcaaga

SEQ ID NO: 245852 - DNA, 15 bp, Homo sapiens
tgtgaaggcagcaag

SEQ ID NO: 245853 - DNA, 15 bp, Homo sapiens
ttgtgaaggcagcaa

SEQ ID NO: 245854 - DNA, 15 bp, Homo sapiens
attgtgaaggcagca

SEQ ID NO: 245855 - DNA, 15 bp, Homo sapiens
tattgtgaaggcagc

SEQ ID NO: 245856 - DNA, 15 bp, Homo sapiens
atattgtgaaggcag

SEQ ID NO: 245857 - DNA, 15 bp, Homo sapiens
tatattgtgaaggca

SEQ ID NO: 245858 - DNA, 15 bp, Homo sapiens
gtatattgtgaaggc

SEQ ID NO: 245859 - DNA, 15 bp, Homo sapiens
tgtatattgtgaagg

SEQ ID NO: 245860 - DNA, 15 bp, Homo sapiens
ttgtatattgtgaag

SEQ ID NO: 245861 - DNA, 15 bp, Homo sapiens
tttgtatattgtgaa

SEQ ID NO: 245862 - DNA, 15 bp, Homo sapiens
ttttgtatattgtga

SEQ ID NO: 245863 - DNA, 15 bp, Homo sapiens
tttttgtatattgtg

SEQ ID NO: 245864 - DNA, 15 bp, Homo sapiens
atttttgtatattgt

SEQ ID NO: 245865 - DNA, 15 bp, Homo sapiens
gatttttgtatattg

SEQ ID NO: 245866 - DNA, 15 bp, Homo sapiens
agatttttgtatatt

SEQ ID NO: 245867 - DNA, 15 bp, Homo sapiens
cagatttttgtatat

SEQ ID NO: 245868 - DNA, 15 bp, Homo sapiens
gcagatttttgtata

SEQ ID NO: 245869 - DNA, 15 bp, Homo sapiens
ggcagatttttgtat

SEQ ID NO: 245870 - DNA, 15 bp, Homo sapiens
tggcagatttttgta

SEQ ID NO: 245871 - DNA, 15 bp, Homo sapiens
atggcagatttttgt

SEQ ID NO: 245872 - DNA, 15 bp, Homo sapiens
tatggcagatttttg

SEQ ID NO: 245873 - DNA, 15 bp, Homo sapiens
ttatggcagattttt

SEQ ID NO: 245874 - DNA, 15 bp, Homo sapiens
tttatggcagatttt

SEQ ID NO: 245875 - DNA, 15 bp, Homo sapiens
ttttatggcagattt

SEQ ID NO: 245876 - DNA, 15 bp, Homo sapiens
cttttatggcagatt

SEQ ID NO: 245877 - DNA, 15 bp, Homo sapiens
gcttttatggcagat

SEQ ID NO: 245878 - DNA, 15 bp, Homo sapiens
ggcttttatggcaga

SEQ ID NO: 245879 - DNA, 15 bp, Homo sapiens
tggcttttatggcag

SEQ ID NO: 245880 - DNA, 15 bp, Homo sapiens
ctggcttttatggca

SEQ ID NO: 245881 - DNA, 15 bp, Homo sapiens
tctggcttttatggc

SEQ ID NO: 245882 - DNA, 15 bp, Homo sapiens
atctggcttttatgg

SEQ ID NO: 245883 - DNA, 15 bp, Homo sapiens
tatctggcttttatg

SEQ ID NO: 245884 - DNA, 15 bp, Homo sapiens
atatctggcttttat

SEQ ID NO: 245885 - DNA, 15 bp, Homo sapiens
gatatctggctttta

SEQ ID NO: 245886 - DNA, 15 bp, Homo sapiens
agatatctggctttt

SEQ ID NO: 245887 - DNA, 15 bp, Homo sapiens
gagatatctggcttt

SEQ ID NO: 245888 - DNA, 15 bp, Homo sapiens
agagatatctggctt

SEQ ID NO: 245889 - DNA, 15 bp, Homo sapiens
gagagatatctggct

SEQ ID NO: 245890 - DNA, 15 bp, Homo sapiens
tgagagatatctggc

SEQ ID NO: 245891 - DNA, 15 bp, Homo sapiens
atgagagatatctgg

SEQ ID NO: 245892 - DNA, 15 bp, Homo sapiens
aatgagagatatctg

SEQ ID NO: 245893 - DNA, 15 bp, Homo sapiens
caatgagagatatct

SEQ ID NO: 245894 - DNA, 15 bp, Homo sapiens
acaatgagagatatc

SEQ ID NO: 245895 - DNA, 15 bp, Homo sapiens
tacaatgagagatat

SEQ ID NO: 245896 - DNA, 15 bp, Homo sapiens
ttacaatgagagata

SEQ ID NO: 245897 - DNA, 15 bp, Homo sapiens
tttacaatgagagat

SEQ ID NO: 245898 - DNA, 15 bp, Homo sapiens
atttacaatgagaga

SEQ ID NO: 245899 - DNA, 15 bp, Homo sapiens
aatttacaatgagag

SEQ ID NO: 245900 - DNA, 15 bp, Homo sapiens
aaatttacaatgaga

SEQ ID NO: 245901 - DNA, 15 bp, Homo sapiens
aaaatttacaatgag

SEQ ID NO: 245902 - DNA, 15 bp, Homo sapiens
aaaaatttacaatga

SEQ ID NO: 245903 - DNA, 15 bp, Homo sapiens
caaaaatttacaatg

SEQ ID NO: 245904 - DNA, 15 bp, Homo sapiens
ccaaaaatttacaat

SEQ ID NO: 245905 - DNA, 15 bp, Homo sapiens
accaaaaatttacaa

SEQ ID NO: 245906 - DNA, 15 bp, Homo sapiens
aaccaaaaatttaca

SEQ ID NO: 245907 - DNA, 15 bp, Homo sapiens
taaccaaaaatttac

SEQ ID NO: 245908 - DNA, 15 bp, Homo sapiens
ataaccaaaaattta

SEQ ID NO: 245909 - DNA, 15 bp, Homo sapiens
cataaccaaaaattt

SEQ ID NO: 245910 - DNA, 15 bp, Homo sapiens
acataaccaaaaatt

SEQ ID NO: 245911 - DNA, 15 bp, Homo sapiens
tacataaccaaaaat

SEQ ID NO: 245912 - DNA, 15 bp, Homo sapiens
atacataaccaaaaa

SEQ ID NO: 245913 - DNA, 15 bp, Homo sapiens
aatacataaccaaaa

SEQ ID NO: 245914 - DNA, 15 bp, Homo sapiens
aaatacataaccaaa

SEQ ID NO: 245915 - DNA, 15 bp, Homo sapiens
aaaatacataaccaa

SEQ ID NO: 245916 - DNA, 15 bp, Homo sapiens
caaaatacataacca

SEQ ID NO: 245917 - DNA, 15 bp, Homo sapiens
gcaaaatacataacc

SEQ ID NO: 245918 - DNA, 15 bp, Homo sapiens
tgcaaaatacataac

SEQ ID NO: 245919 - DNA, 15 bp, Homo sapiens
gtgcaaaatacataa

SEQ ID NO: 245920 - DNA, 15 bp, Homo sapiens
tgtgcaaaatacata

SEQ ID NO: 245921 - DNA, 15 bp, Homo sapiens
ttgtgcaaaatacat

SEQ ID NO: 245922 - DNA, 15 bp, Homo sapiens
cttgtgcaaaataca

SEQ ID NO: 245923 - DNA, 15 bp, Homo sapiens
acttgtgcaaaatac

SEQ ID NO: 245924 - DNA, 15 bp, Homo sapiens
aacttgtgcaaaata

SEQ ID NO: 245925 - DNA, 15 bp, Homo sapiens
caacttgtgcaaaat

SEQ ID NO: 245926 - DNA, 15 bp, Homo sapiens
acaacttgtgcaaaa

SEQ ID NO: 245927 - DNA, 15 bp, Homo sapiens
aacaacttgtgcaaa

SEQ ID NO: 245928 - DNA, 15 bp, Homo sapiens
gaacaacttgtgcaa

SEQ ID NO: 245929 - DNA, 15 bp, Homo sapiens
tgaacaacttgtgca

SEQ ID NO: 245930 - DNA, 15 bp, Homo sapiens
atgaacaacttgtgc

SEQ ID NO: 245931 - DNA, 15 bp, Homo sapiens
aatgaacaacttgtg

SEQ ID NO: 245932 - DNA, 15 bp, Homo sapiens
aaatgaacaacttgt

SEQ ID NO: 245933 - DNA, 15 bp, Homo sapiens
gaaatgaacaacttg

SEQ ID NO: 245934 - DNA, 15 bp, Homo sapiens
ggaaatgaacaactt

SEQ ID NO: 245935 - DNA, 15 bp, Homo sapiens
aggaaatgaacaact

SEQ ID NO: 245936 - DNA, 15 bp, Homo sapiens
gaggaaatgaacaac

SEQ ID NO: 245937 - DNA, 15 bp, Homo sapiens
tgaggaaatgaacaa

SEQ ID NO: 245938 - DNA, 15 bp, Homo sapiens
ctgaggaaatgaaca

SEQ ID NO: 245939 - DNA, 15 bp, Homo sapiens
tctgaggaaatgaac

SEQ ID NO: 245940 - DNA, 15 bp, Homo sapiens
atctgaggaaatgaa

SEQ ID NO: 245941 - DNA, 15 bp, Homo sapiens
tatctgaggaaatga

SEQ ID NO: 245942 - DNA, 15 bp, Homo sapiens
ttatctgaggaaatg

SEQ ID NO: 245943 - DNA, 15 bp, Homo sapiens
tttatctgaggaaat

SEQ ID NO: 245944 - DNA, 15 bp, Homo sapiens
ttttatctgaggaaa

SEQ ID NO: 245945 - DNA, 15 bp, Homo sapiens
cttttatctgaggaa

SEQ ID NO: 245946 - DNA, 15 bp, Homo sapiens
acttttatctgagga

SEQ ID NO: 245947 - DNA, 15 bp, Homo sapiens
gacttttatctgagg

SEQ ID NO: 245948 - DNA, 15 bp, Homo sapiens
tgacttttatctgag

SEQ ID NO: 245949 - DNA, 15 bp, Homo sapiens
ttgacttttatctga

SEQ ID NO: 245950 - DNA, 15 bp, Homo sapiens
gttgacttttatctg

SEQ ID NO: 245951 - DNA, 15 bp, Homo sapiens
agttgacttttatct

SEQ ID NO: 245952 - DNA, 15 bp, Homo sapiens
aagttgacttttatc

SEQ ID NO: 245953 - DNA, 15 bp, Homo sapiens
gaagttgacttttat

SEQ ID NO: 245954 - DNA, 15 bp, Homo sapiens
ggaagttgactttta

SEQ ID NO: 245955 - DNA, 15 bp, Homo sapiens
tggaagttgactttt

SEQ ID NO: 245956 - DNA, 15 bp, Homo sapiens
ctggaagttgacttt

SEQ ID NO: 245957 - DNA, 15 bp, Homo sapiens
cctggaagttgactt

SEQ ID NO: 245958 - DNA, 15 bp, Homo sapiens
ccctggaagttgact

SEQ ID NO: 245959 - DNA, 15 bp, Homo sapiens
tccctggaagttgac

SEQ ID NO: 245960 - DNA, 15 bp, Homo sapiens
ttccctggaagttga

SEQ ID NO: 245961 - DNA, 15 bp, Homo sapiens
attccctggaagttg

SEQ ID NO: 245962 - DNA, 15 bp, Homo sapiens
tattccctggaagtt

SEQ ID NO: 245963 - DNA, 15 bp, Homo sapiens
atattccctggaagt

SEQ ID NO: 245964 - DNA, 15 bp, Homo sapiens
catattccctggaag

SEQ ID NO: 245965 - DNA, 15 bp, Homo sapiens
tcatattccctggaa

SEQ ID NO: 245966 - DNA, 15 bp, Homo sapiens
ctcatattccctgga

SEQ ID NO: 245967 - DNA, 15 bp, Homo sapiens
cctcatattccctgg

SEQ ID NO: 245968 - DNA, 15 bp, Homo sapiens
tcctcatattccctg

SEQ ID NO: 245969 - DNA, 15 bp, Homo sapiens
ttcctcatattccct

SEQ ID NO: 245970 - DNA, 15 bp, Homo sapiens
attcctcatattccc

SEQ ID NO: 245971 - DNA, 15 bp, Homo sapiens
tattcctcatattcc

SEQ ID NO: 245972 - DNA, 15 bp, Homo sapiens
ttattcctcatattc

SEQ ID NO: 245973 - DNA, 15 bp, Homo sapiens
cttattcctcatatt

SEQ ID NO: 245974 - DNA, 15 bp, Homo sapiens
tcttattcctcatat

SEQ ID NO: 245975 - DNA, 15 bp, Homo sapiens
ctcttattcctcata

SEQ ID NO: 245976 - DNA, 15 bp, Homo sapiens
cctcttattcctcat

SEQ ID NO: 245977 - DNA, 15 bp, Homo sapiens
tcctcttattcctca

SEQ ID NO: 245978 - DNA, 15 bp, Homo sapiens
ttcctcttattcctc

SEQ ID NO: 245979 - DNA, 15 bp, Homo sapiens
attcctcttattcct

SEQ ID NO: 245980 - DNA, 15 bp, Homo sapiens
cattcctcttattcc

SEQ ID NO: 245981 - DNA, 15 bp, Homo sapiens
tcattcctcttattc

SEQ ID NO: 245982 - DNA, 15 bp, Homo sapiens
ttcattcctcttatt

SEQ ID NO: 245983 - DNA, 15 bp, Homo sapiens
tttcattcctcttat

SEQ ID NO: 245984 - DNA, 15 bp, Homo sapiens
ctttcattcctctta

SEQ ID NO: 245985 - DNA, 15 bp, Homo sapiens
gctttcattcctctt

SEQ ID NO: 245986 - DNA, 15 bp, Homo sapiens
agctttcattcctct

SEQ ID NO: 245987 - DNA, 15 bp, Homo sapiens
aagctttcattcctc

SEQ ID NO: 245988 - DNA, 15 bp, Homo sapiens
aaagctttcattcct

SEQ ID NO: 245989 - DNA, 15 bp, Homo sapiens
caaagctttcattcc

SEQ ID NO: 245990 - DNA, 15 bp, Homo sapiens
ccaaagctttcattc

SEQ ID NO: 245991 - DNA, 15 bp, Homo sapiens
cccaaagctttcatt

SEQ ID NO: 245992 - DNA, 15 bp, Homo sapiens
acccaaagctttcat

SEQ ID NO: 245993 - DNA, 15 bp, Homo sapiens
aacccaaagctttca

SEQ ID NO: 245994 - DNA, 15 bp, Homo sapiens
gaacccaaagctttc

SEQ ID NO: 245995 - DNA, 15 bp, Homo sapiens
cgaacccaaagcttt

SEQ ID NO: 245996 - DNA, 15 bp, Homo sapiens
ccgaacccaaagctt

SEQ ID NO: 245997 - DNA, 15 bp, Homo sapiens
accgaacccaaagct

SEQ ID NO: 245998 - DNA, 15 bp, Homo sapiens
aaccgaacccaaagc

SEQ ID NO: 245999 - DNA, 15 bp, Homo sapiens
caaccgaacccaaag

SEQ ID NO: 246000 - DNA, 15 bp, Homo sapiens
tcaaccgaacccaaa

SEQ ID NO: 246001 - DNA, 15 bp, Homo sapiens
ttcaaccgaacccaa

SEQ ID NO: 246002 - DNA, 15 bp, Homo sapiens
gttcaaccgaaccca

SEQ ID NO: 246003 - DNA, 15 bp, Homo sapiens
agttcaaccgaaccc

SEQ ID NO: 246004 - DNA, 15 bp, Homo sapiens
aagttcaaccgaacc

SEQ ID NO: 246005 - DNA, 15 bp, Homo sapiens
aaagttcaaccgaac

SEQ ID NO: 246006 - DNA, 15 bp, Homo sapiens
gaaagttcaaccgaa

SEQ ID NO: 246007 - DNA, 15 bp, Homo sapiens
agaaagttcaaccga

SEQ ID NO: 246008 - DNA, 15 bp, Homo sapiens
aagaaagttcaaccg

SEQ ID NO: 246009 - DNA, 15 bp, Homo sapiens
taagaaagttcaacc

SEQ ID NO: 246010 - DNA, 15 bp, Homo sapiens
ttaagaaagttcaac

SEQ ID NO: 246011 - DNA, 15 bp, Homo sapiens
attaagaaagttcaa

SEQ ID NO: 246012 - DNA, 15 bp, Homo sapiens
cattaagaaagttca

SEQ ID NO: 246013 - DNA, 15 bp, Homo sapiens
gcattaagaaagttc

SEQ ID NO: 246014 - DNA, 15 bp, Homo sapiens
tgcattaagaaagtt

SEQ ID NO: 246015 - DNA, 15 bp, Homo sapiens
atgcattaagaaagt

SEQ ID NO: 246016 - DNA, 15 bp, Homo sapiens
gatgcattaagaaag

SEQ ID NO: 246017 - DNA, 15 bp, Homo sapiens
tgatgcattaagaaa

SEQ ID NO: 246018 - DNA, 15 bp, Homo sapiens
gtgatgcattaagaa

SEQ ID NO: 246019 - DNA, 15 bp, Homo sapiens
tgtgatgcattaaga

SEQ ID NO: 246020 - DNA, 15 bp, Homo sapiens
atgtgatgcattaag

SEQ ID NO: 246021 - DNA, 15 bp, Homo sapiens
aatgtgatgcattaa

SEQ ID NO: 246022 - DNA, 15 bp, Homo sapiens
taatgtgatgcatta

SEQ ID NO: 246023 - DNA, 15 bp, Homo sapiens
ttaatgtgatgcatt

SEQ ID NO: 246024 - DNA, 15 bp, Homo sapiens
gttaatgtgatgcat

SEQ ID NO: 246025 - DNA, 15 bp, Homo sapiens
ggttaatgtgatgca

SEQ ID NO: 246026 - DNA, 15 bp, Homo sapiens
tggttaatgtgatgc

SEQ ID NO: 246027 - DNA, 15 bp, Homo sapiens
atggttaatgtgatg

SEQ ID NO: 246028 - DNA, 15 bp, Homo sapiens
catggttaatgtgat

SEQ ID NO: 246029 - DNA, 15 bp, Homo sapiens
acatggttaatgtga

SEQ ID NO: 246030 - DNA, 15 bp, Homo sapiens
tacatggttaatgtg

SEQ ID NO: 246031 - DNA, 15 bp, Homo sapiens
ttacatggttaatgt

SEQ ID NO: 246032 - DNA, 15 bp, Homo sapiens
tttacatggttaatg

SEQ ID NO: 246033 - DNA, 15 bp, Homo sapiens
ttttacatggttaat

SEQ ID NO: 246034 - DNA, 15 bp, Homo sapiens
attttacatggttaa

SEQ ID NO: 246035 - DNA, 15 bp, Homo sapiens
aattttacatggtta

SEQ ID NO: 246036 - DNA, 15 bp, Homo sapiens
gaattttacatggtt

SEQ ID NO: 246037 - DNA, 15 bp, Homo sapiens
tgaattttacatggt

SEQ ID NO: 246038 - DNA, 15 bp, Homo sapiens
gtgaattttacatgg

SEQ ID NO: 246039 - DNA, 15 bp, Homo sapiens
ggtgaattttacatg

SEQ ID NO: 246040 - DNA, 15 bp, Homo sapiens
tggtgaattttacat

SEQ ID NO: 246041 - DNA, 15 bp, Homo sapiens
atggtgaattttaca

SEQ ID NO: 246042 - DNA, 15 bp, Homo sapiens
aatggtgaattttac

SEQ ID NO: 246043 - DNA, 15 bp, Homo sapiens
aaatggtgaatttta

SEQ ID NO: 246044 - DNA, 15 bp, Homo sapiens
gaaatggtgaatttt

SEQ ID NO: 246045 - DNA, 15 bp, Homo sapiens
agaaatggtgaattt

SEQ ID NO: 246046 - DNA, 15 bp, Homo sapiens
gagaaatggtgaatt

SEQ ID NO: 246047 - DNA, 15 bp, Homo sapiens
tgagaaatggtgaat

SEQ ID NO: 246048 - DNA, 15 bp, Homo sapiens
ctgagaaatggtgaa

SEQ ID NO: 246049 - DNA, 15 bp, Homo sapiens
actgagaaatggtga

SEQ ID NO: 246050 - DNA, 15 bp, Homo sapiens
aactgagaaatggtg

SEQ ID NO: 246051 - DNA, 15 bp, Homo sapiens
aaactgagaaatggt

SEQ ID NO: 246052 - DNA, 15 bp, Homo sapiens
caaactgagaaatgg

SEQ ID NO: 246053 - DNA, 15 bp, Homo sapiens
gcaaactgagaaatg

SEQ ID NO: 246054 - DNA, 15 bp, Homo sapiens
ggcaaactgagaaat

SEQ ID NO: 246055 - DNA, 15 bp, Homo sapiens
tggcaaactgagaaa

SEQ ID NO: 246056 - DNA, 15 bp, Homo sapiens
gtggcaaactgagaa

SEQ ID NO: 246057 - DNA, 15 bp, Homo sapiens
tgtggcaaactgaga

SEQ ID NO: 246058 - DNA, 15 bp, Homo sapiens
ctgtggcaaactgag

SEQ ID NO: 246059 - DNA, 15 bp, Homo sapiens
tctgtggcaaactga

SEQ ID NO: 246060 - DNA, 15 bp, Homo sapiens
ttctgtggcaaactg

SEQ ID NO: 246061 - DNA, 15 bp, Homo sapiens
tttctgtggcaaact

SEQ ID NO: 246062 - DNA, 15 bp, Homo sapiens
atttctgtggcaaac

SEQ ID NO: 246063 - DNA, 15 bp, Homo sapiens
tatttctgtggcaaa

SEQ ID NO: 246064 - DNA, 15 bp, Homo sapiens
ttatttctgtggcaa

SEQ ID NO: 246065 - DNA, 15 bp, Homo sapiens
attatttctgtggca

SEQ ID NO: 246066 - DNA, 15 bp, Homo sapiens
tattatttctgtggc

SEQ ID NO: 246067 - DNA, 15 bp, Homo sapiens
ttattatttctgtgg

SEQ ID NO: 246068 - DNA, 15 bp, Homo sapiens
attattatttctgtg

SEQ ID NO: 246069 - DNA, 15 bp, Homo sapiens
tattattatttctgt

SEQ ID NO: 246070 - DNA, 15 bp, Homo sapiens
ttattattatttctg

SEQ ID NO: 246071 - DNA, 15 bp, Homo sapiens
gttattattatttct

SEQ ID NO: 246072 - DNA, 15 bp, Homo sapiens
atgttattattattt

SEQ ID NO: 246073 - DNA, 15 bp, Homo sapiens
tatgttattattatt

SEQ ID NO: 246074 - DNA, 15 bp, Homo sapiens
atatgttattattat

SEQ ID NO: 246075 - DNA, 15 bp, Homo sapiens
tatatgttattatta

SEQ ID NO: 246076 - DNA, 15 bp, Homo sapiens
ttatatgttattatt

SEQ ID NO: 246077 - DNA, 15 bp, Homo sapiens
attatatgttattat

SEQ ID NO: 246078 - DNA, 15 bp, Homo sapiens
tattatatgttatta

SEQ ID NO: 246079 - DNA, 15 bp, Homo sapiens
ttattatatgttatt

SEQ ID NO: 246080 - DNA, 15 bp, Homo sapiens
attattatatgttat

SEQ ID NO: 246081 - DNA, 15 bp, Homo sapiens
cattattatatgtta

SEQ ID NO: 246082 - DNA, 15 bp, Homo sapiens
tcattattatatgtt

SEQ ID NO: 246083 - DNA, 15 bp, Homo sapiens
atcattattatatgt

SEQ ID NO: 246084 - DNA, 15 bp, Homo sapiens
tatcattattatatg

SEQ ID NO: 246085 - DNA, 15 bp, Homo sapiens
ttatcattattatat

SEQ ID NO: 246086 - DNA, 15 bp, Homo sapiens
tttatcattattata

SEQ ID NO: 246087 - DNA, 15 bp, Homo sapiens
atttatcattattat

SEQ ID NO: 246088 - DNA, 15 bp, Homo sapiens
tatttatcattatta

SEQ ID NO: 246089 - DNA, 15 bp, Homo sapiens
ctatttatcattatt

SEQ ID NO: 246090 - DNA, 15 bp, Homo sapiens
actatttatcattat

SEQ ID NO: 246091 - DNA, 15 bp, Homo sapiens
aactatttatcatta

SEQ ID NO: 246092 - DNA, 15 bp, Homo sapiens
caactatttatcatt

SEQ ID NO: 246093 - DNA, 15 bp, Homo sapiens
gcaactatttatcat

SEQ ID NO: 246094 - DNA, 15 bp, Homo sapiens
agcaactatttatca

SEQ ID NO: 246095 - DNA, 15 bp, Homo sapiens
cagcaactatttatc

SEQ ID NO: 246096 - DNA, 15 bp, Homo sapiens
acagcaactatttat

SEQ ID NO: 246097 - DNA, 15 bp, Homo sapiens
cacagcaactattta

SEQ ID NO: 246098 - DNA, 15 bp, Homo sapiens
ccacagcaactattt

SEQ ID NO: 246099 - DNA, 15 bp, Homo sapiens
cccacagcaactatt

SEQ ID NO: 246100 - DNA, 15 bp, Homo sapiens
tcccacagcaactat

SEQ ID NO: 246101 - DNA, 15 bp, Homo sapiens
ttcccacagcaacta

SEQ ID NO: 246102 - DNA, 15 bp, Homo sapiens
cttcccacagcaact

SEQ ID NO: 246103 - DNA, 15 bp, Homo sapiens
acttcccacagcaac

SEQ ID NO: 246104 - DNA, 15 bp, Homo sapiens
tacttcccacagcaa

SEQ ID NO: 246105 - DNA, 15 bp, Homo sapiens
ttacttcccacagca

SEQ ID NO: 246106 - DNA, 15 bp, Homo sapiens
attacttcccacagc

SEQ ID NO: 246107 - DNA, 15 bp, Homo sapiens
tattacttcccacag

SEQ ID NO: 246108 - DNA, 15 bp, Homo sapiens
ttattacttcccaca

SEQ ID NO: 246109 - DNA, 15 bp, Homo sapiens
attattacttcccac

SEQ ID NO: 246110 - DNA, 15 bp, Homo sapiens
cattattacttccca

SEQ ID NO: 246111 - DNA, 15 bp, Homo sapiens
tcattattacttccc

SEQ ID NO: 246112 - DNA, 15 bp, Homo sapiens
atcattattacttcc

SEQ ID NO: 246113 - DNA, 15 bp, Homo sapiens
gatcattattacttc

SEQ ID NO: 246114 - DNA, 15 bp, Homo sapiens
tgatcattattactt

SEQ ID NO: 246115 - DNA, 15 bp, Homo sapiens
atgatcattattact

SEQ ID NO: 246116 - DNA, 15 bp, Homo sapiens
aatgatcattattac

SEQ ID NO: 246117 - DNA, 15 bp, Homo sapiens
caatgatcattatta

SEQ ID NO: 246118 - DNA, 15 bp, Homo sapiens
acaatgatcattatt

SEQ ID NO: 246119 - DNA, 15 bp, Homo sapiens
tacaatgatcattat

SEQ ID NO: 246120 - DNA, 15 bp, Homo sapiens
ttacaatgatcatta

SEQ ID NO: 246121 - DNA, 15 bp, Homo sapiens
attacaatgatcatt

SEQ ID NO: 246122 - DNA, 15 bp, Homo sapiens
tattacaatgatcat

SEQ ID NO: 246123 - DNA, 15 bp, Homo sapiens
ttattacaatgatca

SEQ ID NO: 246124 - DNA, 15 bp, Homo sapiens
tttattacaatgatc

SEQ ID NO: 246125 - DNA, 15 bp, Homo sapiens
atttattacaatgat

SEQ ID NO: 246126 - DNA, 15 bp, Homo sapiens
aatttattacaatga

SEQ ID NO: 246127 - DNA, 15 bp, Homo sapiens
taatttattacaatg

SEQ ID NO: 246128 - DNA, 15 bp, Homo sapiens
gtaatttattacaat

SEQ ID NO: 246129 - DNA, 15 bp, Homo sapiens
tgtaatttattacaa

SEQ ID NO: 246130 - DNA, 15 bp, Homo sapiens
atgtaatttattaca

SEQ ID NO: 246131 - DNA, 15 bp, Homo sapiens
aatgtaatttattac

SEQ ID NO: 246132 - DNA, 15 bp, Homo sapiens
aaatgtaatttatta

SEQ ID NO: 246133 - DNA, 15 bp, Homo sapiens
aaaatgtaatttatt

SEQ ID NO: 246134 - DNA, 15 bp, Homo sapiens
aaaaatgtaatttat

SEQ ID NO: 246135 - DNA, 15 bp, Homo sapiens
caaaaatgtaattta

SEQ ID NO: 246136 - DNA, 15 bp, Homo sapiens
tcaaaaatgtaattt

SEQ ID NO: 246137 - DNA, 15 bp, Homo sapiens
ttcaaaaatgtaatt

SEQ ID NO: 246138 - DNA, 15 bp, Homo sapiens
gttcaaaaatgtaat

SEQ ID NO: 246139 - DNA, 15 bp, Homo sapiens
tgttcaaaaatgtaa

SEQ ID NO: 246140 - DNA, 15 bp, Homo sapiens
ctgttcaaaaatgta

SEQ ID NO: 246141 - DNA, 15 bp, Homo sapiens
actgttcaaaaatgt

SEQ ID NO: 246142 - DNA, 15 bp, Homo sapiens
gactgttcaaaaatg

SEQ ID NO: 246143 - DNA, 15 bp, Homo sapiens
tgactgttcaaaaat

SEQ ID NO: 246144 - DNA, 15 bp, Homo sapiens
atgactgttcaaaaa

SEQ ID NO: 246145 - DNA, 15 bp, Homo sapiens
aatgactgttcaaaa

SEQ ID NO: 246146 - DNA, 15 bp, Homo sapiens
aaatgactgttcaaa

SEQ ID NO: 246147 - DNA, 15 bp, Homo sapiens
taaatgactgttcaa

SEQ ID NO: 246148 - DNA, 15 bp, Homo sapiens
ataaatgactgttca

SEQ ID NO: 246149 - DNA, 15 bp, Homo sapiens
aataaatgactgttc

SEQ ID NO: 246150 - DNA, 15 bp, Homo sapiens
aaataaatgactgtt

SEQ ID NO: 246151 - DNA, 15 bp, Homo sapiens
caaataaatgactgt

SEQ ID NO: 246152 - DNA, 15 bp, Homo sapiens
gcaaataaatgactg

SEQ ID NO: 246153 - DNA, 15 bp, Homo sapiens
ggcaaataaatgact

SEQ ID NO: 246154 - DNA, 15 bp, Homo sapiens
tggcaaataaatgac

SEQ ID NO: 246155 - DNA, 15 bp, Homo sapiens
ctggcaaataaatga

SEQ ID NO: 246156 - DNA, 15 bp, Homo sapiens
cctggcaaataaatg

SEQ ID NO: 246157 - DNA, 15 bp, Homo sapiens
acctggcaaataaat

SEQ ID NO: 246158 - DNA, 15 bp, Homo sapiens
cacctggcaaataaa

SEQ ID NO: 246159 - DNA, 15 bp, Homo sapiens
acacctggcaaataa

SEQ ID NO: 246160 - DNA, 15 bp, Homo sapiens
aacacctggcaaata

SEQ ID NO: 246161 - DNA, 15 bp, Homo sapiens
caacacctggcaaat

SEQ ID NO: 246162 - DNA, 15 bp, Homo sapiens
acaacacctggcaaa

SEQ ID NO: 246163 - DNA, 15 bp, Homo sapiens
cacaacacctggcaa

SEQ ID NO: 246164 - DNA, 15 bp, Homo sapiens
gcacaacacctggca

SEQ ID NO: 246165 - DNA, 15 bp, Homo sapiens
agcacaacacctggc

SEQ ID NO: 246166 - DNA, 15 bp, Homo sapiens
cagcacaacacctgg

SEQ ID NO: 246167 - DNA, 15 bp, Homo sapiens
tcagcacaacacctg

SEQ ID NO: 246168 - DNA, 15 bp, Homo sapiens
ttcagcacaacacct

SEQ ID NO: 246169 - DNA, 15 bp, Homo sapiens
attcagcacaacacc

SEQ ID NO: 246170 - DNA, 15 bp, Homo sapiens
gattcagcacaacac

SEQ ID NO: 246171 - DNA, 15 bp, Homo sapiens
agattcagcacaaca

SEQ ID NO: 246172 - DNA, 15 bp, Homo sapiens
aagattcagcacaac

SEQ ID NO: 246173 - DNA, 15 bp, Homo sapiens
caagattcagcacaa

SEQ ID NO: 246174 - DNA, 15 bp, Homo sapiens
acaagattcagcaca

SEQ ID NO: 246175 - DNA, 15 bp, Homo sapiens
cacaagattcagcac

SEQ ID NO: 246176 - DNA, 15 bp, Homo sapiens
gcacaagattcagca

SEQ ID NO: 246177 - DNA, 15 bp, Homo sapiens
tgcacaagattcagc

SEQ ID NO: 246178 - DNA, 15 bp, Homo sapiens
atgcacaagattcag

SEQ ID NO: 246179 - DNA, 15 bp, Homo sapiens
tatgcacaagattca

SEQ ID NO: 246180 - DNA, 15 bp, Homo sapiens
ctatgcacaagattc

SEQ ID NO: 246181 - DNA, 15 bp, Homo sapiens
tctatgcacaagatt

SEQ ID NO: 246182 - DNA, 15 bp, Homo sapiens
atctatgcacaagat

SEQ ID NO: 246183 - DNA, 15 bp, Homo sapiens
catctatgcacaaga

SEQ ID NO: 246184 - DNA, 15 bp, Homo sapiens
tcatctatgcacaag

SEQ ID NO: 246185 - DNA, 15 bp, Homo sapiens
atcatctatgcacaa

SEQ ID NO: 246186 - DNA, 15 bp, Homo sapiens
gatcatctatgcaca

SEQ ID NO: 246187 - DNA, 15 bp, Homo sapiens
agatcatctatgcac

SEQ ID NO: 246188 - DNA, 15 bp, Homo sapiens
gagatcatctatgca

SEQ ID NO: 246189 - DNA, 15 bp, Homo sapiens
agagatcatctatgc

SEQ ID NO: 246190 - DNA, 15 bp, Homo sapiens
aagagatcatctatg

SEQ ID NO: 246191 - DNA, 15 bp, Homo sapiens
aaagagatcatctat

SEQ ID NO: 246192 - DNA, 15 bp, Homo sapiens
aaaagagatcatcta

SEQ ID NO: 246193 - DNA, 15 bp, Homo sapiens
taaaagagatcatct

SEQ ID NO: 246194 - DNA, 15 bp, Homo sapiens
ttaaaagagatcatc

SEQ ID NO: 246195 - DNA, 15 bp, Homo sapiens
attaaaagagatcat

SEQ ID NO: 246196 - DNA, 15 bp, Homo sapiens
aattaaaagagatca

SEQ ID NO: 246197 - DNA, 15 bp, Homo sapiens
gaattaaaagagatc

SEQ ID NO: 246198 - DNA, 15 bp, Homo sapiens
agaattaaaagagat

SEQ ID NO: 246199 - DNA, 15 bp, Homo sapiens
gagaattaaaagaga

SEQ ID NO: 246200 - DNA, 15 bp, Homo sapiens
agagaattaaaagag

SEQ ID NO: 246201 - DNA, 15 bp, Homo sapiens
gagagaattaaaaga

SEQ ID NO: 246202 - DNA, 15 bp, Homo sapiens
tgagagaattaaaag

SEQ ID NO: 246203 - DNA, 15 bp, Homo sapiens
atgagagaattaaaa

SEQ ID NO: 246204 - DNA, 15 bp, Homo sapiens
aatgagagaattaaa

SEQ ID NO: 246205 - DNA, 15 bp, Homo sapiens
taatgagagaattaa

SEQ ID NO: 246206 - DNA, 15 bp, Homo sapiens
ctaatgagagaatta

SEQ ID NO: 246207 - DNA, 15 bp, Homo sapiens
gctaatgagagaatt

SEQ ID NO: 246208 - DNA, 15 bp, Homo sapiens
ggctaatgagagaat

SEQ ID NO: 246209 - DNA, 15 bp, Homo sapiens
tggctaatgagagaa

SEQ ID NO: 246210 - DNA, 15 bp, Homo sapiens
ttggctaatgagaga

SEQ ID NO: 246211 - DNA, 15 bp, Homo sapiens
cttggctaatgagag

SEQ ID NO: 246212 - DNA, 15 bp, Homo sapiens
acttggctaatgaga

SEQ ID NO: 246213 - DNA, 15 bp, Homo sapiens
cacttggctaatgag

SEQ ID NO: 246214 - DNA, 15 bp, Homo sapiens
tcacttggctaatga

SEQ ID NO: 246215 - DNA, 15 bp, Homo sapiens
ttcacttggctaatg

SEQ ID NO: 246216 - DNA, 15 bp, Homo sapiens
cttcacttggctaat

SEQ ID NO: 246217 - DNA, 15 bp, Homo sapiens
acttcacttggctaa

SEQ ID NO: 246218 - DNA, 15 bp, Homo sapiens
tacttcacttggcta

SEQ ID NO: 246219 - DNA, 15 bp, Homo sapiens
atacttcacttggct

SEQ ID NO: 246220 - DNA, 15 bp, Homo sapiens
tatacttcacttggc

SEQ ID NO: 246221 - DNA, 15 bp, Homo sapiens
ctatacttcacttgg

SEQ ID NO: 246222 - DNA, 15 bp, Homo sapiens
cctatacttcacttg

SEQ ID NO: 246223 - DNA, 15 bp, Homo sapiens
acctatacttcactt

SEQ ID NO: 246224 - DNA, 15 bp, Homo sapiens
tacctatacttcact

SEQ ID NO: 246225 - DNA, 15 bp, Homo sapiens
gtacctatacttcac

SEQ ID NO: 246226 - DNA, 15 bp, Homo sapiens
agtacctatacttca

SEQ ID NO: 246227 - DNA, 15 bp, Homo sapiens
tagtacctatacttc

SEQ ID NO: 246228 - DNA, 15 bp, Homo sapiens
atagtacctatactt

SEQ ID NO: 246229 - DNA, 15 bp, Homo sapiens
tatagtacctatact

SEQ ID NO: 246230 - DNA, 15 bp, Homo sapiens
ttatagtacctatac

SEQ ID NO: 246231 - DNA, 15 bp, Homo sapiens
attatagtacctata

SEQ ID NO: 246232 - DNA, 15 bp, Homo sapiens
aattatagtacctat

SEQ ID NO: 246233 - DNA, 15 bp, Homo sapiens
taattatagtaccta

SEQ ID NO: 246234 - DNA, 15 bp, Homo sapiens
gtaattatagtacct

SEQ ID NO: 246235 - DNA, 15 bp, Homo sapiens
ggtaattatagtacc

SEQ ID NO: 246236 - DNA, 15 bp, Homo sapiens
gggtaattatagtac

SEQ ID NO: 246237 - DNA, 15 bp, Homo sapiens
ggggtaattatagta

SEQ ID NO: 246238 - DNA, 15 bp, Homo sapiens
gggggtaattatagt

SEQ ID NO: 246239 - DNA, 15 bp, Homo sapiens
tgggggtaattatag

SEQ ID NO: 246240 - DNA, 15 bp, Homo sapiens
atgggggtaattata

SEQ ID NO: 246241 - DNA, 15 bp, Homo sapiens
aatgggggtaattat

SEQ ID NO: 246242 - DNA, 15 bp, Homo sapiens
aaatgggggtaatta

SEQ ID NO: 246243 - DNA, 15 bp, Homo sapiens
taaatgggggtaatt

SEQ ID NO: 246244 - DNA, 15 bp, Homo sapiens
gtaaatgggggtaat

SEQ ID NO: 246245 - DNA, 15 bp, Homo sapiens
tgtaaatgggggtaa

SEQ ID NO: 246246 - DNA, 15 bp, Homo sapiens
gtgtaaatgggggta

SEQ ID NO: 246247 - DNA, 15 bp, Homo sapiens
tgtgtaaatgggggt

SEQ ID NO: 246248 - DNA, 15 bp, Homo sapiens
atgtgtaaatggggg

SEQ ID NO: 246249 - DNA, 15 bp, Homo sapiens
tatgtgtaaatgggg

SEQ ID NO: 246250 - DNA, 15 bp, Homo sapiens
ttatgtgtaaatggg

SEQ ID NO: 246251 - DNA, 15 bp, Homo sapiens
cttatgtgtaaatgg

SEQ ID NO: 246252 - DNA, 15 bp, Homo sapiens
acttatgtgtaaatg

SEQ ID NO: 246253 - DNA, 15 bp, Homo sapiens
gacttatgtgtaaat

SEQ ID NO: 246254 - DNA, 15 bp, Homo sapiens
agacttatgtgtaaa

SEQ ID NO: 246255 - DNA, 15 bp, Homo sapiens
aagacttatgtgtaa

SEQ ID NO: 246256 - DNA, 15 bp, Homo sapiens
taagacttatgtgta

SEQ ID NO: 246257 - DNA, 15 bp, Homo sapiens
ttaagacttatgtgt

SEQ ID NO: 246258 - DNA, 15 bp, Homo sapiens
attaagacttatgtg

SEQ ID NO: 246259 - DNA, 15 bp, Homo sapiens
cattaagacttatgt

SEQ ID NO: 246260 - DNA, 15 bp, Homo sapiens
tcattaagacttatg

SEQ ID NO: 246261 - DNA, 15 bp, Homo sapiens
ttcattaagacttat

SEQ ID NO: 246262 - DNA, 15 bp, Homo sapiens
attcattaagactta

SEQ ID NO: 246263 - DNA, 15 bp, Homo sapiens
aattcattaagactt

SEQ ID NO: 246264 - DNA, 15 bp, Homo sapiens
taattcattaagact

SEQ ID NO: 246265 - DNA, 15 bp, Homo sapiens
ataattcattaagac

SEQ ID NO: 246266 - DNA, 15 bp, Homo sapiens
gataattcattaaga

SEQ ID NO: 246267 - DNA, 15 bp, Homo sapiens
tgataattcattaag

SEQ ID NO: 246268 - DNA, 15 bp, Homo sapiens
ttgataattcattaa

SEQ ID NO: 246269 - DNA, 15 bp, Homo sapiens
attgataattcatta

SEQ ID NO: 246270 - DNA, 15 bp, Homo sapiens
tattgataattcatt

SEQ ID NO: 246271 - DNA, 15 bp, Homo sapiens
ttattgataattcat

SEQ ID NO: 246272 - DNA, 15 bp, Homo sapiens
gttattgataattca

SEQ ID NO: 246273 - DNA, 15 bp, Homo sapiens
agttattgataattc

SEQ ID NO: 246274 - DNA, 15 bp, Homo sapiens
cagttattgataatt

SEQ ID NO: 246275 - DNA, 15 bp, Homo sapiens
gcagttattgataat

SEQ ID NO: 246276 - DNA, 15 bp, Homo sapiens
tgcagttattgataa

SEQ ID NO: 246277 - DNA, 15 bp, Homo sapiens
atgcagttattgata

SEQ ID NO: 246278 - DNA, 15 bp, Homo sapiens
aatgcagttattgat

SEQ ID NO: 246279 - DNA, 15 bp, Homo sapiens
taatgcagttattga

SEQ ID NO: 246280 - DNA, 15 bp, Homo sapiens
ttaatgcagttattg

SEQ ID NO: 246281 - DNA, 15 bp, Homo sapiens
tttaatgcagttatt

SEQ ID NO: 246282 - DNA, 15 bp, Homo sapiens
ttttaatgcagttat

SEQ ID NO: 246283 - DNA, 15 bp, Homo sapiens
cttttaatgcagtta

SEQ ID NO: 246284 - DNA, 15 bp, Homo sapiens
acttttaatgcagtt

SEQ ID NO: 246285 - DNA, 15 bp, Homo sapiens
tacttttaatgcagt

SEQ ID NO: 246286 - DNA, 15 bp, Homo sapiens
ttacttttaatgcag

SEQ ID NO: 246287 - DNA, 15 bp, Homo sapiens
attacttttaatgca

SEQ ID NO: 246288 - DNA, 15 bp, Homo sapiens
aattacttttaatgc

SEQ ID NO: 246289 - DNA, 15 bp, Homo sapiens
taattacttttaatg

SEQ ID NO: 246290 - DNA, 15 bp, Homo sapiens
ttaattacttttaat

SEQ ID NO: 246291 - DNA, 15 bp, Homo sapiens
attaattacttttaa

SEQ ID NO: 246292 - DNA, 15 bp, Homo sapiens
tattaattactttta

SEQ ID NO: 246293 - DNA, 15 bp, Homo sapiens
ttattaattactttt

SEQ ID NO: 246294 - DNA, 15 bp, Homo sapiens
cttattaattacttt

SEQ ID NO: 246295 - DNA, 15 bp, Homo sapiens
gcttattaattactt

SEQ ID NO: 246296 - DNA, 15 bp, Homo sapiens
tgcttattaattact

SEQ ID NO: 246297 - DNA, 15 bp, Homo sapiens
gtgcttattaattac

SEQ ID NO: 246298 - DNA, 15 bp, Homo sapiens
cgtgcttattaatta

SEQ ID NO: 246299 - DNA, 15 bp, Homo sapiens
gcgtgcttattaatt

SEQ ID NO: 246300 - DNA, 15 bp, Homo sapiens
agcgtgcttattaat

SEQ ID NO: 246301 - DNA, 15 bp, Homo sapiens
aagcgtgcttattaa

SEQ ID NO: 246302 - DNA, 15 bp, Homo sapiens
taagcgtgcttatta

SEQ ID NO: 246303 - DNA, 15 bp, Homo sapiens
gtaagcgtgcttatt

SEQ ID NO: 246304 - DNA, 15 bp, Homo sapiens
tgtaagcgtgcttat

SEQ ID NO: 246305 - DNA, 15 bp, Homo sapiens
ctgtaagcgtgctta

SEQ ID NO: 246306 - DNA, 15 bp, Homo sapiens
gctgtaagcgtgctt

SEQ ID NO: 246307 - DNA, 15 bp, Homo sapiens
agctgtaagcgtgct

SEQ ID NO: 246308 - DNA, 15 bp, Homo sapiens
aagctgtaagcgtgc

SEQ ID NO: 246309 - DNA, 15 bp, Homo sapiens
caagctgtaagcgtg

SEQ ID NO: 246310 - DNA, 15 bp, Homo sapiens
gcaagctgtaagcgt

SEQ ID NO: 246311 - DNA, 15 bp, Homo sapiens
agcaagctgtaagcg

SEQ ID NO: 246312 - DNA, 15 bp, Homo sapiens
aagcaagctgtaagc

SEQ ID NO: 246313 - DNA, 15 bp, Homo sapiens
caagcaagctgtaag

SEQ ID NO: 246314 - DNA, 15 bp, Homo sapiens
tcaagcaagctgtaa

SEQ ID NO: 246315 - DNA, 15 bp, Homo sapiens
ctcaagcaagctgta

SEQ ID NO: 246316 - DNA, 15 bp, Homo sapiens
tctcaagcaagctgt

SEQ ID NO: 246317 - DNA, 15 bp, Homo sapiens
atctcaagcaagctg

SEQ ID NO: 246318 - DNA, 15 bp, Homo sapiens
aatctcaagcaagct

SEQ ID NO: 246319 - DNA, 15 bp, Homo sapiens
taatctcaagcaagc

SEQ ID NO: 246320 - DNA, 15 bp, Homo sapiens
gtaatctcaagcaag

SEQ ID NO: 246321 - DNA, 15 bp, Homo sapiens
tgtaatctcaagcaa

SEQ ID NO: 246322 - DNA, 15 bp, Homo sapiens
gtgtaatctcaagca

SEQ ID NO: 246323 - DNA, 15 bp, Homo sapiens
tgtgtaatctcaagc

SEQ ID NO: 246324 - DNA, 15 bp, Homo sapiens
ctgtgtaatctcaag

SEQ ID NO: 246325 - DNA, 15 bp, Homo sapiens
gctgtgtaatctcaa

SEQ ID NO: 246326 - DNA, 15 bp, Homo sapiens
agctgtgtaatctca

SEQ ID NO: 246327 - DNA, 15 bp, Homo sapiens
cagctgtgtaatctc

SEQ ID NO: 246328 - DNA, 15 bp, Homo sapiens
ccagctgtgtaatct

SEQ ID NO: 246329 - DNA, 15 bp, Homo sapiens
accagctgtgtaatc

SEQ ID NO: 246330 - DNA, 15 bp, Homo sapiens
taccagctgtgtaat

SEQ ID NO: 246331 - DNA, 15 bp, Homo sapiens
ttaccagctgtgtaa

SEQ ID NO: 246332 - DNA, 15 bp, Homo sapiens
tttaccagctgtgta

SEQ ID NO: 246333 - DNA, 15 bp, Homo sapiens
atttaccagctgtgt

SEQ ID NO: 246334 - DNA, 15 bp, Homo sapiens
tatttaccagctgtg

SEQ ID NO: 246335 - DNA, 15 bp, Homo sapiens
ctatttaccagctgt

SEQ ID NO: 246336 - DNA, 15 bp, Homo sapiens
tctatttaccagctg

SEQ ID NO: 246337 - DNA, 15 bp, Homo sapiens
ttctatttaccagct

SEQ ID NO: 246338 - DNA, 15 bp, Homo sapiens
cttctatttaccagc

SEQ ID NO: 246339 - DNA, 15 bp, Homo sapiens
tcttctatttaccag

SEQ ID NO: 246340 - DNA, 15 bp, Homo sapiens
ctcttctatttacca

SEQ ID NO: 246341 - DNA, 15 bp, Homo sapiens
gctcttctatttacc

SEQ ID NO: 246342 - DNA, 15 bp, Homo sapiens
agctcttctatttac

SEQ ID NO: 246343 - DNA, 15 bp, Homo sapiens
tagctcttctattta

SEQ ID NO: 246344 - DNA, 15 bp, Homo sapiens
ctagctcttctattt

SEQ ID NO: 246345 - DNA, 15 bp, Homo sapiens
actagctcttctatt

SEQ ID NO: 246346 - DNA, 15 bp, Homo sapiens
cactagctcttctat

SEQ ID NO: 246347 - DNA, 15 bp, Homo sapiens
acactagctcttcta

SEQ ID NO: 246348 - DNA, 15 bp, Homo sapiens
aacactagctcttct

SEQ ID NO: 246349 - DNA, 15 bp, Homo sapiens
gaacactagctcttc

SEQ ID NO: 246350 - DNA, 15 bp, Homo sapiens
tgaacactagctctt

SEQ ID NO: 246351 - DNA, 15 bp, Homo sapiens
ttgaacactagctct

SEQ ID NO: 246352 - DNA, 15 bp, Homo sapiens
tttgaacactagctc

SEQ ID NO: 246353 - DNA, 15 bp, Homo sapiens
gtttgaacactagct

SEQ ID NO: 246354 - DNA, 15 bp, Homo sapiens
ggtttgaacactagc

SEQ ID NO: 246355 - DNA, 15 bp, Homo sapiens
gggtttgaacactag

SEQ ID NO: 246356 - DNA, 15 bp, Homo sapiens
tgggtttgaacacta

SEQ ID NO: 246357 - DNA, 15 bp, Homo sapiens
ctgggtttgaacact

SEQ ID NO: 246358 - DNA, 15 bp, Homo sapiens
cctgggtttgaacac

SEQ ID NO: 246359 - DNA, 15 bp, Homo sapiens
ccctgggtttgaaca

SEQ ID NO: 246360 - DNA, 15 bp, Homo sapiens
tccctgggtttgaac

SEQ ID NO: 246361 - DNA, 15 bp, Homo sapiens
atccctgggtttgaa

SEQ ID NO: 246362 - DNA, 15 bp, Homo sapiens
aatccctgggtttga

SEQ ID NO: 246363 - DNA, 15 bp, Homo sapiens
caatccctgggtttg

SEQ ID NO: 246364 - DNA, 15 bp, Homo sapiens
acaatccctgggttt

SEQ ID NO: 246365 - DNA, 15 bp, Homo sapiens
gacaatccctgggtt

SEQ ID NO: 246366 - DNA, 15 bp, Homo sapiens
agacaatccctgggt

SEQ ID NO: 246367 - DNA, 15 bp, Homo sapiens
tagacaatccctggg

SEQ ID NO: 246368 - DNA, 15 bp, Homo sapiens
gtagacaatccctgg

SEQ ID NO: 246369 - DNA, 15 bp, Homo sapiens
tgtagacaatccctg

SEQ ID NO: 246370 - DNA, 15 bp, Homo sapiens
ctgtagacaatccct

SEQ ID NO: 246371 - DNA, 15 bp, Homo sapiens
gctgtagacaatccc

SEQ ID NO: 246372 - DNA, 15 bp, Homo sapiens
agctgtagacaatcc

SEQ ID NO: 246373 - DNA, 15 bp, Homo sapiens
gagctgtagacaatc

SEQ ID NO: 246374 - DNA, 15 bp, Homo sapiens
ggagctgtagacaat

SEQ ID NO: 246375 - DNA, 15 bp, Homo sapiens
aggagctgtagacaa

SEQ ID NO: 246376 - DNA, 15 bp, Homo sapiens
caggagctgtagaca

SEQ ID NO: 246377 - DNA, 15 bp, Homo sapiens
tcaggagctgtagac

SEQ ID NO: 246378 - DNA, 15 bp, Homo sapiens
ttcaggagctgtaga

SEQ ID NO: 246379 - DNA, 15 bp, Homo sapiens
gttcaggagctgtag

SEQ ID NO: 246380 - DNA, 15 bp, Homo sapiens
agttcaggagctgta

SEQ ID NO: 246381 - DNA, 15 bp, Homo sapiens
gagttcaggagctgt

SEQ ID NO: 246382 - DNA, 15 bp, Homo sapiens
ggagttcaggagctg

SEQ ID NO: 246383 - DNA, 15 bp, Homo sapiens
aggagttcaggagct

SEQ ID NO: 246384 - DNA, 15 bp, Homo sapiens
caggagttcaggagc

SEQ ID NO: 246385 - DNA, 15 bp, Homo sapiens
tcaggagttcaggag

SEQ ID NO: 246386 - DNA, 15 bp, Homo sapiens
atcaggagttcagga

SEQ ID NO: 246387 - DNA, 15 bp, Homo sapiens
gatcaggagttcagg

SEQ ID NO: 246388 - DNA, 15 bp, Homo sapiens
tgatcaggagttcag

SEQ ID NO: 246389 - DNA, 15 bp, Homo sapiens
gtgatcaggagttca

SEQ ID NO: 246390 - DNA, 15 bp, Homo sapiens
agtgatcaggagttc

SEQ ID NO: 246391 - DNA, 15 bp, Homo sapiens
tagtgatcaggagtt

SEQ ID NO: 246392 - DNA, 15 bp, Homo sapiens
atagtgatcaggagt

SEQ ID NO: 246393 - DNA, 15 bp, Homo sapiens
catagtgatcaggag

SEQ ID NO: 246394 - DNA, 15 bp, Homo sapiens
gcatagtgatcagga

SEQ ID NO: 246395 - DNA, 15 bp, Homo sapiens
cgcatagtgatcagg

SEQ ID NO: 246396 - DNA, 15 bp, Homo sapiens
ccgcatagtgatcag

SEQ ID NO: 246397 - DNA, 15 bp, Homo sapiens
accgcatagtgatca

SEQ ID NO: 246398 - DNA, 15 bp, Homo sapiens
caccgcatagtgatc

SEQ ID NO: 246399 - DNA, 15 bp, Homo sapiens
gcaccgcatagtgat

SEQ ID NO: 246400 - DNA, 15 bp, Homo sapiens
agcaccgcatagtga

SEQ ID NO: 246401 - DNA, 15 bp, Homo sapiens
cagcaccgcatagtg

SEQ ID NO: 246402 - DNA, 15 bp, Homo sapiens
acagcaccgcatagt

SEQ ID NO: 246403 - DNA, 15 bp, Homo sapiens
cacagcaccgcatag

SEQ ID NO: 246404 - DNA, 15 bp, Homo sapiens
acacagcaccgcata

SEQ ID NO: 246405 - DNA, 15 bp, Homo sapiens
gacacagcaccgcat

SEQ ID NO: 246406 - DNA, 15 bp, Homo sapiens
ggacacagcaccgca

SEQ ID NO: 246407 - DNA, 15 bp, Homo sapiens
aggacacagcaccgc

SEQ ID NO: 246408 - DNA, 15 bp, Homo sapiens
caggacacagcaccg

SEQ ID NO: 246409 - DNA, 15 bp, Homo sapiens
ccaggacacagcacc

SEQ ID NO: 246410 - DNA, 15 bp, Homo sapiens
gccaggacacagcac

SEQ ID NO: 246411 - DNA, 15 bp, Homo sapiens
ggccaggacacagca

SEQ ID NO: 246412 - DNA, 15 bp, Homo sapiens
gggccaggacacagc

SEQ ID NO: 246413 - DNA, 15 bp, Homo sapiens
ggggccaggacacag

SEQ ID NO: 246414 - DNA, 15 bp, Homo sapiens
tggggccaggacaca

SEQ ID NO: 246415 - DNA, 15 bp, Homo sapiens
ttggggccaggacac

SEQ ID NO: 246416 - DNA, 15 bp, Homo sapiens
attggggccaggaca

SEQ ID NO: 246417 - DNA, 15 bp, Homo sapiens
tattggggccaggac

SEQ ID NO: 246418 - DNA, 15 bp, Homo sapiens
atattggggccagga

SEQ ID NO: 246419 - DNA, 15 bp, Homo sapiens
aatattggggccagg

SEQ ID NO: 246420 - DNA, 15 bp, Homo sapiens
taatattggggccag

SEQ ID NO: 246421 - DNA, 15 bp, Homo sapiens
ctaatattggggcca

SEQ ID NO: 246422 - DNA, 15 bp, Homo sapiens
actaatattggggcc

SEQ ID NO: 246423 - DNA, 15 bp, Homo sapiens
aactaatattggggc

SEQ ID NO: 246424 - DNA, 15 bp, Homo sapiens
caactaatattgggg

SEQ ID NO: 246425 - DNA, 15 bp, Homo sapiens
tcaactaatattggg

SEQ ID NO: 246426 - DNA, 15 bp, Homo sapiens
ctcaactaatattgg

SEQ ID NO: 246427 - DNA, 15 bp, Homo sapiens
actcaactaatattg

SEQ ID NO: 246428 - DNA, 15 bp, Homo sapiens
gactcaactaatatt

SEQ ID NO: 246429 - DNA, 15 bp, Homo sapiens
tgactcaactaatat

SEQ ID NO: 246430 - DNA, 15 bp, Homo sapiens
ctgactcaactaata

SEQ ID NO: 246431 - DNA, 15 bp, Homo sapiens
tctgactcaactaat

SEQ ID NO: 246432 - DNA, 15 bp, Homo sapiens
ctctgactcaactaa

SEQ ID NO: 246433 - DNA, 15 bp, Homo sapiens
cctctgactcaacta

SEQ ID NO: 246434 - DNA, 15 bp, Homo sapiens
tcctctgactcaact

SEQ ID NO: 246435 - DNA, 15 bp, Homo sapiens
gtcctctgactcaac

SEQ ID NO: 246436 - DNA, 15 bp, Homo sapiens
cgtcctctgactcaa

SEQ ID NO: 246437 - DNA, 15 bp, Homo sapiens
ccgtcctctgactca

SEQ ID NO: 246438 - DNA, 15 bp, Homo sapiens
tccgtcctctgactc

SEQ ID NO: 246439 - DNA, 15 bp, Homo sapiens
ttccgtcctctgact

SEQ ID NO: 246440 - DNA, 15 bp, Homo sapiens
cttccgtcctctgac

SEQ ID NO: 246441 - DNA, 15 bp, Homo sapiens
acttccgtcctctga

SEQ ID NO: 246442 - DNA, 15 bp, Homo sapiens
aacttccgtcctctg

SEQ ID NO: 246443 - DNA, 15 bp, Homo sapiens
aaacttccgtcctct

SEQ ID NO: 246444 - DNA, 15 bp, Homo sapiens
aaaacttccgtcctc

SEQ ID NO: 246445 - DNA, 15 bp, Homo sapiens
aaaaacttccgtcct

SEQ ID NO: 246446 - DNA, 15 bp, Homo sapiens
taaaaacttccgtcc

SEQ ID NO: 246447 - DNA, 15 bp, Homo sapiens
ctaaaaacttccgtc

SEQ ID NO: 246448 - DNA, 15 bp, Homo sapiens
actaaaaacttccgt

SEQ ID NO: 246449 - DNA, 15 bp, Homo sapiens
gactaaaaacttccg

SEQ ID NO: 246450 - DNA, 15 bp, Homo sapiens
ggactaaaaacttcc

SEQ ID NO: 246451 - DNA, 15 bp, Homo sapiens
gggactaaaaacttc

SEQ ID NO: 246452 - DNA, 15 bp, Homo sapiens
tgggactaaaaactt

SEQ ID NO: 246453 - DNA, 15 bp, Homo sapiens
atgggactaaaaact

SEQ ID NO: 246454 - DNA, 15 bp, Homo sapiens
catgggactaaaaac

SEQ ID NO: 246455 - DNA, 15 bp, Homo sapiens
ccatgggactaaaaa

SEQ ID NO: 246456 - DNA, 15 bp, Homo sapiens
tccatgggactaaaa

SEQ ID NO: 246457 - DNA, 15 bp, Homo sapiens
ttccatgggactaaa

SEQ ID NO: 246458 - DNA, 15 bp, Homo sapiens
tttccatgggactaa

SEQ ID NO: 246459 - DNA, 15 bp, Homo sapiens
gtttccatgggacta

SEQ ID NO: 246460 - DNA, 15 bp, Homo sapiens
agtttccatgggact

SEQ ID NO: 246461 - DNA, 15 bp, Homo sapiens
aagtttccatgggac

SEQ ID NO: 246462 - DNA, 15 bp, Homo sapiens
aaagtttccatggga

SEQ ID NO: 246463 - DNA, 15 bp, Homo sapiens
caaagtttccatggg

SEQ ID NO: 246464 - DNA, 15 bp, Homo sapiens
tcaaagtttccatgg

SEQ ID NO: 246465 - DNA, 15 bp, Homo sapiens
ttcaaagtttccatg

SEQ ID NO: 246466 - DNA, 15 bp, Homo sapiens
attcaaagtttccat

SEQ ID NO: 246467 - DNA, 15 bp, Homo sapiens
tattcaaagtttcca

SEQ ID NO: 246468 - DNA, 15 bp, Homo sapiens
ctattcaaagtttcc

SEQ ID NO: 246469 - DNA, 15 bp, Homo sapiens
cctattcaaagtttc

SEQ ID NO: 246470 - DNA, 15 bp, Homo sapiens
tcctattcaaagttt

SEQ ID NO: 246471 - DNA, 15 bp, Homo sapiens
atcctattcaaagtt

SEQ ID NO: 246472 - DNA, 15 bp, Homo sapiens
catcctattcaaagt

SEQ ID NO: 246473 - DNA, 15 bp, Homo sapiens
tcatcctattcaaag

SEQ ID NO: 246474 - DNA, 15 bp, Homo sapiens
ttcatcctattcaaa

SEQ ID NO: 246475 - DNA, 15 bp, Homo sapiens
cttcatcctattcaa

SEQ ID NO: 246476 - DNA, 15 bp, Homo sapiens
ccttcatcctattca

SEQ ID NO: 246477 - DNA, 15 bp, Homo sapiens
tccttcatcctattc

SEQ ID NO: 246478 - DNA, 15 bp, Homo sapiens
atccttcatcctatt

SEQ ID NO: 246479 - DNA, 15 bp, Homo sapiens
aatccttcatcctat

SEQ ID NO: 246480 - DNA, 15 bp, Homo sapiens
taatccttcatccta

SEQ ID NO: 246481 - DNA, 15 bp, Homo sapiens
ataatccttcatcct

SEQ ID NO: 246482 - DNA, 15 bp, Homo sapiens
tataatccttcatcc

SEQ ID NO: 246483 - DNA, 15 bp, Homo sapiens
atataatccttcatc

SEQ ID NO: 246484 - DNA, 15 bp, Homo sapiens
aatataatccttcat

SEQ ID NO: 246485 - DNA, 15 bp, Homo sapiens
aaatataatccttca

SEQ ID NO: 246486 - DNA, 15 bp, Homo sapiens
taaatataatccttc

SEQ ID NO: 246487 - DNA, 15 bp, Homo sapiens
ctaaatataatcctt

SEQ ID NO: 246488 - DNA, 15 bp, Homo sapiens
cctaaatataatcct

SEQ ID NO: 246489 - DNA, 15 bp, Homo sapiens
tcctaaatataatcc

SEQ ID NO: 246490 - DNA, 15 bp, Homo sapiens
ttcctaaatataatc

SEQ ID NO: 246491 - DNA, 15 bp, Homo sapiens
cttcctaaatataat

SEQ ID NO: 246492 - DNA, 15 bp, Homo sapiens
ccttcctaaatataa

SEQ ID NO: 246493 - DNA, 15 bp, Homo sapiens
tccttcctaaatata

SEQ ID NO: 246494 - DNA, 15 bp, Homo sapiens
ctccttcctaaatat

SEQ ID NO: 246495 - DNA, 15 bp, Homo sapiens
cctccttcctaaata

SEQ ID NO: 246496 - DNA, 15 bp, Homo sapiens
tcctccttcctaaat

SEQ ID NO: 246497 - DNA, 15 bp, Homo sapiens
atcctccttcctaaa

SEQ ID NO: 246498 - DNA, 15 bp, Homo sapiens
tatcctccttcctaa

SEQ ID NO: 246499 - DNA, 15 bp, Homo sapiens
ctatcctccttccta

SEQ ID NO: 246500 - DNA, 15 bp, Homo sapiens
actatcctccttcct

SEQ ID NO: 246501 - DNA, 15 bp, Homo sapiens
tactatcctccttcc

SEQ ID NO: 246502 - DNA, 15 bp, Homo sapiens
ctactatcctccttc

SEQ ID NO: 246503 - DNA, 15 bp, Homo sapiens
actactatcctcctt

SEQ ID NO: 246504 - DNA, 15 bp, Homo sapiens
cactactatcctcct

SEQ ID NO: 246505 - DNA, 15 bp, Homo sapiens
ccactactatcctcc

SEQ ID NO: 246506 - DNA, 15 bp, Homo sapiens
tccactactatcctc

SEQ ID NO: 246507 - DNA, 15 bp, Homo sapiens
ctccactactatcct

SEQ ID NO: 246508 - DNA, 15 bp, Homo sapiens
tctccactactatcc

SEQ ID NO: 246509 - DNA, 15 bp, Homo sapiens
ttctccactactatc

SEQ ID NO: 246510 - DNA, 15 bp, Homo sapiens
tttctccactactat

SEQ ID NO: 246511 - DNA, 15 bp, Homo sapiens
ctttctccactacta

SEQ ID NO: 246512 - DNA, 15 bp, Homo sapiens
actttctccactact

SEQ ID NO: 246513 - DNA, 15 bp, Homo sapiens
tactttctccactac

SEQ ID NO: 246514 - DNA, 15 bp, Homo sapiens
atactttctccacta

SEQ ID NO: 246515 - DNA, 15 bp, Homo sapiens
catactttctccact

SEQ ID NO: 246516 - DNA, 15 bp, Homo sapiens
tcatactttctccac

SEQ ID NO: 246517 - DNA, 15 bp, Homo sapiens
ctcatactttctcca

SEQ ID NO: 246518 - DNA, 15 bp, Homo sapiens
gctcatactttctcc

SEQ ID NO: 246519 - DNA, 15 bp, Homo sapiens
tgctcatactttctc

SEQ ID NO: 246520 - DNA, 15 bp, Homo sapiens
ttgctcatactttct

SEQ ID NO: 246521 - DNA, 15 bp, Homo sapiens
tttgctcatactttc

SEQ ID NO: 246522 - DNA, 15 bp, Homo sapiens
gtttgctcatacttt

SEQ ID NO: 246523 - DNA, 15 bp, Homo sapiens
tgtttgctcatactt

SEQ ID NO: 246524 - DNA, 15 bp, Homo sapiens
atgtttgctcatact

SEQ ID NO: 246525 - DNA, 15 bp, Homo sapiens
gatgtttgctcatac

SEQ ID NO: 246526 - DNA, 15 bp, Homo sapiens
ggatgtttgctcata

SEQ ID NO: 246527 - DNA, 15 bp, Homo sapiens
aggatgtttgctcat

SEQ ID NO: 246528 - DNA, 15 bp, Homo sapiens
aaggatgtttgctca

SEQ ID NO: 246529 - DNA, 15 bp, Homo sapiens
aaaggatgtttgctc

SEQ ID NO: 246530 - DNA, 15 bp, Homo sapiens
gaaaggatgtttgct

SEQ ID NO: 246531 - DNA, 15 bp, Homo sapiens
agaaaggatgtttgc

SEQ ID NO: 246532 - DNA, 15 bp, Homo sapiens
aagaaaggatgtttg

SEQ ID NO: 246533 - DNA, 15 bp, Homo sapiens
aaagaaaggatgttt

SEQ ID NO: 246534 - DNA, 15 bp, Homo sapiens
gaaagaaaggatgtt

SEQ ID NO: 246535 - DNA, 15 bp, Homo sapiens
tgaaagaaaggatgt

SEQ ID NO: 246536 - DNA, 15 bp, Homo sapiens
atgaaagaaaggatg

SEQ ID NO: 246537 - DNA, 15 bp, Homo sapiens
tatgaaagaaaggat

SEQ ID NO: 246538 - DNA, 15 bp, Homo sapiens
gtatgaaagaaagga

SEQ ID NO: 246539 - DNA, 15 bp, Homo sapiens
ggtatgaaagaaagg

SEQ ID NO: 246540 - DNA, 15 bp, Homo sapiens
tggtatgaaagaaag

SEQ ID NO: 246541 - DNA, 15 bp, Homo sapiens
atggtatgaaagaaa

SEQ ID NO: 246542 - DNA, 15 bp, Homo sapiens
tatggtatgaaagaa

SEQ ID NO: 246543 - DNA, 15 bp, Homo sapiens
ctatggtatgaaaga

SEQ ID NO: 246544 - DNA, 15 bp, Homo sapiens
tctatggtatgaaag

SEQ ID NO: 246545 - DNA, 15 bp, Homo sapiens
gtctatggtatgaaa

SEQ ID NO: 246546 - DNA, 15 bp, Homo sapiens
cgtctatggtatgaa

SEQ ID NO: 246547 - DNA, 15 bp, Homo sapiens
ccgtctatggtatga

SEQ ID NO: 246548 - DNA, 15 bp, Homo sapiens
accgtctatggtatg

SEQ ID NO: 246549 - DNA, 15 bp, Homo sapiens
aaccgtctatggtat

SEQ ID NO: 246550 - DNA, 15 bp, Homo sapiens
taaccgtctatggta

SEQ ID NO: 246551 - DNA, 15 bp, Homo sapiens
gtaaccgtctatggt

SEQ ID NO: 246552 - DNA, 15 bp, Homo sapiens
ggtaaccgtctatgg

SEQ ID NO: 246553 - DNA, 15 bp, Homo sapiens
tggtaaccgtctatg

SEQ ID NO: 246554 - DNA, 15 bp, Homo sapiens
atggtaaccgtctat

SEQ ID NO: 246555 - DNA, 15 bp, Homo sapiens
aatggtaaccgtcta

SEQ ID NO: 246556 - DNA, 15 bp, Homo sapiens
aaatggtaaccgtct

SEQ ID NO: 246557 - DNA, 15 bp, Homo sapiens
taaatggtaaccgtc

SEQ ID NO: 246558 - DNA, 15 bp, Homo sapiens
gtaaatggtaaccgt

SEQ ID NO: 246559 - DNA, 15 bp, Homo sapiens
agtaaatggtaaccg

SEQ ID NO: 246560 - DNA, 15 bp, Homo sapiens
tagtaaatggtaacc

SEQ ID NO: 246561 - DNA, 15 bp, Homo sapiens
atagtaaatggtaac

SEQ ID NO: 246562 - DNA, 15 bp, Homo sapiens
catagtaaatggtaa

SEQ ID NO: 246563 - DNA, 15 bp, Homo sapiens
gcatagtaaatggta

SEQ ID NO: 246564 - DNA, 15 bp, Homo sapiens
tgcatagtaaatggt

SEQ ID NO: 246565 - DNA, 15 bp, Homo sapiens
gtgcatagtaaatgg

SEQ ID NO: 246566 - DNA, 15 bp, Homo sapiens
ggtgcatagtaaatg

SEQ ID NO: 246567 - DNA, 15 bp, Homo sapiens
aggtgcatagtaaat

SEQ ID NO: 246568 - DNA, 15 bp, Homo sapiens
gaggtgcatagtaaa

SEQ ID NO: 246569 - DNA, 15 bp, Homo sapiens
ggaggtgcatagtaa

SEQ ID NO: 246570 - DNA, 15 bp, Homo sapiens
aggaggtgcatagta

SEQ ID NO: 246571 - DNA, 15 bp, Homo sapiens
caggaggtgcatagt

SEQ ID NO: 246572 - DNA, 15 bp, Homo sapiens
acaggaggtgcatag

SEQ ID NO: 246573 - DNA, 15 bp, Homo sapiens
cacaggaggtgcata

SEQ ID NO: 246574 - DNA, 15 bp, Homo sapiens
acacaggaggtgcat

SEQ ID NO: 246575 - DNA, 15 bp, Homo sapiens
cacacaggaggtgca

SEQ ID NO: 246576 - DNA, 15 bp, Homo sapiens
gcacacaggaggtgc

SEQ ID NO: 246577 - DNA, 15 bp, Homo sapiens
ggcacacaggaggtg

SEQ ID NO: 246578 - DNA, 15 bp, Homo sapiens
tggcacacaggaggt

SEQ ID NO: 246579 - DNA, 15 bp, Homo sapiens
ctggcacacaggagg

SEQ ID NO: 246580 - DNA, 15 bp, Homo sapiens
gctggcacacaggag

SEQ ID NO: 246581 - DNA, 15 bp, Homo sapiens
tgctggcacacagga

SEQ ID NO: 246582 - DNA, 15 bp, Homo sapiens
ttgctggcacacagg

SEQ ID NO: 246583 - DNA, 15 bp, Homo sapiens
gttgctggcacacag

SEQ ID NO: 246584 - DNA, 15 bp, Homo sapiens
agttgctggcacaca

SEQ ID NO: 246585 - DNA, 15 bp, Homo sapiens
cagttgctggcacac

SEQ ID NO: 246586 - DNA, 15 bp, Homo sapiens
tcagttgctggcaca

SEQ ID NO: 246587 - DNA, 15 bp, Homo sapiens
ctcagttgctggcac

SEQ ID NO: 246588 - DNA, 15 bp, Homo sapiens
actcagttgctggca

SEQ ID NO: 246589 - DNA, 15 bp, Homo sapiens
gactcagttgctggc

SEQ ID NO: 246590 - DNA, 15 bp, Homo sapiens
ggactcagttgctgg

SEQ ID NO: 246591 - DNA, 15 bp, Homo sapiens
tggactcagttgctg

SEQ ID NO: 246592 - DNA, 15 bp, Homo sapiens
ctggactcagttgct

SEQ ID NO: 246593 - DNA, 15 bp, Homo sapiens
gctggactcagttgc

SEQ ID NO: 246594 - DNA, 15 bp, Homo sapiens
agctggactcagttg

SEQ ID NO: 246595 - DNA, 15 bp, Homo sapiens
cagctggactcagtt

SEQ ID NO: 246596 - DNA, 15 bp, Homo sapiens
acagctggactcagt

SEQ ID NO: 246597 - DNA, 15 bp, Homo sapiens
gacagctggactcag

SEQ ID NO: 246598 - DNA, 15 bp, Homo sapiens
ggacagctggactca

SEQ ID NO: 246599 - DNA, 15 bp, Homo sapiens
tggacagctggactc

SEQ ID NO: 246600 - DNA, 15 bp, Homo sapiens
ttggacagctggact

SEQ ID NO: 246601 - DNA, 15 bp, Homo sapiens
cttggacagctggac

SEQ ID NO: 246602 - DNA, 15 bp, Homo sapiens
ccttggacagctgga

SEQ ID NO: 246603 - DNA, 15 bp, Homo sapiens
tccttggacagctgg

SEQ ID NO: 246604 - DNA, 15 bp, Homo sapiens
gtccttggacagctg

SEQ ID NO: 246605 - DNA, 15 bp, Homo sapiens
tgtccttggacagct

SEQ ID NO: 246606 - DNA, 15 bp, Homo sapiens
ttgtccttggacagc

SEQ ID NO: 246607 - DNA, 15 bp, Homo sapiens
tttgtccttggacag

SEQ ID NO: 246608 - DNA, 15 bp, Homo sapiens
ctttgtccttggaca

SEQ ID NO: 246609 - DNA, 15 bp, Homo sapiens
gctttgtccttggac

SEQ ID NO: 246610 - DNA, 15 bp, Homo sapiens
ggctttgtccttgga

SEQ ID NO: 246611 - DNA, 15 bp, Homo sapiens
gggctttgtccttgg

SEQ ID NO: 246612 - DNA, 15 bp, Homo sapiens
tgggctttgtccttg

SEQ ID NO: 246613 - DNA, 15 bp, Homo sapiens
atgggctttgtcctt

SEQ ID NO: 246614 - DNA, 15 bp, Homo sapiens
catgggctttgtcct

SEQ ID NO: 246615 - DNA, 15 bp, Homo sapiens
gcatgggctttgtcc

SEQ ID NO: 246616 - DNA, 15 bp, Homo sapiens
agcatgggctttgtc

SEQ ID NO: 246617 - DNA, 15 bp, Homo sapiens
aagcatgggctttgt

SEQ ID NO: 246618 - DNA, 15 bp, Homo sapiens
aaagcatgggctttg

SEQ ID NO: 246619 - DNA, 15 bp, Homo sapiens
aaaagcatgggcttt

SEQ ID NO: 246620 - DNA, 15 bp, Homo sapiens
aaaaagcatgggctt

SEQ ID NO: 246621 - DNA, 15 bp, Homo sapiens
gaaaaagcatgggct

SEQ ID NO: 246622 - DNA, 15 bp, Homo sapiens
ggaaaaagcatgggc

SEQ ID NO: 246623 - DNA, 15 bp, Homo sapiens
tggaaaaagcatggg

SEQ ID NO: 246624 - DNA, 15 bp, Homo sapiens
ctggaaaaagcatgg

SEQ ID NO: 246625 - DNA, 15 bp, Homo sapiens
actggaaaaagcatg

SEQ ID NO: 246626 - DNA, 15 bp, Homo sapiens
tactggaaaaagcat

SEQ ID NO: 246627 - DNA, 15 bp, Homo sapiens
gtactggaaaaagca

SEQ ID NO: 246628 - DNA, 15 bp, Homo sapiens
agtactggaaaaagc

SEQ ID NO: 246629 - DNA, 15 bp, Homo sapiens
gagtactggaaaaag

SEQ ID NO: 246630 - DNA, 15 bp, Homo sapiens
ggagtactggaaaaa

SEQ ID NO: 246631 - DNA, 15 bp, Homo sapiens
tggagtactggaaaa

SEQ ID NO: 246632 - DNA, 15 bp, Homo sapiens
gtggagtactggaaa

SEQ ID NO: 246633 - DNA, 15 bp, Homo sapiens
tgtggagtactggaa

SEQ ID NO: 246634 - DNA, 15 bp, Homo sapiens
gtgtggagtactgga

SEQ ID NO: 246635 - DNA, 15 bp, Homo sapiens
agtgtggagtactgg

SEQ ID NO: 246636 - DNA, 15 bp, Homo sapiens
cagtgtggagtactg

SEQ ID NO: 246637 - DNA, 15 bp, Homo sapiens
gcagtgtggagtact

SEQ ID NO: 246638 - DNA, 15 bp, Homo sapiens
ggcagtgtggagtac

SEQ ID NO: 246639 - DNA, 15 bp, Homo sapiens
cggcagtgtggagta

SEQ ID NO: 246640 - DNA, 15 bp, Homo sapiens
acggcagtgtggagt

SEQ ID NO: 246641 - DNA, 15 bp, Homo sapiens
aacggcagtgtggag

SEQ ID NO: 246642 - DNA, 15 bp, Homo sapiens
caacggcagtgtgga

SEQ ID NO: 246643 - DNA, 15 bp, Homo sapiens
acaacggcagtgtgg

SEQ ID NO: 246644 - DNA, 15 bp, Homo sapiens
tacaacggcagtgtg

SEQ ID NO: 246645 - DNA, 15 bp, Homo sapiens
atacaacggcagtgt

SEQ ID NO: 246646 - DNA, 15 bp, Homo sapiens
tatacaacggcagtg

SEQ ID NO: 246647 - DNA, 15 bp, Homo sapiens
ctatacaacggcagt

SEQ ID NO: 246648 - DNA, 15 bp, Homo sapiens
cctatacaacggcag

SEQ ID NO: 246649 - DNA, 15 bp, Homo sapiens
gcctatacaacggca

SEQ ID NO: 246650 - DNA, 15 bp, Homo sapiens
agcctatacaacggc

SEQ ID NO: 246651 - DNA, 15 bp, Homo sapiens
aagcctatacaacgg

SEQ ID NO: 246652 - DNA, 15 bp, Homo sapiens
aaagcctatacaacg

SEQ ID NO: 246653 - DNA, 15 bp, Homo sapiens
aaaagcctatacaac

SEQ ID NO: 246654 - DNA, 15 bp, Homo sapiens
gaaaagcctatacaa

SEQ ID NO: 246655 - DNA, 15 bp, Homo sapiens
ggaaaagcctataca

SEQ ID NO: 246656 - DNA, 15 bp, Homo sapiens
tggaaaagcctatac

SEQ ID NO: 246657 - DNA, 15 bp, Homo sapiens
atggaaaagcctata

SEQ ID NO: 246658 - DNA, 15 bp, Homo sapiens
tatggaaaagcctat

SEQ ID NO: 246659 - DNA, 15 bp, Homo sapiens
ctatggaaaagccta

SEQ ID NO: 246660 - DNA, 15 bp, Homo sapiens
cctatggaaaagcct

SEQ ID NO: 246661 - DNA, 15 bp, Homo sapiens
gcctatggaaaagcc

SEQ ID NO: 246662 - DNA, 15 bp, Homo sapiens
agcctatggaaaagc

SEQ ID NO: 246663 - DNA, 15 bp, Homo sapiens
tagcctatggaaaag

SEQ ID NO: 246664 - DNA, 15 bp, Homo sapiens
ttagcctatggaaaa

SEQ ID NO: 246665 - DNA, 15 bp, Homo sapiens
attagcctatggaaa

SEQ ID NO: 246666 - DNA, 15 bp, Homo sapiens
aattagcctatggaa

SEQ ID NO: 246667 - DNA, 15 bp, Homo sapiens
aaattagcctatgga

SEQ ID NO: 246668 - DNA, 15 bp, Homo sapiens
gaaattagcctatgg

SEQ ID NO: 246669 - DNA, 15 bp, Homo sapiens
agaaattagcctatg

SEQ ID NO: 246670 - DNA, 15 bp, Homo sapiens
tagaaattagcctat

SEQ ID NO: 246671 - DNA, 15 bp, Homo sapiens
gtagaaattagccta

SEQ ID NO: 246672 - DNA, 15 bp, Homo sapiens
tgtagaaattagcct

SEQ ID NO: 246673 - DNA, 15 bp, Homo sapiens
ctgtagaaattagcc

SEQ ID NO: 246674 - DNA, 15 bp, Homo sapiens
cctgtagaaattagc

SEQ ID NO: 246675 - DNA, 15 bp, Homo sapiens
tcctgtagaaattag

SEQ ID NO: 246676 - DNA, 15 bp, Homo sapiens
ctcctgtagaaatta

SEQ ID NO: 246677 - DNA, 15 bp, Homo sapiens
cctcctgtagaaatt

SEQ ID NO: 246678 - DNA, 15 bp, Homo sapiens
tcctcctgtagaaat

SEQ ID NO: 246679 - DNA, 15 bp, Homo sapiens
atcctcctgtagaaa

SEQ ID NO: 246680 - DNA, 15 bp, Homo sapiens
gatcctcctgtagaa

SEQ ID NO: 246681 - DNA, 15 bp, Homo sapiens
agatcctcctgtaga

SEQ ID NO: 246682 - DNA, 15 bp, Homo sapiens
tagatcctcctgtag

SEQ ID NO: 246683 - DNA, 15 bp, Homo sapiens
atagatcctcctgta

SEQ ID NO: 246684 - DNA, 15 bp, Homo sapiens
aatagatcctcctgt

SEQ ID NO: 246685 - DNA, 15 bp, Homo sapiens
aaatagatcctcctg

SEQ ID NO: 246686 - DNA, 15 bp, Homo sapiens
aaaatagatcctcct

SEQ ID NO: 246687 - DNA, 15 bp, Homo sapiens
gaaaatagatcctcc

SEQ ID NO: 246688 - DNA, 15 bp, Homo sapiens
agaaaatagatcctc

SEQ ID NO: 246689 - DNA, 15 bp, Homo sapiens
tagaaaatagatcct

SEQ ID NO: 246690 - DNA, 15 bp, Homo sapiens
ctagaaaatagatcc

SEQ ID NO: 246691 - DNA, 15 bp, Homo sapiens
tctagaaaatagatc

SEQ ID NO: 246692 - DNA, 15 bp, Homo sapiens
atctagaaaatagat

SEQ ID NO: 246693 - DNA, 15 bp, Homo sapiens
catctagaaaataga

SEQ ID NO: 246694 - DNA, 15 bp, Homo sapiens
acatctagaaaatag

SEQ ID NO: 246695 - DNA, 15 bp, Homo sapiens
aacatctagaaaata

SEQ ID NO: 246696 - DNA, 15 bp, Homo sapiens
aaacatctagaaaat

SEQ ID NO: 246697 - DNA, 15 bp, Homo sapiens
taaacatctagaaaa

SEQ ID NO: 246698 - DNA, 15 bp, Homo sapiens
ttaaacatctagaaa

SEQ ID NO: 246699 - DNA, 15 bp, Homo sapiens
tttaaacatctagaa

SEQ ID NO: 246700 - DNA, 15 bp, Homo sapiens
ctttaaacatctaga

SEQ ID NO: 246701 - DNA, 15 bp, Homo sapiens
gctttaaacatctag

SEQ ID NO: 246702 - DNA, 15 bp, Homo sapiens
tgctttaaacatcta

SEQ ID NO: 246703 - DNA, 15 bp, Homo sapiens
ctgctttaaacatct

SEQ ID NO: 246704 - DNA, 15 bp, Homo sapiens
actgctttaaacatc

SEQ ID NO: 246705 - DNA, 15 bp, Homo sapiens
aactgctttaaacat

SEQ ID NO: 246706 - DNA, 15 bp, Homo sapiens
aaactgctttaaaca

SEQ ID NO: 246707 - DNA, 15 bp, Homo sapiens
gaaactgctttaaac

SEQ ID NO: 246708 - DNA, 15 bp, Homo sapiens
tgaaactgctttaaa

SEQ ID NO: 246709 - DNA, 15 bp, Homo sapiens
gtgaaactgctttaa

SEQ ID NO: 246710 - DNA, 15 bp, Homo sapiens
tgtgaaactgcttta

SEQ ID NO: 246711 - DNA, 15 bp, Homo sapiens
gtgtgaaactgcttt

SEQ ID NO: 246712 - DNA, 15 bp, Homo sapiens
agtgtgaaactgctt

SEQ ID NO: 246713 - DNA, 15 bp, Homo sapiens
cagtgtgaaactgct

SEQ ID NO: 246714 - DNA, 15 bp, Homo sapiens
acagtgtgaaactgc

SEQ ID NO: 246715 - DNA, 15 bp, Homo sapiens
cacagtgtgaaactg

SEQ ID NO: 246716 - DNA, 15 bp, Homo sapiens
ccacagtgtgaaact

SEQ ID NO: 246717 - DNA, 15 bp, Homo sapiens
accacagtgtgaaac

SEQ ID NO: 246718 - DNA, 15 bp, Homo sapiens
gaccacagtgtgaaa

SEQ ID NO: 246719 - DNA, 15 bp, Homo sapiens
agaccacagtgtgaa

SEQ ID NO: 246720 - DNA, 15 bp, Homo sapiens
cagaccacagtgtga

SEQ ID NO: 246721 - DNA, 15 bp, Homo sapiens
ccagaccacagtgtg

SEQ ID NO: 246722 - DNA, 15 bp, Homo sapiens
accagaccacagtgt

SEQ ID NO: 246723 - DNA, 15 bp, Homo sapiens
taccagaccacagtg

SEQ ID NO: 246724 - DNA, 15 bp, Homo sapiens
ttaccagaccacagt

SEQ ID NO: 246725 - DNA, 15 bp, Homo sapiens
attaccagaccacag

SEQ ID NO: 246726 - DNA, 15 bp, Homo sapiens
cattaccagaccaca

SEQ ID NO: 246727 - DNA, 15 bp, Homo sapiens
ccattaccagaccac

SEQ ID NO: 246728 - DNA, 15 bp, Homo sapiens
tccattaccagacca

SEQ ID NO: 246729 - DNA, 15 bp, Homo sapiens
gtccattaccagacc

SEQ ID NO: 246730 - DNA, 15 bp, Homo sapiens
tgtccattaccagac

SEQ ID NO: 246731 - DNA, 15 bp, Homo sapiens
ttgtccattaccaga

SEQ ID NO: 246732 - DNA, 15 bp, Homo sapiens
tttgtccattaccag

SEQ ID NO: 246733 - DNA, 15 bp, Homo sapiens
ctttgtccattacca

SEQ ID NO: 246734 - DNA, 15 bp, Homo sapiens
cctttgtccattacc

SEQ ID NO: 246735 - DNA, 15 bp, Homo sapiens
acctttgtccattac

SEQ ID NO: 246736 - DNA, 15 bp, Homo sapiens
cacctttgtccatta

SEQ ID NO: 246737 - DNA, 15 bp, Homo sapiens
gcacctttgtccatt

SEQ ID NO: 246738 - DNA, 15 bp, Homo sapiens
agcacctttgtccat

SEQ ID NO: 246739 - DNA, 15 bp, Homo sapiens
aagcacctttgtcca

SEQ ID NO: 246740 - DNA, 15 bp, Homo sapiens
aaagcacctttgtcc

SEQ ID NO: 246741 - DNA, 15 bp, Homo sapiens
aaaagcacctttgtc

SEQ ID NO: 246742 - DNA, 15 bp, Homo sapiens
aaaaagcacctttgt

SEQ ID NO: 246743 - DNA, 15 bp, Homo sapiens
gaaaaagcacctttg

SEQ ID NO: 246744 - DNA, 15 bp, Homo sapiens
tgaaaaagcaccttt

SEQ ID NO: 246745 - DNA, 15 bp, Homo sapiens
atgaaaaagcacctt

SEQ ID NO: 246746 - DNA, 15 bp, Homo sapiens
tatgaaaaagcacct

SEQ ID NO: 246747 - DNA, 15 bp, Homo sapiens
ctatgaaaaagcacc

SEQ ID NO: 246748 - DNA, 15 bp, Homo sapiens
tctatgaaaaagcac

SEQ ID NO: 246749 - DNA, 15 bp, Homo sapiens
atctatgaaaaagca

SEQ ID NO: 246750 - DNA, 15 bp, Homo sapiens
tatctatgaaaaagc

SEQ ID NO: 246751 - DNA, 15 bp, Homo sapiens
ctatctatgaaaaag

SEQ ID NO: 246752 - DNA, 15 bp, Homo sapiens
cctatctatgaaaaa

SEQ ID NO: 246753 - DNA, 15 bp, Homo sapiens
tcctatctatgaaaa

SEQ ID NO: 246754 - DNA, 15 bp, Homo sapiens
ttcctatctatgaaa

SEQ ID NO: 246755 - DNA, 15 bp, Homo sapiens
cttcctatctatgaa

SEQ ID NO: 246756 - DNA, 15 bp, Homo sapiens
tcttcctatctatga

SEQ ID NO: 246757 - DNA, 15 bp, Homo sapiens
atcttcctatctatg

SEQ ID NO: 246758 - DNA, 15 bp, Homo sapiens
catcttcctatctat

SEQ ID NO: 246759 - DNA, 15 bp, Homo sapiens
acatcttcctatcta

SEQ ID NO: 246760 - DNA, 15 bp, Homo sapiens
gacatcttcctatct

SEQ ID NO: 246761 - DNA, 15 bp, Homo sapiens
tgacatcttcctatc

SEQ ID NO: 246762 - DNA, 15 bp, Homo sapiens
atgacatcttcctat

SEQ ID NO: 246763 - DNA, 15 bp, Homo sapiens
aatgacatcttccta

SEQ ID NO: 246764 - DNA, 15 bp, Homo sapiens
gaatgacatcttcct

SEQ ID NO: 246765 - DNA, 15 bp, Homo sapiens
ggaatgacatcttcc

SEQ ID NO: 246766 - DNA, 15 bp, Homo sapiens
gggaatgacatcttc

SEQ ID NO: 246767 - DNA, 15 bp, Homo sapiens
tgggaatgacatctt

SEQ ID NO: 246768 - DNA, 15 bp, Homo sapiens
gtgggaatgacatct

SEQ ID NO: 246769 - DNA, 15 bp, Homo sapiens
tgtgggaatgacatc

SEQ ID NO: 246770 - DNA, 15 bp, Homo sapiens
ctgtgggaatgacat

SEQ ID NO: 246771 - DNA, 15 bp, Homo sapiens
actgtgggaatgaca

SEQ ID NO: 246772 - DNA, 15 bp, Homo sapiens
cactgtgggaatgac

SEQ ID NO: 246773 - DNA, 15 bp, Homo sapiens
gcactgtgggaatga

SEQ ID NO: 246774 - DNA, 15 bp, Homo sapiens
agcactgtgggaatg

SEQ ID NO: 246775 - DNA, 15 bp, Homo sapiens
aagcactgtgggaat

SEQ ID NO: 246776 - DNA, 15 bp, Homo sapiens
caagcactgtgggaa

SEQ ID NO: 246777 - DNA, 15 bp, Homo sapiens
gcaagcactgtggga

SEQ ID NO: 246778 - DNA, 15 bp, Homo sapiens
ggcaagcactgtggg

SEQ ID NO: 246779 - DNA, 15 bp, Homo sapiens
tggcaagcactgtgg

SEQ ID NO: 246780 - DNA, 15 bp, Homo sapiens
ctggcaagcactgtg

SEQ ID NO: 246781 - DNA, 15 bp, Homo sapiens
actggcaagcactgt

SEQ ID NO: 246782 - DNA, 15 bp, Homo sapiens
aactggcaagcactg

SEQ ID NO: 246783 - DNA, 15 bp, Homo sapiens
caactggcaagcact

SEQ ID NO: 246784 - DNA, 15 bp, Homo sapiens
ccaactggcaagcac

SEQ ID NO: 246785 - DNA, 15 bp, Homo sapiens
tccaactggcaagca

SEQ ID NO: 246786 - DNA, 15 bp, Homo sapiens
gtccaactggcaagc

SEQ ID NO: 246787 - DNA, 15 bp, Homo sapiens
ggtccaactggcaag

SEQ ID NO: 246788 - DNA, 15 bp, Homo sapiens
aggtccaactggcaa

SEQ ID NO: 246789 - DNA, 15 bp, Homo sapiens
aaggtccaactggca

SEQ ID NO: 246790 - DNA, 15 bp, Homo sapiens
caaggtccaactggc

SEQ ID NO: 246791 - DNA, 15 bp, Homo sapiens
tcaaggtccaactgg

SEQ ID NO: 246792 - DNA, 15 bp, Homo sapiens
ctcaaggtccaactg

SEQ ID NO: 246793 - DNA, 15 bp, Homo sapiens
tctcaaggtccaact

SEQ ID NO: 246794 - DNA, 15 bp, Homo sapiens
ctctcaaggtccaac

SEQ ID NO: 246795 - DNA, 15 bp, Homo sapiens
cctctcaaggtccaa

SEQ ID NO: 246796 - DNA, 15 bp, Homo sapiens
tcctctcaaggtcca

SEQ ID NO: 246797 - DNA, 15 bp, Homo sapiens
ttcctctcaaggtcc

SEQ ID NO: 246798 - DNA, 15 bp, Homo sapiens
gttcctctcaaggtc

SEQ ID NO: 246799 - DNA, 15 bp, Homo sapiens
agttcctctcaaggt

SEQ ID NO: 246800 - DNA, 15 bp, Homo sapiens
gagttcctctcaagg

SEQ ID NO: 246801 - DNA, 15 bp, Homo sapiens
agagttcctctcaag

SEQ ID NO: 246802 - DNA, 15 bp, Homo sapiens
cagagttcctctcaa

SEQ ID NO: 246803 - DNA, 15 bp, Homo sapiens
tcagagttcctctca

SEQ ID NO: 246804 - DNA, 15 bp, Homo sapiens
ctcagagttcctctc

SEQ ID NO: 246805 - DNA, 15 bp, Homo sapiens
cctcagagttcctct

SEQ ID NO: 246806 - DNA, 15 bp, Homo sapiens
acctcagagttcctc

SEQ ID NO: 246807 - DNA, 15 bp, Homo sapiens
cacctcagagttcct

SEQ ID NO: 246808 - DNA, 15 bp, Homo sapiens
ccacctcagagttcc

SEQ ID NO: 246809 - DNA, 15 bp, Homo sapiens
cccacctcagagttc

SEQ ID NO: 246810 - DNA, 15 bp, Homo sapiens
ccccacctcagagtt

SEQ ID NO: 246811 - DNA, 15 bp, Homo sapiens
tccccacctcagagt

SEQ ID NO: 246812 - DNA, 15 bp, Homo sapiens
ttccccacctcagag

SEQ ID NO: 246813 - DNA, 15 bp, Homo sapiens
tttccccacctcaga

SEQ ID NO: 246814 - DNA, 15 bp, Homo sapiens
gtttccccacctcag

SEQ ID NO: 246815 - DNA, 15 bp, Homo sapiens
tgtttccccacctca

SEQ ID NO: 246816 - DNA, 15 bp, Homo sapiens
gtgtttccccacctc

SEQ ID NO: 246817 - DNA, 15 bp, Homo sapiens
tgtgtttccccacct

SEQ ID NO: 246818 - DNA, 15 bp, Homo sapiens
gtgtgtttccccacc

SEQ ID NO: 246819 - DNA, 15 bp, Homo sapiens
agtgtgtttccccac

SEQ ID NO: 246820 - DNA, 15 bp, Homo sapiens
gagtgtgtttcccca

SEQ ID NO: 246821 - DNA, 15 bp, Homo sapiens
agagtgtgtttcccc

SEQ ID NO: 246822 - DNA, 15 bp, Homo sapiens
aagagtgtgtttccc

SEQ ID NO: 246823 - DNA, 15 bp, Homo sapiens
aaagagtgtgtttcc

SEQ ID NO: 246824 - DNA, 15 bp, Homo sapiens
caaagagtgtgtttc

SEQ ID NO: 246825 - DNA, 15 bp, Homo sapiens
ccaaagagtgtgttt

SEQ ID NO: 246826 - DNA, 15 bp, Homo sapiens
gccaaagagtgtgtt

SEQ ID NO: 246827 - DNA, 15 bp, Homo sapiens
ggccaaagagtgtgt

SEQ ID NO: 246828 - DNA, 15 bp, Homo sapiens
aggccaaagagtgtg

SEQ ID NO: 246829 - DNA, 15 bp, Homo sapiens
aaggccaaagagtgt

SEQ ID NO: 246830 - DNA, 15 bp, Homo sapiens
gaaggccaaagagtg

SEQ ID NO: 246831 - DNA, 15 bp, Homo sapiens
ggaaggccaaagagt

SEQ ID NO: 246832 - DNA, 15 bp, Homo sapiens
aggaaggccaaagag

SEQ ID NO: 246833 - DNA, 15 bp, Homo sapiens
gaggaaggccaaaga

SEQ ID NO: 246834 - DNA, 15 bp, Homo sapiens
agaggaaggccaaag

SEQ ID NO: 246835 - DNA, 15 bp, Homo sapiens
tagaggaaggccaaa

SEQ ID NO: 246836 - DNA, 15 bp, Homo sapiens
atagaggaaggccaa

SEQ ID NO: 246837 - DNA, 15 bp, Homo sapiens
gatagaggaaggcca

SEQ ID NO: 246838 - DNA, 15 bp, Homo sapiens
agatagaggaaggcc

SEQ ID NO: 246839 - DNA, 15 bp, Homo sapiens
aagatagaggaaggc

SEQ ID NO: 246840 - DNA, 15 bp, Homo sapiens
aaagatagaggaagg

SEQ ID NO: 246841 - DNA, 15 bp, Homo sapiens
gaaagatagaggaag

SEQ ID NO: 246842 - DNA, 15 bp, Homo sapiens
ggaaagatagaggaa

SEQ ID NO: 246843 - DNA, 15 bp, Homo sapiens
gggaaagatagagga

SEQ ID NO: 246844 - DNA, 15 bp, Homo sapiens
ggggaaagatagagg

SEQ ID NO: 246845 - DNA, 15 bp, Homo sapiens
tggggaaagatagag

SEQ ID NO: 246846 - DNA, 15 bp, Homo sapiens
atggggaaagataga

SEQ ID NO: 246847 - DNA, 15 bp, Homo sapiens
aatggggaaagatag

SEQ ID NO: 246848 - DNA, 15 bp, Homo sapiens
gaatggggaaagata

SEQ ID NO: 246849 - DNA, 15 bp, Homo sapiens
tgaatggggaaagat

SEQ ID NO: 246850 - DNA, 15 bp, Homo sapiens
gtgaatggggaaaga

SEQ ID NO: 246851 - DNA, 15 bp, Homo sapiens
tgtgaatggggaaag

SEQ ID NO: 246852 - DNA, 15 bp, Homo sapiens
atgtgaatggggaaa

SEQ ID NO: 246853 - DNA, 15 bp, Homo sapiens
catgtgaatggggaa

SEQ ID NO: 246854 - DNA, 15 bp, Homo sapiens
tcatgtgaatgggga

SEQ ID NO: 246855 - DNA, 15 bp, Homo sapiens
atcatgtgaatgggg

SEQ ID NO: 246856 - DNA, 15 bp, Homo sapiens
gatcatgtgaatggg

SEQ ID NO: 246857 - DNA, 15 bp, Homo sapiens
agatcatgtgaatgg

SEQ ID NO: 246858 - DNA, 15 bp, Homo sapiens
cagatcatgtgaatg

SEQ ID NO: 246859 - DNA, 15 bp, Homo sapiens
tcagatcatgtgaat

SEQ ID NO: 246860 - DNA, 15 bp, Homo sapiens
ttcagatcatgtgaa

SEQ ID NO: 246861 - DNA, 15 bp, Homo sapiens
cttcagatcatgtga

SEQ ID NO: 246862 - DNA, 15 bp, Homo sapiens
tcttcagatcatgtg

SEQ ID NO: 246863 - DNA, 15 bp, Homo sapiens
atcttcagatcatgt

SEQ ID NO: 246864 - DNA, 15 bp, Homo sapiens
aatcttcagatcatg

SEQ ID NO: 246865 - DNA, 15 bp, Homo sapiens
aaatcttcagatcat

SEQ ID NO: 246866 - DNA, 15 bp, Homo sapiens
gaaatcttcagatca

SEQ ID NO: 246867 - DNA, 15 bp, Homo sapiens
agaaatcttcagatc

SEQ ID NO: 246868 - DNA, 15 bp, Homo sapiens
cagaaatcttcagat

SEQ ID NO: 246869 - DNA, 15 bp, Homo sapiens
acagaaatcttcaga

SEQ ID NO: 246870 - DNA, 15 bp, Homo sapiens
gacagaaatcttcag

SEQ ID NO: 246871 - DNA, 15 bp, Homo sapiens
tgacagaaatcttca

SEQ ID NO: 246872 - DNA, 15 bp, Homo sapiens
ttgacagaaatcttc

SEQ ID NO: 246873 - DNA, 15 bp, Homo sapiens
gttgacagaaatctt

SEQ ID NO: 246874 - DNA, 15 bp, Homo sapiens
agttgacagaaatct

SEQ ID NO: 246875 - DNA, 15 bp, Homo sapiens
cagttgacagaaatc

SEQ ID NO: 246876 - DNA, 15 bp, Homo sapiens
ccagttgacagaaat

SEQ ID NO: 246877 - DNA, 15 bp, Homo sapiens
accagttgacagaaa

SEQ ID NO: 246878 - DNA, 15 bp, Homo sapiens
taccagttgacagaa

SEQ ID NO: 246879 - DNA, 15 bp, Homo sapiens
ctaccagttgacaga

SEQ ID NO: 246880 - DNA, 15 bp, Homo sapiens
tctaccagttgacag

SEQ ID NO: 246881 - DNA, 15 bp, Homo sapiens
atctaccagttgaca

SEQ ID NO: 246882 - DNA, 15 bp, Homo sapiens
aatctaccagttgac

SEQ ID NO: 246883 - DNA, 15 bp, Homo sapiens
aaatctaccagttga

SEQ ID NO: 246884 - DNA, 15 bp, Homo sapiens
taaatctaccagttg

SEQ ID NO: 246885 - DNA, 15 bp, Homo sapiens
ttaaatctaccagtt

SEQ ID NO: 246886 - DNA, 15 bp, Homo sapiens
cttaaatctaccagt

SEQ ID NO: 246887 - DNA, 15 bp, Homo sapiens
acttaaatctaccag

SEQ ID NO: 246888 - DNA, 15 bp, Homo sapiens
tacttaaatctacca

SEQ ID NO: 246889 - DNA, 15 bp, Homo sapiens
atacttaaatctacc

SEQ ID NO: 246890 - DNA, 15 bp, Homo sapiens
gatacttaaatctac

SEQ ID NO: 246891 - DNA, 15 bp, Homo sapiens
agatacttaaatcta

SEQ ID NO: 246892 - DNA, 15 bp, Homo sapiens
cagatacttaaatct

SEQ ID NO: 246893 - DNA, 15 bp, Homo sapiens
gcagatacttaaatc

SEQ ID NO: 246894 - DNA, 15 bp, Homo sapiens
cgcagatacttaaat

SEQ ID NO: 246895 - DNA, 15 bp, Homo sapiens
tcgcagatacttaaa

SEQ ID NO: 246896 - DNA, 15 bp, Homo sapiens
ctcgcagatacttaa

SEQ ID NO: 246897 - DNA, 15 bp, Homo sapiens
actcgcagatactta

SEQ ID NO: 246898 - DNA, 15 bp, Homo sapiens
tactcgcagatactt

SEQ ID NO: 246899 - DNA, 15 bp, Homo sapiens
ttactcgcagatact

SEQ ID NO: 246900 - DNA, 15 bp, Homo sapiens
cttactcgcagatac

SEQ ID NO: 246901 - DNA, 15 bp, Homo sapiens
tcttactcgcagata

SEQ ID NO: 246902 - DNA, 15 bp, Homo sapiens
atcttactcgcagat

SEQ ID NO: 246903 - DNA, 15 bp, Homo sapiens
catcttactcgcaga

SEQ ID NO: 246904 - DNA, 15 bp, Homo sapiens
ccatcttactcgcag

SEQ ID NO: 246905 - DNA, 15 bp, Homo sapiens
gccatcttactcgca

SEQ ID NO: 246906 - DNA, 15 bp, Homo sapiens
ggccatcttactcgc

SEQ ID NO: 246907 - DNA, 15 bp, Homo sapiens
tggccatcttactcg

SEQ ID NO: 246908 - DNA, 15 bp, Homo sapiens
ttggccatcttactc

SEQ ID NO: 246909 - DNA, 15 bp, Homo sapiens
gttggccatcttact

SEQ ID NO: 246910 - DNA, 15 bp, Homo sapiens
tgttggccatcttac

SEQ ID NO: 246911 - DNA, 15 bp, Homo sapiens
ttgttggccatctta

SEQ ID NO: 246912 - DNA, 15 bp, Homo sapiens
tttgttggccatctt

SEQ ID NO: 246913 - DNA, 15 bp, Homo sapiens
ctttgttggccatct

SEQ ID NO: 246914 - DNA, 15 bp, Homo sapiens
gctttgttggccatc

SEQ ID NO: 246915 - DNA, 15 bp, Homo sapiens
agctttgttggccat

SEQ ID NO: 246916 - DNA, 15 bp, Homo sapiens
cagctttgttggcca

SEQ ID NO: 246917 - DNA, 15 bp, Homo sapiens
ccagctttgttggcc

SEQ ID NO: 246918 - DNA, 15 bp, Homo sapiens
gccagctttgttggc

SEQ ID NO: 246919 - DNA, 15 bp, Homo sapiens
agccagctttgttgg

SEQ ID NO: 246920 - DNA, 15 bp, Homo sapiens
aagccagctttgttg

SEQ ID NO: 246921 - DNA, 15 bp, Homo sapiens
taagccagctttgtt

SEQ ID NO: 246922 - DNA, 15 bp, Homo sapiens
ataagccagctttgt

SEQ ID NO: 246923 - DNA, 15 bp, Homo sapiens
tataagccagctttg

SEQ ID NO: 246924 - DNA, 15 bp, Homo sapiens
ttataagccagcttt

SEQ ID NO: 246925 - DNA, 15 bp, Homo sapiens
cttataagccagctt

SEQ ID NO: 246926 - DNA, 15 bp, Homo sapiens
acttataagccagct

SEQ ID NO: 246927 - DNA, 15 bp, Homo sapiens
gacttataagccagc

SEQ ID NO: 246928 - DNA, 15 bp, Homo sapiens
ggacttataagccag

SEQ ID NO: 246929 - DNA, 15 bp, Homo sapiens
aggacttataagcca

SEQ ID NO: 246930 - DNA, 15 bp, Homo sapiens
taggacttataagcc

SEQ ID NO: 246931 - DNA, 15 bp, Homo sapiens
ttaggacttataagc

SEQ ID NO: 246932 - DNA, 15 bp, Homo sapiens
cttaggacttataag

SEQ ID NO: 246933 - DNA, 15 bp, Homo sapiens
ccttaggacttataa

SEQ ID NO: 246934 - DNA, 15 bp, Homo sapiens
cccttaggacttata

SEQ ID NO: 246935 - DNA, 15 bp, Homo sapiens
tcccttaggacttat

SEQ ID NO: 246936 - DNA, 15 bp, Homo sapiens
gtcccttaggactta

SEQ ID NO: 246937 - DNA, 15 bp, Homo sapiens
ctctaaatggcccca

SEQ ID NO: 246938 - DNA, 15 bp, Homo sapiens
tctctaaatggcccc

SEQ ID NO: 246939 - DNA, 15 bp, Homo sapiens
ctctctaaatggccc

SEQ ID NO: 246940 - DNA, 15 bp, Homo sapiens
cctctctaaatggcc

SEQ ID NO: 246941 - DNA, 15 bp, Homo sapiens
tcctctctaaatggc

SEQ ID NO: 246942 - DNA, 15 bp, Homo sapiens
ttcctctctaaatgg

SEQ ID NO: 246943 - DNA, 15 bp, Homo sapiens
tttcctctctaaatg

SEQ ID NO: 246944 - DNA, 15 bp, Homo sapiens
ttttcctctctaaat

SEQ ID NO: 246945 - DNA, 15 bp, Homo sapiens
tttttcctctctaaa

SEQ ID NO: 246946 - DNA, 15 bp, Homo sapiens
ttttttcctctctaa

SEQ ID NO: 246947 - DNA, 15 bp, Homo sapiens
cttttttcctctcta

SEQ ID NO: 246948 - DNA, 15 bp, Homo sapiens
tcttttttcctctct

SEQ ID NO: 246949 - DNA, 15 bp, Homo sapiens
atcttttttcctctc

SEQ ID NO: 246950 - DNA, 15 bp, Homo sapiens
tatcttttttcctct

SEQ ID NO: 246951 - DNA, 15 bp, Homo sapiens
atatcttttttcctc

SEQ ID NO: 246952 - DNA, 15 bp, Homo sapiens
gatatcttttttcct

SEQ ID NO: 246953 - DNA, 15 bp, Homo sapiens
agatatcttttttcc

SEQ ID NO: 246954 - DNA, 15 bp, Homo sapiens
tagatatcttttttc

SEQ ID NO: 246955 - DNA, 15 bp, Homo sapiens
tatagatatcttttt

SEQ ID NO: 246956 - DNA, 15 bp, Homo sapiens
gtatagatatctttt

SEQ ID NO: 246957 - DNA, 15 bp, Homo sapiens
agtatagatatcttt

SEQ ID NO: 246958 - DNA, 15 bp, Homo sapiens
aagtatagatatctt

SEQ ID NO: 246959 - DNA, 15 bp, Homo sapiens
aaagtatagatatct

SEQ ID NO: 246960 - DNA, 15 bp, Homo sapiens
taaagtatagatatc

SEQ ID NO: 246961 - DNA, 15 bp, Homo sapiens
ataaagtatagatat

SEQ ID NO: 246962 - DNA, 15 bp, Homo sapiens
tataaagtatagata

SEQ ID NO: 246963 - DNA, 15 bp, Homo sapiens
ttataaagtatagat

SEQ ID NO: 246964 - DNA, 15 bp, Homo sapiens
tttataaagtataga

SEQ ID NO: 246965 - DNA, 15 bp, Homo sapiens
ctttataaagtatag

SEQ ID NO: 246966 - DNA, 15 bp, Homo sapiens
tctttataaagtata

SEQ ID NO: 246967 - DNA, 15 bp, Homo sapiens
atctttataaagtat

SEQ ID NO: 246968 - DNA, 15 bp, Homo sapiens
aatctttataaagta

SEQ ID NO: 246969 - DNA, 15 bp, Homo sapiens
taatctttataaagt

SEQ ID NO: 246970 - DNA, 15 bp, Homo sapiens
ttaatctttataaag

SEQ ID NO: 246971 - DNA, 15 bp, Homo sapiens
tttaatctttataaa

SEQ ID NO: 246972 - DNA, 15 bp, Homo sapiens
atttaatctttataa

SEQ ID NO: 246973 - DNA, 15 bp, Homo sapiens
aatttaatctttata

SEQ ID NO: 246974 - DNA, 15 bp, Homo sapiens
aaatttaatctttat

SEQ ID NO: 246975 - DNA, 15 bp, Homo sapiens
aaaatttaatcttta

SEQ ID NO: 246976 - DNA, 15 bp, Homo sapiens
aaaaatttaatcttt

SEQ ID NO: 246977 - DNA, 15 bp, Homo sapiens
taaaaatttaatctt

SEQ ID NO: 246978 - DNA, 15 bp, Homo sapiens
ttaaaaatttaatct

SEQ ID NO: 246979 - DNA, 15 bp, Homo sapiens
tttaaaaatttaatc

SEQ ID NO: 246980 - DNA, 15 bp, Homo sapiens
ttttaaaaatttaat

SEQ ID NO: 246981 - DNA, 15 bp, Homo sapiens
gttttaaaaatttaa

SEQ ID NO: 246982 - DNA, 15 bp, Homo sapiens
agttttaaaaattta

SEQ ID NO: 246983 - DNA, 15 bp, Homo sapiens
cagttttaaaaattt

SEQ ID NO: 246984 - DNA, 15 bp, Homo sapiens
gcagttttaaaaatt

SEQ ID NO: 246985 - DNA, 15 bp, Homo sapiens
ggcagttttaaaaat

SEQ ID NO: 246986 - DNA, 15 bp, Homo sapiens
tggcagttttaaaaa

SEQ ID NO: 246987 - DNA, 15 bp, Homo sapiens
atggcagttttaaaa

SEQ ID NO: 246988 - DNA, 15 bp, Homo sapiens
aatggcagttttaaa

SEQ ID NO: 246989 - DNA, 15 bp, Homo sapiens
caatggcagttttaa

SEQ ID NO: 246990 - DNA, 15 bp, Homo sapiens
gcaatggcagtttta

SEQ ID NO: 246991 - DNA, 15 bp, Homo sapiens
tgcaatggcagtttt

SEQ ID NO: 246992 - DNA, 15 bp, Homo sapiens
ttgcaatggcagttt

SEQ ID NO: 246993 - DNA, 15 bp, Homo sapiens
attgcaatggcagtt

SEQ ID NO: 246994 - DNA, 15 bp, Homo sapiens
aattgcaatggcagt

SEQ ID NO: 246995 - DNA, 15 bp, Homo sapiens
taattgcaatggcag

SEQ ID NO: 246996 - DNA, 15 bp, Homo sapiens
ctaattgcaatggca

SEQ ID NO: 246997 - DNA, 15 bp, Homo sapiens
gctaattgcaatggc

SEQ ID NO: 246998 - DNA, 15 bp, Homo sapiens
tgctaattgcaatgg

SEQ ID NO: 246999 - DNA, 15 bp, Homo sapiens
ttgctaattgcaatg

SEQ ID NO: 247000 - DNA, 15 bp, Homo sapiens
tttgctaattgcaat

SEQ ID NO: 247001 - DNA, 15 bp, Homo sapiens
ttttgctaattgcaa

SEQ ID NO: 247002 - DNA, 15 bp, Homo sapiens
cttttgctaattgca

SEQ ID NO: 247003 - DNA, 15 bp, Homo sapiens
acttttgctaattgc

SEQ ID NO: 247004 - DNA, 15 bp, Homo sapiens
tacttttgctaattg

SEQ ID NO: 247005 - DNA, 15 bp, Homo sapiens
gtacttttgctaatt

SEQ ID NO: 247006 - DNA, 15 bp, Homo sapiens
tgtacttttgctaat

SEQ ID NO: 247007 - DNA, 15 bp, Homo sapiens
ctgtacttttgctaa

SEQ ID NO: 247008 - DNA, 15 bp, Homo sapiens
tctgtacttttgcta

SEQ ID NO: 247009 - DNA, 15 bp, Homo sapiens
ttctgtacttttgct

SEQ ID NO: 247010 - DNA, 15 bp, Homo sapiens
cttctgtacttttgc

SEQ ID NO: 247011 - DNA, 15 bp, Homo sapiens
acttctgtacttttg

SEQ ID NO: 247012 - DNA, 15 bp, Homo sapiens
tacttctgtactttt

SEQ ID NO: 247013 - DNA, 15 bp, Homo sapiens
ttacttctgtacttt

SEQ ID NO: 247014 - DNA, 15 bp, Homo sapiens
attacttctgtactt

SEQ ID NO: 247015 - DNA, 15 bp, Homo sapiens
tattacttctgtact

SEQ ID NO: 247016 - DNA, 15 bp, Homo sapiens
ttattacttctgtac

SEQ ID NO: 247017 - DNA, 15 bp, Homo sapiens
attattacttctgta

SEQ ID NO: 247018 - DNA, 15 bp, Homo sapiens
cattattacttctgt

SEQ ID NO: 247019 - DNA, 15 bp, Homo sapiens
acattattacttctg

SEQ ID NO: 247020 - DNA, 15 bp, Homo sapiens
aacattattacttct

SEQ ID NO: 247021 - DNA, 15 bp, Homo sapiens
aaacattattacttc

SEQ ID NO: 247022 - DNA, 15 bp, Homo sapiens
taaacattattactt

SEQ ID NO: 247023 - DNA, 15 bp, Homo sapiens
ttaaacattattact

SEQ ID NO: 247024 - DNA, 15 bp, Homo sapiens
tttaaacattattac

SEQ ID NO: 247025 - DNA, 15 bp, Homo sapiens
ttttaaacattatta

SEQ ID NO: 247026 - DNA, 15 bp, Homo sapiens
attttaaacattatt

SEQ ID NO: 247027 - DNA, 15 bp, Homo sapiens
aattttaaacattat

SEQ ID NO: 247028 - DNA, 15 bp, Homo sapiens
caattttaaacatta

SEQ ID NO: 247029 - DNA, 15 bp, Homo sapiens
acaattttaaacatt

SEQ ID NO: 247030 - DNA, 15 bp, Homo sapiens
tacaattttaaacat

SEQ ID NO: 247031 - DNA, 15 bp, Homo sapiens
ttacaattttaaaca

SEQ ID NO: 247032 - DNA, 15 bp, Homo sapiens
tttacaattttaaac

SEQ ID NO: 247033 - DNA, 15 bp, Homo sapiens
ttttacaattttaaa

SEQ ID NO: 247034 - DNA, 15 bp, Homo sapiens
attttacaattttaa

SEQ ID NO: 247035 - DNA, 15 bp, Homo sapiens
tattttacaatttta

SEQ ID NO: 247036 - DNA, 15 bp, Homo sapiens
ttattttacaatttt

SEQ ID NO: 247037 - DNA, 15 bp, Homo sapiens
tttattttacaattt

SEQ ID NO: 247038 - DNA, 15 bp, Homo sapiens
atttattttacaatt

SEQ ID NO: 247039 - DNA, 15 bp, Homo sapiens
tatttattttacaat

SEQ ID NO: 247040 - DNA, 15 bp, Homo sapiens
ctatttattttacaa

SEQ ID NO: 247041 - DNA, 15 bp, Homo sapiens
tctatttattttaca

SEQ ID NO: 247042 - DNA, 15 bp, Homo sapiens
ttctatttattttac

SEQ ID NO: 247043 - DNA, 15 bp, Homo sapiens
tttctatttatttta

SEQ ID NO: 247044 - DNA, 15 bp, Homo sapiens
atttctatttatttt

SEQ ID NO: 247045 - DNA, 15 bp, Homo sapiens
tatttctatttattt

SEQ ID NO: 247046 - DNA, 15 bp, Homo sapiens
atatttctatttatt

SEQ ID NO: 247047 - DNA, 15 bp, Homo sapiens
catatttctatttat

SEQ ID NO: 247048 - DNA, 15 bp, Homo sapiens
gcatatttctattta

SEQ ID NO: 247049 - DNA, 15 bp, Homo sapiens
agcatatttctattt

SEQ ID NO: 247050 - DNA, 15 bp, Homo sapiens
cagcatatttctatt

SEQ ID NO: 247051 - DNA, 15 bp, Homo sapiens
tcagcatatttctat

SEQ ID NO: 247052 - DNA, 15 bp, Homo sapiens
atcagcatatttcta

SEQ ID NO: 247053 - DNA, 15 bp, Homo sapiens
aatcagcatatttct

SEQ ID NO: 247054 - DNA, 15 bp, Homo sapiens
taatcagcatatttc

SEQ ID NO: 247055 - DNA, 15 bp, Homo sapiens
ataatcagcatattt

SEQ ID NO: 247056 - DNA, 15 bp, Homo sapiens
tataatcagcatatt

SEQ ID NO: 247057 - DNA, 15 bp, Homo sapiens
ttataatcagcatat

SEQ ID NO: 247058 - DNA, 15 bp, Homo sapiens
tttataatcagcata

SEQ ID NO: 247059 - DNA, 15 bp, Homo sapiens
ctttataatcagcat

SEQ ID NO: 247060 - DNA, 15 bp, Homo sapiens
actttataatcagca

SEQ ID NO: 247061 - DNA, 15 bp, Homo sapiens
tactttataatcagc

SEQ ID NO: 247062 - DNA, 15 bp, Homo sapiens
ttactttataatcag

SEQ ID NO: 247063 - DNA, 15 bp, Homo sapiens
tttactttataatca

SEQ ID NO: 247064 - DNA, 15 bp, Homo sapiens
ttttactttataatc

SEQ ID NO: 247065 - DNA, 15 bp, Homo sapiens
attttactttataat

SEQ ID NO: 247066 - DNA, 15 bp, Homo sapiens
tattttactttataa

SEQ ID NO: 247067 - DNA, 15 bp, Homo sapiens
ttattttactttata

SEQ ID NO: 247068 - DNA, 15 bp, Homo sapiens
attattttactttat

SEQ ID NO: 247069 - DNA, 15 bp, Homo sapiens
tattattttacttta

SEQ ID NO: 247070 - DNA, 15 bp, Homo sapiens
gtattattttacttt

SEQ ID NO: 247071 - DNA, 15 bp, Homo sapiens
tgtattattttactt

SEQ ID NO: 247072 - DNA, 15 bp, Homo sapiens
ctgtattattttact

SEQ ID NO: 247073 - DNA, 15 bp, Homo sapiens
actgtattattttac

SEQ ID NO: 247074 - DNA, 15 bp, Homo sapiens
tactgtattatttta

SEQ ID NO: 247075 - DNA, 15 bp, Homo sapiens
ttactgtattatttt

SEQ ID NO: 247076 - DNA, 15 bp, Homo sapiens
tttactgtattattt

SEQ ID NO: 247077 - DNA, 15 bp, Homo sapiens
ttttactgtattatt

SEQ ID NO: 247078 - DNA, 15 bp, Homo sapiens
cttttactgtattat

SEQ ID NO: 247079 - DNA, 15 bp, Homo sapiens
tcttttactgtatta

SEQ ID NO: 247080 - DNA, 15 bp, Homo sapiens
atcttttactgtatt

SEQ ID NO: 247081 - DNA, 15 bp, Homo sapiens
aatcttttactgtat

SEQ ID NO: 247082 - DNA, 15 bp, Homo sapiens
aaatcttttactgta

SEQ ID NO: 247083 - DNA, 15 bp, Homo sapiens
gaaatcttttactgt

SEQ ID NO: 247084 - DNA, 15 bp, Homo sapiens
tgaaatcttttactg

SEQ ID NO: 247085 - DNA, 15 bp, Homo sapiens
atgaaatcttttact

SEQ ID NO: 247086 - DNA, 15 bp, Homo sapiens
tatgaaatcttttac

SEQ ID NO: 247087 - DNA, 15 bp, Homo sapiens
atatgaaatctttta

SEQ ID NO: 247088 - DNA, 15 bp, Homo sapiens
tatatgaaatctttt

SEQ ID NO: 247089 - DNA, 15 bp, Homo sapiens
ttatatgaaatcttt

SEQ ID NO: 247090 - DNA, 15 bp, Homo sapiens
gttatatgaaatctt

SEQ ID NO: 247091 - DNA, 15 bp, Homo sapiens
ggttatatgaaatct

SEQ ID NO: 247092 - DNA, 15 bp, Homo sapiens
tggttatatgaaatc

SEQ ID NO: 247093 - DNA, 15 bp, Homo sapiens
atggttatatgaaat

SEQ ID NO: 247094 - DNA, 15 bp, Homo sapiens
tatggttatatgaaa

SEQ ID NO: 247095 - DNA, 15 bp, Homo sapiens
atatggttatatgaa

SEQ ID NO: 247096 - DNA, 15 bp, Homo sapiens
tatatggttatatga

SEQ ID NO: 247097 - DNA, 15 bp, Homo sapiens
ctatatggttatatg

SEQ ID NO: 247098 - DNA, 15 bp, Homo sapiens
tctatatggttatat

SEQ ID NO: 247099 - DNA, 15 bp, Homo sapiens
ttctatatggttata

SEQ ID NO: 247100 - DNA, 15 bp, Homo sapiens
tttctatatggttat

SEQ ID NO: 247101 - DNA, 15 bp, Homo sapiens
ttttctatatggtta

SEQ ID NO: 247102 - DNA, 15 bp, Homo sapiens
tttttctatatggtt

SEQ ID NO: 247103 - DNA, 15 bp, Homo sapiens
ttttttctatatggt

SEQ ID NO: 247104 - DNA, 15 bp, Homo sapiens
tttttttctatatgg

SEQ ID NO: 247105 - DNA, 15 bp, Homo sapiens
atttttttctatatg

SEQ ID NO: 247106 - DNA, 15 bp, Homo sapiens
tatttttttctatat

SEQ ID NO: 247107 - DNA, 15 bp, Homo sapiens
ctatttttttctata

SEQ ID NO: 247108 - DNA, 15 bp, Homo sapiens
tctatttttttctat

SEQ ID NO: 247109 - DNA, 15 bp, Homo sapiens
ttctatttttttcta

SEQ ID NO: 247110 - DNA, 15 bp, Homo sapiens
cttctatttttttct

SEQ ID NO: 247111 - DNA, 15 bp, Homo sapiens
acttctatttttttc

SEQ ID NO: 247112 - DNA, 15 bp, Homo sapiens
tacttctattttttt

SEQ ID NO: 247113 - DNA, 15 bp, Homo sapiens
ttacttctatttttt

SEQ ID NO: 247114 - DNA, 15 bp, Homo sapiens
attacttctattttt

SEQ ID NO: 247115 - DNA, 15 bp, Homo sapiens
aattacttctatttt

SEQ ID NO: 247116 - DNA, 15 bp, Homo sapiens
taattacttctattt

SEQ ID NO: 247117 - DNA, 15 bp, Homo sapiens
ttaattacttctatt

SEQ ID NO: 247118 - DNA, 15 bp, Homo sapiens
attaattacttctat

SEQ ID NO: 247119 - DNA, 15 bp, Homo sapiens
gattaattacttcta

SEQ ID NO: 247120 - DNA, 15 bp, Homo sapiens
ggattaattacttct

SEQ ID NO: 247121 - DNA, 15 bp, Homo sapiens
gggattaattacttc

SEQ ID NO: 247122 - DNA, 15 bp, Homo sapiens
agggattaattactt

SEQ ID NO: 247123 - DNA, 15 bp, Homo sapiens
aagggattaattact

SEQ ID NO: 247124 - DNA, 15 bp, Homo sapiens
gaagggattaattac

SEQ ID NO: 247125 - DNA, 15 bp, Homo sapiens
agaagggattaatta

SEQ ID NO: 247126 - DNA, 15 bp, Homo sapiens
aagaagggattaatt

SEQ ID NO: 247127 - DNA, 15 bp, Homo sapiens
aaagaagggattaat

SEQ ID NO: 247128 - DNA, 15 bp, Homo sapiens
aaaagaagggattaa

SEQ ID NO: 247129 - DNA, 15 bp, Homo sapiens
taaaagaagggatta

SEQ ID NO: 247130 - DNA, 15 bp, Homo sapiens
ttaaaagaagggatt

SEQ ID NO: 247131 - DNA, 15 bp, Homo sapiens
tttaaaagaagggat

SEQ ID NO: 247132 - DNA, 15 bp, Homo sapiens
ttttaaaagaaggga

SEQ ID NO: 247133 - DNA, 15 bp, Homo sapiens
tttttaaaagaaggg

SEQ ID NO: 247134 - DNA, 15 bp, Homo sapiens
atttttaaaagaagg

SEQ ID NO: 247135 - DNA, 15 bp, Homo sapiens
tatttttaaaagaag

SEQ ID NO: 247136 - DNA, 15 bp, Homo sapiens
gtatttttaaaagaa

SEQ ID NO: 247137 - DNA, 15 bp, Homo sapiens
tgtatttttaaaaga

SEQ ID NO: 247138 - DNA, 15 bp, Homo sapiens
atgtatttttaaaag

SEQ ID NO: 247139 - DNA, 15 bp, Homo sapiens
tatgtatttttaaaa

SEQ ID NO: 247140 - DNA, 15 bp, Homo sapiens
ttatgtatttttaaa

SEQ ID NO: 247141 - DNA, 15 bp, Homo sapiens
tttatgtatttttaa

SEQ ID NO: 247142 - DNA, 15 bp, Homo sapiens
cttttatgtattttt

SEQ ID NO: 247143 - DNA, 15 bp, Homo sapiens
tcttttatgtatttt

SEQ ID NO: 247144 - DNA, 15 bp, Homo sapiens
ttcttttatgtattt

SEQ ID NO: 247145 - DNA, 15 bp, Homo sapiens
tttcttttatgtatt

SEQ ID NO: 247146 - DNA, 15 bp, Homo sapiens
ctttcttttatgtat

SEQ ID NO: 247147 - DNA, 15 bp, Homo sapiens
tctttcttttatgta

SEQ ID NO: 247148 - DNA, 15 bp, Homo sapiens
ctctttcttttatgt

SEQ ID NO: 247149 - DNA, 15 bp, Homo sapiens
tctctttcttttatg

SEQ ID NO: 247150 - DNA, 15 bp, Homo sapiens
atctctttcttttat

SEQ ID NO: 247151 - DNA, 15 bp, Homo sapiens
tatctctttctttta

SEQ ID NO: 247152 - DNA, 15 bp, Homo sapiens
ttatctctttctttt

SEQ ID NO: 247153 - DNA, 15 bp, Homo sapiens
tttatctctttcttt

SEQ ID NO: 247154 - DNA, 15 bp, Homo sapiens
ctttatctctttctt

SEQ ID NO: 247155 - DNA, 15 bp, Homo sapiens
actttatctctttct

SEQ ID NO: 247156 - DNA, 15 bp, Homo sapiens
tactttatctctttc

SEQ ID NO: 247157 - DNA, 15 bp, Homo sapiens
ctactttatctcttt

SEQ ID NO: 247158 - DNA, 15 bp, Homo sapiens
actactttatctctt

SEQ ID NO: 247159 - DNA, 15 bp, Homo sapiens
tactactttatctct

SEQ ID NO: 247160 - DNA, 15 bp, Homo sapiens
ttactactttatctc

SEQ ID NO: 247161 - DNA, 15 bp, Homo sapiens
attactactttatct

SEQ ID NO: 247162 - DNA, 15 bp, Homo sapiens
aattactactttatc

SEQ ID NO: 247163 - DNA, 15 bp, Homo sapiens
aaattactactttat

SEQ ID NO: 247164 - DNA, 15 bp, Homo sapiens
aaaattactacttta

SEQ ID NO: 247165 - DNA, 15 bp, Homo sapiens
aaaaattactacttt

SEQ ID NO: 247166 - DNA, 15 bp, Homo sapiens
aaaaaattactactt

SEQ ID NO: 247167 - DNA, 15 bp, Homo sapiens
aaaaaaattactact

SEQ ID NO: 247168 - DNA, 15 bp, Homo sapiens
aaaaaaaattactac

SEQ ID NO: 247169 - DNA, 15 bp, Homo sapiens
taaaaaaaattacta

SEQ ID NO: 247170 - DNA, 15 bp, Homo sapiens
ttaaaaaaaattact

SEQ ID NO: 247171 - DNA, 15 bp, Homo sapiens
attaaaaaaaattac

SEQ ID NO: 247172 - DNA, 15 bp, Homo sapiens
tattaaaaaaaatta

SEQ ID NO: 247173 - DNA, 15 bp, Homo sapiens
ttattaaaaaaaatt

SEQ ID NO: 247174 - DNA, 15 bp, Homo sapiens
tttattaaaaaaaat

SEQ ID NO: 247175 - DNA, 15 bp, Homo sapiens
ttttattaaaaaaaa

SEQ ID NO: 247176 - DNA, 15 bp, Homo sapiens
tttttattaaaaaaa

SEQ ID NO: 247177 - DNA, 15 bp, Homo sapiens
ctttttattaaaaaa

SEQ ID NO: 247178 - DNA, 15 bp, Homo sapiens
gctttttattaaaaa

SEQ ID NO: 247179 - DNA, 15 bp, Homo sapiens
agctttttattaaaa

SEQ ID NO: 247180 - DNA, 15 bp, Homo sapiens
tagctttttattaaa

SEQ ID NO: 247181 - DNA, 15 bp, Homo sapiens
ttagctttttattaa

SEQ ID NO: 247182 - DNA, 15 bp, Homo sapiens
tttagctttttatta

SEQ ID NO: 247183 - DNA, 15 bp, Homo sapiens
ttttagctttttatt

SEQ ID NO: 247184 - DNA, 15 bp, Homo sapiens
cttttagctttttat

SEQ ID NO: 247185 - DNA, 15 bp, Homo sapiens
gcttttagcttttta

SEQ ID NO: 247186 - DNA, 15 bp, Homo sapiens
agcttttagcttttt

SEQ ID NO: 247187 - DNA, 15 bp, Homo sapiens
tagcttttagctttt

SEQ ID NO: 247188 - DNA, 15 bp, Homo sapiens
gtagcttttagcttt

SEQ ID NO: 247189 - DNA, 15 bp, Homo sapiens
tgtagcttttagctt

SEQ ID NO: 247190 - DNA, 15 bp, Homo sapiens
ttgtagcttttagct

SEQ ID NO: 247191 - DNA, 15 bp, Homo sapiens
tttgtagcttttagc

SEQ ID NO: 247192 - DNA, 15 bp, Homo sapiens
atttgtagcttttag

SEQ ID NO: 247193 - DNA, 15 bp, Homo sapiens
gatttgtagctttta

SEQ ID NO: 247194 - DNA, 15 bp, Homo sapiens
ggatttgtagctttt

SEQ ID NO: 247195 - DNA, 15 bp, Homo sapiens
tggatttgtagcttt

SEQ ID NO: 247196 - DNA, 15 bp, Homo sapiens
ctggatttgtagctt

SEQ ID NO: 247197 - DNA, 15 bp, Homo sapiens
gctggatttgtagct

SEQ ID NO: 247198 - DNA, 15 bp, Homo sapiens
agctggatttgtagc

SEQ ID NO: 247199 - DNA, 15 bp, Homo sapiens
aagctggatttgtag

SEQ ID NO: 247200 - DNA, 15 bp, Homo sapiens
aaagctggatttgta

SEQ ID NO: 247201 - DNA, 15 bp, Homo sapiens
aaaagctggatttgt

SEQ ID NO: 247202 - DNA, 15 bp, Homo sapiens
taaaagctggatttg

SEQ ID NO: 247203 - DNA, 15 bp, Homo sapiens
ttaaaagctggattt

SEQ ID NO: 247204 - DNA, 15 bp, Homo sapiens
tttaaaagctggatt

SEQ ID NO: 247205 - DNA, 15 bp, Homo sapiens
ttttaaaagctggat

SEQ ID NO: 247206 - DNA, 15 bp, Homo sapiens
cttttaaaagctgga

SEQ ID NO: 247207 - DNA, 15 bp, Homo sapiens
gcttttaaaagctgg

SEQ ID NO: 247208 - DNA, 15 bp, Homo sapiens
tgcttttaaaagctg

SEQ ID NO: 247209 - DNA, 15 bp, Homo sapiens
ttgcttttaaaagct

SEQ ID NO: 247210 - DNA, 15 bp, Homo sapiens
tttgcttttaaaagc

SEQ ID NO: 247211 - DNA, 15 bp, Homo sapiens
gtttgcttttaaaag

SEQ ID NO: 247212 - DNA, 15 bp, Homo sapiens
agtttgcttttaaaa

SEQ ID NO: 247213 - DNA, 15 bp, Homo sapiens
aagtttgcttttaaa

SEQ ID NO: 247214 - DNA, 15 bp, Homo sapiens
taagtttgcttttaa

SEQ ID NO: 247215 - DNA, 15 bp, Homo sapiens
ttaagtttgctttta

SEQ ID NO: 247216 - DNA, 15 bp, Homo sapiens
tttaagtttgctttt

SEQ ID NO: 247217 - DNA, 15 bp, Homo sapiens
ctttaagtttgcttt

SEQ ID NO: 247218 - DNA, 15 bp, Homo sapiens
cctttaagtttgctt

SEQ ID NO: 247219 - DNA, 15 bp, Homo sapiens
tcctttaagtttgct

SEQ ID NO: 247220 - DNA, 15 bp, Homo sapiens
atcctttaagtttgc

SEQ ID NO: 247221 - DNA, 15 bp, Homo sapiens
tatcctttaagtttg

SEQ ID NO: 247222 - DNA, 15 bp, Homo sapiens
gtatcctttaagttt

SEQ ID NO: 247223 - DNA, 15 bp, Homo sapiens
tgtatcctttaagtt

SEQ ID NO: 247224 - DNA, 15 bp, Homo sapiens
ttgtatcctttaagt

SEQ ID NO: 247225 - DNA, 15 bp, Homo sapiens
attgtatcctttaag

SEQ ID NO: 247226 - DNA, 15 bp, Homo sapiens
cattgtatcctttaa

SEQ ID NO: 247227 - DNA, 15 bp, Homo sapiens
tcattgtatccttta

SEQ ID NO: 247228 - DNA, 15 bp, Homo sapiens
atcattgtatccttt

SEQ ID NO: 247229 - DNA, 15 bp, Homo sapiens
gatcattgtatcctt

SEQ ID NO: 247230 - DNA, 15 bp, Homo sapiens
ggatcattgtatcct

SEQ ID NO: 247231 - DNA, 15 bp, Homo sapiens
gggatcattgtatcc

SEQ ID NO: 247232 - DNA, 15 bp, Homo sapiens
ggggatcattgtatc

SEQ ID NO: 247233 - DNA, 15 bp, Homo sapiens
aggggatcattgtat

SEQ ID NO: 247234 - DNA, 15 bp, Homo sapiens
gaggggatcattgta

SEQ ID NO: 247235 - DNA, 15 bp, Homo sapiens
tgaggggatcattgt

SEQ ID NO: 247236 - DNA, 15 bp, Homo sapiens
ttgaggggatcattg

SEQ ID NO: 247237 - DNA, 15 bp, Homo sapiens
gttgaggggatcatt

SEQ ID NO: 247238 - DNA, 15 bp, Homo sapiens
agttgaggggatcat

SEQ ID NO: 247239 - DNA, 15 bp, Homo sapiens
cagttgaggggatca

SEQ ID NO: 247240 - DNA, 15 bp, Homo sapiens
acagttgaggggatc

SEQ ID NO: 247241 - DNA, 15 bp, Homo sapiens
aacagttgaggggat

SEQ ID NO: 247242 - DNA, 15 bp, Homo sapiens
caacagttgagggga

SEQ ID NO: 247243 - DNA, 15 bp, Homo sapiens
acaacagttgagggg

SEQ ID NO: 247244 - DNA, 15 bp, Homo sapiens
cacaacagttgaggg

SEQ ID NO: 247245 - DNA, 15 bp, Homo sapiens
ccacaacagttgagg

SEQ ID NO: 247246 - DNA, 15 bp, Homo sapiens
cccacaacagttgag

SEQ ID NO: 247247 - DNA, 15 bp, Homo sapiens
tcccacaacagttga

SEQ ID NO: 247248 - DNA, 15 bp, Homo sapiens
ttcccacaacagttg

SEQ ID NO: 247249 - DNA, 15 bp, Homo sapiens
gttcccacaacagtt

SEQ ID NO: 247250 - DNA, 15 bp, Homo sapiens
tgttcccacaacagt

SEQ ID NO: 247251 - DNA, 15 bp, Homo sapiens
atgttcccacaacag

SEQ ID NO: 247252 - DNA, 15 bp, Homo sapiens
tatgttcccacaaca

SEQ ID NO: 247253 - DNA, 15 bp, Homo sapiens
ctatgttcccacaac

SEQ ID NO: 247254 - DNA, 15 bp, Homo sapiens
actatgttcccacaa

SEQ ID NO: 247255 - DNA, 15 bp, Homo sapiens
gactatgttcccaca

SEQ ID NO: 247256 - DNA, 15 bp, Homo sapiens
ggactatgttcccac

SEQ ID NO: 247257 - DNA, 15 bp, Homo sapiens
aggactatgttccca

SEQ ID NO: 247258 - DNA, 15 bp, Homo sapiens
caggactatgttccc

SEQ ID NO: 247259 - DNA, 15 bp, Homo sapiens
ccaggactatgttcc

SEQ ID NO: 247260 - DNA, 15 bp, Homo sapiens
accaggactatgttc

SEQ ID NO: 247261 - DNA, 15 bp, Homo sapiens
caccaggactatgtt

SEQ ID NO: 247262 - DNA, 15 bp, Homo sapiens
acaccaggactatgt

SEQ ID NO: 247263 - DNA, 15 bp, Homo sapiens
aacaccaggactatg

SEQ ID NO: 247264 - DNA, 15 bp, Homo sapiens
taacaccaggactat

SEQ ID NO: 247265 - DNA, 15 bp, Homo sapiens
ttaacaccaggacta

SEQ ID NO: 247266 - DNA, 15 bp, Homo sapiens
gttaacaccaggact

SEQ ID NO: 247267 - DNA, 15 bp, Homo sapiens
tgttaacaccaggac

SEQ ID NO: 247268 - DNA, 15 bp, Homo sapiens
gtgttaacaccagga

SEQ ID NO: 247269 - DNA, 15 bp, Homo sapiens
ggtgttaacaccagg

SEQ ID NO: 247270 - DNA, 15 bp, Homo sapiens
aggtgttaacaccag

SEQ ID NO: 247271 - DNA, 15 bp, Homo sapiens
aaggtgttaacacca

SEQ ID NO: 247272 - DNA, 15 bp, Homo sapiens
gaaggtgttaacacc

SEQ ID NO: 247273 - DNA, 15 bp, Homo sapiens
tgaaggtgttaacac

SEQ ID NO: 247274 - DNA, 15 bp, Homo sapiens
ctgaaggtgttaaca

SEQ ID NO: 247275 - DNA, 15 bp, Homo sapiens
tctgaaggtgttaac

SEQ ID NO: 247276 - DNA, 15 bp, Homo sapiens
atctgaaggtgttaa

SEQ ID NO: 247277 - DNA, 15 bp, Homo sapiens
catctgaaggtgtta

SEQ ID NO: 247278 - DNA, 15 bp, Homo sapiens
ccatctgaaggtgtt

SEQ ID NO: 247279 - DNA, 15 bp, Homo sapiens
cccatctgaaggtgt

SEQ ID NO: 247280 - DNA, 15 bp, Homo sapiens
ccccatctgaaggtg

SEQ ID NO: 247281 - DNA, 15 bp, Homo sapiens
cccccatctgaaggt

SEQ ID NO: 247282 - DNA, 15 bp, Homo sapiens
gcccccatctgaagg

SEQ ID NO: 247283 - DNA, 15 bp, Homo sapiens
tgcccccatctgaag

SEQ ID NO: 247284 - DNA, 15 bp, Homo sapiens
atgcccccatctgaa

SEQ ID NO: 247285 - DNA, 15 bp, Homo sapiens
tatgcccccatctga

SEQ ID NO: 247286 - DNA, 15 bp, Homo sapiens
gtatgcccccatctg

SEQ ID NO: 247287 - DNA, 15 bp, Homo sapiens
tgtatgcccccatct

SEQ ID NO: 247288 - DNA, 15 bp, Homo sapiens
ttgtatgcccccatc

SEQ ID NO: 247289 - DNA, 15 bp, Homo sapiens
cttgtatgcccccat

SEQ ID NO: 247290 - DNA, 15 bp, Homo sapiens
ccttgtatgccccca

SEQ ID NO: 247291 - DNA, 15 bp, Homo sapiens
gccttgtatgccccc

SEQ ID NO: 247292 - DNA, 15 bp, Homo sapiens
agccttgtatgcccc

SEQ ID NO: 247293 - DNA, 15 bp, Homo sapiens
gagccttgtatgccc

SEQ ID NO: 247294 - DNA, 15 bp, Homo sapiens
ggagccttgtatgcc

SEQ ID NO: 247295 - DNA, 15 bp, Homo sapiens
gggagccttgtatgc

SEQ ID NO: 247296 - DNA, 15 bp, Homo sapiens
ggggagccttgtatg

SEQ ID NO: 247297 - DNA, 15 bp, Homo sapiens
tggggagccttgtat

SEQ ID NO: 247298 - DNA, 15 bp, Homo sapiens
ctggggagccttgta

SEQ ID NO: 247299 - DNA, 15 bp, Homo sapiens
cctggggagccttgt

SEQ ID NO: 247300 - DNA, 15 bp, Homo sapiens
ccctggggagccttg

SEQ ID NO: 247301 - DNA, 15 bp, Homo sapiens
gccctggggagcctt

SEQ ID NO: 247302 - DNA, 15 bp, Homo sapiens
ggccctggggagcct

SEQ ID NO: 247303 - DNA, 15 bp, Homo sapiens
tggccctggggagcc

SEQ ID NO: 247304 - DNA, 15 bp, Homo sapiens
ttggccctggggagc

SEQ ID NO: 247305 - DNA, 15 bp, Homo sapiens
attggccctggggag

SEQ ID NO: 247306 - DNA, 15 bp, Homo sapiens
cattggccctgggga

SEQ ID NO: 247307 - DNA, 15 bp, Homo sapiens
gcattggccctgggg

SEQ ID NO: 247308 - DNA, 15 bp, Homo sapiens
tgcattggccctggg

SEQ ID NO: 247309 - DNA, 15 bp, Homo sapiens
ttgcattggccctgg

SEQ ID NO: 247310 - DNA, 15 bp, Homo sapiens
gttgcattggccctg

SEQ ID NO: 247311 - DNA, 15 bp, Homo sapiens
tgttgcattggccct

SEQ ID NO: 247312 - DNA, 15 bp, Homo sapiens
ttgttgcattggccc

SEQ ID NO: 247313 - DNA, 15 bp, Homo sapiens
gttgttgcattggcc

SEQ ID NO: 247314 - DNA, 15 bp, Homo sapiens
tgttgttgcattggc

SEQ ID NO: 247315 - DNA, 15 bp, Homo sapiens
ttgttgttgcattgg

SEQ ID NO: 247316 - DNA, 15 bp, Homo sapiens
tttgttgttgcattg

SEQ ID NO: 247317 - DNA, 15 bp, Homo sapiens
atttgttgttgcatt

SEQ ID NO: 247318 - DNA, 15 bp, Homo sapiens
catttgttgttgcat

SEQ ID NO: 247319 - DNA, 15 bp, Homo sapiens
tcatttgttgttgca

SEQ ID NO: 247320 - DNA, 15 bp, Homo sapiens
gtcatttgttgttgc

SEQ ID NO: 247321 - DNA, 15 bp, Homo sapiens
ggtcatttgttgttg

SEQ ID NO: 247322 - DNA, 15 bp, Homo sapiens
aggtcatttgttgtt

SEQ ID NO: 247323 - DNA, 15 bp, Homo sapiens
taggtcatttgttgt

SEQ ID NO: 247324 - DNA, 15 bp, Homo sapiens
gtaggtcatttgttg

SEQ ID NO: 247325 - DNA, 15 bp, Homo sapiens
tgtaggtcatttgtt

SEQ ID NO: 247326 - DNA, 15 bp, Homo sapiens
ctgtaggtcatttgt

SEQ ID NO: 247327 - DNA, 15 bp, Homo sapiens
cctgtaggtcatttg

SEQ ID NO: 247328 - DNA, 15 bp, Homo sapiens
tcctgtaggtcattt

SEQ ID NO: 247329 - DNA, 15 bp, Homo sapiens
ttcctgtaggtcatt

SEQ ID NO: 247330 - DNA, 15 bp, Homo sapiens
attcctgtaggtcat

SEQ ID NO: 247331 - DNA, 15 bp, Homo sapiens
aattcctgtaggtca

SEQ ID NO: 247332 - DNA, 15 bp, Homo sapiens
aaattcctgtaggtc

SEQ ID NO: 247333 - DNA, 15 bp, Homo sapiens
caaattcctgtaggt

SEQ ID NO: 247334 - DNA, 15 bp, Homo sapiens
ccaaattcctgtagg

SEQ ID NO: 247335 - DNA, 15 bp, Homo sapiens
gccaaattcctgtag

SEQ ID NO: 247336 - DNA, 15 bp, Homo sapiens
agccaaattcctgta

SEQ ID NO: 247337 - DNA, 15 bp, Homo sapiens
cagccaaattcctgt

SEQ ID NO: 247338 - DNA, 15 bp, Homo sapiens
tcagccaaattcctg

SEQ ID NO: 247339 - DNA, 15 bp, Homo sapiens
atcagccaaattcct

SEQ ID NO: 247340 - DNA, 15 bp, Homo sapiens
catcagccaaattcc

SEQ ID NO: 247341 - DNA, 15 bp, Homo sapiens
ccatcagccaaattc

SEQ ID NO: 247342 - DNA, 15 bp, Homo sapiens
accatcagccaaatt

SEQ ID NO: 247343 - DNA, 15 bp, Homo sapiens
gaccatcagccaaat

SEQ ID NO: 247344 - DNA, 15 bp, Homo sapiens
agaccatcagccaaa

SEQ ID NO: 247345 - DNA, 15 bp, Homo sapiens
cagaccatcagccaa

SEQ ID NO: 247346 - DNA, 15 bp, Homo sapiens
tcagaccatcagcca

SEQ ID NO: 247347 - DNA, 15 bp, Homo sapiens
ttcagaccatcagcc

SEQ ID NO: 247348 - DNA, 15 bp, Homo sapiens
attcagaccatcagc

SEQ ID NO: 247349 - DNA, 15 bp, Homo sapiens
gattcagaccatcag

SEQ ID NO: 247350 - DNA, 15 bp, Homo sapiens
agattcagaccatca

SEQ ID NO: 247351 - DNA, 15 bp, Homo sapiens
gagattcagaccatc

SEQ ID NO: 247352 - DNA, 15 bp, Homo sapiens
ggagattcagaccat

SEQ ID NO: 247353 - DNA, 15 bp, Homo sapiens
gggagattcagacca

SEQ ID NO: 247354 - DNA, 15 bp, Homo sapiens
ggggagattcagacc

SEQ ID NO: 247355 - DNA, 15 bp, Homo sapiens
tggggagattcagac

SEQ ID NO: 247356 - DNA, 15 bp, Homo sapiens
ctggggagattcaga

SEQ ID NO: 247357 - DNA, 15 bp, Homo sapiens
actggggagattcag

SEQ ID NO: 247358 - DNA, 15 bp, Homo sapiens
aactggggagattca

SEQ ID NO: 247359 - DNA, 15 bp, Homo sapiens
aaactggggagattc

SEQ ID NO: 247360 - DNA, 15 bp, Homo sapiens
caaactggggagatt

SEQ ID NO: 247361 - DNA, 15 bp, Homo sapiens
tcaaactggggagat

SEQ ID NO: 247362 - DNA, 15 bp, Homo sapiens
ctcaaactggggaga

SEQ ID NO: 247363 - DNA, 15 bp, Homo sapiens
tctcaaactggggag

SEQ ID NO: 247364 - DNA, 15 bp, Homo sapiens
ctctcaaactgggga

SEQ ID NO: 247365 - DNA, 15 bp, Homo sapiens
actctcaaactgggg

SEQ ID NO: 247366 - DNA, 15 bp, Homo sapiens
gactctcaaactggg

SEQ ID NO: 247367 - DNA, 15 bp, Homo sapiens
tgactctcaaactgg

SEQ ID NO: 247368 - DNA, 15 bp, Homo sapiens
gtgactctcaaactg

SEQ ID NO: 247369 - DNA, 15 bp, Homo sapiens
cgtgactctcaaact

SEQ ID NO: 247370 - DNA, 15 bp, Homo sapiens
ccgtgactctcaaac

SEQ ID NO: 247371 - DNA, 15 bp, Homo sapiens
tccgtgactctcaaa

SEQ ID NO: 247372 - DNA, 15 bp, Homo sapiens
ctccgtgactctcaa

SEQ ID NO: 247373 - DNA, 15 bp, Homo sapiens
tctccgtgactctca

SEQ ID NO: 247374 - DNA, 15 bp, Homo sapiens
atctccgtgactctc

SEQ ID NO: 247375 - DNA, 15 bp, Homo sapiens
catctccgtgactct

SEQ ID NO: 247376 - DNA, 15 bp, Homo sapiens
tcatctccgtgactc

SEQ ID NO: 247377 - DNA, 15 bp, Homo sapiens
ctcatctccgtgact

SEQ ID NO: 247378 - DNA, 15 bp, Homo sapiens
cctcatctccgtgac

SEQ ID NO: 247379 - DNA, 15 bp, Homo sapiens
ccctcatctccgtga

SEQ ID NO: 247380 - DNA, 15 bp, Homo sapiens
accctcatctccgtg

SEQ ID NO: 247381 - DNA, 15 bp, Homo sapiens
taccctcatctccgt

SEQ ID NO: 247382 - DNA, 15 bp, Homo sapiens
ctaccctcatctccg

SEQ ID NO: 247383 - DNA, 15 bp, Homo sapiens
cctaccctcatctcc

SEQ ID NO: 247384 - DNA, 15 bp, Homo sapiens
ccctaccctcatctc

SEQ ID NO: 247385 - DNA, 15 bp, Homo sapiens
accctaccctcatct

SEQ ID NO: 247386 - DNA, 15 bp, Homo sapiens
aaccctaccctcatc

SEQ ID NO: 247387 - DNA, 15 bp, Homo sapiens
caaccctaccctcat

SEQ ID NO: 247388 - DNA, 15 bp, Homo sapiens
ccaaccctaccctca

SEQ ID NO: 247389 - DNA, 15 bp, Homo sapiens
cccaaccctaccctc

SEQ ID NO: 247390 - DNA, 15 bp, Homo sapiens
acccaaccctaccct

SEQ ID NO: 247391 - DNA, 15 bp, Homo sapiens
cacccaaccctaccc

SEQ ID NO: 247392 - DNA, 15 bp, Homo sapiens
ccacccaaccctacc

SEQ ID NO: 247393 - DNA, 15 bp, Homo sapiens
cccacccaaccctac

SEQ ID NO: 247394 - DNA, 15 bp, Homo sapiens
tcccacccaacccta

SEQ ID NO: 247395 - DNA, 15 bp, Homo sapiens
ctcccacccaaccct

SEQ ID NO: 247396 - DNA, 15 bp, Homo sapiens
cctcccacccaaccc

SEQ ID NO: 247397 - DNA, 15 bp, Homo sapiens
acctcccacccaacc

SEQ ID NO: 247398 - DNA, 15 bp, Homo sapiens
cacctcccacccaac

SEQ ID NO: 247399 - DNA, 15 bp, Homo sapiens
ccacctcccacccaa

SEQ ID NO: 247400 - DNA, 15 bp, Homo sapiens
cccacctcccaccca

SEQ ID NO: 247401 - DNA, 15 bp, Homo sapiens
ccccacctcccaccc

SEQ ID NO: 247402 - DNA, 15 bp, Homo sapiens
accccacctcccacc

SEQ ID NO: 247403 - DNA, 15 bp, Homo sapiens
aaccccacctcccac

SEQ ID NO: 247404 - DNA, 15 bp, Homo sapiens
gaaccccacctccca

SEQ ID NO: 247405 - DNA, 15 bp, Homo sapiens
ggaaccccacctccc

SEQ ID NO: 247406 - DNA, 15 bp, Homo sapiens
gggaaccccacctcc

SEQ ID NO: 247407 - DNA, 15 bp, Homo sapiens
agggaaccccacctc

SEQ ID NO: 247408 - DNA, 15 bp, Homo sapiens
tagggaaccccacct

SEQ ID NO: 247409 - DNA, 15 bp, Homo sapiens
atagggaaccccacc

SEQ ID NO: 247410 - DNA, 15 bp, Homo sapiens
catagggaaccccac

SEQ ID NO: 247411 - DNA, 15 bp, Homo sapiens
tcatagggaacccca

SEQ ID NO: 247412 - DNA, 15 bp, Homo sapiens
ttcatagggaacccc

SEQ ID NO: 247413 - DNA, 15 bp, Homo sapiens
attcatagggaaccc

SEQ ID NO: 247414 - DNA, 15 bp, Homo sapiens
aattcatagggaacc

SEQ ID NO: 247415 - DNA, 15 bp, Homo sapiens
gaattcatagggaac

SEQ ID NO: 247416 - DNA, 15 bp, Homo sapiens
agaattcatagggaa

SEQ ID NO: 247417 - DNA, 15 bp, Homo sapiens
cagaattcataggga

SEQ ID NO: 247418 - DNA, 15 bp, Homo sapiens
ccagaattcataggg

SEQ ID NO: 247419 - DNA, 15 bp, Homo sapiens
cccagaattcatagg

SEQ ID NO: 247420 - DNA, 15 bp, Homo sapiens
gcccagaattcatag

SEQ ID NO: 247421 - DNA, 15 bp, Homo sapiens
agcccagaattcata

SEQ ID NO: 247422 - DNA, 15 bp, Homo sapiens
gagcccagaattcat

SEQ ID NO: 247423 - DNA, 15 bp, Homo sapiens
tgagcccagaattca

SEQ ID NO: 247424 - DNA, 15 bp, Homo sapiens
atgagcccagaattc

SEQ ID NO: 247425 - DNA, 15 bp, Homo sapiens
catgagcccagaatt

SEQ ID NO: 247426 - DNA, 15 bp, Homo sapiens
acatgagcccagaat

SEQ ID NO: 247427 - DNA, 15 bp, Homo sapiens
tacatgagcccagaa

SEQ ID NO: 247428 - DNA, 15 bp, Homo sapiens
ctacatgagcccaga

SEQ ID NO: 247429 - DNA, 15 bp, Homo sapiens
tctacatgagcccag

SEQ ID NO: 247430 - DNA, 15 bp, Homo sapiens
ttctacatgagccca

SEQ ID NO: 247431 - DNA, 15 bp, Homo sapiens
tttctacatgagccc

SEQ ID NO: 247432 - DNA, 15 bp, Homo sapiens
atttctacatgagcc

SEQ ID NO: 247433 - DNA, 15 bp, Homo sapiens
tatttctacatgagc

SEQ ID NO: 247434 - DNA, 15 bp, Homo sapiens
atatttctacatgag

SEQ ID NO: 247435 - DNA, 15 bp, Homo sapiens
aatatttctacatga

SEQ ID NO: 247436 - DNA, 15 bp, Homo sapiens
taatatttctacatg

SEQ ID NO: 247437 - DNA, 15 bp, Homo sapiens
ataatatttctacat

SEQ ID NO: 247438 - DNA, 15 bp, Homo sapiens
gataatatttctaca

SEQ ID NO: 247439 - DNA, 15 bp, Homo sapiens
tgataatatttctac

SEQ ID NO: 247440 - DNA, 15 bp, Homo sapiens
ttgataatatttcta

SEQ ID NO: 247441 - DNA, 15 bp, Homo sapiens
cttgataatatttct

SEQ ID NO: 247442 - DNA, 15 bp, Homo sapiens
gcttgataatatttc

SEQ ID NO: 247443 - DNA, 15 bp, Homo sapiens
agcttgataatattt

SEQ ID NO: 247444 - DNA, 15 bp, Homo sapiens
tagcttgataatatt

SEQ ID NO: 247445 - DNA, 15 bp, Homo sapiens
ctagcttgataatat

SEQ ID NO: 247446 - DNA, 15 bp, Homo sapiens
gctagcttgataata

SEQ ID NO: 247447 - DNA, 15 bp, Homo sapiens
tgctagcttgataat

SEQ ID NO: 247448 - DNA, 15 bp, Homo sapiens
ctgctagcttgataa

SEQ ID NO: 247449 - DNA, 15 bp, Homo sapiens
tctgctagcttgata

SEQ ID NO: 247450 - DNA, 15 bp, Homo sapiens
atctgctagcttgat

SEQ ID NO: 247451 - DNA, 15 bp, Homo sapiens
gatctgctagcttga

SEQ ID NO: 247452 - DNA, 15 bp, Homo sapiens
ggatctgctagcttg

SEQ ID NO: 247453 - DNA, 15 bp, Homo sapiens
gggatctgctagctt

SEQ ID NO: 247454 - DNA, 15 bp, Homo sapiens
ggggatctgctagct

SEQ ID NO: 247455 - DNA, 15 bp, Homo sapiens
aggggatctgctagc

SEQ ID NO: 247456 - DNA, 15 bp, Homo sapiens
caggggatctgctag

SEQ ID NO: 247457 - DNA, 15 bp, Homo sapiens
ccaggggatctgcta

SEQ ID NO: 247458 - DNA, 15 bp, Homo sapiens
cccaggggatctgct

SEQ ID NO: 247459 - DNA, 15 bp, Homo sapiens
acccaggggatctgc

SEQ ID NO: 247460 - DNA, 15 bp, Homo sapiens
aacccaggggatctg

SEQ ID NO: 247461 - DNA, 15 bp, Homo sapiens
aaacccaggggatct

SEQ ID NO: 247462 - DNA, 15 bp, Homo sapiens
taaacccaggggatc

SEQ ID NO: 247463 - DNA, 15 bp, Homo sapiens
gtaaacccaggggat

SEQ ID NO: 247464 - DNA, 15 bp, Homo sapiens
agtaaacccagggga

SEQ ID NO: 247465 - DNA, 15 bp, Homo sapiens
cagtaaacccagggg

SEQ ID NO: 247466 - DNA, 15 bp, Homo sapiens
tcagtaaacccaggg

SEQ ID NO: 247467 - DNA, 15 bp, Homo sapiens
ctcagtaaacccagg

SEQ ID NO: 247468 - DNA, 15 bp, Homo sapiens
actcagtaaacccag

SEQ ID NO: 247469 - DNA, 15 bp, Homo sapiens
tactcagtaaaccca

SEQ ID NO: 247470 - DNA, 15 bp, Homo sapiens
atactcagtaaaccc

SEQ ID NO: 247471 - DNA, 15 bp, Homo sapiens
aatactcagtaaacc

SEQ ID NO: 247472 - DNA, 15 bp, Homo sapiens
aaatactcagtaaac

SEQ ID NO: 247473 - DNA, 15 bp, Homo sapiens
caaatactcagtaaa

SEQ ID NO: 247474 - DNA, 15 bp, Homo sapiens
gcaaatactcagtaa

SEQ ID NO: 247475 - DNA, 15 bp, Homo sapiens
tgcaaatactcagta

SEQ ID NO: 247476 - DNA, 15 bp, Homo sapiens
atgcaaatactcagt

SEQ ID NO: 247477 - DNA, 15 bp, Homo sapiens
catgcaaatactcag

SEQ ID NO: 247478 - DNA, 15 bp, Homo sapiens
acatgcaaatactca

SEQ ID NO: 247479 - DNA, 15 bp, Homo sapiens
aacatgcaaatactc

SEQ ID NO: 247480 - DNA, 15 bp, Homo sapiens
aaacatgcaaatact

SEQ ID NO: 247481 - DNA, 15 bp, Homo sapiens
taaacatgcaaatac

SEQ ID NO: 247482 - DNA, 15 bp, Homo sapiens
ataaacatgcaaata

SEQ ID NO: 247483 - DNA, 15 bp, Homo sapiens
tataaacatgcaaat

SEQ ID NO: 247484 - DNA, 15 bp, Homo sapiens
atataaacatgcaaa

SEQ ID NO: 247485 - DNA, 15 bp, Homo sapiens
aatataaacatgcaa

SEQ ID NO: 247486 - DNA, 15 bp, Homo sapiens
aaatataaacatgca

SEQ ID NO: 247487 - DNA, 15 bp, Homo sapiens
gaaatataaacatgc

SEQ ID NO: 247488 - DNA, 15 bp, Homo sapiens
ggaaatataaacatg

SEQ ID NO: 247489 - DNA, 15 bp, Homo sapiens
tggaaatataaacat

SEQ ID NO: 247490 - DNA, 15 bp, Homo sapiens
ttggaaatataaaca

SEQ ID NO: 247491 - DNA, 15 bp, Homo sapiens
cttggaaatataaac

SEQ ID NO: 247492 - DNA, 15 bp, Homo sapiens
gcttggaaatataaa

SEQ ID NO: 247493 - DNA, 15 bp, Homo sapiens
tgcttggaaatataa

SEQ ID NO: 247494 - DNA, 15 bp, Homo sapiens
ttgcttggaaatata

SEQ ID NO: 247495 - DNA, 15 bp, Homo sapiens
attgcttggaaatat

SEQ ID NO: 247496 - DNA, 15 bp, Homo sapiens
aattgcttggaaata

SEQ ID NO: 247497 - DNA, 15 bp, Homo sapiens
aaattgcttggaaat

SEQ ID NO: 247498 - DNA, 15 bp, Homo sapiens
taaattgcttggaaa

SEQ ID NO: 247499 - DNA, 15 bp, Homo sapiens
ctaaattgcttggaa

SEQ ID NO: 247500 - DNA, 15 bp, Homo sapiens
actaaattgcttgga

SEQ ID NO: 247501 - DNA, 15 bp, Homo sapiens
tactaaattgcttgg

SEQ ID NO: 247502 - DNA, 15 bp, Homo sapiens
gtactaaattgcttg

SEQ ID NO: 247503 - DNA, 15 bp, Homo sapiens
ggtactaaattgctt

SEQ ID NO: 247504 - DNA, 15 bp, Homo sapiens
gggtactaaattgct

SEQ ID NO: 247505 - DNA, 15 bp, Homo sapiens
agggtactaaattgc

SEQ ID NO: 247506 - DNA, 15 bp, Homo sapiens
gagggtactaaattg

SEQ ID NO: 247507 - DNA, 15 bp, Homo sapiens
tgagggtactaaatt

SEQ ID NO: 247508 - DNA, 15 bp, Homo sapiens
ttgagggtactaaat

SEQ ID NO: 247509 - DNA, 15 bp, Homo sapiens
cttgagggtactaaa

SEQ ID NO: 247510 - DNA, 15 bp, Homo sapiens
tcttgagggtactaa

SEQ ID NO: 247511 - DNA, 15 bp, Homo sapiens
gtcttgagggtacta

SEQ ID NO: 247512 - DNA, 15 bp, Homo sapiens
tgtcttgagggtact

SEQ ID NO: 247513 - DNA, 15 bp, Homo sapiens
ttgtcttgagggtac

SEQ ID NO: 247514 - DNA, 15 bp, Homo sapiens
attgtcttgagggta

SEQ ID NO: 247515 - DNA, 15 bp, Homo sapiens
aattgtcttgagggt

SEQ ID NO: 247516 - DNA, 15 bp, Homo sapiens
taattgtcttgaggg

SEQ ID NO: 247517 - DNA, 15 bp, Homo sapiens
ataattgtcttgagg

SEQ ID NO: 247518 - DNA, 15 bp, Homo sapiens
gataattgtcttgag

SEQ ID NO: 247519 - DNA, 15 bp, Homo sapiens
tgataattgtcttga

SEQ ID NO: 247520 - DNA, 15 bp, Homo sapiens
gtgataattgtcttg

SEQ ID NO: 247521 - DNA, 15 bp, Homo sapiens
ggtgataattgtctt

SEQ ID NO: 247522 - DNA, 15 bp, Homo sapiens
aggtgataattgtct

SEQ ID NO: 247523 - DNA, 15 bp, Homo sapiens
caggtgataattgtc

SEQ ID NO: 247524 - DNA, 15 bp, Homo sapiens
acaggtgataattgt

SEQ ID NO: 247525 - DNA, 15 bp, Homo sapiens
gacaggtgataattg

SEQ ID NO: 247526 - DNA, 15 bp, Homo sapiens
ggacaggtgataatt

SEQ ID NO: 247527 - DNA, 15 bp, Homo sapiens
gggacaggtgataat

SEQ ID NO: 247528 - DNA, 15 bp, Homo sapiens
agggacaggtgataa

SEQ ID NO: 247529 - DNA, 15 bp, Homo sapiens
gagggacaggtgata

SEQ ID NO: 247530 - DNA, 15 bp, Homo sapiens
ggagggacaggtgat

SEQ ID NO: 247531 - DNA, 15 bp, Homo sapiens
gggagggacaggtga

SEQ ID NO: 247532 - DNA, 15 bp, Homo sapiens
ggggagggacaggtg

SEQ ID NO: 247533 - DNA, 15 bp, Homo sapiens
aggggagggacaggt

SEQ ID NO: 247534 - DNA, 15 bp, Homo sapiens
gaggggagggacagg

SEQ ID NO: 247535 - DNA, 15 bp, Homo sapiens
cgaggggagggacag

SEQ ID NO: 247536 - DNA, 15 bp, Homo sapiens
gcgaggggagggaca

SEQ ID NO: 247537 - DNA, 15 bp, Homo sapiens
tgcgaggggagggac

SEQ ID NO: 247538 - DNA, 15 bp, Homo sapiens
gtgcgaggggaggga

SEQ ID NO: 247539 - DNA, 15 bp, Homo sapiens
cgtgcgaggggaggg

SEQ ID NO: 247540 - DNA, 15 bp, Homo sapiens
acgtgcgaggggagg

SEQ ID NO: 247541 - DNA, 15 bp, Homo sapiens
tacgtgcgaggggag

SEQ ID NO: 247542 - DNA, 15 bp, Homo sapiens
ctacgtgcgagggga

SEQ ID NO: 247543 - DNA, 15 bp, Homo sapiens
tctacgtgcgagggg

SEQ ID NO: 247544 - DNA, 15 bp, Homo sapiens
gtctacgtgcgaggg

SEQ ID NO: 247545 - DNA, 15 bp, Homo sapiens
tgtctacgtgcgagg

SEQ ID NO: 247546 - DNA, 15 bp, Homo sapiens
gtgtctacgtgcgag

SEQ ID NO: 247547 - DNA, 15 bp, Homo sapiens
tgtgtctacgtgcga

SEQ ID NO: 247548 - DNA, 15 bp, Homo sapiens
atgtgtctacgtgcg

SEQ ID NO: 247549 - DNA, 15 bp, Homo sapiens
gatgtgtctacgtgc

SEQ ID NO: 247550 - DNA, 15 bp, Homo sapiens
tgatgtgtctacgtg

SEQ ID NO: 247551 - DNA, 15 bp, Homo sapiens
ctgatgtgtctacgt

SEQ ID NO: 247552 - DNA, 15 bp, Homo sapiens
actgatgtgtctacg

SEQ ID NO: 247553 - DNA, 15 bp, Homo sapiens
aactgatgtgtctac

SEQ ID NO: 247554 - DNA, 15 bp, Homo sapiens
aaactgatgtgtcta

SEQ ID NO: 247555 - DNA, 15 bp, Homo sapiens
aaaactgatgtgtct

SEQ ID NO: 247556 - DNA, 15 bp, Homo sapiens
caaaactgatgtgtc

SEQ ID NO: 247557 - DNA, 15 bp, Homo sapiens
tcaaaactgatgtgt

SEQ ID NO: 247558 - DNA, 15 bp, Homo sapiens
atcaaaactgatgtg

SEQ ID NO: 247559 - DNA, 15 bp, Homo sapiens
gatcaaaactgatgt

SEQ ID NO: 247560 - DNA, 15 bp, Homo sapiens
tgatcaaaactgatg

SEQ ID NO: 247561 - DNA, 15 bp, Homo sapiens
atgatcaaaactgat

SEQ ID NO: 247562 - DNA, 15 bp, Homo sapiens
aatgatcaaaactga

SEQ ID NO: 247563 - DNA, 15 bp, Homo sapiens
taatgatcaaaactg

SEQ ID NO: 247564 - DNA, 15 bp, Homo sapiens
ttaatgatcaaaact

SEQ ID NO: 247565 - DNA, 15 bp, Homo sapiens
attaatgatcaaaac

SEQ ID NO: 247566 - DNA, 15 bp, Homo sapiens
aattaatgatcaaaa

SEQ ID NO: 247567 - DNA, 15 bp, Homo sapiens
gaattaatgatcaaa

SEQ ID NO: 247568 - DNA, 15 bp, Homo sapiens
agaattaatgatcaa

SEQ ID NO: 247569 - DNA, 15 bp, Homo sapiens
tagaattaatgatca

SEQ ID NO: 247570 - DNA, 15 bp, Homo sapiens
gtagaattaatgatc

SEQ ID NO: 247571 - DNA, 15 bp, Homo sapiens
agtagaattaatgat

SEQ ID NO: 247572 - DNA, 15 bp, Homo sapiens
tagtagaattaatga

SEQ ID NO: 247573 - DNA, 15 bp, Homo sapiens
gtagtagaattaatg

SEQ ID NO: 247574 - DNA, 15 bp, Homo sapiens
agtagtagaattaat

SEQ ID NO: 247575 - DNA, 15 bp, Homo sapiens
aagtagtagaattaa

SEQ ID NO: 247576 - DNA, 15 bp, Homo sapiens
aaagtagtagaatta

SEQ ID NO: 247577 - DNA, 15 bp, Homo sapiens
taaagtagtagaatt

SEQ ID NO: 247578 - DNA, 15 bp, Homo sapiens
ataaagtagtagaat

SEQ ID NO: 247579 - DNA, 15 bp, Homo sapiens
aataaagtagtagaa

SEQ ID NO: 247580 - DNA, 15 bp, Homo sapiens
aaataaagtagtaga

SEQ ID NO: 247581 - DNA, 15 bp, Homo sapiens
taaataaagtagtag

SEQ ID NO: 247582 - DNA, 15 bp, Homo sapiens
ttaaataaagtagta

SEQ ID NO: 247583 - DNA, 15 bp, Homo sapiens
tttaaataaagtagt

SEQ ID NO: 247584 - DNA, 15 bp, Homo sapiens
ttttaaataaagtag

SEQ ID NO: 247585 - DNA, 15 bp, Homo sapiens
tttttaaataaagta

SEQ ID NO: 247586 - DNA, 15 bp, Homo sapiens
gtttttaaataaagt

SEQ ID NO: 247587 - DNA, 15 bp, Homo sapiens
tgtttttaaataaag

SEQ ID NO: 247588 - DNA, 15 bp, Homo sapiens
ttgtttttaaataaa

SEQ ID NO: 247589 - DNA, 15 bp, Homo sapiens
tttgtttttaaataa

SEQ ID NO: 247590 - DNA, 15 bp, Homo sapiens
gtttgtttttaaata

SEQ ID NO: 247591 - DNA, 15 bp, Homo sapiens
tgtttgtttttaaat

SEQ ID NO: 247592 - DNA, 15 bp, Homo sapiens
gtgtttgtttttaaa

SEQ ID NO: 247593 - DNA, 15 bp, Homo sapiens
tgtgtttgtttttaa

SEQ ID NO: 247594 - DNA, 15 bp, Homo sapiens
ttgtgtttgttttta

SEQ ID NO: 247595 - DNA, 15 bp, Homo sapiens
tttgtgtttgttttt

SEQ ID NO: 247596 - DNA, 15 bp, Homo sapiens
atttgtgtttgtttt

SEQ ID NO: 247597 - DNA, 15 bp, Homo sapiens
tatttgtgtttgttt

SEQ ID NO: 247598 - DNA, 15 bp, Homo sapiens
ttatttgtgtttgtt

SEQ ID NO: 247599 - DNA, 15 bp, Homo sapiens
tttatttgtgtttgt

SEQ ID NO: 247600 - DNA, 15 bp, Homo sapiens
gtttatttgtgtttg

SEQ ID NO: 247601 - DNA, 15 bp, Homo sapiens
agtttatttgtgttt

SEQ ID NO: 247602 - DNA, 15 bp, Homo sapiens
aagtttatttgtgtt

SEQ ID NO: 247603 - DNA, 15 bp, Homo sapiens
aaagtttatttgtgt

SEQ ID NO: 247604 - DNA, 15 bp, Homo sapiens
caaagtttatttgtg

SEQ ID NO: 247605 - DNA, 15 bp, Homo sapiens
acaaagtttatttgt

SEQ ID NO: 247606 - DNA, 15 bp, Homo sapiens
gacaaagtttatttg

SEQ ID NO: 247607 - DNA, 15 bp, Homo sapiens
agacaaagtttattt

SEQ ID NO: 247608 - DNA, 15 bp, Homo sapiens
aagacaaagtttatt

SEQ ID NO: 247609 - DNA, 15 bp, Homo sapiens
taagacaaagtttat

SEQ ID NO: 247610 - DNA, 15 bp, Homo sapiens
ataagacaaagttta

SEQ ID NO: 247611 - DNA, 15 bp, Homo sapiens
aataagacaaagttt

SEQ ID NO: 247612 - DNA, 15 bp, Homo sapiens
caataagacaaagtt

SEQ ID NO: 247613 - DNA, 15 bp, Homo sapiens
acaataagacaaagt

SEQ ID NO: 247614 - DNA, 15 bp, Homo sapiens
aacaataagacaaag

SEQ ID NO: 247615 - DNA, 15 bp, Homo sapiens
aaacaataagacaaa

SEQ ID NO: 247616 - DNA, 15 bp, Homo sapiens
aaaacaataagacaa

SEQ ID NO: 247617 - DNA, 15 bp, Homo sapiens
caaaacaataagaca

SEQ ID NO: 247618 - DNA, 15 bp, Homo sapiens
acaaaacaataagac

SEQ ID NO: 247619 - DNA, 15 bp, Homo sapiens
gttacaaaacaataa

SEQ ID NO: 247620 - DNA, 15 bp, Homo sapiens
tgttacaaaacaata

SEQ ID NO: 247621 - DNA, 15 bp, Homo sapiens
ttgttacaaaacaat

SEQ ID NO: 247622 - DNA, 15 bp, Homo sapiens
tttgttacaaaacaa

SEQ ID NO: 247623 - DNA, 15 bp, Homo sapiens
atttgttacaaaaca

SEQ ID NO: 247624 - DNA, 15 bp, Homo sapiens
catttgttacaaaac

SEQ ID NO: 247625 - DNA, 15 bp, Homo sapiens
acatttgttacaaaa

SEQ ID NO: 247626 - DNA, 15 bp, Homo sapiens
aacatttgttacaaa

SEQ ID NO: 247627 - DNA, 15 bp, Homo sapiens
gaacatttgttacaa

SEQ ID NO: 247628 - DNA, 15 bp, Homo sapiens
agaacatttgttaca

SEQ ID NO: 247629 - DNA, 15 bp, Homo sapiens
tagaacatttgttac

SEQ ID NO: 247630 - DNA, 15 bp, Homo sapiens
ctagaacatttgtta

SEQ ID NO: 247631 - DNA, 15 bp, Homo sapiens
actagaacatttgtt

SEQ ID NO: 247632 - DNA, 15 bp, Homo sapiens
tactagaacatttgt

SEQ ID NO: 247633 - DNA, 15 bp, Homo sapiens
ctactagaacatttg

SEQ ID NO: 247634 - DNA, 15 bp, Homo sapiens
actactagaacattt

SEQ ID NO: 247635 - DNA, 15 bp, Homo sapiens
gactactagaacatt

SEQ ID NO: 247636 - DNA, 15 bp, Homo sapiens
tgactactagaacat

SEQ ID NO: 247637 - DNA, 15 bp, Homo sapiens
atgactactagaaca

SEQ ID NO: 247638 - DNA, 15 bp, Homo sapiens
tatgactactagaac

SEQ ID NO: 247639 - DNA, 15 bp, Homo sapiens
gtatgactactagaa

SEQ ID NO: 247640 - DNA, 15 bp, Homo sapiens
tgtatgactactaga

SEQ ID NO: 247641 - DNA, 15 bp, Homo sapiens
atgtatgactactag

SEQ ID NO: 247642 - DNA, 15 bp, Homo sapiens
catgtatgactacta

SEQ ID NO: 247643 - DNA, 15 bp, Homo sapiens
gcatgtatgactact

SEQ ID NO: 247644 - DNA, 15 bp, Homo sapiens
tgcatgtatgactac

SEQ ID NO: 247645 - DNA, 15 bp, Homo sapiens
ttgcatgtatgacta

SEQ ID NO: 247646 - DNA, 15 bp, Homo sapiens
attgcatgtatgact

SEQ ID NO: 247647 - DNA, 15 bp, Homo sapiens
tattgcatgtatgac

SEQ ID NO: 247648 - DNA, 15 bp, Homo sapiens
atattgcatgtatga

SEQ ID NO: 247649 - DNA, 15 bp, Homo sapiens
aatattgcatgtatg

SEQ ID NO: 247650 - DNA, 15 bp, Homo sapiens
caatattgcatgtat

SEQ ID NO: 247651 - DNA, 15 bp, Homo sapiens
tcaatattgcatgta

SEQ ID NO: 247652 - DNA, 15 bp, Homo sapiens
gtcaatattgcatgt

SEQ ID NO: 247653 - DNA, 15 bp, Homo sapiens
tgtcaatattgcatg

SEQ ID NO: 247654 - DNA, 15 bp, Homo sapiens
atgtcaatattgcat

SEQ ID NO: 247655 - DNA, 15 bp, Homo sapiens
gatgtcaatattgca

SEQ ID NO: 247656 - DNA, 15 bp, Homo sapiens
agatgtcaatattgc

SEQ ID NO: 247657 - DNA, 15 bp, Homo sapiens
aagatgtcaatattg

SEQ ID NO: 247658 - DNA, 15 bp, Homo sapiens
taagatgtcaatatt

SEQ ID NO: 247659 - DNA, 15 bp, Homo sapiens
ataagatgtcaatat

SEQ ID NO: 247660 - DNA, 15 bp, Homo sapiens
tataagatgtcaata

SEQ ID NO: 247661 - DNA, 15 bp, Homo sapiens
atataagatgtcaat

SEQ ID NO: 247662 - DNA, 15 bp, Homo sapiens
aatataagatgtcaa

SEQ ID NO: 247663 - DNA, 15 bp, Homo sapiens
aaatataagatgtca

SEQ ID NO: 247664 - DNA, 15 bp, Homo sapiens
aaaatataagatgtc

SEQ ID NO: 247665 - DNA, 15 bp, Homo sapiens
caaaatataagatgt

SEQ ID NO: 247666 - DNA, 15 bp, Homo sapiens
ccaaaatataagatg

SEQ ID NO: 247667 - DNA, 15 bp, Homo sapiens
cccaaaatataagat

SEQ ID NO: 247668 - DNA, 15 bp, Homo sapiens
ccccaaaatataaga

SEQ ID NO: 247669 - DNA, 15 bp, Homo sapiens
accccaaaatataag

SEQ ID NO: 247670 - DNA, 15 bp, Homo sapiens
caccccaaaatataa

SEQ ID NO: 247671 - DNA, 15 bp, Homo sapiens
acaccccaaaatata

SEQ ID NO: 247672 - DNA, 15 bp, Homo sapiens
tacaccccaaaatat

SEQ ID NO: 247673 - DNA, 15 bp, Homo sapiens
atacaccccaaaata

SEQ ID NO: 247674 - DNA, 15 bp, Homo sapiens
catacaccccaaaat

SEQ ID NO: 247675 - DNA, 15 bp, Homo sapiens
ccatacaccccaaaa

SEQ ID NO: 247676 - DNA, 15 bp, Homo sapiens
accatacaccccaaa

SEQ ID NO: 247677 - DNA, 15 bp, Homo sapiens
taccatacaccccaa

SEQ ID NO: 247678 - DNA, 15 bp, Homo sapiens
ataccatacacccca

SEQ ID NO: 247679 - DNA, 15 bp, Homo sapiens
cataccatacacccc

SEQ ID NO: 247680 - DNA, 15 bp, Homo sapiens
ccataccatacaccc

SEQ ID NO: 247681 - DNA, 15 bp, Homo sapiens
accataccatacacc

SEQ ID NO: 247682 - DNA, 15 bp, Homo sapiens
taccataccatacac

SEQ ID NO: 247683 - DNA, 15 bp, Homo sapiens
ctaccataccataca

SEQ ID NO: 247684 - DNA, 15 bp, Homo sapiens
gctaccataccatac

SEQ ID NO: 247685 - DNA, 15 bp, Homo sapiens
ggctaccataccata

SEQ ID NO: 247686 - DNA, 15 bp, Homo sapiens
aggctaccataccat

SEQ ID NO: 247687 - DNA, 15 bp, Homo sapiens
taggctaccatacca

SEQ ID NO: 247688 - DNA, 15 bp, Homo sapiens
ataggctaccatacc

SEQ ID NO: 247689 - DNA, 15 bp, Homo sapiens
aataggctaccatac

SEQ ID NO: 247690 - DNA, 15 bp, Homo sapiens
aaataggctaccata

SEQ ID NO: 247691 - DNA, 15 bp, Homo sapiens
gaaataggctaccat

SEQ ID NO: 247692 - DNA, 15 bp, Homo sapiens
agaaataggctacca

SEQ ID NO: 247693 - DNA, 15 bp, Homo sapiens
tagaaataggctacc

SEQ ID NO: 247694 - DNA, 15 bp, Homo sapiens
atagaaataggctac

SEQ ID NO: 247695 - DNA, 15 bp, Homo sapiens
tatagaaataggcta

SEQ ID NO: 247696 - DNA, 15 bp, Homo sapiens
atatagaaataggct

SEQ ID NO: 247697 - DNA, 15 bp, Homo sapiens
tatatagaaataggc

SEQ ID NO: 247698 - DNA, 15 bp, Homo sapiens
ctatatagaaatagg

SEQ ID NO: 247699 - DNA, 15 bp, Homo sapiens
actatatagaaatag

SEQ ID NO: 247700 - DNA, 15 bp, Homo sapiens
gactatatagaaata

SEQ ID NO: 247701 - DNA, 15 bp, Homo sapiens
ggactatatagaaat

SEQ ID NO: 247702 - DNA, 15 bp, Homo sapiens
aggactatatagaaa

SEQ ID NO: 247703 - DNA, 15 bp, Homo sapiens
aaggactatatagaa

SEQ ID NO: 247704 - DNA, 15 bp, Homo sapiens
aaaggactatataga

SEQ ID NO: 247705 - DNA, 15 bp, Homo sapiens
gaaaggactatatag

SEQ ID NO: 247706 - DNA, 15 bp, Homo sapiens
ggaaaggactatata

SEQ ID NO: 247707 - DNA, 15 bp, Homo sapiens
tggaaaggactatat

SEQ ID NO: 247708 - DNA, 15 bp, Homo sapiens
atggaaaggactata

SEQ ID NO: 247709 - DNA, 15 bp, Homo sapiens
catggaaaggactat

SEQ ID NO: 247710 - DNA, 15 bp, Homo sapiens
acatggaaaggacta

SEQ ID NO: 247711 - DNA, 15 bp, Homo sapiens
aacatggaaaggact

SEQ ID NO: 247712 - DNA, 15 bp, Homo sapiens
aaacatggaaaggac

SEQ ID NO: 247713 - DNA, 15 bp, Homo sapiens
caaacatggaaagga

SEQ ID NO: 247714 - DNA, 15 bp, Homo sapiens
acaaacatggaaagg

SEQ ID NO: 247715 - DNA, 15 bp, Homo sapiens
tacaaacatggaaag

SEQ ID NO: 247716 - DNA, 15 bp, Homo sapiens
atacaaacatggaaa

SEQ ID NO: 247717 - DNA, 15 bp, Homo sapiens
gatacaaacatggaa

SEQ ID NO: 247718 - DNA, 15 bp, Homo sapiens
agatacaaacatgga

SEQ ID NO: 247719 - DNA, 15 bp, Homo sapiens
aagatacaaacatgg

SEQ ID NO: 247720 - DNA, 15 bp, Homo sapiens
aaagatacaaacatg

SEQ ID NO: 247721 - DNA, 15 bp, Homo sapiens
taaagatacaaacat

SEQ ID NO: 247722 - DNA, 15 bp, Homo sapiens
ttaaagatacaaaca

SEQ ID NO: 247723 - DNA, 15 bp, Homo sapiens
tttaaagatacaaac

SEQ ID NO: 247724 - DNA, 15 bp, Homo sapiens
atttaaagatacaaa

SEQ ID NO: 247725 - DNA, 15 bp, Homo sapiens
gatttaaagatacaa

SEQ ID NO: 247726 - DNA, 15 bp, Homo sapiens
agatttaaagataca

SEQ ID NO: 247727 - DNA, 15 bp, Homo sapiens
tagatttaaagatac

SEQ ID NO: 247728 - DNA, 15 bp, Homo sapiens
gtagatttaaagata

SEQ ID NO: 247729 - DNA, 15 bp, Homo sapiens
agtagatttaaagat

SEQ ID NO: 247730 - DNA, 15 bp, Homo sapiens
gagtagatttaaaga

SEQ ID NO: 247731 - DNA, 15 bp, Homo sapiens
agagtagatttaaag

SEQ ID NO: 247732 - DNA, 15 bp, Homo sapiens
aagagtagatttaaa

SEQ ID NO: 247733 - DNA, 15 bp, Homo sapiens
caagagtagatttaa

SEQ ID NO: 247734 - DNA, 15 bp, Homo sapiens
tcaagagtagattta

SEQ ID NO: 247735 - DNA, 15 bp, Homo sapiens
ctcaagagtagattt

SEQ ID NO: 247736 - DNA, 15 bp, Homo sapiens
actcaagagtagatt

SEQ ID NO: 247737 - DNA, 15 bp, Homo sapiens
cactcaagagtagat

SEQ ID NO: 247738 - DNA, 15 bp, Homo sapiens
acactcaagagtaga

SEQ ID NO: 247739 - DNA, 15 bp, Homo sapiens
cacactcaagagtag

SEQ ID NO: 247740 - DNA, 15 bp, Homo sapiens
tcacactcaagagta

SEQ ID NO: 247741 - DNA, 15 bp, Homo sapiens
ttcacactcaagagt

SEQ ID NO: 247742 - DNA, 15 bp, Homo sapiens
tttcacactcaagag

SEQ ID NO: 247743 - DNA, 15 bp, Homo sapiens
atttcacactcaaga

SEQ ID NO: 247744 - DNA, 15 bp, Homo sapiens
aatttcacactcaag

SEQ ID NO: 247745 - DNA, 15 bp, Homo sapiens
taatttcacactcaa

SEQ ID NO: 247746 - DNA, 15 bp, Homo sapiens
gtaatttcacactca

SEQ ID NO: 247747 - DNA, 15 bp, Homo sapiens
agtaatttcacactc

SEQ ID NO: 247748 - DNA, 15 bp, Homo sapiens
aagtaatttcacact

SEQ ID NO: 247749 - DNA, 15 bp, Homo sapiens
aaagtaatttcacac

SEQ ID NO: 247750 - DNA, 15 bp, Homo sapiens
taaagtaatttcaca

SEQ ID NO: 247751 - DNA, 15 bp, Homo sapiens
ttaaagtaatttcac

SEQ ID NO: 247752 - DNA, 15 bp, Homo sapiens
cttaaagtaatttca

SEQ ID NO: 247753 - DNA, 15 bp, Homo sapiens
acttaaagtaatttc

SEQ ID NO: 247754 - DNA, 15 bp, Homo sapiens
cacttaaagtaattt

SEQ ID NO: 247755 - DNA, 15 bp, Homo sapiens
acacttaaagtaatt

SEQ ID NO: 247756 - DNA, 15 bp, Homo sapiens
tacacttaaagtaat

SEQ ID NO: 247757 - DNA, 15 bp, Homo sapiens
atacacttaaagtaa

SEQ ID NO: 247758 - DNA, 15 bp, Homo sapiens
aatacacttaaagta

SEQ ID NO: 247759 - DNA, 15 bp, Homo sapiens
aaatacacttaaagt

SEQ ID NO: 247760 - DNA, 15 bp, Homo sapiens
aaaatacacttaaag

SEQ ID NO: 247761 - DNA, 15 bp, Homo sapiens
caaaatacacttaaa

SEQ ID NO: 247762 - DNA, 15 bp, Homo sapiens
acaaaatacacttaa

SEQ ID NO: 247763 - DNA, 15 bp, Homo sapiens
aacaaaatacactta

SEQ ID NO: 247764 - DNA, 15 bp, Homo sapiens
aaacaaaatacactt

SEQ ID NO: 247765 - DNA, 15 bp, Homo sapiens
gaaacaaaatacact

SEQ ID NO: 247766 - DNA, 15 bp, Homo sapiens
tgaaacaaaatacac

SEQ ID NO: 247767 - DNA, 15 bp, Homo sapiens
ctgaaacaaaataca

SEQ ID NO: 247768 - DNA, 15 bp, Homo sapiens
tctgaaacaaaatac

SEQ ID NO: 247769 - DNA, 15 bp, Homo sapiens
ctctgaaacaaaata

SEQ ID NO: 247770 - DNA, 15 bp, Homo sapiens
tctctgaaacaaaat

SEQ ID NO: 247771 - DNA, 15 bp, Homo sapiens
gtctctgaaacaaaa

SEQ ID NO: 247772 - DNA, 15 bp, Homo sapiens
tgtctctgaaacaaa

SEQ ID NO: 247773 - DNA, 15 bp, Homo sapiens
ctgtctctgaaacaa

SEQ ID NO: 247774 - DNA, 15 bp, Homo sapiens
cctgtctctgaaaca

SEQ ID NO: 247775 - DNA, 15 bp, Homo sapiens
ccctgtctctgaaac

SEQ ID NO: 247776 - DNA, 15 bp, Homo sapiens
accctgtctctgaaa

SEQ ID NO: 247777 - DNA, 15 bp, Homo sapiens
gaccctgtctctgaa

SEQ ID NO: 247778 - DNA, 15 bp, Homo sapiens
agaccctgtctctga

SEQ ID NO: 247779 - DNA, 15 bp, Homo sapiens
gagaccctgtctctg

SEQ ID NO: 247780 - DNA, 15 bp, Homo sapiens
tgagaccctgtctct

SEQ ID NO: 247781 - DNA, 15 bp, Homo sapiens
gtgagaccctgtctc

SEQ ID NO: 247782 - DNA, 15 bp, Homo sapiens
agtgagaccctgtct

SEQ ID NO: 247783 - DNA, 15 bp, Homo sapiens
ggcctgggcaacaga

SEQ ID NO: 247784 - DNA, 15 bp, Homo sapiens
tggcctgggcaacag

SEQ ID NO: 247785 - DNA, 15 bp, Homo sapiens
ctggcctgggcaaca

SEQ ID NO: 247786 - DNA, 15 bp, Homo sapiens
tctggcctgggcaac

SEQ ID NO: 247787 - DNA, 15 bp, Homo sapiens
ctctggcctgggcaa

SEQ ID NO: 247788 - DNA, 15 bp, Homo sapiens
actctggcctgggca

SEQ ID NO: 247789 - DNA, 15 bp, Homo sapiens
cactctggcctgggc

SEQ ID NO: 247790 - DNA, 15 bp, Homo sapiens
gcactctggcctggg

SEQ ID NO: 247791 - DNA, 15 bp, Homo sapiens
tgcactctggcctgg

SEQ ID NO: 247792 - DNA, 15 bp, Homo sapiens
ctgcactctggcctg

SEQ ID NO: 247793 - DNA, 15 bp, Homo sapiens
actgcactctggcct

SEQ ID NO: 247794 - DNA, 15 bp, Homo sapiens
cactgcactctggcc

SEQ ID NO: 247795 - DNA, 15 bp, Homo sapiens
ccactgcactctggc

SEQ ID NO: 247796 - DNA, 15 bp, Homo sapiens
accactgcactctgg

SEQ ID NO: 247797 - DNA, 15 bp, Homo sapiens
caccactgcactctg

SEQ ID NO: 247798 - DNA, 15 bp, Homo sapiens
gttgcaccactgcac

SEQ ID NO: 247799 - DNA, 15 bp, Homo sapiens
ggttgcaccactgca

SEQ ID NO: 247800 - DNA, 15 bp, Homo sapiens
tggttgcaccactgc

SEQ ID NO: 247801 - DNA, 15 bp, Homo sapiens
atggttgcaccactg

SEQ ID NO: 247802 - DNA, 15 bp, Homo sapiens
catggttgcaccact

SEQ ID NO: 247803 - DNA, 15 bp, Homo sapiens
ccatggttgcaccac

SEQ ID NO: 247804 - DNA, 15 bp, Homo sapiens
gccatggttgcacca

SEQ ID NO: 247805 - DNA, 15 bp, Homo sapiens
agccatggttgcacc

SEQ ID NO: 247806 - DNA, 15 bp, Homo sapiens
gagccatggttgcac

SEQ ID NO: 247807 - DNA, 15 bp, Homo sapiens
tgagccatggttgca

SEQ ID NO: 247808 - DNA, 15 bp, Homo sapiens
atgagccatggttgc

SEQ ID NO: 247809 - DNA, 15 bp, Homo sapiens
aatgagccatggttg

SEQ ID NO: 247810 - DNA, 15 bp, Homo sapiens
caatgagccatggtt

SEQ ID NO: 247811 - DNA, 15 bp, Homo sapiens
gcaatgagccatggt

SEQ ID NO: 247812 - DNA, 15 bp, Homo sapiens
tgcaatgagccatgg

SEQ ID NO: 247813 - DNA, 15 bp, Homo sapiens
ctgcaatgagccatg

SEQ ID NO: 247814 - DNA, 15 bp, Homo sapiens
actgcaatgagccat

SEQ ID NO: 247815 - DNA, 15 bp, Homo sapiens
gactgcaatgagcca

SEQ ID NO: 247816 - DNA, 15 bp, Homo sapiens
agactgcaatgagcc

SEQ ID NO: 247817 - DNA, 15 bp, Homo sapiens
aagactgcaatgagc

SEQ ID NO: 247818 - DNA, 15 bp, Homo sapiens
taagactgcaatgag

SEQ ID NO: 247819 - DNA, 15 bp, Homo sapiens
ataagactgcaatga

SEQ ID NO: 247820 - DNA, 15 bp, Homo sapiens
tataagactgcaatg

SEQ ID NO: 247821 - DNA, 15 bp, Homo sapiens
gtataagactgcaat

SEQ ID NO: 247822 - DNA, 15 bp, Homo sapiens
agtataagactgcaa

SEQ ID NO: 247823 - DNA, 15 bp, Homo sapiens
gagtataagactgca

SEQ ID NO: 247824 - DNA, 15 bp, Homo sapiens
ggagtataagactgc

SEQ ID NO: 247825 - DNA, 15 bp, Homo sapiens
aggagtataagactg

SEQ ID NO: 247826 - DNA, 15 bp, Homo sapiens
caggagtataagact

SEQ ID NO: 247827 - DNA, 15 bp, Homo sapiens
ccaggagtataagac

SEQ ID NO: 247828 - DNA, 15 bp, Homo sapiens
gccaggagtataaga

SEQ ID NO: 247829 - DNA, 15 bp, Homo sapiens
ggccaggagtataag

SEQ ID NO: 247830 - DNA, 15 bp, Homo sapiens
aggccaggagtataa

SEQ ID NO: 247831 - DNA, 15 bp, Homo sapiens
gaggccaggagtata

SEQ ID NO: 247832 - DNA, 15 bp, Homo sapiens
tgaggccaggagtat

SEQ ID NO: 247833 - DNA, 15 bp, Homo sapiens
ttgaggccaggagta

SEQ ID NO: 247834 - DNA, 15 bp, Homo sapiens
ttcacttgaggccag

SEQ ID NO: 247835 - DNA, 15 bp, Homo sapiens
gttcacttgaggcca

SEQ ID NO: 247836 - DNA, 15 bp, Homo sapiens
ggttcacttgaggcc

SEQ ID NO: 247837 - DNA, 15 bp, Homo sapiens
aggttcacttgaggc

SEQ ID NO: 247838 - DNA, 15 bp, Homo sapiens
gaggttcacttgagg

SEQ ID NO: 247839 - DNA, 15 bp, Homo sapiens
ggaggttcacttgag

SEQ ID NO: 247840 - DNA, 15 bp, Homo sapiens
aggaggttcacttga

SEQ ID NO: 247841 - DNA, 15 bp, Homo sapiens
caggaggttcacttg

SEQ ID NO: 247842 - DNA, 15 bp, Homo sapiens
gcaggaggttcactt

SEQ ID NO: 247843 - DNA, 15 bp, Homo sapiens
ggcaggaggttcact

SEQ ID NO: 247844 - DNA, 15 bp, Homo sapiens
aggcaggaggttcac

SEQ ID NO: 247845 - DNA, 15 bp, Homo sapiens
gaggcaggaggttca

SEQ ID NO: 247846 - DNA, 15 bp, Homo sapiens
tgaggcaggaggttc

SEQ ID NO: 247847 - DNA, 15 bp, Homo sapiens
ctgaggcaggaggtt

SEQ ID NO: 247848 - DNA, 15 bp, Homo sapiens
gctgaggcaggaggt

SEQ ID NO: 247849 - DNA, 15 bp, Homo sapiens
tacctgtagtcccag

SEQ ID NO: 247850 - DNA, 15 bp, Homo sapiens
gtacctgtagtccca

SEQ ID NO: 247851 - DNA, 15 bp, Homo sapiens
tgtacctgtagtccc

SEQ ID NO: 247852 - DNA, 15 bp, Homo sapiens
atgtacctgtagtcc

SEQ ID NO: 247853 - DNA, 15 bp, Homo sapiens
catgtacctgtagtc

SEQ ID NO: 247854 - DNA, 15 bp, Homo sapiens
gcatgtacctgtagt

SEQ ID NO: 247855 - DNA, 15 bp, Homo sapiens
ggcatgtacctgtag

SEQ ID NO: 247856 - DNA, 15 bp, Homo sapiens
tggcatgtacctgta

SEQ ID NO: 247857 - DNA, 15 bp, Homo sapiens
gtggcatgtacctgt

SEQ ID NO: 247858 - DNA, 15 bp, Homo sapiens
ggtggcatgtacctg

SEQ ID NO: 247859 - DNA, 15 bp, Homo sapiens
tggtggcatgtacct

SEQ ID NO: 247860 - DNA, 15 bp, Homo sapiens
atggtggcatgtacc

SEQ ID NO: 247861 - DNA, 15 bp, Homo sapiens
catggtggcatgtac

SEQ ID NO: 247862 - DNA, 15 bp, Homo sapiens
gcatggtggcatgta

SEQ ID NO: 247863 - DNA, 15 bp, Homo sapiens
caattagctgggcat

SEQ ID NO: 247864 - DNA, 15 bp, Homo sapiens
ccaattagctgggca

SEQ ID NO: 247865 - DNA, 15 bp, Homo sapiens
tccaattagctgggc

SEQ ID NO: 247866 - DNA, 15 bp, Homo sapiens
gtccaattagctggg

SEQ ID NO: 247867 - DNA, 15 bp, Homo sapiens
agtccaattagctgg

SEQ ID NO: 247868 - DNA, 15 bp, Homo sapiens
aagtccaattagctg

SEQ ID NO: 247869 - DNA, 15 bp, Homo sapiens
aaagtccaattagct

SEQ ID NO: 247870 - DNA, 15 bp, Homo sapiens
aaaagtccaattagc

SEQ ID NO: 247871 - DNA, 15 bp, Homo sapiens
aaaaagtccaattag

SEQ ID NO: 247872 - DNA, 15 bp, Homo sapiens
aaaaaagtccaatta

SEQ ID NO: 247873 - DNA, 15 bp, Homo sapiens
aaaaaaagtccaatt

SEQ ID NO: 247874 - DNA, 15 bp, Homo sapiens
taaaaaaagtccaat

SEQ ID NO: 247875 - DNA, 15 bp, Homo sapiens
ctaaaaaaagtccaa

SEQ ID NO: 247876 - DNA, 15 bp, Homo sapiens
tctaaaaaaagtcca

SEQ ID NO: 247877 - DNA, 15 bp, Homo sapiens
ctctaaaaaaagtcc

SEQ ID NO: 247878 - DNA, 15 bp, Homo sapiens
tctctaaaaaaagtc

SEQ ID NO: 247879 - DNA, 15 bp, Homo sapiens
atctctaaaaaaagt

SEQ ID NO: 247880 - DNA, 15 bp, Homo sapiens
catctctaaaaaaag

SEQ ID NO: 247881 - DNA, 15 bp, Homo sapiens
ccatctctaaaaaaa

SEQ ID NO: 247882 - DNA, 15 bp, Homo sapiens
tccatctctaaaaaa

SEQ ID NO: 247883 - DNA, 15 bp, Homo sapiens
ctccatctctaaaaa

SEQ ID NO: 247884 - DNA, 15 bp, Homo sapiens
actccatctctaaaa

SEQ ID NO: 247885 - DNA, 15 bp, Homo sapiens
gactccatctctaaa

SEQ ID NO: 247886 - DNA, 15 bp, Homo sapiens
agactccatctctaa

SEQ ID NO: 247887 - DNA, 15 bp, Homo sapiens
caagactccatctct

SEQ ID NO: 247888 - DNA, 15 bp, Homo sapiens
tagcaagactccatc

SEQ ID NO: 247889 - DNA, 15 bp, Homo sapiens
atagcaagactccat

SEQ ID NO: 247890 - DNA, 15 bp, Homo sapiens
catagcaagactcca

SEQ ID NO: 247891 - DNA, 15 bp, Homo sapiens
acatagcaagactcc

SEQ ID NO: 247892 - DNA, 15 bp, Homo sapiens
caggtcaggagtttg

SEQ ID NO: 247893 - DNA, 15 bp, Homo sapiens
tcaggtcaggagttt

SEQ ID NO: 247894 - DNA, 15 bp, Homo sapiens
ttcaggtcaggagtt

SEQ ID NO: 247895 - DNA, 15 bp, Homo sapiens
cttcaggtcaggagt

SEQ ID NO: 247896 - DNA, 15 bp, Homo sapiens
gcttcaggtcaggag

SEQ ID NO: 247897 - DNA, 15 bp, Homo sapiens
tgcttcaggtcagga

SEQ ID NO: 247898 - DNA, 15 bp, Homo sapiens
ctgcttcaggtcagg

SEQ ID NO: 247899 - DNA, 15 bp, Homo sapiens
actgcttcaggtcag

SEQ ID NO: 247900 - DNA, 15 bp, Homo sapiens
gactgcttcaggtca

SEQ ID NO: 247901 - DNA, 15 bp, Homo sapiens
ggactgcttcaggtc

SEQ ID NO: 247902 - DNA, 15 bp, Homo sapiens
aggactgcttcaggt

SEQ ID NO: 247903 - DNA, 15 bp, Homo sapiens
gaggactgcttcagg

SEQ ID NO: 247904 - DNA, 15 bp, Homo sapiens
ggaggactgcttcag

SEQ ID NO: 247905 - DNA, 15 bp, Homo sapiens
aggaggactgcttca

SEQ ID NO: 247906 - DNA, 15 bp, Homo sapiens
caggaggactgcttc

SEQ ID NO: 247907 - DNA, 15 bp, Homo sapiens
agcaggaggactgct

SEQ ID NO: 247908 - DNA, 15 bp, Homo sapiens
aagcaggaggactgc

SEQ ID NO: 247909 - DNA, 15 bp, Homo sapiens
aaagcaggaggactg

SEQ ID NO: 247910 - DNA, 15 bp, Homo sapiens
caaagcaggaggact

SEQ ID NO: 247911 - DNA, 15 bp, Homo sapiens
ccaaagcaggaggac

SEQ ID NO: 247912 - DNA, 15 bp, Homo sapiens
gccaaagcaggagga

SEQ ID NO: 247913 - DNA, 15 bp, Homo sapiens
ggccaaagcaggagg

SEQ ID NO: 247914 - DNA, 15 bp, Homo sapiens
aggccaaagcaggag

SEQ ID NO: 247915 - DNA, 15 bp, Homo sapiens
gaggccaaagcagga

SEQ ID NO: 247916 - DNA, 15 bp, Homo sapiens
ggaggccaaagcagg

SEQ ID NO: 247917 - DNA, 15 bp, Homo sapiens
gggaggccaaagcag

SEQ ID NO: 247918 - DNA, 15 bp, Homo sapiens
ggggaggccaaagca

SEQ ID NO: 247919 - DNA, 15 bp, Homo sapiens
tggggaggccaaagc

SEQ ID NO: 247920 - DNA, 15 bp, Homo sapiens
ttggggaggccaaag

SEQ ID NO: 247921 - DNA, 15 bp, Homo sapiens
tttggggaggccaaa

SEQ ID NO: 247922 - DNA, 15 bp, Homo sapiens
atttggggaggccaa

SEQ ID NO: 247923 - DNA, 15 bp, Homo sapiens
catttggggaggcca

SEQ ID NO: 247924 - DNA, 15 bp, Homo sapiens
gcatttggggaggcc

SEQ ID NO: 247925 - DNA, 15 bp, Homo sapiens
agcatttggggaggc

SEQ ID NO: 247926 - DNA, 15 bp, Homo sapiens
cagcatttggggagg

SEQ ID NO: 247927 - DNA, 15 bp, Homo sapiens
ccagcatttggggag

SEQ ID NO: 247928 - DNA, 15 bp, Homo sapiens
cccagcatttgggga

SEQ ID NO: 247929 - DNA, 15 bp, Homo sapiens
tcccagcatttgggg

SEQ ID NO: 247930 - DNA, 15 bp, Homo sapiens
atcccagcatttggg

SEQ ID NO: 247931 - DNA, 15 bp, Homo sapiens
aatcccagcatttgg

SEQ ID NO: 247932 - DNA, 15 bp, Homo sapiens
taatcccagcatttg

SEQ ID NO: 247933 - DNA, 15 bp, Homo sapiens
agtggctcatgtctg

SEQ ID NO: 247934 - DNA, 15 bp, Homo sapiens
agctgggcacagtgg

SEQ ID NO: 247935 - DNA, 15 bp, Homo sapiens
aagctgggcacagtg

SEQ ID NO: 247936 - DNA, 15 bp, Homo sapiens
taagctgggcacagt

SEQ ID NO: 247937 - DNA, 15 bp, Homo sapiens
ttaagctgggcacag

SEQ ID NO: 247938 - DNA, 15 bp, Homo sapiens
tttaagctgggcaca

SEQ ID NO: 247939 - DNA, 15 bp, Homo sapiens
atttaagctgggcac

SEQ ID NO: 247940 - DNA, 15 bp, Homo sapiens
catttaagctgggca

SEQ ID NO: 247941 - DNA, 15 bp, Homo sapiens
gcatttaagctgggc

SEQ ID NO: 247942 - DNA, 15 bp, Homo sapiens
tgcatttaagctggg

SEQ ID NO: 247943 - DNA, 15 bp, Homo sapiens
atgcatttaagctgg

SEQ ID NO: 247944 - DNA, 15 bp, Homo sapiens
aatgcatttaagctg

SEQ ID NO: 247945 - DNA, 15 bp, Homo sapiens
aaatgcatttaagct

SEQ ID NO: 247946 - DNA, 15 bp, Homo sapiens
aaaatgcatttaagc

SEQ ID NO: 247947 - DNA, 15 bp, Homo sapiens
taaaatgcatttaag

SEQ ID NO: 247948 - DNA, 15 bp, Homo sapiens
ataaaatgcatttaa

SEQ ID NO: 247949 - DNA, 15 bp, Homo sapiens
tataaaatgcattta

SEQ ID NO: 247950 - DNA, 15 bp, Homo sapiens
ctataaaatgcattt

SEQ ID NO: 247951 - DNA, 15 bp, Homo sapiens
actataaaatgcatt

SEQ ID NO: 247952 - DNA, 15 bp, Homo sapiens
gactataaaatgcat

SEQ ID NO: 247953 - DNA, 15 bp, Homo sapiens
tgactataaaatgca

SEQ ID NO: 247954 - DNA, 15 bp, Homo sapiens
ttgactataaaatgc

SEQ ID NO: 247955 - DNA, 15 bp, Homo sapiens
tttgactataaaatg

SEQ ID NO: 247956 - DNA, 15 bp, Homo sapiens
atttgactataaaat

SEQ ID NO: 247957 - DNA, 15 bp, Homo sapiens
gatttgactataaaa

SEQ ID NO: 247958 - DNA, 15 bp, Homo sapiens
ggatttgactataaa

SEQ ID NO: 247959 - DNA, 15 bp, Homo sapiens
aggatttgactataa

SEQ ID NO: 247960 - DNA, 15 bp, Homo sapiens
taggatttgactata

SEQ ID NO: 247961 - DNA, 15 bp, Homo sapiens
gtaggatttgactat

SEQ ID NO: 247962 - DNA, 15 bp, Homo sapiens
cgtaggatttgacta

SEQ ID NO: 247963 - DNA, 15 bp, Homo sapiens
ccgtaggatttgact

SEQ ID NO: 247964 - DNA, 15 bp, Homo sapiens
tccgtaggatttgac

SEQ ID NO: 247965 - DNA, 15 bp, Homo sapiens
ttccgtaggatttga

SEQ ID NO: 247966 - DNA, 15 bp, Homo sapiens
attccgtaggatttg

SEQ ID NO: 247967 - DNA, 15 bp, Homo sapiens
aattccgtaggattt

SEQ ID NO: 247968 - DNA, 15 bp, Homo sapiens
taattccgtaggatt

SEQ ID NO: 247969 - DNA, 15 bp, Homo sapiens
ataattccgtaggat

SEQ ID NO: 247970 - DNA, 15 bp, Homo sapiens
aataattccgtagga

SEQ ID NO: 247971 - DNA, 15 bp, Homo sapiens
gaataattccgtagg

SEQ ID NO: 247972 - DNA, 15 bp, Homo sapiens
tgaataattccgtag

SEQ ID NO: 247973 - DNA, 15 bp, Homo sapiens
atgaataattccgta

SEQ ID NO: 247974 - DNA, 15 bp, Homo sapiens
aatgaataattccgt

SEQ ID NO: 247975 - DNA, 15 bp, Homo sapiens
taatgaataattccg

SEQ ID NO: 247976 - DNA, 15 bp, Homo sapiens
ataatgaataattcc

SEQ ID NO: 247977 - DNA, 15 bp, Homo sapiens
aataatgaataattc

SEQ ID NO: 247978 - DNA, 15 bp, Homo sapiens
aaataatgaataatt

SEQ ID NO: 247979 - DNA, 15 bp, Homo sapiens
taaataatgaataat

SEQ ID NO: 247980 - DNA, 15 bp, Homo sapiens
gtaaataatgaataa

SEQ ID NO: 247981 - DNA, 15 bp, Homo sapiens
tgtaaataatgaata

SEQ ID NO: 247982 - DNA, 15 bp, Homo sapiens
ttgtaaataatgaat

SEQ ID NO: 247983 - DNA, 15 bp, Homo sapiens
attgtaaataatgaa

SEQ ID NO: 247984 - DNA, 15 bp, Homo sapiens
cattgtaaataatga

SEQ ID NO: 247985 - DNA, 15 bp, Homo sapiens
acattgtaaataatg

SEQ ID NO: 247986 - DNA, 15 bp, Homo sapiens
aacattgtaaataat

SEQ ID NO: 247987 - DNA, 15 bp, Homo sapiens
caacattgtaaataa

SEQ ID NO: 247988 - DNA, 15 bp, Homo sapiens
acaacattgtaaata

SEQ ID NO: 247989 - DNA, 15 bp, Homo sapiens
gacaacattgtaaat

SEQ ID NO: 247990 - DNA, 15 bp, Homo sapiens
agacaacattgtaaa

SEQ ID NO: 247991 - DNA, 15 bp, Homo sapiens
aagacaacattgtaa

SEQ ID NO: 247992 - DNA, 15 bp, Homo sapiens
gaagacaacattgta

SEQ ID NO: 247993 - DNA, 15 bp, Homo sapiens
ggaagacaacattgt

SEQ ID NO: 247994 - DNA, 15 bp, Homo sapiens
aggaagacaacattg

SEQ ID NO: 247995 - DNA, 15 bp, Homo sapiens
caggaagacaacatt

SEQ ID NO: 247996 - DNA, 15 bp, Homo sapiens
gcaggaagacaacat

SEQ ID NO: 247997 - DNA, 15 bp, Homo sapiens
ggcaggaagacaaca

SEQ ID NO: 247998 - DNA, 15 bp, Homo sapiens
aggcaggaagacaac

SEQ ID NO: 247999 - DNA, 15 bp, Homo sapiens
gaggcaggaagacaa

SEQ ID NO: 248000 - DNA, 15 bp, Homo sapiens
ggaggcaggaagaca

SEQ ID NO: 248001 - DNA, 15 bp, Homo sapiens
aggaggcaggaagac

SEQ ID NO: 248002 - DNA, 15 bp, Homo sapiens
caggaggcaggaaga

SEQ ID NO: 248003 - DNA, 15 bp, Homo sapiens
acaggaggcaggaag

SEQ ID NO: 248004 - DNA, 15 bp, Homo sapiens
gacaggaggcaggaa

SEQ ID NO: 248005 - DNA, 15 bp, Homo sapiens
agacaggaggcagga

SEQ ID NO: 248006 - DNA, 15 bp, Homo sapiens
aagacaggaggcagg

SEQ ID NO: 248007 - DNA, 15 bp, Homo sapiens
gaagacaggaggcag

SEQ ID NO: 248008 - DNA, 15 bp, Homo sapiens
tgaagacaggaggca

SEQ ID NO: 248009 - DNA, 15 bp, Homo sapiens
atgaagacaggaggc

SEQ ID NO: 248010 - DNA, 15 bp, Homo sapiens
aatgaagacaggagg

SEQ ID NO: 248011 - DNA, 15 bp, Homo sapiens
taatgaagacaggag

SEQ ID NO: 248012 - DNA, 15 bp, Homo sapiens
ataatgaagacagga

SEQ ID NO: 248013 - DNA, 15 bp, Homo sapiens
gataatgaagacagg

SEQ ID NO: 248014 - DNA, 15 bp, Homo sapiens
tgataatgaagacag

SEQ ID NO: 248015 - DNA, 15 bp, Homo sapiens
atgataatgaagaca

SEQ ID NO: 248016 - DNA, 15 bp, Homo sapiens
catgataatgaagac

SEQ ID NO: 248017 - DNA, 15 bp, Homo sapiens
tcatgataatgaaga

SEQ ID NO: 248018 - DNA, 15 bp, Homo sapiens
ctcatgataatgaag

SEQ ID NO: 248019 - DNA, 15 bp, Homo sapiens
tctcatgataatgaa

SEQ ID NO: 248020 - DNA, 15 bp, Homo sapiens
atctcatgataatga

SEQ ID NO: 248021 - DNA, 15 bp, Homo sapiens
tatctcatgataatg

SEQ ID NO: 248022 - DNA, 15 bp, Homo sapiens
gtatctcatgataat

SEQ ID NO: 248023 - DNA, 15 bp, Homo sapiens
agtatctcatgataa

SEQ ID NO: 248024 - DNA, 15 bp, Homo sapiens
tagtatctcatgata

SEQ ID NO: 248025 - DNA, 15 bp, Homo sapiens
ttagtatctcatgat

SEQ ID NO: 248026 - DNA, 15 bp, Homo sapiens
attagtatctcatga

SEQ ID NO: 248027 - DNA, 15 bp, Homo sapiens
cattagtatctcatg

SEQ ID NO: 248028 - DNA, 15 bp, Homo sapiens
ccattagtatctcat

SEQ ID NO: 248029 - DNA, 15 bp, Homo sapiens
gccattagtatctca

SEQ ID NO: 248030 - DNA, 15 bp, Homo sapiens
tgccattagtatctc

SEQ ID NO: 248031 - DNA, 15 bp, Homo sapiens
atgccattagtatct

SEQ ID NO: 248032 - DNA, 15 bp, Homo sapiens
aatgccattagtatc

SEQ ID NO: 248033 - DNA, 15 bp, Homo sapiens
aaatgccattagtat

SEQ ID NO: 248034 - DNA, 15 bp, Homo sapiens
aaaatgccattagta

SEQ ID NO: 248035 - DNA, 15 bp, Homo sapiens
aaaaatgccattagt

SEQ ID NO: 248036 - DNA, 15 bp, Homo sapiens
aaaaaatgccattag

SEQ ID NO: 248037 - DNA, 15 bp, Homo sapiens
taaaaaatgccatta

SEQ ID NO: 248038 - DNA, 15 bp, Homo sapiens
ttaaaaaatgccatt

SEQ ID NO: 248039 - DNA, 15 bp, Homo sapiens
cttaaaaaatgccat

SEQ ID NO: 248040 - DNA, 15 bp, Homo sapiens
ccttaaaaaatgcca

SEQ ID NO: 248041 - DNA, 15 bp, Homo sapiens
tccttaaaaaatgcc

SEQ ID NO: 248042 - DNA, 15 bp, Homo sapiens
ttccttaaaaaatgc

SEQ ID NO: 248043 - DNA, 15 bp, Homo sapiens
cttccttaaaaaatg

SEQ ID NO: 248044 - DNA, 15 bp, Homo sapiens
tcttccttaaaaaat

SEQ ID NO: 248045 - DNA, 15 bp, Homo sapiens
gtcttccttaaaaaa

SEQ ID NO: 248046 - DNA, 15 bp, Homo sapiens
agtcttccttaaaaa

SEQ ID NO: 248047 - DNA, 15 bp, Homo sapiens
gagtcttccttaaaa

SEQ ID NO: 248048 - DNA, 15 bp, Homo sapiens
agagtcttccttaaa

SEQ ID NO: 248049 - DNA, 15 bp, Homo sapiens
tagagtcttccttaa

SEQ ID NO: 248050 - DNA, 15 bp, Homo sapiens
ttagagtcttcctta

SEQ ID NO: 248051 - DNA, 15 bp, Homo sapiens
tttagagtcttcctt

SEQ ID NO: 248052 - DNA, 15 bp, Homo sapiens
gtttagagtcttcct

SEQ ID NO: 248053 - DNA, 15 bp, Homo sapiens
agtttagagtcttcc

SEQ ID NO: 248054 - DNA, 15 bp, Homo sapiens
aagtttagagtcttc

SEQ ID NO: 248055 - DNA, 15 bp, Homo sapiens
aaagtttagagtctt

SEQ ID NO: 248056 - DNA, 15 bp, Homo sapiens
aaaagtttagagtct

SEQ ID NO: 248057 - DNA, 15 bp, Homo sapiens
caaaagtttagagtc

SEQ ID NO: 248058 - DNA, 15 bp, Homo sapiens
gcaaaagtttagagt

SEQ ID NO: 248059 - DNA, 15 bp, Homo sapiens
tgcaaaagtttagag

SEQ ID NO: 248060 - DNA, 15 bp, Homo sapiens
ctgcaaaagtttaga

SEQ ID NO: 248061 - DNA, 15 bp, Homo sapiens
actgcaaaagtttag

SEQ ID NO: 248062 - DNA, 15 bp, Homo sapiens
tactgcaaaagttta

SEQ ID NO: 248063 - DNA, 15 bp, Homo sapiens
gtactgcaaaagttt

SEQ ID NO: 248064 - DNA, 15 bp, Homo sapiens
ggtactgcaaaagtt

SEQ ID NO: 248065 - DNA, 15 bp, Homo sapiens
aggtactgcaaaagt

SEQ ID NO: 248066 - DNA, 15 bp, Homo sapiens
taggtactgcaaaag

SEQ ID NO: 248067 - DNA, 15 bp, Homo sapiens
ataggtactgcaaaa

SEQ ID NO: 248068 - DNA, 15 bp, Homo sapiens
aataggtactgcaaa

SEQ ID NO: 248069 - DNA, 15 bp, Homo sapiens
taataggtactgcaa

SEQ ID NO: 248070 - DNA, 15 bp, Homo sapiens
ataataggtactgca

SEQ ID NO: 248071 - DNA, 15 bp, Homo sapiens
gataataggtactgc

SEQ ID NO: 248072 - DNA, 15 bp, Homo sapiens
tgataataggtactg

SEQ ID NO: 248073 - DNA, 15 bp, Homo sapiens
ttgataataggtact

SEQ ID NO: 248074 - DNA, 15 bp, Homo sapiens
tttgataataggtac

SEQ ID NO: 248075 - DNA, 15 bp, Homo sapiens
atttgataataggta

SEQ ID NO: 248076 - DNA, 15 bp, Homo sapiens
tatttgataataggt

SEQ ID NO: 248077 - DNA, 15 bp, Homo sapiens
ctatttgataatagg

SEQ ID NO: 248078 - DNA, 15 bp, Homo sapiens
cctatttgataatag

SEQ ID NO: 248079 - DNA, 15 bp, Homo sapiens
tcctatttgataata

SEQ ID NO: 248080 - DNA, 15 bp, Homo sapiens
atcctatttgataat

SEQ ID NO: 248081 - DNA, 15 bp, Homo sapiens
gatcctatttgataa

SEQ ID NO: 248082 - DNA, 15 bp, Homo sapiens
tgatcctatttgata

SEQ ID NO: 248083 - DNA, 15 bp, Homo sapiens
atgatcctatttgat

SEQ ID NO: 248084 - DNA, 15 bp, Homo sapiens
tatgatcctatttga

SEQ ID NO: 248085 - DNA, 15 bp, Homo sapiens
atatgatcctatttg

SEQ ID NO: 248086 - DNA, 15 bp, Homo sapiens
tatatgatcctattt

SEQ ID NO: 248087 - DNA, 15 bp, Homo sapiens
atatatgatcctatt

SEQ ID NO: 248088 - DNA, 15 bp, Homo sapiens
gatatatgatcctat

SEQ ID NO: 248089 - DNA, 15 bp, Homo sapiens
agatatatgatccta

SEQ ID NO: 248090 - DNA, 15 bp, Homo sapiens
aagatatatgatcct

SEQ ID NO: 248091 - DNA, 15 bp, Homo sapiens
taagatatatgatcc

SEQ ID NO: 248092 - DNA, 15 bp, Homo sapiens
ataagatatatgatc

SEQ ID NO: 248093 - DNA, 15 bp, Homo sapiens
aataagatatatgat

SEQ ID NO: 248094 - DNA, 15 bp, Homo sapiens
aaataagatatatga

SEQ ID NO: 248095 - DNA, 15 bp, Homo sapiens
caaataagatatatg

SEQ ID NO: 248096 - DNA, 15 bp, Homo sapiens
tcaaataagatatat

SEQ ID NO: 248097 - DNA, 15 bp, Homo sapiens
ttcaaataagatata

SEQ ID NO: 248098 - DNA, 15 bp, Homo sapiens
attcaaataagatat

SEQ ID NO: 248099 - DNA, 15 bp, Homo sapiens
aattcaaataagata

SEQ ID NO: 248100 - DNA, 15 bp, Homo sapiens
aaattcaaataagat

SEQ ID NO: 248101 - DNA, 15 bp, Homo sapiens
aaaattcaaataaga

SEQ ID NO: 248102 - DNA, 15 bp, Homo sapiens
caaaattcaaataag

SEQ ID NO: 248103 - DNA, 15 bp, Homo sapiens
ccaaaattcaaataa

SEQ ID NO: 248104 - DNA, 15 bp, Homo sapiens
tccaaaattcaaata

SEQ ID NO: 248105 - DNA, 15 bp, Homo sapiens
gtccaaaattcaaat

SEQ ID NO: 248106 - DNA, 15 bp, Homo sapiens
tgtccaaaattcaaa

SEQ ID NO: 248107 - DNA, 15 bp, Homo sapiens
ctgtccaaaattcaa

SEQ ID NO: 248108 - DNA, 15 bp, Homo sapiens
tctgtccaaaattca

SEQ ID NO: 248109 - DNA, 15 bp, Homo sapiens
ttctgtccaaaattc

SEQ ID NO: 248110 - DNA, 15 bp, Homo sapiens
attctgtccaaaatt

SEQ ID NO: 248111 - DNA, 15 bp, Homo sapiens
aattctgtccaaaat

SEQ ID NO: 248112 - DNA, 15 bp, Homo sapiens
aaattctgtccaaaa

SEQ ID NO: 248113 - DNA, 15 bp, Homo sapiens
aaaattctgtccaaa

SEQ ID NO: 248114 - DNA, 15 bp, Homo sapiens
aaaaattctgtccaa

SEQ ID NO: 248115 - DNA, 15 bp, Homo sapiens
aaaaaattctgtcca

SEQ ID NO: 248116 - DNA, 15 bp, Homo sapiens
aaaaaaattctgtcc

SEQ ID NO: 248117 - DNA, 15 bp, Homo sapiens
aaaaaaaattctgtc

SEQ ID NO: 248118 - DNA, 15 bp, Homo sapiens
aaaaaaaaattctgt

SEQ ID NO: 248119 - DNA, 15 bp, Homo sapiens
aaaaaaaaaattctg

SEQ ID NO: 248120 - DNA, 15 bp, Homo sapiens
gaaaaaaaaaattct

SEQ ID NO: 248121 - DNA, 15 bp, Homo sapiens
agaaaaaaaaaattc

SEQ ID NO: 248122 - DNA, 15 bp, Homo sapiens
aagaaaaaaaaaatt

SEQ ID NO: 248123 - DNA, 15 bp, Homo sapiens
caagaaaaaaaaaat

SEQ ID NO: 248124 - DNA, 15 bp, Homo sapiens
tcaagaaaaaaaaaa

SEQ ID NO: 248125 - DNA, 15 bp, Homo sapiens
ttcaagaaaaaaaaa

SEQ ID NO: 248126 - DNA, 15 bp, Homo sapiens
tttcaagaaaaaaaa

SEQ ID NO: 248127 - DNA, 15 bp, Homo sapiens
atttcaagaaaaaaa

SEQ ID NO: 248128 - DNA, 15 bp, Homo sapiens
aatttcaagaaaaaa

SEQ ID NO: 248129 - DNA, 15 bp, Homo sapiens
gaatttcaagaaaaa

SEQ ID NO: 248130 - DNA, 15 bp, Homo sapiens
agaatttcaagaaaa

SEQ ID NO: 248131 - DNA, 15 bp, Homo sapiens
cagaatttcaagaaa

SEQ ID NO: 248132 - DNA, 15 bp, Homo sapiens
tcagaatttcaagaa

SEQ ID NO: 248133 - DNA, 15 bp, Homo sapiens
gtcagaatttcaaga

SEQ ID NO: 248134 - DNA, 15 bp, Homo sapiens
ggtcagaatttcaag

SEQ ID NO: 248135 - DNA, 15 bp, Homo sapiens
aggtcagaatttcaa

SEQ ID NO: 248136 - DNA, 15 bp, Homo sapiens
gaggtcagaatttca

SEQ ID NO: 248137 - DNA, 15 bp, Homo sapiens
ggaggtcagaatttc

SEQ ID NO: 248138 - DNA, 15 bp, Homo sapiens
tggaggtcagaattt

SEQ ID NO: 248139 - DNA, 15 bp, Homo sapiens
gtggaggtcagaatt

SEQ ID NO: 248140 - DNA, 15 bp, Homo sapiens
cgtggaggtcagaat

SEQ ID NO: 248141 - DNA, 15 bp, Homo sapiens
gcgtggaggtcagaa

SEQ ID NO: 248142 - DNA, 15 bp, Homo sapiens
agcgtggaggtcaga

SEQ ID NO: 248143 - DNA, 15 bp, Homo sapiens
aagcgtggaggtcag

SEQ ID NO: 248144 - DNA, 15 bp, Homo sapiens
gaagcgtggaggtca

SEQ ID NO: 248145 - DNA, 15 bp, Homo sapiens
agaagcgtggaggtc

SEQ ID NO: 248146 - DNA, 15 bp, Homo sapiens
aagaagcgtggaggt

SEQ ID NO: 248147 - DNA, 15 bp, Homo sapiens
aaagaagcgtggagg

SEQ ID NO: 248148 - DNA, 15 bp, Homo sapiens
aaaagaagcgtggag

SEQ ID NO: 248149 - DNA, 15 bp, Homo sapiens
gaaaagaagcgtgga

SEQ ID NO: 248150 - DNA, 15 bp, Homo sapiens
agaaaagaagcgtgg

SEQ ID NO: 248151 - DNA, 15 bp, Homo sapiens
gagaaaagaagcgtg

SEQ ID NO: 248152 - DNA, 15 bp, Homo sapiens
agagaaaagaagcgt

SEQ ID NO: 248153 - DNA, 15 bp, Homo sapiens
aagagaaaagaagcg

SEQ ID NO: 248154 - DNA, 15 bp, Homo sapiens
taagagaaaagaagc

SEQ ID NO: 248155 - DNA, 15 bp, Homo sapiens
ttaagagaaaagaag

SEQ ID NO: 248156 - DNA, 15 bp, Homo sapiens
cttaagagaaaagaa

SEQ ID NO: 248157 - DNA, 15 bp, Homo sapiens
acttaagagaaaaga

SEQ ID NO: 248158 - DNA, 15 bp, Homo sapiens
aacttaagagaaaag

SEQ ID NO: 248159 - DNA, 15 bp, Homo sapiens
taacttaagagaaaa

SEQ ID NO: 248160 - DNA, 15 bp, Homo sapiens
ttaacttaagagaaa

SEQ ID NO: 248161 - DNA, 15 bp, Homo sapiens
attaacttaagagaa

SEQ ID NO: 248162 - DNA, 15 bp, Homo sapiens
aattaacttaagaga

SEQ ID NO: 248163 - DNA, 15 bp, Homo sapiens
aaattaacttaagag

SEQ ID NO: 248164 - DNA, 15 bp, Homo sapiens
aaaattaacttaaga

SEQ ID NO: 248165 - DNA, 15 bp, Homo sapiens
aaaaattaacttaag

SEQ ID NO: 248166 - DNA, 15 bp, Homo sapiens
caaaaattaacttaa

SEQ ID NO: 248167 - DNA, 15 bp, Homo sapiens
acaaaaattaactta

SEQ ID NO: 248168 - DNA, 15 bp, Homo sapiens
aacaaaaattaactt

SEQ ID NO: 248169 - DNA, 15 bp, Homo sapiens
aaacaaaaattaact

SEQ ID NO: 248170 - DNA, 15 bp, Homo sapiens
gaaacaaaaattaac

SEQ ID NO: 248171 - DNA, 15 bp, Homo sapiens
agaaacaaaaattaa

SEQ ID NO: 248172 - DNA, 15 bp, Homo sapiens
tagaaacaaaaatta

SEQ ID NO: 248173 - DNA, 15 bp, Homo sapiens
ttagaaacaaaaatt

SEQ ID NO: 248174 - DNA, 15 bp, Homo sapiens
tttagaaacaaaaat

SEQ ID NO: 248175 - DNA, 15 bp, Homo sapiens
ttttagaaacaaaaa

SEQ ID NO: 248176 - DNA, 15 bp, Homo sapiens
cttttagaaacaaaa

SEQ ID NO: 248177 - DNA, 15 bp, Homo sapiens
acttttagaaacaaa

SEQ ID NO: 248178 - DNA, 15 bp, Homo sapiens
tacttttagaaacaa

SEQ ID NO: 248179 - DNA, 15 bp, Homo sapiens
atacttttagaaaca

SEQ ID NO: 248180 - DNA, 15 bp, Homo sapiens
tatacttttagaaac

SEQ ID NO: 248181 - DNA, 15 bp, Homo sapiens
atatacttttagaaa

SEQ ID NO: 248182 - DNA, 15 bp, Homo sapiens
gatatacttttagaa

SEQ ID NO: 248183 - DNA, 15 bp, Homo sapiens
agatatacttttaga

SEQ ID NO: 248184 - DNA, 15 bp, Homo sapiens
aagatatacttttag

SEQ ID NO: 248185 - DNA, 15 bp, Homo sapiens
aaagatatactttta

SEQ ID NO: 248186 - DNA, 15 bp, Homo sapiens
caaagatatactttt

SEQ ID NO: 248187 - DNA, 15 bp, Homo sapiens
ccaaagatatacttt

SEQ ID NO: 248188 - DNA, 15 bp, Homo sapiens
tccaaagatatactt

SEQ ID NO: 248189 - DNA, 15 bp, Homo sapiens
atccaaagatatact

SEQ ID NO: 248190 - DNA, 15 bp, Homo sapiens
aatccaaagatatac

SEQ ID NO: 248191 - DNA, 15 bp, Homo sapiens
aaatccaaagatata

SEQ ID NO: 248192 - DNA, 15 bp, Homo sapiens
gaaatccaaagatat

SEQ ID NO: 248193 - DNA, 15 bp, Homo sapiens
ggaaatccaaagata

SEQ ID NO: 248194 - DNA, 15 bp, Homo sapiens
aggaaatccaaagat

SEQ ID NO: 248195 - DNA, 15 bp, Homo sapiens
caggaaatccaaaga

SEQ ID NO: 248196 - DNA, 15 bp, Homo sapiens
gcaggaaatccaaag

SEQ ID NO: 248197 - DNA, 15 bp, Homo sapiens
ggcaggaaatccaaa

SEQ ID NO: 248198 - DNA, 15 bp, Homo sapiens
aggcaggaaatccaa

SEQ ID NO: 248199 - DNA, 15 bp, Homo sapiens
aaggcaggaaatcca

SEQ ID NO: 248200 - DNA, 15 bp, Homo sapiens
aaaggcaggaaatcc

SEQ ID NO: 248201 - DNA, 15 bp, Homo sapiens
taaaggcaggaaatc

SEQ ID NO: 248202 - DNA, 15 bp, Homo sapiens
ttaaaggcaggaaat

SEQ ID NO: 248203 - DNA, 15 bp, Homo sapiens
tttaaaggcaggaaa

SEQ ID NO: 248204 - DNA, 15 bp, Homo sapiens
ttttaaaggcaggaa

SEQ ID NO: 248205 - DNA, 15 bp, Homo sapiens
cttttaaaggcagga

SEQ ID NO: 248206 - DNA, 15 bp, Homo sapiens
gcttttaaaggcagg

SEQ ID NO: 248207 - DNA, 15 bp, Homo sapiens
agcttttaaaggcag

SEQ ID NO: 248208 - DNA, 15 bp, Homo sapiens
aagcttttaaaggca

SEQ ID NO: 248209 - DNA, 15 bp, Homo sapiens
taagcttttaaaggc

SEQ ID NO: 248210 - DNA, 15 bp, Homo sapiens
ctaagcttttaaagg

SEQ ID NO: 248211 - DNA, 15 bp, Homo sapiens
tctaagcttttaaag

SEQ ID NO: 248212 - DNA, 15 bp, Homo sapiens
ctctaagcttttaaa

SEQ ID NO: 248213 - DNA, 15 bp, Homo sapiens
cctctaagcttttaa

SEQ ID NO: 248214 - DNA, 15 bp, Homo sapiens
tcctctaagctttta

SEQ ID NO: 248215 - DNA, 15 bp, Homo sapiens
gtcctctaagctttt

SEQ ID NO: 248216 - DNA, 15 bp, Homo sapiens
tgtcctctaagcttt

SEQ ID NO: 248217 - DNA, 15 bp, Homo sapiens
ctgtcctctaagctt

SEQ ID NO: 248218 - DNA, 15 bp, Homo sapiens
actgtcctctaagct

SEQ ID NO: 248219 - DNA, 15 bp, Homo sapiens
tactgtcctctaagc

SEQ ID NO: 248220 - DNA, 15 bp, Homo sapiens
ctactgtcctctaag

SEQ ID NO: 248221 - DNA, 15 bp, Homo sapiens
tctactgtcctctaa

SEQ ID NO: 248222 - DNA, 15 bp, Homo sapiens
gtctactgtcctcta

SEQ ID NO: 248223 - DNA, 15 bp, Homo sapiens
tgtctactgtcctct

SEQ ID NO: 248224 - DNA, 15 bp, Homo sapiens
ctgtctactgtcctc

SEQ ID NO: 248225 - DNA, 15 bp, Homo sapiens
actgtctactgtcct

SEQ ID NO: 248226 - DNA, 15 bp, Homo sapiens
cactgtctactgtcc

SEQ ID NO: 248227 - DNA, 15 bp, Homo sapiens
acactgtctactgtc

SEQ ID NO: 248228 - DNA, 15 bp, Homo sapiens
aacactgtctactgt

SEQ ID NO: 248229 - DNA, 15 bp, Homo sapiens
aaacactgtctactg

SEQ ID NO: 248230 - DNA, 15 bp, Homo sapiens
caaacactgtctact

SEQ ID NO: 248231 - DNA, 15 bp, Homo sapiens
gcaaacactgtctac

SEQ ID NO: 248232 - DNA, 15 bp, Homo sapiens
cgcaaacactgtcta

SEQ ID NO: 248233 - DNA, 15 bp, Homo sapiens
tcgcaaacactgtct

SEQ ID NO: 248234 - DNA, 15 bp, Homo sapiens
ctcgcaaacactgtc

SEQ ID NO: 248235 - DNA, 15 bp, Homo sapiens
actcgcaaacactgt

SEQ ID NO: 248236 - DNA, 15 bp, Homo sapiens
cactcgcaaacactg

SEQ ID NO: 248237 - DNA, 15 bp, Homo sapiens
ccactcgcaaacact

SEQ ID NO: 248238 - DNA, 15 bp, Homo sapiens
tccactcgcaaacac

SEQ ID NO: 248239 - DNA, 15 bp, Homo sapiens
atccactcgcaaaca

SEQ ID NO: 248240 - DNA, 15 bp, Homo sapiens
catccactcgcaaac

SEQ ID NO: 248241 - DNA, 15 bp, Homo sapiens
tcatccactcgcaaa

SEQ ID NO: 248242 - DNA, 15 bp, Homo sapiens
ctcatccactcgcaa

SEQ ID NO: 248243 - DNA, 15 bp, Homo sapiens
cctcatccactcgca

SEQ ID NO: 248244 - DNA, 15 bp, Homo sapiens
tcctcatccactcgc

SEQ ID NO: 248245 - DNA, 15 bp, Homo sapiens
ttcctcatccactcg

SEQ ID NO: 248246 - DNA, 15 bp, Homo sapiens
cttcctcatccactc

SEQ ID NO: 248247 - DNA, 15 bp, Homo sapiens
acttcctcatccact

SEQ ID NO: 248248 - DNA, 15 bp, Homo sapiens
aacttcctcatccac

SEQ ID NO: 248249 - DNA, 15 bp, Homo sapiens
caacttcctcatcca

SEQ ID NO: 248250 - DNA, 15 bp, Homo sapiens
tcaacttcctcatcc

SEQ ID NO: 248251 - DNA, 15 bp, Homo sapiens
ttcaacttcctcatc

SEQ ID NO: 248252 - DNA, 15 bp, Homo sapiens
attcaacttcctcat

SEQ ID NO: 248253 - DNA, 15 bp, Homo sapiens
tattcaacttcctca

SEQ ID NO: 248254 - DNA, 15 bp, Homo sapiens
atattcaacttcctc

SEQ ID NO: 248255 - DNA, 15 bp, Homo sapiens
tatattcaacttcct

SEQ ID NO: 248256 - DNA, 15 bp, Homo sapiens
ttatattcaacttcc

SEQ ID NO: 248257 - DNA, 15 bp, Homo sapiens
gttatattcaacttc

SEQ ID NO: 248258 - DNA, 15 bp, Homo sapiens
ggttatattcaactt

SEQ ID NO: 248259 - DNA, 15 bp, Homo sapiens
aggttatattcaact

SEQ ID NO: 248260 - DNA, 15 bp, Homo sapiens
caggttatattcaac

SEQ ID NO: 248261 - DNA, 15 bp, Homo sapiens
tcaggttatattcaa

SEQ ID NO: 248262 - DNA, 15 bp, Homo sapiens
ctcaggttatattca

SEQ ID NO: 248263 - DNA, 15 bp, Homo sapiens
cctcaggttatattc

SEQ ID NO: 248264 - DNA, 15 bp, Homo sapiens
tcctcaggttatatt

SEQ ID NO: 248265 - DNA, 15 bp, Homo sapiens
ttcctcaggttatat

SEQ ID NO: 248266 - DNA, 15 bp, Homo sapiens
attcctcaggttata

SEQ ID NO: 248267 - DNA, 15 bp, Homo sapiens
tattcctcaggttat

SEQ ID NO: 248268 - DNA, 15 bp, Homo sapiens
atattcctcaggtta

SEQ ID NO: 248269 - DNA, 15 bp, Homo sapiens
tatattcctcaggtt

SEQ ID NO: 248270 - DNA, 15 bp, Homo sapiens
atatattcctcaggt

SEQ ID NO: 248271 - DNA, 15 bp, Homo sapiens
tatatattcctcagg

SEQ ID NO: 248272 - DNA, 15 bp, Homo sapiens
ttatatattcctcag

SEQ ID NO: 248273 - DNA, 15 bp, Homo sapiens
cttatatattcctca

SEQ ID NO: 248274 - DNA, 15 bp, Homo sapiens
acttatatattcctc

SEQ ID NO: 248275 - DNA, 15 bp, Homo sapiens
aacttatatattcct

SEQ ID NO: 248276 - DNA, 15 bp, Homo sapiens
taacttatatattcc

SEQ ID NO: 248277 - DNA, 15 bp, Homo sapiens
ataacttatatattc

SEQ ID NO: 248278 - DNA, 15 bp, Homo sapiens
aataacttatatatt

SEQ ID NO: 248279 - DNA, 15 bp, Homo sapiens
gaataacttatatat

SEQ ID NO: 248280 - DNA, 15 bp, Homo sapiens
ggaataacttatata

SEQ ID NO: 248281 - DNA, 15 bp, Homo sapiens
aggaataacttatat

SEQ ID NO: 248282 - DNA, 15 bp, Homo sapiens
caggaataacttata

SEQ ID NO: 248283 - DNA, 15 bp, Homo sapiens
gcaggaataacttat

SEQ ID NO: 248284 - DNA, 15 bp, Homo sapiens
tgcaggaataactta

SEQ ID NO: 248285 - DNA, 15 bp, Homo sapiens
ctgcaggaataactt

SEQ ID NO: 248286 - DNA, 15 bp, Homo sapiens
gctgcaggaataact

SEQ ID NO: 248287 - DNA, 15 bp, Homo sapiens
agctgcaggaataac

SEQ ID NO: 248288 - DNA, 15 bp, Homo sapiens
aagctgcaggaataa

SEQ ID NO: 248289 - DNA, 15 bp, Homo sapiens
aaagctgcaggaata

SEQ ID NO: 248290 - DNA, 15 bp, Homo sapiens
gaaagctgcaggaat

SEQ ID NO: 248291 - DNA, 15 bp, Homo sapiens
agaaagctgcaggaa

SEQ ID NO: 248292 - DNA, 15 bp, Homo sapiens
gagaaagctgcagga

SEQ ID NO: 248293 - DNA, 15 bp, Homo sapiens
tgagaaagctgcagg

SEQ ID NO: 248294 - DNA, 15 bp, Homo sapiens
gtgagaaagctgcag

SEQ ID NO: 248295 - DNA, 15 bp, Homo sapiens
ggtgagaaagctgca

SEQ ID NO: 248296 - DNA, 15 bp, Homo sapiens
gggtgagaaagctgc

SEQ ID NO: 248297 - DNA, 15 bp, Homo sapiens
tgggtgagaaagctg

SEQ ID NO: 248298 - DNA, 15 bp, Homo sapiens
gtgggtgagaaagct

SEQ ID NO: 248299 - DNA, 15 bp, Homo sapiens
agtgggtgagaaagc

SEQ ID NO: 248300 - DNA, 15 bp, Homo sapiens
tagtgggtgagaaag

SEQ ID NO: 248301 - DNA, 15 bp, Homo sapiens
gtagtgggtgagaaa

SEQ ID NO: 248302 - DNA, 15 bp, Homo sapiens
ggtagtgggtgagaa

SEQ ID NO: 248303 - DNA, 15 bp, Homo sapiens
aggtagtgggtgaga

SEQ ID NO: 248304 - DNA, 15 bp, Homo sapiens
gaggtagtgggtgag

SEQ ID NO: 248305 - DNA, 15 bp, Homo sapiens
ggaggtagtgggtga

SEQ ID NO: 248306 - DNA, 15 bp, Homo sapiens
tggaggtagtgggtg

SEQ ID NO: 248307 - DNA, 15 bp, Homo sapiens
atggaggtagtgggt

SEQ ID NO: 248308 - DNA, 15 bp, Homo sapiens
gatggaggtagtggg

SEQ ID NO: 248309 - DNA, 15 bp, Homo sapiens
ggatggaggtagtgg

SEQ ID NO: 248310 - DNA, 15 bp, Homo sapiens
aggatggaggtagtg

SEQ ID NO: 248311 - DNA, 15 bp, Homo sapiens
gaggatggaggtagt

SEQ ID NO: 248312 - DNA, 15 bp, Homo sapiens
agaggatggaggtag

SEQ ID NO: 248313 - DNA, 15 bp, Homo sapiens
gagaggatggaggta

SEQ ID NO: 248314 - DNA, 15 bp, Homo sapiens
ggagaggatggaggt

SEQ ID NO: 248315 - DNA, 15 bp, Homo sapiens
gggagaggatggagg

SEQ ID NO: 248316 - DNA, 15 bp, Homo sapiens
ggggagaggatggag

SEQ ID NO: 248317 - DNA, 15 bp, Homo sapiens
tggggagaggatgga

SEQ ID NO: 248318 - DNA, 15 bp, Homo sapiens
ctggggagaggatgg

SEQ ID NO: 248319 - DNA, 15 bp, Homo sapiens
cctggggagaggatg

SEQ ID NO: 248320 - DNA, 15 bp, Homo sapiens
ccctggggagaggat

SEQ ID NO: 248321 - DNA, 15 bp, Homo sapiens
cccctggggagagga

SEQ ID NO: 248322 - DNA, 15 bp, Homo sapiens
gcccctggggagagg

SEQ ID NO: 248323 - DNA, 15 bp, Homo sapiens
agcccctggggagag

SEQ ID NO: 248324 - DNA, 15 bp, Homo sapiens
aagcccctggggaga

SEQ ID NO: 248325 - DNA, 15 bp, Homo sapiens
aaagcccctggggag

SEQ ID NO: 248326 - DNA, 15 bp, Homo sapiens
aaaagcccctgggga

SEQ ID NO: 248327 - DNA, 15 bp, Homo sapiens
gaaaagcccctgggg

SEQ ID NO: 248328 - DNA, 15 bp, Homo sapiens
ggaaaagcccctggg

SEQ ID NO: 248329 - DNA, 15 bp, Homo sapiens
tggaaaagcccctgg

SEQ ID NO: 248330 - DNA, 15 bp, Homo sapiens
gtggaaaagcccctg

SEQ ID NO: 248331 - DNA, 15 bp, Homo sapiens
tgtggaaaagcccct

SEQ ID NO: 248332 - DNA, 15 bp, Homo sapiens
gtgtggaaaagcccc

SEQ ID NO: 248333 - DNA, 15 bp, Homo sapiens
tgtgtggaaaagccc

SEQ ID NO: 248334 - DNA, 15 bp, Homo sapiens
ctgtgtggaaaagcc

SEQ ID NO: 248335 - DNA, 15 bp, Homo sapiens
tctgtgtggaaaagc

SEQ ID NO: 248336 - DNA, 15 bp, Homo sapiens
gtctgtgtggaaaag

SEQ ID NO: 248337 - DNA, 15 bp, Homo sapiens
tgtctgtgtggaaaa

SEQ ID NO: 248338 - DNA, 15 bp, Homo sapiens
gtgtctgtgtggaaa

SEQ ID NO: 248339 - DNA, 15 bp, Homo sapiens
tgtgtctgtgtggaa

SEQ ID NO: 248340 - DNA, 15 bp, Homo sapiens
gtgtgtctgtgtgga

SEQ ID NO: 248341 - DNA, 15 bp, Homo sapiens
tgtgtgtctgtgtgg

SEQ ID NO: 248342 - DNA, 15 bp, Homo sapiens
ggtgtgtgtgtgtct

SEQ ID NO: 248343 - DNA, 15 bp, Homo sapiens
gggtgtgtgtgtgtc

SEQ ID NO: 248344 - DNA, 15 bp, Homo sapiens
tgggtgtgtgtgtgt

SEQ ID NO: 248345 - DNA, 15 bp, Homo sapiens
gtgggtgtgtgtgtg

SEQ ID NO: 248346 - DNA, 15 bp, Homo sapiens
tgtgggtgtgtgtgt

SEQ ID NO: 248347 - DNA, 15 bp, Homo sapiens
gtgtgggtgtgtgtg

SEQ ID NO: 248348 - DNA, 15 bp, Homo sapiens
ggtgtgggtgtgtgt

SEQ ID NO: 248349 - DNA, 15 bp, Homo sapiens
gggtgtgggtgtgtg

SEQ ID NO: 248350 - DNA, 15 bp, Homo sapiens
tgggtgtgggtgtgt

SEQ ID NO: 248351 - DNA, 15 bp, Homo sapiens
gtgggtgtgggtgtg

SEQ ID NO: 248352 - DNA, 15 bp, Homo sapiens
tgtgggtgtgggtgt

SEQ ID NO: 248353 - DNA, 15 bp, Homo sapiens
gtgtgggtgtgggtg

SEQ ID NO: 248354 - DNA, 15 bp, Homo sapiens
ggtgtgggtgtgggt

SEQ ID NO: 248355 - DNA, 15 bp, Homo sapiens
gggtgtgggtgtggg

SEQ ID NO: 248356 - DNA, 15 bp, Homo sapiens
tgggtgtgggtgtgg

SEQ ID NO: 248357 - DNA, 15 bp, Homo sapiens
tgtgtgggtgtgggt

SEQ ID NO: 248358 - DNA, 15 bp, Homo sapiens
gtgtgtgggtgtggg

SEQ ID NO: 248359 - DNA, 15 bp, Homo sapiens
tgtgtgtgggtgtgg

SEQ ID NO: 248360 - DNA, 15 bp, Homo sapiens
gtgtgtgtgggtgtg

SEQ ID NO: 248361 - DNA, 15 bp, Homo sapiens
tgtgtgtgtgggtgt

SEQ ID NO: 248362 - DNA, 15 bp, Homo sapiens
gtgtgtgtgtgggtg

SEQ ID NO: 248363 - DNA, 15 bp, Homo sapiens
tgtgtgtgtgtgggt

SEQ ID NO: 248364 - DNA, 15 bp, Homo sapiens
ttgtgtgtgtgtggg

SEQ ID NO: 248365 - DNA, 15 bp, Homo sapiens
cttgtgtgtgtgtgg

SEQ ID NO: 248366 - DNA, 15 bp, Homo sapiens
gcttgtgtgtgtgtg

SEQ ID NO: 248367 - DNA, 15 bp, Homo sapiens
tgcttgtgtgtgtgt

SEQ ID NO: 248368 - DNA, 15 bp, Homo sapiens
gtgcttgtgtgtgtg

SEQ ID NO: 248369 - DNA, 15 bp, Homo sapiens
cgtgcttgtgtgtgt

SEQ ID NO: 248370 - DNA, 15 bp, Homo sapiens
acgtgcttgtgtgtg

SEQ ID NO: 248371 - DNA, 15 bp, Homo sapiens
cacgtgcttgtgtgt

SEQ ID NO: 248372 - DNA, 15 bp, Homo sapiens
gcacgtgcttgtgtg

SEQ ID NO: 248373 - DNA, 15 bp, Homo sapiens
tgcacgtgcttgtgt

SEQ ID NO: 248374 - DNA, 15 bp, Homo sapiens
gtgcacgtgcttgtg

SEQ ID NO: 248375 - DNA, 15 bp, Homo sapiens
tgtgcacgtgcttgt

SEQ ID NO: 248376 - DNA, 15 bp, Homo sapiens
ctgtgcacgtgcttg

SEQ ID NO: 248377 - DNA, 15 bp, Homo sapiens
tctgtgcacgtgctt

SEQ ID NO: 248378 - DNA, 15 bp, Homo sapiens
ctctgtgcacgtgct

SEQ ID NO: 248379 - DNA, 15 bp, Homo sapiens
actctgtgcacgtgc

SEQ ID NO: 248380 - DNA, 15 bp, Homo sapiens
cactctgtgcacgtg

SEQ ID NO: 248381 - DNA, 15 bp, Homo sapiens
tcactctgtgcacgt

SEQ ID NO: 248382 - DNA, 15 bp, Homo sapiens
ctcactctgtgcacg

SEQ ID NO: 248383 - DNA, 15 bp, Homo sapiens
tctcactctgtgcac

SEQ ID NO: 248384 - DNA, 15 bp, Homo sapiens
ttctcactctgtgca

SEQ ID NO: 248385 - DNA, 15 bp, Homo sapiens
attctcactctgtgc

SEQ ID NO: 248386 - DNA, 15 bp, Homo sapiens
gattctcactctgtg

SEQ ID NO: 248387 - DNA, 15 bp, Homo sapiens
tgattctcactctgt

SEQ ID NO: 248388 - DNA, 15 bp, Homo sapiens
ttgattctcactctg

SEQ ID NO: 248389 - DNA, 15 bp, Homo sapiens
attgattctcactct

SEQ ID NO: 248390 - DNA, 15 bp, Homo sapiens
cattgattctcactc

SEQ ID NO: 248391 - DNA, 15 bp, Homo sapiens
acattgattctcact

SEQ ID NO: 248392 - DNA, 15 bp, Homo sapiens
aacattgattctcac

SEQ ID NO: 248393 - DNA, 15 bp, Homo sapiens
taacattgattctca

SEQ ID NO: 248394 - DNA, 15 bp, Homo sapiens
gtaacattgattctc

SEQ ID NO: 248395 - DNA, 15 bp, Homo sapiens
agtaacattgattct

SEQ ID NO: 248396 - DNA, 15 bp, Homo sapiens
cagtaacattgattc

SEQ ID NO: 248397 - DNA, 15 bp, Homo sapiens
tcagtaacattgatt

SEQ ID NO: 248398 - DNA, 15 bp, Homo sapiens
atcagtaacattgat

SEQ ID NO: 248399 - DNA, 15 bp, Homo sapiens
catcagtaacattga

SEQ ID NO: 248400 - DNA, 15 bp, Homo sapiens
ccatcagtaacattg

SEQ ID NO: 248401 - DNA, 15 bp, Homo sapiens
cccatcagtaacatt

SEQ ID NO: 248402 - DNA, 15 bp, Homo sapiens
ccccatcagtaacat

SEQ ID NO: 248403 - DNA, 15 bp, Homo sapiens
cccccatcagtaaca

SEQ ID NO: 248404 - DNA, 15 bp, Homo sapiens
acccccatcagtaac

SEQ ID NO: 248405 - DNA, 15 bp, Homo sapiens
tacccccatcagtaa

SEQ ID NO: 248406 - DNA, 15 bp, Homo sapiens
gtacccccatcagta

SEQ ID NO: 248407 - DNA, 15 bp, Homo sapiens
agtacccccatcagt

SEQ ID NO: 248408 - DNA, 15 bp, Homo sapiens
gagtacccccatcag

SEQ ID NO: 248409 - DNA, 15 bp, Homo sapiens
ggagtacccccatca

SEQ ID NO: 248410 - DNA, 15 bp, Homo sapiens
tggagtacccccatc

SEQ ID NO: 248411 - DNA, 15 bp, Homo sapiens
gtggagtacccccat

SEQ ID NO: 248412 - DNA, 15 bp, Homo sapiens
tgtggagtaccccca

SEQ ID NO: 248413 - DNA, 15 bp, Homo sapiens
atgtggagtaccccc

SEQ ID NO: 248414 - DNA, 15 bp, Homo sapiens
aatgtggagtacccc

SEQ ID NO: 248415 - DNA, 15 bp, Homo sapiens
gaatgtggagtaccc

SEQ ID NO: 248416 - DNA, 15 bp, Homo sapiens
agaatgtggagtacc

SEQ ID NO: 248417 - DNA, 15 bp, Homo sapiens
aagaatgtggagtac

SEQ ID NO: 248418 - DNA, 15 bp, Homo sapiens
gaagaatgtggagta

SEQ ID NO: 248419 - DNA, 15 bp, Homo sapiens
ggaagaatgtggagt

SEQ ID NO: 248420 - DNA, 15 bp, Homo sapiens
aggaagaatgtggag

SEQ ID NO: 248421 - DNA, 15 bp, Homo sapiens
taggaagaatgtgga

SEQ ID NO: 248422 - DNA, 15 bp, Homo sapiens
ataggaagaatgtgg

SEQ ID NO: 248423 - DNA, 15 bp, Homo sapiens
tataggaagaatgtg

SEQ ID NO: 248424 - DNA, 15 bp, Homo sapiens
atataggaagaatgt

SEQ ID NO: 248425 - DNA, 15 bp, Homo sapiens
aatataggaagaatg

SEQ ID NO: 248426 - DNA, 15 bp, Homo sapiens
gaatataggaagaat

SEQ ID NO: 248427 - DNA, 15 bp, Homo sapiens
agaatataggaagaa

SEQ ID NO: 248428 - DNA, 15 bp, Homo sapiens
tagaatataggaaga

SEQ ID NO: 248429 - DNA, 15 bp, Homo sapiens
ctagaatataggaag

SEQ ID NO: 248430 - DNA, 15 bp, Homo sapiens
actagaatataggaa

SEQ ID NO: 248431 - DNA, 15 bp, Homo sapiens
gactagaatatagga

SEQ ID NO: 248432 - DNA, 15 bp, Homo sapiens
agactagaatatagg

SEQ ID NO: 248433 - DNA, 15 bp, Homo sapiens
aagactagaatatag

SEQ ID NO: 248434 - DNA, 15 bp, Homo sapiens
caagactagaatata

SEQ ID NO: 248435 - DNA, 15 bp, Homo sapiens
ccaagactagaatat

SEQ ID NO: 248436 - DNA, 15 bp, Homo sapiens
cccaagactagaata

SEQ ID NO: 248437 - DNA, 15 bp, Homo sapiens
acccaagactagaat

SEQ ID NO: 248438 - DNA, 15 bp, Homo sapiens
cacccaagactagaa

SEQ ID NO: 248439 - DNA, 15 bp, Homo sapiens
tcacccaagactaga

SEQ ID NO: 248440 - DNA, 15 bp, Homo sapiens
ttcacccaagactag

SEQ ID NO: 248441 - DNA, 15 bp, Homo sapiens
tttcacccaagacta

SEQ ID NO: 248442 - DNA, 15 bp, Homo sapiens
gtttcacccaagact

SEQ ID NO: 248443 - DNA, 15 bp, Homo sapiens
tgtttcacccaagac

SEQ ID NO: 248444 - DNA, 15 bp, Homo sapiens
ttgtttcacccaaga

SEQ ID NO: 248445 - DNA, 15 bp, Homo sapiens
cttgtttcacccaag

SEQ ID NO: 248446 - DNA, 15 bp, Homo sapiens
ccttgtttcacccaa

SEQ ID NO: 248447 - DNA, 15 bp, Homo sapiens
tccttgtttcaccca

SEQ ID NO: 248448 - DNA, 15 bp, Homo sapiens
gtccttgtttcaccc

SEQ ID NO: 248449 - DNA, 15 bp, Homo sapiens
agtccttgtttcacc

SEQ ID NO: 248450 - DNA, 15 bp, Homo sapiens
cagtccttgtttcac

SEQ ID NO: 248451 - DNA, 15 bp, Homo sapiens
tcagtccttgtttca

SEQ ID NO: 248452 - DNA, 15 bp, Homo sapiens
ttcagtccttgtttc

SEQ ID NO: 248453 - DNA, 15 bp, Homo sapiens
tttcagtccttgttt

SEQ ID NO: 248454 - DNA, 15 bp, Homo sapiens
ttttcagtccttgtt

SEQ ID NO: 248455 - DNA, 15 bp, Homo sapiens
cttttcagtccttgt

SEQ ID NO: 248456 - DNA, 15 bp, Homo sapiens
tcttttcagtccttg

SEQ ID NO: 248457 - DNA, 15 bp, Homo sapiens
atcttttcagtcctt

SEQ ID NO: 248458 - DNA, 15 bp, Homo sapiens
aatcttttcagtcct

SEQ ID NO: 248459 - DNA, 15 bp, Homo sapiens
taatcttttcagtcc

SEQ ID NO: 248460 - DNA, 15 bp, Homo sapiens
ataatcttttcagtc

SEQ ID NO: 248461 - DNA, 15 bp, Homo sapiens
tataatcttttcagt

SEQ ID NO: 248462 - DNA, 15 bp, Homo sapiens
ttataatcttttcag

SEQ ID NO: 248463 - DNA, 15 bp, Homo sapiens
tttataatcttttca

SEQ ID NO: 248464 - DNA, 15 bp, Homo sapiens
atttataatcttttc

SEQ ID NO: 248465 - DNA, 15 bp, Homo sapiens
aatttataatctttt

SEQ ID NO: 248466 - DNA, 15 bp, Homo sapiens
gaatttataatcttt

SEQ ID NO: 248467 - DNA, 15 bp, Homo sapiens
ggaatttataatctt

SEQ ID NO: 248468 - DNA, 15 bp, Homo sapiens
tggaatttataatct

SEQ ID NO: 248469 - DNA, 15 bp, Homo sapiens
ttggaatttataatc

SEQ ID NO: 248470 - DNA, 15 bp, Homo sapiens
tttggaatttataat

SEQ ID NO: 248471 - DNA, 15 bp, Homo sapiens
ctttggaatttataa

SEQ ID NO: 248472 - DNA, 15 bp, Homo sapiens
actttggaatttata

SEQ ID NO: 248473 - DNA, 15 bp, Homo sapiens
tactttggaatttat

SEQ ID NO: 248474 - DNA, 15 bp, Homo sapiens
ttactttggaattta

SEQ ID NO: 248475 - DNA, 15 bp, Homo sapiens
cttactttggaattt

SEQ ID NO: 248476 - DNA, 15 bp, Homo sapiens
acttactttggaatt

SEQ ID NO: 248477 - DNA, 15 bp, Homo sapiens
tacttactttggaat

SEQ ID NO: 248478 - DNA, 15 bp, Homo sapiens
gtacttactttggaa

SEQ ID NO: 248479 - DNA, 15 bp, Homo sapiens
tgtacttactttgga

SEQ ID NO: 248480 - DNA, 15 bp, Homo sapiens
gtgtacttactttgg

SEQ ID NO: 248481 - DNA, 15 bp, Homo sapiens
ggtgtacttactttg

SEQ ID NO: 248482 - DNA, 15 bp, Homo sapiens
tggtgtacttacttt

SEQ ID NO: 248483 - DNA, 15 bp, Homo sapiens
gtggtgtacttactt

SEQ ID NO: 248484 - DNA, 15 bp, Homo sapiens
ggtggtgtacttact

SEQ ID NO: 248485 - DNA, 15 bp, Homo sapiens
aggtggtgtacttac

SEQ ID NO: 248486 - DNA, 15 bp, Homo sapiens
gaggtggtgtactta

SEQ ID NO: 248487 - DNA, 15 bp, Homo sapiens
agaggtggtgtactt

SEQ ID NO: 248488 - DNA, 15 bp, Homo sapiens
gagaggtggtgtact

SEQ ID NO: 248489 - DNA, 15 bp, Homo sapiens
tgagaggtggtgtac

SEQ ID NO: 248490 - DNA, 15 bp, Homo sapiens
ctgagaggtggtgta

SEQ ID NO: 248491 - DNA, 15 bp, Homo sapiens
tctgagaggtggtgt

SEQ ID NO: 248492 - DNA, 15 bp, Homo sapiens
atctgagaggtggtg

SEQ ID NO: 248493 - DNA, 15 bp, Homo sapiens
gatctgagaggtggt

SEQ ID NO: 248494 - DNA, 15 bp, Homo sapiens
agatctgagaggtgg

SEQ ID NO: 248495 - DNA, 15 bp, Homo sapiens
aagatctgagaggtg

SEQ ID NO: 248496 - DNA, 15 bp, Homo sapiens
aaagatctgagaggt

SEQ ID NO: 248497 - DNA, 15 bp, Homo sapiens
taaagatctgagagg

SEQ ID NO: 248498 - DNA, 15 bp, Homo sapiens
ttaaagatctgagag

SEQ ID NO: 248499 - DNA, 15 bp, Homo sapiens
cttaaagatctgaga

SEQ ID NO: 248500 - DNA, 15 bp, Homo sapiens
tcttaaagatctgag

SEQ ID NO: 248501 - DNA, 15 bp, Homo sapiens
ttcttaaagatctga

SEQ ID NO: 248502 - DNA, 15 bp, Homo sapiens
cttcttaaagatctg

SEQ ID NO: 248503 - DNA, 15 bp, Homo sapiens
ccttcttaaagatct

SEQ ID NO: 248504 - DNA, 15 bp, Homo sapiens
accttcttaaagatc

SEQ ID NO: 248505 - DNA, 15 bp, Homo sapiens
caccttcttaaagat

SEQ ID NO: 248506 - DNA, 15 bp, Homo sapiens
acaccttcttaaaga

SEQ ID NO: 248507 - DNA, 15 bp, Homo sapiens
aacaccttcttaaag

SEQ ID NO: 248508 - DNA, 15 bp, Homo sapiens
taacaccttcttaaa

SEQ ID NO: 248509 - DNA, 15 bp, Homo sapiens
gtaacaccttcttaa

SEQ ID NO: 248510 - DNA, 15 bp, Homo sapiens
agtaacaccttctta

SEQ ID NO: 248511 - DNA, 15 bp, Homo sapiens
gagtaacaccttctt

SEQ ID NO: 248512 - DNA, 15 bp, Homo sapiens
tgagtaacaccttct

SEQ ID NO: 248513 - DNA, 15 bp, Homo sapiens
ttgagtaacaccttc

SEQ ID NO: 248514 - DNA, 15 bp, Homo sapiens
tttgagtaacacctt

SEQ ID NO: 248515 - DNA, 15 bp, Homo sapiens
atttgagtaacacct

SEQ ID NO: 248516 - DNA, 15 bp, Homo sapiens
tatttgagtaacacc

SEQ ID NO: 248517 - DNA, 15 bp, Homo sapiens
ttatttgagtaacac

SEQ ID NO: 248518 - DNA, 15 bp, Homo sapiens
tttatttgagtaaca

SEQ ID NO: 248519 - DNA, 15 bp, Homo sapiens
atttatttgagtaac

SEQ ID NO: 248520 - DNA, 15 bp, Homo sapiens
catttatttgagtaa

SEQ ID NO: 248521 - DNA, 15 bp, Homo sapiens
acatttatttgagta

SEQ ID NO: 248522 - DNA, 15 bp, Homo sapiens
aacatttatttgagt

SEQ ID NO: 248523 - DNA, 15 bp, Homo sapiens
caacatttatttgag

SEQ ID NO: 248524 - DNA, 15 bp, Homo sapiens
acaacatttatttga

SEQ ID NO: 248525 - DNA, 15 bp, Homo sapiens
gacaacatttatttg

SEQ ID NO: 248526 - DNA, 15 bp, Homo sapiens
tgacaacatttattt

SEQ ID NO: 248527 - DNA, 15 bp, Homo sapiens
atgacaacatttatt

SEQ ID NO: 248528 - DNA, 15 bp, Homo sapiens
tatgacaacatttat

SEQ ID NO: 248529 - DNA, 15 bp, Homo sapiens
atatgacaacattta

SEQ ID NO: 248530 - DNA, 15 bp, Homo sapiens
gatatgacaacattt

SEQ ID NO: 248531 - DNA, 15 bp, Homo sapiens
tgatatgacaacatt

SEQ ID NO: 248532 - DNA, 15 bp, Homo sapiens
ctgatatgacaacat

SEQ ID NO: 248533 - DNA, 15 bp, Homo sapiens
tctgatatgacaaca

SEQ ID NO: 248534 - DNA, 15 bp, Homo sapiens
atctgatatgacaac

SEQ ID NO: 248535 - DNA, 15 bp, Homo sapiens
aatctgatatgacaa

SEQ ID NO: 248536 - DNA, 15 bp, Homo sapiens
caatctgatatgaca

SEQ ID NO: 248537 - DNA, 15 bp, Homo sapiens
gcaatctgatatgac

SEQ ID NO: 248538 - DNA, 15 bp, Homo sapiens
ggcaatctgatatga

SEQ ID NO: 248539 - DNA, 15 bp, Homo sapiens
tggcaatctgatatg

SEQ ID NO: 248540 - DNA, 15 bp, Homo sapiens
ttggcaatctgatat

SEQ ID NO: 248541 - DNA, 15 bp, Homo sapiens
gttggcaatctgata

SEQ ID NO: 248542 - DNA, 15 bp, Homo sapiens
tgttggcaatctgat

SEQ ID NO: 248543 - DNA, 15 bp, Homo sapiens
atgttggcaatctga

SEQ ID NO: 248544 - DNA, 15 bp, Homo sapiens
aatgttggcaatctg

SEQ ID NO: 248545 - DNA, 15 bp, Homo sapiens
aaatgttggcaatct

SEQ ID NO: 248546 - DNA, 15 bp, Homo sapiens
caaatgttggcaatc

SEQ ID NO: 248547 - DNA, 15 bp, Homo sapiens
acaaatgttggcaat

SEQ ID NO: 248548 - DNA, 15 bp, Homo sapiens
aacaaatgttggcaa

SEQ ID NO: 248549 - DNA, 15 bp, Homo sapiens
aaacaaatgttggca

SEQ ID NO: 248550 - DNA, 15 bp, Homo sapiens
aaaacaaatgttggc

SEQ ID NO: 248551 - DNA, 15 bp, Homo sapiens
gaaaacaaatgttgg

SEQ ID NO: 248552 - DNA, 15 bp, Homo sapiens
tgaaaacaaatgttg

SEQ ID NO: 248553 - DNA, 15 bp, Homo sapiens
gtgaaaacaaatgtt

SEQ ID NO: 248554 - DNA, 15 bp, Homo sapiens
agtgaaaacaaatgt

SEQ ID NO: 248555 - DNA, 15 bp, Homo sapiens
gagtgaaaacaaatg

SEQ ID NO: 248556 - DNA, 15 bp, Homo sapiens
agagtgaaaacaaat

SEQ ID NO: 248557 - DNA, 15 bp, Homo sapiens
aagagtgaaaacaaa

SEQ ID NO: 248558 - DNA, 15 bp, Homo sapiens
gaagagtgaaaacaa

SEQ ID NO: 248559 - DNA, 15 bp, Homo sapiens
tgaagagtgaaaaca

SEQ ID NO: 248560 - DNA, 15 bp, Homo sapiens
atgaagagtgaaaac

SEQ ID NO: 248561 - DNA, 15 bp, Homo sapiens
tatgaagagtgaaaa

SEQ ID NO: 248562 - DNA, 15 bp, Homo sapiens
gtatgaagagtgaaa

SEQ ID NO: 248563 - DNA, 15 bp, Homo sapiens
agtatgaagagtgaa

SEQ ID NO: 248564 - DNA, 15 bp, Homo sapiens
aagtatgaagagtga

SEQ ID NO: 248565 - DNA, 15 bp, Homo sapiens
aaagtatgaagagtg

SEQ ID NO: 248566 - DNA, 15 bp, Homo sapiens
taaagtatgaagagt

SEQ ID NO: 248567 - DNA, 15 bp, Homo sapiens
ctaaagtatgaagag

SEQ ID NO: 248568 - DNA, 15 bp, Homo sapiens
cctaaagtatgaaga

SEQ ID NO: 248569 - DNA, 15 bp, Homo sapiens
gcctaaagtatgaag

SEQ ID NO: 248570 - DNA, 15 bp, Homo sapiens
tgcctaaagtatgaa

SEQ ID NO: 248571 - DNA, 15 bp, Homo sapiens
ctgcctaaagtatga

SEQ ID NO: 248572 - DNA, 15 bp, Homo sapiens
actgcctaaagtatg

SEQ ID NO: 248573 - DNA, 15 bp, Homo sapiens
aactgcctaaagtat

SEQ ID NO: 248574 - DNA, 15 bp, Homo sapiens
caactgcctaaagta

SEQ ID NO: 248575 - DNA, 15 bp, Homo sapiens
tcaactgcctaaagt

SEQ ID NO: 248576 - DNA, 15 bp, Homo sapiens
ttcaactgcctaaag

SEQ ID NO: 248577 - DNA, 15 bp, Homo sapiens
attcaactgcctaaa

SEQ ID NO: 248578 - DNA, 15 bp, Homo sapiens
cattcaactgcctaa

SEQ ID NO: 248579 - DNA, 15 bp, Homo sapiens
gcattcaactgccta

SEQ ID NO: 248580 - DNA, 15 bp, Homo sapiens
tgcattcaactgcct

SEQ ID NO: 248581 - DNA, 15 bp, Homo sapiens
ttgcattcaactgcc

SEQ ID NO: 248582 - DNA, 15 bp, Homo sapiens
tttgcattcaactgc

SEQ ID NO: 248583 - DNA, 15 bp, Homo sapiens
ttttgcattcaactg

SEQ ID NO: 248584 - DNA, 15 bp, Homo sapiens
attttgcattcaact

SEQ ID NO: 248585 - DNA, 15 bp, Homo sapiens
gattttgcattcaac

SEQ ID NO: 248586 - DNA, 15 bp, Homo sapiens
cgattttgcattcaa

SEQ ID NO: 248587 - DNA, 15 bp, Homo sapiens
tcgattttgcattca

SEQ ID NO: 248588 - DNA, 15 bp, Homo sapiens
atcgattttgcattc

SEQ ID NO: 248589 - DNA, 15 bp, Homo sapiens
aatcgattttgcatt

SEQ ID NO: 248590 - DNA, 15 bp, Homo sapiens
taatcgattttgcat

SEQ ID NO: 248591 - DNA, 15 bp, Homo sapiens
ctaatcgattttgca

SEQ ID NO: 248592 - DNA, 15 bp, Homo sapiens
actaatcgattttgc

SEQ ID NO: 248593 - DNA, 15 bp, Homo sapiens
aactaatcgattttg

SEQ ID NO: 248594 - DNA, 15 bp, Homo sapiens
caactaatcgatttt

SEQ ID NO: 248595 - DNA, 15 bp, Homo sapiens
ccaactaatcgattt

SEQ ID NO: 248596 - DNA, 15 bp, Homo sapiens
cccaactaatcgatt

SEQ ID NO: 248597 - DNA, 15 bp, Homo sapiens
tcccaactaatcgat

SEQ ID NO: 248598 - DNA, 15 bp, Homo sapiens
ctcccaactaatcga

SEQ ID NO: 248599 - DNA, 15 bp, Homo sapiens
gctcccaactaatcg

SEQ ID NO: 248600 - DNA, 15 bp, Homo sapiens
agctcccaactaatc

SEQ ID NO: 248601 - DNA, 15 bp, Homo sapiens
gagctcccaactaat

SEQ ID NO: 248602 - DNA, 15 bp, Homo sapiens
cgagctcccaactaa

SEQ ID NO: 248603 - DNA, 15 bp, Homo sapiens
acgagctcccaacta

SEQ ID NO: 248604 - DNA, 15 bp, Homo sapiens
cacgagctcccaact

SEQ ID NO: 248605 - DNA, 15 bp, Homo sapiens
gcacgagctcccaac

SEQ ID NO: 248606 - DNA, 15 bp, Homo sapiens
agcacgagctcccaa

SEQ ID NO: 248607 - DNA, 15 bp, Homo sapiens
aagcacgagctccca

SEQ ID NO: 248608 - DNA, 15 bp, Homo sapiens
caagcacgagctccc

SEQ ID NO: 248609 - DNA, 15 bp, Homo sapiens
tcaagcacgagctcc

SEQ ID NO: 248610 - DNA, 15 bp, Homo sapiens
atcaagcacgagctc

SEQ ID NO: 248611 - DNA, 15 bp, Homo sapiens
aatcaagcacgagct

SEQ ID NO: 248612 - DNA, 15 bp, Homo sapiens
caatcaagcacgagc

SEQ ID NO: 248613 - DNA, 15 bp, Homo sapiens
gcaatcaagcacgag

SEQ ID NO: 248614 - DNA, 15 bp, Homo sapiens
agcaatcaagcacga

SEQ ID NO: 248615 - DNA, 15 bp, Homo sapiens
tagcaatcaagcacg

SEQ ID NO: 248616 - DNA, 15 bp, Homo sapiens
atagcaatcaagcac

SEQ ID NO: 248617 - DNA, 15 bp, Homo sapiens
tatagcaatcaagca

SEQ ID NO: 248618 - DNA, 15 bp, Homo sapiens
atatagcaatcaagc

SEQ ID NO: 248619 - DNA, 15 bp, Homo sapiens
tatatagcaatcaag

SEQ ID NO: 248620 - DNA, 15 bp, Homo sapiens
tatatatagcaatca

SEQ ID NO: 248621 - DNA, 15 bp, Homo sapiens
atatatatagcaatc

SEQ ID NO: 248622 - DNA, 15 bp, Homo sapiens
catatatatagcaat

SEQ ID NO: 248623 - DNA, 15 bp, Homo sapiens
acatatatatagcaa

SEQ ID NO: 248624 - DNA, 15 bp, Homo sapiens
tacatatatatagca

SEQ ID NO: 248625 - DNA, 15 bp, Homo sapiens
ttacatatatatagc

SEQ ID NO: 248626 - DNA, 15 bp, Homo sapiens
gttacatatatatag

SEQ ID NO: 248627 - DNA, 15 bp, Homo sapiens
agttacatatatata

SEQ ID NO: 248628 - DNA, 15 bp, Homo sapiens
aagttacatatatat

SEQ ID NO: 248629 - DNA, 15 bp, Homo sapiens
gaagttacatatata

SEQ ID NO: 248630 - DNA, 15 bp, Homo sapiens
agaagttacatatat

SEQ ID NO: 248631 - DNA, 15 bp, Homo sapiens
tagaagttacatata

SEQ ID NO: 248632 - DNA, 15 bp, Homo sapiens
atagaagttacatat

SEQ ID NO: 248633 - DNA, 15 bp, Homo sapiens
tatagaagttacata

SEQ ID NO: 248634 - DNA, 15 bp, Homo sapiens
ttatagaagttacat

SEQ ID NO: 248635 - DNA, 15 bp, Homo sapiens
cttatagaagttaca

SEQ ID NO: 248636 - DNA, 15 bp, Homo sapiens
acttatagaagttac

SEQ ID NO: 248637 - DNA, 15 bp, Homo sapiens
cacttatagaagtta

SEQ ID NO: 248638 - DNA, 15 bp, Homo sapiens
acacttatagaagtt

SEQ ID NO: 248639 - DNA, 15 bp, Homo sapiens
tacacttatagaagt

SEQ ID NO: 248640 - DNA, 15 bp, Homo sapiens
gtacacttatagaag

SEQ ID NO: 248641 - DNA, 15 bp, Homo sapiens
tgtacacttatagaa

SEQ ID NO: 248642 - DNA, 15 bp, Homo sapiens
atgtacacttataga

SEQ ID NO: 248643 - DNA, 15 bp, Homo sapiens
tatgtacacttatag

SEQ ID NO: 248644 - DNA, 15 bp, Homo sapiens
ttatgtacacttata

SEQ ID NO: 248645 - DNA, 15 bp, Homo sapiens
tttatgtacacttat

SEQ ID NO: 248646 - DNA, 15 bp, Homo sapiens
ctttatgtacactta

SEQ ID NO: 248647 - DNA, 15 bp, Homo sapiens
actttatgtacactt

SEQ ID NO: 248648 - DNA, 15 bp, Homo sapiens
tactttatgtacact

SEQ ID NO: 248649 - DNA, 15 bp, Homo sapiens
ttactttatgtacac

SEQ ID NO: 248650 - DNA, 15 bp, Homo sapiens
tttactttatgtaca

SEQ ID NO: 248651 - DNA, 15 bp, Homo sapiens
atttactttatgtac

SEQ ID NO: 248652 - DNA, 15 bp, Homo sapiens
catttactttatgta

SEQ ID NO: 248653 - DNA, 15 bp, Homo sapiens
acatttactttatgt

SEQ ID NO: 248654 - DNA, 15 bp, Homo sapiens
aacatttactttatg

SEQ ID NO: 248655 - DNA, 15 bp, Homo sapiens
taacatttactttat

SEQ ID NO: 248656 - DNA, 15 bp, Homo sapiens
ttaacatttacttta

SEQ ID NO: 248657 - DNA, 15 bp, Homo sapiens
gttaacatttacttt

SEQ ID NO: 248658 - DNA, 15 bp, Homo sapiens
tgttaacatttactt

SEQ ID NO: 248659 - DNA, 15 bp, Homo sapiens
ctgttaacatttact

SEQ ID NO: 248660 - DNA, 15 bp, Homo sapiens
tctgttaacatttac

SEQ ID NO: 248661 - DNA, 15 bp, Homo sapiens
ttctgttaacattta

SEQ ID NO: 248662 - DNA, 15 bp, Homo sapiens
gttctgttaacattt

SEQ ID NO: 248663 - DNA, 15 bp, Homo sapiens
ggttctgttaacatt

SEQ ID NO: 248664 - DNA, 15 bp, Homo sapiens
aggttctgttaacat

SEQ ID NO: 248665 - DNA, 15 bp, Homo sapiens
caggttctgttaaca

SEQ ID NO: 248666 - DNA, 15 bp, Homo sapiens
acaggttctgttaac

SEQ ID NO: 248667 - DNA, 15 bp, Homo sapiens
tacaggttctgttaa

SEQ ID NO: 248668 - DNA, 15 bp, Homo sapiens
atacaggttctgtta

SEQ ID NO: 248669 - DNA, 15 bp, Homo sapiens
aatacaggttctgtt

SEQ ID NO: 248670 - DNA, 15 bp, Homo sapiens
aaatacaggttctgt

SEQ ID NO: 248671 - DNA, 15 bp, Homo sapiens
aaaatacaggttctg

SEQ ID NO: 248672 - DNA, 15 bp, Homo sapiens
caaaatacaggttct

SEQ ID NO: 248673 - DNA, 15 bp, Homo sapiens
gcaaaatacaggttc

SEQ ID NO: 248674 - DNA, 15 bp, Homo sapiens
ggcaaaatacaggtt

SEQ ID NO: 248675 - DNA, 15 bp, Homo sapiens
aggcaaaatacaggt

SEQ ID NO: 248676 - DNA, 15 bp, Homo sapiens
caggcaaaatacagg

SEQ ID NO: 248677 - DNA, 15 bp, Homo sapiens
acaggcaaaatacag

SEQ ID NO: 248678 - DNA, 15 bp, Homo sapiens
cacaggcaaaataca

SEQ ID NO: 248679 - DNA, 15 bp, Homo sapiens
acacaggcaaaatac

SEQ ID NO: 248680 - DNA, 15 bp, Homo sapiens
gacacaggcaaaata

SEQ ID NO: 248681 - DNA, 15 bp, Homo sapiens
tgacacaggcaaaat

SEQ ID NO: 248682 - DNA, 15 bp, Homo sapiens
ttgacacaggcaaaa

SEQ ID NO: 248683 - DNA, 15 bp, Homo sapiens
gttgacacaggcaaa

SEQ ID NO: 248684 - DNA, 15 bp, Homo sapiens
agttgacacaggcaa

SEQ ID NO: 248685 - DNA, 15 bp, Homo sapiens
aagttgacacaggca

SEQ ID NO: 248686 - DNA, 15 bp, Homo sapiens
gaagttgacacaggc

SEQ ID NO: 248687 - DNA, 15 bp, Homo sapiens
ggaagttgacacagg

SEQ ID NO: 248688 - DNA, 15 bp, Homo sapiens
aggaagttgacacag

SEQ ID NO: 248689 - DNA, 15 bp, Homo sapiens
aaggaagttgacaca

SEQ ID NO: 248690 - DNA, 15 bp, Homo sapiens
aaaggaagttgacac

SEQ ID NO: 248691 - DNA, 15 bp, Homo sapiens
aaaaggaagttgaca

SEQ ID NO: 248692 - DNA, 15 bp, Homo sapiens
gaaaaggaagttgac

SEQ ID NO: 248693 - DNA, 15 bp, Homo sapiens
agaaaaggaagttga

SEQ ID NO: 248694 - DNA, 15 bp, Homo sapiens
cagaaaaggaagttg

SEQ ID NO: 248695 - DNA, 15 bp, Homo sapiens
ccagaaaaggaagtt

SEQ ID NO: 248696 - DNA, 15 bp, Homo sapiens
tccagaaaaggaagt

SEQ ID NO: 248697 - DNA, 15 bp, Homo sapiens
ctccagaaaaggaag

SEQ ID NO: 248698 - DNA, 15 bp, Homo sapiens
tctccagaaaaggaa

SEQ ID NO: 248699 - DNA, 15 bp, Homo sapiens
gtctccagaaaagga

SEQ ID NO: 248700 - DNA, 15 bp, Homo sapiens
agtctccagaaaagg

SEQ ID NO: 248701 - DNA, 15 bp, Homo sapiens
aagtctccagaaaag

SEQ ID NO: 248702 - DNA, 15 bp, Homo sapiens
gaagtctccagaaaa

SEQ ID NO: 248703 - DNA, 15 bp, Homo sapiens
agaagtctccagaaa

SEQ ID NO: 248704 - DNA, 15 bp, Homo sapiens
cagaagtctccagaa

SEQ ID NO: 248705 - DNA, 15 bp, Homo sapiens
ccagaagtctccaga

SEQ ID NO: 248706 - DNA, 15 bp, Homo sapiens
accagaagtctccag

SEQ ID NO: 248707 - DNA, 15 bp, Homo sapiens
aaccagaagtctcca

SEQ ID NO: 248708 - DNA, 15 bp, Homo sapiens
aaaccagaagtctcc

SEQ ID NO: 248709 - DNA, 15 bp, Homo sapiens
aaaaccagaagtctc

SEQ ID NO: 248710 - DNA, 15 bp, Homo sapiens
gaaaaccagaagtct

SEQ ID NO: 248711 - DNA, 15 bp, Homo sapiens
agaaaaccagaagtc

SEQ ID NO: 248712 - DNA, 15 bp, Homo sapiens
gagaaaaccagaagt

SEQ ID NO: 248713 - DNA, 15 bp, Homo sapiens
tgagaaaaccagaag

SEQ ID NO: 248714 - DNA, 15 bp, Homo sapiens
atgagaaaaccagaa

SEQ ID NO: 248715 - DNA, 15 bp, Homo sapiens
tatgagaaaaccaga

SEQ ID NO: 248716 - DNA, 15 bp, Homo sapiens
ctatgagaaaaccag

SEQ ID NO: 248717 - DNA, 15 bp, Homo sapiens
actatgagaaaacca

SEQ ID NO: 248718 - DNA, 15 bp, Homo sapiens
tactatgagaaaacc

SEQ ID NO: 248719 - DNA, 15 bp, Homo sapiens
gtactatgagaaaac

SEQ ID NO: 248720 - DNA, 15 bp, Homo sapiens
ggtactatgagaaaa

SEQ ID NO: 248721 - DNA, 15 bp, Homo sapiens
aggtactatgagaaa

SEQ ID NO: 248722 - DNA, 15 bp, Homo sapiens
gaggtactatgagaa

SEQ ID NO: 248723 - DNA, 15 bp, Homo sapiens
ggaggtactatgaga

SEQ ID NO: 248724 - DNA, 15 bp, Homo sapiens
gggaggtactatgag

SEQ ID NO: 248725 - DNA, 15 bp, Homo sapiens
tgggaggtactatga

SEQ ID NO: 248726 - DNA, 15 bp, Homo sapiens
gtgggaggtactatg

SEQ ID NO: 248727 - DNA, 15 bp, Homo sapiens
ggtgggaggtactat

SEQ ID NO: 248728 - DNA, 15 bp, Homo sapiens
aggtgggaggtacta

SEQ ID NO: 248729 - DNA, 15 bp, Homo sapiens
aaggtgggaggtact

SEQ ID NO: 248730 - DNA, 15 bp, Homo sapiens
gaaggtgggaggtac

SEQ ID NO: 248731 - DNA, 15 bp, Homo sapiens
agaaggtgggaggta

SEQ ID NO: 248732 - DNA, 15 bp, Homo sapiens
tagaaggtgggaggt

SEQ ID NO: 248733 - DNA, 15 bp, Homo sapiens
ttagaaggtgggagg

SEQ ID NO: 248734 - DNA, 15 bp, Homo sapiens
attagaaggtgggag

SEQ ID NO: 248735 - DNA, 15 bp, Homo sapiens
tattagaaggtggga

SEQ ID NO: 248736 - DNA, 15 bp, Homo sapiens
gtattagaaggtggg

SEQ ID NO: 248737 - DNA, 15 bp, Homo sapiens
tgtattagaaggtgg

SEQ ID NO: 248738 - DNA, 15 bp, Homo sapiens
gtgtattagaaggtg

SEQ ID NO: 248739 - DNA, 15 bp, Homo sapiens
agtgtattagaaggt

SEQ ID NO: 248740 - DNA, 15 bp, Homo sapiens
cagtgtattagaagg

SEQ ID NO: 248741 - DNA, 15 bp, Homo sapiens
acagtgtattagaag

SEQ ID NO: 248742 - DNA, 15 bp, Homo sapiens
tacagtgtattagaa

SEQ ID NO: 248743 - DNA, 15 bp, Homo sapiens
atacagtgtattaga

SEQ ID NO: 248744 - DNA, 15 bp, Homo sapiens
tatacagtgtattag

SEQ ID NO: 248745 - DNA, 15 bp, Homo sapiens
ttatacagtgtatta

SEQ ID NO: 248746 - DNA, 15 bp, Homo sapiens
gttatacagtgtatt

SEQ ID NO: 248747 - DNA, 15 bp, Homo sapiens
agttatacagtgtat

SEQ ID NO: 248748 - DNA, 15 bp, Homo sapiens
aagttatacagtgta

SEQ ID NO: 248749 - DNA, 15 bp, Homo sapiens
taagttatacagtgt

SEQ ID NO: 248750 - DNA, 15 bp, Homo sapiens
gtaagttatacagtg

SEQ ID NO: 248751 - DNA, 15 bp, Homo sapiens
agtaagttatacagt

SEQ ID NO: 248752 - DNA, 15 bp, Homo sapiens
aagtaagttatacag

SEQ ID NO: 248753 - DNA, 15 bp, Homo sapiens
taagtaagttataca

SEQ ID NO: 248754 - DNA, 15 bp, Homo sapiens
gtaagtaagttatac

SEQ ID NO: 248755 - DNA, 15 bp, Homo sapiens
tgtaagtaagttata

SEQ ID NO: 248756 - DNA, 15 bp, Homo sapiens
ctgtaagtaagttat

SEQ ID NO: 248757 - DNA, 15 bp, Homo sapiens
actgtaagtaagtta

SEQ ID NO: 248758 - DNA, 15 bp, Homo sapiens
cactgtaagtaagtt

SEQ ID NO: 248759 - DNA, 15 bp, Homo sapiens
acactgtaagtaagt

SEQ ID NO: 248760 - DNA, 15 bp, Homo sapiens
aacactgtaagtaag

SEQ ID NO: 248761 - DNA, 15 bp, Homo sapiens
aaacactgtaagtaa

SEQ ID NO: 248762 - DNA, 15 bp, Homo sapiens
caaacactgtaagta

SEQ ID NO: 248763 - DNA, 15 bp, Homo sapiens
acaaacactgtaagt

SEQ ID NO: 248764 - DNA, 15 bp, Homo sapiens
gacaaacactgtaag

SEQ ID NO: 248765 - DNA, 15 bp, Homo sapiens
cgacaaacactgtaa

SEQ ID NO: 248766 - DNA, 15 bp, Homo sapiens
acgacaaacactgta

SEQ ID NO: 248767 - DNA, 15 bp, Homo sapiens
gacgacaaacactgt

SEQ ID NO: 248768 - DNA, 15 bp, Homo sapiens
agacgacaaacactg

SEQ ID NO: 248769 - DNA, 15 bp, Homo sapiens
gagacgacaaacact

SEQ ID NO: 248770 - DNA, 15 bp, Homo sapiens
agagacgacaaacac

SEQ ID NO: 248771 - DNA, 15 bp, Homo sapiens
aagagacgacaaaca

SEQ ID NO: 248772 - DNA, 15 bp, Homo sapiens
taagagacgacaaac

SEQ ID NO: 248773 - DNA, 15 bp, Homo sapiens
ataagagacgacaaa

SEQ ID NO: 248774 - DNA, 15 bp, Homo sapiens
aataagagacgacaa

SEQ ID NO: 248775 - DNA, 15 bp, Homo sapiens
aaataagagacgaca

SEQ ID NO: 248776 - DNA, 15 bp, Homo sapiens
aaaataagagacgac

SEQ ID NO: 248777 - DNA, 15 bp, Homo sapiens
aaaaataagagacga

SEQ ID NO: 248778 - DNA, 15 bp, Homo sapiens
gaaaaataagagacg

SEQ ID NO: 248779 - DNA, 15 bp, Homo sapiens
ggaaaaataagagac

SEQ ID NO: 248780 - DNA, 15 bp, Homo sapiens
gggaaaaataagaga

SEQ ID NO: 248781 - DNA, 15 bp, Homo sapiens
ggggaaaaataagag

SEQ ID NO: 248782 - DNA, 15 bp, Homo sapiens
tggggaaaaataaga

SEQ ID NO: 248783 - DNA, 15 bp, Homo sapiens
atggggaaaaataag

SEQ ID NO: 248784 - DNA, 15 bp, Homo sapiens
gatggggaaaaataa

SEQ ID NO: 248785 - DNA, 15 bp, Homo sapiens
ggatggggaaaaata

SEQ ID NO: 248786 - DNA, 15 bp, Homo sapiens
aggatggggaaaaat

SEQ ID NO: 248787 - DNA, 15 bp, Homo sapiens
caggatggggaaaaa

SEQ ID NO: 248788 - DNA, 15 bp, Homo sapiens
tcaggatggggaaaa

SEQ ID NO: 248789 - DNA, 15 bp, Homo sapiens
ctcaggatggggaaa

SEQ ID NO: 248790 - DNA, 15 bp, Homo sapiens
cctcaggatggggaa

SEQ ID NO: 248791 - DNA, 15 bp, Homo sapiens
gcctcaggatgggga

SEQ ID NO: 248792 - DNA, 15 bp, Homo sapiens
tgcctcaggatgggg

SEQ ID NO: 248793 - DNA, 15 bp, Homo sapiens
atgcctcaggatggg

SEQ ID NO: 248794 - DNA, 15 bp, Homo sapiens
catgcctcaggatgg

SEQ ID NO: 248795 - DNA, 15 bp, Homo sapiens
ccatgcctcaggatg

SEQ ID NO: 248796 - DNA, 15 bp, Homo sapiens
gccatgcctcaggat

SEQ ID NO: 248797 - DNA, 15 bp, Homo sapiens
ggccatgcctcagga

SEQ ID NO: 248798 - DNA, 15 bp, Homo sapiens
tggccatgcctcagg

SEQ ID NO: 248799 - DNA, 15 bp, Homo sapiens
gtggccatgcctcag

SEQ ID NO: 248800 - DNA, 15 bp, Homo sapiens
agtggccatgcctca

SEQ ID NO: 248801 - DNA, 15 bp, Homo sapiens
gagtggccatgcctc

SEQ ID NO: 248802 - DNA, 15 bp, Homo sapiens
ggagtggccatgcct

SEQ ID NO: 248803 - DNA, 15 bp, Homo sapiens
tggagtggccatgcc

SEQ ID NO: 248804 - DNA, 15 bp, Homo sapiens
gtggagtggccatgc

SEQ ID NO: 248805 - DNA, 15 bp, Homo sapiens
agtggagtggccatg

SEQ ID NO: 248806 - DNA, 15 bp, Homo sapiens
aagtggagtggccat

SEQ ID NO: 248807 - DNA, 15 bp, Homo sapiens
caagtggagtggcca

SEQ ID NO: 248808 - DNA, 15 bp, Homo sapiens
ccaagtggagtggcc

SEQ ID NO: 248809 - DNA, 15 bp, Homo sapiens
gccaagtggagtggc

SEQ ID NO: 248810 - DNA, 15 bp, Homo sapiens
tgccaagtggagtgg

SEQ ID NO: 248811 - DNA, 15 bp, Homo sapiens
gtgccaagtggagtg

SEQ ID NO: 248812 - DNA, 15 bp, Homo sapiens
ggtgccaagtggagt

SEQ ID NO: 248813 - DNA, 15 bp, Homo sapiens
tggtgccaagtggag

SEQ ID NO: 248814 - DNA, 15 bp, Homo sapiens
atggtgccaagtgga

SEQ ID NO: 248815 - DNA, 15 bp, Homo sapiens
catggtgccaagtgg

SEQ ID NO: 248816 - DNA, 15 bp, Homo sapiens
ccatggtgccaagtg

SEQ ID NO: 248817 - DNA, 15 bp, Homo sapiens
tccatggtgccaagt

SEQ ID NO: 248818 - DNA, 15 bp, Homo sapiens
ctccatggtgccaag

SEQ ID NO: 248819 - DNA, 15 bp, Homo sapiens
actccatggtgccaa

SEQ ID NO: 248820 - DNA, 15 bp, Homo sapiens
aactccatggtgcca

SEQ ID NO: 248821 - DNA, 15 bp, Homo sapiens
gaactccatggtgcc

SEQ ID NO: 248822 - DNA, 15 bp, Homo sapiens
tgaactccatggtgc

SEQ ID NO: 248823 - DNA, 15 bp, Homo sapiens
atgaactccatggtg

SEQ ID NO: 248824 - DNA, 15 bp, Homo sapiens
aatgaactccatggt

SEQ ID NO: 248825 - DNA, 15 bp, Homo sapiens
caatgaactccatgg

SEQ ID NO: 248826 - DNA, 15 bp, Homo sapiens
gcaatgaactccatg

SEQ ID NO: 248827 - DNA, 15 bp, Homo sapiens
agcaatgaactccat

SEQ ID NO: 248828 - DNA, 15 bp, Homo sapiens
tagcaatgaactcca

SEQ ID NO: 248829 - DNA, 15 bp, Homo sapiens
ttagcaatgaactcc

SEQ ID NO: 248830 - DNA, 15 bp, Homo sapiens
attagcaatgaactc

SEQ ID NO: 248831 - DNA, 15 bp, Homo sapiens
tattagcaatgaact

SEQ ID NO: 248832 - DNA, 15 bp, Homo sapiens
ttattagcaatgaac

SEQ ID NO: 248833 - DNA, 15 bp, Homo sapiens
attattagcaatgaa

SEQ ID NO: 248834 - DNA, 15 bp, Homo sapiens
aattattagcaatga

SEQ ID NO: 248835 - DNA, 15 bp, Homo sapiens
taattattagcaatg

SEQ ID NO: 248836 - DNA, 15 bp, Homo sapiens
ataattattagcaat

SEQ ID NO: 248837 - DNA, 15 bp, Homo sapiens
tataattattagcaa

SEQ ID NO: 248838 - DNA, 15 bp, Homo sapiens
ctataattattagca

SEQ ID NO: 248839 - DNA, 15 bp, Homo sapiens
cctataattattagc

SEQ ID NO: 248840 - DNA, 15 bp, Homo sapiens
tcctataattattag

SEQ ID NO: 248841 - DNA, 15 bp, Homo sapiens
gtcctataattatta

SEQ ID NO: 248842 - DNA, 15 bp, Homo sapiens
ggtcctataattatt

SEQ ID NO: 248843 - DNA, 15 bp, Homo sapiens
tggtcctataattat

SEQ ID NO: 248844 - DNA, 15 bp, Homo sapiens
ctggtcctataatta

SEQ ID NO: 248845 - DNA, 15 bp, Homo sapiens
actggtcctataatt

SEQ ID NO: 248846 - DNA, 15 bp, Homo sapiens
aactggtcctataat

SEQ ID NO: 248847 - DNA, 15 bp, Homo sapiens
aaactggtcctataa

SEQ ID NO: 248848 - DNA, 15 bp, Homo sapiens
caaactggtcctata

SEQ ID NO: 248849 - DNA, 15 bp, Homo sapiens
tcaaactggtcctat

SEQ ID NO: 248850 - DNA, 15 bp, Homo sapiens
ctcaaactggtccta

SEQ ID NO: 248851 - DNA, 15 bp, Homo sapiens
actcaaactggtcct

SEQ ID NO: 248852 - DNA, 15 bp, Homo sapiens
cactcaaactggtcc

SEQ ID NO: 248853 - DNA, 15 bp, Homo sapiens
gcactcaaactggtc

SEQ ID NO: 248854 - DNA, 15 bp, Homo sapiens
tgcactcaaactggt

SEQ ID NO: 248855 - DNA, 15 bp, Homo sapiens
ctgcactcaaactgg

SEQ ID NO: 248856 - DNA, 15 bp, Homo sapiens
cctgcactcaaactg

SEQ ID NO: 248857 - DNA, 15 bp, Homo sapiens
tcctgcactcaaact

SEQ ID NO: 248858 - DNA, 15 bp, Homo sapiens
ctcctgcactcaaac

SEQ ID NO: 248859 - DNA, 15 bp, Homo sapiens
tctcctgcactcaaa

SEQ ID NO: 248860 - DNA, 15 bp, Homo sapiens
ttctcctgcactcaa

SEQ ID NO: 248861 - DNA, 15 bp, Homo sapiens
tttctcctgcactca

SEQ ID NO: 248862 - DNA, 15 bp, Homo sapiens
ttttctcctgcactc

SEQ ID NO: 248863 - DNA, 15 bp, Homo sapiens
cttttctcctgcact

SEQ ID NO: 248864 - DNA, 15 bp, Homo sapiens
acttttctcctgcac

SEQ ID NO: 248865 - DNA, 15 bp, Homo sapiens
aacttttctcctgca

SEQ ID NO: 248866 - DNA, 15 bp, Homo sapiens
caacttttctcctgc

SEQ ID NO: 248867 - DNA, 15 bp, Homo sapiens
ccaacttttctcctg

SEQ ID NO: 248868 - DNA, 15 bp, Homo sapiens
tccaacttttctcct

SEQ ID NO: 248869 - DNA, 15 bp, Homo sapiens
ttccaacttttctcc

SEQ ID NO: 248870 - DNA, 15 bp, Homo sapiens
cttccaacttttctc

SEQ ID NO: 248871 - DNA, 15 bp, Homo sapiens
gcttccaacttttct

SEQ ID NO: 248872 - DNA, 15 bp, Homo sapiens
ggcttccaacttttc

SEQ ID NO: 248873 - DNA, 15 bp, Homo sapiens
tggcttccaactttt

SEQ ID NO: 248874 - DNA, 15 bp, Homo sapiens
ttggcttccaacttt

SEQ ID NO: 248875 - DNA, 15 bp, Homo sapiens
tttggcttccaactt

SEQ ID NO: 248876 - DNA, 15 bp, Homo sapiens
gtttggcttccaact

SEQ ID NO: 248877 - DNA, 15 bp, Homo sapiens
tgtttggcttccaac

SEQ ID NO: 248878 - DNA, 15 bp, Homo sapiens
ctgtttggcttccaa

SEQ ID NO: 248879 - DNA, 15 bp, Homo sapiens
tctgtttggcttcca

SEQ ID NO: 248880 - DNA, 15 bp, Homo sapiens
ttctgtttggcttcc

SEQ ID NO: 248881 - DNA, 15 bp, Homo sapiens
cttctgtttggcttc

SEQ ID NO: 248882 - DNA, 15 bp, Homo sapiens
acttctgtttggctt

SEQ ID NO: 248883 - DNA, 15 bp, Homo sapiens
cacttctgtttggct

SEQ ID NO: 248884 - DNA, 15 bp, Homo sapiens
ccacttctgtttggc

SEQ ID NO: 248885 - DNA, 15 bp, Homo sapiens
gccacttctgtttgg

SEQ ID NO: 248886 - DNA, 15 bp, Homo sapiens
agccacttctgtttg

SEQ ID NO: 248887 - DNA, 15 bp, Homo sapiens
cagccacttctgttt

SEQ ID NO: 248888 - DNA, 15 bp, Homo sapiens
ccagccacttctgtt

SEQ ID NO: 248889 - DNA, 15 bp, Homo sapiens
tccagccacttctgt

SEQ ID NO: 248890 - DNA, 15 bp, Homo sapiens
ctccagccacttctg

SEQ ID NO: 248891 - DNA, 15 bp, Homo sapiens
actccagccacttct

SEQ ID NO: 248892 - DNA, 15 bp, Homo sapiens
cactccagccacttc

SEQ ID NO: 248893 - DNA, 15 bp, Homo sapiens
ccactccagccactt

SEQ ID NO: 248894 - DNA, 15 bp, Homo sapiens
accactccagccact

SEQ ID NO: 248895 - DNA, 15 bp, Homo sapiens
caccactccagccac

SEQ ID NO: 248896 - DNA, 15 bp, Homo sapiens
tcaccactccagcca

SEQ ID NO: 248897 - DNA, 15 bp, Homo sapiens
ttcaccactccagcc

SEQ ID NO: 248898 - DNA, 15 bp, Homo sapiens
attcaccactccagc

SEQ ID NO: 248899 - DNA, 15 bp, Homo sapiens
cattcaccactccag

SEQ ID NO: 248900 - DNA, 15 bp, Homo sapiens
ccattcaccactcca

SEQ ID NO: 248901 - DNA, 15 bp, Homo sapiens
cccattcaccactcc

SEQ ID NO: 248902 - DNA, 15 bp, Homo sapiens
tcccattcaccactc

SEQ ID NO: 248903 - DNA, 15 bp, Homo sapiens
gtcccattcaccact

SEQ ID NO: 248904 - DNA, 15 bp, Homo sapiens
tgtcccattcaccac

SEQ ID NO: 248905 - DNA, 15 bp, Homo sapiens
gtgtcccattcacca

SEQ ID NO: 248906 - DNA, 15 bp, Homo sapiens
cgtgtcccattcacc

SEQ ID NO: 248907 - DNA, 15 bp, Homo sapiens
tcgtgtcccattcac

SEQ ID NO: 248908 - DNA, 15 bp, Homo sapiens
ctcgtgtcccattca

SEQ ID NO: 248909 - DNA, 15 bp, Homo sapiens
cctcgtgtcccattc

SEQ ID NO: 248910 - DNA, 15 bp, Homo sapiens
tcctcgtgtcccatt

SEQ ID NO: 248911 - DNA, 15 bp, Homo sapiens
ttcctcgtgtcccat

SEQ ID NO: 248912 - DNA, 15 bp, Homo sapiens
cttcctcgtgtccca

SEQ ID NO: 248913 - DNA, 15 bp, Homo sapiens
acttcctcgtgtccc

SEQ ID NO: 248914 - DNA, 15 bp, Homo sapiens
tacttcctcgtgtcc

SEQ ID NO: 248915 - DNA, 15 bp, Homo sapiens
ctacttcctcgtgtc

SEQ ID NO: 248916 - DNA, 15 bp, Homo sapiens
tctacttcctcgtgt

SEQ ID NO: 248917 - DNA, 15 bp, Homo sapiens
atctacttcctcgtg

SEQ ID NO: 248918 - DNA, 15 bp, Homo sapiens
tatctacttcctcgt

SEQ ID NO: 248919 - DNA, 15 bp, Homo sapiens
atatctacttcctcg

SEQ ID NO: 248920 - DNA, 15 bp, Homo sapiens
catatctacttcctc

SEQ ID NO: 248921 - DNA, 15 bp, Homo sapiens
ccatatctacttcct

SEQ ID NO: 248922 - DNA, 15 bp, Homo sapiens
accatatctacttcc

SEQ ID NO: 248923 - DNA, 15 bp, Homo sapiens
taccatatctacttc

SEQ ID NO: 248924 - DNA, 15 bp, Homo sapiens
gtaccatatctactt

SEQ ID NO: 248925 - DNA, 15 bp, Homo sapiens
tgtaccatatctact

SEQ ID NO: 248926 - DNA, 15 bp, Homo sapiens
ctgtaccatatctac

SEQ ID NO: 248927 - DNA, 15 bp, Homo sapiens
actgtaccatatcta

SEQ ID NO: 248928 - DNA, 15 bp, Homo sapiens
tactgtaccatatct

SEQ ID NO: 248929 - DNA, 15 bp, Homo sapiens
gtactgtaccatatc

SEQ ID NO: 248930 - DNA, 15 bp, Homo sapiens
agtactgtaccatat

SEQ ID NO: 248931 - DNA, 15 bp, Homo sapiens
gagtactgtaccata

SEQ ID NO: 248932 - DNA, 15 bp, Homo sapiens
tgagtactgtaccat

SEQ ID NO: 248933 - DNA, 15 bp, Homo sapiens
atgagtactgtacca

SEQ ID NO: 248934 - DNA, 15 bp, Homo sapiens
aatgagtactgtacc

SEQ ID NO: 248935 - DNA, 15 bp, Homo sapiens
caatgagtactgtac

SEQ ID NO: 248936 - DNA, 15 bp, Homo sapiens
ccaatgagtactgta

SEQ ID NO: 248937 - DNA, 15 bp, Homo sapiens
accaatgagtactgt

SEQ ID NO: 248938 - DNA, 15 bp, Homo sapiens
caccaatgagtactg

SEQ ID NO: 248939 - DNA, 15 bp, Homo sapiens
tcaccaatgagtact

SEQ ID NO: 248940 - DNA, 15 bp, Homo sapiens
ttcaccaatgagtac

SEQ ID NO: 248941 - DNA, 15 bp, Homo sapiens
attcaccaatgagta

SEQ ID NO: 248942 - DNA, 15 bp, Homo sapiens
aattcaccaatgagt

SEQ ID NO: 248943 - DNA, 15 bp, Homo sapiens
aaattcaccaatgag

SEQ ID NO: 248944 - DNA, 15 bp, Homo sapiens
aaaattcaccaatga

SEQ ID NO: 248945 - DNA, 15 bp, Homo sapiens
caaaattcaccaatg

SEQ ID NO: 248946 - DNA, 15 bp, Homo sapiens
gcaaaattcaccaat

SEQ ID NO: 248947 - DNA, 15 bp, Homo sapiens
ggcaaaattcaccaa

SEQ ID NO: 248948 - DNA, 15 bp, Homo sapiens
aggcaaaattcacca

SEQ ID NO: 248949 - DNA, 15 bp, Homo sapiens
caggcaaaattcacc

SEQ ID NO: 248950 - DNA, 15 bp, Homo sapiens
acaggcaaaattcac

SEQ ID NO: 248951 - DNA, 15 bp, Homo sapiens
cacaggcaaaattca

SEQ ID NO: 248952 - DNA, 15 bp, Homo sapiens
tcacaggcaaaattc

SEQ ID NO: 248953 - DNA, 15 bp, Homo sapiens
ttcacaggcaaaatt

SEQ ID NO: 248954 - DNA, 15 bp, Homo sapiens
cttcacaggcaaaat

SEQ ID NO: 248955 - DNA, 15 bp, Homo sapiens
ccttcacaggcaaaa

SEQ ID NO: 248956 - DNA, 15 bp, Homo sapiens
tccttcacaggcaaa

SEQ ID NO: 248957 - DNA, 15 bp, Homo sapiens
ctccttcacaggcaa

SEQ ID NO: 248958 - DNA, 15 bp, Homo sapiens
tctccttcacaggca

SEQ ID NO: 248959 - DNA, 15 bp, Homo sapiens
ctctccttcacaggc

SEQ ID NO: 248960 - DNA, 15 bp, Homo sapiens
tctctccttcacagg

SEQ ID NO: 248961 - DNA, 15 bp, Homo sapiens
ttctctccttcacag

SEQ ID NO: 248962 - DNA, 15 bp, Homo sapiens
tttctctccttcaca

SEQ ID NO: 248963 - DNA, 15 bp, Homo sapiens
ttttctctccttcac

SEQ ID NO: 248964 - DNA, 15 bp, Homo sapiens
tttttctctccttca

SEQ ID NO: 248965 - DNA, 15 bp, Homo sapiens
ttttttctctccttc

SEQ ID NO: 248966 - DNA, 15 bp, Homo sapiens
cttttttctctcctt

SEQ ID NO: 248967 - DNA, 15 bp, Homo sapiens
ccttttttctctcct

SEQ ID NO: 248968 - DNA, 15 bp, Homo sapiens
accttttttctctcc

SEQ ID NO: 248969 - DNA, 15 bp, Homo sapiens
caccttttttctctc

SEQ ID NO: 248970 - DNA, 15 bp, Homo sapiens
tcaccttttttctct

SEQ ID NO: 248971 - DNA, 15 bp, Homo sapiens
atcaccttttttctc

SEQ ID NO: 248972 - DNA, 15 bp, Homo sapiens
tatcaccttttttct

SEQ ID NO: 248973 - DNA, 15 bp, Homo sapiens
ttatcaccttttttc

SEQ ID NO: 248974 - DNA, 15 bp, Homo sapiens
gttatcacctttttt

SEQ ID NO: 248975 - DNA, 15 bp, Homo sapiens
agttatcaccttttt

SEQ ID NO: 248976 - DNA, 15 bp, Homo sapiens
tagttatcacctttt

SEQ ID NO: 248977 - DNA, 15 bp, Homo sapiens
ctagttatcaccttt

SEQ ID NO: 248978 - DNA, 15 bp, Homo sapiens
gctagttatcacctt

SEQ ID NO: 248979 - DNA, 15 bp, Homo sapiens
tgctagttatcacct

SEQ ID NO: 248980 - DNA, 15 bp, Homo sapiens
ctgctagttatcacc

SEQ ID NO: 248981 - DNA, 15 bp, Homo sapiens
tctgctagttatcac

SEQ ID NO: 248982 - DNA, 15 bp, Homo sapiens
ttctgctagttatca

SEQ ID NO: 248983 - DNA, 15 bp, Homo sapiens
tttctgctagttatc

SEQ ID NO: 248984 - DNA, 15 bp, Homo sapiens
ttttctgctagttat

SEQ ID NO: 248985 - DNA, 15 bp, Homo sapiens
attttctgctagtta

SEQ ID NO: 248986 - DNA, 15 bp, Homo sapiens
cattttctgctagtt

SEQ ID NO: 248987 - DNA, 15 bp, Homo sapiens
acattttctgctagt

SEQ ID NO: 248988 - DNA, 15 bp, Homo sapiens
tacattttctgctag

SEQ ID NO: 248989 - DNA, 15 bp, Homo sapiens
ctacattttctgcta

SEQ ID NO: 248990 - DNA, 15 bp, Homo sapiens
tctacattttctgct

SEQ ID NO: 248991 - DNA, 15 bp, Homo sapiens
atctacattttctgc

SEQ ID NO: 248992 - DNA, 15 bp, Homo sapiens
aatctacattttctg

SEQ ID NO: 248993 - DNA, 15 bp, Homo sapiens
aaatctacattttct

SEQ ID NO: 248994 - DNA, 15 bp, Homo sapiens
caaatctacattttc

SEQ ID NO: 248995 - DNA, 15 bp, Homo sapiens
tcaaatctacatttt

SEQ ID NO: 248996 - DNA, 15 bp, Homo sapiens
ctcaaatctacattt

SEQ ID NO: 248997 - DNA, 15 bp, Homo sapiens
cctcaaatctacatt

SEQ ID NO: 248998 - DNA, 15 bp, Homo sapiens
acctcaaatctacat

SEQ ID NO: 248999 - DNA, 15 bp, Homo sapiens
tacctcaaatctaca

SEQ ID NO: 249000 - DNA, 15 bp, Homo sapiens
ctacctcaaatctac

SEQ ID NO: 249001 - DNA, 15 bp, Homo sapiens
cctacctcaaatcta

SEQ ID NO: 249002 - DNA, 15 bp, Homo sapiens
ccctacctcaaatct

SEQ ID NO: 249003 - DNA, 15 bp, Homo sapiens
cccctacctcaaatc

SEQ ID NO: 249004 - DNA, 15 bp, Homo sapiens
acccctacctcaaat

SEQ ID NO: 249005 - DNA, 15 bp, Homo sapiens
cacccctacctcaaa

SEQ ID NO: 249006 - DNA, 15 bp, Homo sapiens
acacccctacctcaa

SEQ ID NO: 249007 - DNA, 15 bp, Homo sapiens
cacacccctacctca

SEQ ID NO: 249008 - DNA, 15 bp, Homo sapiens
acacacccctacctc

SEQ ID NO: 249009 - DNA, 15 bp, Homo sapiens
cacacacccctacct

SEQ ID NO: 249010 - DNA, 15 bp, Homo sapiens
acacacacccctacc

SEQ ID NO: 249011 - DNA, 15 bp, Homo sapiens
cacacacacccctac

SEQ ID NO: 249012 - DNA, 15 bp, Homo sapiens
acacacacaccccta

SEQ ID NO: 249013 - DNA, 15 bp, Homo sapiens
cacacacacacccct

SEQ ID NO: 249014 - DNA, 15 bp, Homo sapiens
acacacacacacccc

SEQ ID NO: 249015 - DNA, 15 bp, Homo sapiens
cacacacacacaccc

SEQ ID NO: 249016 - DNA, 15 bp, Homo sapiens
taaacacacacacac

SEQ ID NO: 249017 - DNA, 15 bp, Homo sapiens
ttaaacacacacaca

SEQ ID NO: 249018 - DNA, 15 bp, Homo sapiens
cttaaacacacacac

SEQ ID NO: 249019 - DNA, 15 bp, Homo sapiens
ccttaaacacacaca

SEQ ID NO: 249020 - DNA, 15 bp, Homo sapiens
tccttaaacacacac

SEQ ID NO: 249021 - DNA, 15 bp, Homo sapiens
atccttaaacacaca

SEQ ID NO: 249022 - DNA, 15 bp, Homo sapiens
catccttaaacacac

SEQ ID NO: 249023 - DNA, 15 bp, Homo sapiens
ccatccttaaacaca

SEQ ID NO: 249024 - DNA, 15 bp, Homo sapiens
gccatccttaaacac

SEQ ID NO: 249025 - DNA, 15 bp, Homo sapiens
tgccatccttaaaca

SEQ ID NO: 249026 - DNA, 15 bp, Homo sapiens
gtgccatccttaaac

SEQ ID NO: 249027 - DNA, 15 bp, Homo sapiens
cgtgccatccttaaa

SEQ ID NO: 249028 - DNA, 15 bp, Homo sapiens
acgtgccatccttaa

SEQ ID NO: 249029 - DNA, 15 bp, Homo sapiens
gacgtgccatcctta

SEQ ID NO: 249030 - DNA, 15 bp, Homo sapiens
agacgtgccatcctt

SEQ ID NO: 249031 - DNA, 15 bp, Homo sapiens
cagacgtgccatcct

SEQ ID NO: 249032 - DNA, 15 bp, Homo sapiens
acagacgtgccatcc

SEQ ID NO: 249033 - DNA, 15 bp, Homo sapiens
tacagacgtgccatc

SEQ ID NO: 249034 - DNA, 15 bp, Homo sapiens
ttacagacgtgccat

SEQ ID NO: 249035 - DNA, 15 bp, Homo sapiens
tttacagacgtgcca

SEQ ID NO: 249036 - DNA, 15 bp, Homo sapiens
gtttacagacgtgcc

SEQ ID NO: 249037 - DNA, 15 bp, Homo sapiens
tgtttacagacgtgc

SEQ ID NO: 249038 - DNA, 15 bp, Homo sapiens
atgtttacagacgtg

SEQ ID NO: 249039 - DNA, 15 bp, Homo sapiens
aatgtttacagacgt

SEQ ID NO: 249040 - DNA, 15 bp, Homo sapiens
aaatgtttacagacg

SEQ ID NO: 249041 - DNA, 15 bp, Homo sapiens
taaatgtttacagac

SEQ ID NO: 249042 - DNA, 15 bp, Homo sapiens
ataaatgtttacaga

SEQ ID NO: 249043 - DNA, 15 bp, Homo sapiens
tataaatgtttacag

SEQ ID NO: 249044 - DNA, 15 bp, Homo sapiens
atataaatgtttaca

SEQ ID NO: 249045 - DNA, 15 bp, Homo sapiens
aatataaatgtttac

SEQ ID NO: 249046 - DNA, 15 bp, Homo sapiens
gaatataaatgttta

SEQ ID NO: 249047 - DNA, 15 bp, Homo sapiens
agaatataaatgttt

SEQ ID NO: 249048 - DNA, 15 bp, Homo sapiens
tagaatataaatgtt

SEQ ID NO: 249049 - DNA, 15 bp, Homo sapiens
gtagaatataaatgt

SEQ ID NO: 249050 - DNA, 15 bp, Homo sapiens
tgtagaatataaatg

SEQ ID NO: 249051 - DNA, 15 bp, Homo sapiens
ttgtagaatataaat

SEQ ID NO: 249052 - DNA, 15 bp, Homo sapiens
tttgtagaatataaa

SEQ ID NO: 249053 - DNA, 15 bp, Homo sapiens
ctttgtagaatataa

SEQ ID NO: 249054 - DNA, 15 bp, Homo sapiens
cctttgtagaatata

SEQ ID NO: 249055 - DNA, 15 bp, Homo sapiens
tcctttgtagaatat

SEQ ID NO: 249056 - DNA, 15 bp, Homo sapiens
atcctttgtagaata

SEQ ID NO: 249057 - DNA, 15 bp, Homo sapiens
tatcctttgtagaat

SEQ ID NO: 249058 - DNA, 15 bp, Homo sapiens
ctatcctttgtagaa

SEQ ID NO: 249059 - DNA, 15 bp, Homo sapiens
actatcctttgtaga

SEQ ID NO: 249060 - DNA, 15 bp, Homo sapiens
gactatcctttgtag

SEQ ID NO: 249061 - DNA, 15 bp, Homo sapiens
agactatcctttgta

SEQ ID NO: 249062 - DNA, 15 bp, Homo sapiens
aagactatcctttgt

SEQ ID NO: 249063 - DNA, 15 bp, Homo sapiens
gaagactatcctttg

SEQ ID NO: 249064 - DNA, 15 bp, Homo sapiens
agaagactatccttt

SEQ ID NO: 249065 - DNA, 15 bp, Homo sapiens
aagaagactatcctt

SEQ ID NO: 249066 - DNA, 15 bp, Homo sapiens
caagaagactatcct

SEQ ID NO: 249067 - DNA, 15 bp, Homo sapiens
tcaagaagactatcc

SEQ ID NO: 249068 - DNA, 15 bp, Homo sapiens
ctcaagaagactatc

SEQ ID NO: 249069 - DNA, 15 bp, Homo sapiens
tctcaagaagactat

SEQ ID NO: 249070 - DNA, 15 bp, Homo sapiens
ctctcaagaagacta

SEQ ID NO: 249071 - DNA, 15 bp, Homo sapiens
tctctcaagaagact

SEQ ID NO: 249072 - DNA, 15 bp, Homo sapiens
ctctctcaagaagac

SEQ ID NO: 249073 - DNA, 15 bp, Homo sapiens
cctctctcaagaaga

SEQ ID NO: 249074 - DNA, 15 bp, Homo sapiens
ccctctctcaagaag

SEQ ID NO: 249075 - DNA, 15 bp, Homo sapiens
cccctctctcaagaa

SEQ ID NO: 249076 - DNA, 15 bp, Homo sapiens
acccctctctcaaga

SEQ ID NO: 249077 - DNA, 15 bp, Homo sapiens
aacccctctctcaag

SEQ ID NO: 249078 - DNA, 15 bp, Homo sapiens
caacccctctctcaa

SEQ ID NO: 249079 - DNA, 15 bp, Homo sapiens
tcaacccctctctca

SEQ ID NO: 249080 - DNA, 15 bp, Homo sapiens
gtcaacccctctctc

SEQ ID NO: 249081 - DNA, 15 bp, Homo sapiens
tgtcaacccctctct

SEQ ID NO: 249082 - DNA, 15 bp, Homo sapiens
ctgtcaacccctctc

SEQ ID NO: 249083 - DNA, 15 bp, Homo sapiens
actgtcaacccctct

SEQ ID NO: 249084 - DNA, 15 bp, Homo sapiens
cactgtcaacccctc

SEQ ID NO: 249085 - DNA, 15 bp, Homo sapiens
gcactgtcaacccct

SEQ ID NO: 249086 - DNA, 15 bp, Homo sapiens
tgcactgtcaacccc

SEQ ID NO: 249087 - DNA, 15 bp, Homo sapiens
ctgcactgtcaaccc

SEQ ID NO: 249088 - DNA, 15 bp, Homo sapiens
gctgcactgtcaacc

SEQ ID NO: 249089 - DNA, 15 bp, Homo sapiens
tgctgcactgtcaac

SEQ ID NO: 249090 - DNA, 15 bp, Homo sapiens
gtgctgcactgtcaa

SEQ ID NO: 249091 - DNA, 15 bp, Homo sapiens
tgtgctgcactgtca

SEQ ID NO: 249092 - DNA, 15 bp, Homo sapiens
ctgtgctgcactgtc

SEQ ID NO: 249093 - DNA, 15 bp, Homo sapiens
cctgtgctgcactgt

SEQ ID NO: 249094 - DNA, 15 bp, Homo sapiens
tcctgtgctgcactg

SEQ ID NO: 249095 - DNA, 15 bp, Homo sapiens
ttcctgtgctgcact

SEQ ID NO: 249096 - DNA, 15 bp, Homo sapiens
tttcctgtgctgcac

SEQ ID NO: 249097 - DNA, 15 bp, Homo sapiens
atttcctgtgctgca

SEQ ID NO: 249098 - DNA, 15 bp, Homo sapiens
aatttcctgtgctgc

SEQ ID NO: 249099 - DNA, 15 bp, Homo sapiens
aaatttcctgtgctg

SEQ ID NO: 249100 - DNA, 15 bp, Homo sapiens
aaaatttcctgtgct

SEQ ID NO: 249101 - DNA, 15 bp, Homo sapiens
aaaaatttcctgtgc

SEQ ID NO: 249102 - DNA, 15 bp, Homo sapiens
taaaaatttcctgtg

SEQ ID NO: 249103 - DNA, 15 bp, Homo sapiens
ttaaaaatttcctgt

SEQ ID NO: 249104 - DNA, 15 bp, Homo sapiens
cttaaaaatttcctg

SEQ ID NO: 249105 - DNA, 15 bp, Homo sapiens
tcttaaaaatttcct

SEQ ID NO: 249106 - DNA, 15 bp, Homo sapiens
ttcttaaaaatttcc

SEQ ID NO: 249107 - DNA, 15 bp, Homo sapiens
tttcttaaaaatttc

SEQ ID NO: 249108 - DNA, 15 bp, Homo sapiens
atttcttaaaaattt

SEQ ID NO: 249109 - DNA, 15 bp, Homo sapiens
gatttcttaaaaatt

SEQ ID NO: 249110 - DNA, 15 bp, Homo sapiens
tgatttcttaaaaat

SEQ ID NO: 249111 - DNA, 15 bp, Homo sapiens
atgatttcttaaaaa

SEQ ID NO: 249112 - DNA, 15 bp, Homo sapiens
aatgatttcttaaaa

SEQ ID NO: 249113 - DNA, 15 bp, Homo sapiens
caatgatttcttaaa

SEQ ID NO: 249114 - DNA, 15 bp, Homo sapiens
ccaatgatttcttaa

SEQ ID NO: 249115 - DNA, 15 bp, Homo sapiens
cccaatgatttctta

SEQ ID NO: 249116 - DNA, 15 bp, Homo sapiens
tcccaatgatttctt

SEQ ID NO: 249117 - DNA, 15 bp, Homo sapiens
ttcccaatgatttct

SEQ ID NO: 249118 - DNA, 15 bp, Homo sapiens
cttcccaatgatttc

SEQ ID NO: 249119 - DNA, 15 bp, Homo sapiens
tcttcccaatgattt

SEQ ID NO: 249120 - DNA, 15 bp, Homo sapiens
ttcttcccaatgatt

SEQ ID NO: 249121 - DNA, 15 bp, Homo sapiens
attcttcccaatgat

SEQ ID NO: 249122 - DNA, 15 bp, Homo sapiens
aattcttcccaatga

SEQ ID NO: 249123 - DNA, 15 bp, Homo sapiens
caattcttcccaatg

SEQ ID NO: 249124 - DNA, 15 bp, Homo sapiens
ccaattcttcccaat

SEQ ID NO: 249125 - DNA, 15 bp, Homo sapiens
gccaattcttcccaa

SEQ ID NO: 249126 - DNA, 15 bp, Homo sapiens
ggccaattcttccca

SEQ ID NO: 249127 - DNA, 15 bp, Homo sapiens
aggccaattcttccc

SEQ ID NO: 249128 - DNA, 15 bp, Homo sapiens
aaggccaattcttcc

SEQ ID NO: 249129 - DNA, 15 bp, Homo sapiens
aaaggccaattcttc

SEQ ID NO: 249130 - DNA, 15 bp, Homo sapiens
taaaggccaattctt

SEQ ID NO: 249131 - DNA, 15 bp, Homo sapiens
ttaaaggccaattct

SEQ ID NO: 249132 - DNA, 15 bp, Homo sapiens
attaaaggccaattc

SEQ ID NO: 249133 - DNA, 15 bp, Homo sapiens
tattaaaggccaatt

SEQ ID NO: 249134 - DNA, 15 bp, Homo sapiens
ttattaaaggccaat

SEQ ID NO: 249135 - DNA, 15 bp, Homo sapiens
cttattaaaggccaa

SEQ ID NO: 249136 - DNA, 15 bp, Homo sapiens
tcttattaaaggcca

SEQ ID NO: 249137 - DNA, 15 bp, Homo sapiens
ttcttattaaaggcc

SEQ ID NO: 249138 - DNA, 15 bp, Homo sapiens
cttcttattaaaggc

SEQ ID NO: 249139 - DNA, 15 bp, Homo sapiens
ccttcttattaaagg

SEQ ID NO: 249140 - DNA, 15 bp, Homo sapiens
cccttcttattaaag

SEQ ID NO: 249141 - DNA, 15 bp, Homo sapiens
ccccttcttattaaa

SEQ ID NO: 249142 - DNA, 15 bp, Homo sapiens
cccccttcttattaa

SEQ ID NO: 249143 - DNA, 15 bp, Homo sapiens
tcccccttcttatta

SEQ ID NO: 249144 - DNA, 15 bp, Homo sapiens
gtcccccttcttatt

SEQ ID NO: 249145 - DNA, 15 bp, Homo sapiens
tgtcccccttcttat

SEQ ID NO: 249146 - DNA, 15 bp, Homo sapiens
ttgtcccccttctta

SEQ ID NO: 249147 - DNA, 15 bp, Homo sapiens
attgtcccccttctt

SEQ ID NO: 249148 - DNA, 15 bp, Homo sapiens
aattgtcccccttct

SEQ ID NO: 249149 - DNA, 15 bp, Homo sapiens
aaattgtcccccttc

SEQ ID NO: 249150 - DNA, 15 bp, Homo sapiens
gaaattgtccccctt

SEQ ID NO: 249151 - DNA, 15 bp, Homo sapiens
agaaattgtccccct

SEQ ID NO: 249152 - DNA, 15 bp, Homo sapiens
gagaaattgtccccc

SEQ ID NO: 249153 - DNA, 15 bp, Homo sapiens
tgagaaattgtcccc

SEQ ID NO: 249154 - DNA, 15 bp, Homo sapiens
ctgagaaattgtccc

SEQ ID NO: 249155 - DNA, 15 bp, Homo sapiens
actgagaaattgtcc

SEQ ID NO: 249156 - DNA, 15 bp, Homo sapiens
aactgagaaattgtc

SEQ ID NO: 249157 - DNA, 15 bp, Homo sapiens
taactgagaaattgt

SEQ ID NO: 249158 - DNA, 15 bp, Homo sapiens
ttaactgagaaattg

SEQ ID NO: 249159 - DNA, 15 bp, Homo sapiens
tttaactgagaaatt

SEQ ID NO: 249160 - DNA, 15 bp, Homo sapiens
ctttaactgagaaat

SEQ ID NO: 249161 - DNA, 15 bp, Homo sapiens
cctttaactgagaaa

SEQ ID NO: 249162 - DNA, 15 bp, Homo sapiens
ccctttaactgagaa

SEQ ID NO: 249163 - DNA, 15 bp, Homo sapiens
cccctttaactgaga

SEQ ID NO: 249164 - DNA, 15 bp, Homo sapiens
tcccctttaactgag

SEQ ID NO: 249165 - DNA, 15 bp, Homo sapiens
ctcccctttaactga

SEQ ID NO: 249166 - DNA, 15 bp, Homo sapiens
tctcccctttaactg

SEQ ID NO: 249167 - DNA, 15 bp, Homo sapiens
atctcccctttaact

SEQ ID NO: 249168 - DNA, 15 bp, Homo sapiens
tatctcccctttaac

SEQ ID NO: 249169 - DNA, 15 bp, Homo sapiens
ctatctcccctttaa

SEQ ID NO: 249170 - DNA, 15 bp, Homo sapiens
cctatctccccttta

SEQ ID NO: 249171 - DNA, 15 bp, Homo sapiens
tcctatctccccttt

SEQ ID NO: 249172 - DNA, 15 bp, Homo sapiens
atcctatctcccctt

SEQ ID NO: 249173 - DNA, 15 bp, Homo sapiens
tatcctatctcccct

SEQ ID NO: 249174 - DNA, 15 bp, Homo sapiens
ttatcctatctcccc

SEQ ID NO: 249175 - DNA, 15 bp, Homo sapiens
gttatcctatctccc

SEQ ID NO: 249176 - DNA, 15 bp, Homo sapiens
tgttatcctatctcc

SEQ ID NO: 249177 - DNA, 15 bp, Homo sapiens
ctgttatcctatctc

SEQ ID NO: 249178 - DNA, 15 bp, Homo sapiens
tctgttatcctatct

SEQ ID NO: 249179 - DNA, 15 bp, Homo sapiens
gtctgttatcctatc

SEQ ID NO: 249180 - DNA, 15 bp, Homo sapiens
agtctgttatcctat

SEQ ID NO: 249181 - DNA, 15 bp, Homo sapiens
cagtctgttatccta

SEQ ID NO: 249182 - DNA, 15 bp, Homo sapiens
ccagtctgttatcct

SEQ ID NO: 249183 - DNA, 15 bp, Homo sapiens
gccagtctgttatcc

SEQ ID NO: 249184 - DNA, 15 bp, Homo sapiens
tgccagtctgttatc

SEQ ID NO: 249185 - DNA, 15 bp, Homo sapiens
ctgccagtctgttat

SEQ ID NO: 249186 - DNA, 15 bp, Homo sapiens
actgccagtctgtta

SEQ ID NO: 249187 - DNA, 15 bp, Homo sapiens
aactgccagtctgtt

SEQ ID NO: 249188 - DNA, 15 bp, Homo sapiens
caactgccagtctgt

SEQ ID NO: 249189 - DNA, 15 bp, Homo sapiens
ccaactgccagtctg

SEQ ID NO: 249190 - DNA, 15 bp, Homo sapiens
tccaactgccagtct

SEQ ID NO: 249191 - DNA, 15 bp, Homo sapiens
ctccaactgccagtc

SEQ ID NO: 249192 - DNA, 15 bp, Homo sapiens
cctccaactgccagt

SEQ ID NO: 249193 - DNA, 15 bp, Homo sapiens
ccctccaactgccag

SEQ ID NO: 249194 - DNA, 15 bp, Homo sapiens
tccctccaactgcca

SEQ ID NO: 249195 - DNA, 15 bp, Homo sapiens
ttccctccaactgcc

SEQ ID NO: 249196 - DNA, 15 bp, Homo sapiens
cttccctccaactgc

SEQ ID NO: 249197 - DNA, 15 bp, Homo sapiens
acttccctccaactg

SEQ ID NO: 249198 - DNA, 15 bp, Homo sapiens
aacttccctccaact

SEQ ID NO: 249199 - DNA, 15 bp, Homo sapiens
aaacttccctccaac

SEQ ID NO: 249200 - DNA, 15 bp, Homo sapiens
gaaacttccctccaa

SEQ ID NO: 249201 - DNA, 15 bp, Homo sapiens
ggaaacttccctcca

SEQ ID NO: 249202 - DNA, 15 bp, Homo sapiens
aggaaacttccctcc

SEQ ID NO: 249203 - DNA, 15 bp, Homo sapiens
caggaaacttccctc

SEQ ID NO: 249204 - DNA, 15 bp, Homo sapiens
tcaggaaacttccct

SEQ ID NO: 249205 - DNA, 15 bp, Homo sapiens
ctcaggaaacttccc

SEQ ID NO: 249206 - DNA, 15 bp, Homo sapiens
actcaggaaacttcc

SEQ ID NO: 249207 - DNA, 15 bp, Homo sapiens
aactcaggaaacttc

SEQ ID NO: 249208 - DNA, 15 bp, Homo sapiens
caactcaggaaactt

SEQ ID NO: 249209 - DNA, 15 bp, Homo sapiens
ccaactcaggaaact

SEQ ID NO: 249210 - DNA, 15 bp, Homo sapiens
accaactcaggaaac

SEQ ID NO: 249211 - DNA, 15 bp, Homo sapiens
caccaactcaggaaa

SEQ ID NO: 249212 - DNA, 15 bp, Homo sapiens
ccaccaactcaggaa

SEQ ID NO: 249213 - DNA, 15 bp, Homo sapiens
accaccaactcagga

SEQ ID NO: 249214 - DNA, 15 bp, Homo sapiens
caccaccaactcagg

SEQ ID NO: 249215 - DNA, 15 bp, Homo sapiens
ccaccaccaactcag

SEQ ID NO: 249216 - DNA, 15 bp, Homo sapiens
tccaccaccaactca

SEQ ID NO: 249217 - DNA, 15 bp, Homo sapiens
ctccaccaccaactc

SEQ ID NO: 249218 - DNA, 15 bp, Homo sapiens
tctccaccaccaact

SEQ ID NO: 249219 - DNA, 15 bp, Homo sapiens
ctctccaccaccaac

SEQ ID NO: 249220 - DNA, 15 bp, Homo sapiens
tctctccaccaccaa

SEQ ID NO: 249221 - DNA, 15 bp, Homo sapiens
tctctctccaccacc

SEQ ID NO: 249222 - DNA, 15 bp, Homo sapiens
ttctctctccaccac

SEQ ID NO: 249223 - DNA, 15 bp, Homo sapiens
tttctctctccacca

SEQ ID NO: 249224 - DNA, 15 bp, Homo sapiens
ctttctctctccacc

SEQ ID NO: 249225 - DNA, 15 bp, Homo sapiens
cctttctctctccac

SEQ ID NO: 249226 - DNA, 15 bp, Homo sapiens
tcctttctctctcca

SEQ ID NO: 249227 - DNA, 15 bp, Homo sapiens
ctcctttctctctcc

SEQ ID NO: 249228 - DNA, 15 bp, Homo sapiens
actcctttctctctc

SEQ ID NO: 249229 - DNA, 15 bp, Homo sapiens
gactcctttctctct

SEQ ID NO: 249230 - DNA, 15 bp, Homo sapiens
ggactcctttctctc

SEQ ID NO: 249231 - DNA, 15 bp, Homo sapiens
aggactcctttctct

SEQ ID NO: 249232 - DNA, 15 bp, Homo sapiens
gaggactcctttctc

SEQ ID NO: 249233 - DNA, 15 bp, Homo sapiens
tgaggactcctttct

SEQ ID NO: 249234 - DNA, 15 bp, Homo sapiens
atgaggactcctttc

SEQ ID NO: 249235 - DNA, 15 bp, Homo sapiens
gatgaggactccttt

SEQ ID NO: 249236 - DNA, 15 bp, Homo sapiens
agatgaggactcctt

SEQ ID NO: 249237 - DNA, 15 bp, Homo sapiens
tagatgaggactcct

SEQ ID NO: 249238 - DNA, 15 bp, Homo sapiens
ctagatgaggactcc

SEQ ID NO: 249239 - DNA, 15 bp, Homo sapiens
actagatgaggactc

SEQ ID NO: 249240 - DNA, 15 bp, Homo sapiens
tactagatgaggact

SEQ ID NO: 249241 - DNA, 15 bp, Homo sapiens
ctactagatgaggac

SEQ ID NO: 249242 - DNA, 15 bp, Homo sapiens
actactagatgagga

SEQ ID NO: 249243 - DNA, 15 bp, Homo sapiens
tactactagatgagg

SEQ ID NO: 249244 - DNA, 15 bp, Homo sapiens
atactactagatgag

SEQ ID NO: 249245 - DNA, 15 bp, Homo sapiens
aatactactagatga

SEQ ID NO: 249246 - DNA, 15 bp, Homo sapiens
aaatactactagatg

SEQ ID NO: 249247 - DNA, 15 bp, Homo sapiens
taaatactactagat

SEQ ID NO: 249248 - DNA, 15 bp, Homo sapiens
ctaaatactactaga

SEQ ID NO: 249249 - DNA, 15 bp, Homo sapiens
cctaaatactactag

SEQ ID NO: 249250 - DNA, 15 bp, Homo sapiens
acctaaatactacta

SEQ ID NO: 249251 - DNA, 15 bp, Homo sapiens
aacctaaatactact

SEQ ID NO: 249252 - DNA, 15 bp, Homo sapiens
aaacctaaatactac

SEQ ID NO: 249253 - DNA, 15 bp, Homo sapiens
aaaacctaaatacta

SEQ ID NO: 249254 - DNA, 15 bp, Homo sapiens
gaaaacctaaatact

SEQ ID NO: 249255 - DNA, 15 bp, Homo sapiens
tgaaaacctaaatac

SEQ ID NO: 249256 - DNA, 15 bp, Homo sapiens
ttgaaaacctaaata

SEQ ID NO: 249257 - DNA, 15 bp, Homo sapiens
attgaaaacctaaat

SEQ ID NO: 249258 - DNA, 15 bp, Homo sapiens
cattgaaaacctaaa

SEQ ID NO: 249259 - DNA, 15 bp, Homo sapiens
tcattgaaaacctaa

SEQ ID NO: 249260 - DNA, 15 bp, Homo sapiens
ttcattgaaaaccta

SEQ ID NO: 249261 - DNA, 15 bp, Homo sapiens
cttcattgaaaacct

SEQ ID NO: 249262 - DNA, 15 bp, Homo sapiens
gcttcattgaaaacc

SEQ ID NO: 249263 - DNA, 15 bp, Homo sapiens
cgcttcattgaaaac

SEQ ID NO: 249264 - DNA, 15 bp, Homo sapiens
acgcttcattgaaaa

SEQ ID NO: 249265 - DNA, 15 bp, Homo sapiens
cacgcttcattgaaa

SEQ ID NO: 249266 - DNA, 15 bp, Homo sapiens
tcacgcttcattgaa

SEQ ID NO: 249267 - DNA, 15 bp, Homo sapiens
ctcacgcttcattga

SEQ ID NO: 249268 - DNA, 15 bp, Homo sapiens
tctcacgcttcattg

SEQ ID NO: 249269 - DNA, 15 bp, Homo sapiens
atctcacgcttcatt

SEQ ID NO: 249270 - DNA, 15 bp, Homo sapiens
tatctcacgcttcat

SEQ ID NO: 249271 - DNA, 15 bp, Homo sapiens
ttatctcacgcttca

SEQ ID NO: 249272 - DNA, 15 bp, Homo sapiens
tttatctcacgcttc

SEQ ID NO: 249273 - DNA, 15 bp, Homo sapiens
ctttatctcacgctt

SEQ ID NO: 249274 - DNA, 15 bp, Homo sapiens
actttatctcacgct

SEQ ID NO: 249275 - DNA, 15 bp, Homo sapiens
tactttatctcacgc

SEQ ID NO: 249276 - DNA, 15 bp, Homo sapiens
ttactttatctcacg

SEQ ID NO: 249277 - DNA, 15 bp, Homo sapiens
tttactttatctcac

SEQ ID NO: 249278 - DNA, 15 bp, Homo sapiens
ttttactttatctca

SEQ ID NO: 249279 - DNA, 15 bp, Homo sapiens
attttactttatctc

SEQ ID NO: 249280 - DNA, 15 bp, Homo sapiens
cattttactttatct

SEQ ID NO: 249281 - DNA, 15 bp, Homo sapiens
tcattttactttatc

SEQ ID NO: 249282 - DNA, 15 bp, Homo sapiens
atcattttactttat

SEQ ID NO: 249283 - DNA, 15 bp, Homo sapiens
tatcattttacttta

SEQ ID NO: 249284 - DNA, 15 bp, Homo sapiens
atatcattttacttt

SEQ ID NO: 249285 - DNA, 15 bp, Homo sapiens
aatatcattttactt

SEQ ID NO: 249286 - DNA, 15 bp, Homo sapiens
taatatcattttact

SEQ ID NO: 249287 - DNA, 15 bp, Homo sapiens
ttaatatcattttac

SEQ ID NO: 249288 - DNA, 15 bp, Homo sapiens
cttaatatcatttta

SEQ ID NO: 249289 - DNA, 15 bp, Homo sapiens
ccttaatatcatttt

SEQ ID NO: 249290 - DNA, 15 bp, Homo sapiens
gccttaatatcattt

SEQ ID NO: 249291 - DNA, 15 bp, Homo sapiens
tgccttaatatcatt

SEQ ID NO: 249292 - DNA, 15 bp, Homo sapiens
ctgccttaatatcat

SEQ ID NO: 249293 - DNA, 15 bp, Homo sapiens
tctgccttaatatca

SEQ ID NO: 249294 - DNA, 15 bp, Homo sapiens
ctctgccttaatatc

SEQ ID NO: 249295 - DNA, 15 bp, Homo sapiens
tctctgccttaatat

SEQ ID NO: 249296 - DNA, 15 bp, Homo sapiens
ttctctgccttaata

SEQ ID NO: 249297 - DNA, 15 bp, Homo sapiens
tttctctgccttaat

SEQ ID NO: 249298 - DNA, 15 bp, Homo sapiens
atttctctgccttaa

SEQ ID NO: 249299 - DNA, 15 bp, Homo sapiens
tatttctctgcctta

SEQ ID NO: 249300 - DNA, 15 bp, Homo sapiens
ttatttctctgcctt

SEQ ID NO: 249301 - DNA, 15 bp, Homo sapiens
tttatttctctgcct

SEQ ID NO: 249302 - DNA, 15 bp, Homo sapiens
gtttatttctctgcc

SEQ ID NO: 249303 - DNA, 15 bp, Homo sapiens
ggtttatttctctgc

SEQ ID NO: 249304 - DNA, 15 bp, Homo sapiens
tggtttatttctctg

SEQ ID NO: 249305 - DNA, 15 bp, Homo sapiens
ctggtttatttctct

SEQ ID NO: 249306 - DNA, 15 bp, Homo sapiens
actggtttatttctc

SEQ ID NO: 249307 - DNA, 15 bp, Homo sapiens
aactggtttatttct

SEQ ID NO: 249308 - DNA, 15 bp, Homo sapiens
aaactggtttatttc

SEQ ID NO: 249309 - DNA, 15 bp, Homo sapiens
caaactggtttattt

SEQ ID NO: 249310 - DNA, 15 bp, Homo sapiens
ccaaactggtttatt

SEQ ID NO: 249311 - DNA, 15 bp, Homo sapiens
cccaaactggtttat

SEQ ID NO: 249312 - DNA, 15 bp, Homo sapiens
ccccaaactggttta

SEQ ID NO: 249313 - DNA, 15 bp, Homo sapiens
tccccaaactggttt

SEQ ID NO: 249314 - DNA, 15 bp, Homo sapiens
ctccccaaactggtt

SEQ ID NO: 249315 - DNA, 15 bp, Homo sapiens
tctccccaaactggt

SEQ ID NO: 249316 - DNA, 15 bp, Homo sapiens
ctctccccaaactgg

SEQ ID NO: 249317 - DNA, 15 bp, Homo sapiens
tctctccccaaactg

SEQ ID NO: 249318 - DNA, 15 bp, Homo sapiens
ctctctccccaaact

SEQ ID NO: 249319 - DNA, 15 bp, Homo sapiens
tctctctccccaaac

SEQ ID NO: 249320 - DNA, 15 bp, Homo sapiens
atctctctccccaaa

SEQ ID NO: 249321 - DNA, 15 bp, Homo sapiens
tatctctctccccaa

SEQ ID NO: 249322 - DNA, 15 bp, Homo sapiens
ctatctctctcccca

SEQ ID NO: 249323 - DNA, 15 bp, Homo sapiens
gctatctctctcccc

SEQ ID NO: 249324 - DNA, 15 bp, Homo sapiens
tgctatctctctccc

SEQ ID NO: 249325 - DNA, 15 bp, Homo sapiens
ctgctatctctctcc

SEQ ID NO: 249326 - DNA, 15 bp, Homo sapiens
actgctatctctctc

SEQ ID NO: 249327 - DNA, 15 bp, Homo sapiens
tactgctatctctct

SEQ ID NO: 249328 - DNA, 15 bp, Homo sapiens
ctactgctatctctc

SEQ ID NO: 249329 - DNA, 15 bp, Homo sapiens
actactgctatctct

SEQ ID NO: 249330 - DNA, 15 bp, Homo sapiens
cactactgctatctc

SEQ ID NO: 249331 - DNA, 15 bp, Homo sapiens
tcactactgctatct

SEQ ID NO: 249332 - DNA, 15 bp, Homo sapiens
ttcactactgctatc

SEQ ID NO: 249333 - DNA, 15 bp, Homo sapiens
attcactactgctat

SEQ ID NO: 249334 - DNA, 15 bp, Homo sapiens
aattcactactgcta

SEQ ID NO: 249335 - DNA, 15 bp, Homo sapiens
aaattcactactgct

SEQ ID NO: 249336 - DNA, 15 bp, Homo sapiens
gaaattcactactgc

SEQ ID NO: 249337 - DNA, 15 bp, Homo sapiens
agaaattcactactg

SEQ ID NO: 249338 - DNA, 15 bp, Homo sapiens
cagaaattcactact

SEQ ID NO: 249339 - DNA, 15 bp, Homo sapiens
acagaaattcactac

SEQ ID NO: 249340 - DNA, 15 bp, Homo sapiens
aacagaaattcacta

SEQ ID NO: 249341 - DNA, 15 bp, Homo sapiens
aaacagaaattcact

SEQ ID NO: 249342 - DNA, 15 bp, Homo sapiens
aaaacagaaattcac

SEQ ID NO: 249343 - DNA, 15 bp, Homo sapiens
caaaacagaaattca

SEQ ID NO: 249344 - DNA, 15 bp, Homo sapiens
ccaaaacagaaattc

SEQ ID NO: 249345 - DNA, 15 bp, Homo sapiens
tccaaaacagaaatt

SEQ ID NO: 249346 - DNA, 15 bp, Homo sapiens
ctccaaaacagaaat

SEQ ID NO: 249347 - DNA, 15 bp, Homo sapiens
actccaaaacagaaa

SEQ ID NO: 249348 - DNA, 15 bp, Homo sapiens
aactccaaaacagaa

SEQ ID NO: 249349 - DNA, 15 bp, Homo sapiens
aaactccaaaacaga

SEQ ID NO: 249350 - DNA, 15 bp, Homo sapiens
caaactccaaaacag

SEQ ID NO: 249351 - DNA, 15 bp, Homo sapiens
ccaaactccaaaaca

SEQ ID NO: 249352 - DNA, 15 bp, Homo sapiens
cccaaactccaaaac

SEQ ID NO: 249353 - DNA, 15 bp, Homo sapiens
tcccaaactccaaaa

SEQ ID NO: 249354 - DNA, 15 bp, Homo sapiens
ttcccaaactccaaa

SEQ ID NO: 249355 - DNA, 15 bp, Homo sapiens
tttcccaaactccaa

SEQ ID NO: 249356 - DNA, 15 bp, Homo sapiens
ctttcccaaactcca

SEQ ID NO: 249357 - DNA, 15 bp, Homo sapiens
gctttcccaaactcc

SEQ ID NO: 249358 - DNA, 15 bp, Homo sapiens
tgctttcccaaactc

SEQ ID NO: 249359 - DNA, 15 bp, Homo sapiens
ttgctttcccaaact

SEQ ID NO: 249360 - DNA, 15 bp, Homo sapiens
cttgctttcccaaac

SEQ ID NO: 249361 - DNA, 15 bp, Homo sapiens
acttgctttcccaaa

SEQ ID NO: 249362 - DNA, 15 bp, Homo sapiens
aacttgctttcccaa

SEQ ID NO: 249363 - DNA, 15 bp, Homo sapiens
aaacttgctttccca

SEQ ID NO: 249364 - DNA, 15 bp, Homo sapiens
taaacttgctttccc

SEQ ID NO: 249365 - DNA, 15 bp, Homo sapiens
ataaacttgctttcc

SEQ ID NO: 249366 - DNA, 15 bp, Homo sapiens
aataaacttgctttc

SEQ ID NO: 249367 - DNA, 15 bp, Homo sapiens
taataaacttgcttt

SEQ ID NO: 249368 - DNA, 15 bp, Homo sapiens
ctaataaacttgctt

SEQ ID NO: 249369 - DNA, 15 bp, Homo sapiens
cctaataaacttgct

SEQ ID NO: 249370 - DNA, 15 bp, Homo sapiens
ccctaataaacttgc

SEQ ID NO: 249371 - DNA, 15 bp, Homo sapiens
tccctaataaacttg

SEQ ID NO: 249372 - DNA, 15 bp, Homo sapiens
ttccctaataaactt

SEQ ID NO: 249373 - DNA, 15 bp, Homo sapiens
attccctaataaact

SEQ ID NO: 249374 - DNA, 15 bp, Homo sapiens
tattccctaataaac

SEQ ID NO: 249375 - DNA, 15 bp, Homo sapiens
atattccctaataaa

SEQ ID NO: 249376 - DNA, 15 bp, Homo sapiens
tatattccctaataa

SEQ ID NO: 249377 - DNA, 15 bp, Homo sapiens
ctatattccctaata

SEQ ID NO: 249378 - DNA, 15 bp, Homo sapiens
actatattccctaat

SEQ ID NO: 249379 - DNA, 15 bp, Homo sapiens
cactatattccctaa

SEQ ID NO: 249380 - DNA, 15 bp, Homo sapiens
gcactatattcccta

SEQ ID NO: 249381 - DNA, 15 bp, Homo sapiens
tgcactatattccct

SEQ ID NO: 249382 - DNA, 15 bp, Homo sapiens
ctgcactatattccc

SEQ ID NO: 249383 - DNA, 15 bp, Homo sapiens
actgcactatattcc

SEQ ID NO: 249384 - DNA, 15 bp, Homo sapiens
aactgcactatattc

SEQ ID NO: 249385 - DNA, 15 bp, Homo sapiens
caactgcactatatt

SEQ ID NO: 249386 - DNA, 15 bp, Homo sapiens
gcaactgcactatat

SEQ ID NO: 249387 - DNA, 15 bp, Homo sapiens
ggcaactgcactata

SEQ ID NO: 249388 - DNA, 15 bp, Homo sapiens
tggcaactgcactat

SEQ ID NO: 249389 - DNA, 15 bp, Homo sapiens
ctggcaactgcacta

SEQ ID NO: 249390 - DNA, 15 bp, Homo sapiens
cctggcaactgcact

SEQ ID NO: 249391 - DNA, 15 bp, Homo sapiens
tcctggcaactgcac

SEQ ID NO: 249392 - DNA, 15 bp, Homo sapiens
ctcctggcaactgca

SEQ ID NO: 249393 - DNA, 15 bp, Homo sapiens
actcctggcaactgc

SEQ ID NO: 249394 - DNA, 15 bp, Homo sapiens
aactcctggcaactg

SEQ ID NO: 249395 - DNA, 15 bp, Homo sapiens
caactcctggcaact

SEQ ID NO: 249396 - DNA, 15 bp, Homo sapiens
ccaactcctggcaac

SEQ ID NO: 249397 - DNA, 15 bp, Homo sapiens
tccaactcctggcaa

SEQ ID NO: 249398 - DNA, 15 bp, Homo sapiens
gtccaactcctggca

SEQ ID NO: 249399 - DNA, 15 bp, Homo sapiens
tgtccaactcctggc

SEQ ID NO: 249400 - DNA, 15 bp, Homo sapiens
atgtccaactcctgg

SEQ ID NO: 249401 - DNA, 15 bp, Homo sapiens
aatgtccaactcctg

SEQ ID NO: 249402 - DNA, 15 bp, Homo sapiens
aaatgtccaactcct

SEQ ID NO: 249403 - DNA, 15 bp, Homo sapiens
caaatgtccaactcc

SEQ ID NO: 249404 - DNA, 15 bp, Homo sapiens
tcaaatgtccaactc

SEQ ID NO: 249405 - DNA, 15 bp, Homo sapiens
ctcaaatgtccaact

SEQ ID NO: 249406 - DNA, 15 bp, Homo sapiens
cctcaaatgtccaac

SEQ ID NO: 249407 - DNA, 15 bp, Homo sapiens
acctcaaatgtccaa

SEQ ID NO: 249408 - DNA, 15 bp, Homo sapiens
aacctcaaatgtcca

SEQ ID NO: 249409 - DNA, 15 bp, Homo sapiens
aaacctcaaatgtcc

SEQ ID NO: 249410 - DNA, 15 bp, Homo sapiens
caaacctcaaatgtc

SEQ ID NO: 249411 - DNA, 15 bp, Homo sapiens
tcaaacctcaaatgt

SEQ ID NO: 249412 - DNA, 15 bp, Homo sapiens
ttcaaacctcaaatg

SEQ ID NO: 249413 - DNA, 15 bp, Homo sapiens
tttcaaacctcaaat

SEQ ID NO: 249414 - DNA, 15 bp, Homo sapiens
atttcaaacctcaaa

SEQ ID NO: 249415 - DNA, 15 bp, Homo sapiens
gatttcaaacctcaa

SEQ ID NO: 249416 - DNA, 15 bp, Homo sapiens
tgatttcaaacctca

SEQ ID NO: 249417 - DNA, 15 bp, Homo sapiens
gtgatttcaaacctc

SEQ ID NO: 249418 - DNA, 15 bp, Homo sapiens
tgtgatttcaaacct

SEQ ID NO: 249419 - DNA, 15 bp, Homo sapiens
atgtgatttcaaacc

SEQ ID NO: 249420 - DNA, 15 bp, Homo sapiens
tatgtgatttcaaac

SEQ ID NO: 249421 - DNA, 15 bp, Homo sapiens
atatgtgatttcaaa

SEQ ID NO: 249422 - DNA, 15 bp, Homo sapiens
aatatgtgatttcaa

SEQ ID NO: 249423 - DNA, 15 bp, Homo sapiens
aaatatgtgatttca

SEQ ID NO: 249424 - DNA, 15 bp, Homo sapiens
aaaatatgtgatttc

SEQ ID NO: 249425 - DNA, 15 bp, Homo sapiens
taaaatatgtgattt

SEQ ID NO: 249426 - DNA, 15 bp, Homo sapiens
ttaaaatatgtgatt

SEQ ID NO: 249427 - DNA, 15 bp, Homo sapiens
tttaaaatatgtgat

SEQ ID NO: 249428 - DNA, 15 bp, Homo sapiens
ctttaaaatatgtga

SEQ ID NO: 249429 - DNA, 15 bp, Homo sapiens
actttaaaatatgtg

SEQ ID NO: 249430 - DNA, 15 bp, Homo sapiens
tactttaaaatatgt

SEQ ID NO: 249431 - DNA, 15 bp, Homo sapiens
ttactttaaaatatg

SEQ ID NO: 249432 - DNA, 15 bp, Homo sapiens
tttactttaaaatat

SEQ ID NO: 249433 - DNA, 15 bp, Homo sapiens
aatttactttaaaat

SEQ ID NO: 249434 - DNA, 15 bp, Homo sapiens
caatttactttaaaa

SEQ ID NO: 249435 - DNA, 15 bp, Homo sapiens
tcaatttactttaaa

SEQ ID NO: 249436 - DNA, 15 bp, Homo sapiens
ctcaatttactttaa

SEQ ID NO: 249437 - DNA, 15 bp, Homo sapiens
actcaatttacttta

SEQ ID NO: 249438 - DNA, 15 bp, Homo sapiens
gactcaatttacttt

SEQ ID NO: 249439 - DNA, 15 bp, Homo sapiens
agactcaatttactt

SEQ ID NO: 249440 - DNA, 15 bp, Homo sapiens
cagactcaatttact

SEQ ID NO: 249441 - DNA, 15 bp, Homo sapiens
acagactcaatttac

SEQ ID NO: 249442 - DNA, 15 bp, Homo sapiens
gacagactcaattta

SEQ ID NO: 249443 - DNA, 15 bp, Homo sapiens
agacagactcaattt

SEQ ID NO: 249444 - DNA, 15 bp, Homo sapiens
cagacagactcaatt

SEQ ID NO: 249445 - DNA, 15 bp, Homo sapiens
acagacagactcaat

SEQ ID NO: 249446 - DNA, 15 bp, Homo sapiens
aacagacagactcaa

SEQ ID NO: 249447 - DNA, 15 bp, Homo sapiens
caacagacagactca

SEQ ID NO: 249448 - DNA, 15 bp, Homo sapiens
tcaacagacagactc

SEQ ID NO: 249449 - DNA, 15 bp, Homo sapiens
ctcaacagacagact

SEQ ID NO: 249450 - DNA, 15 bp, Homo sapiens
actcaacagacagac

SEQ ID NO: 249451 - DNA, 15 bp, Homo sapiens
cactcaacagacaga

SEQ ID NO: 249452 - DNA, 15 bp, Homo sapiens
tcactcaacagacag

SEQ ID NO: 249453 - DNA, 15 bp, Homo sapiens
atcactcaacagaca

SEQ ID NO: 249454 - DNA, 15 bp, Homo sapiens
aatcactcaacagac

SEQ ID NO: 249455 - DNA, 15 bp, Homo sapiens
aaatcactcaacaga

SEQ ID NO: 249456 - DNA, 15 bp, Homo sapiens
aaaatcactcaacag

SEQ ID NO: 249457 - DNA, 15 bp, Homo sapiens
gaaaatcactcaaca

SEQ ID NO: 249458 - DNA, 15 bp, Homo sapiens
agaaaatcactcaac

SEQ ID NO: 249459 - DNA, 15 bp, Homo sapiens
gagaaaatcactcaa

SEQ ID NO: 249460 - DNA, 15 bp, Homo sapiens
ggagaaaatcactca

SEQ ID NO: 249461 - DNA, 15 bp, Homo sapiens
tggagaaaatcactc

SEQ ID NO: 249462 - DNA, 15 bp, Homo sapiens
ctggagaaaatcact

SEQ ID NO: 249463 - DNA, 15 bp, Homo sapiens
actggagaaaatcac

SEQ ID NO: 249464 - DNA, 15 bp, Homo sapiens
aactggagaaaatca

SEQ ID NO: 249465 - DNA, 15 bp, Homo sapiens
caactggagaaaatc

SEQ ID NO: 249466 - DNA, 15 bp, Homo sapiens
acaactggagaaaat

SEQ ID NO: 249467 - DNA, 15 bp, Homo sapiens
aacaactggagaaaa

SEQ ID NO: 249468 - DNA, 15 bp, Homo sapiens
aaacaactggagaaa

SEQ ID NO: 249469 - DNA, 15 bp, Homo sapiens
aaaacaactggagaa

SEQ ID NO: 249470 - DNA, 15 bp, Homo sapiens
aaaaacaactggaga

SEQ ID NO: 249471 - DNA, 15 bp, Homo sapiens
taaaaacaactggag

SEQ ID NO: 249472 - DNA, 15 bp, Homo sapiens
ataaaaacaactgga

SEQ ID NO: 249473 - DNA, 15 bp, Homo sapiens
gataaaaacaactgg

SEQ ID NO: 249474 - DNA, 15 bp, Homo sapiens
ggataaaaacaactg

SEQ ID NO: 249475 - DNA, 15 bp, Homo sapiens
tggataaaaacaact

SEQ ID NO: 249476 - DNA, 15 bp, Homo sapiens
gtggataaaaacaac

SEQ ID NO: 249477 - DNA, 15 bp, Homo sapiens
tgtggataaaaacaa

SEQ ID NO: 249478 - DNA, 15 bp, Homo sapiens
ctgtggataaaaaca

SEQ ID NO: 249479 - DNA, 15 bp, Homo sapiens
gctgtggataaaaac

SEQ ID NO: 249480 - DNA, 15 bp, Homo sapiens
agctgtggataaaaa

SEQ ID NO: 249481 - DNA, 15 bp, Homo sapiens
cagctgtggataaaa

SEQ ID NO: 249482 - DNA, 15 bp, Homo sapiens
gcagctgtggataaa

SEQ ID NO: 249483 - DNA, 15 bp, Homo sapiens
agcagctgtggataa

SEQ ID NO: 249484 - DNA, 15 bp, Homo sapiens
gagcagctgtggata

SEQ ID NO: 249485 - DNA, 15 bp, Homo sapiens
tgagcagctgtggat

SEQ ID NO: 249486 - DNA, 15 bp, Homo sapiens
ctgagcagctgtgga

SEQ ID NO: 249487 - DNA, 15 bp, Homo sapiens
cctgagcagctgtgg

SEQ ID NO: 249488 - DNA, 15 bp, Homo sapiens
acctgagcagctgtg

SEQ ID NO: 249489 - DNA, 15 bp, Homo sapiens
gacctgagcagctgt

SEQ ID NO: 249490 - DNA, 15 bp, Homo sapiens
ggacctgagcagctg

SEQ ID NO: 249491 - DNA, 15 bp, Homo sapiens
tggacctgagcagct

SEQ ID NO: 249492 - DNA, 15 bp, Homo sapiens
ctggacctgagcagc

SEQ ID NO: 249493 - DNA, 15 bp, Homo sapiens
tctggacctgagcag

SEQ ID NO: 249494 - DNA, 15 bp, Homo sapiens
ctctggacctgagca

SEQ ID NO: 249495 - DNA, 15 bp, Homo sapiens
actctggacctgagc

SEQ ID NO: 249496 - DNA, 15 bp, Homo sapiens
tactctggacctgag

SEQ ID NO: 249497 - DNA, 15 bp, Homo sapiens
ctactctggacctga

SEQ ID NO: 249498 - DNA, 15 bp, Homo sapiens
cctactctggacctg

SEQ ID NO: 249499 - DNA, 15 bp, Homo sapiens
gcctactctggacct

SEQ ID NO: 249500 - DNA, 15 bp, Homo sapiens
tgcctactctggacc

SEQ ID NO: 249501 - DNA, 15 bp, Homo sapiens
ttgcctactctggac

SEQ ID NO: 249502 - DNA, 15 bp, Homo sapiens
cttgcctactctgga

SEQ ID NO: 249503 - DNA, 15 bp, Homo sapiens
acttgcctactctgg

SEQ ID NO: 249504 - DNA, 15 bp, Homo sapiens
tacttgcctactctg

SEQ ID NO: 249505 - DNA, 15 bp, Homo sapiens
ttacttgcctactct

SEQ ID NO: 249506 - DNA, 15 bp, Homo sapiens
attacttgcctactc

SEQ ID NO: 249507 - DNA, 15 bp, Homo sapiens
aattacttgcctact

SEQ ID NO: 249508 - DNA, 15 bp, Homo sapiens
caattacttgcctac

SEQ ID NO: 249509 - DNA, 15 bp, Homo sapiens
tcaattacttgccta

SEQ ID NO: 249510 - DNA, 15 bp, Homo sapiens
ctcaattacttgcct

SEQ ID NO: 249511 - DNA, 15 bp, Homo sapiens
gctcaattacttgcc

SEQ ID NO: 249512 - DNA, 15 bp, Homo sapiens
agctcaattacttgc

SEQ ID NO: 249513 - DNA, 15 bp, Homo sapiens
cagctcaattacttg

SEQ ID NO: 249514 - DNA, 15 bp, Homo sapiens
tcagctcaattactt

SEQ ID NO: 249515 - DNA, 15 bp, Homo sapiens
atcagctcaattact

SEQ ID NO: 249516 - DNA, 15 bp, Homo sapiens
gatcagctcaattac

SEQ ID NO: 249517 - DNA, 15 bp, Homo sapiens
ggatcagctcaatta

SEQ ID NO: 249518 - DNA, 15 bp, Homo sapiens
tggatcagctcaatt

SEQ ID NO: 249519 - DNA, 15 bp, Homo sapiens
ctggatcagctcaat

SEQ ID NO: 249520 - DNA, 15 bp, Homo sapiens
cctggatcagctcaa

SEQ ID NO: 249521 - DNA, 15 bp, Homo sapiens
gcctggatcagctca

SEQ ID NO: 249522 - DNA, 15 bp, Homo sapiens
ggcctggatcagctc

SEQ ID NO: 249523 - DNA, 15 bp, Homo sapiens
aggcctggatcagct

SEQ ID NO: 249524 - DNA, 15 bp, Homo sapiens
caggcctggatcagc

SEQ ID NO: 249525 - DNA, 15 bp, Homo sapiens
ccaggcctggatcag

SEQ ID NO: 249526 - DNA, 15 bp, Homo sapiens
cccaggcctggatca

SEQ ID NO: 249527 - DNA, 15 bp, Homo sapiens
tcccaggcctggatc

SEQ ID NO: 249528 - DNA, 15 bp, Homo sapiens
atcccaggcctggat

SEQ ID NO: 249529 - DNA, 15 bp, Homo sapiens
aatcccaggcctgga

SEQ ID NO: 249530 - DNA, 15 bp, Homo sapiens
aaatcccaggcctgg

SEQ ID NO: 249531 - DNA, 15 bp, Homo sapiens
caaatcccaggcctg

SEQ ID NO: 249532 - DNA, 15 bp, Homo sapiens
gcaaatcccaggcct

SEQ ID NO: 249533 - DNA, 15 bp, Homo sapiens
tgcaaatcccaggcc

SEQ ID NO: 249534 - DNA, 15 bp, Homo sapiens
ttgcaaatcccaggc

SEQ ID NO: 249535 - DNA, 15 bp, Homo sapiens
cttgcaaatcccagg

SEQ ID NO: 249536 - DNA, 15 bp, Homo sapiens
ccttgcaaatcccag

SEQ ID NO: 249537 - DNA, 15 bp, Homo sapiens
cccttgcaaatccca

SEQ ID NO: 249538 - DNA, 15 bp, Homo sapiens
ccccttgcaaatccc

SEQ ID NO: 249539 - DNA, 15 bp, Homo sapiens
accccttgcaaatcc

SEQ ID NO: 249540 - DNA, 15 bp, Homo sapiens
caccccttgcaaatc

SEQ ID NO: 249541 - DNA, 15 bp, Homo sapiens
tcaccccttgcaaat

SEQ ID NO: 249542 - DNA, 15 bp, Homo sapiens
ctcaccccttgcaaa

SEQ ID NO: 249543 - DNA, 15 bp, Homo sapiens
tctcaccccttgcaa

SEQ ID NO: 249544 - DNA, 15 bp, Homo sapiens
ctctcaccccttgca

SEQ ID NO: 249545 - DNA, 15 bp, Homo sapiens
tctctcaccccttgc

SEQ ID NO: 249546 - DNA, 15 bp, Homo sapiens
ctctctcaccccttg

SEQ ID NO: 249547 - DNA, 15 bp, Homo sapiens
tctctctcacccctt

SEQ ID NO: 249548 - DNA, 15 bp, Homo sapiens
ttctctctcacccct

SEQ ID NO: 249549 - DNA, 15 bp, Homo sapiens
cttctctctcacccc

SEQ ID NO: 249550 - DNA, 15 bp, Homo sapiens
gcttctctctcaccc

SEQ ID NO: 249551 - DNA, 15 bp, Homo sapiens
tgcttctctctcacc

SEQ ID NO: 249552 - DNA, 15 bp, Homo sapiens
ttgcttctctctcac

SEQ ID NO: 249553 - DNA, 15 bp, Homo sapiens
cttgcttctctctca

SEQ ID NO: 249554 - DNA, 15 bp, Homo sapiens
ccttgcttctctctc

SEQ ID NO: 249555 - DNA, 15 bp, Homo sapiens
cccttgcttctctct

SEQ ID NO: 249556 - DNA, 15 bp, Homo sapiens
tcccttgcttctctc

SEQ ID NO: 249557 - DNA, 15 bp, Homo sapiens
ctcccttgcttctct

SEQ ID NO: 249558 - DNA, 15 bp, Homo sapiens
tctcccttgcttctc

SEQ ID NO: 249559 - DNA, 15 bp, Homo sapiens
atctcccttgcttct

SEQ ID NO: 249560 - DNA, 15 bp, Homo sapiens
catctcccttgcttc

SEQ ID NO: 249561 - DNA, 15 bp, Homo sapiens
tcatctcccttgctt

SEQ ID NO: 249562 - DNA, 15 bp, Homo sapiens
ctcatctcccttgct

SEQ ID NO: 249563 - DNA, 15 bp, Homo sapiens
cctcatctcccttgc

SEQ ID NO: 249564 - DNA, 15 bp, Homo sapiens
acctcatctcccttg

SEQ ID NO: 249565 - DNA, 15 bp, Homo sapiens
aacctcatctccctt

SEQ ID NO: 249566 - DNA, 15 bp, Homo sapiens
taacctcatctccct

SEQ ID NO: 249567 - DNA, 15 bp, Homo sapiens
ataacctcatctccc

SEQ ID NO: 249568 - DNA, 15 bp, Homo sapiens
aataacctcatctcc

SEQ ID NO: 249569 - DNA, 15 bp, Homo sapiens
aaataacctcatctc

SEQ ID NO: 249570 - DNA, 15 bp, Homo sapiens
caaataacctcatct

SEQ ID NO: 249571 - DNA, 15 bp, Homo sapiens
acaaataacctcatc

SEQ ID NO: 249572 - DNA, 15 bp, Homo sapiens
tacaaataacctcat

SEQ ID NO: 249573 - DNA, 15 bp, Homo sapiens
ttacaaataacctca

SEQ ID NO: 249574 - DNA, 15 bp, Homo sapiens
attacaaataacctc

SEQ ID NO: 249575 - DNA, 15 bp, Homo sapiens
cattacaaataacct

SEQ ID NO: 249576 - DNA, 15 bp, Homo sapiens
tcattacaaataacc

SEQ ID NO: 249577 - DNA, 15 bp, Homo sapiens
atcattacaaataac

SEQ ID NO: 249578 - DNA, 15 bp, Homo sapiens
aatcattacaaataa

SEQ ID NO: 249579 - DNA, 15 bp, Homo sapiens
gaatcattacaaata

SEQ ID NO: 249580 - DNA, 15 bp, Homo sapiens
agaatcattacaaat

SEQ ID NO: 249581 - DNA, 15 bp, Homo sapiens
tagaatcattacaaa

SEQ ID NO: 249582 - DNA, 15 bp, Homo sapiens
ttagaatcattacaa

SEQ ID NO: 249583 - DNA, 15 bp, Homo sapiens
attagaatcattaca

SEQ ID NO: 249584 - DNA, 15 bp, Homo sapiens
cattagaatcattac

SEQ ID NO: 249585 - DNA, 15 bp, Homo sapiens
tcattagaatcatta

SEQ ID NO: 249586 - DNA, 15 bp, Homo sapiens
atcattagaatcatt

SEQ ID NO: 249587 - DNA, 15 bp, Homo sapiens
tatcattagaatcat

SEQ ID NO: 249588 - DNA, 15 bp, Homo sapiens
ctatcattagaatca

SEQ ID NO: 249589 - DNA, 15 bp, Homo sapiens
tctatcattagaatc

SEQ ID NO: 249590 - DNA, 15 bp, Homo sapiens
gtctatcattagaat

SEQ ID NO: 249591 - DNA, 15 bp, Homo sapiens
ggtctatcattagaa

SEQ ID NO: 249592 - DNA, 15 bp, Homo sapiens
tggtctatcattaga

SEQ ID NO: 249593 - DNA, 15 bp, Homo sapiens
atggtctatcattag

SEQ ID NO: 249594 - DNA, 15 bp, Homo sapiens
catggtctatcatta

SEQ ID NO: 249595 - DNA, 15 bp, Homo sapiens
ccatggtctatcatt

SEQ ID NO: 249596 - DNA, 15 bp, Homo sapiens
tccatggtctatcat

SEQ ID NO: 249597 - DNA, 15 bp, Homo sapiens
gtccatggtctatca

SEQ ID NO: 249598 - DNA, 15 bp, Homo sapiens
agtccatggtctatc

SEQ ID NO: 249599 - DNA, 15 bp, Homo sapiens
gagtccatggtctat

SEQ ID NO: 249600 - DNA, 15 bp, Homo sapiens
tgagtccatggtcta

SEQ ID NO: 249601 - DNA, 15 bp, Homo sapiens
ttgagtccatggtct

SEQ ID NO: 249602 - DNA, 15 bp, Homo sapiens
tttgagtccatggtc

SEQ ID NO: 249603 - DNA, 15 bp, Homo sapiens
atttgagtccatggt

SEQ ID NO: 249604 - DNA, 15 bp, Homo sapiens
aatttgagtccatgg

SEQ ID NO: 249605 - DNA, 15 bp, Homo sapiens
aaatttgagtccatg

SEQ ID NO: 249606 - DNA, 15 bp, Homo sapiens
caaatttgagtccat

SEQ ID NO: 249607 - DNA, 15 bp, Homo sapiens
ccaaatttgagtcca

SEQ ID NO: 249608 - DNA, 15 bp, Homo sapiens
tccaaatttgagtcc

SEQ ID NO: 249609 - DNA, 15 bp, Homo sapiens
gtccaaatttgagtc

SEQ ID NO: 249610 - DNA, 15 bp, Homo sapiens
tgtccaaatttgagt

SEQ ID NO: 249611 - DNA, 15 bp, Homo sapiens
ctgtccaaatttgag

SEQ ID NO: 249612 - DNA, 15 bp, Homo sapiens
tctgtccaaatttga

SEQ ID NO: 249613 - DNA, 15 bp, Homo sapiens
atctgtccaaatttg

SEQ ID NO: 249614 - DNA, 15 bp, Homo sapiens
aatctgtccaaattt

SEQ ID NO: 249615 - DNA, 15 bp, Homo sapiens
gaatctgtccaaatt

SEQ ID NO: 249616 - DNA, 15 bp, Homo sapiens
tgaatctgtccaaat

SEQ ID NO: 249617 - DNA, 15 bp, Homo sapiens
atgaatctgtccaaa

SEQ ID NO: 249618 - DNA, 15 bp, Homo sapiens
gatgaatctgtccaa

SEQ ID NO: 249619 - DNA, 15 bp, Homo sapiens
tgatgaatctgtcca

SEQ ID NO: 249620 - DNA, 15 bp, Homo sapiens
ttgatgaatctgtcc

SEQ ID NO: 249621 - DNA, 15 bp, Homo sapiens
cttgatgaatctgtc

SEQ ID NO: 249622 - DNA, 15 bp, Homo sapiens
tcttgatgaatctgt

SEQ ID NO: 249623 - DNA, 15 bp, Homo sapiens
ttcttgatgaatctg

SEQ ID NO: 249624 - DNA, 15 bp, Homo sapiens
tttcttgatgaatct

SEQ ID NO: 249625 - DNA, 15 bp, Homo sapiens
atttcttgatgaatc

SEQ ID NO: 249626 - DNA, 15 bp, Homo sapiens
tatttcttgatgaat

SEQ ID NO: 249627 - DNA, 15 bp, Homo sapiens
atatttcttgatgaa

SEQ ID NO: 249628 - DNA, 15 bp, Homo sapiens
aatatttcttgatga

SEQ ID NO: 249629 - DNA, 15 bp, Homo sapiens
aaatatttcttgatg

SEQ ID NO: 249630 - DNA, 15 bp, Homo sapiens
aaaatatttcttgat

SEQ ID NO: 249631 - DNA, 15 bp, Homo sapiens
taaaatatttcttga

SEQ ID NO: 249632 - DNA, 15 bp, Homo sapiens
ttaaaatatttcttg

SEQ ID NO: 249633 - DNA, 15 bp, Homo sapiens
gttttaaaatatttc

SEQ ID NO: 249634 - DNA, 15 bp, Homo sapiens
ggttttaaaatattt

SEQ ID NO: 249635 - DNA, 15 bp, Homo sapiens
aggttttaaaatatt

SEQ ID NO: 249636 - DNA, 15 bp, Homo sapiens
aaggttttaaaatat

SEQ ID NO: 249637 - DNA, 15 bp, Homo sapiens
taaggttttaaaata

SEQ ID NO: 249638 - DNA, 15 bp, Homo sapiens
ttaaggttttaaaat

SEQ ID NO: 249639 - DNA, 15 bp, Homo sapiens
attaaggttttaaaa

SEQ ID NO: 249640 - DNA, 15 bp, Homo sapiens
aattaaggttttaaa

SEQ ID NO: 249641 - DNA, 15 bp, Homo sapiens
taattaaggttttaa

SEQ ID NO: 249642 - DNA, 15 bp, Homo sapiens
ataattaaggtttta

SEQ ID NO: 249643 - DNA, 15 bp, Homo sapiens
cataattaaggtttt

SEQ ID NO: 249644 - DNA, 15 bp, Homo sapiens
gcataattaaggttt

SEQ ID NO: 249645 - DNA, 15 bp, Homo sapiens
tgcataattaaggtt

SEQ ID NO: 249646 - DNA, 15 bp, Homo sapiens
ttgcataattaaggt

SEQ ID NO: 249647 - DNA, 15 bp, Homo sapiens
tttgcataattaagg

SEQ ID NO: 249648 - DNA, 15 bp, Homo sapiens
atttgcataattaag

SEQ ID NO: 249649 - DNA, 15 bp, Homo sapiens
tatttgcataattaa

SEQ ID NO: 249650 - DNA, 15 bp, Homo sapiens
atatttgcataatta

SEQ ID NO: 249651 - DNA, 15 bp, Homo sapiens
tatatttgcataatt

SEQ ID NO: 249652 - DNA, 15 bp, Homo sapiens
gtatatttgcataat

SEQ ID NO: 249653 - DNA, 15 bp, Homo sapiens
agtatatttgcataa

SEQ ID NO: 249654 - DNA, 15 bp, Homo sapiens
aagtatatttgcata

SEQ ID NO: 249655 - DNA, 15 bp, Homo sapiens
gaagtatatttgcat

SEQ ID NO: 249656 - DNA, 15 bp, Homo sapiens
ggaagtatatttgca

SEQ ID NO: 249657 - DNA, 15 bp, Homo sapiens
tggaagtatatttgc

SEQ ID NO: 249658 - DNA, 15 bp, Homo sapiens
atggaagtatatttg

SEQ ID NO: 249659 - DNA, 15 bp, Homo sapiens
tatggaagtatattt

SEQ ID NO: 249660 - DNA, 15 bp, Homo sapiens
atatggaagtatatt

SEQ ID NO: 249661 - DNA, 15 bp, Homo sapiens
gatatggaagtatat

SEQ ID NO: 249662 - DNA, 15 bp, Homo sapiens
tgatatggaagtata

SEQ ID NO: 249663 - DNA, 15 bp, Homo sapiens
ttgatatggaagtat

SEQ ID NO: 249664 - DNA, 15 bp, Homo sapiens
cttgatatggaagta

SEQ ID NO: 249665 - DNA, 15 bp, Homo sapiens
tcttgatatggaagt

SEQ ID NO: 249666 - DNA, 15 bp, Homo sapiens
ctcttgatatggaag

SEQ ID NO: 249667 - DNA, 15 bp, Homo sapiens
gctcttgatatggaa

SEQ ID NO: 249668 - DNA, 15 bp, Homo sapiens
agctcttgatatgga

SEQ ID NO: 249669 - DNA, 15 bp, Homo sapiens
aagctcttgatatgg

SEQ ID NO: 249670 - DNA, 15 bp, Homo sapiens
taagctcttgatatg

SEQ ID NO: 249671 - DNA, 15 bp, Homo sapiens
ctaagctcttgatat

SEQ ID NO: 249672 - DNA, 15 bp, Homo sapiens
gctaagctcttgata

SEQ ID NO: 249673 - DNA, 15 bp, Homo sapiens
agctaagctcttgat

SEQ ID NO: 249674 - DNA, 15 bp, Homo sapiens
aagctaagctcttga

SEQ ID NO: 249675 - DNA, 15 bp, Homo sapiens
taagctaagctcttg

SEQ ID NO: 249676 - DNA, 15 bp, Homo sapiens
ttaagctaagctctt

SEQ ID NO: 249677 - DNA, 15 bp, Homo sapiens
tttaagctaagctct

SEQ ID NO: 249678 - DNA, 15 bp, Homo sapiens
ttttaagctaagctc

SEQ ID NO: 249679 - DNA, 15 bp, Homo sapiens
attttaagctaagct

SEQ ID NO: 249680 - DNA, 15 bp, Homo sapiens
cattttaagctaagc

SEQ ID NO: 249681 - DNA, 15 bp, Homo sapiens
tcattttaagctaag

SEQ ID NO: 249682 - DNA, 15 bp, Homo sapiens
ctcattttaagctaa

SEQ ID NO: 249683 - DNA, 15 bp, Homo sapiens
tctcattttaagcta

SEQ ID NO: 249684 - DNA, 15 bp, Homo sapiens
gtctcattttaagct

SEQ ID NO: 249685 - DNA, 15 bp, Homo sapiens
agtctcattttaagc

SEQ ID NO: 249686 - DNA, 15 bp, Homo sapiens
tagtctcattttaag

SEQ ID NO: 249687 - DNA, 15 bp, Homo sapiens
atagtctcattttaa

SEQ ID NO: 249688 - DNA, 15 bp, Homo sapiens
gatagtctcatttta

SEQ ID NO: 249689 - DNA, 15 bp, Homo sapiens
agatagtctcatttt

SEQ ID NO: 249690 - DNA, 15 bp, Homo sapiens
gagatagtctcattt

SEQ ID NO: 249691 - DNA, 15 bp, Homo sapiens
agagatagtctcatt

SEQ ID NO: 249692 - DNA, 15 bp, Homo sapiens
cagagatagtctcat

SEQ ID NO: 249693 - DNA, 15 bp, Homo sapiens
acagagatagtctca

SEQ ID NO: 249694 - DNA, 15 bp, Homo sapiens
aacagagatagtctc

SEQ ID NO: 249695 - DNA, 15 bp, Homo sapiens
aaacagagatagtct

SEQ ID NO: 249696 - DNA, 15 bp, Homo sapiens
taaacagagatagtc

SEQ ID NO: 249697 - DNA, 15 bp, Homo sapiens
ttaaacagagatagt

SEQ ID NO: 249698 - DNA, 15 bp, Homo sapiens
tttaaacagagatag

SEQ ID NO: 249699 - DNA, 15 bp, Homo sapiens
atttaaacagagata

SEQ ID NO: 249700 - DNA, 15 bp, Homo sapiens
gatttaaacagagat

SEQ ID NO: 249701 - DNA, 15 bp, Homo sapiens
ggatttaaacagaga

SEQ ID NO: 249702 - DNA, 15 bp, Homo sapiens
gggatttaaacagag

SEQ ID NO: 249703 - DNA, 15 bp, Homo sapiens
tgggatttaaacaga

SEQ ID NO: 249704 - DNA, 15 bp, Homo sapiens
atgggatttaaacag

SEQ ID NO: 249705 - DNA, 15 bp, Homo sapiens
aatgggatttaaaca

SEQ ID NO: 249706 - DNA, 15 bp, Homo sapiens
aaatgggatttaaac

SEQ ID NO: 249707 - DNA, 15 bp, Homo sapiens
gaaatgggatttaaa

SEQ ID NO: 249708 - DNA, 15 bp, Homo sapiens
agaaatgggatttaa

SEQ ID NO: 249709 - DNA, 15 bp, Homo sapiens
tagaaatgggattta

SEQ ID NO: 249710 - DNA, 15 bp, Homo sapiens
atagaaatgggattt

SEQ ID NO: 249711 - DNA, 15 bp, Homo sapiens
aatagaaatgggatt

SEQ ID NO: 249712 - DNA, 15 bp, Homo sapiens
taatagaaatgggat

SEQ ID NO: 249713 - DNA, 15 bp, Homo sapiens
gtaatagaaatggga

SEQ ID NO: 249714 - DNA, 15 bp, Homo sapiens
agtaatagaaatggg

SEQ ID NO: 249715 - DNA, 15 bp, Homo sapiens
aagtaatagaaatgg

SEQ ID NO: 249716 - DNA, 15 bp, Homo sapiens
taagtaatagaaatg

SEQ ID NO: 249717 - DNA, 15 bp, Homo sapiens
gtaagtaatagaaat

SEQ ID NO: 249718 - DNA, 15 bp, Homo sapiens
tagtaagtaatagaa

SEQ ID NO: 249719 - DNA, 15 bp, Homo sapiens
atagtaagtaataga

SEQ ID NO: 249720 - DNA, 15 bp, Homo sapiens
tatagtaagtaatag

SEQ ID NO: 249721 - DNA, 15 bp, Homo sapiens
ctatagtaagtaata

SEQ ID NO: 249722 - DNA, 15 bp, Homo sapiens
cctatagtaagtaat

SEQ ID NO: 249723 - DNA, 15 bp, Homo sapiens
tcctatagtaagtaa

SEQ ID NO: 249724 - DNA, 15 bp, Homo sapiens
gtcctatagtaagta

SEQ ID NO: 249725 - DNA, 15 bp, Homo sapiens
ggtcctatagtaagt

SEQ ID NO: 249726 - DNA, 15 bp, Homo sapiens
aggtcctatagtaag

SEQ ID NO: 249727 - DNA, 15 bp, Homo sapiens
gaggtcctatagtaa

SEQ ID NO: 249728 - DNA, 15 bp, Homo sapiens
tgaggtcctatagta

SEQ ID NO: 249729 - DNA, 15 bp, Homo sapiens
ctgaggtcctatagt

SEQ ID NO: 249730 - DNA, 15 bp, Homo sapiens
tctgaggtcctatag

SEQ ID NO: 249731 - DNA, 15 bp, Homo sapiens
gtctgaggtcctata

SEQ ID NO: 249732 - DNA, 15 bp, Homo sapiens
tgtctgaggtcctat

SEQ ID NO: 249733 - DNA, 15 bp, Homo sapiens
ttgtctgaggtccta

SEQ ID NO: 249734 - DNA, 15 bp, Homo sapiens
cttgtctgaggtcct

SEQ ID NO: 249735 - DNA, 15 bp, Homo sapiens
gcttgtctgaggtcc

SEQ ID NO: 249736 - DNA, 15 bp, Homo sapiens
agcttgtctgaggtc

SEQ ID NO: 249737 - DNA, 15 bp, Homo sapiens
tagcttgtctgaggt

SEQ ID NO: 249738 - DNA, 15 bp, Homo sapiens
atagcttgtctgagg

SEQ ID NO: 249739 - DNA, 15 bp, Homo sapiens
gatagcttgtctgag

SEQ ID NO: 249740 - DNA, 15 bp, Homo sapiens
agatagcttgtctga

SEQ ID NO: 249741 - DNA, 15 bp, Homo sapiens
tagatagcttgtctg

SEQ ID NO: 249742 - DNA, 15 bp, Homo sapiens
ttagatagcttgtct

SEQ ID NO: 249743 - DNA, 15 bp, Homo sapiens
cttagatagcttgtc

SEQ ID NO: 249744 - DNA, 15 bp, Homo sapiens
gcttagatagcttgt

SEQ ID NO: 249745 - DNA, 15 bp, Homo sapiens
tgcttagatagcttg

SEQ ID NO: 249746 - DNA, 15 bp, Homo sapiens
gtgcttagatagctt

SEQ ID NO: 249747 - DNA, 15 bp, Homo sapiens
agtgcttagatagct

SEQ ID NO: 249748 - DNA, 15 bp, Homo sapiens
gagtgcttagatagc

SEQ ID NO: 249749 - DNA, 15 bp, Homo sapiens
agagtgcttagatag

SEQ ID NO: 249750 - DNA, 15 bp, Homo sapiens
gagagtgcttagata

SEQ ID NO: 249751 - DNA, 15 bp, Homo sapiens
agagagtgcttagat

SEQ ID NO: 249752 - DNA, 15 bp, Homo sapiens
cagagagtgcttaga

SEQ ID NO: 249753 - DNA, 15 bp, Homo sapiens
gcagagagtgcttag

SEQ ID NO: 249754 - DNA, 15 bp, Homo sapiens
ggcagagagtgctta

SEQ ID NO: 249755 - DNA, 15 bp, Homo sapiens
gggcagagagtgctt

SEQ ID NO: 249756 - DNA, 15 bp, Homo sapiens
agggcagagagtgct

SEQ ID NO: 249757 - DNA, 15 bp, Homo sapiens
tagggcagagagtgc

SEQ ID NO: 249758 - DNA, 15 bp, Homo sapiens
ctagggcagagagtg

SEQ ID NO: 249759 - DNA, 15 bp, Homo sapiens
actagggcagagagt

SEQ ID NO: 249760 - DNA, 15 bp, Homo sapiens
aactagggcagagag

SEQ ID NO: 249761 - DNA, 15 bp, Homo sapiens
aaactagggcagaga

SEQ ID NO: 249762 - DNA, 15 bp, Homo sapiens
aaaactagggcagag

SEQ ID NO: 249763 - DNA, 15 bp, Homo sapiens
aaaaactagggcaga

SEQ ID NO: 249764 - DNA, 15 bp, Homo sapiens
aaaaaactagggcag

SEQ ID NO: 249765 - DNA, 15 bp, Homo sapiens
gaaaaaactagggca

SEQ ID NO: 249766 - DNA, 15 bp, Homo sapiens
ggaaaaaactagggc

SEQ ID NO: 249767 - DNA, 15 bp, Homo sapiens
tggaaaaaactaggg

SEQ ID NO: 249768 - DNA, 15 bp, Homo sapiens
atggaaaaaactagg

SEQ ID NO: 249769 - DNA, 15 bp, Homo sapiens
gatggaaaaaactag

SEQ ID NO: 249770 - DNA, 15 bp, Homo sapiens
agatggaaaaaacta

SEQ ID NO: 249771 - DNA, 15 bp, Homo sapiens
cagatggaaaaaact

SEQ ID NO: 249772 - DNA, 15 bp, Homo sapiens
acagatggaaaaaac

SEQ ID NO: 249773 - DNA, 15 bp, Homo sapiens
tacagatggaaaaaa

SEQ ID NO: 249774 - DNA, 15 bp, Homo sapiens
ttacagatggaaaaa

SEQ ID NO: 249775 - DNA, 15 bp, Homo sapiens
cttacagatggaaaa

SEQ ID NO: 249776 - DNA, 15 bp, Homo sapiens
tcttacagatggaaa

SEQ ID NO: 249777 - DNA, 15 bp, Homo sapiens
atcttacagatggaa

SEQ ID NO: 249778 - DNA, 15 bp, Homo sapiens
catcttacagatgga

SEQ ID NO: 249779 - DNA, 15 bp, Homo sapiens
ccatcttacagatgg

SEQ ID NO: 249780 - DNA, 15 bp, Homo sapiens
tccatcttacagatg

SEQ ID NO: 249781 - DNA, 15 bp, Homo sapiens
ctccatcttacagat

SEQ ID NO: 249782 - DNA, 15 bp, Homo sapiens
tctccatcttacaga

SEQ ID NO: 249783 - DNA, 15 bp, Homo sapiens
gtctccatcttacag

SEQ ID NO: 249784 - DNA, 15 bp, Homo sapiens
tgtctccatcttaca

SEQ ID NO: 249785 - DNA, 15 bp, Homo sapiens
ttgtctccatcttac

SEQ ID NO: 249786 - DNA, 15 bp, Homo sapiens
attgtctccatctta

SEQ ID NO: 249787 - DNA, 15 bp, Homo sapiens
tattgtctccatctt

SEQ ID NO: 249788 - DNA, 15 bp, Homo sapiens
atattgtctccatct

SEQ ID NO: 249789 - DNA, 15 bp, Homo sapiens
aatattgtctccatc

SEQ ID NO: 249790 - DNA, 15 bp, Homo sapiens
caatattgtctccat

SEQ ID NO: 249791 - DNA, 15 bp, Homo sapiens
acaatattgtctcca

SEQ ID NO: 249792 - DNA, 15 bp, Homo sapiens
gacaatattgtctcc

SEQ ID NO: 249793 - DNA, 15 bp, Homo sapiens
tgacaatattgtctc

SEQ ID NO: 249794 - DNA, 15 bp, Homo sapiens
gtgacaatattgtct

SEQ ID NO: 249795 - DNA, 15 bp, Homo sapiens
ggtgacaatattgtc

SEQ ID NO: 249796 - DNA, 15 bp, Homo sapiens
gggtgacaatattgt

SEQ ID NO: 249797 - DNA, 15 bp, Homo sapiens
tgggtgacaatattg

SEQ ID NO: 249798 - DNA, 15 bp, Homo sapiens
ttgggtgacaatatt

SEQ ID NO: 249799 - DNA, 15 bp, Homo sapiens
cttgggtgacaatat

SEQ ID NO: 249800 - DNA, 15 bp, Homo sapiens
acttgggtgacaata

SEQ ID NO: 249801 - DNA, 15 bp, Homo sapiens
gacttgggtgacaat

SEQ ID NO: 249802 - DNA, 15 bp, Homo sapiens
tgacttgggtgacaa

SEQ ID NO: 249803 - DNA, 15 bp, Homo sapiens
atgacttgggtgaca

SEQ ID NO: 249804 - DNA, 15 bp, Homo sapiens
tatgacttgggtgac

SEQ ID NO: 249805 - DNA, 15 bp, Homo sapiens
ctatgacttgggtga

SEQ ID NO: 249806 - DNA, 15 bp, Homo sapiens
tctatgacttgggtg

SEQ ID NO: 249807 - DNA, 15 bp, Homo sapiens
ttctatgacttgggt

SEQ ID NO: 249808 - DNA, 15 bp, Homo sapiens
attctatgacttggg

SEQ ID NO: 249809 - DNA, 15 bp, Homo sapiens
aattctatgacttgg

SEQ ID NO: 249810 - DNA, 15 bp, Homo sapiens
caattctatgacttg

SEQ ID NO: 249811 - DNA, 15 bp, Homo sapiens
acaattctatgactt

SEQ ID NO: 249812 - DNA, 15 bp, Homo sapiens
tacaattctatgact

SEQ ID NO: 249813 - DNA, 15 bp, Homo sapiens
ttacaattctatgac

SEQ ID NO: 249814 - DNA, 15 bp, Homo sapiens
attacaattctatga

SEQ ID NO: 249815 - DNA, 15 bp, Homo sapiens
gattacaattctatg

SEQ ID NO: 249816 - DNA, 15 bp, Homo sapiens
ggattacaattctat

SEQ ID NO: 249817 - DNA, 15 bp, Homo sapiens
tggattacaattcta

SEQ ID NO: 249818 - DNA, 15 bp, Homo sapiens
ttggattacaattct

SEQ ID NO: 249819 - DNA, 15 bp, Homo sapiens
tttggattacaattc

SEQ ID NO: 249820 - DNA, 15 bp, Homo sapiens
atttggattacaatt

SEQ ID NO: 249821 - DNA, 15 bp, Homo sapiens
tatttggattacaat

SEQ ID NO: 249822 - DNA, 15 bp, Homo sapiens
ctatttggattacaa

SEQ ID NO: 249823 - DNA, 15 bp, Homo sapiens
tctatttggattaca

SEQ ID NO: 249824 - DNA, 15 bp, Homo sapiens
ttctatttggattac

SEQ ID NO: 249825 - DNA, 15 bp, Homo sapiens
attctatttggatta

SEQ ID NO: 249826 - DNA, 15 bp, Homo sapiens
aattctatttggatt

SEQ ID NO: 249827 - DNA, 15 bp, Homo sapiens
aaattctatttggat

SEQ ID NO: 249828 - DNA, 15 bp, Homo sapiens
taaattctatttgga

SEQ ID NO: 249829 - DNA, 15 bp, Homo sapiens
gtaaattctatttgg

SEQ ID NO: 249830 - DNA, 15 bp, Homo sapiens
tgtaaattctatttg

SEQ ID NO: 249831 - DNA, 15 bp, Homo sapiens
gtgtaaattctattt

SEQ ID NO: 249832 - DNA, 15 bp, Homo sapiens
tgtgtaaattctatt

SEQ ID NO: 249833 - DNA, 15 bp, Homo sapiens
atgtgtaaattctat

SEQ ID NO: 249834 - DNA, 15 bp, Homo sapiens
tatgtgtaaattcta

SEQ ID NO: 249835 - DNA, 15 bp, Homo sapiens
ctatgtgtaaattct

SEQ ID NO: 249836 - DNA, 15 bp, Homo sapiens
tctatgtgtaaattc

SEQ ID NO: 249837 - DNA, 15 bp, Homo sapiens
ttctatgtgtaaatt

SEQ ID NO: 249838 - DNA, 15 bp, Homo sapiens
tttctatgtgtaaat

SEQ ID NO: 249839 - DNA, 15 bp, Homo sapiens
ttttctatgtgtaaa

SEQ ID NO: 249840 - DNA, 15 bp, Homo sapiens
tttttctatgtgtaa

SEQ ID NO: 249841 - DNA, 15 bp, Homo sapiens
ctttttctatgtgta

SEQ ID NO: 249842 - DNA, 15 bp, Homo sapiens
actttttctatgtgt

SEQ ID NO: 249843 - DNA, 15 bp, Homo sapiens
aactttttctatgtg

SEQ ID NO: 249844 - DNA, 15 bp, Homo sapiens
aaactttttctatgt

SEQ ID NO: 249845 - DNA, 15 bp, Homo sapiens
taaactttttctatg

SEQ ID NO: 249846 - DNA, 15 bp, Homo sapiens
ataaactttttctat

SEQ ID NO: 249847 - DNA, 15 bp, Homo sapiens
gataaactttttcta

SEQ ID NO: 249848 - DNA, 15 bp, Homo sapiens
ggataaactttttct

SEQ ID NO: 249849 - DNA, 15 bp, Homo sapiens
tggataaactttttc

SEQ ID NO: 249850 - DNA, 15 bp, Homo sapiens
ttggataaacttttt

SEQ ID NO: 249851 - DNA, 15 bp, Homo sapiens
tttggataaactttt

SEQ ID NO: 249852 - DNA, 15 bp, Homo sapiens
ttttggataaacttt

SEQ ID NO: 249853 - DNA, 15 bp, Homo sapiens
tttttggataaactt

SEQ ID NO: 249854 - DNA, 15 bp, Homo sapiens
ttttttggataaact

SEQ ID NO: 249855 - DNA, 15 bp, Homo sapiens
cttttttggataaac

SEQ ID NO: 249856 - DNA, 15 bp, Homo sapiens
acttttttggataaa

SEQ ID NO: 249857 - DNA, 15 bp, Homo sapiens
aacttttttggataa

SEQ ID NO: 249858 - DNA, 15 bp, Homo sapiens
aaacttttttggata

SEQ ID NO: 249859 - DNA, 15 bp, Homo sapiens
taaacttttttggat

SEQ ID NO: 249860 - DNA, 15 bp, Homo sapiens
gtaaacttttttgga

SEQ ID NO: 249861 - DNA, 15 bp, Homo sapiens
agtaaacttttttgg

SEQ ID NO: 249862 - DNA, 15 bp, Homo sapiens
aagtaaacttttttg

SEQ ID NO: 249863 - DNA, 15 bp, Homo sapiens
caagtaaactttttt

SEQ ID NO: 249864 - DNA, 15 bp, Homo sapiens
ccaagtaaacttttt

SEQ ID NO: 249865 - DNA, 15 bp, Homo sapiens
accaagtaaactttt

SEQ ID NO: 249866 - DNA, 15 bp, Homo sapiens
taccaagtaaacttt

SEQ ID NO: 249867 - DNA, 15 bp, Homo sapiens
gtaccaagtaaactt

SEQ ID NO: 249868 - DNA, 15 bp, Homo sapiens
tgtaccaagtaaact

SEQ ID NO: 249869 - DNA, 15 bp, Homo sapiens
ttgtaccaagtaaac

SEQ ID NO: 249870 - DNA, 15 bp, Homo sapiens
tttgtaccaagtaaa

SEQ ID NO: 249871 - DNA, 15 bp, Homo sapiens
atttgtaccaagtaa

SEQ ID NO: 249872 - DNA, 15 bp, Homo sapiens
gatttgtaccaagta

SEQ ID NO: 249873 - DNA, 15 bp, Homo sapiens
cgatttgtaccaagt

SEQ ID NO: 249874 - DNA, 15 bp, Homo sapiens
tcgatttgtaccaag

SEQ ID NO: 249875 - DNA, 15 bp, Homo sapiens
ctcgatttgtaccaa

SEQ ID NO: 249876 - DNA, 15 bp, Homo sapiens
gctcgatttgtacca

SEQ ID NO: 249877 - DNA, 15 bp, Homo sapiens
tgctcgatttgtacc

SEQ ID NO: 249878 - DNA, 15 bp, Homo sapiens
gtgctcgatttgtac

SEQ ID NO: 249879 - DNA, 15 bp, Homo sapiens
agtgctcgatttgta

SEQ ID NO: 249880 - DNA, 15 bp, Homo sapiens
gagtgctcgatttgt

SEQ ID NO: 249881 - DNA, 15 bp, Homo sapiens
tgagtgctcgatttg

SEQ ID NO: 249882 - DNA, 15 bp, Homo sapiens
ttgagtgctcgattt

SEQ ID NO: 249883 - DNA, 15 bp, Homo sapiens
tttgagtgctcgatt

SEQ ID NO: 249884 - DNA, 15 bp, Homo sapiens
atttgagtgctcgat

SEQ ID NO: 249885 - DNA, 15 bp, Homo sapiens
tatttgagtgctcga

SEQ ID NO: 249886 - DNA, 15 bp, Homo sapiens
ctatttgagtgctcg

SEQ ID NO: 249887 - DNA, 15 bp, Homo sapiens
gctatttgagtgctc

SEQ ID NO: 249888 - DNA, 15 bp, Homo sapiens
tgctatttgagtgct

SEQ ID NO: 249889 - DNA, 15 bp, Homo sapiens
atgctatttgagtgc

SEQ ID NO: 249890 - DNA, 15 bp, Homo sapiens
catgctatttgagtg

SEQ ID NO: 249891 - DNA, 15 bp, Homo sapiens
acatgctatttgagt

SEQ ID NO: 249892 - DNA, 15 bp, Homo sapiens
aacatgctatttgag

SEQ ID NO: 249893 - DNA, 15 bp, Homo sapiens
taacatgctatttga

SEQ ID NO: 249894 - DNA, 15 bp, Homo sapiens
ataacatgctatttg

SEQ ID NO: 249895 - DNA, 15 bp, Homo sapiens
aataacatgctattt

SEQ ID NO: 249896 - DNA, 15 bp, Homo sapiens
taataacatgctatt

SEQ ID NO: 249897 - DNA, 15 bp, Homo sapiens
gtaataacatgctat

SEQ ID NO: 249898 - DNA, 15 bp, Homo sapiens
agtaataacatgcta

SEQ ID NO: 249899 - DNA, 15 bp, Homo sapiens
cagtaataacatgct

SEQ ID NO: 249900 - DNA, 15 bp, Homo sapiens
acagtaataacatgc

SEQ ID NO: 249901 - DNA, 15 bp, Homo sapiens
cacagtaataacatg

SEQ ID NO: 249902 - DNA, 15 bp, Homo sapiens
tcacagtaataacat

SEQ ID NO: 249903 - DNA, 15 bp, Homo sapiens
atcacagtaataaca

SEQ ID NO: 249904 - DNA, 15 bp, Homo sapiens
aatcacagtaataac

SEQ ID NO: 249905 - DNA, 15 bp, Homo sapiens
taatcacagtaataa

SEQ ID NO: 249906 - DNA, 15 bp, Homo sapiens
ttaatcacagtaata

SEQ ID NO: 249907 - DNA, 15 bp, Homo sapiens
attaatcacagtaat

SEQ ID NO: 249908 - DNA, 15 bp, Homo sapiens
tattaatcacagtaa

SEQ ID NO: 249909 - DNA, 15 bp, Homo sapiens
atattaatcacagta

SEQ ID NO: 249910 - DNA, 15 bp, Homo sapiens
tatattaatcacagt

SEQ ID NO: 249911 - DNA, 15 bp, Homo sapiens
gtatattaatcacag

SEQ ID NO: 249912 - DNA, 15 bp, Homo sapiens
tgtatattaatcaca

SEQ ID NO: 249913 - DNA, 15 bp, Homo sapiens
atgtatattaatcac

SEQ ID NO: 249914 - DNA, 15 bp, Homo sapiens
gatgtatattaatca

SEQ ID NO: 249915 - DNA, 15 bp, Homo sapiens
ggatgtatattaatc

SEQ ID NO: 249916 - DNA, 15 bp, Homo sapiens
aggatgtatattaat

SEQ ID NO: 249917 - DNA, 15 bp, Homo sapiens
caggatgtatattaa

SEQ ID NO: 249918 - DNA, 15 bp, Homo sapiens
tcaggatgtatatta

SEQ ID NO: 249919 - DNA, 15 bp, Homo sapiens
gtcaggatgtatatt

SEQ ID NO: 249920 - DNA, 15 bp, Homo sapiens
ggtcaggatgtatat

SEQ ID NO: 249921 - DNA, 15 bp, Homo sapiens
aggtcaggatgtata

SEQ ID NO: 249922 - DNA, 15 bp, Homo sapiens
taggtcaggatgtat

SEQ ID NO: 249923 - DNA, 15 bp, Homo sapiens
ctaggtcaggatgta

SEQ ID NO: 249924 - DNA, 15 bp, Homo sapiens
actaggtcaggatgt

SEQ ID NO: 249925 - DNA, 15 bp, Homo sapiens
tactaggtcaggatg

SEQ ID NO: 249926 - DNA, 15 bp, Homo sapiens
atactaggtcaggat

SEQ ID NO: 249927 - DNA, 15 bp, Homo sapiens
tatactaggtcagga

SEQ ID NO: 249928 - DNA, 15 bp, Homo sapiens
atatactaggtcagg

SEQ ID NO: 249929 - DNA, 15 bp, Homo sapiens
aatatactaggtcag

SEQ ID NO: 249930 - DNA, 15 bp, Homo sapiens
aaatatactaggtca

SEQ ID NO: 249931 - DNA, 15 bp, Homo sapiens
aaaatatactaggtc

SEQ ID NO: 249932 - DNA, 15 bp, Homo sapiens
taaaatatactaggt

SEQ ID NO: 249933 - DNA, 15 bp, Homo sapiens
gtaaaatatactagg

SEQ ID NO: 249934 - DNA, 15 bp, Homo sapiens
agtaaaatatactag

SEQ ID NO: 249935 - DNA, 15 bp, Homo sapiens
aagtaaaatatacta

SEQ ID NO: 249936 - DNA, 15 bp, Homo sapiens
aaagtaaaatatact

SEQ ID NO: 249937 - DNA, 15 bp, Homo sapiens
caaagtaaaatatac

SEQ ID NO: 249938 - DNA, 15 bp, Homo sapiens
gcaaagtaaaatata

SEQ ID NO: 249939 - DNA, 15 bp, Homo sapiens
tgcaaagtaaaatat

SEQ ID NO: 249940 - DNA, 15 bp, Homo sapiens
gtgcaaagtaaaata

SEQ ID NO: 249941 - DNA, 15 bp, Homo sapiens
tgtgcaaagtaaaat

SEQ ID NO: 249942 - DNA, 15 bp, Homo sapiens
ctgtgcaaagtaaaa

SEQ ID NO: 249943 - DNA, 15 bp, Homo sapiens
gctgtgcaaagtaaa

SEQ ID NO: 249944 - DNA, 15 bp, Homo sapiens
tgctgtgcaaagtaa

SEQ ID NO: 249945 - DNA, 15 bp, Homo sapiens
ttgctgtgcaaagta

SEQ ID NO: 249946 - DNA, 15 bp, Homo sapiens
tttgctgtgcaaagt

SEQ ID NO: 249947 - DNA, 15 bp, Homo sapiens
ctttgctgtgcaaag

SEQ ID NO: 249948 - DNA, 15 bp, Homo sapiens
tctttgctgtgcaaa

SEQ ID NO: 249949 - DNA, 15 bp, Homo sapiens
ttctttgctgtgcaa

SEQ ID NO: 249950 - DNA, 15 bp, Homo sapiens
cttctttgctgtgca

SEQ ID NO: 249951 - DNA, 15 bp, Homo sapiens
tcttctttgctgtgc

SEQ ID NO: 249952 - DNA, 15 bp, Homo sapiens
ttcttctttgctgtg

SEQ ID NO: 249953 - DNA, 15 bp, Homo sapiens
tttcttctttgctgt

SEQ ID NO: 249954 - DNA, 15 bp, Homo sapiens
atttcttctttgctg

SEQ ID NO: 249955 - DNA, 15 bp, Homo sapiens
tatttcttctttgct

SEQ ID NO: 249956 - DNA, 15 bp, Homo sapiens
atatttcttctttgc

SEQ ID NO: 249957 - DNA, 15 bp, Homo sapiens
aatatttcttctttg

SEQ ID NO: 249958 - DNA, 15 bp, Homo sapiens
aaatatttcttcttt

SEQ ID NO: 249959 - DNA, 15 bp, Homo sapiens
aaaatatttcttctt

SEQ ID NO: 249960 - DNA, 15 bp, Homo sapiens
aaaaatatttcttct

SEQ ID NO: 249961 - DNA, 15 bp, Homo sapiens
aaaaaatatttcttc

SEQ ID NO: 249962 - DNA, 15 bp, Homo sapiens
aaaaaaatatttctt

SEQ ID NO: 249963 - DNA, 15 bp, Homo sapiens
gaaaaaaatatttct

SEQ ID NO: 249964 - DNA, 15 bp, Homo sapiens
agaaaaaaatatttc

SEQ ID NO: 249965 - DNA, 15 bp, Homo sapiens
aagaaaaaaatattt

SEQ ID NO: 249966 - DNA, 15 bp, Homo sapiens
aaagaaaaaaatatt

SEQ ID NO: 249967 - DNA, 15 bp, Homo sapiens
caaagaaaaaaatat

SEQ ID NO: 249968 - DNA, 15 bp, Homo sapiens
tcaaagaaaaaaata

SEQ ID NO: 249969 - DNA, 15 bp, Homo sapiens
atcaaagaaaaaaat

SEQ ID NO: 249970 - DNA, 15 bp, Homo sapiens
aatcaaagaaaaaaa

SEQ ID NO: 249971 - DNA, 15 bp, Homo sapiens
caatcaaagaaaaaa

SEQ ID NO: 249972 - DNA, 15 bp, Homo sapiens
acaatcaaagaaaaa

SEQ ID NO: 249973 - DNA, 15 bp, Homo sapiens
gacaatcaaagaaaa

SEQ ID NO: 249974 - DNA, 15 bp, Homo sapiens
agacaatcaaagaaa

SEQ ID NO: 249975 - DNA, 15 bp, Homo sapiens
aagacaatcaaagaa

SEQ ID NO: 249976 - DNA, 15 bp, Homo sapiens
taagacaatcaaaga

SEQ ID NO: 249977 - DNA, 15 bp, Homo sapiens
ataagacaatcaaag

SEQ ID NO: 249978 - DNA, 15 bp, Homo sapiens
gataagacaatcaaa

SEQ ID NO: 249979 - DNA, 15 bp, Homo sapiens
agataagacaatcaa

SEQ ID NO: 249980 - DNA, 15 bp, Homo sapiens
gagataagacaatca

SEQ ID NO: 249981 - DNA, 15 bp, Homo sapiens
tgagataagacaatc

SEQ ID NO: 249982 - DNA, 15 bp, Homo sapiens
ctgagataagacaat

SEQ ID NO: 249983 - DNA, 15 bp, Homo sapiens
tctgagataagacaa

SEQ ID NO: 249984 - DNA, 15 bp, Homo sapiens
ctctgagataagaca

SEQ ID NO: 249985 - DNA, 15 bp, Homo sapiens
gctctgagataagac

SEQ ID NO: 249986 - DNA, 15 bp, Homo sapiens
tgctctgagataaga

SEQ ID NO: 249987 - DNA, 15 bp, Homo sapiens
ttgctctgagataag

SEQ ID NO: 249988 - DNA, 15 bp, Homo sapiens
attgctctgagataa

SEQ ID NO: 249989 - DNA, 15 bp, Homo sapiens
tattgctctgagata

SEQ ID NO: 249990 - DNA, 15 bp, Homo sapiens
atattgctctgagat

SEQ ID NO: 249991 - DNA, 15 bp, Homo sapiens
tatattgctctgaga

SEQ ID NO: 249992 - DNA, 15 bp, Homo sapiens
gtatattgctctgag

SEQ ID NO: 249993 - DNA, 15 bp, Homo sapiens
tgtatattgctctga

SEQ ID NO: 249994 - DNA, 15 bp, Homo sapiens
atgtatattgctctg

SEQ ID NO: 249995 - DNA, 15 bp, Homo sapiens
tatgtatattgctct

SEQ ID NO: 249996 - DNA, 15 bp, Homo sapiens
ctatgtatattgctc

SEQ ID NO: 249997 - DNA, 15 bp, Homo sapiens
actatgtatattgct

SEQ ID NO: 249998 - DNA, 15 bp, Homo sapiens
aactatgtatattgc

SEQ ID NO: 249999 - DNA, 15 bp, Homo sapiens
gaactatgtatattg

SEQ ID NO: 250000 - DNA, 15 bp, Homo sapiens
agaactatgtatatt

SEQ ID NO: 250001 - DNA, 15 bp, Homo sapiens
aagaactatgtatat

SEQ ID NO: 250002 - DNA, 15 bp, Homo sapiens
caagaactatgtata

SEQ ID NO: 250003 - DNA, 15 bp, Homo sapiens
acaagaactatgtat

SEQ ID NO: 250004 - DNA, 15 bp, Homo sapiens
gacaagaactatgta

SEQ ID NO: 250005 - DNA, 15 bp, Homo sapiens
ggacaagaactatgt

SEQ ID NO: 250006 - DNA, 15 bp, Homo sapiens
gggacaagaactatg

SEQ ID NO: 250007 - DNA, 15 bp, Homo sapiens
ggggacaagaactat

SEQ ID NO: 250008 - DNA, 15 bp, Homo sapiens
tggggacaagaacta

SEQ ID NO: 250009 - DNA, 15 bp, Homo sapiens
gtggggacaagaact

SEQ ID NO: 250010 - DNA, 15 bp, Homo sapiens
tgtggggacaagaac

SEQ ID NO: 250011 - DNA, 15 bp, Homo sapiens
atgtggggacaagaa

SEQ ID NO: 250012 - DNA, 15 bp, Homo sapiens
aatgtggggacaaga

SEQ ID NO: 250013 - DNA, 15 bp, Homo sapiens
aaatgtggggacaag

SEQ ID NO: 250014 - DNA, 15 bp, Homo sapiens
caaatgtggggacaa

SEQ ID NO: 250015 - DNA, 15 bp, Homo sapiens
acaaatgtggggaca

SEQ ID NO: 250016 - DNA, 15 bp, Homo sapiens
tacaaatgtggggac

SEQ ID NO: 250017 - DNA, 15 bp, Homo sapiens
atacaaatgtgggga

SEQ ID NO: 250018 - DNA, 15 bp, Homo sapiens
aatacaaatgtgggg

SEQ ID NO: 250019 - DNA, 15 bp, Homo sapiens
aaatacaaatgtggg

SEQ ID NO: 250020 - DNA, 15 bp, Homo sapiens
aaaatacaaatgtgg

SEQ ID NO: 250021 - DNA, 15 bp, Homo sapiens
aaaaatacaaatgtg

SEQ ID NO: 250022 - DNA, 15 bp, Homo sapiens
taaaaatacaaatgt

SEQ ID NO: 250023 - DNA, 15 bp, Homo sapiens
gtaaaaatacaaatg

SEQ ID NO: 250024 - DNA, 15 bp, Homo sapiens
agtaaaaatacaaat

SEQ ID NO: 250025 - DNA, 15 bp, Homo sapiens
aagtaaaaatacaaa

SEQ ID NO: 250026 - DNA, 15 bp, Homo sapiens
taagtaaaaatacaa

SEQ ID NO: 250027 - DNA, 15 bp, Homo sapiens
ataagtaaaaataca

SEQ ID NO: 250028 - DNA, 15 bp, Homo sapiens
gataagtaaaaatac

SEQ ID NO: 250029 - DNA, 15 bp, Homo sapiens
agataagtaaaaata

SEQ ID NO: 250030 - DNA, 15 bp, Homo sapiens
aagataagtaaaaat

SEQ ID NO: 250031 - DNA, 15 bp, Homo sapiens
aaagataagtaaaaa

SEQ ID NO: 250032 - DNA, 15 bp, Homo sapiens
taaagataagtaaaa

SEQ ID NO: 250033 - DNA, 15 bp, Homo sapiens
ctaaagataagtaaa

SEQ ID NO: 250034 - DNA, 15 bp, Homo sapiens
actaaagataagtaa

SEQ ID NO: 250035 - DNA, 15 bp, Homo sapiens
aactaaagataagta

SEQ ID NO: 250036 - DNA, 15 bp, Homo sapiens
aaactaaagataagt

SEQ ID NO: 250037 - DNA, 15 bp, Homo sapiens
aaaactaaagataag

SEQ ID NO: 250038 - DNA, 15 bp, Homo sapiens
caaaactaaagataa

SEQ ID NO: 250039 - DNA, 15 bp, Homo sapiens
acaaaactaaagata

SEQ ID NO: 250040 - DNA, 15 bp, Homo sapiens
aacaaaactaaagat

SEQ ID NO: 250041 - DNA, 15 bp, Homo sapiens
gaacaaaactaaaga

SEQ ID NO: 250042 - DNA, 15 bp, Homo sapiens
agaacaaaactaaag

SEQ ID NO: 250043 - DNA, 15 bp, Homo sapiens
cagaacaaaactaaa

SEQ ID NO: 250044 - DNA, 15 bp, Homo sapiens
acagaacaaaactaa

SEQ ID NO: 250045 - DNA, 15 bp, Homo sapiens
aacagaacaaaacta

SEQ ID NO: 250046 - DNA, 15 bp, Homo sapiens
taacagaacaaaact

SEQ ID NO: 250047 - DNA, 15 bp, Homo sapiens
ataacagaacaaaac

SEQ ID NO: 250048 - DNA, 15 bp, Homo sapiens
tataacagaacaaaa

SEQ ID NO: 250049 - DNA, 15 bp, Homo sapiens
atataacagaacaaa

SEQ ID NO: 250050 - DNA, 15 bp, Homo sapiens
catataacagaacaa

SEQ ID NO: 250051 - DNA, 15 bp, Homo sapiens
gcatataacagaaca

SEQ ID NO: 250052 - DNA, 15 bp, Homo sapiens
ggcatataacagaac

SEQ ID NO: 250053 - DNA, 15 bp, Homo sapiens
aggcatataacagaa

SEQ ID NO: 250054 - DNA, 15 bp, Homo sapiens
aaggcatataacaga

SEQ ID NO: 250055 - DNA, 15 bp, Homo sapiens
aaaggcatataacag

SEQ ID NO: 250056 - DNA, 15 bp, Homo sapiens
taaaggcatataaca

SEQ ID NO: 250057 - DNA, 15 bp, Homo sapiens
ataaaggcatataac

SEQ ID NO: 250058 - DNA, 15 bp, Homo sapiens
tataaaggcatataa

SEQ ID NO: 250059 - DNA, 15 bp, Homo sapiens
ttataaaggcatata

SEQ ID NO: 250060 - DNA, 15 bp, Homo sapiens
attataaaggcatat

SEQ ID NO: 250061 - DNA, 15 bp, Homo sapiens
aattataaaggcata

SEQ ID NO: 250062 - DNA, 15 bp, Homo sapiens
taattataaaggcat

SEQ ID NO: 250063 - DNA, 15 bp, Homo sapiens
ataattataaaggca

SEQ ID NO: 250064 - DNA, 15 bp, Homo sapiens
tataattataaaggc

SEQ ID NO: 250065 - DNA, 15 bp, Homo sapiens
ttataattataaagg

SEQ ID NO: 250066 - DNA, 15 bp, Homo sapiens
attataattataaag

SEQ ID NO: 250067 - DNA, 15 bp, Homo sapiens
aattataattataaa

SEQ ID NO: 250068 - DNA, 15 bp, Homo sapiens
caattataattataa

SEQ ID NO: 250069 - DNA, 15 bp, Homo sapiens
ccaattataattata

SEQ ID NO: 250070 - DNA, 15 bp, Homo sapiens
tccaattataattat

SEQ ID NO: 250071 - DNA, 15 bp, Homo sapiens
ttccaattataatta

SEQ ID NO: 250072 - DNA, 15 bp, Homo sapiens
attccaattataatt

SEQ ID NO: 250073 - DNA, 15 bp, Homo sapiens
cattccaattataat

SEQ ID NO: 250074 - DNA, 15 bp, Homo sapiens
ccattccaattataa

SEQ ID NO: 250075 - DNA, 15 bp, Homo sapiens
tccattccaattata

SEQ ID NO: 250076 - DNA, 15 bp, Homo sapiens
ttccattccaattat

SEQ ID NO: 250077 - DNA, 15 bp, Homo sapiens
attccattccaatta

SEQ ID NO: 250078 - DNA, 15 bp, Homo sapiens
cattccattccaatt

SEQ ID NO: 250079 - DNA, 15 bp, Homo sapiens
tcattccattccaat

SEQ ID NO: 250080 - DNA, 15 bp, Homo sapiens
atcattccattccaa

SEQ ID NO: 250081 - DNA, 15 bp, Homo sapiens
tatcattccattcca

SEQ ID NO: 250082 - DNA, 15 bp, Homo sapiens
atatcattccattcc

SEQ ID NO: 250083 - DNA, 15 bp, Homo sapiens
tatatcattccattc

SEQ ID NO: 250084 - DNA, 15 bp, Homo sapiens
atatatcattccatt

SEQ ID NO: 250085 - DNA, 15 bp, Homo sapiens
tatatatcattccat

SEQ ID NO: 250086 - DNA, 15 bp, Homo sapiens
ttatatatcattcca

SEQ ID NO: 250087 - DNA, 15 bp, Homo sapiens
gttatatatcattcc

SEQ ID NO: 250088 - DNA, 15 bp, Homo sapiens
tgttatatatcattc

SEQ ID NO: 250089 - DNA, 15 bp, Homo sapiens
ttgttatatatcatt

SEQ ID NO: 250090 - DNA, 15 bp, Homo sapiens
tttgttatatatcat

SEQ ID NO: 250091 - DNA, 15 bp, Homo sapiens
gtttgttatatatca

SEQ ID NO: 250092 - DNA, 15 bp, Homo sapiens
ggtttgttatatatc

SEQ ID NO: 250093 - DNA, 15 bp, Homo sapiens
aggtttgttatatat

SEQ ID NO: 250094 - DNA, 15 bp, Homo sapiens
gaggtttgttatata

SEQ ID NO: 250095 - DNA, 15 bp, Homo sapiens
tgaggtttgttatat

SEQ ID NO: 250096 - DNA, 15 bp, Homo sapiens
gtgaggtttgttata

SEQ ID NO: 250097 - DNA, 15 bp, Homo sapiens
tgtgaggtttgttat

SEQ ID NO: 250098 - DNA, 15 bp, Homo sapiens
ttgtgaggtttgtta

SEQ ID NO: 250099 - DNA, 15 bp, Homo sapiens
tttgtgaggtttgtt

SEQ ID NO: 250100 - DNA, 15 bp, Homo sapiens
ttttgtgaggtttgt

SEQ ID NO: 250101 - DNA, 15 bp, Homo sapiens
attttgtgaggtttg

SEQ ID NO: 250102 - DNA, 15 bp, Homo sapiens
gattttgtgaggttt

SEQ ID NO: 250103 - DNA, 15 bp, Homo sapiens
ggattttgtgaggtt

SEQ ID NO: 250104 - DNA, 15 bp, Homo sapiens
tggattttgtgaggt

SEQ ID NO: 250105 - DNA, 15 bp, Homo sapiens
ctggattttgtgagg

SEQ ID NO: 250106 - DNA, 15 bp, Homo sapiens
actggattttgtgag

SEQ ID NO: 250107 - DNA, 15 bp, Homo sapiens
aactggattttgtga

SEQ ID NO: 250108 - DNA, 15 bp, Homo sapiens
taactggattttgtg

SEQ ID NO: 250109 - DNA, 15 bp, Homo sapiens
ataactggattttgt

SEQ ID NO: 250110 - DNA, 15 bp, Homo sapiens
tataactggattttg

SEQ ID NO: 250111 - DNA, 15 bp, Homo sapiens
ttataactggatttt

SEQ ID NO: 250112 - DNA, 15 bp, Homo sapiens
cttataactggattt

SEQ ID NO: 250113 - DNA, 15 bp, Homo sapiens
gcttataactggatt

SEQ ID NO: 250114 - DNA, 15 bp, Homo sapiens
tgcttataactggat

SEQ ID NO: 250115 - DNA, 15 bp, Homo sapiens
atgcttataactgga

SEQ ID NO: 250116 - DNA, 15 bp, Homo sapiens
tatgcttataactgg

SEQ ID NO: 250117 - DNA, 15 bp, Homo sapiens
ttatgcttataactg

SEQ ID NO: 250118 - DNA, 15 bp, Homo sapiens
tttatgcttataact

SEQ ID NO: 250119 - DNA, 15 bp, Homo sapiens
ttttatgcttataac

SEQ ID NO: 250120 - DNA, 15 bp, Homo sapiens
attttatgcttataa

SEQ ID NO: 250121 - DNA, 15 bp, Homo sapiens
aattttatgcttata

SEQ ID NO: 250122 - DNA, 15 bp, Homo sapiens
caattttatgcttat

SEQ ID NO: 250123 - DNA, 15 bp, Homo sapiens
ccaattttatgctta

SEQ ID NO: 250124 - DNA, 15 bp, Homo sapiens
tccaattttatgctt

SEQ ID NO: 250125 - DNA, 15 bp, Homo sapiens
atccaattttatgct

SEQ ID NO: 250126 - DNA, 15 bp, Homo sapiens
tatccaattttatgc

SEQ ID NO: 250127 - DNA, 15 bp, Homo sapiens
ctatccaattttatg

SEQ ID NO: 250128 - DNA, 15 bp, Homo sapiens
gctatccaattttat

SEQ ID NO: 250129 - DNA, 15 bp, Homo sapiens
agctatccaatttta

SEQ ID NO: 250130 - DNA, 15 bp, Homo sapiens
tagctatccaatttt

SEQ ID NO: 250131 - DNA, 15 bp, Homo sapiens
ctagctatccaattt

SEQ ID NO: 250132 - DNA, 15 bp, Homo sapiens
actagctatccaatt

SEQ ID NO: 250133 - DNA, 15 bp, Homo sapiens
tactagctatccaat

SEQ ID NO: 250134 - DNA, 15 bp, Homo sapiens
ttactagctatccaa

SEQ ID NO: 250135 - DNA, 15 bp, Homo sapiens
gttactagctatcca

SEQ ID NO: 250136 - DNA, 15 bp, Homo sapiens
tgttactagctatcc

SEQ ID NO: 250137 - DNA, 15 bp, Homo sapiens
ttgttactagctatc

SEQ ID NO: 250138 - DNA, 15 bp, Homo sapiens
tttgttactagctat

SEQ ID NO: 250139 - DNA, 15 bp, Homo sapiens
atttgttactagcta

SEQ ID NO: 250140 - DNA, 15 bp, Homo sapiens
tatttgttactagct

SEQ ID NO: 250141 - DNA, 15 bp, Homo sapiens
ttatttgttactagc

SEQ ID NO: 250142 - DNA, 15 bp, Homo sapiens
cttatttgttactag

SEQ ID NO: 250143 - DNA, 15 bp, Homo sapiens
acttatttgttacta

SEQ ID NO: 250144 - DNA, 15 bp, Homo sapiens
tacttatttgttact

SEQ ID NO: 250145 - DNA, 15 bp, Homo sapiens
atacttatttgttac

SEQ ID NO: 250146 - DNA, 15 bp, Homo sapiens
tatacttatttgtta

SEQ ID NO: 250147 - DNA, 15 bp, Homo sapiens
atatacttatttgtt

SEQ ID NO: 250148 - DNA, 15 bp, Homo sapiens
aatatacttatttgt

SEQ ID NO: 250149 - DNA, 15 bp, Homo sapiens
aaatatacttatttg

SEQ ID NO: 250150 - DNA, 15 bp, Homo sapiens
caaatatacttattt

SEQ ID NO: 250151 - DNA, 15 bp, Homo sapiens
ccaaatatacttatt

SEQ ID NO: 250152 - DNA, 15 bp, Homo sapiens
cccaaatatacttat

SEQ ID NO: 250153 - DNA, 15 bp, Homo sapiens
acccaaatatactta

SEQ ID NO: 250154 - DNA, 15 bp, Homo sapiens
tacccaaatatactt

SEQ ID NO: 250155 - DNA, 15 bp, Homo sapiens
ttacccaaatatact

SEQ ID NO: 250156 - DNA, 15 bp, Homo sapiens
cttacccaaatatac

SEQ ID NO: 250157 - DNA, 15 bp, Homo sapiens
acttacccaaatata

SEQ ID NO: 250158 - DNA, 15 bp, Homo sapiens
cacttacccaaatat

SEQ ID NO: 250159 - DNA, 15 bp, Homo sapiens
acacttacccaaata

SEQ ID NO: 250160 - DNA, 15 bp, Homo sapiens
aacacttacccaaat

SEQ ID NO: 250161 - DNA, 15 bp, Homo sapiens
taacacttacccaaa

SEQ ID NO: 250162 - DNA, 15 bp, Homo sapiens
ctaacacttacccaa

SEQ ID NO: 250163 - DNA, 15 bp, Homo sapiens
actaacacttaccca

SEQ ID NO: 250164 - DNA, 15 bp, Homo sapiens
aactaacacttaccc

SEQ ID NO: 250165 - DNA, 15 bp, Homo sapiens
aaactaacacttacc

SEQ ID NO: 250166 - DNA, 15 bp, Homo sapiens
aaaactaacacttac

SEQ ID NO: 250167 - DNA, 15 bp, Homo sapiens
aaaaactaacactta

SEQ ID NO: 250168 - DNA, 15 bp, Homo sapiens
caaaaactaacactt

SEQ ID NO: 250169 - DNA, 15 bp, Homo sapiens
ccaaaaactaacact

SEQ ID NO: 250170 - DNA, 15 bp, Homo sapiens
tccaaaaactaacac

SEQ ID NO: 250171 - DNA, 15 bp, Homo sapiens
ctccaaaaactaaca

SEQ ID NO: 250172 - DNA, 15 bp, Homo sapiens
tctccaaaaactaac

SEQ ID NO: 250173 - DNA, 15 bp, Homo sapiens
ttctccaaaaactaa

SEQ ID NO: 250174 - DNA, 15 bp, Homo sapiens
tttctccaaaaacta

SEQ ID NO: 250175 - DNA, 15 bp, Homo sapiens
gtttctccaaaaact

SEQ ID NO: 250176 - DNA, 15 bp, Homo sapiens
tgtttctccaaaaac

SEQ ID NO: 250177 - DNA, 15 bp, Homo sapiens
ttgtttctccaaaaa

SEQ ID NO: 250178 - DNA, 15 bp, Homo sapiens
cttgtttctccaaaa

SEQ ID NO: 250179 - DNA, 15 bp, Homo sapiens
acttgtttctccaaa

SEQ ID NO: 250180 - DNA, 15 bp, Homo sapiens
aacttgtttctccaa

SEQ ID NO: 250181 - DNA, 15 bp, Homo sapiens
caacttgtttctcca

SEQ ID NO: 250182 - DNA, 15 bp, Homo sapiens
gcaacttgtttctcc

SEQ ID NO: 250183 - DNA, 15 bp, Homo sapiens
ggcaacttgtttctc

SEQ ID NO: 250184 - DNA, 15 bp, Homo sapiens
aggcaacttgtttct

SEQ ID NO: 250185 - DNA, 15 bp, Homo sapiens
aaggcaacttgtttc

SEQ ID NO: 250186 - DNA, 15 bp, Homo sapiens
gaaggcaacttgttt

SEQ ID NO: 250187 - DNA, 15 bp, Homo sapiens
agaaggcaacttgtt

SEQ ID NO: 250188 - DNA, 15 bp, Homo sapiens
cagaaggcaacttgt

SEQ ID NO: 250189 - DNA, 15 bp, Homo sapiens
tcagaaggcaacttg

SEQ ID NO: 250190 - DNA, 15 bp, Homo sapiens
atcagaaggcaactt

SEQ ID NO: 250191 - DNA, 15 bp, Homo sapiens
gatcagaaggcaact

SEQ ID NO: 250192 - DNA, 15 bp, Homo sapiens
tgatcagaaggcaac

SEQ ID NO: 250193 - DNA, 15 bp, Homo sapiens
atgatcagaaggcaa

SEQ ID NO: 250194 - DNA, 15 bp, Homo sapiens
gatgatcagaaggca

SEQ ID NO: 250195 - DNA, 15 bp, Homo sapiens
ggatgatcagaaggc

SEQ ID NO: 250196 - DNA, 15 bp, Homo sapiens
aggatgatcagaagg

SEQ ID NO: 250197 - DNA, 15 bp, Homo sapiens
aaggatgatcagaag

SEQ ID NO: 250198 - DNA, 15 bp, Homo sapiens
aaaggatgatcagaa

SEQ ID NO: 250199 - DNA, 15 bp, Homo sapiens
taaaggatgatcaga

SEQ ID NO: 250200 - DNA, 15 bp, Homo sapiens
ttaaaggatgatcag

SEQ ID NO: 250201 - DNA, 15 bp, Homo sapiens
cttaaaggatgatca

SEQ ID NO: 250202 - DNA, 15 bp, Homo sapiens
ccttaaaggatgatc

SEQ ID NO: 250203 - DNA, 15 bp, Homo sapiens
accttaaaggatgat

SEQ ID NO: 250204 - DNA, 15 bp, Homo sapiens
aaccttaaaggatga

SEQ ID NO: 250205 - DNA, 15 bp, Homo sapiens
aaaccttaaaggatg

SEQ ID NO: 250206 - DNA, 15 bp, Homo sapiens
gaaaccttaaaggat

SEQ ID NO: 250207 - DNA, 15 bp, Homo sapiens
tgaaaccttaaagga

SEQ ID NO: 250208 - DNA, 15 bp, Homo sapiens
atgaaaccttaaagg

SEQ ID NO: 250209 - DNA, 15 bp, Homo sapiens
catgaaaccttaaag

SEQ ID NO: 250210 - DNA, 15 bp, Homo sapiens
ccatgaaaccttaaa

SEQ ID NO: 250211 - DNA, 15 bp, Homo sapiens
tccatgaaaccttaa

SEQ ID NO: 250212 - DNA, 15 bp, Homo sapiens
ttccatgaaacctta

SEQ ID NO: 250213 - DNA, 15 bp, Homo sapiens
tttccatgaaacctt

SEQ ID NO: 250214 - DNA, 15 bp, Homo sapiens
ttttccatgaaacct

SEQ ID NO: 250215 - DNA, 15 bp, Homo sapiens
tttttccatgaaacc

SEQ ID NO: 250216 - DNA, 15 bp, Homo sapiens
atttttccatgaaac

SEQ ID NO: 250217 - DNA, 15 bp, Homo sapiens
tatttttccatgaaa

SEQ ID NO: 250218 - DNA, 15 bp, Homo sapiens
atatttttccatgaa

SEQ ID NO: 250219 - DNA, 15 bp, Homo sapiens
catatttttccatga

SEQ ID NO: 250220 - DNA, 15 bp, Homo sapiens
tcatatttttccatg

SEQ ID NO: 250221 - DNA, 15 bp, Homo sapiens
ctcatatttttccat

SEQ ID NO: 250222 - DNA, 15 bp, Homo sapiens
tctcatatttttcca

SEQ ID NO: 250223 - DNA, 15 bp, Homo sapiens
gtctcatatttttcc

SEQ ID NO: 250224 - DNA, 15 bp, Homo sapiens
ggtctcatatttttc

SEQ ID NO: 250225 - DNA, 15 bp, Homo sapiens
tggtctcatattttt

SEQ ID NO: 250226 - DNA, 15 bp, Homo sapiens
gtggtctcatatttt

SEQ ID NO: 250227 - DNA, 15 bp, Homo sapiens
agtggtctcatattt

SEQ ID NO: 250228 - DNA, 15 bp, Homo sapiens
gagtggtctcatatt

SEQ ID NO: 250229 - DNA, 15 bp, Homo sapiens
agagtggtctcatat

SEQ ID NO: 250230 - DNA, 15 bp, Homo sapiens
tagagtggtctcata

SEQ ID NO: 250231 - DNA, 15 bp, Homo sapiens
ttagagtggtctcat

SEQ ID NO: 250232 - DNA, 15 bp, Homo sapiens
attagagtggtctca

SEQ ID NO: 250233 - DNA, 15 bp, Homo sapiens
cattagagtggtctc

SEQ ID NO: 250234 - DNA, 15 bp, Homo sapiens
tcattagagtggtct

SEQ ID NO: 250235 - DNA, 15 bp, Homo sapiens
ctcattagagtggtc

SEQ ID NO: 250236 - DNA, 15 bp, Homo sapiens
cctcattagagtggt

SEQ ID NO: 250237 - DNA, 15 bp, Homo sapiens
tcctcattagagtgg

SEQ ID NO: 250238 - DNA, 15 bp, Homo sapiens
gtcctcattagagtg

SEQ ID NO: 250239 - DNA, 15 bp, Homo sapiens
tgtcctcattagagt

SEQ ID NO: 250240 - DNA, 15 bp, Homo sapiens
ttgtcctcattagag

SEQ ID NO: 250241 - DNA, 15 bp, Homo sapiens
tttgtcctcattaga

SEQ ID NO: 250242 - DNA, 15 bp, Homo sapiens
atttgtcctcattag

SEQ ID NO: 250243 - DNA, 15 bp, Homo sapiens
catttgtcctcatta

SEQ ID NO: 250244 - DNA, 15 bp, Homo sapiens
ccatttgtcctcatt

SEQ ID NO: 250245 - DNA, 15 bp, Homo sapiens
cccatttgtcctcat

SEQ ID NO: 250246 - DNA, 15 bp, Homo sapiens
acccatttgtcctca

SEQ ID NO: 250247 - DNA, 15 bp, Homo sapiens
aacccatttgtcctc

SEQ ID NO: 250248 - DNA, 15 bp, Homo sapiens
aaacccatttgtcct

SEQ ID NO: 250249 - DNA, 15 bp, Homo sapiens
taaacccatttgtcc

SEQ ID NO: 250250 - DNA, 15 bp, Homo sapiens
ttaaacccatttgtc

SEQ ID NO: 250251 - DNA, 15 bp, Homo sapiens
cttaaacccatttgt

SEQ ID NO: 250252 - DNA, 15 bp, Homo sapiens
tcttaaacccatttg

SEQ ID NO: 250253 - DNA, 15 bp, Homo sapiens
ttcttaaacccattt

SEQ ID NO: 250254 - DNA, 15 bp, Homo sapiens
cttcttaaacccatt

SEQ ID NO: 250255 - DNA, 15 bp, Homo sapiens
acttcttaaacccat

SEQ ID NO: 250256 - DNA, 15 bp, Homo sapiens
tacttcttaaaccca

SEQ ID NO: 250257 - DNA, 15 bp, Homo sapiens
atacttcttaaaccc

SEQ ID NO: 250258 - DNA, 15 bp, Homo sapiens
gatacttcttaaacc

SEQ ID NO: 250259 - DNA, 15 bp, Homo sapiens
agatacttcttaaac

SEQ ID NO: 250260 - DNA, 15 bp, Homo sapiens
aagatacttcttaaa

SEQ ID NO: 250261 - DNA, 15 bp, Homo sapiens
gaagatacttcttaa

SEQ ID NO: 250262 - DNA, 15 bp, Homo sapiens
ggaagatacttctta

SEQ ID NO: 250263 - DNA, 15 bp, Homo sapiens
tggaagatacttctt

SEQ ID NO: 250264 - DNA, 15 bp, Homo sapiens
gtggaagatacttct

SEQ ID NO: 250265 - DNA, 15 bp, Homo sapiens
tgtggaagatacttc

SEQ ID NO: 250266 - DNA, 15 bp, Homo sapiens
ctgtggaagatactt

SEQ ID NO: 250267 - DNA, 15 bp, Homo sapiens
tctgtggaagatact

SEQ ID NO: 250268 - DNA, 15 bp, Homo sapiens
ctctgtggaagatac

SEQ ID NO: 250269 - DNA, 15 bp, Homo sapiens
gctctgtggaagata

SEQ ID NO: 250270 - DNA, 15 bp, Homo sapiens
tgctctgtggaagat

SEQ ID NO: 250271 - DNA, 15 bp, Homo sapiens
ctgctctgtggaaga

SEQ ID NO: 250272 - DNA, 15 bp, Homo sapiens
actgctctgtggaag

SEQ ID NO: 250273 - DNA, 15 bp, Homo sapiens
gactgctctgtggaa

SEQ ID NO: 250274 - DNA, 15 bp, Homo sapiens
tgactgctctgtgga

SEQ ID NO: 250275 - DNA, 15 bp, Homo sapiens
atgactgctctgtgg

SEQ ID NO: 250276 - DNA, 15 bp, Homo sapiens
aatgactgctctgtg

SEQ ID NO: 250277 - DNA, 15 bp, Homo sapiens
aaatgactgctctgt

SEQ ID NO: 250278 - DNA, 15 bp, Homo sapiens
caaatgactgctctg

SEQ ID NO: 250279 - DNA, 15 bp, Homo sapiens
gcaaatgactgctct

SEQ ID NO: 250280 - DNA, 15 bp, Homo sapiens
ggcaaatgactgctc

SEQ ID NO: 250281 - DNA, 15 bp, Homo sapiens
gggcaaatgactgct

SEQ ID NO: 250282 - DNA, 15 bp, Homo sapiens
tgggcaaatgactgc

SEQ ID NO: 250283 - DNA, 15 bp, Homo sapiens
ctgggcaaatgactg

SEQ ID NO: 250284 - DNA, 15 bp, Homo sapiens
tctgggcaaatgact

SEQ ID NO: 250285 - DNA, 15 bp, Homo sapiens
ttctgggcaaatgac

SEQ ID NO: 250286 - DNA, 15 bp, Homo sapiens
tttctgggcaaatga

SEQ ID NO: 250287 - DNA, 15 bp, Homo sapiens
atttctgggcaaatg

SEQ ID NO: 250288 - DNA, 15 bp, Homo sapiens
gatttctgggcaaat

SEQ ID NO: 250289 - DNA, 15 bp, Homo sapiens
tgatttctgggcaaa

SEQ ID NO: 250290 - DNA, 15 bp, Homo sapiens
ttgatttctgggcaa

SEQ ID NO: 250291 - DNA, 15 bp, Homo sapiens
cttgatttctgggca

SEQ ID NO: 250292 - DNA, 15 bp, Homo sapiens
tcttgatttctgggc

SEQ ID NO: 250293 - DNA, 15 bp, Homo sapiens
atcttgatttctggg

SEQ ID NO: 250294 - DNA, 15 bp, Homo sapiens
aatcttgatttctgg

SEQ ID NO: 250295 - DNA, 15 bp, Homo sapiens
aaatcttgatttctg

SEQ ID NO: 250296 - DNA, 15 bp, Homo sapiens
aaaatcttgatttct

SEQ ID NO: 250297 - DNA, 15 bp, Homo sapiens
taaaatcttgatttc

SEQ ID NO: 250298 - DNA, 15 bp, Homo sapiens
gtaaaatcttgattt

SEQ ID NO: 250299 - DNA, 15 bp, Homo sapiens
ggtaaaatcttgatt

SEQ ID NO: 250300 - DNA, 15 bp, Homo sapiens
tggtaaaatcttgat

SEQ ID NO: 250301 - DNA, 15 bp, Homo sapiens
ctggtaaaatcttga

SEQ ID NO: 250302 - DNA, 15 bp, Homo sapiens
gctggtaaaatcttg

SEQ ID NO: 250303 - DNA, 15 bp, Homo sapiens
ggctggtaaaatctt

SEQ ID NO: 250304 - DNA, 15 bp, Homo sapiens
aggctggtaaaatct

SEQ ID NO: 250305 - DNA, 15 bp, Homo sapiens
taggctggtaaaatc

SEQ ID NO: 250306 - DNA, 15 bp, Homo sapiens
ataggctggtaaaat

SEQ ID NO: 250307 - DNA, 15 bp, Homo sapiens
gataggctggtaaaa

SEQ ID NO: 250308 - DNA, 15 bp, Homo sapiens
tgataggctggtaaa

SEQ ID NO: 250309 - DNA, 15 bp, Homo sapiens
ttgataggctggtaa

SEQ ID NO: 250310 - DNA, 15 bp, Homo sapiens
tttgataggctggta

SEQ ID NO: 250311 - DNA, 15 bp, Homo sapiens
ttttgataggctggt

SEQ ID NO: 250312 - DNA, 15 bp, Homo sapiens
cttttgataggctgg

SEQ ID NO: 250313 - DNA, 15 bp, Homo sapiens
acttttgataggctg

SEQ ID NO: 250314 - DNA, 15 bp, Homo sapiens
cacttttgataggct

SEQ ID NO: 250315 - DNA, 15 bp, Homo sapiens
gcacttttgataggc

SEQ ID NO: 250316 - DNA, 15 bp, Homo sapiens
tgcacttttgatagg

SEQ ID NO: 250317 - DNA, 15 bp, Homo sapiens
atgcacttttgatag

SEQ ID NO: 250318 - DNA, 15 bp, Homo sapiens
catgcacttttgata

SEQ ID NO: 250319 - DNA, 15 bp, Homo sapiens
acatgcacttttgat

SEQ ID NO: 250320 - DNA, 15 bp, Homo sapiens
gacatgcacttttga

SEQ ID NO: 250321 - DNA, 15 bp, Homo sapiens
ggacatgcacttttg

SEQ ID NO: 250322 - DNA, 15 bp, Homo sapiens
aggacatgcactttt

SEQ ID NO: 250323 - DNA, 15 bp, Homo sapiens
aaggacatgcacttt

SEQ ID NO: 250324 - DNA, 15 bp, Homo sapiens
aaaggacatgcactt

SEQ ID NO: 250325 - DNA, 15 bp, Homo sapiens
caaaggacatgcact

SEQ ID NO: 250326 - DNA, 15 bp, Homo sapiens
gcaaaggacatgcac

SEQ ID NO: 250327 - DNA, 15 bp, Homo sapiens
agcaaaggacatgca

SEQ ID NO: 250328 - DNA, 15 bp, Homo sapiens
cagcaaaggacatgc

SEQ ID NO: 250329 - DNA, 15 bp, Homo sapiens
acagcaaaggacatg

SEQ ID NO: 250330 - DNA, 15 bp, Homo sapiens
aacagcaaaggacat

SEQ ID NO: 250331 - DNA, 15 bp, Homo sapiens
caacagcaaaggaca

SEQ ID NO: 250332 - DNA, 15 bp, Homo sapiens
ccaacagcaaaggac

SEQ ID NO: 250333 - DNA, 15 bp, Homo sapiens
accaacagcaaagga

SEQ ID NO: 250334 - DNA, 15 bp, Homo sapiens
aaccaacagcaaagg

SEQ ID NO: 250335 - DNA, 15 bp, Homo sapiens
gaaccaacagcaaag

SEQ ID NO: 250336 - DNA, 15 bp, Homo sapiens
tgaaccaacagcaaa

SEQ ID NO: 250337 - DNA, 15 bp, Homo sapiens
atgaaccaacagcaa

SEQ ID NO: 250338 - DNA, 15 bp, Homo sapiens
aatgaaccaacagca

SEQ ID NO: 250339 - DNA, 15 bp, Homo sapiens
caatgaaccaacagc

SEQ ID NO: 250340 - DNA, 15 bp, Homo sapiens
acaatgaaccaacag

SEQ ID NO: 250341 - DNA, 15 bp, Homo sapiens
cacaatgaaccaaca

SEQ ID NO: 250342 - DNA, 15 bp, Homo sapiens
acacaatgaaccaac

SEQ ID NO: 250343 - DNA, 15 bp, Homo sapiens
aacacaatgaaccaa

SEQ ID NO: 250344 - DNA, 15 bp, Homo sapiens
taacacaatgaacca

SEQ ID NO: 250345 - DNA, 15 bp, Homo sapiens
gtaacacaatgaacc

SEQ ID NO: 250346 - DNA, 15 bp, Homo sapiens
tgtaacacaatgaac

SEQ ID NO: 250347 - DNA, 15 bp, Homo sapiens
atgtaacacaatgaa

SEQ ID NO: 250348 - DNA, 15 bp, Homo sapiens
catgtaacacaatga

SEQ ID NO: 250349 - DNA, 15 bp, Homo sapiens
acatgtaacacaatg

SEQ ID NO: 250350 - DNA, 15 bp, Homo sapiens
aacatgtaacacaat

SEQ ID NO: 250351 - DNA, 15 bp, Homo sapiens
taacatgtaacacaa

SEQ ID NO: 250352 - DNA, 15 bp, Homo sapiens
ctaacatgtaacaca

SEQ ID NO: 250353 - DNA, 15 bp, Homo sapiens
cctaacatgtaacac

SEQ ID NO: 250354 - DNA, 15 bp, Homo sapiens
gcctaacatgtaaca

SEQ ID NO: 250355 - DNA, 15 bp, Homo sapiens
tgcctaacatgtaac

SEQ ID NO: 250356 - DNA, 15 bp, Homo sapiens
ctgcctaacatgtaa

SEQ ID NO: 250357 - DNA, 15 bp, Homo sapiens
actgcctaacatgta

SEQ ID NO: 250358 - DNA, 15 bp, Homo sapiens
tactgcctaacatgt

SEQ ID NO: 250359 - DNA, 15 bp, Homo sapiens
atactgcctaacatg

SEQ ID NO: 250360 - DNA, 15 bp, Homo sapiens
aatactgcctaacat
